United States Patent 7,618,814 (MICRORNA-RELATED NUCLEIC ACIDS AND USES THEREOF) - sequence listing, part 12

SEQ ID NO: 442032 - RNA, 32 nt, Human
gcgauucuucugccucagccuccugguagcug

SEQ ID NO: 442033 - RNA, 32 nt, Human
gcgauucuugugcuucagccuccugaguagcu

SEQ ID NO: 442034 - RNA, 31 nt, Human
gcgauugagaucauccuggccaacacgguga

SEQ ID NO: 442035 - RNA, 32 nt, Human
gcgauugcaccaccacacuccagccugcgcga

SEQ ID NO: 442036 - RNA, 32 nt, Human
gcgauugcuuauugucccuccagccugugcug

SEQ ID NO: 442037 - RNA, 32 nt, Human
gcgauuggcugggaacuguauccacccaaaug

SEQ ID NO: 442038 - RNA, 32 nt, Human
gcgauuguagcgggaccgucacacacaacugg

SEQ ID NO: 442039 - RNA, 32 nt, Human
gcgauugugcaggaguaggagacaaaauguac

SEQ ID NO: 442040 - RNA, 32 nt, Human
gcgauuucacagucuacugccuguuuccacug

SEQ ID NO: 442041 - RNA, 32 nt, Human
gcgauuuucauaccugcauacucugaucacua

SEQ ID NO: 442042 - RNA, 32 nt, Human
gcgauuuuccugcuucaucuucccagguagcu

SEQ ID NO: 442043 - RNA, 32 nt, Human
gcgauuuucuugccucugccuccugaguagcu

SEQ ID NO: 442044 - RNA, 32 nt, Human
gcgcaaaaugcagccucuaagagcuggagggg

SEQ ID NO: 442045 - RNA, 32 nt, Human
gcgcaaaggcagcaagguuggugacuuuggag

SEQ ID NO: 442046 - RNA, 32 nt, Human
gcgcaaaugcacaugaagaaacagguuuccag

SEQ ID NO: 442047 - RNA, 32 nt, Human
gcgcaacaccuuggugcuccagucccggguug

SEQ ID NO: 442048 - RNA, 32 nt, Human
gcgcaacauggcgaaaccccgucucuacaaua

SEQ ID NO: 442049 - RNA, 19 nt, Human
gcgcaaccucugccuccca

SEQ ID NO: 442050 - RNA, 32 nt, Human
gcgcaacguucgauuucuaccucagcagcagu

SEQ ID NO: 442051 - RNA, 32 nt, Human
gcgcaacuccagagaguaauaaaacucuggug

SEQ ID NO: 442052 - RNA, 32 nt, Human
gcgcaacuccuccauuuuccucccgcagguga

SEQ ID NO: 442053 - RNA, 32 nt, Human
gcgcaacugccuggcucugcucgcuccggcgc

SEQ ID NO: 442054 - RNA, 32 nt, Human
gcgcaacuguagucccagcuacucgggaggcu

SEQ ID NO: 442055 - RNA, 32 nt, Human
gcgcaagagaggagggccgacuggaggguguc

SEQ ID NO: 442056 - RNA, 32 nt, Human
gcgcaagagguugaggcuccagugagccacga

SEQ ID NO: 442057 - RNA, 21 nt, Human
gcgcaagaugauuguuugaga

SEQ ID NO: 442058 - RNA, 32 nt, Human
gcgcaagccuguaaucccagcuauuugggagg

SEQ ID NO: 442059 - RNA, 32 nt, Human
gcgcaaggaacagaaggagaccaccuucuaca

SEQ ID NO: 442060 - RNA, 32 nt, Human
gcgcaaggagcagaaggagaccaccuucuaua

SEQ ID NO: 442061 - RNA, 32 nt, Human
gcgcaaggaggacugggcgccgcccguccugg

SEQ ID NO: 442062 - RNA, 32 nt, Human
gcgcaagggcuccggcgaccagaggauucuuc

SEQ ID NO: 442063 - RNA, 32 nt, Human
gcgcaagguggcggagggcaguguggguucug

SEQ ID NO: 442064 - RNA, 32 nt, Human
gcgcaauauuuaugggagugggagggaugggg

SEQ ID NO: 442065 - RNA, 32 nt, Human
gcgcaaucucacugcaagcuccacuuccuggg

SEQ ID NO: 442066 - RNA, 32 nt, Human
gcgcaaucucacugcauccuccgccucccggg

SEQ ID NO: 442067 - RNA, 32 nt, Human
gcgcaaucucagcucacugcaaccuccgccuc

SEQ ID NO: 442068 - RNA, 32 nt, Human
gcgcaaucugaaacuucucuucuguuuucuuu

SEQ ID NO: 442069 - RNA, 32 nt, Human
gcgcaaucuggacacugggagauucggagcgc

SEQ ID NO: 442070 - RNA, 21 nt, Human
gcgcaaucuuggcucacugca

SEQ ID NO: 442071 - RNA, 30 nt, Human
gcgcaauggaggaggaggaugaggaagcgc

SEQ ID NO: 442072 - RNA, 32 nt, Human
gcgcaauuauaaugcaaugucuuuuugaugca

SEQ ID NO: 442073 - RNA, 32 nt, Human
gcgcaauugcgcuccagccugggcgacaagag

SEQ ID NO: 442074 - RNA, 32 nt, Human
gcgcaauuucagcucacugaaccucugccucc

SEQ ID NO: 442075 - RNA, 32 nt, Human
gcgcaauuucauggcauggagaugccuuucac

SEQ ID NO: 442076 - RNA, 32 nt, Human
gcgcacaacaugggcaaccaccugccgcuccu

SEQ ID NO: 442077 - RNA, 32 nt, Human
gcgcacacagaucuagcccaggaacaagccca

SEQ ID NO: 442078 - RNA, 17 nt, Human
gcgcacacccaggcagc

SEQ ID NO: 442079 - RNA, 32 nt, Human
gcgcacaccuguaaucccagcuacucugaagc

SEQ ID NO: 442080 - RNA, 32 nt, Human
gcgcacaccuguaaucucagcuacucgggagg

SEQ ID NO: 442081 - RNA, 22 nt, Human
gcgcacaccuguaauuccagcu

SEQ ID NO: 442082 - RNA, 32 nt, Human
gcgcacagauacaaugaggcaugaaguucaga

SEQ ID NO: 442083 - RNA, 32 nt, Human
gcgcacagcacggaccugcgugccucagcuuu

SEQ ID NO: 442084 - RNA, 19 nt, Human
gcgcacagccagcggccgc

SEQ ID NO: 442085 - RNA, 19 nt, Human
gcgcacagcccucaugccc

SEQ ID NO: 442086 - RNA, 32 nt, Human
gcgcacaggcaggagguugcaguugggcgcuc

SEQ ID NO: 442087 - RNA, 32 nt, Human
gcgcaccagagaacccagccagagggguugug

SEQ ID NO: 442088 - RNA, 32 nt, Human
gcgcaccaggagacccuagagugguuuccauc

SEQ ID NO: 442089 - RNA, 22 nt, Human
gcgcaccagucccggcccggca

SEQ ID NO: 442090 - RNA, 32 nt, Human
gcgcaccaugucugcccucggagugaccgugg

SEQ ID NO: 442091 - RNA, 32 nt, Human
gcgcaccauugcacuccagccuugggcgacaa

SEQ ID NO: 442092 - RNA, 32 nt, Human
gcgcacccaggagaaggagcagaucaagaccc

SEQ ID NO: 442093 - RNA, 32 nt, Human
gcgcacccccuucgagaucucccucuggaucc

SEQ ID NO: 442094 - RNA, 32 nt, Human
gcgcaccgcccaacccccaccucccgguguau

SEQ ID NO: 442095 - RNA, 19 nt, Human
gcgcaccggggcucgggca

SEQ ID NO: 442096 - RNA, 32 nt, Human
gcgcaccuagguggcuucugacuuugauuuuc

SEQ ID NO: 442097 - RNA, 23 nt, Human
gcgcaccucggaggagccaggag

SEQ ID NO: 442098 - RNA, 32 nt, Human
gcgcaccucugcucccuucuccucacuaccca

SEQ ID NO: 442099 - RNA, 32 nt, Human
gcgcaccugcagucccagcuacucgggaggcu

SEQ ID NO: 442100 - RNA, 32 nt, Human
gcgcaccugcuuccuccacuucaccuucggag

SEQ ID NO: 442101 - RNA, 32 nt, Human
gcgcaccuguaaucccagccacucagaaggcu

SEQ ID NO: 442102 - RNA, 32 nt, Human
gcgcaccuguaaucccagcuacucgggaggcu

SEQ ID NO: 442103 - RNA, 32 nt, Human
gcgcaccuguaaucccagcuacuuggaaggcu

SEQ ID NO: 442104 - RNA, 32 nt, Human
gcgcaccuguaaucccagcuacuugggaggcu

SEQ ID NO: 442105 - RNA, 32 nt, Human
gcgcaccuguaaucccagcugcucgggaggcu

SEQ ID NO: 442106 - RNA, 17 nt, Human
gcgcaccuguaaucuca

SEQ ID NO: 442107 - RNA, 32 nt, Human
gcgcaccuguaaucucagcuacuggagaggcu

SEQ ID NO: 442108 - RNA, 17 nt, Human
gcgcaccuguaauucca

SEQ ID NO: 442109 - RNA, 32 nt, Human
gcgcaccuguaauuccagcuacucgggaggcu

SEQ ID NO: 442110 - RNA, 17 nt, Human
gcgcaccuguaguccca

SEQ ID NO: 442111 - RNA, 32 nt, Human
gcgcaccuguagucccagcuacuugggaggcu

SEQ ID NO: 442112 - RNA, 32 nt, Human
gcgcaccuguaguuccagcuacucgggaggcu

SEQ ID NO: 442113 - RNA, 32 nt, Human
gcgcaccugucaucccagcuacucgggaggcu

SEQ ID NO: 442114 - RNA, 32 nt, Human
gcgcaccuguggucccagcuacucgggaggcu

SEQ ID NO: 442115 - RNA, 32 nt, Human
gcgcaccuguggucccagcuacuugggaggcu

SEQ ID NO: 442116 - RNA, 32 nt, Human
gcgcaccuugaaaggggaaggcagacauccug

SEQ ID NO: 442117 - RNA, 19 nt, Human
gcgcacgccuguaauccca

SEQ ID NO: 442118 - RNA, 22 nt, Human
gcgcacgccuguaaucccagcu

SEQ ID NO: 442119 - RNA, 32 nt, Human
gcgcacgccuguaaucccagcuacucgggagg

SEQ ID NO: 442120 - RNA, 32 nt, Human
gcgcacgccuguaaucucagcuacuagggacg

SEQ ID NO: 442121 - RNA, 32 nt, Human
gcgcacgcugggcaguggccugggcaacccca

SEQ ID NO: 442122 - RNA, 32 nt, Human
gcgcacggacuggccaggccccgcgggccggg

SEQ ID NO: 442123 - RNA, 32 nt, Human
gcgcacgggaggacggagaggcggaaaggaug

SEQ ID NO: 442124 - RNA, 32 nt, Human
gcgcacggucacccaaaggaggucgacucgcc

SEQ ID NO: 442125 - RNA, 32 nt, Human
gcgcacgugucggcgcucacacacacaugcua

SEQ ID NO: 442126 - RNA, 21 nt, Human
gcgcacguugguuucuugguc

SEQ ID NO: 442127 - RNA, 32 nt, Human
gcgcacugcaaccuggaccuccugggcucaag

SEQ ID NO: 442128 - RNA, 32 nt, Human
gcgcacugcagccuugaacuccugggcucaag

SEQ ID NO: 442129 - RNA, 32 nt, Human
gcgcacugcaguuaaugaauucugccuucaac

SEQ ID NO: 442130 - RNA, 32 nt, Human
gcgcacugggacggcagccaggaaacgugugg

SEQ ID NO: 442131 - RNA, 32 nt, Human
gcgcacugggauccugcuggaaccucagcugc

SEQ ID NO: 442132 - RNA, 32 nt, Human
gcgcacuuauggucccagcuaauugggagccu

SEQ ID NO: 442133 - RNA, 32 nt, Human
gcgcagaagaucaagaccagccugggaaauau

SEQ ID NO: 442134 - RNA, 32 nt, Human
gcgcagaccgggccgcagcccaugccccgagc

SEQ ID NO: 442135 - RNA, 32 nt, Human
gcgcagaccucuuggccuucucucacaggucg

SEQ ID NO: 442136 - RNA, 32 nt, Human
gcgcagagaacucccagagaagaaggagauca

SEQ ID NO: 442137 - RNA, 32 nt, Human
gcgcagagccccguccugauugaucgcaucgc

SEQ ID NO: 442138 - RNA, 32 nt, Human
gcgcagaggcggagcugugcucagcacaggcc

SEQ ID NO: 442139 - RNA, 32 nt, Human
gcgcagaggcgucacgcacuccaugguaacga

SEQ ID NO: 442140 - RNA, 32 nt, Human
gcgcagaggugacagacagccacugaggccca

SEQ ID NO: 442141 - RNA, 32 nt, Human
gcgcagauggccugggcgagccaggucugagg

SEQ ID NO: 442142 - RNA, 32 nt, Human
gcgcagauuccuuccaggugggaagaaagcuu

SEQ ID NO: 442143 - RNA, 27 nt, Human
gcgcagcacaacggccgccgccgccac

SEQ ID NO: 442144 - RNA, 32 nt, Human
gcgcagcacagcccggccauggagcacgcggu

SEQ ID NO: 442145 - RNA, 18 nt, Human
gcgcagcagagccagggg

SEQ ID NO: 442146 - RNA, 22 nt, Human
gcgcagcagccgccgccgccgc

SEQ ID NO: 442147 - RNA, 20 nt, Human
gcgcagcagccucugugggg

SEQ ID NO: 442148 - RNA, 27 nt, Human
gcgcagcagcggcggcggcaguggcgg

SEQ ID NO: 442149 - RNA, 22 nt, Human
gcgcagcagcgggagcuagggg

SEQ ID NO: 442150 - RNA, 32 nt, Human
gcgcagcagucggcguccgccucccaguacca

SEQ ID NO: 442151 - RNA, 23 nt, Human
gcgcagcagugcaccacugggaa

SEQ ID NO: 442152 - RNA, 32 nt, Human
gcgcagcauccugagcgcgccucugccgaggc

SEQ ID NO: 442153 - RNA, 22 nt, Human
gcgcagccaccgccgccgccgc

SEQ ID NO: 442154 - RNA, 32 nt, Human
gcgcagccauuuucucccgggagagguuggag

SEQ ID NO: 442155 - RNA, 18 nt, Human
gcgcagcccaaggagggg

SEQ ID NO: 442156 - RNA, 32 nt, Human
gcgcagcccaggaggcgggagccccugcacac

SEQ ID NO: 442157 - RNA, 32 nt, Human
gcgcagccccucuccucuucaggcuacagggu

SEQ ID NO: 442158 - RNA, 32 nt, Human
gcgcagcccgcucccgccgccaccuccucccc

SEQ ID NO: 442159 - RNA, 19 nt, Human
gcgcagcccggcacccgca

SEQ ID NO: 442160 - RNA, 32 nt, Human
gcgcagcccuagugggagcccagcacacugcu

SEQ ID NO: 442161 - RNA, 32 nt, Human
gcgcagcccugucccguguccuguccucuacu

SEQ ID NO: 442162 - RNA, 32 nt, Human
gcgcagccgacaucagcacccuagaccagaag

SEQ ID NO: 442163 - RNA, 32 nt, Human
gcgcagccgagcggagcccaggagagcagaga

SEQ ID NO: 442164 - RNA, 32 nt, Human
gcgcagccugggcccagcccaccccgcgccgg

SEQ ID NO: 442165 - RNA, 19 nt, Human
gcgcagcgcggacccggcc

SEQ ID NO: 442166 - RNA, 32 nt, Human
gcgcagcgcgggggcugggauucacgcccaga

SEQ ID NO: 442167 - RNA, 32 nt, Human
gcgcagcggccgaugguacagcccgcuccccc

SEQ ID NO: 442168 - RNA, 32 nt, Human
gcgcagcggcucaugccuguaaccucagcacu

SEQ ID NO: 442169 - RNA, 32 nt, Human
gcgcagcuccacccauugugccccaggccagc

SEQ ID NO: 442170 - RNA, 28 nt, Human
gcgcagcugacugcugccucucacggcc

SEQ ID NO: 442171 - RNA, 32 nt, Human
gcgcagcugcacuccagccugggcaacagagc

SEQ ID NO: 442172 - RNA, 32 nt, Human
gcgcagcuuauuaagagagaaggcuuuacuag

SEQ ID NO: 442173 - RNA, 32 nt, Human
gcgcaggaagacgcagaacaacagaaauagcc

SEQ ID NO: 442174 - RNA, 32 nt, Human
gcgcaggaauaagcaaagagacccuggaccca

SEQ ID NO: 442175 - RNA, 32 nt, Human
gcgcaggacccuuggaaauguugcaaguguua

SEQ ID NO: 442176 - RNA, 19 nt, Human
gcgcaggacugggcggccu

SEQ ID NO: 442177 - RNA, 32 nt, Human
gcgcaggagaaaaggagggggaagagaguccg

SEQ ID NO: 442178 - RNA, 32 nt, Human
gcgcaggaggaaacaguaccggcuggaggccg

SEQ ID NO: 442179 - RNA, 32 nt, Human
gcgcaggaggccugaggaguggcuacuggagc

SEQ ID NO: 442180 - RNA, 19 nt, Human
gcgcaggcagcccccgccc

SEQ ID NO: 442181 - RNA, 19 nt, Human
gcgcaggccaggaucagcg

SEQ ID NO: 442182 - RNA, 32 nt, Human
gcgcaggccguuccaucugccucccaggucug

SEQ ID NO: 442183 - RNA, 32 nt, Human
gcgcagggagcugccaaggccaugucuguucc

SEQ ID NO: 442184 - RNA, 32 nt, Human
gcgcagggcccccagcccaaguucuuccaucu

SEQ ID NO: 442185 - RNA, 32 nt, Human
gcgcaggggaggcagaagucaugacaggcgag

SEQ ID NO: 442186 - RNA, 32 nt, Human
gcgcaggggaggcaggcggaggccaugggcag

SEQ ID NO: 442187 - RNA, 32 nt, Human
gcgcaggggcaucucuccccugcuccagcgca

SEQ ID NO: 442188 - RNA, 19 nt, Human
gcgcaggggcugggcagcu

SEQ ID NO: 442189 - RNA, 18 nt, Human
gcgcaggggcugggggcc

SEQ ID NO: 442190 - RNA, 22 nt, Human
gcgcaggggugggagggcggcc

SEQ ID NO: 442191 - RNA, 32 nt, Human
gcgcagggugccggggaagcucgggaauggag

SEQ ID NO: 442192 - RNA, 32 nt, Human
gcgcaggguggagggaguggccagcggcccug

SEQ ID NO: 442193 - RNA, 32 nt, Human
gcgcagguggagccagcgagaggcucugaggc

SEQ ID NO: 442194 - RNA, 32 nt, Human
gcgcagucaugcaggaaaaccucagauuugcu

SEQ ID NO: 442195 - RNA, 32 nt, Human
gcgcagucauucucauaaucgcccacgggcuu

SEQ ID NO: 442196 - RNA, 32 nt, Human
gcgcagucgucacgccuguaaucccagcacuu

SEQ ID NO: 442197 - RNA, 32 nt, Human
gcgcagucuccacggaggccucaggccucggu

SEQ ID NO: 442198 - RNA, 19 nt, Human
gcgcagugccccccuccca

SEQ ID NO: 442199 - RNA, 32 nt, Human
gcgcaguggcucacaacuguaaccucaagcac

SEQ ID NO: 442200 - RNA, 32 nt, Human
gcgcaguggcuguaaucccagcacuuugggag

SEQ ID NO: 442201 - RNA, 32 nt, Human
gcgcagugguucaugcuguaaucccaucacuu

SEQ ID NO: 442202 - RNA, 32 nt, Human
gcgcaguguaaaugagcaaagauggaucagga

SEQ ID NO: 442203 - RNA, 32 nt, Human
gcgcaguuugcucgcuuuccuccccugccggc

SEQ ID NO: 442204 - RNA, 32 nt, Human
gcgcauaccuguaaucucugcuauuugggaga

SEQ ID NO: 442205 - RNA, 32 nt, Human
gcgcauagaggagagaaggaaaccugaggagu

SEQ ID NO: 442206 - RNA, 32 nt, Human
gcgcauagggguucuccaggcugcaguuggcg

SEQ ID NO: 442207 - RNA, 32 nt, Human
gcgcaucaguguucucuggguccugugcccuc

SEQ ID NO: 442208 - RNA, 32 nt, Human
gcgcauccaaucucaaggaaucuuuaagcaga

SEQ ID NO: 442209 - RNA, 32 nt, Human
gcgcauccggaggcggccgggccccgccaugg

SEQ ID NO: 442210 - RNA, 32 nt, Human
gcgcaugauuacuuguuuuauauuucauguug

SEQ ID NO: 442211 - RNA, 32 nt, Human
gcgcaugcacacacagacggacagagacagaa

SEQ ID NO: 442212 - RNA, 32 nt, Human
gcgcaugcaccacgugcugaaagaggcucuca

SEQ ID NO: 442213 - RNA, 32 nt, Human
gcgcaugcaccacgugcugaaggaggcgcuca

SEQ ID NO: 442214 - RNA, 32 nt, Human
gcgcaugccuguaaucccagaacuuugggagg

SEQ ID NO: 442215 - RNA, 32 nt, Human
gcgcaugccuguaaucccagcacuuugggagg

SEQ ID NO: 442216 - RNA, 32 nt, Human
gcgcaugccuguaaucccagcuacucgggagg

SEQ ID NO: 442217 - RNA, 32 nt, Human
gcgcaugccuguaaucccagcuacugggaagg

SEQ ID NO: 442218 - RNA, 32 nt, Human
gcgcaugccuguaaucccagcuacuuaggagg

SEQ ID NO: 442219 - RNA, 32 nt, Human
gcgcaugccuguaaucccagcuacuugggaga

SEQ ID NO: 442220 - RNA, 32 nt, Human
gcgcaugccuguaaucccagcuacuugggagc

SEQ ID NO: 442221 - RNA, 32 nt, Human
gcgcaugccuguaaucccagcuacuugggagg

SEQ ID NO: 442222 - RNA, 32 nt, Human
gcgcaugccuguaaucccagcugcuugggagg

SEQ ID NO: 442223 - RNA, 32 nt, Human
gcgcaugccuguaauccuagcuacucgggagg

SEQ ID NO: 442224 - RNA, 32 nt, Human
gcgcaugccuguaaucucagcuacucaggagg

SEQ ID NO: 442225 - RNA, 32 nt, Human
gcgcaugccuguagucccagcuaacugggagg

SEQ ID NO: 442226 - RNA, 32 nt, Human
gcgcaugccuguagucccagcuacuugggagg

SEQ ID NO: 442227 - RNA, 32 nt, Human
gcgcaugccuuuaaucucagcuauucuggagg

SEQ ID NO: 442228 - RNA, 32 nt, Human
gcgcaugcuuguaaucccagcuacucgggagg

SEQ ID NO: 442229 - RNA, 32 nt, Human
gcgcauggaagaggcgguccagccaucugaug

SEQ ID NO: 442230 - RNA, 29 nt, Human
gcgcauggagccagaggaggaggaugaac

SEQ ID NO: 442231 - RNA, 32 nt, Human
gcgcauggucucagcucacugcaaccucugcc

SEQ ID NO: 442232 - RNA, 32 nt, Human
gcgcaugucuguaaucccagcuacuggggaag

SEQ ID NO: 442233 - RNA, 32 nt, Human
gcgcaugucuguaaucccagcuacuggggagg

SEQ ID NO: 442234 - RNA, 29 nt, Human
gcgcauguggggcucccugggcuggggcc

SEQ ID NO: 442235 - RNA, 32 nt, Human
gcgcauguguguuugcauguaggagaacgugc

SEQ ID NO: 442236 - RNA, 32 nt, Human
gcgcauucaaaacagucucaguaacaaagaca

SEQ ID NO: 442237 - RNA, 32 nt, Human
gcgcauucaguuuggaaaagacagcuuuucau

SEQ ID NO: 442238 - RNA, 32 nt, Human
gcgcauucccacacuccagucuggauccaggu

SEQ ID NO: 442239 - RNA, 32 nt, Human
gcgcauugccuguaaucccagcuacuagggag

SEQ ID NO: 442240 - RNA, 32 nt, Human
gcgcauuggugagcccgacuccccagccucgg

SEQ ID NO: 442241 - RNA, 32 nt, Human
gcgccaaccagaaacuuugccccucgaagucc

SEQ ID NO: 442242 - RNA, 32 nt, Human
gcgccaaggccuucacccaggugucgcaccug

SEQ ID NO: 442243 - RNA, 32 nt, Human
gcgccaagggauccagccuagagcagaccuua

SEQ ID NO: 442244 - RNA, 32 nt, Human
gcgccaaugcacuccagccugggcgacagaga

SEQ ID NO: 442245 - RNA, 32 nt, Human
gcgccacagcauuccagccugggcgauggagu

SEQ ID NO: 442246 - RNA, 19 nt, Human
gcgccacaucccaccggcc

SEQ ID NO: 442247 - RNA, 32 nt, Human
gcgccaccaaccccacccacacugcugccugg

SEQ ID NO: 442248 - RNA, 32 nt, Human
gcgccaccacacuccagccugggcaacagaga

SEQ ID NO: 442249 - RNA, 20 nt, Human
gcgccaccacgcugcacccc

SEQ ID NO: 442250 - RNA, 21 nt, Human
gcgccaccacgcugcaccccc

SEQ ID NO: 442251 - RNA, 22 nt, Human
gcgccaccacugaugccaccca

SEQ ID NO: 442252 - RNA, 32 nt, Human
gcgccaccacugcacuccagccugggcaacag

SEQ ID NO: 442253 - RNA, 32 nt, Human
gcgccaccauggugcuggagucgguggucgcg

SEQ ID NO: 442254 - RNA, 32 nt, Human
gcgccacccacccucgcuuucuccggcuuccu

SEQ ID NO: 442255 - RNA, 32 nt, Human
gcgccacccaggccgccacacgccgaggcuuc

SEQ ID NO: 442256 - RNA, 24 nt, Human
gcgccaccccgcggucaucgguca

SEQ ID NO: 442257 - RNA, 32 nt, Human
gcgccacccucggggcgccgacggucacggag

SEQ ID NO: 442258 - RNA, 32 nt, Human
gcgccaccgcacuccagccucgccgacaaagc

SEQ ID NO: 442259 - RNA, 32 nt, Human
gcgccaccgcacuccagccugggcaacagagc

SEQ ID NO: 442260 - RNA, 32 nt, Human
gcgccaccgcacuccagccugggcgacagagc

SEQ ID NO: 442261 - RNA, 32 nt, Human
gcgccaccgcauuccagccugggcgacagagc

SEQ ID NO: 442262 - RNA, 32 nt, Human
gcgccaccgcccuccagccugggcgacagagc

SEQ ID NO: 442263 - RNA, 32 nt, Human
gcgccaccgcgcuccagccugggugacagagc

SEQ ID NO: 442264 - RNA, 32 nt, Human
gcgccaccgggggaggaggaggaggagaaggu

SEQ ID NO: 442265 - RNA, 18 nt, Human
gcgccaccguccccggcg

SEQ ID NO: 442266 - RNA, 32 nt, Human
gcgccaccgugccuggcuaacuuuucauuuuu

SEQ ID NO: 442267 - RNA, 21 nt, Human
gcgccaccugagggucagcca

SEQ ID NO: 442268 - RNA, 17 nt, Human
gcgccaccuugggccag

SEQ ID NO: 442269 - RNA, 32 nt, Human
gcgccacgagcccggccgagugcagcuggagc

SEQ ID NO: 442270 - RNA, 32 nt, Human
gcgccacgcucgccccugcacacucacauaug

SEQ ID NO: 442271 - RNA, 32 nt, Human
gcgccacggcacuccagccugggagacagagc

SEQ ID NO: 442272 - RNA, 32 nt, Human
gcgccacggcacuccagccugggcgacagagc

SEQ ID NO: 442273 - RNA, 32 nt, Human
gcgccacuacacuccagccugagcaacagagu

SEQ ID NO: 442274 - RNA, 32 nt, Human
gcgccacuacacuccagccugggcaacagagg

SEQ ID NO: 442275 - RNA, 32 nt, Human
gcgccacuacacuccagccugggcgacagagc

SEQ ID NO: 442276 - RNA, 32 nt, Human
gcgccacuacacuccagccugggugacagagu

SEQ ID NO: 442277 - RNA, 32 nt, Human
gcgccacuauacuccagccugggcaacagaca

SEQ ID NO: 442278 - RNA, 32 nt, Human
gcgccacucugcuggcugaggcugcggagagu

SEQ ID NO: 442279 - RNA, 32 nt, Human
gcgccacugcacucaagccugggcaacaccug

SEQ ID NO: 442280 - RNA, 32 nt, Human
gcgccacugcacucaagucugggcgacagggu

SEQ ID NO: 442281 - RNA, 32 nt, Human
gcgccacugcacuccaaccugggcaauagagg

SEQ ID NO: 442282 - RNA, 32 nt, Human
gcgccacugcacuccaaccugggugacagacu

SEQ ID NO: 442283 - RNA, 32 nt, Human
gcgccacugcacuccacccuggguaacggaac

SEQ ID NO: 442284 - RNA, 32 nt, Human
gcgccacugcacuccacccugggugacagagu

SEQ ID NO: 442285 - RNA, 32 nt, Human
gcgccacugcacuccagcagucugggcgacag

SEQ ID NO: 442286 - RNA, 32 nt, Human
gcgccacugcacuccagccagggcgaaggagu

SEQ ID NO: 442287 - RNA, 32 nt, Human
gcgccacugcacuccagcccgggcgacagagc

SEQ ID NO: 442288 - RNA, 32 nt, Human
gcgccacugcacuccagcccgggugacagagc

SEQ ID NO: 442289 - RNA, 32 nt, Human
gcgccacugcacuccagcccuggcgacagagu

SEQ ID NO: 442290 - RNA, 32 nt, Human
gcgccacugcacuccagccuagacgacagagc

SEQ ID NO: 442291 - RNA, 32 nt, Human
gcgccacugcacuccagccuaggcaacagagc

SEQ ID NO: 442292 - RNA, 32 nt, Human
gcgccacugcacuccagccuaggggacaguua

SEQ ID NO: 442293 - RNA, 32 nt, Human
gcgccacugcacuccagccuaggugacagagg

SEQ ID NO: 442294 - RNA, 32 nt, Human
gcgccacugcacuccagccuaggugauagagc

SEQ ID NO: 442295 - RNA, 32 nt, Human
gcgccacugcacuccagccucagcaauagagu

SEQ ID NO: 442296 - RNA, 32 nt, Human
gcgccacugcacuccagccucggcaacagagc

SEQ ID NO: 442297 - RNA, 32 nt, Human
gcgccacugcacuccagccucggugacagagc

SEQ ID NO: 442298 - RNA, 32 nt, Human
gcgccacugcacuccagccugacgacaaagcg

SEQ ID NO: 442299 - RNA, 32 nt, Human
gcgccacugcacuccagccugagcgacagagu

SEQ ID NO: 442300 - RNA, 32 nt, Human
gcgccacugcacuccagccugagugacagagc

SEQ ID NO: 442301 - RNA, 32 nt, Human
gcgccacugcacuccagccuggacgacagagc

SEQ ID NO: 442302 - RNA, 32 nt, Human
gcgccacugcacuccagccuggacgacagagu

SEQ ID NO: 442303 - RNA, 32 nt, Human
gcgccacugcacuccagccuggcaacagagug

SEQ ID NO: 442304 - RNA, 32 nt, Human
gcgccacugcacuccagccuggcgacaaagcg

SEQ ID NO: 442305 - RNA, 32 nt, Human
gcgccacugcacuccagccuggcgacagagca

SEQ ID NO: 442306 - RNA, 32 nt, Human
gcgccacugcacuccagccuggcgacagagcg

SEQ ID NO: 442307 - RNA, 32 nt, Human
gcgccacugcacuccagccugggagacagagu

SEQ ID NO: 442308 - RNA, 32 nt, Human
gcgccacugcacuccagccugggcaacaagaa

SEQ ID NO: 442309 - RNA, 32 nt, Human
gcgccacugcacuccagccugggcaacaagag

SEQ ID NO: 442310 - RNA, 32 nt, Human
gcgccacugcacuccagccugggcaacagaac

SEQ ID NO: 442311 - RNA, 32 nt, Human
gcgccacugcacuccagccugggcaacagagc

SEQ ID NO: 442312 - RNA, 32 nt, Human
gcgccacugcacuccagccugggcaacagagg

SEQ ID NO: 442313 - RNA, 32 nt, Human
gcgccacugcacuccagccugggcaacagagu

SEQ ID NO: 442314 - RNA, 32 nt, Human
gcgccacugcacuccagccugggcaacaggcu

SEQ ID NO: 442315 - RNA, 32 nt, Human
gcgccacugcacuccagccugggcaauagagu

SEQ ID NO: 442316 - RNA, 32 nt, Human
gcgccacugcacuccagccugggcagcaagag

SEQ ID NO: 442317 - RNA, 32 nt, Human
gcgccacugcacuccagccugggcagcagagc

SEQ ID NO: 442318 - RNA, 32 nt, Human
gcgccacugcacuccagccugggcagcagagg

SEQ ID NO: 442319 - RNA, 32 nt, Human
gcgccacugcacuccagccugggcgacacagc

SEQ ID NO: 442320 - RNA, 30 nt, Human
gcgccacugcacuccagccugggcgacaga

SEQ ID NO: 442321 - RNA, 32 nt, Human
gcgccacugcacuccagccugggcgacagagc

SEQ ID NO: 442322 - RNA, 32 nt, Human
gcgccacugcacuccagccugggcgacagagu

SEQ ID NO: 442323 - RNA, 32 nt, Human
gcgccacugcacuccagccugggcgacagcaa

SEQ ID NO: 442324 - RNA, 32 nt, Human
gcgccacugcacuccagccugggcgacagcga

SEQ ID NO: 442325 - RNA, 32 nt, Human
gcgccacugcacuccagccugggcgacagggc

SEQ ID NO: 442326 - RNA, 32 nt, Human
gcgccacugcacuccagccugggcgacggagc

SEQ ID NO: 442327 - RNA, 32 nt, Human
gcgccacugcacuccagccugggcgagagaau

SEQ ID NO: 442328 - RNA, 32 nt, Human
gcgccacugcacuccagccugggcgauagagc

SEQ ID NO: 442329 - RNA, 32 nt, Human
gcgccacugcacuccagccugggcgucagagu

SEQ ID NO: 442330 - RNA, 32 nt, Human
gcgccacugcacuccagccugggcuacagagc

SEQ ID NO: 442331 - RNA, 32 nt, Human
gcgccacugcacuccagccugggggacagagc

SEQ ID NO: 442332 - RNA, 32 nt, Human
gcgccacugcacuccagccuggguaacagagc

SEQ ID NO: 442333 - RNA, 32 nt, Human
gcgccacugcacuccagccugggugacacagc

SEQ ID NO: 442334 - RNA, 32 nt, Human
gcgccacugcacuccagccugggugacagaac

SEQ ID NO: 442335 - RNA, 32 nt, Human
gcgccacugcacuccagccugggugacagaau

SEQ ID NO: 442336 - RNA, 32 nt, Human
gcgccacugcacuccagccugggugacagaga

SEQ ID NO: 442337 - RNA, 32 nt, Human
gcgccacugcacuccagccugggugacagagc

SEQ ID NO: 442338 - RNA, 32 nt, Human
gcgccacugcacuccagccugggugacagagg

SEQ ID NO: 442339 - RNA, 32 nt, Human
gcgccacugcacuccagccugggugacagagu

SEQ ID NO: 442340 - RNA, 32 nt, Human
gcgccacugcacuccagccugggugacugagg

SEQ ID NO: 442341 - RNA, 32 nt, Human
gcgccacugcacuccagccugggugagagagu

SEQ ID NO: 442342 - RNA, 32 nt, Human
gcgccacugcacuccagccugggugauagagc

SEQ ID NO: 442343 - RNA, 32 nt, Human
gcgccacugcacuccagccugggugauagagu

SEQ ID NO: 442344 - RNA, 32 nt, Human
gcgccacugcacuccagccuggugacagagca

SEQ ID NO: 442345 - RNA, 32 nt, Human
gcgccacugcacuccagccuggugacagagcg

SEQ ID NO: 442346 - RNA, 32 nt, Human
gcgccacugcacuccagccugguugacagagc

SEQ ID NO: 442347 - RNA, 32 nt, Human
gcgccacugcacuccagcgcggaagacagagu

SEQ ID NO: 442348 - RNA, 32 nt, Human
gcgccacugcacuccagcgugggcuacagagu

SEQ ID NO: 442349 - RNA, 32 nt, Human
gcgccacugcacuccagcuugggcaacagagc

SEQ ID NO: 442350 - RNA, 32 nt, Human
gcgccacugcacuccaggccugggugacagug

SEQ ID NO: 442351 - RNA, 32 nt, Human
gcgccacugcacuccaggcugggcaacggagu

SEQ ID NO: 442352 - RNA, 32 nt, Human
gcgccacugcacuccaggcugggcgacagagc

SEQ ID NO: 442353 - RNA, 32 nt, Human
gcgccacugcacuccagucugggacaacagag

SEQ ID NO: 442354 - RNA, 32 nt, Human
gcgccacugcacuccagucugggcaacagagc

SEQ ID NO: 442355 - RNA, 32 nt, Human
gcgccacugcacuccagucugggcaacagagu

SEQ ID NO: 442356 - RNA, 32 nt, Human
gcgccacugcacuccagucugggcgacagagc

SEQ ID NO: 442357 - RNA, 32 nt, Human
gcgccacugcacuccagucugggcgauagagc

SEQ ID NO: 442358 - RNA, 32 nt, Human
gcgccacugcacuccagucuggucggcaagag

SEQ ID NO: 442359 - RNA, 32 nt, Human
gcgccacugcacuccaguuugggcaacagaau

SEQ ID NO: 442360 - RNA, 32 nt, Human
gcgccacugcacuccggccugaugacagagcg

SEQ ID NO: 442361 - RNA, 32 nt, Human
gcgccacugcacuccugccugggacacaaugc

SEQ ID NO: 442362 - RNA, 32 nt, Human
gcgccacugcacuccugccugggcaacugagc

SEQ ID NO: 442363 - RNA, 32 nt, Human
gcgccacugcacucuagccggagugacagagu

SEQ ID NO: 442364 - RNA, 32 nt, Human
gcgccacugcacucuagccuaagcaauggagc

SEQ ID NO: 442365 - RNA, 32 nt, Human
gcgccacugcacucuagccugagugacagagc

SEQ ID NO: 442366 - RNA, 32 nt, Human
gcgccacugcacucuagccugggccauagagc

SEQ ID NO: 442367 - RNA, 32 nt, Human
gcgccacugcacucuagccugggcuacagagc

SEQ ID NO: 442368 - RNA, 32 nt, Human
gcgccacugcacucuagccugggugacagagc

SEQ ID NO: 442369 - RNA, 32 nt, Human
gcgccacugcacucuagccugggugacagagu

SEQ ID NO: 442370 - RNA, 32 nt, Human
gcgccacugcacugcacgccagccuaggcgac

SEQ ID NO: 442371 - RNA, 32 nt, Human
gcgccacugcacuucagccuggacaacagagu

SEQ ID NO: 442372 - RNA, 32 nt, Human
gcgccacugcacuucagccuggaugacagagc

SEQ ID NO: 442373 - RNA, 32 nt, Human
gcgccacugcacuucagccugggcaacagagc

SEQ ID NO: 442374 - RNA, 32 nt, Human
gcgccacugcacuucagccugggugacagagc

SEQ ID NO: 442375 - RNA, 32 nt, Human
gcgccacugcacuucagccuuggagacagggg

SEQ ID NO: 442376 - RNA, 32 nt, Human
gcgccacugcaguccagccugggcaacaagag

SEQ ID NO: 442377 - RNA, 32 nt, Human
gcgccacugcauuccagccuggacgacagagc

SEQ ID NO: 442378 - RNA, 32 nt, Human
gcgccacugcauuccagccugggcaacagagc

SEQ ID NO: 442379 - RNA, 32 nt, Human
gcgccacugcauuccagccugggugacugagc

SEQ ID NO: 442380 - RNA, 32 nt, Human
gcgccacugcauucuagccuggaugacagagc

SEQ ID NO: 442381 - RNA, 32 nt, Human
gcgccacugcccuccagccugggcgacagaau

SEQ ID NO: 442382 - RNA, 32 nt, Human
gcgccacugcgcuccagccuggacaacacagu

SEQ ID NO: 442383 - RNA, 32 nt, Human
gcgccacugcgcuccagccugggcaacagagc

SEQ ID NO: 442384 - RNA, 32 nt, Human
gcgccacugcucuccagccuggguggcagagc

SEQ ID NO: 442385 - RNA, 18 nt, Human
gcgccacugcuucugcca

SEQ ID NO: 442386 - RNA, 32 nt, Human
gcgccacuggacuccagccugcgugacagaga

SEQ ID NO: 442387 - RNA, 32 nt, Human
gcgccacuggacuccagccuggacaacagagc

SEQ ID NO: 442388 - RNA, 32 nt, Human
gcgccacugggcuccagccugggcgacagagu

SEQ ID NO: 442389 - RNA, 32 nt, Human
gcgccacuguacuccagccuggacaacagcga

SEQ ID NO: 442390 - RNA, 32 nt, Human
gcgccacuguacuccagccuggcaacagagug

SEQ ID NO: 442391 - RNA, 32 nt, Human
gcgccacuguacuccagccugggcaacagagc

SEQ ID NO: 442392 - RNA, 32 nt, Human
gcgccacuguacuccagccugggugacagagc

SEQ ID NO: 442393 - RNA, 32 nt, Human
gcgccacuguacuccagccugggugacgagcg

SEQ ID NO: 442394 - RNA, 32 nt, Human
gcgccacuguacuccagccugggugaggagag

SEQ ID NO: 442395 - RNA, 32 nt, Human
gcgccacuguacuccagcuugggcaacagagc

SEQ ID NO: 442396 - RNA, 32 nt, Human
gcgccacugugcuccagccugggcaacagagc

SEQ ID NO: 442397 - RNA, 32 nt, Human
gcgccacuucacuccagccugggcaacagagu

SEQ ID NO: 442398 - RNA, 32 nt, Human
gcgccacuucacuccagccugggugacagaga

SEQ ID NO: 442399 - RNA, 32 nt, Human
gcgccacuucucagaaacacacagagcuuuag

SEQ ID NO: 442400 - RNA, 20 nt, Human
gcgccagagcccagcacucc

SEQ ID NO: 442401 - RNA, 32 nt, Human
gcgccagagccgaagaaggagacugaaaguga

SEQ ID NO: 442402 - RNA, 21 nt, Human
gcgccagcagcagcagcagca

SEQ ID NO: 442403 - RNA, 19 nt, Human
gcgccagcagccucugcca

SEQ ID NO: 442404 - RNA, 32 nt, Human
gcgccagcagcucuggugcugugcuucccgug

SEQ ID NO: 442405 - RNA, 32 nt, Human
gcgccagcaugggagagcgagggaccugcccg

SEQ ID NO: 442406 - RNA, 32 nt, Human
gcgccagccaccacggcccuccggacauuccu

SEQ ID NO: 442407 - RNA, 21 nt, Human
gcgccagcccguggcccggca

SEQ ID NO: 442408 - RNA, 19 nt, Human
gcgccagccgccccgagcc

SEQ ID NO: 442409 - RNA, 19 nt, Human
gcgccagccggucggcagg

SEQ ID NO: 442410 - RNA, 32 nt, Human
gcgccagcgggaaccacuaucucugcacuccu

SEQ ID NO: 442411 - RNA, 17 nt, Human
gcgccaggaagagagca

SEQ ID NO: 442412 - RNA, 32 nt, Human
gcgccaggagccgccugcgaccgcccgggcgu

SEQ ID NO: 442413 - RNA, 32 nt, Human
gcgccaggccgggaagaguacaaggacaagga

SEQ ID NO: 442414 - RNA, 32 nt, Human
gcgccaggccuggagauggcuggaaacugcuc

SEQ ID NO: 442415 - RNA, 22 nt, Human
gcgccagggacgcugccagcau

SEQ ID NO: 442416 - RNA, 18 nt, Human
gcgccagggacgggggca

SEQ ID NO: 442417 - RNA, 32 nt, Human
gcgccagggaggaggcaggcucaaccuucaga

SEQ ID NO: 442418 - RNA, 21 nt, Human
gcgccagggccugagcugccg

SEQ ID NO: 442419 - RNA, 18 nt, Human
gcgccaggggacccagca

SEQ ID NO: 442420 - RNA, 18 nt, Human
gcgccaggggagccgcca

SEQ ID NO: 442421 - RNA, 32 nt, Human
gcgccaggggcaggcagcuaggcagggagggg

SEQ ID NO: 442422 - RNA, 31 nt, Human
gcgccaggugacccuguuuccccgggcuggg

SEQ ID NO: 442423 - RNA, 32 nt, Human
gcgccaguacacuccagccuggguaacagagc

SEQ ID NO: 442424 - RNA, 32 nt, Human
gcgccagugaggaggaagggaaggcgguucag

SEQ ID NO: 442425 - RNA, 32 nt, Human
gcgccagugcacuccagccugggcaagaagag

SEQ ID NO: 442426 - RNA, 32 nt, Human
gcgccagugcacuccagcugggcgacagagcg

SEQ ID NO: 442427 - RNA, 32 nt, Human
gcgccaguuuuucuuguuaugacuguguauuu

SEQ ID NO: 442428 - RNA, 32 nt, Human
gcgccauauauguauguauguguaugugugug

SEQ ID NO: 442429 - RNA, 32 nt, Human
gcgccaucacacuccagccuaggcgacagagu

SEQ ID NO: 442430 - RNA, 32 nt, Human
gcgccaucaugggcugauuuuuauuaccaggu

SEQ ID NO: 442431 - RNA, 21 nt, Human
gcgccaucccaagcccagccc

SEQ ID NO: 442432 - RNA, 32 nt, Human
gcgccauccccaccuucgccuccugaggcaca

SEQ ID NO: 442433 - RNA, 32 nt, Human
gcgccaucccugagagagcagcagucuggaga

SEQ ID NO: 442434 - RNA, 23 nt, Human
gcgccauccuaaccauccagcca

SEQ ID NO: 442435 - RNA, 32 nt, Human
gcgccaucgcacuccagccugggcaacaagag

SEQ ID NO: 442436 - RNA, 32 nt, Human
gcgccaucgcacuccagccugggugacaagag

SEQ ID NO: 442437 - RNA, 32 nt, Human
gcgccaucugcaggagcuggcgggcuggccuu

SEQ ID NO: 442438 - RNA, 32 nt, Human
gcgccaugaauccugccacacagggaucaagg

SEQ ID NO: 442439 - RNA, 30 nt, Human
gcgccaugagucugacuuccaguuccagcg

SEQ ID NO: 442440 - RNA, 32 nt, Human
gcgccauggcacucacuccagccugggcaaca

SEQ ID NO: 442441 - RNA, 30 nt, Human
gcgccaugggcaagaacaagcagccacgcg

SEQ ID NO: 442442 - RNA, 30 nt, Human
gcgccauguccaccccuccguuggccgcgu

SEQ ID NO: 442443 - RNA, 30 nt, Human
gcgccauguccucugagucauccaccaugg

SEQ ID NO: 442444 - RNA, 30 nt, Human
gcgccauguccugcuuggccggcuggaggg

SEQ ID NO: 442445 - RNA, 21 nt, Human
gcgccaugugggcaucagcca

SEQ ID NO: 442446 - RNA, 32 nt, Human
gcgccauugcacuccaaccuaggugacaaagc

SEQ ID NO: 442447 - RNA, 32 nt, Human
gcgccauugcacuccaaccuggacgacagagc

SEQ ID NO: 442448 - RNA, 32 nt, Human
gcgccauugcacuccagcccgggcaacaagag

SEQ ID NO: 442449 - RNA, 32 nt, Human
gcgccauugcacuccagccuagguaacaagag

SEQ ID NO: 442450 - RNA, 32 nt, Human
gcgccauugcacuccagccugagcgacagagc

SEQ ID NO: 442451 - RNA, 32 nt, Human
gcgccauugcacuccagccuggacaacaagag

SEQ ID NO: 442452 - RNA, 32 nt, Human
gcgccauugcacuccagccuggcugacagagc

SEQ ID NO: 442453 - RNA, 32 nt, Human
gcgccauugcacuccagccugggcaaaaagag

SEQ ID NO: 442454 - RNA, 32 nt, Human
gcgccauugcacuccagccugggcaacaacag

SEQ ID NO: 442455 - RNA, 32 nt, Human
gcgccauugcacuccagccugggcaacaagag

SEQ ID NO: 442456 - RNA, 32 nt, Human
gcgccauugcacuccagccugggcaacacagc

SEQ ID NO: 442457 - RNA, 32 nt, Human
gcgccauugcacuccagccugggcaacagagu

SEQ ID NO: 442458 - RNA, 32 nt, Human
gcgccauugcacuccagccugggcaacgaaaa

SEQ ID NO: 442459 - RNA, 32 nt, Human
gcgccauugcacuccagccugggcaacgagug

SEQ ID NO: 442460 - RNA, 32 nt, Human
gcgccauugcacuccagccugggcaacuccgu

SEQ ID NO: 442461 - RNA, 32 nt, Human
gcgccauugcacuccagccugggcgacaagag

SEQ ID NO: 442462 - RNA, 32 nt, Human
gcgccauugcacuccagccugggcgacagagc

SEQ ID NO: 442463 - RNA, 32 nt, Human
gcgccauugcacuccagccugggcgacagagu

SEQ ID NO: 442464 - RNA, 32 nt, Human
gcgccauugcacuccagccugggcgacugaau

SEQ ID NO: 442465 - RNA, 32 nt, Human
gcgccauugcacuccagccugggcggcagagc

SEQ ID NO: 442466 - RNA, 32 nt, Human
gcgccauugcacuccagccuggggacaaagca

SEQ ID NO: 442467 - RNA, 32 nt, Human
gcgccauugcacuccagccugggggacaagag

SEQ ID NO: 442468 - RNA, 32 nt, Human
gcgccauugcacuccagccuggguaacaagag

SEQ ID NO: 442469 - RNA, 32 nt, Human
gcgccauugcacuccagccugggugacaagag

SEQ ID NO: 442470 - RNA, 32 nt, Human
gcgccauugcacuccagccugggugacagagc

SEQ ID NO: 442471 - RNA, 32 nt, Human
gcgccauugcacuccagccugggugacgagug

SEQ ID NO: 442472 - RNA, 32 nt, Human
gcgccauugcacuccagccuuggaacaagagu

SEQ ID NO: 442473 - RNA, 32 nt, Human
gcgccauugcacuccagucugggugacagagc

SEQ ID NO: 442474 - RNA, 32 nt, Human
gcgccauugcacuccauccuggacaacaggag

SEQ ID NO: 442475 - RNA, 32 nt, Human
gcgccauugcacucccgccugggcgacuccau

SEQ ID NO: 442476 - RNA, 32 nt, Human
gcgccauugcacuccggccuggggacaagagc

SEQ ID NO: 442477 - RNA, 32 nt, Human
gcgccauugcacucuagccuaggugacagagu

SEQ ID NO: 442478 - RNA, 32 nt, Human
gcgccauugcauuccagccugggcaacaagag

SEQ ID NO: 442479 - RNA, 32 nt, Human
gcgccauugcauuccagccugggugacagagc

SEQ ID NO: 442480 - RNA, 32 nt, Human
gcgccauuguacuccagccugggcaacaagag

SEQ ID NO: 442481 - RNA, 32 nt, Human
gcgccauuguacuccagccugggcgaugagca

SEQ ID NO: 442482 - RNA, 32 nt, Human
gcgccauuguacuccagccugggggacaggag

SEQ ID NO: 442483 - RNA, 32 nt, Human
gcgccauugugcuccagccugggugacaaagc

SEQ ID NO: 442484 - RNA, 32 nt, Human
gcgccauuucacuccagccugggcgacagagc

SEQ ID NO: 442485 - RNA, 32 nt, Human
gcgcccacagccgcccgacggcgcccagagag

SEQ ID NO: 442486 - RNA, 32 nt, Human
gcgcccacagccgcccugaggcuguaggcaug

SEQ ID NO: 442487 - RNA, 32 nt, Human
gcgcccaccaccacagccugcuaauuuuugua

SEQ ID NO: 442488 - RNA, 32 nt, Human
gcgcccaccccggaguugguggcgcagaggcg

SEQ ID NO: 442489 - RNA, 17 nt, Human
gcgcccacgucuggcug

SEQ ID NO: 442490 - RNA, 32 nt, Human
gcgcccagacaggccuggagcacggaugaaua

SEQ ID NO: 442491 - RNA, 32 nt, Human
gcgcccagacucugaacucagcagaaaguggc

SEQ ID NO: 442492 - RNA, 32 nt, Human
gcgcccagcauugcgacugagaucagcauuuu

SEQ ID NO: 442493 - RNA, 32 nt, Human
gcgcccagccccaaguggcuuuuucaauuaca

SEQ ID NO: 442494 - RNA, 32 nt, Human
gcgcccagccccugcugcucugggcagacgau

SEQ ID NO: 442495 - RNA, 20 nt, Human
gcgcccagcccgcccagccc

SEQ ID NO: 442496 - RNA, 22 nt, Human
gcgcccagcccggcccgccgca

SEQ ID NO: 442497 - RNA, 32 nt, Human
gcgcccagccuccuuccccacagggucucgcc

SEQ ID NO: 442498 - RNA, 20 nt, Human
gcgcccagccugccagccgc

SEQ ID NO: 442499 - RNA, 31 nt, Human
gcgcccagcuggcugcagcacuuguagcaug

SEQ ID NO: 442500 - RNA, 21 nt, Human
gcgcccaggacccuggccugc

SEQ ID NO: 442501 - RNA, 32 nt, Human
gcgcccaggccgacagggccuaccucccgcuc

SEQ ID NO: 442502 - RNA, 32 nt, Human
gcgcccagggccgcggaggugggacgcgaugc

SEQ ID NO: 442503 - RNA, 32 nt, Human
gcgcccagguccugggcuggccgccgggaugu

SEQ ID NO: 442504 - RNA, 32 nt, Human
gcgcccaucacugacccgugagaacucgacug

SEQ ID NO: 442505 - RNA, 32 nt, Human
gcgcccauucgucugucccagagcuuauuggc

SEQ ID NO: 442506 - RNA, 21 nt, Human
gcgccccacacuacccccugg

SEQ ID NO: 442507 - RNA, 25 nt, Human
gcgccccaccccgcgcgcccgagca

SEQ ID NO: 442508 - RNA, 32 nt, Human
gcgccccacgccauugcagucugccauccucu

SEQ ID NO: 442509 - RNA, 32 nt, Human
gcgccccagcagagccacggguacgggaggua

SEQ ID NO: 442510 - RNA, 17 nt, Human
gcgccccagcggcgggu

SEQ ID NO: 442511 - RNA, 23 nt, Human
gcgccccaguuucugcccuggca

SEQ ID NO: 442512 - RNA, 32 nt, Human
gcgccccauaucacugcaacaccuacaaguuu

SEQ ID NO: 442513 - RNA, 32 nt, Human
gcgcccccacacacaguagggccagaacacca

SEQ ID NO: 442514 - RNA, 32 nt, Human
gcgcccccacccuacgcugcugccuucuccuc

SEQ ID NO: 442515 - RNA, 31 nt, Human
gcgcccccacucaagacuaccaaagccagga

SEQ ID NO: 442516 - RNA, 32 nt, Human
gcgcccccagaacauacacugugaacucaauc

SEQ ID NO: 442517 - RNA, 32 nt, Human
gcgcccccaucuuaugguggaagcagucgcua

SEQ ID NO: 442518 - RNA, 18 nt, Human
gcgcccccgcacagcggg

SEQ ID NO: 442519 - RNA, 32 nt, Human
gcgcccccgcagcugccgccgccgccagggcc

SEQ ID NO: 442520 - RNA, 18 nt, Human
gcgcccccgcgagggggc

SEQ ID NO: 442521 - RNA, 32 nt, Human
gcgcccccgcggcuggaggguggucgccacug

SEQ ID NO: 442522 - RNA, 32 nt, Human
gcgcccccuccccaugaucucccuuuccagau

SEQ ID NO: 442523 - RNA, 32 nt, Human
gcgcccccuccccgcgccucccuccccgcccu

SEQ ID NO: 442524 - RNA, 32 nt, Human
gcgcccccugcacuccagccugggcuucagag

SEQ ID NO: 442525 - RNA, 32 nt, Human
gcgcccccugccccaccagccugagugccccg

SEQ ID NO: 442526 - RNA, 32 nt, Human
gcgcccccugcuggcccugaggcugcagaguu

SEQ ID NO: 442527 - RNA, 32 nt, Human
gcgcccccuggaggcagagcacugagcuggac

SEQ ID NO: 442528 - RNA, 18 nt, Human
gcgcccccuggcggcggg

SEQ ID NO: 442529 - RNA, 25 nt, Human
gcgccccgccucgcccaggugccuc

SEQ ID NO: 442530 - RNA, 32 nt, Human
gcgccccgcuccgccucaccugccaccaggga

SEQ ID NO: 442531 - RNA, 32 nt, Human
gcgccccgcugccagcccauuuuccggacgcc

SEQ ID NO: 442532 - RNA, 32 nt, Human
gcgccccggccuccgggagacuggcgcaugcc

SEQ ID NO: 442533 - RNA, 32 nt, Human
gcgccccgggcaggccagucauguguuaaguu

SEQ ID NO: 442534 - RNA, 32 nt, Human
gcgccccguccaccccgcggcagcuccucgcc

SEQ ID NO: 442535 - RNA, 16 nt, Human
gcgccccuagcuggug

SEQ ID NO: 442536 - RNA, 32 nt, Human
gcgccccucagccucugccacugugaaccggc

SEQ ID NO: 442537 - RNA, 32 nt, Human
gcgccccucccaggcccucagggcagcgggac

SEQ ID NO: 442538 - RNA, 32 nt, Human
gcgccccuccccaccccugccuguguucugug

SEQ ID NO: 442539 - RNA, 23 nt, Human
gcgccccucgccccagcgcccca

SEQ ID NO: 442540 - RNA, 32 nt, Human
gcgccccugagccccauuccauucauacagac

SEQ ID NO: 442541 - RNA, 32 nt, Human
gcgccccugcacuccaaccuggacaacacagc

SEQ ID NO: 442542 - RNA, 32 nt, Human
gcgccccugcacuccagccugggugacagagc

SEQ ID NO: 442543 - RNA, 32 nt, Human
gcgccccugcauucccagcuacuugggaggcu

SEQ ID NO: 442544 - RNA, 21 nt, Human
gcgccccuggccccccagccu

SEQ ID NO: 442545 - RNA, 18 nt, Human
gcgccccuggcucccggg

SEQ ID NO: 442546 - RNA, 21 nt, Human
gcgccccuggcuucccagccu

SEQ ID NO: 442547 - RNA, 32 nt, Human
gcgccccuggggaaaugggaccagccuaaucu

SEQ ID NO: 442548 - RNA, 16 nt, Human
gcgccccuggggggug

SEQ ID NO: 442549 - RNA, 17 nt, Human
gcgccccuggggugggu

SEQ ID NO: 442550 - RNA, 20 nt, Human
gcgccccugguaaccagccc

SEQ ID NO: 442551 - RNA, 17 nt, Human
gcgccccugugcgagug

SEQ ID NO: 442552 - RNA, 18 nt, Human
gcgcccgagagaccggca

SEQ ID NO: 442553 - RNA, 21 nt, Human
gcgcccgagcgccuggcccug

SEQ ID NO: 442554 - RNA, 32 nt, Human
gcgcccgaggcagacggugcaggggccuccgg

SEQ ID NO: 442555 - RNA, 32 nt, Human
gcgcccgagggugcaggaggcucugaagcggc

SEQ ID NO: 442556 - RNA, 32 nt, Human
gcgcccgagucuguccagcugcagggagggcg

SEQ ID NO: 442557 - RNA, 23 nt, Human
gcgcccgcagcccgacgccccag

SEQ ID NO: 442558 - RNA, 32 nt, Human
gcgcccgcagcccucagggggucggccccgcg

SEQ ID NO: 442559 - RNA, 32 nt, Human
gcgcccgccacuucaguggaucccgcgccggg

SEQ ID NO: 442560 - RNA, 32 nt, Human
gcgcccgccagccuucccggccggaccggcug

SEQ ID NO: 442561 - RNA, 32 nt, Human
gcgcccgccauggagaagacugagcugaucca

SEQ ID NO: 442562 - RNA, 32 nt, Human
gcgcccgcccaccucuaugcugcguucuccug

SEQ ID NO: 442563 - RNA, 32 nt, Human
gcgcccgccgcgguccccaccuccauggacgc

SEQ ID NO: 442564 - RNA, 32 nt, Human
gcgcccgccgcugaagcgcaggacgcgccgcc

SEQ ID NO: 442565 - RNA, 22 nt, Human
gcgcccgcgcccccgccgggcc

SEQ ID NO: 442566 - RNA, 32 nt, Human
gcgcccgcggcagcgccucccagccugccgcc

SEQ ID NO: 442567 - RNA, 32 nt, Human
gcgcccgcugcucucuccaggucccgccgcgc

SEQ ID NO: 442568 - RNA, 32 nt, Human
gcgcccgcugggaaugaugaagaagaacaauu

SEQ ID NO: 442569 - RNA, 32 nt, Human
gcgcccggaaggccccugcuguggagaagccg

SEQ ID NO: 442570 - RNA, 18 nt, Human
gcgcccggagaccugcgg

SEQ ID NO: 442571 - RNA, 32 nt, Human
gcgcccggcaguuauguauucuccgcucuguc

SEQ ID NO: 442572 - RNA, 32 nt, Human
gcgcccggccagguuguggguuuuaaugggac

SEQ ID NO: 442573 - RNA, 32 nt, Human
gcgcccggccgaagaucacauucuuuaacaag

SEQ ID NO: 442574 - RNA, 32 nt, Human
gcgcccggccgugaacgcuauuuucuaagcag

SEQ ID NO: 442575 - RNA, 32 nt, Human
gcgcccggcuccgagcccgccugcuguccgcu

SEQ ID NO: 442576 - RNA, 32 nt, Human
gcgcccggcugggacagucucuccauacccca

SEQ ID NO: 442577 - RNA, 16 nt, Human
gcgcccggcugggccc

SEQ ID NO: 442578 - RNA, 32 nt, Human
gcgcccgggccgcggcggcgcggcggcgcgag

SEQ ID NO: 442579 - RNA, 22 nt, Human
gcgcccggggcccgcgaaggag

SEQ ID NO: 442580 - RNA, 32 nt, Human
gcgcccgucgggagguugcagaguuccuggag

SEQ ID NO: 442581 - RNA, 32 nt, Human
gcgcccgugccuccucucacacaggcuccaca

SEQ ID NO: 442582 - RNA, 21 nt, Human
gcgcccuacucggcucagccc

SEQ ID NO: 442583 - RNA, 32 nt, Human
gcgcccuauguaaggccagccgcggcaggacc

SEQ ID NO: 442584 - RNA, 16 nt, Human
gcgcccuccacgggua

SEQ ID NO: 442585 - RNA, 32 nt, Human
gcgcccucccagcucccugccucuguuucccc

SEQ ID NO: 442586 - RNA, 32 nt, Human
gcgcccuccgcuccgcccgcagugccaaccau

SEQ ID NO: 442587 - RNA, 32 nt, Human
gcgcccucgccccagcugguuuggaguucaac

SEQ ID NO: 442588 - RNA, 32 nt, Human
gcgcccucuccuccaaccuccccuuucauaga

SEQ ID NO: 442589 - RNA, 32 nt, Human
gcgcccucuccucucuuccugccaagguuuau

SEQ ID NO: 442590 - RNA, 32 nt, Human
gcgcccugaaccccagccuguccgucaccccg

SEQ ID NO: 442591 - RNA, 32 nt, Human
gcgcccugcaccugacagcuuuaucuccccag

SEQ ID NO: 442592 - RNA, 32 nt, Human
gcgcccugcagggacggugcaggcugguuggg

SEQ ID NO: 442593 - RNA, 24 nt, Human
gcgcccugccacucccuggccugc

SEQ ID NO: 442594 - RNA, 20 nt, Human
gcgcccugccagcccagccc

SEQ ID NO: 442595 - RNA, 32 nt, Human
gcgcccugcccgaucggcucucuccuuuuuaa

SEQ ID NO: 442596 - RNA, 32 nt, Human
gcgcccugccgcgcuaccgccugcugcgcgac

SEQ ID NO: 442597 - RNA, 31 nt, Human
gcgcccugccucuguggcucugccuguggau

SEQ ID NO: 442598 - RNA, 32 nt, Human
gcgcccugcuccugaacuucagcuccugcaca

SEQ ID NO: 442599 - RNA, 32 nt, Human
gcgcccuggccugggccuugcccagccgcccc

SEQ ID NO: 442600 - RNA, 31 nt, Human
gcgcccuggcuucuccccaaggagaugagga

SEQ ID NO: 442601 - RNA, 32 nt, Human
gcgcccuggggcccuggccucccuggaggggc

SEQ ID NO: 442602 - RNA, 32 nt, Human
gcgcccuguccaccguggcuggcuggccacuc

SEQ ID NO: 442603 - RNA, 32 nt, Human
gcgcccuguucugaaggcaccuccucaccuca

SEQ ID NO: 442604 - RNA, 32 nt, Human
gcgcccuuaacugcauccagccuggggcugag

SEQ ID NO: 442605 - RNA, 32 nt, Human
gcgcccuucuaccggccucuggcuccggagcu

SEQ ID NO: 442606 - RNA, 32 nt, Human
gcgccgacggggcugugccggagcagcugugc

SEQ ID NO: 442607 - RNA, 32 nt, Human
gcgccgagauugugccacugcacuccagccug

SEQ ID NO: 442608 - RNA, 32 nt, Human
gcgccgagccccgggauagcggcagacgagcc

SEQ ID NO: 442609 - RNA, 32 nt, Human
gcgccgagcggaggaggaggaggaggcgagga

SEQ ID NO: 442610 - RNA, 32 nt, Human
gcgccgaggaaaagaauggggagggucagcag

SEQ ID NO: 442611 - RNA, 32 nt, Human
gcgccgaggaggaagagguugauggcggcggc

SEQ ID NO: 442612 - RNA, 32 nt, Human
gcgccgaggcaggacacagagcacagcugugc

SEQ ID NO: 442613 - RNA, 32 nt, Human
gcgccgaguacuccagccgggacgcacugugu

SEQ ID NO: 442614 - RNA, 32 nt, Human
gcgccgauugccucucggccugggcaaugguc

SEQ ID NO: 442615 - RNA, 32 nt, Human
gcgccgcacacgcacccacccacccacccagc

SEQ ID NO: 442616 - RNA, 32 nt, Human
gcgccgcaccugcccgccucggcguucgugac

SEQ ID NO: 442617 - RNA, 32 nt, Human
gcgccgcacuccauccccacaggcuggggacg

SEQ ID NO: 442618 - RNA, 32 nt, Human
gcgccgcagccugcugacguuuucuucagaug

SEQ ID NO: 442619 - RNA, 32 nt, Human
gcgccgccacugccgcagccaggagaugguuc

SEQ ID NO: 442620 - RNA, 32 nt, Human
gcgccgccgagggcuggcugggaacgccgcag

SEQ ID NO: 442621 - RNA, 32 nt, Human
gcgccgccgcagcugcagugacauguccagca

SEQ ID NO: 442622 - RNA, 32 nt, Human
gcgccgccgcagggacccgccacccaccuccc

SEQ ID NO: 442623 - RNA, 32 nt, Human
gcgccgccgcccucccuuccucuuccccaucu

SEQ ID NO: 442624 - RNA, 20 nt, Human
gcgccgccgccgccgccgcc

SEQ ID NO: 442625 - RNA, 21 nt, Human
gcgccgccgccgccgccgccg

SEQ ID NO: 442626 - RNA, 32 nt, Human
gcgccgccggcggcggagggagcgugacugcg

SEQ ID NO: 442627 - RNA, 32 nt, Human
gcgccgccugggagcuggagcccgcgcagcgc

SEQ ID NO: 442628 - RNA, 32 nt, Human
gcgccgccuguugcucgcuccuccgggcgguc

SEQ ID NO: 442629 - RNA, 22 nt, Human
gcgccgccuucgccgccaacca

SEQ ID NO: 442630 - RNA, 32 nt, Human
gcgccgcgcacuccaacccggcgggcaccucg

SEQ ID NO: 442631 - RNA, 17 nt, Human
gcgccgcgccucgagcu

SEQ ID NO: 442632 - RNA, 23 nt, Human
gcgccgcgcgcccaggcggggcc

SEQ ID NO: 442633 - RNA, 32 nt, Human
gcgccgcgcucgggggccaugcagcgccuggc

SEQ ID NO: 442634 - RNA, 32 nt, Human
gcgccgcgcugaggccgagguccgcagggccg

SEQ ID NO: 442635 - RNA, 17 nt, Human
gcgccgcgcuuugagcc

SEQ ID NO: 442636 - RNA, 32 nt, Human
gcgccgcggcagcugcuccggcugccggccgg

SEQ ID NO: 442637 - RNA, 23 nt, Human
gcgccgcggcccgccuggccugc

SEQ ID NO: 442638 - RNA, 32 nt, Human
gcgccgcggcugcugcugcgcaggcccagugc

SEQ ID NO: 442639 - RNA, 32 nt, Human
gcgccgcgggacugaagcucgagaagggccug

SEQ ID NO: 442640 - RNA, 32 nt, Human
gcgccgcgucgacaaacccccauccugggaaa

SEQ ID NO: 442641 - RNA, 32 nt, Human
gcgccgcuacauuccagccugggcaacacgag

SEQ ID NO: 442642 - RNA, 22 nt, Human
gcgccgcuccagccaugucagc

SEQ ID NO: 442643 - RNA, 32 nt, Human
gcgccgcucccaggaacccuguacuccggggu

SEQ ID NO: 442644 - RNA, 20 nt, Human
gcgccgcuccccucccugcc

SEQ ID NO: 442645 - RNA, 32 nt, Human
gcgccgcucccuccgcugcacgcccaggccug

SEQ ID NO: 442646 - RNA, 32 nt, Human
gcgccgcugcacuccagccugggcaacagagu

SEQ ID NO: 442647 - RNA, 32 nt, Human
gcgccgcugcacuccagccugggccacacagu

SEQ ID NO: 442648 - RNA, 32 nt, Human
gcgccgcugcacuccagccugggcgacagagc

SEQ ID NO: 442649 - RNA, 32 nt, Human
gcgccgcugcacuccagccugggcgacagagu

SEQ ID NO: 442650 - RNA, 32 nt, Human
gcgccgcugcacuccagccugggcggcagagc

SEQ ID NO: 442651 - RNA, 32 nt, Human
gcgccgcugcacuccagccugggugacagagu

SEQ ID NO: 442652 - RNA, 32 nt, Human
gcgccgcugcauuccagccugggugacagagc

SEQ ID NO: 442653 - RNA, 32 nt, Human
gcgccgcugccaggaccuugcagguggagagc

SEQ ID NO: 442654 - RNA, 24 nt, Human
gcgccgcugcugccccgccuugca

SEQ ID NO: 442655 - RNA, 24 nt, Human
gcgccgcugcugccggggcucgca

SEQ ID NO: 442656 - RNA, 32 nt, Human
gcgccgcuggcgccagcacugggaggaggcgg

SEQ ID NO: 442657 - RNA, 32 nt, Human
gcgccggaaguggucccgcagaggcggggugg

SEQ ID NO: 442658 - RNA, 32 nt, Human
gcgccggacccgggaagaacuggugagccaag

SEQ ID NO: 442659 - RNA, 32 nt, Human
gcgccggacccuggcccugcccugggugcugc

SEQ ID NO: 442660 - RNA, 32 nt, Human
gcgccggacgcugguugcgcgcucccaggcgc

SEQ ID NO: 442661 - RNA, 32 nt, Human
gcgccggagaggggcuggaggcggggcgaggg

SEQ ID NO: 442662 - RNA, 32 nt, Human
gcgccggagcagcgugggaaagaagggaagag

SEQ ID NO: 442663 - RNA, 32 nt, Human
gcgccggagucaaacgguucccggcccagucc

SEQ ID NO: 442664 - RNA, 19 nt, Human
gcgccggagucccgagcua

SEQ ID NO: 442665 - RNA, 32 nt, Human
gcgccggaguggcaugaagcuguaggacucau

SEQ ID NO: 442666 - RNA, 32 nt, Human
gcgccggcccgcccgccugccugcucagcgca

SEQ ID NO: 442667 - RNA, 32 nt, Human
gcgccggcccugccugcugcucugcccagggc

SEQ ID NO: 442668 - RNA, 32 nt, Human
gcgccggccuccugcugggcaagugccgccag

SEQ ID NO: 442669 - RNA, 32 nt, Human
gcgccggcgccauggaccuggucaucacguag

SEQ ID NO: 442670 - RNA, 23 nt, Human
gcgccggcgccgcagaucagcca

SEQ ID NO: 442671 - RNA, 19 nt, Human
gcgccggcguucucugcca

SEQ ID NO: 442672 - RNA, 32 nt, Human
gcgccgggccccacuucugagcacagagcaga

SEQ ID NO: 442673 - RNA, 19 nt, Human
gcgccgggcgcggcugcag

SEQ ID NO: 442674 - RNA, 32 nt, Human
gcgccgggcucccuccggggugcagccgccgu

SEQ ID NO: 442675 - RNA, 32 nt, Human
gcgccggggagggagagcucaggccgccaugc

SEQ ID NO: 442676 - RNA, 32 nt, Human
gcgccggggaggugcgggaacacgugaccggc

SEQ ID NO: 442677 - RNA, 32 nt, Human
gcgccggggaucccugaacacagacagcgcgg

SEQ ID NO: 442678 - RNA, 32 nt, Human
gcgccgggggucgcuccugcugugucuuccgc

SEQ ID NO: 442679 - RNA, 32 nt, Human
gcgccggggugaggccuggcucggucccugcg

SEQ ID NO: 442680 - RNA, 32 nt, Human
gcgccgggugaaggcgagagccucggcgagcc

SEQ ID NO: 442681 - RNA, 32 nt, Human
gcgccgguggcguuccgcuccaugacugucgc

SEQ ID NO: 442682 - RNA, 32 nt, Human
gcgccgguugccgcugcggagcgcggcggguc

SEQ ID NO: 442683 - RNA, 32 nt, Human
gcgccguccaaccuuacauggguucagggcgc

SEQ ID NO: 442684 - RNA, 32 nt, Human
gcgccguccagggcuagagcaagcgcggcccc

SEQ ID NO: 442685 - RNA, 32 nt, Human
gcgccguugcacuccagccugggcaacaagag

SEQ ID NO: 442686 - RNA, 32 nt, Human
gcgccguuguacuccagccugggcaacagagc

SEQ ID NO: 442687 - RNA, 32 nt, Human
gcgccuacccucauaccuaucucccuccuccc

SEQ ID NO: 442688 - RNA, 32 nt, Human
gcgccuacuccuccuccuccucucccggcggc

SEQ ID NO: 442689 - RNA, 32 nt, Human
gcgccuagucccauuuucacuuccuuugacgc

SEQ ID NO: 442690 - RNA, 32 nt, Human
gcgccuagucuccuccaaaaugcuaacuuuaa

SEQ ID NO: 442691 - RNA, 32 nt, Human
gcgccuagugacugcagaaacagacacccagu

SEQ ID NO: 442692 - RNA, 32 nt, Human
gcgccuauagccacugcgcccugggggccugg

SEQ ID NO: 442693 - RNA, 32 nt, Human
gcgccucacccuccaguggagacagagggcag

SEQ ID NO: 442694 - RNA, 32 nt, Human
gcgccucagaucuucguuggcggccauggcuu

SEQ ID NO: 442695 - RNA, 32 nt, Human
gcgccucagccaccucacuccugggccugcug

SEQ ID NO: 442696 - RNA, 32 nt, Human
gcgccucagccgccucacuccugggccugcug

SEQ ID NO: 442697 - RNA, 32 nt, Human
gcgccuccaggugcuguguccugagcacucuu

SEQ ID NO: 442698 - RNA, 32 nt, Human
gcgccucccagccugugccccuuccuaguacc

SEQ ID NO: 442699 - RNA, 21 nt, Human
gcgccuccccaaucccagccc

SEQ ID NO: 442700 - RNA, 32 nt, Human
gcgccuccccgccccgccgccccacaccucuc

SEQ ID NO: 442701 - RNA, 32 nt, Human
gcgccuccgccaagccggcccagcugcacccc

SEQ ID NO: 442702 - RNA, 32 nt, Human
gcgccuccggcagaggggcgaggaccgagcgc

SEQ ID NO: 442703 - RNA, 32 nt, Human
gcgccuccuccagguccuccuggguccccucc

SEQ ID NO: 442704 - RNA, 32 nt, Human
gcgccuccuccuccuccugcuccccgccgcuu

SEQ ID NO: 442705 - RNA, 32 nt, Human
gcgccuccuccugccagcacccccagcaccug

SEQ ID NO: 442706 - RNA, 19 nt, Human
gcgccuccugcacagcggc

SEQ ID NO: 442707 - RNA, 32 nt, Human
gcgccuccugcaggcggcccaucucuaagcgu

SEQ ID NO: 442708 - RNA, 32 nt, Human
gcgccucgcccacucuggccccaaaccaaucg

SEQ ID NO: 442709 - RNA, 32 nt, Human
gcgccucggcuucgcgcucguguagaucguuc

SEQ ID NO: 442710 - RNA, 32 nt, Human
gcgccucgggcggaaccuggagauaaugggca

SEQ ID NO: 442711 - RNA, 32 nt, Human
gcgccucggucacccugcacagcaggccacag

SEQ ID NO: 442712 - RNA, 18 nt, Human
gcgccucucacacaggua

SEQ ID NO: 442713 - RNA, 32 nt, Human
gcgccucucaccauggggccucaggccccugu

SEQ ID NO: 442714 - RNA, 32 nt, Human
gcgccucuccacuguuucaugagcccaaacac

SEQ ID NO: 442715 - RNA, 32 nt, Human
gcgccucugccuggccacccugucugggaggu

SEQ ID NO: 442716 - RNA, 32 nt, Human
gcgccucugcggucgucgcuccugggccucgg

SEQ ID NO: 442717 - RNA, 32 nt, Human
gcgccucugggaacuggaugaguccuucggcg

SEQ ID NO: 442718 - RNA, 32 nt, Human
gcgccucuuccuaggugcugggauucaguccc

SEQ ID NO: 442719 - RNA, 32 nt, Human
gcgccugaagcacaaagcagauagcuaggaau

SEQ ID NO: 442720 - RNA, 32 nt, Human
gcgccugagccaugcccagcagcccuguguaa

SEQ ID NO: 442721 - RNA, 32 nt, Human
gcgccugaggaggaggaggaggcgggggcggc

SEQ ID NO: 442722 - RNA, 32 nt, Human
gcgccugagguccgacugucucugccugcagc

SEQ ID NO: 442723 - RNA, 32 nt, Human
gcgccugauuuagggcccuucucuaggaugcc

SEQ ID NO: 442724 - RNA, 32 nt, Human
gcgccugcagaggcgagcagagcccgcagccc

SEQ ID NO: 442725 - RNA, 32 nt, Human
gcgccugcagccuuaaccuccacggccuucga

SEQ ID NO: 442726 - RNA, 32 nt, Human
gcgccugccaagaacagcaucuccccagcccu

SEQ ID NO: 442727 - RNA, 32 nt, Human
gcgccugcccacuuggccucagucuccccacc

SEQ ID NO: 442728 - RNA, 32 nt, Human
gcgccugccgccccggaggcaggaugagcauc

SEQ ID NO: 442729 - RNA, 32 nt, Human
gcgccugccuccaaccugcgggcgggaggugg

SEQ ID NO: 442730 - RNA, 32 nt, Human
gcgccugccugcccaucucugcccucgguugg

SEQ ID NO: 442731 - RNA, 32 nt, Human
gcgccugccuggggucagcccucgucacacug

SEQ ID NO: 442732 - RNA, 32 nt, Human
gcgccugcgaacagccauugcacuccagccug

SEQ ID NO: 442733 - RNA, 32 nt, Human
gcgccugcgcggagcuggaguccggcugggcc

SEQ ID NO: 442734 - RNA, 32 nt, Human
gcgccugcuccacguucucuucugucuguugc

SEQ ID NO: 442735 - RNA, 32 nt, Human
gcgccuggagcggagagcagaggcggcccggc

SEQ ID NO: 442736 - RNA, 32 nt, Human
gcgccuggaggaggcaggggcaggaagcggcc

SEQ ID NO: 442737 - RNA, 32 nt, Human
gcgccuggcaggcaguggugagcccugcagga

SEQ ID NO: 442738 - RNA, 32 nt, Human
gcgccuggcugauuccuaggcaguuggcggca

SEQ ID NO: 442739 - RNA, 32 nt, Human
gcgccuggcuguaauuacuauacccaguuuuu

SEQ ID NO: 442740 - RNA, 32 nt, Human
gcgccugggaccugagacggcguuggccuuuc

SEQ ID NO: 442741 - RNA, 30 nt, Human
gcgccugggaggagcgccuggacucgcggg

SEQ ID NO: 442742 - RNA, 32 nt, Human
gcgccugggcccugcccucuagcucccgcgcu

SEQ ID NO: 442743 - RNA, 18 nt, Human
gcgccugggggacgggua

SEQ ID NO: 442744 - RNA, 32 nt, Human
gcgccugggggagggggacuggagaggcgaga

SEQ ID NO: 442745 - RNA, 32 nt, Human
gcgccuggugcaggaagcgacucacguuuguc

SEQ ID NO: 442746 - RNA, 32 nt, Human
gcgccuguagaaucccagcugcucgggaggcu

SEQ ID NO: 442747 - RNA, 32 nt, Human
gcgccuguagccccagcuacucgggaggcuga

SEQ ID NO: 442748 - RNA, 32 nt, Human
gcgccuguagccccagcuacuugggaggcuga

SEQ ID NO: 442749 - RNA, 18 nt, Human
gcgccuguaguuccagcu

SEQ ID NO: 442750 - RNA, 32 nt, Human
gcgccuguccaggaugcagggagcucgggcuc

SEQ ID NO: 442751 - RNA, 32 nt, Human
gcgccugugcagaaugaacgaagucacauagg

SEQ ID NO: 442752 - RNA, 32 nt, Human
gcgccuucaaacccagacaugcugcugcugcu

SEQ ID NO: 442753 - RNA, 32 nt, Human
gcgccuuccgauuccauucauggcauuuugug

SEQ ID NO: 442754 - RNA, 32 nt, Human
gcgccuuccuaagugcucgccgcgguagccgg

SEQ ID NO: 442755 - RNA, 32 nt, Human
gcgccuucugcaaggcccuggccuagacaggc

SEQ ID NO: 442756 - RNA, 32 nt, Human
gcgccuugccacccucaucuccaauaugccug

SEQ ID NO: 442757 - RNA, 32 nt, Human
gcgccuuuccacgcccuccagccccgggggag

SEQ ID NO: 442758 - RNA, 32 nt, Human
gcgccuuucucccugcggccccggcucgcugc

SEQ ID NO: 442759 - RNA, 32 nt, Human
gcgccuuugcacuccagccuggaagacaaaac

SEQ ID NO: 442760 - RNA, 32 nt, Human
gcgccuuugguaacagaagagaagacugugga

SEQ ID NO: 442761 - RNA, 32 nt, Human
gcgccuuuuuccucagcugucuuccaaguauu

SEQ ID NO: 442762 - RNA, 32 nt, Human
gcgcgaaccugaggaggaagaaacggggcuag

SEQ ID NO: 442763 - RNA, 32 nt, Human
gcgcgaacugcggccccgccucuccuuugggg

SEQ ID NO: 442764 - RNA, 32 nt, Human
gcgcgaauccuagugcauuccuuugugagaaa

SEQ ID NO: 442765 - RNA, 32 nt, Human
gcgcgacagccaccuggugccaacucacugag

SEQ ID NO: 442766 - RNA, 32 nt, Human
gcgcgacccccaggaacguucggaaagcuggu

SEQ ID NO: 442767 - RNA, 32 nt, Human
gcgcgaccugcuccgacuucugcagggaaggg

SEQ ID NO: 442768 - RNA, 32 nt, Human
gcgcgacucccagaagagauagccaggcgucc

SEQ ID NO: 442769 - RNA, 32 nt, Human
gcgcgacugcacuccagccugggcgagagagc

SEQ ID NO: 442770 - RNA, 32 nt, Human
gcgcgagaaagagcggacagaggcagacgccg

SEQ ID NO: 442771 - RNA, 32 nt, Human
gcgcgagagagggagggaggaggggacggugc

SEQ ID NO: 442772 - RNA, 32 nt, Human
gcgcgagagcaugcuugguuuucugugguuug

SEQ ID NO: 442773 - RNA, 23 nt, Human
gcgcgagaggccuucggcggccu

SEQ ID NO: 442774 - RNA, 32 nt, Human
gcgcgagcaccucgagcucagcagagcagccg

SEQ ID NO: 442775 - RNA, 32 nt, Human
gcgcgagccccuccuccacacccgagucccag

SEQ ID NO: 442776 - RNA, 32 nt, Human
gcgcgaggaggagcgaccuggccucaccgcug

SEQ ID NO: 442777 - RNA, 32 nt, Human
gcgcgaggcccagcaggugcaggcagagcagc

SEQ ID NO: 442778 - RNA, 21 nt, Human
gcgcgaggcccgggcccugag

SEQ ID NO: 442779 - RNA, 20 nt, Human
gcgcgaggccgggcuaggcc

SEQ ID NO: 442780 - RNA, 32 nt, Human
gcgcgagggaggagcugcgccgccgggaaggg

SEQ ID NO: 442781 - RNA, 32 nt, Human
gcgcgagggucuccgcccucugcuccgggcug

SEQ ID NO: 442782 - RNA, 21 nt, Human
gcgcgaggugucagggcggcc

SEQ ID NO: 442783 - RNA, 32 nt, Human
gcgcgaguccaguacuccuacuucgccaaguc

SEQ ID NO: 442784 - RNA, 21 nt, Human
gcgcgaucauggcucacugca

SEQ ID NO: 442785 - RNA, 32 nt, Human
gcgcgaucucagcucaccgcaaccuccgccuc

SEQ ID NO: 442786 - RNA, 32 nt, Human
gcgcgaucucagcucaccucaaccuccgccuc

SEQ ID NO: 442787 - RNA, 32 nt, Human
gcgcgaucucagcucacuacaaccuccgccuc

SEQ ID NO: 442788 - RNA, 21 nt, Human
gcgcgaucucagcucacugca

SEQ ID NO: 442789 - RNA, 32 nt, Human
gcgcgaucucagcucacugcaaccuccgccuc

SEQ ID NO: 442790 - RNA, 21 nt, Human
gcgcgaucugggcucacugca

SEQ ID NO: 442791 - RNA, 21 nt, Human
gcgcgaucuuggcucaccgca

SEQ ID NO: 442792 - RNA, 30 nt, Human
gcgcgaugggcggagagcaggaggaggagc

SEQ ID NO: 442793 - RNA, 21 nt, Human
gcgcgcaaagaggcagggcag

SEQ ID NO: 442794 - RNA, 32 nt, Human
gcgcgcaaggccgccucuacuccgccucaucu

SEQ ID NO: 442795 - RNA, 32 nt, Human
gcgcgcacacacacauacaagcgggcacgacg

SEQ ID NO: 442796 - RNA, 32 nt, Human
gcgcgcacacacacaugcuuuacaaguuuuau

SEQ ID NO: 442797 - RNA, 32 nt, Human
gcgcgcacaggcaggagguugcaguugggcgc

SEQ ID NO: 442798 - RNA, 32 nt, Human
gcgcgcagccccggggaggccggaggacgcgc

SEQ ID NO: 442799 - RNA, 32 nt, Human
gcgcgcagcccgcggggccugaagggauguuc

SEQ ID NO: 442800 - RNA, 32 nt, Human
gcgcgcaggcccugcguuggaaaauggcgggg

SEQ ID NO: 442801 - RNA, 32 nt, Human
gcgcgcaggugagugagccagggcggagcgca

SEQ ID NO: 442802 - RNA, 32 nt, Human
gcgcgcaggugccgggacguggaugcccagga

SEQ ID NO: 442803 - RNA, 32 nt, Human
gcgcgcaucccuccaccuuccacauccugcuc

SEQ ID NO: 442804 - RNA, 31 nt, Human
gcgcgcauggccugggcgggcucgcggcggg

SEQ ID NO: 442805 - RNA, 32 nt, Human
gcgcgcauguaaucccagcuacucgggaggcu

SEQ ID NO: 442806 - RNA, 32 nt, Human
gcgcgccaguuucaggaugcagggucuaggag

SEQ ID NO: 442807 - RNA, 32 nt, Human
gcgcgccauggagcaugugacagagggcuccu

SEQ ID NO: 442808 - RNA, 32 nt, Human
gcgcgcccaccugagcccccgcgcuggcgcca

SEQ ID NO: 442809 - RNA, 16 nt, Human
gcgcgcccacgcgccu

SEQ ID NO: 442810 - RNA, 32 nt, Human
gcgcgcccagccgccucgguucccggcgacca

SEQ ID NO: 442811 - RNA, 19 nt, Human
gcgcgccccaagcugcgca

SEQ ID NO: 442812 - RNA, 32 nt, Human
gcgcgccccaggagccaaagccgggcuccaag

SEQ ID NO: 442813 - RNA, 19 nt, Human
gcgcgcccccuggcccggc

SEQ ID NO: 442814 - RNA, 32 nt, Human
gcgcgccccggggcggaggacggugccagccg

SEQ ID NO: 442815 - RNA, 32 nt, Human
gcgcgccccucgggcugcaccggcacuggccg

SEQ ID NO: 442816 - RNA, 32 nt, Human
gcgcgccccugccuacggggucccgcugcucu

SEQ ID NO: 442817 - RNA, 32 nt, Human
gcgcgcccucacugcagccccugcgucgccgg

SEQ ID NO: 442818 - RNA, 32 nt, Human
gcgcgcccucuggccucaagggagcauuggca

SEQ ID NO: 442819 - RNA, 32 nt, Human
gcgcgcccugccucuguggcucugccugugga

SEQ ID NO: 442820 - RNA, 32 nt, Human
gcgcgccgccuccccgcccucucucacucccc

SEQ ID NO: 442821 - RNA, 17 nt, Human
gcgcgccgcggcccgca

SEQ ID NO: 442822 - RNA, 32 nt, Human
gcgcgccgcgggucagggcgcaauggcggcgc

SEQ ID NO: 442823 - RNA, 32 nt, Human
gcgcgccuauaaucccagcuacucgggaggcu

SEQ ID NO: 442824 - RNA, 32 nt, Human
gcgcgccucccuccuuccuucuccccuggcug

SEQ ID NO: 442825 - RNA, 32 nt, Human
gcgcgccuguaaucccagcuacucaaggcuga

SEQ ID NO: 442826 - RNA, 32 nt, Human
gcgcgccuguaaucccagcuacucaggaggcu

SEQ ID NO: 442827 - RNA, 32 nt, Human
gcgcgccuguaaucccagcuacucgggaagcu

SEQ ID NO: 442828 - RNA, 32 nt, Human
gcgcgccuguaaucccagcuacuugggaagcu

SEQ ID NO: 442829 - RNA, 32 nt, Human
gcgcgccuguaaucccaguuacuuaggaggcu

SEQ ID NO: 442830 - RNA, 32 nt, Human
gcgcgccuguagucccagcuacucgggaggcu

SEQ ID NO: 442831 - RNA, 32 nt, Human
gcgcgccuguagucccagcuacuugggaggcu

SEQ ID NO: 442832 - RNA, 32 nt, Human
gcgcgccuguagucccagcuccucaggaggcu

SEQ ID NO: 442833 - RNA, 32 nt, Human
gcgcgccugugaucccagcuacccgggaggca

SEQ ID NO: 442834 - RNA, 32 nt, Human
gcgcgccuguggucccagcuacucgggaggcu

SEQ ID NO: 442835 - RNA, 32 nt, Human
gcgcgccuguuaguuuguuaaaccagaucuag

SEQ ID NO: 442836 - RNA, 32 nt, Human
gcgcgccuguugucuuagcuacucaggaggcu

SEQ ID NO: 442837 - RNA, 19 nt, Human
gcgcgccuuagcagcagca

SEQ ID NO: 442838 - RNA, 32 nt, Human
gcgcgcgagagggaccgggcgguggcggcggc

SEQ ID NO: 442839 - RNA, 32 nt, Human
gcgcgcgauccuucgaccacacgcgccgcucg

SEQ ID NO: 442840 - RNA, 19 nt, Human
gcgcgcgcgucaccagagu

SEQ ID NO: 442841 - RNA, 32 nt, Human
gcgcgcggaggaacgcuggguccccggcgccg

SEQ ID NO: 442842 - RNA, 31 nt, Human
gcgcgcggccgcucugggccugguuccagcg

SEQ ID NO: 442843 - RNA, 23 nt, Human
gcgcgcgggaagguggcagagcg

SEQ ID NO: 442844 - RNA, 24 nt, Human
gcgcgcgggaccaacgcaaggagc

SEQ ID NO: 442845 - RNA, 32 nt, Human
gcgcgcgggaugcgcggggagccuucucugca

SEQ ID NO: 442846 - RNA, 19 nt, Human
gcgcgcgggcgggcggaca

SEQ ID NO: 442847 - RNA, 32 nt, Human
gcgcgcggggcccggcccuggcggcgcggcgc

SEQ ID NO: 442848 - RNA, 32 nt, Human
gcgcgcgggggugagauaagcggccaugugau

SEQ ID NO: 442849 - RNA, 32 nt, Human
gcgcgcggugccggcugggucuguaccaaagg

SEQ ID NO: 442850 - RNA, 32 nt, Human
gcgcgcgugggcaggucauugcaguugggcgc

SEQ ID NO: 442851 - RNA, 32 nt, Human
gcgcgcuacugcccauccccgguugucccacu

SEQ ID NO: 442852 - RNA, 32 nt, Human
gcgcgcuccuagcgccccagacccgccugcgg

SEQ ID NO: 442853 - RNA, 32 nt, Human
gcgcgcuccucaugacaaucuaaugccugaug

SEQ ID NO: 442854 - RNA, 32 nt, Human
gcgcgcucgcagucuucgccggcgcagucacc

SEQ ID NO: 442855 - RNA, 32 nt, Human
gcgcgcucgccccgccgcuccugcugcagccc

SEQ ID NO: 442856 - RNA, 32 nt, Human
gcgcgcugagacggcgggugagcuccacgaga

SEQ ID NO: 442857 - RNA, 32 nt, Human
gcgcgcugccggcgcuccuuccuccucggcuc

SEQ ID NO: 442858 - RNA, 32 nt, Human
gcgcgcuuugcaccuccuauucccaggguccg

SEQ ID NO: 442859 - RNA, 18 nt, Human
gcgcggaaccgggcggcu

SEQ ID NO: 442860 - RNA, 21 nt, Human
gcgcggaagucgcgcgggacc

SEQ ID NO: 442861 - RNA, 32 nt, Human
gcgcggacacugaagggagggagcacaggcgg

SEQ ID NO: 442862 - RNA, 32 nt, Human
gcgcggagacgggguuuugccauguugaccug

SEQ ID NO: 442863 - RNA, 32 nt, Human
gcgcggagaugggggugcacgaauguccugcc

SEQ ID NO: 442864 - RNA, 18 nt, Human
gcgcggagccgggcggcu

SEQ ID NO: 442865 - RNA, 32 nt, Human
gcgcggaggaggaggaucugggggaagaggag

SEQ ID NO: 442866 - RNA, 32 nt, Human
gcgcggaggcggggcgcgggggcaguggucgg

SEQ ID NO: 442867 - RNA, 32 nt, Human
gcgcggagguuggagagaggaggcaggugucu

SEQ ID NO: 442868 - RNA, 32 nt, Human
gcgcggagucggaggaagaggagggaggaggg

SEQ ID NO: 442869 - RNA, 32 nt, Human
gcgcggaucacugaggcuguggcggcacugcg

SEQ ID NO: 442870 - RNA, 32 nt, Human
gcgcggaucucagaacagucuuugucagaugg

SEQ ID NO: 442871 - RNA, 32 nt, Human
gcgcggauuuuaaggaaacagagcaacagcua

SEQ ID NO: 442872 - RNA, 32 nt, Human
gcgcggcaggcaggccccugagccggugcacc

SEQ ID NO: 442873 - RNA, 24 nt, Human
gcgcggccacccccuccccagggg

SEQ ID NO: 442874 - RNA, 24 nt, Human
gcgcggccaccccguccccagggg

SEQ ID NO: 442875 - RNA, 32 nt, Human
gcgcggccaccugcaccugccgccacuagcac

SEQ ID NO: 442876 - RNA, 32 nt, Human
gcgcggcccagccaccuccggagucgccgccu

SEQ ID NO: 442877 - RNA, 20 nt, Human
gcgcggcccagccccgggca

SEQ ID NO: 442878 - RNA, 32 nt, Human
gcgcggcccagccucacuucccgggcacguuc

SEQ ID NO: 442879 - RNA, 15 nt, Human
gcgcggccccgggca

SEQ ID NO: 442880 - RNA, 32 nt, Human
gcgcggcccugccucccucucgcccggcggca

SEQ ID NO: 442881 - RNA, 32 nt, Human
gcgcggccgaggccgcacuaccugucugcggg

SEQ ID NO: 442882 - RNA, 17 nt, Human
gcgcggccgcgcggacc

SEQ ID NO: 442883 - RNA, 21 nt, Human
gcgcggccgcgcuuggcccca

SEQ ID NO: 442884 - RNA, 32 nt, Human
gcgcggccggggcucgccagcaccagcccugg

SEQ ID NO: 442885 - RNA, 32 nt, Human
gcgcggccuggccuggccuggguggcgggcgu

SEQ ID NO: 442886 - RNA, 32 nt, Human
gcgcggcgacaugccggagcugguggugaccg

SEQ ID NO: 442887 - RNA, 32 nt, Human
gcgcggcgccgcucggugcagaccaugaauua

SEQ ID NO: 442888 - RNA, 32 nt, Human
gcgcggcgcgggccaccaugggggcccagcuc

SEQ ID NO: 442889 - RNA, 32 nt, Human
gcgcggcggcggcuggagcagcgcgguagggu

SEQ ID NO: 442890 - RNA, 32 nt, Human
gcgcggcuccacccugggcugcgucuccuggu

SEQ ID NO: 442891 - RNA, 32 nt, Human
gcgcggcucgcgccuccugcuucaagagccca

SEQ ID NO: 442892 - RNA, 32 nt, Human
gcgcggcugcagcagggcgaggcuccaggugg

SEQ ID NO: 442893 - RNA, 32 nt, Human
gcgcggcuuccucucggucgcucccuggcgcc

SEQ ID NO: 442894 - RNA, 32 nt, Human
gcgcgggaagaaaaggagaggaggaagcugag

SEQ ID NO: 442895 - RNA, 32 nt, Human
gcgcgggaagccccaugcuccaaucaaaggga

SEQ ID NO: 442896 - RNA, 32 nt, Human
gcgcgggacaggcagaugcagugagugagggg

SEQ ID NO: 442897 - RNA, 32 nt, Human
gcgcgggacuuuguacagcagugucuuaucca

SEQ ID NO: 442898 - RNA, 32 nt, Human
gcgcgggagagggaggagaaggagcagccgcc

SEQ ID NO: 442899 - RNA, 19 nt, Human
gcgcgggagccaggggccu

SEQ ID NO: 442900 - RNA, 32 nt, Human
gcgcgggaggaagaggaggaggaggaggaggc

SEQ ID NO: 442901 - RNA, 32 nt, Human
gcgcgggaggcugcagcauggcagaggcggca

SEQ ID NO: 442902 - RNA, 32 nt, Human
gcgcgggagggcugugugauggccucggagcg

SEQ ID NO: 442903 - RNA, 32 nt, Human
gcgcgggccggguggaggcuugagcggggacc

SEQ ID NO: 442904 - RNA, 32 nt, Human
gcgcgggcgagcgggccuuuuccggccucugc

SEQ ID NO: 442905 - RNA, 32 nt, Human
gcgcgggcgauuuguagguaauggcaggcguu

SEQ ID NO: 442906 - RNA, 19 nt, Human
gcgcgggcgcugggcggcu

SEQ ID NO: 442907 - RNA, 32 nt, Human
gcgcgggcugccgggaguggucucugaggcgg

SEQ ID NO: 442908 - RNA, 32 nt, Human
gcgcggggaacauggagagcgagcgcgacaug

SEQ ID NO: 442909 - RNA, 19 nt, Human
gcgcggggaaggcgcaccu

SEQ ID NO: 442910 - RNA, 32 nt, Human
gcgcggggaggcgggcgcgccgcccgggccgc

SEQ ID NO: 442911 - RNA, 32 nt, Human
gcgcggggauuccaggagucgugguuucuugc

SEQ ID NO: 442912 - RNA, 21 nt, Human
gcgcggggcacccgggggccu

SEQ ID NO: 442913 - RNA, 20 nt, Human
gcgcggggcaguagcggccu

SEQ ID NO: 442914 - RNA, 32 nt, Human
gcgcggggccccggucuacaccgcgcuggacc

SEQ ID NO: 442915 - RNA, 20 nt, Human
gcgcggggccggagcggccu

SEQ ID NO: 442916 - RNA, 32 nt, Human
gcgcggggcgcacggcccuaggagcgcggggc

SEQ ID NO: 442917 - RNA, 18 nt, Human
gcgcggggcgcggcggcc

SEQ ID NO: 442918 - RNA, 32 nt, Human
gcgcggggcggcguugguggucuucgcggcgu

SEQ ID NO: 442919 - RNA, 32 nt, Human
gcgcggggcgggcuguuuugcauuaugugcgg

SEQ ID NO: 442920 - RNA, 32 nt, Human
gcgcggggcucccuccuuaccgcaggagcucc

SEQ ID NO: 442921 - RNA, 32 nt, Human
gcgcgggggaaagaaaggcagcgggaauuuga

SEQ ID NO: 442922 - RNA, 32 nt, Human
gcgcgggggaaagaagcguggcggggcuguag

SEQ ID NO: 442923 - RNA, 32 nt, Human
gcgcgggggagccauuaggaggcgaggagaga

SEQ ID NO: 442924 - RNA, 21 nt, Human
gcgcgggggcgcaaccgccac

SEQ ID NO: 442925 - RNA, 22 nt, Human
gcgcggggucuccgggcgcccu

SEQ ID NO: 442926 - RNA, 32 nt, Human
gcgcgggucuccugguccuucugccaucaugc

SEQ ID NO: 442927 - RNA, 32 nt, Human
gcgcgggugccgggcccugccuugccggccau

SEQ ID NO: 442928 - RNA, 32 nt, Human
gcgcggucgucacgccuguaaucccagcacuu

SEQ ID NO: 442929 - RNA, 32 nt, Human
gcgcggugcucacgccuguaaucccagcacuu

SEQ ID NO: 442930 - RNA, 32 nt, Human
gcgcgguggacugucuucucugugcaaugauc

SEQ ID NO: 442931 - RNA, 32 nt, Human
gcgcgguggcucacaccuuaaucccagcacuu

SEQ ID NO: 442932 - RNA, 32 nt, Human
gcgcgguggcucacgccugcagucccagcacu

SEQ ID NO: 442933 - RNA, 32 nt, Human
gcgcgguggcucacgccuguaaccucagcacu

SEQ ID NO: 442934 - RNA, 31 nt, Human
gcgcgguggcugcucccuugcuggggcucag

SEQ ID NO: 442935 - RNA, 32 nt, Human
gcgcgguucaugacuguguccccugaccgcag

SEQ ID NO: 442936 - RNA, 32 nt, Human
gcgcguccagccccagacccgccggggucccu

SEQ ID NO: 442937 - RNA, 32 nt, Human
gcgcgucccucacgugacuguguuaaaggaga

SEQ ID NO: 442938 - RNA, 32 nt, Human
gcgcguccugcccgcuucccucggugaccugc

SEQ ID NO: 442939 - RNA, 32 nt, Human
gcgcgucgggcacagcgcgugcagccucgugc

SEQ ID NO: 442940 - RNA, 32 nt, Human
gcgcgucguccuccucgcccuccaggccgccc

SEQ ID NO: 442941 - RNA, 32 nt, Human
gcgcgucuagccccagcgccagggcacgcgag

SEQ ID NO: 442942 - RNA, 32 nt, Human
gcgcgucucauuuucagccuugcccggacucu

SEQ ID NO: 442943 - RNA, 32 nt, Human
gcgcgucuccagccucugcacacacauuggcg

SEQ ID NO: 442944 - RNA, 32 nt, Human
gcgcgucuucaggccuuuguaaguugucaaau

SEQ ID NO: 442945 - RNA, 32 nt, Human
gcgcgucuuccuuacagccauuuaguugggag

SEQ ID NO: 442946 - RNA, 32 nt, Human
gcgcgugagagggagcgcgcgggcagccgagc

SEQ ID NO: 442947 - RNA, 32 nt, Human
gcgcgugccuguaaucccagcuacucgggaag

SEQ ID NO: 442948 - RNA, 32 nt, Human
gcgcgugccuguaaucccagcuacuugggagu

SEQ ID NO: 442949 - RNA, 32 nt, Human
gcgcgugcucaggaguugguguccugccugcg

SEQ ID NO: 442950 - RNA, 32 nt, Human
gcgcgugcuucuaguccuagcuacucagaaga

SEQ ID NO: 442951 - RNA, 32 nt, Human
gcgcgugcuuguaaucccagcuacucaggagg

SEQ ID NO: 442952 - RNA, 32 nt, Human
gcgcguggaggaggaggaaaaggagggaaagg

SEQ ID NO: 442953 - RNA, 23 nt, Human
gcgcguggcucacgccuauaauc

SEQ ID NO: 442954 - RNA, 32 nt, Human
gcgcguggcucacgccuauaaucccagcacuu

SEQ ID NO: 442955 - RNA, 23 nt, Human
gcgcguggcucacgccuguaauc

SEQ ID NO: 442956 - RNA, 32 nt, Human
gcgcguggcucacgccuguaaucccagcacuu

SEQ ID NO: 442957 - RNA, 32 nt, Human
gcgcgugggugaggaaggucaggucuaggaac

SEQ ID NO: 442958 - RNA, 32 nt, Human
gcgcgugguuggcagaggcagagacauaagac

SEQ ID NO: 442959 - RNA, 32 nt, Human
gcgcguguguaaucccagcuacuugggaggcu

SEQ ID NO: 442960 - RNA, 32 nt, Human
gcgcguucugcuguaacgagcgggcucggagg

SEQ ID NO: 442961 - RNA, 32 nt, Human
gcgcguuugucugagccugggacuaacauaau

SEQ ID NO: 442962 - RNA, 32 nt, Human
gcgcuaagggccgccgccaccaugccaggggg

SEQ ID NO: 442963 - RNA, 32 nt, Human
gcgcuacagcccagagguuauacauuucaaca

SEQ ID NO: 442964 - RNA, 32 nt, Human
gcgcuaccaaccacagccuggcagccuggucu

SEQ ID NO: 442965 - RNA, 32 nt, Human
gcgcuaccagcagacucuggaggccugugccu

SEQ ID NO: 442966 - RNA, 32 nt, Human
gcgcuaccaggaggggcaggucucagccagcu

SEQ ID NO: 442967 - RNA, 32 nt, Human
gcgcuacccuuuuccgcuccacggugaccucc

SEQ ID NO: 442968 - RNA, 32 nt, Human
gcgcuaccugcucuaccaguggcccugugaua

SEQ ID NO: 442969 - RNA, 24 nt, Human
gcgcuacuccuggcauguggauca

SEQ ID NO: 442970 - RNA, 32 nt, Human
gcgcuacugaacuccagccuggguuacagagc

SEQ ID NO: 442971 - RNA, 32 nt, Human
gcgcuacugcacuccagccuaggcaacagagg

SEQ ID NO: 442972 - RNA, 32 nt, Human
gcgcuacugcacuccagccuggacaacagagg

SEQ ID NO: 442973 - RNA, 32 nt, Human
gcgcuacugcacuccagccugggcgacagagu

SEQ ID NO: 442974 - RNA, 32 nt, Human
gcgcuacugcacuccagccugggcgacaguac

SEQ ID NO: 442975 - RNA, 32 nt, Human
gcgcuacugcacuccagccugggugacagagu

SEQ ID NO: 442976 - RNA, 32 nt, Human
gcgcuacugcacuccagccugggugacagugu

SEQ ID NO: 442977 - RNA, 32 nt, Human
gcgcuacugcauuccagccugggcgccgagau

SEQ ID NO: 442978 - RNA, 32 nt, Human
gcgcuacuuccacuccagcgccaacuacacug

SEQ ID NO: 442979 - RNA, 22 nt, Human
gcgcuagagccauccagaagug

SEQ ID NO: 442980 - RNA, 32 nt, Human
gcgcuagagcccgggcgacagagcaagacuug

SEQ ID NO: 442981 - RNA, 32 nt, Human
gcgcuagaggcaagaggaagggggucugcgag

SEQ ID NO: 442982 - RNA, 18 nt, Human
gcgcuagcccaccuccca

SEQ ID NO: 442983 - RNA, 32 nt, Human
gcgcuagccugaggagcucagagccuaaggaa

SEQ ID NO: 442984 - RNA, 32 nt, Human
gcgcuagggcuccgaggagcuggggcgggcua

SEQ ID NO: 442985 - RNA, 32 nt, Human
gcgcuagucccaggagcucggaauguucgugg

SEQ ID NO: 442986 - RNA, 32 nt, Human
gcgcuagucccuugguuuaauuugugccuuau

SEQ ID NO: 442987 - RNA, 32 nt, Human
gcgcuauuacugggauauagaccuggauaauu

SEQ ID NO: 442988 - RNA, 32 nt, Human
gcgcuauuaucuagauucaguguuacauuuuc

SEQ ID NO: 442989 - RNA, 32 nt, Human
gcgcuauugcacuccagccugggugacagagc

SEQ ID NO: 442990 - RNA, 32 nt, Human
gcgcuauugcacuccagucuggguaacaggga

SEQ ID NO: 442991 - RNA, 32 nt, Human
gcgcucaacacuggggaaaggaaggaggcggg

SEQ ID NO: 442992 - RNA, 27 nt, Human
gcgcucaauaaaucuaagcuucccuuu

SEQ ID NO: 442993 - RNA, 27 nt, Human
gcgcucacacauucaccguuggccugc

SEQ ID NO: 442994 - RNA, 32 nt, Human
gcgcucaccuguaaucccaccauuuugggagg

SEQ ID NO: 442995 - RNA, 32 nt, Human
gcgcucaccuguuuuccaugugaggauacaau

SEQ ID NO: 442996 - RNA, 21 nt, Human
gcgcucagacccccuggcugc

SEQ ID NO: 442997 - RNA, 23 nt, Human
gcgcucagacgccccagcuccgc

SEQ ID NO: 442998 - RNA, 32 nt, Human
gcgcucagagcugugagagaagacaggaaggu

SEQ ID NO: 442999 - RNA, 22 nt, Human
gcgcucagcacaggcagcucgc

SEQ ID NO: 443000 - RNA, 32 nt, Human
gcgcucagcccaaacccagggcucuuaaccac

SEQ ID NO: 443001 - RNA, 32 nt, Human
gcgcucagcuuccgacgggagaggguagaccg

SEQ ID NO: 443002 - RNA, 32 nt, Human
gcgcucaggaagggugagguggagcccugcac

SEQ ID NO: 443003 - RNA, 32 nt, Human
gcgcucaugccccacgcggggucuccaaguga

SEQ ID NO: 443004 - RNA, 32 nt, Human
gcgcucaugcccguaaucccagcacuuuggua

SEQ ID NO: 443005 - RNA, 32 nt, Human
gcgcucauggccuccugcuucuugccuaccac

SEQ ID NO: 443006 - RNA, 32 nt, Human
gcgcuccaaagaagaggugggauaguuggaga

SEQ ID NO: 443007 - RNA, 32 nt, Human
gcgcuccaaagaagaggugggauaguuggagg

SEQ ID NO: 443008 - RNA, 32 nt, Human
gcgcuccagcagcugcugccgcccagcccggc

SEQ ID NO: 443009 - RNA, 32 nt, Human
gcgcuccagccuaggugacagagcaagacucc

SEQ ID NO: 443010 - RNA, 28 nt, Human
gcgcuccagcuagcugccucaucaaaaa

SEQ ID NO: 443011 - RNA, 32 nt, Human
gcgcuccagucccucagacgugggcugagcuu

SEQ ID NO: 443012 - RNA, 32 nt, Human
gcgcucccaagcucugaguccuuguuuuucgu

SEQ ID NO: 443013 - RNA, 32 nt, Human
gcgcucccaggagaguggaggcugcaggaaga

SEQ ID NO: 443014 - RNA, 19 nt, Human
gcgcucccagugcccagcc

SEQ ID NO: 443015 - RNA, 32 nt, Human
gcgcuccccagaggugagcugauccccagcca

SEQ ID NO: 443016 - RNA, 20 nt, Human
gcgcuccccucagcuccugc

SEQ ID NO: 443017 - RNA, 32 nt, Human
gcgcuccccucagcuccugcagugcuaauuaa

SEQ ID NO: 443018 - RNA, 32 nt, Human
gcgcucccgaaggcguuccuggagggcccugg

SEQ ID NO: 443019 - RNA, 32 nt, Human
gcgcucccucccucccccuucucugucccccg

SEQ ID NO: 443020 - RNA, 18 nt, Human
gcgcucccugcgaguggc

SEQ ID NO: 443021 - RNA, 21 nt, Human
gcgcuccgcccccgcugagcc

SEQ ID NO: 443022 - RNA, 32 nt, Human
gcgcuccgcuugccucuccaccccgcccgacu

SEQ ID NO: 443023 - RNA, 20 nt, Human
gcgcuccggagagaccgaca

SEQ ID NO: 443024 - RNA, 32 nt, Human
gcgcuccucccucaggcuuucucccucagucu

SEQ ID NO: 443025 - RNA, 32 nt, Human
gcgcuccucgcucgccuccuguacccauccag

SEQ ID NO: 443026 - RNA, 32 nt, Human
gcgcuccucuaggcugcaaagggggccuccga

SEQ ID NO: 443027 - RNA, 32 nt, Human
gcgcuccucucuggcugagguggaaacagaga

SEQ ID NO: 443028 - RNA, 32 nt, Human
gcgcuccugcugcugcucacccuuaugaaccu

SEQ ID NO: 443029 - RNA, 22 nt, Human
gcgcucgagcagcggcucggug

SEQ ID NO: 443030 - RNA, 32 nt, Human
gcgcucgcacacacacgcacgcacgcacacac

SEQ ID NO: 443031 - RNA, 32 nt, Human
gcgcucgccagcggcucccccuucuccucggc

SEQ ID NO: 443032 - RNA, 32 nt, Human
gcgcucgcccuuggcccugcugccucugucua

SEQ ID NO: 443033 - RNA, 32 nt, Human
gcgcucgccugccccacagccugggccuuggg

SEQ ID NO: 443034 - RNA, 25 nt, Human
gcgcucgcgcaggagaccccgggug

SEQ ID NO: 443035 - RNA, 32 nt, Human
gcgcucgcggcugagcuagauccugccgagcc

SEQ ID NO: 443036 - RNA, 21 nt, Human
gcgcucggcccucgccaggcc

SEQ ID NO: 443037 - RNA, 32 nt, Human
gcgcucggccuccagcagucggcuuucugcug

SEQ ID NO: 443038 - RNA, 32 nt, Human
gcgcucggcggcuccuuccagcaggggcuugc

SEQ ID NO: 443039 - RNA, 32 nt, Human
gcgcucggcucgcaggauggaucccguacccg

SEQ ID NO: 443040 - RNA, 32 nt, Human
gcgcucggcucgggggcggcggcgcgggagga

SEQ ID NO: 443041 - RNA, 18 nt, Human
gcgcucggcuggcugcag

SEQ ID NO: 443042 - RNA, 32 nt, Human
gcgcucggcuucuuccucugugcuggucauga

SEQ ID NO: 443043 - RNA, 32 nt, Human
gcgcucgggcaggcgggcugaggaggcugccg

SEQ ID NO: 443044 - RNA, 32 nt, Human
gcgcucucgacucuccugccugcccagcugcg

SEQ ID NO: 443045 - RNA, 32 nt, Human
gcgcucucuaaauuaugucucuggcauauuuu

SEQ ID NO: 443046 - RNA, 32 nt, Human
gcgcucucuaacucuccuuuacacugcaauga

SEQ ID NO: 443047 - RNA, 32 nt, Human
gcgcucugacaugcagaaggugacccugggcc

SEQ ID NO: 443048 - RNA, 32 nt, Human
gcgcucugcaauucgcccugcccagccauccu

SEQ ID NO: 443049 - RNA, 32 nt, Human
gcgcucugcccggcuuccucagucuccucgcc

SEQ ID NO: 443050 - RNA, 32 nt, Human
gcgcucugcccucccuccuuccuucuugcuuc

SEQ ID NO: 443051 - RNA, 32 nt, Human
gcgcucugccugccgccugccugccugccacu

SEQ ID NO: 443052 - RNA, 32 nt, Human
gcgcucuggaaaagacagggagccaggcccuc

SEQ ID NO: 443053 - RNA, 32 nt, Human
gcgcucugggacugacaccagcgguuugggcu

SEQ ID NO: 443054 - RNA, 32 nt, Human
gcgcucugucaguccgcaaacuccuugccgcc

SEQ ID NO: 443055 - RNA, 22 nt, Human
gcgcucugugggcgacuaagug

SEQ ID NO: 443056 - RNA, 32 nt, Human
gcgcucuuaaucuccccucuacuugacucugc

SEQ ID NO: 443057 - RNA, 32 nt, Human
gcgcucuuacccugcacaaucucccccuccag

SEQ ID NO: 443058 - RNA, 22 nt, Human
gcgcugaaaguuuuggugcccc

SEQ ID NO: 443059 - RNA, 32 nt, Human
gcgcugacgaggagcccggcugagggaggaug

SEQ ID NO: 443060 - RNA, 32 nt, Human
gcgcugacgcugcagcccuggaccugcugggg

SEQ ID NO: 443061 - RNA, 32 nt, Human
gcgcugacucacucccugccccaucuccaccc

SEQ ID NO: 443062 - RNA, 24 nt, Human
gcgcugagaaaggcaccagcuccu

SEQ ID NO: 443063 - RNA, 32 nt, Human
gcgcugagaucgaguugcugggggaggccucu

SEQ ID NO: 443064 - RNA, 19 nt, Human
gcgcugagauugucuaaag

SEQ ID NO: 443065 - RNA, 20 nt, Human
gcgcugaggagcggcgaccc

SEQ ID NO: 443066 - RNA, 22 nt, Human
gcgcugaggccugacgccgccu

SEQ ID NO: 443067 - RNA, 20 nt, Human
gcgcugaggcggggcuugca

SEQ ID NO: 443068 - RNA, 32 nt, Human
gcgcugaggcggggcuugcaggugagggggcu

SEQ ID NO: 443069 - RNA, 24 nt, Human
gcgcugagggacccggcgcucgcc

SEQ ID NO: 443070 - RNA, 22 nt, Human
gcgcugagggcccuccucccca

SEQ ID NO: 443071 - RNA, 23 nt, Human
gcgcugaggggcgcggagcuccc

SEQ ID NO: 443072 - RNA, 32 nt, Human
gcgcugaggugcugggacagccaugguuucag

SEQ ID NO: 443073 - RNA, 21 nt, Human
gcgcugaucccgcuggcccug

SEQ ID NO: 443074 - RNA, 21 nt, Human
gcgcugcagcccaaggagcag

SEQ ID NO: 443075 - RNA, 32 nt, Human
gcgcugcagggaacagcggggcaaacagugag

SEQ ID NO: 443076 - RNA, 32 nt, Human
gcgcugcauuuucuccccucucccucccuccu

SEQ ID NO: 443077 - RNA, 32 nt, Human
gcgcugccacagucucaucccauuuccagcuc

SEQ ID NO: 443078 - RNA, 32 nt, Human
gcgcugccagaggcggggccugacuggagagc

SEQ ID NO: 443079 - RNA, 17 nt, Human
gcgcugccagccccgcc

SEQ ID NO: 443080 - RNA, 32 nt, Human
gcgcugccauuuccuaccccugccauuuccca

SEQ ID NO: 443081 - RNA, 32 nt, Human
gcgcugcccagaggcguccuggccugaacagc

SEQ ID NO: 443082 - RNA, 32 nt, Human
gcgcugcccaggaagggcagggcuggggugau

SEQ ID NO: 443083 - RNA, 32 nt, Human
gcgcugccccugcuuugugcuggucuccugug

SEQ ID NO: 443084 - RNA, 32 nt, Human
gcgcugccgccgcccucgaggcucccucugac

SEQ ID NO: 443085 - RNA, 21 nt, Human
gcgcugccgccgccgccgccg

SEQ ID NO: 443086 - RNA, 32 nt, Human
gcgcugccggggcgagguugcgaggggcggug

SEQ ID NO: 443087 - RNA, 32 nt, Human
gcgcugccgguuacguaaagaugaggggcuga

SEQ ID NO: 443088 - RNA, 32 nt, Human
gcgcugccgugagacuggugcuccaggaacca

SEQ ID NO: 443089 - RNA, 32 nt, Human
gcgcugccucgcaauccugggcuagguccuuu

SEQ ID NO: 443090 - RNA, 32 nt, Human
gcgcugccuggaggcaggaaggagaggcaggg

SEQ ID NO: 443091 - RNA, 32 nt, Human
gcgcugccuucacuccuggagugaguuuccau

SEQ ID NO: 443092 - RNA, 32 nt, Human
gcgcugcggccugggagccucggggagaugcg

SEQ ID NO: 443093 - RNA, 32 nt, Human
gcgcugcggcgacgccuggauccugccuccgc

SEQ ID NO: 443094 - RNA, 32 nt, Human
gcgcugcgucggugaggugcucaaauugcaug

SEQ ID NO: 443095 - RNA, 32 nt, Human
gcgcugcgugagcugccauguaucgccagccg

SEQ ID NO: 443096 - RNA, 21 nt, Human
gcgcugcgugcccuggcucug

SEQ ID NO: 443097 - RNA, 32 nt, Human
gcgcugcuacgagcggugucuccuggggcucc

SEQ ID NO: 443098 - RNA, 20 nt, Human
gcgcugcucgccccgggcca

SEQ ID NO: 443099 - RNA, 32 nt, Human
gcgcugcugaaaccaggaauccaggucaggcc

SEQ ID NO: 443100 - RNA, 32 nt, Human
gcgcugcugcacucaagcuuggaugacagagc

SEQ ID NO: 443101 - RNA, 32 nt, Human
gcgcugcugcacuccaaccugggcgacagagc

SEQ ID NO: 443102 - RNA, 32 nt, Human
gcgcugcugcacuccagccugggugacagagu

SEQ ID NO: 443103 - RNA, 20 nt, Human
gcgcugcugccgcccagccc

SEQ ID NO: 443104 - RNA, 32 nt, Human
gcgcugcugccuaggugccauuuccuuuccuc

SEQ ID NO: 443105 - RNA, 21 nt, Human
gcgcugcugcuccagccugac

SEQ ID NO: 443106 - RNA, 32 nt, Human
gcgcuggaagagcugagaggccaggcugugga

SEQ ID NO: 443107 - RNA, 22 nt, Human
gcgcuggacacucucugcccug

SEQ ID NO: 443108 - RNA, 32 nt, Human
gcgcuggaccugcucaccugagccugcagaag

SEQ ID NO: 443109 - RNA, 20 nt, Human
gcgcuggagacgccaggccc

SEQ ID NO: 443110 - RNA, 32 nt, Human
gcgcuggagagggggcgcugagcuguugggua

SEQ ID NO: 443111 - RNA, 21 nt, Human
gcgcuggaggaaaccagcccu

SEQ ID NO: 443112 - RNA, 32 nt, Human
gcgcuggaggcgugggucagggagacaggcau

SEQ ID NO: 443113 - RNA, 19 nt, Human
gcgcuggaggcucuuggcc

SEQ ID NO: 443114 - RNA, 32 nt, Human
gcgcuggaucaguccacggcuuggggaaaggc

SEQ ID NO: 443115 - RNA, 19 nt, Human
gcgcuggauuacaggcaug

SEQ ID NO: 443116 - RNA, 32 nt, Human
gcgcuggauuacaggcaugagccacuacaccc

SEQ ID NO: 443117 - RNA, 32 nt, Human
gcgcuggcagaggcugugcucccuccucaggu

SEQ ID NO: 443118 - RNA, 32 nt, Human
gcgcuggcccugccacuccagccuggccucac

SEQ ID NO: 443119 - RNA, 32 nt, Human
gcgcuggcccugggccugggccuguggcucgg

SEQ ID NO: 443120 - RNA, 32 nt, Human
gcgcuggccucccgccgcugugcauugcagca

SEQ ID NO: 443121 - RNA, 32 nt, Human
gcgcuggcgagauaccauggugccauccuccu

SEQ ID NO: 443122 - RNA, 32 nt, Human
gcgcugggaaaucaccccacaggguggagguc

SEQ ID NO: 443123 - RNA, 32 nt, Human
gcgcugggagacagcggcugcccacgcaguuc

SEQ ID NO: 443124 - RNA, 32 nt, Human
gcgcugggagcccagagcaggaggcagagccc

SEQ ID NO: 443125 - RNA, 32 nt, Human
gcgcugggagcugcggucuccggccauggccc

SEQ ID NO: 443126 - RNA, 32 nt, Human
gcgcugggcacuucccugcugccuguaaauau

SEQ ID NO: 443127 - RNA, 32 nt, Human
gcgcugggcaugcucaguagccgcggcgcugc

SEQ ID NO: 443128 - RNA, 32 nt, Human
gcgcugggcccaggcaggggcuucugauuagg

SEQ ID NO: 443129 - RNA, 32 nt, Human
gcgcugggcccccguccugccugagcgguuac

SEQ ID NO: 443130 - RNA, 25 nt, Human
gcgcugggcggcugcggggccugac

SEQ ID NO: 443131 - RNA, 32 nt, Human
gcgcugggcucucagggcaggguugggacagc

SEQ ID NO: 443132 - RNA, 32 nt, Human
gcgcuggggagggcgaggcggaggcggcaaaa

SEQ ID NO: 443133 - RNA, 18 nt, Human
gcgcugggggccgagucc

SEQ ID NO: 443134 - RNA, 32 nt, Human
gcgcugggggccgguuuggugccugaggagcu

SEQ ID NO: 443135 - RNA, 32 nt, Human
gcgcugggucggaagugagcaggcugaggcca

SEQ ID NO: 443136 - RNA, 32 nt, Human
gcgcuggguggugguucugccugcuugcugcu

SEQ ID NO: 443137 - RNA, 32 nt, Human
gcgcuggguucugcagcagggcucagccucag

SEQ ID NO: 443138 - RNA, 32 nt, Human
gcgcugguaagccuguguuuugguucgcuaug

SEQ ID NO: 443139 - RNA, 32 nt, Human
gcgcugguagugagcuuccacuucugcccuga

SEQ ID NO: 443140 - RNA, 24 nt, Human
gcgcuggugcuggcguuggcccug

SEQ ID NO: 443141 - RNA, 32 nt, Human
gcgcugguggcugcagcuggggugaggcgcga

SEQ ID NO: 443142 - RNA, 32 nt, Human
gcgcuggugggugggaucguggcggagcgcca

SEQ ID NO: 443143 - RNA, 32 nt, Human
gcgcuggugucuguuggggacagccccauccc

SEQ ID NO: 443144 - RNA, 32 nt, Human
gcgcugucacccaggcuggagugcagugcugc

SEQ ID NO: 443145 - RNA, 19 nt, Human
gcgcugucacccugggcca

SEQ ID NO: 443146 - RNA, 32 nt, Human
gcgcugucagacuccggcugauccuggcucga

SEQ ID NO: 443147 - RNA, 32 nt, Human
gcgcugucccuaggaggaauuucuccuucagg

SEQ ID NO: 443148 - RNA, 24 nt, Human
gcgcuguccucgggggccugggga

SEQ ID NO: 443149 - RNA, 32 nt, Human
gcgcuguccucgggggccuggggaaccgcgcg

SEQ ID NO: 443150 - RNA, 32 nt, Human
gcgcuguccuugccgggaagucacuguugaag

SEQ ID NO: 443151 - RNA, 32 nt, Human
gcgcugucgcccaggcuggagcgcaauggcgc

SEQ ID NO: 443152 - RNA, 32 nt, Human
gcgcugucggggcagcagcccaggcauccgcu

SEQ ID NO: 443153 - RNA, 32 nt, Human
gcgcugucucagcucacugcaaccuccgccuc

SEQ ID NO: 443154 - RNA, 32 nt, Human
gcgcuguggcucacaguguaaucccaacacuu

SEQ ID NO: 443155 - RNA, 32 nt, Human
gcgcuguguagggcuauuuccacccacccggc

SEQ ID NO: 443156 - RNA, 32 nt, Human
gcgcuguguccgucgccaugacagaucagacc

SEQ ID NO: 443157 - RNA, 32 nt, Human
gcgcugugugagcuggcccugccccuccucau

SEQ ID NO: 443158 - RNA, 32 nt, Human
gcgcuguugcccaggcucuagugcaauggcac

SEQ ID NO: 443159 - RNA, 32 nt, Human
gcgcuguugcccaggcuggagugcaguggcgu

SEQ ID NO: 443160 - RNA, 32 nt, Human
gcgcuguugcccgcccuccacccacuagguga

SEQ ID NO: 443161 - RNA, 32 nt, Human
gcgcuguugccuuuguaugucuucccaccuca

SEQ ID NO: 443162 - RNA, 32 nt, Human
gcgcuguuucuugagccaggucuucuguccau

SEQ ID NO: 443163 - RNA, 32 nt, Human
gcgcuucagcaaccgcucccaccuccuccagc

SEQ ID NO: 443164 - RNA, 32 nt, Human
gcgcuucauggagaacuuccaaaagguggaaa

SEQ ID NO: 443165 - RNA, 32 nt, Human
gcgcuuccccaaacucaccuccugggcggcug

SEQ ID NO: 443166 - RNA, 32 nt, Human
gcgcuucuaccuuuuggucuuuaaagugugau

SEQ ID NO: 443167 - RNA, 32 nt, Human
gcgcuucuagguugcuggggcucugcugguua

SEQ ID NO: 443168 - RNA, 32 nt, Human
gcgcuucuccagccucagccuccugaguagcu

SEQ ID NO: 443169 - RNA, 32 nt, Human
gcgcuucugagugcccgggaggucaucaugaa

SEQ ID NO: 443170 - RNA, 32 nt, Human
gcgcuucuucucccccgccaucaugucgccca

SEQ ID NO: 443171 - RNA, 32 nt, Human
gcgcuucuucucuccauccuuggaccuucaca

SEQ ID NO: 443172 - RNA, 32 nt, Human
gcgcuucuucuuucuugguuugauccugacug

SEQ ID NO: 443173 - RNA, 32 nt, Human
gcgcuugacccagagccagauccagcauggcc

SEQ ID NO: 443174 - RNA, 22 nt, Human
gcgcuugaggaccagcccagcc

SEQ ID NO: 443175 - RNA, 32 nt, Human
gcgcuugaggggauuauaauuucuuuaaaaag

SEQ ID NO: 443176 - RNA, 32 nt, Human
gcgcuugcagugagccgagauugccccacugc

SEQ ID NO: 443177 - RNA, 32 nt, Human
gcgcuugcagugagcugagcucccaccacugc

SEQ ID NO: 443178 - RNA, 32 nt, Human
gcgcuugccuguagucuagcuacuuggggugg

SEQ ID NO: 443179 - RNA, 20 nt, Human
gcgcuugcgcaggcgcucgg

SEQ ID NO: 443180 - RNA, 32 nt, Human
gcgcuugcgcucccccuacucguucuaauucc

SEQ ID NO: 443181 - RNA, 32 nt, Human
gcgcuugggaaaggcaggagcgccagcggucg

SEQ ID NO: 443182 - RNA, 32 nt, Human
gcgcuuguccugcuucacccuaccccgccuaa

SEQ ID NO: 443183 - RNA, 32 nt, Human
gcgcuuguugcccaggcuggaaugcaauggcg

SEQ ID NO: 443184 - RNA, 32 nt, Human
gcgcuuguuuuucuccugcucucccccaccgc

SEQ ID NO: 443185 - RNA, 32 nt, Human
gcgcuuuaugcccaugaugucauuucaggcuc

SEQ ID NO: 443186 - RNA, 32 nt, Human
gcgcuuuccauucauuugguuuagcacagcca

SEQ ID NO: 443187 - RNA, 31 nt, Human
gcgcuuugccucucuccugucuuugucugcu

SEQ ID NO: 443188 - RNA, 32 nt, Human
gcgcuuugcuuuggucuaucuuugagcgccca

SEQ ID NO: 443189 - RNA, 32 nt, Human
gcgcuuuggcaggccaaggcgggcagaucgcu

SEQ ID NO: 443190 - RNA, 32 nt, Human
gcgcuuugggaggcagaggcagguggaucacc

SEQ ID NO: 443191 - RNA, 32 nt, Human
gcgcuuuuggcuccucuucuggcuccugcugg

SEQ ID NO: 443192 - RNA, 32 nt, Human
gcggaaaaagccagagaggcuggugagggagc

SEQ ID NO: 443193 - RNA, 32 nt, Human
gcggaaagcaucuaggcugaagggugcaggug

SEQ ID NO: 443194 - RNA, 32 nt, Human
gcggaaagggaagccgggcggggccagggggu

SEQ ID NO: 443195 - RNA, 21 nt, Human
gcggaaagugagagccagcag

SEQ ID NO: 443196 - RNA, 32 nt, Human
gcggaaauuaaccccaagguguauuuuugucu

SEQ ID NO: 443197 - RNA, 32 nt, Human
gcggaacaaggcacugacaagccucaacgagg

SEQ ID NO: 443198 - RNA, 20 nt, Human
gcggaacaccugaggucagg

SEQ ID NO: 443199 - RNA, 32 nt, Human
gcggaacagcccauccagcagagugaguccau

SEQ ID NO: 443200 - RNA, 32 nt, Human
gcggaaccugcggggcagaggcggcggccgca

SEQ ID NO: 443201 - RNA, 32 nt, Human
gcggaaccuuucacaccucuuucucagggacg

SEQ ID NO: 443202 - RNA, 25 nt, Human
gcggaacuaccaaucauggcugcag

SEQ ID NO: 443203 - RNA, 32 nt, Human
gcggaagaaagcccaggcggucuguggcccag

SEQ ID NO: 443204 - RNA, 32 nt, Human
gcggaagaagaaaaagaaggacaaagacaaag

SEQ ID NO: 443205 - RNA, 32 nt, Human
gcggaagaggaagcagggcggaagggaagccc

SEQ ID NO: 443206 - RNA, 32 nt, Human
gcggaagaggaggaggaggaggaggaaggggc

SEQ ID NO: 443207 - RNA, 32 nt, Human
gcggaagagggcggaggguagugggauggggg

SEQ ID NO: 443208 - RNA, 17 nt, Human
gcggaagcgcggcgcug

SEQ ID NO: 443209 - RNA, 32 nt, Human
gcggaaggagggcaaugagcuguucaaaugug

SEQ ID NO: 443210 - RNA, 32 nt, Human
gcggaaggaguuuccuggacugcgcugucgcu

SEQ ID NO: 443211 - RNA, 23 nt, Human
gcggaaggcaguuuugcuuggga

SEQ ID NO: 443212 - RNA, 32 nt, Human
gcggaaggcgaguuuucuuuuguuuucuguag

SEQ ID NO: 443213 - RNA, 22 nt, Human
gcggaaggcggagacagcgaga

SEQ ID NO: 443214 - RNA, 32 nt, Human
gcggaaggggcuggcuaaugugcaguggagcg

SEQ ID NO: 443215 - RNA, 32 nt, Human
gcggaagguggagguggguagcccagguucag

SEQ ID NO: 443216 - RNA, 22 nt, Human
gcggaaggugggaggaggcaga

SEQ ID NO: 443217 - RNA, 22 nt, Human
gcggaaggugggaggagggaga

SEQ ID NO: 443218 - RNA, 32 nt, Human
gcggaagugggagauggagcagggcaccuguu

SEQ ID NO: 443219 - RNA, 32 nt, Human
gcggaaucuuuuugaaauaaaaagccacuuug

SEQ ID NO: 443220 - RNA, 32 nt, Human
gcggaauggggcuguguggcugcuagauuagg

SEQ ID NO: 443221 - RNA, 19 nt, Human
gcggaaugugcccagcaga

SEQ ID NO: 443222 - RNA, 32 nt, Human
gcggaauuacgagggcuggcuguuuuacaccg

SEQ ID NO: 443223 - RNA, 32 nt, Human
gcggacaaaacucaggccagagccacagcugg

SEQ ID NO: 443224 - RNA, 32 nt, Human
gcggacaaaaucuggagcaaagaaggauuuua

SEQ ID NO: 443225 - RNA, 32 nt, Human
gcggacaaccaccaccaccacccccacaccca

SEQ ID NO: 443226 - RNA, 32 nt, Human
gcggacaagcacuccagggcaucaguccgggc

SEQ ID NO: 443227 - RNA, 32 nt, Human
gcggacaccggagcgggcaggagcagcggccg

SEQ ID NO: 443228 - RNA, 32 nt, Human
gcggacagacaggcgagauggcggcggaggug

SEQ ID NO: 443229 - RNA, 24 nt, Human
gcggacagaccaccugaggucagg

SEQ ID NO: 443230 - RNA, 32 nt, Human
gcggacagaggcuaguggugguggugguggua

SEQ ID NO: 443231 - RNA, 32 nt, Human
gcggacagagggcuggaaacaagacgcuccag

SEQ ID NO: 443232 - RNA, 32 nt, Human
gcggacagaucacuugagcucaggaguucgag

SEQ ID NO: 443233 - RNA, 32 nt, Human
gcggacaggaagaacaccagcacgaggguccg

SEQ ID NO: 443234 - RNA, 32 nt, Human
gcggacaggaagaggcucugggcuggcacaug

SEQ ID NO: 443235 - RNA, 32 nt, Human
gcggacagugcgggccagggaggaaaaccaga

SEQ ID NO: 443236 - RNA, 32 nt, Human
gcggacagugugggccagggaggaaaaccaga

SEQ ID NO: 443237 - RNA, 32 nt, Human
gcggacauccuagcuccuucucaggccuccaa

SEQ ID NO: 443238 - RNA, 19 nt, Human
gcggacaucuguaauccca

SEQ ID NO: 443239 - RNA, 32 nt, Human
gcggaccacccaggcuugaggcagcggcggga

SEQ ID NO: 443240 - RNA, 32 nt, Human
gcggaccacugcagacugagcgguggaccgaa

SEQ ID NO: 443241 - RNA, 32 nt, Human
gcggaccagagguggaaggcgcggcgggcgua

SEQ ID NO: 443242 - RNA, 20 nt, Human
gcggaccaucggcuggcaga

SEQ ID NO: 443243 - RNA, 21 nt, Human
gcggacccccuccgcggggga

SEQ ID NO: 443244 - RNA, 24 nt, Human
gcggaccccgaccuccaguugccu

SEQ ID NO: 443245 - RNA, 32 nt, Human
gcggacccucgcugcccuaccucucucgcggg

SEQ ID NO: 443246 - RNA, 32 nt, Human
gcggacccugagcaacccccuccugggcuccu

SEQ ID NO: 443247 - RNA, 32 nt, Human
gcggacccugcucuccccgggcugcgggccau

SEQ ID NO: 443248 - RNA, 32 nt, Human
gcggaccggaaggggccgaggcugcacgggcc

SEQ ID NO: 443249 - RNA, 32 nt, Human
gcggaccucugguggacauggcugcuucccgc

SEQ ID NO: 443250 - RNA, 32 nt, Human
gcggacgccuguaaucccagcuacuuggaagg

SEQ ID NO: 443251 - RNA, 19 nt, Human
gcggacgccuguaguccca

SEQ ID NO: 443252 - RNA, 18 nt, Human
gcggacgcgugggucgac

SEQ ID NO: 443253 - RNA, 32 nt, Human
gcggacggcacagagggagggagcgagcgagc

SEQ ID NO: 443254 - RNA, 32 nt, Human
gcggacggcggcggaggagacccuaggcucgc

SEQ ID NO: 443255 - RNA, 32 nt, Human
gcggacguaugcagaggcucucaaggccaggc

SEQ ID NO: 443256 - RNA, 19 nt, Human
gcggacugacagcaccagg

SEQ ID NO: 443257 - RNA, 32 nt, Human
gcggacugagugcugggauccaaggcauucua

SEQ ID NO: 443258 - RNA, 32 nt, Human
gcggacugcccugagggcgggaaagggugguc

SEQ ID NO: 443259 - RNA, 32 nt, Human
gcggacuggcuggggagugaugacagaauaca

SEQ ID NO: 443260 - RNA, 32 nt, Human
gcggacugggaguaucaugaaggacgccgccg

SEQ ID NO: 443261 - RNA, 32 nt, Human
gcggacugucacucagaucugcagagaugaau

SEQ ID NO: 443262 - RNA, 32 nt, Human
gcggacuuaccuggcccagcccugccucccuc

SEQ ID NO: 443263 - RNA, 18 nt, Human
gcggacuugcugcugcug

SEQ ID NO: 443264 - RNA, 32 nt, Human
gcggacuuuucaggggacauucagaggcauca

SEQ ID NO: 443265 - RNA, 32 nt, Human
gcggagaauugcuuucugccauuguuauuguc

SEQ ID NO: 443266 - RNA, 32 nt, Human
gcggagacacuggccuaccucugacagcgcgg

SEQ ID NO: 443267 - RNA, 29 nt, Human
gcggagaccacguggagaaaggggccgcu

SEQ ID NO: 443268 - RNA, 19 nt, Human
gcggagaccauggccccca

SEQ ID NO: 443269 - RNA, 32 nt, Human
gcggagagagccaagacggaggaggggaaggg

SEQ ID NO: 443270 - RNA, 32 nt, Human
gcggagagccagagaagugacagggaagcuac

SEQ ID NO: 443271 - RNA, 32 nt, Human
gcggagaggggcccugcuucccacacaaaucc

SEQ ID NO: 443272 - RNA, 32 nt, Human
gcggagaucccaggauccugggugcugucugg

SEQ ID NO: 443273 - RNA, 19 nt, Human
gcggagaugggaggggaga

SEQ ID NO: 443274 - RNA, 32 nt, Human
gcggagcagagucccgggcaggagaaccaagg

SEQ ID NO: 443275 - RNA, 32 nt, Human
gcggagcagcgccuagggcuggaaggcggcug

SEQ ID NO: 443276 - RNA, 32 nt, Human
gcggagcaggaggcagaggagcagauggagca

SEQ ID NO: 443277 - RNA, 15 nt, Human
gcggagcaggcucug

SEQ ID NO: 443278 - RNA, 32 nt, Human
gcggagcaugugcugagggaagucugccuggu

SEQ ID NO: 443279 - RNA, 19 nt, Human
gcggagccagaggcugcag

SEQ ID NO: 443280 - RNA, 32 nt, Human
gcggagccccggccgcugccucccgggacagu

SEQ ID NO: 443281 - RNA, 32 nt, Human
gcggagcccgagcggcggcugcgcagucccgc

SEQ ID NO: 443282 - RNA, 20 nt, Human
gcggagcccggagcuggggc

SEQ ID NO: 443283 - RNA, 32 nt, Human
gcggagccgcacuccggcggcggcggcggcgc

SEQ ID NO: 443284 - RNA, 32 nt, Human
gcggagccggcgggcgaggaggaggacugcac

SEQ ID NO: 443285 - RNA, 32 nt, Human
gcggagccggggcuggagagcggcgaccacug

SEQ ID NO: 443286 - RNA, 32 nt, Human
gcggagccuccccucgcagauaucucccgggg

SEQ ID NO: 443287 - RNA, 32 nt, Human
gcggagccuugaagccgugucugugaucagga

SEQ ID NO: 443288 - RNA, 32 nt, Human
gcggagcggagcgggggugaggagagucgagg

SEQ ID NO: 443289 - RNA, 32 nt, Human
gcggagcuaggaggcgcgagcagagaacgugu

SEQ ID NO: 443290 - RNA, 24 nt, Human
gcggagcucccgccgccgcucccc

SEQ ID NO: 443291 - RNA, 32 nt, Human
gcggagcuccggcuggaggcaagagccgcgcg

SEQ ID NO: 443292 - RNA, 32 nt, Human
gcggagcuccuggaccggcccuucccagaggc

SEQ ID NO: 443293 - RNA, 20 nt, Human
gcggagcuccugggcugcag

SEQ ID NO: 443294 - RNA, 32 nt, Human
gcggagcucucgguuccucucagucggacuuc

SEQ ID NO: 443295 - RNA, 32 nt, Human
gcggagcugggaaaagggaggcagaggaggca

SEQ ID NO: 443296 - RNA, 32 nt, Human
gcggagcugggccgguucuccacagccugugu

SEQ ID NO: 443297 - RNA, 18 nt, Human
gcggagcuggguggcugc

SEQ ID NO: 443298 - RNA, 32 nt, Human
gcggagcuuaaguugugagaagaaagggggaa

SEQ ID NO: 443299 - RNA, 32 nt, Human
gcggaggagaagcaggaggagggaggaggaag

SEQ ID NO: 443300 - RNA, 32 nt, Human
gcggaggagaaggaggaggaggcgaacccaga

SEQ ID NO: 443301 - RNA, 32 nt, Human
gcggaggagagggagcagcgucacgggcgccc

SEQ ID NO: 443302 - RNA, 32 nt, Human
gcggaggagagggcaggggaacggcggugcag

SEQ ID NO: 443303 - RNA, 32 nt, Human
gcggaggagagggcgcagggguccuucuggcc

SEQ ID NO: 443304 - RNA, 32 nt, Human
gcggaggaggagaaaaaggaauaagaaggaga

SEQ ID NO: 443305 - RNA, 32 nt, Human
gcggaggaggagaaggaaggggccgggccggg

SEQ ID NO: 443306 - RNA, 32 nt, Human
gcggaggaggagacgcccaugccccucagggg

SEQ ID NO: 443307 - RNA, 32 nt, Human
gcggaggaggagcagcgcgggagccaggcgcu

SEQ ID NO: 443308 - RNA, 32 nt, Human
gcggaggaggaggcggcggcgucgguggcggc

SEQ ID NO: 443309 - RNA, 32 nt, Human
gcggaggaggcggaggaggagggaaggaagau

SEQ ID NO: 443310 - RNA, 22 nt, Human
gcggaggagggaacagcuggga

SEQ ID NO: 443311 - RNA, 32 nt, Human
gcggaggagguggguccugggaagcgggaugu

SEQ ID NO: 443312 - RNA, 32 nt, Human
gcggaggauacccagggugaggcggagccccu

SEQ ID NO: 443313 - RNA, 32 nt, Human
gcggaggauggaaacacccuucuacggcgaug

SEQ ID NO: 443314 - RNA, 32 nt, Human
gcggaggauggaaacacuugcccggcaauguc

SEQ ID NO: 443315 - RNA, 19 nt, Human
gcggaggcagaggcugcag

SEQ ID NO: 443316 - RNA, 19 nt, Human
gcggaggcagcggcuguag

SEQ ID NO: 443317 - RNA, 25 nt, Human
gcggaggcaggagguggaaacccca

SEQ ID NO: 443318 - RNA, 32 nt, Human
gcggaggcaggcggaucgccugaggugaggag

SEQ ID NO: 443319 - RNA, 32 nt, Human
gcggaggcaggugagaggaggaaggaagcggc

SEQ ID NO: 443320 - RNA, 32 nt, Human
gcggaggcccgcagagcacagagcaggagaag

SEQ ID NO: 443321 - RNA, 32 nt, Human
gcggaggccgcacuccagcacugcgcagggac

SEQ ID NO: 443322 - RNA, 32 nt, Human
gcggaggcggaacugcggaguugcugggucca

SEQ ID NO: 443323 - RNA, 32 nt, Human
gcggaggcggaggcggagguugcagugagcca

SEQ ID NO: 443324 - RNA, 19 nt, Human
gcggaggcggagguugcag

SEQ ID NO: 443325 - RNA, 32 nt, Human
gcggaggcggccgcugcucgaggaucaaacag

SEQ ID NO: 443326 - RNA, 32 nt, Human
gcggaggcggcggcucgggagggaaggaggcg

SEQ ID NO: 443327 - RNA, 20 nt, Human
gcggaggcggggauugcgga

SEQ ID NO: 443328 - RNA, 32 nt, Human
gcggaggcgugcguuugcuuuuacagauaucu

SEQ ID NO: 443329 - RNA, 32 nt, Human
gcggaggcuaugggcagccaggaggugcuggg

SEQ ID NO: 443330 - RNA, 22 nt, Human
gcggaggcucacgccuguaauc

SEQ ID NO: 443331 - RNA, 22 nt, Human
gcggaggcuccuucagcugccu

SEQ ID NO: 443332 - RNA, 23 nt, Human
gcggaggcugcagugagcuggga

SEQ ID NO: 443333 - RNA, 32 nt, Human
gcggaggcuguaaaaccuggcacucugcuugg

SEQ ID NO: 443334 - RNA, 32 nt, Human
gcggagggagagagaaaggaaaagggcuuaag

SEQ ID NO: 443335 - RNA, 19 nt, Human
gcggagggagaggcugcag

SEQ ID NO: 443336 - RNA, 32 nt, Human
gcggagggagcagccgcugccacagucggagc

SEQ ID NO: 443337 - RNA, 22 nt, Human
gcggagggagccggggcuggga

SEQ ID NO: 443338 - RNA, 32 nt, Human
gcggagggaggagagggcgccgccgcaaucuc

SEQ ID NO: 443339 - RNA, 32 nt, Human
gcggagggaggcggaggcugugagggacuccg

SEQ ID NO: 443340 - RNA, 32 nt, Human
gcggagggcagucugcucaaggucacgcagcu

SEQ ID NO: 443341 - RNA, 32 nt, Human
gcggagggcccaagucaucuuuauggcagcaa

SEQ ID NO: 443342 - RNA, 24 nt, Human
gcggagggcggaaggcugcugggg

SEQ ID NO: 443343 - RNA, 32 nt, Human
gcggaggggcaggccagagggaagcgcuuugu

SEQ ID NO: 443344 - RNA, 21 nt, Human
gcggaggggccgcagcuggga

SEQ ID NO: 443345 - RNA, 32 nt, Human
gcggaggggcugggacuaccguaccugggggu

SEQ ID NO: 443346 - RNA, 32 nt, Human
gcggagggggugauaugacuacauacauggca

SEQ ID NO: 443347 - RNA, 32 nt, Human
gcggagggucuugccaaaggcuuuucauccua

SEQ ID NO: 443348 - RNA, 32 nt, Human
gcggaggucacuuuggagaagggugggccuua

SEQ ID NO: 443349 - RNA, 32 nt, Human
gcggaggucuccugccccuucauugcaacacc

SEQ ID NO: 443350 - RNA, 32 nt, Human
gcggaggugagaggagaggaggagaaaacugc

SEQ ID NO: 443351 - RNA, 32 nt, Human
gcggaggugcggcggggagugggagccggccc

SEQ ID NO: 443352 - RNA, 18 nt, Human
gcggaggugcggcugcag

SEQ ID NO: 443353 - RNA, 32 nt, Human
gcggagguguccggcggccaggaggauggcca

SEQ ID NO: 443354 - RNA, 32 nt, Human
gcggagguuagguuugggaguggagcuagcgu

SEQ ID NO: 443355 - RNA, 32 nt, Human
gcggagguugcagugaguugcagucacacccc

SEQ ID NO: 443356 - RNA, 32 nt, Human
gcggaguccacacccaggcauucucgcagccc

SEQ ID NO: 443357 - RNA, 32 nt, Human
gcggaguccgcgcgucacgcucggagaagcac

SEQ ID NO: 443358 - RNA, 32 nt, Human
gcggagucgcuguuccuggugcugaaacgcuc

SEQ ID NO: 443359 - RNA, 32 nt, Human
gcggagucuccucucuuggcaucgaccacacc

SEQ ID NO: 443360 - RNA, 32 nt, Human
gcggagucugcggcgcgggugaagagcggcgc

SEQ ID NO: 443361 - RNA, 32 nt, Human
gcggagugcaguggaacaaccuuggcucacgg

SEQ ID NO: 443362 - RNA, 21 nt, Human
gcggagugcuuccugcagccg

SEQ ID NO: 443363 - RNA, 28 nt, Human
gcggagugggagggcagugaaaucuaga

SEQ ID NO: 443364 - RNA, 32 nt, Human
gcggagugugagggauuuuggaagcacuugcc

SEQ ID NO: 443365 - RNA, 32 nt, Human
gcggaguucuuuaucuucagugagaaugugcc

SEQ ID NO: 443366 - RNA, 20 nt, Human
gcggaguuuggcucaccgca

SEQ ID NO: 443367 - RNA, 20 nt, Human
gcggauaaccugaggucagg

SEQ ID NO: 443368 - RNA, 32 nt, Human
gcggaucaccaggucaggagaucaagaccauc

SEQ ID NO: 443369 - RNA, 20 nt, Human
gcggaucaccuaaggucagg

SEQ ID NO: 443370 - RNA, 20 nt, Human
gcggaucaccugaagucagg

SEQ ID NO: 443371 - RNA, 20 nt, Human
gcggaucaccugagaucagg

SEQ ID NO: 443372 - RNA, 20 nt, Human
gcggaucaccugagcucagg

SEQ ID NO: 443373 - RNA, 20 nt, Human
gcggaucaccugaggccagg

SEQ ID NO: 443374 - RNA, 19 nt, Human
gcggaucaccugaggucag

SEQ ID NO: 443375 - RNA, 20 nt, Human
gcggaucaccugaggucagg

SEQ ID NO: 443376 - RNA, 19 nt, Human
gcggaucaccugaggucgg

SEQ ID NO: 443377 - RNA, 20 nt, Human
gcggaucaccugaggucggg

SEQ ID NO: 443378 - RNA, 20 nt, Human
gcggaucaccugaggugagg

SEQ ID NO: 443379 - RNA, 20 nt, Human
gcggaucaccugagguuagg

SEQ ID NO: 443380 - RNA, 19 nt, Human
gcggaucaccugagucagg

SEQ ID NO: 443381 - RNA, 20 nt, Human
gcggaucaccugaguucagg

SEQ ID NO: 443382 - RNA, 20 nt, Human
gcggaucaccugaugucagg

SEQ ID NO: 443383 - RNA, 20 nt, Human
gcggaucaccuguggucagg

SEQ ID NO: 443384 - RNA, 20 nt, Human
gcggaucacgugaggucagg

SEQ ID NO: 443385 - RNA, 20 nt, Human
gcggaucacucgaggucagg

SEQ ID NO: 443386 - RNA, 32 nt, Human
gcggaucacuugagcccaggaguuugagacca

SEQ ID NO: 443387 - RNA, 20 nt, Human
gcggaucacuugaggccagg

SEQ ID NO: 443388 - RNA, 18 nt, Human
gcggaucacuugagguca

SEQ ID NO: 443389 - RNA, 19 nt, Human
gcggaucacuugaggucag

SEQ ID NO: 443390 - RNA, 20 nt, Human
gcggaucacuugaggucagg

SEQ ID NO: 443391 - RNA, 18 nt, Human
gcggaucacuugagguua

SEQ ID NO: 443392 - RNA, 20 nt, Human
gcggaucaucugagaucagg

SEQ ID NO: 443393 - RNA, 20 nt, Human
gcggaucaucugaggccagg

SEQ ID NO: 443394 - RNA, 20 nt, Human
gcggaucaucugaggucagg

SEQ ID NO: 443395 - RNA, 18 nt, Human
gcggaucauuugagguca

SEQ ID NO: 443396 - RNA, 24 nt, Human
gcggaucccgcaaccgacacuggg

SEQ ID NO: 443397 - RNA, 32 nt, Human
gcggaucccggagagccccggagugagcggag

SEQ ID NO: 443398 - RNA, 24 nt, Human
gcggaucccggucucgccgcagca

SEQ ID NO: 443399 - RNA, 23 nt, Human
gcggauccgccgggcauugagga

SEQ ID NO: 443400 - RNA, 20 nt, Human
gcggaucgccugagaucagg

SEQ ID NO: 443401 - RNA, 20 nt, Human
gcggaucgccugaggucagg

SEQ ID NO: 443402 - RNA, 32 nt, Human
gcggaucgcuugagcccaggagaccagguugg

SEQ ID NO: 443403 - RNA, 18 nt, Human
gcggaucgcuugagguca

SEQ ID NO: 443404 - RNA, 20 nt, Human
gcggaugaccugaggucagg

SEQ ID NO: 443405 - RNA, 32 nt, Human
gcggaugcacuuccugcaccuccagucuucug

SEQ ID NO: 443406 - RNA, 32 nt, Human
gcggaugccuguaaucccagcuacuugggagg

SEQ ID NO: 443407 - RNA, 32 nt, Human
gcggauggguacccgggcacaccagcccucag

SEQ ID NO: 443408 - RNA, 32 nt, Human
gcggaugugguggugcuggaggugagcagcuc

SEQ ID NO: 443409 - RNA, 32 nt, Human
gcggauguugcuugcacuccagccugggugac

SEQ ID NO: 443410 - RNA, 32 nt, Human
gcggauguuggggcugaggggaaggaggagaa

SEQ ID NO: 443411 - RNA, 32 nt, Human
gcggauguuucugccacugcugggcuccacuu

SEQ ID NO: 443412 - RNA, 32 nt, Human
gcggauuacuugagcccaggaguucgggacca

SEQ ID NO: 443413 - RNA, 32 nt, Human
gcggauucucccggcggggaggacgggcgggg

SEQ ID NO: 443414 - RNA, 32 nt, Human
gcggauucuccuuccuccugcuacugauacca

SEQ ID NO: 443415 - RNA, 32 nt, Human
gcggauucucuuucucuuucucuuucucuucu

SEQ ID NO: 443416 - RNA, 21 nt, Human
gcggauucugacaucgaggga

SEQ ID NO: 443417 - RNA, 32 nt, Human
gcggauugcuugagcccaggaguuugagggca

SEQ ID NO: 443418 - RNA, 32 nt, Human
gcggauuucaggagucaagaauccuuaaacgg

SEQ ID NO: 443419 - RNA, 32 nt, Human
gcggauuuucagguuguggcagcuggugccgg

SEQ ID NO: 443420 - RNA, 32 nt, Human
gcggauuuucuuucuuuccucucccggcguug

SEQ ID NO: 443421 - RNA, 32 nt, Human
gcggcaaaagcccauugaagaagaaccagccc

SEQ ID NO: 443422 - RNA, 32 nt, Human
gcggcaaaccgcaugcucuuacccacacuacg

SEQ ID NO: 443423 - RNA, 20 nt, Human
gcggcaacggccccggccca

SEQ ID NO: 443424 - RNA, 32 nt, Human
gcggcaaggccuucgccuggagcuccaaccuc

SEQ ID NO: 443425 - RNA, 32 nt, Human
gcggcaaguacccaggugagaugugcaagagg

SEQ ID NO: 443426 - RNA, 20 nt, Human
gcggcaauggccucagccca

SEQ ID NO: 443427 - RNA, 32 nt, Human
gcggcaauuucagggucccuuuguucgccagg

SEQ ID NO: 443428 - RNA, 32 nt, Human
gcggcacacuucacuacagacacucuauuaag

SEQ ID NO: 443429 - RNA, 32 nt, Human
gcggcacagaagcagccgggggcgcugacucc

SEQ ID NO: 443430 - RNA, 19 nt, Human
gcggcacaugccuguaauc

SEQ ID NO: 443431 - RNA, 32 nt, Human
gcggcaccaacaucaucauuggcuccaucgcu

SEQ ID NO: 443432 - RNA, 32 nt, Human
gcggcaccacugccgucauuucagcuucuggc

SEQ ID NO: 443433 - RNA, 32 nt, Human
gcggcaccacugggaacucuggacuugagugu

SEQ ID NO: 443434 - RNA, 32 nt, Human
gcggcaccagcucggagagaaaggagguucca

SEQ ID NO: 443435 - RNA, 32 nt, Human
gcggcaccaggccacaguuguaagggaucuug

SEQ ID NO: 443436 - RNA, 32 nt, Human
gcggcaccaucccaccacagugaaaacuuaug

SEQ ID NO: 443437 - RNA, 32 nt, Human
gcggcaccauguccaccauccagucggagacu

SEQ ID NO: 443438 - RNA, 32 nt, Human
gcggcacccacuggggcugcaucccccucccc

SEQ ID NO: 443439 - RNA, 32 nt, Human
gcggcaccccuccugaaguaccacagauuuag

SEQ ID NO: 443440 - RNA, 32 nt, Human
gcggcaccuccuuacugaccuccaggaucacc

SEQ ID NO: 443441 - RNA, 22 nt, Human
gcggcaccugccaucuucugaa

SEQ ID NO: 443442 - RNA, 32 nt, Human
gcggcaccugcggcgccugagccuggggaagc

SEQ ID NO: 443443 - RNA, 32 nt, Human
gcggcaccuggcccucagcugcagggaaaccg

SEQ ID NO: 443444 - RNA, 32 nt, Human
gcggcacucagccugcacgcccuccgcgcccc

SEQ ID NO: 443445 - RNA, 32 nt, Human
gcggcacugcacuccagccugggugacaaagu

SEQ ID NO: 443446 - RNA, 32 nt, Human
gcggcacugcagcugcguggccgcccuggagg

SEQ ID NO: 443447 - RNA, 32 nt, Human
gcggcagaaacauagcuccuggagcgcgggac

SEQ ID NO: 443448 - RNA, 32 nt, Human
gcggcagaaauucucccccuacugggccagcu

SEQ ID NO: 443449 - RNA, 32 nt, Human
gcggcagaggcagagaugggagugaugcggac

SEQ ID NO: 443450 - RNA, 32 nt, Human
gcggcagaggcgguguccaggcuuccgggcgg

SEQ ID NO: 443451 - RNA, 31 nt, Human
gcggcagcaacuuucugacaggugccgggga

SEQ ID NO: 443452 - RNA, 32 nt, Human
gcggcagcagccgccgccgagaugucccggcg

SEQ ID NO: 443453 - RNA, 32 nt, Human
gcggcagcagcggaggaguaggaggagacgga

SEQ ID NO: 443454 - RNA, 32 nt, Human
gcggcagcaggaucacagaaccucuggaugga

SEQ ID NO: 443455 - RNA, 32 nt, Human
gcggcagcaguuucagcgugcaguucccaaac

SEQ ID NO: 443456 - RNA, 32 nt, Human
gcggcagccaccgaggagggagcagugccggg

SEQ ID NO: 443457 - RNA, 32 nt, Human
gcggcagcccaggcgcggagggagcgaguccg

SEQ ID NO: 443458 - RNA, 32 nt, Human
gcggcagccgcgggagccccugggcaggcguc

SEQ ID NO: 443459 - RNA, 17 nt, Human
gcggcagccggcugcug

SEQ ID NO: 443460 - RNA, 32 nt, Human
gcggcagccuggggcucguuugggugauuucc

SEQ ID NO: 443461 - RNA, 19 nt, Human
gcggcagcgagccgggucc

SEQ ID NO: 443462 - RNA, 19 nt, Human
gcggcagcgaugccugccc

SEQ ID NO: 443463 - RNA, 22 nt, Human
gcggcagcggcagcggcagcgc

SEQ ID NO: 443464 - RNA, 21 nt, Human
gcggcagcggcggagacacua

SEQ ID NO: 443465 - RNA, 32 nt, Human
gcggcagcgggaccccagcgcgggcggcggcg

SEQ ID NO: 443466 - RNA, 23 nt, Human
gcggcagcggguucgguugcgcg

SEQ ID NO: 443467 - RNA, 32 nt, Human
gcggcagcgguuggagguuguaggaccggcga

SEQ ID NO: 443468 - RNA, 32 nt, Human
gcggcagcuagccuggccaguggcugucccgu

SEQ ID NO: 443469 - RNA, 32 nt, Human
gcggcagcuccaggaccucggcccuugggcuu

SEQ ID NO: 443470 - RNA, 18 nt, Human
gcggcagcuccugucccu

SEQ ID NO: 443471 - RNA, 32 nt, Human
gcggcaggaagaggagcgggagcaggagcgcg

SEQ ID NO: 443472 - RNA, 32 nt, Human
gcggcaggaaugcugcgcgccgcccugucccu

SEQ ID NO: 443473 - RNA, 32 nt, Human
gcggcaggagcuaucccacuggaagccaccuu

SEQ ID NO: 443474 - RNA, 32 nt, Human
gcggcaggagcugaggggaguuguagggaacu

SEQ ID NO: 443475 - RNA, 32 nt, Human
gcggcaggcccaggaauggcuggguaggacag

SEQ ID NO: 443476 - RNA, 32 nt, Human
gcggcaggcgcgcggagccagcggagccagcu

SEQ ID NO: 443477 - RNA, 32 nt, Human
gcggcaggcggcaucccagggugauaggcuga

SEQ ID NO: 443478 - RNA, 32 nt, Human
gcggcaggcugaagcuguucuuuugccucuuc

SEQ ID NO: 443479 - RNA, 32 nt, Human
gcggcagggccuggccugccucuccugugcug

SEQ ID NO: 443480 - RNA, 32 nt, Human
gcggcagggggaggaggaccgggagaacacca

SEQ ID NO: 443481 - RNA, 32 nt, Human
gcggcagggucuggaagcaugggggaggggga

SEQ ID NO: 443482 - RNA, 32 nt, Human
gcggcagggucuggggccggcgccugggaggg

SEQ ID NO: 443483 - RNA, 32 nt, Human
gcggcagguucucuuugagucaaaagcuuguc

SEQ ID NO: 443484 - RNA, 32 nt, Human
gcggcagucaucaagaugucauggcaccccca

SEQ ID NO: 443485 - RNA, 32 nt, Human
gcggcauauucagauucagaccucuuugggcu

SEQ ID NO: 443486 - RNA, 32 nt, Human
gcggcauccuucugccuguuucuguaagcaaa

SEQ ID NO: 443487 - RNA, 32 nt, Human
gcggcaucuggcccggccgcuccucgcugcgc

SEQ ID NO: 443488 - RNA, 32 nt, Human
gcggcaugaucacaccucacugcagccucaau

SEQ ID NO: 443489 - RNA, 32 nt, Human
gcggcauugcacuccagccugggcaacaagag

SEQ ID NO: 443490 - RNA, 22 nt, Human
gcggccaacgugggugaucaac

SEQ ID NO: 443491 - RNA, 32 nt, Human
gcggccaaucuccaagcucccugggccgcaac

SEQ ID NO: 443492 - RNA, 32 nt, Human
gcggccaccaccuccuccuccuccuggcccug

SEQ ID NO: 443493 - RNA, 32 nt, Human
gcggccacccgcucuccaggaaaggcacagcu

SEQ ID NO: 443494 - RNA, 20 nt, Human
gcggccaccgccucccggcc

SEQ ID NO: 443495 - RNA, 32 nt, Human
gcggccaccuccaagccaaggagguccuggag

SEQ ID NO: 443496 - RNA, 32 nt, Human
gcggccacgcacuccgccagaaggucgccagg

SEQ ID NO: 443497 - RNA, 32 nt, Human
gcggccagccccggcccugggcucggaggcug

SEQ ID NO: 443498 - RNA, 32 nt, Human
gcggccaggacagcagaggcugaggggccggg

SEQ ID NO: 443499 - RNA, 32 nt, Human
gcggccaggaggugagauggcagcugggcaaa

SEQ ID NO: 443500 - RNA, 32 nt, Human
gcggccaggcagagaaggugcccggagcucag

SEQ ID NO: 443501 - RNA, 32 nt, Human
gcggccaggccugccggucaggaaggccacaa

SEQ ID NO: 443502 - RNA, 32 nt, Human
gcggccaggcggaggcgagggagcagguuaga

SEQ ID NO: 443503 - RNA, 32 nt, Human
gcggccagggcagaaagcggcggcaggagaag

SEQ ID NO: 443504 - RNA, 32 nt, Human
gcggccaggucccugcugaaucacacgccgcc

SEQ ID NO: 443505 - RNA, 32 nt, Human
gcggccagugcuggaugcggggacccagcgca

SEQ ID NO: 443506 - RNA, 32 nt, Human
gcggccagugggcaggaugacgagccagaccc

SEQ ID NO: 443507 - RNA, 32 nt, Human
gcggccaucacugaagcaggagcggccaaaau

SEQ ID NO: 443508 - RNA, 31 nt, Human
gcggccauggcgacgggcggccagcagaagg

SEQ ID NO: 443509 - RNA, 22 nt, Human
gcggcccacuacagggcugcag

SEQ ID NO: 443510 - RNA, 32 nt, Human
gcggcccacugcaauccguggaggaaugugcc

SEQ ID NO: 443511 - RNA, 32 nt, Human
gcggcccagaaguaagccauccauccaugcca

SEQ ID NO: 443512 - RNA, 32 nt, Human
gcggcccagcacucggcacuggccacuugcag

SEQ ID NO: 443513 - RNA, 32 nt, Human
gcggcccagcagaggagcggaaagcauggucc

SEQ ID NO: 443514 - RNA, 22 nt, Human
gcggcccagcccggcccagccc

SEQ ID NO: 443515 - RNA, 32 nt, Human
gcggcccaggacggcggcuaggccguagugca

SEQ ID NO: 443516 - RNA, 32 nt, Human
gcggcccaggcggggugcgaguggcgcagucg

SEQ ID NO: 443517 - RNA, 32 nt, Human
gcggccccaaucccuguccucuccucuccugc

SEQ ID NO: 443518 - RNA, 23 nt, Human
gcggccccacccugcacuggucc

SEQ ID NO: 443519 - RNA, 20 nt, Human
gcggccccaccucaguccgg

SEQ ID NO: 443520 - RNA, 22 nt, Human
gcggccccaggacgcagcagca

SEQ ID NO: 443521 - RNA, 32 nt, Human
gcggccccauccugcugacgucaggccccagg

SEQ ID NO: 443522 - RNA, 18 nt, Human
gcggcccccaccagggca

SEQ ID NO: 443523 - RNA, 24 nt, Human
gcggcccccgaaggugggcguccc

SEQ ID NO: 443524 - RNA, 32 nt, Human
gcggcccccgcagccuagaccucccaggccug

SEQ ID NO: 443525 - RNA, 32 nt, Human
gcggcccccggaugaagagaucugggaacccg

SEQ ID NO: 443526 - RNA, 32 nt, Human
gcggcccccgucgcauacacacuggcacagac

SEQ ID NO: 443527 - RNA, 25 nt, Human
gcggcccccuccagcccccggcucc

SEQ ID NO: 443528 - RNA, 32 nt, Human
gcggcccccuccccucaccucucccccucccc

SEQ ID NO: 443529 - RNA, 32 nt, Human
gcggccccgagccucuuguugcuggacuauga

SEQ ID NO: 443530 - RNA, 32 nt, Human
gcggccccgagugcccugugaaaucagcucag

SEQ ID NO: 443531 - RNA, 32 nt, Human
gcggccccgcggggaggaagagggaaaaggaa

SEQ ID NO: 443532 - RNA, 32 nt, Human
gcggccccggagcggccgcagcgcgguggucu

SEQ ID NO: 443533 - RNA, 23 nt, Human
gcggccccggcuccagcccagcc

SEQ ID NO: 443534 - RNA, 32 nt, Human
gcggccccguggccaccaugucccugcacggc

SEQ ID NO: 443535 - RNA, 32 nt, Human
gcggccccugcaggagaagacagacugcugcu

SEQ ID NO: 443536 - RNA, 32 nt, Human
gcggccccugcagggugggggucuguggcaga

SEQ ID NO: 443537 - RNA, 32 nt, Human
gcggccccugcucuaccuccuagcgccggugc

SEQ ID NO: 443538 - RNA, 32 nt, Human
gcggcccgccccggggaggcaggcuggcaggu

SEQ ID NO: 443539 - RNA, 32 nt, Human
gcggcccgcuggcugcccuucccgccagcgca

SEQ ID NO: 443540 - RNA, 22 nt, Human
gcggcccggcccggcccagcuc

SEQ ID NO: 443541 - RNA, 32 nt, Human
gcggcccggccgccugcggcacugccuuccgu

SEQ ID NO: 443542 - RNA, 32 nt, Human
gcggcccggccuggaugcgcugggcggagggu

SEQ ID NO: 443543 - RNA, 32 nt, Human
gcggcccguguccccuuccuccauccuugcug

SEQ ID NO: 443544 - RNA, 32 nt, Human
gcggcccucucgcucucgcagcaacaagggaa

SEQ ID NO: 443545 - RNA, 32 nt, Human
gcggcccugacacgugauggaccaaagccacc

SEQ ID NO: 443546 - RNA, 25 nt, Human
gcggcccugcccucccgcccagccc

SEQ ID NO: 443547 - RNA, 32 nt, Human
gcggcccugccugggccuucggagccuccugc

SEQ ID NO: 443548 - RNA, 32 nt, Human
gcggcccugccuggugccauugccucagccaa

SEQ ID NO: 443549 - RNA, 32 nt, Human
gcggcccugcgcgggcuguccaggccuccgcc

SEQ ID NO: 443550 - RNA, 32 nt, Human
gcggcccuggaggauguuagacuugcucccuc

SEQ ID NO: 443551 - RNA, 32 nt, Human
gcggcccuggggauggggaaggagcaggagcu

SEQ ID NO: 443552 - RNA, 22 nt, Human
gcggccgagccagcggcggcgg

SEQ ID NO: 443553 - RNA, 32 nt, Human
gcggccgaggaggaggaggaggaggccccgga

SEQ ID NO: 443554 - RNA, 32 nt, Human
gcggccgagggggauggagcgagcgccgagcc

SEQ ID NO: 443555 - RNA, 32 nt, Human
gcggccgaugaggacgguucugagggaacuag

SEQ ID NO: 443556 - RNA, 19 nt, Human
gcggccgcaacgcaacgga

SEQ ID NO: 443557 - RNA, 19 nt, Human
gcggccgcagcaucucgga

SEQ ID NO: 443558 - RNA, 32 nt, Human
gcggccgcagugggguggagggggcagggcgu

SEQ ID NO: 443559 - RNA, 27 nt, Human
gcggccgccagcuaggggcgcgggaag

SEQ ID NO: 443560 - RNA, 32 nt, Human
gcggccgcccccagacccgcagugccaugcgc

SEQ ID NO: 443561 - RNA, 23 nt, Human
gcggccgccgccgccaccgccgc

SEQ ID NO: 443562 - RNA, 32 nt, Human
gcggccgccuucugcuggcuguguccaugcag

SEQ ID NO: 443563 - RNA, 18 nt, Human
gcggccgcgcggcagcug

SEQ ID NO: 443564 - RNA, 32 nt, Human
gcggccgcggaggaggaggaaggggaggaggg

SEQ ID NO: 443565 - RNA, 32 nt, Human
gcggccgcggccacagucaugcucagucgacu

SEQ ID NO: 443566 - RNA, 32 nt, Human
gcggccgcggcuccuguccagacccugacccu

SEQ ID NO: 443567 - RNA, 32 nt, Human
gcggccgcgugcagaggugcaggcagagcagc

SEQ ID NO: 443568 - RNA, 32 nt, Human
gcggccgcguggggcccagcacaaagaccugu

SEQ ID NO: 443569 - RNA, 32 nt, Human
gcggccgcugaauucuagaacccaggugcaac

SEQ ID NO: 443570 - RNA, 32 nt, Human
gcggccgcugaauucuagggaggcgcgccccc

SEQ ID NO: 443571 - RNA, 32 nt, Human
gcggccgcugccugccgggcccucucuucugg

SEQ ID NO: 443572 - RNA, 22 nt, Human
gcggccgcuggcccuggccccg

SEQ ID NO: 443573 - RNA, 32 nt, Human
gcggccggcacuguagauuaacaggaaacuuc

SEQ ID NO: 443574 - RNA, 32 nt, Human
gcggccggcugcaggucggccaggagcuccug

SEQ ID NO: 443575 - RNA, 19 nt, Human
gcggccgggacccccgucc

SEQ ID NO: 443576 - RNA, 32 nt, Human
gcggccgggaggauggccugggcugcgggugg

SEQ ID NO: 443577 - RNA, 32 nt, Human
gcggccggggcugaagggagaggcgcaggagc

SEQ ID NO: 443578 - RNA, 25 nt, Human
gcggccggucggcccggcccagccc

SEQ ID NO: 443579 - RNA, 32 nt, Human
gcggccguggagcccaggcuuugaugucuuuc

SEQ ID NO: 443580 - RNA, 22 nt, Human
gcggccguugcgggcggcgcgg

SEQ ID NO: 443581 - RNA, 32 nt, Human
gcggccucagagagcuuccuccccucggaagg

SEQ ID NO: 443582 - RNA, 32 nt, Human
gcggccucagaugaaugcggcuguuaagaccu

SEQ ID NO: 443583 - RNA, 32 nt, Human
gcggccucaguugaguagugcauuccugaguu

SEQ ID NO: 443584 - RNA, 32 nt, Human
gcggccucccaaagugcugggaucacaggcgc

SEQ ID NO: 443585 - RNA, 21 nt, Human
gcggccuccgcccuggucccg

SEQ ID NO: 443586 - RNA, 32 nt, Human
gcggccuccggaagugcugggauuacaggcgu

SEQ ID NO: 443587 - RNA, 32 nt, Human
gcggccuccugccaccaccaggcucccuaacc

SEQ ID NO: 443588 - RNA, 20 nt, Human
gcggccucggaccccggacc

SEQ ID NO: 443589 - RNA, 32 nt, Human
gcggccucucuaggaagcuguuccuuucuaug

SEQ ID NO: 443590 - RNA, 32 nt, Human
gcggccucugcaggaucugcagcuguggaagg

SEQ ID NO: 443591 - RNA, 32 nt, Human
gcggccucuugugugagggccugugggauucu

SEQ ID NO: 443592 - RNA, 19 nt, Human
gcggccugagcgcccggcc

SEQ ID NO: 443593 - RNA, 32 nt, Human
gcggccugccaccacagcacgcggccuccuga

SEQ ID NO: 443594 - RNA, 19 nt, Human
gcggccuggcaggcaacca

SEQ ID NO: 443595 - RNA, 32 nt, Human
gcggccuggggcugagcauggagcagcgcggc

SEQ ID NO: 443596 - RNA, 32 nt, Human
gcggccuucacucagggucagcgggcaccagg

SEQ ID NO: 443597 - RNA, 32 nt, Human
gcggccuucccaggccccgcuuuugcuuucgg

SEQ ID NO: 443598 - RNA, 32 nt, Human
gcggccuucccaggccccgcuuuugcuuuugg

SEQ ID NO: 443599 - RNA, 32 nt, Human
gcggccuucuuuccuuucugucaaccucucau

SEQ ID NO: 443600 - RNA, 32 nt, Human
gcggccuugccacauauucuggcuccaggcuc

SEQ ID NO: 443601 - RNA, 32 nt, Human
gcggccuuuagaaugaacaugacaucaccuug

SEQ ID NO: 443602 - RNA, 32 nt, Human
gcggccuuucaccucuuccuugauuacucaca

SEQ ID NO: 443603 - RNA, 32 nt, Human
gcggccuuucccgaauggggacagaacccgcu

SEQ ID NO: 443604 - RNA, 24 nt, Human
gcggccuuugcccgaccuuccaca

SEQ ID NO: 443605 - RNA, 32 nt, Human
gcggcgaaacaacaugugucuucuggaacuuc

SEQ ID NO: 443606 - RNA, 32 nt, Human
gcggcgaaaccagccuugucauuucagcauuc

SEQ ID NO: 443607 - RNA, 32 nt, Human
gcggcgaaggaggugguggcugcguugggcuc

SEQ ID NO: 443608 - RNA, 32 nt, Human
gcggcgacaugaaacugcuuacccacaaucug

SEQ ID NO: 443609 - RNA, 32 nt, Human
gcggcgacugggaggggcagcggcagcagugg

SEQ ID NO: 443610 - RNA, 32 nt, Human
gcggcgagagguggccugggaauggccgggcc

SEQ ID NO: 443611 - RNA, 32 nt, Human
gcggcgaggagaaaggaaggagaggagaaaac

SEQ ID NO: 443612 - RNA, 32 nt, Human
gcggcgaggccgcggcgacaagguagccaccc

SEQ ID NO: 443613 - RNA, 32 nt, Human
gcggcgaugaggugguccugaggcagaagccc

SEQ ID NO: 443614 - RNA, 22 nt, Human
gcggcgaugaucuguuugugcg

SEQ ID NO: 443615 - RNA, 31 nt, Human
gcggcgauggagcggaggucgcggaggaagu

SEQ ID NO: 443616 - RNA, 32 nt, Human
gcggcgcacacguguaaucccagcuacucagg

SEQ ID NO: 443617 - RNA, 19 nt, Human
gcggcgcagccccccggcc

SEQ ID NO: 443618 - RNA, 32 nt, Human
gcggcgcagcugcucccgcugccacagccgcc

SEQ ID NO: 443619 - RNA, 32 nt, Human
gcggcgccaagcugagccccuucgcacccgag

SEQ ID NO: 443620 - RNA, 18 nt, Human
gcggcgccagucggugcg

SEQ ID NO: 443621 - RNA, 32 nt, Human
gcggcgccaugcaggucuccagccucaaugag

SEQ ID NO: 443622 - RNA, 32 nt, Human
gcggcgcccgggagcaggugugcaggagcgca

SEQ ID NO: 443623 - RNA, 32 nt, Human
gcggcgcccgggagccgagcuugcagcgaggg

SEQ ID NO: 443624 - RNA, 32 nt, Human
gcggcgcccgggagccggagccuucgcggcgu

SEQ ID NO: 443625 - RNA, 32 nt, Human
gcggcgcccucgggagggagcugcgcgcgggc

SEQ ID NO: 443626 - RNA, 32 nt, Human
gcggcgccgcgcacuccaacccggcgggcacc

SEQ ID NO: 443627 - RNA, 32 nt, Human
gcggcgccggcuccugccgccugggccccggg

SEQ ID NO: 443628 - RNA, 18 nt, Human
gcggcgccuguaauccca

SEQ ID NO: 443629 - RNA, 28 nt, Human
gcggcgccuguaaucccagcuacuuggg

SEQ ID NO: 443630 - RNA, 32 nt, Human
gcggcgccuguaggcuggagggacugugaggu

SEQ ID NO: 443631 - RNA, 19 nt, Human
gcggcgcgaagcccgggug

SEQ ID NO: 443632 - RNA, 32 nt, Human
gcggcgcgaggggcgggcuuucaggcucccgg

SEQ ID NO: 443633 - RNA, 32 nt, Human
gcggcgcgcacaggcaggagguugcaguuggg

SEQ ID NO: 443634 - RNA, 18 nt, Human
gcggcgcgcgcugugcuc

SEQ ID NO: 443635 - RNA, 32 nt, Human
gcggcgcggacagcugagcuucuccuccgucg

SEQ ID NO: 443636 - RNA, 32 nt, Human
gcggcgcggagagacgcagcggagguuuuccu

SEQ ID NO: 443637 - RNA, 32 nt, Human
gcggcgcggcgccggcggcgggugcgcuccga

SEQ ID NO: 443638 - RNA, 32 nt, Human
gcggcgcggcgggaccauggagcucagagcgc

SEQ ID NO: 443639 - RNA, 32 nt, Human
gcggcgcggcggggaagagagacugcggcggg

SEQ ID NO: 443640 - RNA, 32 nt, Human
gcggcgcgggaggcacguuccuuagcuccgcc

SEQ ID NO: 443641 - RNA, 32 nt, Human
gcggcgcggguuccugccucucugggugggug

SEQ ID NO: 443642 - RNA, 32 nt, Human
gcggcgcgugcgucugugccucugcgcggguc

SEQ ID NO: 443643 - RNA, 32 nt, Human
gcggcgcucgguuucccgccuccuagggaagg

SEQ ID NO: 443644 - RNA, 32 nt, Human
gcggcgcucucagaccgagagcugcccuugcc

SEQ ID NO: 443645 - RNA, 32 nt, Human
gcggcgcugacauuggacaggugguggacgag

SEQ ID NO: 443646 - RNA, 32 nt, Human
gcggcgcugcacucuagccugggugacagagu

SEQ ID NO: 443647 - RNA, 32 nt, Human
gcggcgcugccgcggcagcggcgggccccuca

SEQ ID NO: 443648 - RNA, 32 nt, Human
gcggcgcugcgcucggccaggccggcaccaug

SEQ ID NO: 443649 - RNA, 32 nt, Human
gcggcgcugggaaaggaggagauugggaggcu

SEQ ID NO: 443650 - RNA, 32 nt, Human
gcggcgcuggggccagaggggccaggcgggag

SEQ ID NO: 443651 - RNA, 32 nt, Human
gcggcgcuuugugcuccagucgcuccuaacgc

SEQ ID NO: 443652 - RNA, 32 nt, Human
gcggcggaaccucccuccccagcucugagcac

SEQ ID NO: 443653 - RNA, 32 nt, Human
gcggcggacgcgcggcucccaccccuccccuc

SEQ ID NO: 443654 - RNA, 32 nt, Human
gcggcggagaggacgagaccgggacaagacca

SEQ ID NO: 443655 - RNA, 32 nt, Human
gcggcggagaggggacugcggucagcugcguc

SEQ ID NO: 443656 - RNA, 32 nt, Human
gcggcggagaggggcccacggcggcggcccgg

SEQ ID NO: 443657 - RNA, 32 nt, Human
gcggcggagauggaggagggaggccgggacaa

SEQ ID NO: 443658 - RNA, 32 nt, Human
gcggcggagcgagcgcgcuccgggagggccga

SEQ ID NO: 443659 - RNA, 32 nt, Human
gcggcggagcugggaccuaccugccugagucc

SEQ ID NO: 443660 - RNA, 32 nt, Human
gcggcggaggaggaggaggagcgggaggagcg

SEQ ID NO: 443661 - RNA, 32 nt, Human
gcggcggaggcagaggaagagggagcgggagc

SEQ ID NO: 443662 - RNA, 32 nt, Human
gcggcggagggcggaggagacucgcuugcacc

SEQ ID NO: 443663 - RNA, 32 nt, Human
gcggcggaggggcauugcacuuccgggaaguc

SEQ ID NO: 443664 - RNA, 32 nt, Human
gcggcggaucuccuccuccuuuccagcaguga

SEQ ID NO: 443665 - RNA, 32 nt, Human
gcggcggcaagggacagcaggagcaguggugc

SEQ ID NO: 443666 - RNA, 32 nt, Human
gcggcggcagaggcucccuacacaaaagcauu

SEQ ID NO: 443667 - RNA, 32 nt, Human
gcggcggcagccugccuugcucugccaggaac

SEQ ID NO: 443668 - RNA, 32 nt, Human
gcggcggcaggagagguuguggugcuaguuuc

SEQ ID NO: 443669 - RNA, 32 nt, Human
gcggcggcagggcggggccggagcagcgggcg

SEQ ID NO: 443670 - RNA, 32 nt, Human
gcggcggcaguggcggucccacuggcaggcgg

SEQ ID NO: 443671 - RNA, 32 nt, Human
gcggcggccagaggaaccccgagucccggccc

SEQ ID NO: 443672 - RNA, 19 nt, Human
gcggcggccagcggcgcgg

SEQ ID NO: 443673 - RNA, 32 nt, Human
gcggcggccagggaggugcggagcagccucgg

SEQ ID NO: 443674 - RNA, 20 nt, Human
gcggcggcccagcgaaggag

SEQ ID NO: 443675 - RNA, 17 nt, Human
gcggcggccgcgaggag

SEQ ID NO: 443676 - RNA, 32 nt, Human
gcggcggccgcuccucuaguuccacaaugucc

SEQ ID NO: 443677 - RNA, 32 nt, Human
gcggcggcgcuuggcagccaggagcucugcau

SEQ ID NO: 443678 - RNA, 27 nt, Human
gcggcggcggaggcgcccggucccggc

SEQ ID NO: 443679 - RNA, 32 nt, Human
gcggcggcggcgcaggcucagagcagaccccg

SEQ ID NO: 443680 - RNA, 18 nt, Human
gcggcggcggcggcgcgg

SEQ ID NO: 443681 - RNA, 32 nt, Human
gcggcggcggcggucgaggagcucccauggca

SEQ ID NO: 443682 - RNA, 32 nt, Human
gcggcggcgggcaguugcaguggugcagaaug

SEQ ID NO: 443683 - RNA, 32 nt, Human
gcggcggcgggcggaggcugggccggaggggu

SEQ ID NO: 443684 - RNA, 32 nt, Human
gcggcggcgggugggaaauggcggaguaucug

SEQ ID NO: 443685 - RNA, 32 nt, Human
gcggcggcggugagaagagcgaggcggaggag

SEQ ID NO: 443686 - RNA, 32 nt, Human
gcggcggcgguuccagcaugaagaggagagcu

SEQ ID NO: 443687 - RNA, 21 nt, Human
gcggcggcgucggccggaucg

SEQ ID NO: 443688 - RNA, 22 nt, Human
gcggcggcucaugccuguaauc

SEQ ID NO: 443689 - RNA, 32 nt, Human
gcggcggcucgggagagagggacgcgggcugc

SEQ ID NO: 443690 - RNA, 32 nt, Human
gcggcggcugacucgccuucucuccggggcug

SEQ ID NO: 443691 - RNA, 20 nt, Human
gcggcggcugccagucugug

SEQ ID NO: 443692 - RNA, 32 nt, Human
gcggcggcugcccuccucacacucggcuccgc

SEQ ID NO: 443693 - RNA, 32 nt, Human
gcggcggcugcggcucgggagcgcggcugcuu

SEQ ID NO: 443694 - RNA, 32 nt, Human
gcggcggcugcggcuucucugggcgccugggc

SEQ ID NO: 443695 - RNA, 32 nt, Human
gcggcggcugggaacgccgcuccccgacgcac

SEQ ID NO: 443696 - RNA, 32 nt, Human
gcggcgggacagugccagugggcguguggggc

SEQ ID NO: 443697 - RNA, 32 nt, Human
gcggcgggagagagcccugagaccagugcacc

SEQ ID NO: 443698 - RNA, 32 nt, Human
gcggcgggagagaggaggaggcggcggcgggg

SEQ ID NO: 443699 - RNA, 32 nt, Human
gcggcgggagcagcauggauuggggcacugag

SEQ ID NO: 443700 - RNA, 32 nt, Human
gcggcgggagcugcugccugcccaggcccgcc

SEQ ID NO: 443701 - RNA, 32 nt, Human
gcggcgggaggaagaacgcuucccaaccagcc

SEQ ID NO: 443702 - RNA, 20 nt, Human
gcggcgggaggcgggcgcgg

SEQ ID NO: 443703 - RNA, 32 nt, Human
gcggcgggagguaaggcauggccaggccggcu

SEQ ID NO: 443704 - RNA, 32 nt, Human
gcggcgggcaggcggcgggcgcggcgggcgag

SEQ ID NO: 443705 - RNA, 22 nt, Human
gcggcgggccccagucugagcg

SEQ ID NO: 443706 - RNA, 21 nt, Human
gcggcgggccgccuuugccca

SEQ ID NO: 443707 - RNA, 32 nt, Human
gcggcgggcugcuccugucacccagcggcggc

SEQ ID NO: 443708 - RNA, 32 nt, Human
gcggcggggaaggaggaggagggggagagucg

SEQ ID NO: 443709 - RNA, 32 nt, Human
gcggcggggaggcagcaggcgcgggagcgggc

SEQ ID NO: 443710 - RNA, 32 nt, Human
gcggcggggagugggagccggcccggcucagu

SEQ ID NO: 443711 - RNA, 32 nt, Human
gcggcggggccagaggcucagcggcucccagg

SEQ ID NO: 443712 - RNA, 32 nt, Human
gcggcgggggaaggaugcaggggaagaagccg

SEQ ID NO: 443713 - RNA, 20 nt, Human
gcggcgggggcacccggcgu

SEQ ID NO: 443714 - RNA, 32 nt, Human
gcggcggggucgcgggacaggagaagcggagg

SEQ ID NO: 443715 - RNA, 22 nt, Human
gcggcggggucggguccgcgcg

SEQ ID NO: 443716 - RNA, 32 nt, Human
gcggcggggucugagcccaagucggaagccgc

SEQ ID NO: 443717 - RNA, 32 nt, Human
gcggcggugcgugcuggcgccggagaguuccg

SEQ ID NO: 443718 - RNA, 32 nt, Human
gcggcggugcuaggcucgccucugccucccuc

SEQ ID NO: 443719 - RNA, 32 nt, Human
gcggcggugcuggagguugcggcggcggcugc

SEQ ID NO: 443720 - RNA, 32 nt, Human
gcggcgguggacugcgcuggacgauagcuugg

SEQ ID NO: 443721 - RNA, 32 nt, Human
gcggcguagggaggccggggccggggcugagg

SEQ ID NO: 443722 - RNA, 32 nt, Human
gcggcgucagccacacugaugguggggcucac

SEQ ID NO: 443723 - RNA, 32 nt, Human
gcggcguccgggaggcggcggagacgcggggc

SEQ ID NO: 443724 - RNA, 32 nt, Human
gcggcgucgggagcguucugcccagccggccc

SEQ ID NO: 443725 - RNA, 32 nt, Human
gcggcgucucgaggcgaguuggcggagcugug

SEQ ID NO: 443726 - RNA, 32 nt, Human
gcggcgucugcagcucgcuucaagauggccgc

SEQ ID NO: 443727 - RNA, 22 nt, Human
gcggcgugacguuggcugugcg

SEQ ID NO: 443728 - RNA, 32 nt, Human
gcggcgugaguugcauguugugugaggauccc

SEQ ID NO: 443729 - RNA, 19 nt, Human
gcggcgugaugcgcgcgga

SEQ ID NO: 443730 - RNA, 20 nt, Human
gcggcguggcguccgcucug

SEQ ID NO: 443731 - RNA, 32 nt, Human
gcggcgugggaggcugggccgcagugaguggg

SEQ ID NO: 443732 - RNA, 21 nt, Human
gcggcgugggcccgucgcgcg

SEQ ID NO: 443733 - RNA, 32 nt, Human
gcggcguuggccagggcagccgcggcgggcag

SEQ ID NO: 443734 - RNA, 32 nt, Human
gcggcuacauggugacuccaguacggggacau

SEQ ID NO: 443735 - RNA, 32 nt, Human
gcggcuacgggagaagucuuaguagcuuguau

SEQ ID NO: 443736 - RNA, 32 nt, Human
gcggcuacuuuaaaaugcuucuuucucagaau

SEQ ID NO: 443737 - RNA, 32 nt, Human
gcggcuagacgccgaguccgacuugcagcugg

SEQ ID NO: 443738 - RNA, 32 nt, Human
gcggcuagagcaucaccucuucacgcaagugu

SEQ ID NO: 443739 - RNA, 32 nt, Human
gcggcuagcagggagaggggcggagaggcagc

SEQ ID NO: 443740 - RNA, 32 nt, Human
gcggcuaguuuuucuuucuguuuccaggugaa

SEQ ID NO: 443741 - RNA, 32 nt, Human
gcggcuauaggaaaacagccuguugcauggua

SEQ ID NO: 443742 - RNA, 18 nt, Human
gcggcucacagcgagggg

SEQ ID NO: 443743 - RNA, 32 nt, Human
gcggcucacccaggccugccauggguccuuag

SEQ ID NO: 443744 - RNA, 32 nt, Human
gcggcucacuacaaccucugccucaagcgauc

SEQ ID NO: 443745 - RNA, 19 nt, Human
gcggcucacuccuguaauc

SEQ ID NO: 443746 - RNA, 32 nt, Human
gcggcucacugcaaccuccaccucccagguuc

SEQ ID NO: 443747 - RNA, 32 nt, Human
gcggcucacugcaaccuccaccucccgggcuc

SEQ ID NO: 443748 - RNA, 32 nt, Human
gcggcucacugcaaccuggaacuccugggcuc

SEQ ID NO: 443749 - RNA, 32 nt, Human
gcggcucacugcagccuccauccucuggguuc

SEQ ID NO: 443750 - RNA, 32 nt, Human
gcggcucagccaugagcaacaggaguagcuuu

SEQ ID NO: 443751 - RNA, 32 nt, Human
gcggcucaggggaaacgaggcugcaguggugg

SEQ ID NO: 443752 - RNA, 32 nt, Human
gcggcucaguucagcagagcuggaguugaaca

SEQ ID NO: 443753 - RNA, 23 nt, Human
gcggcuccacccgacccagaccc

SEQ ID NO: 443754 - RNA, 24 nt, Human
gcggcuccacuacagacccagccc

SEQ ID NO: 443755 - RNA, 32 nt, Human
gcggcuccagggccauggcggaggagcagggc

SEQ ID NO: 443756 - RNA, 32 nt, Human
gcggcuccaggugggaggaaggcgggcgaagg

SEQ ID NO: 443757 - RNA, 24 nt, Human
gcggcucccagcucugccaggccc

SEQ ID NO: 443758 - RNA, 22 nt, Human
gcggcucccagggccuccagcc

SEQ ID NO: 443759 - RNA, 23 nt, Human
gcggcucccagggccucccgccc

SEQ ID NO: 443760 - RNA, 32 nt, Human
gcggcucccccuccucuuacuccgcguccucu

SEQ ID NO: 443761 - RNA, 22 nt, Human
gcggcucccgaggguccaggcc

SEQ ID NO: 443762 - RNA, 22 nt, Human
gcggcucccggggcccagcacc

SEQ ID NO: 443763 - RNA, 23 nt, Human
gcggcucccgggguccccagcuc

SEQ ID NO: 443764 - RNA, 23 nt, Human
gcggcucccgggugucccaggcc

SEQ ID NO: 443765 - RNA, 22 nt, Human
gcggcucccgguaucccgaccc

SEQ ID NO: 443766 - RNA, 32 nt, Human
gcggcucccucaccugccggcuuguuccucgg

SEQ ID NO: 443767 - RNA, 20 nt, Human
gcggcucccucccugcgcag

SEQ ID NO: 443768 - RNA, 32 nt, Human
gcggcucccuuucagcagcugcgggagcaugc

SEQ ID NO: 443769 - RNA, 32 nt, Human
gcggcuccggccagggccgggccgggggccgg

SEQ ID NO: 443770 - RNA, 32 nt, Human
gcggcuccuaucucuuggugauccccuucccc

SEQ ID NO: 443771 - RNA, 32 nt, Human
gcggcuccugcaggaggccacugucugcagcu

SEQ ID NO: 443772 - RNA, 32 nt, Human
gcggcuccugcucuuccuggacuccugagcag

SEQ ID NO: 443773 - RNA, 32 nt, Human
gcggcuccuuagggcagaacagcugcaugugg

SEQ ID NO: 443774 - RNA, 32 nt, Human
gcggcucggugacuugauacuuggggcagccc

SEQ ID NO: 443775 - RNA, 32 nt, Human
gcggcucgguggucgagccagggaggaggcgg

SEQ ID NO: 443776 - RNA, 19 nt, Human
gcggcucucgccuguaauc

SEQ ID NO: 443777 - RNA, 32 nt, Human
gcggcucugaagccugagcgggggccgggggc

SEQ ID NO: 443778 - RNA, 32 nt, Human
gcggcucugccgcggcggcagcauggguggcc

SEQ ID NO: 443779 - RNA, 32 nt, Human
gcggcucuggacugcagccucccaaggcucca

SEQ ID NO: 443780 - RNA, 22 nt, Human
gcggcucuggagccgcccggcc

SEQ ID NO: 443781 - RNA, 32 nt, Human
gcggcucugguuccuccagccaccucaguccc

SEQ ID NO: 443782 - RNA, 32 nt, Human
gcggcucuuccuggacagugagagcagggcug

SEQ ID NO: 443783 - RNA, 32 nt, Human
gcggcucuuccuggacagugagagcagggcuu

SEQ ID NO: 443784 - RNA, 19 nt, Human
gcggcucuugccuguaauc

SEQ ID NO: 443785 - RNA, 32 nt, Human
gcggcugaaggaggggcugagccucaggaccc

SEQ ID NO: 443786 - RNA, 32 nt, Human
gcggcugacacacacguucaagcccaggacug

SEQ ID NO: 443787 - RNA, 32 nt, Human
gcggcugagaguggagccuuucaggcuggcau

SEQ ID NO: 443788 - RNA, 21 nt, Human
gcggcugaggaaagcaggagg

SEQ ID NO: 443789 - RNA, 32 nt, Human
gcggcugaggacggggcagagcugagucggcu

SEQ ID NO: 443790 - RNA, 32 nt, Human
gcggcugaggaggcgggaaggcggcagugguu

SEQ ID NO: 443791 - RNA, 32 nt, Human
gcggcugagguggguguaucaccugaaguccg

SEQ ID NO: 443792 - RNA, 32 nt, Human
gcggcugauauccugaucuugccccuccagag

SEQ ID NO: 443793 - RNA, 32 nt, Human
gcggcugcaagaggaggccggaggcgagcgcg

SEQ ID NO: 443794 - RNA, 32 nt, Human
gcggcugcacccugccccauccugccgggauc

SEQ ID NO: 443795 - RNA, 32 nt, Human
gcggcugcagaggcagugcccgcagacaaugg

SEQ ID NO: 443796 - RNA, 32 nt, Human
gcggcugcagccgccgccgccgggaaggagag

SEQ ID NO: 443797 - RNA, 19 nt, Human
gcggcugcagcgcgggcgg

SEQ ID NO: 443798 - RNA, 19 nt, Human
gcggcugcagcugccgcgg

SEQ ID NO: 443799 - RNA, 32 nt, Human
gcggcugcagugaacaagaucgcgccacugca

SEQ ID NO: 443800 - RNA, 32 nt, Human
gcggcugcagugagcugugauugcaccacugc

SEQ ID NO: 443801 - RNA, 32 nt, Human
gcggcugcauuuucagugcccugcaggaaugg

SEQ ID NO: 443802 - RNA, 32 nt, Human
gcggcugccagccugccccacuggugugugcc

SEQ ID NO: 443803 - RNA, 32 nt, Human
gcggcugccccagcuacgcugggaggaggccg

SEQ ID NO: 443804 - RNA, 19 nt, Human
gcggcugccgccgcagcgu

SEQ ID NO: 443805 - RNA, 18 nt, Human
gcggcugccgcucggcgc

SEQ ID NO: 443806 - RNA, 23 nt, Human
gcggcugccgggacucggcgcgg

SEQ ID NO: 443807 - RNA, 32 nt, Human
gcggcugccugggcuggggcucgcuccagggc

SEQ ID NO: 443808 - RNA, 32 nt, Human
gcggcugcgagaggagggcgggcgggaggcua

SEQ ID NO: 443809 - RNA, 32 nt, Human
gcggcugcgaguggagaaccagcagcugagca

SEQ ID NO: 443810 - RNA, 32 nt, Human
gcggcugcggcggcggagcuccuccgaggucc

SEQ ID NO: 443811 - RNA, 32 nt, Human
gcggcugcggcuccugcaccuccccggggagc

SEQ ID NO: 443812 - RNA, 32 nt, Human
gcggcugcgggguuccuggugcugaggacgga

SEQ ID NO: 443813 - RNA, 32 nt, Human
gcggcugcgugagacuccggcuccaggcguuc

SEQ ID NO: 443814 - RNA, 32 nt, Human
gcggcugcugcccucccucuucugccuccccu

SEQ ID NO: 443815 - RNA, 32 nt, Human
gcggcuggaagagagugugguguguggacggg

SEQ ID NO: 443816 - RNA, 32 nt, Human
gcggcuggacaagggcugcaagcacaacagcu

SEQ ID NO: 443817 - RNA, 32 nt, Human
gcggcuggagaaagaugcaguccucaggaagg

SEQ ID NO: 443818 - RNA, 32 nt, Human
gcggcuggagcagcaagggagucagggccagg

SEQ ID NO: 443819 - RNA, 32 nt, Human
gcggcuggaggcggaggcaacggcggcuggag

SEQ ID NO: 443820 - RNA, 32 nt, Human
gcggcuggaucugucuuugacuuacauggggc

SEQ ID NO: 443821 - RNA, 32 nt, Human
gcggcuggcaggcaggauguuuugaaauggug

SEQ ID NO: 443822 - RNA, 32 nt, Human
gcggcuggccuuggugacagaugcagacagug

SEQ ID NO: 443823 - RNA, 32 nt, Human
gcggcuggcgaagaaggaaagaggguacucuc

SEQ ID NO: 443824 - RNA, 32 nt, Human
gcggcugggaccccguuucauccauccaugcu

SEQ ID NO: 443825 - RNA, 32 nt, Human
gcggcugggagagguugugccacccgggacca

SEQ ID NO: 443826 - RNA, 32 nt, Human
gcggcugggcagggcggcguggggcuucgcug

SEQ ID NO: 443827 - RNA, 32 nt, Human
gcggcugggcuggaggucaaggaugcauucca

SEQ ID NO: 443828 - RNA, 19 nt, Human
gcggcuggggcccgcgcgg

SEQ ID NO: 443829 - RNA, 32 nt, Human
gcggcuggucugcgcuccugugcauugccuug

SEQ ID NO: 443830 - RNA, 32 nt, Human
gcggcugguggaggcgggccauaggcaaugag

SEQ ID NO: 443831 - RNA, 32 nt, Human
gcggcuggugucugagcugauugccugugaac

SEQ ID NO: 443832 - RNA, 32 nt, Human
gcggcugugauccaggcuggggcgagaccaug

SEQ ID NO: 443833 - RNA, 32 nt, Human
gcggcuguucuaccccucccccuccccgcggu

SEQ ID NO: 443834 - RNA, 32 nt, Human
gcggcuucagaucuccaaucccugccaccacc

SEQ ID NO: 443835 - RNA, 32 nt, Human
gcggcuucagcacugcagccacgacccgccug

SEQ ID NO: 443836 - RNA, 32 nt, Human
gcggcuucagggagcacagggugcaggagcgg

SEQ ID NO: 443837 - RNA, 28 nt, Human
gcggcuuccggugcugccugcgucaucu

SEQ ID NO: 443838 - RNA, 32 nt, Human
gcggcuucucagagcacaacagcuccagcugg

SEQ ID NO: 443839 - RNA, 32 nt, Human
gcggcuucucugagaaacccuaucgaagggga

SEQ ID NO: 443840 - RNA, 32 nt, Human
gcggcuucuggcuucucuguggagcuugguuc

SEQ ID NO: 443841 - RNA, 32 nt, Human
gcggcuucuuucuuuccgugccgauagcgcuc

SEQ ID NO: 443842 - RNA, 32 nt, Human
gcggcuugguucaccuggaggcuggugugggg

SEQ ID NO: 443843 - RNA, 32 nt, Human
gcggcuugucccaggcugcugggcuguggucu

SEQ ID NO: 443844 - RNA, 32 nt, Human
gcggcuuuaucauuccuuuccaguucauaaac

SEQ ID NO: 443845 - RNA, 18 nt, Human
gcggcuuugugcaggcgg

SEQ ID NO: 443846 - RNA, 32 nt, Human
gcggcuuuuggcggccuuucugcuccucgcgg

SEQ ID NO: 443847 - RNA, 32 nt, Human
gcgggaaacugaagccauuacucuccaaaccc

SEQ ID NO: 443848 - RNA, 20 nt, Human
gcgggaaagaagccagcaga

SEQ ID NO: 443849 - RNA, 32 nt, Human
gcgggaaccagcacaaaguguuggcaucgccc

SEQ ID NO: 443850 - RNA, 32 nt, Human
gcgggaacccaggaggcagagguugcagugag

SEQ ID NO: 443851 - RNA, 32 nt, Human
gcgggaaccuggucccagcuugaguuccugcc

SEQ ID NO: 443852 - RNA, 19 nt, Human
gcgggaacggggcggggug

SEQ ID NO: 443853 - RNA, 32 nt, Human
gcgggaacucagcuucaaccucgaugucuuca

SEQ ID NO: 443854 - RNA, 32 nt, Human
gcgggaacucaggaaaaugaaggaggcuggcg

SEQ ID NO: 443855 - RNA, 32 nt, Human
gcgggaacugaggcacagagggguuaaguaac

SEQ ID NO: 443856 - RNA, 32 nt, Human
gcgggaagagcagggagaggagguggacucau

SEQ ID NO: 443857 - RNA, 32 nt, Human
gcgggaagagggcucggagcugccuuccugcu

SEQ ID NO: 443858 - RNA, 32 nt, Human
gcgggaagcagggacaguggagagggcgcugc

SEQ ID NO: 443859 - RNA, 32 nt, Human
gcgggaagcaggugcccaggagagaggggaua

SEQ ID NO: 443860 - RNA, 32 nt, Human
gcgggaagcgaagaggcgggcgggccagcgag

SEQ ID NO: 443861 - RNA, 32 nt, Human
gcgggaaggaaaaugagugagucuuugguugu

SEQ ID NO: 443862 - RNA, 32 nt, Human
gcgggaaggacuuccucuuuacacccacagag

SEQ ID NO: 443863 - RNA, 32 nt, Human
gcgggaaggcggggcucggaugcaaucgggac

SEQ ID NO: 443864 - RNA, 32 nt, Human
gcgggaaggcugucccggcgccucaggcagcu

SEQ ID NO: 443865 - RNA, 32 nt, Human
gcgggaagugauucuagugagguggagagaga

SEQ ID NO: 443866 - RNA, 32 nt, Human
gcgggacagccaagcaccuccaaccaaauaag

SEQ ID NO: 443867 - RNA, 32 nt, Human
gcgggacagcgacauggccggccacacgcagc

SEQ ID NO: 443868 - RNA, 32 nt, Human
gcgggacaguuauguuuccuugccccgucgca

SEQ ID NO: 443869 - RNA, 32 nt, Human
gcgggacaugcacacaaugugaaacagacaaa

SEQ ID NO: 443870 - RNA, 32 nt, Human
gcgggaccagagggagggaggcugcggacgag

SEQ ID NO: 443871 - RNA, 32 nt, Human
gcgggaccaggaggaggaggaggaggaggagg

SEQ ID NO: 443872 - RNA, 32 nt, Human
gcgggaccccuccacuuauugcggaaugagcc

SEQ ID NO: 443873 - RNA, 32 nt, Human
gcgggacccgagacggaggcgcggggccgggg

SEQ ID NO: 443874 - RNA, 23 nt, Human
gcgggacccgccagcuucagcga

SEQ ID NO: 443875 - RNA, 32 nt, Human
gcgggaccucaagggcucacugcggcuaagug

SEQ ID NO: 443876 - RNA, 21 nt, Human
gcgggacgcaaggccagcaga

SEQ ID NO: 443877 - RNA, 32 nt, Human
gcgggacgggacuggcccugcccagccaugaa

SEQ ID NO: 443878 - RNA, 31 nt, Human
gcgggacugaggcugccucacguguugcaag

SEQ ID NO: 443879 - RNA, 18 nt, Human
gcgggacuuaggcagcuc

SEQ ID NO: 443880 - RNA, 32 nt, Human
gcgggagaaagcaccagcagguucugagcccu

SEQ ID NO: 443881 - RNA, 32 nt, Human
gcgggagaaccagcagcaggaacggcuccugc

SEQ ID NO: 443882 - RNA, 32 nt, Human
gcgggagaaucacuugaacccaggagguggag

SEQ ID NO: 443883 - RNA, 19 nt, Human
gcgggagaaucgcuugaac

SEQ ID NO: 443884 - RNA, 19 nt, Human
gcgggagaauugcuugaac

SEQ ID NO: 443885 - RNA, 32 nt, Human
gcgggagagaggaagagaggggagcgcggugg

SEQ ID NO: 443886 - RNA, 32 nt, Human
gcgggagagaggaggaggcggcggcggggcag

SEQ ID NO: 443887 - RNA, 32 nt, Human
gcgggagagcuaggagagccagcuggagucug

SEQ ID NO: 443888 - RNA, 24 nt, Human
gcgggagaggcgcaguggcugcag

SEQ ID NO: 443889 - RNA, 32 nt, Human
gcgggagauucaaaccuggaagaaggaggaac

SEQ ID NO: 443890 - RNA, 32 nt, Human
gcgggagcagcccagggccagagagggagccc

SEQ ID NO: 443891 - RNA, 32 nt, Human
gcgggagcaugcuggggcucugggggcagcgg

SEQ ID NO: 443892 - RNA, 32 nt, Human
gcgggagccacggaccaagaccagccacaucc

SEQ ID NO: 443893 - RNA, 16 nt, Human
gcgggagccagcgcag

SEQ ID NO: 443894 - RNA, 18 nt, Human
gcgggagcccccuuggca

SEQ ID NO: 443895 - RNA, 21 nt, Human
gcgggagcccugaggcugcgg

SEQ ID NO: 443896 - RNA, 31 nt, Human
gcgggagccgcacagucgaggagggagcgcg

SEQ ID NO: 443897 - RNA, 32 nt, Human
gcgggagcggggaaucugggauucagaacucu

SEQ ID NO: 443898 - RNA, 18 nt, Human
gcgggagcggggcugcag

SEQ ID NO: 443899 - RNA, 19 nt, Human
gcgggagcuacggcugcgg

SEQ ID NO: 443900 - RNA, 32 nt, Human
gcgggagcugagcgcaggggaggcaggcggag

SEQ ID NO: 443901 - RNA, 20 nt, Human
gcgggagcugcgggcugcgg

SEQ ID NO: 443902 - RNA, 22 nt, Human
gcgggagcuggagaggcugcgg

SEQ ID NO: 443903 - RNA, 32 nt, Human
gcgggagcuggagcggggcccuccgggguauc

SEQ ID NO: 443904 - RNA, 32 nt, Human
gcgggagcugugcagcuccuuaucauggggac

SEQ ID NO: 443905 - RNA, 32 nt, Human
gcgggaggaagaggaggaggaggaggaggcug

SEQ ID NO: 443906 - RNA, 32 nt, Human
gcgggaggacucagagucagggacacagcagc

SEQ ID NO: 443907 - RNA, 32 nt, Human
gcgggaggagagaagggacagcucugggaggc

SEQ ID NO: 443908 - RNA, 18 nt, Human
gcgggaggagcgggcugc

SEQ ID NO: 443909 - RNA, 32 nt, Human
gcgggaggaggcacaucacauagcaagagugg

SEQ ID NO: 443910 - RNA, 32 nt, Human
gcgggaggaggcggcggcggcggcuagcgagg

SEQ ID NO: 443911 - RNA, 21 nt, Human
gcgggaggaucgaccgacaga

SEQ ID NO: 443912 - RNA, 32 nt, Human
gcgggaggaucucuugagcccaggaguucgag

SEQ ID NO: 443913 - RNA, 19 nt, Human
gcgggaggcagaccagcag

SEQ ID NO: 443914 - RNA, 22 nt, Human
gcgggaggcagguuccgcacga

SEQ ID NO: 443915 - RNA, 32 nt, Human
gcgggaggcgacauggagacaggggcggccga

SEQ ID NO: 443916 - RNA, 20 nt, Human
gcgggaggcggcagccgcag

SEQ ID NO: 443917 - RNA, 18 nt, Human
gcgggaggcggugguaga

SEQ ID NO: 443918 - RNA, 32 nt, Human
gcgggagggaagggcggcacuggagagauggg

SEQ ID NO: 443919 - RNA, 32 nt, Human
gcgggagggaggcgggagucgggggaagacgc

SEQ ID NO: 443920 - RNA, 32 nt, Human
gcgggagggcgcagcgcugggccucgugucgc

SEQ ID NO: 443921 - RNA, 24 nt, Human
gcgggagggcguccggucugcacg

SEQ ID NO: 443922 - RNA, 32 nt, Human
gcgggaggggaggcuccucuccaugguccaga

SEQ ID NO: 443923 - RNA, 32 nt, Human
gcgggaggggcgcgagcgggcuggccgaggag

SEQ ID NO: 443924 - RNA, 32 nt, Human
gcgggagggggagggggagugggcgggcagug

SEQ ID NO: 443925 - RNA, 32 nt, Human
gcgggagggggucgagaaagaggaacgaggag

SEQ ID NO: 443926 - RNA, 23 nt, Human
gcgggagggguggaggcugcggg

SEQ ID NO: 443927 - RNA, 32 nt, Human
gcgggagggugagggcaagaggacugaugguu

SEQ ID NO: 443928 - RNA, 32 nt, Human
gcgggagggugcaccugucccgggcgccgugg

SEQ ID NO: 443929 - RNA, 32 nt, Human
gcgggaggguugcuugagcucaggaguuugag

SEQ ID NO: 443930 - RNA, 32 nt, Human
gcgggaggugccucuuuagaaaccacgaagug

SEQ ID NO: 443931 - RNA, 23 nt, Human
gcgggaggugggaugugagacag

SEQ ID NO: 443932 - RNA, 21 nt, Human
gcgggagguggguggcugcgg

SEQ ID NO: 443933 - RNA, 32 nt, Human
gcgggaggugucgcggggagccuggugcccuu

SEQ ID NO: 443934 - RNA, 32 nt, Human
gcgggaguacgcgagagcagggauggggcagc

SEQ ID NO: 443935 - RNA, 32 nt, Human
gcgggaguagacucugcuuccuccagccacac

SEQ ID NO: 443936 - RNA, 32 nt, Human
gcgggagugauguggaggucgcccugggagcc

SEQ ID NO: 443937 - RNA, 32 nt, Human
gcgggaguuccagagagaggacauagcucuga

SEQ ID NO: 443938 - RNA, 32 nt, Human
gcgggauccaaacuuccggugccugcagagcu

SEQ ID NO: 443939 - RNA, 32 nt, Human
gcgggauccagaaacaugucgaccacacuucu

SEQ ID NO: 443940 - RNA, 32 nt, Human
gcgggauccgcgggggcagcccggccgggcgg

SEQ ID NO: 443941 - RNA, 32 nt, Human
gcgggauccggugggagccggagucccgccga

SEQ ID NO: 443942 - RNA, 32 nt, Human
gcgggaugcggcggggcggcagccugagcgcc

SEQ ID NO: 443943 - RNA, 32 nt, Human
gcgggaugcgggagcaggcaaagggaaagcga

SEQ ID NO: 443944 - RNA, 32 nt, Human
gcgggauggaggaggaugcaggaagaggaguc

SEQ ID NO: 443945 - RNA, 32 nt, Human
gcgggaugggccaccgccgaauuuguaccccc

SEQ ID NO: 443946 - RNA, 32 nt, Human
gcgggaugguauagccgggccugagggcgggc

SEQ ID NO: 443947 - RNA, 22 nt, Human
gcgggcaaaucaccugagguca

SEQ ID NO: 443948 - RNA, 23 nt, Human
gcgggcaaaucaccugaggucag

SEQ ID NO: 443949 - RNA, 32 nt, Human
gcgggcaagccuggcagggcagagggagcccc

SEQ ID NO: 443950 - RNA, 32 nt, Human
gcgggcaagcuccggggucucuggguggagag

SEQ ID NO: 443951 - RNA, 22 nt, Human
gcgggcaaggacagcuccgcga

SEQ ID NO: 443952 - RNA, 32 nt, Human
gcgggcacagcccagagcucuggggcggugca

SEQ ID NO: 443953 - RNA, 32 nt, Human
gcgggcacagcccuuucucaggguuggacccc

SEQ ID NO: 443954 - RNA, 32 nt, Human
gcgggcaccauggugcugucggugccugugau

SEQ ID NO: 443955 - RNA, 32 nt, Human
gcgggcacccggaaacaugcaggggagggugc

SEQ ID NO: 443956 - RNA, 32 nt, Human
gcgggcaccucgggggcgggcgcggggcgcag

SEQ ID NO: 443957 - RNA, 19 nt, Human
gcgggcaccuguaguccca

SEQ ID NO: 443958 - RNA, 32 nt, Human
gcgggcacuuguagucccagcuacucaggagg

SEQ ID NO: 443959 - RNA, 32 nt, Human
gcgggcagaagggagagagggaggggcagcua

SEQ ID NO: 443960 - RNA, 24 nt, Human
gcgggcagaucaccugaggccagg

SEQ ID NO: 443961 - RNA, 22 nt, Human
gcgggcagaucaccugagguca

SEQ ID NO: 443962 - RNA, 24 nt, Human
gcgggcagaucaccugaggucagg

SEQ ID NO: 443963 - RNA, 23 nt, Human
gcgggcagaucacugaggucagg

SEQ ID NO: 443964 - RNA, 24 nt, Human
gcgggcagaucacuugaagucagg

SEQ ID NO: 443965 - RNA, 24 nt, Human
gcgggcagaucacuugagaucagg

SEQ ID NO: 443966 - RNA, 24 nt, Human
gcgggcagaucacuugaggucagg

SEQ ID NO: 443967 - RNA, 32 nt, Human
gcgggcagaucuccugagcucaggaguucgag

SEQ ID NO: 443968 - RNA, 18 nt, Human
gcgggcagcagcuccagc

SEQ ID NO: 443969 - RNA, 32 nt, Human
gcgggcagcagcugugugcgggccuggggguu

SEQ ID NO: 443970 - RNA, 32 nt, Human
gcgggcagcaugguucacuccagcaugggggc

SEQ ID NO: 443971 - RNA, 32 nt, Human
gcgggcagcccagccucugucccucuuugccu

SEQ ID NO: 443972 - RNA, 32 nt, Human
gcgggcagcgucgccucacgcggagcagagcu

SEQ ID NO: 443973 - RNA, 32 nt, Human
gcgggcaggcggguggggcaggcugggggcug

SEQ ID NO: 443974 - RNA, 32 nt, Human
gcgggcaggcuggggguauguguggcaggaac

SEQ ID NO: 443975 - RNA, 32 nt, Human
gcgggcagggaguggagucggggucuuacucc

SEQ ID NO: 443976 - RNA, 32 nt, Human
gcgggcagggccugaagugcaggugcgggcag

SEQ ID NO: 443977 - RNA, 32 nt, Human
gcgggcaggggugggagcccucacaggcaagg

SEQ ID NO: 443978 - RNA, 32 nt, Human
gcgggcagugaacgaguguggggaaggauugg

SEQ ID NO: 443979 - RNA, 29 nt, Human
gcgggcaguuuaugugugccuggacacag

SEQ ID NO: 443980 - RNA, 32 nt, Human
gcgggcaucuuggaaucaugacucccacaaug

SEQ ID NO: 443981 - RNA, 32 nt, Human
gcgggcaucuuucaccaaagcuacucaggaag

SEQ ID NO: 443982 - RNA, 32 nt, Human
gcgggcauggcguggaggaggagggaggccgg

SEQ ID NO: 443983 - RNA, 32 nt, Human
gcgggcaugguggcucacgccuguaaucccag

SEQ ID NO: 443984 - RNA, 32 nt, Human
gcgggcaugguggugggcgccuguaauuccag

SEQ ID NO: 443985 - RNA, 32 nt, Human
gcgggccagcacugguaccuagccggggcccg

SEQ ID NO: 443986 - RNA, 32 nt, Human
gcgggccagccugggccccagcccacaccuuc

SEQ ID NO: 443987 - RNA, 32 nt, Human
gcgggccaggcgcgcggugucaccuccacgaa

SEQ ID NO: 443988 - RNA, 32 nt, Human
gcgggccaggucgcccuugagacucagugcgc

SEQ ID NO: 443989 - RNA, 32 nt, Human
gcgggcccaagagaugaaggaaaggagugaaa

SEQ ID NO: 443990 - RNA, 32 nt, Human
gcgggcccaagccuuuggaucucaggugaccg

SEQ ID NO: 443991 - RNA, 19 nt, Human
gcgggcccacaucuuccgg

SEQ ID NO: 443992 - RNA, 32 nt, Human
gcgggcccagaacauccggggagacaaggccc

SEQ ID NO: 443993 - RNA, 22 nt, Human
gcgggcccagacugcgcuccgg

SEQ ID NO: 443994 - RNA, 25 nt, Human
gcgggcccaugaggaggccugggga

SEQ ID NO: 443995 - RNA, 32 nt, Human
gcgggcccccuccaggagcuccgggcaagcag

SEQ ID NO: 443996 - RNA, 32 nt, Human
gcgggcccccuucaccccuuuucugucugcac

SEQ ID NO: 443997 - RNA, 32 nt, Human
gcgggccccgggcccuccuccgucucagccgc

SEQ ID NO: 443998 - RNA, 23 nt, Human
gcgggcccgggaccacccuccgg

SEQ ID NO: 443999 - RNA, 32 nt, Human
gcgggcccugcccacaccuccuggggcgcgug

SEQ ID NO: 444000 - RNA, 32 nt, Human
gcgggcccugcccuccccaugccuccugcccu

SEQ ID NO: 444001 - RNA, 32 nt, Human
gcgggcccuggguuugaagcagccuggcuuuc

SEQ ID NO: 444002 - RNA, 20 nt, Human
gcgggcccuuccaccgcagc

SEQ ID NO: 444003 - RNA, 19 nt, Human
gcgggccgccagccccagc

SEQ ID NO: 444004 - RNA, 32 nt, Human
gcgggccgcggcuccggcauggccgggaucau

SEQ ID NO: 444005 - RNA, 32 nt, Human
gcgggccgcucaccugacauguggaccugcag

SEQ ID NO: 444006 - RNA, 19 nt, Human
gcgggccggagggcugcag

SEQ ID NO: 444007 - RNA, 32 nt, Human
gcgggccgggcccggggccgcuuggaauggcg

SEQ ID NO: 444008 - RNA, 27 nt, Human
gcgggccgggggcggaggcgcuggggg

SEQ ID NO: 444009 - RNA, 32 nt, Human
gcgggccuacagccaugucccgggacccgggg

SEQ ID NO: 444010 - RNA, 32 nt, Human
gcgggccucacaggucacccagccagaucuca

SEQ ID NO: 444011 - RNA, 32 nt, Human
gcgggccuccagcagcccugugccugccgcua

SEQ ID NO: 444012 - RNA, 32 nt, Human
gcgggccucgaccgcaggucucaucccacacu

SEQ ID NO: 444013 - RNA, 32 nt, Human
gcucacucacugcccucccucccuccugggcu

SEQ ID NO: 444014 - RNA, 32 nt, Human
gcucacuccaaccuccgccuccuggguucaag

SEQ ID NO: 444015 - RNA, 32 nt, Human
gcucacuccagccuccaacuccugggcucaag

SEQ ID NO: 444016 - RNA, 32 nt, Human
gcucacuccagccuccacuucccagguucaag

SEQ ID NO: 444017 - RNA, 32 nt, Human
gcucacuccagccucggauguuuccucgcugc

SEQ ID NO: 444018 - RNA, 32 nt, Human
gcucacucccuuccucuccaucucucccucuc

SEQ ID NO: 444019 - RNA, 32 nt, Human
gcucacucccuugagccugcuuccucacucca

SEQ ID NO: 444020 - RNA, 32 nt, Human
gcucacuccucaucuuacccuaccaucucccc

SEQ ID NO: 444021 - RNA, 32 nt, Human
gcucacuccuguaaucccaacacuuugagagg

SEQ ID NO: 444022 - RNA, 32 nt, Human
gcucacuccuguaaucccaccacuuugggagg

SEQ ID NO: 444023 - RNA, 32 nt, Human
gcucacuccuguaaucccagcacuuuggaggc

SEQ ID NO: 444024 - RNA, 32 nt, Human
gcucacuccuguaaucccagcacuuugggaag

SEQ ID NO: 444025 - RNA, 32 nt, Human
gcucacuccuguaaucccagcacuuugggagg

SEQ ID NO: 444026 - RNA, 32 nt, Human
gcucacuccuguaaucccagcauuuugagagg

SEQ ID NO: 444027 - RNA, 32 nt, Human
gcucacuccuguaaucccagcauuuugggagg

SEQ ID NO: 444028 - RNA, 32 nt, Human
gcucacuccuguaaucccggcacuuuggaaug

SEQ ID NO: 444029 - RNA, 32 nt, Human
gcucacuccuguaauccgagcaauuugggagg

SEQ ID NO: 444030 - RNA, 32 nt, Human
gcucacuccuguaauccuagcaguuuggaagg

SEQ ID NO: 444031 - RNA, 32 nt, Human
gcucacuccuguaaucucaacaauuugagagg

SEQ ID NO: 444032 - RNA, 32 nt, Human
gcucacuccuguaaucucagaacuuugggagg

SEQ ID NO: 444033 - RNA, 32 nt, Human
gcucacuccuguaauuccagcacuuugggagg

SEQ ID NO: 444034 - RNA, 32 nt, Human
gcucacuccuguagucccagcacuuugggagg

SEQ ID NO: 444035 - RNA, 32 nt, Human
gcucacuccuuucuacuaauuguggaugucuc

SEQ ID NO: 444036 - RNA, 32 nt, Human
gcucacucggcuuccaggacaccccgcucagg

SEQ ID NO: 444037 - RNA, 32 nt, Human
gcucacucuaccccaucuccuugccgggugag

SEQ ID NO: 444038 - RNA, 32 nt, Human
gcucacucuagccuugaauuccugggcccaag

SEQ ID NO: 444039 - RNA, 32 nt, Human
gcucacucuccccuccaagauaugagaaacug

SEQ ID NO: 444040 - RNA, 32 nt, Human
gcucacucuccucccugcagcugcaguguggc

SEQ ID NO: 444041 - RNA, 32 nt, Human
gcucacucugcaaccuccacuucccagguuca

SEQ ID NO: 444042 - RNA, 22 nt, Human
gcucacugaaaccucugccucc

SEQ ID NO: 444043 - RNA, 21 nt, Human
gcucacugaaccucugccucc

SEQ ID NO: 444044 - RNA, 32 nt, Human
gcucacugaagccuccgcuuccuggguucaag

SEQ ID NO: 444045 - RNA, 32 nt, Human
gcucacugaagggugagccaggccagugcuuc

SEQ ID NO: 444046 - RNA, 32 nt, Human
gcucacugacacucuguaaaggccaaucaaug

SEQ ID NO: 444047 - RNA, 32 nt, Human
gcucacugcaaacuccaccucccagguucaag

SEQ ID NO: 444048 - RNA, 22 nt, Human
gcucacugcaaacucugccucc

SEQ ID NO: 444049 - RNA, 32 nt, Human
gcucacugcaaaucuccgccucccagguucaa

SEQ ID NO: 444050 - RNA, 32 nt, Human
gcucacugcaacauccaccucaugggcucaag

SEQ ID NO: 444051 - RNA, 32 nt, Human
gcucacugcaacauccaccuccuggguucaag

SEQ ID NO: 444052 - RNA, 32 nt, Human
gcucacugcaacauccagcuccuggguuucag

SEQ ID NO: 444053 - RNA, 22 nt, Human
gcucacugcaacauccgccucu

SEQ ID NO: 444054 - RNA, 32 nt, Human
gcucacugcaacaucugacuccuggguucaag

SEQ ID NO: 444055 - RNA, 22 nt, Human
gcucacugcaaccaacaccuuc

SEQ ID NO: 444056 - RNA, 22 nt, Human
gcucacugcaaccacugccucc

SEQ ID NO: 444057 - RNA, 32 nt, Human
gcucacugcaaccacugcuuccuggguucaag

SEQ ID NO: 444058 - RNA, 32 nt, Human
gcucacugcaacccccaccucccggguucaag

SEQ ID NO: 444059 - RNA, 22 nt, Human
gcucacugcaacccccgccucc

SEQ ID NO: 444060 - RNA, 32 nt, Human
gcucacugcaacccccgccuccuggguucaag

SEQ ID NO: 444061 - RNA, 22 nt, Human
gcucacugcaaccccuccuccu

SEQ ID NO: 444062 - RNA, 23 nt, Human
gcucacugcaaccucaaacuccu

SEQ ID NO: 444063 - RNA, 32 nt, Human
gcucacugcaaccucaaacuccugggcucaag

SEQ ID NO: 444064 - RNA, 21 nt, Human
gcucacugcaaccucaauccu

SEQ ID NO: 444065 - RNA, 32 nt, Human
gcucacugcaaccucagccuccugggcucaag

SEQ ID NO: 444066 - RNA, 22 nt, Human
gcucacugcaaccuccaccccc

SEQ ID NO: 444067 - RNA, 21 nt, Human
gcucacugcaaccuccaccuc

SEQ ID NO: 444068 - RNA, 32 nt, Human
gcucacugcaaccuccaccucacagguucaag

SEQ ID NO: 444069 - RNA, 22 nt, Human
gcucacugcaaccuccaccucc

SEQ ID NO: 444070 - RNA, 32 nt, Human
gcucacugcaaccuccaccucccagaaggaag

SEQ ID NO: 444071 - RNA, 32 nt, Human
gcucacugcaaccuccaccucccaggaucaag

SEQ ID NO: 444072 - RNA, 32 nt, Human
gcucacugcaaccuccaccucccaggcucaag

SEQ ID NO: 444073 - RNA, 32 nt, Human
gcucacugcaaccuccaccucccaggucagcg

SEQ ID NO: 444074 - RNA, 32 nt, Human
gcucacugcaaccuccaccucccagguccaag

SEQ ID NO: 444075 - RNA, 32 nt, Human
gcucacugcaaccuccaccucccaggugcaag

SEQ ID NO: 444076 - RNA, 32 nt, Human
gcucacugcaaccuccaccucccagguucaag

SEQ ID NO: 444077 - RNA, 32 nt, Human
gcucacugcaaccuccaccucccagguucaca

SEQ ID NO: 444078 - RNA, 32 nt, Human
gcucacugcaaccuccaccuccccggguucaa

SEQ ID NO: 444079 - RNA, 32 nt, Human
gcucacugcaaccuccaccucccgggcucaag

SEQ ID NO: 444080 - RNA, 32 nt, Human
gcucacugcaaccuccaccucccgggucaagc

SEQ ID NO: 444081 - RNA, 32 nt, Human
gcucacugcaaccuccaccucccggguucaac

SEQ ID NO: 444082 - RNA, 32 nt, Human
gcucacugcaaccuccaccucccggguucaag

SEQ ID NO: 444083 - RNA, 32 nt, Human
gcucacugcaaccuccaccucccggguucacg

SEQ ID NO: 444084 - RNA, 32 nt, Human
gcucacugcaaccuccaccucccggguucagg

SEQ ID NO: 444085 - RNA, 32 nt, Human
gcucacugcaaccuccaccucccggguucaug

SEQ ID NO: 444086 - RNA, 32 nt, Human
gcucacugcaaccuccaccucccggguuccag

SEQ ID NO: 444087 - RNA, 32 nt, Human
gcucacugcaaccuccaccucccggguuucag

SEQ ID NO: 444088 - RNA, 32 nt, Human
gcucacugcaaccuccaccucccugguucaag

SEQ ID NO: 444089 - RNA, 32 nt, Human
gcucacugcaaccuccaccuccggguucaagc

SEQ ID NO: 444090 - RNA, 23 nt, Human
gcucacugcaaccuccaccuccu

SEQ ID NO: 444091 - RNA, 32 nt, Human
gcucacugcaaccuccaccuccuagguucaag

SEQ ID NO: 444092 - RNA, 32 nt, Human
gcucacugcaaccuccaccuccugaguucaag

SEQ ID NO: 444093 - RNA, 32 nt, Human
gcucacugcaaccuccaccuccuggauucaag

SEQ ID NO: 444094 - RNA, 32 nt, Human
gcucacugcaaccuccaccuccuggauucgag

SEQ ID NO: 444095 - RNA, 32 nt, Human
gcucacugcaaccuccaccuccuggcuucaag

SEQ ID NO: 444096 - RNA, 32 nt, Human
gcucacugcaaccuccaccuccugggcucaag

SEQ ID NO: 444097 - RNA, 32 nt, Human
gcucacugcaaccuccaccuccugggucaagc

SEQ ID NO: 444098 - RNA, 32 nt, Human
gcucacugcaaccuccaccuccuggguucaag

SEQ ID NO: 444099 - RNA, 32 nt, Human
gcucacugcaaccuccaccuccuggguucagg

SEQ ID NO: 444100 - RNA, 32 nt, Human
gcucacugcaaccuccaccuccuggguugaag

SEQ ID NO: 444101 - RNA, 32 nt, Human
gcucacugcaaccuccaccuccuggguuuaag

SEQ ID NO: 444102 - RNA, 32 nt, Human
gcucacugcaaccuccaccuccugguucaagc

SEQ ID NO: 444103 - RNA, 32 nt, Human
gcucacugcaaccuccaccucgcagguucaag

SEQ ID NO: 444104 - RNA, 22 nt, Human
gcucacugcaaccuccaccucu

SEQ ID NO: 444105 - RNA, 32 nt, Human
gcucacugcaaccuccaccucucagguucaag

SEQ ID NO: 444106 - RNA, 32 nt, Human
gcucacugcaaccuccaccucugggauucaag

SEQ ID NO: 444107 - RNA, 21 nt, Human
gcucacugcaaccuccaccuu

SEQ ID NO: 444108 - RNA, 32 nt, Human
gcucacugcaaccuccacuuccuggguucaag

SEQ ID NO: 444109 - RNA, 22 nt, Human
gcucacugcaaccuccaucucc

SEQ ID NO: 444110 - RNA, 23 nt, Human
gcucacugcaaccuccaucuccu

SEQ ID NO: 444111 - RNA, 32 nt, Human
gcucacugcaaccucccccuccuggguucaag

SEQ ID NO: 444112 - RNA, 32 nt, Human
gcucacugcaaccuccgacuccuggguucaag

SEQ ID NO: 444113 - RNA, 22 nt, Human
gcucacugcaaccuccgcagcc

SEQ ID NO: 444114 - RNA, 22 nt, Human
gcucacugcaaccuccgcaucc

SEQ ID NO: 444115 - RNA, 23 nt, Human
gcucacugcaaccuccgcccccu

SEQ ID NO: 444116 - RNA, 22 nt, Human
gcucacugcaaccuccgccucc

SEQ ID NO: 444117 - RNA, 23 nt, Human
gcucacugcaaccuccgccuccu

SEQ ID NO: 444118 - RNA, 32 nt, Human
gcucacugcaaccuccgccuccugggaucaag

SEQ ID NO: 444119 - RNA, 32 nt, Human
gcucacugcaaccuccgccuccugggcucaag

SEQ ID NO: 444120 - RNA, 32 nt, Human
gcucacugcaaccuccgccuccuggguuaaag

SEQ ID NO: 444121 - RNA, 32 nt, Human
gcucacugcaaccuccgccuccuggguucaaa

SEQ ID NO: 444122 - RNA, 32 nt, Human
gcucacugcaaccuccgccuccuggguucaag

SEQ ID NO: 444123 - RNA, 32 nt, Human
gcucacugcaaccuccgccuccuggguucaca

SEQ ID NO: 444124 - RNA, 32 nt, Human
gcucacugcaaccuccgccuccuggguucagg

SEQ ID NO: 444125 - RNA, 32 nt, Human
gcucacugcaaccuccgccuccuggguuccaa

SEQ ID NO: 444126 - RNA, 32 nt, Human
gcucacugcaaccuccgccuccuggguucggg

SEQ ID NO: 444127 - RNA, 23 nt, Human
gcucacugcaaccuccgccucuu

SEQ ID NO: 444128 - RNA, 23 nt, Human
gcucacugcaaccuccgccugcu

SEQ ID NO: 444129 - RNA, 23 nt, Human
gcucacugcaaccuccgcuuccu

SEQ ID NO: 444130 - RNA, 22 nt, Human
gcucacugcaaccuccgucucc

SEQ ID NO: 444131 - RNA, 23 nt, Human
gcucacugcaaccuccgucuccu

SEQ ID NO: 444132 - RNA, 32 nt, Human
gcucacugcaaccuccgucuccuggguucaag

SEQ ID NO: 444133 - RNA, 22 nt, Human
gcucacugcaaccuccgucucu

SEQ ID NO: 444134 - RNA, 32 nt, Human
gcucacugcaaccuccguuuccuggguucgag

SEQ ID NO: 444135 - RNA, 22 nt, Human
gcucacugcaaccuccuccucc

SEQ ID NO: 444136 - RNA, 23 nt, Human
gcucacugcaaccuccuccuucu

SEQ ID NO: 444137 - RNA, 23 nt, Human
gcucacugcaaccucgaccuccu

SEQ ID NO: 444138 - RNA, 23 nt, Human
gcucacugcaaccucgaccucuu

SEQ ID NO: 444139 - RNA, 22 nt, Human
gcucacugcaaccucggccucc

SEQ ID NO: 444140 - RNA, 22 nt, Human
gcucacugcaaccucuaccucc

SEQ ID NO: 444141 - RNA, 23 nt, Human
gcucacugcaaccucuaccuccu

SEQ ID NO: 444142 - RNA, 32 nt, Human
gcucacugcaaccucuaccuccuggauucaag

SEQ ID NO: 444143 - RNA, 32 nt, Human
gcucacugcaaccucuaccuccuggguucaag

SEQ ID NO: 444144 - RNA, 22 nt, Human
gcucacugcaaccucucucucc

SEQ ID NO: 444145 - RNA, 32 nt, Human
gcucacugcaaccucucucucccggguucaag

SEQ ID NO: 444146 - RNA, 23 nt, Human
gcucacugcaaccucugacuccu

SEQ ID NO: 444147 - RNA, 22 nt, Human
gcucacugcaaccucugccucc

SEQ ID NO: 444148 - RNA, 23 nt, Human
gcucacugcaaccucugccuccu

SEQ ID NO: 444149 - RNA, 32 nt, Human
gcucacugcaaccucugccuccugggcucaac

SEQ ID NO: 444150 - RNA, 32 nt, Human
gcucacugcaaccucugccuccugggcucaag

SEQ ID NO: 444151 - RNA, 32 nt, Human
gcucacugcaaccucugccuccugggguucaa

SEQ ID NO: 444152 - RNA, 32 nt, Human
gcucacugcaaccucugccuccugggugcaag

SEQ ID NO: 444153 - RNA, 32 nt, Human
gcucacugcaaccucugccuccuggguucaag

SEQ ID NO: 444154 - RNA, 32 nt, Human
gcucacugcaaccucugccuccuggguucagg

SEQ ID NO: 444155 - RNA, 32 nt, Human
gcucacugcaaccucugccuccuggguucucc

SEQ ID NO: 444156 - RNA, 32 nt, Human
gcucacugcaaccucugccuccuggguuuaaa

SEQ ID NO: 444157 - RNA, 32 nt, Human
gcucacugcaaccucugccuccuggguuuaag

SEQ ID NO: 444158 - RNA, 23 nt, Human
gcucacugcaaccucugccuucu

SEQ ID NO: 444159 - RNA, 22 nt, Human
gcucacugcaaccucugcuucc

SEQ ID NO: 444160 - RNA, 23 nt, Human
gcucacugcaaccucugcuuccu

SEQ ID NO: 444161 - RNA, 32 nt, Human
gcucacugcaaccucugcuuccuggguucaaa

SEQ ID NO: 444162 - RNA, 23 nt, Human
gcucacugcaaccucugucuccu

SEQ ID NO: 444163 - RNA, 32 nt, Human
gcucacugcaaccucugucuccugggcucaag

SEQ ID NO: 444164 - RNA, 32 nt, Human
gcucacugcaaccucugucuccuggguucaaa

SEQ ID NO: 444165 - RNA, 32 nt, Human
gcucacugcaaccucugucuccuggguucaag

SEQ ID NO: 444166 - RNA, 32 nt, Human
gcucacugcaaccucugucuccuggguucagg

SEQ ID NO: 444167 - RNA, 32 nt, Human
gcucacugcaaccucugucuccuggguuuaag

SEQ ID NO: 444168 - RNA, 32 nt, Human
gcucacugcaaccucuguguccugggcucaag

SEQ ID NO: 444169 - RNA, 32 nt, Human
gcucacugcaaccucuugccucccagguucaa

SEQ ID NO: 444170 - RNA, 32 nt, Human
gcucacugcaaccugcgccuccuggguucaag

SEQ ID NO: 444171 - RNA, 32 nt, Human
gcucacugcaaccuggaacuccugggcucaau

SEQ ID NO: 444172 - RNA, 22 nt, Human
gcucacugcaaccugugccucc

SEQ ID NO: 444173 - RNA, 23 nt, Human
gcucacugcaaccuucgccaccu

SEQ ID NO: 444174 - RNA, 22 nt, Human
gcucacugcaaccuuggccucc

SEQ ID NO: 444175 - RNA, 22 nt, Human
gcucacugcaaccuuugucucc

SEQ ID NO: 444176 - RNA, 32 nt, Human
gcucacugcaacguccaccuccuggguucaag

SEQ ID NO: 444177 - RNA, 23 nt, Human
gcucacugcaacguccaccucuu

SEQ ID NO: 444178 - RNA, 32 nt, Human
gcucacugcaacguccaccucuugaguucaag

SEQ ID NO: 444179 - RNA, 32 nt, Human
gcucacugcaacguccgccuccuggguucaag

SEQ ID NO: 444180 - RNA, 22 nt, Human
gcucacugcaacgucugccucc

SEQ ID NO: 444181 - RNA, 32 nt, Human
gcucacugcaacgucugccuccuggguucaag

SEQ ID NO: 444182 - RNA, 32 nt, Human
gcucacugcaacuaccaccuccuggguucaag

SEQ ID NO: 444183 - RNA, 32 nt, Human
gcucacugcaacuccaccucccggguucacgc

SEQ ID NO: 444184 - RNA, 32 nt, Human
gcucacugcaacucugccucccggguucaagc

SEQ ID NO: 444185 - RNA, 32 nt, Human
gcucacugcaacucugcuucccagguucaagu

SEQ ID NO: 444186 - RNA, 32 nt, Human
gcucacugcaacugcagccucccggguucagg

SEQ ID NO: 444187 - RNA, 22 nt, Human
gcucacugcaacuuccaccucc

SEQ ID NO: 444188 - RNA, 32 nt, Human
gcucacugcaacuuccaccucccagguucaag

SEQ ID NO: 444189 - RNA, 32 nt, Human
gcucacugcaacuuccaccucccggguucaag

SEQ ID NO: 444190 - RNA, 32 nt, Human
gcucacugcaacuuccaccucugggaucaagg

SEQ ID NO: 444191 - RNA, 32 nt, Human
gcucacugcaacuuccacuucccggguucaag

SEQ ID NO: 444192 - RNA, 22 nt, Human
gcucacugcaacuuccgcaucc

SEQ ID NO: 444193 - RNA, 32 nt, Human
gcucacugcaacuuccgcaucccagguucaag

SEQ ID NO: 444194 - RNA, 32 nt, Human
gcucacugcaacuuccgccccgccagguucgg

SEQ ID NO: 444195 - RNA, 32 nt, Human
gcucacugcaacuuccgccucccggguucaag

SEQ ID NO: 444196 - RNA, 32 nt, Human
gcucacugcaacuuccgccucccgguuucaag

SEQ ID NO: 444197 - RNA, 32 nt, Human
gcucacugcaacuuccgccuccugggaucaag

SEQ ID NO: 444198 - RNA, 32 nt, Human
gcucacugcaacuuccgccuccuguguucaag

SEQ ID NO: 444199 - RNA, 32 nt, Human
gcucacugcaacuuccgucucccggguucaag

SEQ ID NO: 444200 - RNA, 32 nt, Human
gcucacugcaacuucuaccaccuagguucaag

SEQ ID NO: 444201 - RNA, 32 nt, Human
gcucacugcaacuucuaccuccgagguucaag

SEQ ID NO: 444202 - RNA, 32 nt, Human
gcucacugcaacuucugccaccuggguucaag

SEQ ID NO: 444203 - RNA, 32 nt, Human
gcucacugcaacuucugccucccagguucaag

SEQ ID NO: 444204 - RNA, 32 nt, Human
gcucacugcaacuucugccucccggguucaaa

SEQ ID NO: 444205 - RNA, 32 nt, Human
gcucacugcaacuucugccucccggguucaag

SEQ ID NO: 444206 - RNA, 23 nt, Human
gcucacugcaacuucugccuccu

SEQ ID NO: 444207 - RNA, 32 nt, Human
gcucacugcaacuucugccuccuagguucaag

SEQ ID NO: 444208 - RNA, 32 nt, Human
gcucacugcaacuucugccuccuggguucaag

SEQ ID NO: 444209 - RNA, 32 nt, Human
gcucacugcaacuucugccuccugguaucaag

SEQ ID NO: 444210 - RNA, 32 nt, Human
gcucacugcaacuucugccucuuggguucaag

SEQ ID NO: 444211 - RNA, 32 nt, Human
gcucacugcaacuucugccuuccagguucaag

SEQ ID NO: 444212 - RNA, 32 nt, Human
gcucacugcaacuugggccucccagguucaag

SEQ ID NO: 444213 - RNA, 32 nt, Human
gcucacugcaagcccugccuccuggguucaug

SEQ ID NO: 444214 - RNA, 22 nt, Human
gcucacugcaagcuccaacucc

SEQ ID NO: 444215 - RNA, 22 nt, Human
gcucacugcaagcuccaccucc

SEQ ID NO: 444216 - RNA, 32 nt, Human
gcucacugcaagcuccaccucccagguucaca

SEQ ID NO: 444217 - RNA, 32 nt, Human
gcucacugcaagcuccaccucccagguucacg

SEQ ID NO: 444218 - RNA, 32 nt, Human
gcucacugcaagcuccaccucccggguucacg

SEQ ID NO: 444219 - RNA, 32 nt, Human
gcucacugcaagcuccaccucccggguucaug

SEQ ID NO: 444220 - RNA, 32 nt, Human
gcucacugcaagcuccaccucccggguuuaug

SEQ ID NO: 444221 - RNA, 23 nt, Human
gcucacugcaagcuccaccuccu

SEQ ID NO: 444222 - RNA, 32 nt, Human
gcucacugcaagcuccaccuccuggguucaag

SEQ ID NO: 444223 - RNA, 32 nt, Human
gcucacugcaagcuccaccuccuggguucacg

SEQ ID NO: 444224 - RNA, 32 nt, Human
gcucacugcaagcuccaccuccuggguucaug

SEQ ID NO: 444225 - RNA, 18 nt, Human
gcucacugcaagcuccgc

SEQ ID NO: 444226 - RNA, 22 nt, Human
gcucacugcaagcuccgccucc

SEQ ID NO: 444227 - RNA, 23 nt, Human
gcucacugcaagcuccgccuccu

SEQ ID NO: 444228 - RNA, 32 nt, Human
gcucacugcaagcuccgccuccuggguucaag

SEQ ID NO: 444229 - RNA, 32 nt, Human
gcucacugcaagcuccgccuccuggguucaca

SEQ ID NO: 444230 - RNA, 32 nt, Human
gcucacugcaagcuccgccuccuggguucacg

SEQ ID NO: 444231 - RNA, 32 nt, Human
gcucacugcaagcuccgccuccuggguucaug

SEQ ID NO: 444232 - RNA, 32 nt, Human
gcucacugcaagcuccgccuccuggguugaca

SEQ ID NO: 444233 - RNA, 32 nt, Human
gcucacugcaagcucggccuccuggguucaaa

SEQ ID NO: 444234 - RNA, 18 nt, Human
gcucacugcaagcucugc

SEQ ID NO: 444235 - RNA, 22 nt, Human
gcucacugcaagcucugccucc

SEQ ID NO: 444236 - RNA, 32 nt, Human
gcucacugcaagcucugccuccugggcucaca

SEQ ID NO: 444237 - RNA, 32 nt, Human
gcucacugcaagcucugccuccuggguucaag

SEQ ID NO: 444238 - RNA, 32 nt, Human
gcucacugcaagcucugccuccuggguucacg

SEQ ID NO: 444239 - RNA, 32 nt, Human
gcucacugcaagcucugcguccuggguugacg

SEQ ID NO: 444240 - RNA, 23 nt, Human
gcucacugcaaucuccaccuccu

SEQ ID NO: 444241 - RNA, 32 nt, Human
gcucacugcaaucuccaccuccuggguucaag

SEQ ID NO: 444242 - RNA, 22 nt, Human
gcucacugcaaucuccgccucc

SEQ ID NO: 444243 - RNA, 23 nt, Human
gcucacugcaaucucugccuccu

SEQ ID NO: 444244 - RNA, 32 nt, Human
gcucacugcaaucucugccuccuggguucaag

SEQ ID NO: 444245 - RNA, 32 nt, Human
gcucacugcaaucucugccuccuggguucaga

SEQ ID NO: 444246 - RNA, 23 nt, Human
gcucacugcacccucaaccuccu

SEQ ID NO: 444247 - RNA, 32 nt, Human
gcucacugcacccucaaccuccuggguucaag

SEQ ID NO: 444248 - RNA, 32 nt, Human
gcucacugcacccuccgccuccugggcucaag

SEQ ID NO: 444249 - RNA, 32 nt, Human
gcucacugcagacuccaacuccuggccucaaa

SEQ ID NO: 444250 - RNA, 32 nt, Human
gcucacugcagacuucaccuccugaguucaag

SEQ ID NO: 444251 - RNA, 22 nt, Human
gcucacugcagccacugccucc

SEQ ID NO: 444252 - RNA, 32 nt, Human
gcucacugcagcccugaacuccugggcucaag

SEQ ID NO: 444253 - RNA, 23 nt, Human
gcucacugcagccucaaacuccu

SEQ ID NO: 444254 - RNA, 32 nt, Human
gcucacugcagccucaaacuccuaggcucagg

SEQ ID NO: 444255 - RNA, 32 nt, Human
gcucacugcagccucaaacuccugaguccaag

SEQ ID NO: 444256 - RNA, 32 nt, Human
gcucacugcagccucaaacuccugggcucaag

SEQ ID NO: 444257 - RNA, 32 nt, Human
gcucacugcagccucaaacuccugggcucagg

SEQ ID NO: 444258 - RNA, 32 nt, Human
gcucacugcagccucaaacucuuuggcucaag

SEQ ID NO: 444259 - RNA, 32 nt, Human
gcucacugcagccucaaccucccaggcucaag

SEQ ID NO: 444260 - RNA, 32 nt, Human
gcucacugcagccucaaccucccagguucaag

SEQ ID NO: 444261 - RNA, 23 nt, Human
gcucacugcagccucaaccuccu

SEQ ID NO: 444262 - RNA, 32 nt, Human
gcucacugcagccucaaccuccugagcucaag

SEQ ID NO: 444263 - RNA, 32 nt, Human
gcucacugcagccucaaccuccugggcuaagu

SEQ ID NO: 444264 - RNA, 32 nt, Human
gcucacugcagccucaaccuccugggcucaag

SEQ ID NO: 444265 - RNA, 32 nt, Human
gcucacugcagccucaaccucugaaggcccag

SEQ ID NO: 444266 - RNA, 32 nt, Human
gcucacugcagccucaaccugcugggcucaag

SEQ ID NO: 444267 - RNA, 32 nt, Human
gcucacugcagccucaaccuggguucaaguga

SEQ ID NO: 444268 - RNA, 32 nt, Human
gcucacugcagccucaaccuucuggguucaag

SEQ ID NO: 444269 - RNA, 32 nt, Human
gcucacugcagccucaacuuccagcgcuaaag

SEQ ID NO: 444270 - RNA, 23 nt, Human
gcucacugcagccucaacuuccu

SEQ ID NO: 444271 - RNA, 32 nt, Human
gcucacugcagccucagcguccugggcucaaa

SEQ ID NO: 444272 - RNA, 32 nt, Human
gcucacugcagccucauacuccugggcucaag

SEQ ID NO: 444273 - RNA, 32 nt, Human
gcucacugcagccuccaacuccuggguucaag

SEQ ID NO: 444274 - RNA, 22 nt, Human
gcucacugcagccuccaccucc

SEQ ID NO: 444275 - RNA, 32 nt, Human
gcucacugcagccuccaccucccagguucaag

SEQ ID NO: 444276 - RNA, 32 nt, Human
gcucacugcagccuccaccuccccgguuccag

SEQ ID NO: 444277 - RNA, 32 nt, Human
gcucacugcagccuccaccucccggguucaau

SEQ ID NO: 444278 - RNA, 23 nt, Human
gcucacugcagccuccaccuccu

SEQ ID NO: 444279 - RNA, 32 nt, Human
gcucacugcagccuccaccuccugggcucaaa

SEQ ID NO: 444280 - RNA, 32 nt, Human
gcucacugcagccuccaccuccugggcucaag

SEQ ID NO: 444281 - RNA, 32 nt, Human
gcucacugcagccuccaccuccugggcucaug

SEQ ID NO: 444282 - RNA, 32 nt, Human
gcucacugcagccuccaccuccugggcucucc

SEQ ID NO: 444283 - RNA, 32 nt, Human
gcucacugcagccuccaccuccuggguucaag

SEQ ID NO: 444284 - RNA, 32 nt, Human
gcucacugcagccuccacuuccuggguucaca

SEQ ID NO: 444285 - RNA, 18 nt, Human
gcucacugcagccucccu

SEQ ID NO: 444286 - RNA, 32 nt, Human
gcucacugcagccuccgccuccuggguucaag

SEQ ID NO: 444287 - RNA, 32 nt, Human
gcucacugcagccuccuucuccuggguccaag

SEQ ID NO: 444288 - RNA, 32 nt, Human
gcucacugcagccucgaacuccugggcucaag

SEQ ID NO: 444289 - RNA, 22 nt, Human
gcucacugcagccucgaccucc

SEQ ID NO: 444290 - RNA, 23 nt, Human
gcucacugcagccucgaccuccu

SEQ ID NO: 444291 - RNA, 32 nt, Human
gcucacugcagccucgaccuccugggcucaac

SEQ ID NO: 444292 - RNA, 32 nt, Human
gcucacugcagccucgaccuccugggcucaag

SEQ ID NO: 444293 - RNA, 32 nt, Human
gcucacugcagccucgacuuccugggcucaaa

SEQ ID NO: 444294 - RNA, 32 nt, Human
gcucacugcagccucugccuccuggguucaag

SEQ ID NO: 444295 - RNA, 32 nt, Human
gcucacugcagccucugccuccuggguuccaa

SEQ ID NO: 444296 - RNA, 32 nt, Human
gcucacugcagccuggaacuccugggaucaag

SEQ ID NO: 444297 - RNA, 32 nt, Human
gcucacugcagccuggaacuccugggcucagg

SEQ ID NO: 444298 - RNA, 32 nt, Human
gcucacugcagccuggaauuccugggcucaag

SEQ ID NO: 444299 - RNA, 32 nt, Human
gcucacugcagccuggagcuccugggcacaag

SEQ ID NO: 444300 - RNA, 32 nt, Human
gcucacugcagccuugaacuccuggccucaag

SEQ ID NO: 444301 - RNA, 32 nt, Human
gcucacugcagccuugaacuccugggaucaaa

SEQ ID NO: 444302 - RNA, 32 nt, Human
gcucacugcagccuugaauuccugggcucgag

SEQ ID NO: 444303 - RNA, 32 nt, Human
gcucacugcagccuugaccuccugggcugaag

SEQ ID NO: 444304 - RNA, 32 nt, Human
gcucacugcagccuugaccuccuggguucaag

SEQ ID NO: 444305 - RNA, 32 nt, Human
gcucacugcagccuugaccuccuggguuccgg

SEQ ID NO: 444306 - RNA, 32 nt, Human
gcucacugcagccuugacuuccugggcucaag

SEQ ID NO: 444307 - RNA, 32 nt, Human
gcucacugcagccuugagcuccugggcuacca

SEQ ID NO: 444308 - RNA, 32 nt, Human
gcucacugcagccuugagcuccugggcucaag

SEQ ID NO: 444309 - RNA, 32 nt, Human
gcucacugcagcuucaaacuccugggcucaaa

SEQ ID NO: 444310 - RNA, 23 nt, Human
gcucacugcagcuucaacacccc

SEQ ID NO: 444311 - RNA, 32 nt, Human
gcucacugcagcuuugacuuccugggcucaag

SEQ ID NO: 444312 - RNA, 32 nt, Human
gcucacugcaggcuccgccuccuggguucacg

SEQ ID NO: 444313 - RNA, 23 nt, Human
gcucacugcaggcucugccuccu

SEQ ID NO: 444314 - RNA, 32 nt, Human
gcucacugcaggcucugccuccuggguucacg

SEQ ID NO: 444315 - RNA, 32 nt, Human
gcucacugcaggcucugccuccuggguuccag

SEQ ID NO: 444316 - RNA, 23 nt, Human
gcucacugcagguucagccuucu

SEQ ID NO: 444317 - RNA, 22 nt, Human
gcucacugcagucucugccucc

SEQ ID NO: 444318 - RNA, 23 nt, Human
gcucacugcagucuucagccucc

SEQ ID NO: 444319 - RNA, 32 nt, Human
gcucacugcagucuugaacuccugggcucaag

SEQ ID NO: 444320 - RNA, 32 nt, Human
gcucacugcaguuucaaguuccugggcucaaa

SEQ ID NO: 444321 - RNA, 32 nt, Human
gcucacugcauccucaaccuccuggguucaga

SEQ ID NO: 444322 - RNA, 32 nt, Human
gcucacugcauccucaacuuccugggcucaag

SEQ ID NO: 444323 - RNA, 32 nt, Human
gcucacugcauccuccaccuccuggguucaag

SEQ ID NO: 444324 - RNA, 32 nt, Human
gcucacugcauccuccaguuccuggguucaag

SEQ ID NO: 444325 - RNA, 22 nt, Human
gcucacugcauccuccgccucc

SEQ ID NO: 444326 - RNA, 22 nt, Human
gcucacugcauccucugccucc

SEQ ID NO: 444327 - RNA, 32 nt, Human
gcucacugcauccucugccuccuggguucaaa

SEQ ID NO: 444328 - RNA, 32 nt, Human
gcucacugcauccucugccuccuggguucaag

SEQ ID NO: 444329 - RNA, 22 nt, Human
gcucacugccaccucugccucc

SEQ ID NO: 444330 - RNA, 32 nt, Human
gcucacugccaccuuugccuccuggguucaag

SEQ ID NO: 444331 - RNA, 32 nt, Human
gcucacugccagcugcggccugggcaccgcgg

SEQ ID NO: 444332 - RNA, 32 nt, Human
gcucacugcccagcccccaucuaccucugaga

SEQ ID NO: 444333 - RNA, 32 nt, Human
gcucacugcccuucuagaugugccuucccgcu

SEQ ID NO: 444334 - RNA, 32 nt, Human
gcucacugccgccucaaccucuccuggguuca

SEQ ID NO: 444335 - RNA, 22 nt, Human
gcucacugcgaccuccaccucc

SEQ ID NO: 444336 - RNA, 23 nt, Human
gcucacugcgaccuccaccuccu

SEQ ID NO: 444337 - RNA, 32 nt, Human
gcucacugcgaccuccaccuccuggguucaag

SEQ ID NO: 444338 - RNA, 32 nt, Human
gcucacugcgaccucugcuuccuggguucaag

SEQ ID NO: 444339 - RNA, 32 nt, Human
gcucacugcgaccugcaccuccuggguucaag

SEQ ID NO: 444340 - RNA, 32 nt, Human
gcucacugcgagcuccaccucucggguucaca

SEQ ID NO: 444341 - RNA, 32 nt, Human
gcucacugcgagcucugccuccuggguucaag

SEQ ID NO: 444342 - RNA, 32 nt, Human
gcucacugcggccuugaacuccugggcuuaag

SEQ ID NO: 444343 - RNA, 32 nt, Human
gcucacugcucacccaccugcugcugccauga

SEQ ID NO: 444344 - RNA, 32 nt, Human
gcucacugcuguucucugggcuuguugacugu

SEQ ID NO: 444345 - RNA, 32 nt, Human
gcucacuggcaacaucugccucccggguucaa

SEQ ID NO: 444346 - RNA, 32 nt, Human
gcucacugggauaucuggcauuaguggaugcu

SEQ ID NO: 444347 - RNA, 32 nt, Human
gcucacugggcacgguggcucacaccuguaac

SEQ ID NO: 444348 - RNA, 32 nt, Human
gcucacuggucuuguaacuguccucuccuuau

SEQ ID NO: 444349 - RNA, 32 nt, Human
gcucacuguaaccucaaaauccugggcucaag

SEQ ID NO: 444350 - RNA, 20 nt, Human
gcucacuguaaccucaaacu

SEQ ID NO: 444351 - RNA, 23 nt, Human
gcucacuguaaccucaaacuccu

SEQ ID NO: 444352 - RNA, 20 nt, Human
gcucacuguaaccuccaccu

SEQ ID NO: 444353 - RNA, 22 nt, Human
gcucacuguaaccuccaccucc

SEQ ID NO: 444354 - RNA, 32 nt, Human
gcucacuguaaccuccaccuccuggguucacg

SEQ ID NO: 444355 - RNA, 32 nt, Human
gcucacuguaaccuccgacuccuggguucaag

SEQ ID NO: 444356 - RNA, 32 nt, Human
gcucacuguaaccuccgccuccuggguucaaa

SEQ ID NO: 444357 - RNA, 22 nt, Human
gcucacuguaaccucugccucc

SEQ ID NO: 444358 - RNA, 32 nt, Human
gcucacuguaaccucugccuccuggguucaag

SEQ ID NO: 444359 - RNA, 32 nt, Human
gcucacuguaaucuccgccuccuggguucaag

SEQ ID NO: 444360 - RNA, 32 nt, Human
gcucacuguacccuugaacuccugggcucaag

SEQ ID NO: 444361 - RNA, 32 nt, Human
gcucacuguacuccagcccggguucaagcaau

SEQ ID NO: 444362 - RNA, 32 nt, Human
gcucacuguagccacaaccucucaggcucaag

SEQ ID NO: 444363 - RNA, 32 nt, Human
gcucacuguagccucgaauuccugggcucaag

SEQ ID NO: 444364 - RNA, 32 nt, Human
gcucacuguagccucgaccuccugggcucaag

SEQ ID NO: 444365 - RNA, 32 nt, Human
gcucacuguagccucuaucuccugggcucaag

SEQ ID NO: 444366 - RNA, 32 nt, Human
gcucacuguagccuugacauccugggcucaag

SEQ ID NO: 444367 - RNA, 32 nt, Human
gcucacuguagccuugaucuccugggcucaag

SEQ ID NO: 444368 - RNA, 32 nt, Human
gcucacuguagucucaaccuccugggcucaag

SEQ ID NO: 444369 - RNA, 22 nt, Human
gcucacuguauccucugccucc

SEQ ID NO: 444370 - RNA, 23 nt, Human
gcucacugugaccuccgccuccu

SEQ ID NO: 444371 - RNA, 32 nt, Human
gcucacugugaccuccgccuccuggguucaag

SEQ ID NO: 444372 - RNA, 32 nt, Human
gcucacugugaccucugccuccuggguuuaag

SEQ ID NO: 444373 - RNA, 18 nt, Human
gcucacugugcucaggga

SEQ ID NO: 444374 - RNA, 32 nt, Human
gcucacuguguauuuaauaaauggacaaagag

SEQ ID NO: 444375 - RNA, 32 nt, Human
gcucacuucacugcacuccagucugggugaca

SEQ ID NO: 444376 - RNA, 32 nt, Human
gcucacuucagucucaaaauccugggcucaag

SEQ ID NO: 444377 - RNA, 32 nt, Human
gcucacuuccaguagcagaaccaccuuaguug

SEQ ID NO: 444378 - RNA, 31 nt, Human
gcucacuucuagagagaagaaaaaggcuggg

SEQ ID NO: 444379 - RNA, 32 nt, Human
gcucacuucucucccacuucugcuccauuugu

SEQ ID NO: 444380 - RNA, 32 nt, Human
gcucacuuucgccuucuccauccccugccgug

SEQ ID NO: 444381 - RNA, 32 nt, Human
gcucagaaacauuugacauuuggggugacgcg

SEQ ID NO: 444382 - RNA, 32 nt, Human
gcucagaaaccacugcauucugaccugcugua

SEQ ID NO: 444383 - RNA, 31 nt, Human
gcucagaaauaauugcucuguugaaaauaau

SEQ ID NO: 444384 - RNA, 32 nt, Human
gcucagaaauuuguucaagaucgcacagcuag

SEQ ID NO: 444385 - RNA, 32 nt, Human
gcucagaacaagaacugagauccagagagaug

SEQ ID NO: 444386 - RNA, 32 nt, Human
gcucagaacagcuucagcugucuaugggaagg

SEQ ID NO: 444387 - RNA, 22 nt, Human
gcucagaagaccaguguuucca

SEQ ID NO: 444388 - RNA, 32 nt, Human
gcucagaagcggccccaacaccugccacgcug

SEQ ID NO: 444389 - RNA, 32 nt, Human
gcucagaagucaccuccucagugcaguuagcc

SEQ ID NO: 444390 - RNA, 32 nt, Human
gcucagaauagcaccauugcugguuuguauua

SEQ ID NO: 444391 - RNA, 32 nt, Human
gcucagaauaugcucacugcuaagcuacaaac

SEQ ID NO: 444392 - RNA, 32 nt, Human
gcucagaccacugcaaucuaugggcagaccgc

SEQ ID NO: 444393 - RNA, 32 nt, Human
gcucagaccuauaaucccagcacuuugggagu

SEQ ID NO: 444394 - RNA, 32 nt, Human
gcucagaccuguaaucccagaacuuugggagc

SEQ ID NO: 444395 - RNA, 32 nt, Human
gcucagacgguuuauggaggcaaagguuugga

SEQ ID NO: 444396 - RNA, 32 nt, Human
gcucagacuguacucuucuagccaucugaaau

SEQ ID NO: 444397 - RNA, 32 nt, Human
gcucagacuuggggagggagggguguggcucc

SEQ ID NO: 444398 - RNA, 32 nt, Human
gcucagagaaauuauucauaagagaaaagaau

SEQ ID NO: 444399 - RNA, 32 nt, Human
gcucagagacaaacuggucaagugugagggca

SEQ ID NO: 444400 - RNA, 32 nt, Human
gcucagagaccuggcagacaccaccuuaaccc

SEQ ID NO: 444401 - RNA, 32 nt, Human
gcucagagauggggaccaucuuggagcgauca

SEQ ID NO: 444402 - RNA, 32 nt, Human
gcucagagccagucuuuuuggugaggguaacc

SEQ ID NO: 444403 - RNA, 32 nt, Human
gcucagagccaugccaggugucugugauaggg

SEQ ID NO: 444404 - RNA, 30 nt, Human
gcucagagccucuccuccuuccugucccga

SEQ ID NO: 444405 - RNA, 32 nt, Human
gcucagagcggaggggagacugaccggagcgc

SEQ ID NO: 444406 - RNA, 32 nt, Human
gcucagagcugcugagcaggaaccggagggug

SEQ ID NO: 444407 - RNA, 32 nt, Human
gcucagagcugcugugugucauccuguguuug

SEQ ID NO: 444408 - RNA, 31 nt, Human
gcucagaggagaccugcaguggguagcuccu

SEQ ID NO: 444409 - RNA, 32 nt, Human
gcucagaggaggaggacaaagacggcggggug

SEQ ID NO: 444410 - RNA, 32 nt, Human
gcucagaggaggcagagauggggugguggcug

SEQ ID NO: 444411 - RNA, 32 nt, Human
gcucagaggggccucaucuuccccagcccucc

SEQ ID NO: 444412 - RNA, 32 nt, Human
gcucagagucccgagacacagacaugaacacc

SEQ ID NO: 444413 - RNA, 32 nt, Human
gcucagagugaccaagcggaagaagaaaaaga

SEQ ID NO: 444414 - RNA, 32 nt, Human
gcucagaguggcugagacuuguguccugacca

SEQ ID NO: 444415 - RNA, 32 nt, Human
gcucagagugggagacagagagacaagugugc

SEQ ID NO: 444416 - RNA, 32 nt, Human
gcucagaguuugaaguuccacagccaggcugu

SEQ ID NO: 444417 - RNA, 32 nt, Human
gcucagaucaagaauccaguuaccucaaagcu

SEQ ID NO: 444418 - RNA, 32 nt, Human
gcucagaucccaccccugaucuccagacucau

SEQ ID NO: 444419 - RNA, 32 nt, Human
gcucagaucucccucccgaucucccuccccac

SEQ ID NO: 444420 - RNA, 32 nt, Human
gcucagaugcaggaacccagaaugggggcuuc

SEQ ID NO: 444421 - RNA, 32 nt, Human
gcucagaugcugaauccccaaccagagaagac

SEQ ID NO: 444422 - RNA, 32 nt, Human
gcucagauggccugggugcuauguggagcagg

SEQ ID NO: 444423 - RNA, 32 nt, Human
gcucagaugguccuccugccucagcuuccaaa

SEQ ID NO: 444424 - RNA, 19 nt, Human
gcucagauguccuaaugaa

SEQ ID NO: 444425 - RNA, 32 nt, Human
gcucagcaaccacuuugcaccaugaggcagca

SEQ ID NO: 444426 - RNA, 32 nt, Human
gcucagcacacaggcugguaguguugggcacc

SEQ ID NO: 444427 - RNA, 32 nt, Human
gcucagcaccauccaucuccgucucccuagag

SEQ ID NO: 444428 - RNA, 32 nt, Human
gcucagcacccugcgggaauucuauuaaaucu

SEQ ID NO: 444429 - RNA, 32 nt, Human
gcucagcaccugcggcgcccucagggagccgg

SEQ ID NO: 444430 - RNA, 32 nt, Human
gcucagcacugaguagaccuagagcauuuuua

SEQ ID NO: 444431 - RNA, 32 nt, Human
gcucagcagacauccacacacaguaauggggu

SEQ ID NO: 444432 - RNA, 32 nt, Human
gcucagcagcccaaggacgauggugaggggag

SEQ ID NO: 444433 - RNA, 32 nt, Human
gcucagcaggagaaaggcaaggggcucguuca

SEQ ID NO: 444434 - RNA, 32 nt, Human
gcucagcaggcacagggcagaucaaugcauca

SEQ ID NO: 444435 - RNA, 32 nt, Human
gcucagcagggucccagcccacggccacacau

SEQ ID NO: 444436 - RNA, 32 nt, Human
gcucagcagugaccuggagugugcaaauaaau

SEQ ID NO: 444437 - RNA, 32 nt, Human
gcucagcauagacccagcucucugggggaugg

SEQ ID NO: 444438 - RNA, 32 nt, Human
gcucagcauugagagaauaaaaugucacuacc

SEQ ID NO: 444439 - RNA, 22 nt, Human
gcucagcauuguguacaaaaua

SEQ ID NO: 444440 - RNA, 32 nt, Human
gcucagccaagaaggagcgggguggcgcagcg

SEQ ID NO: 444441 - RNA, 32 nt, Human
gcucagccacagaccuuugagggaguaaaggg

SEQ ID NO: 444442 - RNA, 19 nt, Human
gcucagccaccugucuccu

SEQ ID NO: 444443 - RNA, 32 nt, Human
gcucagccacucugcccagcuggguuggaucu

SEQ ID NO: 444444 - RNA, 22 nt, Human
gcucagccagcagcccccuccc

SEQ ID NO: 444445 - RNA, 21 nt, Human
gcucagccaggccccgcggug

SEQ ID NO: 444446 - RNA, 32 nt, Human
gcucagccagggaugcagaaccaucccugcuu

SEQ ID NO: 444447 - RNA, 20 nt, Human
gcucagccauguccccuccc

SEQ ID NO: 444448 - RNA, 20 nt, Human
gcucagcccacccccuccca

SEQ ID NO: 444449 - RNA, 32 nt, Human
gcucagcccagcccuggcacagagaagagaca

SEQ ID NO: 444450 - RNA, 32 nt, Human
gcucagcccagccugggcacagccagugccca

SEQ ID NO: 444451 - RNA, 32 nt, Human
gcucagccccaucagucucaaagguuaagcca

SEQ ID NO: 444452 - RNA, 32 nt, Human
gcucagccccgcucgauuuuuccucuucuguu

SEQ ID NO: 444453 - RNA, 32 nt, Human
gcucagccccuccccuccaacucucaucccau

SEQ ID NO: 444454 - RNA, 25 nt, Human
gcucagcccgacugcccuccuccca

SEQ ID NO: 444455 - RNA, 32 nt, Human
gcucagcccucccugccccucccuucaaccau

SEQ ID NO: 444456 - RNA, 32 nt, Human
gcucagcccugaggggcuuacuuugcccgugg

SEQ ID NO: 444457 - RNA, 32 nt, Human
gcucagcccugccugguuccugcagcacauca

SEQ ID NO: 444458 - RNA, 32 nt, Human
gcucagcccuuggccgucgcaaaggagcuggc

SEQ ID NO: 444459 - RNA, 24 nt, Human
gcucagccgaaagccccccgccca

SEQ ID NO: 444460 - RNA, 32 nt, Human
gcucagccgacucgcagggccugcucuucuuc

SEQ ID NO: 444461 - RNA, 21 nt, Human
gcucagccgccuccucugcca

SEQ ID NO: 444462 - RNA, 32 nt, Human
gcucagccuaaacacgcuaacauggugcccca

SEQ ID NO: 444463 - RNA, 32 nt, Human
gcucagccugacugcaacucaccucgaaggcg

SEQ ID NO: 444464 - RNA, 20 nt, Human
gcucagccuggagugcagug

SEQ ID NO: 444465 - RNA, 32 nt, Human
gcucagccugugccaccauugcucugucugau

SEQ ID NO: 444466 - RNA, 32 nt, Human
gcucagcgaggcagaggguggggcugcacaga

SEQ ID NO: 444467 - RNA, 32 nt, Human
gcucagcgauugcuucccagcagcagcagcag

SEQ ID NO: 444468 - RNA, 32 nt, Human
gcucagcgccggccuuucccucccucugccaa

SEQ ID NO: 444469 - RNA, 22 nt, Human
gcucagcgugaagucugaaaua

SEQ ID NO: 444470 - RNA, 32 nt, Human
gcucagcuacuccuaaccuccacuuacaaacu

SEQ ID NO: 444471 - RNA, 32 nt, Human
gcucagcuaggccgggcagacaaggacagaag

SEQ ID NO: 444472 - RNA, 25 nt, Human
gcucagcuauauauguaauaaaaua

SEQ ID NO: 444473 - RNA, 32 nt, Human
gcucagcuauggacacaucugagccagccaag

SEQ ID NO: 444474 - RNA, 32 nt, Human
gcucagcucacacccaagacauggccacuccg

SEQ ID NO: 444475 - RNA, 32 nt, Human
gcucagcucacugcaaccuccaccucccaggu

SEQ ID NO: 444476 - RNA, 32 nt, Human
gcucagcucaguaccucagccaccuccaagau

SEQ ID NO: 444477 - RNA, 32 nt, Human
gcucagcuccacacaaagcugcagaaggacga

SEQ ID NO: 444478 - RNA, 32 nt, Human
gcucagcuccacacuagccuaggcccugcaag

SEQ ID NO: 444479 - RNA, 32 nt, Human
gcucagcuccuggagagugaggguugaagaaa

SEQ ID NO: 444480 - RNA, 32 nt, Human
gcucagcucugccccgcgccucccgggcuccg

SEQ ID NO: 444481 - RNA, 32 nt, Human
gcucagcucugguuuccucucccaggcucacc

SEQ ID NO: 444482 - RNA, 32 nt, Human
gcucagcugcaaccacagccucgucguucugg

SEQ ID NO: 444483 - RNA, 32 nt, Human
gcucagcugcagcugccaccugcacacggugc

SEQ ID NO: 444484 - RNA, 32 nt, Human
gcucagcugcccaggcuggagugugguggcgc

SEQ ID NO: 444485 - RNA, 21 nt, Human
gcucagcugggagcgcagagg

SEQ ID NO: 444486 - RNA, 32 nt, Human
gcucagcugggcuuuaucacacaucccgugaa

SEQ ID NO: 444487 - RNA, 32 nt, Human
gcucagcuggguccccagugcccagcaucagc

SEQ ID NO: 444488 - RNA, 32 nt, Human
gcucagcuuaagggaggcuucuugccuguggg

SEQ ID NO: 444489 - RNA, 32 nt, Human
gcucagcuuccgccccagccagggaagcggca

SEQ ID NO: 444490 - RNA, 32 nt, Human
gcucagcuucuaaucccagcacuuugguaggc

SEQ ID NO: 444491 - RNA, 18 nt, Human
gcucagcuucucugaaua

SEQ ID NO: 444492 - RNA, 32 nt, Human
gcucagcuugguuuuggacaagccuguccauu

SEQ ID NO: 444493 - RNA, 32 nt, Human
gcucaggaaaugcaguagcaggccauauugca

SEQ ID NO: 444494 - RNA, 32 nt, Human
gcucaggaacugcuuuugauucacauuaagcu

SEQ ID NO: 444495 - RNA, 32 nt, Human
gcucaggaagcugaggugggaggaucacuuga

SEQ ID NO: 444496 - RNA, 32 nt, Human
gcucaggacugagacaguuauucacugaacau

SEQ ID NO: 444497 - RNA, 32 nt, Human
gcucaggagccagcagggcagaguucugccug

SEQ ID NO: 444498 - RNA, 32 nt, Human
gcucaggagcccuaccucccugccauuauagc

SEQ ID NO: 444499 - RNA, 19 nt, Human
gcucaggagcugcauccca

SEQ ID NO: 444500 - RNA, 32 nt, Human
gcucaggaggagggacccucuacucauuaugu

SEQ ID NO: 444501 - RNA, 32 nt, Human
gcucaggaggcagagguuacagguuacaguga

SEQ ID NO: 444502 - RNA, 32 nt, Human
gcucaggaggcagagguugcagugagccaaaa

SEQ ID NO: 444503 - RNA, 32 nt, Human
gcucaggaggcagagguugcagugagcugaga

SEQ ID NO: 444504 - RNA, 32 nt, Human
gcucaggaggcugaagcaggaggaucacuuga

SEQ ID NO: 444505 - RNA, 32 nt, Human
gcucaggaggcugaggcaggagaaucgcuuga

SEQ ID NO: 444506 - RNA, 32 nt, Human
gcucaggaggcugaggcaggagaaucgcuugg

SEQ ID NO: 444507 - RNA, 32 nt, Human
gcucaggaggcugaggcaggagaguggacuga

SEQ ID NO: 444508 - RNA, 32 nt, Human
gcucaggaggcugaggcaggaggaucucuuga

SEQ ID NO: 444509 - RNA, 32 nt, Human
gcucaggaggcugaggcaugagaaucgcuuga

SEQ ID NO: 444510 - RNA, 32 nt, Human
gcucaggaggcugaggugggaggaucaccuga

SEQ ID NO: 444511 - RNA, 32 nt, Human
gcucaggaggcugaggugggaggauugcuuga

SEQ ID NO: 444512 - RNA, 32 nt, Human
gcucaggaggguaggccagggugugaagggac

SEQ ID NO: 444513 - RNA, 32 nt, Human
gcucaggagggugggugggagcugcagugggc

SEQ ID NO: 444514 - RNA, 32 nt, Human
gcucaggagguugggucugcagugagcuaucu

SEQ ID NO: 444515 - RNA, 32 nt, Human
gcucaggaguaugagacuagccuggacaacau

SEQ ID NO: 444516 - RNA, 32 nt, Human
gcucaggaguucaagaccagccuggacaacau

SEQ ID NO: 444517 - RNA, 32 nt, Human
gcucaggaguucaagacgagccugggcaacau

SEQ ID NO: 444518 - RNA, 32 nt, Human
gcucaggaguucgagagcagccugggcaacau

SEQ ID NO: 444519 - RNA, 32 nt, Human
gcucaggauauauccugguguugcuugaccug

SEQ ID NO: 444520 - RNA, 32 nt, Human
gcucaggaugaaagaggagcugagagaagugc

SEQ ID NO: 444521 - RNA, 32 nt, Human
gcucaggaugagggaaaagaaaaagauugaga

SEQ ID NO: 444522 - RNA, 21 nt, Human
gcucaggcaagcccacccuca

SEQ ID NO: 444523 - RNA, 32 nt, Human
gcucaggcaagugccuugcacacaguagguac

SEQ ID NO: 444524 - RNA, 23 nt, Human
gcucaggcaauccgcccaccuca

SEQ ID NO: 444525 - RNA, 32 nt, Human
gcucaggcagcagccccugggcgcgggaaggu

SEQ ID NO: 444526 - RNA, 18 nt, Human
gcucaggcagguccugug

SEQ ID NO: 444527 - RNA, 32 nt, Human
gcucaggcauuugacuccuacagcagaaguuc

SEQ ID NO: 444528 - RNA, 21 nt, Human
gcucaggccacccugccgagg

SEQ ID NO: 444529 - RNA, 32 nt, Human
gcucaggcccaggaggugggagaaggucacag

SEQ ID NO: 444530 - RNA, 19 nt, Human
gcucaggcccugcccccca

SEQ ID NO: 444531 - RNA, 15 nt, Human
gcucaggccucacag

SEQ ID NO: 444532 - RNA, 32 nt, Human
gcucaggccugacaccaggggcugccaaugcc

SEQ ID NO: 444533 - RNA, 16 nt, Human
gcucaggccugcccca

SEQ ID NO: 444534 - RNA, 32 nt, Human
gcucaggccugggagucaguaguuuccuaaga

SEQ ID NO: 444535 - RNA, 19 nt, Human
gcucaggccuguaacccca

SEQ ID NO: 444536 - RNA, 32 nt, Human
gcucaggccuguaaccccagcacuucgggagg

SEQ ID NO: 444537 - RNA, 32 nt, Human
gcucaggccuguaaccccaguacuuugggagg

SEQ ID NO: 444538 - RNA, 32 nt, Human
gcucaggccuguaaccucagcacuuuggugag

SEQ ID NO: 444539 - RNA, 32 nt, Human
gcucaggccuguaaucccaacacuuugggagg

SEQ ID NO: 444540 - RNA, 32 nt, Human
gcucaggccuguaaucccaacccuuuggaagg

SEQ ID NO: 444541 - RNA, 32 nt, Human
gcucaggccuguaaucccagcacucugggagg

SEQ ID NO: 444542 - RNA, 32 nt, Human
gcucaggccuguaaucccagcacugugggagg

SEQ ID NO: 444543 - RNA, 32 nt, Human
gcucaggccuguaaucccagcacuucaggaag

SEQ ID NO: 444544 - RNA, 32 nt, Human
gcucaggccuguaaucccagcacuuuccaagg

SEQ ID NO: 444545 - RNA, 32 nt, Human
gcucaggccuguaaucccagcacuuugggaag

SEQ ID NO: 444546 - RNA, 32 nt, Human
gcucaggccuguaaucccagcacuuugggagg

SEQ ID NO: 444547 - RNA, 32 nt, Human
gcucaggccuguaaucccagcauuuucagagg

SEQ ID NO: 444548 - RNA, 32 nt, Human
gcucaggccuguaaucccagcauuuugggagg

SEQ ID NO: 444549 - RNA, 32 nt, Human
gcucaggccuguaauccuaacacuuugggagg

SEQ ID NO: 444550 - RNA, 32 nt, Human
gcucaggccuguaauccuggcacuuugggagg

SEQ ID NO: 444551 - RNA, 19 nt, Human
gcucaggccuguaaucuca

SEQ ID NO: 444552 - RNA, 32 nt, Human
gcucaggccuguaaucucagcacuuugggagg

SEQ ID NO: 444553 - RNA, 32 nt, Human
gcucaggccugugaucccagcacuuugggagg

SEQ ID NO: 444554 - RNA, 32 nt, Human
gcucaggcgagggagaugagagacggcggcgg

SEQ ID NO: 444555 - RNA, 32 nt, Human
gcucaggcgcuucucccaccuuggccuccuga

SEQ ID NO: 444556 - RNA, 20 nt, Human
gcucaggcuacugccacuca

SEQ ID NO: 444557 - RNA, 32 nt, Human
gcucaggcucaagagcaacauggaggucugca

SEQ ID NO: 444558 - RNA, 32 nt, Human
gcucaggcucaggugauccucacaccuuagcc

SEQ ID NO: 444559 - RNA, 32 nt, Human
gcucaggcucucugccuuccagaggccgcuuc

SEQ ID NO: 444560 - RNA, 32 nt, Human
gcucaggcugaucucaaacuccugggcuccaa

SEQ ID NO: 444561 - RNA, 32 nt, Human
gcucaggcugaucucgagcuccugggcucaag

SEQ ID NO: 444562 - RNA, 21 nt, Human
gcucaggcuggaguacagugg

SEQ ID NO: 444563 - RNA, 20 nt, Human
gcucaggcuggagugcaaug

SEQ ID NO: 444564 - RNA, 21 nt, Human
gcucaggcuggagugcaaugg

SEQ ID NO: 444565 - RNA, 19 nt, Human
gcucaggcuggagugcagu

SEQ ID NO: 444566 - RNA, 20 nt, Human
gcucaggcuggagugcagug

SEQ ID NO: 444567 - RNA, 23 nt, Human
gcucaggcuggagugcagugaug

SEQ ID NO: 444568 - RNA, 21 nt, Human
gcucaggcuggagugcagugg

SEQ ID NO: 444569 - RNA, 24 nt, Human
gcucaggcuggagugcaguggcgu

SEQ ID NO: 444570 - RNA, 23 nt, Human
gcucaggcuggagugcaguguug

SEQ ID NO: 444571 - RNA, 21 nt, Human
gcucaggcuggauugcagugg

SEQ ID NO: 444572 - RNA, 24 nt, Human
gcucaggcuggauugcaguggcgu

SEQ ID NO: 444573 - RNA, 32 nt, Human
gcucaggcuggccuugaacuccugggcucaag

SEQ ID NO: 444574 - RNA, 19 nt, Human
gcucaggcugggugcagug

SEQ ID NO: 444575 - RNA, 20 nt, Human
gcucaggcugggugcagugg

SEQ ID NO: 444576 - RNA, 32 nt, Human
gcucaggcugucccugagggccuguguuuuga

SEQ ID NO: 444577 - RNA, 32 nt, Human
gcucaggcuguggggcaggcugggcagggggc

SEQ ID NO: 444578 - RNA, 20 nt, Human
gcucaggcuuauucacauga

SEQ ID NO: 444579 - RNA, 32 nt, Human
gcucaggcuucacuuuguaaaccagguggggg

SEQ ID NO: 444580 - RNA, 32 nt, Human
gcucaggcuuugcccaggugccaggagaaggu

SEQ ID NO: 444581 - RNA, 32 nt, Human
gcucagggaaaugaagacaggagaacugcugc

SEQ ID NO: 444582 - RNA, 32 nt, Human
gcucagggaaggccucuucaugggcauguucc

SEQ ID NO: 444583 - RNA, 32 nt, Human
gcucagggacugcccucaucugauguccucuc

SEQ ID NO: 444584 - RNA, 32 nt, Human
gcucagggacugcccucauuugauguccuuuu

SEQ ID NO: 444585 - RNA, 20 nt, Human
gcucagggagcagcagagcc

SEQ ID NO: 444586 - RNA, 32 nt, Human
gcucagggagccaaagggaacagccagauccu

SEQ ID NO: 444587 - RNA, 32 nt, Human
gcucagggagcuaggcaguugcccaaggggac

SEQ ID NO: 444588 - RNA, 32 nt, Human
gcucagggaggcacugugagccaggaauggau

SEQ ID NO: 444589 - RNA, 32 nt, Human
gcucagggaguagaccugacuggggagcuaag

SEQ ID NO: 444590 - RNA, 32 nt, Human
gcucagggaugggccuuccagccggagcaccc

SEQ ID NO: 444591 - RNA, 31 nt, Human
gcucagggcaaaggcaacuuggcuucacagg

SEQ ID NO: 444592 - RNA, 32 nt, Human
gcucagggcacugagagaucccagaagguaac

SEQ ID NO: 444593 - RNA, 32 nt, Human
gcucagggccaguucuggugggcagcagagac

SEQ ID NO: 444594 - RNA, 21 nt, Human
gcucagggcccaccuccucca

SEQ ID NO: 444595 - RNA, 32 nt, Human
gcucagggcccaccuccuccagcgaguacccc

SEQ ID NO: 444596 - RNA, 32 nt, Human
gcucagggcccaguggccuggccagcucugga

SEQ ID NO: 444597 - RNA, 32 nt, Human
gcucagggccgcggccgacaucagcccggugu

SEQ ID NO: 444598 - RNA, 32 nt, Human
gcucagggccuggguugagggagcuuagggaa

SEQ ID NO: 444599 - RNA, 24 nt, Human
gcucagggcggucgagugcagugg

SEQ ID NO: 444600 - RNA, 32 nt, Human
gcucagggcugccggggagaccccaagaggac

SEQ ID NO: 444601 - RNA, 32 nt, Human
gcucagggcuugguacaaugagcugaauuaga

SEQ ID NO: 444602 - RNA, 32 nt, Human
gcucaggggaacacaagugcacagagagagau

SEQ ID NO: 444603 - RNA, 19 nt, Human
gcucaggggagaauggagu

SEQ ID NO: 444604 - RNA, 32 nt, Human
gcucaggggaggcaggaagaugaaggacuguu

SEQ ID NO: 444605 - RNA, 20 nt, Human
gcucaggggcagcucauaga

SEQ ID NO: 444606 - RNA, 21 nt, Human
gcucagggggcagcaagccag

SEQ ID NO: 444607 - RNA, 32 nt, Human
gcucagggggccaaggcugcagugagucauga

SEQ ID NO: 444608 - RNA, 19 nt, Human
gcucagggggccccugaug

SEQ ID NO: 444609 - RNA, 32 nt, Human
gcucaggggugagguggagagggagacaugac

SEQ ID NO: 444610 - RNA, 23 nt, Human
gcucaggggugggaucggggagc

SEQ ID NO: 444611 - RNA, 32 nt, Human
gcucagggucucaaacauggacgcccacugug

SEQ ID NO: 444612 - RNA, 32 nt, Human
gcucaggguggacagcugcucuugccaaccgg

SEQ ID NO: 444613 - RNA, 32 nt, Human
gcucagggugggcggaggaagcgguuagacgc

SEQ ID NO: 444614 - RNA, 32 nt, Human
gcucagguauaaccucaccuucccuggcucau

SEQ ID NO: 444615 - RNA, 20 nt, Human
gcucagguccgacccugcug

SEQ ID NO: 444616 - RNA, 32 nt, Human
gcucaggucuagggguuggggaauauuaaagu

SEQ ID NO: 444617 - RNA, 32 nt, Human
gcucaggucucacuccagccaucgcuguggcc

SEQ ID NO: 444618 - RNA, 32 nt, Human
gcucaggucuguggguucccuggucaugccau

SEQ ID NO: 444619 - RNA, 32 nt, Human
gcucaggucuguuuguaaaucuuuaauaaaua

SEQ ID NO: 444620 - RNA, 32 nt, Human
gcucaggugaguccucacaggcgugcugcagg

SEQ ID NO: 444621 - RNA, 32 nt, Human
gcucaggugauccucccaucucagccucucga

SEQ ID NO: 444622 - RNA, 32 nt, Human
gcucaggugauccucccaucucagccugccuc

SEQ ID NO: 444623 - RNA, 32 nt, Human
gcucaggugauccuccugccucaggccuuccc

SEQ ID NO: 444624 - RNA, 32 nt, Human
gcucaggugcagaagcagagccccuaacugga

SEQ ID NO: 444625 - RNA, 32 nt, Human
gcucaggugccaggucaggaugugggaggaca

SEQ ID NO: 444626 - RNA, 32 nt, Human
gcucaggugggacgagggcugcagugaaggcc

SEQ ID NO: 444627 - RNA, 32 nt, Human
gcucaggugggcagagcuuaaagggaacgccc

SEQ ID NO: 444628 - RNA, 32 nt, Human
gcucagguucaucauugaaacaucccaguguu

SEQ ID NO: 444629 - RNA, 32 nt, Human
gcucagguuccaagacucagcugccuaauccc

SEQ ID NO: 444630 - RNA, 18 nt, Human
gcucagguuguucacaga

SEQ ID NO: 444631 - RNA, 32 nt, Human
gcucagguuucugccuccagguacagucuggc

SEQ ID NO: 444632 - RNA, 20 nt, Human
gcucaguaaccagcugcgcc

SEQ ID NO: 444633 - RNA, 32 nt, Human
gcucaguaauuccuguuacuuuacagacagga

SEQ ID NO: 444634 - RNA, 32 nt, Human
gcucaguacagggcaggagcugcugugguguu

SEQ ID NO: 444635 - RNA, 20 nt, Human
gcucaguaccucagccaccu

SEQ ID NO: 444636 - RNA, 21 nt, Human
gcucaguagucagacuggaua

SEQ ID NO: 444637 - RNA, 32 nt, Human
gcucaguauagaacuacauuaucugcaaacuc

SEQ ID NO: 444638 - RNA, 32 nt, Human
gcucaguauuccuacaggguaagagguaggaa

SEQ ID NO: 444639 - RNA, 32 nt, Human
gcucagucaagaacuaagaaauaguaugaauu

SEQ ID NO: 444640 - RNA, 32 nt, Human
gcucagucaagggcuaaugauugcccaccccc

SEQ ID NO: 444641 - RNA, 32 nt, Human
gcucaguccuggaagaacguggccgccugccc

SEQ ID NO: 444642 - RNA, 32 nt, Human
gcucagucgcucaggcuggagugcaauggugg

SEQ ID NO: 444643 - RNA, 32 nt, Human
gcucagucuaggggaaggcagggccuuggucc

SEQ ID NO: 444644 - RNA, 32 nt, Human
gcucagucucaaaggcagaugcaucagagcca

SEQ ID NO: 444645 - RNA, 32 nt, Human
gcucagucuccaaguuccuuuaugaaacaggg

SEQ ID NO: 444646 - RNA, 32 nt, Human
gcucagucuccaggagacucagggccugccag

SEQ ID NO: 444647 - RNA, 32 nt, Human
gcucagucuggacucuacuuacacucauuuuu

SEQ ID NO: 444648 - RNA, 32 nt, Human
gcucagugaaaggcuucccuacccuuugcacu

SEQ ID NO: 444649 - RNA, 32 nt, Human
gcucagugacccuuucucuagggggacaucag

SEQ ID NO: 444650 - RNA, 32 nt, Human
gcucagugaugacgugggggaggugggagagg

SEQ ID NO: 444651 - RNA, 32 nt, Human
gcucagugcaaccuccgccuccuggguucaag

SEQ ID NO: 444652 - RNA, 32 nt, Human
gcucagugcaaccuugaccuccugggcucaag

SEQ ID NO: 444653 - RNA, 32 nt, Human
gcucagugcagccucaaacuccugggcucaag

SEQ ID NO: 444654 - RNA, 32 nt, Human
gcucagugcagccucaaacucuugggcucaag

SEQ ID NO: 444655 - RNA, 32 nt, Human
gcucagugcagccuccaacuccugggcucaau

SEQ ID NO: 444656 - RNA, 32 nt, Human
gcucagugcccuuuaagugcaucccgcugugc

SEQ ID NO: 444657 - RNA, 32 nt, Human
gcucagugccugagauugaaaaagucaacaua

SEQ ID NO: 444658 - RNA, 32 nt, Human
gcucagugcuauuuauauacuacaguaauuuu

SEQ ID NO: 444659 - RNA, 32 nt, Human
gcucagugcugcuggaugaugagggagaucaa

SEQ ID NO: 444660 - RNA, 20 nt, Human
gcucaguggagcagcugcgg

SEQ ID NO: 444661 - RNA, 32 nt, Human
gcucaguggaucaugaccaaacuccugucaug

SEQ ID NO: 444662 - RNA, 19 nt, Human
gcucaguggauugcagugg

SEQ ID NO: 444663 - RNA, 24 nt, Human
gcucaguggcucacaccuguaauc

SEQ ID NO: 444664 - RNA, 32 nt, Human
gcucaguguaugcuaggcaacaauucucccgc

SEQ ID NO: 444665 - RNA, 32 nt, Human
gcucagugucacagaccuuuguggaagcaaca

SEQ ID NO: 444666 - RNA, 32 nt, Human
gcucagugucaccuggcuauggaaggggcugg

SEQ ID NO: 444667 - RNA, 31 nt, Human
gcucagugucauccagggccugugucccucc

SEQ ID NO: 444668 - RNA, 32 nt, Human
gcucagugugacccaaccuccuaauuucccca

SEQ ID NO: 444669 - RNA, 19 nt, Human
gcucaguuccacgacacgc

SEQ ID NO: 444670 - RNA, 21 nt, Human
gcucaguuccaggaaggcuga

SEQ ID NO: 444671 - RNA, 32 nt, Human
gcucaguuccaguagcagaaccaccuuaguug

SEQ ID NO: 444672 - RNA, 32 nt, Human
gcucaguugcaucuggaaggugcagugugcac

SEQ ID NO: 444673 - RNA, 32 nt, Human
gcucaguugcccagacuggagagcaguggcca

SEQ ID NO: 444674 - RNA, 19 nt, Human
gcucaguuggcucccaaag

SEQ ID NO: 444675 - RNA, 32 nt, Human
gcucaguuuccaggugguuccucugccuggca

SEQ ID NO: 444676 - RNA, 32 nt, Human
gcucauaccuguaaaucccagcacuuugggag

SEQ ID NO: 444677 - RNA, 32 nt, Human
gcucauaccuguaaucccagcaauuugggagg

SEQ ID NO: 444678 - RNA, 32 nt, Human
gcucauaccuguaaucccagcacuuugggaag

SEQ ID NO: 444679 - RNA, 32 nt, Human
gcucauaccuguaaucccagcacuuugggagg

SEQ ID NO: 444680 - RNA, 32 nt, Human
gcucauaccuguaaucccagcaguuugggagg

SEQ ID NO: 444681 - RNA, 32 nt, Human
gcucauaccuguaaucccaggacuuugggagg

SEQ ID NO: 444682 - RNA, 32 nt, Human
gcucauaccuguaaucccggcacuuugggagg

SEQ ID NO: 444683 - RNA, 32 nt, Human
gcucauaccuguaauccuagcacucugggagg

SEQ ID NO: 444684 - RNA, 32 nt, Human
gcucauaccuguaaucucagcacugugggagg

SEQ ID NO: 444685 - RNA, 32 nt, Human
gcucauaccuguaaugccagcacuuugggagg

SEQ ID NO: 444686 - RNA, 32 nt, Human
gcucauaccuguuaauuccagcacuuugggag

SEQ ID NO: 444687 - RNA, 32 nt, Human
gcucauaccuguuauaccagcacuuugggagg

SEQ ID NO: 444688 - RNA, 31 nt, Human
gcucauacucauaauggccuguugaguuguu

SEQ ID NO: 444689 - RNA, 32 nt, Human
gcucauacugauucauuuugaucucugcuaau

SEQ ID NO: 444690 - RNA, 32 nt, Human
gcucauacuuguaacccagcacuuugggaagc

SEQ ID NO: 444691 - RNA, 32 nt, Human
gcucauagcaagcuccgccuccuggguucaug

SEQ ID NO: 444692 - RNA, 32 nt, Human
gcucauaucugugauuccagcacuuugagagg

SEQ ID NO: 444693 - RNA, 32 nt, Human
gcucauaugccaccuuuuuaaaccaauggaaa

SEQ ID NO: 444694 - RNA, 32 nt, Human
gcucauauguauaaucuuagcacuuugggagg

SEQ ID NO: 444695 - RNA, 32 nt, Human
gcucauauguuuagaauggucaagcaauccca

SEQ ID NO: 444696 - RNA, 32 nt, Human
gcucauauuccugaugcauuugccagaugcaa

SEQ ID NO: 444697 - RNA, 32 nt, Human
gcucauauuuacacuuacagcuuuucauuuga

SEQ ID NO: 444698 - RNA, 22 nt, Human
gcucaucaaacucucagcauau

SEQ ID NO: 444699 - RNA, 32 nt, Human
gcucaucacaguucuuuccucuuucugcucug

SEQ ID NO: 444700 - RNA, 22 nt, Human
gcucaucacauguccuucccca

SEQ ID NO: 444701 - RNA, 27 nt, Human
gcucaucacccuuccacauccuccucc

SEQ ID NO: 444702 - RNA, 32 nt, Human
gcucaucaccuugggaggccacuguaggagga

SEQ ID NO: 444703 - RNA, 32 nt, Human
gcucaucagacugaaacuugcucacagacuuc

SEQ ID NO: 444704 - RNA, 32 nt, Human
gcucaucagccaaaacucaagccuugccuuuu

SEQ ID NO: 444705 - RNA, 24 nt, Human
gcucaucaucccuucuucauacca

SEQ ID NO: 444706 - RNA, 32 nt, Human
gcucauccauccacagagcagugcagugggag

SEQ ID NO: 444707 - RNA, 32 nt, Human
gcucaucccaaagcauuugccucuuuuguguc

SEQ ID NO: 444708 - RNA, 32 nt, Human
gcucaucccuguaaucccagugcuuugggagg

SEQ ID NO: 444709 - RNA, 32 nt, Human
gcucaucccuguaauuccagcacuuuggaagg

SEQ ID NO: 444710 - RNA, 27 nt, Human
gcucaucccuuuuagggcaacaaggaa

SEQ ID NO: 444711 - RNA, 32 nt, Human
gcucauccgccguggagagcgaggccacgcac

SEQ ID NO: 444712 - RNA, 21 nt, Human
gcucauccgugucucugaaga

SEQ ID NO: 444713 - RNA, 32 nt, Human
gcucauccugggagagaggugacaaguucaga

SEQ ID NO: 444714 - RNA, 32 nt, Human
gcucaucggagaagaaagaauggcugucagcc

SEQ ID NO: 444715 - RNA, 32 nt, Human
gcucaucguaaccuccaccucccggguucaag

SEQ ID NO: 444716 - RNA, 32 nt, Human
gcucaucgucuagugaggaaggcaugugugaa

SEQ ID NO: 444717 - RNA, 32 nt, Human
gcucaucguuucuucccggaaacaucugcaga

SEQ ID NO: 444718 - RNA, 32 nt, Human
gcucaucuaacaggcuggaguuuucaggcaga

SEQ ID NO: 444719 - RNA, 32 nt, Human
gcucaucuacauuggcauucuggaccaugccc

SEQ ID NO: 444720 - RNA, 32 nt, Human
gcucaucuaggguggacccagcugcuggggaa

SEQ ID NO: 444721 - RNA, 32 nt, Human
gcucaucuccauuagaaaauggagucaucuua

SEQ ID NO: 444722 - RNA, 32 nt, Human
gcucaucucccaggauggugacuaaguagcuu

SEQ ID NO: 444723 - RNA, 32 nt, Human
gcucaucucgugaccucugccacccacauccu

SEQ ID NO: 444724 - RNA, 32 nt, Human
gcucaucucuccccauuucuuucuucccauaa

SEQ ID NO: 444725 - RNA, 32 nt, Human
gcucaucucugaguucucaggacccuugcccc

SEQ ID NO: 444726 - RNA, 32 nt, Human
gcucaucugccugggcccgugcaguuuugcag

SEQ ID NO: 444727 - RNA, 32 nt, Human
gcucaucugggcagaggaagcuucagaaagcu

SEQ ID NO: 444728 - RNA, 24 nt, Human
gcucaucuuagcuuacaaacacua

SEQ ID NO: 444729 - RNA, 32 nt, Human
gcucaucuucaugaccuacaauggguaccucu

SEQ ID NO: 444730 - RNA, 18 nt, Human
gcucaucuugaaacuuga

SEQ ID NO: 444731 - RNA, 28 nt, Human
gcucaucuuuggauugccucaucauccc

SEQ ID NO: 444732 - RNA, 21 nt, Human
gcucaugacagcacccugcug

SEQ ID NO: 444733 - RNA, 19 nt, Human
gcucaugacuguaauccca

SEQ ID NO: 444734 - RNA, 32 nt, Human
gcucaugacuguaaucccaacacuuuggagga

SEQ ID NO: 444735 - RNA, 32 nt, Human
gcucaugacuguaaucccagcacuuugggagg

SEQ ID NO: 444736 - RNA, 32 nt, Human
gcucaugacuguaaucccaguacuuugggaag

SEQ ID NO: 444737 - RNA, 32 nt, Human
gcucaugauaacuuacgggauaacaauaguag

SEQ ID NO: 444738 - RNA, 32 nt, Human
gcucaugauguucuuucuggagguucaacacu

SEQ ID NO: 444739 - RNA, 32 nt, Human
gcucaugcacaugcaacaggugcgucugucua

SEQ ID NO: 444740 - RNA, 31 nt, Human
gcucaugcacuuuauguauauguuccaggaa

SEQ ID NO: 444741 - RNA, 32 nt, Human
gcucaugcauguaaucccagcacuuugggagg

SEQ ID NO: 444742 - RNA, 32 nt, Human
gcucaugcaugugucaaugucauaacugucuu

SEQ ID NO: 444743 - RNA, 32 nt, Human
gcucaugccacaggaucccagcacuuugggag

SEQ ID NO: 444744 - RNA, 32 nt, Human
gcucaugccagcaauccuagcacuuugggagg

SEQ ID NO: 444745 - RNA, 32 nt, Human
gcucaugccaguuaucccagcacuuugggagg

SEQ ID NO: 444746 - RNA, 32 nt, Human
gcucaugcccauaaucccagcacuuugggaga

SEQ ID NO: 444747 - RNA, 32 nt, Human
gcucaugcccguaaucccagcacuuugggaga

SEQ ID NO: 444748 - RNA, 32 nt, Human
gcucaugcccguaaucccagcacuuugguagg

SEQ ID NO: 444749 - RNA, 32 nt, Human
gcucaugcccguaaucucagcacuuugggagg

SEQ ID NO: 444750 - RNA, 32 nt, Human
gcucaugcccguaauuucugcacuuugggaga

SEQ ID NO: 444751 - RNA, 32 nt, Human
gcucaugcccucaauguuuauauuguguuauc

SEQ ID NO: 444752 - RNA, 17 nt, Human
gcucaugcccuucagcu

SEQ ID NO: 444753 - RNA, 32 nt, Human
gcucaugccgguaaucucagcacuuugggagg

SEQ ID NO: 444754 - RNA, 32 nt, Human
gcucaugccuauaaaauuccagcacuuuggga

SEQ ID NO: 444755 - RNA, 19 nt, Human
gcucaugccuauaauccca

SEQ ID NO: 444756 - RNA, 32 nt, Human
gcucaugccuauaaucccagcacuuuaggagc

SEQ ID NO: 444757 - RNA, 32 nt, Human
gcucaugccuauaaucccagcacuuuaggagg

SEQ ID NO: 444758 - RNA, 32 nt, Human
gcucaugccuauaaucccagcacuuugagagg

SEQ ID NO: 444759 - RNA, 32 nt, Human
gcucaugccuauaaucccagcacuuuggcagg

SEQ ID NO: 444760 - RNA, 32 nt, Human
gcucaugccuauaaucccagcacuuugggaag

SEQ ID NO: 444761 - RNA, 32 nt, Human
gcucaugccuauaaucccagcacuuugggagg

SEQ ID NO: 444762 - RNA, 32 nt, Human
gcucaugccuauaaucccagcacuuuuggagg

SEQ ID NO: 444763 - RNA, 32 nt, Human
gcucaugccuauaaucccggcacuuugggagg

SEQ ID NO: 444764 - RNA, 32 nt, Human
gcucaugccuauaaucccggcacuuugggagu

SEQ ID NO: 444765 - RNA, 32 nt, Human
gcucaugccuauaauccuagcacuuugagagg

SEQ ID NO: 444766 - RNA, 32 nt, Human
gcucaugccuauaauccuagcacuuugggagg

SEQ ID NO: 444767 - RNA, 32 nt, Human
gcucaugccuauaaucucagcacuuuugggag

SEQ ID NO: 444768 - RNA, 32 nt, Human
gcucaugccuauaaucuuagcacuuugggagg

SEQ ID NO: 444769 - RNA, 32 nt, Human
gcucaugccuauaauuccagcacuuuggaggg

SEQ ID NO: 444770 - RNA, 32 nt, Human
gcucaugccuauaauuccagcacuuugggagg

SEQ ID NO: 444771 - RNA, 32 nt, Human
gcucaugccuauagucccagcacuuugggagg

SEQ ID NO: 444772 - RNA, 32 nt, Human
gcucaugccuauauucccagcacuuugagagg

SEQ ID NO: 444773 - RNA, 32 nt, Human
gcucaugccuauauucccugcacuuugggagg

SEQ ID NO: 444774 - RNA, 32 nt, Human
gcucaugccuauuaucccagcacuuugggagg

SEQ ID NO: 444775 - RNA, 32 nt, Human
gcucaugccucuaaucccagcacuuugggagg

SEQ ID NO: 444776 - RNA, 32 nt, Human
gcucaugccugaaauccuagcacuuugggaag

SEQ ID NO: 444777 - RNA, 32 nt, Human
gcucaugccugcaaucccagcacuuugggagg

SEQ ID NO: 444778 - RNA, 32 nt, Human
gcucaugccugcaauuccagcacuuugggagg

SEQ ID NO: 444779 - RNA, 32 nt, Human
gcucaugccuggaaucccagcacuuugagagg

SEQ ID NO: 444780 - RNA, 32 nt, Human
gcucaugccuggaaucccagcacuuugggagg

SEQ ID NO: 444781 - RNA, 32 nt, Human
gcucaugccuguaaacccagcacuuugggagg

SEQ ID NO: 444782 - RNA, 32 nt, Human
gcucaugccuguaaaucccagcacuuugguag

SEQ ID NO: 444783 - RNA, 32 nt, Human
gcucaugccuguaaccccagcacuuugggagg

SEQ ID NO: 444784 - RNA, 32 nt, Human
gcucaugccuguaaccucagcacuuugggagg

SEQ ID NO: 444785 - RNA, 32 nt, Human
gcucaugccuguaagcccaacacuuugggagg

SEQ ID NO: 444786 - RNA, 32 nt, Human
gcucaugccuguaagcccagcacuuugggagg

SEQ ID NO: 444787 - RNA, 32 nt, Human
gcucaugccuguaauagcagcuacucgggagg

SEQ ID NO: 444788 - RNA, 32 nt, Human
gcucaugccuguaaucaaucccagcacuuugg

SEQ ID NO: 444789 - RNA, 32 nt, Human
gcucaugccuguaaucauagcauuaugggagg

SEQ ID NO: 444790 - RNA, 32 nt, Human
gcucaugccuguaauccaacauugggaggcca

SEQ ID NO: 444791 - RNA, 32 nt, Human
gcucaugccuguaauccaagcauuuugagagg

SEQ ID NO: 444792 - RNA, 32 nt, Human
gcucaugccuguaauccagcacuuugggaggc

SEQ ID NO: 444793 - RNA, 32 nt, Human
gcucaugccuguaauccaguacuuuaggaggc

SEQ ID NO: 444794 - RNA, 18 nt, Human
gcucaugccuguaauccc

SEQ ID NO: 444795 - RNA, 19 nt, Human
gcucaugccuguaauccca

SEQ ID NO: 444796 - RNA, 32 nt, Human
gcucaugccuguaaucccaaaacuuugggagu

SEQ ID NO: 444797 - RNA, 32 nt, Human
gcucaugccuguaaucccaacacucugggagg

SEQ ID NO: 444798 - RNA, 32 nt, Human
gcucaugccuguaaucccaacacuuugagaag

SEQ ID NO: 444799 - RNA, 32 nt, Human
gcucaugccuguaaucccaacacuuugagagg

SEQ ID NO: 444800 - RNA, 32 nt, Human
gcucaugccuguaaucccaacacuuugggaga

SEQ ID NO: 444801 - RNA, 32 nt, Human
gcucaugccuguaaucccaacacuuugggagg

SEQ ID NO: 444802 - RNA, 32 nt, Human
gcucaugccuguaaucccaacacuuugggagu

SEQ ID NO: 444803 - RNA, 32 nt, Human
gcucaugccuguaaucccaacacuuuugggag

SEQ ID NO: 444804 - RNA, 32 nt, Human
gcucaugccuguaaucccaacauucugggagg

SEQ ID NO: 444805 - RNA, 32 nt, Human
gcucaugccuguaaucccaauacuuugggagg

SEQ ID NO: 444806 - RNA, 32 nt, Human
gcucaugccuguaaucccaccacuuugggagg

SEQ ID NO: 444807 - RNA, 32 nt, Human
gcucaugccuguaaucccaccacuuugggugg

SEQ ID NO: 444808 - RNA, 32 nt, Human
gcucaugccuguaaucccagaacuuugggagg

SEQ ID NO: 444809 - RNA, 32 nt, Human
gcucaugccuguaaucccagaauuuugggagg

SEQ ID NO: 444810 - RNA, 21 nt, Human
gcucaugccuguaaucccagc

SEQ ID NO: 444811 - RNA, 32 nt, Human
gcucaugccuguaaucccagcaauuuaggagg

SEQ ID NO: 444812 - RNA, 32 nt, Human
gcucaugccuguaaucccagcacauugggaag

SEQ ID NO: 444813 - RNA, 32 nt, Human
gcucaugccuguaaucccagcaccuugaaggc

SEQ ID NO: 444814 - RNA, 32 nt, Human
gcucaugccuguaaucccagcaccuugggagg

SEQ ID NO: 444815 - RNA, 32 nt, Human
gcucaugccuguaaucccagcacuaugggagg

SEQ ID NO: 444816 - RNA, 32 nt, Human
gcucaugccuguaaucccagcacucuggaagg

SEQ ID NO: 444817 - RNA, 32 nt, Human
gcucaugccuguaaucccagcacucugggagg

SEQ ID NO: 444818 - RNA, 32 nt, Human
gcucaugccuguaaucccagcacuguaggcgg

SEQ ID NO: 444819 - RNA, 32 nt, Human
gcucaugccuguaaucccagcacugugggaga

SEQ ID NO: 444820 - RNA, 32 nt, Human
gcucaugccuguaaucccagcacugugggagg

SEQ ID NO: 444821 - RNA, 32 nt, Human
gcucaugccuguaaucccagcacuuauuuuau

SEQ ID NO: 444822 - RNA, 32 nt, Human
gcucaugccuguaaucccagcacuucaggagg

SEQ ID NO: 444823 - RNA, 32 nt, Human
gcucaugccuguaaucccagcacuucgggagg

SEQ ID NO: 444824 - RNA, 32 nt, Human
gcucaugccuguaaucccagcacuuggagagg

SEQ ID NO: 444825 - RNA, 32 nt, Human
gcucaugccuguaaucccagcacuugggaggc

SEQ ID NO: 444826 - RNA, 32 nt, Human
gcucaugccuguaaucccagcacuuggggagg

SEQ ID NO: 444827 - RNA, 32 nt, Human
gcucaugccuguaaucccagcacuuucaaagg

SEQ ID NO: 444828 - RNA, 32 nt, Human
gcucaugccuguaaucccagcacuuucagagg

SEQ ID NO: 444829 - RNA, 32 nt, Human
gcucaugccuguaaucccagcacuuucggagg

SEQ ID NO: 444830 - RNA, 32 nt, Human
gcucaugccuguaaucccagcacuuugagaga

SEQ ID NO: 444831 - RNA, 32 nt, Human
gcucaugccuguaaucccagcacuuugagagg

SEQ ID NO: 444832 - RNA, 32 nt, Human
gcucaugccuguaaucccagcacuuugauagg

SEQ ID NO: 444833 - RNA, 32 nt, Human
gcucaugccuguaaucccagcacuuugcgagg

SEQ ID NO: 444834 - RNA, 32 nt, Human
gcucaugccuguaaucccagcacuuuggaagg

SEQ ID NO: 444835 - RNA, 32 nt, Human
gcucaugccuguaaucccagcacuuuggcagg

SEQ ID NO: 444836 - RNA, 32 nt, Human
gcucaugccuguaaucccagcacuuugggaag

SEQ ID NO: 444837 - RNA, 32 nt, Human
gcucaugccuguaaucccagcacuuugggaga

SEQ ID NO: 444838 - RNA, 32 nt, Human
gcucaugccuguaaucccagcacuuugggagg

SEQ ID NO: 444839 - RNA, 32 nt, Human
gcucaugccuguaaucccagcacuuugggagu

SEQ ID NO: 444840 - RNA, 32 nt, Human
gcucaugccuguaaucccagcacuuugggaug

SEQ ID NO: 444841 - RNA, 32 nt, Human
gcucaugccuguaaucccagcacuuugggauu

SEQ ID NO: 444842 - RNA, 32 nt, Human
gcucaugccuguaaucccagcacuuuggggag

SEQ ID NO: 444843 - RNA, 32 nt, Human
gcucaugccuguaaucccagcacuuugggggc

SEQ ID NO: 444844 - RNA, 32 nt, Human
gcucaugccuguaaucccagcacuuugguagg

SEQ ID NO: 444845 - RNA, 32 nt, Human
gcucaugccuguaaucccagcacuuuucggag

SEQ ID NO: 444846 - RNA, 32 nt, Human
gcucaugccuguaaucccagcacuuuugaggc

SEQ ID NO: 444847 - RNA, 32 nt, Human
gcucaugccuguaaucccagcacuuuuggagg

SEQ ID NO: 444848 - RNA, 32 nt, Human
gcucaugccuguaaucccagcauuuugagagg

SEQ ID NO: 444849 - RNA, 32 nt, Human
gcucaugccuguaaucccagcauuuuggaagg

SEQ ID NO: 444850 - RNA, 32 nt, Human
gcucaugccuguaaucccagcauuuugggaga

SEQ ID NO: 444851 - RNA, 32 nt, Human
gcucaugccuguaaucccagcauuuugggagg

SEQ ID NO: 444852 - RNA, 32 nt, Human
gcucaugccuguaaucccagcauuuugguagg

SEQ ID NO: 444853 - RNA, 32 nt, Human
gcucaugccuguaaucccagcccuuugggagg

SEQ ID NO: 444854 - RNA, 32 nt, Human
gcucaugccuguaaucccagcgcuuugggagg

SEQ ID NO: 444855 - RNA, 32 nt, Human
gcucaugccuguaaucccaggacuuugggagg

SEQ ID NO: 444856 - RNA, 32 nt, Human
gcucaugccuguaaucccaggacuuugguagg

SEQ ID NO: 444857 - RNA, 21 nt, Human
gcucaugccuguaaucccagu

SEQ ID NO: 444858 - RNA, 32 nt, Human
gcucaugccuguaaucccaguacuuugggagg

SEQ ID NO: 444859 - RNA, 32 nt, Human
gcucaugccuguaaucccagugcuuugggagg

SEQ ID NO: 444860 - RNA, 32 nt, Human
gcucaugccuguaaucccgacacuuugggagg

SEQ ID NO: 444861 - RNA, 32 nt, Human
gcucaugccuguaaucccggcacuuugggagg

SEQ ID NO: 444862 - RNA, 21 nt, Human
gcucaugccuguaaucccugc

SEQ ID NO: 444863 - RNA, 32 nt, Human
gcucaugccuguaaucccugcaauuugggaga

SEQ ID NO: 444864 - RNA, 32 nt, Human
gcucaugccuguaaucccugcacuuugggagg

SEQ ID NO: 444865 - RNA, 32 nt, Human
gcucaugccuguaaucccugcacuuugggaug

SEQ ID NO: 444866 - RNA, 32 nt, Human
gcucaugccuguaauccgagcacuucgggaag

SEQ ID NO: 444867 - RNA, 32 nt, Human
gcucaugccuguaauccgagcacuuugggagg

SEQ ID NO: 444868 - RNA, 19 nt, Human
gcucaugccuguaauccua

SEQ ID NO: 444869 - RNA, 32 nt, Human
gcucaugccuguaauccuaacacuuugggagg

SEQ ID NO: 444870 - RNA, 21 nt, Human
gcucaugccuguaauccuagc

SEQ ID NO: 444871 - RNA, 32 nt, Human
gcucaugccuguaauccuagcacuuugagagg

SEQ ID NO: 444872 - RNA, 32 nt, Human
gcucaugccuguaauccuagcacuuuggaagg

SEQ ID NO: 444873 - RNA, 32 nt, Human
gcucaugccuguaauccuagcacuuugggaag

SEQ ID NO: 444874 - RNA, 32 nt, Human
gcucaugccuguaauccuagcacuuugggagg

SEQ ID NO: 444875 - RNA, 32 nt, Human
gcucaugccuguaauccuagcacuuuggggga

SEQ ID NO: 444876 - RNA, 32 nt, Human
gcucaugccuguaauccuagcacuuugggugg

SEQ ID NO: 444877 - RNA, 32 nt, Human
gcucaugccuguaauccuagcagcuugggagg

SEQ ID NO: 444878 - RNA, 32 nt, Human
gcucaugccuguaauccuagcagguugggagg

SEQ ID NO: 444879 - RNA, 32 nt, Human
gcucaugccuguaauccuagcauuuugggagg

SEQ ID NO: 444880 - RNA, 32 nt, Human
gcucaugccuguaauccuggcacuuugggagg

SEQ ID NO: 444881 - RNA, 32 nt, Human
gcucaugccuguaaucgcagcacuuugggagg

SEQ ID NO: 444882 - RNA, 32 nt, Human
gcucaugccuguaaucguagcacuuugagagg

SEQ ID NO: 444883 - RNA, 32 nt, Human
gcucaugccuguaaucucaacacuuugggaag

SEQ ID NO: 444884 - RNA, 32 nt, Human
gcucaugccuguaaucucagaacuuugggagg

SEQ ID NO: 444885 - RNA, 32 nt, Human
gcucaugccuguaaucucagcaauuugggagg

SEQ ID NO: 444886 - RNA, 32 nt, Human
gcucaugccuguaaucucagcacuguaggagg

SEQ ID NO: 444887 - RNA, 32 nt, Human
gcucaugccuguaaucucagcacuuugagagg

SEQ ID NO: 444888 - RNA, 32 nt, Human
gcucaugccuguaaucucagcacuuugggaga

SEQ ID NO: 444889 - RNA, 32 nt, Human
gcucaugccuguaaucucagcacuuugggagg

SEQ ID NO: 444890 - RNA, 32 nt, Human
gcucaugccuguaaucucagcuacuuggcugg

SEQ ID NO: 444891 - RNA, 32 nt, Human
gcucaugccuguaaucucaguacauugggagg

SEQ ID NO: 444892 - RNA, 32 nt, Human
gcucaugccuguaaucucaguacuuugggagg

SEQ ID NO: 444893 - RNA, 22 nt, Human
gcucaugccuguaaucuccagc

SEQ ID NO: 444894 - RNA, 32 nt, Human
gcucaugccuguaaucuccagcacuuugggag

SEQ ID NO: 444895 - RNA, 32 nt, Human
gcucaugccuguaaucugagcacuuugggaga

SEQ ID NO: 444896 - RNA, 32 nt, Human
gcucaugccuguaaucuuaucacuuugggagg

SEQ ID NO: 444897 - RNA, 32 nt, Human
gcucaugccuguaaugccagcacuuugccaag

SEQ ID NO: 444898 - RNA, 32 nt, Human
gcucaugccuguaauuccagcacuuuaggagg

SEQ ID NO: 444899 - RNA, 32 nt, Human
gcucaugccuguaauuccagcacuuugggagg

SEQ ID NO: 444900 - RNA, 32 nt, Human
gcucaugccuguaauuccggcacuuugggagg

SEQ ID NO: 444901 - RNA, 32 nt, Human
gcucaugccuguaauuucaguacuuugggagg

SEQ ID NO: 444902 - RNA, 32 nt, Human
gcucaugccuguagucccagcacucgggaagg

SEQ ID NO: 444903 - RNA, 32 nt, Human
gcucaugccuguagucccagcacucugugggg

SEQ ID NO: 444904 - RNA, 32 nt, Human
gcucaugccuguagucccagcacuuugggaga

SEQ ID NO: 444905 - RNA, 32 nt, Human
gcucaugccuguagucccagcacuuugggagg

SEQ ID NO: 444906 - RNA, 32 nt, Human
gcucaugccuguagucccagcuacucuggagg

SEQ ID NO: 444907 - RNA, 32 nt, Human
gcucaugccuguagucccagcuacuugggagg

SEQ ID NO: 444908 - RNA, 32 nt, Human
gcucaugccuguaguccuagcacuuugggagg

SEQ ID NO: 444909 - RNA, 32 nt, Human
gcucaugccuguaguuccagcgcuuugggagg

SEQ ID NO: 444910 - RNA, 32 nt, Human
gcucaugccuguauaaucccagcacuuuggga

SEQ ID NO: 444911 - RNA, 32 nt, Human
gcucaugccuguauccagcacuuugggaggcc

SEQ ID NO: 444912 - RNA, 32 nt, Human
gcucaugccuguaucccagcacuuugggaggc

SEQ ID NO: 444913 - RNA, 32 nt, Human
gcucaugccuguaucccagcccuuugggaggc

SEQ ID NO: 444914 - RNA, 32 nt, Human
gcucaugccuguauucccaccacuuugggagg

SEQ ID NO: 444915 - RNA, 32 nt, Human
gcucaugccuguauucccaguacuuugggagc

SEQ ID NO: 444916 - RNA, 32 nt, Human
gcucaugccugucaucccagcacuuugggaag

SEQ ID NO: 444917 - RNA, 32 nt, Human
gcucaugccugucaucccagcacuuugggagg

SEQ ID NO: 444918 - RNA, 32 nt, Human
gcucaugccugugaucccagcacuuugggagg

SEQ ID NO: 444919 - RNA, 32 nt, Human
gcucaugccugugaucccagcacuuugggugg

SEQ ID NO: 444920 - RNA, 32 nt, Human
gcucaugccugugauccuagcacuuugcgagg

SEQ ID NO: 444921 - RNA, 32 nt, Human
gcucaugccugugauccuagcacuuugggagu

SEQ ID NO: 444922 - RNA, 32 nt, Human
gcucaugccugugaucgcagcacuuugggagg

SEQ ID NO: 444923 - RNA, 32 nt, Human
gcucaugccuguggucccagcacuuugggagg

SEQ ID NO: 444924 - RNA, 32 nt, Human
gcucaugccuuaaucccagcacuuugggaggu

SEQ ID NO: 444925 - RNA, 32 nt, Human
gcucaugccuuaaucccagcacuuuuggaggc

SEQ ID NO: 444926 - RNA, 32 nt, Human
gcucaugccuuuaaucccagcacuuugggagg

SEQ ID NO: 444927 - RNA, 32 nt, Human
gcucaugcgacugcacuccagccugggugacu

SEQ ID NO: 444928 - RNA, 32 nt, Human
gcucaugcguguaaucccagcacuuugggagg

SEQ ID NO: 444929 - RNA, 32 nt, Human
gcucaugcuccuggugcugcugggacuugggg

SEQ ID NO: 444930 - RNA, 32 nt, Human
gcucaugcugccggcccugcgccugcccagcc

SEQ ID NO: 444931 - RNA, 32 nt, Human
gcucaugcuggucucaaacuccugggcucaag

SEQ ID NO: 444932 - RNA, 19 nt, Human
gcucaugcuuguaauccca

SEQ ID NO: 444933 - RNA, 21 nt, Human
gcucaugcuuguaaucccagc

SEQ ID NO: 444934 - RNA, 32 nt, Human
gcucaugcuuguaaucccagcacuuggggagg

SEQ ID NO: 444935 - RNA, 32 nt, Human
gcucaugcuuguaaucccagcacuuugggaag

SEQ ID NO: 444936 - RNA, 32 nt, Human
gcucaugcuuguaaucccagcacuuugggagg

SEQ ID NO: 444937 - RNA, 32 nt, Human
gcucaugcuuguaaucccagcacuuugguagg

SEQ ID NO: 444938 - RNA, 32 nt, Human
gcucaugcuuguaauccuagcacuuuuugagg

SEQ ID NO: 444939 - RNA, 19 nt, Human
gcucaugcuuguaaucuca

SEQ ID NO: 444940 - RNA, 32 nt, Human
gcucaugcuuguaaucucaacauuuugggagg

SEQ ID NO: 444941 - RNA, 32 nt, Human
gcucaugcuuguaaucucaccacuuugggagg

SEQ ID NO: 444942 - RNA, 32 nt, Human
gcucaugcuuguaaucucagcacuuugggagu

SEQ ID NO: 444943 - RNA, 20 nt, Human
gcucauggagcacaagcaga

SEQ ID NO: 444944 - RNA, 17 nt, Human
gcucauggagcgcaggg

SEQ ID NO: 444945 - RNA, 29 nt, Human
gcucauggcgggcggaggagccggggacc

SEQ ID NO: 444946 - RNA, 32 nt, Human
gcucauggcuacgcuccagccccgggugugga

SEQ ID NO: 444947 - RNA, 32 nt, Human
gcucaugggaucugguuguuuagaagcaugca

SEQ ID NO: 444948 - RNA, 32 nt, Human
gcucaugggcucugagccaaagaaggaggcau

SEQ ID NO: 444949 - RNA, 24 nt, Human
gcucaugguuaaugcaggcaggug

SEQ ID NO: 444950 - RNA, 32 nt, Human
gcucaugucuauaaucccagcacuuugggagg

SEQ ID NO: 444951 - RNA, 32 nt, Human
gcucaugucucuaaucccagcacuuugggaga

SEQ ID NO: 444952 - RNA, 19 nt, Human
gcucaugucuguaauccca

SEQ ID NO: 444953 - RNA, 21 nt, Human
gcucaugucuguaaucccagc

SEQ ID NO: 444954 - RNA, 29 nt, Human
gcucaugucuguaaucccagcacuuuggg

SEQ ID NO: 444955 - RNA, 32 nt, Human
gcucaugucuguaaucccagcacuuugggagg

SEQ ID NO: 444956 - RNA, 29 nt, Human
gcucaugucuuacccugucaucuugccag

SEQ ID NO: 444957 - RNA, 29 nt, Human
gcucaugucuuacccugucuucuugccag

SEQ ID NO: 444958 - RNA, 32 nt, Human
gcucaugugugggcacacacgcacaaacacac

SEQ ID NO: 444959 - RNA, 32 nt, Human
gcucauguguuuuggggacaaaagugaaauga

SEQ ID NO: 444960 - RNA, 32 nt, Human
gcucauguuucuuuggucauucuguccauccu

SEQ ID NO: 444961 - RNA, 32 nt, Human
gcucauguuuguaaaucccagcacuuugggaa

SEQ ID NO: 444962 - RNA, 32 nt, Human
gcucauguuuguaaucccagcacuuuggggga

SEQ ID NO: 444963 - RNA, 32 nt, Human
gcucauguuuguaauccuagcacuuugggagg

SEQ ID NO: 444964 - RNA, 22 nt, Human
gcucauuaaacagccuccccca

SEQ ID NO: 444965 - RNA, 32 nt, Human
gcucauuacaaccuccaccucccggguucagg

SEQ ID NO: 444966 - RNA, 32 nt, Human
gcucauuacagccuccgccuccugggcucaag

SEQ ID NO: 444967 - RNA, 32 nt, Human
gcucauuacaguucuuuccucuuucugcucug

SEQ ID NO: 444968 - RNA, 19 nt, Human
gcucauuaccugccaucca

SEQ ID NO: 444969 - RNA, 32 nt, Human
gcucauucaaagauguucucagugcaacugag

SEQ ID NO: 444970 - RNA, 32 nt, Human
gcucauucaaagcugaaucagaaaccagccgu

SEQ ID NO: 444971 - RNA, 32 nt, Human
gcucauucacucaaaaagcaacagugagacag

SEQ ID NO: 444972 - RNA, 21 nt, Human
gcucauucacugcaaacuccc

SEQ ID NO: 444973 - RNA, 32 nt, Human
gcucauucagcaucugaccucuaccuucauaa

SEQ ID NO: 444974 - RNA, 32 nt, Human
gcucauuccccgagcacuccagccuggcaguc

SEQ ID NO: 444975 - RNA, 32 nt, Human
gcucauucccugggagugcacacacugagccc

SEQ ID NO: 444976 - RNA, 32 nt, Human
gcucauuccuguaaucccagcacuuugggagg

SEQ ID NO: 444977 - RNA, 32 nt, Human
gcucauuccuguaaucccagcucuuugggagg

SEQ ID NO: 444978 - RNA, 20 nt, Human
gcucauucgucacccuguug

SEQ ID NO: 444979 - RNA, 20 nt, Human
gcucauucugucccaugcug

SEQ ID NO: 444980 - RNA, 32 nt, Human
gcucauugaagccucgcacuccugggcucaag

SEQ ID NO: 444981 - RNA, 32 nt, Human
gcucauugcaaccuccgccuccuggguucaag

SEQ ID NO: 444982 - RNA, 32 nt, Human
gcucauugcaacuuccaccuccuggguugaag

SEQ ID NO: 444983 - RNA, 32 nt, Human
gcucauugcaacuuccacuucccagguucaag

SEQ ID NO: 444984 - RNA, 32 nt, Human
gcucauugcaccugggagggcaccuggagcuc

SEQ ID NO: 444985 - RNA, 32 nt, Human
gcucauugcagccucaaacuccugggcucaag

SEQ ID NO: 444986 - RNA, 22 nt, Human
gcucauugcagccucaaccucc

SEQ ID NO: 444987 - RNA, 32 nt, Human
gcucauugcagccuccacuuccugggcucaag

SEQ ID NO: 444988 - RNA, 32 nt, Human
gcucauugcagccucgaacuccugggcucaua

SEQ ID NO: 444989 - RNA, 32 nt, Human
gcucauugcagccuucaauuccugggcucagg

SEQ ID NO: 444990 - RNA, 32 nt, Human
gcucauugcagcuuugaccuccugggcuuagg

SEQ ID NO: 444991 - RNA, 32 nt, Human
gcucauugcaucuuugaccuccugggcucagc

SEQ ID NO: 444992 - RNA, 32 nt, Human
gcucauugcucuucagagagagugguuggagc

SEQ ID NO: 444993 - RNA, 32 nt, Human
gcucauugcuuucuaagaucuaaaaugauacu

SEQ ID NO: 444994 - RNA, 32 nt, Human
gcucauuggauucagguauuuuucccuuugca

SEQ ID NO: 444995 - RNA, 32 nt, Human
gcucauuuccacccaaccccaggauuuccaca

SEQ ID NO: 444996 - RNA, 32 nt, Human
gcucauuuccacccagccccaggauuuccaga

SEQ ID NO: 444997 - RNA, 24 nt, Human
gcucauuucuaucauucuccccca

SEQ ID NO: 444998 - RNA, 20 nt, Human
gcucauuucuguguugccuu

SEQ ID NO: 444999 - RNA, 18 nt, Human
gcucauuugcuugccuug

SEQ ID NO: 445000 - RNA, 16 nt, Human
gcucauuuggguucag

SEQ ID NO: 445001 - RNA, 18 nt, Human
gcucauuugguucaggca

SEQ ID NO: 445002 - RNA, 32 nt, Human
gcuccaaaaagccccagaaagaguaugccuuc

SEQ ID NO: 445003 - RNA, 26 nt, Human
gcuccaaaauggucuccugguccgug

SEQ ID NO: 445004 - RNA, 32 nt, Human
gcuccaaaccuguaaggacccaggagggcuuc

SEQ ID NO: 445005 - RNA, 32 nt, Human
gcuccaaacuauuauccagacccauaacccca

SEQ ID NO: 445006 - RNA, 20 nt, Human
gcuccaaaguucuugaagca

SEQ ID NO: 445007 - RNA, 32 nt, Human
gcuccaacaauccucccaucucagccucugaa

SEQ ID NO: 445008 - RNA, 32 nt, Human
gcuccaacacaaaugcugccuccuuuaggaug

SEQ ID NO: 445009 - RNA, 32 nt, Human
gcuccaacaucaccagccucgguugacgugga

SEQ ID NO: 445010 - RNA, 32 nt, Human
gcuccaaccccucaaccucuaucucauagaug

SEQ ID NO: 445011 - RNA, 21 nt, Human
gcuccaaccucucuggucuuc

SEQ ID NO: 445012 - RNA, 32 nt, Human
gcuccaaccugcaaagaucuguccucagccuu

SEQ ID NO: 445013 - RNA, 32 nt, Human
gcuccaacucacugcucacccucuucugugag

SEQ ID NO: 445014 - RNA, 31 nt, Human
gcuccaacucccucagggccuguguugccgc

SEQ ID NO: 445015 - RNA, 32 nt, Human
gcuccaacugcuacaacagauccaucaagcaa

SEQ ID NO: 445016 - RNA, 32 nt, Human
gcuccaacuuccugcugacagggggcuuagug

SEQ ID NO: 445017 - RNA, 32 nt, Human
gcuccaagaaauagacagaaaguccccugaac

SEQ ID NO: 445018 - RNA, 32 nt, Human
gcuccaagacacugaccgggcuuuucagagcc

SEQ ID NO: 445019 - RNA, 32 nt, Human
gcuccaagcagagcagaaagaaaacagaugau

SEQ ID NO: 445020 - RNA, 32 nt, Human
gcuccaagcaguggacugcccacccacuccca

SEQ ID NO: 445021 - RNA, 32 nt, Human
gcuccaagcucugcuuuuccuuccucugaaac

SEQ ID NO: 445022 - RNA, 32 nt, Human
gcuccaaggaacauugccucucuggaucugcu

SEQ ID NO: 445023 - RNA, 32 nt, Human
gcuccaaggcaguggaaauaaaaagaaggaaa

SEQ ID NO: 445024 - RNA, 32 nt, Human
gcuccaagggagaaacuucugggagccuccaa

SEQ ID NO: 445025 - RNA, 32 nt, Human
gcuccaagggagcguggucguggaagaaacaa

SEQ ID NO: 445026 - RNA, 32 nt, Human
gcuccaaguccagcaaccugcacuccagccug

SEQ ID NO: 445027 - RNA, 32 nt, Human
gcuccaaugccacugagcccugcucccucugc

SEQ ID NO: 445028 - RNA, 32 nt, Human
gcuccaauugccagcaaccucugcuuguccgg

SEQ ID NO: 445029 - RNA, 32 nt, Human
gcuccacaaccaccuccagccugggagauagg

SEQ ID NO: 445030 - RNA, 19 nt, Human
gcuccacaccagccauccc

SEQ ID NO: 445031 - RNA, 32 nt, Human
gcuccacaccgcagcgcagccuccgggacucc

SEQ ID NO: 445032 - RNA, 32 nt, Human
gcuccacaccugccuccauagcacuuugccug

SEQ ID NO: 445033 - RNA, 19 nt, Human
gcuccacagcuguagcucu

SEQ ID NO: 445034 - RNA, 32 nt, Human
gcuccacaggccugcacucggagucuggggcc

SEQ ID NO: 445035 - RNA, 18 nt, Human
gcuccacagggacuugag

SEQ ID NO: 445036 - RNA, 32 nt, Human
gcuccacagggacuugaggcaugcaguuggga

SEQ ID NO: 445037 - RNA, 32 nt, Human
gcuccacagguugggagccgucgugggaccug

SEQ ID NO: 445038 - RNA, 32 nt, Human
gcuccacaguccugucauccuggucaggacua

SEQ ID NO: 445039 - RNA, 32 nt, Human
gcuccacauccagcuuucaucuuccaucaaug

SEQ ID NO: 445040 - RNA, 32 nt, Human
gcuccacauccuucauucacugaucucuggga

SEQ ID NO: 445041 - RNA, 20 nt, Human
gcuccacauucuccuccucg

SEQ ID NO: 445042 - RNA, 22 nt, Human
gcuccaccagccacugaugcca

SEQ ID NO: 445043 - RNA, 32 nt, Human
gcuccaccagcugcagaauuucaacacgcuga

SEQ ID NO: 445044 - RNA, 23 nt, Human
gcuccaccagcuuccagggcggc

SEQ ID NO: 445045 - RNA, 32 nt, Human
gcuccacccagaggccaguccugugugucugg

SEQ ID NO: 445046 - RNA, 32 nt, Human
gcuccacccagccugcgccacuguguucuuaa

SEQ ID NO: 445047 - RNA, 32 nt, Human
gcuccacccagccugcgccacuguguucuucu

SEQ ID NO: 445048 - RNA, 32 nt, Human
gcuccacccagcucugugcccaaggccccuga

SEQ ID NO: 445049 - RNA, 32 nt, Human
gcuccacccauggcuaaagggggccaagguau

SEQ ID NO: 445050 - RNA, 23 nt, Human
gcuccaccccccggcucccggga

SEQ ID NO: 445051 - RNA, 32 nt, Human
gcuccacccucucucccaccauggcccgucag

SEQ ID NO: 445052 - RNA, 32 nt, Human
gcuccacccucucuccccuggaaaggacacca

SEQ ID NO: 445053 - RNA, 32 nt, Human
gcuccacccugcagaaccucagugguggcguc

SEQ ID NO: 445054 - RNA, 32 nt, Human
gcuccaccuccaacuugacaucaugcuuucug

SEQ ID NO: 445055 - RNA, 32 nt, Human
gcuccaccuccugauccuguguguccuccgac

SEQ ID NO: 445056 - RNA, 19 nt, Human
gcuccaccuccuggguuca

SEQ ID NO: 445057 - RNA, 21 nt, Human
gcuccaccuucucuggucuuc

SEQ ID NO: 445058 - RNA, 20 nt, Human
gcuccacgcccuccaggggg

SEQ ID NO: 445059 - RNA, 23 nt, Human
gcuccacgcugucgcagccaccg

SEQ ID NO: 445060 - RNA, 32 nt, Human
gcuccacggcaccauggccccgaagcugcugc

SEQ ID NO: 445061 - RNA, 32 nt, Human
gcuccacguguacccccuucacucccucccac

SEQ ID NO: 445062 - RNA, 23 nt, Human
gcuccacguucucuucugucugu

SEQ ID NO: 445063 - RNA, 21 nt, Human
gcuccacuccaccggccugug

SEQ ID NO: 445064 - RNA, 32 nt, Human
gcuccacucccaggcccacuugcugccauugg

SEQ ID NO: 445065 - RNA, 32 nt, Human
gcuccacucccaggcucugggggcuggggagu

SEQ ID NO: 445066 - RNA, 32 nt, Human
gcuccacuccuuggcuggaggcagugcugagg

SEQ ID NO: 445067 - RNA, 32 nt, Human
gcuccacugauuggaggauagagccagcuguc

SEQ ID NO: 445068 - RNA, 32 nt, Human
gcuccacugcaacaucacgguuuuccuuguuc

SEQ ID NO: 445069 - RNA, 32 nt, Human
gcuccacugcaacaucacguuuuccuuguucc

SEQ ID NO: 445070 - RNA, 32 nt, Human
gcuccacugcacuccagcccaggugacagugu

SEQ ID NO: 445071 - RNA, 32 nt, Human
gcuccacugcacuccagccugggugacagauc

SEQ ID NO: 445072 - RNA, 32 nt, Human
gcuccacugcuggucauucuggaugaugaggc

SEQ ID NO: 445073 - RNA, 32 nt, Human
gcuccacugucucuccugccucccucuuucau

SEQ ID NO: 445074 - RNA, 32 nt, Human
gcuccacugugguccagaaaaggaggccuuuc

SEQ ID NO: 445075 - RNA, 21 nt, Human
gcuccacuuccagaagccagg

SEQ ID NO: 445076 - RNA, 32 nt, Human
gcuccacuuccgaggaggagaaguagcuacau

SEQ ID NO: 445077 - RNA, 32 nt, Human
gcuccacuugcugguguuuuauagauucauac

SEQ ID NO: 445078 - RNA, 32 nt, Human
gcuccacuuuugaggcugcaguccauucagag

SEQ ID NO: 445079 - RNA, 32 nt, Human
gcuccagaaauuuuccucuggaacuaucagga

SEQ ID NO: 445080 - RNA, 32 nt, Human
gcuccagaaggagcuuuccaggauagcuuuga

SEQ ID NO: 445081 - RNA, 25 nt, Human
gcuccagaagucugugacuaccuug

SEQ ID NO: 445082 - RNA, 32 nt, Human
gcuccagaaucaggagcuuccccucaggaaau

SEQ ID NO: 445083 - RNA, 32 nt, Human
gcuccagaccccacuacagcagcuuuugacug

SEQ ID NO: 445084 - RNA, 32 nt, Human
gcuccagaccccagagggccagaagaacucac

SEQ ID NO: 445085 - RNA, 32 nt, Human
gcuccagaccuggaauccacaaaagccaaacc

SEQ ID NO: 445086 - RNA, 32 nt, Human
gcuccagacucaauuagaacagcuccaagaag

SEQ ID NO: 445087 - RNA, 21 nt, Human
gcuccagagagcugccuucca

SEQ ID NO: 445088 - RNA, 32 nt, Human
gcuccagagcauaccguggcccaggugguauc

SEQ ID NO: 445089 - RNA, 32 nt, Human
gcuccagagcccacgaggcuugcagaucgggg

SEQ ID NO: 445090 - RNA, 32 nt, Human
gcuccagagcccagauguaaaaggugcaauuu

SEQ ID NO: 445091 - RNA, 17 nt, Human
gcuccagagcucagggg

SEQ ID NO: 445092 - RNA, 32 nt, Human
gcuccagagugccggcgcagggccaagagcca

SEQ ID NO: 445093 - RNA, 32 nt, Human
gcuccagauaaagcugaggagccugugccagu

SEQ ID NO: 445094 - RNA, 20 nt, Human
gcuccagaugcgcuuuucca

SEQ ID NO: 445095 - RNA, 19 nt, Human
gcuccagcaaaagcgcagg

SEQ ID NO: 445096 - RNA, 21 nt, Human
gcuccagcaagcccgucaucu

SEQ ID NO: 445097 - RNA, 31 nt, Human
gcuccagcaagcucgaccaugccaagagacu

SEQ ID NO: 445098 - RNA, 32 nt, Human
gcuccagcagaggaaguuccaguccccacccg

SEQ ID NO: 445099 - RNA, 32 nt, Human
gcuccagcagaggcugggcaccuucagccauc

SEQ ID NO: 445100 - RNA, 23 nt, Human
gcuccagcagccccaaccccgcc

SEQ ID NO: 445101 - RNA, 32 nt, Human
gcuccagcagcuucaccuggagggaggggugc

SEQ ID NO: 445102 - RNA, 21 nt, Human
gcuccagcaggaaauggcuga

SEQ ID NO: 445103 - RNA, 21 nt, Human
gcuccagcaggauggcggcuc

SEQ ID NO: 445104 - RNA, 32 nt, Human
gcuccagcaguuacagcagcagcagcuccagc

SEQ ID NO: 445105 - RNA, 21 nt, Human
gcuccagcaucccgucagggg

SEQ ID NO: 445106 - RNA, 17 nt, Human
gcuccagccaaaagggg

SEQ ID NO: 445107 - RNA, 32 nt, Human
gcuccagccacaucuggacccaucagugacug

SEQ ID NO: 445108 - RNA, 32 nt, Human
gcuccagccacugcccuggccucagcauauca

SEQ ID NO: 445109 - RNA, 32 nt, Human
gcuccagccagaucuggcuggggacagcaccg

SEQ ID NO: 445110 - RNA, 32 nt, Human
gcuccagccagcagcucccacacugcucccag

SEQ ID NO: 445111 - RNA, 32 nt, Human
gcuccagccagccccuaacugguccccagaag

SEQ ID NO: 445112 - RNA, 17 nt, Human
gcuccagccagccgggg

SEQ ID NO: 445113 - RNA, 32 nt, Human
gcuccagccagcucugccccacagggaaggag

SEQ ID NO: 445114 - RNA, 20 nt, Human
gcuccagccaggccugggca

SEQ ID NO: 445115 - RNA, 32 nt, Human
gcuccagccauccucucaccucagccucccaa

SEQ ID NO: 445116 - RNA, 32 nt, Human
gcuccagcccaaugccccagcuggccuucccc

SEQ ID NO: 445117 - RNA, 21 nt, Human
gcuccagcccaccagcccucc

SEQ ID NO: 445118 - RNA, 22 nt, Human
gcuccagcccagccagcacucu

SEQ ID NO: 445119 - RNA, 32 nt, Human
gcuccagcccaggacuucgaggcugcaaugag

SEQ ID NO: 445120 - RNA, 20 nt, Human
gcuccagccccacagcccgc

SEQ ID NO: 445121 - RNA, 22 nt, Human
gcuccagccccgcagcccaccg

SEQ ID NO: 445122 - RNA, 21 nt, Human
gcuccagccccucucuugucu

SEQ ID NO: 445123 - RNA, 19 nt, Human
gcuccagccccuggaaggc

SEQ ID NO: 445124 - RNA, 19 nt, Human
gcuccagcccggcccggca

SEQ ID NO: 445125 - RNA, 32 nt, Human
gcuccagcccuucaucagccugggcagucuua

SEQ ID NO: 445126 - RNA, 23 nt, Human
gcuccagccgccgccgccgccgc

SEQ ID NO: 445127 - RNA, 22 nt, Human
gcuccagccgccugcagcgggg

SEQ ID NO: 445128 - RNA, 20 nt, Human
gcuccagccgggcgcagugg

SEQ ID NO: 445129 - RNA, 32 nt, Human
gcuccagccugaggcuuccagaagugcccuac

SEQ ID NO: 445130 - RNA, 23 nt, Human
gcuccagccugagugauagagug

SEQ ID NO: 445131 - RNA, 16 nt, Human
gcuccagccuggaggg

SEQ ID NO: 445132 - RNA, 32 nt, Human
gcuccagccugggcaacaaagugagacucugu

SEQ ID NO: 445133 - RNA, 22 nt, Human
gcuccagccugggcaacaagag

SEQ ID NO: 445134 - RNA, 26 nt, Human
gcuccagccugggugacagagugaga

SEQ ID NO: 445135 - RNA, 32 nt, Human
gcuccagccugggugaggagacccuguccuaa

SEQ ID NO: 445136 - RNA, 21 nt, Human
gcuccagcgaagaaaaggcug

SEQ ID NO: 445137 - RNA, 24 nt, Human
gcuccagcgacagccaacgccucu

SEQ ID NO: 445138 - RNA, 23 nt, Human
gcuccagcgccgcgcagccaccg

SEQ ID NO: 445139 - RNA, 19 nt, Human
gcuccagcuacucaggagg

SEQ ID NO: 445140 - RNA, 23 nt, Human
gcuccagcuacucaggaggcuga

SEQ ID NO: 445141 - RNA, 21 nt, Human
gcuccagcuagcauguuuuuc

SEQ ID NO: 445142 - RNA, 20 nt, Human
gcuccagcucacuaggccga

SEQ ID NO: 445143 - RNA, 32 nt, Human
gcuccagcucacucuaccccaucuccuugccg

SEQ ID NO: 445144 - RNA, 21 nt, Human
gcuccagcuccagaccuuguc

SEQ ID NO: 445145 - RNA, 32 nt, Human
gcuccagcucgugccaucuucccaauguacca

SEQ ID NO: 445146 - RNA, 32 nt, Human
gcuccagcugcagggccagggggugcagguga

SEQ ID NO: 445147 - RNA, 20 nt, Human
gcuccagcugccuuaggagg

SEQ ID NO: 445148 - RNA, 17 nt, Human
gcuccagcugggagggg

SEQ ID NO: 445149 - RNA, 32 nt, Human
gcuccagcugguuguugccaugugggaaugga

SEQ ID NO: 445150 - RNA, 32 nt, Human
gcuccagcuguggccuuccacucugagcccua

SEQ ID NO: 445151 - RNA, 32 nt, Human
gcuccagcuguucauaccacaucaguguuucc

SEQ ID NO: 445152 - RNA, 19 nt, Human
gcuccagcuguucgaaggu

SEQ ID NO: 445153 - RNA, 32 nt, Human
gcuccagcuguucuuccugcacaggccaucga

SEQ ID NO: 445154 - RNA, 32 nt, Human
gcuccagcuucucccuccaucucccuccccuu

SEQ ID NO: 445155 - RNA, 32 nt, Human
gcuccagcuuugaccugggaagcuguuucagg

SEQ ID NO: 445156 - RNA, 32 nt, Human
gcuccaggagaaagcaggcgggcgggcggaga

SEQ ID NO: 445157 - RNA, 21 nt, Human
gcuccaggagagagaagaggu

SEQ ID NO: 445158 - RNA, 20 nt, Human
gcuccaggagagugagcagg

SEQ ID NO: 445159 - RNA, 32 nt, Human
gcuccaggaggaagcccaggaggcugaugccu

SEQ ID NO: 445160 - RNA, 21 nt, Human
gcuccaggaggacaaggcuga

SEQ ID NO: 445161 - RNA, 23 nt, Human
gcuccaggaggagcaugugcagg

SEQ ID NO: 445162 - RNA, 32 nt, Human
gcuccaggagggaggcugggaggcaggacuuu

SEQ ID NO: 445163 - RNA, 24 nt, Human
gcuccaggaggucacacagcaggu

SEQ ID NO: 445164 - RNA, 21 nt, Human
gcuccaggcagacaaggcuga

SEQ ID NO: 445165 - RNA, 22 nt, Human
gcuccaggcaggagaaggcuga

SEQ ID NO: 445166 - RNA, 32 nt, Human
gcuccaggcaucccccucacccccaccaacga

SEQ ID NO: 445167 - RNA, 32 nt, Human
gcuccaggcaugaccccggcacccucauaggg

SEQ ID NO: 445168 - RNA, 32 nt, Human
gcuccaggccgagaggaugcuguugagcacau

SEQ ID NO: 445169 - RNA, 32 nt, Human
gcuccaggccguucuccuccccugagcaucca

SEQ ID NO: 445170 - RNA, 32 nt, Human
gcuccaggccuccauguguugugcugcacggg

SEQ ID NO: 445171 - RNA, 32 nt, Human
gcuccaggcgacccggccucugaccccacgga

SEQ ID NO: 445172 - RNA, 21 nt, Human
gcuccaggcggacaaggcuga

SEQ ID NO: 445173 - RNA, 32 nt, Human
gcuccaggcugugccuacacagcagugcuggu

SEQ ID NO: 445174 - RNA, 21 nt, Human
gcuccagggagcacaggaggu

SEQ ID NO: 445175 - RNA, 32 nt, Human
gcuccagggcagugucccucccuggcuugccu

SEQ ID NO: 445176 - RNA, 23 nt, Human
gcuccagggccacguuccagggu

SEQ ID NO: 445177 - RNA, 21 nt, Human
gcuccagggcugcccagcagg

SEQ ID NO: 445178 - RNA, 20 nt, Human
gcuccagggcuugucagagg

SEQ ID NO: 445179 - RNA, 16 nt, Human
gcuccaggggccagca

SEQ ID NO: 445180 - RNA, 20 nt, Human
gcuccaggggccccagcugg

SEQ ID NO: 445181 - RNA, 32 nt, Human
gcuccaggggcuaggugcguuaagaugagcau

SEQ ID NO: 445182 - RNA, 23 nt, Human
gcuccagggggaagacgcagagg

SEQ ID NO: 445183 - RNA, 21 nt, Human
gcuccagggucccugguuuuc

SEQ ID NO: 445184 - RNA, 32 nt, Human
gcuccagggucuggggcagcuugggcacaggu

SEQ ID NO: 445185 - RNA, 19 nt, Human
gcuccagguagacgcaggg

SEQ ID NO: 445186 - RNA, 32 nt, Human
gcuccaggucacaacucccaaaggagaugcag

SEQ ID NO: 445187 - RNA, 21 nt, Human
gcuccaggugcgccagcaggu

SEQ ID NO: 445188 - RNA, 32 nt, Human
gcuccaguaaaggguuuuggcugcauuugggg

SEQ ID NO: 445189 - RNA, 22 nt, Human
gcuccagucacccggaagcuga

SEQ ID NO: 445190 - RNA, 32 nt, Human
gcuccagucagcccacaagaugccauuguccc

SEQ ID NO: 445191 - RNA, 32 nt, Human
gcuccagucagccugcuuccacgaggccuguc

SEQ ID NO: 445192 - RNA, 21 nt, Human
gcuccaguccugugccaguag

SEQ ID NO: 445193 - RNA, 20 nt, Human
gcuccaguccuucccuagcc

SEQ ID NO: 445194 - RNA, 20 nt, Human
gcuccagucgggaauggcca

SEQ ID NO: 445195 - RNA, 32 nt, Human
gcuccagucuccacagccauccuggcccacac

SEQ ID NO: 445196 - RNA, 18 nt, Human
gcuccagucuccccugcc

SEQ ID NO: 445197 - RNA, 23 nt, Human
gcuccagugaaacuugggcacau

SEQ ID NO: 445198 - RNA, 32 nt, Human
gcuccagugauccucucaccucagccucccaa

SEQ ID NO: 445199 - RNA, 32 nt, Human
gcuccagugcugguuuuagaacaagaaugaag

SEQ ID NO: 445200 - RNA, 32 nt, Human
gcuccaguuaucuguauuuuauguaauguaau

SEQ ID NO: 445201 - RNA, 32 nt, Human
gcuccaguucccaacaaguuauucauuuccau

SEQ ID NO: 445202 - RNA, 21 nt, Human
gcuccaguugcucaucugaga

SEQ ID NO: 445203 - RNA, 24 nt, Human
gcuccaguugucaccauguuucca

SEQ ID NO: 445204 - RNA, 32 nt, Human
gcuccaguuugugggcuccucccaggccugac

SEQ ID NO: 445205 - RNA, 32 nt, Human
gcuccauagaggccuggcugacuggagcagag

SEQ ID NO: 445206 - RNA, 22 nt, Human
gcuccauagcgggcuccacagc

SEQ ID NO: 445207 - RNA, 32 nt, Human
gcuccaucaccaggcuggagugcaguggugcg

SEQ ID NO: 445208 - RNA, 32 nt, Human
gcuccaucacccaagccagagugcagugguga

SEQ ID NO: 445209 - RNA, 32 nt, Human
gcuccaucagccggcuggacaguuuuacaucu

SEQ ID NO: 445210 - RNA, 21 nt, Human
gcuccaucaucuucuuccgag

SEQ ID NO: 445211 - RNA, 32 nt, Human
gcuccaucaugaagacuugcuuccccaccaaa

SEQ ID NO: 445212 - RNA, 21 nt, Human
gcuccauccccagccccggcc

SEQ ID NO: 445213 - RNA, 32 nt, Human
gcuccaucccuggcuuccccagccugcggccg

SEQ ID NO: 445214 - RNA, 32 nt, Human
gcuccauccggcugccccauuccggcucccug

SEQ ID NO: 445215 - RNA, 19 nt, Human
gcuccauccuggcugcuug

SEQ ID NO: 445216 - RNA, 22 nt, Human
gcuccauccuucccugccgggg

SEQ ID NO: 445217 - RNA, 32 nt, Human
gcuccaucgcccaggccugggaugcagugaug

SEQ ID NO: 445218 - RNA, 32 nt, Human
gcuccaucgcccaggcugcagugcagugacac

SEQ ID NO: 445219 - RNA, 19 nt, Human
gcuccaucuauuuuuucca

SEQ ID NO: 445220 - RNA, 20 nt, Human
gcuccaucuccacccugcug

SEQ ID NO: 445221 - RNA, 32 nt, Human
gcuccaucugucccucccugaggucccucauc

SEQ ID NO: 445222 - RNA, 32 nt, Human
gcuccaucuuuuccucacucccucugauuggu

SEQ ID NO: 445223 - RNA, 23 nt, Human
gcuccaugcaaccucugccuccu

SEQ ID NO: 445224 - RNA, 32 nt, Human
gcuccaugcaaccucugccuccuggguucaag

SEQ ID NO: 445225 - RNA, 31 nt, Human
gcuccaugccucucuguccucuucuuuguug

SEQ ID NO: 445226 - RNA, 32 nt, Human
gcuccauggaccaggcccugcccaugcaucca

SEQ ID NO: 445227 - RNA, 32 nt, Human
gcuccauggaccaggcccugcccaugcauccg

SEQ ID NO: 445228 - RNA, 32 nt, Human
gcuccauggagccuucagucuccugggaagcu

SEQ ID NO: 445229 - RNA, 32 nt, Human
gcuccauguccuuguguggcugcuccagcgag

SEQ ID NO: 445230 - RNA, 32 nt, Human
gcuccauuauggcuugauuuacuccacgugca

SEQ ID NO: 445231 - RNA, 32 nt, Human
gcuccauucaucucugaggucucacagcccca

SEQ ID NO: 445232 - RNA, 32 nt, Human
gcuccauucauguuccugcaaaggacauaauc

SEQ ID NO: 445233 - RNA, 32 nt, Human
gcuccauuccaggucaacugaauuaaaauuug

SEQ ID NO: 445234 - RNA, 32 nt, Human
gcuccauucccacucccugccugucuccuagg

SEQ ID NO: 445235 - RNA, 32 nt, Human
gcuccauugcacuccagccugggcaacaagag

SEQ ID NO: 445236 - RNA, 32 nt, Human
gcuccauugcacuccagccugggcaacgagcg

SEQ ID NO: 445237 - RNA, 32 nt, Human
gcuccauugcacuccagccugggcgauagagu

SEQ ID NO: 445238 - RNA, 32 nt, Human
gcuccauugcacuccagccugggugacaguga

SEQ ID NO: 445239 - RNA, 32 nt, Human
gcuccauugcccaggcuggacugcagcagcgu

SEQ ID NO: 445240 - RNA, 32 nt, Human
gcuccauugcccaggcuggauuacaguggcgc

SEQ ID NO: 445241 - RNA, 32 nt, Human
gcuccauuguugaccacugauguaacucaacg

SEQ ID NO: 445242 - RNA, 32 nt, Human
gcuccauuguuugagccaagaaucuaagucau

SEQ ID NO: 445243 - RNA, 24 nt, Human
gcuccauuuccccuccuccucucu

SEQ ID NO: 445244 - RNA, 32 nt, Human
gcuccauuuccccuccuccucucuaccagaca

SEQ ID NO: 445245 - RNA, 32 nt, Human
gcucccaaaccaugucaggaccaccuuccucu

SEQ ID NO: 445246 - RNA, 21 nt, Human
gcucccaaagccagagcccag

SEQ ID NO: 445247 - RNA, 24 nt, Human
gcucccaaagcucugggaggacau

SEQ ID NO: 445248 - RNA, 32 nt, Human
gcucccaaaguacugggauuacaggcaugagc

SEQ ID NO: 445249 - RNA, 32 nt, Human
gcucccaaagugcugagauuacaggcaugaac

SEQ ID NO: 445250 - RNA, 32 nt, Human
gcucccaaagugcuggaauuacaggcauuagc

SEQ ID NO: 445251 - RNA, 32 nt, Human
gcucccaaagugcugggauuacaggcaugagc

SEQ ID NO: 445252 - RNA, 32 nt, Human
gcucccaaagugcugggauuacaggcgugagc

SEQ ID NO: 445253 - RNA, 32 nt, Human
gcucccaaaguguugggauuacaggcaugagc

SEQ ID NO: 445254 - RNA, 32 nt, Human
gcucccaaaguguugggauuacaggcgugagu

SEQ ID NO: 445255 - RNA, 32 nt, Human
gcucccaacuauucccguagcucagugccccc

SEQ ID NO: 445256 - RNA, 32 nt, Human
gcucccaagaggaggagagggaggcugcagac

SEQ ID NO: 445257 - RNA, 32 nt, Human
gcucccaagcuccauucuuccuucccucaacu

SEQ ID NO: 445258 - RNA, 32 nt, Human
gcucccaaggccaggugucucuaaaggaagcc

SEQ ID NO: 445259 - RNA, 32 nt, Human
gcucccaagggcuucugucuucaucucugcau

SEQ ID NO: 445260 - RNA, 32 nt, Human
gcucccaagguggcagugguggcagcagugau

SEQ ID NO: 445261 - RNA, 32 nt, Human
gcucccaaguagcugagauuacaggcauccgc

SEQ ID NO: 445262 - RNA, 32 nt, Human
gcucccaaguagcugggacuacaguagcuggg

SEQ ID NO: 445263 - RNA, 32 nt, Human
gcucccaaguagcugggauuacaggcauguac

SEQ ID NO: 445264 - RNA, 32 nt, Human
gcucccaaguagcugggauuacaggugcccgc

SEQ ID NO: 445265 - RNA, 32 nt, Human
gcucccaaucacccugcacauuugauucuaaa

SEQ ID NO: 445266 - RNA, 21 nt, Human
gcucccaauccaguccuccaa

SEQ ID NO: 445267 - RNA, 23 nt, Human
gcucccacaccccucggcccgug

SEQ ID NO: 445268 - RNA, 32 nt, Human
gcucccacaggcuggagugcaauggugugauc

SEQ ID NO: 445269 - RNA, 32 nt, Human
gcucccaccacugcacuccagccugggaagca

SEQ ID NO: 445270 - RNA, 32 nt, Human
gcucccaccacugcacuccagccugggcgaca

SEQ ID NO: 445271 - RNA, 32 nt, Human
gcucccaccagccugccaggccaggcuccugg

SEQ ID NO: 445272 - RNA, 32 nt, Human
gcucccaccagugugaagcagaaggaugacuu

SEQ ID NO: 445273 - RNA, 32 nt, Human
gcucccaccauggggcccaugccgaguggaug

SEQ ID NO: 445274 - RNA, 32 nt, Human
gcucccacccacccuccagaucccuuccagcu

SEQ ID NO: 445275 - RNA, 22 nt, Human
gcucccacccaccugacuccaa

SEQ ID NO: 445276 - RNA, 21 nt, Human
gcucccaccccuccggccccc

SEQ ID NO: 445277 - RNA, 22 nt, Human
gcucccaccccugaccuucucc

SEQ ID NO: 445278 - RNA, 19 nt, Human
gcucccacccuuucuccuc

SEQ ID NO: 445279 - RNA, 32 nt, Human
gcucccaccgcaguaccgccuccuggaacgga

SEQ ID NO: 445280 - RNA, 32 nt, Human
gcucccaccuauaauccuagcacuuugggagg

SEQ ID NO: 445281 - RNA, 18 nt, Human
gcucccaccucggccucc

SEQ ID NO: 445282 - RNA, 32 nt, Human
gcucccaccuguagucccagcacuuugggagg

SEQ ID NO: 445283 - RNA, 27 nt, Human
gcucccacgagucccugcucagcccca

SEQ ID NO: 445284 - RNA, 32 nt, Human
gcucccacgagucccugcucagccccagcagu

SEQ ID NO: 445285 - RNA, 32 nt, Human
gcucccacgcagcagagguuccacugagagga

SEQ ID NO: 445286 - RNA, 32 nt, Human
gcucccacggaggggagcaggaaugcugcacu

SEQ ID NO: 445287 - RNA, 32 nt, Human
gcucccacggaucccacuucugacaccaucua

SEQ ID NO: 445288 - RNA, 32 nt, Human
gcucccacuccaugcugcuucugggugggacc

SEQ ID NO: 445289 - RNA, 32 nt, Human
gcucccacugcacuccagccugggcgacagag

SEQ ID NO: 445290 - RNA, 32 nt, Human
gcucccacugccugucugcucuguucccaaag

SEQ ID NO: 445291 - RNA, 32 nt, Human
gcucccacugugguugagcuuuauguuuacag

SEQ ID NO: 445292 - RNA, 32 nt, Human
gcucccacuuccuuuuccuuaauaagaaccau

SEQ ID NO: 445293 - RNA, 32 nt, Human
gcucccacuuucccccuaacauagugccuguc

SEQ ID NO: 445294 - RNA, 22 nt, Human
gcucccagaagagcuggcauug

SEQ ID NO: 445295 - RNA, 32 nt, Human
gcucccagacacaggcccguccucggaagagc

SEQ ID NO: 445296 - RNA, 32 nt, Human
gcucccagcagagugaggacuucauucucuag

SEQ ID NO: 445297 - RNA, 32 nt, Human
gcucccagccaagaaccucggggccgcugcgc

SEQ ID NO: 445298 - RNA, 23 nt, Human
gcucccagcccagcuguagcucu

SEQ ID NO: 445299 - RNA, 32 nt, Human
gcucccagccugaauucugucuaucuagcugu

SEQ ID NO: 445300 - RNA, 32 nt, Human
gcucccagccugccucaccagggaagguugga

SEQ ID NO: 445301 - RNA, 32 nt, Human
gcucccagccugggcucugggagugggggcuc

SEQ ID NO: 445302 - RNA, 32 nt, Human
gcucccagcuacuuggaagacugaggugaaag

SEQ ID NO: 445303 - RNA, 32 nt, Human
gcucccagcucgaguugugggccccgccgcgg

SEQ ID NO: 445304 - RNA, 22 nt, Human
gcucccaggacccaggguacau

SEQ ID NO: 445305 - RNA, 32 nt, Human
gcucccaggagaaggggacccggccggagaag

SEQ ID NO: 445306 - RNA, 32 nt, Human
gcucccaggaugaacugguugcaguggcugcu

SEQ ID NO: 445307 - RNA, 32 nt, Human
gcucccaggcagccuccgccagccggaccccg

SEQ ID NO: 445308 - RNA, 32 nt, Human
gcucccaggcgagggggacuuggggcuuccac

SEQ ID NO: 445309 - RNA, 32 nt, Human
gcucccaggcuacgcaccuguacagcauguga

SEQ ID NO: 445310 - RNA, 32 nt, Human
gcucccaggcuggaguccaguggugugaucuc

SEQ ID NO: 445311 - RNA, 32 nt, Human
gcucccaggcuggggcugugcugcaggcuccg

SEQ ID NO: 445312 - RNA, 32 nt, Human
gcucccagggcggcccgcugccccacacccuc

SEQ ID NO: 445313 - RNA, 32 nt, Human
gcucccagguagcugggauuacgggcgcccac

SEQ ID NO: 445314 - RNA, 32 nt, Human
gcucccaguacagugcccccugcuuguggugc

SEQ ID NO: 445315 - RNA, 32 nt, Human
gcucccagugcagcugccaccccagcccaaau

SEQ ID NO: 445316 - RNA, 27 nt, Human
gcucccauaaccgcugauucucagggu

SEQ ID NO: 445317 - RNA, 32 nt, Human
gcucccaucauccugagcuagagacacgugac

SEQ ID NO: 445318 - RNA, 32 nt, Human
gcucccaucccuccuuccucuccuucuccaag

SEQ ID NO: 445319 - RNA, 21 nt, Human
gcucccaucucagucucccaa

SEQ ID NO: 445320 - RNA, 32 nt, Human
gcucccaucucuacccagucucaggccugcuu

SEQ ID NO: 445321 - RNA, 32 nt, Human
gcucccaucucucucuuugccucauagauuua

SEQ ID NO: 445322 - RNA, 20 nt, Human
gcucccaucucugauccucc

SEQ ID NO: 445323 - RNA, 24 nt, Human
gcucccaucugaaccacuuugccu

SEQ ID NO: 445324 - RNA, 32 nt, Human
gcucccaucugccucugcugcacacacaggca

SEQ ID NO: 445325 - RNA, 32 nt, Human
gcucccaucugucccugaggaagccccacuuc

SEQ ID NO: 445326 - RNA, 22 nt, Human
gcucccaugcacaacucuccaa

SEQ ID NO: 445327 - RNA, 32 nt, Human
gcucccaugccacccuccagaauucaccaaca

SEQ ID NO: 445328 - RNA, 32 nt, Human
gcucccaugggcuaggagccagugugaggcug

SEQ ID NO: 445329 - RNA, 32 nt, Human
gcucccaugugcuugaggaaggcuggugagcc

SEQ ID NO: 445330 - RNA, 32 nt, Human
gcucccauuagcuggugcaggcuuccguuaag

SEQ ID NO: 445331 - RNA, 32 nt, Human
gcucccauugcagcuacauacuugagauguac

SEQ ID NO: 445332 - RNA, 32 nt, Human
gcucccauuuagucucuuucuagccagccugu

SEQ ID NO: 445333 - RNA, 32 nt, Human
gcuccccaaauacccacagcucccaccgggua

SEQ ID NO: 445334 - RNA, 32 nt, Human
gcuccccaacccagugcugccaacuguacagc

SEQ ID NO: 445335 - RNA, 25 nt, Human
gcuccccaagaacgcggcucugcgc

SEQ ID NO: 445336 - RNA, 32 nt, Human
gcuccccaauaacugcacuucaccuguaaaga

SEQ ID NO: 445337 - RNA, 32 nt, Human
gcuccccaauccagcacucugccugcuccuuc

SEQ ID NO: 445338 - RNA, 32 nt, Human
gcuccccacacagcuggcuacacugcucaggc

SEQ ID NO: 445339 - RNA, 32 nt, Human
gcuccccacacgugcucgcagccuggcggggc

SEQ ID NO: 445340 - RNA, 32 nt, Human
gcuccccacagaccugguguaauuucacaagg

SEQ ID NO: 445341 - RNA, 22 nt, Human
gcuccccacaggucccucuccc

SEQ ID NO: 445342 - RNA, 32 nt, Human
gcuccccacccaggcagggcagcaugggaccc

SEQ ID NO: 445343 - RNA, 32 nt, Human
gcuccccacccuggcccccugccccugcacuc

SEQ ID NO: 445344 - RNA, 32 nt, Human
gcuccccacccuggcccugccccagccugugu

SEQ ID NO: 445345 - RNA, 21 nt, Human
gcuccccaccuggcucucagc

SEQ ID NO: 445346 - RNA, 32 nt, Human
gcuccccaccuugccugcgcccgcccggagcc

SEQ ID NO: 445347 - RNA, 19 nt, Human
gcuccccaccuuggccugc

SEQ ID NO: 445348 - RNA, 16 nt, Human
gcuccccacgccacca

SEQ ID NO: 445349 - RNA, 18 nt, Human
gcuccccacgcgccacca

SEQ ID NO: 445350 - RNA, 32 nt, Human
gcuccccacgcugaaacccugcagccuuaaga

SEQ ID NO: 445351 - RNA, 18 nt, Human
gcuccccacgugccacca

SEQ ID NO: 445352 - RNA, 32 nt, Human
gcuccccacucagaaaaggaggcggcuucggg

SEQ ID NO: 445353 - RNA, 32 nt, Human
gcuccccacugcacuugccaccugagucacau

SEQ ID NO: 445354 - RNA, 32 nt, Human
gcuccccagaagcaagagaguucaagugaagg

SEQ ID NO: 445355 - RNA, 25 nt, Human
gcuccccagaagcaccucucugggu

SEQ ID NO: 445356 - RNA, 32 nt, Human
gcuccccagccauguggaaguguaaguccaau

SEQ ID NO: 445357 - RNA, 26 nt, Human
gcuccccagcccaggguucccccagc

SEQ ID NO: 445358 - RNA, 32 nt, Human
gcuccccagccccaggccgggaggcccagaug

SEQ ID NO: 445359 - RNA, 22 nt, Human
gcuccccagcccuggcucugca

SEQ ID NO: 445360 - RNA, 22 nt, Human
gcuccccagcccuuccuuaggg

SEQ ID NO: 445361 - RNA, 22 nt, Human
gcuccccagcccuuugcugcgc

SEQ ID NO: 445362 - RNA, 24 nt, Human
gcuccccagcucacucucugaagc

SEQ ID NO: 445363 - RNA, 23 nt, Human
gcuccccagcucuuccugucagc

SEQ ID NO: 445364 - RNA, 32 nt, Human
gcuccccagcuuccucuccucggaaggcaauu

SEQ ID NO: 445365 - RNA, 32 nt, Human
gcuccccaggguggcaggagcugaggaagggc

SEQ ID NO: 445366 - RNA, 32 nt, Human
gcuccccaguagcugggacuacaggcgcccgc

SEQ ID NO: 445367 - RNA, 21 nt, Human
gcuccccaguuuccugggggu

SEQ ID NO: 445368 - RNA, 32 nt, Human
gcuccccaucugcccacccacuaaagcccaug

SEQ ID NO: 445369 - RNA, 32 nt, Human
gcuccccaucuucuccuuacugcaucucagcc

SEQ ID NO: 445370 - RNA, 32 nt, Human
gcuccccaugaagaucaggaucaacggcaggg

SEQ ID NO: 445371 - RNA, 32 nt, Human
gcuccccaugcuucacacaggucccccagaug

SEQ ID NO: 445372 - RNA, 22 nt, Human
gcuccccauggaccaggccugg

SEQ ID NO: 445373 - RNA, 32 nt, Human
gcuccccauugauugaagagucacugucugaa

SEQ ID NO: 445374 - RNA, 32 nt, Human
gcucccccagcaaucucugccuacaccuccug

SEQ ID NO: 445375 - RNA, 21 nt, Human
gcuccccccacaggggugcag

SEQ ID NO: 445376 - RNA, 32 nt, Human
gcucccccgaccggugggcauuugugaggccc

SEQ ID NO: 445377 - RNA, 32 nt, Human
gcucccccgcccugcccugcccucaccucccu

SEQ ID NO: 445378 - RNA, 32 nt, Human
gcucccccgcuguccccgaggauuucccgcgg

SEQ ID NO: 445379 - RNA, 23 nt, Human
gcucccccggacuggcccugccc

SEQ ID NO: 445380 - RNA, 32 nt, Human
gcucccccuccaccgccuccgccgccucagca

SEQ ID NO: 445381 - RNA, 32 nt, Human
gcucccccucccccaaauucccuuucuccucc

SEQ ID NO: 445382 - RNA, 32 nt, Human
gcucccccucccccuccucccugcuccuucgc

SEQ ID NO: 445383 - RNA, 23 nt, Human
gcucccccucugcuucucggggu

SEQ ID NO: 445384 - RNA, 23 nt, Human
gcucccccugcagaaugucuuca

SEQ ID NO: 445385 - RNA, 21 nt, Human
gcucccccugccucuccccuc

SEQ ID NO: 445386 - RNA, 32 nt, Human
gcucccccugcucacucucugcugaccuccgg

SEQ ID NO: 445387 - RNA, 32 nt, Human
gcucccccugugcugggcucugugccacacac

SEQ ID NO: 445388 - RNA, 32 nt, Human
gcucccccuucaccccuccuugcccgccuacc

SEQ ID NO: 445389 - RNA, 32 nt, Human
gcucccccuucuuuaguaauaggugcuggcaa

SEQ ID NO: 445390 - RNA, 19 nt, Human
gcuccccgacagguggggc

SEQ ID NO: 445391 - RNA, 26 nt, Human
gcuccccgccaccgccgccgccgccg

SEQ ID NO: 445392 - RNA, 22 nt, Human
gcuccccgcgccgccgccgccg

SEQ ID NO: 445393 - RNA, 32 nt, Human
gcuccccggcgcucacaccugagcucacucgc

SEQ ID NO: 445394 - RNA, 19 nt, Human
gcuccccggcuguggcccu

SEQ ID NO: 445395 - RNA, 21 nt, Human
gcuccccgggagccagcccca

SEQ ID NO: 445396 - RNA, 20 nt, Human
gcuccccggggcggggcggg

SEQ ID NO: 445397 - RNA, 26 nt, Human
gcuccccggugccgccgccgcugccg

SEQ ID NO: 445398 - RNA, 22 nt, Human
gcuccccggugcuaccuugccu

SEQ ID NO: 445399 - RNA, 21 nt, Human
gcuccccgugccacucagggu

SEQ ID NO: 445400 - RNA, 22 nt, Human
gcuccccgugccguggggcagg

SEQ ID NO: 445401 - RNA, 32 nt, Human
gcuccccuccagggcuccugcagccucgccgc

SEQ ID NO: 445402 - RNA, 32 nt, Human
gcuccccuccccucccccuccccgggcccggg

SEQ ID NO: 445403 - RNA, 32 nt, Human
gcuccccuccggagcugggauccaggcgcgua

SEQ ID NO: 445404 - RNA, 24 nt, Human
gcuccccuccugcucucccucccu

SEQ ID NO: 445405 - RNA, 32 nt, Human
gcuccccucugcccagcccuucccaggcugau

SEQ ID NO: 445406 - RNA, 21 nt, Human
gcuccccugaauaucuucucu

SEQ ID NO: 445407 - RNA, 32 nt, Human
gcuccccugagucucaggcaacaguuuuguca

SEQ ID NO: 445408 - RNA, 32 nt, Human
gcuccccugccaggauagacagaagagcugcc

SEQ ID NO: 445409 - RNA, 19 nt, Human
gcuccccugccccccucuc

SEQ ID NO: 445410 - RNA, 32 nt, Human
gcuccccugccucaccaccuccucuccgcucu

SEQ ID NO: 445411 - RNA, 26 nt, Human
gcuccccugccucuguucuccuuucu

SEQ ID NO: 445412 - RNA, 32 nt, Human
gcuccccugccugggcccugacuucagcuccc

SEQ ID NO: 445413 - RNA, 32 nt, Human
gcuccccugcgcccucuccucuccccgcgccc

SEQ ID NO: 445414 - RNA, 32 nt, Human
gcuccccugcugaagguggggauugcccaucc

SEQ ID NO: 445415 - RNA, 32 nt, Human
gcuccccugcuuuggggagaucucaaaccaug

SEQ ID NO: 445416 - RNA, 32 nt, Human
gcuccccugggucaccuccucccugcucgcug

SEQ ID NO: 445417 - RNA, 32 nt, Human
gcuccccuguucaaaguggccacagcgcagac

SEQ ID NO: 445418 - RNA, 32 nt, Human
gcuccccuguuuaucuagagccuucguuccug

SEQ ID NO: 445419 - RNA, 27 nt, Human
gcuccccuucccucccccuuccucucu

SEQ ID NO: 445420 - RNA, 22 nt, Human
gcuccccuuccuggcccucccc

SEQ ID NO: 445421 - RNA, 32 nt, Human
gcuccccuucucucuaccuucucccccaacgu

SEQ ID NO: 445422 - RNA, 32 nt, Human
gcuccccuugcagggcagacagugccuggcac

SEQ ID NO: 445423 - RNA, 23 nt, Human
gcuccccuuguagcugucuuaca

SEQ ID NO: 445424 - RNA, 32 nt, Human
gcuccccuuuccugcccugccuuucggugcaa

SEQ ID NO: 445425 - RNA, 32 nt, Human
gcucccgaaucccugcaucucccgccccaggc

SEQ ID NO: 445426 - RNA, 32 nt, Human
gcucccgaggagggggaugcagaggugaugca

SEQ ID NO: 445427 - RNA, 32 nt, Human
gcucccgaggcaggcaggcccaguugcuguuu

SEQ ID NO: 445428 - RNA, 32 nt, Human
gcucccgaguagcugggauuacaggcaugugc

SEQ ID NO: 445429 - RNA, 21 nt, Human
gcucccgauucuccuccucuc

SEQ ID NO: 445430 - RNA, 32 nt, Human
gcucccgcagacugagccacagccugggccuc

SEQ ID NO: 445431 - RNA, 32 nt, Human
gcucccgcagccgccccgccgcccgcccggag

SEQ ID NO: 445432 - RNA, 32 nt, Human
gcucccgcauuucucaugcuucuucucauggg

SEQ ID NO: 445433 - RNA, 21 nt, Human
gcucccgcccccacccuccaa

SEQ ID NO: 445434 - RNA, 32 nt, Human
gcucccgccuggaaucccagcacuuugggagg

SEQ ID NO: 445435 - RNA, 19 nt, Human
gcucccgccuguaauccca

SEQ ID NO: 445436 - RNA, 32 nt, Human
gcucccgccuguaaucccagaacuuugggagg

SEQ ID NO: 445437 - RNA, 32 nt, Human
gcucccgccuguaaucccagcacuuugggaag

SEQ ID NO: 445438 - RNA, 32 nt, Human
gcucccgccuguaaucccagcacuuugggagg

SEQ ID NO: 445439 - RNA, 32 nt, Human
gcucccgccuguaaucccaguacuuugggaag

SEQ ID NO: 445440 - RNA, 32 nt, Human
gcucccgccuguaaucccauuacuuugggagg

SEQ ID NO: 445441 - RNA, 32 nt, Human
gcucccgccuguaauccuagcacuuugggagg

SEQ ID NO: 445442 - RNA, 32 nt, Human
gcucccgccugugaucccggcacuuugggagg

SEQ ID NO: 445443 - RNA, 32 nt, Human
gcucccgcugggacuccacuuccguggauguc

SEQ ID NO: 445444 - RNA, 23 nt, Human
gcucccgcuguacugcagccccg

SEQ ID NO: 445445 - RNA, 32 nt, Human
gcucccggaagcugcagcagcugguaacaaag

SEQ ID NO: 445446 - RNA, 24 nt, Human
gcucccggacccugacucugcagc

SEQ ID NO: 445447 - RNA, 32 nt, Human
gcucccggcccggcagccgagccccagcacaa

SEQ ID NO: 445448 - RNA, 21 nt, Human
gcucccggcccggcccagccc

SEQ ID NO: 445449 - RNA, 21 nt, Human
gcucccggcgcacggagcaca

SEQ ID NO: 445450 - RNA, 32 nt, Human
gcucccggcucccucccccuucggauguggcu

SEQ ID NO: 445451 - RNA, 32 nt, Human
gcucccggcucugaggcugccccaggggcacu

SEQ ID NO: 445452 - RNA, 31 nt, Human
gcucccggcugaauaaaccucuuccuucuuu

SEQ ID NO: 445453 - RNA, 22 nt, Human
gcucccgggccucagccuccca

SEQ ID NO: 445454 - RNA, 32 nt, Human
gcucccggggcccagaggcaggacuguggcgg

SEQ ID NO: 445455 - RNA, 32 nt, Human
gcucccgguccgccucccagcaucccugcgag

SEQ ID NO: 445456 - RNA, 32 nt, Human
gcucccggugcugccugcagggccacaggcuc

SEQ ID NO: 445457 - RNA, 32 nt, Human
gcucccgguggaagcaagggagcccagccgga

SEQ ID NO: 445458 - RNA, 20 nt, Human
gcucccgguucccuccccag

SEQ ID NO: 445459 - RNA, 32 nt, Human
gcucccgguucccuccccagcuccucgucuuu

SEQ ID NO: 445460 - RNA, 23 nt, Human
gcucccguagcacacuauaacau

SEQ ID NO: 445461 - RNA, 32 nt, Human
gcucccgucccuggcccggaccuuggcugucu

SEQ ID NO: 445462 - RNA, 32 nt, Human
gcucccguugcuaccggaaugccucuucaggu

SEQ ID NO: 445463 - RNA, 32 nt, Human
gcucccuacaacuuccaccucccagguucaag

SEQ ID NO: 445464 - RNA, 32 nt, Human
gcucccuacccacacuggcuuccugccuccca

SEQ ID NO: 445465 - RNA, 32 nt, Human
gcucccuagagcaggagaucuugagugggaga

SEQ ID NO: 445466 - RNA, 24 nt, Human
gcucccuagccagacaguggaggu

SEQ ID NO: 445467 - RNA, 32 nt, Human
gcucccuauaaaaggcaggcagagccaccgag

SEQ ID NO: 445468 - RNA, 32 nt, Human
gcucccucacuggccuccggcaggccaggcug

SEQ ID NO: 445469 - RNA, 22 nt, Human
gcucccucagagcuacucuuca

SEQ ID NO: 445470 - RNA, 32 nt, Human
gcucccucagcuugcagggagguauggagagg

SEQ ID NO: 445471 - RNA, 32 nt, Human
gcucccucagcuugcagggagguguggagcga

SEQ ID NO: 445472 - RNA, 32 nt, Human
gcucccucagcuugcggggagguguggaggga

SEQ ID NO: 445473 - RNA, 21 nt, Human
gcucccucagugguugucuca

SEQ ID NO: 445474 - RNA, 32 nt, Human
gcucccucauagucuacccccacgccucagug

SEQ ID NO: 445475 - RNA, 32 nt, Human
gcucccuccagaaauagcaaacuucaugcagc

SEQ ID NO: 445476 - RNA, 32 nt, Human
gcucccuccagcccaugacccggggcuaggag

SEQ ID NO: 445477 - RNA, 32 nt, Human
gcucccuccauucagggcguuugggagccacc

SEQ ID NO: 445478 - RNA, 32 nt, Human
gcucccuccccacauuccccaugcucaaggcc

SEQ ID NO: 445479 - RNA, 23 nt, Human
gcucccuccccagggucaucuca

SEQ ID NO: 445480 - RNA, 32 nt, Human
gcucccuccccgagcuggcccagcacaaggca

SEQ ID NO: 445481 - RNA, 32 nt, Human
gcucccuccccuccucccuugcucaccccacg

SEQ ID NO: 445482 - RNA, 32 nt, Human
gcucccucccgcaccccgauguggaccucuac

SEQ ID NO: 445483 - RNA, 24 nt, Human
gcucccucccggggcucuucuuca

SEQ ID NO: 445484 - RNA, 32 nt, Human
gcucccucccuucaccuuuccucuccuggcgg

SEQ ID NO: 445485 - RNA, 24 nt, Human
gcucccuccucaagguugucuuca

SEQ ID NO: 445486 - RNA, 20 nt, Human
gcucccuccucccugccuuc

SEQ ID NO: 445487 - RNA, 24 nt, Human
gcucccuccucggaguccccuuca

SEQ ID NO: 445488 - RNA, 27 nt, Human
gcucccuccucggauuugauugucuuc

SEQ ID NO: 445489 - RNA, 23 nt, Human
gcucccuccucggcccgucccca

SEQ ID NO: 445490 - RNA, 24 nt, Human
gcucccuccucgggcugcauuuca

SEQ ID NO: 445491 - RNA, 32 nt, Human
gcucccuccucucuaccuaccucugaccuucu

SEQ ID NO: 445492 - RNA, 32 nt, Human
gcucccuccucuucuucaauaaccccaaagag

SEQ ID NO: 445493 - RNA, 18 nt, Human
gcucccuccugaagcagg

SEQ ID NO: 445494 - RNA, 23 nt, Human
gcucccucuaccuggaaaccucc

SEQ ID NO: 445495 - RNA, 32 nt, Human
gcucccucucaccacccucuucugccuaugag

SEQ ID NO: 445496 - RNA, 32 nt, Human
gcucccucuccccaaccgcgaaacgugagggg

SEQ ID NO: 445497 - RNA, 32 nt, Human
gcucccucuccgugcucugccugguggccacg

SEQ ID NO: 445498 - RNA, 32 nt, Human
gcucccucuccucccugagcaccugcugcugc

SEQ ID NO: 445499 - RNA, 32 nt, Human
gcucccucucuccacacggagcuccuggcagc

SEQ ID NO: 445500 - RNA, 32 nt, Human
gcucccucugcugccccugaugcaugcuucug

SEQ ID NO: 445501 - RNA, 32 nt, Human
gcucccucuggcccuucucuguuuaguaguug

SEQ ID NO: 445502 - RNA, 32 nt, Human
gcucccucuguggaggugaggaggggagauuc

SEQ ID NO: 445503 - RNA, 32 nt, Human
gcucccucuguggggccugcuggggccuggga

SEQ ID NO: 445504 - RNA, 32 nt, Human
gcucccucuguuaccuuuccaucuagcaaguu

SEQ ID NO: 445505 - RNA, 32 nt, Human
gcucccucuuggguccugugccaaguccgccc

SEQ ID NO: 445506 - RNA, 32 nt, Human
gcucccucuuugggguucccaaggcacccugu

SEQ ID NO: 445507 - RNA, 32 nt, Human
gcucccucuuuuccacagaggcugcugagggc

SEQ ID NO: 445508 - RNA, 32 nt, Human
gcucccugaagcuuuccuaauauugcugugcu

SEQ ID NO: 445509 - RNA, 32 nt, Human
gcucccugaauguuaaccacagaggagucacu

SEQ ID NO: 445510 - RNA, 32 nt, Human
gcucccugcaaccuccaccucccggguucaag

SEQ ID NO: 445511 - RNA, 23 nt, Human
gcucccugcaaccuccaccuccu

SEQ ID NO: 445512 - RNA, 32 nt, Human
gcucccugcaaccuccaccuccuggguucaaa

SEQ ID NO: 445513 - RNA, 32 nt, Human
gcucccugcaaccuccaccuccuggguucaag

SEQ ID NO: 445514 - RNA, 22 nt, Human
gcucccugcaaccuccgccucc

SEQ ID NO: 445515 - RNA, 32 nt, Human
gcucccugcaaccuccgccuccuggauuccag

SEQ ID NO: 445516 - RNA, 32 nt, Human
gcucccugcaaccuccgccuccuggguucaag

SEQ ID NO: 445517 - RNA, 32 nt, Human
gcucccugcaaccucugcuuccuggguucagg

SEQ ID NO: 445518 - RNA, 32 nt, Human
gcucccugcaaucuccaccucccagguucaag

SEQ ID NO: 445519 - RNA, 32 nt, Human
gcucccugcacacccaggccagccaccccucc

SEQ ID NO: 445520 - RNA, 32 nt, Human
gcucccugcaccuggccgcccugccuucccgc

SEQ ID NO: 445521 - RNA, 32 nt, Human
gcucccugcagccucaaacuccugggcucaag

SEQ ID NO: 445522 - RNA, 32 nt, Human
gcucccugcagccuugaccuccugggcucaag

SEQ ID NO: 445523 - RNA, 32 nt, Human
gcucccugcaguugcaaauuccugggcucaag

SEQ ID NO: 445524 - RNA, 21 nt, Human
gcucccugcccaggccauauc

SEQ ID NO: 445525 - RNA, 24 nt, Human
gcucccugccccccagaccauuuc

SEQ ID NO: 445526 - RNA, 22 nt, Human
gcucccugcccucugcucaccc

SEQ ID NO: 445527 - RNA, 32 nt, Human
gcucccugcccucugcucacccauguccaauc

SEQ ID NO: 445528 - RNA, 20 nt, Human
gcucccugcccuugagcccc

SEQ ID NO: 445529 - RNA, 20 nt, Human
gcucccugcccuuggggccc

SEQ ID NO: 445530 - RNA, 32 nt, Human
gcucccugccuccaagccuggugccacaggcc

SEQ ID NO: 445531 - RNA, 31 nt, Human
gcucccugccucuggggccuccaguccuuca

SEQ ID NO: 445532 - RNA, 25 nt, Human
gcucccugccuguggcucagcccca

SEQ ID NO: 445533 - RNA, 32 nt, Human
gcucccugcgcucccgccaccucggcaacucc

SEQ ID NO: 445534 - RNA, 21 nt, Human
gcucccugcuuuuucaugcca

SEQ ID NO: 445535 - RNA, 22 nt, Human
gcucccuggaacagugcagggg

SEQ ID NO: 445536 - RNA, 20 nt, Human
gcucccuggagcccagggca

SEQ ID NO: 445537 - RNA, 32 nt, Human
gcucccuggaggcugggccaggaggcagccuc

SEQ ID NO: 445538 - RNA, 32 nt, Human
gcucccuggccccugcccccagccccugcagc

SEQ ID NO: 445539 - RNA, 32 nt, Human
gcucccuggcucccaugucaagagucgcugug

SEQ ID NO: 445540 - RNA, 32 nt, Human
gcucccugggauucaauguucauuaaaauauc

SEQ ID NO: 445541 - RNA, 32 nt, Human
gcucccugggcuggcauggggaggggagagaa

SEQ ID NO: 445542 - RNA, 32 nt, Human
gcucccuggggaacccagcaggcggcgaagau

SEQ ID NO: 445543 - RNA, 32 nt, Human
gcucccuggggcuggucacagcuggcucauga

SEQ ID NO: 445544 - RNA, 20 nt, Human
gcucccugggucccuuccca

SEQ ID NO: 445545 - RNA, 23 nt, Human
gcucccugggucuccuccucucu

SEQ ID NO: 445546 - RNA, 32 nt, Human
gcucccugguagggacaauaaagguuuugggu

SEQ ID NO: 445547 - RNA, 22 nt, Human
gcucccuguaaccucaaacucc

SEQ ID NO: 445548 - RNA, 26 nt, Human
gcucccugucucacaaggccucuuca

SEQ ID NO: 445549 - RNA, 32 nt, Human
gcucccugucuucugucagccucagggcaucc

SEQ ID NO: 445550 - RNA, 32 nt, Human
gcucccuguuccugccagguacugaacugacu

SEQ ID NO: 445551 - RNA, 32 nt, Human
gcucccuguucugcaucucgcucaacagacug

SEQ ID NO: 445552 - RNA, 32 nt, Human
gcucccuuaaagauugugccagugauagaugu

SEQ ID NO: 445553 - RNA, 32 nt, Human
gcucccuucauacuccucacccuacgcaccgc

SEQ ID NO: 445554 - RNA, 32 nt, Human
gcucccuuccaccugucauucccaccacccug

SEQ ID NO: 445555 - RNA, 32 nt, Human
gcucccuuccccacaaggcuccugggccuccg

SEQ ID NO: 445556 - RNA, 32 nt, Human
gcucccuuccgaggcugcagggccaggcgcgg

SEQ ID NO: 445557 - RNA, 32 nt, Human
gcucccuugacucaggacugugcucgaauugu

SEQ ID NO: 445558 - RNA, 32 nt, Human
gcucccuugcagaugcaccguggccuggcggc

SEQ ID NO: 445559 - RNA, 32 nt, Human
gcucccuuggcaggcuguggucuccucugcaa

SEQ ID NO: 445560 - RNA, 32 nt, Human
gcucccuugggcagacagcaggcuuaggccau

SEQ ID NO: 445561 - RNA, 32 nt, Human
gcucccuugggcuggagcugcaguaccguacc

SEQ ID NO: 445562 - RNA, 32 nt, Human
gcucccuugucauucugacuccugggcuuacc

SEQ ID NO: 445563 - RNA, 32 nt, Human
gcucccuuuaaccuccagcuccuggguucaag

SEQ ID NO: 445564 - RNA, 32 nt, Human
gcucccuuugaccuuuuugagaacaagaagaa

SEQ ID NO: 445565 - RNA, 32 nt, Human
gcucccuuuucaccugaaaugccuucagcuca

SEQ ID NO: 445566 - RNA, 32 nt, Human
gcuccgaagaacaugugucacaaaagaugaag

SEQ ID NO: 445567 - RNA, 32 nt, Human
gcuccgaccacucauucagugugugaccucag

SEQ ID NO: 445568 - RNA, 32 nt, Human
gcuccgagaacucugucaucaguggcuaaggc

SEQ ID NO: 445569 - RNA, 32 nt, Human
gcuccgaggagggguggacuccaccuuggaca

SEQ ID NO: 445570 - RNA, 19 nt, Human
gcuccgaggaguccgcccg

SEQ ID NO: 445571 - RNA, 31 nt, Human
gcuccgaggccagagagaaaagacugcgagg

SEQ ID NO: 445572 - RNA, 32 nt, Human
gcuccgaggcggagcugcagcagcugcggcag

SEQ ID NO: 445573 - RNA, 32 nt, Human
gcuccgagggaggagagaggggcucgggaagg

SEQ ID NO: 445574 - RNA, 32 nt, Human
gcuccgagggccaggagcaggacggcggccgc

SEQ ID NO: 445575 - RNA, 32 nt, Human
gcuccgaggucggcgggggucuggguggccau

SEQ ID NO: 445576 - RNA, 32 nt, Human
gcuccgauguccacccuuguccccagguggac

SEQ ID NO: 445577 - RNA, 24 nt, Human
gcuccgcaaagcucugggcuugug

SEQ ID NO: 445578 - RNA, 24 nt, Human
gcuccgcagaccugcgcuaucuca

SEQ ID NO: 445579 - RNA, 32 nt, Human
gcuccgcaggccacgagaagcugccggugcac

SEQ ID NO: 445580 - RNA, 32 nt, Human
gcuccgcaggcccagccgccucuccugcgccc

SEQ ID NO: 445581 - RNA, 20 nt, Human
gcuccgcauccaaccccggg

SEQ ID NO: 445582 - RNA, 23 nt, Human
gcuccgcauccuugcgccacgug

SEQ ID NO: 445583 - RNA, 32 nt, Human
gcuccgccacugcaugcucccgccggaccgag

SEQ ID NO: 445584 - RNA, 22 nt, Human
gcuccgcccccucacgcgcucu

SEQ ID NO: 445585 - RNA, 32 nt, Human
gcuccgcccccucccucucccuugagaagcug

SEQ ID NO: 445586 - RNA, 32 nt, Human
gcuccgcccuggagugaaggaggagccgucac

SEQ ID NO: 445587 - RNA, 32 nt, Human
gcuccgcccuggcacguguccuugcuggcggc

SEQ ID NO: 445588 - RNA, 32 nt, Human
gcuccgcccuugccuuggggccgagggagccc

SEQ ID NO: 445589 - RNA, 19 nt, Human
gcuccgccgccgccgagca

SEQ ID NO: 445590 - RNA, 20 nt, Human
gcuccgccgccgccgccgcc

SEQ ID NO: 445591 - RNA, 32 nt, Human
gcuccgccguccuucgcuucuuuugcugggcu

SEQ ID NO: 445592 - RNA, 32 nt, Human
gcuccgccuccaacgugacaucaugcuuucug

SEQ ID NO: 445593 - RNA, 32 nt, Human
gcuccgccuccaacuugacaucaugcuuucug

SEQ ID NO: 445594 - RNA, 32 nt, Human
gcuccgccucccacuugacaucaugcuuucug

SEQ ID NO: 445595 - RNA, 20 nt, Human
gcuccgccucccgccccggg

SEQ ID NO: 445596 - RNA, 20 nt, Human
gcuccgccucccggguucag

SEQ ID NO: 445597 - RNA, 19 nt, Human
gcuccgccuccuggguuca

SEQ ID NO: 445598 - RNA, 21 nt, Human
gcuccgccucgguggcaaaca

SEQ ID NO: 445599 - RNA, 20 nt, Human
gcuccgccuggcacugggca

SEQ ID NO: 445600 - RNA, 32 nt, Human
gcuccgccuggccuggccauacugugucccau

SEQ ID NO: 445601 - RNA, 32 nt, Human
gcuccgccuguccccaacccagucccauuuuu

SEQ ID NO: 445602 - RNA, 21 nt, Human
gcuccgcgccgccugggucuc

SEQ ID NO: 445603 - RNA, 21 nt, Human
gcuccgcgccgcgccgcuccg

SEQ ID NO: 445604 - RNA, 32 nt, Human
gcuccgcgccugcuccuucuccacuuuuugca

SEQ ID NO: 445605 - RNA, 19 nt, Human
gcuccgcgccugcuggauc

SEQ ID NO: 445606 - RNA, 32 nt, Human
gcuccgcgccugcuggaucguggaugcagcgu

SEQ ID NO: 445607 - RNA, 32 nt, Human
gcuccgcgcgggagccauguaacccugcggcg

SEQ ID NO: 445608 - RNA, 20 nt, Human
gcuccgcgcucccagccucg

SEQ ID NO: 445609 - RNA, 32 nt, Human
gcuccgcgcucuugugaaauacugguucuguu

SEQ ID NO: 445610 - RNA, 32 nt, Human
gcuccgcggccuggaguggcucugccggggca

SEQ ID NO: 445611 - RNA, 32 nt, Human
gcuccgcggcgccgcugagcaggcgcuccugg

SEQ ID NO: 445612 - RNA, 22 nt, Human
gcuccgcgucccgaccggcccg

SEQ ID NO: 445613 - RNA, 22 nt, Human
gcuccgcucagggccccgguca

SEQ ID NO: 445614 - RNA, 32 nt, Human
gcuccgcugcgcuugucuccagcuuccagccc

SEQ ID NO: 445615 - RNA, 32 nt, Human
gcuccgcuucccaggcuggggugcaguggugc

SEQ ID NO: 445616 - RNA, 32 nt, Human
gcuccggaaaugcaacugcguacgggcuggcc

SEQ ID NO: 445617 - RNA, 32 nt, Human
gcuccggaagaugaaaccgaaaaagaaucugc

SEQ ID NO: 445618 - RNA, 32 nt, Human
gcuccggaccagcucagccucugauaagcugg

SEQ ID NO: 445619 - RNA, 32 nt, Human
gcuccggacgcagagguggcaguggcaccagg

SEQ ID NO: 445620 - RNA, 32 nt, Human
gcuccggagaagcaguaggcgaggggccuggc

SEQ ID NO: 445621 - RNA, 18 nt, Human
gcuccggagcugcagcca

SEQ ID NO: 445622 - RNA, 32 nt, Human
gcuccggaggcugaggcaggagaaucgcuuga

SEQ ID NO: 445623 - RNA, 32 nt, Human
gcuccggccaaaugcugggcucaggccugggu

SEQ ID NO: 445624 - RNA, 19 nt, Human
gcuccggccagcccagccc

SEQ ID NO: 445625 - RNA, 23 nt, Human
gcuccggccaguucccuuuuaga

SEQ ID NO: 445626 - RNA, 22 nt, Human
gcuccggccucagccagcccca

SEQ ID NO: 445627 - RNA, 21 nt, Human
gcuccggcgccugcagccccg

SEQ ID NO: 445628 - RNA, 32 nt, Human
gcuccggcucacugcccagcccccaucuaccu

SEQ ID NO: 445629 - RNA, 32 nt, Human
gcuccggcucccagguucacgccauuguccug

SEQ ID NO: 445630 - RNA, 22 nt, Human
gcuccggcuccgaguccgagga

SEQ ID NO: 445631 - RNA, 32 nt, Human
gcuccggcucgagcucaggcuccagcuucagc

SEQ ID NO: 445632 - RNA, 21 nt, Human
gcuccggcuggcaccugagga

SEQ ID NO: 445633 - RNA, 32 nt, Human
gcuccgggagccaagcagggauccgggccucg

SEQ ID NO: 445634 - RNA, 32 nt, Human
gcuccgggaggccuuggcugggacagaguggg

SEQ ID NO: 445635 - RNA, 32 nt, Human
gcuccgggcccgcggcaaccucgggcgcuguu

SEQ ID NO: 445636 - RNA, 32 nt, Human
gcuccgggcucuuccagggagggguggguaca

SEQ ID NO: 445637 - RNA, 32 nt, Human
gcuccggggaaggcgguugcagcuccugagug

SEQ ID NO: 445638 - RNA, 32 nt, Human
gcuccggggcccaguggcucuaccccugcucc

SEQ ID NO: 445639 - RNA, 32 nt, Human
gcuccggggcggagcucgcgauagcgaccggg

SEQ ID NO: 445640 - RNA, 32 nt, Human
gcuccggggcucucaucuuccacucggaucuc

SEQ ID NO: 445641 - RNA, 32 nt, Human
gcuccggggcuucuucccugcccgcccggggc

SEQ ID NO: 445642 - RNA, 32 nt, Human
gcuccgggggcagaccagacucugacucuccu

SEQ ID NO: 445643 - RNA, 32 nt, Human
gcuccgggucuggagggaugcgacauccugag

SEQ ID NO: 445644 - RNA, 32 nt, Human
gcuccgggugccgcggcacugcagcgcugaga

SEQ ID NO: 445645 - RNA, 32 nt, Human
gcuccggugcucgcacaaucccccgccucggc

SEQ ID NO: 445646 - RNA, 32 nt, Human
gcuccggugugucugucgguugcaguguugga

SEQ ID NO: 445647 - RNA, 21 nt, Human
gcuccgguucacucuuuccaa

SEQ ID NO: 445648 - RNA, 32 nt, Human
gcuccgguuggugagcgcgccugcgcguugac

SEQ ID NO: 445649 - RNA, 20 nt, Human
gcuccgucacacucuccgag

SEQ ID NO: 445650 - RNA, 32 nt, Human
gcuccgucacccaggcuggagugcaguggcaa

SEQ ID NO: 445651 - RNA, 32 nt, Human
gcuccgucacccaggcuggagugcaguggcgc

SEQ ID NO: 445652 - RNA, 22 nt, Human
gcuccgucccuccccacccagg

SEQ ID NO: 445653 - RNA, 28 nt, Human
gcuccguccugcauuucugugguccgug

SEQ ID NO: 445654 - RNA, 32 nt, Human
gcuccgucgcccaggcuggcaugcaguugcgc

SEQ ID NO: 445655 - RNA, 32 nt, Human
gcuccgugacccaggcuggaaugcaauggcuc

SEQ ID NO: 445656 - RNA, 32 nt, Human
gcuccgugccuccaccaccacuggccaccagg

SEQ ID NO: 445657 - RNA, 32 nt, Human
gcuccgugcuuuuagcccuccugagccaaaga

SEQ ID NO: 445658 - RNA, 31 nt, Human
gcuccguggguggcaggacugaacuugaaca

SEQ ID NO: 445659 - RNA, 23 nt, Human
gcuccgugugccccagcacgaca

SEQ ID NO: 445660 - RNA, 32 nt, Human
gcuccguucccuggcuagucugugccugguca

SEQ ID NO: 445661 - RNA, 32 nt, Human
gcuccguucuccucacugucauggugccacca

SEQ ID NO: 445662 - RNA, 32 nt, Human
gcuccguugcccagguuggagugcaguggccc

SEQ ID NO: 445663 - RNA, 32 nt, Human
gcuccguugccuagcuggagugcacgaucuca

SEQ ID NO: 445664 - RNA, 32 nt, Human
gcuccuaaagccagggguuagcaccuggccag

SEQ ID NO: 445665 - RNA, 24 nt, Human
gcuccuaaagccuucugucuccua

SEQ ID NO: 445666 - RNA, 32 nt, Human
gcuccuaaagugcugggauuacaggcgugagc

SEQ ID NO: 445667 - RNA, 32 nt, Human
gcuccuaagaguucuuaauuuauaacuaauuu

SEQ ID NO: 445668 - RNA, 32 nt, Human
gcuccuaaggaaccccacccccaugcaauuug

SEQ ID NO: 445669 - RNA, 32 nt, Human
gcuccuaaugggggcccaaagcucagggcugg

SEQ ID NO: 445670 - RNA, 32 nt, Human
gcuccuaccucuucccuccuugccagccccug

SEQ ID NO: 445671 - RNA, 32 nt, Human
gcuccuagaaaggcgaaaagauauucaggagc

SEQ ID NO: 445672 - RNA, 32 nt, Human
gcuccuagaacaguuccuggcuuguaacagaa

SEQ ID NO: 445673 - RNA, 32 nt, Human
gcuccuagccugggugacagagcaagacucca

SEQ ID NO: 445674 - RNA, 19 nt, Human
gcuccuagccugugcucug

SEQ ID NO: 445675 - RNA, 32 nt, Human
gcuccuagcgggcuuggucaagagcaggaggc

SEQ ID NO: 445676 - RNA, 32 nt, Human
gcuccuauccacccuggccagcacccagcuua

SEQ ID NO: 445677 - RNA, 32 nt, Human
gcuccuaucccaccccaccccaaaaagagaaa

SEQ ID NO: 445678 - RNA, 28 nt, Human
gcuccucaacgugcggccucaucauaag

SEQ ID NO: 445679 - RNA, 18 nt, Human
gcuccucacaacauggug

SEQ ID NO: 445680 - RNA, 32 nt, Human
gcuccucacccaggcuggaaugcaguggugug

SEQ ID NO: 445681 - RNA, 23 nt, Human
gcuccucagccaggacacagggu

SEQ ID NO: 445682 - RNA, 22 nt, Human
gcuccucagcccucuucucccu

SEQ ID NO: 445683 - RNA, 21 nt, Human
gcuccucagcucccucagugu

SEQ ID NO: 445684 - RNA, 25 nt, Human
gcuccucagcugggggccucggggu

SEQ ID NO: 445685 - RNA, 19 nt, Human
gcuccucagcuucgugucc

SEQ ID NO: 445686 - RNA, 32 nt, Human
gcuccucaggaggcugaggugggaggauggcu

SEQ ID NO: 445687 - RNA, 32 nt, Human
gcuccucaggcaccuccucucugacggggccu

SEQ ID NO: 445688 - RNA, 32 nt, Human
gcuccucaggcugccucucugccuguuacugc

SEQ ID NO: 445689 - RNA, 21 nt, Human
gcuccucagggccccggggca

SEQ ID NO: 445690 - RNA, 32 nt, Human
gcuccucaguaggacagacagacgcaggcggg

SEQ ID NO: 445691 - RNA, 18 nt, Human
gcuccucagucgcagggg

SEQ ID NO: 445692 - RNA, 32 nt, Human
gcuccucaugccacaagaugugacaccuuucc

SEQ ID NO: 445693 - RNA, 32 nt, Human
gcuccucauggacgggagcgcaguggggaagg

SEQ ID NO: 445694 - RNA, 32 nt, Human
gcuccucauuuuuccuccuguugcaccccagc

SEQ ID NO: 445695 - RNA, 24 nt, Human
gcuccuccaaagccagagcccaag

SEQ ID NO: 445696 - RNA, 25 nt, Human
gcuccuccacccagugcuucugccc

SEQ ID NO: 445697 - RNA, 32 nt, Human
gcuccuccagaguggagccagggggacagugg

SEQ ID NO: 445698 - RNA, 32 nt, Human
gcuccuccagcagcucagaauguggccuguau

SEQ ID NO: 445699 - RNA, 32 nt, Human
gcuccuccaugcaguacucacacugcugucug

SEQ ID NO: 445700 - RNA, 32 nt, Human
gcuccucccaacaaacuccagaacagcagaaa

SEQ ID NO: 445701 - RNA, 32 nt, Human
gcuccucccacacccacccuggcuuccaucau

SEQ ID NO: 445702 - RNA, 32 nt, Human
gcuccucccacaguccuaucuccucaccaggc

SEQ ID NO: 445703 - RNA, 32 nt, Human
gcuccucccaccccaccucuucucagccuugc

SEQ ID NO: 445704 - RNA, 18 nt, Human
gcuccuccccagccucca

SEQ ID NO: 445705 - RNA, 32 nt, Human
gcuccucccccaggaagagccuuaaaccccaa

SEQ ID NO: 445706 - RNA, 19 nt, Human
gcuccucccccucaugcca

SEQ ID NO: 445707 - RNA, 32 nt, Human
gcuccuccccugagacaagugagggguagucg

SEQ ID NO: 445708 - RNA, 19 nt, Human
gcuccuccccugccugcca

SEQ ID NO: 445709 - RNA, 32 nt, Human
gcuccuccccuucuuucucuuccuucugccuc

SEQ ID NO: 445710 - RNA, 32 nt, Human
gcuccucccucuuuacccuccccuccagugaa

SEQ ID NO: 445711 - RNA, 20 nt, Human
gcuccucccugaccuuccuc

SEQ ID NO: 445712 - RNA, 32 nt, Human
gcuccucccugccucaguggcucuggguaccu

SEQ ID NO: 445713 - RNA, 32 nt, Human
gcuccucccugccuugccuuguuugcugaggg

SEQ ID NO: 445714 - RNA, 23 nt, Human
gcuccuccgacccgcuccgcucc

SEQ ID NO: 445715 - RNA, 32 nt, Human
gcuccuccgccuggccugggccgucugcccgc

SEQ ID NO: 445716 - RNA, 21 nt, Human
gcuccuccggcucugcagggu

SEQ ID NO: 445717 - RNA, 32 nt, Human
gcuccuccucacccucuaccucccugugcuca

SEQ ID NO: 445718 - RNA, 19 nt, Human
gcuccuccucagccugcca

SEQ ID NO: 445719 - RNA, 19 nt, Human
gcuccuccucaggcugcug

SEQ ID NO: 445720 - RNA, 32 nt, Human
gcuccuccuccaggauggcuggaggugggacc

SEQ ID NO: 445721 - RNA, 23 nt, Human
gcuccuccuccucccucccaagg

SEQ ID NO: 445722 - RNA, 32 nt, Human
gcuccuccucuccccucuccucuuucagagca

SEQ ID NO: 445723 - RNA, 32 nt, Human
gcuccuccugcacggaagagacaggggcaggg

SEQ ID NO: 445724 - RNA, 16 nt, Human
gcuccuccugccacca

SEQ ID NO: 445725 - RNA, 32 nt, Human
gcuccuccuuccaagagcacugaggcaccagu

SEQ ID NO: 445726 - RNA, 32 nt, Human
gcuccucgcaucagauccucugugcugggaau

SEQ ID NO: 445727 - RNA, 32 nt, Human
gcuccucgcccgcgggaagaccaggcugcgac

SEQ ID NO: 445728 - RNA, 21 nt, Human
gcuccucgcucucggacgcca

SEQ ID NO: 445729 - RNA, 25 nt, Human
gcuccucgcugucgccgccgcugcc

SEQ ID NO: 445730 - RNA, 32 nt, Human
gcuccucggacaccaagcagaauucugcaugg

SEQ ID NO: 445731 - RNA, 32 nt, Human
gcuccucggacucugguuaccucugaggcugg

SEQ ID NO: 445732 - RNA, 32 nt, Human
gcuccucggcuaugcuaauguccccucagaga

SEQ ID NO: 445733 - RNA, 23 nt, Human
gcuccucgucaugugauuuucca

SEQ ID NO: 445734 - RNA, 32 nt, Human
gcuccucguccuccucguccuccggggcccca

SEQ ID NO: 445735 - RNA, 32 nt, Human
gcuccucuaaaccuggguaagcucuuugaccu

SEQ ID NO: 445736 - RNA, 32 nt, Human
gcuccucucacugcccucugcaccagcaacau

SEQ ID NO: 445737 - RNA, 22 nt, Human
gcuccucucaggcugggccccg

SEQ ID NO: 445738 - RNA, 32 nt, Human
gcuccucuccacccugacucuacaggccgggg

SEQ ID NO: 445739 - RNA, 32 nt, Human
gcuccucuccagacacagagacaugggagugg

SEQ ID NO: 445740 - RNA, 32 nt, Human
gcuccucuccagaguuuccucucaccuccgug

SEQ ID NO: 445741 - RNA, 32 nt, Human
gcuccucuccuggaggauugcagguggaacuc

SEQ ID NO: 445742 - RNA, 32 nt, Human
gcuccucuccuuccuuuuccuuccuaggcacu

SEQ ID NO: 445743 - RNA, 32 nt, Human
gcuccucuccuuuccuccucccccucggagcc

SEQ ID NO: 445744 - RNA, 23 nt, Human
gcuccucucgccgccgccuccac

SEQ ID NO: 445745 - RNA, 32 nt, Human
gcuccucucggccccuccuccugggccgccuc

SEQ ID NO: 445746 - RNA, 32 nt, Human
gcuccucucucaccuccucucucccucuccug

SEQ ID NO: 445747 - RNA, 17 nt, Human
gcuccucugaagccagg

SEQ ID NO: 445748 - RNA, 24 nt, Human
gcuccucugaaggaucaccugccc

SEQ ID NO: 445749 - RNA, 23 nt, Human
gcuccucugacucccaucucacu

SEQ ID NO: 445750 - RNA, 19 nt, Human
gcuccucugacugaaccua

SEQ ID NO: 445751 - RNA, 32 nt, Human
gcuccucugagccaggaggccggugcugggcc

SEQ ID NO: 445752 - RNA, 32 nt, Human
gcuccucugcaaaggccagccagcuugggagc

SEQ ID NO: 445753 - RNA, 32 nt, Human
gcuccucugcagcuuccuccucagccucccuc

SEQ ID NO: 445754 - RNA, 32 nt, Human
gcuccucugccuauuugcccacaggcuuugcu

SEQ ID NO: 445755 - RNA, 32 nt, Human
gcuccucugcucccucuuuuucucccuucucu

SEQ ID NO: 445756 - RNA, 32 nt, Human
gcuccucugcuuacuuuuccuccuggcuggau

SEQ ID NO: 445757 - RNA, 32 nt, Human
gcuccucuggugcccacgcccuugccacccug

SEQ ID NO: 445758 - RNA, 21 nt, Human
gcuccucugucaccagcccca

SEQ ID NO: 445759 - RNA, 32 nt, Human
gcuccucugucccagcucugcggcccaggggg

SEQ ID NO: 445760 - RNA, 18 nt, Human
gcuccucugugggugagg

SEQ ID NO: 445761 - RNA, 32 nt, Human
gcuccucuuguucgguuaaccagcacauaaca

SEQ ID NO: 445762 - RNA, 32 nt, Human
gcuccucuuugcuuccuucccucucucuccuc

SEQ ID NO: 445763 - RNA, 32 nt, Human
gcuccugaaagaaaugcuagaagccuaagaac

SEQ ID NO: 445764 - RNA, 32 nt, Human
gcuccugaacaacaggccucaugccucucuuu

SEQ ID NO: 445765 - RNA, 32 nt, Human
gcuccugaacaucucugauuucuccggcuguc

SEQ ID NO: 445766 - RNA, 32 nt, Human
gcuccugaacuuuucuuucuuccaucaugcuc

SEQ ID NO: 445767 - RNA, 32 nt, Human
gcuccugaagcagcaguuauggagcuucccuc

SEQ ID NO: 445768 - RNA, 32 nt, Human
gcuccugaagcuugugggcagcuccagaagcu

SEQ ID NO: 445769 - RNA, 32 nt, Human
gcuccugacagccuggcgacguggcgaagaug

SEQ ID NO: 445770 - RNA, 32 nt, Human
gcuccugaccagacccucagaaccugaggacg

SEQ ID NO: 445771 - RNA, 23 nt, Human
gcuccugacccgacccagcccca

SEQ ID NO: 445772 - RNA, 32 nt, Human
gcuccugacugggcacaggagcucccagcuuu

SEQ ID NO: 445773 - RNA, 32 nt, Human
gcuccugacuguugcugcuccccagcccaugg

SEQ ID NO: 445774 - RNA, 32 nt, Human
gcuccugacuuccauucccccuucaaaguccg

SEQ ID NO: 445775 - RNA, 32 nt, Human
gcuccugagaccuggcccugccacacgcucca

SEQ ID NO: 445776 - RNA, 32 nt, Human
gcuccugagauggaagaucuguccucuccaga

SEQ ID NO: 445777 - RNA, 32 nt, Human
gcuccugaggaggaaaauggcggagaacgcgg

SEQ ID NO: 445778 - RNA, 32 nt, Human
gcuccugaggccaaagccagagacucgaacag

SEQ ID NO: 445779 - RNA, 32 nt, Human
gcuccugaggcugaggcaggaagaucacuuga

SEQ ID NO: 445780 - RNA, 32 nt, Human
gcuccugaggggcagaggagcagagaugcauc

SEQ ID NO: 445781 - RNA, 32 nt, Human
gcuccugaguagcuaggauuacaggcacaugc

SEQ ID NO: 445782 - RNA, 32 nt, Human
gcuccugaguagcuggaacuacaggcacgcac

SEQ ID NO: 445783 - RNA, 32 nt, Human
gcuccugaguagcugggacuacaggauuacag

SEQ ID NO: 445784 - RNA, 32 nt, Human
gcuccugaguagcugggauuacaggcacguga

SEQ ID NO: 445785 - RNA, 32 nt, Human
gcuccugaguagcugggauuacaggcgcccgc

SEQ ID NO: 445786 - RNA, 32 nt, Human
gcuccugaguagcugggccugugcacugggca

SEQ ID NO: 445787 - RNA, 32 nt, Human
gcuccugaguagcuggggauuacaggugccua

SEQ ID NO: 445788 - RNA, 32 nt, Human
gcuccugaucccccuucuccuugcaucacccg

SEQ ID NO: 445789 - RNA, 32 nt, Human
gcuccugaucuuccucccuuccucccuuucuu

SEQ ID NO: 445790 - RNA, 32 nt, Human
gcuccugauggccauggaaggaacauuuuucu

SEQ ID NO: 445791 - RNA, 32 nt, Human
gcuccugcaagggugagcacuguauacacaga

SEQ ID NO: 445792 - RNA, 32 nt, Human
gcuccugcacacaugcaugcacacaaacgugu

SEQ ID NO: 445793 - RNA, 17 nt, Human
gcuccugcaccagcccc

SEQ ID NO: 445794 - RNA, 32 nt, Human
gcuccugcacuucuccccagagcgggacccuc

SEQ ID NO: 445795 - RNA, 24 nt, Human
gcuccugcagcgccucggucugug

SEQ ID NO: 445796 - RNA, 32 nt, Human
gcuccugcaggcggcgcuugcgguacgggcug

SEQ ID NO: 445797 - RNA, 32 nt, Human
gcuccugcauauguauaugcugggugaccuug

SEQ ID NO: 445798 - RNA, 32 nt, Human
gcuccugcauuccgucacuccaugacuucauc

SEQ ID NO: 445799 - RNA, 22 nt, Human
gcuccugccacagccgucgccu

SEQ ID NO: 445800 - RNA, 26 nt, Human
gcuccugccagccaugccuucagggu

SEQ ID NO: 445801 - RNA, 32 nt, Human
gcuccugcccaagagaggggcuguggggcccc

SEQ ID NO: 445802 - RNA, 32 nt, Human
gcuccugcccacacuccuaccugcugcccuga

SEQ ID NO: 445803 - RNA, 32 nt, Human
gcuccugcccacacuccugccugcugcccuga

SEQ ID NO: 445804 - RNA, 32 nt, Human
gcuccugcccacgcuccugacugcugcccuga

SEQ ID NO: 445805 - RNA, 32 nt, Human
gcuccugccccuccuuuaucaaaguuggggac

SEQ ID NO: 445806 - RNA, 32 nt, Human
gcuccugcccgcacuccugccugcugcccuga

SEQ ID NO: 445807 - RNA, 32 nt, Human
gcuccugccgagaagcugggccaccccuuaag

SEQ ID NO: 445808 - RNA, 20 nt, Human
gcuccugccgccgccgccgc

SEQ ID NO: 445809 - RNA, 32 nt, Human
gcuccugccuauaaucccagcacuuugggagg

SEQ ID NO: 445810 - RNA, 32 nt, Human
gcuccugccuccugccccagcagguaccacgg

SEQ ID NO: 445811 - RNA, 17 nt, Human
gcuccugccugccacca

SEQ ID NO: 445812 - RNA, 32 nt, Human
gcuccugccuggauucccagcacuuugggaga

SEQ ID NO: 445813 - RNA, 32 nt, Human
gcuccugccuguaaucccagcacuuugggagg

SEQ ID NO: 445814 - RNA, 32 nt, Human
gcuccugccuguaaucgcagcacuuugggagg

SEQ ID NO: 445815 - RNA, 32 nt, Human
gcuccugccugugauccuagcacuuugggagg

SEQ ID NO: 445816 - RNA, 32 nt, Human
gcuccugccuguucucagccccggcuccugcc

SEQ ID NO: 445817 - RNA, 32 nt, Human
gcuccugccuugaugaagcccauguccugccu

SEQ ID NO: 445818 - RNA, 23 nt, Human
gcuccugcgaccccccagccccg

SEQ ID NO: 445819 - RNA, 32 nt, Human
gcuccugcgcuuccucuccuccuggguguuaa

SEQ ID NO: 445820 - RNA, 32 nt, Human
gcuccugcuccggcuccuccaucuuggccucg

SEQ ID NO: 445821 - RNA, 32 nt, Human
gcuccugcucucccucucccuccuccaggcca

SEQ ID NO: 445822 - RNA, 21 nt, Human
gcuccugcugaaacaccuccc

SEQ ID NO: 445823 - RNA, 31 nt, Human
gcuccugcugcgucugggccugaaggucucu

SEQ ID NO: 445824 - RNA, 32 nt, Human
gcuccugcuggcuugguagaagacagaauucg

SEQ ID NO: 445825 - RNA, 32 nt, Human
gcuccugcugggcuccagccagaguagucaca

SEQ ID NO: 445826 - RNA, 32 nt, Human
gcuccugcuucaggugcagaaacacagcuauu

SEQ ID NO: 445827 - RNA, 25 nt, Human
gcuccuggaacuauacagauaggua

SEQ ID NO: 445828 - RNA, 22 nt, Human
gcuccuggaagggauccagggu

SEQ ID NO: 445829 - RNA, 32 nt, Human
gcuccuggacugcccuguaucuaaguccucaa

SEQ ID NO: 445830 - RNA, 32 nt, Human
gcuccuggaggcaggugaugcugugggcacgc

SEQ ID NO: 445831 - RNA, 32 nt, Human
gcuccuggauccgcuccugccugcgcccgcag

SEQ ID NO: 445832 - RNA, 19 nt, Human
gcuccuggaucucccaggu

SEQ ID NO: 445833 - RNA, 32 nt, Human
gcuccuggaugaccaggcaccgcuguugagca

SEQ ID NO: 445834 - RNA, 32 nt, Human
gcuccuggccauauaucaagguuucaauaaau

SEQ ID NO: 445835 - RNA, 24 nt, Human
gcuccuggccccuuggcuggccgg

SEQ ID NO: 445836 - RNA, 32 nt, Human
gcuccuggccucaaucgaucuuccugccaagg

SEQ ID NO: 445837 - RNA, 32 nt, Human
gcuccuggcgccuucucccuagggguagacuc

SEQ ID NO: 445838 - RNA, 32 nt, Human
gcuccuggcgcuacugcccuccagagucccuc

SEQ ID NO: 445839 - RNA, 25 nt, Human
gcuccuggcucccuccucggcccgu

SEQ ID NO: 445840 - RNA, 32 nt, Human
gcuccuggcugcaggcccaggccccaaggucu

SEQ ID NO: 445841 - RNA, 32 nt, Human
gcuccuggcuucccccuggagcugggagagag

SEQ ID NO: 445842 - RNA, 32 nt, Human
gcuccugggaaaggaaaggaccacagcaaaca

SEQ ID NO: 445843 - RNA, 32 nt, Human
gcuccugggacaccuccaguguccagcacaca

SEQ ID NO: 445844 - RNA, 32 nt, Human
gcuccugggcaggcucggcagggcaggcagcu

SEQ ID NO: 445845 - RNA, 32 nt, Human
gcuccugggccccagccccgcgcaggccaagg

SEQ ID NO: 445846 - RNA, 32 nt, Human
gcuccuggggugcagggugcuuggggguggcu

SEQ ID NO: 445847 - RNA, 32 nt, Human
gcuccugggugugucagaggccagccugggga

SEQ ID NO: 445848 - RNA, 31 nt, Human
gcuccuggguuucagcaauucuccugccuca

SEQ ID NO: 445849 - RNA, 18 nt, Human
gcuccuggugcccagccc

SEQ ID NO: 445850 - RNA, 32 nt, Human
gcuccuggugcuaacaacaaaguuccacuucc

SEQ ID NO: 445851 - RNA, 32 nt, Human
gcuccuggugcuguuccugcauucacccacug

SEQ ID NO: 445852 - RNA, 32 nt, Human
gcuccugguggaagcaagggagcccagccgaa

SEQ ID NO: 445853 - RNA, 32 nt, Human
gcuccugguggggcagaaaggcugcaacgcug

SEQ ID NO: 445854 - RNA, 32 nt, Human
gcuccuguauaguucccucccacacugaauag

SEQ ID NO: 445855 - RNA, 32 nt, Human
gcuccuguccagacccugacccucccucccaa

SEQ ID NO: 445856 - RNA, 32 nt, Human
gcuccugucccuggcccuaccuccuucccugu

SEQ ID NO: 445857 - RNA, 32 nt, Human
gcuccugucgcccaggcuggagugcaauggca

SEQ ID NO: 445858 - RNA, 32 nt, Human
gcuccugucuauaaucgcagcacuuugggagg

SEQ ID NO: 445859 - RNA, 32 nt, Human
gcuccugucuguuuccccauccugccagauuu

SEQ ID NO: 445860 - RNA, 32 nt, Human
gcuccugugaggcagacaggacagugagguug

SEQ ID NO: 445861 - RNA, 32 nt, Human
gcuccugugauguucuggggaggccuuggaag

SEQ ID NO: 445862 - RNA, 32 nt, Human
gcuccugugcugcugagcagggcaaccaguag

SEQ ID NO: 445863 - RNA, 32 nt, Human
gcuccuguugugcaggcuggagugcaguggca

SEQ ID NO: 445864 - RNA, 32 nt, Human
gcuccuuaaagcagaggagccuguccugggag

SEQ ID NO: 445865 - RNA, 32 nt, Human
gcuccuucaccacccccacgauugguaugaug

SEQ ID NO: 445866 - RNA, 32 nt, Human
gcuccuucagaaauagcagcaggcugguugcu

SEQ ID NO: 445867 - RNA, 32 nt, Human
gcuccuucagccaggccagcagaagggccuuc

SEQ ID NO: 445868 - RNA, 32 nt, Human
gcuccuucagcuucucuggcuccugggccagg

SEQ ID NO: 445869 - RNA, 32 nt, Human
gcuccuuccagccauggcucucagaguccuuc

SEQ ID NO: 445870 - RNA, 18 nt, Human
gcuccuuccagcuugcca

SEQ ID NO: 445871 - RNA, 32 nt, Human
gcuccuuccagugcgcccaguacagcaggaga

SEQ ID NO: 445872 - RNA, 32 nt, Human
gcuccuucccaaacugcccccuugcccagcca

SEQ ID NO: 445873 - RNA, 20 nt, Human
gcuccuuccuccucggcucg

SEQ ID NO: 445874 - RNA, 32 nt, Human
gcuccuuccuggaguacaacagcuggcaugug

SEQ ID NO: 445875 - RNA, 32 nt, Human
gcuccuucuccacuuuuugcagaucaaacagc

SEQ ID NO: 445876 - RNA, 32 nt, Human
gcuccuucuccagccuuauugcacugacuaaa

SEQ ID NO: 445877 - RNA, 18 nt, Human
gcuccuucucuucaugcc

SEQ ID NO: 445878 - RNA, 32 nt, Human
gcuccuucucuucucccaucugcuaccagagc

SEQ ID NO: 445879 - RNA, 32 nt, Human
gcuccuucugucuuguagagucuuguuauagu

SEQ ID NO: 445880 - RNA, 32 nt, Human
gcuccuucuucagcccuccccuucccagcccc

SEQ ID NO: 445881 - RNA, 32 nt, Human
gcuccuucuuguucugcccuccagagauuugc

SEQ ID NO: 445882 - RNA, 32 nt, Human
gcuccuugacucugccguuuccuaauaagacc

SEQ ID NO: 445883 - RNA, 32 nt, Human
gcuccuugagggaugaaccugggagcccaaga

SEQ ID NO: 445884 - RNA, 32 nt, Human
gcuccuugccacccucaucuccagcaugccug

SEQ ID NO: 445885 - RNA, 21 nt, Human
gcuccuugccugccacuucuu

SEQ ID NO: 445886 - RNA, 24 nt, Human
gcuccuugcugagcuuuugagggu

SEQ ID NO: 445887 - RNA, 32 nt, Human
gcuccuugcugguuuuuaacuuggggagaaac

SEQ ID NO: 445888 - RNA, 32 nt, Human
gcuccuuggcggugccuggagcccgggcgcac

SEQ ID NO: 445889 - RNA, 32 nt, Human
gcuccuuggcuauaaguuauuuucccuguuac

SEQ ID NO: 445890 - RNA, 23 nt, Human
gcuccuuggcuucugaaggcuga

SEQ ID NO: 445891 - RNA, 32 nt, Human
gcuccuuggucaccaggcaaugggagcuguag

SEQ ID NO: 445892 - RNA, 32 nt, Human
gcuccuuuaagcugcugcugcauacacauuuc

SEQ ID NO: 445893 - RNA, 32 nt, Human
gcuccuuucacauuggauugugugugaguggu

SEQ ID NO: 445894 - RNA, 32 nt, Human
gcuccuuucagagguuggacagugccaugaca

SEQ ID NO: 445895 - RNA, 32 nt, Human
gcuccuuucccuuuuccaucaucucuuuuccc

SEQ ID NO: 445896 - RNA, 22 nt, Human
gcuccuuugcaggaaacugggg

SEQ ID NO: 445897 - RNA, 23 nt, Human
gcuccuuuggguaaauaccaagg

SEQ ID NO: 445898 - RNA, 32 nt, Human
gcuccuuuucacccugcccccugggccugagg

SEQ ID NO: 445899 - RNA, 32 nt, Human
gcuccuuuucauuaccccuccuccguuuucac

SEQ ID NO: 445900 - RNA, 32 nt, Human
gcucgaaaguagaagaaaguguugccagggac

SEQ ID NO: 445901 - RNA, 32 nt, Human
gcucgaacccaggagguggagguugcagugag

SEQ ID NO: 445902 - RNA, 32 nt, Human
gcucgaaugguccucucacugcagccucccaa

SEQ ID NO: 445903 - RNA, 32 nt, Human
gcucgacaugaucuuaucaacauggaaaauaa

SEQ ID NO: 445904 - RNA, 32 nt, Human
gcucgacauuaggccucaaggcugccaucugu

SEQ ID NO: 445905 - RNA, 32 nt, Human
gcucgacccgcagcaggagcagcagcuguucc

SEQ ID NO: 445906 - RNA, 17 nt, Human
gcucgacuuccaccucu

SEQ ID NO: 445907 - RNA, 32 nt, Human
gcucgagaauacugcccaguuacucuagcgcg

SEQ ID NO: 445908 - RNA, 32 nt, Human
gcucgagaccagccuggaaaauguggugaaau

SEQ ID NO: 445909 - RNA, 32 nt, Human
gcucgagaccagccuggccaacauggugaaac

SEQ ID NO: 445910 - RNA, 25 nt, Human
gcucgagaccagccugggcaacaug

SEQ ID NO: 445911 - RNA, 32 nt, Human
gcucgagaggagaauguggccacuuuccgagg

SEQ ID NO: 445912 - RNA, 32 nt, Human
gcucgagccagccuggccaacauggcaaaacc

SEQ ID NO: 445913 - RNA, 32 nt, Human
gcucgagccugggguccaugucccuuugccgu

SEQ ID NO: 445914 - RNA, 32 nt, Human
gcucgagcggccagggccaggcgaggccgggg

SEQ ID NO: 445915 - RNA, 32 nt, Human
gcucgagcgguucuccugcgucagccucccaa

SEQ ID NO: 445916 - RNA, 32 nt, Human
gcucgaggaggaugccugggcccggugcaagg

SEQ ID NO: 445917 - RNA, 32 nt, Human
gcucgaggcuguucccuguccugccucagugc

SEQ ID NO: 445918 - RNA, 32 nt, Human
gcucgagggaaucugcuuacaggucguuccua

SEQ ID NO: 445919 - RNA, 32 nt, Human
gcucgagugacaucuucgcgcaccaaucggga

SEQ ID NO: 445920 - RNA, 21 nt, Human
gcucgaucucggcucacugca

SEQ ID NO: 445921 - RNA, 32 nt, Human
gcucgaugcagaaccaccaugcuccagacaca

SEQ ID NO: 445922 - RNA, 23 nt, Human
gcucgaugcucggccugcugcug

SEQ ID NO: 445923 - RNA, 32 nt, Human
gcucgauucccaggaucucggcugccuuuucc

SEQ ID NO: 445924 - RNA, 32 nt, Human
gcucgauucucccagugccuggcugaguuucg

SEQ ID NO: 445925 - RNA, 32 nt, Human
gcucgcaaaccugaaaacuacugacgcgccuu

SEQ ID NO: 445926 - RNA, 32 nt, Human
gcucgcacccccacuuucgccuccuccagcuc

SEQ ID NO: 445927 - RNA, 32 nt, Human
gcucgcaccuguaaucccagcacucuaggagg

SEQ ID NO: 445928 - RNA, 32 nt, Human
gcucgcaccuguaaucccagcacuuugggagg

SEQ ID NO: 445929 - RNA, 32 nt, Human
gcucgcagcagcuggggaggagccaaagccuc

SEQ ID NO: 445930 - RNA, 21 nt, Human
gcucgcagcuccccagucuca

SEQ ID NO: 445931 - RNA, 32 nt, Human
gcucgcaggaaggaagaagggagccgaggacg

SEQ ID NO: 445932 - RNA, 31 nt, Human
gcucgccagagagucuauguaugggauugaa

SEQ ID NO: 445933 - RNA, 19 nt, Human
gcucgccagcgcugugcuc

SEQ ID NO: 445934 - RNA, 32 nt, Human
gcucgccaggaaccucgccugguccugauuuc

SEQ ID NO: 445935 - RNA, 32 nt, Human
gcucgccaugucuucucacaagacuuucagga

SEQ ID NO: 445936 - RNA, 32 nt, Human
gcucgcccagacuccgggcagugagagggagg

SEQ ID NO: 445937 - RNA, 32 nt, Human
gcucgccccucuacuccuccacgccccggccc

SEQ ID NO: 445938 - RNA, 32 nt, Human
gcucgcccggagcagcccaggagcucagcaug

SEQ ID NO: 445939 - RNA, 32 nt, Human
gcucgccggcgcccugugcggacggcccugcc

SEQ ID NO: 445940 - RNA, 32 nt, Human
gcucgccucggaucagcugagccuucugagcu

SEQ ID NO: 445941 - RNA, 32 nt, Human
gcucgccucuggcggagcagcagccacucgcg

SEQ ID NO: 445942 - RNA, 32 nt, Human
gcucgccugaguaugggguggugucauggagc

SEQ ID NO: 445943 - RNA, 32 nt, Human
gcucgccuguaaucccagcacuuugggaggcc

SEQ ID NO: 445944 - RNA, 32 nt, Human
gcucgccuguaaucccagcuacuugggaggcu

SEQ ID NO: 445945 - RNA, 32 nt, Human
gcucgccuuuucguaccugggcucaggugcgg

SEQ ID NO: 445946 - RNA, 32 nt, Human
gcucgcgaggauguggggaaaagggaacccuc

SEQ ID NO: 445947 - RNA, 32 nt, Human
gcucgcgccauugcacuccagccuuggaacaa

SEQ ID NO: 445948 - RNA, 32 nt, Human
gcucgcgccgcucugcugcugcugcugccgcc

SEQ ID NO: 445949 - RNA, 32 nt, Human
gcucgcgccggcucaccaugcacugccacgcc

SEQ ID NO: 445950 - RNA, 32 nt, Human
gcucgcgccuguaaucccagcacuuugggagg

SEQ ID NO: 445951 - RNA, 32 nt, Human
gcucgcgcuugugaucccagcacuuugggaga

SEQ ID NO: 445952 - RNA, 32 nt, Human
gcucgcggaggcacuucuccgagcgugacgug

SEQ ID NO: 445953 - RNA, 18 nt, Human
gcucgcgggcccgugccg

SEQ ID NO: 445954 - RNA, 20 nt, Human
gcucgcguugaagccgcacg

SEQ ID NO: 445955 - RNA, 32 nt, Human
gcucgcucaccucccuccucugcaccaugacu

SEQ ID NO: 445956 - RNA, 32 nt, Human
gcucgcuccuguaaucccagcacuuugggagg

SEQ ID NO: 445957 - RNA, 32 nt, Human
gcucgcuccuuggucugcaguccuuuaaacaa

SEQ ID NO: 445958 - RNA, 32 nt, Human
gcucgcucucacugcuacugcuuccugggagg

SEQ ID NO: 445959 - RNA, 32 nt, Human
gcucgcucuccccagugucagcaacagcacuu

SEQ ID NO: 445960 - RNA, 32 nt, Human
gcucgcucuccuccccuuccuuccgcucaaug

SEQ ID NO: 445961 - RNA, 32 nt, Human
gcucgcucuccucugccaguugccggaggucu

SEQ ID NO: 445962 - RNA, 32 nt, Human
gcucgcucuccucugcgccugcgccgccggga

SEQ ID NO: 445963 - RNA, 32 nt, Human
gcucgcugcaaccaccaucuccuggguucagg

SEQ ID NO: 445964 - RNA, 22 nt, Human
gcucgcugcaacccccaccucc

SEQ ID NO: 445965 - RNA, 32 nt, Human
gcucgcugcaacccccaccucccagguucaag

SEQ ID NO: 445966 - RNA, 32 nt, Human
gcucgcugcaaccuccaccuccugggcucaca

SEQ ID NO: 445967 - RNA, 32 nt, Human
gcucgcugcaaccuccaccuccuggguucaag

SEQ ID NO: 445968 - RNA, 32 nt, Human
gcucgcugcaaccuccuccuccuggguucaag

SEQ ID NO: 445969 - RNA, 32 nt, Human
gcucgcugcagccacugccuccuggguucagg

SEQ ID NO: 445970 - RNA, 32 nt, Human
gcucgcugcagccuccaccucccagguucaag

SEQ ID NO: 445971 - RNA, 32 nt, Human
gcucgcugcagccucugccuccuggguucaag

SEQ ID NO: 445972 - RNA, 32 nt, Human
gcucgcugccuggugcuugucuuggcgagaug

SEQ ID NO: 445973 - RNA, 32 nt, Human
gcucgcuggcccugcacuccgccuuaguccug

SEQ ID NO: 445974 - RNA, 32 nt, Human
gcucgcugugcccgcugugccugcugugcccg

SEQ ID NO: 445975 - RNA, 32 nt, Human
gcucgcuugugucuauucaucauguuuagccu

SEQ ID NO: 445976 - RNA, 32 nt, Human
gcucggaaauccaucccacccaccucuguccc

SEQ ID NO: 445977 - RNA, 32 nt, Human
gcucggaagauggaggcugcagugagccauga

SEQ ID NO: 445978 - RNA, 18 nt, Human
gcucggaccaggcagcca

SEQ ID NO: 445979 - RNA, 22 nt, Human
gcucggaccuuccgcucucccc

SEQ ID NO: 445980 - RNA, 32 nt, Human
gcucggacuaagccauguggauucaggugugg

SEQ ID NO: 445981 - RNA, 18 nt, Human
gcucggacuuggugaagc

SEQ ID NO: 445982 - RNA, 32 nt, Human
gcucggagaaggacaggacaauggcggccuua

SEQ ID NO: 445983 - RNA, 32 nt, Human
gcucggagcagagaaggccagagcagagaggg

SEQ ID NO: 445984 - RNA, 32 nt, Human
gcucggagcccacguccuccucggugacacag

SEQ ID NO: 445985 - RNA, 21 nt, Human
gcucggaggaaccucugguaa

SEQ ID NO: 445986 - RNA, 32 nt, Human
gcucggaggcggaagcuugaggggcgcgggga

SEQ ID NO: 445987 - RNA, 32 nt, Human
gcucggauucacucugugaccgcauaugugag

SEQ ID NO: 445988 - RNA, 32 nt, Human
gcucggcaagcauaggcgaguuggcaguggaa

SEQ ID NO: 445989 - RNA, 20 nt, Human
gcucggcagcagcgcagcgg

SEQ ID NO: 445990 - RNA, 23 nt, Human
gcucggcagccgcccgcagcccc

SEQ ID NO: 445991 - RNA, 32 nt, Human
gcucggccacggguggcgaggcugcggugagg

SEQ ID NO: 445992 - RNA, 32 nt, Human
gcucggccagaacagcagcagcagcgaggaga

SEQ ID NO: 445993 - RNA, 32 nt, Human
gcucggcccaaggcaggagaaucucuugaagc

SEQ ID NO: 445994 - RNA, 32 nt, Human
gcucggcccuuccuucggucagaaagucgccc

SEQ ID NO: 445995 - RNA, 20 nt, Human
gcucggccgcugggaaccgu

SEQ ID NO: 445996 - RNA, 20 nt, Human
gcucggccguagcggagcug

SEQ ID NO: 445997 - RNA, 32 nt, Human
gcucggccuaggucuacguccccagcuccagc

SEQ ID NO: 445998 - RNA, 32 nt, Human
gcucggccucgccggccucccugcugcaggcc

SEQ ID NO: 445999 - RNA, 32 nt, Human
gcucggccuuaaggagcugaagagucugggua

SEQ ID NO: 446000 - RNA, 32 nt, Human
gcucggcgaaggccaaguugaaggcuuccacg

SEQ ID NO: 446001 - RNA, 32 nt, Human
gcucggcgagaaauugaucuccccagcuuuuc

SEQ ID NO: 446002 - RNA, 32 nt, Human
gcucggcgagcuccuccagaccuccuaggccu

SEQ ID NO: 446003 - RNA, 32 nt, Human
gcucggcgaguuggaguucauccuggaagcgu

SEQ ID NO: 446004 - RNA, 18 nt, Human
gcucggcgccggggccca

SEQ ID NO: 446005 - RNA, 32 nt, Human
gcucggcgcgcagguccugggcccagggcggg

SEQ ID NO: 446006 - RNA, 32 nt, Human
gcucggcggcaccuccacacccgccccaacgc

SEQ ID NO: 446007 - RNA, 32 nt, Human
gcucggcugaaccaggacuccucacugucuac

SEQ ID NO: 446008 - RNA, 32 nt, Human
gcucggcuucagucuccaggagacagugguca

SEQ ID NO: 446009 - RNA, 32 nt, Human
gcucggcuuccugcugauggucaggguuuugg

SEQ ID NO: 446010 - RNA, 32 nt, Human
gcucggcuucuuccucugugcuggucaugaaa

SEQ ID NO: 446011 - RNA, 32 nt, Human
gcucggcuuuggacuguguccucagcuccuuc

SEQ ID NO: 446012 - RNA, 32 nt, Human
gcucgggaacucacagaaaaugcugaguccgg

SEQ ID NO: 446013 - RNA, 20 nt, Human
gcucgggagcuggccgggga

SEQ ID NO: 446014 - RNA, 32 nt, Human
gcucgggaggcugaggcaggagaaucacuuga

SEQ ID NO: 446015 - RNA, 32 nt, Human
gcucgggaggcugaggcaggagaaucgcuuga

SEQ ID NO: 446016 - RNA, 32 nt, Human
gcucgggaggcugaggcaggagaaucucuuuc

SEQ ID NO: 446017 - RNA, 32 nt, Human
gcucgggaggcugaggcaggggaaucgcuuga

SEQ ID NO: 446018 - RNA, 32 nt, Human
gcucgggaggcugaggcaggggcauugcuugg

SEQ ID NO: 446019 - RNA, 32 nt, Human
gcucgggcagccgccgccaccgcugcccagga

SEQ ID NO: 446020 - RNA, 32 nt, Human
gcucgggccacuuacacaccacugccugauaa

SEQ ID NO: 446021 - RNA, 18 nt, Human
gcucgggccccagccccg

SEQ ID NO: 446022 - RNA, 18 nt, Human
gcucgggccccugcacca

SEQ ID NO: 446023 - RNA, 19 nt, Human
gcucgggccgcgccugcca

SEQ ID NO: 446024 - RNA, 20 nt, Human
gcucgggccgggggccacca

SEQ ID NO: 446025 - RNA, 32 nt, Human
gcucgggccuguaaucccagcacuuucggagg

SEQ ID NO: 446026 - RNA, 18 nt, Human
gcucgggccuguguaauu

SEQ ID NO: 446027 - RNA, 32 nt, Human
gcucgggcuagccucaaacuccugggcucaag

SEQ ID NO: 446028 - RNA, 32 nt, Human
gcucgggcuauccuuccaucucagccucccga

SEQ ID NO: 446029 - RNA, 32 nt, Human
gcucgggcuccugguggaggagggaagccugg

SEQ ID NO: 446030 - RNA, 32 nt, Human
gcucggggacucugcggcugcucucggaccug

SEQ ID NO: 446031 - RNA, 32 nt, Human
gcucggggaggaggcagugacggccggugaga

SEQ ID NO: 446032 - RNA, 32 nt, Human
gcucggggaggcagagaaucucuugggagucu

SEQ ID NO: 446033 - RNA, 32 nt, Human
gcucggggcugaagcacuggaugcacuucuug

SEQ ID NO: 446034 - RNA, 32 nt, Human
gcucggggcugcaggcuggagugcagugggac

SEQ ID NO: 446035 - RNA, 32 nt, Human
gcucggggucccugccaaaaaugcagaaccug

SEQ ID NO: 446036 - RNA, 32 nt, Human
gcucgggucaccuucucuguggaacagcaagu

SEQ ID NO: 446037 - RNA, 32 nt, Human
gcucgggucagaagcucacucccgugcccucg

SEQ ID NO: 446038 - RNA, 32 nt, Human
gcucgggucccuucaccuccccgcccuuucuu

SEQ ID NO: 446039 - RNA, 32 nt, Human
gcucgggugaagcucucgggaagggcaagacu

SEQ ID NO: 446040 - RNA, 32 nt, Human
gcucggucaccuaggcuggaguguaguggcgc

SEQ ID NO: 446041 - RNA, 24 nt, Human
gcucgguccuuccgaggaagcuaa

SEQ ID NO: 446042 - RNA, 32 nt, Human
gcucgguggaaaugcccagccgagggacgcga

SEQ ID NO: 446043 - RNA, 32 nt, Human
gcucgguggagacgguuugccccuguggcucg

SEQ ID NO: 446044 - RNA, 32 nt, Human
gcucgguucccaagucucaccucgccaguacu

SEQ ID NO: 446045 - RNA, 32 nt, Human
gcucguaaccaccacucugagaccagcuucuu

SEQ ID NO: 446046 - RNA, 32 nt, Human
gcucguaccuguaauccagcacuuugggaagc

SEQ ID NO: 446047 - RNA, 32 nt, Human
gcucguacucgugcgccucgcuucgcuuuucc

SEQ ID NO: 446048 - RNA, 32 nt, Human
gcucguagaggagagaaaacaagaguggacug

SEQ ID NO: 446049 - RNA, 32 nt, Human
gcucguaucuguaaucccagcacuuugagagg

SEQ ID NO: 446050 - RNA, 32 nt, Human
gcucgucacccaggcuggagugcaauugugca

SEQ ID NO: 446051 - RNA, 32 nt, Human
gcucgucaggaaggcaggagacaggagacggg

SEQ ID NO: 446052 - RNA, 32 nt, Human
gcucgucccacccuagggacucagccacuugc

SEQ ID NO: 446053 - RNA, 20 nt, Human
gcucguccccggccccggcc

SEQ ID NO: 446054 - RNA, 25 nt, Human
gcucguccucagcccaaagccugca

SEQ ID NO: 446055 - RNA, 32 nt, Human
gcucguccuccccuccccacccucacccaccu

SEQ ID NO: 446056 - RNA, 32 nt, Human
gcucgucgcugcuguuuccugcugggggugcc

SEQ ID NO: 446057 - RNA, 32 nt, Human
gcucgucgcuggcugcucccaccaaccaccac

SEQ ID NO: 446058 - RNA, 32 nt, Human
gcucgucucggaacuccugaccucaggugauc

SEQ ID NO: 446059 - RNA, 32 nt, Human
gcucgucugccuggacuguugcgggccccggg

SEQ ID NO: 446060 - RNA, 32 nt, Human
gcucgucugugucccugccacucugaguuauc

SEQ ID NO: 446061 - RNA, 32 nt, Human
gcucgugaccucacgugauccucccgucuccg

SEQ ID NO: 446062 - RNA, 32 nt, Human
gcucgugagcacacucagugcccagcccagcc

SEQ ID NO: 446063 - RNA, 32 nt, Human
gcucgugcauguaauccuagcacuuugggagg

SEQ ID NO: 446064 - RNA, 32 nt, Human
gcucgugccuacaaucccagcacuuugggagg

SEQ ID NO: 446065 - RNA, 19 nt, Human
gcucgugccuguaauacca

SEQ ID NO: 446066 - RNA, 32 nt, Human
gcucgugccuguaauaccaacauuuugggagg

SEQ ID NO: 446067 - RNA, 32 nt, Human
gcucgugccuguaaucccagcacuuugggagg

SEQ ID NO: 446068 - RNA, 32 nt, Human
gcucgugccuguacucccagcacuuugggagg

SEQ ID NO: 446069 - RNA, 32 nt, Human
gcucgugccuguagucccagcacuuugggagg

SEQ ID NO: 446070 - RNA, 32 nt, Human
gcucgugccugucaucccagcacuuugggagg

SEQ ID NO: 446071 - RNA, 32 nt, Human
gcucgugccugugaucucagcacuugggaaag

SEQ ID NO: 446072 - RNA, 32 nt, Human
gcucgugcucaaguagccuggcuggcacaggg

SEQ ID NO: 446073 - RNA, 32 nt, Human
gcucgugcuggguggauugugauguggaaacc

SEQ ID NO: 446074 - RNA, 32 nt, Human
gcucgugcuuguaaucccagcacuuugggagg

SEQ ID NO: 446075 - RNA, 32 nt, Human
gcucguggacccugggcucgucuuugcagagu

SEQ ID NO: 446076 - RNA, 32 nt, Human
gcucguggagcagaaucucccgacacccacac

SEQ ID NO: 446077 - RNA, 23 nt, Human
gcucguggccgcgccugcucccg

SEQ ID NO: 446078 - RNA, 19 nt, Human
gcucguggcuguaauccca

SEQ ID NO: 446079 - RNA, 32 nt, Human
gcucgugugccuggcccgagcccugcuccgca

SEQ ID NO: 446080 - RNA, 32 nt, Human
gcucguuacccaggguggagugcagugguagc

SEQ ID NO: 446081 - RNA, 32 nt, Human
gcucguuagcuuuaaucaaucaugcccugccu

SEQ ID NO: 446082 - RNA, 32 nt, Human
gcucguucaacucaggaacuuccccagauucc

SEQ ID NO: 446083 - RNA, 32 nt, Human
gcucguucucggcuugucuacaggcccuuuuc

SEQ ID NO: 446084 - RNA, 32 nt, Human
gcucguugcuugccuauucuuuacagaggaau

SEQ ID NO: 446085 - RNA, 32 nt, Human
gcucguuugagggauugggguggaccuggggu

SEQ ID NO: 446086 - RNA, 32 nt, Human
gcucguuuuauagcaaccucucucuacccuag

SEQ ID NO: 446087 - RNA, 32 nt, Human
gcucguuuugcagagaaggcaguguuccucua

SEQ ID NO: 446088 - RNA, 32 nt, Human
gcucuaaaacgggaaggcuauuugggacaggc

SEQ ID NO: 446089 - RNA, 32 nt, Human
gcucuaaagacuguucuggccccagacacagg

SEQ ID NO: 446090 - RNA, 32 nt, Human
gcucuaaaugcagaauuaauggagacuucaau

SEQ ID NO: 446091 - RNA, 21 nt, Human
gcucuaacaucucuggucuuu

SEQ ID NO: 446092 - RNA, 32 nt, Human
gcucuaacauggcaugcccuuucucagcccag

SEQ ID NO: 446093 - RNA, 32 nt, Human
gcucuaacccagccaggaagguguaaacaaua

SEQ ID NO: 446094 - RNA, 32 nt, Human
gcucuaacccauuuuccuccagcccuggcuac

SEQ ID NO: 446095 - RNA, 32 nt, Human
gcucuaagaccacccagcucucuuccuggcua

SEQ ID NO: 446096 - RNA, 32 nt, Human
gcucuaagggcagcugaccaccugccagcccc

SEQ ID NO: 446097 - RNA, 32 nt, Human
gcucuaaguugaaugcaguccuagugggaauc

SEQ ID NO: 446098 - RNA, 32 nt, Human
gcucuacaaggagucccugagccgccucaugg

SEQ ID NO: 446099 - RNA, 32 nt, Human
gcucuacacauacugcaugcucaggacccaua

SEQ ID NO: 446100 - RNA, 32 nt, Human
gcucuacagcggagguggcuguggcgguggcg

SEQ ID NO: 446101 - RNA, 32 nt, Human
gcucuacaucuucugccuuagucucaguuugu

SEQ ID NO: 446102 - RNA, 32 nt, Human
gcucuacauuauuucuucaaaggaaaggaaag

SEQ ID NO: 446103 - RNA, 32 nt, Human
gcucuaccacccaggcuggagugcaguggugu

SEQ ID NO: 446104 - RNA, 32 nt, Human
gcucuaccaguuccuguuucuucugagccaga

SEQ ID NO: 446105 - RNA, 32 nt, Human
gcucuaccaguucucguuuugggccagaggca

SEQ ID NO: 446106 - RNA, 32 nt, Human
gcucuaccccauuggcucagagcuagggcaaa

SEQ ID NO: 446107 - RNA, 17 nt, Human
gcucuaccccgccgcag

SEQ ID NO: 446108 - RNA, 32 nt, Human
gcucuacccuauacugaugcuccgacugccua

SEQ ID NO: 446109 - RNA, 32 nt, Human
gcucuacccucugccucucaccaggagacacu

SEQ ID NO: 446110 - RNA, 32 nt, Human
gcucuacccuugggaagccugaucccggugug

SEQ ID NO: 446111 - RNA, 32 nt, Human
gcucuaccgcaaggaccuggagauugugcucu

SEQ ID NO: 446112 - RNA, 26 nt, Human
gcucuaccuagcgcugcaggcuccug

SEQ ID NO: 446113 - RNA, 32 nt, Human
gcucuaccuaucugauacaucuguaaaugugg

SEQ ID NO: 446114 - RNA, 19 nt, Human
gcucuaccucucuuucuca

SEQ ID NO: 446115 - RNA, 32 nt, Human
gcucuacgcgagguuuguuaauaaaaguuugu

SEQ ID NO: 446116 - RNA, 32 nt, Human
gcucuacggugacuuugaagacuuggaaacag

SEQ ID NO: 446117 - RNA, 22 nt, Human
gcucuacucauuccuuccacca

SEQ ID NO: 446118 - RNA, 32 nt, Human
gcucuacuccacccacucccagcucugccaag

SEQ ID NO: 446119 - RNA, 32 nt, Human
gcucuacucuagaggggcagguccaaguucac

SEQ ID NO: 446120 - RNA, 32 nt, Human
gcucuacugccagugugaccucacccucucca

SEQ ID NO: 446121 - RNA, 32 nt, Human
gcucuacuuggaagacauuuuccucuuucucc

SEQ ID NO: 446122 - RNA, 32 nt, Human
gcucuagaucccccuccccugccugcucugca

SEQ ID NO: 446123 - RNA, 20 nt, Human
gcucuagccaagguccugcc

SEQ ID NO: 446124 - RNA, 32 nt, Human
gcucuagccaucucucggucacuggcaauaaa

SEQ ID NO: 446125 - RNA, 32 nt, Human
gcucuagccugaacccuggccugggccgagca

SEQ ID NO: 446126 - RNA, 32 nt, Human
gcucuagcucacuguugccucgcugucugcca

SEQ ID NO: 446127 - RNA, 32 nt, Human
gcucuagcuucuuguguaccauaguacugugg

SEQ ID NO: 446128 - RNA, 32 nt, Human
gcucuaggaaacaccagucuugagagguggcc

SEQ ID NO: 446129 - RNA, 32 nt, Human
gcucuaggaacacagugccagugcagaaguuu

SEQ ID NO: 446130 - RNA, 32 nt, Human
gcucuaggaagcagauacaguuauuaagucca

SEQ ID NO: 446131 - RNA, 32 nt, Human
gcucuaggaaggcagcaugcucagugggaaca

SEQ ID NO: 446132 - RNA, 19 nt, Human
gcucuaggaccugggccuc

SEQ ID NO: 446133 - RNA, 32 nt, Human
gcucuaggaggaggcagggacuccaggguguc

SEQ ID NO: 446134 - RNA, 32 nt, Human
gcucuaggaggaggcagggauuccaggguguu

SEQ ID NO: 446135 - RNA, 32 nt, Human
gcucuaggcccuucagacuugcacuuggagaa

SEQ ID NO: 446136 - RNA, 21 nt, Human
gcucuaggccuuauccucccu

SEQ ID NO: 446137 - RNA, 32 nt, Human
gcucuaggcugcuguccaugccagcuugggac

SEQ ID NO: 446138 - RNA, 32 nt, Human
gcucuaggcuucuccugcugaguccuggucuu

SEQ ID NO: 446139 - RNA, 32 nt, Human
gcucuagggacaccuggugauuccuacacaag

SEQ ID NO: 446140 - RNA, 32 nt, Human
gcucuagggcugaagguggaaguagggccacu

SEQ ID NO: 446141 - RNA, 32 nt, Human
gcucuaggggaagguauacugggcagggaguu

SEQ ID NO: 446142 - RNA, 32 nt, Human
gcucuagguuucuucucccaaaggggacccaa

SEQ ID NO: 446143 - RNA, 32 nt, Human
gcucuaguaccauuccuuccucuuagccccag

SEQ ID NO: 446144 - RNA, 32 nt, Human
gcucuagugcauucaagagagccuguuacuag

SEQ ID NO: 446145 - RNA, 32 nt, Human
gcucuaguggguggaaacgggugguugccaug

SEQ ID NO: 446146 - RNA, 30 nt, Human
gcucuaguguuugguggcguugccguugca

SEQ ID NO: 446147 - RNA, 32 nt, Human
gcucuaguugcccacacuagagugcaauggcg

SEQ ID NO: 446148 - RNA, 32 nt, Human
gcucuauaaauccugcuccucuuucccauauc

SEQ ID NO: 446149 - RNA, 32 nt, Human
gcucuauagcagacacuaaagacuggguuaca

SEQ ID NO: 446150 - RNA, 32 nt, Human
gcucuaucaccaggugggagugcaguggcaca

SEQ ID NO: 446151 - RNA, 32 nt, Human
gcucuaucacccaagcuggaguacaguggcac

SEQ ID NO: 446152 - RNA, 32 nt, Human
gcucuaucacccaggcugaagugcaguagugc

SEQ ID NO: 446153 - RNA, 32 nt, Human
gcucuaucacccaggcugaagugcagugguac

SEQ ID NO: 446154 - RNA, 32 nt, Human
gcucuaucacccaggcuggagugcaguggugc

SEQ ID NO: 446155 - RNA, 32 nt, Human
gcucuaucaccuaggcuggagugcagcggcau

SEQ ID NO: 446156 - RNA, 32 nt, Human
gcucuaucagccacagaucucaugguggcugu

SEQ ID NO: 446157 - RNA, 32 nt, Human
gcucuaucagggcaugucagaccaacagaggg

SEQ ID NO: 446158 - RNA, 32 nt, Human
gcucuauccccuuccuccuaccugaccaggcc

SEQ ID NO: 446159 - RNA, 32 nt, Human
gcucuaucgccaggcuggaguguaguggcaug

SEQ ID NO: 446160 - RNA, 32 nt, Human
gcucuaucgcccaggauggagugcaguggcuc

SEQ ID NO: 446161 - RNA, 32 nt, Human
gcucuaucgcccaggcuggagugcaguggcgc

SEQ ID NO: 446162 - RNA, 32 nt, Human
gcucuaucgccuaggcugaagcacaguggugc

SEQ ID NO: 446163 - RNA, 32 nt, Human
gcucuaucggccgccucgcuaccagauagcca

SEQ ID NO: 446164 - RNA, 32 nt, Human
gcucuaugaauuuuccaugaaaggaggaagua

SEQ ID NO: 446165 - RNA, 32 nt, Human
gcucuaugcaaccuccaccuccuggguucaug

SEQ ID NO: 446166 - RNA, 23 nt, Human
gcucuaugcugucuauccucucu

SEQ ID NO: 446167 - RNA, 32 nt, Human
gcucuaugcuuguguaccuuugcacauauuuu

SEQ ID NO: 446168 - RNA, 32 nt, Human
gcucuauggaccaggcccugcccaugcauccg

SEQ ID NO: 446169 - RNA, 32 nt, Human
gcucuauggcccaggcuggaguacagugacac

SEQ ID NO: 446170 - RNA, 32 nt, Human
gcucuauggugacuuugaagacuuggaaacag

SEQ ID NO: 446171 - RNA, 32 nt, Human
gcucuaugugagucucaggaagugaauuaaau

SEQ ID NO: 446172 - RNA, 32 nt, Human
gcucuauuacucaggcuggaguaaaauggugc

SEQ ID NO: 446173 - RNA, 21 nt, Human
gcucuauuccauaccgugcca

SEQ ID NO: 446174 - RNA, 19 nt, Human
gcucuauucccccucugcc

SEQ ID NO: 446175 - RNA, 32 nt, Human
gcucuauuccugacacuaccucucauuugcaa

SEQ ID NO: 446176 - RNA, 20 nt, Human
gcucuauucuguaccugcca

SEQ ID NO: 446177 - RNA, 32 nt, Human
gcucuauucuuuucucuuucuucauuuaacau

SEQ ID NO: 446178 - RNA, 32 nt, Human
gcucuauugcccaggcuggagugcaguggcuc

SEQ ID NO: 446179 - RNA, 32 nt, Human
gcucuauugcccaggcuggagugcagugguac

SEQ ID NO: 446180 - RNA, 32 nt, Human
gcucuauugcccagucuggagugcaguggcau

SEQ ID NO: 446181 - RNA, 32 nt, Human
gcucuauuggccaggcuggaguguaguggcac

SEQ ID NO: 446182 - RNA, 32 nt, Human
gcucuauuguucagacuggagugcaguggcau

SEQ ID NO: 446183 - RNA, 32 nt, Human
gcucuauuuauggaggagaugaaaguuuccgg

SEQ ID NO: 446184 - RNA, 32 nt, Human
gcucucaacccccauauuuugccuuugaauac

SEQ ID NO: 446185 - RNA, 32 nt, Human
gcucucaauccccagcccucauccagaguuug

SEQ ID NO: 446186 - RNA, 32 nt, Human
gcucucaauggccgcagacuccuccagccucu

SEQ ID NO: 446187 - RNA, 32 nt, Human
gcucucacaggcuggggauguuuauaaaguga

SEQ ID NO: 446188 - RNA, 32 nt, Human
gcucucacaguucuuuuucuuccugucauaac

SEQ ID NO: 446189 - RNA, 21 nt, Human
gcucucaccagacaaugaaug

SEQ ID NO: 446190 - RNA, 32 nt, Human
gcucucaccccagggaugaaacacccagaaac

SEQ ID NO: 446191 - RNA, 32 nt, Human
gcucucacccucccuucucucccucaauaaug

SEQ ID NO: 446192 - RNA, 32 nt, Human
gcucucacccugggguccccagccucucaccg

SEQ ID NO: 446193 - RNA, 32 nt, Human
gcucucaccgcaaccuccgucuccuggguuca

SEQ ID NO: 446194 - RNA, 32 nt, Human
gcucucacucacugauaaugcuuauuaccuuc

SEQ ID NO: 446195 - RNA, 32 nt, Human
gcucucacuucacaccgauucccaccagggca

SEQ ID NO: 446196 - RNA, 32 nt, Human
gcucucagagagagcucuccccuggcagugac

SEQ ID NO: 446197 - RNA, 32 nt, Human
gcucucagaguuucugugaugauuuguugagc

SEQ ID NO: 446198 - RNA, 32 nt, Human
gcucucagaucgagucuugcucugucacccgg

SEQ ID NO: 446199 - RNA, 19 nt, Human
gcucucagccagcggccgg

SEQ ID NO: 446200 - RNA, 32 nt, Human
gcucucagcuacuccugaaacgggcagagaug

SEQ ID NO: 446201 - RNA, 22 nt, Human
gcucucagcucacugcagcccu

SEQ ID NO: 446202 - RNA, 32 nt, Human
gcucucagcugcacucacagcaccagugagac

SEQ ID NO: 446203 - RNA, 32 nt, Human
gcucucagcuggcagugcaaugcuuguagaag

SEQ ID NO: 446204 - RNA, 32 nt, Human
gcucucagcugguauugaacuggugggagaaa

SEQ ID NO: 446205 - RNA, 32 nt, Human
gcucucagcuuuuagaaaauucuaucugcuaa

SEQ ID NO: 446206 - RNA, 32 nt, Human
gcucucaggaugacucuuggcucuugggcaug

SEQ ID NO: 446207 - RNA, 32 nt, Human
gcucucaggcagcagagggccgccgucggggu

SEQ ID NO: 446208 - RNA, 21 nt, Human
gcucucaggccuccuccucca

SEQ ID NO: 446209 - RNA, 20 nt, Human
gcucucagggacugagggca

SEQ ID NO: 446210 - RNA, 32 nt, Human
gcucucagggcuagaaugcuucccccucuuau

SEQ ID NO: 446211 - RNA, 22 nt, Human
gcucucaguagcgucagcccca

SEQ ID NO: 446212 - RNA, 32 nt, Human
gcucucaguaggaacuuggaaugcaagcugga

SEQ ID NO: 446213 - RNA, 32 nt, Human
gcucucauauuuuaaaauauccuuggaggcua

SEQ ID NO: 446214 - RNA, 32 nt, Human
gcucucaugaucauaacggcucugcugugaag

SEQ ID NO: 446215 - RNA, 32 nt, Human
gcucuccaaaccugcuugcuugcaccccucua

SEQ ID NO: 446216 - RNA, 32 nt, Human
gcucuccaacaagaaggaaagcagggaggaag

SEQ ID NO: 446217 - RNA, 32 nt, Human
gcucuccaaggagcaggagcugggugaucuug

SEQ ID NO: 446218 - RNA, 32 nt, Human
gcucuccaauuuaaaaaggaagggccucuccu

SEQ ID NO: 446219 - RNA, 23 nt, Human
gcucuccacccccucuggcccca

SEQ ID NO: 446220 - RNA, 23 nt, Human
gcucuccagaaaaaugcuuugaa

SEQ ID NO: 446221 - RNA, 32 nt, Human
gcucuccagaagcaugaacugcaguggagaug

SEQ ID NO: 446222 - RNA, 32 nt, Human
gcucuccagcagcugcuccugccugauucaac

SEQ ID NO: 446223 - RNA, 32 nt, Human
gcucuccagcccugcagcagaagaacuucccg

SEQ ID NO: 446224 - RNA, 23 nt, Human
gcucuccagccucugacacaaga

SEQ ID NO: 446225 - RNA, 23 nt, Human
gcucuccagccugcgccuggggu

SEQ ID NO: 446226 - RNA, 32 nt, Human
gcucuccagccugggcaacagagcaaggcucu

SEQ ID NO: 446227 - RNA, 32 nt, Human
gcucuccagccuggggaacagagcaagacugu

SEQ ID NO: 446228 - RNA, 32 nt, Human
gcucuccagguggucagagggcccaguggugc

SEQ ID NO: 446229 - RNA, 32 nt, Human
gcucuccaugccaccaccugcccuaccauuua

SEQ ID NO: 446230 - RNA, 32 nt, Human
gcucuccauggcccacagcaggcacaggucug

SEQ ID NO: 446231 - RNA, 21 nt, Human
gcucucccaacacauaacuca

SEQ ID NO: 446232 - RNA, 24 nt, Human
gcucucccacaauucaucuucccu

SEQ ID NO: 446233 - RNA, 32 nt, Human
gcucucccacagaaaccuuuguccuugcaacu

SEQ ID NO: 446234 - RNA, 32 nt, Human
gcucucccaggaggaagcauuccccaccccac

SEQ ID NO: 446235 - RNA, 32 nt, Human
gcucuccccaaccacucuccccagauccugga

SEQ ID NO: 446236 - RNA, 32 nt, Human
gcucuccccacccauuccccugccccuaggag

SEQ ID NO: 446237 - RNA, 32 nt, Human
gcucuccccaugagcaaguucuugccuucauu

SEQ ID NO: 446238 - RNA, 23 nt, Human
gcucucccccgccagcagccccg

SEQ ID NO: 446239 - RNA, 16 nt, Human
gcucuccccuccugug

SEQ ID NO: 446240 - RNA, 32 nt, Human
gcucucccgagucugugacuacaggcaaauca

SEQ ID NO: 446241 - RNA, 32 nt, Human
gcucucccgcauuccuccucccacuuggccaa

SEQ ID NO: 446242 - RNA, 32 nt, Human
gcucucccuccaccaacucucaaggcuccuca

SEQ ID NO: 446243 - RNA, 32 nt, Human
gcucucccucccccugucccccacccucaugg

SEQ ID NO: 446244 - RNA, 32 nt, Human
gcucucccuccccuccccacuccuccucucuu

SEQ ID NO: 446245 - RNA, 32 nt, Human
gcucucccuccucuccccuucgcuguccccuc

SEQ ID NO: 446246 - RNA, 32 nt, Human
gcucucccuccucugagugccaugucuagggc

SEQ ID NO: 446247 - RNA, 32 nt, Human
gcucucccucugauuuaggagaucuuguuacc

SEQ ID NO: 446248 - RNA, 32 nt, Human
gcucucccugcuccccauucugaagcccaggu

SEQ ID NO: 446249 - RNA, 32 nt, Human
gcucucccuggacuugcccugccuggaacagg

SEQ ID NO: 446250 - RNA, 32 nt, Human
gcucucccugucucuaggucgcugagagaggu

SEQ ID NO: 446251 - RNA, 32 nt, Human
gcucucccuuugcgcagcccuaccuuaaggaa

SEQ ID NO: 446252 - RNA, 32 nt, Human
gcucuccgcuccaccccuuagccugggaaccc

SEQ ID NO: 446253 - RNA, 32 nt, Human
gcucuccggacccugcagcagagaggccagag

SEQ ID NO: 446254 - RNA, 26 nt, Human
gcucuccggggcuccugccagcccca

SEQ ID NO: 446255 - RNA, 24 nt, Human
gcucuccguggggcaccccaugga

SEQ ID NO: 446256 - RNA, 20 nt, Human
gcucuccuaccucccucucu

SEQ ID NO: 446257 - RNA, 19 nt, Human
gcucuccuaucagaagcuc

SEQ ID NO: 446258 - RNA, 32 nt, Human
gcucuccucccccuaaaaagcugacucacugu

SEQ ID NO: 446259 - RNA, 32 nt, Human
gcucuccucccgcuucaggccuaggauggcaa

SEQ ID NO: 446260 - RNA, 19 nt, Human
gcucuccucccugccacca

SEQ ID NO: 446261 - RNA, 17 nt, Human
gcucuccuccugcugcc

SEQ ID NO: 446262 - RNA, 32 nt, Human
gcucuccucggaggcugcuggggaggagccuc

SEQ ID NO: 446263 - RNA, 32 nt, Human
gcucuccucuggcuagagugggaagagggggc

SEQ ID NO: 446264 - RNA, 19 nt, Human
gcucuccugccacccagag

SEQ ID NO: 446265 - RNA, 20 nt, Human
gcucuccugccacccugcug

SEQ ID NO: 446266 - RNA, 32 nt, Human
gcucuccugcccaccucuccccacccugaacc

SEQ ID NO: 446267 - RNA, 21 nt, Human
gcucuccugcccugcccuccu

SEQ ID NO: 446268 - RNA, 21 nt, Human
gcucuccugcccugccuuccu

SEQ ID NO: 446269 - RNA, 20 nt, Human
gcucuccugcccugggccuc

SEQ ID NO: 446270 - RNA, 22 nt, Human
gcucuccugccuccaccgccuu

SEQ ID NO: 446271 - RNA, 32 nt, Human
gcucuccugccuccaccgccuugguuuugcuu

SEQ ID NO: 446272 - RNA, 24 nt, Human
gcucuccugccucuucgucuuucu

SEQ ID NO: 446273 - RNA, 32 nt, Human
gcucuccugcugagguggagacugcagugagc

SEQ ID NO: 446274 - RNA, 32 nt, Human
gcucuccugcugagguggagauugcagugaac

SEQ ID NO: 446275 - RNA, 22 nt, Human
gcucuccugcugccgccucucu

SEQ ID NO: 446276 - RNA, 32 nt, Human
gcucuccugcuguguggcuuggggcuuguugc

SEQ ID NO: 446277 - RNA, 24 nt, Human
gcucuccuggcucacucuuacggu

SEQ ID NO: 446278 - RNA, 24 nt, Human
gcucuccuguccucccugugcuca

SEQ ID NO: 446279 - RNA, 32 nt, Human
gcucuccugucuggggcaucuacuggagcacc

SEQ ID NO: 446280 - RNA, 32 nt, Human
gcucuccuucugagucaggacauguguacagg

SEQ ID NO: 446281 - RNA, 32 nt, Human
gcucuccuugaauaagaaagccagcagaacuc

SEQ ID NO: 446282 - RNA, 32 nt, Human
gcucuccuugcagugcaggccccagccgcucu

SEQ ID NO: 446283 - RNA, 32 nt, Human
gcucuccuugcuccuggccuugcugaccucag

SEQ ID NO: 446284 - RNA, 32 nt, Human
gcucuccuuuggguguaugcaggugugugggg

SEQ ID NO: 446285 - RNA, 32 nt, Human
gcucuccuuuucccucuuacccucucucucuu

SEQ ID NO: 446286 - RNA, 32 nt, Human
gcucucgagagcuccagcaggagaggcccuuc

SEQ ID NO: 446287 - RNA, 32 nt, Human
gcucucgcccaggcuggagugcaguggguggg

SEQ ID NO: 446288 - RNA, 32 nt, Human
gcucucgccucaccccggcuccugggcuuuga

SEQ ID NO: 446289 - RNA, 32 nt, Human
gcucucgccuguaaucccagcacuuugggagg

SEQ ID NO: 446290 - RNA, 32 nt, Human
gcucucgccuguaaucucagcacuuugggagg

SEQ ID NO: 446291 - RNA, 23 nt, Human
gcucucgcgggcgcgcucggggu

SEQ ID NO: 446292 - RNA, 32 nt, Human
gcucucgcuccacuugcccuucccaggaacca

SEQ ID NO: 446293 - RNA, 32 nt, Human
gcucucgcugguuuguucuuggguuguuuuuc

SEQ ID NO: 446294 - RNA, 32 nt, Human
gcucucggcccacacaauaugaccucggggag

SEQ ID NO: 446295 - RNA, 21 nt, Human
gcucucggcccagcagacccc

SEQ ID NO: 446296 - RNA, 32 nt, Human
gcucucggccccggagcccggucgcaggagcg

SEQ ID NO: 446297 - RNA, 23 nt, Human
gcucucggcucacugcaaccucu

SEQ ID NO: 446298 - RNA, 32 nt, Human
gcucucggcugcagcgcuggguggaucuagga

SEQ ID NO: 446299 - RNA, 21 nt, Human
gcucucggcugggcgcagugg

SEQ ID NO: 446300 - RNA, 32 nt, Human
gcucucgggaaagcugcccagauggggcugcg

SEQ ID NO: 446301 - RNA, 32 nt, Human
gcucucguugccaaggcuggagugcaauggca

SEQ ID NO: 446302 - RNA, 32 nt, Human
gcucucguugccgaggcuggaguguaguagug

SEQ ID NO: 446303 - RNA, 32 nt, Human
gcucucuaacccgagcuagagugcagugacgc

SEQ ID NO: 446304 - RNA, 32 nt, Human
gcucucuaccucucccugcuccuggugccugc

SEQ ID NO: 446305 - RNA, 32 nt, Human
gcucucuagcuggcuggaguguaggauugcgu

SEQ ID NO: 446306 - RNA, 32 nt, Human
gcucucuauuggagagaggaagugacuggccu

SEQ ID NO: 446307 - RNA, 32 nt, Human
gcucucucacccaggccugaagugcaguggca

SEQ ID NO: 446308 - RNA, 32 nt, Human
gcucucucacccaggcuggaguagagugacaa

SEQ ID NO: 446309 - RNA, 32 nt, Human
gcucucucacccaggcuggaguguaagugaca

SEQ ID NO: 446310 - RNA, 23 nt, Human
gcucucucaccucuauuaccucc

SEQ ID NO: 446311 - RNA, 32 nt, Human
gcucucucagugccauggagaggcaggaagag

SEQ ID NO: 446312 - RNA, 32 nt, Human
gcucucucauuuucuuuucuucuccuuucccc

SEQ ID NO: 446313 - RNA, 32 nt, Human
gcucucuccaccacgcugccucaggcccuagg

SEQ ID NO: 446314 - RNA, 32 nt, Human
gcucucuccaguaccagacucauuucaguacc

SEQ ID NO: 446315 - RNA, 32 nt, Human
gcucucucccuuaaaacuaacagggagagagc

SEQ ID NO: 446316 - RNA, 32 nt, Human
gcucucuccuacucaguuugaucucucuaaaa

SEQ ID NO: 446317 - RNA, 32 nt, Human
gcucucuccucaaauggaggcagccauggccu

SEQ ID NO: 446318 - RNA, 32 nt, Human
gcucucuccugauagucuuucaguuaaggaga

SEQ ID NO: 446319 - RNA, 32 nt, Human
gcucucuccugcuucaagaucuugccucuuua

SEQ ID NO: 446320 - RNA, 32 nt, Human
gcucucuccuucagaaccccgcucugaggaaa

SEQ ID NO: 446321 - RNA, 32 nt, Human
gcucucuccuuguggggagguggauccucugc

SEQ ID NO: 446322 - RNA, 32 nt, Human
gcucucuccuuuccccuuuuccucuuauccca

SEQ ID NO: 446323 - RNA, 32 nt, Human
gcucucucgcccaggcuggagugcaguggugc

SEQ ID NO: 446324 - RNA, 32 nt, Human
gcucucucuagcuccccaauucugccugccuc

SEQ ID NO: 446325 - RNA, 32 nt, Human
gcucucucuaucuugcaaauaggaguccuuaa

SEQ ID NO: 446326 - RNA, 32 nt, Human
gcucucucuccucaucuccaucucccaggcuc

SEQ ID NO: 446327 - RNA, 32 nt, Human
gcucucucucugcugccucuucauacguuuuc

SEQ ID NO: 446328 - RNA, 32 nt, Human
gcucucucucugggacugaccugcugcaagca

SEQ ID NO: 446329 - RNA, 22 nt, Human
gcucucucucuuugccugcugc

SEQ ID NO: 446330 - RNA, 31 nt, Human
gcucucucugucucugggucuucuggcugug

SEQ ID NO: 446331 - RNA, 32 nt, Human
gcucucucugugggcuucucuuggugcacggu

SEQ ID NO: 446332 - RNA, 20 nt, Human
gcucucucuuugccugcugc

SEQ ID NO: 446333 - RNA, 32 nt, Human
gcucucugaauccauugauacagucaugccaa

SEQ ID NO: 446334 - RNA, 32 nt, Human
gcucucugagccagucccucagccacugaagu

SEQ ID NO: 446335 - RNA, 32 nt, Human
gcucucugaucaucuucuucaauuccugcuag

SEQ ID NO: 446336 - RNA, 32 nt, Human
gcucucugauccacucaggggucagggcauca

SEQ ID NO: 446337 - RNA, 32 nt, Human
gcucucugcaaacucugcuuccuggguucaca

SEQ ID NO: 446338 - RNA, 32 nt, Human
gcucucugcaaccuccaccuccuggguucaag

SEQ ID NO: 446339 - RNA, 22 nt, Human
gcucucugcaaccucugccucc

SEQ ID NO: 446340 - RNA, 32 nt, Human
gcucucugcaacuuccgccuccuggguucaag

SEQ ID NO: 446341 - RNA, 21 nt, Human
gcucucugccccucaugcccc

SEQ ID NO: 446342 - RNA, 24 nt, Human
gcucucugcccuugaucagcccca

SEQ ID NO: 446343 - RNA, 32 nt, Human
gcucucugccucccucuccaacgcccggauga

SEQ ID NO: 446344 - RNA, 22 nt, Human
gcucucugccucccuuccagga

SEQ ID NO: 446345 - RNA, 31 nt, Human
gcucucugccucucugcccuuuggucuaugu

SEQ ID NO: 446346 - RNA, 32 nt, Human
gcucucugcucacauuucucucucccauuuuc

SEQ ID NO: 446347 - RNA, 32 nt, Human
gcucucugcucacuuuucucucucccguuuuc

SEQ ID NO: 446348 - RNA, 32 nt, Human
gcucucugcuuugggcucugcaggccaccaga

SEQ ID NO: 446349 - RNA, 32 nt, Human
gcucucuggaacccauuucucaagggagaacc

SEQ ID NO: 446350 - RNA, 32 nt, Human
gcucucuggcaggcaggcuaggaagcucuagg

SEQ ID NO: 446351 - RNA, 29 nt, Human
gcucucuggccgcuaucaucccagcagug

SEQ ID NO: 446352 - RNA, 32 nt, Human
gcucucuggccuccagccucccagcagcaugg

SEQ ID NO: 446353 - RNA, 32 nt, Human
gcucucuggcugaggcugccugccuggagggg

SEQ ID NO: 446354 - RNA, 32 nt, Human
gcucucugggaggugugcuggguguguucgug

SEQ ID NO: 446355 - RNA, 32 nt, Human
gcucucugggcugacugggccaggggagguua

SEQ ID NO: 446356 - RNA, 32 nt, Human
gcucucuggggucugacucugccccuuuucuu

SEQ ID NO: 446357 - RNA, 32 nt, Human
gcucucuguccgaucugugcauguuauuuuuc

SEQ ID NO: 446358 - RNA, 32 nt, Human
gcucucugugcuacuuacaucucccucccuug

SEQ ID NO: 446359 - RNA, 32 nt, Human
gcucucugugcucucagggacaccuccucuga

SEQ ID NO: 446360 - RNA, 32 nt, Human
gcucucuguggcagaguguguggagcggaugg

SEQ ID NO: 446361 - RNA, 32 nt, Human
gcucucuuacccaagcuggagugcagugacau

SEQ ID NO: 446362 - RNA, 32 nt, Human
gcucucuucaugccuugaaauuuuggggucca

SEQ ID NO: 446363 - RNA, 32 nt, Human
gcucucuuccucauguuauaacauggauccac

SEQ ID NO: 446364 - RNA, 32 nt, Human
gcucucuugcccagacuggaauacaguggugu

SEQ ID NO: 446365 - RNA, 32 nt, Human
gcucucuugcccaggcuggagugcaauggcac

SEQ ID NO: 446366 - RNA, 32 nt, Human
gcucucuugccuggcguucccucugcacggcu

SEQ ID NO: 446367 - RNA, 32 nt, Human
gcucucuuguccaggcuggagugcaauagcgc

SEQ ID NO: 446368 - RNA, 32 nt, Human
gcucucuuugguagggagaggggcuccaauau

SEQ ID NO: 446369 - RNA, 32 nt, Human
gcucucuuuuuaacuuucucugugauaaggaa

SEQ ID NO: 446370 - RNA, 32 nt, Human
gcucugaaaaacaugcccccgaggcucugugc

SEQ ID NO: 446371 - RNA, 32 nt, Human
gcucugaaaacacaguggagguuguggugaag

SEQ ID NO: 446372 - RNA, 32 nt, Human
gcucugaaaagaagauauuuuucaaccugaac

SEQ ID NO: 446373 - RNA, 32 nt, Human
gcucugaaacaguaggacauccugggugggug

SEQ ID NO: 446374 - RNA, 32 nt, Human
gcucugaacacaucccugagcugcagagcuga

SEQ ID NO: 446375 - RNA, 32 nt, Human
gcucugaacuagugccugcuacccaggacacc

SEQ ID NO: 446376 - RNA, 32 nt, Human
gcucugaacuucuccuucauccagggaugggc

SEQ ID NO: 446377 - RNA, 20 nt, Human
gcucugaacuuugagacagg

SEQ ID NO: 446378 - RNA, 32 nt, Human
gcucugaagagggagacugaggagcuggccug

SEQ ID NO: 446379 - RNA, 32 nt, Human
gcucugaagggaggggaagagagaggccuggg

SEQ ID NO: 446380 - RNA, 32 nt, Human
gcucugaagguaaacucaagucuccggagacu

SEQ ID NO: 446381 - RNA, 32 nt, Human
gcucugaaggucaaaagccucauuuuauuuug

SEQ ID NO: 446382 - RNA, 32 nt, Human
gcucugaaggugaaggugggagagcaggcccc

SEQ ID NO: 446383 - RNA, 32 nt, Human
gcucugacaucaucaucaccauuaacagcuga

SEQ ID NO: 446384 - RNA, 21 nt, Human
gcucugaccaaucuggucuuc

SEQ ID NO: 446385 - RNA, 32 nt, Human
gcucugaccaggaaagcuagugccauccccug

SEQ ID NO: 446386 - RNA, 32 nt, Human
gcucugaccccaaaacgaggugucuuugguaa

SEQ ID NO: 446387 - RNA, 32 nt, Human
gcucugaccccaauaucaggaacuuggcaucu

SEQ ID NO: 446388 - RNA, 31 nt, Human
gcucugaccuccucugggcccugucgccccu

SEQ ID NO: 446389 - RNA, 23 nt, Human
gcucugaccugggcagccuuccu

SEQ ID NO: 446390 - RNA, 32 nt, Human
gcucugacgcacaggcuggagugcaguggcuc

SEQ ID NO: 446391 - RNA, 32 nt, Human
gcucugacgcccuccauuucucuggcuccggc

SEQ ID NO: 446392 - RNA, 32 nt, Human
gcucugacucuucgauccucccucuuuguguc

SEQ ID NO: 446393 - RNA, 32 nt, Human
gcucugacuguacuuacgcugcacugucggug

SEQ ID NO: 446394 - RNA, 32 nt, Human
gcucugacuucucauuacugugcugaaaguca

SEQ ID NO: 446395 - RNA, 32 nt, Human
gcucugagaagaacaccugagagcgcuuucca

SEQ ID NO: 446396 - RNA, 32 nt, Human
gcucugagaaggugcuggauucugagugggcc

SEQ ID NO: 446397 - RNA, 21 nt, Human
gcucugagaauuccccugguc

SEQ ID NO: 446398 - RNA, 32 nt, Human
gcucugagaccucgcuuccuuuauggauccaa

SEQ ID NO: 446399 - RNA, 22 nt, Human
gcucugagagggacagacggug

SEQ ID NO: 446400 - RNA, 21 nt, Human
gcucugagauacuaauaggug

SEQ ID NO: 446401 - RNA, 20 nt, Human
gcucugagccaagggugagg

SEQ ID NO: 446402 - RNA, 32 nt, Human
gcucugagcccuccuucuugcccugagcuuuc

SEQ ID NO: 446403 - RNA, 32 nt, Human
gcucugagccgggagagccgaacagcugaaga

SEQ ID NO: 446404 - RNA, 22 nt, Human
gcucugagccucuagcaugguu

SEQ ID NO: 446405 - RNA, 32 nt, Human
gcucugagccugugacuccuucugcuaggcag

SEQ ID NO: 446406 - RNA, 32 nt, Human
gcucugagcugagagagaagaaauagcuaugc

SEQ ID NO: 446407 - RNA, 32 nt, Human
gcucugagcuggauugauggggccagucuccc

SEQ ID NO: 446408 - RNA, 32 nt, Human
gcucugaggauccggccucaccucuccacggg

SEQ ID NO: 446409 - RNA, 32 nt, Human
gcucugaggauucuggcugggaagaaaaagag

SEQ ID NO: 446410 - RNA, 32 nt, Human
gcucugagggagagacagugagcugcaagacu

SEQ ID NO: 446411 - RNA, 32 nt, Human
gcucugaggggaggggguccgugguagaggcc

SEQ ID NO: 446412 - RNA, 32 nt, Human
gcucugagggucccugccugaagagggacagg

SEQ ID NO: 446413 - RNA, 21 nt, Human
gcucugaggguggaaggcagg

SEQ ID NO: 446414 - RNA, 32 nt, Human
gcucugagguacucugcucacaggccccagac

SEQ ID NO: 446415 - RNA, 32 nt, Human
gcucugagguguccugaacacacagcaacggc

SEQ ID NO: 446416 - RNA, 32 nt, Human
gcucugaguaaacgcauguugugugcaaaguu

SEQ ID NO: 446417 - RNA, 32 nt, Human
gcucugaguagcugggauuauaggcaugcacc

SEQ ID NO: 446418 - RNA, 32 nt, Human
gcucugaguccagcuuagcuuuccaaaauucu

SEQ ID NO: 446419 - RNA, 22 nt, Human
gcucugagucugcccacgcagg

SEQ ID NO: 446420 - RNA, 32 nt, Human
gcucugaguggccacugggggaaaggcagccu

SEQ ID NO: 446421 - RNA, 32 nt, Human
gcucugaguggccauggggaagcgauacuucu

SEQ ID NO: 446422 - RNA, 32 nt, Human
gcucugauaacugccuuuccuuccuucugugc

SEQ ID NO: 446423 - RNA, 32 nt, Human
gcucugaucacccagggauucucucuccaacc

SEQ ID NO: 446424 - RNA, 32 nt, Human
gcucugaucaccucaagccucccacucugaac

SEQ ID NO: 446425 - RNA, 32 nt, Human
gcucugaucccaggcuggauggaguggcugga

SEQ ID NO: 446426 - RNA, 32 nt, Human
gcucugaucgggguccaacccagggagacugu

SEQ ID NO: 446427 - RNA, 32 nt, Human
gcucugaucuaccagcccugguguaguuuauu

SEQ ID NO: 446428 - RNA, 32 nt, Human
gcucugaucuccaagggaaaguuuuccugcau

SEQ ID NO: 446429 - RNA, 27 nt, Human
gcucugauuaucuagcauuuuuagggu

SEQ ID NO: 446430 - RNA, 18 nt, Human
gcucugauuucugacuca

SEQ ID NO: 446431 - RNA, 32 nt, Human
gcucugcaacaaaucuccagccuggguugcca

SEQ ID NO: 446432 - RNA, 32 nt, Human
gcucugcaacgugggagccuuggaggcgggug

SEQ ID NO: 446433 - RNA, 32 nt, Human
gcucugcaauuccccucugcugcugucccucc

SEQ ID NO: 446434 - RNA, 32 nt, Human
gcucugcaccaaccccaggcuacugagccacc

SEQ ID NO: 446435 - RNA, 32 nt, Human
gcucugcaccuuccucccgucuugccuucucc

SEQ ID NO: 446436 - RNA, 21 nt, Human
gcucugcacuccacccaggag

SEQ ID NO: 446437 - RNA, 32 nt, Human
gcucugcagcagccucugccacccugugaccu

SEQ ID NO: 446438 - RNA, 32 nt, Human
gcucugcagccugggcucugcccugccucagc

SEQ ID NO: 446439 - RNA, 32 nt, Human
gcucugcagcuagcauuucaaccauaugugga

SEQ ID NO: 446440 - RNA, 32 nt, Human
gcucugcagcugugaggaaacagccuucguua

SEQ ID NO: 446441 - RNA, 32 nt, Human
gcucugcaggacuccauuucucccacagcucu

SEQ ID NO: 446442 - RNA, 20 nt, Human
gcucugcaggcacccagggu

SEQ ID NO: 446443 - RNA, 32 nt, Human
gcucugcaggccccagcacccgcagagcagac

SEQ ID NO: 446444 - RNA, 32 nt, Human
gcucugcagggagcccuggugccagagaccuu

SEQ ID NO: 446445 - RNA, 20 nt, Human
gcucugcagggccuagggua

SEQ ID NO: 446446 - RNA, 32 nt, Human
gcucugcagggugggggcaauugaaggcccaa

SEQ ID NO: 446447 - RNA, 32 nt, Human
gcucugcagggugggggcuagagaggaagcag

SEQ ID NO: 446448 - RNA, 22 nt, Human
gcucugcaguccucggcgugug

SEQ ID NO: 446449 - RNA, 32 nt, Human
gcucugcaugccgccagccuaguagaaaguuc

SEQ ID NO: 446450 - RNA, 24 nt, Human
gcucugcaugcuccucugccugug

SEQ ID NO: 446451 - RNA, 32 nt, Human
gcucugcauucuucgcuguccaggccugccgg

SEQ ID NO: 446452 - RNA, 32 nt, Human
gcucugcauuuguuuucccuuaggugaacaau

SEQ ID NO: 446453 - RNA, 32 nt, Human
gcucugccaagcugagccuggccaagcuaggu

SEQ ID NO: 446454 - RNA, 32 nt, Human
gcucugccacccaggcuggagugcaguggugc

SEQ ID NO: 446455 - RNA, 32 nt, Human
gcucugccagaggcugaggugcccaggguguc

SEQ ID NO: 446456 - RNA, 32 nt, Human
gcucugccagcagccuuccacgggggagggag

SEQ ID NO: 446457 - RNA, 32 nt, Human
gcucugccaucugacagcucccagaggguucu

SEQ ID NO: 446458 - RNA, 32 nt, Human
gcucugccaucuuuagcgcuggcuucauucuc

SEQ ID NO: 446459 - RNA, 32 nt, Human
gcucugccauggcuauuuccacugcucuauuu

SEQ ID NO: 446460 - RNA, 32 nt, Human
gcucugcccacugugaaaccacuagguucuag

SEQ ID NO: 446461 - RNA, 32 nt, Human
gcucugcccagcaguccaaagcggcauggcca

SEQ ID NO: 446462 - RNA, 32 nt, Human
gcucugcccaggagguggcguccagcagucca

SEQ ID NO: 446463 - RNA, 21 nt, Human
gcucugccccagacugggggg

SEQ ID NO: 446464 - RNA, 24 nt, Human
gcucugccccaguauccccaggga

SEQ ID NO: 446465 - RNA, 32 nt, Human
gcucugccccauccugucacuccuggaauaag

SEQ ID NO: 446466 - RNA, 22 nt, Human
gcucugccccaugggcacggga

SEQ ID NO: 446467 - RNA, 18 nt, Human
gcucugccccucaggggg

SEQ ID NO: 446468 - RNA, 32 nt, Human
gcucugccccugggguggaggccagaggagau

SEQ ID NO: 446469 - RNA, 32 nt, Human
gcucugccccuggguggcugggaggagaggcc

SEQ ID NO: 446470 - RNA, 32 nt, Human
gcucugccccuuccagcuggagccgcccgugc

SEQ ID NO: 446471 - RNA, 32 nt, Human
gcucugccccuugcaggcuuugcucacggggu

SEQ ID NO: 446472 - RNA, 32 nt, Human
gcucugcccgcagccugaccucuagcccuggu

SEQ ID NO: 446473 - RNA, 32 nt, Human
gcucugcccuggaaagggggugaccucuugcc

SEQ ID NO: 446474 - RNA, 32 nt, Human
gcucugccgcccaggcgggagugcaguggcag

SEQ ID NO: 446475 - RNA, 32 nt, Human
gcucugccgcccaggcuggagugcaguggcgc

SEQ ID NO: 446476 - RNA, 17 nt, Human
gcucugccguaaucuca

SEQ ID NO: 446477 - RNA, 32 nt, Human
gcucugccguggcugccucugcacugacaccc

SEQ ID NO: 446478 - RNA, 23 nt, Human
gcucugccucaacuuuccuagga

SEQ ID NO: 446479 - RNA, 26 nt, Human
gcucugccucacccugcuggcuccug

SEQ ID NO: 446480 - RNA, 32 nt, Human
gcucugccuccacccccucccuauuccugaug

SEQ ID NO: 446481 - RNA, 32 nt, Human
gcucugccugcagcugggccucugccucaucc

SEQ ID NO: 446482 - RNA, 32 nt, Human
gcucugccuucccaucaucuccuuucaggacc

SEQ ID NO: 446483 - RNA, 25 nt, Human
gcucugccuucccucccugguccuc

SEQ ID NO: 446484 - RNA, 18 nt, Human
gcucugccuuggguucag

SEQ ID NO: 446485 - RNA, 32 nt, Human
gcucugccuuggugucaugccugcugcacccc

SEQ ID NO: 446486 - RNA, 32 nt, Human
gcucugcgagccccugcacuccauccugcuga

SEQ ID NO: 446487 - RNA, 32 nt, Human
gcucugcgcccaggauggagugcaguggcaug

SEQ ID NO: 446488 - RNA, 20 nt, Human
gcucugcgcccgccgccccg

SEQ ID NO: 446489 - RNA, 19 nt, Human
gcucugcgccgucgccccg

SEQ ID NO: 446490 - RNA, 32 nt, Human
gcucugcgggagaaaagcccaucucuagcaca

SEQ ID NO: 446491 - RNA, 22 nt, Human
gcucugcgguccucggccugug

SEQ ID NO: 446492 - RNA, 32 nt, Human
gcucugcgugguggagauaaaugaggaguaga

SEQ ID NO: 446493 - RNA, 21 nt, Human
gcucugcuaagcuuuggggua

SEQ ID NO: 446494 - RNA, 32 nt, Human
gcucugcuaugaaugcaccugcccucauuuga

SEQ ID NO: 446495 - RNA, 32 nt, Human
gcucugcuaugggagaagcaggcuggggcuug

SEQ ID NO: 446496 - RNA, 32 nt, Human
gcucugcuauggugaacauccagacugucacc

SEQ ID NO: 446497 - RNA, 32 nt, Human
gcucugcucacccugagcaugcagagagagca

SEQ ID NO: 446498 - RNA, 32 nt, Human
gcucugcucaggcugggaggcagagggcacaa

SEQ ID NO: 446499 - RNA, 32 nt, Human
gcucugcuccacugcuggaaggaacccuucgg

SEQ ID NO: 446500 - RNA, 32 nt, Human
gcucugcuccaggaguccaggaaagacgaggc

SEQ ID NO: 446501 - RNA, 32 nt, Human
gcucugcucccgccuguuuucuuucugacucu

SEQ ID NO: 446502 - RNA, 24 nt, Human
gcucugcuccuccccugccugcca

SEQ ID NO: 446503 - RNA, 32 nt, Human
gcucugcugcacugagacuucuugucaaugcc

SEQ ID NO: 446504 - RNA, 32 nt, Human
gcucugcugcagcugggagugugcagagacug

SEQ ID NO: 446505 - RNA, 32 nt, Human
gcucugcugcccaggcuagagugcaguggcgu

SEQ ID NO: 446506 - RNA, 32 nt, Human
gcucugcugcccaggcuggaaugcaguggugc

SEQ ID NO: 446507 - RNA, 32 nt, Human
gcucugcugcccaggcuggaguacagugaugu

SEQ ID NO: 446508 - RNA, 32 nt, Human
gcucugcugcccgccuggcugcucugucugcu

SEQ ID NO: 446509 - RNA, 32 nt, Human
gcucugcugcuggcuucuccugccaggaagug

SEQ ID NO: 446510 - RNA, 18 nt, Human
gcucugcuggagccaauc

SEQ ID NO: 446511 - RNA, 20 nt, Human
gcucugcuggagugcggugg

SEQ ID NO: 446512 - RNA, 32 nt, Human
gcucugcugucagauuagagugcagcggcaug

SEQ ID NO: 446513 - RNA, 32 nt, Human
gcucugcugugaaugugccugccugucauuug

SEQ ID NO: 446514 - RNA, 32 nt, Human
gcucuggaaaggccuuccuggguggggaauag

SEQ ID NO: 446515 - RNA, 32 nt, Human
gcucuggaacccagcaggaucacagcugccug

SEQ ID NO: 446516 - RNA, 32 nt, Human
gcucuggaagagaaggaacagggagcagagag

SEQ ID NO: 446517 - RNA, 32 nt, Human
gcucuggaagagaggcaguagcaaagagauga

SEQ ID NO: 446518 - RNA, 32 nt, Human
gcucuggaagcugacuucugaagaugacugcc

SEQ ID NO: 446519 - RNA, 22 nt, Human
gcucuggaagcugugacugagc

SEQ ID NO: 446520 - RNA, 32 nt, Human
gcucuggaagucagguggguuuccugagagag

SEQ ID NO: 446521 - RNA, 24 nt, Human
gcucuggaaguuguggacaaaccg

SEQ ID NO: 446522 - RNA, 32 nt, Human
gcucuggacauaugccuguugauuugagaaga

SEQ ID NO: 446523 - RNA, 32 nt, Human
gcucuggaccuuucccccucucccugcggccu

SEQ ID NO: 446524 - RNA, 21 nt, Human
gcucuggacugacugcaggug

SEQ ID NO: 446525 - RNA, 32 nt, Human
gcucuggacuggggacacagggauagcugagc

SEQ ID NO: 446526 - RNA, 32 nt, Human
gcucuggacuugccuccagagacugcuccaga

SEQ ID NO: 446527 - RNA, 24 nt, Human
gcucuggagagacugagacgggug

SEQ ID NO: 446528 - RNA, 21 nt, Human
gcucuggagaggaaacaaacc

SEQ ID NO: 446529 - RNA, 20 nt, Human
gcucuggagcccccagagga

SEQ ID NO: 446530 - RNA, 32 nt, Human
gcucuggaggcagcacacacagaauaacccug

SEQ ID NO: 446531 - RNA, 32 nt, Human
gcucuggaggcaggcugggcgguggcggccga

SEQ ID NO: 446532 - RNA, 22 nt, Human
gcucuggaggccacggugcagg

SEQ ID NO: 446533 - RNA, 32 nt, Human
gcucuggaggcugaggcaggagaaucacuuga

SEQ ID NO: 446534 - RNA, 32 nt, Human
gcucuggaggcuggaagccaagaucaagaugu

SEQ ID NO: 446535 - RNA, 32 nt, Human
gcucuggaggcuggagucugagcuggcagcac

SEQ ID NO: 446536 - RNA, 32 nt, Human
gcucuggagggaaaagccagagagaccaagau

SEQ ID NO: 446537 - RNA, 32 nt, Human
gcucuggagggagggccaggagcugccacacc

SEQ ID NO: 446538 - RNA, 32 nt, Human
gcucuggagggagugagcaggaugcugugaga

SEQ ID NO: 446539 - RNA, 32 nt, Human
gcucuggagguggaggcugccaugagccauga

SEQ ID NO: 446540 - RNA, 32 nt, Human
gcucuggagguggccuguucagugggggcaag

SEQ ID NO: 446541 - RNA, 32 nt, Human
gcucuggagguggcgaguaggccaguguggua

SEQ ID NO: 446542 - RNA, 22 nt, Human
gcucuggaguaaauaacaaaga

SEQ ID NO: 446543 - RNA, 22 nt, Human
gcucuggauccccagaacaaga

SEQ ID NO: 446544 - RNA, 32 nt, Human
gcucuggauggcugaaggcuccugggccaucu

SEQ ID NO: 446545 - RNA, 22 nt, Human
gcucuggcacugcccccuccca

SEQ ID NO: 446546 - RNA, 32 nt, Human
gcucuggcagagaccucugcccuccucacccu

SEQ ID NO: 446547 - RNA, 32 nt, Human
gcucuggcagggccaggagacauggcuucugc

SEQ ID NO: 446548 - RNA, 18 nt, Human
gcucuggccauccuuucc

SEQ ID NO: 446549 - RNA, 32 nt, Human
gcucuggcccuggcccacauugcacauggaaa

SEQ ID NO: 446550 - RNA, 32 nt, Human
gcucuggccucaguacccucagucuccucucc

SEQ ID NO: 446551 - RNA, 32 nt, Human
gcucuggccuccugcucagacuaaaggcaccu

SEQ ID NO: 446552 - RNA, 32 nt, Human
gcucuggcgcccaggcuggaguacaguggcau

SEQ ID NO: 446553 - RNA, 32 nt, Human
gcucuggcucuggggaacuggcccaggcauca

SEQ ID NO: 446554 - RNA, 32 nt, Human
gcucuggcugaacuggggaacucucuuguggu

SEQ ID NO: 446555 - RNA, 32 nt, Human
gcucugggaagcagugagucacacacacugcc

SEQ ID NO: 446556 - RNA, 21 nt, Human
gcucugggaaguggcugcacc

SEQ ID NO: 446557 - RNA, 22 nt, Human
gcucugggagacgaggugcagg

SEQ ID NO: 446558 - RNA, 32 nt, Human
gcucugggagagaaaggaggccagccugcugu

SEQ ID NO: 446559 - RNA, 20 nt, Human
gcugcuggagcacaggcaua

SEQ ID NO: 446560 - RNA, 32 nt, Human
gcugcuggagcagcagcggcccccgcucccgg

SEQ ID NO: 446561 - RNA, 19 nt, Human
gcugcuggagccccgagca

SEQ ID NO: 446562 - RNA, 22 nt, Human
gcugcuggagccugcccucaga

SEQ ID NO: 446563 - RNA, 20 nt, Human
gcugcuggagcgcucggggu

SEQ ID NO: 446564 - RNA, 21 nt, Human
gcugcuggagcuggcaaggua

SEQ ID NO: 446565 - RNA, 32 nt, Human
gcugcuggagcuugaguggaaagccgagccuu

SEQ ID NO: 446566 - RNA, 23 nt, Human
gcugcuggaggagaugcccaagg

SEQ ID NO: 446567 - RNA, 22 nt, Human
gcugcuggaggcugucguccca

SEQ ID NO: 446568 - RNA, 20 nt, Human
gcugcuggagggcugugggc

SEQ ID NO: 446569 - RNA, 22 nt, Human
gcugcuggagguggggcgaggc

SEQ ID NO: 446570 - RNA, 24 nt, Human
gcugcuggaguacauguguucaca

SEQ ID NO: 446571 - RNA, 22 nt, Human
gcugcuggagugcaauugcaca

SEQ ID NO: 446572 - RNA, 18 nt, Human
gcugcuggagugcagugg

SEQ ID NO: 446573 - RNA, 32 nt, Human
gcugcuggauaacauuugucauucauauucuu

SEQ ID NO: 446574 - RNA, 25 nt, Human
gcugcuggauugcacucucaaggca

SEQ ID NO: 446575 - RNA, 20 nt, Human
gcugcuggcacagcgcaggg

SEQ ID NO: 446576 - RNA, 18 nt, Human
gcugcuggcagccaaggu

SEQ ID NO: 446577 - RNA, 19 nt, Human
gcugcuggcagccccaagg

SEQ ID NO: 446578 - RNA, 21 nt, Human
gcugcuggccaacgcagggca

SEQ ID NO: 446579 - RNA, 19 nt, Human
gcugcuggccacaggugac

SEQ ID NO: 446580 - RNA, 21 nt, Human
gcugcuggccaggcccgaggc

SEQ ID NO: 446581 - RNA, 32 nt, Human
gcugcuggcccggcggaaggcugagaaggaac

SEQ ID NO: 446582 - RNA, 32 nt, Human
gcugcuggcgagggagagaugggugggccaug

SEQ ID NO: 446583 - RNA, 21 nt, Human
gcugcuggcgcgggcccgggc

SEQ ID NO: 446584 - RNA, 32 nt, Human
gcugcuggcguaguguaggccagacauugaca

SEQ ID NO: 446585 - RNA, 32 nt, Human
gcugcuggcuagugauaaauaacugaaaccca

SEQ ID NO: 446586 - RNA, 32 nt, Human
gcugcuggcuccugcccugcuuccugugaucg

SEQ ID NO: 446587 - RNA, 20 nt, Human
gcugcuggcuggcccaagca

SEQ ID NO: 446588 - RNA, 32 nt, Human
gcugcuggcuggcccaagcagagagcugaggc

SEQ ID NO: 446589 - RNA, 32 nt, Human
gcugcuggcuuuaggaggaagcuguucaagcg

SEQ ID NO: 446590 - RNA, 32 nt, Human
gcugcugggaaccugagguugucaaaggggcg

SEQ ID NO: 446591 - RNA, 32 nt, Human
gcugcugggacccaccucccccuccccggcca

SEQ ID NO: 446592 - RNA, 32 nt, Human
gcugcugggaggaaggaggagacagaaggagu

SEQ ID NO: 446593 - RNA, 32 nt, Human
gcugcugggaggacgacggacggcagcggcca

SEQ ID NO: 446594 - RNA, 32 nt, Human
gcugcugggaggagguggugggcugguucgga

SEQ ID NO: 446595 - RNA, 32 nt, Human
gcugcugggaggaugaccauggcugggggcag

SEQ ID NO: 446596 - RNA, 20 nt, Human
gcugcugggaguccauggca

SEQ ID NO: 446597 - RNA, 32 nt, Human
gcugcugggagugggagugacucccccaccuc

SEQ ID NO: 446598 - RNA, 32 nt, Human
gcugcugggauuacaggcgugagccaccacuc

SEQ ID NO: 446599 - RNA, 32 nt, Human
gcugcugggcagcaccuccuaacuucagggaa

SEQ ID NO: 446600 - RNA, 32 nt, Human
gcugcugggcagcugggcagagcucugggaag

SEQ ID NO: 446601 - RNA, 32 nt, Human
gcugcugggcccagaggugacauuugacuuuu

SEQ ID NO: 446602 - RNA, 19 nt, Human
gcugcugggccccgagcca

SEQ ID NO: 446603 - RNA, 32 nt, Human
gcugcugggccgcuccccuuggaggcccugcu

SEQ ID NO: 446604 - RNA, 32 nt, Human
gcugcugggccggcccugccuugcgcuagcag

SEQ ID NO: 446605 - RNA, 22 nt, Human
gcugcugggcggccgcggggca

SEQ ID NO: 446606 - RNA, 20 nt, Human
gcugcugggcuccggggaca

SEQ ID NO: 446607 - RNA, 32 nt, Human
gcugcugggcucuccaccucaggccuuggaua

SEQ ID NO: 446608 - RNA, 21 nt, Human
gcugcuggggacgcucagggc

SEQ ID NO: 446609 - RNA, 21 nt, Human
gcugcuggggaggcugaggua

SEQ ID NO: 446610 - RNA, 32 nt, Human
gcugcuggggcagauggcgguggcaggaguuu

SEQ ID NO: 446611 - RNA, 22 nt, Human
gcugcuggggcagggcccaggg

SEQ ID NO: 446612 - RNA, 20 nt, Human
gcugcuggggccuuggggca

SEQ ID NO: 446613 - RNA, 21 nt, Human
gcugcuggggcgccacgagca

SEQ ID NO: 446614 - RNA, 22 nt, Human
gcugcuggggcuggggauggca

SEQ ID NO: 446615 - RNA, 20 nt, Human
gcugcuggggggcugaggca

SEQ ID NO: 446616 - RNA, 20 nt, Human
gcugcugggguggaagagca

SEQ ID NO: 446617 - RNA, 32 nt, Human
gcugcugggugagcagcuggaggccggacagu

SEQ ID NO: 446618 - RNA, 32 nt, Human
gcugcugggugagggccuggagauguggaacc

SEQ ID NO: 446619 - RNA, 32 nt, Human
gcugcugggugcacagaugaggggagguggga

SEQ ID NO: 446620 - RNA, 19 nt, Human
gcugcugggugcgaaggca

SEQ ID NO: 446621 - RNA, 23 nt, Human
gcugcuggguuugcauguuuaca

SEQ ID NO: 446622 - RNA, 32 nt, Human
gcugcuggucccagagagugcagcccagggca

SEQ ID NO: 446623 - RNA, 32 nt, Human
gcugcuggucccauggccaccugcuggcuuug

SEQ ID NO: 446624 - RNA, 22 nt, Human
gcugcuggucgggggccugggc

SEQ ID NO: 446625 - RNA, 32 nt, Human
gcugcuggucugggugcugcuggccuccaagc

SEQ ID NO: 446626 - RNA, 22 nt, Human
gcugcuggugggagcccgaggu

SEQ ID NO: 446627 - RNA, 32 nt, Human
gcugcugguguccuccaggccugggugggcgg

SEQ ID NO: 446628 - RNA, 32 nt, Human
gcugcuggugucugucucaggguacggugcag

SEQ ID NO: 446629 - RNA, 32 nt, Human
gcugcugguguuuggcuuauugacauacucca

SEQ ID NO: 446630 - RNA, 32 nt, Human
gcugcuguauaugauauagcuuuguuaaauau

SEQ ID NO: 446631 - RNA, 32 nt, Human
gcugcugucacagucucauuuguucuuccaac

SEQ ID NO: 446632 - RNA, 32 nt, Human
gcugcugucagccuuuuugcugcugucaaguc

SEQ ID NO: 446633 - RNA, 32 nt, Human
gcugcugucaucauccccuugccuuuucaagc

SEQ ID NO: 446634 - RNA, 32 nt, Human
gcugcugucuccaggagccccugagaagauuu

SEQ ID NO: 446635 - RNA, 18 nt, Human
gcugcugucugacuucau

SEQ ID NO: 446636 - RNA, 17 nt, Human
gcugcugucuucucccu

SEQ ID NO: 446637 - RNA, 32 nt, Human
gcugcugugaccaaagggagaauggagauaac

SEQ ID NO: 446638 - RNA, 32 nt, Human
gcugcugugaccccagcaccuuccucaggaug

SEQ ID NO: 446639 - RNA, 32 nt, Human
gcugcugugauacugaguuuucuaaacagcau

SEQ ID NO: 446640 - RNA, 32 nt, Human
gcugcugugcaggggagcacagggaacagaag

SEQ ID NO: 446641 - RNA, 32 nt, Human
gcugcugugcagggguguggaguagggagcug

SEQ ID NO: 446642 - RNA, 21 nt, Human
gcugcugugccgucccgugug

SEQ ID NO: 446643 - RNA, 32 nt, Human
gcugcugugcugccauccccugcucacuccgc

SEQ ID NO: 446644 - RNA, 22 nt, Human
gcugcugugcugggcccggggc

SEQ ID NO: 446645 - RNA, 16 nt, Human
gcugcugugggaggug

SEQ ID NO: 446646 - RNA, 18 nt, Human
gcugcuguguagacugua

SEQ ID NO: 446647 - RNA, 32 nt, Human
gcugcugugucuggaaacccuccugagucagc

SEQ ID NO: 446648 - RNA, 32 nt, Human
gcugcuguuauucaaagaucaaaggaguaaaa

SEQ ID NO: 446649 - RNA, 15 nt, Human
gcugcuguucacuga

SEQ ID NO: 446650 - RNA, 32 nt, Human
gcugcuguuccaacgcugccugcacuacaaca

SEQ ID NO: 446651 - RNA, 32 nt, Human
gcugcuguugggagccaagaccggcccuuugg

SEQ ID NO: 446652 - RNA, 32 nt, Human
gcugcuguuucuggggcucugaaaaucugugg

SEQ ID NO: 446653 - RNA, 32 nt, Human
gcugcuguuuucugaaggugagaagccauuuu

SEQ ID NO: 446654 - RNA, 29 nt, Human
gcugcuguuuugucugugccugggcucug

SEQ ID NO: 446655 - RNA, 32 nt, Human
gcugcuuacucugcccugggccgccugaggcc

SEQ ID NO: 446656 - RNA, 21 nt, Human
gcugcuuagagccaggggguu

SEQ ID NO: 446657 - RNA, 20 nt, Human
gcugcuuagggcccaagcca

SEQ ID NO: 446658 - RNA, 32 nt, Human
gcugcuuauaacacaucccaagugcaggccgc

SEQ ID NO: 446659 - RNA, 32 nt, Human
gcugcuuauuaaaccuccuucuggaccuauug

SEQ ID NO: 446660 - RNA, 32 nt, Human
gcugcuucacacugacuuacacggugagcagc

SEQ ID NO: 446661 - RNA, 32 nt, Human
gcugcuucagggaaugugucccucccaccaug

SEQ ID NO: 446662 - RNA, 32 nt, Human
gcugcuucaggugugauccagcacuuucccag

SEQ ID NO: 446663 - RNA, 32 nt, Human
gcugcuucaugggcugaugugaggauuaaaca

SEQ ID NO: 446664 - RNA, 32 nt, Human
gcugcuuccacugucucagaaacugguccccg

SEQ ID NO: 446665 - RNA, 32 nt, Human
gcugcuuccaggcugggcagcacaaggccuug

SEQ ID NO: 446666 - RNA, 32 nt, Human
gcugcuuccagugaaugcuacacaccugcacc

SEQ ID NO: 446667 - RNA, 32 nt, Human
gcugcuuccauguucagucccuucccugcuuc

SEQ ID NO: 446668 - RNA, 32 nt, Human
gcugcuucccacagggugacaggcugggcugg

SEQ ID NO: 446669 - RNA, 32 nt, Human
gcugcuuccccuuuuuggccuguuuccuuagc

SEQ ID NO: 446670 - RNA, 32 nt, Human
gcugcuucccugggccauagauuugcaaugca

SEQ ID NO: 446671 - RNA, 32 nt, Human
gcugcuucccuggugugucuguucucuccucu

SEQ ID NO: 446672 - RNA, 32 nt, Human
gcugcuuccucaucuaccugugguguugggac

SEQ ID NO: 446673 - RNA, 24 nt, Human
gcugcuuccuggggacccagggca

SEQ ID NO: 446674 - RNA, 32 nt, Human
gcugcuuccuucaguuccccaggcuccuccuc

SEQ ID NO: 446675 - RNA, 32 nt, Human
gcugcuuccuucuggccagauggcagagggca

SEQ ID NO: 446676 - RNA, 32 nt, Human
gcugcuucgcguagcuuugaggaaggucuagu

SEQ ID NO: 446677 - RNA, 32 nt, Human
gcugcuucggugucccugucgggcuucccagc

SEQ ID NO: 446678 - RNA, 32 nt, Human
gcugcuucuccuccaucuugcuaguuaacaga

SEQ ID NO: 446679 - RNA, 32 nt, Human
gcugcuucuccucuuguuucugccuuaauaau

SEQ ID NO: 446680 - RNA, 32 nt, Human
gcugcuucugcagagaaggcaggccacugaug

SEQ ID NO: 446681 - RNA, 32 nt, Human
gcugcuucuggaagugcuggaagcaucacccc

SEQ ID NO: 446682 - RNA, 32 nt, Human
gcugcuucugugacccccacagcccagacuca

SEQ ID NO: 446683 - RNA, 32 nt, Human
gcugcuucuuguagaggaaacagcuuugaagu

SEQ ID NO: 446684 - RNA, 32 nt, Human
gcugcuucuuucucccccagacgcccuugcau

SEQ ID NO: 446685 - RNA, 32 nt, Human
gcugcuugaacccuggaaguggagguugcagu

SEQ ID NO: 446686 - RNA, 24 nt, Human
gcugcuugagcccaggaguucaga

SEQ ID NO: 446687 - RNA, 32 nt, Human
gcugcuugagggcugauagcucugccuuaccc

SEQ ID NO: 446688 - RNA, 20 nt, Human
gcugcuugagguccaaggca

SEQ ID NO: 446689 - RNA, 32 nt, Human
gcugcuugaguuguuucuuauauucuaaagca

SEQ ID NO: 446690 - RNA, 22 nt, Human
gcugcuugauaucacugacucu

SEQ ID NO: 446691 - RNA, 32 nt, Human
gcugcuugcacacuagggcacaugugggcuuu

SEQ ID NO: 446692 - RNA, 32 nt, Human
gcugcuugcagagaaggggcugccucaggauc

SEQ ID NO: 446693 - RNA, 32 nt, Human
gcugcuugccuuucuccguuuauugacucaca

SEQ ID NO: 446694 - RNA, 32 nt, Human
gcugcuugcgcuacuggcagagcugcugcgag

SEQ ID NO: 446695 - RNA, 32 nt, Human
gcugcuugcggacaggauguccugggguccga

SEQ ID NO: 446696 - RNA, 32 nt, Human
gcugcuuggaaaacuguccacacuugcuacuc

SEQ ID NO: 446697 - RNA, 32 nt, Human
gcugcuuggaguugaaaaaugcacacagccaa

SEQ ID NO: 446698 - RNA, 32 nt, Human
gcugcuugggaggaaggccaggaggaacacga

SEQ ID NO: 446699 - RNA, 19 nt, Human
gcugcuuggggccagggca

SEQ ID NO: 446700 - RNA, 32 nt, Human
gcugcuugguuggaggaagugaagcuggcuua

SEQ ID NO: 446701 - RNA, 32 nt, Human
gcugcuugguuugcucugagugcaaauggaac

SEQ ID NO: 446702 - RNA, 32 nt, Human
gcugcuuguacagaaagugaaaauuaguuggc

SEQ ID NO: 446703 - RNA, 32 nt, Human
gcugcuugucaagaagcauuucccggcaagag

SEQ ID NO: 446704 - RNA, 32 nt, Human
gcugcuugucccagcagguggccuugaucucu

SEQ ID NO: 446705 - RNA, 32 nt, Human
gcugcuugugccaggccccagugccccuggcc

SEQ ID NO: 446706 - RNA, 32 nt, Human
gcugcuugugggcagugaggaggcggacagca

SEQ ID NO: 446707 - RNA, 32 nt, Human
gcugcuuguucucccauggauuccugucccaa

SEQ ID NO: 446708 - RNA, 32 nt, Human
gcugcuuuaaggcuuuuagugaacaucugaag

SEQ ID NO: 446709 - RNA, 32 nt, Human
gcugcuuuccucaaaaugaguguuagugucaa

SEQ ID NO: 446710 - RNA, 32 nt, Human
gcugcuuuccugaaggugaaucauucugucca

SEQ ID NO: 446711 - RNA, 32 nt, Human
gcugcuuucuccccucccuucuugacucucug

SEQ ID NO: 446712 - RNA, 32 nt, Human
gcugcuuucucuccucuucccuuuccgggugc

SEQ ID NO: 446713 - RNA, 32 nt, Human
gcugcuuucucuucuacuucuugugcuuuacu

SEQ ID NO: 446714 - RNA, 32 nt, Human
gcugcuuugagcaggaacaaggccuccaggcc

SEQ ID NO: 446715 - RNA, 32 nt, Human
gcugcuuugcagguacaucaugugacagugga

SEQ ID NO: 446716 - RNA, 32 nt, Human
gcugcuuugccauucugguugcacugaucuuu

SEQ ID NO: 446717 - RNA, 19 nt, Human
gcugcuuugggccggggca

SEQ ID NO: 446718 - RNA, 32 nt, Human
gcugcuuugggggacucccaaaguaggccuuu

SEQ ID NO: 446719 - RNA, 22 nt, Human
gcugcuuugucugccagugccg

SEQ ID NO: 446720 - RNA, 32 nt, Human
gcugcuuuguggacaccgcaggaaguuccucg

SEQ ID NO: 446721 - RNA, 32 nt, Human
gcuggaaaaaggcagagaacgugggagugauc

SEQ ID NO: 446722 - RNA, 32 nt, Human
gcuggaaaacagugacaacaguggauuuuguu

SEQ ID NO: 446723 - RNA, 32 nt, Human
gcuggaaacauguugcacaauggucuccccac

SEQ ID NO: 446724 - RNA, 30 nt, Human
gcuggaaaccaacaggugaccucagggagg

SEQ ID NO: 446725 - RNA, 32 nt, Human
gcuggaaaccaagaggauccaaacuuccugca

SEQ ID NO: 446726 - RNA, 32 nt, Human
gcuggaaaccacagggaggggaagggagggga

SEQ ID NO: 446727 - RNA, 26 nt, Human
gcuggaaaccaggcagguuccuuccc

SEQ ID NO: 446728 - RNA, 25 nt, Human
gcuggaaacucuggcugcucaggaa

SEQ ID NO: 446729 - RNA, 32 nt, Human
gcuggaaacuucaggaaagcaccaaugagcuu

SEQ ID NO: 446730 - RNA, 32 nt, Human
gcuggaaagaggacaaguuugagaggcaacac

SEQ ID NO: 446731 - RNA, 32 nt, Human
gcuggaaagaggagaaggagagggaguacaaa

SEQ ID NO: 446732 - RNA, 32 nt, Human
gcuggaaagccacacgcggcagaggagagcug

SEQ ID NO: 446733 - RNA, 32 nt, Human
gcuggaaauacuuggaauauuuuccagagucu

SEQ ID NO: 446734 - RNA, 32 nt, Human
gcuggaacacagacuuccugggggucccgccg

SEQ ID NO: 446735 - RNA, 16 nt, Human
gcuggaacacugugau

SEQ ID NO: 446736 - RNA, 32 nt, Human
gcuggaacaggugagcagccugggcgacggcc

SEQ ID NO: 446737 - RNA, 32 nt, Human
gcuggaaccaguagcaaggagcccgagaucag

SEQ ID NO: 446738 - RNA, 32 nt, Human
gcuggaacccagaagggugagauuugugagau

SEQ ID NO: 446739 - RNA, 32 nt, Human
gcuggaacccaggaggcaaagguugcagugag

SEQ ID NO: 446740 - RNA, 32 nt, Human
gcuggaacccaggaggcagaggucgcagugag

SEQ ID NO: 446741 - RNA, 32 nt, Human
gcuggaacccaggagguggagguugcagugag

SEQ ID NO: 446742 - RNA, 32 nt, Human
gcuggaacccgggagguagaggcugcagugag

SEQ ID NO: 446743 - RNA, 32 nt, Human
gcuggaaccugggagguggaggcugcagugaa

SEQ ID NO: 446744 - RNA, 32 nt, Human
gcuggaaccugucggaacuccaugccuuccuc

SEQ ID NO: 446745 - RNA, 21 nt, Human
gcuggaacgcagucccuucca

SEQ ID NO: 446746 - RNA, 32 nt, Human
gcuggaacguggaggcagagguugcagugagc

SEQ ID NO: 446747 - RNA, 32 nt, Human
gcuggaacugagggagugagcuuggggacuuc

SEQ ID NO: 446748 - RNA, 32 nt, Human
gcuggaacuggaauuugucuuccuauugacuc

SEQ ID NO: 446749 - RNA, 32 nt, Human
gcuggaagagaagcucugucuucaggggccag

SEQ ID NO: 446750 - RNA, 19 nt, Human
gcuggaagagcugcccuca

SEQ ID NO: 446751 - RNA, 32 nt, Human
gcuggaagaggaggaggaggagaggcggcggg

SEQ ID NO: 446752 - RNA, 32 nt, Human
gcuggaagaggaggugucccagugagccgccc

SEQ ID NO: 446753 - RNA, 32 nt, Human
gcuggaagagugagggugaaggcaagaaguag

SEQ ID NO: 446754 - RNA, 32 nt, Human
gcuggaagaugaagccaugauagcuacagaga

SEQ ID NO: 446755 - RNA, 32 nt, Human
gcuggaagccauggucccgaaguguagggcaa

SEQ ID NO: 446756 - RNA, 25 nt, Human
gcuggaagcccagccccuacugcug

SEQ ID NO: 446757 - RNA, 32 nt, Human
gcuggaagcccaggccugcagcuguggaacuc

SEQ ID NO: 446758 - RNA, 32 nt, Human
gcuggaagcccauccuggaugugcugcacucg

SEQ ID NO: 446759 - RNA, 19 nt, Human
gcuggaagcuggcaggcga

SEQ ID NO: 446760 - RNA, 20 nt, Human
gcuggaagcugugggggaag

SEQ ID NO: 446761 - RNA, 32 nt, Human
gcuggaaggaaaccuuucccucuugggaccuc

SEQ ID NO: 446762 - RNA, 32 nt, Human
gcuggaaggauagccucgcuucccaggugcag

SEQ ID NO: 446763 - RNA, 24 nt, Human
gcuggaaggcugcgauucccagug

SEQ ID NO: 446764 - RNA, 32 nt, Human
gcuggaaggggacgguacucaccagaauggcu

SEQ ID NO: 446765 - RNA, 32 nt, Human
gcuggaaggggaggggcgagagggcugucucg

SEQ ID NO: 446766 - RNA, 32 nt, Human
gcuggaaggggaggggcgccaggugaggcggc

SEQ ID NO: 446767 - RNA, 25 nt, Human
gcuggaaggucuuguggccacagga

SEQ ID NO: 446768 - RNA, 32 nt, Human
gcuggaagucaugugugaaucauggagaaauc

SEQ ID NO: 446769 - RNA, 32 nt, Human
gcuggaaguucaggaugccaccaccuugaaca

SEQ ID NO: 446770 - RNA, 19 nt, Human
gcuggaauaaacgcugcug

SEQ ID NO: 446771 - RNA, 32 nt, Human
gcuggaauaugggaaaauuaauuugggcuuag

SEQ ID NO: 446772 - RNA, 32 nt, Human
gcuggaaucacaggcaggaucuggaaggaggg

SEQ ID NO: 446773 - RNA, 24 nt, Human
gcuggaauccuguguuccucgcca

SEQ ID NO: 446774 - RNA, 32 nt, Human
gcuggaaugagcugcaaggaggagugaguucu

SEQ ID NO: 446775 - RNA, 32 nt, Human
gcuggaauggggagcaaugagaggagggagug

SEQ ID NO: 446776 - RNA, 32 nt, Human
gcuggaaugggggccaggcugagccgaucugg

SEQ ID NO: 446777 - RNA, 32 nt, Human
gcuggaauuuccaagcugcuucacagaggcca

SEQ ID NO: 446778 - RNA, 28 nt, Human
gcuggacaacacagcaagacuccaucuc

SEQ ID NO: 446779 - RNA, 22 nt, Human
gcuggacaacagaagccccaug

SEQ ID NO: 446780 - RNA, 32 nt, Human
gcuggacaacuagaauguugaccucgagccga

SEQ ID NO: 446781 - RNA, 32 nt, Human
gcuggacaagggguaggagcugcuggaacagg

SEQ ID NO: 446782 - RNA, 32 nt, Human
gcuggacaagugguuuguuugugugcaaacca

SEQ ID NO: 446783 - RNA, 32 nt, Human
gcuggacaauggugugaacccaggaggcggug

SEQ ID NO: 446784 - RNA, 32 nt, Human
gcuggacacacguggaaccaagccagggaugg

SEQ ID NO: 446785 - RNA, 20 nt, Human
gcuggacacaggaggccuca

SEQ ID NO: 446786 - RNA, 24 nt, Human
gcuggacacaggcgcggccucaug

SEQ ID NO: 446787 - RNA, 32 nt, Human
gcuggacagagggaggaggccaggccagagcc

SEQ ID NO: 446788 - RNA, 32 nt, Human
gcuggacagauggaacuggaagggcagccguc

SEQ ID NO: 446789 - RNA, 32 nt, Human
gcuggacagauggcuggccaagugggagcaga

SEQ ID NO: 446790 - RNA, 19 nt, Human
gcuggacagcacucugcca

SEQ ID NO: 446791 - RNA, 21 nt, Human
gcuggacagcagcgggccccg

SEQ ID NO: 446792 - RNA, 20 nt, Human
gcuggacagcgacacgcagg

SEQ ID NO: 446793 - RNA, 32 nt, Human
gcuggacaggcugcccucucccucucugcccc

SEQ ID NO: 446794 - RNA, 32 nt, Human
gcuggacaguggacccuaccagccugcgggaa

SEQ ID NO: 446795 - RNA, 24 nt, Human
gcuggaccaaggcuaaccuuucua

SEQ ID NO: 446796 - RNA, 32 nt, Human
gcuggaccacguagccccagaucacaccuggg

SEQ ID NO: 446797 - RNA, 32 nt, Human
gcuggaccaggacccauggcaagagcaccugg

SEQ ID NO: 446798 - RNA, 32 nt, Human
gcuggaccaggagaaaaggcaguuaugaagcc

SEQ ID NO: 446799 - RNA, 22 nt, Human
gcuggaccaucucuguaggauc

SEQ ID NO: 446800 - RNA, 25 nt, Human
gcuggaccaugaggcugucucccca

SEQ ID NO: 446801 - RNA, 32 nt, Human
gcuggacccaugagccucgcuggggccuccuc

SEQ ID NO: 446802 - RNA, 21 nt, Human
gcuggacccugcucacugcug

SEQ ID NO: 446803 - RNA, 21 nt, Human
gcuggaccgggacccauggca

SEQ ID NO: 446804 - RNA, 32 nt, Human
gcuggaccgggacccauggcaagagcaccugg

SEQ ID NO: 446805 - RNA, 32 nt, Human
gcuggaccuaguuucacaaucuguugucucca

SEQ ID NO: 446806 - RNA, 32 nt, Human
gcuggaccucaccaagcugcuguggccaucaa

SEQ ID NO: 446807 - RNA, 19 nt, Human
gcuggaccuccccuuucca

SEQ ID NO: 446808 - RNA, 32 nt, Human
gcuggaccugcagcagggguuuguggaggugg

SEQ ID NO: 446809 - RNA, 32 nt, Human
gcuggacgcuguucuguucagugugcucuuug

SEQ ID NO: 446810 - RNA, 32 nt, Human
gcuggacggugaccuucauucaggggaaccug

SEQ ID NO: 446811 - RNA, 20 nt, Human
gcuggacguagcucuuucca

SEQ ID NO: 446812 - RNA, 20 nt, Human
gcuggacuaaauggcugcag

SEQ ID NO: 446813 - RNA, 32 nt, Human
gcuggacuauuucacuagaaaccacguagaau

SEQ ID NO: 446814 - RNA, 32 nt, Human
gcuggacucaaugcaaccuucucccacgagca

SEQ ID NO: 446815 - RNA, 18 nt, Human
gcuggacucagcugccca

SEQ ID NO: 446816 - RNA, 32 nt, Human
gcuggacucagcugcccaccugagccugacag

SEQ ID NO: 446817 - RNA, 32 nt, Human
gcuggacuccacugcuuuggaggcugcccagu

SEQ ID NO: 446818 - RNA, 32 nt, Human
gcuggacuccaggcuccccugccugcauagug

SEQ ID NO: 446819 - RNA, 32 nt, Human
gcuggacuccuggagguuguucugagcuuacc

SEQ ID NO: 446820 - RNA, 19 nt, Human
gcuggacucgcgccuccca

SEQ ID NO: 446821 - RNA, 21 nt, Human
gcuggacucgcgccucccacg

SEQ ID NO: 446822 - RNA, 19 nt, Human
gcuggacucuggccuuccc

SEQ ID NO: 446823 - RNA, 20 nt, Human
gcuggacugaauaucuuucc

SEQ ID NO: 446824 - RNA, 22 nt, Human
gcuggacugagcugcucuccca

SEQ ID NO: 446825 - RNA, 20 nt, Human
gcuggacugaguguccccca

SEQ ID NO: 446826 - RNA, 32 nt, Human
gcuggacugcugcuguucaggagccaccagag

SEQ ID NO: 446827 - RNA, 19 nt, Human
gcuggacuggaacccuucc

SEQ ID NO: 446828 - RNA, 32 nt, Human
gcuggacuggaggugggcaugccacccucaca

SEQ ID NO: 446829 - RNA, 32 nt, Human
gcuggacuggcagccaaguaaaggagagugau

SEQ ID NO: 446830 - RNA, 20 nt, Human
gcuggacuggccacuauccg

SEQ ID NO: 446831 - RNA, 21 nt, Human
gcuggacuggccuugcuucua

SEQ ID NO: 446832 - RNA, 22 nt, Human
gcuggacuggcugccuuguucc

SEQ ID NO: 446833 - RNA, 22 nt, Human
gcuggacuggcuguccuuucca

SEQ ID NO: 446834 - RNA, 32 nt, Human
gcuggacuggggcaggcugggcuuccaggaaa

SEQ ID NO: 446835 - RNA, 19 nt, Human
gcuggacugggucugccca

SEQ ID NO: 446836 - RNA, 20 nt, Human
gcuggacugggugggcccca

SEQ ID NO: 446837 - RNA, 32 nt, Human
gcuggacuguacugcugccaucucuggcucac

SEQ ID NO: 446838 - RNA, 20 nt, Human
gcuggacuguuggccuuucc

SEQ ID NO: 446839 - RNA, 32 nt, Human
gcuggacuucugaccacugacuucuccugacc

SEQ ID NO: 446840 - RNA, 32 nt, Human
gcuggacuugccaaagaugaccugggagagug

SEQ ID NO: 446841 - RNA, 21 nt, Human
gcuggagaaaaggcccagggu

SEQ ID NO: 446842 - RNA, 32 nt, Human
gcuggagaaaugcacuagcagagugcaggauc

SEQ ID NO: 446843 - RNA, 32 nt, Human
gcuggagaagaaagagccccugguuuuauuug

SEQ ID NO: 446844 - RNA, 32 nt, Human
gcuggagaagaugacaaagaggaagaagacca

SEQ ID NO: 446845 - RNA, 19 nt, Human
gcuggagaaucgcuugaac

SEQ ID NO: 446846 - RNA, 32 nt, Human
gcuggagaauggugugaacccaggaggcggag

SEQ ID NO: 446847 - RNA, 20 nt, Human
gcuggagaccauucuuucca

SEQ ID NO: 446848 - RNA, 32 nt, Human
gcuggagacgacgaggaggaggauuaagucca

SEQ ID NO: 446849 - RNA, 32 nt, Human
gcuggagacuggcugcuggggccuccuugcuu

SEQ ID NO: 446850 - RNA, 32 nt, Human
gcuggagacugguuaauugggccaaagauaca

SEQ ID NO: 446851 - RNA, 32 nt, Human
gcuggagagaagagaaggcagcagcagaggcc

SEQ ID NO: 446852 - RNA, 32 nt, Human
gcuggagagacacuccaacaucugcagcagga

SEQ ID NO: 446853 - RNA, 24 nt, Human
gcuggagagaggcugucuuuccca

SEQ ID NO: 446854 - RNA, 32 nt, Human
gcuggagagagggagagagaggcccgcccgcu

SEQ ID NO: 446855 - RNA, 32 nt, Human
gcuggagagcgggacguggcagaggagccacu

SEQ ID NO: 446856 - RNA, 32 nt, Human
gcuggagaggaagguaaagaagaagagaauau

SEQ ID NO: 446857 - RNA, 32 nt, Human
gcuggagaggagcaaugaaagggaggagacac

SEQ ID NO: 446858 - RNA, 32 nt, Human
gcuggagaggaugcuggagcuggagugggaag

SEQ ID NO: 446859 - RNA, 32 nt, Human
gcuggagaggcaggcagagggcagugguucuc

SEQ ID NO: 446860 - RNA, 23 nt, Human
gcuggagaggggcagcugggccc

SEQ ID NO: 446861 - RNA, 19 nt, Human
gcuggagaggugggggaag

SEQ ID NO: 446862 - RNA, 32 nt, Human
gcuggagauccuuucucucaagggcaggauua

SEQ ID NO: 446863 - RNA, 32 nt, Human
gcuggagaugaaagcuuuguagugaggacuga

SEQ ID NO: 446864 - RNA, 32 nt, Human
gcuggagaugccaagugagugugugcauuuuu

SEQ ID NO: 446865 - RNA, 32 nt, Human
gcuggagaugccuguggaacauuccagccagg

SEQ ID NO: 446866 - RNA, 32 nt, Human
gcuggagaugggggcagggggagcagcauccu

SEQ ID NO: 446867 - RNA, 32 nt, Human
gcuggagauuacaggcaugagccaccacgccc

SEQ ID NO: 446868 - RNA, 32 nt, Human
gcuggagcagaagcaacaggaggcugagagga

SEQ ID NO: 446869 - RNA, 32 nt, Human
gcuggagcagaggagcucacgccugcgggucg

SEQ ID NO: 446870 - RNA, 32 nt, Human
gcuggagcagaggcccuucacccagagccagu

SEQ ID NO: 446871 - RNA, 32 nt, Human
gcuggagcagcccaggcccggcggacagccuc

SEQ ID NO: 446872 - RNA, 32 nt, Human
gcuggagcagccgcccaacuccuggcgcggga

SEQ ID NO: 446873 - RNA, 32 nt, Human
gcuggagcaguuuggggcaggggguucuggga

SEQ ID NO: 446874 - RNA, 32 nt, Human
gcuggagcauuuccuucccuuuccagugaagg

SEQ ID NO: 446875 - RNA, 31 nt, Human
gcuggagcauuuuucugaugccagcugaaua

SEQ ID NO: 446876 - RNA, 32 nt, Human
gcuggagccagagagguagaggcugcagugag

SEQ ID NO: 446877 - RNA, 32 nt, Human
gcuggagccaggaccuggcguugggcgguacu

SEQ ID NO: 446878 - RNA, 32 nt, Human
gcuggagccaggcugggggugcuggguggaga

SEQ ID NO: 446879 - RNA, 28 nt, Human
gcuggagccagugcugccuguccguccc

SEQ ID NO: 446880 - RNA, 16 nt, Human
gcuggagcccaaggca

SEQ ID NO: 446881 - RNA, 32 nt, Human
gcuggagcccagcaguuggagguggugcaccu

SEQ ID NO: 446882 - RNA, 32 nt, Human
gcuggagcccaggaaauugaggcugcagugag

SEQ ID NO: 446883 - RNA, 32 nt, Human
gcuggagcccaggaggcacaggcugcagugag

SEQ ID NO: 446884 - RNA, 32 nt, Human
gcuggagcccaggaguucgagaccugccuugg

SEQ ID NO: 446885 - RNA, 32 nt, Human
gcuggagcccaggaguuugagguuacaguaaa

SEQ ID NO: 446886 - RNA, 32 nt, Human
gcuggagcccaggccagcuggggagggguggg

SEQ ID NO: 446887 - RNA, 32 nt, Human
gcuggagcccccauggccagcccagccuggcu

SEQ ID NO: 446888 - RNA, 19 nt, Human
gcuggagccccgggccugg

SEQ ID NO: 446889 - RNA, 32 nt, Human
gcuggagccugagucagggcccagaggcugag

SEQ ID NO: 446890 - RNA, 32 nt, Human
gcuggagccugggaaguugaggcugcagugag

SEQ ID NO: 446891 - RNA, 32 nt, Human
gcuggagcgagucacggggagagcagaaagcu

SEQ ID NO: 446892 - RNA, 32 nt, Human
gcuggagcuacugccuugcccuuccuucccuc

SEQ ID NO: 446893 - RNA, 32 nt, Human
gcuggagcucacugcacuccagcagucauggg

SEQ ID NO: 446894 - RNA, 32 nt, Human
gcuggagcugauggaggugcagcuggagagga

SEQ ID NO: 446895 - RNA, 32 nt, Human
gcuggagcugcuggaggcccugggguugguag

SEQ ID NO: 446896 - RNA, 32 nt, Human
gcuggagcuggcagaggugaugagcggcggag

SEQ ID NO: 446897 - RNA, 32 nt, Human
gcuggagcugggaacccagcgagcgccugacc

SEQ ID NO: 446898 - RNA, 32 nt, Human
gcuggagcuuccgggcccuggaaagggguccc

SEQ ID NO: 446899 - RNA, 32 nt, Human
gcuggagcuucucagcuugaaauccuaggccu

SEQ ID NO: 446900 - RNA, 32 nt, Human
gcuggagcuugcucccccuuguucggaagcug

SEQ ID NO: 446901 - RNA, 23 nt, Human
gcuggaggaacaacugggcccug

SEQ ID NO: 446902 - RNA, 32 nt, Human
gcuggaggaagacaucccagauccagaggagc

SEQ ID NO: 446903 - RNA, 32 nt, Human
gcuggaggaagugccaucugcauggccacucu

SEQ ID NO: 446904 - RNA, 32 nt, Human
gcuggaggacacaccgaccccaccccaugcug

SEQ ID NO: 446905 - RNA, 32 nt, Human
gcuggaggacagugaugugaucucgggucacc

SEQ ID NO: 446906 - RNA, 32 nt, Human
gcuggaggaccugccccuaccugcugcaucgu

SEQ ID NO: 446907 - RNA, 32 nt, Human
gcuggaggacgcuuccuccugguuagauccuc

SEQ ID NO: 446908 - RNA, 32 nt, Human
gcuggaggacggggagguugucaggggcuaug

SEQ ID NO: 446909 - RNA, 32 nt, Human
gcuggaggagagaagccaguugugugucucag

SEQ ID NO: 446910 - RNA, 18 nt, Human
gcuggaggagcaggggug

SEQ ID NO: 446911 - RNA, 18 nt, Human
gcuggaggagcccaaggg

SEQ ID NO: 446912 - RNA, 18 nt, Human
gcuggaggagcucagagu

SEQ ID NO: 446913 - RNA, 32 nt, Human
gcuggaggaggaaaccggcggagcagcuuccc

SEQ ID NO: 446914 - RNA, 32 nt, Human
gcuggaggaggaagagggcauggcggccucac

SEQ ID NO: 446915 - RNA, 32 nt, Human
gcuggaggaggcggagaggcagagggaggagc

SEQ ID NO: 446916 - RNA, 24 nt, Human
gcuggaggaggggaagcugggccc

SEQ ID NO: 446917 - RNA, 21 nt, Human
gcuggaggaguuuccuuccca

SEQ ID NO: 446918 - RNA, 32 nt, Human
gcuggaggaucacuugagcccaggaaguugag

SEQ ID NO: 446919 - RNA, 32 nt, Human
gcuggaggaugacaaggagaagauggugggca

SEQ ID NO: 446920 - RNA, 32 nt, Human
gcuggaggaugagagaucacauggaaugaggc

SEQ ID NO: 446921 - RNA, 32 nt, Human
gcuggaggcagaaacagcagaagcguuaacag

SEQ ID NO: 446922 - RNA, 32 nt, Human
gcuggaggcagauagacacaguauagggggaa

SEQ ID NO: 446923 - RNA, 18 nt, Human
gcuggaggcagccaggaa

SEQ ID NO: 446924 - RNA, 21 nt, Human
gcuggaggccaugcucccucc

SEQ ID NO: 446925 - RNA, 32 nt, Human
gcuggaggcccgggcuggaggggcaguguugc

SEQ ID NO: 446926 - RNA, 23 nt, Human
gcuggaggccuguguggggacca

SEQ ID NO: 446927 - RNA, 32 nt, Human
gcuggaggccuucuuguuucuccagucccugg

SEQ ID NO: 446928 - RNA, 32 nt, Human
gcuggaggcggaggcagcuggggagguccgag

SEQ ID NO: 446929 - RNA, 32 nt, Human
gcuggaggcggcagcgguuggaggcuucgccc

SEQ ID NO: 446930 - RNA, 21 nt, Human
gcuggaggcuggccacagugg

SEQ ID NO: 446931 - RNA, 21 nt, Human
gcuggaggcugggugcagugg

SEQ ID NO: 446932 - RNA, 32 nt, Human
gcuggagggaaggagccaggagggagagagcc

SEQ ID NO: 446933 - RNA, 19 nt, Human
gcuggagggagcagggggu

SEQ ID NO: 446934 - RNA, 32 nt, Human
gcuggagggagguggagggaggaaggugggaa

SEQ ID NO: 446935 - RNA, 32 nt, Human
gcuggagggcccugaacccugcacugcguggc

SEQ ID NO: 446936 - RNA, 32 nt, Human
gcuggagggcggaggaaggagaaggagggccc

SEQ ID NO: 446937 - RNA, 21 nt, Human
gcuggagggcuguccccuuca

SEQ ID NO: 446938 - RNA, 32 nt, Human
gcuggaggggccaagacugacaggcacagcgg

SEQ ID NO: 446939 - RNA, 22 nt, Human
gcuggaggggcugggccaagga

SEQ ID NO: 446940 - RNA, 32 nt, Human
gcuggagggggagcgaggggagagggggcugc

SEQ ID NO: 446941 - RNA, 16 nt, Human
gcuggagggggcgcgg

SEQ ID NO: 446942 - RNA, 23 nt, Human
gcuggagguaaggcugggcccug

SEQ ID NO: 446943 - RNA, 32 nt, Human
gcuggagguccaggccagggugacugggagau

SEQ ID NO: 446944 - RNA, 21 nt, Human
gcuggaggugcacguuccccc

SEQ ID NO: 446945 - RNA, 31 nt, Human
gcuggaggugccggugggccuguguugcugg

SEQ ID NO: 446946 - RNA, 32 nt, Human
gcuggaggugugaggauccgaacccaggggug

SEQ ID NO: 446947 - RNA, 32 nt, Human
gcuggagguucugcgggagcagcuggccacgg

SEQ ID NO: 446948 - RNA, 32 nt, Human
gcuggagguugaggacgcccagugagugugca

SEQ ID NO: 446949 - RNA, 32 nt, Human
gcuggagguugccauggagggccauuccugcc

SEQ ID NO: 446950 - RNA, 32 nt, Human
gcuggaguacaguagugcaaucucagcucacu

SEQ ID NO: 446951 - RNA, 32 nt, Human
gcuggaguacaguggugcgaucaugggcuuac

SEQ ID NO: 446952 - RNA, 32 nt, Human
gcuggaguauuuucuaauaauccugcuugacc

SEQ ID NO: 446953 - RNA, 32 nt, Human
gcuggagucacuccuucucugucucaugugua

SEQ ID NO: 446954 - RNA, 25 nt, Human
gcuggaguccuccaucuccuuccca

SEQ ID NO: 446955 - RNA, 21 nt, Human
gcuggagucucccagcugcca

SEQ ID NO: 446956 - RNA, 22 nt, Human
gcuggagugaaggcggagggag

SEQ ID NO: 446957 - RNA, 32 nt, Human
gcuggagugcaauggcgcgaucuuggcucacu

SEQ ID NO: 446958 - RNA, 32 nt, Human
gcuggagugcaauggugcaaugaucucggcuc

SEQ ID NO: 446959 - RNA, 32 nt, Human
gcuggagugcaguagugcaaucagggcucacu

SEQ ID NO: 446960 - RNA, 32 nt, Human
gcuggagugcaguggugcaguggcucgaucuc

SEQ ID NO: 446961 - RNA, 32 nt, Human
gcuggagugcaguggugcaguggugcaaucuc

SEQ ID NO: 446962 - RNA, 18 nt, Human
gcuggagugcaguggugu

SEQ ID NO: 446963 - RNA, 32 nt, Human
gcuggagugcaguggugugauccuggcucacu

SEQ ID NO: 446964 - RNA, 32 nt, Human
gcuggagugcgggccucguccacccacagacc

SEQ ID NO: 446965 - RNA, 32 nt, Human
gcuggaguggaaguggagagacacucucuucu

SEQ ID NO: 446966 - RNA, 32 nt, Human
gcuggaguguaagugacaugaucauagcucac

SEQ ID NO: 446967 - RNA, 32 nt, Human
gcuggaguguaguagugugauccuggcucacu

SEQ ID NO: 446968 - RNA, 32 nt, Human
gcuggaguguaguggugugauccuggcucacu

SEQ ID NO: 446969 - RNA, 19 nt, Human
gcuggagugugacuggaaa

SEQ ID NO: 446970 - RNA, 32 nt, Human
gcuggaguucaaugaguccuagacagugagag

SEQ ID NO: 446971 - RNA, 32 nt, Human
gcuggaguuugcugugggcacugaggcgcggg

SEQ ID NO: 446972 - RNA, 19 nt, Human
gcuggaguuuguccuucca

SEQ ID NO: 446973 - RNA, 32 nt, Human
gcuggauaaaaaggguaugaugacagaugaag

SEQ ID NO: 446974 - RNA, 22 nt, Human
gcuggauaaccagacugugaca

SEQ ID NO: 446975 - RNA, 32 nt, Human
gcuggauauccagguucucgccaggccccgau

SEQ ID NO: 446976 - RNA, 32 nt, Human
gcuggauccagacugcagauccagagcugcgc

SEQ ID NO: 446977 - RNA, 32 nt, Human
gcuggauccauggcuggggauccaggcaaggc

SEQ ID NO: 446978 - RNA, 32 nt, Human
gcuggauccauguaugggguccagcgcuggcu

SEQ ID NO: 446979 - RNA, 32 nt, Human
gcuggauccuuugacagagaguggucccuaaa

SEQ ID NO: 446980 - RNA, 32 nt, Human
gcuggaucguaggguucgaggcugcuugcuuu

SEQ ID NO: 446981 - RNA, 32 nt, Human
gcuggaucuggggcagccaccuugcuaccaug

SEQ ID NO: 446982 - RNA, 32 nt, Human
gcuggaucuugagucccauuagcugugagaug

SEQ ID NO: 446983 - RNA, 32 nt, Human
gcuggaugaaaccaaggauaguucagguauaa

SEQ ID NO: 446984 - RNA, 32 nt, Human
gcuggaugaaauggcaguggauuuuuaaacuu

SEQ ID NO: 446985 - RNA, 32 nt, Human
gcuggaugagugaaacaggaauggagcaagcc

SEQ ID NO: 446986 - RNA, 32 nt, Human
gcuggaugcagcagcggcugggcuugguccca

SEQ ID NO: 446987 - RNA, 32 nt, Human
gcuggauggaaacccuggaauaggcuacuuga

SEQ ID NO: 446988 - RNA, 32 nt, Human
gcuggauggcugugucuggccuaggagaccac

SEQ ID NO: 446989 - RNA, 32 nt, Human
gcuggaugggcuguggugggaggguugcagcg

SEQ ID NO: 446990 - RNA, 32 nt, Human
gcuggauguaaucaccuuugguuggacuagaa

SEQ ID NO: 446991 - RNA, 24 nt, Human
gcuggaugugaaacuguugaaaag

SEQ ID NO: 446992 - RNA, 22 nt, Human
gcuggaugugcaugcccugugg

SEQ ID NO: 446993 - RNA, 32 nt, Human
gcuggaugugccucccaggccugcugugguuc

SEQ ID NO: 446994 - RNA, 32 nt, Human
gcuggaugugguggcagugccuguaaucccag

SEQ ID NO: 446995 - RNA, 32 nt, Human
gcuggaugugguggcuccuuccuccucuauag

SEQ ID NO: 446996 - RNA, 32 nt, Human
gcuggaugugucauccacugagccuucaucuc

SEQ ID NO: 446997 - RNA, 32 nt, Human
gcuggauguuauugcgggcaccuguaauccca

SEQ ID NO: 446998 - RNA, 32 nt, Human
gcuggauuaagcuuuguugugauugugaccaa

SEQ ID NO: 446999 - RNA, 32 nt, Human
gcuggauuaucuugaaccugugcuauuaaaug

SEQ ID NO: 447000 - RNA, 26 nt, Human
gcuggauuccucuguguucuuuccca

SEQ ID NO: 447001 - RNA, 23 nt, Human
gcuggauucucaggcugggcccc

SEQ ID NO: 447002 - RNA, 32 nt, Human
gcuggauucuucuuccucaaauauuuggggcu

SEQ ID NO: 447003 - RNA, 32 nt, Human
gcuggauuuuuaaugaaacagacucagggagg

SEQ ID NO: 447004 - RNA, 32 nt, Human
gcuggcaaaagagcagugcugaaggaggagau

SEQ ID NO: 447005 - RNA, 32 nt, Human
gcuggcaaccagcgccccagaagcacagccag

SEQ ID NO: 447006 - RNA, 32 nt, Human
gcuggcaagaagaagcgaaagcagaggaggag

SEQ ID NO: 447007 - RNA, 32 nt, Human
gcuggcaagaagauaaaauaugacagaaccug

SEQ ID NO: 447008 - RNA, 32 nt, Human
gcuggcaaggggauauucagcucugcaaagga

SEQ ID NO: 447009 - RNA, 32 nt, Human
gcuggcaaggggugacugccucugagucauug

SEQ ID NO: 447010 - RNA, 32 nt, Human
gcuggcaaugcuguuucacuggaggacacggc

SEQ ID NO: 447011 - RNA, 32 nt, Human
gcuggcacaagagcagcggcuugggggagccg

SEQ ID NO: 447012 - RNA, 19 nt, Human
gcuggcacacagcccuggg

SEQ ID NO: 447013 - RNA, 32 nt, Human
gcuggcacagccccaggcuuggugaggaagag

SEQ ID NO: 447014 - RNA, 32 nt, Human
gcuggcacaggcaucucagaggugugagauga

SEQ ID NO: 447015 - RNA, 32 nt, Human
gcuggcaccacugcacugugaugggggcccuc

SEQ ID NO: 447016 - RNA, 18 nt, Human
gcuggcaccagggcucgg

SEQ ID NO: 447017 - RNA, 32 nt, Human
gcuggcacccacuccugggcugcucagagcug

SEQ ID NO: 447018 - RNA, 32 nt, Human
gcuggcacccaucccagggcuccucuggagcu

SEQ ID NO: 447019 - RNA, 32 nt, Human
gcuggcaccccacagggagccuuggagcccug

SEQ ID NO: 447020 - RNA, 24 nt, Human
gcuggcaccugcucccugugcuca

SEQ ID NO: 447021 - RNA, 32 nt, Human
gcuggcaccuguaaucccagcauuaugggaaa

SEQ ID NO: 447022 - RNA, 32 nt, Human
gcuggcaccuguaaucccagcauuaugggaga

SEQ ID NO: 447023 - RNA, 32 nt, Human
gcuggcaccuguaaucccagcauuuugggaga

SEQ ID NO: 447024 - RNA, 32 nt, Human
gcuggcacggugccucaggaagguggcgacuc

SEQ ID NO: 447025 - RNA, 32 nt, Human
gcuggcacugacugggcauagcuccccgcuuc

SEQ ID NO: 447026 - RNA, 32 nt, Human
gcuggcacugcaccuggauuuguacugcaaga

SEQ ID NO: 447027 - RNA, 18 nt, Human
gcuggcacuuuggcccug

SEQ ID NO: 447028 - RNA, 32 nt, Human
gcuggcagaaagauugcauagucagugcuucc

SEQ ID NO: 447029 - RNA, 21 nt, Human
gcuggcagacgggcagggggu

SEQ ID NO: 447030 - RNA, 32 nt, Human
gcuggcagaggagcagcuggacuggggccuuu

SEQ ID NO: 447031 - RNA, 32 nt, Human
gcuggcagaggccauuuguggaaaguggagag

SEQ ID NO: 447032 - RNA, 32 nt, Human
gcuggcagaggcugugcucccuccucaggugg

SEQ ID NO: 447033 - RNA, 32 nt, Human
gcuggcagaggggacagaguucagggaggggc

SEQ ID NO: 447034 - RNA, 32 nt, Human
gcuggcagaguuguguuugcaguguaguccug

SEQ ID NO: 447035 - RNA, 32 nt, Human
gcuggcagauacaaaagacaguggcuuuuauc

SEQ ID NO: 447036 - RNA, 24 nt, Human
gcuggcagaucacuuaaggucagg

SEQ ID NO: 447037 - RNA, 24 nt, Human
gcuggcagaucacuugaggccagg

SEQ ID NO: 447038 - RNA, 24 nt, Human
gcuggcagaucacuugaggucagg

SEQ ID NO: 447039 - RNA, 32 nt, Human
gcuggcagaugggaacagguucuucuugagga

SEQ ID NO: 447040 - RNA, 32 nt, Human
gcuggcagcgcugccuccugcccacauuccug

SEQ ID NO: 447041 - RNA, 32 nt, Human
gcuggcagcggagagagcagcccuggagcagg

SEQ ID NO: 447042 - RNA, 32 nt, Human
gcuggcagcuccggguggcggugcaggggcga

SEQ ID NO: 447043 - RNA, 32 nt, Human
gcuggcagcugugugguagggagguccaagua

SEQ ID NO: 447044 - RNA, 32 nt, Human
gcuggcaggagaaacugaggaaccacaguccu

SEQ ID NO: 447045 - RNA, 32 nt, Human
gcuggcaggagagaagcagggugggcugcugg

SEQ ID NO: 447046 - RNA, 32 nt, Human
gcuggcaggaggguaguuucuccagucucccc

SEQ ID NO: 447047 - RNA, 32 nt, Human
gcuggcaggcagacccaggcaguuuggcacca

SEQ ID NO: 447048 - RNA, 32 nt, Human
gcuggcaggcagcgugcggcagaagaugcuuc

SEQ ID NO: 447049 - RNA, 32 nt, Human
gcuggcaggcccuguggcugcuggcugagggu

SEQ ID NO: 447050 - RNA, 21 nt, Human
gcuggcaggccgggcaggggg

SEQ ID NO: 447051 - RNA, 32 nt, Human
gcuggcaggcugccuuccuuccuggagguucu

SEQ ID NO: 447052 - RNA, 32 nt, Human
gcuggcaggcuggagcugggaacccagcgagc

SEQ ID NO: 447053 - RNA, 32 nt, Human
gcuggcaggcuugaggcccaggaagagccagu

SEQ ID NO: 447054 - RNA, 32 nt, Human
gcuggcagggagugguugaggucugggggcca

SEQ ID NO: 447055 - RNA, 32 nt, Human
gcuggcagggcagaggagguagucuggaguug

SEQ ID NO: 447056 - RNA, 20 nt, Human
gcuggcagggcagcaggggg

SEQ ID NO: 447057 - RNA, 22 nt, Human
gcuggcagggcccucuggggca

SEQ ID NO: 447058 - RNA, 20 nt, Human
gcuggcagggcucucggcgg

SEQ ID NO: 447059 - RNA, 19 nt, Human
gcuggcaggggaggggcug

SEQ ID NO: 447060 - RNA, 32 nt, Human
gcuggcaggggagggggcagacagccucgccu

SEQ ID NO: 447061 - RNA, 17 nt, Human
gcuggcaggggcagggg

SEQ ID NO: 447062 - RNA, 32 nt, Human
gcuggcaggggcaggggugaacuggaggcaag

SEQ ID NO: 447063 - RNA, 17 nt, Human
gcuggcagguagggggu

SEQ ID NO: 447064 - RNA, 32 nt, Human
gcuggcagguggccucacccacagcaggggag

SEQ ID NO: 447065 - RNA, 18 nt, Human
gcuggcaggugggagggg

SEQ ID NO: 447066 - RNA, 32 nt, Human
gcuggcagugccuguccccagcagccagcaaa

SEQ ID NO: 447067 - RNA, 17 nt, Human
gcuggcaguggcagggg

SEQ ID NO: 447068 - RNA, 32 nt, Human
gcuggcaguucuguucacguccauugccggca

SEQ ID NO: 447069 - RNA, 32 nt, Human
gcuggcauaggaucugcccagaagagaaaaug

SEQ ID NO: 447070 - RNA, 32 nt, Human
gcuggcaucauguccuguggccgccccacuug

SEQ ID NO: 447071 - RNA, 32 nt, Human
gcuggcaucccugcuugcagcugugaaggggg

SEQ ID NO: 447072 - RNA, 22 nt, Human
gcuggcaucugaaccuagggua

SEQ ID NO: 447073 - RNA, 32 nt, Human
gcuggcaugagacucaaaugcaaagauccugc

SEQ ID NO: 447074 - RNA, 32 nt, Human
gcuggcaugcugguguguaccuguaguccuag

SEQ ID NO: 447075 - RNA, 32 nt, Human
gcuggcaugguggcucccgccuguaaucccag

SEQ ID NO: 447076 - RNA, 32 nt, Human
gcuggcauggugguacagaagguaucagucaa

SEQ ID NO: 447077 - RNA, 32 nt, Human
gcuggcauguuguauucaagaguggcagaaga

SEQ ID NO: 447078 - RNA, 32 nt, Human
gcuggcauucaugucuucauuuugggaugcag

SEQ ID NO: 447079 - RNA, 32 nt, Human
gcuggcauuccaggcugcugagugcggcaucu

SEQ ID NO: 447080 - RNA, 32 nt, Human
gcuggcauuuggacucaaugaaaagggcaccu

SEQ ID NO: 447081 - RNA, 32 nt, Human
gcuggccaaaagagcuuguuugcugggaggug

SEQ ID NO: 447082 - RNA, 32 nt, Human
gcuggccaaacaacuaaagcccacuugcauca

SEQ ID NO: 447083 - RNA, 32 nt, Human
gcuggccaacagcuuguccccgaucugccucc

SEQ ID NO: 447084 - RNA, 32 nt, Human
gcuggccaagugggcggugggugaggggcccc

SEQ ID NO: 447085 - RNA, 32 nt, Human
gcuggccaaucagugucaucuccuggguaaau

SEQ ID NO: 447086 - RNA, 32 nt, Human
gcuggccagagggagaggcagcagggaacgug

SEQ ID NO: 447087 - RNA, 32 nt, Human
gcuggccagagguggaaggaaggaggaaagga

SEQ ID NO: 447088 - RNA, 32 nt, Human
gcuggccagcuauuguggaugcugauggaaga

SEQ ID NO: 447089 - RNA, 32 nt, Human
gcuggccaggaaaaucgaaagggaaacacccu

SEQ ID NO: 447090 - RNA, 32 nt, Human
gcuggccaucaaggccagcugggaugaguccg

SEQ ID NO: 447091 - RNA, 32 nt, Human
gcuggccauucugccuuucugacauuuccuug

SEQ ID NO: 447092 - RNA, 32 nt, Human
gcuggccauuuugccuuucugacauuuccuug

SEQ ID NO: 447093 - RNA, 22 nt, Human
gcuggcccaaggcuggacccug

SEQ ID NO: 447094 - RNA, 32 nt, Human
gcuggcccacccaaggagcagugccggacaac

SEQ ID NO: 447095 - RNA, 32 nt, Human
gcuggcccacugguccccucucuggcucugug

SEQ ID NO: 447096 - RNA, 32 nt, Human
gcuggcccagaggaaggguuagaugugggugg

SEQ ID NO: 447097 - RNA, 15 nt, Human
gcuggcccagagugg

SEQ ID NO: 447098 - RNA, 32 nt, Human
gcuggcccagccagggcaggcagaagcuaggg

SEQ ID NO: 447099 - RNA, 32 nt, Human
gcuggcccaggccaagauggagaaggcagcca

SEQ ID NO: 447100 - RNA, 32 nt, Human
gcuggcccagggugguggucagcugggucagg

SEQ ID NO: 447101 - RNA, 32 nt, Human
gcuggcccaggugcucccucccuuccugcagg

SEQ ID NO: 447102 - RNA, 32 nt, Human
gcuggccccacaagccacucaguuccaaggga

SEQ ID NO: 447103 - RNA, 32 nt, Human
gcuggccccacucuuguagcauggacacugcu

SEQ ID NO: 447104 - RNA, 32 nt, Human
gcuggccccaggacuucugaucucaguccucu

SEQ ID NO: 447105 - RNA, 32 nt, Human
gcuggcccccuccucugcuuuagccccggcaa

SEQ ID NO: 447106 - RNA, 32 nt, Human
gcuggccccgagcacagacucucccccaaggc

SEQ ID NO: 447107 - RNA, 32 nt, Human
gcuggccccggccuuccgcggcugcuucuugu

SEQ ID NO: 447108 - RNA, 32 nt, Human
gcuggccccggguccgccccagaggaguccac

SEQ ID NO: 447109 - RNA, 32 nt, Human
gcuggccccucagucccuuccuacuccccaac

SEQ ID NO: 447110 - RNA, 32 nt, Human
gcuggccccugaggcccaugcucccugaacgc

SEQ ID NO: 447111 - RNA, 32 nt, Human
gcuggccccuggcuggaggggagggcaguggc

SEQ ID NO: 447112 - RNA, 20 nt, Human
gcuggcccgacgccucccga

SEQ ID NO: 447113 - RNA, 32 nt, Human
gcuggcccggcucuccagcugcagaggcaggu

SEQ ID NO: 447114 - RNA, 32 nt, Human
gcuggcccgggagggggcgcggggcacgguug

SEQ ID NO: 447115 - RNA, 32 nt, Human
gcuggcccggggcugcagccugaccccucugc

SEQ ID NO: 447116 - RNA, 32 nt, Human
gcuggcccuaagguaaugcagaaagauuugga

SEQ ID NO: 447117 - RNA, 32 nt, Human
gcuggcccuagcauuggacccuaggagaccug

SEQ ID NO: 447118 - RNA, 23 nt, Human
gcuggcccucagccacagugccc

SEQ ID NO: 447119 - RNA, 32 nt, Human
gcuggcccucaggcugcugcucugccuucauu

SEQ ID NO: 447120 - RNA, 32 nt, Human
gcuggcccucauucggggucgggaaccaaggg

SEQ ID NO: 447121 - RNA, 32 nt, Human
gcuggcccucauugccuccgggggcuaccuua

SEQ ID NO: 447122 - RNA, 32 nt, Human
gcuggcccuccaccaucuucacauuccaagac

SEQ ID NO: 447123 - RNA, 32 nt, Human
gcuggcccuccacccccaccucaagugccuua

SEQ ID NO: 447124 - RNA, 32 nt, Human
gcuggcccuccuccucuucccuggcccauuga

SEQ ID NO: 447125 - RNA, 32 nt, Human
gcuggcccuccuggcccccgccuuccacgccc

SEQ ID NO: 447126 - RNA, 24 nt, Human
gcuggcccugaacuccugggccca

SEQ ID NO: 447127 - RNA, 32 nt, Human
gcuggcccugagacauccagucuuccacacuc

SEQ ID NO: 447128 - RNA, 21 nt, Human
gcuggcccugaggcagggggu

SEQ ID NO: 447129 - RNA, 32 nt, Human
gcuggcccugccacuccagccuggccucacug

SEQ ID NO: 447130 - RNA, 32 nt, Human
gcuggcccugccucugccuggccggcgccgca

SEQ ID NO: 447131 - RNA, 32 nt, Human
gcuggcccugccucuucuggccuggugucucc

SEQ ID NO: 447132 - RNA, 32 nt, Human
gcuggcccugcuggcccugccucuucuggccu

SEQ ID NO: 447133 - RNA, 21 nt, Human
gcuggcccugggcggggccac

SEQ ID NO: 447134 - RNA, 21 nt, Human
gcuggccgccaccgcugccac

SEQ ID NO: 447135 - RNA, 26 nt, Human
gcuggccgccucccugagccggcugg

SEQ ID NO: 447136 - RNA, 32 nt, Human
gcuggccgcgggcagccaggcccagcccccgc

SEQ ID NO: 447137 - RNA, 32 nt, Human
gcuggccggaggacaggucaggugagggggcc

SEQ ID NO: 447138 - RNA, 16 nt, Human
gcuggccggcaggggg

SEQ ID NO: 447139 - RNA, 17 nt, Human
gcuggccgggcgcggug

SEQ ID NO: 447140 - RNA, 32 nt, Human
gcuggccggggaggggcggauggaggggccug

SEQ ID NO: 447141 - RNA, 32 nt, Human
gcuggccgguaagauauuagugccucauuuua

SEQ ID NO: 447142 - RNA, 32 nt, Human
gcuggccgucaagaaguaaggaaagaagaagc

SEQ ID NO: 447143 - RNA, 24 nt, Human
gcuggccucaaacuccugggcuca

SEQ ID NO: 447144 - RNA, 23 nt, Human
gcuggccucagcaaacaaugcca

SEQ ID NO: 447145 - RNA, 20 nt, Human
gcuggccuccaagcuggcag

SEQ ID NO: 447146 - RNA, 32 nt, Human
gcuggccuccacccgcucagacgcccgcacac

SEQ ID NO: 447147 - RNA, 18 nt, Human
gcuggccuccauggcccc

SEQ ID NO: 447148 - RNA, 32 nt, Human
gcuggccucccgccgcugugcauugcagcauu

SEQ ID NO: 447149 - RNA, 32 nt, Human
gcuggccuccuaugccucaucaugucccaaac

SEQ ID NO: 447150 - RNA, 21 nt, Human
gcuggccuccuguggggccac

SEQ ID NO: 447151 - RNA, 21 nt, Human
gcuggccucgcucugcugcug

SEQ ID NO: 447152 - RNA, 32 nt, Human
gcuggccucggacugcaggacagaauccuuac

SEQ ID NO: 447153 - RNA, 32 nt, Human
gcuggccucgucucagaaccucuucuuguguc

SEQ ID NO: 447154 - RNA, 32 nt, Human
gcuggccucucacugccuccccaaggcccccu

SEQ ID NO: 447155 - RNA, 18 nt, Human
gcuggccugagcaggggg

SEQ ID NO: 447156 - RNA, 32 nt, Human
gcuggccugaugcuggugucugugccggagcc

SEQ ID NO: 447157 - RNA, 32 nt, Human
gcuggccugcaaacuccaggagcacagagaca

SEQ ID NO: 447158 - RNA, 32 nt, Human
gcuggccugccccuucuuccagaggcuauggc

SEQ ID NO: 447159 - RNA, 32 nt, Human
gcuggccugcucacagagcucuaccucagccu

SEQ ID NO: 447160 - RNA, 32 nt, Human
gcuggccugcucauggggcugcgucgcucacc

SEQ ID NO: 447161 - RNA, 32 nt, Human
gcuggccuggaacugacccuuccuucauccuc

SEQ ID NO: 447162 - RNA, 32 nt, Human
gcuggccuggacugccugugcucugggcucca

SEQ ID NO: 447163 - RNA, 18 nt, Human
gcuggccuggcagggggu

SEQ ID NO: 447164 - RNA, 32 nt, Human
gcuggccuggcccauucaccucuuguggccca

SEQ ID NO: 447165 - RNA, 32 nt, Human
gcuggccuggcucugugccugccugccuccag

SEQ ID NO: 447166 - RNA, 16 nt, Human
gcuggccuggguccag

SEQ ID NO: 447167 - RNA, 32 nt, Human
gcuggccugguccuggcacauccucugcacug

SEQ ID NO: 447168 - RNA, 17 nt, Human
gcuggccuguaauccca

SEQ ID NO: 447169 - RNA, 23 nt, Human
gcuggccugugguggucugugua

SEQ ID NO: 447170 - RNA, 32 nt, Human
gcuggccugugucuaaggcugccuguaagaaa

SEQ ID NO: 447171 - RNA, 19 nt, Human
gcuggccuucuuccugcca

SEQ ID NO: 447172 - RNA, 32 nt, Human
gcuggccuucuuccugccacaggccaugccuc

SEQ ID NO: 447173 - RNA, 24 nt, Human
gcuggccuugaacuccugggcuca

SEQ ID NO: 447174 - RNA, 24 nt, Human
gcuggccuugagcuccugggcuca

SEQ ID NO: 447175 - RNA, 32 nt, Human
gcuggccuuggaggacggucagcuggaggaug

SEQ ID NO: 447176 - RNA, 21 nt, Human
gcuggcgagcgcggcacccca

SEQ ID NO: 447177 - RNA, 18 nt, Human
gcuggcgagggugggggu

SEQ ID NO: 447178 - RNA, 32 nt, Human
gcuggcgagggugggggugggcaagggaugca

SEQ ID NO: 447179 - RNA, 32 nt, Human
gcuggcgcggggcggaggagaaucgcucuuaa

SEQ ID NO: 447180 - RNA, 32 nt, Human
gcuggcggacucaggcuggggucugcagugca

SEQ ID NO: 447181 - RNA, 16 nt, Human
gcuggcggagcacggg

SEQ ID NO: 447182 - RNA, 32 nt, Human
gcuggcggaugugcgagcgaggagaacgaggu

SEQ ID NO: 447183 - RNA, 20 nt, Human
gcuggcggcaaagagggguu

SEQ ID NO: 447184 - RNA, 17 nt, Human
gcuggcggcaguggugg

SEQ ID NO: 447185 - RNA, 20 nt, Human
gcuggcggccaccgcagggg

SEQ ID NO: 447186 - RNA, 18 nt, Human
gcuggcggccggcggggg

SEQ ID NO: 447187 - RNA, 19 nt, Human
gcuggcggcggccgggggu

SEQ ID NO: 447188 - RNA, 21 nt, Human
gcuggcggcggcgcagcgguu

SEQ ID NO: 447189 - RNA, 19 nt, Human
gcuggcggcggggcugggg

SEQ ID NO: 447190 - RNA, 18 nt, Human
gcuggcggcugaggaggg

SEQ ID NO: 447191 - RNA, 18 nt, Human
gcuggcgggagagggugg

SEQ ID NO: 447192 - RNA, 20 nt, Human
gcuggcgggagggccgcacc

SEQ ID NO: 447193 - RNA, 32 nt, Human
gcuggcgggagguuuggagcagauggauaccg

SEQ ID NO: 447194 - RNA, 16 nt, Human
gcuggcgggcgggcgg

SEQ ID NO: 447195 - RNA, 17 nt, Human
gcuggcgggcgggcggg

SEQ ID NO: 447196 - RNA, 32 nt, Human
gcuggcggggagaagcagacacccucccagca

SEQ ID NO: 447197 - RNA, 17 nt, Human
gcuggcggggccggggg

SEQ ID NO: 447198 - RNA, 16 nt, Human
gcuggcggggcugggg

SEQ ID NO: 447199 - RNA, 17 nt, Human
gcuggcgggggaggcgg

SEQ ID NO: 447200 - RNA, 16 nt, Human
gcuggcgggggagggg

SEQ ID NO: 447201 - RNA, 18 nt, Human
gcuggcggggggaggagg

SEQ ID NO: 447202 - RNA, 32 nt, Human
gcuggcggucaccauggcaaugcgggagcugg

SEQ ID NO: 447203 - RNA, 32 nt, Human
gcuggcggucaccgaggaaaacacccugugug

SEQ ID NO: 447204 - RNA, 32 nt, Human
gcuggcggucgggagagcggcggcagcgagag

SEQ ID NO: 447205 - RNA, 18 nt, Human
gcuggcggugacagccgg

SEQ ID NO: 447206 - RNA, 21 nt, Human
gcuggcggugagcaggggguu

SEQ ID NO: 447207 - RNA, 18 nt, Human
gcuggcgguggugggggu

SEQ ID NO: 447208 - RNA, 20 nt, Human
gcuggcgguguggcgggggg

SEQ ID NO: 447209 - RNA, 32 nt, Human
gcuggcgucugugccaucucugcuccacugac

SEQ ID NO: 447210 - RNA, 18 nt, Human
gcuggcgugccagggggu

SEQ ID NO: 447211 - RNA, 32 nt, Human
gcuggcgugggggucucagaauggagcccuca

SEQ ID NO: 447212 - RNA, 32 nt, Human
gcuggcgugguggcacguaccuguaaucucag

SEQ ID NO: 447213 - RNA, 32 nt, Human
gcuggcgugguggcucacaccuguaaucccag

SEQ ID NO: 447214 - RNA, 32 nt, Human
gcuggcguuggguuccaaauuugcauuuuauu

SEQ ID NO: 447215 - RNA, 32 nt, Human
gcuggcguuuuggaaucgaauuucgacaggga

SEQ ID NO: 447216 - RNA, 32 nt, Human
gcuggcuacaaugcuauccagccggugguggc

SEQ ID NO: 447217 - RNA, 32 nt, Human
gcuggcuagcauggugagaccgucucuacuaa

SEQ ID NO: 447218 - RNA, 32 nt, Human
gcuggcuagggagggacagggcagggaggcuc

SEQ ID NO: 447219 - RNA, 32 nt, Human
gcuggcucacugcagccuccaccucccagguu

SEQ ID NO: 447220 - RNA, 32 nt, Human
gcuggcucaggccccaaccucuggccuuuuaa

SEQ ID NO: 447221 - RNA, 21 nt, Human
gcuggcuccagcccgcugcug

SEQ ID NO: 447222 - RNA, 32 nt, Human
gcuggcuccagccuggaaaccugucugagguu

SEQ ID NO: 447223 - RNA, 32 nt, Human
gcuggcucccaucucccucccauuugcagacc

SEQ ID NO: 447224 - RNA, 32 nt, Human
gcuggcucccccacaccucccaccugcauugc

SEQ ID NO: 447225 - RNA, 32 nt, Human
gcuggcucccucuuggucuucccaggcugggg

SEQ ID NO: 447226 - RNA, 32 nt, Human
gcuggcucgagccugggguccaugucccuuug

SEQ ID NO: 447227 - RNA, 32 nt, Human
gcuggcucucaaaucccaaaguugggaggcau

SEQ ID NO: 447228 - RNA, 32 nt, Human
gcuggcucucaauccccgccucgcgggggugc

SEQ ID NO: 447229 - RNA, 32 nt, Human
gcuggcucuccacaccccuccuguuccagaaa

SEQ ID NO: 447230 - RNA, 32 nt, Human
gcuggcucucugccccaacccugggcacuggc

SEQ ID NO: 447231 - RNA, 32 nt, Human
gcuggcucugggaagagagugagggacagagg

SEQ ID NO: 447232 - RNA, 20 nt, Human
gcuggcucugggcagggagu

SEQ ID NO: 447233 - RNA, 32 nt, Human
gcuggcucuguuuccaagccuggggagggguu

SEQ ID NO: 447234 - RNA, 32 nt, Human
gcuggcugacaguuccaugaggauggcaaaag

SEQ ID NO: 447235 - RNA, 32 nt, Human
gcuggcugaccugggcccacagagccuggcuu

SEQ ID NO: 447236 - RNA, 32 nt, Human
gcuggcugagauuggggcagcggcucagcagu

SEQ ID NO: 447237 - RNA, 32 nt, Human
gcuggcugagccuauggccaaugaguauuccu

SEQ ID NO: 447238 - RNA, 32 nt, Human
gcuggcugagggugggcacuaagcuggccacc

SEQ ID NO: 447239 - RNA, 32 nt, Human
gcuggcugcacuggcccugcggcgggccccag

SEQ ID NO: 447240 - RNA, 32 nt, Human
gcuggcugcagccuccaccucccuggcucaag

SEQ ID NO: 447241 - RNA, 32 nt, Human
gcuggcugcccauagcaucccaugucccacgu

SEQ ID NO: 447242 - RNA, 21 nt, Human
gcuggcugcccccagccaagc

SEQ ID NO: 447243 - RNA, 22 nt, Human
gcuggcugcccugcagaggcca

SEQ ID NO: 447244 - RNA, 32 nt, Human
gcuggcugccuccugucagcugggcaggcggg

SEQ ID NO: 447245 - RNA, 31 nt, Human
gcuggcugccucuccuccugcugucucugcu

SEQ ID NO: 447246 - RNA, 20 nt, Human
gcuggcugcggcagcagggg

SEQ ID NO: 447247 - RNA, 32 nt, Human
gcuggcugcugcuuuucugcuccuggaagcgg

SEQ ID NO: 447248 - RNA, 32 nt, Human
gcuggcugcuguugugccucaucucugggcac

SEQ ID NO: 447249 - RNA, 19 nt, Human
gcuggcuggagugcagugg

SEQ ID NO: 447250 - RNA, 21 nt, Human
gcuggcuggcccagugcuccu

SEQ ID NO: 447251 - RNA, 32 nt, Human
gcuggcuggccucacccaccccugcacaguug

SEQ ID NO: 447252 - RNA, 32 nt, Human
gcuggcuggcgcgcccagccucgcagaaccag

SEQ ID NO: 447253 - RNA, 32 nt, Human
gcuggcuggcgugcgugaacagguguggaccg

SEQ ID NO: 447254 - RNA, 21 nt, Human
gcuggcuggcuuucuuucuuu

SEQ ID NO: 447255 - RNA, 32 nt, Human
gcuggcugggcagcacgucucuccccacaggg

SEQ ID NO: 447256 - RNA, 32 nt, Human
gcuggcugggcaggcaggggcuugccucuugc

SEQ ID NO: 447257 - RNA, 32 nt, Human
gcuggcugggcccagacagacugugguggccu

SEQ ID NO: 447258 - RNA, 17 nt, Human
gcuggcugggcgcggug

SEQ ID NO: 447259 - RNA, 17 nt, Human
gcuggcugggcguggug

SEQ ID NO: 447260 - RNA, 32 nt, Human
gcuggcugggcuggggaggggguagugacagu

SEQ ID NO: 447261 - RNA, 19 nt, Human
gcuggcugggggcuugaca

SEQ ID NO: 447262 - RNA, 32 nt, Human
gcuggcugggguccccgaagaucucaggaauu

SEQ ID NO: 447263 - RNA, 32 nt, Human
gcuggcugguaggccagccaccugggauggca

SEQ ID NO: 447264 - RNA, 32 nt, Human
gcuggcuggugggaugggggaggguggggagc

SEQ ID NO: 447265 - RNA, 24 nt, Human
gcuggcugguuagagguucccuuu

SEQ ID NO: 447266 - RNA, 19 nt, Human
gcuggcuguaccuguuccu

SEQ ID NO: 447267 - RNA, 32 nt, Human
gcuggcuguaggaaccccagggaggcacaggg

SEQ ID NO: 447268 - RNA, 32 nt, Human
gcuggcugucauggcaacaggaggcugugcug

SEQ ID NO: 447269 - RNA, 32 nt, Human
gcuggcugugcacauucccuccugcuccccag

SEQ ID NO: 447270 - RNA, 32 nt, Human
gcuggcugugggacucuaaggccaggccagca

SEQ ID NO: 447271 - RNA, 32 nt, Human
gcuggcugugugaucuugggcaaguucaacca

SEQ ID NO: 447272 - RNA, 32 nt, Human
gcuggcugugugaucuugggcaaguucgacca

SEQ ID NO: 447273 - RNA, 24 nt, Human
gcuggcuguuuucuucuggggcuu

SEQ ID NO: 447274 - RNA, 32 nt, Human
gcuggcuucagcugcagaacucucagucccuc

SEQ ID NO: 447275 - RNA, 32 nt, Human
gcuggcuucauucucagacucugguagcauga

SEQ ID NO: 447276 - RNA, 32 nt, Human
gcuggcuucucaccagccuggcccugcagaag

SEQ ID NO: 447277 - RNA, 32 nt, Human
gcuggcuucucccaggccucuucuacuauggc

SEQ ID NO: 447278 - RNA, 32 nt, Human
gcuggcuucucuccccugccccaaaccucucu

SEQ ID NO: 447279 - RNA, 32 nt, Human
gcuggcuucugcgcuuucuuccucuccaaagu

SEQ ID NO: 447280 - RNA, 32 nt, Human
gcuggcuugaagucugugucucaggucgagga

SEQ ID NO: 447281 - RNA, 32 nt, Human
gcuggcuugagcuccucuggaaugugcaggga

SEQ ID NO: 447282 - RNA, 20 nt, Human
gcuggcuuggccaugccuuu

SEQ ID NO: 447283 - RNA, 32 nt, Human
gcuggcuuggccggaaacccgggggaggccca

SEQ ID NO: 447284 - RNA, 32 nt, Human
gcuggcuuuccuucugggcugucuccaucuga

SEQ ID NO: 447285 - RNA, 32 nt, Human
gcuggcuuucuuucuuucuuucuuucuuucuu

SEQ ID NO: 447286 - RNA, 21 nt, Human
gcuggcuuugcggcaggggug

SEQ ID NO: 447287 - RNA, 32 nt, Human
gcuggcuuugggcaucucgggcaggacagguc

SEQ ID NO: 447288 - RNA, 32 nt, Human
gcuggcuuugucuuugggccugggcaggcuua

SEQ ID NO: 447289 - RNA, 23 nt, Human
gcugggaaacccuagaccauguc

SEQ ID NO: 447290 - RNA, 32 nt, Human
gcugggaaagaggucagugcagauguuuuugg

SEQ ID NO: 447291 - RNA, 32 nt, Human
gcugggaaaggccuggccagcagguagccugu

SEQ ID NO: 447292 - RNA, 32 nt, Human
gcugggaaaugaggaggccaugcacagggugg

SEQ ID NO: 447293 - RNA, 32 nt, Human
gcugggaaccacugacccagacucaguuccug

SEQ ID NO: 447294 - RNA, 32 nt, Human
gcugggaaccugagguugucaaaggggcggca

SEQ ID NO: 447295 - RNA, 32 nt, Human
gcugggaagagaggcgaagccaggucaccuuu

SEQ ID NO: 447296 - RNA, 32 nt, Human
gcugggaagggacggcccucgcccgcggugau

SEQ ID NO: 447297 - RNA, 32 nt, Human
gcugggaagucuucugucucagugcugguuuu

SEQ ID NO: 447298 - RNA, 32 nt, Human
gcugggaauggaguugggaggcagguguugaa

SEQ ID NO: 447299 - RNA, 32 nt, Human
gcugggaauggccauguggaacaggccaugcc

SEQ ID NO: 447300 - RNA, 32 nt, Human
gcugggaauuacaggcacccaccacaucuggc

SEQ ID NO: 447301 - RNA, 32 nt, Human
gcugggacaaaguuagaauugccugaagauuu

SEQ ID NO: 447302 - RNA, 24 nt, Human
gcugggacaacauagggagaccac

SEQ ID NO: 447303 - RNA, 19 nt, Human
gcugggacaacucugaggc

SEQ ID NO: 447304 - RNA, 19 nt, Human
gcugggacagaguggggcc

SEQ ID NO: 447305 - RNA, 32 nt, Human
gcugggacagcuagagaagauggcccaggcug

SEQ ID NO: 447306 - RNA, 23 nt, Human
gcugggacaggagaaucgcuuga

SEQ ID NO: 447307 - RNA, 32 nt, Human
gcugggacagggaaggaagucagugaagcugg

SEQ ID NO: 447308 - RNA, 32 nt, Human
gcugggacagggacucugccucuuggaguuug

SEQ ID NO: 447309 - RNA, 23 nt, Human
gcugggacaugugaugggggcac

SEQ ID NO: 447310 - RNA, 24 nt, Human
gcugggacauuauguaggagccac

SEQ ID NO: 447311 - RNA, 24 nt, Human
gcugggaccacaaaugugagccac

SEQ ID NO: 447312 - RNA, 32 nt, Human
gcugggaccacagcuugggcaggaaagggaug

SEQ ID NO: 447313 - RNA, 18 nt, Human
gcugggaccacaggcaug

SEQ ID NO: 447314 - RNA, 32 nt, Human
gcugggaccagugaaaccuacuucaugaagag

SEQ ID NO: 447315 - RNA, 32 nt, Human
gcugggaccccuccccuccaacacacauacuc

SEQ ID NO: 447316 - RNA, 21 nt, Human
gcugggaccgaggcugggcca

SEQ ID NO: 447317 - RNA, 32 nt, Human
gcugggaccuauccccucacaucuaaugaaug

SEQ ID NO: 447318 - RNA, 32 nt, Human
gcugggaccucucuccccaacugcccugcucu

SEQ ID NO: 447319 - RNA, 23 nt, Human
gcugggaccuggggaaccaagga

SEQ ID NO: 447320 - RNA, 32 nt, Human
gcugggacgcgguggguguggagcagcauccc

SEQ ID NO: 447321 - RNA, 32 nt, Human
gcugggacuaagucacagggaucugcugcagc

SEQ ID NO: 447322 - RNA, 24 nt, Human
gcugggacuacaauugugagccac

SEQ ID NO: 447323 - RNA, 24 nt, Human
gcugggacuacagaugugggccac

SEQ ID NO: 447324 - RNA, 32 nt, Human
gcugggacuacaggauuacaguuuaaagacaa

SEQ ID NO: 447325 - RNA, 24 nt, Human
gcugggacuacaggcacaggccac

SEQ ID NO: 447326 - RNA, 32 nt, Human
gcugggacuacaggccccugcccagcuaauuu

SEQ ID NO: 447327 - RNA, 20 nt, Human
gcugggacuacaggcgugag

SEQ ID NO: 447328 - RNA, 24 nt, Human
gcugggacuacaggugccaucaga

SEQ ID NO: 447329 - RNA, 20 nt, Human
gcugggacuacaggugugag

SEQ ID NO: 447330 - RNA, 24 nt, Human
gcugggacuauaagugugagccac

SEQ ID NO: 447331 - RNA, 32 nt, Human
gcugggacucacucuagcuugcccagcaacuu

SEQ ID NO: 447332 - RNA, 32 nt, Human
gcugggacuccucgguccuugccuccuaguuu

SEQ ID NO: 447333 - RNA, 21 nt, Human
gcugggacugagaaggcucac

SEQ ID NO: 447334 - RNA, 24 nt, Human
gcugggacugcaguuguaagccac

SEQ ID NO: 447335 - RNA, 32 nt, Human
gcugggacugcgggcgccccaccaccacgccc

SEQ ID NO: 447336 - RNA, 24 nt, Human
gcugggacugggaggcagagccgc

SEQ ID NO: 447337 - RNA, 32 nt, Human
gcugggacugggugggggcaggauggaguuag

SEQ ID NO: 447338 - RNA, 32 nt, Human
gcugggagaacuguacuggugcuucaucauca

SEQ ID NO: 447339 - RNA, 32 nt, Human
gcugggagacacagcaagacuccgucucaaaa

SEQ ID NO: 447340 - RNA, 32 nt, Human
gcugggagacccacagagugugcaucagucac

SEQ ID NO: 447341 - RNA, 32 nt, Human
gcugggagagcagcaagggggaccaggugcgc

SEQ ID NO: 447342 - RNA, 32 nt, Human
gcugggagaggcaggaaggauccuccccuaga

SEQ ID NO: 447343 - RNA, 32 nt, Human
gcugggagagguaaguugaaguagcugaaggu

SEQ ID NO: 447344 - RNA, 22 nt, Human
gcugggagcacaggcacugcag

SEQ ID NO: 447345 - RNA, 20 nt, Human
gcugggagccuagucacgga

SEQ ID NO: 447346 - RNA, 20 nt, Human
gcugggagcgacacgcagug

SEQ ID NO: 447347 - RNA, 21 nt, Human
gcugggagcgacacgcaguga

SEQ ID NO: 447348 - RNA, 32 nt, Human
gcugggagcgccugccuucucuugccuugaaa

SEQ ID NO: 447349 - RNA, 19 nt, Human
gcugggagcguccucuuca

SEQ ID NO: 447350 - RNA, 32 nt, Human
gcugggagcugcagacuggaaauguuuauuug

SEQ ID NO: 447351 - RNA, 22 nt, Human
gcugggagcugggcuaggcccc

SEQ ID NO: 447352 - RNA, 32 nt, Human
gcugggagcuguagaccggagcuguuccuauu

SEQ ID NO: 447353 - RNA, 32 nt, Human
gcugggagcugugcaccggagcuguuccuauu

SEQ ID NO: 447354 - RNA, 24 nt, Human
gcugggaggaagggaugggccccg

SEQ ID NO: 447355 - RNA, 19 nt, Human
gcugggaggacagagccag

SEQ ID NO: 447356 - RNA, 32 nt, Human
gcugggaggagaaggcggcggaagguggagau

SEQ ID NO: 447357 - RNA, 32 nt, Human
gcugggaggagccuggagaaagaggcgaccuu

SEQ ID NO: 447358 - RNA, 32 nt, Human
gcugggaggagguggugacgguggcaacggca

SEQ ID NO: 447359 - RNA, 32 nt, Human
gcugggaggagucagagcuggcuuccauucac

SEQ ID NO: 447360 - RNA, 32 nt, Human
gcugggaggcagagguugcagugagcugagau

SEQ ID NO: 447361 - RNA, 32 nt, Human
gcugggaggcagaguuuucagugagccaagau

SEQ ID NO: 447362 - RNA, 32 nt, Human
gcugggaggcggagguugcagugagccaagau

SEQ ID NO: 447363 - RNA, 32 nt, Human
gcugggaggcggagguugcagugagcugagau

SEQ ID NO: 447364 - RNA, 32 nt, Human
gcugggaggcuuccugcgcucagaccuauccu

SEQ ID NO: 447365 - RNA, 32 nt, Human
gcugggagggagaagugcuacgccuuugcagg

SEQ ID NO: 447366 - RNA, 32 nt, Human
gcugggagggaggaugugugcauuuuguaaau

SEQ ID NO: 447367 - RNA, 32 nt, Human
gcugggagggcucuuccaggagguaggaguug

SEQ ID NO: 447368 - RNA, 32 nt, Human
gcugggaggggccguccuuccuucccuucacc

SEQ ID NO: 447369 - RNA, 32 nt, Human
gcugggaggggcugaguguacuugguggaggc

SEQ ID NO: 447370 - RNA, 32 nt, Human
gcugggagggggcccuuccagacugggggccc

SEQ ID NO: 447371 - RNA, 32 nt, Human
gcugggagggggcccuuccagauugggggccc

SEQ ID NO: 447372 - RNA, 32 nt, Human
gcugggagguggaugcugcagugagcagugau

SEQ ID NO: 447373 - RNA, 24 nt, Human
gcugggaguacaggcgcgcaccac

SEQ ID NO: 447374 - RNA, 32 nt, Human
gcugggagucaagucagcuaggaaggaagcag

SEQ ID NO: 447375 - RNA, 32 nt, Human
gcugggauaccaguacuacagcucuuccucca

SEQ ID NO: 447376 - RNA, 22 nt, Human
gcugggauagggguggagccac

SEQ ID NO: 447377 - RNA, 32 nt, Human
gcugggaucacugucugcagucaccaccggcu

SEQ ID NO: 447378 - RNA, 32 nt, Human
gcugggaucuccaaggggccuccuggauucag

SEQ ID NO: 447379 - RNA, 32 nt, Human
gcugggaucugcugguggccugggcagugccc

SEQ ID NO: 447380 - RNA, 31 nt, Human
gcugggaugaagaugcugccaggaguggacg

SEQ ID NO: 447381 - RNA, 21 nt, Human
gcugggaugauaugggggaag

SEQ ID NO: 447382 - RNA, 32 nt, Human
gcugggaugcaauggcauggucucagcucacu

SEQ ID NO: 447383 - RNA, 32 nt, Human
gcugggaugcaauguaggcugagggaaagacg

SEQ ID NO: 447384 - RNA, 24 nt, Human
gcugggaugggagaaucgcuugag

SEQ ID NO: 447385 - RNA, 24 nt, Human
gcugggaugggcccuccaagccca

SEQ ID NO: 447386 - RNA, 32 nt, Human
gcugggaugggugagagaauugaggugacuuu

SEQ ID NO: 447387 - RNA, 22 nt, Human
gcugggaugguggcgagcugua

SEQ ID NO: 447388 - RNA, 23 nt, Human
gcugggauuacaccaccaugccc

SEQ ID NO: 447389 - RNA, 32 nt, Human
gcugggauuacaccaccaugcccagcuacuaa

SEQ ID NO: 447390 - RNA, 32 nt, Human
gcugggauuacaggaugagccacugagcccag

SEQ ID NO: 447391 - RNA, 24 nt, Human
gcugggauuacaggcacacaccac

SEQ ID NO: 447392 - RNA, 24 nt, Human
gcugggauuacaggcacgcaccac

SEQ ID NO: 447393 - RNA, 20 nt, Human
gcugggauuacaggcaugag

SEQ ID NO: 447394 - RNA, 24 nt, Human
gcugggauuacaggcgcacaccac

SEQ ID NO: 447395 - RNA, 18 nt, Human
gcugggauuacaggcgug

SEQ ID NO: 447396 - RNA, 20 nt, Human
gcugggauuacaggcgugag

SEQ ID NO: 447397 - RNA, 20 nt, Human
gcugggauuacaggcguggg

SEQ ID NO: 447398 - RNA, 32 nt, Human
gcugggauuacagggcaccugccaccacgccu

SEQ ID NO: 447399 - RNA, 20 nt, Human
gcugggauuacagguaugag

SEQ ID NO: 447400 - RNA, 20 nt, Human
gcugggauuacaggugugag

SEQ ID NO: 447401 - RNA, 24 nt, Human
gcugggauuacaugcgugagccac

SEQ ID NO: 447402 - RNA, 24 nt, Human
gcugggauuacuggcaugagccac

SEQ ID NO: 447403 - RNA, 24 nt, Human
gcugggauuacuggcgugagccac

SEQ ID NO: 447404 - RNA, 22 nt, Human
gcugggauuaggugugagccac

SEQ ID NO: 447405 - RNA, 23 nt, Human
gcugggauucaggugugagccac

SEQ ID NO: 447406 - RNA, 32 nt, Human
gcugggauucuggcaucugccucccuagaccu

SEQ ID NO: 447407 - RNA, 23 nt, Human
gcugggauugcagcgugagccac

SEQ ID NO: 447408 - RNA, 32 nt, Human
gcugggauuuacaggcaugagccaccgcaccc

SEQ ID NO: 447409 - RNA, 32 nt, Human
gcugggauuuacaggcaugagccaccgcgccc

SEQ ID NO: 447410 - RNA, 32 nt, Human
gcugggcaacaaagcaagacccggucucuccc

SEQ ID NO: 447411 - RNA, 32 nt, Human
gcugggcaacacagcaagacucugucucaaaa

SEQ ID NO: 447412 - RNA, 32 nt, Human
gcugggcaacacagggagacccccucucuaca

SEQ ID NO: 447413 - RNA, 32 nt, Human
gcugggcaagaagaaagccaagggcaaggcca

SEQ ID NO: 447414 - RNA, 32 nt, Human
gcugggcacacaguaggugcuuuagcggacag

SEQ ID NO: 447415 - RNA, 32 nt, Human
gcugggcacagcaacuggaucccagccuucuu

SEQ ID NO: 447416 - RNA, 32 nt, Human
gcugggcacccaggacccccaggugcuugaca

SEQ ID NO: 447417 - RNA, 32 nt, Human
gcugggcaccugaaggaugacauggcccugcc

SEQ ID NO: 447418 - RNA, 32 nt, Human
gcugggcacgcaguaggggcucaggagaugcu

SEQ ID NO: 447419 - RNA, 32 nt, Human
gcugggcacggcccuggcguucggcacuagac

SEQ ID NO: 447420 - RNA, 32 nt, Human
gcugggcacugagcugccgccuggugaagggg

SEQ ID NO: 447421 - RNA, 32 nt, Human
gcugggcacugaggucccuggcgucccugguu

SEQ ID NO: 447422 - RNA, 32 nt, Human
gcugggcacugcguggccuugccccucucccg

SEQ ID NO: 447423 - RNA, 32 nt, Human
gcugggcagagcccugggggcgcggugcugcc

SEQ ID NO: 447424 - RNA, 32 nt, Human
gcugggcagagcugcggcacagggccugggcu

SEQ ID NO: 447425 - RNA, 32 nt, Human
gcugggcagaggcagaggucagcacuggccau

SEQ ID NO: 447426 - RNA, 32 nt, Human
gcugggcagccccagagagaggauguggaaag

SEQ ID NO: 447427 - RNA, 32 nt, Human
gcugggcaggaggagagggcagaggaagaccc

SEQ ID NO: 447428 - RNA, 32 nt, Human
gcugggcagggacccaggcucaugcucccagc

SEQ ID NO: 447429 - RNA, 32 nt, Human
gcugggcagggccuggcggagguggaguggcc

SEQ ID NO: 447430 - RNA, 32 nt, Human
gcugggcaucuccccauauucucucuccugua

SEQ ID NO: 447431 - RNA, 32 nt, Human
gcugggcaucucuccucuguggcucuaggaca

SEQ ID NO: 447432 - RNA, 32 nt, Human
gcugggcauggcugccuguaaucccagcacuu

SEQ ID NO: 447433 - RNA, 31 nt, Human
gcugggcaugggagagaaacgggcuggggag

SEQ ID NO: 447434 - RNA, 31 nt, Human
gcugggcaugguggcgggcacuuguaguccc

SEQ ID NO: 447435 - RNA, 31 nt, Human
gcugggcauuauguguccaugccagggaugc

SEQ ID NO: 447436 - RNA, 32 nt, Human
gcugggcauuuccaucauauagaccucugccc

SEQ ID NO: 447437 - RNA, 32 nt, Human
gcugggccaagccagggauggggccacagcca

SEQ ID NO: 447438 - RNA, 32 nt, Human
gcugggccagcagaagcuaggacaucugugag

SEQ ID NO: 447439 - RNA, 32 nt, Human
gcugggccagccgcccacccccacccccagug

SEQ ID NO: 447440 - RNA, 32 nt, Human
gcugggccagccuggcccugcagggcagagca

SEQ ID NO: 447441 - RNA, 32 nt, Human
gcugggccagggacucaacaauggggacagaa

SEQ ID NO: 447442 - RNA, 32 nt, Human
gcugggccaugggacccuggaggcagagcugg

SEQ ID NO: 447443 - RNA, 32 nt, Human
gcugggccauuuuguucuuggagggacaaaau

SEQ ID NO: 447444 - RNA, 32 nt, Human
gcugggcccacacaccucuccauggacuccag

SEQ ID NO: 447445 - RNA, 32 nt, Human
gcugggcccagccuggggacagggaaccugcc

SEQ ID NO: 447446 - RNA, 32 nt, Human
gcugggcccagccugucucgcccuggccgcgg

SEQ ID NO: 447447 - RNA, 32 nt, Human
gcugggcccaggacggugcguccggccucgcc

SEQ ID NO: 447448 - RNA, 32 nt, Human
gcugggcccaggcuguggcaugauggccggag

SEQ ID NO: 447449 - RNA, 32 nt, Human
gcugggccccacaaacaccacaaacaccuuuu

SEQ ID NO: 447450 - RNA, 32 nt, Human
gcugggccccucagagccucugagaugcagag

SEQ ID NO: 447451 - RNA, 32 nt, Human
gcugggccccuggggaggagggagggugggcg

SEQ ID NO: 447452 - RNA, 32 nt, Human
gcugggcccgugagccacucggccucaggucg

SEQ ID NO: 447453 - RNA, 32 nt, Human
gcugggcccuccaggauuugagagagggagag

SEQ ID NO: 447454 - RNA, 32 nt, Human
gcugggcccugccuccccguuacccuccuucc

SEQ ID NO: 447455 - RNA, 32 nt, Human
gcugggcccugccugcagccagggcugggguu

SEQ ID NO: 447456 - RNA, 32 nt, Human
gcugggcccuggagggucaagagccccaauua

SEQ ID NO: 447457 - RNA, 32 nt, Human
gcugggcccuggcagguggaaaaccaucuccc

SEQ ID NO: 447458 - RNA, 32 nt, Human
gcugggccgaggacagggcggcaggggugaca

SEQ ID NO: 447459 - RNA, 32 nt, Human
gcugggccggaagccucugccugcagguuucu

SEQ ID NO: 447460 - RNA, 22 nt, Human
gcugggccgggacuuccuuccu

SEQ ID NO: 447461 - RNA, 32 nt, Human
gcugggccucaaggagaccguucauggaagcu

SEQ ID NO: 447462 - RNA, 32 nt, Human
gcugggccuccacuucagccuagugaacaaaa

SEQ ID NO: 447463 - RNA, 32 nt, Human
gcugggccucuaagaaccacagccacagaguc

SEQ ID NO: 447464 - RNA, 32 nt, Human
gcugggccucugaagcucuccucuuugagguc

SEQ ID NO: 447465 - RNA, 32 nt, Human
gcugggccucugccucauccugacucccccug

SEQ ID NO: 447466 - RNA, 32 nt, Human
gcugggccugcuguccagcuucccaggugcag

SEQ ID NO: 447467 - RNA, 32 nt, Human
gcugggccuggcucccaggaccaguccagucc

SEQ ID NO: 447468 - RNA, 17 nt, Human
gcugggccuggcucccu

SEQ ID NO: 447469 - RNA, 32 nt, Human
gcugggccuggcugagggcccugugugcucac

SEQ ID NO: 447470 - RNA, 32 nt, Human
gcugggccugggacaggcuccuccucucccuc

SEQ ID NO: 447471 - RNA, 32 nt, Human
gcugggccugggacuucugccucugccgccuc

SEQ ID NO: 447472 - RNA, 32 nt, Human
gcugggccugggcacaggaggagcagcugcuu

SEQ ID NO: 447473 - RNA, 32 nt, Human
gcugggccuguccugccgucauggcccccugc

SEQ ID NO: 447474 - RNA, 32 nt, Human
gcugggccuuugaggacacagaucagaagaaa

SEQ ID NO: 447475 - RNA, 32 nt, Human
gcugggccuuugucuccugggcaccgggugcc

SEQ ID NO: 447476 - RNA, 32 nt, Human
gcugggcgacagagcgagacccugucucaaaa

SEQ ID NO: 447477 - RNA, 20 nt, Human
gcugggcgacguggaggagg

SEQ ID NO: 447478 - RNA, 32 nt, Human
gcugggcgagcuccacugacaaguggguagga

SEQ ID NO: 447479 - RNA, 32 nt, Human
gcugggcgcccaggaggaagggagggcagagg

SEQ ID NO: 447480 - RNA, 32 nt, Human
gcugggcggacugucugugugucugucucucu

SEQ ID NO: 447481 - RNA, 32 nt, Human
gcugggcggcauaagcauugccacuaucgaag

SEQ ID NO: 447482 - RNA, 32 nt, Human
gcugggcggcgccggcggcaugugcgagggcc

SEQ ID NO: 447483 - RNA, 32 nt, Human
gcugggcgggggagaggaaggggcggggcagg

SEQ ID NO: 447484 - RNA, 32 nt, Human
gcugggcgggguggcucagaccuguaauccca

SEQ ID NO: 447485 - RNA, 32 nt, Human
gcugggcgugcuagagguugcagcaugagacu

SEQ ID NO: 447486 - RNA, 32 nt, Human
gcugggcguggggcucacaccuguaaucccag

SEQ ID NO: 447487 - RNA, 32 nt, Human
gcugggcuacaaagcaagacucccucucaaaa

SEQ ID NO: 447488 - RNA, 32 nt, Human
gcugggcuagcuaaaggguggggagagggaag

SEQ ID NO: 447489 - RNA, 32 nt, Human
gcugggcucaaagauaaaaggaagggaaaagc

SEQ ID NO: 447490 - RNA, 32 nt, Human
gcugggcucacagcaggugcuuaauaaacaga

SEQ ID NO: 447491 - RNA, 32 nt, Human
gcugggcucacuguggccccaccccaagccgu

SEQ ID NO: 447492 - RNA, 32 nt, Human
gcugggcuccacccaccuucuugcucuaccag

SEQ ID NO: 447493 - RNA, 32 nt, Human
gcugggcucccagagcugcuggcguuucgaau

SEQ ID NO: 447494 - RNA, 32 nt, Human
gcugggcucgcgccggggcucugggugugugc

SEQ ID NO: 447495 - RNA, 32 nt, Human
gcugggcucgggcuauccuuccaucucagccu

SEQ ID NO: 447496 - RNA, 32 nt, Human
gcugggcucugccacccuaccuguucaguguc

SEQ ID NO: 447497 - RNA, 31 nt, Human
gcugggcucuguguguggccuguguccccug

SEQ ID NO: 447498 - RNA, 32 nt, Human
gcugggcucuuggagguaggggagcuacaggg

SEQ ID NO: 447499 - RNA, 22 nt, Human
gcugggcugagcagggccucua

SEQ ID NO: 447500 - RNA, 32 nt, Human
gcugggcugccuggcacugcccgcuugccggu

SEQ ID NO: 447501 - RNA, 21 nt, Human
gcugggcugcgagcugggccc

SEQ ID NO: 447502 - RNA, 32 nt, Human
gcugggcuggacugccugggccagugauaaug

SEQ ID NO: 447503 - RNA, 32 nt, Human
gcugggcuggagagacuggacuuagucuugcc

SEQ ID NO: 447504 - RNA, 32 nt, Human
gcugggcugggaaguggggaaagcaggggagc

SEQ ID NO: 447505 - RNA, 20 nt, Human
gcugggcugggcugagcccc

SEQ ID NO: 447506 - RNA, 32 nt, Human
gcugggcugggcugggcugugggagcccuaug

SEQ ID NO: 447507 - RNA, 32 nt, Human
gcugggcugggcugugguggggugggggacaa

SEQ ID NO: 447508 - RNA, 20 nt, Human
gcugggcuggggugggcccc

SEQ ID NO: 447509 - RNA, 32 nt, Human
gcugggcuggugcccccaggagauggagggcc

SEQ ID NO: 447510 - RNA, 32 nt, Human
gcugggcuguagccaauagccaugcaggacug

SEQ ID NO: 447511 - RNA, 23 nt, Human
gcugggcuguucccagccuccca

SEQ ID NO: 447512 - RNA, 32 nt, Human
gcugggcuucaugucaaacaugucaauguaug

SEQ ID NO: 447513 - RNA, 20 nt, Human
gcugggcuugccugcugcug

SEQ ID NO: 447514 - RNA, 17 nt, Human
gcugggcuuggguccag

SEQ ID NO: 447515 - RNA, 32 nt, Human
gcugggcuugguuuucuugaccugccugccug

SEQ ID NO: 447516 - RNA, 32 nt, Human
gcugggcuugucagggggcaccccaaagaggg

SEQ ID NO: 447517 - RNA, 18 nt, Human
gcuggggaaaaugugcca

SEQ ID NO: 447518 - RNA, 32 nt, Human
gcuggggaagagaguccugaacgguuugaugu

SEQ ID NO: 447519 - RNA, 32 nt, Human
gcuggggaaggaagacagggacugcagguguc

SEQ ID NO: 447520 - RNA, 32 nt, Human
gcuggggaaggacacacuggaggcucuugcug

SEQ ID NO: 447521 - RNA, 32 nt, Human
gcuggggaagggacagucaagagcagucaguu

SEQ ID NO: 447522 - RNA, 32 nt, Human
gcuggggaaggggaaagagggaggaaggggag

SEQ ID NO: 447523 - RNA, 32 nt, Human
gcuggggaagugaacccugagguggggacccu

SEQ ID NO: 447524 - RNA, 32 nt, Human
gcuggggacaagggcugccacugcacuuagca

SEQ ID NO: 447525 - RNA, 32 nt, Human
gcuggggacaugcaacaauaacaggugaguuc

SEQ ID NO: 447526 - RNA, 17 nt, Human
gcuggggacccagggca

SEQ ID NO: 447527 - RNA, 21 nt, Human
gcuggggacuacaggcacccg

SEQ ID NO: 447528 - RNA, 32 nt, Human
gcuggggacuacaggugcgugccaccacgcuc

SEQ ID NO: 447529 - RNA, 21 nt, Human
gcuggggacuccugggcccug

SEQ ID NO: 447530 - RNA, 21 nt, Human
gcuggggacucucugugcccc

SEQ ID NO: 447531 - RNA, 21 nt, Human
gcuggggacuggcgcagcccc

SEQ ID NO: 447532 - RNA, 32 nt, Human
gcuggggacugggggccagggagcagcaagcc

SEQ ID NO: 447533 - RNA, 32 nt, Human
gcuggggagaagguguucauucacuugcauuu

SEQ ID NO: 447534 - RNA, 24 nt, Human
gcuggggagaauggggcugggccc

SEQ ID NO: 447535 - RNA, 32 nt, Human
gcuggggagaggagggcagugaggagcgagga

SEQ ID NO: 447536 - RNA, 32 nt, Human
gcuggggagaggagggcuggaggcagagagug

SEQ ID NO: 447537 - RNA, 32 nt, Human
gcuggggagagggagaaggcaggccucaggau

SEQ ID NO: 447538 - RNA, 32 nt, Human
gcuggggagagggcagggaggcuuccugggcc

SEQ ID NO: 447539 - RNA, 32 nt, Human
gcuggggagagggggagggggcugugguggug

SEQ ID NO: 447540 - RNA, 32 nt, Human
gcuggggagagguggaggcugacagcugagac

SEQ ID NO: 447541 - RNA, 32 nt, Human
gcuggggagauggaggcugcagugagcuauaa

SEQ ID NO: 447542 - RNA, 23 nt, Human
gcuggggagcgacugacgccccg

SEQ ID NO: 447543 - RNA, 21 nt, Human
gcuggggagcgcugagccgcg

SEQ ID NO: 447544 - RNA, 32 nt, Human
gcuggggagcugcacccaccucccuuccaggg

SEQ ID NO: 447545 - RNA, 32 nt, Human
gcuggggaggacauucuggggcugaggguuga

SEQ ID NO: 447546 - RNA, 32 nt, Human
gcuggggaggccaggguauaagaaaagcauca

SEQ ID NO: 447547 - RNA, 22 nt, Human
gcuggggaggcggcgggccccg

SEQ ID NO: 447548 - RNA, 32 nt, Human
gcuggggaggcugaaguaggaggaucauuuau

SEQ ID NO: 447549 - RNA, 32 nt, Human
gcuggggaggcugaggugggaggauugcuugg

SEQ ID NO: 447550 - RNA, 32 nt, Human
gcuggggagggagaggaugggaccagguugga

SEQ ID NO: 447551 - RNA, 22 nt, Human
gcuggggagggcccaggccacg

SEQ ID NO: 447552 - RNA, 32 nt, Human
gcuggggagggcucuuccauccccagcacccc

SEQ ID NO: 447553 - RNA, 24 nt, Human
gcuggggaggggggcugggcuccc

SEQ ID NO: 447554 - RNA, 24 nt, Human
gcuggggaggggucgcuggccccg

SEQ ID NO: 447555 - RNA, 32 nt, Human
gcuggggagggugggagcacgaacgagguggg

SEQ ID NO: 447556 - RNA, 32 nt, Human
gcuggggagguagaggaaagugcuagaguaca

SEQ ID NO: 447557 - RNA, 32 nt, Human
gcuggggaggucgaggcagcagugagccgaga

SEQ ID NO: 447558 - RNA, 32 nt, Human
gcuggggaggucuuggaggccuggucucugcc

SEQ ID NO: 447559 - RNA, 32 nt, Human
gcuggggagugagaggaugagcuagugagugg

SEQ ID NO: 447560 - RNA, 32 nt, Human
gcuggggagugggaacagggaggggcagaaaa

SEQ ID NO: 447561 - RNA, 32 nt, Human
gcuggggaucccggaccucgauucugcgggcg

SEQ ID NO: 447562 - RNA, 32 nt, Human
gcuggggaugggccuggcugcacagcauccuc

SEQ ID NO: 447563 - RNA, 32 nt, Human
gcuggggauggguggaggcagugacaggcucc

SEQ ID NO: 447564 - RNA, 32 nt, Human
gcuggggauuacaggugccuaccagcaugcuc

SEQ ID NO: 447565 - RNA, 32 nt, Human
gcuggggauuuguggagggaagaccaccaccc

SEQ ID NO: 447566 - RNA, 32 nt, Human
gcuggggcaagaacucugggcuuggguaauga

SEQ ID NO: 447567 - RNA, 32 nt, Human
gcuggggcaauggcaucugucacgguguuuuc

SEQ ID NO: 447568 - RNA, 32 nt, Human
gcuggggcaccgggagcugugaagggaacgug

SEQ ID NO: 447569 - RNA, 32 nt, Human
gcuggggcagaagagggucucacuuugucacc

SEQ ID NO: 447570 - RNA, 23 nt, Human
gcuggggcagcagaaucgcuuga

SEQ ID NO: 447571 - RNA, 32 nt, Human
gcuggggcagcccucagagccuggccacgugg

SEQ ID NO: 447572 - RNA, 32 nt, Human
gcuggggcagccugcagcugcccacccaaccu

SEQ ID NO: 447573 - RNA, 24 nt, Human
gcuggggcaggagaaucacuugag

SEQ ID NO: 447574 - RNA, 23 nt, Human
gcuggggcaggagaaucgcuuga

SEQ ID NO: 447575 - RNA, 24 nt, Human
gcuggggcaggagaauugccugag

SEQ ID NO: 447576 - RNA, 23 nt, Human
gcuggggcaggagaauugcuuga

SEQ ID NO: 447577 - RNA, 32 nt, Human
gcuggggcagggaagggugggaggggccccau

SEQ ID NO: 447578 - RNA, 32 nt, Human
gcuggggcagggccccggccugggacucagca

SEQ ID NO: 447579 - RNA, 32 nt, Human
gcuggggccagccuggucucccaggccugagg

SEQ ID NO: 447580 - RNA, 32 nt, Human
gcuggggccagccugucuucaccggcacccuc

SEQ ID NO: 447581 - RNA, 32 nt, Human
gcuggggccaggcuucucuccccaccaccugc

SEQ ID NO: 447582 - RNA, 32 nt, Human
gcuggggcccacaaagucaaggcugcagugag

SEQ ID NO: 447583 - RNA, 32 nt, Human
gcuggggccccagcuguacggagucuucccag

SEQ ID NO: 447584 - RNA, 32 nt, Human
gcuggggcccucaggaucaucauuaaccccau

SEQ ID NO: 447585 - RNA, 32 nt, Human
gcuggggcccugcuuguuggccugaccccucc

SEQ ID NO: 447586 - RNA, 32 nt, Human
gcuggggcccuggagcccccuuuggggcggag

SEQ ID NO: 447587 - RNA, 32 nt, Human
gcuggggccgaggcagcuggagauguggucaa

SEQ ID NO: 447588 - RNA, 18 nt, Human
gcuggggccgccuugggg

SEQ ID NO: 447589 - RNA, 32 nt, Human
gcuggggccugaugccuggucaucauuugagu

SEQ ID NO: 447590 - RNA, 32 nt, Human
gcuggggccuggccucgcccacgguggauccg

SEQ ID NO: 447591 - RNA, 32 nt, Human
gcuggggccuuuuucugucucauaaagacagg

SEQ ID NO: 447592 - RNA, 21 nt, Human
gcuggggcgaaggucgcugag

SEQ ID NO: 447593 - RNA, 24 nt, Human
gcuggggcgagaggauugcuugag

SEQ ID NO: 447594 - RNA, 24 nt, Human
gcuggggcgaggugugaaggccac

SEQ ID NO: 447595 - RNA, 18 nt, Human
gcuggggcgcagagggag

SEQ ID NO: 447596 - RNA, 32 nt, Human
gcuggggcggcugaaguaggagggucacuuag

SEQ ID NO: 447597 - RNA, 24 nt, Human
gcuggggcgggcgaaucgccugag

SEQ ID NO: 447598 - RNA, 32 nt, Human
gcuggggcggggcuuggccagugccuucaggg

SEQ ID NO: 447599 - RNA, 32 nt, Human
gcuggggcggugagggcauggggugaggcaug

SEQ ID NO: 447600 - RNA, 32 nt, Human
gcuggggcuagugccagagaaucccuucucag

SEQ ID NO: 447601 - RNA, 32 nt, Human
gcuggggcucaucgagggucucaggccgaggc

SEQ ID NO: 447602 - RNA, 32 nt, Human
gcuggggcucugcugguuaaggaacaggaagc

SEQ ID NO: 447603 - RNA, 22 nt, Human
gcuggggcugacuccugccuca

SEQ ID NO: 447604 - RNA, 32 nt, Human
gcuggggcugcagcgcugccuccgagaccgag

SEQ ID NO: 447605 - RNA, 32 nt, Human
gcuggggcugcagcuggugguguuuccaacaa

SEQ ID NO: 447606 - RNA, 32 nt, Human
gcuggggcuggaaccaggucuccugcccuugu

SEQ ID NO: 447607 - RNA, 32 nt, Human
gcuggggcugggccaucaccauuccagagaca

SEQ ID NO: 447608 - RNA, 32 nt, Human
gcuggggcugggggugggaugggcuggugaga

SEQ ID NO: 447609 - RNA, 32 nt, Human
gcugggggagaaaggaccuccuggaacugacu

SEQ ID NO: 447610 - RNA, 32 nt, Human
gcugggggagccaccggccuuggccagcccag

SEQ ID NO: 447611 - RNA, 17 nt, Human
gcugggggagccagggc

SEQ ID NO: 447612 - RNA, 32 nt, Human
gcugggggagcuauggaagugcccaaggcugc

SEQ ID NO: 447613 - RNA, 32 nt, Human
gcugggggaggcaccccacagacucagcgccg

SEQ ID NO: 447614 - RNA, 32 nt, Human
gcugggggaggcaggaggaugccugccuggac

SEQ ID NO: 447615 - RNA, 32 nt, Human
gcugggggaggcaguggcggcuggaguaggua

SEQ ID NO: 447616 - RNA, 32 nt, Human
gcugggggaggcggcacauuggcaguguguca

SEQ ID NO: 447617 - RNA, 32 nt, Human
gcugggggaggggcucaagggagcccagcugg

SEQ ID NO: 447618 - RNA, 21 nt, Human
gcugggggaggguucagggca

SEQ ID NO: 447619 - RNA, 32 nt, Human
gcugggggaggugggagggaucacgccuauag

SEQ ID NO: 447620 - RNA, 32 nt, Human
gcugggggaugggagagccacaguguguuucu

SEQ ID NO: 447621 - RNA, 23 nt, Human
gcugggggcacagccccucccca

SEQ ID NO: 447622 - RNA, 32 nt, Human
gcugggggcaggaggagguggggaggggcacu

SEQ ID NO: 447623 - RNA, 32 nt, Human
gcugggggcaguggacagggaauugggauacc

SEQ ID NO: 447624 - RNA, 23 nt, Human
gcugggggccauccuccuuccca

SEQ ID NO: 447625 - RNA, 31 nt, Human
gcugggggccucucuccugggucagggaugu

SEQ ID NO: 447626 - RNA, 32 nt, Human
gcugggggccugagagacagacaggaacccac

SEQ ID NO: 447627 - RNA, 32 nt, Human
gcugggggcucagaccagggaucgcucaggcc

SEQ ID NO: 447628 - RNA, 32 nt, Human
gcugggggcugcagggcugggucagggguaca

SEQ ID NO: 447629 - RNA, 32 nt, Human
gcugggggcuggcaauggcgguguggugucca

SEQ ID NO: 447630 - RNA, 22 nt, Human
gcuggggggaggcccggccccg

SEQ ID NO: 447631 - RNA, 32 nt, Human
gcuggggguagaaaugucaugggugacuucug

SEQ ID NO: 447632 - RNA, 32 nt, Human
gcuggggguggaggguggaggagggagcagga

SEQ ID NO: 447633 - RNA, 32 nt, Human
gcuggggguggcugggaggggaagggaaggga

SEQ ID NO: 447634 - RNA, 22 nt, Human
gcuggggguuggaacagggggu

SEQ ID NO: 447635 - RNA, 19 nt, Human
gcugggguagagcggagga

SEQ ID NO: 447636 - RNA, 17 nt, Human
gcugggguaggaggaag

SEQ ID NO: 447637 - RNA, 22 nt, Human
gcugggguagggagacaggaag

SEQ ID NO: 447638 - RNA, 32 nt, Human
gcugggguccccucagugugaauggcccauua

SEQ ID NO: 447639 - RNA, 32 nt, Human
gcugggguccugacacaacaggaguacaucug

SEQ ID NO: 447640 - RNA, 32 nt, Human
gcugggguccugaugccucuguuuccaaacaa

SEQ ID NO: 447641 - RNA, 32 nt, Human
gcuggggucucaaggcuggagucaaggugaug

SEQ ID NO: 447642 - RNA, 23 nt, Human
gcuggggucuggcacagaggagg

SEQ ID NO: 447643 - RNA, 32 nt, Human
gcuggggucugucuugucuggagcaguggggc

SEQ ID NO: 447644 - RNA, 19 nt, Human
gcuggggucuuggaggaag

SEQ ID NO: 447645 - RNA, 32 nt, Human
gcuggggugagaccccucccuuccagaaucca

SEQ ID NO: 447646 - RNA, 32 nt, Human
gcuggggugagcucagggaggggaagaggaga

SEQ ID NO: 447647 - RNA, 18 nt, Human
gcuggggugcagaggagg

SEQ ID NO: 447648 - RNA, 32 nt, Human
gcugggguggagaagggcuagcccaccgcagc

SEQ ID NO: 447649 - RNA, 32 nt, Human
gcugggguggaggaucagucacacugcugagu

SEQ ID NO: 447650 - RNA, 19 nt, Human
gcugggguggcagagggag

SEQ ID NO: 447651 - RNA, 32 nt, Human
gcuggggugggaacaggauggcgggcaauaga

SEQ ID NO: 447652 - RNA, 32 nt, Human
gcuggggugggacugucugugugcccuguggg

SEQ ID NO: 447653 - RNA, 24 nt, Human
gcuggggugggaggacugcuugag

SEQ ID NO: 447654 - RNA, 32 nt, Human
gcuggggugggcggaggucgcugccuggggau

SEQ ID NO: 447655 - RNA, 32 nt, Human
gcugggguggggaaagguggcccaguggagcc

SEQ ID NO: 447656 - RNA, 32 nt, Human
gcugggguggggauggggguaucaggagucua

SEQ ID NO: 447657 - RNA, 32 nt, Human
gcugggguggguggaaggggcaggaggguggc

SEQ ID NO: 447658 - RNA, 32 nt, Human
gcuggggugucaauaaagcugugcuugggguc

SEQ ID NO: 447659 - RNA, 22 nt, Human
gcugggguguuccuggaagagg

SEQ ID NO: 447660 - RNA, 32 nt, Human
gcugggguuggggguggguggggagcuuuugg

SEQ ID NO: 447661 - RNA, 32 nt, Human
gcugggguuggugagagugggacucgggggaa

SEQ ID NO: 447662 - RNA, 32 nt, Human
gcuggguagagcaaucugggcacuuuggccaa

SEQ ID NO: 447663 - RNA, 32 nt, Human
gcuggguaguguucucauuugggggcugaagu

SEQ ID NO: 447664 - RNA, 32 nt, Human
gcugggucaauacaaacaaaaagguacuguca

SEQ ID NO: 447665 - RNA, 20 nt, Human
gcugggucaccagcugccca

SEQ ID NO: 447666 - RNA, 32 nt, Human
gcugggucagggguacacagagcuaaggccaa

SEQ ID NO: 447667 - RNA, 32 nt, Human
gcugggucauaugacaagcauuagccaaugag

SEQ ID NO: 447668 - RNA, 32 nt, Human
gcugggucaugauuuccacaucaugagcgaag

SEQ ID NO: 447669 - RNA, 32 nt, Human
gcugggucccacccuccgagccauggugcccc

SEQ ID NO: 447670 - RNA, 32 nt, Human
gcugggucccagggaugcagaagggucaaaac

SEQ ID NO: 447671 - RNA, 23 nt, Human
gcuggguccccccaaccuucccc

SEQ ID NO: 447672 - RNA, 32 nt, Human
gcuggguccuaaguccucucagcaguggguga

SEQ ID NO: 447673 - RNA, 32 nt, Human
gcugggucgcguagcccaggguggaggcagaa

SEQ ID NO: 447674 - RNA, 32 nt, Human
gcugggucgggaagaaaaauaauucugcaagg

SEQ ID NO: 447675 - RNA, 32 nt, Human
gcugggucgggccgacgugccacccacccgga

SEQ ID NO: 447676 - RNA, 32 nt, Human
gcugggucuagggugcgaagaacugcaauggc

SEQ ID NO: 447677 - RNA, 32 nt, Human
gcugggucuaugccagccuggcccugcagggu

SEQ ID NO: 447678 - RNA, 32 nt, Human
gcugggucucagaagcucagauguuccucaga

SEQ ID NO: 447679 - RNA, 32 nt, Human
gcugggucucaggcugggcucagcaaaggacu

SEQ ID NO: 447680 - RNA, 19 nt, Human
gcugggucuccagcugguu

SEQ ID NO: 447681 - RNA, 32 nt, Human
gcugggucucgaacuccugaccucaggugauc

SEQ ID NO: 447682 - RNA, 23 nt, Human
gcugggucugcccucuucccccu

SEQ ID NO: 447683 - RNA, 20 nt, Human
gcugggucugcguccuuucc

SEQ ID NO: 447684 - RNA, 32 nt, Human
gcugggucuggagggccccugcugggugggcc

SEQ ID NO: 447685 - RNA, 32 nt, Human
gcugggucugggaggagggaggcugggaggcc

SEQ ID NO: 447686 - RNA, 32 nt, Human
gcugggucuuuguaacccagcacuuccucuug

SEQ ID NO: 447687 - RNA, 32 nt, Human
gcugggugaagccccugcauccuaauuccccc

SEQ ID NO: 447688 - RNA, 32 nt, Human
gcugggugacgaggccacccagagccaggcgg

SEQ ID NO: 447689 - RNA, 31 nt, Human
gcugggugacuucccccaaccgcagagacag

SEQ ID NO: 447690 - RNA, 32 nt, Human
gcugggugagccaaggacagggcuggcuccuc

SEQ ID NO: 447691 - RNA, 32 nt, Human
gcugggugcagggcgcgccaggagucccagcc

SEQ ID NO: 447692 - RNA, 32 nt, Human
gcugggugccccggaagaagggcaggcaggaa

SEQ ID NO: 447693 - RNA, 32 nt, Human
gcugggugccccguugcccucccaggccacua

SEQ ID NO: 447694 - RNA, 32 nt, Human
gcugggugcccugugcacgccaccccacuucc

SEQ ID NO: 447695 - RNA, 32 nt, Human
gcugggugcgguggcuguuggcauuuugggag

SEQ ID NO: 447696 - RNA, 32 nt, Human
gcugggugcucacuggugaugaggcagaugaa

SEQ ID NO: 447697 - RNA, 32 nt, Human
gcugggugcuuugcgcaaaaccaggcagcgag

SEQ ID NO: 447698 - RNA, 18 nt, Human
gcuggguggaugcagugg

SEQ ID NO: 447699 - RNA, 19 nt, Human
gcuggguggccuggcccug

SEQ ID NO: 447700 - RNA, 32 nt, Human
gcuggguggcugcuccgggcgcauccaccagc

SEQ ID NO: 447701 - RNA, 32 nt, Human
gcugggugggaagcaucaucugcacagucccu

SEQ ID NO: 447702 - RNA, 32 nt, Human
gcugggugggcaaaucacuugaggucaagagu

SEQ ID NO: 447703 - RNA, 31 nt, Human
gcuggguggguggguggggaagaaaugggcc

SEQ ID NO: 447704 - RNA, 32 nt, Human
gcuggguggguguguccaggaggagagcaggg

SEQ ID NO: 447705 - RNA, 32 nt, Human
gcuggguggguuuggaguucuuggcuuuaauc

SEQ ID NO: 447706 - RNA, 31 nt, Human
gcugggugguucucugggccucaguuucccu

SEQ ID NO: 447707 - RNA, 19 nt, Human
gcuggguguaagagugcca

SEQ ID NO: 447708 - RNA, 32 nt, Human
gcuggguguacagguggguuugggagagagga

SEQ ID NO: 447709 - RNA, 32 nt, Human
gcuggguguauggcgcccaccuguaauccuag

SEQ ID NO: 447710 - RNA, 32 nt, Human
gcugggugucagaccuggaggagaagcuccca

SEQ ID NO: 447711 - RNA, 32 nt, Human
gcugggugugagccaccaccagucaacaaaau

SEQ ID NO: 447712 - RNA, 32 nt, Human
gcugggugugcgguguucugucuccgcucccg

SEQ ID NO: 447713 - RNA, 24 nt, Human
gcugggugugcugucuccuuccca

SEQ ID NO: 447714 - RNA, 32 nt, Human
gcugggugugggccccgaguacacgggagauc

SEQ ID NO: 447715 - RNA, 21 nt, Human
gcugggugugggcggggccac

SEQ ID NO: 447716 - RNA, 32 nt, Human
gcuggguuaggggagcaccuguuucagacugg

SEQ ID NO: 447717 - RNA, 32 nt, Human
gcuggguucauacacgugcacacacacgcaua

SEQ ID NO: 447718 - RNA, 32 nt, Human
gcuggguucccacucccggccuaggcaccucc

SEQ ID NO: 447719 - RNA, 32 nt, Human
gcuggguugaaguucgagugaagauuaaacug

SEQ ID NO: 447720 - RNA, 32 nt, Human
gcuggguugccagaaaagaugguggccuaguc

SEQ ID NO: 447721 - RNA, 32 nt, Human
gcuggguuggggacccagggaacaucggucua

SEQ ID NO: 447722 - RNA, 32 nt, Human
gcuggguuguccaggguguccucagucucuau

SEQ ID NO: 447723 - RNA, 32 nt, Human
gcuggguuugcucucccgcuguugccaggggc

SEQ ID NO: 447724 - RNA, 32 nt, Human
gcugguaaccccacucccucugcugcagcacc

SEQ ID NO: 447725 - RNA, 32 nt, Human
gcugguaaccuuucugcuauuuccuugaccuc

SEQ ID NO: 447726 - RNA, 32 nt, Human
gcugguaagcaugugcaugcucugccuuucuu

SEQ ID NO: 447727 - RNA, 32 nt, Human
gcugguaaugauguauaccuggcagcugaccg

SEQ ID NO: 447728 - RNA, 32 nt, Human
gcugguaccauccugguagaagagcccucuga

SEQ ID NO: 447729 - RNA, 32 nt, Human
gcugguacggguggaaugggggugagacacca

SEQ ID NO: 447730 - RNA, 32 nt, Human
gcugguacugggugggcaccugggagccacag

SEQ ID NO: 447731 - RNA, 32 nt, Human
gcugguagcugaggggacgggcaagugagagg

SEQ ID NO: 447732 - RNA, 32 nt, Human
gcugguaguaaggaggccaguuuggaggcagg

SEQ ID NO: 447733 - RNA, 32 nt, Human
gcugguaugagacucccugggaccuagaggcu

SEQ ID NO: 447734 - RNA, 32 nt, Human
gcugguauuauuauguucuuagcaauaaaugc

SEQ ID NO: 447735 - RNA, 32 nt, Human
gcuggucaacacagagagaugagcuucagggg

SEQ ID NO: 447736 - RNA, 32 nt, Human
gcuggucacagagucuccugggcacagguuau

SEQ ID NO: 447737 - RNA, 32 nt, Human
gcuggucaccccaagaucuacuuauacaugaa

SEQ ID NO: 447738 - RNA, 24 nt, Human
gcuggucacgaacuccugggcuca

SEQ ID NO: 447739 - RNA, 32 nt, Human
gcuggucagacccagagguugucaggagguca

SEQ ID NO: 447740 - RNA, 32 nt, Human
gcugguccagcaccugcucucaccaugaccuc

SEQ ID NO: 447741 - RNA, 32 nt, Human
gcugguccagugaugggcaagugacagaccuu

SEQ ID NO: 447742 - RNA, 32 nt, Human
gcugguccauccuccccacuccuggucagccu

SEQ ID NO: 447743 - RNA, 32 nt, Human
gcugguccaucuuuacccuucucugagcuaug

SEQ ID NO: 447744 - RNA, 32 nt, Human
gcugguccauuccccauucauggcacagagca

SEQ ID NO: 447745 - RNA, 32 nt, Human
gcuggucccaggcuggauugccguggcacaau

SEQ ID NO: 447746 - RNA, 32 nt, Human
gcugguccccagaaagcaggacagaaagaagg

SEQ ID NO: 447747 - RNA, 32 nt, Human
gcugguccccuccucugcuuuagccccggcaa

SEQ ID NO: 447748 - RNA, 24 nt, Human
gcuggucccugccucuggggcuuu

SEQ ID NO: 447749 - RNA, 32 nt, Human
gcugguccuccuggcccaggcugcaggagcca

SEQ ID NO: 447750 - RNA, 32 nt, Human
gcugguccugaacccagaucucuggcugagag

SEQ ID NO: 447751 - RNA, 24 nt, Human
gcugguccugaacuccugggcuca

SEQ ID NO: 447752 - RNA, 32 nt, Human
gcugguccugcaggaucccuggaguugcagcu

SEQ ID NO: 447753 - RNA, 24 nt, Human
gcuggucgcgaacuccugagcuca

SEQ ID NO: 447754 - RNA, 24 nt, Human
gcuggucgugaacuccugagcuca

SEQ ID NO: 447755 - RNA, 24 nt, Human
gcuggucgugaacuccugggcuca

SEQ ID NO: 447756 - RNA, 24 nt, Human
gcuggucuaaaacuccugaccuca

SEQ ID NO: 447757 - RNA, 22 nt, Human
gcuggucuagaacucaaccuca

SEQ ID NO: 447758 - RNA, 32 nt, Human
gcuggucuagaacuucuggucucaagcaaucu

SEQ ID NO: 447759 - RNA, 32 nt, Human
gcuggucuauuuuacccugugacauuuaaaua

SEQ ID NO: 447760 - RNA, 32 nt, Human
gcuggucucaaaacuccugaccucaggugaug

SEQ ID NO: 447761 - RNA, 32 nt, Human
gcuggucucaaaacuccugagcucaagugauc

SEQ ID NO: 447762 - RNA, 24 nt, Human
gcuggucucaaaccccugggcuca

SEQ ID NO: 447763 - RNA, 24 nt, Human
gcuggucucaaacuccuaggcuca

SEQ ID NO: 447764 - RNA, 24 nt, Human
gcuggucucaaacuccuccacuca

SEQ ID NO: 447765 - RNA, 24 nt, Human
gcuggucucaaacuccugaacuca

SEQ ID NO: 447766 - RNA, 21 nt, Human
gcuggucucaaacuccugacc

SEQ ID NO: 447767 - RNA, 24 nt, Human
gcuggucucaaacuccugagcuca

SEQ ID NO: 447768 - RNA, 24 nt, Human
gcuggucucaaacuccugcucuca

SEQ ID NO: 447769 - RNA, 24 nt, Human
gcuggucucaaacuccuggacuca

SEQ ID NO: 447770 - RNA, 24 nt, Human
gcuggucucaaacuccugggcuca

SEQ ID NO: 447771 - RNA, 24 nt, Human
gcuggucucaaacucgugugccca

SEQ ID NO: 447772 - RNA, 24 nt, Human
gcuggucucaaccuccugggcuca

SEQ ID NO: 447773 - RNA, 32 nt, Human
gcuggucucaacuccugaccucaggugaucca

SEQ ID NO: 447774 - RNA, 23 nt, Human
gcuggucucaacuccugggcuca

SEQ ID NO: 447775 - RNA, 24 nt, Human
gcuggucucaaucuccugggccca

SEQ ID NO: 447776 - RNA, 24 nt, Human
gcuggucucaggcuccugggcuca

SEQ ID NO: 447777 - RNA, 24 nt, Human
gcuggucuccaacuccugagcuca

SEQ ID NO: 447778 - RNA, 24 nt, Human
gcuggucuccaacuccugcccuca

SEQ ID NO: 447779 - RNA, 24 nt, Human
gcuggucuccaacuccuggacuca

SEQ ID NO: 447780 - RNA, 24 nt, Human
gcuggucuccaacuccugggcuca

SEQ ID NO: 447781 - RNA, 20 nt, Human
gcuggucuccagccagguga

SEQ ID NO: 447782 - RNA, 32 nt, Human
gcuggucuccgcaugagagaaaagccaccucc

SEQ ID NO: 447783 - RNA, 24 nt, Human
gcuggucucgaaccccugagcuca

SEQ ID NO: 447784 - RNA, 23 nt, Human
gcuggucucgaacucccaccuca

SEQ ID NO: 447785 - RNA, 24 nt, Human
gcuggucucgaacuccugaacuca

SEQ ID NO: 447786 - RNA, 24 nt, Human
gcuggucucgaacuccugagcuca

SEQ ID NO: 447787 - RNA, 24 nt, Human
gcuggucucgaacuccugcccuca

SEQ ID NO: 447788 - RNA, 24 nt, Human
gcuggucucgaacuccuggacuca

SEQ ID NO: 447789 - RNA, 24 nt, Human
gcuggucucgaacuccugggcuca

SEQ ID NO: 447790 - RNA, 24 nt, Human
gcuggucucgaacuccuguccuca

SEQ ID NO: 447791 - RNA, 32 nt, Human
gcuggucucgacuccugaccucaggugaucca

SEQ ID NO: 447792 - RNA, 32 nt, Human
gcuggucucggaacuccugacugcaggugauc

SEQ ID NO: 447793 - RNA, 24 nt, Human
gcuggucucggacuccugggcuca

SEQ ID NO: 447794 - RNA, 24 nt, Human
gcuggucucuaacuccugggcuca

SEQ ID NO: 447795 - RNA, 24 nt, Human
gcuggucugaaacucccaacuuca

SEQ ID NO: 447796 - RNA, 24 nt, Human
gcuggucugaagcugcugggcuca

SEQ ID NO: 447797 - RNA, 24 nt, Human
gcuggucugaaguucugggauguu

SEQ ID NO: 447798 - RNA, 24 nt, Human
gcuggucuggaacgccugaccuca

SEQ ID NO: 447799 - RNA, 24 nt, Human
gcuggucuggaacuccuaaccuca

SEQ ID NO: 447800 - RNA, 18 nt, Human
gcuggucuggaacuccug

SEQ ID NO: 447801 - RNA, 24 nt, Human
gcuggucuggaacuccugaccuca

SEQ ID NO: 447802 - RNA, 24 nt, Human
gcuggucuggaacuccugagcuca

SEQ ID NO: 447803 - RNA, 23 nt, Human
gcuggucuggaacuccuggccuc

SEQ ID NO: 447804 - RNA, 24 nt, Human
gcuggucuggccccuccugccuca

SEQ ID NO: 447805 - RNA, 32 nt, Human
gcuggucuggccuggccguguggugaugaggc

SEQ ID NO: 447806 - RNA, 21 nt, Human
gcuggucugggucucugccca

SEQ ID NO: 447807 - RNA, 24 nt, Human
gcuggucuuaaacuccugggcuca

SEQ ID NO: 447808 - RNA, 32 nt, Human
gcuggucuuccuagaaguaccugcuggguucu

SEQ ID NO: 447809 - RNA, 24 nt, Human
gcuggucuugaacucccgggcuca

SEQ ID NO: 447810 - RNA, 32 nt, Human
gcuggucuugaacuccuaaccucgggugaucc

SEQ ID NO: 447811 - RNA, 24 nt, Human
gcuggucuugaacuccuagacuca

SEQ ID NO: 447812 - RNA, 24 nt, Human
gcuggucuugaacuccuaggcuca

SEQ ID NO: 447813 - RNA, 24 nt, Human
gcuggucuugaacuccugaacuca

SEQ ID NO: 447814 - RNA, 24 nt, Human
gcuggucuugaacuccugagcuca

SEQ ID NO: 447815 - RNA, 24 nt, Human
gcuggucuugaacuccuggacuca

SEQ ID NO: 447816 - RNA, 32 nt, Human
gcuggucuugaacuccuggcuucgggugaucc

SEQ ID NO: 447817 - RNA, 24 nt, Human
gcuggucuugaacuccugggcuca

SEQ ID NO: 447818 - RNA, 24 nt, Human
gcuggucuugaacuccugugcuca

SEQ ID NO: 447819 - RNA, 26 nt, Human
gcuggucuugagaacuccugggcuca

SEQ ID NO: 447820 - RNA, 32 nt, Human
gcuggucuugagaacuccugggcucaaguggu

SEQ ID NO: 447821 - RNA, 24 nt, Human
gcuggucuugagcuccugagcuca

SEQ ID NO: 447822 - RNA, 32 nt, Human
gcuggucuugcacuccugaccucacgugaucu

SEQ ID NO: 447823 - RNA, 32 nt, Human
gcuggucuugugaacuccuggccucaggugau

SEQ ID NO: 447824 - RNA, 32 nt, Human
gcuggucuuuauuccucccucaugagcacagg

SEQ ID NO: 447825 - RNA, 23 nt, Human
gcuggucuuuggccuggugcuca

SEQ ID NO: 447826 - RNA, 32 nt, Human
gcuggugaaagcuuccuuugcuccaauaagcu

SEQ ID NO: 447827 - RNA, 32 nt, Human
gcuggugaacagcucagcagacaacaugcugg

SEQ ID NO: 447828 - RNA, 32 nt, Human
gcuggugaaggguuuccucuccuccaccaugg

SEQ ID NO: 447829 - RNA, 32 nt, Human
gcuggugaauggcaggugugugccucaguguc

SEQ ID NO: 447830 - RNA, 22 nt, Human
gcuggugaccgccacagccccg

SEQ ID NO: 447831 - RNA, 32 nt, Human
gcuggugacucugugugaacuggccuuuggga

SEQ ID NO: 447832 - RNA, 32 nt, Human
gcuggugagaggaggaguuagagcuggucguu

SEQ ID NO: 447833 - RNA, 23 nt, Human
gcuggugauugaggggcccgggc

SEQ ID NO: 447834 - RNA, 22 nt, Human
gcuggugcagagauggaggaag

SEQ ID NO: 447835 - RNA, 32 nt, Human
gcuggugcagccacccucgcucccucugcucu

SEQ ID NO: 447836 - RNA, 32 nt, Human
gcuggugccagaauaacacagacucagcugcc

SEQ ID NO: 447837 - RNA, 17 nt, Human
gcuggugccagcagggg

SEQ ID NO: 447838 - RNA, 32 nt, Human
gcuggugccagccuguuaccuguucucacuga

SEQ ID NO: 447839 - RNA, 20 nt, Human
gcuggugccagccuucuccc

SEQ ID NO: 447840 - RNA, 32 nt, Human
gcuggugcccuauuuccagccaccccagcagc

SEQ ID NO: 447841 - RNA, 21 nt, Human
gcuggugcccugagcgacaga

SEQ ID NO: 447842 - RNA, 18 nt, Human
gcuggugcccugcagcug

SEQ ID NO: 447843 - RNA, 32 nt, Human
gcuggugcccugcuuucagauacuggauugua

SEQ ID NO: 447844 - RNA, 32 nt, Human
gcuggugccgggaggguggagguagauguacc

SEQ ID NO: 447845 - RNA, 32 nt, Human
gcuggugccuccaguauuugguauacagaagg

SEQ ID NO: 447846 - RNA, 32 nt, Human
gcuggugccuggccuuccuggaauggugggug

SEQ ID NO: 447847 - RNA, 32 nt, Human
gcuggugcucaggccggccuguccugggccca

SEQ ID NO: 447848 - RNA, 32 nt, Human
gcuggugcuccaggcuggcggcgcucaccuuu

SEQ ID NO: 447849 - RNA, 24 nt, Human
gcuggugcucuccuccugugccca

SEQ ID NO: 447850 - RNA, 32 nt, Human
gcuggugcugcugcucgucauccuggccagga

SEQ ID NO: 447851 - RNA, 24 nt, Human
gcugguggacagaaggcacugcag

SEQ ID NO: 447852 - RNA, 32 nt, Human
gcugguggagccaagacaaggugcaggcagug

SEQ ID NO: 447853 - RNA, 32 nt, Human
gcugguggagccagacagagcaggugcgggga

SEQ ID NO: 447854 - RNA, 32 nt, Human
gcugguggagcuuuguaaggauucucugcagg

SEQ ID NO: 447855 - RNA, 32 nt, Human
gcugguggcccagguccugcugcucauuaguu

SEQ ID NO: 447856 - RNA, 20 nt, Human
gcugguggccuuggccggcu

SEQ ID NO: 447857 - RNA, 32 nt, Human
gcugguggcgaagcggcucaggagaaccgggg

SEQ ID NO: 447858 - RNA, 32 nt, Human
gcugguggcugcagcuggggugaggcgcgagg

SEQ ID NO: 447859 - RNA, 32 nt, Human
gcugguggcugccagcccuggggcccggcaca

SEQ ID NO: 447860 - RNA, 32 nt, Human
gcugguggcugggaggggagccuggcugcccu

SEQ ID NO: 447861 - RNA, 32 nt, Human
gcugguggcuucugaauuugguauuugaacua

SEQ ID NO: 447862 - RNA, 32 nt, Human
gcuggugggaaagaguuuguuuuuggggccua

SEQ ID NO: 447863 - RNA, 20 nt, Human
gcuggugggaacaggggcgu

SEQ ID NO: 447864 - RNA, 32 nt, Human
gcuggugggcacacagggagggggaggucagg

SEQ ID NO: 447865 - RNA, 32 nt, Human
gcuggugggcaggaagguaaaggggagaccau

SEQ ID NO: 447866 - RNA, 32 nt, Human
gcuggugggcaggccacugcugggacaggguc

SEQ ID NO: 447867 - RNA, 19 nt, Human
gcuggugggcagggggcug

SEQ ID NO: 447868 - RNA, 18 nt, Human
gcuggugggcaguggguu

SEQ ID NO: 447869 - RNA, 32 nt, Human
gcuggugggguggaggaugcugaguggugggu

SEQ ID NO: 447870 - RNA, 32 nt, Human
gcuggugggguuucaagacaugguucagcauc

SEQ ID NO: 447871 - RNA, 32 nt, Human
gcuggugguccaccacccucaggaugaggucc

SEQ ID NO: 447872 - RNA, 32 nt, Human
gcugguggucgggagagcggcggcagcgagag

SEQ ID NO: 447873 - RNA, 32 nt, Human
gcuggugguggagucauggcugcaggccaggg

SEQ ID NO: 447874 - RNA, 32 nt, Human
gcuggugguggcuucagcggaggcaggccggg

SEQ ID NO: 447875 - RNA, 32 nt, Human
gcuggugguggcuucgggcucaugcccagaca

SEQ ID NO: 447876 - RNA, 32 nt, Human
gcuggugguguggcuguaggggaggggagacc

SEQ ID NO: 447877 - RNA, 32 nt, Human
gcuggugguuuuucagcucccuucccuugaga

SEQ ID NO: 447878 - RNA, 32 nt, Human
gcugguguauagcacugcuacugauaugugua

SEQ ID NO: 447879 - RNA, 24 nt, Human
gcuggugucaaacuccugggcuca

SEQ ID NO: 447880 - RNA, 32 nt, Human
gcugguguccccgugugucuuucaugggacug

SEQ ID NO: 447881 - RNA, 29 nt, Human
gcugguguccguggcgugccuggguggaa

SEQ ID NO: 447882 - RNA, 24 nt, Human
gcuggugucgaacuccugggcuca

SEQ ID NO: 447883 - RNA, 32 nt, Human
gcuggugucuguaaucccagcugugggagguu

SEQ ID NO: 447884 - RNA, 32 nt, Human
gcuggugucuucauccagaagggacaguuugu

SEQ ID NO: 447885 - RNA, 32 nt, Human
gcuggugugcaggggugcggucaugggcucau

SEQ ID NO: 447886 - RNA, 32 nt, Human
gcuggugugcugcuuaguuugcuguggguuuu

SEQ ID NO: 447887 - RNA, 24 nt, Human
gcugguguggaacuccugaacuca

SEQ ID NO: 447888 - RNA, 32 nt, Human
gcuggugugguggcuuaugccuguaaucccac

SEQ ID NO: 447889 - RNA, 32 nt, Human
gcugguguuaaauaucagcuccuaauaagaug

SEQ ID NO: 447890 - RNA, 32 nt, Human
gcugguguugggcccggagcagcaucuuccgg

SEQ ID NO: 447891 - RNA, 32 nt, Human
gcugguguuuuuccugccuaggcggagacacc

SEQ ID NO: 447892 - RNA, 32 nt, Human
gcugguuaaagaaccauccggaucgcagcgcg

SEQ ID NO: 447893 - RNA, 32 nt, Human
gcugguuacacgugucucucacaccacauuuc

SEQ ID NO: 447894 - RNA, 32 nt, Human
gcugguuacuguacgcaaguugagugccagac

SEQ ID NO: 447895 - RNA, 32 nt, Human
gcugguucaggugcccuggagggaaggggaag

SEQ ID NO: 447896 - RNA, 32 nt, Human
gcugguucauuuucuuuucuucucuuuucuuu

SEQ ID NO: 447897 - RNA, 32 nt, Human
gcugguuccaacuguuuaaucccuucugucuu

SEQ ID NO: 447898 - RNA, 32 nt, Human
gcugguucccaagcucgcacagaaggugauaa

SEQ ID NO: 447899 - RNA, 32 nt, Human
gcugguucccagaggauugucuacccugaagu

SEQ ID NO: 447900 - RNA, 19 nt, Human
gcugguucccaggcugcug

SEQ ID NO: 447901 - RNA, 32 nt, Human
gcugguuccuucagaccccuaacccuacuaac

SEQ ID NO: 447902 - RNA, 32 nt, Human
gcugguucuccaggaagcagacaccucucacu

SEQ ID NO: 447903 - RNA, 32 nt, Human
gcugguucuccagggcugcagucucuccaggu

SEQ ID NO: 447904 - RNA, 24 nt, Human
gcugguucugaacuccugggcuca

SEQ ID NO: 447905 - RNA, 32 nt, Human
gcugguucugcuggugccucugccccuggcuu

SEQ ID NO: 447906 - RNA, 32 nt, Human
gcugguugaagugcuuucugucuagugagggg

SEQ ID NO: 447907 - RNA, 32 nt, Human
gcugguugccaacgugucaaccagccuguguu

SEQ ID NO: 447908 - RNA, 22 nt, Human
gcugguugccggcgcccgcccg

SEQ ID NO: 447909 - RNA, 21 nt, Human
gcugguugcuugaacugacag

SEQ ID NO: 447910 - RNA, 24 nt, Human
gcugguuggcgacuguucuuucca

SEQ ID NO: 447911 - RNA, 32 nt, Human
gcugguuggugcugcccugccucucgugccgg

SEQ ID NO: 447912 - RNA, 30 nt, Human
gcugguugguuuuuccugcuccugggguaa

SEQ ID NO: 447913 - RNA, 32 nt, Human
gcugguuguugcuaagguugcugccaugguaa

SEQ ID NO: 447914 - RNA, 24 nt, Human
gcugguuuaaaacuccugagcuca

SEQ ID NO: 447915 - RNA, 24 nt, Human
gcugguuugaacuccuacaacuca

SEQ ID NO: 447916 - RNA, 32 nt, Human
gcugguuuggaguaaaauauaaaagagcuugu

SEQ ID NO: 447917 - RNA, 32 nt, Human
gcugguuuggggaguggugagguagggguggg

SEQ ID NO: 447918 - RNA, 32 nt, Human
gcugguuuggugcggugaguccugccccggcu

SEQ ID NO: 447919 - RNA, 24 nt, Human
gcugguuuuucccacaugggcuuu

SEQ ID NO: 447920 - RNA, 32 nt, Human
gcuguaaaaccaaagaccagaagucagauaua

SEQ ID NO: 447921 - RNA, 32 nt, Human
gcuguaaacuacugcaacccucacauccucaa

SEQ ID NO: 447922 - RNA, 32 nt, Human
gcuguaacacaaacagggcugcaacaugcccc

SEQ ID NO: 447923 - RNA, 32 nt, Human
gcuguaaccaugguacucaguccuuccaaagu

SEQ ID NO: 447924 - RNA, 32 nt, Human
gcuguaacuacuguuucagaauguugcugcug

SEQ ID NO: 447925 - RNA, 32 nt, Human
gcuguaacuggaagcaacacuccuggguaaaa

SEQ ID NO: 447926 - RNA, 32 nt, Human
gcuguaagaaaaggucuagaaauaggugaaag

SEQ ID NO: 447927 - RNA, 32 nt, Human
gcuguaagaagagacugggaagauaggcucug

SEQ ID NO: 447928 - RNA, 32 nt, Human
gcuguaagacuuggugggcggggugggguggg

SEQ ID NO: 447929 - RNA, 32 nt, Human
gcuguaagagcaucagauuugaaacauaucug

SEQ ID NO: 447930 - RNA, 32 nt, Human
gcuguaagagcucauuuuggaggaauaaugga

SEQ ID NO: 447931 - RNA, 32 nt, Human
gcuguaagauagucaaccacaguagucaccua

SEQ ID NO: 447932 - RNA, 32 nt, Human
gcuguaagcauucugagcugggcuuguuguuu

SEQ ID NO: 447933 - RNA, 22 nt, Human
gcuguaagcugccugccgggcc

SEQ ID NO: 447934 - RNA, 32 nt, Human
gcuguaaggagagguuggaagugaagaugaug

SEQ ID NO: 447935 - RNA, 32 nt, Human
gcuguaaucccagcuacuugggaggcugaggc

SEQ ID NO: 447936 - RNA, 32 nt, Human
gcuguaauccuagcuacucgggaggcugaggc

SEQ ID NO: 447937 - RNA, 32 nt, Human
gcuguaauccuggcuacucaggaggccgaggc

SEQ ID NO: 447938 - RNA, 32 nt, Human
gcuguaaucgagcucccgccaucccaggugcu

SEQ ID NO: 447939 - RNA, 32 nt, Human
gcuguaaucugcaaacucugggaggcugaggu

SEQ ID NO: 447940 - RNA, 32 nt, Human
gcuguaauggaugaacaugccacccagcuccc

SEQ ID NO: 447941 - RNA, 32 nt, Human
gcuguaauggcauuuaaagcaaacaaacaaac

SEQ ID NO: 447942 - RNA, 32 nt, Human
gcuguaauuuaacccagagcagcuccacguga

SEQ ID NO: 447943 - RNA, 32 nt, Human
gcuguacaacgucaggauucagagguaggcuc

SEQ ID NO: 447944 - RNA, 32 nt, Human
gcuguacacagaugcuacagacuuguacuaac

SEQ ID NO: 447945 - RNA, 32 nt, Human
gcuguacacagcagaucaguacuguucaacag

SEQ ID NO: 447946 - RNA, 32 nt, Human
gcuguacacccaaggauucuguucugcaacuc

SEQ ID NO: 447947 - RNA, 32 nt, Human
gcuguacagaagcacuuuucauggacagaaau

SEQ ID NO: 447948 - RNA, 32 nt, Human
gcuguacaggcagagacccaggggagggagcu

SEQ ID NO: 447949 - RNA, 31 nt, Human
gcuguacauacuuuuuggguuuauuuggaaa

SEQ ID NO: 447950 - RNA, 32 nt, Human
gcuguacaucuagccaccccagccuggccacg

SEQ ID NO: 447951 - RNA, 32 nt, Human
gcuguacccacugucuaaccaaucccaaugag

SEQ ID NO: 447952 - RNA, 32 nt, Human
gcuguacccaggaauggagccugcacggugaa

SEQ ID NO: 447953 - RNA, 17 nt, Human
gcuguacccccaggguc

SEQ ID NO: 447954 - RNA, 32 nt, Human
gcuguaccccuaccccugccuccccgaagccu

SEQ ID NO: 447955 - RNA, 20 nt, Human
gcuguaccugagauuaggag

SEQ ID NO: 447956 - RNA, 32 nt, Human
gcuguaccuggauccugcuccucuggguugaa

SEQ ID NO: 447957 - RNA, 32 nt, Human
gcuguacgcaggccggccuccaccuccagagg

SEQ ID NO: 447958 - RNA, 32 nt, Human
gcuguacugccaggcugcgaugcgugcuggcc

SEQ ID NO: 447959 - RNA, 16 nt, Human
gcuguacuggguccag

SEQ ID NO: 447960 - RNA, 32 nt, Human
gcuguacuuuccagaucuucuaugugacacaa

SEQ ID NO: 447961 - RNA, 32 nt, Human
gcuguagacaucuguccuacacuugagaugau

SEQ ID NO: 447962 - RNA, 21 nt, Human
gcuguagacuugcugcugcug

SEQ ID NO: 447963 - RNA, 32 nt, Human
gcuguagagagggacagaaggggcgguucagc

SEQ ID NO: 447964 - RNA, 32 nt, Human
gcuguagagcaucugaccccuuauuaccaccu

SEQ ID NO: 447965 - RNA, 32 nt, Human
gcuguagaggggcagaugugguuugaacccag

SEQ ID NO: 447966 - RNA, 32 nt, Human
gcuguagaguuggcgggccaggagggcaguug

SEQ ID NO: 447967 - RNA, 32 nt, Human
gcuguagauaaacugguuauccuaaaaucaug

SEQ ID NO: 447968 - RNA, 32 nt, Human
gcuguagauggacaagcuugauuguuggaacc

SEQ ID NO: 447969 - RNA, 32 nt, Human
gcuguagcaaacaauuucuagauacuagaagc

SEQ ID NO: 447970 - RNA, 29 nt, Human
gcuguagcaaaucucagguaagaagagaa

SEQ ID NO: 447971 - RNA, 32 nt, Human
gcuguagcaccuggguacgcucagggagcaaa

SEQ ID NO: 447972 - RNA, 32 nt, Human
gcuguagccaauagccaugcaggacugguuca

SEQ ID NO: 447973 - RNA, 22 nt, Human
gcuguagccagccggagccaga

SEQ ID NO: 447974 - RNA, 20 nt, Human
gcuguagccauauggaacuc

SEQ ID NO: 447975 - RNA, 32 nt, Human
gcuguagcccaagaggaagaggucacuggggc

SEQ ID NO: 447976 - RNA, 25 nt, Human
gcuguagccccagggacccagggca

SEQ ID NO: 447977 - RNA, 32 nt, Human
gcuguagccuggugaagaccaccugggccgga

SEQ ID NO: 447978 - RNA, 22 nt, Human
gcuguagcucccgagcuacucu

SEQ ID NO: 447979 - RNA, 23 nt, Human
gcuguagcucugggccuggaacu

SEQ ID NO: 447980 - RNA, 19 nt, Human
gcuguagcugugcuggugg

SEQ ID NO: 447981 - RNA, 32 nt, Human
gcuguagcuuaagacaaggcaauaccugagau

SEQ ID NO: 447982 - RNA, 23 nt, Human
gcuguagcuuccaggcuggccuc

SEQ ID NO: 447983 - RNA, 32 nt, Human
gcuguaggaggaggcagggauuccaggguguc

SEQ ID NO: 447984 - RNA, 32 nt, Human
gcuguaggauauuuuugggaaauaaauccaaa

SEQ ID NO: 447985 - RNA, 32 nt, Human
gcuguaggcacuugggcugacugccugcagaa

SEQ ID NO: 447986 - RNA, 32 nt, Human
gcuguagggggcaccugucuggcuccgggccc

SEQ ID NO: 447987 - RNA, 32 nt, Human
gcuguagguaucugugugugcaccuugaagaa

SEQ ID NO: 447988 - RNA, 32 nt, Human
gcuguagguccugaggccagggauuuuuaauu

SEQ ID NO: 447989 - RNA, 32 nt, Human
gcuguagguggcucccucccaccccaacgauu

SEQ ID NO: 447990 - RNA, 32 nt, Human
gcuguagucagcguuauguaugccauugacuc

SEQ ID NO: 447991 - RNA, 32 nt, Human
gcuguagucccagcuacucgggaggcugaggc

SEQ ID NO: 447992 - RNA, 32 nt, Human
gcuguagucccagcuacuuuggaggcugaggc

SEQ ID NO: 447993 - RNA, 32 nt, Human
gcuguagucgcagcuacucaggaggcugaggc

SEQ ID NO: 447994 - RNA, 32 nt, Human
gcuguagucuuagcuacucaggaggcugaagc

SEQ ID NO: 447995 - RNA, 32 nt, Human
gcuguagugagcugucauugugccacuauccu

SEQ ID NO: 447996 - RNA, 32 nt, Human
gcuguaguuagcaaaauuggcauccucuuuag

SEQ ID NO: 447997 - RNA, 31 nt, Human
gcuguauauuuuuuguagaugcucuuuauua

SEQ ID NO: 447998 - RNA, 32 nt, Human
gcuguaucccacacaaaacacgcacacagagc

SEQ ID NO: 447999 - RNA, 32 nt, Human
gcuguaucuucccagggcuccgccaagcaccg

SEQ ID NO: 448000 - RNA, 32 nt, Human
gcuguaugauacaaagugauuuauucacaacc

SEQ ID NO: 448001 - RNA, 32 nt, Human
gcuguauggcccagagaggagcucaugugucu

SEQ ID NO: 448002 - RNA, 32 nt, Human
gcuguaugggcucucuuccuccuuccaccgug

SEQ ID NO: 448003 - RNA, 29 nt, Human
gcuguaugucugugugagacuggauuuuc

SEQ ID NO: 448004 - RNA, 31 nt, Human
gcuguauucaauaaaucuguuuggaggaaaa

SEQ ID NO: 448005 - RNA, 32 nt, Human
gcuguauucauggauucagccaaccauggcug

SEQ ID NO: 448006 - RNA, 32 nt, Human
gcuguauucucuucucuucggggaagcacaag

SEQ ID NO: 448007 - RNA, 32 nt, Human
gcuguauucugacuuugaagccuguuaagagg

SEQ ID NO: 448008 - RNA, 32 nt, Human
gcuguauucuucacagcaacagagcucaguua

SEQ ID NO: 448009 - RNA, 32 nt, Human
gcuguauugccagacuggagugcaguggcgug

SEQ ID NO: 448010 - RNA, 32 nt, Human
gcuguauugcccaggcuggagugcaguggcgc

SEQ ID NO: 448011 - RNA, 32 nt, Human
gcuguauugcccaggcuggagugugguggcac

SEQ ID NO: 448012 - RNA, 32 nt, Human
gcuguauuggcuacuccagaaaguaggaguaa

SEQ ID NO: 448013 - RNA, 32 nt, Human
gcuguauuguuuauugcugguuuaugaccuua

SEQ ID NO: 448014 - RNA, 21 nt, Human
gcuguauuuaucucugaggca

SEQ ID NO: 448015 - RNA, 32 nt, Human
gcuguauuucccaggcuggagugcagaggcac

SEQ ID NO: 448016 - RNA, 32 nt, Human
gcuguauuugugaauugugcugguuuccuggg

SEQ ID NO: 448017 - RNA, 32 nt, Human
gcugucaaauccuuuagaugcuucuggguucc

SEQ ID NO: 448018 - RNA, 32 nt, Human
gcugucaacagaguggaggucucaguggggaa

SEQ ID NO: 448019 - RNA, 32 nt, Human
gcugucaaccauuggucauccuuugucagacu

SEQ ID NO: 448020 - RNA, 32 nt, Human
gcugucaacuccugccuccaccuggggucacc

SEQ ID NO: 448021 - RNA, 17 nt, Human
gcugucaagagggugua

SEQ ID NO: 448022 - RNA, 27 nt, Human
gcugucaagcaauggauaaacagcucu

SEQ ID NO: 448023 - RNA, 32 nt, Human
gcugucaagucgcugagaagcugcugugacuc

SEQ ID NO: 448024 - RNA, 32 nt, Human
gcugucaaugcuguguugucaugugccacuuc

SEQ ID NO: 448025 - RNA, 21 nt, Human
gcugucacaauuauuaccauc

SEQ ID NO: 448026 - RNA, 15 nt, Human
gcugucacagaugac

SEQ ID NO: 448027 - RNA, 15 nt, Human
gcugucacagauggc

SEQ ID NO: 448028 - RNA, 32 nt, Human
gcugucacagcccugagagucaggguggagau

SEQ ID NO: 448029 - RNA, 19 nt, Human
gcugucaccacccugguag

SEQ ID NO: 448030 - RNA, 32 nt, Human
gcugucaccaggcuggagugcaguggcgcgau

SEQ ID NO: 448031 - RNA, 25 nt, Human
gcugucacccaggcuggagugcagu

SEQ ID NO: 448032 - RNA, 32 nt, Human
gcugucaccugcaauucucccuuaucagggcc

SEQ ID NO: 448033 - RNA, 32 nt, Human
gcugucaccuggucuugcccagaagagccguu

SEQ ID NO: 448034 - RNA, 32 nt, Human
gcugucaccuuccaccccacaaggccaaccuu

SEQ ID NO: 448035 - RNA, 32 nt, Human
gcugucaccuucuguugacaacagucaguagc

SEQ ID NO: 448036 - RNA, 32 nt, Human
gcugucacucucgcucuccucuugcuugaaca

SEQ ID NO: 448037 - RNA, 32 nt, Human
gcugucacuguagcugcucccguagggucguu

SEQ ID NO: 448038 - RNA, 23 nt, Human
gcugucacuucuuuuggcuugug

SEQ ID NO: 448039 - RNA, 32 nt, Human
gcugucagaauaugcauccacagagaugagcc

SEQ ID NO: 448040 - RNA, 32 nt, Human
gcugucagagguacaggagcugggagagucca

SEQ ID NO: 448041 - RNA, 32 nt, Human
gcugucagcagcacuguguuccaggcucuugu

SEQ ID NO: 448042 - RNA, 32 nt, Human
gcugucagccauuccuguucccaugagaugau

SEQ ID NO: 448043 - RNA, 32 nt, Human
gcugucagcccugaaaaacacacaggucagac

SEQ ID NO: 448044 - RNA, 32 nt, Human
gcugucagcugauucccgggguugguggcagc

SEQ ID NO: 448045 - RNA, 30 nt, Human
gcugucagcuugcagcccggggacagaggc

SEQ ID NO: 448046 - RNA, 32 nt, Human
gcugucaggaaggagaaagguucuuucuggcu

SEQ ID NO: 448047 - RNA, 21 nt, Human
gcugucaggacagcgcgggga

SEQ ID NO: 448048 - RNA, 32 nt, Human
gcugucaggagagaggugcagggaggaaggcc

SEQ ID NO: 448049 - RNA, 32 nt, Human
gcugucaggagagauggcugaaaaggugauca

SEQ ID NO: 448050 - RNA, 21 nt, Human
gcugucaggccacgcugguga

SEQ ID NO: 448051 - RNA, 32 nt, Human
gcugucaggccacggccgcuuggggcuuggcu

SEQ ID NO: 448052 - RNA, 23 nt, Human
gcugucaggccuggugaagggug

SEQ ID NO: 448053 - RNA, 22 nt, Human
gcugucagggccugcgguguga

SEQ ID NO: 448054 - RNA, 32 nt, Human
gcugucagguaccggccauggugcagguggga

SEQ ID NO: 448055 - RNA, 32 nt, Human
gcugucaggucaccagugagcagaucaaagcc

SEQ ID NO: 448056 - RNA, 32 nt, Human
gcugucagugccuccccacuuccaagcagaaa

SEQ ID NO: 448057 - RNA, 32 nt, Human
gcugucaucuauggguggccacugugaccuac

SEQ ID NO: 448058 - RNA, 32 nt, Human
gcugucaugaggcacagugacaagggccagga

SEQ ID NO: 448059 - RNA, 32 nt, Human
gcugucaugcaccaugagacaaagcccaagcu

SEQ ID NO: 448060 - RNA, 32 nt, Human
gcugucauggccucaccuggagcggaggggac

SEQ ID NO: 448061 - RNA, 32 nt, Human
gcugucaugguccuuugcagagcugcugcuuu

SEQ ID NO: 448062 - RNA, 32 nt, Human
gcugucauucugcugguggcuuccugcgucuu

SEQ ID NO: 448063 - RNA, 32 nt, Human
gcuguccaaagacaaugggguuuucuuccugu

SEQ ID NO: 448064 - RNA, 32 nt, Human
gcuguccaacagggguugggaggggcauuuug

SEQ ID NO: 448065 - RNA, 32 nt, Human
gcuguccaauggaggcccuccgugcuaguacg

SEQ ID NO: 448066 - RNA, 32 nt, Human
gcuguccacaucuggcuuuugugggacucaga

SEQ ID NO: 448067 - RNA, 18 nt, Human
gcuguccaccaggcagcu

SEQ ID NO: 448068 - RNA, 32 nt, Human
gcuguccacucccugccugccugcccgcaucu

SEQ ID NO: 448069 - RNA, 32 nt, Human
gcuguccacugccaccacucgggcagugcuug

SEQ ID NO: 448070 - RNA, 19 nt, Human
gcuguccagagcccugccg

SEQ ID NO: 448071 - RNA, 20 nt, Human
gcuguccagccagccagcca

SEQ ID NO: 448072 - RNA, 32 nt, Human
gcuguccaucugcugaaggccaccuucaguuu

SEQ ID NO: 448073 - RNA, 32 nt, Human
gcuguccauucaauuccaaauacugguuuuaa

SEQ ID NO: 448074 - RNA, 32 nt, Human
gcuguccauuccagugguaagggagaggggac

SEQ ID NO: 448075 - RNA, 21 nt, Human
gcugucccaagcaauggguaa

SEQ ID NO: 448076 - RNA, 20 nt, Human
gcugucccaccaggcaguaa

SEQ ID NO: 448077 - RNA, 18 nt, Human
gcugucccacugugguaa

SEQ ID NO: 448078 - RNA, 32 nt, Human
gcugucccagaggggagggguugugugugcga

SEQ ID NO: 448079 - RNA, 20 nt, Human
gcugucccagauccuaguga

SEQ ID NO: 448080 - RNA, 32 nt, Human
gcugucccagcacuguggguucagauagcagc

SEQ ID NO: 448081 - RNA, 21 nt, Human
gcugucccaggcugccagcca

SEQ ID NO: 448082 - RNA, 32 nt, Human
gcugucccaugguguguucugccccucccacc

SEQ ID NO: 448083 - RNA, 32 nt, Human
gcuguccccagccugcacagcccaagcccagg

SEQ ID NO: 448084 - RNA, 32 nt, Human
gcuguccccaggcugcaguucuggucccuggu

SEQ ID NO: 448085 - RNA, 22 nt, Human
gcuguccccaguuuugccccaa

SEQ ID NO: 448086 - RNA, 32 nt, Human
gcuguccccauucucuccuuucaccaucucuc

SEQ ID NO: 448087 - RNA, 32 nt, Human
gcugucccccagagauggcagauccugaggua

SEQ ID NO: 448088 - RNA, 32 nt, Human
gcugucccccggggcuccuucugcaugacacu

SEQ ID NO: 448089 - RNA, 32 nt, Human
gcuguccccuagugagggacuguguugacuga

SEQ ID NO: 448090 - RNA, 32 nt, Human
gcuguccccucucccucaguccuuccugacug

SEQ ID NO: 448091 - RNA, 32 nt, Human
gcuguccccugacccagagccuaggggauccg

SEQ ID NO: 448092 - RNA, 32 nt, Human
gcuguccccugcccuccccuccccaacuaccc

SEQ ID NO: 448093 - RNA, 19 nt, Human
gcugucccgagcuagguga

SEQ ID NO: 448094 - RNA, 20 nt, Human
gcugucccgagcuaggugac

SEQ ID NO: 448095 - RNA, 32 nt, Human
gcugucccgagucuggacuuucccucugcccc

SEQ ID NO: 448096 - RNA, 19 nt, Human
gcugucccgcgggccccgg

SEQ ID NO: 448097 - RNA, 18 nt, Human
gcugucccggguguacca

SEQ ID NO: 448098 - RNA, 32 nt, Human
gcugucccucccccuuguccuuucccuucagu

SEQ ID NO: 448099 - RNA, 32 nt, Human
gcugucccucccccuugucuuucccuucagua

SEQ ID NO: 448100 - RNA, 18 nt, Human
gcugucccucccuuguaa

SEQ ID NO: 448101 - RNA, 32 nt, Human
gcugucccuccucuccccuuauguggcggggg

SEQ ID NO: 448102 - RNA, 21 nt, Human
gcugucccuccugccaaguaa

SEQ ID NO: 448103 - RNA, 32 nt, Human
gcugucccugcagggccaucugacugccaagc

SEQ ID NO: 448104 - RNA, 32 nt, Human
gcugucccuuucucuuugccccugaguugugu

SEQ ID NO: 448105 - RNA, 20 nt, Human
gcuguccgacgccugcccca

SEQ ID NO: 448106 - RNA, 18 nt, Human
gcuguccgaggugcucca

SEQ ID NO: 448107 - RNA, 20 nt, Human
gcuguccgcaaccuccgcca

SEQ ID NO: 448108 - RNA, 18 nt, Human
gcuguccgcagcuugcgc

SEQ ID NO: 448109 - RNA, 21 nt, Human
gcuguccgcaugcuccgggcc

SEQ ID NO: 448110 - RNA, 18 nt, Human
gcuguccgccagcccgcg

SEQ ID NO: 448111 - RNA, 20 nt, Human
gcuguccgccagcuacccgc

SEQ ID NO: 448112 - RNA, 19 nt, Human
gcuguccgccagugcauca

SEQ ID NO: 448113 - RNA, 18 nt, Human
gcuguccgccaugcccgc

SEQ ID NO: 448114 - RNA, 18 nt, Human
gcuguccgccaugccgcg

SEQ ID NO: 448115 - RNA, 18 nt, Human
gcuguccgccccccguca

SEQ ID NO: 448116 - RNA, 32 nt, Human
gcuguccgcccugccugccugccugugugguc

SEQ ID NO: 448117 - RNA, 20 nt, Human
gcuguccgccucagcuccca

SEQ ID NO: 448118 - RNA, 18 nt, Human
gcuguccgcggucgcgcc

SEQ ID NO: 448119 - RNA, 18 nt, Human
gcuguccgcuccugccca

SEQ ID NO: 448120 - RNA, 19 nt, Human
gcuguccgcuucagcacca

SEQ ID NO: 448121 - RNA, 32 nt, Human
gcuguccggcagcugcucuuuguccacccaaa

SEQ ID NO: 448122 - RNA, 32 nt, Human
gcuguccggcuggcagagccugacgugucucu

SEQ ID NO: 448123 - RNA, 18 nt, Human
gcuguccgucggcgccca

SEQ ID NO: 448124 - RNA, 21 nt, Human
gcuguccguggcggcuggugu

SEQ ID NO: 448125 - RNA, 32 nt, Human
gcuguccgugggagguggaggccgaggacauu

SEQ ID NO: 448126 - RNA, 18 nt, Human
gcuguccguucaggacca

SEQ ID NO: 448127 - RNA, 21 nt, Human
gcuguccuagcucccugguaa

SEQ ID NO: 448128 - RNA, 32 nt, Human
gcuguccucagaggaggaggaggaggaggcag

SEQ ID NO: 448129 - RNA, 32 nt, Human
gcuguccuccauccuccauucuguccaacucc

SEQ ID NO: 448130 - RNA, 32 nt, Human
gcuguccucccaggacaagccaaggauccaac

SEQ ID NO: 448131 - RNA, 32 nt, Human
gcuguccucccuucauuucuguggaccuugga

SEQ ID NO: 448132 - RNA, 32 nt, Human
gcuguccuccggcagcuggagauguccgagcc

SEQ ID NO: 448133 - RNA, 32 nt, Human
gcuguccuccuuuaccuuccucucuccucagc

SEQ ID NO: 448134 - RNA, 32 nt, Human
gcuguccucugauccccagcuuccuagggcuc

SEQ ID NO: 448135 - RNA, 32 nt, Human
gcuguccucuggccucagccuccugaguagcu

SEQ ID NO: 448136 - RNA, 32 nt, Human
gcuguccugaauugcuguaacaagcacacuau

SEQ ID NO: 448137 - RNA, 25 nt, Human
gcuguccugcacucuuucuugcaag

SEQ ID NO: 448138 - RNA, 21 nt, Human
gcuguccugcccagccuuccu

SEQ ID NO: 448139 - RNA, 18 nt, Human
gcuguccugcuccaguaa

SEQ ID NO: 448140 - RNA, 16 nt, Human
gcuguccugcuuuugc

SEQ ID NO: 448141 - RNA, 32 nt, Human
gcuguccuggagaaaguccuagagguuaucuc

SEQ ID NO: 448142 - RNA, 21 nt, Human
gcuguccugggggcugcgcua

SEQ ID NO: 448143 - RNA, 32 nt, Human
gcuguccugggugggagggaaacuucauuuca

SEQ ID NO: 448144 - RNA, 22 nt, Human
gcuguccuguguguagcacuca

SEQ ID NO: 448145 - RNA, 32 nt, Human
gcuguccuucccgcagcuucuuggagugucag

SEQ ID NO: 448146 - RNA, 32 nt, Human
gcuguccuucuggagagugguggagaaccaag

SEQ ID NO: 448147 - RNA, 32 nt, Human
gcuguccuugagccucgacucugggugagccc

SEQ ID NO: 448148 - RNA, 32 nt, Human
gcuguccuugcuugugccugccucuuucacuu

SEQ ID NO: 448149 - RNA, 19 nt, Human
gcuguccuuuugcuggcca

SEQ ID NO: 448150 - RNA, 32 nt, Human
gcugucgcacggucagaucaugggcuccacca

SEQ ID NO: 448151 - RNA, 25 nt, Human
gcugucgcccaggcuggagugcagu

SEQ ID NO: 448152 - RNA, 32 nt, Human
gcugucgcccgcgccaccuccaccgccgccgc

SEQ ID NO: 448153 - RNA, 21 nt, Human
gcugucgccgccgccgccgcc

SEQ ID NO: 448154 - RNA, 23 nt, Human
gcugucgccgccgcucucagggu

SEQ ID NO: 448155 - RNA, 20 nt, Human
gcugucgccgccgcugccac

SEQ ID NO: 448156 - RNA, 32 nt, Human
gcugucgccggcggagggugcauguuugcgag

SEQ ID NO: 448157 - RNA, 32 nt, Human
gcugucgccugacagcauaccucaaaaggccc

SEQ ID NO: 448158 - RNA, 32 nt, Human
gcugucgccuggcgccgcgcauggcccacgcg

SEQ ID NO: 448159 - RNA, 32 nt, Human
gcugucgccuguaaugccagcgcuuugggagg

SEQ ID NO: 448160 - RNA, 32 nt, Human
gcugucggacugcgcucccagccugggcucug

SEQ ID NO: 448161 - RNA, 32 nt, Human
gcugucggagggaaggaggacggugcggggcc

SEQ ID NO: 448162 - RNA, 32 nt, Human
gcugucggcaggcgauguacaaaugaaagcgc

SEQ ID NO: 448163 - RNA, 27 nt, Human
gcugucggccucgcuuuuccugggcca

SEQ ID NO: 448164 - RNA, 32 nt, Human
gcugucgggccgcggcggcgcuuggcagccag

SEQ ID NO: 448165 - RNA, 32 nt, Human
gcugucguaguuggagguggccugaggagcuc

SEQ ID NO: 448166 - RNA, 32 nt, Human
gcugucuagaguagcuuaccagaagcuuccau

SEQ ID NO: 448167 - RNA, 32 nt, Human
gcugucucacccaggcuggagugcaguggcac

SEQ ID NO: 448168 - RNA, 32 nt, Human
gcugucucacugggggccugcuuuccucaaag

SEQ ID NO: 448169 - RNA, 32 nt, Human
gcugucucauagaugggauuuguacucuuggg

SEQ ID NO: 448170 - RNA, 32 nt, Human
gcugucuccacucaaaaccucagggcugugac

SEQ ID NO: 448171 - RNA, 32 nt, Human
gcugucuccagaggaucaaagccacacccaaa

SEQ ID NO: 448172 - RNA, 32 nt, Human
gcugucuccaguuucugggguuaagcacuaag

SEQ ID NO: 448173 - RNA, 21 nt, Human
gcugucuccccggcuggcugg

SEQ ID NO: 448174 - RNA, 32 nt, Human
gcugucucccuccagggauccgcaccgcccua

SEQ ID NO: 448175 - RNA, 32 nt, Human
gcugucucuaaaauacuuggcaugucauuagg

SEQ ID NO: 448176 - RNA, 32 nt, Human
gcugucucuaaggguggccccuccucucaggc

SEQ ID NO: 448177 - RNA, 32 nt, Human
gcugucucucccuccauuguucagcucuguac

SEQ ID NO: 448178 - RNA, 32 nt, Human
gcugucucucccuuucucccccucucucucug

SEQ ID NO: 448179 - RNA, 32 nt, Human
gcugucucucuguggaucagauuucucuccug

SEQ ID NO: 448180 - RNA, 32 nt, Human
gcugucucugccacaggagagccacauggucg

SEQ ID NO: 448181 - RNA, 32 nt, Human
gcugucucuguggugcuuuugcccucauaccu

SEQ ID NO: 448182 - RNA, 19 nt, Human
gcugucugagagcuagcca

SEQ ID NO: 448183 - RNA, 19 nt, Human
gcugucugagcagggaggu

SEQ ID NO: 448184 - RNA, 19 nt, Human
gcugucugagccacagcca

SEQ ID NO: 448185 - RNA, 20 nt, Human
gcugucugaggacugcucca

SEQ ID NO: 448186 - RNA, 19 nt, Human
gcugucugaguacugugau

SEQ ID NO: 448187 - RNA, 32 nt, Human
gcugucugagucuaaagcaccguaucuuggug

SEQ ID NO: 448188 - RNA, 18 nt, Human
gcugucugaucugugaca

SEQ ID NO: 448189 - RNA, 31 nt, Human
gcugucugccucucuacggcucugcuuccca

SEQ ID NO: 448190 - RNA, 21 nt, Human
gcugucugccugagcaacucu

SEQ ID NO: 448191 - RNA, 32 nt, Human
gcugucugccuguauuuucggacuuugacauu

SEQ ID NO: 448192 - RNA, 30 nt, Human
gcugucugcuugaaaggagaaagacaguaa

SEQ ID NO: 448193 - RNA, 32 nt, Human
gcugucugguuugcccacuucaucucauucuc

SEQ ID NO: 448194 - RNA, 32 nt, Human
gcugucuguaugcccugggagcucagguggga

SEQ ID NO: 448195 - RNA, 32 nt, Human
gcugucuguccagugcucucuuccugccucca

SEQ ID NO: 448196 - RNA, 32 nt, Human
gcugucuguccccuucuccaucgcccucuccc

SEQ ID NO: 448197 - RNA, 32 nt, Human
gcugucugucucccccucucuguuuaugucug

SEQ ID NO: 448198 - RNA, 32 nt, Human
gcugucuguguguacgugugcaggggaguaca

SEQ ID NO: 448199 - RNA, 32 nt, Human
gcugucuguuaacuccgcggucaguucccgga

SEQ ID NO: 448200 - RNA, 32 nt, Human
gcugucuguucugcagagaguagccugaggcc

SEQ ID NO: 448201 - RNA, 32 nt, Human
gcugucuucaacaacaggugcugcuuagucau

SEQ ID NO: 448202 - RNA, 21 nt, Human
gcugucuucagcagcaucuca

SEQ ID NO: 448203 - RNA, 32 nt, Human
gcugucuuccacacccuuccucccuccaggcu

SEQ ID NO: 448204 - RNA, 32 nt, Human
gcugucuucccaagaucacccccaggaguugg

SEQ ID NO: 448205 - RNA, 32 nt, Human
gcugucuucccaagccuuugaugacaaaccaa

SEQ ID NO: 448206 - RNA, 19 nt, Human
gcugucuucccccugcuaa

SEQ ID NO: 448207 - RNA, 32 nt, Human
gcugucuuccucccuuccccuggggguccugc

SEQ ID NO: 448208 - RNA, 32 nt, Human
gcugucuucugcuggccucauccugcagcagg

SEQ ID NO: 448209 - RNA, 32 nt, Human
gcugucuugcccaggcuggaguucaggggcua

SEQ ID NO: 448210 - RNA, 32 nt, Human
gcugucuuggucuccccuguggaaacccuucu

SEQ ID NO: 448211 - RNA, 32 nt, Human
gcugucuuguagcugcuuuccucccaguuagg

SEQ ID NO: 448212 - RNA, 32 nt, Human
gcugucuuucuccuccagagggucugugucuu

SEQ ID NO: 448213 - RNA, 32 nt, Human
gcugucuuuguucuccuuggccugugugggcu

SEQ ID NO: 448214 - RNA, 32 nt, Human
gcugugaaagagaucugugaccuugcacccug

SEQ ID NO: 448215 - RNA, 20 nt, Human
gcugugaaaggacugaggca

SEQ ID NO: 448216 - RNA, 32 nt, Human
gcugugaaccaccugggcuucaucucaagccu

SEQ ID NO: 448217 - RNA, 32 nt, Human
gcugugaaggcagugaaaagcaguugaaauac

SEQ ID NO: 448218 - RNA, 32 nt, Human
gcugugaauauuccuaacuuacccagauguug

SEQ ID NO: 448219 - RNA, 32 nt, Human
gcugugaaucagugagaaacugugacugccuc

SEQ ID NO: 448220 - RNA, 32 nt, Human
gcugugaaugauaccuggccuuucucacuaug

SEQ ID NO: 448221 - RNA, 32 nt, Human
gcugugaauucuccugcagacaggagggcccu

SEQ ID NO: 448222 - RNA, 29 nt, Human
gcugugacaguucuguuggucuacagaaa

SEQ ID NO: 448223 - RNA, 32 nt, Human
gcugugacaucucaucuucuguccucagaugg

SEQ ID NO: 448224 - RNA, 32 nt, Human
gcugugaccaacacaugugagacccaguccug

SEQ ID NO: 448225 - RNA, 32 nt, Human
gcugugaccagagcaaccagagccugccaccc

SEQ ID NO: 448226 - RNA, 32 nt, Human
gcugugaccagccugguggcgcgaagugucug

SEQ ID NO: 448227 - RNA, 32 nt, Human
gcugugacccccagauucauggaggggcuuua

SEQ ID NO: 448228 - RNA, 32 nt, Human
gcugugaccucaccucucuggcuuugggcggc

SEQ ID NO: 448229 - RNA, 18 nt, Human
gcugugacggacccaagg

SEQ ID NO: 448230 - RNA, 18 nt, Human
gcugugacgucugcgcca

SEQ ID NO: 448231 - RNA, 32 nt, Human
gcugugacuccagauacuuugcacugaagaga

SEQ ID NO: 448232 - RNA, 32 nt, Human
gcugugacucccacugcacuccagcucgggga

SEQ ID NO: 448233 - RNA, 32 nt, Human
gcugugacuccucuguggacaugguggcagca

SEQ ID NO: 448234 - RNA, 32 nt, Human
gcugugacugacucacacucuaacccagcaac

SEQ ID NO: 448235 - RNA, 32 nt, Human
gcugugacugcugcaagcucugccuucaccag

SEQ ID NO: 448236 - RNA, 20 nt, Human
gcugugacugggccagggca

SEQ ID NO: 448237 - RNA, 32 nt, Human
gcugugagaagaaggaaagcggcuggccuggu

SEQ ID NO: 448238 - RNA, 32 nt, Human
gcugugagacccaagacaaaaggggcugaggg

SEQ ID NO: 448239 - RNA, 32 nt, Human
gcugugagacugagcugggcucugaguguaaa

SEQ ID NO: 448240 - RNA, 32 nt, Human
gcugugagagauucuuucaagaagaccaaaau

SEQ ID NO: 448241 - RNA, 32 nt, Human
gcugugagagcaccacucaucugcgaaacgca

SEQ ID NO: 448242 - RNA, 32 nt, Human
gcugugagagccagaaugaagcauguacaaga

SEQ ID NO: 448243 - RNA, 32 nt, Human
gcugugagcagucuccugcauucacacgacaa

SEQ ID NO: 448244 - RNA, 32 nt, Human
gcugugagccaagagccgcggagcacgccggg

SEQ ID NO: 448245 - RNA, 32 nt, Human
gcugugagccaccuccagccucggguggcugc

SEQ ID NO: 448246 - RNA, 32 nt, Human
gcugugagccacugcacccggccgggaauuua

SEQ ID NO: 448247 - RNA, 32 nt, Human
gcugugagccagcacucagcugugucagauuu

SEQ ID NO: 448248 - RNA, 32 nt, Human
gcugugagccauggcaccuggccacacacguc

SEQ ID NO: 448249 - RNA, 32 nt, Human
gcugugagcccaggcaguguggucaccgagug

SEQ ID NO: 448250 - RNA, 32 nt, Human
gcugugagccgaggcauuccagccugggcaac

SEQ ID NO: 448251 - RNA, 21 nt, Human
gcugugagcugcuuuggcaga

SEQ ID NO: 448252 - RNA, 32 nt, Human
gcugugaggaagagcacaggcuucaugcacau

SEQ ID NO: 448253 - RNA, 32 nt, Human
gcugugaggaaggcguuccuguucccauuuua

SEQ ID NO: 448254 - RNA, 32 nt, Human
gcugugaggaggcuacaaaggccaggcuggug

SEQ ID NO: 448255 - RNA, 32 nt, Human
gcugugaggccacuggugcugagucaaaggga

SEQ ID NO: 448256 - RNA, 32 nt, Human
gcugugaggccccuggacaagcagagguggcc

SEQ ID NO: 448257 - RNA, 32 nt, Human
gcugugaggccuggggccuugcacuggcugga

SEQ ID NO: 448258 - RNA, 32 nt, Human
gcugugaggcucaaaugagccaaagguuauaa

SEQ ID NO: 448259 - RNA, 32 nt, Human
gcugugagggaggggaaaagcauuuuucaaua

SEQ ID NO: 448260 - RNA, 18 nt, Human
gcugugagggcugugcca

SEQ ID NO: 448261 - RNA, 32 nt, Human
gcugugaguaccucuuucuacuccuuucaggu

SEQ ID NO: 448262 - RNA, 32 nt, Human
gcugugaguagagaagcuaggccccgagccgg

SEQ ID NO: 448263 - RNA, 32 nt, Human
gcugugagucacuggccaggagcccagggugu

SEQ ID NO: 448264 - RNA, 32 nt, Human
gcugugagucauggggcucacugaggccuugu

SEQ ID NO: 448265 - RNA, 32 nt, Human
gcugugaguuguuucaauaaaggggcccaagg

SEQ ID NO: 448266 - RNA, 32 nt, Human
gcugugaucuguccugggcggggaccaggagg

SEQ ID NO: 448267 - RNA, 20 nt, Human
gcugugauggcaccaaggca

SEQ ID NO: 448268 - RNA, 32 nt, Human
gcugugauugugccacgggagcaugagcccuu

SEQ ID NO: 448269 - RNA, 32 nt, Human
gcugugauugugccacugcacucauccuggaa

SEQ ID NO: 448270 - RNA, 32 nt, Human
gcugugauugugccacugcacuccagccuggg

SEQ ID NO: 448271 - RNA, 32 nt, Human
gcugugauugugccacuguacuccagccuggg

SEQ ID NO: 448272 - RNA, 32 nt, Human
gcugugcaaaauaugcauaagaaaguagaaaa

SEQ ID NO: 448273 - RNA, 32 nt, Human
gcugugcacaucuccccacuccagccaccuuc

SEQ ID NO: 448274 - RNA, 32 nt, Human
gcugugcacggccuccccugcccuccuguucu

SEQ ID NO: 448275 - RNA, 32 nt, Human
gcugugcacucguuugcuuucuccaacgacuc

SEQ ID NO: 448276 - RNA, 32 nt, Human
gcugugcagaaggugaaauggaggaaaccaca

SEQ ID NO: 448277 - RNA, 25 nt, Human
gcugugcagagccauaagccuccca

SEQ ID NO: 448278 - RNA, 32 nt, Human
gcugugcagagggacagauggaagaaagcuag

SEQ ID NO: 448279 - RNA, 32 nt, Human
gcugugcagaucccagucccucauuucugucg

SEQ ID NO: 448280 - RNA, 32 nt, Human
gcugugcagcuccuuguccuuccugagcgucu

SEQ ID NO: 448281 - RNA, 32 nt, Human
gcugugcagcuugauagcaucuuacccacggu

SEQ ID NO: 448282 - RNA, 23 nt, Human
gcugugcaggaggguuacuugag

SEQ ID NO: 448283 - RNA, 32 nt, Human
gcugugcaggguacuccuccagauggaaucag

SEQ ID NO: 448284 - RNA, 32 nt, Human
gcugugcagggugcagcgcucagguggauccu

SEQ ID NO: 448285 - RNA, 32 nt, Human
gcugugcaugaucaugguuaagccacaacauc

SEQ ID NO: 448286 - RNA, 32 nt, Human
gcugugccaauacugccuacugugcuagccug

SEQ ID NO: 448287 - RNA, 32 nt, Human
gcugugccacaucuucugccauccuaagggga

SEQ ID NO: 448288 - RNA, 32 nt, Human
gcugugccacugggacccgccucugccaugaa

SEQ ID NO: 448289 - RNA, 21 nt, Human
gcugugccagcaggggggcug

SEQ ID NO: 448290 - RNA, 32 nt, Human
gcugugccagguugaaguauuguauuuugcaa

SEQ ID NO: 448291 - RNA, 32 nt, Human
gcugugccaucccgccggacgucgggauggug

SEQ ID NO: 448292 - RNA, 32 nt, Human
gcugugcccacacauggugaaagggacuacca

SEQ ID NO: 448293 - RNA, 32 nt, Human
gcugugcccauucuacuaacugagugagacau

SEQ ID NO: 448294 - RNA, 32 nt, Human
gcugugccccagcuguuccagcagcuugucug

SEQ ID NO: 448295 - RNA, 32 nt, Human
gcugugcccgggcuccucuccagcacuccgug

SEQ ID NO: 448296 - RNA, 19 nt, Human
gcugugccgccgccgccau

SEQ ID NO: 448297 - RNA, 21 nt, Human
gcugugccgcuggcucagccc

SEQ ID NO: 448298 - RNA, 32 nt, Human
gcugugccgggaggcagccacagggaagcuca

SEQ ID NO: 448299 - RNA, 32 nt, Human
gcugugccgguugcuuucugcagccgcaucuc

SEQ ID NO: 448300 - RNA, 32 nt, Human
gcugugccuauucaaguggccuucaggcagag

SEQ ID NO: 448301 - RNA, 32 nt, Human
gcugugccuccccagggacucugcccauguuc

SEQ ID NO: 448302 - RNA, 32 nt, Human
gcugugccuccccuaugugcagccgcugggau

SEQ ID NO: 448303 - RNA, 32 nt, Human
gcugugccucgggcuuggcuccaccucagggc

SEQ ID NO: 448304 - RNA, 32 nt, Human
gcugugccucuacugcccugaggacuuaccag

SEQ ID NO: 448305 - RNA, 32 nt, Human
gcugugccuggacugaagcugucccgcagguc

SEQ ID NO: 448306 - RNA, 32 nt, Human
gcugugccugggagccgagagaggcgguaaua

SEQ ID NO: 448307 - RNA, 32 nt, Human
gcugugccugggaguggcuucagcccaggcgu

SEQ ID NO: 448308 - RNA, 32 nt, Human
gcugugccugggcuccaaggacaggaacacug

SEQ ID NO: 448309 - RNA, 32 nt, Human
gcugugcgauccagauggcuugagugaugaag

SEQ ID NO: 448310 - RNA, 17 nt, Human
gcugugcgcaccaaaga

SEQ ID NO: 448311 - RNA, 21 nt, Human
gcugugcgggccccccuuccc

SEQ ID NO: 448312 - RNA, 32 nt, Human
gcugugcgugagccgggacuguacccacagcu

SEQ ID NO: 448313 - RNA, 32 nt, Human
gcugugcguucugagggagggagaccucggca

SEQ ID NO: 448314 - RNA, 24 nt, Human
gcugugcuaagaaugucaauggaa

SEQ ID NO: 448315 - RNA, 32 nt, Human
gcugugcucacugauccgccuccagggccacc

SEQ ID NO: 448316 - RNA, 32 nt, Human
gcugugcucagaggaggugagaggagaggaag

SEQ ID NO: 448317 - RNA, 32 nt, Human
gcugugcuccaagaugaggaggacggaagugu

SEQ ID NO: 448318 - RNA, 21 nt, Human
gcugugcuccagcuccugcgg

SEQ ID NO: 448319 - RNA, 22 nt, Human
gcugugcucucaccagcugcug

SEQ ID NO: 448320 - RNA, 32 nt, Human
gcugugcucugaaugcuucuccuucacauagg

SEQ ID NO: 448321 - RNA, 20 nt, Human
gcugugcugcaccccaugug

SEQ ID NO: 448322 - RNA, 32 nt, Human
gcugugcugcugcuggucuccugauggcuguu

SEQ ID NO: 448323 - RNA, 32 nt, Human
gcugugcuggccugccaggccugcugcaugcu

SEQ ID NO: 448324 - RNA, 32 nt, Human
gcugugcugggaaggacacagagagguggcug

SEQ ID NO: 448325 - RNA, 32 nt, Human
gcugugcugggaaggccgaggaugggggccca

SEQ ID NO: 448326 - RNA, 31 nt, Human
gcugugcugguccagcaccugcucucaccau

SEQ ID NO: 448327 - RNA, 32 nt, Human
gcugugcugucugcuagggucaccuccuguuu

SEQ ID NO: 448328 - RNA, 32 nt, Human
gcugugcugugcuauggugcucugucuacuug

SEQ ID NO: 448329 - RNA, 32 nt, Human
gcugugcuuccagagguggcgugaugccuccc

SEQ ID NO: 448330 - RNA, 18 nt, Human
gcugugcuugaccaagga

SEQ ID NO: 448331 - RNA, 18 nt, Human
gcugugcuuugcccgugg

SEQ ID NO: 448332 - RNA, 32 nt, Human
gcugugcuuuggaacaaucacagggaauggcc

SEQ ID NO: 448333 - RNA, 32 nt, Human
gcuguggaaagacuucacgucuugccgaauga

SEQ ID NO: 448334 - RNA, 32 nt, Human
gcuguggaacaaccagcucacgcacacaggca

SEQ ID NO: 448335 - RNA, 32 nt, Human
gcuguggaaccccgggcccccugcugcgggcu

SEQ ID NO: 448336 - RNA, 32 nt, Human
gcuguggaagcagccaaggcacuuccucaccc

SEQ ID NO: 448337 - RNA, 32 nt, Human
gcuguggaauuuguuuuccuucauaauauuua

SEQ ID NO: 448338 - RNA, 32 nt, Human
gcuguggacagaaaagccuccuuaagugagcu

SEQ ID NO: 448339 - RNA, 32 nt, Human
gcuguggaccaaugcaucucuuuaaaggcaaa

SEQ ID NO: 448340 - RNA, 32 nt, Human
gcuguggacccugucuucugggcacaguggac

SEQ ID NO: 448341 - RNA, 32 nt, Human
gcuguggaccgcgugggcucgccucccuggga

SEQ ID NO: 448342 - RNA, 32 nt, Human
gcuguggaccucuccuccuucuccuugaccuc

SEQ ID NO: 448343 - RNA, 32 nt, Human
gcuguggacucaggacccaggacucuguuuac

SEQ ID NO: 448344 - RNA, 32 nt, Human
gcuguggagaaaagaaguccauggaagccagg

SEQ ID NO: 448345 - RNA, 22 nt, Human
gcuguggagagcuggccgggga

SEQ ID NO: 448346 - RNA, 32 nt, Human
gcuguggagaggaggaagcggaacuagagaug

SEQ ID NO: 448347 - RNA, 32 nt, Human
gcuguggagagggacagaaggggugguucagc

SEQ ID NO: 448348 - RNA, 32 nt, Human
gcuguggagaggggcuacgcagcugccccagc

SEQ ID NO: 448349 - RNA, 32 nt, Human
gcuguggagagggugcacagggccuggcaggg

SEQ ID NO: 448350 - RNA, 32 nt, Human
gcuguggagauccauuccccaccuuuccugug

SEQ ID NO: 448351 - RNA, 32 nt, Human
gcuguggaggccaggguggaacugggguugcc

SEQ ID NO: 448352 - RNA, 32 nt, Human
gcuguggagugcaggccagagcagggugugcg

SEQ ID NO: 448353 - RNA, 22 nt, Human
gcuguggcagagaauugcuuga

SEQ ID NO: 448354 - RNA, 24 nt, Human
gcuguggcaggagaacugcuugag

SEQ ID NO: 448355 - RNA, 23 nt, Human
gcuguggcaggagaaucgcuaga

SEQ ID NO: 448356 - RNA, 23 nt, Human
gcuguggcaggagaaucguuuga

SEQ ID NO: 448357 - RNA, 32 nt, Human
gcuguggcaggcaggggugguaguaguaguga

SEQ ID NO: 448358 - RNA, 32 nt, Human
gcuguggcagggcaggggcggcuuggaaccug

SEQ ID NO: 448359 - RNA, 19 nt, Human
gcuguggcagggggcacug

SEQ ID NO: 448360 - RNA, 32 nt, Human
gcuguggcauugugugggcauguggccaggca

SEQ ID NO: 448361 - RNA, 32 nt, Human
gcuguggccagcugcugacccagcuccuccug

SEQ ID NO: 448362 - RNA, 32 nt, Human
gcuguggccaggacaugacaaugacggcuuuc

SEQ ID NO: 448363 - RNA, 22 nt, Human
gcuguggccaguggagagccac

SEQ ID NO: 448364 - RNA, 32 nt, Human
gcuguggccauauguuuguauauugugugugg

SEQ ID NO: 448365 - RNA, 25 nt, Human
gcuguggcccaggcugaagugcagu

SEQ ID NO: 448366 - RNA, 32 nt, Human
gcuguggcccauucccccucugcuaugccuua

SEQ ID NO: 448367 - RNA, 21 nt, Human
gcuguggcccugccuggcuag

SEQ ID NO: 448368 - RNA, 32 nt, Human
gcuguggcccuggaugcuggagcuggaggguu

SEQ ID NO: 448369 - RNA, 32 nt, Human
gcuguggcccugggcccagcuguggguccuga

SEQ ID NO: 448370 - RNA, 32 nt, Human
gcuguggccuccccugccccugcuccagcucc

SEQ ID NO: 448371 - RNA, 22 nt, Human
gcuguggcgccacguccuccca

SEQ ID NO: 448372 - RNA, 32 nt, Human
gcuguggcggugcacaggggaggcagguccuu

SEQ ID NO: 448373 - RNA, 22 nt, Human
gcuguggcucaagccuguaauc

SEQ ID NO: 448374 - RNA, 22 nt, Human
gcuguggcucacaccuguaauc

SEQ ID NO: 448375 - RNA, 21 nt, Human
gcuguggcucaccugcugcug

SEQ ID NO: 448376 - RNA, 22 nt, Human
gcuguggcucacgccugcaauc

SEQ ID NO: 448377 - RNA, 22 nt, Human
gcuguggcucacgccuguaauc

SEQ ID NO: 448378 - RNA, 22 nt, Human
gcuguggcucacgccuguaauu

SEQ ID NO: 448379 - RNA, 22 nt, Human
gcuguggcucaugacuauaauc

SEQ ID NO: 448380 - RNA, 22 nt, Human
gcuguggcucaugccuguaauc

SEQ ID NO: 448381 - RNA, 32 nt, Human
gcuguggcuccaguuccagcacugccucuccc

SEQ ID NO: 448382 - RNA, 21 nt, Human
gcuguggcucugcccuuucca

SEQ ID NO: 448383 - RNA, 32 nt, Human
gcuguggcugaaggcagcuuccacagcucacu

SEQ ID NO: 448384 - RNA, 32 nt, Human
gcuguggcugcugcggucagggagaggucgca

SEQ ID NO: 448385 - RNA, 22 nt, Human
gcuguggcuuaugccuguaauc

SEQ ID NO: 448386 - RNA, 32 nt, Human
gcugugggaagagagaugagggucagauaggu

SEQ ID NO: 448387 - RNA, 26 nt, Human
gcugugggaccuuccuggcugacugg

SEQ ID NO: 448388 - RNA, 32 nt, Human
gcugugggacugccuucuguccuucauccgcc

SEQ ID NO: 448389 - RNA, 21 nt, Human
gcugugggacuggcccgccag

SEQ ID NO: 448390 - RNA, 30 nt, Human
gcugugggacuggcccugcuccuguacugc

SEQ ID NO: 448391 - RNA, 18 nt, Human
gcugugggagcagaguga

SEQ ID NO: 448392 - RNA, 32 nt, Human
gcugugggagcaggcccagugggaggcugugg

SEQ ID NO: 448393 - RNA, 32 nt, Human
gcugugggagccaagaauaagacagaaggcau

SEQ ID NO: 448394 - RNA, 20 nt, Human
gcugugggagcugcccugug

SEQ ID NO: 448395 - RNA, 32 nt, Human
gcugugggcacccugcaggaggcaccuguagg

SEQ ID NO: 448396 - RNA, 32 nt, Human
gcugugggcaucuucugcccaugggcuccauu

SEQ ID NO: 448397 - RNA, 21 nt, Human
gcugugggccaggcugcucag

SEQ ID NO: 448398 - RNA, 32 nt, Human
gcugugggcccucuggaauugugcuccucaca

SEQ ID NO: 448399 - RNA, 32 nt, Human
gcugugggccugacagaaguugauauuugggu

SEQ ID NO: 448400 - RNA, 22 nt, Human
gcugugggcggagcugggucag

SEQ ID NO: 448401 - RNA, 23 nt, Human
gcugugggcuaccgggccgccgg

SEQ ID NO: 448402 - RNA, 22 nt, Human
gcugugggcucccugucccugg

SEQ ID NO: 448403 - RNA, 21 nt, Human
gcugugggcucucugggacag

SEQ ID NO: 448404 - RNA, 32 nt, Human
gcugugggcugcaggcaagcggucgggugggg

SEQ ID NO: 448405 - RNA, 23 nt, Human
gcugugggcuuuggguuugucag

SEQ ID NO: 448406 - RNA, 21 nt, Human
gcuguggggagcuggagagga

SEQ ID NO: 448407 - RNA, 32 nt, Human
gcuguggggaggaggcaggaaucugaaaaggu

SEQ ID NO: 448408 - RNA, 32 nt, Human
gcuguggggcagcugggauccagguaagaccg

SEQ ID NO: 448409 - RNA, 32 nt, Human
gcuguggggcaggcacuagggggccuuucccu

SEQ ID NO: 448410 - RNA, 21 nt, Human
gcuguggggcaggcugggcag

SEQ ID NO: 448411 - RNA, 32 nt, Human
gcuguggggcaggcugggcagggggcugagcu

SEQ ID NO: 448412 - RNA, 32 nt, Human
gcuguggggccaguugauaccugcuggcagga

SEQ ID NO: 448413 - RNA, 32 nt, Human
gcuguggggcugggggaugcccucuuuucuau

SEQ ID NO: 448414 - RNA, 32 nt, Human
gcugugggggugccuuccucagccucuggccc

SEQ ID NO: 448415 - RNA, 32 nt, Human
gcuguggggucugcccuggccacccacugugu

SEQ ID NO: 448416 - RNA, 20 nt, Human
gcugugggugcagcauuuca

SEQ ID NO: 448417 - RNA, 32 nt, Human
gcuguggguucagaggacuccaccuccuggcu

SEQ ID NO: 448418 - RNA, 32 nt, Human
gcuguggguucgagguggaggcugcagcugaa

SEQ ID NO: 448419 - RNA, 20 nt, Human
gcuguggguucucugaagca

SEQ ID NO: 448420 - RNA, 22 nt, Human
gcuguggguuuugggggcucag

SEQ ID NO: 448421 - RNA, 22 nt, Human
gcugugguaaaaaaccugcagg

SEQ ID NO: 448422 - RNA, 32 nt, Human
gcugugguaaguccagccugcccagggcugcu

SEQ ID NO: 448423 - RNA, 32 nt, Human
gcuguggucagaaacaggucagugauggaggc

SEQ ID NO: 448424 - RNA, 32 nt, Human
gcuguggucaggcaggcgaauggggagcaagc

SEQ ID NO: 448425 - RNA, 32 nt, Human
gcuguggucccagcuacucaggaggcugaggu

SEQ ID NO: 448426 - RNA, 20 nt, Human
gcuguggucucagcaaugca

SEQ ID NO: 448427 - RNA, 18 nt, Human
gcuguggucuccuuggua

SEQ ID NO: 448428 - RNA, 24 nt, Human
gcuguggucuuaacguagacugca

SEQ ID NO: 448429 - RNA, 22 nt, Human
gcuguggucuuccagcacacag

SEQ ID NO: 448430 - RNA, 20 nt, Human
gcuguggucuugaucugcag

SEQ ID NO: 448431 - RNA, 21 nt, Human
gcuguggucuuggcgcgggga

SEQ ID NO: 448432 - RNA, 32 nt, Human
gcuguggugaacacucgugugggggugggggu

SEQ ID NO: 448433 - RNA, 32 nt, Human
gcuguggugagcuguugauugcaccacugcac

SEQ ID NO: 448434 - RNA, 32 nt, Human
gcuguggugcagcccugcuccagccuuggccu

SEQ ID NO: 448435 - RNA, 32 nt, Human
gcuguggugcaggagagaaggaaguuugggaa

SEQ ID NO: 448436 - RNA, 32 nt, Human
gcuguggugcggaagccaggaggcaggcgcgc

SEQ ID NO: 448437 - RNA, 32 nt, Human
gcuguggugggaagaguuagggccagugucuu

SEQ ID NO: 448438 - RNA, 24 nt, Human
gcuguggugggaggauugcuugag

SEQ ID NO: 448439 - RNA, 32 nt, Human
gcuguggugguguugaucaguugcuccagugu

SEQ ID NO: 448440 - RNA, 32 nt, Human
gcuguggugugaggacuucucagacaaaggca

SEQ ID NO: 448441 - RNA, 19 nt, Human
gcugugguuaagcacugca

SEQ ID NO: 448442 - RNA, 32 nt, Human
gcugugguuaguaucuuguucugugauugguu

SEQ ID NO: 448443 - RNA, 32 nt, Human
gcugugguugcuucucuuccuccugcugccgc

SEQ ID NO: 448444 - RNA, 19 nt, Human
gcugugguuuagcacugca

SEQ ID NO: 448445 - RNA, 32 nt, Human
gcuguguaaccuugaacuacacaauucuccuu

SEQ ID NO: 448446 - RNA, 18 nt, Human
gcuguguaacugcugcca

SEQ ID NO: 448447 - RNA, 32 nt, Human
gcuguguaauccuaugucagcucucuuaggaa

SEQ ID NO: 448448 - RNA, 32 nt, Human
gcuguguaggcugcagaugagaguucuguucu

SEQ ID NO: 448449 - RNA, 32 nt, Human
gcuguguaugaucaguuaucuaccucagaguc

SEQ ID NO: 448450 - RNA, 32 nt, Human
gcuguguaugcagccugcagguuuccauacac

SEQ ID NO: 448451 - RNA, 32 nt, Human
gcuguguauguguggggguggggagggcauau

SEQ ID NO: 448452 - RNA, 32 nt, Human
gcugugucacacaggcuggagugcaguggcgu

SEQ ID NO: 448453 - RNA, 21 nt, Human
gcugugucacagccagaggga

SEQ ID NO: 448454 - RNA, 32 nt, Human
gcugugucaccaaggcuggagggcaauagcau

SEQ ID NO: 448455 - RNA, 32 nt, Human
gcugugucaccaggauggagugcaguggcaug

SEQ ID NO: 448456 - RNA, 32 nt, Human
gcugugucaccaggcuggagcaguggcacgau

SEQ ID NO: 448457 - RNA, 32 nt, Human
gcugugucacccaggcugccaggcuggagugg

SEQ ID NO: 448458 - RNA, 32 nt, Human
gcugugucacccaggcuggagugcaguggcgc

SEQ ID NO: 448459 - RNA, 32 nt, Human
gcugugucaccuaggcuggagugcaguggcac

SEQ ID NO: 448460 - RNA, 21 nt, Human
gcuguguccagacagcacaaa

SEQ ID NO: 448461 - RNA, 22 nt, Human
gcuguguccagggcucagggca

SEQ ID NO: 448462 - RNA, 32 nt, Human
gcugugucccagagacauggguccuccgggug

SEQ ID NO: 448463 - RNA, 32 nt, Human
gcugugucccagguuuccucagucucuaaccc

SEQ ID NO: 448464 - RNA, 19 nt, Human
gcugugucccugaacaucc

SEQ ID NO: 448465 - RNA, 22 nt, Human
gcugugucccuugaaacacaga

SEQ ID NO: 448466 - RNA, 32 nt, Human
gcuguguccgccgcaccagccaccccaaagcc

SEQ ID NO: 448467 - RNA, 32 nt, Human
gcuguguccugccucagcacaaagacccagug

SEQ ID NO: 448468 - RNA, 32 nt, Human
gcuguguccuuucccuuaccucccucugccag

SEQ ID NO: 448469 - RNA, 32 nt, Human
gcugugucgccaaggcuggagugcaguggugc

SEQ ID NO: 448470 - RNA, 32 nt, Human
gcugugucgcccagacuggagugcaguggugg

SEQ ID NO: 448471 - RNA, 32 nt, Human
gcugugucgcccaggcuggagugcagugagcu

SEQ ID NO: 448472 - RNA, 32 nt, Human
gcugugucgccuaggcuggagugcaguggcgu

SEQ ID NO: 448473 - RNA, 21 nt, Human
gcugugucuagcagcaccugu

SEQ ID NO: 448474 - RNA, 32 nt, Human
gcugugucuguggagcugcggccacucaugcu

SEQ ID NO: 448475 - RNA, 32 nt, Human
gcugugucuucaugucccugagggucuugggc

SEQ ID NO: 448476 - RNA, 32 nt, Human
gcugugugaacccagcaagucacaggaucacu

SEQ ID NO: 448477 - RNA, 32 nt, Human
gcugugugaauucaggccuuguggaaaacacc

SEQ ID NO: 448478 - RNA, 32 nt, Human
gcugugugacagaucaacgugcugaugguaag

SEQ ID NO: 448479 - RNA, 19 nt, Human
gcugugugacagcugcacc

SEQ ID NO: 448480 - RNA, 32 nt, Human
gcugugugacuucaggcaagccacuuuaccuc

SEQ ID NO: 448481 - RNA, 32 nt, Human
gcugugugagcccuucagcugcagagcggggg

SEQ ID NO: 448482 - RNA, 32 nt, Human
gcugugugcacugugccagggacaggaggguu

SEQ ID NO: 448483 - RNA, 32 nt, Human
gcugugugccaaggaguaaauugcugggcugc

SEQ ID NO: 448484 - RNA, 31 nt, Human
gcugugugcccugguggaccugugucugggc

SEQ ID NO: 448485 - RNA, 32 nt, Human
gcugugugccugugccuggggccuuauguugc

SEQ ID NO: 448486 - RNA, 19 nt, Human
gcugugugcugacuaugca

SEQ ID NO: 448487 - RNA, 32 nt, Human
gcugugugcugcccgccugccugcuggcucuc

SEQ ID NO: 448488 - RNA, 32 nt, Human
gcuguguggagccaccacuccuagccacagcu

SEQ ID NO: 448489 - RNA, 32 nt, Human
gcuguguggcccaggcuggagugcaguggcgc

SEQ ID NO: 448490 - RNA, 32 nt, Human
gcuguguggcccggagugagauucagaaaguc

SEQ ID NO: 448491 - RNA, 32 nt, Human
gcuguguggccgcggccccagcgugcgucucu

SEQ ID NO: 448492 - RNA, 32 nt, Human
gcuguguggccuagguuggagugcaauggcgc

SEQ ID NO: 448493 - RNA, 32 nt, Human
gcuguguggccugacagucucuaccaguccug

SEQ ID NO: 448494 - RNA, 32 nt, Human
gcuguguggcuuuccuuccugaagaguccgug

SEQ ID NO: 448495 - RNA, 23 nt, Human
gcugugugggagggaccuagggc

SEQ ID NO: 448496 - RNA, 32 nt, Human
gcugugugggccugggcuaugcggcagggcag

SEQ ID NO: 448497 - RNA, 21 nt, Human
gcuguguggggagccgaggua

SEQ ID NO: 448498 - RNA, 32 nt, Human
gcuguguguccuugcccugccugccuguggcu

SEQ ID NO: 448499 - RNA, 29 nt, Human
gcugugugucuguguagacugggcacagc

SEQ ID NO: 448500 - RNA, 31 nt, Human
gcuguguguggaauugcuugccaaagaaguu

SEQ ID NO: 448501 - RNA, 21 nt, Human
gcuguguguggggcccaagca

SEQ ID NO: 448502 - RNA, 32 nt, Human
gcuguguguguagugugguuggccaguaggug

SEQ ID NO: 448503 - RNA, 32 nt, Human
gcuguguguuggcgugccacgguggggauuuc

SEQ ID NO: 448504 - RNA, 32 nt, Human
gcuguguuaaaccucagaguuuaaaagcuacu

SEQ ID NO: 448505 - RNA, 32 nt, Human
gcuguguuaacacucccucccgaggagacuuc

SEQ ID NO: 448506 - RNA, 24 nt, Human
gcuguguuacccaggcuggucuca

SEQ ID NO: 448507 - RNA, 32 nt, Human
gcuguguuagacugcaugcuugaguguuuggg

SEQ ID NO: 448508 - RNA, 32 nt, Human
gcuguguuagcgguucaugcacaugccugacg

SEQ ID NO: 448509 - RNA, 32 nt, Human
gcuguguucaggauguugaagugcagugucag

SEQ ID NO: 448510 - RNA, 32 nt, Human
gcuguguuccaggggcccugauuuccucggau

SEQ ID NO: 448511 - RNA, 32 nt, Human
gcuguguucccgccgccgccccggcuagucuc

SEQ ID NO: 448512 - RNA, 32 nt, Human
gcuguguuccugggcccugcccauggccucaa

SEQ ID NO: 448513 - RNA, 32 nt, Human
gcuguguucuaacccagcucuggagacuuagg

SEQ ID NO: 448514 - RNA, 32 nt, Human
gcuguguucugcagcaaaacaggcugggggaa

SEQ ID NO: 448515 - RNA, 32 nt, Human
gcuguguugcagaauggaguuuccauggauuu

SEQ ID NO: 448516 - RNA, 32 nt, Human
gcuguguugccaaggcuggagugcaggccgcg

SEQ ID NO: 448517 - RNA, 24 nt, Human
gcuguguugcccagacuggucuca

SEQ ID NO: 448518 - RNA, 32 nt, Human
gcuguguugcccaggcuagagugcagcaguga

SEQ ID NO: 448519 - RNA, 32 nt, Human
gcuguguugcccaggcuggagugcaauggcgc

SEQ ID NO: 448520 - RNA, 32 nt, Human
gcuguguugcccaggcuggagugcaguagcua

SEQ ID NO: 448521 - RNA, 32 nt, Human
gcuguguugcccaggcuggagugcaguggccu

SEQ ID NO: 448522 - RNA, 32 nt, Human
gcuguguugcccaggcuggagugcaguggugu

SEQ ID NO: 448523 - RNA, 32 nt, Human
gcuguguugcccaggcuggagugcgguggcua

SEQ ID NO: 448524 - RNA, 32 nt, Human
gcuguguugcccugacuggaguucaguggugc

SEQ ID NO: 448525 - RNA, 32 nt, Human
gcuguguuguccaggcuggagugcaauggugu

SEQ ID NO: 448526 - RNA, 32 nt, Human
gcuguguuguccaggcuggagugcaguggugu

SEQ ID NO: 448527 - RNA, 32 nt, Human
gcuguguuuggacgcguuccugcccagccccu

SEQ ID NO: 448528 - RNA, 18 nt, Human
gcuguguuuucuaacaca

SEQ ID NO: 448529 - RNA, 32 nt, Human
gcuguuaaauagauuucucaauaauguaaaua

SEQ ID NO: 448530 - RNA, 32 nt, Human
gcuguuaaccacccgccccgcccccucccugc

SEQ ID NO: 448531 - RNA, 32 nt, Human
gcuguuaaccagccugcauuacaucuggaagu

SEQ ID NO: 448532 - RNA, 32 nt, Human
gcuguuaauuccaaaugugaacuuuuugaguc

SEQ ID NO: 448533 - RNA, 32 nt, Human
gcuguuaccaggaggagagcaagacgcugagc

SEQ ID NO: 448534 - RNA, 32 nt, Human
gcuguuaccaugucuacauuuuguagaaugau

SEQ ID NO: 448535 - RNA, 31 nt, Human
gcuguuaccucagcugggccuggauggucua

SEQ ID NO: 448536 - RNA, 32 nt, Human
gcuguuaccuuccucagggcuuagggagggag

SEQ ID NO: 448537 - RNA, 32 nt, Human
gcuguuacucagccccugagucugacucaucu

SEQ ID NO: 448538 - RNA, 21 nt, Human
gcuguuacugauagacaccuu

SEQ ID NO: 448539 - RNA, 32 nt, Human
gcuguuagaagcaggaggugugcagggggugg

SEQ ID NO: 448540 - RNA, 32 nt, Human
gcuguuagcaggagcuaugucccuuccuaucg

SEQ ID NO: 448541 - RNA, 32 nt, Human
gcuguuaggcugugcugugcucugcuuaagga

SEQ ID NO: 448542 - RNA, 32 nt, Human
gcuguuagugucuucuuccugcccucagcacc

SEQ ID NO: 448543 - RNA, 32 nt, Human
gcuguuauggccgccuccuugagguaguaucc

SEQ ID NO: 448544 - RNA, 32 nt, Human
gcuguucacucccauucuccccuacaguuuua

SEQ ID NO: 448545 - RNA, 32 nt, Human
gcuguucagaagaauaaaauaugacuguuuua

SEQ ID NO: 448546 - RNA, 32 nt, Human
gcuguucagacagaagagcugaaucagcagca

SEQ ID NO: 448547 - RNA, 32 nt, Human
gcuguucagcugguugagguuucaaaccuccc

SEQ ID NO: 448548 - RNA, 32 nt, Human
gcuguucaggguggaggcacagaugagcagag

SEQ ID NO: 448549 - RNA, 32 nt, Human
gcuguucauucauaaagaucuggauuugcuuu

SEQ ID NO: 448550 - RNA, 32 nt, Human
gcuguucauucuguacagugaauuuucugaac

SEQ ID NO: 448551 - RNA, 32 nt, Human
gcuguuccaggaacugggcauguaugaagaua

SEQ ID NO: 448552 - RNA, 32 nt, Human
gcuguuccaggcuccaggggaaaaaggugugg

SEQ ID NO: 448553 - RNA, 31 nt, Human
gcuguuccauggaagaauaccaacagucccc

SEQ ID NO: 448554 - RNA, 32 nt, Human
gcuguucccagcuccagcucuaaccucgccua

SEQ ID NO: 448555 - RNA, 32 nt, Human
gcuguucccaggaggcagcucccuccuggcac

SEQ ID NO: 448556 - RNA, 32 nt, Human
gcuguuccccgaggaggaagggaaggggcucu

SEQ ID NO: 448557 - RNA, 32 nt, Human
gcuguucccuaucaaguauuaauguagggaug

SEQ ID NO: 448558 - RNA, 32 nt, Human
gcuguuccuacucaguaaacaggugugaugag

SEQ ID NO: 448559 - RNA, 32 nt, Human
gcuguuccuccagggccagcacucgggcgagg

SEQ ID NO: 448560 - RNA, 32 nt, Human
gcuguuccucccugucaccugccuccucauca

SEQ ID NO: 448561 - RNA, 32 nt, Human
gcuguuccugacuacagccaucaugccucggg

SEQ ID NO: 448562 - RNA, 18 nt, Human
gcuguuccuuccuucaca

SEQ ID NO: 448563 - RNA, 32 nt, Human
gcuguucgaacccagccagggaugaaaaauca

SEQ ID NO: 448564 - RNA, 20 nt, Human
gcuguucgcugucuuuucca

SEQ ID NO: 448565 - RNA, 18 nt, Human
gcuguucggugcaggggg

SEQ ID NO: 448566 - RNA, 32 nt, Human
gcuguucuaguuccucuccauccgccaccucc

SEQ ID NO: 448567 - RNA, 32 nt, Human
gcuguucucagcuccagcuucaaaccucgagu

SEQ ID NO: 448568 - RNA, 32 nt, Human
gcuguucuccacuccugacuucucccagccuc

SEQ ID NO: 448569 - RNA, 32 nt, Human
gcuguucuccccucacugcugagucucccagg

SEQ ID NO: 448570 - RNA, 32 nt, Human
gcuguucuccugcugcucuccugcugcuggcc

SEQ ID NO: 448571 - RNA, 32 nt, Human
gcuguucucuggagaaaaauaaaauggaaauu

SEQ ID NO: 448572 - RNA, 18 nt, Human
gcuguucucuuuuauuca

SEQ ID NO: 448573 - RNA, 32 nt, Human
gcuguucugggcuuccagugauuggcagcuga

SEQ ID NO: 448574 - RNA, 32 nt, Human
gcuguucuggguagccuggggcugaggaggug

SEQ ID NO: 448575 - RNA, 32 nt, Human
gcuguucuuccaaagcccccaggcuggcuuag

SEQ ID NO: 448576 - RNA, 32 nt, Human
gcuguucuuguguggcuuucugggcaguaggg

SEQ ID NO: 448577 - RNA, 21 nt, Human
gcuguucuuucagcugcucca

SEQ ID NO: 448578 - RNA, 32 nt, Human
gcuguugaaagcuucacaagaccauuguuaag

SEQ ID NO: 448579 - RNA, 22 nt, Human
gcuguugaacauccacaaggca

SEQ ID NO: 448580 - RNA, 32 nt, Human
gcuguugaagggucaccuggaggcagacguug

SEQ ID NO: 448581 - RNA, 32 nt, Human
gcuguugacaucagccugcuucuuccccucug

SEQ ID NO: 448582 - RNA, 32 nt, Human
gcuguugagacccugagcccugagucuguauu

SEQ ID NO: 448583 - RNA, 32 nt, Human
gcuguugagauauuuuaaaauauugccuccgu

SEQ ID NO: 448584 - RNA, 32 nt, Human
gcuguugagaugguaacagauuugcuccuaaa

SEQ ID NO: 448585 - RNA, 32 nt, Human
gcuguugagggcccuggagaaacuucagcaga

SEQ ID NO: 448586 - RNA, 19 nt, Human
gcuguugagguccuaggca

SEQ ID NO: 448587 - RNA, 32 nt, Human
gcuguugcaacacugccucacucuuccccucc

SEQ ID NO: 448588 - RNA, 32 nt, Human
gcuguugcagaggcggcuugcuucccaccugu

SEQ ID NO: 448589 - RNA, 32 nt, Human
gcuguugcagugagccaagaucacgccauugc

SEQ ID NO: 448590 - RNA, 25 nt, Human
gcuguugcccaggcugcagugcagu

SEQ ID NO: 448591 - RNA, 25 nt, Human
gcuguugcccaggcuguagugcagu

SEQ ID NO: 448592 - RNA, 21 nt, Human
gcuguugccgaccccggggca

SEQ ID NO: 448593 - RNA, 32 nt, Human
gcuguugccgccgcugcucuagcugccgucag

SEQ ID NO: 448594 - RNA, 32 nt, Human
gcuguugccugggagcuugguacuuucccucc

SEQ ID NO: 448595 - RNA, 19 nt, Human
gcuguugcggacccggggc

SEQ ID NO: 448596 - RNA, 32 nt, Human
gcuguugcuauuuguauuucucuuguccuuua

SEQ ID NO: 448597 - RNA, 32 nt, Human
gcuguugcugaggagggggcugggaccccuuc

SEQ ID NO: 448598 - RNA, 32 nt, Human
gcuguugcugauuuuauucuugaucaguaguu

SEQ ID NO: 448599 - RNA, 32 nt, Human
gcuguugcugcugccaacuacuucuuugcaug

SEQ ID NO: 448600 - RNA, 20 nt, Human
gcuguuggaaaauggugcca

SEQ ID NO: 448601 - RNA, 32 nt, Human
gcuguuggaaagaucuuugugaggauuaggaa

SEQ ID NO: 448602 - RNA, 32 nt, Human
gcuguuggacugucauuucauugcucauugua

SEQ ID NO: 448603 - RNA, 32 nt, Human
gcuguuggagagugcuggaggaaaugcacuuu

SEQ ID NO: 448604 - RNA, 20 nt, Human
gcuguuggaggaccccgagg

SEQ ID NO: 448605 - RNA, 22 nt, Human
gcuguuggaggugcuccgagca

SEQ ID NO: 448606 - RNA, 32 nt, Human
gcuguuggauucugaggguggggagggagaga

SEQ ID NO: 448607 - RNA, 21 nt, Human
gcuguuggcaggaacuccaag

SEQ ID NO: 448608 - RNA, 32 nt, Human
gcuguuggcaugagccacugauguucauguga

SEQ ID NO: 448609 - RNA, 32 nt, Human
gcuguuggccaucccuuccccagccacaggug

SEQ ID NO: 448610 - RNA, 32 nt, Human
gcuguuggcucaccgagaccagccucaucucg

SEQ ID NO: 448611 - RNA, 32 nt, Human
gcuguuggcugcacaucaggaaggcugugaug

SEQ ID NO: 448612 - RNA, 32 nt, Human
gcuguugggaggaacagaugagacaguggcua

SEQ ID NO: 448613 - RNA, 32 nt, Human
gcuguugggaggaagcagaggcagaugggaaa

SEQ ID NO: 448614 - RNA, 32 nt, Human
gcuguuggggagaaggaaaucugaggccccca

SEQ ID NO: 448615 - RNA, 32 nt, Human
gcuguugggggaagaagaguuuuuggacccau

SEQ ID NO: 448616 - RNA, 22 nt, Human
gcuguugggggagaagagggca

SEQ ID NO: 448617 - RNA, 32 nt, Human
gcuguuggggguuucccuguguggaccauggg

SEQ ID NO: 448618 - RNA, 32 nt, Human
gcuguugguggagguccugccuccaggaauag

SEQ ID NO: 448619 - RNA, 32 nt, Human
gcuguuguacaaaggaauugcagcugcuuaca

SEQ ID NO: 448620 - RNA, 32 nt, Human
gcuguuguaguuacaguaaauacacugugaag

SEQ ID NO: 448621 - RNA, 32 nt, Human
gcuguuguaucugucaaaagagaggagaggua

SEQ ID NO: 448622 - RNA, 32 nt, Human
gcuguugucacccaggcuggagugcaguggug

SEQ ID NO: 448623 - RNA, 32 nt, Human
gcuguugucaccggguuuggaaagcaccuuaa

SEQ ID NO: 448624 - RNA, 32 nt, Human
gcuguugucaucuguugaccacaaacacguuu

SEQ ID NO: 448625 - RNA, 32 nt, Human
gcuguugucauuuuucucagcaucuuuguuau

SEQ ID NO: 448626 - RNA, 32 nt, Human
gcuguugucgccuaggcuggagugcaaugaug

SEQ ID NO: 448627 - RNA, 32 nt, Human
gcuguugucucccaggcuggagugcaguggcg

SEQ ID NO: 448628 - RNA, 32 nt, Human
gcuguugugaucacucagcucagcuuuuguua

SEQ ID NO: 448629 - RNA, 32 nt, Human
gcuguuguggugaaggcuuccucgcuaaaagu

SEQ ID NO: 448630 - RNA, 21 nt, Human
gcuguugugucaacugggcca

SEQ ID NO: 448631 - RNA, 25 nt, Human
gcuguuguuaggaaggcaccaaaga

SEQ ID NO: 448632 - RNA, 32 nt, Human
gcuguuguugcccaggcuggagugcaauagca

SEQ ID NO: 448633 - RNA, 32 nt, Human
gcuguuguugcccaggcuggagugcaauggca

SEQ ID NO: 448634 - RNA, 32 nt, Human
gcuguuguugcccaggcuggagugcaauggcg

SEQ ID NO: 448635 - RNA, 26 nt, Human
gcuguuguuuuuugcuccuugagcua

SEQ ID NO: 448636 - RNA, 32 nt, Human
gcuguuuaaggguuuuaucugagccacuuuaa

SEQ ID NO: 448637 - RNA, 32 nt, Human
gcuguuuaccugcauuuguucacuuuuguuga

SEQ ID NO: 448638 - RNA, 32 nt, Human
gcuguuuacuuaagauucuguggugugacauc

SEQ ID NO: 448639 - RNA, 32 nt, Human
gcuguuuagagcugagcaaggccaagugggug

SEQ ID NO: 448640 - RNA, 32 nt, Human
gcuguuuauaguaaaauaaaacucccuaccuu

SEQ ID NO: 448641 - RNA, 24 nt, Human
gcuguuucaaaguucucuguggca

SEQ ID NO: 448642 - RNA, 32 nt, Human
gcuguuucacacuguauauguacauuguuuuc

SEQ ID NO: 448643 - RNA, 32 nt, Human
gcuguuucacagugccaaucuaguucccuccu

SEQ ID NO: 448644 - RNA, 32 nt, Human
gcuguuuccuggcuggagugcaguggcaugau

SEQ ID NO: 448645 - RNA, 32 nt, Human
gcuguuuccuuucaaaguucugggaggacgaa

SEQ ID NO: 448646 - RNA, 32 nt, Human
gcuguuucucccacauauucacauacgugucu

SEQ ID NO: 448647 - RNA, 32 nt, Human
gcuguuucuccgccggucuacuucccauauuu

SEQ ID NO: 448648 - RNA, 32 nt, Human
gcuguuucuuggaaccugcucuccugcuugcu

SEQ ID NO: 448649 - RNA, 32 nt, Human
gcuguuucuuggcucugcucagccaugccagg

SEQ ID NO: 448650 - RNA, 32 nt, Human
gcuguuugaaagcuucaccucaccuuucugca

SEQ ID NO: 448651 - RNA, 32 nt, Human
gcuguuugaaccugccugucuccuggauuuca

SEQ ID NO: 448652 - RNA, 31 nt, Human
gcuguuugacuucucugcugaagugauuucc

SEQ ID NO: 448653 - RNA, 32 nt, Human
gcuguuugcacagcuccaacugugcaugcuca

SEQ ID NO: 448654 - RNA, 32 nt, Human
gcuguuugcaucccugccaggagccuuaaacc

SEQ ID NO: 448655 - RNA, 32 nt, Human
gcuguuugcccaggaacuuaggguggguaccu

SEQ ID NO: 448656 - RNA, 32 nt, Human
gcuguuuggcagaguccuguccuggcuauggg

SEQ ID NO: 448657 - RNA, 32 nt, Human
gcuguuugggcagaauaaagacaagugacuug

SEQ ID NO: 448658 - RNA, 32 nt, Human
gcuguuuggggaggggguguguggagccgggu

SEQ ID NO: 448659 - RNA, 32 nt, Human
gcuguuugguaucaucaccugccauacauguu

SEQ ID NO: 448660 - RNA, 32 nt, Human
gcuguuugucaaggguggggcagcagcaacuu

SEQ ID NO: 448661 - RNA, 19 nt, Human
gcuguuugugcugcagcca

SEQ ID NO: 448662 - RNA, 32 nt, Human
gcuguuuucacucauuagcuccugagguaaac

SEQ ID NO: 448663 - RNA, 32 nt, Human
gcuguuuuccuccccucuguguacucccuuaa

SEQ ID NO: 448664 - RNA, 32 nt, Human
gcuguuuucucaugucucucccagugugaauu

SEQ ID NO: 448665 - RNA, 32 nt, Human
gcuguuuucuucuucuuguaguucuaauuuag

SEQ ID NO: 448666 - RNA, 32 nt, Human
gcuguuuucuugcaggugaagcuccugcaguc

SEQ ID NO: 448667 - RNA, 32 nt, Human
gcuguuuugaauaacauaggugcucuuccuca

SEQ ID NO: 448668 - RNA, 32 nt, Human
gcuguuuuuaucaaaaaggaacaugaggauca

SEQ ID NO: 448669 - RNA, 32 nt, Human
  misc_feature (4)..(4): n is a, c, g or u
gcunugaaggaggcaauguucuucucauuuga

SEQ ID NO: 448670 - RNA, 32 nt, Human
gcuuaaaaauacugaauuuaccuucacaaaag

SEQ ID NO: 448671 - RNA, 32 nt, Human
gcuuaaaaggccauguucuuuccacuucaugu

SEQ ID NO: 448672 - RNA, 32 nt, Human
gcuuaaacccaggaggcaaaggcugcagugag

SEQ ID NO: 448673 - RNA, 32 nt, Human
gcuuaaacccaggaggcggagguugcagugag

SEQ ID NO: 448674 - RNA, 32 nt, Human
gcuuaaacccaggaggcggugguuguaggaag

SEQ ID NO: 448675 - RNA, 32 nt, Human
gcuuaaacccaggagguggagguugcagugag

SEQ ID NO: 448676 - RNA, 32 nt, Human
gcuuaaacccgggaggcagaggcugcagagag

SEQ ID NO: 448677 - RNA, 32 nt, Human
gcuuaaaguaucagugguugagaagagcuuuu

SEQ ID NO: 448678 - RNA, 17 nt, Human
gcuuaaauaacugugau

SEQ ID NO: 448679 - RNA, 32 nt, Human
gcuuaacacagccgggcuugggggcagucagg

SEQ ID NO: 448680 - RNA, 32 nt, Human
gcuuaacacccaccauccaggguccagcuccu

SEQ ID NO: 448681 - RNA, 32 nt, Human
gcuuaacagucuuauucucauucuuuauuuug

SEQ ID NO: 448682 - RNA, 32 nt, Human
gcuuaacaugaaacugucugcauuucuaccug

SEQ ID NO: 448683 - RNA, 32 nt, Human
gcuuaaccaagagugagaggauaugucauguu

SEQ ID NO: 448684 - RNA, 32 nt, Human
gcuuaaccacuuccuuuggucugcacccaaug

SEQ ID NO: 448685 - RNA, 32 nt, Human
gcuuaaccagugagggaagcacugaagagcgc

SEQ ID NO: 448686 - RNA, 32 nt, Human
gcuuaaccauuuccuaugugccaagcugugcc

SEQ ID NO: 448687 - RNA, 32 nt, Human
gcuuaacccaugagcuccaugugccuuuugga

SEQ ID NO: 448688 - RNA, 32 nt, Human
gcuuaaccuuggcuccuguggcauuuuacaaa

SEQ ID NO: 448689 - RNA, 32 nt, Human
gcuuaacgucucugaaccucagcuucuucauc

SEQ ID NO: 448690 - RNA, 32 nt, Human
gcuuaacucuugugguggccagccuccaagau

SEQ ID NO: 448691 - RNA, 32 nt, Human
gcuuaagacacaccugccuucauuucaaccac

SEQ ID NO: 448692 - RNA, 19 nt, Human
gcuuaagacacuccugcug

SEQ ID NO: 448693 - RNA, 32 nt, Human
gcuuaagauccagcugggacuccuagccuccc

SEQ ID NO: 448694 - RNA, 32 nt, Human
gcuuaagcaggagguagagaccaccuguugca

SEQ ID NO: 448695 - RNA, 32 nt, Human
gcuuaagcccagaaggucgaggcugcagugag

SEQ ID NO: 448696 - RNA, 32 nt, Human
gcuuaagcccaggaaguugagaccgcagagag

SEQ ID NO: 448697 - RNA, 32 nt, Human
gcuuaagcccaggagacagagguugcagugag

SEQ ID NO: 448698 - RNA, 32 nt, Human
gcuuaagcccaggagguucaggcugcaguaag

SEQ ID NO: 448699 - RNA, 22 nt, Human
gcuuaagcccaggaguucaaga

SEQ ID NO: 448700 - RNA, 32 nt, Human
gcuuaagcccaggaguucgagaucagccugga

SEQ ID NO: 448701 - RNA, 32 nt, Human
gcuuaagcccaggaguucgggguuacagugag

SEQ ID NO: 448702 - RNA, 32 nt, Human
gcuuaagcccaggaguuugagucuguaaugca

SEQ ID NO: 448703 - RNA, 32 nt, Human
gcuuaagccuaggagacggaggcuguagugag

SEQ ID NO: 448704 - RNA, 22 nt, Human
gcuuaagcucaagaguuugaga

SEQ ID NO: 448705 - RNA, 32 nt, Human
gcuuaagcugccgaggugacacagggcgcugu

SEQ ID NO: 448706 - RNA, 32 nt, Human
gcuuaaggacaaagucuagaaaccacuaucau

SEQ ID NO: 448707 - RNA, 32 nt, Human
gcuuaaggacagugguuaugacaugggggccu

SEQ ID NO: 448708 - RNA, 32 nt, Human
gcuuaaggaucacuguuggcaaugaccacuuc

SEQ ID NO: 448709 - RNA, 32 nt, Human
gcuuaaggcugcagacuaggaaaugggauucc

SEQ ID NO: 448710 - RNA, 32 nt, Human
gcuuaagggaggcggcggcagcgcggcggugg

SEQ ID NO: 448711 - RNA, 21 nt, Human
gcuuaagggucacagguucug

SEQ ID NO: 448712 - RNA, 32 nt, Human
gcuuaagucugggagguugaggcugcagugag

SEQ ID NO: 448713 - RNA, 21 nt, Human
gcuuaauaacaugcaagcuaa

SEQ ID NO: 448714 - RNA, 21 nt, Human
gcuuaauaacugaccuucuga

SEQ ID NO: 448715 - RNA, 19 nt, Human
gcuuaauaauuaauggcua

SEQ ID NO: 448716 - RNA, 32 nt, Human
gcuuaaucuggaacauaauuaaacauccuaca

SEQ ID NO: 448717 - RNA, 32 nt, Human
gcuuaaucuucucugccccaguucuuccugag

SEQ ID NO: 448718 - RNA, 32 nt, Human
gcuuaaucuuuucuaaaaucgccuguaugaaa

SEQ ID NO: 448719 - RNA, 22 nt, Human
gcuuaaugcaaccucuaccucc

SEQ ID NO: 448720 - RNA, 32 nt, Human
gcuuaauucccccaagcagaagaccagaucca

SEQ ID NO: 448721 - RNA, 32 nt, Human
gcuuaauuugcacauccccaccccuugacaac

SEQ ID NO: 448722 - RNA, 32 nt, Human
gcuuaauuuguuuuuaaauacuuuccuggcug

SEQ ID NO: 448723 - RNA, 32 nt, Human
gcuuacaacuagauaaaacauucuuuugacau

SEQ ID NO: 448724 - RNA, 32 nt, Human
gcuuacaacuuaggagcagcaccaacugaagg

SEQ ID NO: 448725 - RNA, 32 nt, Human
gcuuacaccaguaaucccagcacuuugggagg

SEQ ID NO: 448726 - RNA, 32 nt, Human
gcuuacaccuauaaucccagcacuuugggagg

SEQ ID NO: 448727 - RNA, 32 nt, Human
gcuuacaccuguaaccccagcacuuugggagg

SEQ ID NO: 448728 - RNA, 32 nt, Human
gcuuacaccuguaagcccagcacuuugggagg

SEQ ID NO: 448729 - RNA, 32 nt, Human
gcuuacaccuguaaucccaacacuuugcgagg

SEQ ID NO: 448730 - RNA, 32 nt, Human
gcuuacaccuguaaucccaacacuuugggaag

SEQ ID NO: 448731 - RNA, 32 nt, Human
gcuuacaccuguaaucccaaugcuuugggaga

SEQ ID NO: 448732 - RNA, 32 nt, Human
gcuuacaccuguaaucccagcacuuugggagg

SEQ ID NO: 448733 - RNA, 32 nt, Human
gcuuacaccuguaaucccaguacuuugggagg

SEQ ID NO: 448734 - RNA, 32 nt, Human
gcuuacaccuguaauccuaguacuuugggagg

SEQ ID NO: 448735 - RNA, 32 nt, Human
gcuuacaccuguaaucgcagcauuuugggagg

SEQ ID NO: 448736 - RNA, 32 nt, Human
gcuuacaccuguaaucugagcgcuuugggagg

SEQ ID NO: 448737 - RNA, 32 nt, Human
gcuuacaccuguaauuccagcacuuugggacg

SEQ ID NO: 448738 - RNA, 32 nt, Human
gcuuacaccugugaucccagcacuuugggagg

SEQ ID NO: 448739 - RNA, 32 nt, Human
gcuuacacuguugcaucacaagggacucaccc

SEQ ID NO: 448740 - RNA, 32 nt, Human
gcuuacagauaaccaaaaccuuagucaaucug

SEQ ID NO: 448741 - RNA, 20 nt, Human
gcuuacaggaagcuuuuugu

SEQ ID NO: 448742 - RNA, 32 nt, Human
gcuuacaggcugagccaagcccacggccaugc

SEQ ID NO: 448743 - RNA, 32 nt, Human
gcuuacauagccccacgaaucccccaagaggu

SEQ ID NO: 448744 - RNA, 20 nt, Human
gcuuacaucauccuccuguu

SEQ ID NO: 448745 - RNA, 32 nt, Human
gcuuacaucuguaaucccagcacuuugggagg

SEQ ID NO: 448746 - RNA, 22 nt, Human
gcuuacaucuuugucuguagua

SEQ ID NO: 448747 - RNA, 32 nt, Human
gcuuaccaaauggcaagcauugugcugauucc

SEQ ID NO: 448748 - RNA, 32 nt, Human
gcuuaccaccugccaccaagguuuccucucuu

SEQ ID NO: 448749 - RNA, 32 nt, Human
gcuuaccaccuuccaggguccagcacaggugc

SEQ ID NO: 448750 - RNA, 19 nt, Human
gcuuaccacuucccacuca

SEQ ID NO: 448751 - RNA, 32 nt, Human
gcuuacccagaaccacuccuccaggagagcug

SEQ ID NO: 448752 - RNA, 32 nt, Human
gcuuaccccuccauucacagccuccuuacucu

SEQ ID NO: 448753 - RNA, 32 nt, Human
gcuuaccccuguaaucccagcacuuugggagg

SEQ ID NO: 448754 - RNA, 20 nt, Human
gcuuaccugaccucuugcug

SEQ ID NO: 448755 - RNA, 32 nt, Human
gcuuaccugcaaaugaaucacuguggaaaugu

SEQ ID NO: 448756 - RNA, 32 nt, Human
gcuuaccugccugugccauucuuccucugggc

SEQ ID NO: 448757 - RNA, 32 nt, Human
gcuuaccuggcuuaggaaagaccaucauggcc

SEQ ID NO: 448758 - RNA, 17 nt, Human
gcuuaccuguaauucca

SEQ ID NO: 448759 - RNA, 19 nt, Human
gcuuaccuguaauuccagc

SEQ ID NO: 448760 - RNA, 32 nt, Human
gcuuaccugugggugggggagggagaccacac

SEQ ID NO: 448761 - RNA, 32 nt, Human
gcuuaccuucucuuccucauccagaaagcauc

SEQ ID NO: 448762 - RNA, 32 nt, Human
gcuuaccuucugcuguuuguuccaggcucacc

SEQ ID NO: 448763 - RNA, 32 nt, Human
gcuuaccuuguccccaaagggguggguugugg

SEQ ID NO: 448764 - RNA, 32 nt, Human
gcuuacgccuauaaucccagcacuuugggagg

SEQ ID NO: 448765 - RNA, 32 nt, Human
gcuuacgccuauaaucccagcuacucaggagg

SEQ ID NO: 448766 - RNA, 19 nt, Human
gcuuacgccugcaauccca

SEQ ID NO: 448767 - RNA, 32 nt, Human
gcuuacgccuguaaucccaauacuuugggagg

SEQ ID NO: 448768 - RNA, 32 nt, Human
gcuuacgccuguaaucccagcacuuugagagg

SEQ ID NO: 448769 - RNA, 32 nt, Human
gcuuacgccuguaaucccagcacuuugggacg

SEQ ID NO: 448770 - RNA, 32 nt, Human
gcuuacgccuguaaucccagcacuuugggagg

SEQ ID NO: 448771 - RNA, 32 nt, Human
gcuuacgccuguaaucccagcgcuuugggagg

SEQ ID NO: 448772 - RNA, 32 nt, Human
gcuuacgccuguaaucccaggacuuugggagg

SEQ ID NO: 448773 - RNA, 32 nt, Human
gcuuacgccuguaauccuagcacuuugggagg

SEQ ID NO: 448774 - RNA, 32 nt, Human
gcuuacgccuguaauuccagcacuuugggagg

SEQ ID NO: 448775 - RNA, 32 nt, Human
gcuuacgccuguuaucccagcacuuugggagg

SEQ ID NO: 448776 - RNA, 32 nt, Human
gcuuacgccuuuccuuuucuugcuccuucuuc

SEQ ID NO: 448777 - RNA, 32 nt, Human
gcuuacgcuuguagucccagcacuuugggagg

SEQ ID NO: 448778 - RNA, 32 nt, Human
gcuuacggcacaguagagagcuuccagggcug

SEQ ID NO: 448779 - RNA, 32 nt, Human
gcuuacuacaaccuccgccuccuggguucaag

SEQ ID NO: 448780 - RNA, 32 nt, Human
gcuuacuacgaccucugccuccuggguucaag

SEQ ID NO: 448781 - RNA, 32 nt, Human
gcuuacucacucagcaguuacccggccccugu

SEQ ID NO: 448782 - RNA, 32 nt, Human
gcuuacucuccccucaccuuuucuuuucacug

SEQ ID NO: 448783 - RNA, 19 nt, Human
gcuuacugauaaacuugag

SEQ ID NO: 448784 - RNA, 32 nt, Human
gcuuacugcaaccuccaccucccaggugcaag

SEQ ID NO: 448785 - RNA, 32 nt, Human
gcuuacugcaaccuccaccucccagguucaag

SEQ ID NO: 448786 - RNA, 32 nt, Human
gcuuacugcaaccuccaccucccggguucaag

SEQ ID NO: 448787 - RNA, 23 nt, Human
gcuuacugcaaccuccaccuccu

SEQ ID NO: 448788 - RNA, 32 nt, Human
gcuuacugcaaccuccaccuccuggguucaag

SEQ ID NO: 448789 - RNA, 32 nt, Human
gcuuacugcaaccuccgccuccuggguucaag

SEQ ID NO: 448790 - RNA, 32 nt, Human
gcuuacugcaaccuccgccuucccagauucaa

SEQ ID NO: 448791 - RNA, 32 nt, Human
gcuuacugcaacuuccagcuccuggguucgaa

SEQ ID NO: 448792 - RNA, 32 nt, Human
gcuuacugcaacuuccgacucccagguucaag

SEQ ID NO: 448793 - RNA, 32 nt, Human
gcuuacugcaagcuccgccuccuggguucacg

SEQ ID NO: 448794 - RNA, 32 nt, Human
gcuuacugcaagcucugccuccuggguucaag

SEQ ID NO: 448795 - RNA, 32 nt, Human
gcuuacugcacccucaaccuccugggcucaag

SEQ ID NO: 448796 - RNA, 23 nt, Human
gcuuacugcagccucaaccuccu

SEQ ID NO: 448797 - RNA, 32 nt, Human
gcuuacugcagccucaaccuccugggcucagg

SEQ ID NO: 448798 - RNA, 32 nt, Human
gcuuacugcauccccuuuucuaagugcuucac

SEQ ID NO: 448799 - RNA, 32 nt, Human
gcuuacugcccaggugacuugugcauugcuuu

SEQ ID NO: 448800 - RNA, 32 nt, Human
gcuuacuguaccuuccaacuccuggguucaag

SEQ ID NO: 448801 - RNA, 32 nt, Human
gcuuacugugacauccgccuccuggguucaaa

SEQ ID NO: 448802 - RNA, 32 nt, Human
gcuuacuuacugcaaugucuuuggcccuccuu

SEQ ID NO: 448803 - RNA, 32 nt, Human
gcuuacuuaguuuuucucuuccuugucuccca

SEQ ID NO: 448804 - RNA, 19 nt, Human
gcuuacuucaguccugcug

SEQ ID NO: 448805 - RNA, 32 nt, Human
gcuuacuucugccucugcccuggggcuggacu

SEQ ID NO: 448806 - RNA, 32 nt, Human
gcuuacuuugcaaagaaggaagaugguuguuu

SEQ ID NO: 448807 - RNA, 19 nt, Human
gcuuagaaaaaacagccug

SEQ ID NO: 448808 - RNA, 32 nt, Human
gcuuagaaaccccaucaacugaucuagugagu

SEQ ID NO: 448809 - RNA, 32 nt, Human
gcuuagaacaucaauuccucugcugccauuua

SEQ ID NO: 448810 - RNA, 32 nt, Human
gcuuagacugaggagcucugugggcagcccca

SEQ ID NO: 448811 - RNA, 32 nt, Human
gcuuagacugucuccugccacuuuaaauguca

SEQ ID NO: 448812 - RNA, 32 nt, Human
gcuuagagaauagaguuguucaggcugccaau

SEQ ID NO: 448813 - RNA, 32 nt, Human
gcuuagaggaacuugaguuaggauccguacuu

SEQ ID NO: 448814 - RNA, 32 nt, Human
gcuuagagguuucucacaccucuguucccagg

SEQ ID NO: 448815 - RNA, 18 nt, Human
gcuuagagugaaacuuga

SEQ ID NO: 448816 - RNA, 32 nt, Human
gcuuagaugagagcauaucaucaggaaaguuu

SEQ ID NO: 448817 - RNA, 32 nt, Human
gcuuagaugagguggugaaauagggguaucag

SEQ ID NO: 448818 - RNA, 32 nt, Human
gcuuagauguuccaguaaucuaauauggccac

SEQ ID NO: 448819 - RNA, 32 nt, Human
gcuuagcaaggagccaacauaacagaugggcu

SEQ ID NO: 448820 - RNA, 32 nt, Human
gcuuagcaugaaucuucuuuauuguccugauu

SEQ ID NO: 448821 - RNA, 32 nt, Human
gcuuagccauucagaagagaaaaauggaauau

SEQ ID NO: 448822 - RNA, 32 nt, Human
gcuuagcccagcucagggguggggaagaggcg

SEQ ID NO: 448823 - RNA, 32 nt, Human
gcuuagcccaguuuccagggaagcauuguuuu

SEQ ID NO: 448824 - RNA, 32 nt, Human
gcuuagccguccaggcuagagugcaguagugc

SEQ ID NO: 448825 - RNA, 32 nt, Human
gcuuagcucucugcuuuguucuugggagccaa

SEQ ID NO: 448826 - RNA, 20 nt, Human
gcuuagcuggagugcggugg

SEQ ID NO: 448827 - RNA, 32 nt, Human
gcuuagcugggcuguaaagaugaaggcaucaa

SEQ ID NO: 448828 - RNA, 32 nt, Human
gcuuagcuucaaggacaccugccuucaaagcc

SEQ ID NO: 448829 - RNA, 32 nt, Human
gcuuagcuuucugucugugaaugucuauauag

SEQ ID NO: 448830 - RNA, 32 nt, Human
gcuuaggaagcaugagggcaacuauagugagg

SEQ ID NO: 448831 - RNA, 32 nt, Human
gcuuaggaaugcccuuuauggaaagggcuaug

SEQ ID NO: 448832 - RNA, 32 nt, Human
gcuuaggaggcugaagcaggaggauugauuga

SEQ ID NO: 448833 - RNA, 32 nt, Human
gcuuaggaggggcggagacgcucacaucgucu

SEQ ID NO: 448834 - RNA, 32 nt, Human
gcuuaggagguugaggcugcagugagcugugc

SEQ ID NO: 448835 - RNA, 32 nt, Human
gcuuaggauggcuaugugaucagguguggcca

SEQ ID NO: 448836 - RNA, 32 nt, Human
gcuuaggccaugagccuccucaacaagcccaa

SEQ ID NO: 448837 - RNA, 32 nt, Human
gcuuaggccgcagaggucugugggccugagcc

SEQ ID NO: 448838 - RNA, 20 nt, Human
gcuuaggccgggcgcagugg

SEQ ID NO: 448839 - RNA, 32 nt, Human
gcuuaggcgagggagucaggcuggcuucggcc

SEQ ID NO: 448840 - RNA, 24 nt, Human
gcuuaggcgccaccacuaguacca

SEQ ID NO: 448841 - RNA, 32 nt, Human
gcuuagggagucacuauuggaggcagagaggc

SEQ ID NO: 448842 - RNA, 26 nt, Human
gcuuaggggacaagaguuugaacuca

SEQ ID NO: 448843 - RNA, 32 nt, Human
gcuuaggggccuuggaaugccugcuguccagc

SEQ ID NO: 448844 - RNA, 24 nt, Human
gcuuagguaggagaauagcuugag

SEQ ID NO: 448845 - RNA, 32 nt, Human
gcuuaggugucacccacuggccuucguggugu

SEQ ID NO: 448846 - RNA, 32 nt, Human
gcuuagguuuuucugucauccucagaucccac

SEQ ID NO: 448847 - RNA, 22 nt, Human
gcuuagucacauggccacaccc

SEQ ID NO: 448848 - RNA, 32 nt, Human
gcuuaguccaauugcagagaacucgcuuccca

SEQ ID NO: 448849 - RNA, 32 nt, Human
gcuuaguccagucugugcuccugggcuacaag

SEQ ID NO: 448850 - RNA, 32 nt, Human
gcuuagugcuaggacugagaggcugcaccaua

SEQ ID NO: 448851 - RNA, 32 nt, Human
gcuuagugcucacuaggggacaugcacaugga

SEQ ID NO: 448852 - RNA, 32 nt, Human
gcuuagugcucagagcuggggagggagguucc

SEQ ID NO: 448853 - RNA, 32 nt, Human
gcuuaguggagaugggcaccacugccauuugc

SEQ ID NO: 448854 - RNA, 32 nt, Human
gcuuaguggagugcuuaggguaguuggccagg

SEQ ID NO: 448855 - RNA, 21 nt, Human
gcuuaguggggacccagggca

SEQ ID NO: 448856 - RNA, 23 nt, Human
gcuuaguguccucauccguuaaa

SEQ ID NO: 448857 - RNA, 32 nt, Human
gcuuaguuacaacuguuaaugugugaccugcu

SEQ ID NO: 448858 - RNA, 32 nt, Human
gcuuaguuaggaaggcaguaggauguggccug

SEQ ID NO: 448859 - RNA, 32 nt, Human
gcuuaguuccaaugcauuuggcuccagaaaga

SEQ ID NO: 448860 - RNA, 32 nt, Human
gcuuaguucugagccauuuauucugcuacacu

SEQ ID NO: 448861 - RNA, 32 nt, Human
gcuuaguugcuucccaccccagccugacacac

SEQ ID NO: 448862 - RNA, 32 nt, Human
gcuuauaacauccugacuaugcuuacaaauau

SEQ ID NO: 448863 - RNA, 19 nt, Human
gcuuauaccuguaauccua

SEQ ID NO: 448864 - RNA, 32 nt, Human
gcuuauaccuguaauccuagcacuuugggagg

SEQ ID NO: 448865 - RNA, 32 nt, Human
gcuuauaguccuggggaucagaauuccaaaau

SEQ ID NO: 448866 - RNA, 32 nt, Human
gcuuauaugcuaacucuuuucauguuagcaaa

SEQ ID NO: 448867 - RNA, 32 nt, Human
gcuuaucaggacuuccagagucaugcaugaac

SEQ ID NO: 448868 - RNA, 21 nt, Human
gcuuaucccccagacccugcu

SEQ ID NO: 448869 - RNA, 32 nt, Human
gcuuaucccgggaauucaagguugcagugagc

SEQ ID NO: 448870 - RNA, 32 nt, Human
gcuuaucccuucugcucucuccccucacccag

SEQ ID NO: 448871 - RNA, 32 nt, Human
gcuuauccuaacaaucuucauggcaggauuuu

SEQ ID NO: 448872 - RNA, 32 nt, Human
gcuuauccuucagagcaaugaccugcaugcag

SEQ ID NO: 448873 - RNA, 32 nt, Human
gcuuaucuacagcccuaaucugcugauugaac

SEQ ID NO: 448874 - RNA, 19 nt, Human
gcuuaucucaccucugcug

SEQ ID NO: 448875 - RNA, 32 nt, Human
gcuuaucuccaauaaacaucuauguuaaaucc

SEQ ID NO: 448876 - RNA, 32 nt, Human
gcuuaucucugccuccuuccuccuccuuccca

SEQ ID NO: 448877 - RNA, 32 nt, Human
gcuuaucugauuugccuccuuuggaaaggcug

SEQ ID NO: 448878 - RNA, 32 nt, Human
gcuuaucuguuggcuucucuuggccuguggga

SEQ ID NO: 448879 - RNA, 17 nt, Human
gcuuaucuucuuugaua

SEQ ID NO: 448880 - RNA, 32 nt, Human
gcuuaugagagccaaguagucaguggaagaga

SEQ ID NO: 448881 - RNA, 31 nt, Human
gcuuaugaguuauuucacacauuccugagca

SEQ ID NO: 448882 - RNA, 32 nt, Human
gcuuaugaucugagcaaaaugugaacuucagu

SEQ ID NO: 448883 - RNA, 19 nt, Human
gcuuaugauuuauccugcu

SEQ ID NO: 448884 - RNA, 32 nt, Human
gcuuaugcagaacaucucugugaaacgcugcu

SEQ ID NO: 448885 - RNA, 32 nt, Human
gcuuaugcaucuggugggagaggguggggagg

SEQ ID NO: 448886 - RNA, 32 nt, Human
gcuuaugcccauaaucacagcacuucgggagg

SEQ ID NO: 448887 - RNA, 32 nt, Human
gcuuaugccuaggagguugaggcugcagugag

SEQ ID NO: 448888 - RNA, 32 nt, Human
gcuuaugccuauaauccuagcacuuugggagg

SEQ ID NO: 448889 - RNA, 32 nt, Human
gcuuaugccuguaaucccacuuugggaggcca

SEQ ID NO: 448890 - RNA, 32 nt, Human
gcuuaugccuguaaucccagcacucugggagg

SEQ ID NO: 448891 - RNA, 32 nt, Human
gcuuaugccuguaaucccagcacuuggggaag

SEQ ID NO: 448892 - RNA, 32 nt, Human
gcuuaugccuguaaucccagcacuuugcaggc

SEQ ID NO: 448893 - RNA, 32 nt, Human
gcuuaugccuguaaucccagcacuuuggaagg

SEQ ID NO: 448894 - RNA, 32 nt, Human
gcuuaugccuguaaucccagcacuuugggagg

SEQ ID NO: 448895 - RNA, 32 nt, Human
gcuuaugccuguaaucccagcacuuuggguga

SEQ ID NO: 448896 - RNA, 32 nt, Human
gcuuaugccuguaaucccagcaugcugggagg

SEQ ID NO: 448897 - RNA, 32 nt, Human
gcuuaugccuguaaucccgguacuuugggagg

SEQ ID NO: 448898 - RNA, 32 nt, Human
gcuuaugccuguaaucccugcacuuugggaag

SEQ ID NO: 448899 - RNA, 32 nt, Human
gcuuaugccuguaauccuagaacuuugggagg

SEQ ID NO: 448900 - RNA, 32 nt, Human
gcuuaugccuguaauccuagcgcuuugggagg

SEQ ID NO: 448901 - RNA, 32 nt, Human
gcuuaugccuguaauugcagcacuuuuagagg

SEQ ID NO: 448902 - RNA, 32 nt, Human
gcuuaugcuacuuaaucagaaucuugagaaaa

SEQ ID NO: 448903 - RNA, 32 nt, Human
gcuuaugcuuguaaucccagcacuuugggagg

SEQ ID NO: 448904 - RNA, 32 nt, Human
gcuuauggaagacauaccugcaauggaagcug

SEQ ID NO: 448905 - RNA, 29 nt, Human
gcuuauggccauauguauggccauuugua

SEQ ID NO: 448906 - RNA, 32 nt, Human
gcuuauggccggucacagccucagugugacuc

SEQ ID NO: 448907 - RNA, 32 nt, Human
gcuuauggcguuggucacuggcaggcucagag

SEQ ID NO: 448908 - RNA, 32 nt, Human
gcuuaugggaaacugcugauucccuucguguc

SEQ ID NO: 448909 - RNA, 32 nt, Human
gcuuaugggaauccugagcugcuuuucaccau

SEQ ID NO: 448910 - RNA, 32 nt, Human
gcuuaugggauccuccugccucagcuuccuaa

SEQ ID NO: 448911 - RNA, 32 nt, Human
gcuuaugggggaaggugacgccuucugggccc

SEQ ID NO: 448912 - RNA, 32 nt, Human
gcuuauggugaguguggcugggggugcagaga

SEQ ID NO: 448913 - RNA, 32 nt, Human
gcuuaugguuccuuuucucaggagaggauuuu

SEQ ID NO: 448914 - RNA, 32 nt, Human
gcuuaugucaucucuguuauuguccccagcuu

SEQ ID NO: 448915 - RNA, 32 nt, Human
gcuuaugucuguaaucccagcacuuuugagag

SEQ ID NO: 448916 - RNA, 32 nt, Human
gcuuauuccucccauuccucuacuuuacugug

SEQ ID NO: 448917 - RNA, 32 nt, Human
gcuuauucuccucccuguuaucugcuagaucu

SEQ ID NO: 448918 - RNA, 32 nt, Human
gcuuauugaagccucugccuccuggguucaag

SEQ ID NO: 448919 - RNA, 32 nt, Human
gcuuauugcaaccuccgcuuccuggguucaaa

SEQ ID NO: 448920 - RNA, 32 nt, Human
gcuuauugcagucuccaccuccugaguucaag

SEQ ID NO: 448921 - RNA, 32 nt, Human
gcuuauugcccaggcuggagugcaauggcacg

SEQ ID NO: 448922 - RNA, 23 nt, Human
gcuuauuggcaccagggacagag

SEQ ID NO: 448923 - RNA, 32 nt, Human
gcuuauuggugauccuagaugcagccugcaac

SEQ ID NO: 448924 - RNA, 31 nt, Human
gcuuauuuaucuguuugccaugcagaaaaua

SEQ ID NO: 448925 - RNA, 18 nt, Human
gcuuauuugccaaagcug

SEQ ID NO: 448926 - RNA, 15 nt, Human
gcuuauuugcccugc

SEQ ID NO: 448927 - RNA, 19 nt, Human
gcuuauuuguaaacucugu

SEQ ID NO: 448928 - RNA, 32 nt, Human
gcuuauuuucuuuccgcccccuccggggcuga

SEQ ID NO: 448929 - RNA, 32 nt, Human
gcuucaaaaagccacagcagagcauugucacc

SEQ ID NO: 448930 - RNA, 32 nt, Human
gcuucaaaacuagaagugcgcaugaaggaugc

SEQ ID NO: 448931 - RNA, 32 nt, Human
gcuucaaacagaguccagcacaguguggcacc

SEQ ID NO: 448932 - RNA, 32 nt, Human
gcuucaaagcaaacccuuacacacacaaagcc

SEQ ID NO: 448933 - RNA, 22 nt, Human
gcuucaaccaaaugaaacuuga

SEQ ID NO: 448934 - RNA, 32 nt, Human
gcuucaacugaguagagagcagccuggguucc

SEQ ID NO: 448935 - RNA, 32 nt, Human
gcuucaacuguacuucauuuaaugccauuaau

SEQ ID NO: 448936 - RNA, 32 nt, Human
gcuucaacuuccugggcucaaguaauccuccc

SEQ ID NO: 448937 - RNA, 25 nt, Human
gcuucaacuugauuaucuugugaaa

SEQ ID NO: 448938 - RNA, 32 nt, Human
gcuucaagauccugcuaccauuuucuuuuggg

SEQ ID NO: 448939 - RNA, 32 nt, Human
gcuucaagcaauccuccugccuuggccuccca

SEQ ID NO: 448940 - RNA, 32 nt, Human
gcuucaaggaaugggaaagggaggguaggaag

SEQ ID NO: 448941 - RNA, 32 nt, Human
gcuucaaggccuggggagccuguccuuccaug

SEQ ID NO: 448942 - RNA, 32 nt, Human
gcuucaagggagcauuauagggcagaaaacaa

SEQ ID NO: 448943 - RNA, 24 nt, Human
gcuucaagggauccucccaccuca

SEQ ID NO: 448944 - RNA, 32 nt, Human
gcuucaagggcagccuggaggaaagaggugug

SEQ ID NO: 448945 - RNA, 32 nt, Human
gcuucaagucucucucugugacuggugauuuu

SEQ ID NO: 448946 - RNA, 32 nt, Human
gcuucaaguucagaucaggcaaggaacaaacc

SEQ ID NO: 448947 - RNA, 32 nt, Human
gcuucaauaaaucugugcuuuuauugcuucaa

SEQ ID NO: 448948 - RNA, 32 nt, Human
gcuucaaugccacggccugaccggaguauccg

SEQ ID NO: 448949 - RNA, 32 nt, Human
gcuucaauucaggagcuuugaaggaaguccaa

SEQ ID NO: 448950 - RNA, 32 nt, Human
gcuucacaaaagcugauagaguacaaucccac

SEQ ID NO: 448951 - RNA, 20 nt, Human
gcuucacaaaugaaaaggag

SEQ ID NO: 448952 - RNA, 19 nt, Human
gcuucacaaaugugcugag

SEQ ID NO: 448953 - RNA, 32 nt, Human
gcuucacaagcaggcagcugaacacuucguac

SEQ ID NO: 448954 - RNA, 32 nt, Human
gcuucacaagggcaggagagcccuccaucacu

SEQ ID NO: 448955 - RNA, 32 nt, Human
gcuucacagccucuauggcuacaugguucuuc

SEQ ID NO: 448956 - RNA, 32 nt, Human
gcuucacaguaggaaaggguaaguggggccca

SEQ ID NO: 448957 - RNA, 32 nt, Human
gcuucacaguggacucuccacgcccagcuagc

SEQ ID NO: 448958 - RNA, 32 nt, Human
gcuucacaugguuaaaaacaagcacaauuuug

SEQ ID NO: 448959 - RNA, 32 nt, Human
gcuucaccaaagaggaccccacucugaagcca

SEQ ID NO: 448960 - RNA, 32 nt, Human
gcuucaccacucccucugggcugugauucugu

SEQ ID NO: 448961 - RNA, 32 nt, Human
gcuucaccacugggcucuuccucccagaccca

SEQ ID NO: 448962 - RNA, 32 nt, Human
gcuucaccauccugggucaagcaguguuccuu

SEQ ID NO: 448963 - RNA, 32 nt, Human
gcuucacccaucacugguggguugcaggaaca

SEQ ID NO: 448964 - RNA, 32 nt, Human
gcuucacccugaguuuuguuuuguauuguuuu

SEQ ID NO: 448965 - RNA, 32 nt, Human
gcuucaccgaccgaucuccaucggcugcggcc

SEQ ID NO: 448966 - RNA, 32 nt, Human
gcuucaccgagucccucaagccccaggaggca

SEQ ID NO: 448967 - RNA, 32 nt, Human
gcuucaccucauuccucccacuggccuuaccc

SEQ ID NO: 448968 - RNA, 32 nt, Human
gcuucaccuggaggggccagagggucaccugg

SEQ ID NO: 448969 - RNA, 32 nt, Human
gcuucaccugggacagcagacacagcagaacc

SEQ ID NO: 448970 - RNA, 32 nt, Human
gcuucacgagacugaccagccuggugagauaa

SEQ ID NO: 448971 - RNA, 32 nt, Human
gcuucacgccuguaauucuagcacuuugggag

SEQ ID NO: 448972 - RNA, 18 nt, Human
gcuucacgguaagcugag

SEQ ID NO: 448973 - RNA, 32 nt, Human
gcuucacgugguuuggagaugggugggggaaa

SEQ ID NO: 448974 - RNA, 21 nt, Human
gcuucacuauacaguauucca

SEQ ID NO: 448975 - RNA, 32 nt, Human
gcuucacucggaucacgcccuccugggcacag

SEQ ID NO: 448976 - RNA, 32 nt, Human
gcuucacuuccguuccagccucagcggcagcu

SEQ ID NO: 448977 - RNA, 32 nt, Human
gcuucacuugcuccuucacuucccaguuccgc

SEQ ID NO: 448978 - RNA, 32 nt, Human
gcuucagaaacucccaauuccaaaaagcugag

SEQ ID NO: 448979 - RNA, 32 nt, Human
gcuucagaagccaugacuccccaacucugccu

SEQ ID NO: 448980 - RNA, 21 nt, Human
gcuucagaagcccugcuccca

SEQ ID NO: 448981 - RNA, 32 nt, Human
gcuucagacuuagaggugaauaaauugagguc

SEQ ID NO: 448982 - RNA, 32 nt, Human
gcuucagagagggagaagcacugugaggccuc

SEQ ID NO: 448983 - RNA, 18 nt, Human
gcuucagagcuucccaug

SEQ ID NO: 448984 - RNA, 32 nt, Human
gcuucagaggcuaauauaacaaaaccaauaaa

SEQ ID NO: 448985 - RNA, 32 nt, Human
gcuucagaugggaagaagucagaggaaccaga

SEQ ID NO: 448986 - RNA, 32 nt, Human
gcuucagcaggagauccuucccagaagguuga

SEQ ID NO: 448987 - RNA, 22 nt, Human
gcuucagccccagacccugcag

SEQ ID NO: 448988 - RNA, 22 nt, Human
gcuucagccccaggcccuaagc

SEQ ID NO: 448989 - RNA, 32 nt, Human
gcuucagcccgggagauugaggcugcggugag

SEQ ID NO: 448990 - RNA, 32 nt, Human
gcuucagccuccauucucacuuuccuucucaa

SEQ ID NO: 448991 - RNA, 20 nt, Human
gcuucagccucgccugcugc

SEQ ID NO: 448992 - RNA, 32 nt, Human
gcuucagccuggaccagggguggacccugugc

SEQ ID NO: 448993 - RNA, 22 nt, Human
gcuucagccugggcaacaagag

SEQ ID NO: 448994 - RNA, 18 nt, Human
gcuucagccuguguaguc

SEQ ID NO: 448995 - RNA, 32 nt, Human
gcuucagcgaugacuccagucuggguguccca

SEQ ID NO: 448996 - RNA, 32 nt, Human
gcuucagcuccuuuacuugcugcuccaacugc

SEQ ID NO: 448997 - RNA, 32 nt, Human
gcuucagcuggcagagaggcuuucccagaaaa

SEQ ID NO: 448998 - RNA, 32 nt, Human
gcuucagcuucucggguguacaacagcagcug

SEQ ID NO: 448999 - RNA, 32 nt, Human
gcuucagcuuucuuacagcuauucugggccug

SEQ ID NO: 449000 - RNA, 32 nt, Human
gcuucaggaaguguggcgaccagaaagcguag

SEQ ID NO: 449001 - RNA, 32 nt, Human
gcuucaggaccugcuuggucagcugcagguug

SEQ ID NO: 449002 - RNA, 32 nt, Human
gcuucaggauacuuccaggagacagagccacc

SEQ ID NO: 449003 - RNA, 32 nt, Human
gcuucaggaugaaaggugagaccccggugaac

SEQ ID NO: 449004 - RNA, 26 nt, Human
gcuucaggcccccgccuuggccugug

SEQ ID NO: 449005 - RNA, 32 nt, Human
gcuucaggccugaagagcagagaagcccuguu

SEQ ID NO: 449006 - RNA, 32 nt, Human
gcuucaggcucugaagcacuccccaucucagg

SEQ ID NO: 449007 - RNA, 32 nt, Human
gcuucaggcugcucccugaccccucugaccuu

SEQ ID NO: 449008 - RNA, 32 nt, Human
gcuucaggcugcuucugcucugugucugccca

SEQ ID NO: 449009 - RNA, 32 nt, Human
gcuucaggcuguagagggaauuuggucugaag

SEQ ID NO: 449010 - RNA, 32 nt, Human
gcuucagggacuuaccuuccuggucauuuuua

SEQ ID NO: 449011 - RNA, 32 nt, Human
gcuucaggguaaaacugucuacuagcaagauu

SEQ ID NO: 449012 - RNA, 32 nt, Human
gcuucaggguacagcucccccgcagccagaag

SEQ ID NO: 449013 - RNA, 32 nt, Human
gcuucagguccaggcuguguuuggcuuucagg

SEQ ID NO: 449014 - RNA, 22 nt, Human
gcuucaguagaaugaaacguga

SEQ ID NO: 449015 - RNA, 32 nt, Human
gcuucagucaacugaccaaacacugcuuugaa

SEQ ID NO: 449016 - RNA, 24 nt, Human
gcuucagucagcgcaaguauucca

SEQ ID NO: 449017 - RNA, 32 nt, Human
gcuucagucucagcagagaauuuccuaaaugc

SEQ ID NO: 449018 - RNA, 32 nt, Human
gcuucagucuccaggagacaguggucaccucu

SEQ ID NO: 449019 - RNA, 32 nt, Human
gcuucagugagcuaugggugcaccacuacaca

SEQ ID NO: 449020 - RNA, 32 nt, Human
gcuucagugccugccuuggggugaggaagaca

SEQ ID NO: 449021 - RNA, 32 nt, Human
gcuucagugcggcucugucccugcugccgccu

SEQ ID NO: 449022 - RNA, 20 nt, Human
gcuucagugcugugugcucu

SEQ ID NO: 449023 - RNA, 32 nt, Human
gcuucaguggacaaagaagaugagacauuuca

SEQ ID NO: 449024 - RNA, 32 nt, Human
gcuucaguggccaccagccucgucacauacac

SEQ ID NO: 449025 - RNA, 32 nt, Human
gcuucaguguuaacacagcagugauugucagc

SEQ ID NO: 449026 - RNA, 32 nt, Human
gcuucaguucauucccccaucuugcugccaag

SEQ ID NO: 449027 - RNA, 20 nt, Human
gcuucaguuucaacaucugu

SEQ ID NO: 449028 - RNA, 23 nt, Human
gcuucaguuucccauggcuggaa

SEQ ID NO: 449029 - RNA, 32 nt, Human
gcuucaguuucccccagcacccaggagagccu

SEQ ID NO: 449030 - RNA, 24 nt, Human
gcuucaguuuccucaucugugaaa

SEQ ID NO: 449031 - RNA, 24 nt, Human
gcuucaguuuccuggucuguagaa

SEQ ID NO: 449032 - RNA, 20 nt, Human
gcuucaguuuucucaucugu

SEQ ID NO: 449033 - RNA, 22 nt, Human
gcuucaguuuuucaugucccca

SEQ ID NO: 449034 - RNA, 24 nt, Human
gcuucauacucuugagcacauccu

SEQ ID NO: 449035 - RNA, 32 nt, Human
gcuucauaucucucccuucuuuaccuucauuu

SEQ ID NO: 449036 - RNA, 32 nt, Human
gcuucauccaauauaucauucaaaugcaucug

SEQ ID NO: 449037 - RNA, 32 nt, Human
gcuucauccaugucccuacaaaggacaugaac

SEQ ID NO: 449038 - RNA, 32 nt, Human
gcuucauccaugucccugcaaaggacaugguc

SEQ ID NO: 449039 - RNA, 32 nt, Human
gcuucauccauguuccuacaaaggacaugaac

SEQ ID NO: 449040 - RNA, 32 nt, Human
gcuucaucccccaagauggccgaugaucuggc

SEQ ID NO: 449041 - RNA, 21 nt, Human
gcuucauccguggaacuugag

SEQ ID NO: 449042 - RNA, 32 nt, Human
gcuucauccuugggccagaaggcuccaacccu

SEQ ID NO: 449043 - RNA, 32 nt, Human
gcuucaucguggggcucucaguuccgauuccc

SEQ ID NO: 449044 - RNA, 18 nt, Human
gcuucaucuaaaacuuug

SEQ ID NO: 449045 - RNA, 32 nt, Human
gcuucaucuaugucccuacaaaggacaugaac

SEQ ID NO: 449046 - RNA, 32 nt, Human
gcuucaucucugccucucuccaccccacccca

SEQ ID NO: 449047 - RNA, 21 nt, Human
gcuucaucugcaaagggcccu

SEQ ID NO: 449048 - RNA, 24 nt, Human
gcuucaucuguagaaacagccacu

SEQ ID NO: 449049 - RNA, 24 nt, Human
gcuucaucuguauuuacagcugcu

SEQ ID NO: 449050 - RNA, 24 nt, Human
gcuucaucuguauuuauagccacu

SEQ ID NO: 449051 - RNA, 24 nt, Human
gcuucaucuguauuuauggcuacu

SEQ ID NO: 449052 - RNA, 24 nt, Human
gcuucaucuguauuuccagccacu

SEQ ID NO: 449053 - RNA, 32 nt, Human
gcuucaugagcagcugcuugaguucaggaagu

SEQ ID NO: 449054 - RNA, 18 nt, Human
gcuucaugcagacuugag

SEQ ID NO: 449055 - RNA, 32 nt, Human
gcuucaugccagguuaggaaggcagcauucca

SEQ ID NO: 449056 - RNA, 32 nt, Human
gcuucaugccucccuucucccagcucaggugg

SEQ ID NO: 449057 - RNA, 32 nt, Human
gcuucaugccuguaauccaagcacuuugagag

SEQ ID NO: 449058 - RNA, 30 nt, Human
gcuucaugcugaggaagauucuugaagacu

SEQ ID NO: 449059 - RNA, 32 nt, Human
gcuucauggucuucguggacaugugagggccg

SEQ ID NO: 449060 - RNA, 32 nt, Human
gcuucaugguguuccuggaaggcagaugagcu

SEQ ID NO: 449061 - RNA, 32 nt, Human
gcuucaugucacagcauuuaguuuguucaaca

SEQ ID NO: 449062 - RNA, 32 nt, Human
gcuucaugugcaugugcacacugcccccugau

SEQ ID NO: 449063 - RNA, 32 nt, Human
gcuucauguguauggcuauuuguauuuaacaa

SEQ ID NO: 449064 - RNA, 32 nt, Human
gcuucauuaaauuaaucucacuuugaauaucu

SEQ ID NO: 449065 - RNA, 32 nt, Human
gcuucauuaagaguuuuauacugugaagauuu

SEQ ID NO: 449066 - RNA, 32 nt, Human
gcuucauuauucaccauccagagaccaaauaa

SEQ ID NO: 449067 - RNA, 32 nt, Human
gcuucauucaccgaacuuugugcucaaaaugc

SEQ ID NO: 449068 - RNA, 32 nt, Human
gcuucauucagucuauggaccaggaagaauuu

SEQ ID NO: 449069 - RNA, 32 nt, Human
gcuucauucucacccuguauuucuuuagcccu

SEQ ID NO: 449070 - RNA, 32 nt, Human
gcuucauucugucacccaggcuggagugcaaa

SEQ ID NO: 449071 - RNA, 32 nt, Human
gcuucauuuaggucucacaacucacuagacau

SEQ ID NO: 449072 - RNA, 32 nt, Human
gcuucauuuauuccuuuccuuucuauccuuuu

SEQ ID NO: 449073 - RNA, 32 nt, Human
gcuucauuucuuccacuucuccagaaaaugga

SEQ ID NO: 449074 - RNA, 32 nt, Human
gcuucauuugacacccagagucugacuuugga

SEQ ID NO: 449075 - RNA, 32 nt, Human
gcuuccaaaagaucaaguugcuuuuguuuguu

SEQ ID NO: 449076 - RNA, 32 nt, Human
gcuuccaaaagcuugugaguuggggaauccau

SEQ ID NO: 449077 - RNA, 32 nt, Human
gcuuccaaaagugcccgaggcagcccuuccag

SEQ ID NO: 449078 - RNA, 32 nt, Human
gcuuccaaaggaucaggggaucacccugagaa

SEQ ID NO: 449079 - RNA, 32 nt, Human
gcuuccaaagugauggacaggaaggggcagag

SEQ ID NO: 449080 - RNA, 32 nt, Human
gcuuccaacacucacuggcugugugacuuugg

SEQ ID NO: 449081 - RNA, 32 nt, Human
gcuuccaacccagccaggggucuuaggugucc

SEQ ID NO: 449082 - RNA, 32 nt, Human
gcuuccaacuuaggcuuuuggcucagaagauu

SEQ ID NO: 449083 - RNA, 32 nt, Human
gcuuccaagaaagaggaggagaguugaaaaga

SEQ ID NO: 449084 - RNA, 32 nt, Human
gcuuccaagcagcaugcuacaggccagccuuc

SEQ ID NO: 449085 - RNA, 19 nt, Human
gcuuccaagcccccggcac

SEQ ID NO: 449086 - RNA, 32 nt, Human
gcuuccaaguucugagagcccaaaaaggccag

SEQ ID NO: 449087 - RNA, 32 nt, Human
gcuuccaaucauggcagaaaagaaaggggcgc

SEQ ID NO: 449088 - RNA, 32 nt, Human
gcuuccacaaaacauagcaggggaacuauuau

SEQ ID NO: 449089 - RNA, 32 nt, Human
gcuuccaccaggagucuggagugcaauggcac

SEQ ID NO: 449090 - RNA, 32 nt, Human
gcuuccacccuuucacacaauucaugucauca

SEQ ID NO: 449091 - RNA, 21 nt, Human
gcuuccaccucuccacuccug

SEQ ID NO: 449092 - RNA, 32 nt, Human
gcuuccaccucuccacuccugugucuaccugg

SEQ ID NO: 449093 - RNA, 32 nt, Human
gcuuccaccugcuaggagggugguguacucua

SEQ ID NO: 449094 - RNA, 15 nt, Human
gcuuccaccugcucc

SEQ ID NO: 449095 - RNA, 32 nt, Human
gcuuccacgcauggcuucugccauugguucuc

SEQ ID NO: 449096 - RNA, 32 nt, Human
gcuuccacggcagcaucuucagcucuuggguu

SEQ ID NO: 449097 - RNA, 32 nt, Human
gcuuccacgugggccucacauuccaguccuuu

SEQ ID NO: 449098 - RNA, 32 nt, Human
gcuuccacuacaucaggaggugaaggaggaaa

SEQ ID NO: 449099 - RNA, 32 nt, Human
gcuuccacugcacccccucccaagggacacag

SEQ ID NO: 449100 - RNA, 21 nt, Human
gcuuccacugcauccuggcca

SEQ ID NO: 449101 - RNA, 32 nt, Human
gcuuccacuguggcucaauccuauguucugaa

SEQ ID NO: 449102 - RNA, 23 nt, Human
gcuuccagaaacacccacaggca

SEQ ID NO: 449103 - RNA, 22 nt, Human
gcuuccagaaagcccagggcag

SEQ ID NO: 449104 - RNA, 32 nt, Human
gcuuccagaaaugccacacuugugugccacag

SEQ ID NO: 449105 - RNA, 32 nt, Human
gcuuccagaaccuggcaggaggcugguguauc

SEQ ID NO: 449106 - RNA, 20 nt, Human
gcuuccagaacuacagacag

SEQ ID NO: 449107 - RNA, 24 nt, Human
gcuuccagaggaagaagcaggcag

SEQ ID NO: 449108 - RNA, 32 nt, Human
gcuuccagaggaagacgagggagcaggagcuu

SEQ ID NO: 449109 - RNA, 24 nt, Human
gcuuccagaggaaggaacaggcag

SEQ ID NO: 449110 - RNA, 23 nt, Human
gcuuccagaggaaggaucaggca

SEQ ID NO: 449111 - RNA, 22 nt, Human
gcuuccagcagcacaaaagcag

SEQ ID NO: 449112 - RNA, 21 nt, Human
gcuuccagcagugccuucccu

SEQ ID NO: 449113 - RNA, 32 nt, Human
gcuuccagcauuuucauggauuacaaaugucu

SEQ ID NO: 449114 - RNA, 32 nt, Human
gcuuccagccaagaaaauagacugaggugcuu

SEQ ID NO: 449115 - RNA, 32 nt, Human
gcuuccagcccacuccagccaggggagcaggg

SEQ ID NO: 449116 - RNA, 32 nt, Human
gcuuccagcccuacauugaaccaccuucuuuc

SEQ ID NO: 449117 - RNA, 32 nt, Human
gcuuccagccucuaccaugcaggagagaacac

SEQ ID NO: 449118 - RNA, 32 nt, Human
gcuuccaggaacucagccugcacagaggcagc

SEQ ID NO: 449119 - RNA, 32 nt, Human
gcuuccaggccuggcuuccucucuugggagac

SEQ ID NO: 449120 - RNA, 32 nt, Human
gcuuccaggccugguuccugggcggguguuga

SEQ ID NO: 449121 - RNA, 32 nt, Human
gcuuccaggcuggauggagugcccuggcgcga

SEQ ID NO: 449122 - RNA, 19 nt, Human
gcuuccagggacccaggca

SEQ ID NO: 449123 - RNA, 22 nt, Human
gcuuccagggucacuccuugcc

SEQ ID NO: 449124 - RNA, 32 nt, Human
gcuuccagguauggagaaagagacaaagagga

SEQ ID NO: 449125 - RNA, 22 nt, Human
gcuuccaguacugcacuuugcc

SEQ ID NO: 449126 - RNA, 22 nt, Human
ggaacccaugauuguuaauuca

SEQ ID NO: 449127 - RNA, 32 nt, Human
ggaaccccaccugacccaagcccaccugcugc

SEQ ID NO: 449128 - RNA, 32 nt, Human
ggaaccccauagccccucuccaccucacccca

SEQ ID NO: 449129 - RNA, 20 nt, Human
ggaaccccaucucuacaaaa

SEQ ID NO: 449130 - RNA, 18 nt, Human
ggaaccccaucucuacua

SEQ ID NO: 449131 - RNA, 32 nt, Human
ggaaccccaucuucagcccagccuguccgucc

SEQ ID NO: 449132 - RNA, 26 nt, Human
ggaacccccaagugaggcuggaggga

SEQ ID NO: 449133 - RNA, 32 nt, Human
ggaaccccucaacgaagcugugaaugaagagg

SEQ ID NO: 449134 - RNA, 32 nt, Human
ggaaccccuccccacccucuuuccccagcgcu

SEQ ID NO: 449135 - RNA, 32 nt, Human
ggaaccccucccccauuuacuucuccaccucc

SEQ ID NO: 449136 - RNA, 32 nt, Human
ggaaccccucccugaggaccucagacccucuc

SEQ ID NO: 449137 - RNA, 30 nt, Human
ggaacccgaccucgccccgugaccucagag

SEQ ID NO: 449138 - RNA, 24 nt, Human
ggaacccgagcugagccugccucu

SEQ ID NO: 449139 - RNA, 32 nt, Human
ggaacccgaggggacaccagcucugcacaagu

SEQ ID NO: 449140 - RNA, 18 nt, Human
ggaacccgcggcgagcug

SEQ ID NO: 449141 - RNA, 32 nt, Human
ggaacccggaagguggagguugcagugagccg

SEQ ID NO: 449142 - RNA, 32 nt, Human
ggaacccggagcaccuccacuucuagggaaga

SEQ ID NO: 449143 - RNA, 21 nt, Human
ggaacccggcgcggcugccug

SEQ ID NO: 449144 - RNA, 32 nt, Human
ggaacccggcugugggugguucugagcuguuu

SEQ ID NO: 449145 - RNA, 32 nt, Human
ggaacccgggagcagagacugcagugagcuga

SEQ ID NO: 449146 - RNA, 32 nt, Human
ggaacccgggaggcagagcuugcagugagccg

SEQ ID NO: 449147 - RNA, 32 nt, Human
ggaacccgggaggcagagguugcagugagcug

SEQ ID NO: 449148 - RNA, 32 nt, Human
ggaacccgggaggcggagcuugcagugagccg

SEQ ID NO: 449149 - RNA, 32 nt, Human
ggaacccgggaggcggagguugccgugagucg

SEQ ID NO: 449150 - RNA, 32 nt, Human
ggaacccgggaggcggauguugcggugagccg

SEQ ID NO: 449151 - RNA, 32 nt, Human
ggaacccgggagguggagguuguggugagcug

SEQ ID NO: 449152 - RNA, 21 nt, Human
ggaacccgugcaggcgcugag

SEQ ID NO: 449153 - RNA, 32 nt, Human
ggaacccguggucacacacacgcacugcccug

SEQ ID NO: 449154 - RNA, 32 nt, Human
ggaacccuauuuccuuccccugcagcucagcc

SEQ ID NO: 449155 - RNA, 32 nt, Human
ggaacccucacacaccacugauaggaauguau

SEQ ID NO: 449156 - RNA, 32 nt, Human
ggaacccucagccaggaggcgcggcuggucgg

SEQ ID NO: 449157 - RNA, 32 nt, Human
ggaacccuccuugcuagcguugcaaagaaggg

SEQ ID NO: 449158 - RNA, 32 nt, Human
ggaacccucuuuucccccuagaagaaccacca

SEQ ID NO: 449159 - RNA, 32 nt, Human
ggaacccugcagccuucccaugcuaucuguug

SEQ ID NO: 449160 - RNA, 32 nt, Human
ggaacccugccucuuccugcuaccuguggguc

SEQ ID NO: 449161 - RNA, 32 nt, Human
ggaacccugcucaucugguagggcucuuuccu

SEQ ID NO: 449162 - RNA, 32 nt, Human
ggaacccugcuuguccaacagggugucaggau

SEQ ID NO: 449163 - RNA, 32 nt, Human
ggaacccuggagacagaagucaggugucauca

SEQ ID NO: 449164 - RNA, 32 nt, Human
ggaacccuggagguugagguugcagugagcug

SEQ ID NO: 449165 - RNA, 32 nt, Human
ggaacccuggugucuccuccagcgugguggaa

SEQ ID NO: 449166 - RNA, 32 nt, Human
ggaacccuuuuucuccccgcuguggccucugc

SEQ ID NO: 449167 - RNA, 32 nt, Human
ggaaccgacaggccgguguccccagccgcaaa

SEQ ID NO: 449168 - RNA, 32 nt, Human
ggaaccgaccucuucagccaguggaaauguuc

SEQ ID NO: 449169 - RNA, 18 nt, Human
ggaaccgagccugcucua

SEQ ID NO: 449170 - RNA, 32 nt, Human
ggaaccgcaaucagcugugagccagcaccacc

SEQ ID NO: 449171 - RNA, 32 nt, Human
ggaaccgcacacagccacaucuuccuagaccu

SEQ ID NO: 449172 - RNA, 32 nt, Human
ggaaccgcagagccagaagagcacggagcagc

SEQ ID NO: 449173 - RNA, 16 nt, Human
ggaaccgcggcugcug

SEQ ID NO: 449174 - RNA, 32 nt, Human
ggaaccgcuccuugucccuccuggccuccccg

SEQ ID NO: 449175 - RNA, 32 nt, Human
ggaaccggacuugccuuugggcaccuuccagg

SEQ ID NO: 449176 - RNA, 32 nt, Human
ggaaccgggcgcaggggagcgagcccggcccc

SEQ ID NO: 449177 - RNA, 32 nt, Human
ggaaccgggguuucaccauguuggccaggcug

SEQ ID NO: 449178 - RNA, 32 nt, Human
ggaaccguaucaggccagcaugguggcucaug

SEQ ID NO: 449179 - RNA, 32 nt, Human
ggaaccguuuuacacuggauguuucucaugua

SEQ ID NO: 449180 - RNA, 32 nt, Human
ggaaccuagccucccuuuccaucaugggacuc

SEQ ID NO: 449181 - RNA, 32 nt, Human
ggaaccuaguacaggucucccacccagggccu

SEQ ID NO: 449182 - RNA, 32 nt, Human
ggaaccucacucagcccaggguguagggcagg

SEQ ID NO: 449183 - RNA, 32 nt, Human
ggaaccucagcaggcuggcuccagcuccagaa

SEQ ID NO: 449184 - RNA, 32 nt, Human
ggaaccuccagucucagcaccaugaaucaaac

SEQ ID NO: 449185 - RNA, 32 nt, Human
ggaaccuccccagccugcgccugcugcaugcc

SEQ ID NO: 449186 - RNA, 32 nt, Human
ggaaccucgcgaaccacugguggcacauccuu

SEQ ID NO: 449187 - RNA, 32 nt, Human
ggaaccucgcuaugccuugcucccaucaacac

SEQ ID NO: 449188 - RNA, 32 nt, Human
ggaaccucugucucauccuccuggaaccuugc

SEQ ID NO: 449189 - RNA, 32 nt, Human
ggaaccucuucuuccccucuuccagagcuucc

SEQ ID NO: 449190 - RNA, 32 nt, Human
ggaaccucuuucuuugaucuucuuuuucuuuu

SEQ ID NO: 449191 - RNA, 32 nt, Human
ggaaccugacacauaguaggcacacaguaaac

SEQ ID NO: 449192 - RNA, 32 nt, Human
ggaaccugagugcgcugggcuuggggaagucg

SEQ ID NO: 449193 - RNA, 32 nt, Human
ggaaccugcguccugggugacaucccggaccu

SEQ ID NO: 449194 - RNA, 32 nt, Human
ggaaccuggauauugagcucuuacuuuucucc

SEQ ID NO: 449195 - RNA, 32 nt, Human
ggaaccuggccccgggcaaccagccagagaag

SEQ ID NO: 449196 - RNA, 32 nt, Human
ggaaccugggaggcggagcuuacagugaaccg

SEQ ID NO: 449197 - RNA, 32 nt, Human
ggaaccugggaggcggagguugcagugaacca

SEQ ID NO: 449198 - RNA, 32 nt, Human
ggaaccugggagguggaggcugcagugaaccg

SEQ ID NO: 449199 - RNA, 32 nt, Human
ggaaccugggauguggagguugcagugagcca

SEQ ID NO: 449200 - RNA, 32 nt, Human
ggaaccugggcaggaggcacagaggaagccaa

SEQ ID NO: 449201 - RNA, 19 nt, Human
ggaaccugggccucugaga

SEQ ID NO: 449202 - RNA, 32 nt, Human
ggaaccugggcggugcaugcacugugcacccu

SEQ ID NO: 449203 - RNA, 32 nt, Human
ggaaccuggggaggggcccagagcaaagggca

SEQ ID NO: 449204 - RNA, 32 nt, Human
ggaaccugguauaaaacuacagacgucagaca

SEQ ID NO: 449205 - RNA, 32 nt, Human
ggaaccugguucacccuucauaccagcuccaa

SEQ ID NO: 449206 - RNA, 32 nt, Human
ggaaccuguaaucccagcuacaggggaggcug

SEQ ID NO: 449207 - RNA, 32 nt, Human
ggaaccuguguggagccagccgcagugagccc

SEQ ID NO: 449208 - RNA, 32 nt, Human
ggaaccuguuagcugcuccucuccgcagccag

SEQ ID NO: 449209 - RNA, 32 nt, Human
ggaaccuuaaugcccaggaugauccugucuaa

SEQ ID NO: 449210 - RNA, 32 nt, Human
ggaaccuucuaccaucucaucucccagugauu

SEQ ID NO: 449211 - RNA, 32 nt, Human
ggaaccuugggcaaggaagaaugugagcaaga

SEQ ID NO: 449212 - RNA, 32 nt, Human
ggaaccuuuagggaggauaguggagaagccgc

SEQ ID NO: 449213 - RNA, 32 nt, Human
ggaaccuuugcuuuaggacuuagggaugaugu

SEQ ID NO: 449214 - RNA, 32 nt, Human
ggaacgaacagcugucugccuuguugugagag

SEQ ID NO: 449215 - RNA, 23 nt, Human
ggaacgaacccuggcuggagggg

SEQ ID NO: 449216 - RNA, 32 nt, Human
ggaacgaauggacugaacaaaacucagccugc

SEQ ID NO: 449217 - RNA, 32 nt, Human
ggaacgagagaaagagugagaggaauagaaga

SEQ ID NO: 449218 - RNA, 32 nt, Human
ggaacgauggaaugcaucuguuacuagagacu

SEQ ID NO: 449219 - RNA, 32 nt, Human
ggaacgauuuggaacgaaaggaaguggaagaa

SEQ ID NO: 449220 - RNA, 19 nt, Human
ggaacgcagagcaccgagg

SEQ ID NO: 449221 - RNA, 19 nt, Human
ggaacgccccggcugggug

SEQ ID NO: 449222 - RNA, 32 nt, Human
ggaacgccggagaguuggucucuccccuucua

SEQ ID NO: 449223 - RNA, 32 nt, Human
ggaacgccgugccaguggcggcugguaucccg

SEQ ID NO: 449224 - RNA, 32 nt, Human
ggaacgcgcacccgccccaacgcccagacacg

SEQ ID NO: 449225 - RNA, 25 nt, Human
ggaacgcgcagccagccuugggaag

SEQ ID NO: 449226 - RNA, 32 nt, Human
ggaacgcggaaggugcccucugcggugggcau

SEQ ID NO: 449227 - RNA, 32 nt, Human
ggaacgcggaggcagggagaggcuccgugacg

SEQ ID NO: 449228 - RNA, 32 nt, Human
ggaacgcugcagcugcacccacccugcuugau

SEQ ID NO: 449229 - RNA, 32 nt, Human
ggaacgcugccuggcgaacccugguguucaag

SEQ ID NO: 449230 - RNA, 32 nt, Human
ggaacggaccacacccucucuccccagcaugg

SEQ ID NO: 449231 - RNA, 32 nt, Human
ggaacggagcggcggggcaggagcuguucugg

SEQ ID NO: 449232 - RNA, 32 nt, Human
ggaacggaucccuuagguucaggaagcuucug

SEQ ID NO: 449233 - RNA, 32 nt, Human
ggaacggcagcccagccgugggacggacgugg

SEQ ID NO: 449234 - RNA, 19 nt, Human
ggaacggcccagguccccg

SEQ ID NO: 449235 - RNA, 32 nt, Human
ggaacggcugcuucuccucugcccagggcccu

SEQ ID NO: 449236 - RNA, 32 nt, Human
ggaacgggagccaacauggcagcgggguucgg

SEQ ID NO: 449237 - RNA, 32 nt, Human
ggaacgggaggcgaagggauaaugagcugggg

SEQ ID NO: 449238 - RNA, 18 nt, Human
ggaacgggcagcuggcug

SEQ ID NO: 449239 - RNA, 32 nt, Human
ggaacgggcuuucuuuucaggccagcguggca

SEQ ID NO: 449240 - RNA, 32 nt, Human
ggaacggggcaggcccuagguggggugggcug

SEQ ID NO: 449241 - RNA, 32 nt, Human
ggaacggggccagacucagcccgacagcggga

SEQ ID NO: 449242 - RNA, 32 nt, Human
ggaacgggggccuucuccauaggaagaggagg

SEQ ID NO: 449243 - RNA, 22 nt, Human
ggaacgggguguuaucuuuacu

SEQ ID NO: 449244 - RNA, 23 nt, Human
ggaacggugaggccaucuacuga

SEQ ID NO: 449245 - RNA, 32 nt, Human
ggaacggugaucuucuugaaugauguuucagu

SEQ ID NO: 449246 - RNA, 19 nt, Human
ggaacgguggggcuggcug

SEQ ID NO: 449247 - RNA, 20 nt, Human
ggaacgucggguccugggaa

SEQ ID NO: 449248 - RNA, 32 nt, Human
ggaacgucuccaccagcuucccuuccagccga

SEQ ID NO: 449249 - RNA, 32 nt, Human
ggaacgugaaacuccacaaggccagaagcagc

SEQ ID NO: 449250 - RNA, 32 nt, Human
ggaacgugagccaggaggcccggaccggccac

SEQ ID NO: 449251 - RNA, 32 nt, Human
ggaacguggaggcagagguugcagugagccga

SEQ ID NO: 449252 - RNA, 32 nt, Human
ggaacguggcugguuggaggagguagaucacc

SEQ ID NO: 449253 - RNA, 32 nt, Human
ggaacgugggucaggguggggcaacaguggca

SEQ ID NO: 449254 - RNA, 32 nt, Human
ggaacguguagcuguugagagguggacucugu

SEQ ID NO: 449255 - RNA, 32 nt, Human
ggaacuaaaaccagaggcauuauuacugcauu

SEQ ID NO: 449256 - RNA, 32 nt, Human
ggaacuacagaaggcucugccgucugugucuu

SEQ ID NO: 449257 - RNA, 32 nt, Human
ggaacuaccacugguccacucuggaccucaga

SEQ ID NO: 449258 - RNA, 32 nt, Human
ggaacuacugcaggaauccagauucugggaaa

SEQ ID NO: 449259 - RNA, 32 nt, Human
ggaacuacuguacuuugccauuuuucuauaaa

SEQ ID NO: 449260 - RNA, 32 nt, Human
ggaacuagagagaguggcaggagcgcuccagg

SEQ ID NO: 449261 - RNA, 32 nt, Human
ggaacuagcugcagagggaugagugaccacca

SEQ ID NO: 449262 - RNA, 32 nt, Human
ggaacuaguccauauaacccagcuucaguagc

SEQ ID NO: 449263 - RNA, 32 nt, Human
ggaacuauguggagcccagcugcugcagccca

SEQ ID NO: 449264 - RNA, 32 nt, Human
ggaacuauugaagcccgcuuucagguucuuuu

SEQ ID NO: 449265 - RNA, 32 nt, Human
ggaacucaacagcuccaguuaaaugcuuugau

SEQ ID NO: 449266 - RNA, 32 nt, Human
ggaacucaagcucagcuucugccuccugucuc

SEQ ID NO: 449267 - RNA, 18 nt, Human
ggaacucacacgcagucc

SEQ ID NO: 449268 - RNA, 32 nt, Human
ggaacucagaggagucaaguggucaaagcuca

SEQ ID NO: 449269 - RNA, 32 nt, Human
ggaacucagcugucuguggcuucccaugucuu

SEQ ID NO: 449270 - RNA, 32 nt, Human
ggaacucaggaggcagagguugcagugagcca

SEQ ID NO: 449271 - RNA, 32 nt, Human
ggaacucaggaggcggaggcugcagucaacca

SEQ ID NO: 449272 - RNA, 32 nt, Human
ggaacucauacugucuacacaucagaccauag

SEQ ID NO: 449273 - RNA, 32 nt, Human
ggaacuccagccugcgccaccacgucacgcac

SEQ ID NO: 449274 - RNA, 22 nt, Human
ggaacuccaggacgaggaggac

SEQ ID NO: 449275 - RNA, 32 nt, Human
ggaacuccaguucuggggucagaagauuuaaa

SEQ ID NO: 449276 - RNA, 32 nt, Human
ggaacucccagaccaggaguuggggcaggcug

SEQ ID NO: 449277 - RNA, 32 nt, Human
ggaacuccccucuccacugauggcugggaagg

SEQ ID NO: 449278 - RNA, 32 nt, Human
ggaacucccugccucugagccaccaacuggac

SEQ ID NO: 449279 - RNA, 32 nt, Human
ggaacuccucaagaaccugaagauugagagcg

SEQ ID NO: 449280 - RNA, 32 nt, Human
ggaacuccuccaggggcugagauuggauucac

SEQ ID NO: 449281 - RNA, 32 nt, Human
ggaacuccuuaguggcgaagcagcagccccug

SEQ ID NO: 449282 - RNA, 32 nt, Human
ggaacucggcugcggcuccauggucugaguug

SEQ ID NO: 449283 - RNA, 32 nt, Human
ggaacucucaucaucccucuagggacagcagg

SEQ ID NO: 449284 - RNA, 32 nt, Human
ggaacucuccaccuccgucucccuuggggccc

SEQ ID NO: 449285 - RNA, 32 nt, Human
ggaacucucccacauccucuuccccaacuuca

SEQ ID NO: 449286 - RNA, 32 nt, Human
ggaacucucucuuuucuugcuguucucugaau

SEQ ID NO: 449287 - RNA, 32 nt, Human
ggaacucugcugucagguugugaguuuuguuu

SEQ ID NO: 449288 - RNA, 32 nt, Human
ggaacucuggcacccaggcaugaagcacguug

SEQ ID NO: 449289 - RNA, 21 nt, Human
ggaacugaaugaggaguggaa

SEQ ID NO: 449290 - RNA, 32 nt, Human
ggaacugacacauucucucagagcucaagguc

SEQ ID NO: 449291 - RNA, 32 nt, Human
ggaacugacccaggcuggacuugcggggagga

SEQ ID NO: 449292 - RNA, 32 nt, Human
ggaacugaccgaccuauugucuugggacccac

SEQ ID NO: 449293 - RNA, 21 nt, Human
ggaacugaggaauccagcacg

SEQ ID NO: 449294 - RNA, 32 nt, Human
ggaacugaggggaguaugugacuaaauguguc

SEQ ID NO: 449295 - RNA, 20 nt, Human
ggaacugagguggaguccca

SEQ ID NO: 449296 - RNA, 32 nt, Human
ggaacugaugaaugugaauuucccucuaagaa

SEQ ID NO: 449297 - RNA, 32 nt, Human
ggaacugcaacuccagcguccucagcacccca

SEQ ID NO: 449298 - RNA, 31 nt, Human
ggaacugcaagcuagaaaacaagcugaaaca

SEQ ID NO: 449299 - RNA, 32 nt, Human
ggaacugcagagccagaagagcacggagcagc

SEQ ID NO: 449300 - RNA, 32 nt, Human
ggaacugcagcaaaugcaaacuugaagucaug

SEQ ID NO: 449301 - RNA, 32 nt, Human
ggaacugcagcccuaggaaucugggugaaugg

SEQ ID NO: 449302 - RNA, 31 nt, Human
ggaacugcaugauuccucugccaaaggccac

SEQ ID NO: 449303 - RNA, 32 nt, Human
ggaacugccaacgcuucugcuugggaauugcg

SEQ ID NO: 449304 - RNA, 32 nt, Human
ggaacugccacugcaacucugcacguccagga

SEQ ID NO: 449305 - RNA, 32 nt, Human
ggaacugccccuggcccuccugucccacuauu

SEQ ID NO: 449306 - RNA, 25 nt, Human
ggaacugccugaaugugguuuggga

SEQ ID NO: 449307 - RNA, 32 nt, Human
ggaacugcugccacaaccucaggcugggcacc

SEQ ID NO: 449308 - RNA, 32 nt, Human
ggaacugcugugcagccccucagaguaccgcu

SEQ ID NO: 449309 - RNA, 32 nt, Human
ggaacugcuguucaccauucauuccagaccug

SEQ ID NO: 449310 - RNA, 32 nt, Human
ggaacugcuugucccaugcugcucugauuuau

SEQ ID NO: 449311 - RNA, 32 nt, Human
ggaacuggaagacgucuuguagugcuacauug

SEQ ID NO: 449312 - RNA, 18 nt, Human
ggaacuggaaggggggug

SEQ ID NO: 449313 - RNA, 32 nt, Human
ggaacuggaauaggcguguccucucccucgac

SEQ ID NO: 449314 - RNA, 21 nt, Human
ggaacuggagaccccucccaa

SEQ ID NO: 449315 - RNA, 32 nt, Human
ggaacuggagcaucauaaagauagcaagcuac

SEQ ID NO: 449316 - RNA, 32 nt, Human
ggaacuggaggaggggacuccaggaaugggga

SEQ ID NO: 449317 - RNA, 20 nt, Human
ggaacuggaggagugggcug

SEQ ID NO: 449318 - RNA, 32 nt, Human
ggaacuggagggugagaggaagggugggucug

SEQ ID NO: 449319 - RNA, 32 nt, Human
ggaacuggagguuggcuccagcaaaggagguu

SEQ ID NO: 449320 - RNA, 32 nt, Human
ggaacuggcaucccauucagcaucucaggacu

SEQ ID NO: 449321 - RNA, 19 nt, Human
ggaacuggcccagcuccgg

SEQ ID NO: 449322 - RNA, 32 nt, Human
ggaacuggcuaugagcagaagguucgggccag

SEQ ID NO: 449323 - RNA, 18 nt, Human
ggaacuggcucgauuuca

SEQ ID NO: 449324 - RNA, 32 nt, Human
ggaacugggaggcagguuuggaggcugcagug

SEQ ID NO: 449325 - RNA, 32 nt, Human
ggaacugggccgcagcccccagcuucacccac

SEQ ID NO: 449326 - RNA, 32 nt, Human
ggaacuggggcaaggcccaucugucugcaagg

SEQ ID NO: 449327 - RNA, 32 nt, Human
ggaacuggggccaccagcccugggcacgagau

SEQ ID NO: 449328 - RNA, 32 nt, Human
ggaacugguuuugaagagacacucugaaauga

SEQ ID NO: 449329 - RNA, 32 nt, Human
ggaacuguaggccuugcugaagcauccuccca

SEQ ID NO: 449330 - RNA, 32 nt, Human
ggaacuguauccacccaaaugucaccgauuuc

SEQ ID NO: 449331 - RNA, 32 nt, Human
ggaacugucaagcagaaguuuucacccuccuu

SEQ ID NO: 449332 - RNA, 32 nt, Human
ggaacuguccaggaugcggggagguguggagg

SEQ ID NO: 449333 - RNA, 18 nt, Human
ggaacuguccgcagugug

SEQ ID NO: 449334 - RNA, 32 nt, Human
ggaacugugauggaccacuuccaaaacagaga

SEQ ID NO: 449335 - RNA, 32 nt, Human
ggaacugugcccaguguggccccguggccucu

SEQ ID NO: 449336 - RNA, 32 nt, Human
ggaacugugugccuauaccugccugugugugu

SEQ ID NO: 449337 - RNA, 32 nt, Human
ggaacuguguguguucugaugguucaaugggg

SEQ ID NO: 449338 - RNA, 23 nt, Human
ggaacuguguguguugcaggggg

SEQ ID NO: 449339 - RNA, 32 nt, Human
ggaacuguuuuguaucugccucuuuacuaguc

SEQ ID NO: 449340 - RNA, 32 nt, Human
ggaacuuaaacucagucuucugacuccaagcu

SEQ ID NO: 449341 - RNA, 32 nt, Human
ggaacuuaacagcaaggccagaugcacauccc

SEQ ID NO: 449342 - RNA, 32 nt, Human
ggaacuuacacucuuuaagccauuccagucau

SEQ ID NO: 449343 - RNA, 22 nt, Human
ggaacuuauucauuaaccacca

SEQ ID NO: 449344 - RNA, 32 nt, Human
ggaacuucagaauaugcagaugcccagacugu

SEQ ID NO: 449345 - RNA, 32 nt, Human
ggaacuucaugcugggacaagcagcccaucaa

SEQ ID NO: 449346 - RNA, 32 nt, Human
ggaacuucauucuucacaaacuagccagugac

SEQ ID NO: 449347 - RNA, 32 nt, Human
ggaacuuccaccugggcucugcgcuaggucuc

SEQ ID NO: 449348 - RNA, 32 nt, Human
ggaacuucccaggaggggaagggacagaccag

SEQ ID NO: 449349 - RNA, 32 nt, Human
ggaacuucucagggaugcaaaauucaucaacc

SEQ ID NO: 449350 - RNA, 32 nt, Human
ggaacuucugccuuccugguuuccuugacuuu

SEQ ID NO: 449351 - RNA, 32 nt, Human
ggaacuugcaagcagccagggaacgcugaaaa

SEQ ID NO: 449352 - RNA, 21 nt, Human
ggaacuugcacccuggucuuu

SEQ ID NO: 449353 - RNA, 31 nt, Human
ggaacuugcagaggaacugcggcuuuaccaa

SEQ ID NO: 449354 - RNA, 32 nt, Human
ggaacuugcccaggucaggcacuguggaugug

SEQ ID NO: 449355 - RNA, 21 nt, Human
ggaacuugccgucugguuuuu

SEQ ID NO: 449356 - RNA, 32 nt, Human
ggaacuugcugggccaagcugcagcggcgcug

SEQ ID NO: 449357 - RNA, 32 nt, Human
ggaacuuggaagggaagagcucugaaggagcc

SEQ ID NO: 449358 - RNA, 32 nt, Human
ggaacuuggagcugaaaaacauuggcacugag

SEQ ID NO: 449359 - RNA, 32 nt, Human
ggaacuuggcugcuuuuucuuucugcaguuag

SEQ ID NO: 449360 - RNA, 32 nt, Human
ggaacuuggggguggucuuggcauucagagcu

SEQ ID NO: 449361 - RNA, 32 nt, Human
ggaacuuggguggggaggggacaugaggagga

SEQ ID NO: 449362 - RNA, 32 nt, Human
ggaacuugguggccccuguagagaugccaggu

SEQ ID NO: 449363 - RNA, 32 nt, Human
ggaacuugugcagcaaaguuugggagcuacug

SEQ ID NO: 449364 - RNA, 22 nt, Human
ggaacuugugccuggcuggcug

SEQ ID NO: 449365 - RNA, 32 nt, Human
ggaacuugugcuggcccugcaaugucaaggga

SEQ ID NO: 449366 - RNA, 22 nt, Human
ggaacuuguuuccuuagucuuu

SEQ ID NO: 449367 - RNA, 32 nt, Human
ggaacuuucauaauuaccuuaguucuccaugc

SEQ ID NO: 449368 - RNA, 32 nt, Human
ggaacuuucauaauuaccuuaguucuccauuc

SEQ ID NO: 449369 - RNA, 32 nt, Human
ggaacuuugaauacugaaugacucucaaucac

SEQ ID NO: 449370 - RNA, 32 nt, Human
ggaacuuugccaucaguggcugaggccagaga

SEQ ID NO: 449371 - RNA, 32 nt, Human
ggaacuuugccucauaccccaccaaccccugc

SEQ ID NO: 449372 - RNA, 32 nt, Human
ggaagaaaaacaggucucagcccaggguccuc

SEQ ID NO: 449373 - RNA, 23 nt, Human
ggaagaaaaagagcagaggcaga

SEQ ID NO: 449374 - RNA, 32 nt, Human
ggaagaaaagaaggagggagagagggaggaag

SEQ ID NO: 449375 - RNA, 32 nt, Human
ggaagaaaagagaccaggucucagcuugacua

SEQ ID NO: 449376 - RNA, 32 nt, Human
ggaagaaaaggaggaaggaaggaaaaggugau

SEQ ID NO: 449377 - RNA, 32 nt, Human
ggaagaaaaggcugcugggccaggacacuuca

SEQ ID NO: 449378 - RNA, 32 nt, Human
ggaagaaacaggguaagagcaaagacaaggug

SEQ ID NO: 449379 - RNA, 32 nt, Human
ggaagaaaccaccagcuuuauagugugccuga

SEQ ID NO: 449380 - RNA, 32 nt, Human
ggaagaaagaaggagagcaggagggcgaggag

SEQ ID NO: 449381 - RNA, 32 nt, Human
ggaagaaagagggagacaguagcugcucaaau

SEQ ID NO: 449382 - RNA, 32 nt, Human
ggaagaaagcauuuugcaucagccuggaguga

SEQ ID NO: 449383 - RNA, 20 nt, Human
ggaagaaagcuaucuaggga

SEQ ID NO: 449384 - RNA, 32 nt, Human
ggaagaaagcuccugauuggcuggugguggaa

SEQ ID NO: 449385 - RNA, 25 nt, Human
ggaagaaaggaaaaggaagggcaga

SEQ ID NO: 449386 - RNA, 32 nt, Human
ggaagaaaggaaggaaggaaagaaggaaggga

SEQ ID NO: 449387 - RNA, 32 nt, Human
ggaagaaaggaaggaaggaaggcgagagagag

SEQ ID NO: 449388 - RNA, 23 nt, Human
ggaagaaaggaggaagaggcagg

SEQ ID NO: 449389 - RNA, 22 nt, Human
ggaagaaagggaaggagguaga

SEQ ID NO: 449390 - RNA, 26 nt, Human
ggaagaaagggagagagaagaaaaga

SEQ ID NO: 449391 - RNA, 24 nt, Human
ggaagaaagggaggauagaacaga

SEQ ID NO: 449392 - RNA, 32 nt, Human
ggaagaaagggugggagggaggaagaacggaa

SEQ ID NO: 449393 - RNA, 32 nt, Human
ggaagaaagugaaagaugagugccaguacuuu

SEQ ID NO: 449394 - RNA, 32 nt, Human
ggaagaaaguucugguucacaugccuuguagc

SEQ ID NO: 449395 - RNA, 32 nt, Human
ggaagaaauagcggggagaaaagggaguuggu

SEQ ID NO: 449396 - RNA, 32 nt, Human
ggaagaaauggaauucuggcuccugggucccu

SEQ ID NO: 449397 - RNA, 32 nt, Human
ggaagaaauggugagcaggggcugcaauugca

SEQ ID NO: 449398 - RNA, 32 nt, Human
ggaagaacaacaaagacaugcuuuccauuuuu

SEQ ID NO: 449399 - RNA, 32 nt, Human
ggaagaacaaggcaauucucacccucaguuuu

SEQ ID NO: 449400 - RNA, 32 nt, Human
ggaagaacacccuucuccgucucccucuuuuu

SEQ ID NO: 449401 - RNA, 22 nt, Human
ggaagaacagagaggggacaga

SEQ ID NO: 449402 - RNA, 32 nt, Human
ggaagaacauggccuggccaaauguuuuucaa

SEQ ID NO: 449403 - RNA, 32 nt, Human
ggaagaaccaguccugccaacaucuugaucuu

SEQ ID NO: 449404 - RNA, 32 nt, Human
ggaagaacccuccacccugccucguggguggg

SEQ ID NO: 449405 - RNA, 32 nt, Human
ggaagaacucauuguugaucacacuguugccu

SEQ ID NO: 449406 - RNA, 32 nt, Human
ggaagaacugauuucaauauauugccgcugca

SEQ ID NO: 449407 - RNA, 32 nt, Human
ggaagaacuuugucccuuuacuucugauuuga

SEQ ID NO: 449408 - RNA, 32 nt, Human
ggaagaagaaaauagcagcaagaaauaucucu

SEQ ID NO: 449409 - RNA, 32 nt, Human
ggaagaagaagagauuucggaggccauccugc

SEQ ID NO: 449410 - RNA, 32 nt, Human
ggaagaagaagaggaggaagaagauauccucu

SEQ ID NO: 449411 - RNA, 32 nt, Human
ggaagaagaaggagguugcuggccuuggauau

SEQ ID NO: 449412 - RNA, 19 nt, Human
ggaagaagacagggaccag

SEQ ID NO: 449413 - RNA, 32 nt, Human
ggaagaagaccggagucaaaggacucaucugu

SEQ ID NO: 449414 - RNA, 32 nt, Human
ggaagaagagaaggaagaggagagggggccgc

SEQ ID NO: 449415 - RNA, 32 nt, Human
ggaagaagagaaggagguccucauccuauagc

SEQ ID NO: 449416 - RNA, 32 nt, Human
ggaagaagagagaaggagaaggaagaaggaga

SEQ ID NO: 449417 - RNA, 23 nt, Human
ggaagaagaggagcaggccggga

SEQ ID NO: 449418 - RNA, 24 nt, Human
ggaagaagaggaggaggaggaaga

SEQ ID NO: 449419 - RNA, 32 nt, Human
ggaagaagaggaggaggaggaagaggaggagg

SEQ ID NO: 449420 - RNA, 32 nt, Human
ggaagaagaggaggaggaggaggaggaggagg

SEQ ID NO: 449421 - RNA, 32 nt, Human
ggaagaagagguggaggugugguuguggugga

SEQ ID NO: 449422 - RNA, 32 nt, Human
ggaagaagagugaaggccaguguuaggaaaaa

SEQ ID NO: 449423 - RNA, 32 nt, Human
ggaagaagauauccucucucuggcagaagaaa

SEQ ID NO: 449424 - RNA, 32 nt, Human
ggaagaagcacagaauuccucaacucccagug

SEQ ID NO: 449425 - RNA, 32 nt, Human
ggaagaagccagaaccccaccuggccugccca

SEQ ID NO: 449426 - RNA, 32 nt, Human
ggaagaagcuugcugguagcacuugcuacccu

SEQ ID NO: 449427 - RNA, 23 nt, Human
ggaagaaggaagaaaaccugaua

SEQ ID NO: 449428 - RNA, 20 nt, Human
ggaagaaggaggcagcaggg

SEQ ID NO: 449429 - RNA, 24 nt, Human
ggaagaaggaggcuaggagcaggg

SEQ ID NO: 449430 - RNA, 20 nt, Human
ggaagaaggcaggcuucugg

SEQ ID NO: 449431 - RNA, 32 nt, Human
ggaagaaggcccugucccccugucgccacugc

SEQ ID NO: 449432 - RNA, 24 nt, Human
ggaagaaggggagacgagccggga

SEQ ID NO: 449433 - RNA, 20 nt, Human
ggaagaagggucguuucuga

SEQ ID NO: 449434 - RNA, 32 nt, Human
ggaagaagucagggacagggaccaggauacca

SEQ ID NO: 449435 - RNA, 32 nt, Human
ggaagaaguguuuaguucuggaaaagguaaau

SEQ ID NO: 449436 - RNA, 32 nt, Human
ggaagaauaaagugccuucugagcaagcagcu

SEQ ID NO: 449437 - RNA, 32 nt, Human
ggaagaaucaggcucagcgcacuggcacaugc

SEQ ID NO: 449438 - RNA, 32 nt, Human
ggaagaaucugaggaacacagaacagccccag

SEQ ID NO: 449439 - RNA, 16 nt, Human
ggaagaaugcuuuuga

SEQ ID NO: 449440 - RNA, 32 nt, Human
ggaagaauggcgaggggagagcagaggagaag

SEQ ID NO: 449441 - RNA, 32 nt, Human
ggaagaaugucccuuuucuucaaguuugggaa

SEQ ID NO: 449442 - RNA, 32 nt, Human
ggaagaauguguaugcuguugcuguugaauag

SEQ ID NO: 449443 - RNA, 32 nt, Human
ggaagaauuggcaccuuccuagggaaggagac

SEQ ID NO: 449444 - RNA, 32 nt, Human
ggaagacaacccaggcaguaccauucaggaca

SEQ ID NO: 449445 - RNA, 32 nt, Human
ggaagacaaggcagaagaggcuggccaggccc

SEQ ID NO: 449446 - RNA, 32 nt, Human
ggaagacaagucaggaggauugauugaagcua

SEQ ID NO: 449447 - RNA, 21 nt, Human
ggaagacagacacagaugcaa

SEQ ID NO: 449448 - RNA, 32 nt, Human
ggaagacagacuccugucuucacuccuaaaug

SEQ ID NO: 449449 - RNA, 21 nt, Human
ggaagacagagauggcagagc

SEQ ID NO: 449450 - RNA, 32 nt, Human
ggaagacagagcagaggccucggcugcagcac

SEQ ID NO: 449451 - RNA, 32 nt, Human
ggaagacagaggugccuggguggccgaggccu

SEQ ID NO: 449452 - RNA, 32 nt, Human
ggaagacagagguggcaggacaaggaagagga

SEQ ID NO: 449453 - RNA, 32 nt, Human
ggaagacagauggggaagggggcggugaacac

SEQ ID NO: 449454 - RNA, 32 nt, Human
ggaagacagcacaaaguggauccauacucuga

SEQ ID NO: 449455 - RNA, 32 nt, Human
ggaagacagccaaggcugcagcugcugaagga

SEQ ID NO: 449456 - RNA, 32 nt, Human
ggaagacagccaauagcacccauuaaaagaaa

SEQ ID NO: 449457 - RNA, 32 nt, Human
ggaagacagccuggccuugcccaccugcacac

SEQ ID NO: 449458 - RNA, 32 nt, Human
ggaagacaggagaaacuacuuaaggugguuaa

SEQ ID NO: 449459 - RNA, 20 nt, Human
ggaagacaggccccugggaa

SEQ ID NO: 449460 - RNA, 32 nt, Human
ggaagacaggcuucccuuccuucccccuccuu

SEQ ID NO: 449461 - RNA, 32 nt, Human
ggaagacaggucacucuccccuaggcaguucc

SEQ ID NO: 449462 - RNA, 23 nt, Human
ggaagacagguuccucacagcaa

SEQ ID NO: 449463 - RNA, 32 nt, Human
ggaagacagugcagccacccagccuuuaccag

SEQ ID NO: 449464 - RNA, 32 nt, Human
ggaagacaguggccacagcccaacaggaggcc

SEQ ID NO: 449465 - RNA, 21 nt, Human
ggaagacaguuaucagggcaa

SEQ ID NO: 449466 - RNA, 32 nt, Human
ggaagacaucuuccuucucugccucggcuucc

SEQ ID NO: 449467 - RNA, 32 nt, Human
ggaagacaugccgacgucuccucugccuaggg

SEQ ID NO: 449468 - RNA, 32 nt, Human
ggaagaccacaguauuucucccuucccacucu

SEQ ID NO: 449469 - RNA, 27 nt, Human
ggaagaccagccucagaggguccuucu

SEQ ID NO: 449470 - RNA, 32 nt, Human
ggaagaccagccuggccaacauggcgaaaccc

SEQ ID NO: 449471 - RNA, 32 nt, Human
ggaagaccaguugggcccaagccugggauagu

SEQ ID NO: 449472 - RNA, 32 nt, Human
ggaagaccaguuucuuucaaucuaaggcuauu

SEQ ID NO: 449473 - RNA, 32 nt, Human
ggaagaccaugggcuguaggggagaguguggc

SEQ ID NO: 449474 - RNA, 32 nt, Human
ggaagacccaggagcugggaggcacgggagua

SEQ ID NO: 449475 - RNA, 23 nt, Human
ggaagacccaggccauguuccca

SEQ ID NO: 449476 - RNA, 32 nt, Human
ggaagacccagucucagacucugugccuuuaa

SEQ ID NO: 449477 - RNA, 32 nt, Human
ggaagaccccgagguggaaaagaaggagcacc

SEQ ID NO: 449478 - RNA, 32 nt, Human
ggaagacccuucuuccaugcagcuugauguca

SEQ ID NO: 449479 - RNA, 23 nt, Human
ggaagaccgaggcggguggauca

SEQ ID NO: 449480 - RNA, 32 nt, Human
ggaagaccuauaccccacgccugggccuggcu

SEQ ID NO: 449481 - RNA, 23 nt, Human
ggaagacgcccggucccgggccg

SEQ ID NO: 449482 - RNA, 26 nt, Human
ggaagacgcggggaagaggaggcgga

SEQ ID NO: 449483 - RNA, 32 nt, Human
ggaagacgcugaggaggaggaggaggcggagg

SEQ ID NO: 449484 - RNA, 32 nt, Human
ggaagacguucuugcauccucagccuguguca

SEQ ID NO: 449485 - RNA, 32 nt, Human
ggaagacucauuuuggacuucugaccuugaac

SEQ ID NO: 449486 - RNA, 32 nt, Human
ggaagacucccacucccugaaaucuggaguga

SEQ ID NO: 449487 - RNA, 32 nt, Human
ggaagacucccagcacuucuggaacugugcuu

SEQ ID NO: 449488 - RNA, 32 nt, Human
ggaagacucugccucaccugccuccuugaagg

SEQ ID NO: 449489 - RNA, 32 nt, Human
ggaagacugaggacaugggcucagugguggcu

SEQ ID NO: 449490 - RNA, 21 nt, Human
ggaagacugcuugagcccagg

SEQ ID NO: 449491 - RNA, 32 nt, Human
ggaagacuggaugucuuucuucuucauccaag

SEQ ID NO: 449492 - RNA, 32 nt, Human
ggaagacuguggcugcuagcacuuggagccaa

SEQ ID NO: 449493 - RNA, 21 nt, Human
ggaagacuuggccccugggga

SEQ ID NO: 449494 - RNA, 32 nt, Human
ggaagacuuugcccugcccugagagcuggucu

SEQ ID NO: 449495 - RNA, 32 nt, Human
ggaagagaaaaugccugcaguuguaaugucug

SEQ ID NO: 449496 - RNA, 18 nt, Human
ggaagagaaacuuuuuga

SEQ ID NO: 449497 - RNA, 32 nt, Human
ggaagagaaagagugaagaaaaguugcgagcg

SEQ ID NO: 449498 - RNA, 32 nt, Human
ggaagagaaaguagagaagaaaagaaugaugu

SEQ ID NO: 449499 - RNA, 32 nt, Human
ggaagagaaaugcaaagugugggcagccgcca

SEQ ID NO: 449500 - RNA, 32 nt, Human
ggaagagaagaaaacggaggagaggaggggac

SEQ ID NO: 449501 - RNA, 32 nt, Human
ggaagagaagaaaauggaggagaggaggggac

SEQ ID NO: 449502 - RNA, 32 nt, Human
ggaagagaagaauguugcuuaagaaagaacau

SEQ ID NO: 449503 - RNA, 32 nt, Human
ggaagagaagagaagaggacaguaccaagauc

SEQ ID NO: 449504 - RNA, 32 nt, Human
ggaagagaagcaggagggguguuuuucuugaa

SEQ ID NO: 449505 - RNA, 18 nt, Human
ggaagagaagcaucauga

SEQ ID NO: 449506 - RNA, 21 nt, Human
ggaagagaagugugcuuuuga

SEQ ID NO: 449507 - RNA, 32 nt, Human
ggaagagaaucugucagccuuggagggaaggg

SEQ ID NO: 449508 - RNA, 32 nt, Human
ggaagagaaugggagacaaaggaccuggugau

SEQ ID NO: 449509 - RNA, 16 nt, Human
ggaagagaaugucuga

SEQ ID NO: 449510 - RNA, 18 nt, Human
ggaagagaauugucuuga

SEQ ID NO: 449511 - RNA, 32 nt, Human
ggaagagacacaggaacacagauggagggcaa

SEQ ID NO: 449512 - RNA, 32 nt, Human
ggaagagacacuccuuuccuuuuacuaagacc

SEQ ID NO: 449513 - RNA, 32 nt, Human
ggaagagacagugugggcugagagcagaggga

SEQ ID NO: 449514 - RNA, 17 nt, Human
ggaagagaccugccuga

SEQ ID NO: 449515 - RNA, 32 nt, Human
ggaagagacgucggagucugaucgcagacaca

SEQ ID NO: 449516 - RNA, 32 nt, Human
ggaagagacuccagggcucugcagagagggaa

SEQ ID NO: 449517 - RNA, 20 nt, Human
ggaagagagaagcugggaga

SEQ ID NO: 449518 - RNA, 32 nt, Human
ggaagagagacagagaaacagagacagaaaga

SEQ ID NO: 449519 - RNA, 28 nt, Human
ggaagagagacagaggaucaagggcuuu

SEQ ID NO: 449520 - RNA, 32 nt, Human
ggaagagagaccagagaguuuagaggccagga

SEQ ID NO: 449521 - RNA, 32 nt, Human
ggaagagagaggaagggugagggugaggcgug

SEQ ID NO: 449522 - RNA, 32 nt, Human
ggaagagagauggagucacauggauuuuuggu

SEQ ID NO: 449523 - RNA, 17 nt, Human
ggaagagagcuggcugg

SEQ ID NO: 449524 - RNA, 32 nt, Human
ggaagagagcuugggcugggaacgcgccugau

SEQ ID NO: 449525 - RNA, 32 nt, Human
ggaagagaggccuggagauaccagguugucuu

SEQ ID NO: 449526 - RNA, 18 nt, Human
ggaagagaggccuucugg

SEQ ID NO: 449527 - RNA, 32 nt, Human
ggaagagagggaggaggaaaggaaggagagag

SEQ ID NO: 449528 - RNA, 32 nt, Human
ggaagagagggagggaggcgggaggagcgcgg

SEQ ID NO: 449529 - RNA, 17 nt, Human
ggaagagaggguucuga

SEQ ID NO: 449530 - RNA, 18 nt, Human
ggaagagagugauacuga

SEQ ID NO: 449531 - RNA, 32 nt, Human
ggaagagauagaggaggaggagggggaggaag

SEQ ID NO: 449532 - RNA, 17 nt, Human
ggaagagauauuucugg

SEQ ID NO: 449533 - RNA, 18 nt, Human
ggaagagaugaagcucug

SEQ ID NO: 449534 - RNA, 18 nt, Human
ggaagagauggcugcuga

SEQ ID NO: 449535 - RNA, 32 nt, Human
ggaagagaugguugacccagaggauccugaua

SEQ ID NO: 449536 - RNA, 18 nt, Human
ggaagagaugugugccug

SEQ ID NO: 449537 - RNA, 16 nt, Human
ggaagagauguuugga

SEQ ID NO: 449538 - RNA, 18 nt, Human
ggaagagauucugcccug

SEQ ID NO: 449539 - RNA, 32 nt, Human
ggaagagauugagagaccuagcaaugugaagu

SEQ ID NO: 449540 - RNA, 18 nt, Human
ggaagagauugcaucuga

SEQ ID NO: 449541 - RNA, 16 nt, Human
ggaagagauugccuga

SEQ ID NO: 449542 - RNA, 18 nt, Human
ggaagagauuguauuaga

SEQ ID NO: 449543 - RNA, 18 nt, Human
ggaagagauuugucucug

SEQ ID NO: 449544 - RNA, 32 nt, Human
ggaagagcaauggcugcagcagcagcuucuca

SEQ ID NO: 449545 - RNA, 22 nt, Human
ggaagagcacaaggugcaggug

SEQ ID NO: 449546 - RNA, 24 nt, Human
ggaagagcaucauggcugugcagg

SEQ ID NO: 449547 - RNA, 32 nt, Human
ggaagagcauccccuuccuccuuucccuggcc

SEQ ID NO: 449548 - RNA, 32 nt, Human
ggaagagcauggcaggcagagauacagcaagg

SEQ ID NO: 449549 - RNA, 32 nt, Human
ggaagagcauguggugauuggccacacacuga

SEQ ID NO: 449550 - RNA, 32 nt, Human
ggaagagcauuuuucuaaggagaacaggugac

SEQ ID NO: 449551 - RNA, 22 nt, Human
ggaagagccaaacccgacucuc

SEQ ID NO: 449552 - RNA, 32 nt, Human
ggaagagccauggugaaaccgcaucucuacua

SEQ ID NO: 449553 - RNA, 32 nt, Human
ggaagagcccaggaugccucaggccuggcaac

SEQ ID NO: 449554 - RNA, 32 nt, Human
ggaagagccuccauuucaucucauguccauuu

SEQ ID NO: 449555 - RNA, 32 nt, Human
ggaagagcucacugccagcugcggccugggca

SEQ ID NO: 449556 - RNA, 32 nt, Human
ggaagagcuggaacagcaggaggcggaggugc

SEQ ID NO: 449557 - RNA, 22 nt, Human
ggaagagcugggccccugggag

SEQ ID NO: 449558 - RNA, 32 nt, Human
ggaagagcuggguaccaggccacccacugugg

SEQ ID NO: 449559 - RNA, 32 nt, Human
ggaagagcuguggaggacacacucucaguuug

SEQ ID NO: 449560 - RNA, 32 nt, Human
ggaagaggaagaagagguagaaaacauauuuu

SEQ ID NO: 449561 - RNA, 32 nt, Human
ggaagaggaagaggaaagcaaaggagucaggg

SEQ ID NO: 449562 - RNA, 32 nt, Human
ggaagaggaagaggaagagaggaagcggaggg

SEQ ID NO: 449563 - RNA, 32 nt, Human
ggaagaggaagaggaggaaggcgacggcaaca

SEQ ID NO: 449564 - RNA, 32 nt, Human
ggaagaggaagaggaggacgaacagagauccu

SEQ ID NO: 449565 - RNA, 32 nt, Human
ggaagaggaagaggaggagaggccggggacga

SEQ ID NO: 449566 - RNA, 32 nt, Human
ggaagaggaagaggaggaggaggagaccggca

SEQ ID NO: 449567 - RNA, 32 nt, Human
ggaagaggaaggcagcccuggagugguuucuu

SEQ ID NO: 449568 - RNA, 32 nt, Human
ggaagaggaagggagaggcaagcaacuaggua

SEQ ID NO: 449569 - RNA, 32 nt, Human
ggaagaggaaucaagaguaaagagguaggggu

SEQ ID NO: 449570 - RNA, 32 nt, Human
ggaagaggacaaagagacagagcccagggggu

SEQ ID NO: 449571 - RNA, 32 nt, Human
ggaagaggacacugaagaggagagcucagcca

SEQ ID NO: 449572 - RNA, 32 nt, Human
ggaagaggacagagcaaagccaugaacaucau

SEQ ID NO: 449573 - RNA, 32 nt, Human
ggaagaggacagugaugugacuucuuggucag

SEQ ID NO: 449574 - RNA, 32 nt, Human
ggaagaggaccagcuccuggucaggagacuga

SEQ ID NO: 449575 - RNA, 32 nt, Human
ggaagaggacccugucccccagcacugggcuu

SEQ ID NO: 449576 - RNA, 32 nt, Human
ggaagaggaccgggaggagagguggagagcgg

SEQ ID NO: 449577 - RNA, 32 nt, Human
ggaagaggagacaaacccuacugucggccugc

SEQ ID NO: 449578 - RNA, 32 nt, Human
ggaagaggagccaaugacaggguagggagaug

SEQ ID NO: 449579 - RNA, 32 nt, Human
ggaagaggaggaagaagaggaggaggaggaga

SEQ ID NO: 449580 - RNA, 32 nt, Human
ggaagaggaggaagaggaaggggagagggacg

SEQ ID NO: 449581 - RNA, 21 nt, Human
ggaagaggaggaggaggaaga

SEQ ID NO: 449582 - RNA, 32 nt, Human
ggaagaggaggaggaggaagaggggagcacaa

SEQ ID NO: 449583 - RNA, 32 nt, Human
ggaagaggaggaggaggaagggagcaccagug

SEQ ID NO: 449584 - RNA, 20 nt, Human
ggaagaggaggaggaggaga

SEQ ID NO: 449585 - RNA, 32 nt, Human
ggaagaggaggaggaggagaccggcagcaacu

SEQ ID NO: 449586 - RNA, 24 nt, Human
ggaagaggaggaggaggaggaaga

SEQ ID NO: 449587 - RNA, 23 nt, Human
ggaagaggaggaggaggaggaga

SEQ ID NO: 449588 - RNA, 32 nt, Human
ggaagaggaggaggaggaggagaaggaggaga

SEQ ID NO: 449589 - RNA, 32 nt, Human
ggaagaggaggaggaggaggagcuggaggagg

SEQ ID NO: 449590 - RNA, 32 nt, Human
ggaagaggaggaggaggaggaggaagcugaag

SEQ ID NO: 449591 - RNA, 32 nt, Human
ggaagaggaggaggaggaggaggaaggggcuu

SEQ ID NO: 449592 - RNA, 32 nt, Human
ggaagaggaggaggaggaggaggcuggguugg

SEQ ID NO: 449593 - RNA, 32 nt, Human
ggaagaggaggcaccgcggcggcggcugagag

SEQ ID NO: 449594 - RNA, 32 nt, Human
ggaagaggaggggaggaggaggaggaggagga

SEQ ID NO: 449595 - RNA, 32 nt, Human
ggaagaggagugggccugaggagcagcaggaa

SEQ ID NO: 449596 - RNA, 32 nt, Human
ggaagaggcaggcagaggcugaggcugauucc

SEQ ID NO: 449597 - RNA, 32 nt, Human
ggaagaggcccggcggaggcggcggugcagcg

SEQ ID NO: 449598 - RNA, 32 nt, Human
ggaagaggccugcacagacaggaggagcagcu

SEQ ID NO: 449599 - RNA, 18 nt, Human
ggaagaggccuuucuaga

SEQ ID NO: 449600 - RNA, 32 nt, Human
ggaagaggccuuucuagaauuuucuuugagca

SEQ ID NO: 449601 - RNA, 16 nt, Human
ggaagaggccuuuuga

SEQ ID NO: 449602 - RNA, 17 nt, Human
ggaagaggcuccucuga

SEQ ID NO: 449603 - RNA, 32 nt, Human
ggaagaggcugcaggcucaagggcagggauuc

SEQ ID NO: 449604 - RNA, 17 nt, Human
ggaagaggcugcucugg

SEQ ID NO: 449605 - RNA, 32 nt, Human
ggaagaggcugcugagaaagagaaugagaaga

SEQ ID NO: 449606 - RNA, 17 nt, Human
ggaagaggcuuaccuga

SEQ ID NO: 449607 - RNA, 20 nt, Human
ggaagaggcuucagacgcug

SEQ ID NO: 449608 - RNA, 20 nt, Human
ggaagaggcuuccaucccuc

SEQ ID NO: 449609 - RNA, 16 nt, Human
ggaagaggcuuccugg

SEQ ID NO: 449610 - RNA, 32 nt, Human
ggaagagggacgccgcugagggccaaggggcg

SEQ ID NO: 449611 - RNA, 17 nt, Human
ggaagagggagcucugg

SEQ ID NO: 449612 - RNA, 32 nt, Human
ggaagagggagugaggcccuguggacacagca

SEQ ID NO: 449613 - RNA, 32 nt, Human
ggaagagggauuauaauuuggugcuguuugua

SEQ ID NO: 449614 - RNA, 32 nt, Human
ggaagagggcaggcgaggcgggaaggugggcu

SEQ ID NO: 449615 - RNA, 32 nt, Human
ggaagagggcaugcaaguucugccugucuucu

SEQ ID NO: 449616 - RNA, 32 nt, Human
ggaagagggccugguuguuuauuuauauguuu

SEQ ID NO: 449617 - RNA, 32 nt, Human
ggaagagggcuggaugcagggccagcucaacc

SEQ ID NO: 449618 - RNA, 18 nt, Human
ggaagagggcuuccauga

SEQ ID NO: 449619 - RNA, 17 nt, Human
ggaagagggcuuuuuga

SEQ ID NO: 449620 - RNA, 23 nt, Human
ggaagaggggaaagagaggcaga

SEQ ID NO: 449621 - RNA, 24 nt, Human
ggaagaggggaaggaggaggaaga

SEQ ID NO: 449622 - RNA, 32 nt, Human
ggaagaggggccugagggcggaagggguuugg

SEQ ID NO: 449623 - RNA, 32 nt, Human
ggaagagggggaggagaaggaggaagaggggg

SEQ ID NO: 449624 - RNA, 21 nt, Human
ggaagagggggaggagacagg

SEQ ID NO: 449625 - RNA, 21 nt, Human
ggaagagggggaggaggaaga

SEQ ID NO: 449626 - RNA, 32 nt, Human
ggaagagggggaggaggaagaggggaaggagg

SEQ ID NO: 449627 - RNA, 18 nt, Human
ggaagagggggagggaga

SEQ ID NO: 449628 - RNA, 32 nt, Human
ggaagagggugcaaguccccuccuggggcccc

SEQ ID NO: 449629 - RNA, 32 nt, Human
ggaagaggguuggauuaucauuaccuuuacaa

SEQ ID NO: 449630 - RNA, 17 nt, Human
ggaagagguauuucuga

SEQ ID NO: 449631 - RNA, 16 nt, Human
ggaagaggucuucgga

SEQ ID NO: 449632 - RNA, 17 nt, Human
ggaagaggugccccugg

SEQ ID NO: 449633 - RNA, 18 nt, Human
ggaagaggugcucuccug

SEQ ID NO: 449634 - RNA, 32 nt, Human
ggaagagguggaggaggaggaggaggaggugg

SEQ ID NO: 449635 - RNA, 32 nt, Human
ggaagagguggaggaggaggggccagggcagu

SEQ ID NO: 449636 - RNA, 19 nt, Human
ggaagagguggcaagggga

SEQ ID NO: 449637 - RNA, 18 nt, Human
ggaagagguggcccucug

SEQ ID NO: 449638 - RNA, 17 nt, Human
ggaagagguggcucugg

SEQ ID NO: 449639 - RNA, 32 nt, Human
ggaagagucaugggaggugaaaggggcacguu

SEQ ID NO: 449640 - RNA, 32 nt, Human
ggaagaguccuugaguguggcagcaguuuuga

SEQ ID NO: 449641 - RNA, 32 nt, Human
ggaagagugaagaacagaaaaauguuaguggg

SEQ ID NO: 449642 - RNA, 32 nt, Human
ggaagagugacuucugugagauggcuggcugg

SEQ ID NO: 449643 - RNA, 32 nt, Human
ggaagagugagcaggacacagaggggagggga

SEQ ID NO: 449644 - RNA, 32 nt, Human
ggaagagugggaggaggaggggaagcggcgaa

SEQ ID NO: 449645 - RNA, 32 nt, Human
ggaagaguggggcugcuaggcaaguggauuag

SEQ ID NO: 449646 - RNA, 32 nt, Human
ggaagagugggguagagccaggcggcacaggc

SEQ ID NO: 449647 - RNA, 32 nt, Human
ggaagagugguuuggagagagccuucuagaau

SEQ ID NO: 449648 - RNA, 19 nt, Human
ggaagaguuccugcuucug

SEQ ID NO: 449649 - RNA, 32 nt, Human
ggaagaguugcugagacgacuacagcaaauua

SEQ ID NO: 449650 - RNA, 32 nt, Human
ggaagauaaagauggucacacaaacaguuucc

SEQ ID NO: 449651 - RNA, 32 nt, Human
ggaagauaagagaaaaagaagaauggauaaaa

SEQ ID NO: 449652 - RNA, 32 nt, Human
ggaagauaggguugggacagggugcuuuggaa

SEQ ID NO: 449653 - RNA, 32 nt, Human
ggaagauauugguggcuggugguuuugugcuu

SEQ ID NO: 449654 - RNA, 32 nt, Human
ggaagauauuucuaaucggucuugcccagagg

SEQ ID NO: 449655 - RNA, 32 nt, Human
ggaagaucacaaggucaggagaucgagaccau

SEQ ID NO: 449656 - RNA, 32 nt, Human
ggaagaucacuugaggccaggaguucaaggcu

SEQ ID NO: 449657 - RNA, 32 nt, Human
ggaagaucacuugaggccaggaguuugagacc

SEQ ID NO: 449658 - RNA, 24 nt, Human
ggaagaucaggaggaggaggaaga

SEQ ID NO: 449659 - RNA, 32 nt, Human
ggaagaucaggaggaggaggaagaagaggaaa

SEQ ID NO: 449660 - RNA, 32 nt, Human
ggaagaucauuugagcccaggaggcugaggcu

SEQ ID NO: 449661 - RNA, 32 nt, Human
ggaagauccaggaguugaagaccagccugggc

SEQ ID NO: 449662 - RNA, 32 nt, Human
ggaagauccugaagcaguucagaaggaauaag

SEQ ID NO: 449663 - RNA, 22 nt, Human
ggaagaucuccccccagagcaa

SEQ ID NO: 449664 - RNA, 32 nt, Human
ggaagaucuggagugaaaaggcagcagaugca

SEQ ID NO: 449665 - RNA, 32 nt, Human
ggaagaugaagaggaggaagagggagaaggga

SEQ ID NO: 449666 - RNA, 18 nt, Human
ggaagaugacuccuggga

SEQ ID NO: 449667 - RNA, 32 nt, Human
ggaagaugagagaaaauuaguaggauuaguug

SEQ ID NO: 449668 - RNA, 32 nt, Human
ggaagaugcaccuugaucucacccucacucca

SEQ ID NO: 449669 - RNA, 32 nt, Human
ggaagaugcccaccccugcuugggacuugaga

SEQ ID NO: 449670 - RNA, 22 nt, Human
ggaagaugccugccggcaccga

SEQ ID NO: 449671 - RNA, 32 nt, Human
ggaagauggaaaaaggaauccaggcaaaaagg

SEQ ID NO: 449672 - RNA, 32 nt, Human
ggaagauggccaggcuguugaaagcuucacaa

SEQ ID NO: 449673 - RNA, 32 nt, Human
ggaagauggcggcugcuccuuuggaggagcgg

SEQ ID NO: 449674 - RNA, 30 nt, Human
ggaagauggcggcugugguggagaauguag

SEQ ID NO: 449675 - RNA, 21 nt, Human
ggaagauggcuugagcccagg

SEQ ID NO: 449676 - RNA, 23 nt, Human
ggaagauggggcugcaccugcca

SEQ ID NO: 449677 - RNA, 22 nt, Human
ggaagauucgcuugagcccagg

SEQ ID NO: 449678 - RNA, 32 nt, Human
ggaagauucugagacauuucgccugagauaua

SEQ ID NO: 449679 - RNA, 21 nt, Human
ggaagauugcuucagcccagg

SEQ ID NO: 449680 - RNA, 32 nt, Human
ggaagauuguuuaggggguuaaggagcucaga

SEQ ID NO: 449681 - RNA, 32 nt, Human
ggaagauuuaacauuugcuugggaaugugauu

SEQ ID NO: 449682 - RNA, 32 nt, Human
ggaagauuucacuucauugucuagcccagaau

SEQ ID NO: 449683 - RNA, 32 nt, Human
ggaagauuucccagccuuucuucacaacacuu

SEQ ID NO: 449684 - RNA, 32 nt, Human
ggaagauuuccuuauugucauuuccuuccauc

SEQ ID NO: 449685 - RNA, 32 nt, Human
ggaagauuugcaguuaaagauggcuaccauca

SEQ ID NO: 449686 - RNA, 32 nt, Human
ggaagcaaagguugucacaucuucccaagcca

SEQ ID NO: 449687 - RNA, 32 nt, Human
ggaagcaacuccaggaacacuccuuccacucc

SEQ ID NO: 449688 - RNA, 32 nt, Human
ggaagcaaguucgccagagagaaaguugaccg

SEQ ID NO: 449689 - RNA, 24 nt, Human
ggaagcaaugccugcccccuggag

SEQ ID NO: 449690 - RNA, 22 nt, Human
ggaagcacacggccucugggaa

SEQ ID NO: 449691 - RNA, 32 nt, Human
ggaagcacagcuccaaguucagacaggugccc

SEQ ID NO: 449692 - RNA, 31 nt, Human
ggaagcacagcuucauuuccugugucuuuuu

SEQ ID NO: 449693 - RNA, 32 nt, Human
ggaagcacaggcaaugucugcaaucagcugug

SEQ ID NO: 449694 - RNA, 32 nt, Human
ggaagcacaugccucucucaggccaaacucac

SEQ ID NO: 449695 - RNA, 32 nt, Human
ggaagcacgugcuuaagcccuuuugcugauuu

SEQ ID NO: 449696 - RNA, 32 nt, Human
ggaagcacuucaggaacaagcacacagcugug

SEQ ID NO: 449697 - RNA, 32 nt, Human
ggaagcagaacacacagcuggaggcuuggaac

SEQ ID NO: 449698 - RNA, 32 nt, Human
ggaagcagacaggaaggagagaagcagaaaca

SEQ ID NO: 449699 - RNA, 21 nt, Human
ggaagcagacaggcuccuggg

SEQ ID NO: 449700 - RNA, 32 nt, Human
ggaagcagaccagcccacuacagagccaggca

SEQ ID NO: 449701 - RNA, 32 nt, Human
ggaagcagaggaggccagggaggcaggggagg

SEQ ID NO: 449702 - RNA, 32 nt, Human
ggaagcagaggaggccagggaggcaguggagg

SEQ ID NO: 449703 - RNA, 32 nt, Human
ggaagcagaguuuucaucagcugcugaagugg

SEQ ID NO: 449704 - RNA, 32 nt, Human
ggaagcagaugaaaggcuuaagaaaaaggcgg

SEQ ID NO: 449705 - RNA, 32 nt, Human
ggaagcagcacagagcuggacaggcuuugaac

SEQ ID NO: 449706 - RNA, 32 nt, Human
ggaagcagcagccucgccccuggcagagaugc

SEQ ID NO: 449707 - RNA, 32 nt, Human
ggaagcagcaggaaaugugcauguggguagag

SEQ ID NO: 449708 - RNA, 32 nt, Human
ggaagcagccaggaguggcuggggaagaaucu

SEQ ID NO: 449709 - RNA, 32 nt, Human
ggaagcagccccgggcugggaaagggcugagu

SEQ ID NO: 449710 - RNA, 16 nt, Human
ggaagcagccucagag

SEQ ID NO: 449711 - RNA, 17 nt, Human
ggaagcagcgcuggcug

SEQ ID NO: 449712 - RNA, 32 nt, Human
ggaagcagcucagcccagccugggagaggcca

SEQ ID NO: 449713 - RNA, 21 nt, Human
ggaagcagcugagcccaagga

SEQ ID NO: 449714 - RNA, 17 nt, Human
ggaagcagcugcagagg

SEQ ID NO: 449715 - RNA, 19 nt, Human
ggaagcagcuggaaagaga

SEQ ID NO: 449716 - RNA, 32 nt, Human
ggaagcagcuucuagagaacagcuucaggugc

SEQ ID NO: 449717 - RNA, 32 nt, Human
ggaagcaggaaagcacgaaggagcagccagcc

SEQ ID NO: 449718 - RNA, 16 nt, Human
ggaagcaggaacccca

SEQ ID NO: 449719 - RNA, 32 nt, Human
ggaagcaggaagcagacuccagagggccuccc

SEQ ID NO: 449720 - RNA, 32 nt, Human
ggaagcaggacccuccugacuggugcucuucc

SEQ ID NO: 449721 - RNA, 32 nt, Human
ggaagcaggaggaaacccgaagauccuggaga

SEQ ID NO: 449722 - RNA, 32 nt, Human
ggaagcaggcagcaggaggucugggggcugga

SEQ ID NO: 449723 - RNA, 32 nt, Human
ggaagcaggcagcaugggaagcaggauggcag

SEQ ID NO: 449724 - RNA, 20 nt, Human
ggaagcagggcagaacucug

SEQ ID NO: 449725 - RNA, 32 nt, Human
ggaagcaggggaggggagggagcagcugggca

SEQ ID NO: 449726 - RNA, 32 nt, Human
ggaagcaggggcugaggaacacuuagagggug

SEQ ID NO: 449727 - RNA, 22 nt, Human
ggaagcaggguaggaguccuuc

SEQ ID NO: 449728 - RNA, 20 nt, Human
ggaagcaggugucccuggag

SEQ ID NO: 449729 - RNA, 32 nt, Human
ggaagcaguaagugguagccaccccaccccug

SEQ ID NO: 449730 - RNA, 32 nt, Human
ggaagcagucuuaacaaaggcucuuuucagag

SEQ ID NO: 449731 - RNA, 32 nt, Human
ggaagcagugagaagcaccagaauugagaaac

SEQ ID NO: 449732 - RNA, 32 nt, Human
ggaagcaguuuggcccagcccaaggagacccc

SEQ ID NO: 449733 - RNA, 23 nt, Human
ggaagcauaggaugccauuucuu

SEQ ID NO: 449734 - RNA, 32 nt, Human
ggaagcaucacccaggcuggcagaucauggua

SEQ ID NO: 449735 - RNA, 32 nt, Human
ggaagcauccacccucucgcugccccagccug

SEQ ID NO: 449736 - RNA, 32 nt, Human
ggaagcauccaggaaccccagagcaggcagug

SEQ ID NO: 449737 - RNA, 22 nt, Human
ggaagcauccgagucacuccuu

SEQ ID NO: 449738 - RNA, 32 nt, Human
ggaagcaucuacccguucacuccagucccacc

SEQ ID NO: 449739 - RNA, 32 nt, Human
ggaagcaugaaggaugcacaggucaggccauu

SEQ ID NO: 449740 - RNA, 23 nt, Human
ggaagcaugccaacaaagccaca

SEQ ID NO: 449741 - RNA, 23 nt, Human
ggaagcaugccugaucucuucuu

SEQ ID NO: 449742 - RNA, 32 nt, Human
ggaagccaaaagacuggccaccucugguucaa

SEQ ID NO: 449743 - RNA, 32 nt, Human
ggaagccaaaccacagccucugcaucaaccag

SEQ ID NO: 449744 - RNA, 32 nt, Human
ggaagccaaagggcuccucucuacccugacuc

SEQ ID NO: 449745 - RNA, 32 nt, Human
ggaagccaacuuaacccaggggucugaaagua

SEQ ID NO: 449746 - RNA, 32 nt, Human
ggaagccaagcauggcccugccucuggcgccu

SEQ ID NO: 449747 - RNA, 25 nt, Human
ggaagccaaggagggaggaucacuu

SEQ ID NO: 449748 - RNA, 25 nt, Human
ggaagccaaggcaggaagacugcuu

SEQ ID NO: 449749 - RNA, 32 nt, Human
ggaagccaaggcaggaggauugcuugaggcca

SEQ ID NO: 449750 - RNA, 32 nt, Human
ggaagccaaggcagguggaucgcuugagcuca

SEQ ID NO: 449751 - RNA, 32 nt, Human
ggaagccaaggcagguggauugcuugagccca

SEQ ID NO: 449752 - RNA, 32 nt, Human
ggaagccaagggaggaggaucacuugagccca

SEQ ID NO: 449753 - RNA, 25 nt, Human
ggaagccaagguaagaggauugcuu

SEQ ID NO: 449754 - RNA, 32 nt, Human
ggaagccaagguaagaggauugcuugagccca

SEQ ID NO: 449755 - RNA, 23 nt, Human
ggaagccaagguaggaggaucau

SEQ ID NO: 449756 - RNA, 25 nt, Human
ggaagccaagguggaaggauugcuu

SEQ ID NO: 449757 - RNA, 25 nt, Human
ggaagccaaggugggagaauugcuu

SEQ ID NO: 449758 - RNA, 32 nt, Human
ggaagccaaggugggagaauugcuugaagcca

SEQ ID NO: 449759 - RNA, 25 nt, Human
ggaagccaaggugggaggaucacuu

SEQ ID NO: 449760 - RNA, 32 nt, Human
ggaagccaaggugggaguaucgcuugagccca

SEQ ID NO: 449761 - RNA, 32 nt, Human
ggaagccaaguccaggcugagccccaggagga

SEQ ID NO: 449762 - RNA, 32 nt, Human
ggaagccacaugcuggauggcuacaaggggcu

SEQ ID NO: 449763 - RNA, 20 nt, Human
ggaagccacccaacuucccu

SEQ ID NO: 449764 - RNA, 32 nt, Human
ggaagccaccgugugguucuuucacaggcacg

SEQ ID NO: 449765 - RNA, 32 nt, Human
ggaagccacugcaaccaggaccggaguggagg

SEQ ID NO: 449766 - RNA, 32 nt, Human
ggaagccacugccaccaugggagcuacuuccu

SEQ ID NO: 449767 - RNA, 25 nt, Human
ggaagccagacccacagaggcacuu

SEQ ID NO: 449768 - RNA, 32 nt, Human
ggaagccagaggucuugaaagacuucagccau

SEQ ID NO: 449769 - RNA, 32 nt, Human
ggaagccagcacuagcucucaucccccauccg

SEQ ID NO: 449770 - RNA, 32 nt, Human
ggaagccagcauggcuggagcacggaguggcc

SEQ ID NO: 449771 - RNA, 18 nt, Human
ggaagccagccucaggga

SEQ ID NO: 449772 - RNA, 32 nt, Human
ggaagccagcuggggaaaugggggcugcaggg

SEQ ID NO: 449773 - RNA, 20 nt, Human
ggaagccagcuuccagguca

SEQ ID NO: 449774 - RNA, 32 nt, Human
ggaagccaggagacugcaguggcaggucugga

SEQ ID NO: 449775 - RNA, 32 nt, Human
ggaagccaggauguaauucucagaaccagucu

SEQ ID NO: 449776 - RNA, 19 nt, Human
ggaagccaggcgcggggag

SEQ ID NO: 449777 - RNA, 32 nt, Human
ggaagccagggcaugaggauuguuugagccca

SEQ ID NO: 449778 - RNA, 19 nt, Human
ggaagccagggcucagaga

SEQ ID NO: 449779 - RNA, 32 nt, Human
ggaagccaggggacuccagccugggcggggug

SEQ ID NO: 449780 - RNA, 32 nt, Human
ggaagccagguaaagaggggccagggaagaau

SEQ ID NO: 449781 - RNA, 22 nt, Human
ggaagccaggucucuccucuca

SEQ ID NO: 449782 - RNA, 32 nt, Human
ggaagccagugcagggugggugaggaagugca

SEQ ID NO: 449783 - RNA, 32 nt, Human
ggaagccagugucccaggcguucucacgcccg

SEQ ID NO: 449784 - RNA, 32 nt, Human
ggaagccauagcacuccuaauguuuggugcua

SEQ ID NO: 449785 - RNA, 32 nt, Human
ggaagccaucaucucauuaccucugucagugc

SEQ ID NO: 449786 - RNA, 32 nt, Human
ggaagccaugguacaggcagagcucagggcga

SEQ ID NO: 449787 - RNA, 19 nt, Human
ggaagcccaacuccuauga

SEQ ID NO: 449788 - RNA, 32 nt, Human
ggaagcccaaguagauggcacacgcagugccc

SEQ ID NO: 449789 - RNA, 28 nt, Human
ggaagcccaaguguuggccauccucaac

SEQ ID NO: 449790 - RNA, 32 nt, Human
ggaagcccacggccuggcuggggcagggucaa

SEQ ID NO: 449791 - RNA, 27 nt, Human
ggaagcccagacacucggggccuggag

SEQ ID NO: 449792 - RNA, 32 nt, Human
ggaagcccagggagguugagcagugagagagg

SEQ ID NO: 449793 - RNA, 18 nt, Human
ggaagcccauccaucugg

SEQ ID NO: 449794 - RNA, 18 nt, Human
ggaagcccaucccuggga

SEQ ID NO: 449795 - RNA, 32 nt, Human
ggaagcccauuccuccccaucaguuggccucu

SEQ ID NO: 449796 - RNA, 32 nt, Human
ggaagccccucaggcucacacggggagccacc

SEQ ID NO: 449797 - RNA, 32 nt, Human
ggaagccccugcccuuccuguggcauagugug

SEQ ID NO: 449798 - RNA, 32 nt, Human
ggaagccccuggccagccuccaccugagccca

SEQ ID NO: 449799 - RNA, 32 nt, Human
ggaagcccgagaaacacaggagagcgagcgca

SEQ ID NO: 449800 - RNA, 32 nt, Human
ggaagcccgggagugagagaaagcggcuccgg

SEQ ID NO: 449801 - RNA, 32 nt, Human
ggaagcccucauccucaccaccucccccuucc

SEQ ID NO: 449802 - RNA, 32 nt, Human
ggaagcccucauccucaccgccucccccuucc

SEQ ID NO: 449803 - RNA, 32 nt, Human
ggaagcccuccccucuucauaguccccaucuc

SEQ ID NO: 449804 - RNA, 17 nt, Human
ggaagcccugacuuccc

SEQ ID NO: 449805 - RNA, 32 nt, Human
ggaagcccugcagaaaguuccaucaggcuguu

SEQ ID NO: 449806 - RNA, 32 nt, Human
ggaagcccugcagcagaaacaguguggcuccu

SEQ ID NO: 449807 - RNA, 32 nt, Human
ggaagcccugcccagggaugguccugccauga

SEQ ID NO: 449808 - RNA, 21 nt, Human
ggaagccgaagagccugggga

SEQ ID NO: 449809 - RNA, 32 nt, Human
ggaagccgaagcaggaggaucacuggaggcca

SEQ ID NO: 449810 - RNA, 32 nt, Human
ggaagccgaagcaggaguuguuguugcugagg

SEQ ID NO: 449811 - RNA, 32 nt, Human
ggaagccgagaaacagcggaaacagaacugag

SEQ ID NO: 449812 - RNA, 32 nt, Human
ggaagccgaggcgagagaauugcuugagacca

SEQ ID NO: 449813 - RNA, 32 nt, Human
ggaagccgaguucacucucugccugcccaggg

SEQ ID NO: 449814 - RNA, 24 nt, Human
ggaagccgauggcggcggcugcgg

SEQ ID NO: 449815 - RNA, 32 nt, Human
ggaagccgauucugauuccuguggacccacag

SEQ ID NO: 449816 - RNA, 32 nt, Human
ggaagccgcagcccaaggaggucgucacuugc

SEQ ID NO: 449817 - RNA, 19 nt, Human
ggaagccgcuuauccuguu

SEQ ID NO: 449818 - RNA, 32 nt, Human
ggaagccggaccuggagccggagcagccgcga

SEQ ID NO: 449819 - RNA, 32 nt, Human
ggaagccggagcuaguggaagacucugccuca

SEQ ID NO: 449820 - RNA, 17 nt, Human
ggaagccgggcuggcug

SEQ ID NO: 449821 - RNA, 32 nt, Human
ggaagccggggaaggccaggguggaagggcgg

SEQ ID NO: 449822 - RNA, 23 nt, Human
ggaagccggggcaaaggcugcag

SEQ ID NO: 449823 - RNA, 24 nt, Human
ggaagccguauguaugucaggggg

SEQ ID NO: 449824 - RNA, 32 nt, Human
ggaagccuagguguccuugagcugaaccgcac

SEQ ID NO: 449825 - RNA, 32 nt, Human
ggaagccuccgggagaccagagcugggugcag

SEQ ID NO: 449826 - RNA, 32 nt, Human
ggaagccucucagaggaggaggagcuggagac

SEQ ID NO: 449827 - RNA, 32 nt, Human
ggaagccucucaguagagaugaaccauggccc

SEQ ID NO: 449828 - RNA, 32 nt, Human
ggaagccucucaucauuggguuuccaucccca

SEQ ID NO: 449829 - RNA, 32 nt, Human
ggaagccucugaucucucuauuuggaaguuug

SEQ ID NO: 449830 - RNA, 32 nt, Human
ggaagccucugcacuuccacacauggcacagu

SEQ ID NO: 449831 - RNA, 16 nt, Human
ggaagccucugggagg

SEQ ID NO: 449832 - RNA, 32 nt, Human
ggaagccugaucauucuuccaucagcucugca

SEQ ID NO: 449833 - RNA, 32 nt, Human
ggaagccugcaaccaggacgcucuccaggagg

SEQ ID NO: 449834 - RNA, 32 nt, Human
ggaagccugcacgagacugcccauguguacau

SEQ ID NO: 449835 - RNA, 32 nt, Human
ggaagccugcacuccagcuucgaguggaacga

SEQ ID NO: 449836 - RNA, 23 nt, Human
ggaagccugcgugugcgcagcuc

SEQ ID NO: 449837 - RNA, 24 nt, Human
ggaagccugcuccuuccccucuca

SEQ ID NO: 449838 - RNA, 32 nt, Human
ggaagccuggacugugcagccuucgggcaccc

SEQ ID NO: 449839 - RNA, 32 nt, Human
ggaagccuggggacugcagcccagggacgagg

SEQ ID NO: 449840 - RNA, 32 nt, Human
ggaagccuguaaucccagcuacuugggaggcu

SEQ ID NO: 449841 - RNA, 32 nt, Human
ggaagccuguagucccagcuacuccggaggcu

SEQ ID NO: 449842 - RNA, 22 nt, Human
ggaagccuguggaggacuguuu

SEQ ID NO: 449843 - RNA, 22 nt, Human
ggaagccugugggcuccucuga

SEQ ID NO: 449844 - RNA, 32 nt, Human
ggaagccuucaaggagccaugggucugugcug

SEQ ID NO: 449845 - RNA, 32 nt, Human
ggaagccuugcucuuuuccaucaugccucuaa

SEQ ID NO: 449846 - RNA, 32 nt, Human
ggaagcgagagaggaggggagagacccuggcc

SEQ ID NO: 449847 - RNA, 32 nt, Human
ggaagcgagcagaggcuccacaggcuuacgcu

SEQ ID NO: 449848 - RNA, 32 nt, Human
ggaagcgaggaacccggccuucucccgcuccu

SEQ ID NO: 449849 - RNA, 32 nt, Human
ggaagcgaugcagcauccagaacgacggagga

SEQ ID NO: 449850 - RNA, 32 nt, Human
ggaagcgauggagcccgggaagagaagaacca

SEQ ID NO: 449851 - RNA, 30 nt, Human
ggaagcgauucucccaugcucauguguaau

SEQ ID NO: 449852 - RNA, 22 nt, Human
ggaagcgcgagggccucaaagg

SEQ ID NO: 449853 - RNA, 32 nt, Human
ggaagcgcggaggcggggcgcgggggcagugg

SEQ ID NO: 449854 - RNA, 22 nt, Human
ggaagcgcggcggggccuccag

SEQ ID NO: 449855 - RNA, 32 nt, Human
ggaagcgcuucacuccagguugguagcuucuu

SEQ ID NO: 449856 - RNA, 17 nt, Human
ggaagcggagaccccga

SEQ ID NO: 449857 - RNA, 32 nt, Human
ggaagcggagccaacaugccaguggcccggag

SEQ ID NO: 449858 - RNA, 23 nt, Human
ggaagcggaggaggcggaggcgg

SEQ ID NO: 449859 - RNA, 32 nt, Human
ggaagcggagggggagcagguuugcggggcca

SEQ ID NO: 449860 - RNA, 23 nt, Human
ggaagcggcgguggcggccgcgg

SEQ ID NO: 449861 - RNA, 32 nt, Human
ggaagcgggaggagagccacacggucaaguug

SEQ ID NO: 449862 - RNA, 24 nt, Human
ggaagcgggaggcgagcggguagg

SEQ ID NO: 449863 - RNA, 32 nt, Human
ggaagcgggggagugggcucgucuccuaaauu

SEQ ID NO: 449864 - RNA, 32 nt, Human
ggaagcgggguccucagcugggggccucgggg

SEQ ID NO: 449865 - RNA, 31 nt, Human
ggaagcgggguucucccugccacagggaccc

SEQ ID NO: 449866 - RNA, 20 nt, Human
ggaagcguugccgcuggcug

SEQ ID NO: 449867 - RNA, 31 nt, Human
ggaagcuaaaggaacuugggcauucagggag

SEQ ID NO: 449868 - RNA, 23 nt, Human
ggaagcuaaauaucaucuaucuu

SEQ ID NO: 449869 - RNA, 32 nt, Human
ggaagcuaagucccaggaaaacauaccuacag

SEQ ID NO: 449870 - RNA, 24 nt, Human
ggaagcuacccugagauauaguca

SEQ ID NO: 449871 - RNA, 32 nt, Human
ggaagcuacuguccucacacuccuggaucacu

SEQ ID NO: 449872 - RNA, 32 nt, Human
ggaagcuaggaaaaggaaagugaaggaauggu

SEQ ID NO: 449873 - RNA, 32 nt, Human
ggaagcucacagaacuugggucuggcuggcuc

SEQ ID NO: 449874 - RNA, 32 nt, Human
ggaagcucagagcgcuggucuccacccuggug

SEQ ID NO: 449875 - RNA, 32 nt, Human
ggaagcucaucauccagcucaggaagagauga

SEQ ID NO: 449876 - RNA, 32 nt, Human
ggaagcucauuuccagaagauccuuaaaauga

SEQ ID NO: 449877 - RNA, 32 nt, Human
ggaagcuccacaaauucauuugccuauucauu

SEQ ID NO: 449878 - RNA, 32 nt, Human
ggaagcuccagccccaggauggggcugcccug

SEQ ID NO: 449879 - RNA, 32 nt, Human
ggaagcuccagcugcugcugggcugccuggca

SEQ ID NO: 449880 - RNA, 32 nt, Human
ggaagcuccaucugagcaaguacaccaaauga

SEQ ID NO: 449881 - RNA, 32 nt, Human
ggaagcuccuuuuucuccaccucucucaauac

SEQ ID NO: 449882 - RNA, 32 nt, Human
ggaagcucuaaauuugaaacuguacuuaauaa

SEQ ID NO: 449883 - RNA, 32 nt, Human
ggaagcucucagaaaaaucucuagugguggcu

SEQ ID NO: 449884 - RNA, 32 nt, Human
ggaagcucugaggaugguugcagugaggaagc

SEQ ID NO: 449885 - RNA, 32 nt, Human
ggaagcucugcaucccuucucccauaccuugc

SEQ ID NO: 449886 - RNA, 32 nt, Human
ggaagcucuucauuuauaaagcuauuugaagg

SEQ ID NO: 449887 - RNA, 32 nt, Human
ggaagcucuucuuccugcuuggcuuccaccuu

SEQ ID NO: 449888 - RNA, 19 nt, Human
ggaagcugaacccuuggaa

SEQ ID NO: 449889 - RNA, 32 nt, Human
ggaagcugaagcagaaagauugcuugagccug

SEQ ID NO: 449890 - RNA, 19 nt, Human
ggaagcugaagcaggagaa

SEQ ID NO: 449891 - RNA, 25 nt, Human
ggaagcugaagcaggaggauugcuu

SEQ ID NO: 449892 - RNA, 32 nt, Human
ggaagcugaagcaggaggauugcuugagccca

SEQ ID NO: 449893 - RNA, 19 nt, Human
ggaagcugaagcccgggga

SEQ ID NO: 449894 - RNA, 32 nt, Human
ggaagcugaaggccacuuccucccagauggcc

SEQ ID NO: 449895 - RNA, 17 nt, Human
ggaagcugaagugggag

SEQ ID NO: 449896 - RNA, 31 nt, Human
ggaagcugacuucuuaggcuaaaggacaaaa

SEQ ID NO: 449897 - RNA, 19 nt, Human
ggaagcugagaagcuggaa

SEQ ID NO: 449898 - RNA, 32 nt, Human
ggaagcugagacaggaggaucgcuugaaccca

SEQ ID NO: 449899 - RNA, 32 nt, Human
ggaagcugagacgagacaaucgcuugaaccuu

SEQ ID NO: 449900 - RNA, 20 nt, Human
ggaagcugagccuccaggag

SEQ ID NO: 449901 - RNA, 32 nt, Human
ggaagcugaggaaggagaauugcuugaacccg

SEQ ID NO: 449902 - RNA, 32 nt, Human
ggaagcugaggcaauagaauugcuugaaccug

SEQ ID NO: 449903 - RNA, 32 nt, Human
ggaagcugaggcagaagaaucgcuugaacucg

SEQ ID NO: 449904 - RNA, 32 nt, Human
ggaagcugaggcaggaaaaucgcuugaaccug

SEQ ID NO: 449905 - RNA, 32 nt, Human
ggaagcugaggcaggagaaucgcuugaacccg

SEQ ID NO: 449906 - RNA, 32 nt, Human
ggaagcugaggcaggagaaucgcuugaaccug

SEQ ID NO: 449907 - RNA, 32 nt, Human
ggaagcugaggcaggagaauugcuugaaccca

SEQ ID NO: 449908 - RNA, 32 nt, Human
ggaagcugaggcaggagaauugcuugaaccug

SEQ ID NO: 449909 - RNA, 22 nt, Human
ggaagcugaggcaggaggauca

SEQ ID NO: 449910 - RNA, 32 nt, Human
ggaagcugaggcaggaggaucucuugaacccg

SEQ ID NO: 449911 - RNA, 16 nt, Human
ggaagcugaggcaggg

SEQ ID NO: 449912 - RNA, 19 nt, Human
ggaagcugaggcaggggga

SEQ ID NO: 449913 - RNA, 20 nt, Human
ggaagcugaggccacaggga

SEQ ID NO: 449914 - RNA, 20 nt, Human
ggaagcugaggccacgggag

SEQ ID NO: 449915 - RNA, 32 nt, Human
ggaagcugaggcgagagaaucgcuugaacccg

SEQ ID NO: 449916 - RNA, 32 nt, Human
ggaagcugaggcgagagaaucgcuugaaccug

SEQ ID NO: 449917 - RNA, 19 nt, Human
ggaagcugaggcucagaga

SEQ ID NO: 449918 - RNA, 21 nt, Human
ggaagcugagggcacgaggag

SEQ ID NO: 449919 - RNA, 21 nt, Human
ggaagcugagggcccgcugag

SEQ ID NO: 449920 - RNA, 20 nt, Human
ggaagcugaggggcaugagg

SEQ ID NO: 449921 - RNA, 32 nt, Human
ggaagcugagguaggagaaucgcuugaaccca

SEQ ID NO: 449922 - RNA, 25 nt, Human
ggaagcugagguaggaggauugcuu

SEQ ID NO: 449923 - RNA, 32 nt, Human
ggaagcugagguaggaggauugcuugagccca

SEQ ID NO: 449924 - RNA, 32 nt, Human
ggaagcugaggugagaggaucucuagagccca

SEQ ID NO: 449925 - RNA, 32 nt, Human
ggaagcugaggugggaagaucgcuugagccca

SEQ ID NO: 449926 - RNA, 25 nt, Human
ggaagcugaggugggaggaucacuu

SEQ ID NO: 449927 - RNA, 32 nt, Human
ggaagcugaggugggaggauugauugagcuca

SEQ ID NO: 449928 - RNA, 32 nt, Human
ggaagcugaggugggagggucgcuugagccca

SEQ ID NO: 449929 - RNA, 32 nt, Human
ggaagcugcaccugacagaagcuccaggaugc

SEQ ID NO: 449930 - RNA, 32 nt, Human
ggaagcugcaccugacggagcauaccgacuuc

SEQ ID NO: 449931 - RNA, 32 nt, Human
ggaagcugcauccacagcagaccucacugaca

SEQ ID NO: 449932 - RNA, 22 nt, Human
ggaagcugcccugcccuuggaa

SEQ ID NO: 449933 - RNA, 32 nt, Human
ggaagcugccuugggaucagagcagacauaaa

SEQ ID NO: 449934 - RNA, 19 nt, Human
ggaagcugcucacacucuu

SEQ ID NO: 449935 - RNA, 32 nt, Human
ggaagcugcuggcugacugccauguccacgca

SEQ ID NO: 449936 - RNA, 32 nt, Human
ggaagcugcugucccacuugggccauaugauc

SEQ ID NO: 449937 - RNA, 22 nt, Human
ggaagcugcugucucccaggaa

SEQ ID NO: 449938 - RNA, 32 nt, Human
ggaagcugcuucuguuuggccacaggccugug

SEQ ID NO: 449939 - RNA, 32 nt, Human
ggaagcuggaaacccugcauaguguggcugag

SEQ ID NO: 449940 - RNA, 32 nt, Human
ggaagcuggagaagaugacaaagaggaagaag

SEQ ID NO: 449941 - RNA, 32 nt, Human
ggaagcuggagagagcacagugaaauugaaau

SEQ ID NO: 449942 - RNA, 19 nt, Human
ggaagcuggagcucagaga

SEQ ID NO: 449943 - RNA, 32 nt, Human
ggaagcuggcgcugggggaggcugagggugag

SEQ ID NO: 449944 - RNA, 32 nt, Human
ggaagcuggcggggacugggaggcaggaaccu

SEQ ID NO: 449945 - RNA, 16 nt, Human
ggaagcuggcuggcug

SEQ ID NO: 449946 - RNA, 26 nt, Human
ggaagcuggcugggugggugugguua

SEQ ID NO: 449947 - RNA, 32 nt, Human
ggaagcuggcuuguucagggguccccagcagg

SEQ ID NO: 449948 - RNA, 32 nt, Human
ggaagcugggaaagacugauguugauuuggaa

SEQ ID NO: 449949 - RNA, 21 nt, Human
ggaagcugggaaaugaaguca

SEQ ID NO: 449950 - RNA, 32 nt, Human
ggaagcugggagaaaggaggucgaggaggagg

SEQ ID NO: 449951 - RNA, 32 nt, Human
ggaagcugggaggucaggugggguggaugaua

SEQ ID NO: 449952 - RNA, 19 nt, Human
ggaagcugggccucagagg

SEQ ID NO: 449953 - RNA, 32 nt, Human
ggaagcuggggagagaaaggaaggaaacggga

SEQ ID NO: 449954 - RNA, 32 nt, Human
ggaagcugggggaaggguggucugagcacccc

SEQ ID NO: 449955 - RNA, 20 nt, Human
ggaagcugucccugcccagu

SEQ ID NO: 449956 - RNA, 18 nt, Human
ggaagcugugcccaggaa

SEQ ID NO: 449957 - RNA, 32 nt, Human
ggaagcugugcuguagccuguaauuacugaca

SEQ ID NO: 449958 - RNA, 32 nt, Human
ggaagcuguggcugccggcggugggacgcccc

SEQ ID NO: 449959 - RNA, 32 nt, Human
ggaagcuguggcugggcgugggaaggcugagu

SEQ ID NO: 449960 - RNA, 32 nt, Human
ggaagcuguggggagaccagaggaucaagcug

SEQ ID NO: 449961 - RNA, 21 nt, Human
ggaagcuguucuaccuuggaa

SEQ ID NO: 449962 - RNA, 32 nt, Human
ggaagcuuacagucaugguggaaggugaacag

SEQ ID NO: 449963 - RNA, 31 nt, Human
ggaagcuuauuagguucacuguugaaugaug

SEQ ID NO: 449964 - RNA, 32 nt, Human
ggaagcuuccugccuuuuucuuugguugcucc

SEQ ID NO: 449965 - RNA, 32 nt, Human
ggaagcuucuaggaggcugagaagcaggagau

SEQ ID NO: 449966 - RNA, 32 nt, Human
ggaagcuugacaggcagcugggcaucagugca

SEQ ID NO: 449967 - RNA, 32 nt, Human
ggaagcuuugggcuucggugggugcaggcuca

SEQ ID NO: 449968 - RNA, 21 nt, Human
ggaagcuuuugaauuuuuuca

SEQ ID NO: 449969 - RNA, 32 nt, Human
ggaaggaaaagugccaugucaacccccaguaa

SEQ ID NO: 449970 - RNA, 32 nt, Human
ggaaggaaacccacaaaccaaagauacuguag

SEQ ID NO: 449971 - RNA, 32 nt, Human
ggaaggaaagaaagaaggaagugaagagggag

SEQ ID NO: 449972 - RNA, 32 nt, Human
ggaaggaaagagaacgggccaagacugggacu

SEQ ID NO: 449973 - RNA, 32 nt, Human
ggaaggaaagagaccuuccuggucacacuugg

SEQ ID NO: 449974 - RNA, 32 nt, Human
ggaaggaaagccauuaaucuuugcacaguacc

SEQ ID NO: 449975 - RNA, 23 nt, Human
ggaaggaaaggagggagggagcg

SEQ ID NO: 449976 - RNA, 32 nt, Human
ggaaggaacucaccuugaacuuagcuuucuuu

SEQ ID NO: 449977 - RNA, 32 nt, Human
ggaaggaagaaaggaggaagaggcaggcacaa

SEQ ID NO: 449978 - RNA, 32 nt, Human
ggaaggaagaaggaggcuaggagcagggggaa

SEQ ID NO: 449979 - RNA, 32 nt, Human
ggaaggaagaaugaaauuaaaaggagacuuuc

SEQ ID NO: 449980 - RNA, 32 nt, Human
ggaaggaagagaaaggggagcucuccagcaaa

SEQ ID NO: 449981 - RNA, 32 nt, Human
ggaaggaagcucuugcuucucaguccaugcuc

SEQ ID NO: 449982 - RNA, 32 nt, Human
ggaaggaagcuuggcugcucaguuucugaguc

SEQ ID NO: 449983 - RNA, 32 nt, Human
ggaaggaaggaaaaggaggggagaggagggga

SEQ ID NO: 449984 - RNA, 32 nt, Human
ggaaggaaggaaggaaggaaagaaagaaaggu

SEQ ID NO: 449985 - RNA, 32 nt, Human
ggaaggaaggaaggaaggaagaaagaaagaaa

SEQ ID NO: 449986 - RNA, 32 nt, Human
ggaaggaaggaaggagaaaggaaaggaaggca

SEQ ID NO: 449987 - RNA, 32 nt, Human
ggaaggaaggacuggaaggaaaaagagacagg

SEQ ID NO: 449988 - RNA, 20 nt, Human
ggaaggaaggagcacccaga

SEQ ID NO: 449989 - RNA, 32 nt, Human
ggaaggaaggcaacugugaggcuucugagaag

SEQ ID NO: 449990 - RNA, 19 nt, Human
ggaaggaaggguuggggga

SEQ ID NO: 449991 - RNA, 32 nt, Human
ggaaggacacagacccaaaagccagacccagg

SEQ ID NO: 449992 - RNA, 19 nt, Human
ggaaggacccaggauuuga

SEQ ID NO: 449993 - RNA, 21 nt, Human
ggaaggaccccacauccuucu

SEQ ID NO: 449994 - RNA, 32 nt, Human
ggaaggaccgggaaggaagagcggagccggag

SEQ ID NO: 449995 - RNA, 32 nt, Human
ggaaggaccuuuccucaccucccuuuugacag

SEQ ID NO: 449996 - RNA, 32 nt, Human
ggaaggacgaggcagagcuccgcgcugacgaa

SEQ ID NO: 449997 - RNA, 32 nt, Human
ggaaggacucacacuggagaaaaacccuauga

SEQ ID NO: 449998 - RNA, 32 nt, Human
ggaaggacucggccgggccgccggaugugacg

SEQ ID NO: 449999 - RNA, 32 nt, Human
ggaaggacugaggaagggaggccugggggccg

SEQ ID NO: 450000 - RNA, 32 nt, Human
ggaaggacuggggcacuuucugccacaguaga

SEQ ID NO: 450001 - RNA, 22 nt, Human
ggaaggacuguggcugcaggug

SEQ ID NO: 450002 - RNA, 19 nt, Human
ggaaggacuugcugggagg

SEQ ID NO: 450003 - RNA, 32 nt, Human
ggaaggagaacagugucaucucuuccuuuguu

SEQ ID NO: 450004 - RNA, 32 nt, Human
ggaaggagaaggccuuugcugccugaaagucu

SEQ ID NO: 450005 - RNA, 32 nt, Human
ggaaggagagaaggaaggaaggaacuuccgua

SEQ ID NO: 450006 - RNA, 32 nt, Human
ggaaggagaggcacccacacaaaggacgcagg

SEQ ID NO: 450007 - RNA, 32 nt, Human
ggaaggagaggggagagcagcgacaggccucc

SEQ ID NO: 450008 - RNA, 32 nt, Human
ggaaggagagguuucucacaccaaggcagaug

SEQ ID NO: 450009 - RNA, 32 nt, Human
ggaaggagauggagcuugcgggagcccccacu

SEQ ID NO: 450010 - RNA, 18 nt, Human
ggaaggagauuugggaga

SEQ ID NO: 450011 - RNA, 32 nt, Human
ggaaggagcccucccucucucccuugucccuc

SEQ ID NO: 450012 - RNA, 32 nt, Human
ggaaggagcuagugggggacucgaggccugag

SEQ ID NO: 450013 - RNA, 32 nt, Human
ggaaggaggaggaggacccugcaccucagggg

SEQ ID NO: 450014 - RNA, 32 nt, Human
ggaaggaggaggaggaggagcaaagguguugg

SEQ ID NO: 450015 - RNA, 32 nt, Human
ggaaggaggcagcuaggcuguagauggaagau

SEQ ID NO: 450016 - RNA, 21 nt, Human
ggaaggaggcaggugcaggug

SEQ ID NO: 450017 - RNA, 32 nt, Human
ggaaggaggcugggacugugcccugacaugau

SEQ ID NO: 450018 - RNA, 32 nt, Human
ggaaggagggagcagggcucggcgaggggaag

SEQ ID NO: 450019 - RNA, 24 nt, Human
ggaaggagggcagggggcgcggga

SEQ ID NO: 450020 - RNA, 32 nt, Human
ggaaggagggccuguggcugcaguccaggcau

SEQ ID NO: 450021 - RNA, 17 nt, Human
ggaaggaggggaggaga

SEQ ID NO: 450022 - RNA, 32 nt, Human
ggaaggaggggaggagaaaggcaaaagcaaac

SEQ ID NO: 450023 - RNA, 32 nt, Human
ggaaggaggggagggaaaagucccacggagga

SEQ ID NO: 450024 - RNA, 18 nt, Human
ggaaggaggggagggaga

SEQ ID NO: 450025 - RNA, 18 nt, Human
ggaaggagggggaggagg

SEQ ID NO: 450026 - RNA, 21 nt, Human
ggaaggagggugccugggagg

SEQ ID NO: 450027 - RNA, 20 nt, Human
ggaaggaggguguggggagg

SEQ ID NO: 450028 - RNA, 19 nt, Human
ggaaggaggguuagggagg

SEQ ID NO: 450029 - RNA, 24 nt, Human
ggaaggaggucucccguugggaga

SEQ ID NO: 450030 - RNA, 21 nt, Human
ggaaggaggugggggccggga

SEQ ID NO: 450031 - RNA, 22 nt, Human
ggaaggaguacggaggccgaga

SEQ ID NO: 450032 - RNA, 32 nt, Human
ggaaggaguccugggagcauggcuuucccuga

SEQ ID NO: 450033 - RNA, 18 nt, Human
ggaaggagucgcugggag

SEQ ID NO: 450034 - RNA, 32 nt, Human
ggaaggaguuacuguguuauucugaguucuua

SEQ ID NO: 450035 - RNA, 32 nt, Human
ggaaggaguugacaggugggcccagugaacuu

SEQ ID NO: 450036 - RNA, 32 nt, Human
ggaaggaguuugcagagaagcuggagucccug

SEQ ID NO: 450037 - RNA, 32 nt, Human
ggaaggauagaagcuugaagaccuggggaaau

SEQ ID NO: 450038 - RNA, 25 nt, Human
ggaaggauauguaauaaugcaggug

SEQ ID NO: 450039 - RNA, 32 nt, Human
ggaaggaucuuucuaguccagccccucgcuuu

SEQ ID NO: 450040 - RNA, 32 nt, Human
ggaaggaugucagcugaccucucaccucccau

SEQ ID NO: 450041 - RNA, 20 nt, Human
ggaaggauugcucgaggcca

SEQ ID NO: 450042 - RNA, 32 nt, Human
ggaaggauuuugucgucugccucccaguucug

SEQ ID NO: 450043 - RNA, 32 nt, Human
ggaaggcaaauacucaggguuugaagggagac

SEQ ID NO: 450044 - RNA, 32 nt, Human
ggaaggcaagcuccaaaccccugccuggaaga

SEQ ID NO: 450045 - RNA, 19 nt, Human
ggaaggcaauggguuucaa

SEQ ID NO: 450046 - RNA, 32 nt, Human
ggaaggcaauugcuccuuaacagcagaguauc

SEQ ID NO: 450047 - RNA, 32 nt, Human
ggaaggcacacagagaggccacgugaggacac

SEQ ID NO: 450048 - RNA, 32 nt, Human
ggaaggcacaccauggcuuccucugcuugguu

SEQ ID NO: 450049 - RNA, 32 nt, Human
ggaaggcacagggaagcaucagcaaccaaggu

SEQ ID NO: 450050 - RNA, 32 nt, Human
ggaaggcaccaauuuucccagccccacuccca

SEQ ID NO: 450051 - RNA, 19 nt, Human
ggaaggcacccaagcucua

SEQ ID NO: 450052 - RNA, 32 nt, Human
ggaaggcacuaaggggaagggagaagcccuca

SEQ ID NO: 450053 - RNA, 22 nt, Human
ggaaggcacuugggauuuucug

SEQ ID NO: 450054 - RNA, 32 nt, Human
ggaaggcagacaggcgccagagcccagcacuc

SEQ ID NO: 450055 - RNA, 24 nt, Human
ggaaggcagacgagaggcacuuua

SEQ ID NO: 450056 - RNA, 32 nt, Human
ggaaggcagagcagcgucugccugacggggag

SEQ ID NO: 450057 - RNA, 18 nt, Human
ggaaggcagaggcaguga

SEQ ID NO: 450058 - RNA, 32 nt, Human
ggaaggcagagugugacagagcagagccaggg

SEQ ID NO: 450059 - RNA, 21 nt, Human
ggaaggcagccaggcuggcag

SEQ ID NO: 450060 - RNA, 32 nt, Human
ggaaggcagccaggcuggcagauuuccaaaag

SEQ ID NO: 450061 - RNA, 20 nt, Human
ggaaggcagccgcacccugg

SEQ ID NO: 450062 - RNA, 22 nt, Human
ggaaggcagcuuucauuuguuu

SEQ ID NO: 450063 - RNA, 32 nt, Human
ggaaggcaggagaggccagggaagcagaggag

SEQ ID NO: 450064 - RNA, 32 nt, Human
ggaaggcaggcaggacgggggcguuggggagc

SEQ ID NO: 450065 - RNA, 21 nt, Human
ggaaggcaggcaggagcucug

SEQ ID NO: 450066 - RNA, 19 nt, Human
ggaaggcaggcagggcucu

SEQ ID NO: 450067 - RNA, 32 nt, Human
ggaaggcaggcuuaaagccaggaagcaccuca

SEQ ID NO: 450068 - RNA, 21 nt, Human
ggaaggcagggaggaggcaga

SEQ ID NO: 450069 - RNA, 19 nt, Human
ggaaggcagggagggccug

SEQ ID NO: 450070 - RNA, 32 nt, Human
ggaaggcagggugguuggaacagaacaagaga

SEQ ID NO: 450071 - RNA, 23 nt, Human
ggaaggccaagacagguggauca

SEQ ID NO: 450072 - RNA, 32 nt, Human
ggaaggccaagugcugcaaguggcugggagug

SEQ ID NO: 450073 - RNA, 32 nt, Human
ggaaggccagaaccucacccugcccuccuccc

SEQ ID NO: 450074 - RNA, 21 nt, Human
ggaaggccagccccgcaucuc

SEQ ID NO: 450075 - RNA, 21 nt, Human
ggaaggccagcccuccuccuc

SEQ ID NO: 450076 - RNA, 21 nt, Human
ggaaggccagugcaacccccu

SEQ ID NO: 450077 - RNA, 32 nt, Human
ggaaggccaguuccaauuugagccgcugugaa

SEQ ID NO: 450078 - RNA, 32 nt, Human
ggaaggcccaccccuggggcugggcaguguag

SEQ ID NO: 450079 - RNA, 32 nt, Human
ggaaggcccacuguccagcagcccccagguug

SEQ ID NO: 450080 - RNA, 32 nt, Human
ggaaggcccccaggaggagcaggcugguggca

SEQ ID NO: 450081 - RNA, 32 nt, Human
ggaaggcccgggccauuucuucccugaccugu

SEQ ID NO: 450082 - RNA, 20 nt, Human
ggaaggcccucaccuggagg

SEQ ID NO: 450083 - RNA, 32 nt, Human
ggaaggcccugagcgucacugcugcugggcgg

SEQ ID NO: 450084 - RNA, 32 nt, Human
ggaaggcccugaggcggaggcugugcuccgcc

SEQ ID NO: 450085 - RNA, 32 nt, Human
ggaaggcccuggggacccuugugccuguugcu

SEQ ID NO: 450086 - RNA, 32 nt, Human
ggaaggcccugggggugcaguggagcgaccgu

SEQ ID NO: 450087 - RNA, 21 nt, Human
ggaaggccgagcaaggaccau

SEQ ID NO: 450088 - RNA, 21 nt, Human
ggaaggccgaggcagaggauc

SEQ ID NO: 450089 - RNA, 23 nt, Human
ggaaggccgaggcaggaggauca

SEQ ID NO: 450090 - RNA, 23 nt, Human
ggaaggccgaggcaggcagaucg

SEQ ID NO: 450091 - RNA, 23 nt, Human
ggaaggccgaggcaggcggauca

SEQ ID NO: 450092 - RNA, 22 nt, Human
ggaaggccgaggcaggcggauu

SEQ ID NO: 450093 - RNA, 23 nt, Human
ggaaggccgaggcagguggauca

SEQ ID NO: 450094 - RNA, 23 nt, Human
ggaaggccgaggcgggcagauca

SEQ ID NO: 450095 - RNA, 23 nt, Human
ggaaggccgaggcgggcggauca

SEQ ID NO: 450096 - RNA, 23 nt, Human
ggaaggccgaggcggggggauca

SEQ ID NO: 450097 - RNA, 23 nt, Human
ggaaggccgaggcggguggguca

SEQ ID NO: 450098 - RNA, 24 nt, Human
ggaaggccgaggugggcagaucau

SEQ ID NO: 450099 - RNA, 21 nt, Human
ggaaggccgagguggguggau

SEQ ID NO: 450100 - RNA, 23 nt, Human
ggaaggccgagguggguggauca

SEQ ID NO: 450101 - RNA, 24 nt, Human
ggaaggccgggcgcgguggcucau

SEQ ID NO: 450102 - RNA, 18 nt, Human
ggaaggccgggguggauc

SEQ ID NO: 450103 - RNA, 23 nt, Human
ggaaggccgggguggaucccucu

SEQ ID NO: 450104 - RNA, 32 nt, Human
ggaaggccucacguuguccuccagagcugcuc

SEQ ID NO: 450105 - RNA, 32 nt, Human
ggaaggccugcucugccccacugggguguccu

SEQ ID NO: 450106 - RNA, 32 nt, Human
ggaaggccuuccagaucuggcuccagggucac

SEQ ID NO: 450107 - RNA, 32 nt, Human
ggaaggccuuucucuccaugcuccuuuugcgg

SEQ ID NO: 450108 - RNA, 32 nt, Human
ggaaggcgaagguaguuaauaauuugaauaga

SEQ ID NO: 450109 - RNA, 32 nt, Human
ggaaggcgagcucuccuccaccguccaaagua

SEQ ID NO: 450110 - RNA, 32 nt, Human
ggaaggcgaggcgagcuuuggugaggaggcgc

SEQ ID NO: 450111 - RNA, 25 nt, Human
ggaaggcgaggugccuggccugcca

SEQ ID NO: 450112 - RNA, 32 nt, Human
ggaaggcgauuggcaucgaucucuccaucccu

SEQ ID NO: 450113 - RNA, 32 nt, Human
ggaaggcgcugggccuggaccucugccacuca

SEQ ID NO: 450114 - RNA, 32 nt, Human
ggaaggcggccuuccccugcaguccugugucc

SEQ ID NO: 450115 - RNA, 21 nt, Human
ggaaggcgguagguaccuacc

SEQ ID NO: 450116 - RNA, 32 nt, Human
ggaaggcgguucugagagcuucagagagcgau

SEQ ID NO: 450117 - RNA, 32 nt, Human
ggaaggcgguugcagcuccugagugcagcgcg

SEQ ID NO: 450118 - RNA, 22 nt, Human
ggaaggcuaaugagucugaacu

SEQ ID NO: 450119 - RNA, 32 nt, Human
ggaaggcucaaaggagucaacauuuagaucug

SEQ ID NO: 450120 - RNA, 32 nt, Human
ggaaggcuccugggccuuucuggcucugggaa

SEQ ID NO: 450121 - RNA, 20 nt, Human
ggaaggcucggcgcccccuc

SEQ ID NO: 450122 - RNA, 23 nt, Human
ggaaggcucugguggagaaccug

SEQ ID NO: 450123 - RNA, 32 nt, Human
ggaaggcucugguucucuagggacuugaaggc

SEQ ID NO: 450124 - RNA, 23 nt, Human
ggaaggcugaagcccgcuuccca

SEQ ID NO: 450125 - RNA, 32 nt, Human
ggaaggcugagccucuccccagccuucaugcc

SEQ ID NO: 450126 - RNA, 23 nt, Human
ggaaggcugaggcacauggacca

SEQ ID NO: 450127 - RNA, 23 nt, Human
ggaaggcugaggcaggagaauca

SEQ ID NO: 450128 - RNA, 24 nt, Human
ggaaggcugaggcaggagaaucau

SEQ ID NO: 450129 - RNA, 24 nt, Human
ggaaggcugaggcaggaggaucau

SEQ ID NO: 450130 - RNA, 24 nt, Human
ggaaggcugaggcgggcagaucau

SEQ ID NO: 450131 - RNA, 23 nt, Human
ggaaggcugaggcgggcggauca

SEQ ID NO: 450132 - RNA, 32 nt, Human
ggaaggcugcccuguggccacacccauccucc

SEQ ID NO: 450133 - RNA, 22 nt, Human
ggaaggcugcgagaggacucua

SEQ ID NO: 450134 - RNA, 32 nt, Human
ggaaggcuggagaggcagacggugggacccac

SEQ ID NO: 450135 - RNA, 32 nt, Human
ggaaggcugggcagacuggcuuuuguuaccug

SEQ ID NO: 450136 - RNA, 19 nt, Human
ggaaggcugggcugggagg

SEQ ID NO: 450137 - RNA, 32 nt, Human
ggaaggcuggggccgggcaggccaggccaagc

SEQ ID NO: 450138 - RNA, 22 nt, Human
ggaaggcugugcccaucuccca

SEQ ID NO: 450139 - RNA, 32 nt, Human
ggaaggcuguggggucuugcucugccuuagca

SEQ ID NO: 450140 - RNA, 18 nt, Human
ggaaggcuguguuucuga

SEQ ID NO: 450141 - RNA, 32 nt, Human
ggaaggcuuggccuugaugaugcagcuggccc

SEQ ID NO: 450142 - RNA, 32 nt, Human
ggaagggaaacaauaaaucucgcugaauugaa

SEQ ID NO: 450143 - RNA, 32 nt, Human
ggaagggaaaggggaggaagauggagggagaa

SEQ ID NO: 450144 - RNA, 32 nt, Human
ggaagggaacugcugggcucauccacaccaug

SEQ ID NO: 450145 - RNA, 32 nt, Human
ggaagggaagagcucugaaggagccagagggg

SEQ ID NO: 450146 - RNA, 32 nt, Human
ggaagggaagcacacucugcuguucuggaauc

SEQ ID NO: 450147 - RNA, 32 nt, Human
ggaagggaaggaaggagagggagggggaggau

SEQ ID NO: 450148 - RNA, 32 nt, Human
ggaagggaaggaggagaaagcaggcgaagcgg

SEQ ID NO: 450149 - RNA, 32 nt, Human
ggaagggaagugaggaggagggacaaggaaga

SEQ ID NO: 450150 - RNA, 32 nt, Human
ggaagggaauggggagaagggagaagcaagca

SEQ ID NO: 450151 - RNA, 19 nt, Human
ggaagggacaagcugugga

SEQ ID NO: 450152 - RNA, 32 nt, Human
ggaagggacaccaucaggccucuggcugaggc

SEQ ID NO: 450153 - RNA, 32 nt, Human
ggaagggacugcagaggugugcgagaugagug

SEQ ID NO: 450154 - RNA, 32 nt, Human
ggaagggacuuccucuuucucucccuccuccc

SEQ ID NO: 450155 - RNA, 32 nt, Human
ggaagggagaggagguguaagauggucacucu

SEQ ID NO: 450156 - RNA, 32 nt, Human
ggaagggagagggagaaaaggaggagaacagg

SEQ ID NO: 450157 - RNA, 32 nt, Human
ggaagggagagggggagcuguuugucacacuu

SEQ ID NO: 450158 - RNA, 32 nt, Human
ggaagggagcccagcuggugacaagagagccc

SEQ ID NO: 450159 - RNA, 19 nt, Human
ggaagggagcugcugggaa

SEQ ID NO: 450160 - RNA, 32 nt, Human
ggaagggaggaggagagccaggugagcagugg

SEQ ID NO: 450161 - RNA, 32 nt, Human
ggaagggaggcgaaggccugagguuuuccauc

SEQ ID NO: 450162 - RNA, 32 nt, Human
ggaagggaggcuggggcugcagggcagugaaa

SEQ ID NO: 450163 - RNA, 32 nt, Human
ggaagggagggagggagaaaggagaaguuggu

SEQ ID NO: 450164 - RNA, 32 nt, Human
ggaagggaggggaggagaggagaggagaggaa

SEQ ID NO: 450165 - RNA, 32 nt, Human
ggaagggagguggagguccaguaagggccugg

SEQ ID NO: 450166 - RNA, 32 nt, Human
ggaagggaggugggcagcagugggucagagau

SEQ ID NO: 450167 - RNA, 17 nt, Human
ggaagggaguguuccga

SEQ ID NO: 450168 - RNA, 20 nt, Human
ggaagggauagccagaggga

SEQ ID NO: 450169 - RNA, 32 nt, Human
ggaagggcaaaguccuuuggggcaaagaaccc

SEQ ID NO: 450170 - RNA, 32 nt, Human
ggaagggcaauauuuaucaugcuucaguggug

SEQ ID NO: 450171 - RNA, 21 nt, Human
ggaagggcacacagcagcagg

SEQ ID NO: 450172 - RNA, 32 nt, Human
ggaagggcacaggggcugagcacuacagaagu

SEQ ID NO: 450173 - RNA, 21 nt, Human
ggaagggcaccagcaugcagg

SEQ ID NO: 450174 - RNA, 32 nt, Human
ggaagggcagaagucccgccgaaggcacuccc

SEQ ID NO: 450175 - RNA, 32 nt, Human
ggaagggcagacggaggcaucuugguguauac

SEQ ID NO: 450176 - RNA, 32 nt, Human
ggaagggcagagccagaagcaagccgugccag

SEQ ID NO: 450177 - RNA, 22 nt, Human
ggaagggcagagcggagagccg

SEQ ID NO: 450178 - RNA, 25 nt, Human
ggaagggcagggcagacugcaggug

SEQ ID NO: 450179 - RNA, 21 nt, Human
ggaagggcaggggaccuggga

SEQ ID NO: 450180 - RNA, 32 nt, Human
ggaagggcaggguagagaggguauguccagua

SEQ ID NO: 450181 - RNA, 32 nt, Human
ggaagggcaggugggagcugugacacagugug

SEQ ID NO: 450182 - RNA, 18 nt, Human
ggaagggcauuccaggca

SEQ ID NO: 450183 - RNA, 32 nt, Human
ggaagggccaggcagagcaggaagccuucggu

SEQ ID NO: 450184 - RNA, 22 nt, Human
ggaagggccugggcuggcugug

SEQ ID NO: 450185 - RNA, 32 nt, Human
ggaagggcgugcaaaaacuaacauugaaauuu

SEQ ID NO: 450186 - RNA, 32 nt, Human
ggaagggcugagaaaagcugagaaugagaagu

SEQ ID NO: 450187 - RNA, 21 nt, Human
ggaagggcugagcuggaggug

SEQ ID NO: 450188 - RNA, 32 nt, Human
ggaagggcugcagcugagcuggggguugaauu

SEQ ID NO: 450189 - RNA, 32 nt, Human
ggaaggggaacacagaccaggaagcucgguga

SEQ ID NO: 450190 - RNA, 32 nt, Human
ggaaggggaagaggaaagcaaaggcgucagga

SEQ ID NO: 450191 - RNA, 32 nt, Human
ggaaggggaagaggaagaagagugaacaaagc

SEQ ID NO: 450192 - RNA, 32 nt, Human
ggaaggggaagcagaguguccacccaccaggg

SEQ ID NO: 450193 - RNA, 32 nt, Human
ggaaggggaagggagagaauaaucuugggggu

SEQ ID NO: 450194 - RNA, 32 nt, Human
ggaaggggacagggaagaagaggcucucccgc

SEQ ID NO: 450195 - RNA, 32 nt, Human
ggaaggggacagugaaaagaggagugacagga

SEQ ID NO: 450196 - RNA, 32 nt, Human
ggaaggggacagugaaauuggggcuagagaag

SEQ ID NO: 450197 - RNA, 32 nt, Human
ggaaggggacccagagagaaaguccuggcugc

SEQ ID NO: 450198 - RNA, 21 nt, Human
ggaaggggaccuagcccggag

SEQ ID NO: 450199 - RNA, 32 nt, Human
ggaaggggagaaaggggcugccagaggcggga

SEQ ID NO: 450200 - RNA, 32 nt, Human
ggaaggggagagaaaccgagagaaccgguucc

SEQ ID NO: 450201 - RNA, 32 nt, Human
ggaaggggagagaagcaggagucgggagacug

SEQ ID NO: 450202 - RNA, 32 nt, Human
ggaaggggagagaugccgagguggucaguauc

SEQ ID NO: 450203 - RNA, 32 nt, Human
ggaaggggaggcagaggaggaacaucuggaaa

SEQ ID NO: 450204 - RNA, 32 nt, Human
ggaaggggaggcgggcgggcggagaggagaga

SEQ ID NO: 450205 - RNA, 18 nt, Human
ggaaggggagggugaggu

SEQ ID NO: 450206 - RNA, 32 nt, Human
ggaaggggagugagaaagaggcugaaauuaag

SEQ ID NO: 450207 - RNA, 22 nt, Human
ggaaggggaguggcuggaggga

SEQ ID NO: 450208 - RNA, 32 nt, Human
ggaaggggaguggcuggagggagcagggggug

SEQ ID NO: 450209 - RNA, 16 nt, Human
ggaaggggaguggggu

SEQ ID NO: 450210 - RNA, 18 nt, Human
ggaaggggaugccccuga

SEQ ID NO: 450211 - RNA, 17 nt, Human
ggaaggggauuggggug

SEQ ID NO: 450212 - RNA, 32 nt, Human
ggaaggggcaaggaagacuggcaaacagaugg

SEQ ID NO: 450213 - RNA, 32 nt, Human
ggaaggggcaggaggaaggguugagguuacuu

SEQ ID NO: 450214 - RNA, 18 nt, Human
ggaaggggcaguggggug

SEQ ID NO: 450215 - RNA, 19 nt, Human
ggaaggggccaagcugcag

SEQ ID NO: 450216 - RNA, 32 nt, Human
ggaaggggccaugggagucccugcugagcucg

SEQ ID NO: 450217 - RNA, 18 nt, Human
ggaaggggcgcugggaga

SEQ ID NO: 450218 - RNA, 32 nt, Human
ggaaggggcggggagagcgccagagggaggcc

SEQ ID NO: 450219 - RNA, 32 nt, Human
ggaaggggcguugcccccacagggcaaaccuu

SEQ ID NO: 450220 - RNA, 32 nt, Human
ggaaggggcugacugggucugguccuuaccaa

SEQ ID NO: 450221 - RNA, 32 nt, Human
ggaagggggaauccuugacgcauuuuacagac

SEQ ID NO: 450222 - RNA, 32 nt, Human
ggaagggggaaucugccucuuguugccauggg

SEQ ID NO: 450223 - RNA, 17 nt, Human
ggaagggggcccucugg

SEQ ID NO: 450224 - RNA, 16 nt, Human
ggaagggggcuuccgg

SEQ ID NO: 450225 - RNA, 22 nt, Human
ggaaggggggccgcaucacccu

SEQ ID NO: 450226 - RNA, 32 nt, Human
ggaagggggugaggauguggguugggacaggu

SEQ ID NO: 450227 - RNA, 32 nt, Human
ggaagggggugcccugaaaccaaacuggaagc

SEQ ID NO: 450228 - RNA, 19 nt, Human
ggaaggggguggccaggag

SEQ ID NO: 450229 - RNA, 32 nt, Human
ggaagggguaccugggcugggugcagggccau

SEQ ID NO: 450230 - RNA, 32 nt, Human
ggaaggggucuguagugucacucaaggcggug

SEQ ID NO: 450231 - RNA, 17 nt, Human
ggaaggggugacucuga

SEQ ID NO: 450232 - RNA, 32 nt, Human
ggaaggggugaggagagcagccagaggaaaac

SEQ ID NO: 450233 - RNA, 32 nt, Human
ggaaggguaaugcacugccagacugagaagac

SEQ ID NO: 450234 - RNA, 18 nt, Human
ggaagggucagggcccuc

SEQ ID NO: 450235 - RNA, 19 nt, Human
ggaagggucucugcuucug

SEQ ID NO: 450236 - RNA, 32 nt, Human
ggaagggucugccccgagcuuucugguuggca

SEQ ID NO: 450237 - RNA, 32 nt, Human
ggaagggucuggaagguggcagggaagccagc

SEQ ID NO: 450238 - RNA, 32 nt, Human
ggaagggugcuagaggcccaucaaggaagugg

SEQ ID NO: 450239 - RNA, 31 nt, Human
ggaagggugcucaaggauuggagaggagaca

SEQ ID NO: 450240 - RNA, 32 nt, Human
ggaaggguggggacgaggcgucgggaggguau

SEQ ID NO: 450241 - RNA, 32 nt, Human
ggaagggugguuuaaggaaccggcaggggucu

SEQ ID NO: 450242 - RNA, 31 nt, Human
ggaagggugucucaaagccuguugagcccau

SEQ ID NO: 450243 - RNA, 32 nt, Human
ggaagguaaagugagagguuuaggucaguguu

SEQ ID NO: 450244 - RNA, 32 nt, Human
ggaagguaaaugccaaacccagagccauguga

SEQ ID NO: 450245 - RNA, 23 nt, Human
ggaagguaagugggccaccugcu

SEQ ID NO: 450246 - RNA, 32 nt, Human
ggaagguacaucauguugucacauuaauuugg

SEQ ID NO: 450247 - RNA, 22 nt, Human
ggaagguaccagggagaaccug

SEQ ID NO: 450248 - RNA, 18 nt, Human
ggaagguacccggcucua

SEQ ID NO: 450249 - RNA, 32 nt, Human
ggaagguagcacugagucccacacauucucug

SEQ ID NO: 450250 - RNA, 32 nt, Human
ggaagguagcucaguggcauuucugagcaggg

SEQ ID NO: 450251 - RNA, 20 nt, Human
ggaagguaggggagaaucua

SEQ ID NO: 450252 - RNA, 32 nt, Human
ggaagguagucugagccacugccuuucccaag

SEQ ID NO: 450253 - RNA, 32 nt, Human
ggaagguccuaaguacagacaggguacaucug

SEQ ID NO: 450254 - RNA, 32 nt, Human
ggaaggucgugggccacacaaugcugugugac

SEQ ID NO: 450255 - RNA, 32 nt, Human
ggaaggucugaugccucccgugggcagucagg

SEQ ID NO: 450256 - RNA, 32 nt, Human
ggaaggucugcagcuucacuccugagccagcg

SEQ ID NO: 450257 - RNA, 21 nt, Human
ggaaggugaccugccugacca

SEQ ID NO: 450258 - RNA, 18 nt, Human
ggaaggugacgcacucca

SEQ ID NO: 450259 - RNA, 32 nt, Human
ggaaggugacgcacuccagcuuuaugaaguca

SEQ ID NO: 450260 - RNA, 31 nt, Human
ggaaggugacuucucucuguuugucuuaagu

SEQ ID NO: 450261 - RNA, 32 nt, Human
ggaaggugagccuuuuccuggccaagggcagc

SEQ ID NO: 450262 - RNA, 32 nt, Human
ggaaggugaggcaccugaagcagagaaaguaa

SEQ ID NO: 450263 - RNA, 32 nt, Human
ggaaggugaggcaccugaggcagagaaaguaa

SEQ ID NO: 450264 - RNA, 32 nt, Human
ggaaggugaggcagaagcauugcuugagcuug

SEQ ID NO: 450265 - RNA, 22 nt, Human
ggaaggugagggauucagggga

SEQ ID NO: 450266 - RNA, 20 nt, Human
ggaaggugauggggcggggg

SEQ ID NO: 450267 - RNA, 24 nt, Human
ggaaggugauggguauuagugggg

SEQ ID NO: 450268 - RNA, 32 nt, Human
ggaaggugccagcccgccccggaugggcaucg

SEQ ID NO: 450269 - RNA, 32 nt, Human
ggaaggugcccauuccacucugccuuugucac

SEQ ID NO: 450270 - RNA, 32 nt, Human
ggaaggugcuagaagccaggcccaggaagguu

SEQ ID NO: 450271 - RNA, 32 nt, Human
ggaaggugcucacaggugcacugcggggagaa

SEQ ID NO: 450272 - RNA, 32 nt, Human
ggaagguggaguuuccugcuguugcuugugaa

SEQ ID NO: 450273 - RNA, 32 nt, Human
ggaagguggccggcuaugucccagaaaccguc

SEQ ID NO: 450274 - RNA, 32 nt, Human
ggaaggugggagcagggugagcugcaggccug

SEQ ID NO: 450275 - RNA, 21 nt, Human
ggaaggugggcgggcagggga

SEQ ID NO: 450276 - RNA, 32 nt, Human
ggaaggugggcugaggcccagggugaacaugc

SEQ ID NO: 450277 - RNA, 18 nt, Human
ggaaggugggguagggug

SEQ ID NO: 450278 - RNA, 18 nt, Human
ggaaggugggucugggga

SEQ ID NO: 450279 - RNA, 32 nt, Human
ggaaggugggugagccacugcccucaaacccg

SEQ ID NO: 450280 - RNA, 22 nt, Human
ggaagguggugacaacucaggg

SEQ ID NO: 450281 - RNA, 21 nt, Human
ggaagguggugcgcaugguga

SEQ ID NO: 450282 - RNA, 23 nt, Human
ggaagguggugguuccgugggga

SEQ ID NO: 450283 - RNA, 21 nt, Human
ggaaggugguguccgggagga

SEQ ID NO: 450284 - RNA, 32 nt, Human
ggaaggugguuuugagaacuauguguuugguc

SEQ ID NO: 450285 - RNA, 32 nt, Human
ggaagguguagggagagguaagcaguguguau

SEQ ID NO: 450286 - RNA, 22 nt, Human
ggaagguguugaguccugggaa

SEQ ID NO: 450287 - RNA, 32 nt, Human
ggaagguucucuuugaccccaucucauuucga

SEQ ID NO: 450288 - RNA, 32 nt, Human
ggaagguugaggcugaaaugagcugugaucau

SEQ ID NO: 450289 - RNA, 32 nt, Human
ggaagguugugcugguauuuggcucaugacag

SEQ ID NO: 450290 - RNA, 32 nt, Human
ggaagguuuuaagcagagaagugacagguugg

SEQ ID NO: 450291 - RNA, 32 nt, Human
ggaagguuuuauugaaaacuacagcuggagau

SEQ ID NO: 450292 - RNA, 32 nt, Human
ggaagguuuucaggcuccucacaaaggagaga

SEQ ID NO: 450293 - RNA, 32 nt, Human
ggaaguaaaagggagagagggagggaggaagg

SEQ ID NO: 450294 - RNA, 32 nt, Human
ggaaguaacugccucugacuucaacucaagaa

SEQ ID NO: 450295 - RNA, 32 nt, Human
ggaaguaauuuccaguucuuacacucugauac

SEQ ID NO: 450296 - RNA, 32 nt, Human
ggaaguacacgcccgugaaauucacggaggcg

SEQ ID NO: 450297 - RNA, 32 nt, Human
ggaaguaccugccgccaucuugcucaccagcc

SEQ ID NO: 450298 - RNA, 32 nt, Human
ggaaguacucucaguggggaccaccugcuuuc

SEQ ID NO: 450299 - RNA, 32 nt, Human
ggaaguacucugucuguggccugcagucuagu

SEQ ID NO: 450300 - RNA, 32 nt, Human
ggaaguacugaccaucggcugccugugagcag

SEQ ID NO: 450301 - RNA, 18 nt, Human
ggaaguacugggggccag

SEQ ID NO: 450302 - RNA, 32 nt, Human
ggaaguaggauucugguucuuuguuccuauuc

SEQ ID NO: 450303 - RNA, 32 nt, Human
ggaaguaggcagggagaaaggaacauccggaa

SEQ ID NO: 450304 - RNA, 32 nt, Human
ggaaguaggcgagacggggaaggaguucugag

SEQ ID NO: 450305 - RNA, 30 nt, Human
ggaaguaguuuuaauguagaaagacauuua

SEQ ID NO: 450306 - RNA, 32 nt, Human
ggaaguauacauauuuguuuuuccaaaguuuu

SEQ ID NO: 450307 - RNA, 32 nt, Human
ggaagucaagccugcagugaaccaugauagca

SEQ ID NO: 450308 - RNA, 32 nt, Human
ggaagucaagccugcagugagccaugacuguu

SEQ ID NO: 450309 - RNA, 32 nt, Human
ggaagucacagaacaguaguacgcuagcaggg

SEQ ID NO: 450310 - RNA, 31 nt, Human
ggaagucacagcuauauuccagagcugcuau

SEQ ID NO: 450311 - RNA, 31 nt, Human
ggaagucacagcugucagguaccggccaugg

SEQ ID NO: 450312 - RNA, 32 nt, Human
ggaagucaccagagaacaggagagggauuuga

SEQ ID NO: 450313 - RNA, 21 nt, Human
ggaagucaugugugaaucaug

SEQ ID NO: 450314 - RNA, 32 nt, Human
ggaagucauugaaaaagagaacagugacguag

SEQ ID NO: 450315 - RNA, 32 nt, Human
ggaagucauuuugauaauuuugcuuaaaccac

SEQ ID NO: 450316 - RNA, 15 nt, Human
ggaaguccagggagg

SEQ ID NO: 450317 - RNA, 32 nt, Human
ggaagucccagaggacucugugaaugaaguuu

SEQ ID NO: 450318 - RNA, 32 nt, Human
ggaagucccaggaggauggggaccaggaaggc

SEQ ID NO: 450319 - RNA, 32 nt, Human
ggaagucccgcucuccccgcggcucugaguug

SEQ ID NO: 450320 - RNA, 32 nt, Human
ggaaguccuccccuacaucuguuuucuucugu

SEQ ID NO: 450321 - RNA, 32 nt, Human
ggaaguccugcagaugugcgugccugugugug

SEQ ID NO: 450322 - RNA, 32 nt, Human
ggaaguccugggacccagggaggggaggggcc

SEQ ID NO: 450323 - RNA, 32 nt, Human
ggaaguccuuccccuucucuucccaggccugg

SEQ ID NO: 450324 - RNA, 32 nt, Human
ggaaguccuugcaagcuaauucuuugaccugu

SEQ ID NO: 450325 - RNA, 32 nt, Human
ggaagucgcggccacugccugugugcggaugu

SEQ ID NO: 450326 - RNA, 32 nt, Human
ggaagucgucccaggcugcuagauacuaaggu

SEQ ID NO: 450327 - RNA, 32 nt, Human
ggaagucucaaggcuugaguuagaagucuuaa

SEQ ID NO: 450328 - RNA, 32 nt, Human
ggaagucucugcauccaugccacccaccccag

SEQ ID NO: 450329 - RNA, 32 nt, Human
ggaagucucuuccuccuccuccucuucucucc

SEQ ID NO: 450330 - RNA, 32 nt, Human
ggaagucugaaggugagcauucaguuaggugg

SEQ ID NO: 450331 - RNA, 32 nt, Human
ggaagucugucaacugggagggggagaggggg

SEQ ID NO: 450332 - RNA, 32 nt, Human
ggaagucuuccagaauacaaacuacucccagu

SEQ ID NO: 450333 - RNA, 32 nt, Human
ggaagucuugcagcugaagggaggcacuccuu

SEQ ID NO: 450334 - RNA, 32 nt, Human
ggaagugaaggcagauuucccuccuucgucgc

SEQ ID NO: 450335 - RNA, 32 nt, Human
ggaagugacacacaacauccacuaugagacuu

SEQ ID NO: 450336 - RNA, 21 nt, Human
ggaagugacuaaugcugaaaa

SEQ ID NO: 450337 - RNA, 23 nt, Human
ggaagugacuuuuccccauuuga

SEQ ID NO: 450338 - RNA, 32 nt, Human
ggaagugagacacgugcauuccugccuuccgu

SEQ ID NO: 450339 - RNA, 20 nt, Human
ggaagugagagccugcucca

SEQ ID NO: 450340 - RNA, 23 nt, Human
ggaagugaggccauggagggagg

SEQ ID NO: 450341 - RNA, 32 nt, Human
ggaagugaggccauggagggaggcagaagagc

SEQ ID NO: 450342 - RNA, 18 nt, Human
ggaagugauaguuucuga

SEQ ID NO: 450343 - RNA, 32 nt, Human
ggaagugauaucauaaaaguagcaaccuucau

SEQ ID NO: 450344 - RNA, 32 nt, Human
ggaagugaucagagggaacgagcuguagguuu

SEQ ID NO: 450345 - RNA, 32 nt, Human
ggaagugcagaggcaaagggugcuacccaagc

SEQ ID NO: 450346 - RNA, 25 nt, Human
ggaagugcagcaggcaggugaucau

SEQ ID NO: 450347 - RNA, 21 nt, Human
ggaagugcauggacagugccu

SEQ ID NO: 450348 - RNA, 32 nt, Human
ggaagugcccacugaggggaggccuguguguu

SEQ ID NO: 450349 - RNA, 32 nt, Human
ggaagugccccagggugagaacgugcccagcc

SEQ ID NO: 450350 - RNA, 32 nt, Human
ggaagugccuguagucccagcuacucuggagg

SEQ ID NO: 450351 - RNA, 32 nt, Human
ggaagugcgcuuggagaagaugacacccccga

SEQ ID NO: 450352 - RNA, 32 nt, Human
ggaagugcucucucgccacucugggugcuuua

SEQ ID NO: 450353 - RNA, 21 nt, Human
ggaagugcugccagguuccuc

SEQ ID NO: 450354 - RNA, 20 nt, Human
ggaagugcugggauuacagg

SEQ ID NO: 450355 - RNA, 24 nt, Human
ggaaguggaagcaggcuggaaaga

SEQ ID NO: 450356 - RNA, 32 nt, Human
ggaaguggaaggcagugaacacacucagcagc

SEQ ID NO: 450357 - RNA, 32 nt, Human
ggaaguggagccaucaucacaggguacgaagg

SEQ ID NO: 450358 - RNA, 32 nt, Human
ggaaguggaggaaccacuguccgccugcggag

SEQ ID NO: 450359 - RNA, 32 nt, Human
ggaaguggaggcauugccucuccagaugugcc

SEQ ID NO: 450360 - RNA, 20 nt, Human
ggaaguggaggcggagggag

SEQ ID NO: 450361 - RNA, 32 nt, Human
ggaaguggaggcggagggagacgguggcgucg

SEQ ID NO: 450362 - RNA, 25 nt, Human
ggaaguggagggggugaaagugagg

SEQ ID NO: 450363 - RNA, 32 nt, Human
ggaaguggagugacaggggacagguagagaga

SEQ ID NO: 450364 - RNA, 32 nt, Human
ggaaguggcucugggcaccagccuguggggcu

SEQ ID NO: 450365 - RNA, 32 nt, Human
ggaaguggcugcaggcaacacagggccucucc

SEQ ID NO: 450366 - RNA, 32 nt, Human
ggaaguggcuuccugccucugaagacagcaca

SEQ ID NO: 450367 - RNA, 32 nt, Human
ggaaguggcuuuccuauucucuuccaagccag

SEQ ID NO: 450368 - RNA, 32 nt, Human
ggaagugggaagagagguggucuucuggcauu

SEQ ID NO: 450369 - RNA, 19 nt, Human
ggaagugggcccucagaga

SEQ ID NO: 450370 - RNA, 27 nt, Human
ggaagugggccuaggagggccugcagg

SEQ ID NO: 450371 - RNA, 32 nt, Human
ggaaguggggaagaguagguucucgguacuua

SEQ ID NO: 450372 - RNA, 32 nt, Human
ggaaguggggaccacgccauagagggucugcu

SEQ ID NO: 450373 - RNA, 32 nt, Human
ggaaguggggacggaacaggaggcgagagccg

SEQ ID NO: 450374 - RNA, 23 nt, Human
ggaaguggggcagggaggcgcag

SEQ ID NO: 450375 - RNA, 32 nt, Human
ggaagugggggcugcaaaauggaggcuuuccc

SEQ ID NO: 450376 - RNA, 25 nt, Human
ggaagugggggugaggagccugcgg

SEQ ID NO: 450377 - RNA, 32 nt, Human
ggaagugggguccagacaggaguggggagccc

SEQ ID NO: 450378 - RNA, 32 nt, Human
ggaagugggugaggcugggcagggccuggcgg

SEQ ID NO: 450379 - RNA, 32 nt, Human
ggaaguggguguccaugggccacugagcagug

SEQ ID NO: 450380 - RNA, 32 nt, Human
ggaagugguaggacucuggaagaggccacaca

SEQ ID NO: 450381 - RNA, 32 nt, Human
ggaaguguaagcagcugaggucucuugaggga

SEQ ID NO: 450382 - RNA, 32 nt, Human
ggaaguguagcuccggaugguggagaaccagu

SEQ ID NO: 450383 - RNA, 32 nt, Human
ggaagugucccaaagcaccaagggggugagac

SEQ ID NO: 450384 - RNA, 32 nt, Human
ggaagugucucaagauaguuggaaaagaagaa

SEQ ID NO: 450385 - RNA, 32 nt, Human
ggaagugucugcuggauuccauuuucuaagag

SEQ ID NO: 450386 - RNA, 32 nt, Human
ggaaguguuagaaaguugcuggagugagaaau

SEQ ID NO: 450387 - RNA, 32 nt, Human
ggaaguguuuguaaucccagcacuuugggagg

SEQ ID NO: 450388 - RNA, 32 nt, Human
ggaaguuaagcgagggagagacggugaaacac

SEQ ID NO: 450389 - RNA, 32 nt, Human
ggaaguucaacaguaagcagcaccuccaagac

SEQ ID NO: 450390 - RNA, 32 nt, Human
ggaaguucaagaucaaagugccagcagauuca

SEQ ID NO: 450391 - RNA, 32 nt, Human
ggaaguucacagucacuuucucggugauaacc

SEQ ID NO: 450392 - RNA, 32 nt, Human
ggaaguucgagaccagccugaccaacauggag

SEQ ID NO: 450393 - RNA, 32 nt, Human
ggaaguucucacugugaacuuuacagcaaugc

SEQ ID NO: 450394 - RNA, 32 nt, Human
ggaaguugagaaccaggaaagcugcuuucacg

SEQ ID NO: 450395 - RNA, 25 nt, Human
ggaaguugagacuuaaaaaauacuu

SEQ ID NO: 450396 - RNA, 32 nt, Human
ggaaguugagcggcggcaagaaauaauggcgg

SEQ ID NO: 450397 - RNA, 32 nt, Human
ggaaguugagcuccaccuccuuuccaagugag

SEQ ID NO: 450398 - RNA, 25 nt, Human
ggaaguugaggcaggaggauugcuu

SEQ ID NO: 450399 - RNA, 32 nt, Human
ggaaguugaggcaggaggauugcuugagccca

SEQ ID NO: 450400 - RNA, 32 nt, Human
ggaaguugaggcaggaggauugcuugagugca

SEQ ID NO: 450401 - RNA, 25 nt, Human
ggaaguugcaggcgggaggacucuu

SEQ ID NO: 450402 - RNA, 32 nt, Human
ggaaguugcaugcugccuccuggguuuuaucc

SEQ ID NO: 450403 - RNA, 22 nt, Human
ggaaguugcuccaagaacagua

SEQ ID NO: 450404 - RNA, 32 nt, Human
ggaaguugcuguucucagaccugguucugaga

SEQ ID NO: 450405 - RNA, 32 nt, Human
ggaaguugcuugaauguuggggagaggaaaau

SEQ ID NO: 450406 - RNA, 32 nt, Human
ggaaguuggagaccuugggagcuccagggaaa

SEQ ID NO: 450407 - RNA, 32 nt, Human
ggaaguuggucgccugccccacucccuccugg

SEQ ID NO: 450408 - RNA, 32 nt, Human
ggaaguugguguagaccagcuguggagcugaa

SEQ ID NO: 450409 - RNA, 32 nt, Human
ggaaguugugacguugcagcuccaaccgacgu

SEQ ID NO: 450410 - RNA, 32 nt, Human
ggaaguuguuaugucauggggucaugggagga

SEQ ID NO: 450411 - RNA, 32 nt, Human
ggaaguuuauaucuaaaaauguuaauagugcg

SEQ ID NO: 450412 - RNA, 32 nt, Human
ggaaguuuguauugccaaguacacuguugauc

SEQ ID NO: 450413 - RNA, 32 nt, Human
ggaaguuuuguagccacacacaggauacugcc

SEQ ID NO: 450414 - RNA, 32 nt, Human
ggaauaaaaacaauaugaguaguguaaucuug

SEQ ID NO: 450415 - RNA, 25 nt, Human
ggaauaaaacuacugaugcagugaa

SEQ ID NO: 450416 - RNA, 32 nt, Human
ggaauaaacagcugcccuagccccagagggau

SEQ ID NO: 450417 - RNA, 32 nt, Human
ggaauaaagaagcggggagaaggaucaggcuc

SEQ ID NO: 450418 - RNA, 32 nt, Human
ggaauaacaggagacagggaagagguggaaau

SEQ ID NO: 450419 - RNA, 32 nt, Human
ggaauaaccuuaaaaaguuaaaaagucauugu

SEQ ID NO: 450420 - RNA, 32 nt, Human
ggaauaagaguaaauuggguaaggagauaucc

SEQ ID NO: 450421 - RNA, 21 nt, Human
ggaauaagcaaaggugugcaa

SEQ ID NO: 450422 - RNA, 32 nt, Human
ggaauaagcacuuuuuaaaaaugcagauacau

SEQ ID NO: 450423 - RNA, 32 nt, Human
ggaauaaggggaaggaagagagagggagcagg

SEQ ID NO: 450424 - RNA, 32 nt, Human
ggaauaagggucuugacuguugcccaagcugg

SEQ ID NO: 450425 - RNA, 32 nt, Human
ggaauaaguagcugguguuucuagccuccgcc

SEQ ID NO: 450426 - RNA, 32 nt, Human
ggaauaaguaucucacauggcaggugcagggc

SEQ ID NO: 450427 - RNA, 32 nt, Human
ggaauaagucugccucugccucugccucaccc

SEQ ID NO: 450428 - RNA, 32 nt, Human
ggaauaauaaacagaggaaggcgggcuaaugc

SEQ ID NO: 450429 - RNA, 32 nt, Human
ggaauaauccagccuaggcuguggguggcugg

SEQ ID NO: 450430 - RNA, 32 nt, Human
ggaauaaucuguccuucacagaggauuauggu

SEQ ID NO: 450431 - RNA, 32 nt, Human
ggaauaaugauuucucagauuuguaggcuuga

SEQ ID NO: 450432 - RNA, 32 nt, Human
ggaauaauguuccaucaugcagguggaccuca

SEQ ID NO: 450433 - RNA, 32 nt, Human
ggaauacaagagcuagggcugccuaaggaagg

SEQ ID NO: 450434 - RNA, 32 nt, Human
ggaauacaagcauacaccaccaugcccagcua

SEQ ID NO: 450435 - RNA, 32 nt, Human
ggaauacacauccugaagaucucgugacuaua

SEQ ID NO: 450436 - RNA, 24 nt, Human
ggaauacagaagagaaacuagaaa

SEQ ID NO: 450437 - RNA, 32 nt, Human
ggaauacaggcacccgccaccaugcccggcua

SEQ ID NO: 450438 - RNA, 32 nt, Human
ggaauacaucucucacacauacucacaaacac

SEQ ID NO: 450439 - RNA, 32 nt, Human
ggaauacauuuucaaaaugcaguaaucaaaau

SEQ ID NO: 450440 - RNA, 32 nt, Human
ggaauacccucccggcuaucgcuucagugggu

SEQ ID NO: 450441 - RNA, 32 nt, Human
ggaauacugagcugauggugucauccagcagc

SEQ ID NO: 450442 - RNA, 32 nt, Human
ggaauagaugaggaugggcacaugguggagag

SEQ ID NO: 450443 - RNA, 32 nt, Human
ggaauagcacuggcuucagcaggcgugucaug

SEQ ID NO: 450444 - RNA, 32 nt, Human
ggaauagcagaguuuucuuuucuuuguauuac

SEQ ID NO: 450445 - RNA, 32 nt, Human
ggaauagcugacugguaaguuauuauucuucc

SEQ ID NO: 450446 - RNA, 32 nt, Human
ggaauagcuugaccacagucucuauccugggg

SEQ ID NO: 450447 - RNA, 32 nt, Human
ggaauaggagcugaauaaaaugaggcugagac

SEQ ID NO: 450448 - RNA, 32 nt, Human
ggaauaggagcuugcucuguccacucuacaca

SEQ ID NO: 450449 - RNA, 32 nt, Human
ggaauagggaaaaagguaagagacuaacgugg

SEQ ID NO: 450450 - RNA, 32 nt, Human
ggaauagguuuaacccaguuugcauucuccaa

SEQ ID NO: 450451 - RNA, 32 nt, Human
ggaauaguuuucuccucguugguucauguguu

SEQ ID NO: 450452 - RNA, 21 nt, Human
ggaauauaaaguaagcaugaa

SEQ ID NO: 450453 - RNA, 32 nt, Human
ggaauauaggguggaaaugguguggacaggca

SEQ ID NO: 450454 - RNA, 32 nt, Human
ggaauauauaaauaacucuuauaacacaacaa

SEQ ID NO: 450455 - RNA, 32 nt, Human
ggaauaucacacucuggggacugugguggggu

SEQ ID NO: 450456 - RNA, 32 nt, Human
ggaauaucacacucuggggacuguuguggggu

SEQ ID NO: 450457 - RNA, 32 nt, Human
ggaauauccugcaaccugcugcucugagccug

SEQ ID NO: 450458 - RNA, 27 nt, Human
ggaauaucuacagcagugaugcuugaa

SEQ ID NO: 450459 - RNA, 32 nt, Human
ggaauaugacaggaaaaguuacccacaggaug

SEQ ID NO: 450460 - RNA, 32 nt, Human
ggaauaugauacaaguggcaucaggaaaugag

SEQ ID NO: 450461 - RNA, 32 nt, Human
ggaauauggauaagauuagaccagccccucuc

SEQ ID NO: 450462 - RNA, 24 nt, Human
ggaauauguaagacugugcgaaaa

SEQ ID NO: 450463 - RNA, 30 nt, Human
ggaauaugucgaguuucucuagggcgcccc

SEQ ID NO: 450464 - RNA, 32 nt, Human
ggaauauugggagcuaggagucugaaccugaa

SEQ ID NO: 450465 - RNA, 32 nt, Human
ggaauauuuauaaaugagcaaauaucauacug

SEQ ID NO: 450466 - RNA, 32 nt, Human
ggaauauuugugugggggagggggaggagaag

SEQ ID NO: 450467 - RNA, 32 nt, Human
ggaauauuuuguccuucugugacagcaccacu

SEQ ID NO: 450468 - RNA, 32 nt, Human
ggaaucaaaacacacccccacucugaugguga

SEQ ID NO: 450469 - RNA, 32 nt, Human
ggaaucaagggagaggaacggggaagaaacga

SEQ ID NO: 450470 - RNA, 32 nt, Human
ggaaucaaguccacucuucugccugcaacauu

SEQ ID NO: 450471 - RNA, 32 nt, Human
ggaaucacagcccagacacaaaagcaggaaac

SEQ ID NO: 450472 - RNA, 32 nt, Human
ggaaucacccuacagaagaggccagcuauaaa

SEQ ID NO: 450473 - RNA, 32 nt, Human
ggaaucacuguuugccagcuguguggccuugg

SEQ ID NO: 450474 - RNA, 32 nt, Human
ggaaucagaggacgaggcugcucuaaagacug

SEQ ID NO: 450475 - RNA, 32 nt, Human
ggaaucagaggcagcuguuaccagguuucggc

SEQ ID NO: 450476 - RNA, 32 nt, Human
ggaaucagcccaucuaaagcagucuuuauaug

SEQ ID NO: 450477 - RNA, 32 nt, Human
ggaaucaggguaaaaggugcagguguggagag

SEQ ID NO: 450478 - RNA, 32 nt, Human
ggaaucaucuagaacaauuaagccgaccagga

SEQ ID NO: 450479 - RNA, 32 nt, Human
ggaaucauuuggaaaugcgaagacugugaaaa

SEQ ID NO: 450480 - RNA, 32 nt, Human
ggaauccacagcaacaguagccagacccgcug

SEQ ID NO: 450481 - RNA, 32 nt, Human
ggaauccagaagaaagaggagugacagauaag

SEQ ID NO: 450482 - RNA, 32 nt, Human
ggaauccagacucccuucucucaaggggaggc

SEQ ID NO: 450483 - RNA, 21 nt, Human
ggaauccagauacccaccaca

SEQ ID NO: 450484 - RNA, 32 nt, Human
ggaauccaucacagccccgggucuuucacccc

SEQ ID NO: 450485 - RNA, 32 nt, Human
ggaauccauguaaaacucucugugcaucuaaa

SEQ ID NO: 450486 - RNA, 32 nt, Human
ggaaucccaaaccaagcagcucuugcugguca

SEQ ID NO: 450487 - RNA, 32 nt, Human
ggaaucccaagaggggaaggggaagagcagcc

SEQ ID NO: 450488 - RNA, 32 nt, Human
ggaaucccagaaacuuccaucucagguccuuc

SEQ ID NO: 450489 - RNA, 32 nt, Human
ggaaucccaucuuuccagcaucaucugcuaag

SEQ ID NO: 450490 - RNA, 32 nt, Human
ggaauccccaaaaagauaacauuuuucuucug

SEQ ID NO: 450491 - RNA, 32 nt, Human
ggaaucccccgucuaccucucuccuugguccu

SEQ ID NO: 450492 - RNA, 32 nt, Human
ggaauccccuaggagccuucagucugggagaa

SEQ ID NO: 450493 - RNA, 32 nt, Human
ggaaucccucccccucuuacuuuuucucuugu

SEQ ID NO: 450494 - RNA, 21 nt, Human
ggaaucccucuuuccauguga

SEQ ID NO: 450495 - RNA, 19 nt, Human
ggaaucccuuccucccaug

SEQ ID NO: 450496 - RNA, 32 nt, Human
ggaauccggagcgcuuggaucucagguuuagc

SEQ ID NO: 450497 - RNA, 32 nt, Human
ggaauccgggagaugcauguugcagugagcug

SEQ ID NO: 450498 - RNA, 32 nt, Human
ggaauccguggcucuaccugcccagcaugaca

SEQ ID NO: 450499 - RNA, 22 nt, Human
ggaauccuacuacgagcgauca

SEQ ID NO: 450500 - RNA, 25 nt, Human
ggaauccuaggcggaagaaccccga

SEQ ID NO: 450501 - RNA, 32 nt, Human
ggaauccuagggggcuccaugacaccuucccc

SEQ ID NO: 450502 - RNA, 32 nt, Human
ggaauccuccuucucuugcccugaagagcucu

SEQ ID NO: 450503 - RNA, 32 nt, Human
ggaauccucuaucaccuccugcuguuccaccu

SEQ ID NO: 450504 - RNA, 32 nt, Human
ggaauccugccugccccauggaguugcgcagc

SEQ ID NO: 450505 - RNA, 32 nt, Human
ggaauccugcugcaucacagaagcuggaaguu

SEQ ID NO: 450506 - RNA, 32 nt, Human
ggaauccuggauuuugcccucuccuuagcucu

SEQ ID NO: 450507 - RNA, 32 nt, Human
ggaauccuuaaagccauguccaaggauuuggu

SEQ ID NO: 450508 - RNA, 32 nt, Human
ggaauccuucaccgucucagcugguaucagcc

SEQ ID NO: 450509 - RNA, 32 nt, Human
ggaauccuuuaagauuauguccaguuauuugc

SEQ ID NO: 450510 - RNA, 32 nt, Human
ggaaucgacaucuucuugguauugguuuucgc

SEQ ID NO: 450511 - RNA, 32 nt, Human
ggaaucgcaauguuguggcgucugacuuguau

SEQ ID NO: 450512 - RNA, 32 nt, Human
ggaaucgcugccucuggcuuucuguuuucuac

SEQ ID NO: 450513 - RNA, 32 nt, Human
ggaaucgcuugaaccugggaggcggagguugc

SEQ ID NO: 450514 - RNA, 32 nt, Human
ggaaucgcuugaaccugggagguggaggcuac

SEQ ID NO: 450515 - RNA, 32 nt, Human
ggaaucggaucaucccugacucagcuuauacc

SEQ ID NO: 450516 - RNA, 32 nt, Human
ggaaucguagggggcuccaugacaccuucccc

SEQ ID NO: 450517 - RNA, 32 nt, Human
ggaaucgugccacuccacuccagccugggcaa

SEQ ID NO: 450518 - RNA, 32 nt, Human
ggaaucuaaggcacuagagggcuugacggcca

SEQ ID NO: 450519 - RNA, 23 nt, Human
ggaaucucacaaacauaauguug

SEQ ID NO: 450520 - RNA, 32 nt, Human
ggaaucuccacaacgacaggugcuuuggaggc

SEQ ID NO: 450521 - RNA, 32 nt, Human
ggaaucuccagccuuccagauuuucugggacc

SEQ ID NO: 450522 - RNA, 32 nt, Human
ggaaucucccacacugucugcucccuauaaaa

SEQ ID NO: 450523 - RNA, 32 nt, Human
ggaaucucucucuguugcccaggcuggagugu

SEQ ID NO: 450524 - RNA, 32 nt, Human
ggaaucucuguaggcucaccuuugccauuucu

SEQ ID NO: 450525 - RNA, 32 nt, Human
ggaaucugagccuucucuuacaacagggaguc

SEQ ID NO: 450526 - RNA, 32 nt, Human
ggaaucugagccuugugaugucaggcuguuaa

SEQ ID NO: 450527 - RNA, 32 nt, Human
ggaaucuggagcugucauuuuagaagagcaac

SEQ ID NO: 450528 - RNA, 32 nt, Human
ggaaucuggccaggcccugcuuaggcccccau

SEQ ID NO: 450529 - RNA, 32 nt, Human
ggaaucugggaggcccugagacagggauugug

SEQ ID NO: 450530 - RNA, 32 nt, Human
ggaaucugggcuggggaaagacggcaccggga

SEQ ID NO: 450531 - RNA, 32 nt, Human
ggaaucuguaaaccuugagggauagcuuucug

SEQ ID NO: 450532 - RNA, 32 nt, Human
ggaaucuguagcugugcuuugagaauugccau

SEQ ID NO: 450533 - RNA, 32 nt, Human
ggaaucugugagacagagugaauccucuugau

SEQ ID NO: 450534 - RNA, 32 nt, Human
ggaaucuuacuauuucaucugauaccuuguuc

SEQ ID NO: 450535 - RNA, 32 nt, Human
ggaaucuucuugucauucuuuuuaaacggaug

SEQ ID NO: 450536 - RNA, 32 nt, Human
ggaaucuugcagcugcuuuuuauucuaaguac

SEQ ID NO: 450537 - RNA, 21 nt, Human
ggaaucuugggcaccugggaa

SEQ ID NO: 450538 - RNA, 32 nt, Human
ggaaugaaacuagauaauuucaagaaacugag

SEQ ID NO: 450539 - RNA, 32 nt, Human
ggaaugaagagaguguaaauaaccaaucugaa

SEQ ID NO: 450540 - RNA, 20 nt, Human
ggaaugaagccuuagccagg

SEQ ID NO: 450541 - RNA, 32 nt, Human
ggaaugaaggcaggaaggaggcuggaauaaau

SEQ ID NO: 450542 - RNA, 22 nt, Human
ggaaugaaugccuaauggugga

SEQ ID NO: 450543 - RNA, 32 nt, Human
ggaaugaauggaagcugacgggcagagagagg

SEQ ID NO: 450544 - RNA, 32 nt, Human
ggaaugacaaccuacccagccugguggggcug

SEQ ID NO: 450545 - RNA, 32 nt, Human
ggaaugacauguuguuuggauuacugagccag

SEQ ID NO: 450546 - RNA, 32 nt, Human
ggaaugaccaacucuauccaggccugacagug

SEQ ID NO: 450547 - RNA, 32 nt, Human
ggaaugaccagaaaauuuuugucuuucaugga

SEQ ID NO: 450548 - RNA, 32 nt, Human
ggaaugaccagccuguccaacagaggggcagc

SEQ ID NO: 450549 - RNA, 32 nt, Human
ggaaugaccgcucucccuuugcgcagcccuac

SEQ ID NO: 450550 - RNA, 28 nt, Human
ggaaugacguuccuccacaguauccuga

SEQ ID NO: 450551 - RNA, 32 nt, Human
ggaaugacuaaacaagauaauggcaguuuagg

SEQ ID NO: 450552 - RNA, 32 nt, Human
ggaaugacugugaggagacaucagggcugagg

SEQ ID NO: 450553 - RNA, 32 nt, Human
ggaaugagaaauguuagucaugugaguucuug

SEQ ID NO: 450554 - RNA, 32 nt, Human
ggaaugagagcagcauggacugccacaguuuu

SEQ ID NO: 450555 - RNA, 32 nt, Human
ggaaugagagggcagaggucucuccacaggug

SEQ ID NO: 450556 - RNA, 18 nt, Human
ggaaugagcaaaucucaa

SEQ ID NO: 450557 - RNA, 32 nt, Human
ggaaugagcaggaagccaaucagccaaagaaa

SEQ ID NO: 450558 - RNA, 32 nt, Human
ggaaugagcaggcaggggagacugagauggaa

SEQ ID NO: 450559 - RNA, 32 nt, Human
ggaaugagccacucccaguucuggagagugag

SEQ ID NO: 450560 - RNA, 32 nt, Human
ggaaugagcccaccaucugccccaaccaccag

SEQ ID NO: 450561 - RNA, 32 nt, Human
ggaaugagccuugacccuggccccagacggag

SEQ ID NO: 450562 - RNA, 32 nt, Human
ggaaugagcugccuaccugcugcuccacgagg

SEQ ID NO: 450563 - RNA, 32 nt, Human
ggaaugaggaagagaagacaaaagcaagaugg

SEQ ID NO: 450564 - RNA, 17 nt, Human
ggaaugaggccugcucc

SEQ ID NO: 450565 - RNA, 32 nt, Human
ggaaugaggcuggauacggugcagugaaaaag

SEQ ID NO: 450566 - RNA, 32 nt, Human
ggaaugagggagaaaugcccuuuuuggcaauu

SEQ ID NO: 450567 - RNA, 17 nt, Human
ggaaugaguguuucuga

SEQ ID NO: 450568 - RNA, 32 nt, Human
ggaaugaguuaagauuugggggacuguaggga

SEQ ID NO: 450569 - RNA, 32 nt, Human
ggaaugauagcccagaacaaaaagaaaucuug

SEQ ID NO: 450570 - RNA, 32 nt, Human
ggaaugauccaauacuguugcccuuuuccuug

SEQ ID NO: 450571 - RNA, 32 nt, Human
ggaaugcagaaggagacaggaggacucaagug

SEQ ID NO: 450572 - RNA, 32 nt, Human
ggaaugcagacagccucuucuccucuggggcc

SEQ ID NO: 450573 - RNA, 32 nt, Human
ggaaugcagcccccugaagacagcacuacaag

SEQ ID NO: 450574 - RNA, 32 nt, Human
ggaaugcagcuucuguccuuucuugggauguc

SEQ ID NO: 450575 - RNA, 32 nt, Human
ggaaugcaggccacagcacccaaucaagacaa

SEQ ID NO: 450576 - RNA, 32 nt, Human
ggaaugcagggcccugagccugacagcacucu

SEQ ID NO: 450577 - RNA, 32 nt, Human
ggaaugcaguccacaguggccagguggccaga

SEQ ID NO: 450578 - RNA, 31 nt, Human
ggaaugcaguuucagcgugaccugcagucau

SEQ ID NO: 450579 - RNA, 32 nt, Human
ggaaugcauauguauaauaucuauguugccuu

SEQ ID NO: 450580 - RNA, 32 nt, Human
ggaaugcauauuccacuggaacuggaauucca

SEQ ID NO: 450581 - RNA, 24 nt, Human
ggaaugcauuaagaggguuuggga

SEQ ID NO: 450582 - RNA, 23 nt, Human
ggaaugccaaggcagguggauca

SEQ ID NO: 450583 - RNA, 32 nt, Human
ggaaugccagaaaugcauggcagcagcuaaua

SEQ ID NO: 450584 - RNA, 32 nt, Human
ggaaugccagccagggagcacagugagccuua

SEQ ID NO: 450585 - RNA, 32 nt, Human
ggaaugccagcgcgugccaagccuggggcugg

SEQ ID NO: 450586 - RNA, 32 nt, Human
ggaaugccaucaucucuaguucccagggccca

SEQ ID NO: 450587 - RNA, 32 nt, Human
ggaaugcccaacucccccuucucagccuucuu

SEQ ID NO: 450588 - RNA, 32 nt, Human
ggaaugccucuccuguugcauuggucccugaa

SEQ ID NO: 450589 - RNA, 32 nt, Human
ggaaugccugccucccuguuaccagcucugca

SEQ ID NO: 450590 - RNA, 32 nt, Human
ggaaugccugggagugggggugcaggcgggca

SEQ ID NO: 450591 - RNA, 32 nt, Human
ggaaugccuugcaauaugaauguuaauauaau

SEQ ID NO: 450592 - RNA, 32 nt, Human
ggaaugcgguaggagagcagggugucagcaag

SEQ ID NO: 450593 - RNA, 23 nt, Human
ggaaugcuacaggggccagcagg

SEQ ID NO: 450594 - RNA, 32 nt, Human
ggaaugcuauugguuuuuacacauuaaucuug

SEQ ID NO: 450595 - RNA, 32 nt, Human
ggaaugcugaguuugucaugucccaugggccu

SEQ ID NO: 450596 - RNA, 32 nt, Human
ggaaugcuggaagccaagcuugcacauucuag

SEQ ID NO: 450597 - RNA, 32 nt, Human
ggaaugcuggacaauaaagcgagugcugccca

SEQ ID NO: 450598 - RNA, 32 nt, Human
ggaaugcugggcccccagccuggccagacaag

SEQ ID NO: 450599 - RNA, 24 nt, Human
ggaauggaaagaacuacagaggga

SEQ ID NO: 450600 - RNA, 32 nt, Human
ggaauggaaagcaggccucugaggcaguggac

SEQ ID NO: 450601 - RNA, 32 nt, Human
ggaauggacagaggaauccugaagccuuaaca

SEQ ID NO: 450602 - RNA, 32 nt, Human
ggaauggagcccuggaaucugcauuuuguaag

SEQ ID NO: 450603 - RNA, 32 nt, Human
ggaauggagccugcacggugaauggcuuugua

SEQ ID NO: 450604 - RNA, 19 nt, Human
ggaauggagggcuccgggc

SEQ ID NO: 450605 - RNA, 32 nt, Human
ggaauggaggggccaucguggggcucucccgg

SEQ ID NO: 450606 - RNA, 21 nt, Human
ggaauggagggugguggggag

SEQ ID NO: 450607 - RNA, 32 nt, Human
ggaauggaucuacagccugccucccagguuuc

SEQ ID NO: 450608 - RNA, 32 nt, Human
ggaauggcaaaacuacugucgguugauguguc

SEQ ID NO: 450609 - RNA, 32 nt, Human
ggaauggcaaacuguuuuguuuugaaggaucu

SEQ ID NO: 450610 - RNA, 23 nt, Human
ggaauggcauuguauuuaccacc

SEQ ID NO: 450611 - RNA, 32 nt, Human
ggaauggccugcuaggagaugcagugagcccc

SEQ ID NO: 450612 - RNA, 32 nt, Human
ggaaugggagaaaacagccagcaggaggagcu

SEQ ID NO: 450613 - RNA, 32 nt, Human
ggaauggggaaagggggaagagcagcaugcgg

SEQ ID NO: 450614 - RNA, 32 nt, Human
ggaaugggggaagaggaggagcaggaggcccu

SEQ ID NO: 450615 - RNA, 17 nt, Human
ggaaugggguaggggga

SEQ ID NO: 450616 - RNA, 32 nt, Human
ggaaugggguagggggaggaguugugggggaa

SEQ ID NO: 450617 - RNA, 32 nt, Human
ggaaugguauuagucaaacauggugccagugu

SEQ ID NO: 450618 - RNA, 16 nt, Human
ggaauggugcuucugg

SEQ ID NO: 450619 - RNA, 32 nt, Human
ggaaugguugagugaggguaagggaaagaaua

SEQ ID NO: 450620 - RNA, 32 nt, Human
ggaauguaaaccgauuuaaugccaaaccaccu

SEQ ID NO: 450621 - RNA, 32 nt, Human
ggaauguacauauuuauuuacuuuucuaacug

SEQ ID NO: 450622 - RNA, 21 nt, Human
ggaauguacguuguggcccuc

SEQ ID NO: 450623 - RNA, 32 nt, Human
ggaauguauaaaugaggguggguccuucugca

SEQ ID NO: 450624 - RNA, 32 nt, Human
ggaauguauauacuuuugcuaauguuccagca

SEQ ID NO: 450625 - RNA, 32 nt, Human
ggaaugucagggacuagugacccaguccuguu

SEQ ID NO: 450626 - RNA, 32 nt, Human
ggaaugucgcccauuacuccucaggccuggcc

SEQ ID NO: 450627 - RNA, 32 nt, Human
ggaaugucugcagcuucacuccugaagccagc

SEQ ID NO: 450628 - RNA, 32 nt, Human
ggaaugucuggcuuuuccucagcuuauugauc

SEQ ID NO: 450629 - RNA, 32 nt, Human
ggaaugugaacacauuguuuguagugcuaucc

SEQ ID NO: 450630 - RNA, 21 nt, Human
ggaaugugaaggguaugcaga

SEQ ID NO: 450631 - RNA, 21 nt, Human
ggaaugugaccuuugcugcag

SEQ ID NO: 450632 - RNA, 32 nt, Human
ggaaugugaguguguuugugugcaugaaagag

SEQ ID NO: 450633 - RNA, 32 nt, Human
ggaaugugauagauagcuucuauaauuaugca

SEQ ID NO: 450634 - RNA, 32 nt, Human
ggaaugugcacguuuccaggggcgaguauugu

SEQ ID NO: 450635 - RNA, 22 nt, Human
ggaaugugcagacccugggguc

SEQ ID NO: 450636 - RNA, 32 nt, Human
ggaaugugccaugucuuucuucaguguuaugg

SEQ ID NO: 450637 - RNA, 32 nt, Human
ggaauguggacgcuuuccugcccagccagggc

SEQ ID NO: 450638 - RNA, 32 nt, Human
ggaauguggcaaauccuauaacaaguuuucaa

SEQ ID NO: 450639 - RNA, 32 nt, Human
ggaaugugggagagaggcagaaaaaggagcag

SEQ ID NO: 450640 - RNA, 32 nt, Human
ggaaugugguaaccaggaggaagggucacugg

SEQ ID NO: 450641 - RNA, 22 nt, Human
ggaauguguaugaugcaacaga

SEQ ID NO: 450642 - RNA, 21 nt, Human
ggaauguguggcaacugcaga

SEQ ID NO: 450643 - RNA, 32 nt, Human
ggaauguguugcagcaguuuucgcagaugaua

SEQ ID NO: 450644 - RNA, 32 nt, Human
ggaauguuaccuguuucugcugcuagaagauc

SEQ ID NO: 450645 - RNA, 32 nt, Human
ggaauguucucagcagagaagaaugaggagaa

SEQ ID NO: 450646 - RNA, 32 nt, Human
ggaauguucuuucugcucuauacuguggccug

SEQ ID NO: 450647 - RNA, 31 nt, Human
ggaauguuuaauaaauauucauugaauaaug

SEQ ID NO: 450648 - RNA, 32 nt, Human
ggaauguuuaccagacacagagcccagaggga

SEQ ID NO: 450649 - RNA, 32 nt, Human
ggaauguuuauggaauauuuaggauaaaugau

SEQ ID NO: 450650 - RNA, 32 nt, Human
ggaauguuuucacuggcccuuaccucaugauu

SEQ ID NO: 450651 - RNA, 32 nt, Human
ggaauuaaaggcuuccucugggugccugcuga

SEQ ID NO: 450652 - RNA, 32 nt, Human
ggaauuaagacaaagacacagaaauagagugc

SEQ ID NO: 450653 - RNA, 32 nt, Human
ggaauuaagacaaagacacagaaauauagugc

SEQ ID NO: 450654 - RNA, 32 nt, Human
ggaauuacaagugugucccaugccugaccuuc

SEQ ID NO: 450655 - RNA, 32 nt, Human
ggaauuacacagaagacgggugacagccaagg

SEQ ID NO: 450656 - RNA, 32 nt, Human
ggaauuacauaaggauaaugaggcccaacuga

SEQ ID NO: 450657 - RNA, 32 nt, Human
ggaauuacauauauuuguaugauucuucuagu

SEQ ID NO: 450658 - RNA, 32 nt, Human
ggaauuacuugguuuugcacauuaagaggccc

SEQ ID NO: 450659 - RNA, 32 nt, Human
ggaauuagcccuggccugaaaguggcccauca

SEQ ID NO: 450660 - RNA, 32 nt, Human
ggaauuaggacuccaguaccacugccuucacc

SEQ ID NO: 450661 - RNA, 32 nt, Human
ggaauuaggagagaagguagggguugggaauc

SEQ ID NO: 450662 - RNA, 32 nt, Human
ggaauuaggagccagguugacaaggacuuuuu

SEQ ID NO: 450663 - RNA, 32 nt, Human
ggaauuaggaggugggcacuuuaagggaugau

SEQ ID NO: 450664 - RNA, 32 nt, Human
ggaauuagggcuguggacacugucuugaggau

SEQ ID NO: 450665 - RNA, 32 nt, Human
ggaauuaguucagauuauuaagccugaauagg

SEQ ID NO: 450666 - RNA, 31 nt, Human
ggaauuaucaccagugauguuggagacuuaa

SEQ ID NO: 450667 - RNA, 32 nt, Human
ggaauuauccagacugccuugccacuagauga

SEQ ID NO: 450668 - RNA, 32 nt, Human
ggaauuaugagggagaggucugagggaaggga

SEQ ID NO: 450669 - RNA, 32 nt, Human
ggaauuauuuuauacagauuaggagaaauuaa

SEQ ID NO: 450670 - RNA, 32 nt, Human
ggaauuauuuucaugcagacagcuugucaagc

SEQ ID NO: 450671 - RNA, 32 nt, Human
ggaauucacaccccuccccuucucccacagcc

SEQ ID NO: 450672 - RNA, 32 nt, Human
ggaauucacccaggcagccuggagucagccau

SEQ ID NO: 450673 - RNA, 32 nt, Human
ggaauucagaggcagagcuuucagaugauucu

SEQ ID NO: 450674 - RNA, 32 nt, Human
ggaauucagaucugccuugugugaacagaacc

SEQ ID NO: 450675 - RNA, 32 nt, Human
ggaauucagcacugcauucucuuugcacccuc

SEQ ID NO: 450676 - RNA, 32 nt, Human
ggaauucaucuccagcaguggccugagaggaa

SEQ ID NO: 450677 - RNA, 20 nt, Human
ggaauucauuugccauccac

SEQ ID NO: 450678 - RNA, 32 nt, Human
ggaauuccaauucuuuuucucuccuuagaucu

SEQ ID NO: 450679 - RNA, 32 nt, Human
ggaauuccacaucugcucgugcaugccaucca

SEQ ID NO: 450680 - RNA, 32 nt, Human
ggaauuccaccugagaacaagucccgcaaacc

SEQ ID NO: 450681 - RNA, 32 nt, Human
ggaauuccugcucugguugcuggaucguguac

SEQ ID NO: 450682 - RNA, 18 nt, Human
ggaauuccuuggagccac

SEQ ID NO: 450683 - RNA, 32 nt, Human
ggaauucgccagccuucagccucccaacgugc

SEQ ID NO: 450684 - RNA, 32 nt, Human
ggaauucgggaaugacacgucuucugauccca

SEQ ID NO: 450685 - RNA, 25 nt, Human
ggaauucuaggcggaagaaccccga

SEQ ID NO: 450686 - RNA, 32 nt, Human
ggaauucuauuuuaugaaccuagagaagcaga

SEQ ID NO: 450687 - RNA, 32 nt, Human
ggaauucugaagcgcuggugaccccuggggua

SEQ ID NO: 450688 - RNA, 32 nt, Human
ggaauucugauaguguguagagcagggucuau

SEQ ID NO: 450689 - RNA, 32 nt, Human
ggaauucugcacuccaguuacuuaacuuuccc

SEQ ID NO: 450690 - RNA, 32 nt, Human
ggaauucugcagccacacccacugcggcaguc

SEQ ID NO: 450691 - RNA, 32 nt, Human
ggaauucugccuaaguugucugccuuuucuac

SEQ ID NO: 450692 - RNA, 32 nt, Human
ggaauucugggaaaacuuuuacuuccugauua

SEQ ID NO: 450693 - RNA, 32 nt, Human
ggaauucuguauuacaugaaugcugcuuauau

SEQ ID NO: 450694 - RNA, 32 nt, Human
ggaauucuuuguacuaauacagggagcacacu

SEQ ID NO: 450695 - RNA, 32 nt, Human
ggaauugaaauguuaagauacccagaacaaca

SEQ ID NO: 450696 - RNA, 32 nt, Human
ggaauugacaaucagaucacauggacacagga

SEQ ID NO: 450697 - RNA, 32 nt, Human
ggaauugacuccggcgugcacacacguacaca

SEQ ID NO: 450698 - RNA, 32 nt, Human
ggaauugagagucacagacacugagccacgca

SEQ ID NO: 450699 - RNA, 32 nt, Human
ggaauugauugucagccaccucccucugccag

SEQ ID NO: 450700 - RNA, 32 nt, Human
ggaauugcaugccaucuccacccugagccuga

SEQ ID NO: 450701 - RNA, 32 nt, Human
ggaauugccccaggaggacaccagauacagac

SEQ ID NO: 450702 - RNA, 32 nt, Human
ggaauugccucagccuccuaccaguccucccu

SEQ ID NO: 450703 - RNA, 32 nt, Human
ggaauugcugagacaggauggccuggcagggg

SEQ ID NO: 450704 - RNA, 32 nt, Human
ggaauuggacuggagugaaugggcacaggggu

SEQ ID NO: 450705 - RNA, 32 nt, Human
ggaauuggaggcggcagugagucaugaguaug

SEQ ID NO: 450706 - RNA, 32 nt, Human
ggaauuguaggauguuuagcagcaucacuggc

SEQ ID NO: 450707 - RNA, 32 nt, Human
ggaauuguuaauaauugcuccuaaagauuaua

SEQ ID NO: 450708 - RNA, 32 nt, Human
ggaauuguuaucugucucuugcucugagauac

SEQ ID NO: 450709 - RNA, 32 nt, Human
ggaauuguuuugccuuucuguucaucugugaa

SEQ ID NO: 450710 - RNA, 32 nt, Human
ggaauuuaaccagcaacauugacccagaaaug

SEQ ID NO: 450711 - RNA, 32 nt, Human
ggaauuuacacaaauuauaaaaauuagucggg

SEQ ID NO: 450712 - RNA, 32 nt, Human
ggaauuuagaacuaauccauccauccaucuac

SEQ ID NO: 450713 - RNA, 32 nt, Human
ggaauuuauuauuuugggcaugauggcuuuca

SEQ ID NO: 450714 - RNA, 32 nt, Human
ggaauuucaaaccauugcucuuagucccaagc

SEQ ID NO: 450715 - RNA, 32 nt, Human
ggaauuucacacuuuaccuacucugaucacuc

SEQ ID NO: 450716 - RNA, 32 nt, Human
ggaauuucaguacacugaauuuugccucugac

SEQ ID NO: 450717 - RNA, 32 nt, Human
ggaauuucauggcaacaaugcugguaagggca

SEQ ID NO: 450718 - RNA, 32 nt, Human
ggaauuucuacccaaagcugucugagaguuua

SEQ ID NO: 450719 - RNA, 20 nt, Human
ggaauuucugguccugggaa

SEQ ID NO: 450720 - RNA, 32 nt, Human
ggaauuugagaccuggccaacauggugaaacc

SEQ ID NO: 450721 - RNA, 32 nt, Human
ggaauuugaggcaagaggauugcuagaggcca

SEQ ID NO: 450722 - RNA, 32 nt, Human
ggaauuugcauccagcagcagcacuuagaccu

SEQ ID NO: 450723 - RNA, 32 nt, Human
ggaauuugcauucaugugcauuuaccaagagg

SEQ ID NO: 450724 - RNA, 32 nt, Human
ggaauuuggaaaccucaaauggcuaaacuauu

SEQ ID NO: 450725 - RNA, 32 nt, Human
ggaauuuggggaagccaccaugcaauccagug

SEQ ID NO: 450726 - RNA, 23 nt, Human
ggaauuuucuuaagagguuucaa

SEQ ID NO: 450727 - RNA, 32 nt, Human
ggaauuuuuguagggauugaagccagagcuag

SEQ ID NO: 450728 - RNA, 19 nt, Human
ggacaaaagaauucuuucc

SEQ ID NO: 450729 - RNA, 32 nt, Human
ggacaaaagccaaaggugccaggccuuagagc

SEQ ID NO: 450730 - RNA, 32 nt, Human
ggacaaacaggugacccagcagacccagccug

SEQ ID NO: 450731 - RNA, 22 nt, Human
ggacaaacagugcacuauguua

SEQ ID NO: 450732 - RNA, 32 nt, Human
ggacaaaccaaagccuuuguucuuucuuauug

SEQ ID NO: 450733 - RNA, 32 nt, Human
ggacaaaccagccagccucuccagagcaggcg

SEQ ID NO: 450734 - RNA, 32 nt, Human
ggacaaaccuagaauuuucucccuuuauguau

SEQ ID NO: 450735 - RNA, 32 nt, Human
ggacaaaccucaccaguaccugcacaggagaa

SEQ ID NO: 450736 - RNA, 21 nt, Human
ggacaaacuuggggacaguca

SEQ ID NO: 450737 - RNA, 32 nt, Human
ggacaaagccuggggcugggcgggggccaugg

SEQ ID NO: 450738 - RNA, 26 nt, Human
ggacaaagcucuccguggcuguggca

SEQ ID NO: 450739 - RNA, 32 nt, Human
ggacaaaggcauugcaccuacuuucuccuuga

SEQ ID NO: 450740 - RNA, 25 nt, Human
ggacaaagggaugaggcuccagaga

SEQ ID NO: 450741 - RNA, 32 nt, Human
ggacaaagguagacaucuuuccucacugccag

SEQ ID NO: 450742 - RNA, 24 nt, Human
ggacaaaguagacacccgccuaca

SEQ ID NO: 450743 - RNA, 32 nt, Human
ggacaaagucuccagcccacguucucucugcc

SEQ ID NO: 450744 - RNA, 21 nt, Human
ggacaaagugccacuacaaca

SEQ ID NO: 450745 - RNA, 21 nt, Human
ggacaaauaggcucuauuuua

SEQ ID NO: 450746 - RNA, 32 nt, Human
ggacaaauauccacccaagagaaccaaucaua

SEQ ID NO: 450747 - RNA, 32 nt, Human
ggacaaaucucucaccaggacugaggagacca

SEQ ID NO: 450748 - RNA, 32 nt, Human
ggacaaaucucuuugugcuguuugguaacacu

SEQ ID NO: 450749 - RNA, 21 nt, Human
ggacaaaugaccacuauguua

SEQ ID NO: 450750 - RNA, 32 nt, Human
ggacaaaugagaccagcaaugugaacuguauu

SEQ ID NO: 450751 - RNA, 32 nt, Human
ggacaaaugccacacggcucucaccaguggcu

SEQ ID NO: 450752 - RNA, 20 nt, Human
ggacaaaugccacugcaaca

SEQ ID NO: 450753 - RNA, 32 nt, Human
ggacaaauggcagcagaaagagaaagaacaga

SEQ ID NO: 450754 - RNA, 32 nt, Human
ggacaaauuccuaggaucuccccaccaccccu

SEQ ID NO: 450755 - RNA, 32 nt, Human
ggacaaauuuauuugcaaaaugagucuaguuu

SEQ ID NO: 450756 - RNA, 32 nt, Human
ggacaaauuugugaaugcagcggccaaaagau

SEQ ID NO: 450757 - RNA, 18 nt, Human
ggacaacaaucucugaga

SEQ ID NO: 450758 - RNA, 20 nt, Human
ggacaacacaccugcugcug

SEQ ID NO: 450759 - RNA, 32 nt, Human
ggacaacacagcugcuuccccaggcugcccac

SEQ ID NO: 450760 - RNA, 32 nt, Human
ggacaacacagugagaccucaucucuaucaaa

SEQ ID NO: 450761 - RNA, 24 nt, Human
ggacaacacagugagacucugucu

SEQ ID NO: 450762 - RNA, 32 nt, Human
ggacaacagaagacugucuaaggaugccugga

SEQ ID NO: 450763 - RNA, 24 nt, Human
ggacaacagagggagacucugucu

SEQ ID NO: 450764 - RNA, 24 nt, Human
ggacaacagagugagacuccaucu

SEQ ID NO: 450765 - RNA, 24 nt, Human
ggacaacagagugggacucugucu

SEQ ID NO: 450766 - RNA, 32 nt, Human
ggacaacagcugcuauuuucacuugagcccaa

SEQ ID NO: 450767 - RNA, 32 nt, Human
ggacaacaggcgcccgucaccacgcccagcua

SEQ ID NO: 450768 - RNA, 32 nt, Human
ggacaacagguacgcaccaccacggccagcua

SEQ ID NO: 450769 - RNA, 32 nt, Human
ggacaacaggugugcaccaccaugcccugcua

SEQ ID NO: 450770 - RNA, 32 nt, Human
ggacaacagugaauguguuuaugccagcgugu

SEQ ID NO: 450771 - RNA, 32 nt, Human
ggacaacauacagccucuggaaacccaaccuu

SEQ ID NO: 450772 - RNA, 32 nt, Human
ggacaacauacuaaaaccucaucucuaugaaa

SEQ ID NO: 450773 - RNA, 32 nt, Human
ggacaacauagugaaacccugucucuacuaag

SEQ ID NO: 450774 - RNA, 32 nt, Human
ggacaacauagugagacccccaucucuaaaua

SEQ ID NO: 450775 - RNA, 32 nt, Human
ggacaacaucgugaaaccuugucucuacaaaa

SEQ ID NO: 450776 - RNA, 32 nt, Human
ggacaacaugaugagauccccaucucuaaaag

SEQ ID NO: 450777 - RNA, 32 nt, Human
ggacaacauggcgaaaccucaucucuauuaaa

SEQ ID NO: 450778 - RNA, 32 nt, Human
ggacaacauggggagaccccaucucuaccgga

SEQ ID NO: 450779 - RNA, 32 nt, Human
ggacaacauggugaaaccccaucucuacgaaa

SEQ ID NO: 450780 - RNA, 32 nt, Human
ggacaacauggugaaaccccaucucuuuaaaa

SEQ ID NO: 450781 - RNA, 32 nt, Human
ggacaacauggugaaaccccgucucuacaaaa

SEQ ID NO: 450782 - RNA, 32 nt, Human
ggacaacauggugaaaccccuucucuacuaaa

SEQ ID NO: 450783 - RNA, 32 nt, Human
ggacaacauggugaaacccuaucucuacuaaa

SEQ ID NO: 450784 - RNA, 32 nt, Human
ggacaacauggugaaacccugucucuacuguc

SEQ ID NO: 450785 - RNA, 32 nt, Human
ggacaacauggugaaacccuucucuacuaaaa

SEQ ID NO: 450786 - RNA, 32 nt, Human
ggacaacauggugaacccgucucuacuaauuu

SEQ ID NO: 450787 - RNA, 32 nt, Human
ggacaacauggugagaccucgucucuacaaaa

SEQ ID NO: 450788 - RNA, 21 nt, Human
ggacaacauuggucuaggaca

SEQ ID NO: 450789 - RNA, 32 nt, Human
ggacaacauugugaaaccuugucucuacaaaa

SEQ ID NO: 450790 - RNA, 32 nt, Human
ggacaaccauuuacuugguguaaagaacuuaa

SEQ ID NO: 450791 - RNA, 32 nt, Human
ggacaaccuauguuauggauguuuccaccaac

SEQ ID NO: 450792 - RNA, 21 nt, Human
ggacaaccuggugguggugga

SEQ ID NO: 450793 - RNA, 32 nt, Human
ggacaacgcaaccuaccucacaggguuguugu

SEQ ID NO: 450794 - RNA, 32 nt, Human
ggacaacuccaccccuuccuuggccuugcccc

SEQ ID NO: 450795 - RNA, 32 nt, Human
ggacaacuccacccuccuuccuuccccacagg

SEQ ID NO: 450796 - RNA, 32 nt, Human
ggacaacuccuuccuguugagggucgagccug

SEQ ID NO: 450797 - RNA, 32 nt, Human
ggacaacugaaaagucacaucacagcuggcau

SEQ ID NO: 450798 - RNA, 32 nt, Human
ggacaacugccuggugacacugcugccgcugc

SEQ ID NO: 450799 - RNA, 32 nt, Human
ggacaacuggaagacaguuacgcuucguccuc

SEQ ID NO: 450800 - RNA, 32 nt, Human
ggacaacuggaaggaggacucagguagcccca

SEQ ID NO: 450801 - RNA, 21 nt, Human
ggacaacuuuaaguggacacu

SEQ ID NO: 450802 - RNA, 32 nt, Human
ggacaacuuuguggccaccugcucugaaaguc

SEQ ID NO: 450803 - RNA, 32 nt, Human
ggacaagaaggagccagcucccagcggguuca

SEQ ID NO: 450804 - RNA, 32 nt, Human
ggacaagacaggcagagaucuauaaacagaca

SEQ ID NO: 450805 - RNA, 17 nt, Human
ggacaagacuacugugg

SEQ ID NO: 450806 - RNA, 32 nt, Human
ggacaagacuccgacuccagcucugacuuuuu

SEQ ID NO: 450807 - RNA, 20 nt, Human
ggacaagaguggcacugugg

SEQ ID NO: 450808 - RNA, 32 nt, Human
ggacaagaguugagcagccuuucugcugauua

SEQ ID NO: 450809 - RNA, 24 nt, Human
ggacaagaguuugaacucaaggga

SEQ ID NO: 450810 - RNA, 32 nt, Human
ggacaagauacaaguucacaugaugggaaaaa

SEQ ID NO: 450811 - RNA, 32 nt, Human
ggacaagauauauuuuucucuguauuucuaua

SEQ ID NO: 450812 - RNA, 32 nt, Human
ggacaagauccccuaaugagcuggcagguggg

SEQ ID NO: 450813 - RNA, 32 nt, Human
ggacaagauucccagagaggagaggaggcugu

SEQ ID NO: 450814 - RNA, 32 nt, Human
ggacaagauuuucagccauuuuugccacauau

SEQ ID NO: 450815 - RNA, 32 nt, Human
ggacaagcagaacagguguggaagagagauuu

SEQ ID NO: 450816 - RNA, 32 nt, Human
ggacaagcagagaaggcuaaagugcucugguu

SEQ ID NO: 450817 - RNA, 32 nt, Human
ggacaagcaguuggagugagaaucaagacagc

SEQ ID NO: 450818 - RNA, 32 nt, Human
ggacaagccacuaguccccucuggaccucaac

SEQ ID NO: 450819 - RNA, 32 nt, Human
ggacaagccagcugccccaggguucuuccccu

SEQ ID NO: 450820 - RNA, 32 nt, Human
ggacaagccauccaaaaaccccaggcccacau

SEQ ID NO: 450821 - RNA, 32 nt, Human
ggacaagccgccaagacccaggggcccagagc

SEQ ID NO: 450822 - RNA, 16 nt, Human
ggacaagccucuggga

SEQ ID NO: 450823 - RNA, 19 nt, Human
ggacaagcggcggcggcug

SEQ ID NO: 450824 - RNA, 32 nt, Human
ggacaagcuaguauucuugucuuuggacuuca

SEQ ID NO: 450825 - RNA, 32 nt, Human
ggacaagcucacuauucacacaagcucagccu

SEQ ID NO: 450826 - RNA, 32 nt, Human
ggacaagcuguggagcuggcugagucacagcc

SEQ ID NO: 450827 - RNA, 32 nt, Human
ggacaaggacucaggacauggguguggaagaa

SEQ ID NO: 450828 - RNA, 32 nt, Human
ggacaaggaggcggggccugcagcuggcuugg

SEQ ID NO: 450829 - RNA, 32 nt, Human
ggacaaggaguuuccagcugcuggcuggaguc

SEQ ID NO: 450830 - RNA, 32 nt, Human
ggacaaggcagguggaggggaggccaguguac

SEQ ID NO: 450831 - RNA, 19 nt, Human
ggacaaggccagaaacagc

SEQ ID NO: 450832 - RNA, 32 nt, Human
ggacaaggcugcagggccucuuucggguuucc

SEQ ID NO: 450833 - RNA, 32 nt, Human
ggacaaggcugguuauuagaacaaagauuucg

SEQ ID NO: 450834 - RNA, 32 nt, Human
ggacaagggagacacaacacaaaucccucuaa

SEQ ID NO: 450835 - RNA, 32 nt, Human
ggacaagggaggcaguggcuaguggggugaac

SEQ ID NO: 450836 - RNA, 32 nt, Human
ggacaagggcaagauuauuaagcagcaagaga

SEQ ID NO: 450837 - RNA, 32 nt, Human
ggacaagggcuguguugucacagcaggaauag

SEQ ID NO: 450838 - RNA, 32 nt, Human
ggacaaggggagaguccccuacuccccugauc

SEQ ID NO: 450839 - RNA, 32 nt, Human
ggacaagguccuggcuagagaaugucaauguc

SEQ ID NO: 450840 - RNA, 32 nt, Human
ggacaagguucucgaguucccauugcugaaag

SEQ ID NO: 450841 - RNA, 32 nt, Human
ggacaagugcagcugcugcgccugugcuggga

SEQ ID NO: 450842 - RNA, 21 nt, Human
ggacaauaaauggaugugaca

SEQ ID NO: 450843 - RNA, 32 nt, Human
ggacaauauagugaaaccccgucucuacuaaa

SEQ ID NO: 450844 - RNA, 32 nt, Human
ggacaauauggugaaacccugucuuuacuaaa

SEQ ID NO: 450845 - RNA, 32 nt, Human
ggacaauauggugaagcccuaucucuacuaaa

SEQ ID NO: 450846 - RNA, 32 nt, Human
ggacaaucugcaaaauggagagaauacaauaa

SEQ ID NO: 450847 - RNA, 32 nt, Human
ggacaaugacauaugaaugaggaucaaaacga

SEQ ID NO: 450848 - RNA, 30 nt, Human
ggacaauggagguggcgguggagaaggcgg

SEQ ID NO: 450849 - RNA, 22 nt, Human
ggacaauggccaggugaagccu

SEQ ID NO: 450850 - RNA, 30 nt, Human
ggacaauggguucagacaaaagagugagua

SEQ ID NO: 450851 - RNA, 32 nt, Human
ggacaauggugacagauccaggcaccgagcuc

SEQ ID NO: 450852 - RNA, 32 nt, Human
ggacaauuagggacuggugugccugucauucu

SEQ ID NO: 450853 - RNA, 19 nt, Human
ggacaauuauggcugugac

SEQ ID NO: 450854 - RNA, 32 nt, Human
ggacaauuguaacugugaaacuauggcuuaac

SEQ ID NO: 450855 - RNA, 32 nt, Human
ggacaauuucuagaagacuacaauucagucua

SEQ ID NO: 450856 - RNA, 32 nt, Human
ggacaauuucuccuaguuaccacuagggguua

SEQ ID NO: 450857 - RNA, 32 nt, Human
ggacaauuuugcagcaauacagcagcaucagg

SEQ ID NO: 450858 - RNA, 32 nt, Human
ggacacaaacaccagcuauugccugcaucugg

SEQ ID NO: 450859 - RNA, 32 nt, Human
ggacacaaagcuaacacagccaucguuauaca

SEQ ID NO: 450860 - RNA, 32 nt, Human
ggacacaaccugcuggagugcaauggcacgau

SEQ ID NO: 450861 - RNA, 32 nt, Human
ggacacaauaccaacucuuucaugccaggaga

SEQ ID NO: 450862 - RNA, 32 nt, Human
ggacacacaccaagggcacuccugcagguggc

SEQ ID NO: 450863 - RNA, 32 nt, Human
ggacacacagauggacagagagcaggaaagac

SEQ ID NO: 450864 - RNA, 32 nt, Human
ggacacacagccaggcaaggagggagcucacc

SEQ ID NO: 450865 - RNA, 32 nt, Human
ggacacacagcccaggcuguucugagucagaa

SEQ ID NO: 450866 - RNA, 22 nt, Human
ggacacacaggaccacucagug

SEQ ID NO: 450867 - RNA, 23 nt, Human
ggacacacaggccaccugugcag

SEQ ID NO: 450868 - RNA, 21 nt, Human
ggacacacaggugugcaccuc

SEQ ID NO: 450869 - RNA, 32 nt, Human
ggacacacaguguggcauccucauguuugcac

SEQ ID NO: 450870 - RNA, 32 nt, Human
ggacacaccagggcaucaccagucucuaucac

SEQ ID NO: 450871 - RNA, 32 nt, Human
ggacacaccauggggugaagccaucccaaggc

SEQ ID NO: 450872 - RNA, 32 nt, Human
ggacacacgauccaguccugaccaaacagaau

SEQ ID NO: 450873 - RNA, 32 nt, Human
ggacacagaacuaaaacuacuacuuacaucua

SEQ ID NO: 450874 - RNA, 32 nt, Human
ggacacagacacaaaaucccugcccuuaacaa

SEQ ID NO: 450875 - RNA, 32 nt, Human
ggacacagacuugccggcucuaccuaucgcca

SEQ ID NO: 450876 - RNA, 32 nt, Human
ggacacagagagagacacaaacagggagggcg

SEQ ID NO: 450877 - RNA, 32 nt, Human
ggacacagagccacugcaguccccgcucggag

SEQ ID NO: 450878 - RNA, 21 nt, Human
ggacacagagccacugugcag

SEQ ID NO: 450879 - RNA, 32 nt, Human
ggacacagagcucccucucucccuccaaagaa

SEQ ID NO: 450880 - RNA, 19 nt, Human
ggacacagaggcucagaga

SEQ ID NO: 450881 - RNA, 32 nt, Human
ggacacagagggcaagacugcaucccaguuac

SEQ ID NO: 450882 - RNA, 32 nt, Human
ggacacagcgcacacccagacccuccaccagg

SEQ ID NO: 450883 - RNA, 32 nt, Human
ggacacagcuaaaucauaucauauaccaucuu

SEQ ID NO: 450884 - RNA, 32 nt, Human
ggacacagcugcuccccucuggcuaugaagag

SEQ ID NO: 450885 - RNA, 32 nt, Human
ggacacagcuuuggccuugggaauucugggaa

SEQ ID NO: 450886 - RNA, 32 nt, Human
ggacacaggaagugcugccauugagaguguuc

SEQ ID NO: 450887 - RNA, 32 nt, Human
ggacacagggaggggaacaacacacaccaggg

SEQ ID NO: 450888 - RNA, 31 nt, Human
ggacacaggguggucccuugccagggacugg

SEQ ID NO: 450889 - RNA, 32 nt, Human
ggacacauagagggaaacaacacacacugggg

SEQ ID NO: 450890 - RNA, 32 nt, Human
ggacacauagaggggaacaacacacacugggg

SEQ ID NO: 450891 - RNA, 25 nt, Human
ggacacauauauuaaacagauuguu

SEQ ID NO: 450892 - RNA, 32 nt, Human
ggacacauaucuuuugaguuauuuggacugaa

SEQ ID NO: 450893 - RNA, 23 nt, Human
ggacacaucaccaacccauggac

SEQ ID NO: 450894 - RNA, 32 nt, Human
ggacacauccccacccugccucccaucuggcc

SEQ ID NO: 450895 - RNA, 25 nt, Human
ggacacaucugcccacagcugcaca

SEQ ID NO: 450896 - RNA, 32 nt, Human
ggacacaucuggggacagucuccuuccuggag

SEQ ID NO: 450897 - RNA, 32 nt, Human
ggacacaugagcccuggaugaguaugguaggg

SEQ ID NO: 450898 - RNA, 32 nt, Human
ggacacauuccagauuucugugcugaaauauu

SEQ ID NO: 450899 - RNA, 32 nt, Human
ggacacauuuuauccugauccacaguggaguu

SEQ ID NO: 450900 - RNA, 20 nt, Human
ggacaccaacaggguuucaa

SEQ ID NO: 450901 - RNA, 32 nt, Human
ggacaccaagucuuguagcuucuccuaaauau

SEQ ID NO: 450902 - RNA, 32 nt, Human
ggacaccaccaggcaccucccuaggcaacgcc

SEQ ID NO: 450903 - RNA, 32 nt, Human
ggacaccacgccagugcuuuccugccuuccuu

SEQ ID NO: 450904 - RNA, 32 nt, Human
ggacaccacuuaaauauccaucaauggaagac

SEQ ID NO: 450905 - RNA, 32 nt, Human
ggacaccagaagagacaggagaucagagacca

SEQ ID NO: 450906 - RNA, 31 nt, Human
ggacaccagagagucguguggcugagguuuc

SEQ ID NO: 450907 - RNA, 21 nt, Human
ggacaccagccuggugcccau

SEQ ID NO: 450908 - RNA, 30 nt, Human
ggacaccaggaggucagggcacagaggacg

SEQ ID NO: 450909 - RNA, 17 nt, Human
ggacaccaggcuggcug

SEQ ID NO: 450910 - RNA, 32 nt, Human
ggacaccagggagagacagagacagagaugac

SEQ ID NO: 450911 - RNA, 32 nt, Human
ggacaccagggugggggugaaggagacacuac

SEQ ID NO: 450912 - RNA, 32 nt, Human
ggacaccaguuauuagaggaugagaaaaguaa

SEQ ID NO: 450913 - RNA, 32 nt, Human
ggacaccaucgagggagcaggagcaucaggcg

SEQ ID NO: 450914 - RNA, 32 nt, Human
ggacaccaucuugaccaaacaccaagaaggca

SEQ ID NO: 450915 - RNA, 32 nt, Human
ggacaccaugccacaaggagagugaucucuuc

SEQ ID NO: 450916 - RNA, 32 nt, Human
ggacaccauucaagccagcugaauuccgguca

SEQ ID NO: 450917 - RNA, 32 nt, Human
ggacaccauuggaccccacccagccuggaucu

SEQ ID NO: 450918 - RNA, 32 nt, Human
ggacacccaagaauaaaagaauaaccacaaag

SEQ ID NO: 450919 - RNA, 32 nt, Human
ggacacccacgcccuucucuccagaagccggg

SEQ ID NO: 450920 - RNA, 32 nt, Human
ggacacccaucuuaccggccaauguccaaaau

SEQ ID NO: 450921 - RNA, 19 nt, Human
ggacaccccaggcugccac

SEQ ID NO: 450922 - RNA, 19 nt, Human
ggacacccccagcuuccac

SEQ ID NO: 450923 - RNA, 32 nt, Human
ggacacccggggucaagcagaagaggaaggca

SEQ ID NO: 450924 - RNA, 18 nt, Human
ggacacccugaaauccac

SEQ ID NO: 450925 - RNA, 32 nt, Human
ggacacccuugccaccacuggggacugccacu

SEQ ID NO: 450926 - RNA, 19 nt, Human
ggacacccuugucuaggga

SEQ ID NO: 450927 - RNA, 32 nt, Human
ggacaccgagcccugagugcugugcugcugcu

SEQ ID NO: 450928 - RNA, 32 nt, Human
ggacaccgugagccagccaggccuggccgcug

SEQ ID NO: 450929 - RNA, 32 nt, Human
ggacaccuaauacccacagcccuccagagacc

SEQ ID NO: 450930 - RNA, 32 nt, Human
ggacaccucccagccagaaggcucugagacau

SEQ ID NO: 450931 - RNA, 22 nt, Human
ggacaccucccuucccuucuca

SEQ ID NO: 450932 - RNA, 32 nt, Human
ggacaccuccucugauaugcugaggccagugu

SEQ ID NO: 450933 - RNA, 32 nt, Human
ggacaccuccuggcacaacaccaccuucuuug

SEQ ID NO: 450934 - RNA, 32 nt, Human
ggacaccucuuggagcucaccaccacugucac

SEQ ID NO: 450935 - RNA, 32 nt, Human
ggacaccugcccugcccugccaccugucuguc

SEQ ID NO: 450936 - RNA, 32 nt, Human
ggacaccugcucaccccugccucaucuguacu

SEQ ID NO: 450937 - RNA, 32 nt, Human
ggacaccugcuccacuucaccuuuugccauga

SEQ ID NO: 450938 - RNA, 32 nt, Human
ggacaccuggaacugcggcaaaguaggagaag

SEQ ID NO: 450939 - RNA, 32 nt, Human
ggacaccuggagcccccaggagcugggagagg

SEQ ID NO: 450940 - RNA, 32 nt, Human
ggacaccuggccagugcugaagggcuguugug

SEQ ID NO: 450941 - RNA, 32 nt, Human
ggacaccugggcaaggaagggcugugcauuga

SEQ ID NO: 450942 - RNA, 32 nt, Human
ggacaccugguccugcuagcuggaccacuggc

SEQ ID NO: 450943 - RNA, 17 nt, Human
ggacaccuguaauccca

SEQ ID NO: 450944 - RNA, 32 nt, Human
ggacaccuguaaucccagcuacuagggaggcu

SEQ ID NO: 450945 - RNA, 32 nt, Human
ggacaccuguaaucccagcuacucagguggcu

SEQ ID NO: 450946 - RNA, 32 nt, Human
ggacaccuguaaucccugcugcuugggaggca

SEQ ID NO: 450947 - RNA, 32 nt, Human
ggacaccuguagucccagcugcuugggaggcu

SEQ ID NO: 450948 - RNA, 24 nt, Human
ggacaccugugacaccuggccaca

SEQ ID NO: 450949 - RNA, 32 nt, Human
ggacaccuguucugcuguuguguccugccauu

SEQ ID NO: 450950 - RNA, 32 nt, Human
ggacaccuucuuuccacgcuuuccagccugug

SEQ ID NO: 450951 - RNA, 32 nt, Human
ggacaccuuuaaucccaguuacucaggaggcu

SEQ ID NO: 450952 - RNA, 18 nt, Human
ggacacgaggacacggga

SEQ ID NO: 450953 - RNA, 32 nt, Human
ggacacgccagaggaggaggccggggaauggc

SEQ ID NO: 450954 - RNA, 32 nt, Human
ggacacgccaugacucuggagggucuguauuu

SEQ ID NO: 450955 - RNA, 32 nt, Human
ggacacgcccaucuuggauuuccugaaagcag

SEQ ID NO: 450956 - RNA, 32 nt, Human
ggacacggagccaagacagagucuagcaaaga

SEQ ID NO: 450957 - RNA, 32 nt, Human
ggacacggcccaccuggaggccugugugcgcu

SEQ ID NO: 450958 - RNA, 32 nt, Human
ggacacggcccuguggugucucacccacgggc

SEQ ID NO: 450959 - RNA, 32 nt, Human
ggacacggcucccaggccucugaccccugcuc

SEQ ID NO: 450960 - RNA, 32 nt, Human
ggacacgggcagcagacaguggucaguccuuu

SEQ ID NO: 450961 - RNA, 32 nt, Human
ggacacggucacccguugccagcucuagccuu

SEQ ID NO: 450962 - RNA, 32 nt, Human
ggacacgugauggaccguaggaagaaggcacu

SEQ ID NO: 450963 - RNA, 32 nt, Human
ggacacuaucaagaaaauaggcugggugcagu

SEQ ID NO: 450964 - RNA, 32 nt, Human
ggacacucaaauaaugugauuuuaugaggcua

SEQ ID NO: 450965 - RNA, 31 nt, Human
ggacacucaauaaauguucauuggugaaaaa

SEQ ID NO: 450966 - RNA, 32 nt, Human
ggacacucagcacaucuuagcuuuauuuccuu

SEQ ID NO: 450967 - RNA, 20 nt, Human
ggacacucaggcacagagug

SEQ ID NO: 450968 - RNA, 32 nt, Human
ggacacuccagaugugguuggaagcauaagug

SEQ ID NO: 450969 - RNA, 32 nt, Human
ggacacuccagaugugguuggaagcauaugug

SEQ ID NO: 450970 - RNA, 32 nt, Human
ggacacucugaacuccugcacucuccagaagu

SEQ ID NO: 450971 - RNA, 32 nt, Human
ggacacucugaggagaggcagauggagcucca

SEQ ID NO: 450972 - RNA, 32 nt, Human
ggacacugacguaggaggguugcuugagacug

SEQ ID NO: 450973 - RNA, 32 nt, Human
ggacacugagccgggcaacagguggccccggc

SEQ ID NO: 450974 - RNA, 32 nt, Human
ggacacugagguagccucauuccacagguuua

SEQ ID NO: 450975 - RNA, 32 nt, Human
ggacacugcagaggaagauaaugaagagaucu

SEQ ID NO: 450976 - RNA, 32 nt, Human
ggacacugcagucuggcuacacacagagaucu

SEQ ID NO: 450977 - RNA, 32 nt, Human
ggacacugcccccuaccuucucugcccacacc

SEQ ID NO: 450978 - RNA, 32 nt, Human
ggacacugcccuggcccuccauacucugcucc

SEQ ID NO: 450979 - RNA, 32 nt, Human
ggacacugcugggcacaguuaacucuaauucu

SEQ ID NO: 450980 - RNA, 32 nt, Human
ggacacuggcuggccuuccuucucuucugagc

SEQ ID NO: 450981 - RNA, 32 nt, Human
ggacacuggggcauccugcucaucucacaccc

SEQ ID NO: 450982 - RNA, 32 nt, Human
ggacacuguaggaggcagauccaagaggcuuc

SEQ ID NO: 450983 - RNA, 32 nt, Human
ggacacugucggcacggugggcugggggcgua

SEQ ID NO: 450984 - RNA, 32 nt, Human
ggacacuuagggccacagaggccaggccaggg

SEQ ID NO: 450985 - RNA, 32 nt, Human
ggacacuuaugcugaauuauguucuuauuauu

SEQ ID NO: 450986 - RNA, 32 nt, Human
ggacacuucccuaccggggcugaggccaugcu

SEQ ID NO: 450987 - RNA, 32 nt, Human
ggacacuuuucuucccuccagccaggguuucu

SEQ ID NO: 450988 - RNA, 32 nt, Human
ggacagaaaccagccucagaguccggggcagg

SEQ ID NO: 450989 - RNA, 32 nt, Human
ggacagaaagccaccagccaauggagaacaaa

SEQ ID NO: 450990 - RNA, 32 nt, Human
ggacagaacugggauggauacacacaugcuua

SEQ ID NO: 450991 - RNA, 32 nt, Human
ggacagaacuucuuccaaaagagagggauggc

SEQ ID NO: 450992 - RNA, 21 nt, Human
ggacagaagcagacagcaggu

SEQ ID NO: 450993 - RNA, 32 nt, Human
ggacagaagccagugccuuuaagucauuugug

SEQ ID NO: 450994 - RNA, 32 nt, Human
ggacagaauucuagguggaugauuuuugccau

SEQ ID NO: 450995 - RNA, 31 nt, Human
ggacagacacagccugaaaccaaagccucug

SEQ ID NO: 450996 - RNA, 32 nt, Human
ggacagacagaagaaaagacaagaagcagcug

SEQ ID NO: 450997 - RNA, 32 nt, Human
ggacagacccggggcagccucugggugaacag

SEQ ID NO: 450998 - RNA, 32 nt, Human
ggacagacccuuuaaccucaccucugugcauc

SEQ ID NO: 450999 - RNA, 32 nt, Human
ggacagaccucaggagcuuucauuucaguuag

SEQ ID NO: 451000 - RNA, 20 nt, Human
ggacagacgcaaaccugagg

SEQ ID NO: 451001 - RNA, 21 nt, Human
ggacagacguuucucuggagg

SEQ ID NO: 451002 - RNA, 32 nt, Human
ggacagacuacuuuuuaaaugauaugaagaaa

SEQ ID NO: 451003 - RNA, 32 nt, Human
ggacagagacccagagggcagcgucagacacc

SEQ ID NO: 451004 - RNA, 20 nt, Human
ggacagagagaugacugggg

SEQ ID NO: 451005 - RNA, 32 nt, Human
ggacagagagcagagaggccgggggucuucag

SEQ ID NO: 451006 - RNA, 32 nt, Human
ggacagagagcucugaaggacagaacacgcau

SEQ ID NO: 451007 - RNA, 32 nt, Human
ggacagagaggaaggagguggagcagcugggg

SEQ ID NO: 451008 - RNA, 32 nt, Human
ggacagagagugcacaaacuacccagcacagc

SEQ ID NO: 451009 - RNA, 32 nt, Human
ggacagagaguuacagaaaugggagacuguuu

SEQ ID NO: 451010 - RNA, 20 nt, Human
ggacagagcagcucuugucc

SEQ ID NO: 451011 - RNA, 32 nt, Human
ggacagagcagggaccucaacuacacugauca

SEQ ID NO: 451012 - RNA, 32 nt, Human
ggacagagccaggagucaagugcagugccaag

SEQ ID NO: 451013 - RNA, 32 nt, Human
ggacagagcccaaaacggggguagacuuugug

SEQ ID NO: 451014 - RNA, 32 nt, Human
ggacagagcccagcagaucccagcugugaaga

SEQ ID NO: 451015 - RNA, 17 nt, Human
ggacagagccucaggga

SEQ ID NO: 451016 - RNA, 18 nt, Human
ggacagagcgccuuccac

SEQ ID NO: 451017 - RNA, 19 nt, Human
ggacagagcuaaagaaaca

SEQ ID NO: 451018 - RNA, 22 nt, Human
ggacagagcucagacaagagca

SEQ ID NO: 451019 - RNA, 32 nt, Human
ggacagagcucaggggcucagagcagaguugg

SEQ ID NO: 451020 - RNA, 24 nt, Human
ggacagagcucccucacuucaaga

SEQ ID NO: 451021 - RNA, 22 nt, Human
ggacagaggaagaccugauggg

SEQ ID NO: 451022 - RNA, 32 nt, Human
ggacagaggaagcuuuagauagagacuuuaga

SEQ ID NO: 451023 - RNA, 32 nt, Human
ggacagaggccugcuucagggaagcugggagu

SEQ ID NO: 451024 - RNA, 32 nt, Human
ggacagaggcgaggggacagcccagcgccauc

SEQ ID NO: 451025 - RNA, 23 nt, Human
ggacagaggggaagaaagcuggg

SEQ ID NO: 451026 - RNA, 32 nt, Human
ggacagagguagacuguccuccccuaccuccu

SEQ ID NO: 451027 - RNA, 32 nt, Human
ggacagagguggagacaggugcagugacccag

SEQ ID NO: 451028 - RNA, 19 nt, Human
ggacagagucucucucugu

SEQ ID NO: 451029 - RNA, 31 nt, Human
ggacagagugagagaagucagcugucacggg

SEQ ID NO: 451030 - RNA, 32 nt, Human
ggacagauagacagugcugcccugcgaagugg

SEQ ID NO: 451031 - RNA, 32 nt, Human
ggacagauauuuuaguaucucaguaauguccu

SEQ ID NO: 451032 - RNA, 22 nt, Human
ggacagaucacuugaggucagg

SEQ ID NO: 451033 - RNA, 32 nt, Human
ggacagaucuagauguuuguuuaccaagcuau

SEQ ID NO: 451034 - RNA, 32 nt, Human
ggacagaugccuccuuccucuuuuccuuccca

SEQ ID NO: 451035 - RNA, 32 nt, Human
ggacagauggaugucgcacacgccgagacucu

SEQ ID NO: 451036 - RNA, 32 nt, Human
ggacagauggccaggccugugcacacaccagc

SEQ ID NO: 451037 - RNA, 32 nt, Human
ggacagauugagcaaagaaucuuugagcgguc

SEQ ID NO: 451038 - RNA, 32 nt, Human
ggacagauugaggaaauuccuagaucacugag

SEQ ID NO: 451039 - RNA, 32 nt, Human
ggacagcaagaggcacucugucuucacuugaa

SEQ ID NO: 451040 - RNA, 32 nt, Human
ggacagcaaggcccccagcccgugggaaagac

SEQ ID NO: 451041 - RNA, 32 nt, Human
ggacagcaagggacccugagcucugcaagcug

SEQ ID NO: 451042 - RNA, 32 nt, Human
ggacagcacacagaaagguuuucaucaucaag

SEQ ID NO: 451043 - RNA, 32 nt, Human
ggacagcacagcccggggacugcccagccagc

SEQ ID NO: 451044 - RNA, 32 nt, Human
ggacagcaccccgagggccacaggugagggac

SEQ ID NO: 451045 - RNA, 32 nt, Human
ggacagcaccucuucaaccaccuccggcuucc

SEQ ID NO: 451046 - RNA, 32 nt, Human
ggacagcacgcgcgggcugcugugcugccugg

SEQ ID NO: 451047 - RNA, 32 nt, Human
ggacagcacugagcaggccccggagaggaggg

SEQ ID NO: 451048 - RNA, 32 nt, Human
ggacagcacugggugcucaggcuggccaagga

SEQ ID NO: 451049 - RNA, 32 nt, Human
ggacagcagacccuggggguuggcucugaugg

SEQ ID NO: 451050 - RNA, 26 nt, Human
ggacagcagcuuccgcugucuccaca

SEQ ID NO: 451051 - RNA, 19 nt, Human
ggacagcaggauagacagg

SEQ ID NO: 451052 - RNA, 32 nt, Human
ggacagcaggcagaggccgagccugggccaca

SEQ ID NO: 451053 - RNA, 32 nt, Human
ggacagcagggacagcggggaggcaggaaaag

SEQ ID NO: 451054 - RNA, 32 nt, Human
ggacagcaggguggccguggugaaggagaacg

SEQ ID NO: 451055 - RNA, 32 nt, Human
ggacagcauccugggcgagcucaacgggcccc

SEQ ID NO: 451056 - RNA, 32 nt, Human
ggacagcauuugaaggacacauauugcaguug

SEQ ID NO: 451057 - RNA, 19 nt, Human
ggacagccacauccugcug

SEQ ID NO: 451058 - RNA, 32 nt, Human
ggacagccacucacccucucugugcugucucc

SEQ ID NO: 451059 - RNA, 32 nt, Human
ggacagccagcacccccuccccaaagaccggg

SEQ ID NO: 451060 - RNA, 22 nt, Human
ggacagccagggcggcagggag

SEQ ID NO: 451061 - RNA, 25 nt, Human
ggacagccaguaaccucgcagagag

SEQ ID NO: 451062 - RNA, 32 nt, Human
ggacagcccacggucuggaggccgaggaccac

SEQ ID NO: 451063 - RNA, 32 nt, Human
ggacagcccacuguuccaugcugcccaagaag

SEQ ID NO: 451064 - RNA, 32 nt, Human
ggacagcccaggaaacaaggggucugaggaug

SEQ ID NO: 451065 - RNA, 32 nt, Human
ggacagcccaggccauggcaggaagaaucccu

SEQ ID NO: 451066 - RNA, 32 nt, Human
ggacagcccaucgugugaacuauagaguuugu

SEQ ID NO: 451067 - RNA, 32 nt, Human
ggacagcccaucucccuucaagaacccuacgg

SEQ ID NO: 451068 - RNA, 32 nt, Human
ggacagccccucuucucagcagucaccguggc

SEQ ID NO: 451069 - RNA, 32 nt, Human
ggacagccccuucagccccuucuccccucccc

SEQ ID NO: 451070 - RNA, 32 nt, Human
ggacagcccucuguuguuucuaaugccauacu

SEQ ID NO: 451071 - RNA, 16 nt, Human
ggacagccggcugcug

SEQ ID NO: 451072 - RNA, 32 nt, Human
ggacagccguaaucacucugugccucaguuuc

SEQ ID NO: 451073 - RNA, 32 nt, Human
ggacagccuccaggagcacagcggcuucuccu

SEQ ID NO: 451074 - RNA, 32 nt, Human
ggacagccuccucuuuucuagaagucuauuua

SEQ ID NO: 451075 - RNA, 32 nt, Human
ggacagccuggcacagaggcagagucuagagc

SEQ ID NO: 451076 - RNA, 32 nt, Human
ggacagccugggggacuuccugccuaggcaag

SEQ ID NO: 451077 - RNA, 22 nt, Human
ggacagccugugcagggggcug

SEQ ID NO: 451078 - RNA, 32 nt, Human
ggacagcgcauugcgaccuccaccaccccugc

SEQ ID NO: 451079 - RNA, 23 nt, Human
ggacagcgccauccaccugugca

SEQ ID NO: 451080 - RNA, 32 nt, Human
ggacagcggcagcacccccaugcccagggacg

SEQ ID NO: 451081 - RNA, 32 nt, Human
ggacagcguggcaugagccaggagcccgggcc

SEQ ID NO: 451082 - RNA, 32 nt, Human
ggacagcucagcugccaauacauucaacccuu

SEQ ID NO: 451083 - RNA, 32 nt, Human
ggacagcuccagcagcucaggcuccagcccuc

SEQ ID NO: 451084 - RNA, 32 nt, Human
ggacagcucccaucucucccauggcccugaca

SEQ ID NO: 451085 - RNA, 32 nt, Human
ggacagcucgcagucccugagccucugcaggc

SEQ ID NO: 451086 - RNA, 32 nt, Human
ggacagcucugaucccccuccuuccucuccuc

SEQ ID NO: 451087 - RNA, 32 nt, Human
ggacagcucugcccuugaggcccuucagaaau

SEQ ID NO: 451088 - RNA, 32 nt, Human
ggacagcucuggaaggugcucacaggugcacu

SEQ ID NO: 451089 - RNA, 32 nt, Human
ggacagcugaaggcaauaggaggcagauuauc

SEQ ID NO: 451090 - RNA, 18 nt, Human
ggacagcugagugucaua

SEQ ID NO: 451091 - RNA, 32 nt, Human
ggacagcugcagagaagaggccuggaacucgg

SEQ ID NO: 451092 - RNA, 32 nt, Human
ggacagcugcggccagagacccugcuagcccc

SEQ ID NO: 451093 - RNA, 32 nt, Human
ggacagcugcucaugguaggccuucuuggcug

SEQ ID NO: 451094 - RNA, 32 nt, Human
ggacagcugcuuguuacauuuggcucacgcua

SEQ ID NO: 451095 - RNA, 32 nt, Human
ggacagcuggaaggcaagguucagcugggacu

SEQ ID NO: 451096 - RNA, 32 nt, Human
ggacagcugggaacugggggaugcaagugaga

SEQ ID NO: 451097 - RNA, 32 nt, Human
ggacagcuuccuauggggaagacagaggcuuc

SEQ ID NO: 451098 - RNA, 32 nt, Human
ggacagcuuuuccguggaaauucaaggcaucu

SEQ ID NO: 451099 - RNA, 32 nt, Human
ggacaggaaaaguaggaggaggaucuggggca

SEQ ID NO: 451100 - RNA, 32 nt, Human
ggacaggaaagauaggaauguugcuaugagga

SEQ ID NO: 451101 - RNA, 32 nt, Human
ggacaggaagagaccuuauuuccugaugggac

SEQ ID NO: 451102 - RNA, 32 nt, Human
ggacaggaaggaaaggaggauuaggaauauaa

SEQ ID NO: 451103 - RNA, 17 nt, Human
ggacaggaaguggggug

SEQ ID NO: 451104 - RNA, 32 nt, Human
ggacaggacuccaaaggcuuuuggucccagag

SEQ ID NO: 451105 - RNA, 16 nt, Human
ggacaggacugcagca

SEQ ID NO: 451106 - RNA, 32 nt, Human
ggacaggacuuccuuccaucuucuccugcuca

SEQ ID NO: 451107 - RNA, 32 nt, Human
ggacaggagagggaggggugggggacaguggg

SEQ ID NO: 451108 - RNA, 16 nt, Human
ggacaggagaucagca

SEQ ID NO: 451109 - RNA, 32 nt, Human
ggacaggagcccagaagagacacugaggacaa

SEQ ID NO: 451110 - RNA, 32 nt, Human
ggacaggagcgcgggaucgaaggguggacucc

SEQ ID NO: 451111 - RNA, 32 nt, Human
ggacaggaggaaagugaggacaggugggguac

SEQ ID NO: 451112 - RNA, 32 nt, Human
ggacaggagggaaugcagggaggaaggaaaga

SEQ ID NO: 451113 - RNA, 20 nt, Human
ggacaggaucccggcggcag

SEQ ID NO: 451114 - RNA, 32 nt, Human
ggacaggaugacagacagggacgaagcagaga

SEQ ID NO: 451115 - RNA, 32 nt, Human
ggacaggaugcaggucagggagagggaaggca

SEQ ID NO: 451116 - RNA, 32 nt, Human
ggacaggauggcugugugugguggucaccagg

SEQ ID NO: 451117 - RNA, 32 nt, Human
ggacaggcacacacaugcagauaugcugccug

SEQ ID NO: 451118 - RNA, 32 nt, Human
ggacaggcacagcagaggugagagugggagga

SEQ ID NO: 451119 - RNA, 32 nt, Human
ggacaggcacagcuacuuacgcgaacacagca

SEQ ID NO: 451120 - RNA, 32 nt, Human
ggacaggcacuggccucagaccggggccacac

SEQ ID NO: 451121 - RNA, 32 nt, Human
ggacaggccacagcugucaugccaccucccag

SEQ ID NO: 451122 - RNA, 32 nt, Human
ggacaggccacuugcuugcuguguggcauugg

SEQ ID NO: 451123 - RNA, 26 nt, Human
ggacaggccagagaggaggccagcag

SEQ ID NO: 451124 - RNA, 32 nt, Human
ggacaggccaggccugaucccaccucacuucc

SEQ ID NO: 451125 - RNA, 32 nt, Human
ggacaggcccucagccccuccugccccaucca

SEQ ID NO: 451126 - RNA, 32 nt, Human
ggacaggcccuggcacuuggcaggugcuuggu

SEQ ID NO: 451127 - RNA, 32 nt, Human
ggacaggccugaugccugcagugguuuagggc

SEQ ID NO: 451128 - RNA, 32 nt, Human
ggacaggcgcaggggaggcugccugaagggca

SEQ ID NO: 451129 - RNA, 22 nt, Human
ggacaggcggcggcggaggcgg

SEQ ID NO: 451130 - RNA, 32 nt, Human
ggacaggcggugagcucaguggauugcagugg

SEQ ID NO: 451131 - RNA, 18 nt, Human
ggacaggcgucuagguga

SEQ ID NO: 451132 - RNA, 32 nt, Human
ggacaggcucaaucuuucuggcccaaacucag

SEQ ID NO: 451133 - RNA, 32 nt, Human
ggacaggcucacaccugugaccacugugucag

SEQ ID NO: 451134 - RNA, 32 nt, Human
ggacaggcuccuccucucccuccagaagccag

SEQ ID NO: 451135 - RNA, 19 nt, Human
ggacaggcugaaaauagca

SEQ ID NO: 451136 - RNA, 22 nt, Human
ggacaggcuggcuggcuggcug

SEQ ID NO: 451137 - RNA, 32 nt, Human
ggacaggcuuucacuuucacucccaugaggag

SEQ ID NO: 451138 - RNA, 32 nt, Human
ggacagggaagguggaggaguggauagaacuu

SEQ ID NO: 451139 - RNA, 32 nt, Human
ggacagggaccugggagccgagcgaauagcau

SEQ ID NO: 451140 - RNA, 32 nt, Human
ggacagggaggagagcggcuguggagaaacuu

SEQ ID NO: 451141 - RNA, 32 nt, Human
ggacagggaguugccuucucucugccugguug

SEQ ID NO: 451142 - RNA, 32 nt, Human
ggacagggcaugugcugacuccacacugaauc

SEQ ID NO: 451143 - RNA, 32 nt, Human
ggacagggccagauuucauguugacccugggg

SEQ ID NO: 451144 - RNA, 32 nt, Human
ggacagggcccagcagcaucucagccuccuac

SEQ ID NO: 451145 - RNA, 32 nt, Human
ggacagggcccccacaggggaugguuucacga

SEQ ID NO: 451146 - RNA, 32 nt, Human
ggacagggcccugucuccucagcuucaggcac

SEQ ID NO: 451147 - RNA, 32 nt, Human
ggacagggcgcagagccgggaggcaggccgca

SEQ ID NO: 451148 - RNA, 32 nt, Human
ggacagggcuguagcugugaggucuugucucc

SEQ ID NO: 451149 - RNA, 32 nt, Human
ggacagggcuuggugggcacucggaagccagu

SEQ ID NO: 451150 - RNA, 32 nt, Human
ggacaggggucugaaguacacuggaauuuacu

SEQ ID NO: 451151 - RNA, 32 nt, Human
ggacagggucaccaccuuucucucccuucuuc

SEQ ID NO: 451152 - RNA, 32 nt, Human
ggacaggguggagaggaggagaacccugaagg

SEQ ID NO: 451153 - RNA, 23 nt, Human
ggacaggguggcugacuggcaga

SEQ ID NO: 451154 - RNA, 32 nt, Human
ggacagguaggaaggaaggaaaggaggaaagg

SEQ ID NO: 451155 - RNA, 32 nt, Human
ggacaggucaggaaggagagaucugacugagc

SEQ ID NO: 451156 - RNA, 32 nt, Human
ggacagguccugggugagggugggagauuuag

SEQ ID NO: 451157 - RNA, 32 nt, Human
ggacaggucucgagucacugcuacaguuucag

SEQ ID NO: 451158 - RNA, 32 nt, Human
ggacaggucugcgcugcagugggaucuggcug

SEQ ID NO: 451159 - RNA, 18 nt, Human
ggacaggugacugggagg

SEQ ID NO: 451160 - RNA, 32 nt, Human
ggacaggugaucuggggaaaacgcagcuacac

SEQ ID NO: 451161 - RNA, 19 nt, Human
ggacaggugaugccagcag

SEQ ID NO: 451162 - RNA, 32 nt, Human
ggacaggugcagccuggcaugggggagcgugg

SEQ ID NO: 451163 - RNA, 21 nt, Human
ggacaggugccaggcuggcug

SEQ ID NO: 451164 - RNA, 32 nt, Human
ggacagguggauugaugagacuccuccagugg

SEQ ID NO: 451165 - RNA, 22 nt, Human
ggacagguggcagcaggucggc

SEQ ID NO: 451166 - RNA, 18 nt, Human
ggacagguggccugggca

SEQ ID NO: 451167 - RNA, 31 nt, Human
ggacaggugucucuugagccuguguuccaag

SEQ ID NO: 451168 - RNA, 32 nt, Human
ggacaggugucucuugagccuguguuccaaga

SEQ ID NO: 451169 - RNA, 32 nt, Human
ggacagguugcaugaguuggggugccgucagu

SEQ ID NO: 451170 - RNA, 32 nt, Human
ggacaguaaaaccuagaguuggaguuggaucu

SEQ ID NO: 451171 - RNA, 32 nt, Human
ggacaguaacccugccacacacugccugaaau

SEQ ID NO: 451172 - RNA, 32 nt, Human
ggacaguacucugcucucaccucucugcuucu

SEQ ID NO: 451173 - RNA, 32 nt, Human
ggacaguagcuggcacagaggggcuacuaaac

SEQ ID NO: 451174 - RNA, 32 nt, Human
ggacagucacugcaaucucuuuaccaccuccc

SEQ ID NO: 451175 - RNA, 32 nt, Human
ggacagucagcuuuguuucucccuucaucugc

SEQ ID NO: 451176 - RNA, 32 nt, Human
ggacagucaguuccucacuggaguccucuguu

SEQ ID NO: 451177 - RNA, 21 nt, Human
ggacagucccucucuguggag

SEQ ID NO: 451178 - RNA, 32 nt, Human
ggacagugaaguuuaacacaacugaacucuaa

SEQ ID NO: 451179 - RNA, 32 nt, Human
ggacagugccaaccuccuccuggggaucccau

SEQ ID NO: 451180 - RNA, 32 nt, Human
ggacagugcccgguccccuugagggccaucac

SEQ ID NO: 451181 - RNA, 32 nt, Human
ggacagugcugcugcccccggcgggccuuccu

SEQ ID NO: 451182 - RNA, 18 nt, Human
ggacaguggaaaggcagg

SEQ ID NO: 451183 - RNA, 20 nt, Human
ggacaguggaaccucagaga

SEQ ID NO: 451184 - RNA, 32 nt, Human
ggacaguggaucaccugaggucagggguucga

SEQ ID NO: 451185 - RNA, 32 nt, Human
ggacaguggggccuguccuuguucauccacuc

SEQ ID NO: 451186 - RNA, 23 nt, Human
ggacagugggggcucucuuacca

SEQ ID NO: 451187 - RNA, 32 nt, Human
ggacagugggucaggcaggacaaggagaaagc

SEQ ID NO: 451188 - RNA, 17 nt, Human
ggacaguggguggagug

SEQ ID NO: 451189 - RNA, 32 nt, Human
ggacagugguauggccuuggccccagaccacu

SEQ ID NO: 451190 - RNA, 32 nt, Human
ggacagugucaguucccagagguccugggaca

SEQ ID NO: 451191 - RNA, 32 nt, Human
ggacagugugccaccugcugucugagaggcag

SEQ ID NO: 451192 - RNA, 32 nt, Human
ggacagugugcuggucacccuggugcagggcc

SEQ ID NO: 451193 - RNA, 32 nt, Human
ggacaguugaggcaacucguagauggagauuu

SEQ ID NO: 451194 - RNA, 32 nt, Human
ggacaguugauuccugggguccacacuccugg

SEQ ID NO: 451195 - RNA, 32 nt, Human
ggacaguugggacuucaugccugauuagcuga

SEQ ID NO: 451196 - RNA, 32 nt, Human
ggacaguugguguuuggccgugccgcugucua

SEQ ID NO: 451197 - RNA, 32 nt, Human
ggacauacaauauuucugucuccagucuacca

SEQ ID NO: 451198 - RNA, 32 nt, Human
ggacauacauaaggagagaagguacagugaug

SEQ ID NO: 451199 - RNA, 22 nt, Human
ggacauaccaucuuguccugcu

SEQ ID NO: 451200 - RNA, 20 nt, Human
ggacauaccugaaggcuggu

SEQ ID NO: 451201 - RNA, 32 nt, Human
ggacauacugccuggcagccugccuuccuagg

SEQ ID NO: 451202 - RNA, 32 nt, Human
ggacauagaggguggacaguucaggccugugu

SEQ ID NO: 451203 - RNA, 24 nt, Human
ggacauaggcaagccuugaucaua

SEQ ID NO: 451204 - RNA, 32 nt, Human
ggacauagggcugagaguagccaugggcucug

SEQ ID NO: 451205 - RNA, 32 nt, Human
ggacauaucacagccucugcccccggcuguga

SEQ ID NO: 451206 - RNA, 32 nt, Human
ggacauaucuuuguggcuacuguggcugcgcu

SEQ ID NO: 451207 - RNA, 32 nt, Human
ggacaucaaaaacaaccugaaagaggcgauug

SEQ ID NO: 451208 - RNA, 32 nt, Human
ggacaucaaacaucucacagacugccuggaag

SEQ ID NO: 451209 - RNA, 32 nt, Human
ggacaucaaauuuccagggacuacguucggag

SEQ ID NO: 451210 - RNA, 32 nt, Human
ggacaucaacauaggaauuuggggagcacaua

SEQ ID NO: 451211 - RNA, 31 nt, Human
ggacaucacagcuucaggccugaagagcaga

SEQ ID NO: 451212 - RNA, 32 nt, Human
ggacaucacagcuucaggccugaagagcagag

SEQ ID NO: 451213 - RNA, 32 nt, Human
ggacaucaccuuuucgcuuuuuccaagauggc

SEQ ID NO: 451214 - RNA, 32 nt, Human
ggacaucagaacuuauuccucuugucaaacug

SEQ ID NO: 451215 - RNA, 24 nt, Human
ggacaucagugucuucucugugag

SEQ ID NO: 451216 - RNA, 32 nt, Human
ggacauccaggugcccuucauccaagcuccua

SEQ ID NO: 451217 - RNA, 32 nt, Human
ggacaucccgcugaagccacgcuccuuccagc

SEQ ID NO: 451218 - RNA, 32 nt, Human
ggacauccgaaagcuacaccacagaugccagu

SEQ ID NO: 451219 - RNA, 32 nt, Human
ggacauccgggagguguaucagccuggcucag

SEQ ID NO: 451220 - RNA, 32 nt, Human
ggacauccugugcaugaugccuagagagucug

SEQ ID NO: 451221 - RNA, 32 nt, Human
ggacaucgcgccacugcacuccagccugggcg

SEQ ID NO: 451222 - RNA, 32 nt, Human
ggacaucgggcaggacugacacugugucuugu

SEQ ID NO: 451223 - RNA, 32 nt, Human
ggacaucgggggcaaguuugcaguggggccgg

SEQ ID NO: 451224 - RNA, 32 nt, Human
ggacaucgucaggcuggcccaggaccaggagg

SEQ ID NO: 451225 - RNA, 25 nt, Human
ggacaucucagaaaagaagaggcag

SEQ ID NO: 451226 - RNA, 32 nt, Human
ggacaucucaggucuucagggucuuccaucug

SEQ ID NO: 451227 - RNA, 32 nt, Human
ggacaucuccuuggggcuggucaguugcaucc

SEQ ID NO: 451228 - RNA, 23 nt, Human
ggacaucucuaguguagcugcca

SEQ ID NO: 451229 - RNA, 32 nt, Human
ggacaucugaguaccuaucucacacacugacc

SEQ ID NO: 451230 - RNA, 32 nt, Human
ggacaucuggccuuaagccucuguugaacagg

SEQ ID NO: 451231 - RNA, 32 nt, Human
ggacaucugggcucugggcugcaucauguaca

SEQ ID NO: 451232 - RNA, 32 nt, Human
ggacaucugguugcuuuggccugcugcccucu

SEQ ID NO: 451233 - RNA, 17 nt, Human
ggacaucuguaauccca

SEQ ID NO: 451234 - RNA, 20 nt, Human
ggacaucuguaaucccagcu

SEQ ID NO: 451235 - RNA, 32 nt, Human
ggacaucuguaaucccagcuacucaggaggcu

SEQ ID NO: 451236 - RNA, 21 nt, Human
ggacaucuucccacaucuaca

SEQ ID NO: 451237 - RNA, 32 nt, Human
ggacaucuuuuucucaccuucauucucaguga

SEQ ID NO: 451238 - RNA, 23 nt, Human
ggacaugaaauuuacaaagggcc

SEQ ID NO: 451239 - RNA, 32 nt, Human
ggacaugaagugaaaagcgggaagagcuucuu

SEQ ID NO: 451240 - RNA, 32 nt, Human
ggacaugaaguuaaccacagucgggaaacaag

SEQ ID NO: 451241 - RNA, 32 nt, Human
ggacaugacacacagccuaccuggugugacac

SEQ ID NO: 451242 - RNA, 32 nt, Human
ggacaugacagugacgggccugcucuggggcu

SEQ ID NO: 451243 - RNA, 18 nt, Human
ggacaugacuucaggugg

SEQ ID NO: 451244 - RNA, 29 nt, Human
ggacaugagaagcauuggcaucaggguaa

SEQ ID NO: 451245 - RNA, 32 nt, Human
ggacaugagacaccacauuccauuugugcuag

SEQ ID NO: 451246 - RNA, 32 nt, Human
ggacaugcacacacaaguaacauugagcugca

SEQ ID NO: 451247 - RNA, 32 nt, Human
ggacaugcacacacacucacaugcucucacuc

SEQ ID NO: 451248 - RNA, 32 nt, Human
ggacaugcacacacgugcagauaugcuguccg

SEQ ID NO: 451249 - RNA, 29 nt, Human
ggacaugcacggacacagccgcaacggcc

SEQ ID NO: 451250 - RNA, 32 nt, Human
ggacaugcagauuaguagaacuuucaaguaaa

SEQ ID NO: 451251 - RNA, 18 nt, Human
ggacaugcagccccuccu

SEQ ID NO: 451252 - RNA, 32 nt, Human
ggacaugcagggcucacaggagacagggcuca

SEQ ID NO: 451253 - RNA, 32 nt, Human
ggacaugccagcuacacuggccuuggcgcccu

SEQ ID NO: 451254 - RNA, 32 nt, Human
ggacaugcccuagggaacagugcucugaaucg

SEQ ID NO: 451255 - RNA, 32 nt, Human
ggacaugccgugguggagaacacaccuguggc

SEQ ID NO: 451256 - RNA, 32 nt, Human
ggacaugcuccugcauacuccuggguguccca

SEQ ID NO: 451257 - RNA, 32 nt, Human
ggacaugcugccugaacauacacacgcacacc

SEQ ID NO: 451258 - RNA, 32 nt, Human
ggacaugcuguccucugcuccuggguguacug

SEQ ID NO: 451259 - RNA, 32 nt, Human
ggacauggagaaagcagacaugguggacggua

SEQ ID NO: 451260 - RNA, 32 nt, Human
ggacauggagauuaguagaacuuucaaguaca

SEQ ID NO: 451261 - RNA, 32 nt, Human
ggacauggccaccuuuccccagugucugaggc

SEQ ID NO: 451262 - RNA, 32 nt, Human
ggacauggccuggaccagggaggcaggccucc

SEQ ID NO: 451263 - RNA, 29 nt, Human
ggacauggcuccccacaacccccacacuc

SEQ ID NO: 451264 - RNA, 20 nt, Human
ggacaugggaggggcugcac

SEQ ID NO: 451265 - RNA, 32 nt, Human
ggacaugggcccagagagguuaugugagugac

SEQ ID NO: 451266 - RNA, 32 nt, Human
ggacaugggguaccaccuacacccaacaaguc

SEQ ID NO: 451267 - RNA, 32 nt, Human
ggacaugggugaacggaaguggaagcugugag

SEQ ID NO: 451268 - RNA, 32 nt, Human
ggacauggugggaugggcauguggucccagcu

SEQ ID NO: 451269 - RNA, 21 nt, Human
ggacauggugucccaugccca

SEQ ID NO: 451270 - RNA, 32 nt, Human
ggacaugguucagaaacagcuaaagcagacaa

SEQ ID NO: 451271 - RNA, 32 nt, Human
ggacauguacugccucucaucuagaauuuauu

SEQ ID NO: 451272 - RNA, 32 nt, Human
ggacauguuggcgugcaccuccugaguagcug

SEQ ID NO: 451273 - RNA, 32 nt, Human
ggacauucagugguugcugggguccgcagacu

SEQ ID NO: 451274 - RNA, 32 nt, Human
ggacauucccacccucccccaugcugccaagu

SEQ ID NO: 451275 - RNA, 32 nt, Human
ggacauucuagucccugacucgccagaugcau

SEQ ID NO: 451276 - RNA, 32 nt, Human
ggacauucugagggacccggaggcagggagcc

SEQ ID NO: 451277 - RNA, 32 nt, Human
ggacauucuggaagcauggaaggcguggacuu

SEQ ID NO: 451278 - RNA, 32 nt, Human
ggacauucuuacugugcuaaaaagccacugca

SEQ ID NO: 451279 - RNA, 32 nt, Human
ggacauugcagccgccuaccugcuccagggaa

SEQ ID NO: 451280 - RNA, 32 nt, Human
ggacauugcugccucugccugggcugcagccg

SEQ ID NO: 451281 - RNA, 32 nt, Human
ggacauuggaaagagacagcaugggggaaagg

SEQ ID NO: 451282 - RNA, 32 nt, Human
ggacauugggaagcaguauaagaaaaacuuca

SEQ ID NO: 451283 - RNA, 32 nt, Human
ggacauuguaugcagggagcacuguucacauc

SEQ ID NO: 451284 - RNA, 32 nt, Human
ggacauuguuuugaacuagguggacaugccau

SEQ ID NO: 451285 - RNA, 32 nt, Human
ggacauuuauucaucaugccuaaggaauuuga

SEQ ID NO: 451286 - RNA, 31 nt, Human
ggacauuucaauaaaauuguuuggaaaauaa

SEQ ID NO: 451287 - RNA, 32 nt, Human
ggacauuucuauaaucuauauucuaauuugau

SEQ ID NO: 451288 - RNA, 32 nt, Human
ggaccaaaaaggauggauuucccuggccucuc

SEQ ID NO: 451289 - RNA, 32 nt, Human
ggaccaaaagcaggcggggacaaggacaguaa

SEQ ID NO: 451290 - RNA, 32 nt, Human
ggaccaaaaguuauuuuagcuuccucaauaga

SEQ ID NO: 451291 - RNA, 22 nt, Human
ggaccaaagcuguaccuagagg

SEQ ID NO: 451292 - RNA, 32 nt, Human
ggaccaacauggugaaaccccaucucuacuaa

SEQ ID NO: 451293 - RNA, 32 nt, Human
ggaccaacauggugaaaccccgucucuacuaa

SEQ ID NO: 451294 - RNA, 19 nt, Human
ggaccaaccagacacggga

SEQ ID NO: 451295 - RNA, 32 nt, Human
ggaccaacccuccacugcgaguugaccaauaa

SEQ ID NO: 451296 - RNA, 32 nt, Human
ggaccaaccugcucuguccccaaaggacgccu

SEQ ID NO: 451297 - RNA, 26 nt, Human
ggaccaagaccagccacauccagggg

SEQ ID NO: 451298 - RNA, 21 nt, Human
ggaccaagacuccccuagaga

SEQ ID NO: 451299 - RNA, 32 nt, Human
ggaccaagagacaacacagaagaggcuggacc

SEQ ID NO: 451300 - RNA, 32 nt, Human
ggaccaagaggaaaagagucggagggguagac

SEQ ID NO: 451301 - RNA, 32 nt, Human
ggaccaagauaacaaucucaucuucgcaggau

SEQ ID NO: 451302 - RNA, 24 nt, Human
ggaccaagcacagggcauuuagag

SEQ ID NO: 451303 - RNA, 21 nt, Human
ggaccaagcaggagcuuaaga

SEQ ID NO: 451304 - RNA, 25 nt, Human
ggaccaagccugugucaccuggaga

SEQ ID NO: 451305 - RNA, 21 nt, Human
ggaccaagccuuccucggaga

SEQ ID NO: 451306 - RNA, 32 nt, Human
ggaccaagcuuuguccaagugaagcaggcuuc

SEQ ID NO: 451307 - RNA, 32 nt, Human
ggaccaaggaccgagacacagacauggaagga

SEQ ID NO: 451308 - RNA, 32 nt, Human
ggaccaaggaggcaaugccaggaagcugguga

SEQ ID NO: 451309 - RNA, 22 nt, Human
ggaccaagggaggccagcaggu

SEQ ID NO: 451310 - RNA, 32 nt, Human
ggaccaagggaggccagcagguggacaggggg

SEQ ID NO: 451311 - RNA, 32 nt, Human
ggaccaagguggaucucaguaaggagguagag

SEQ ID NO: 451312 - RNA, 17 nt, Human
ggaccaaucagcauucu

SEQ ID NO: 451313 - RNA, 32 nt, Human
ggaccaaugucacaucgcuucaugggcauggc

SEQ ID NO: 451314 - RNA, 32 nt, Human
ggaccacaagcccaaaaaggacaaaaaugggc

SEQ ID NO: 451315 - RNA, 32 nt, Human
ggaccacaaggcaaucugggguguggacagac

SEQ ID NO: 451316 - RNA, 32 nt, Human
ggaccacacccccgucacucugaccccagcac

SEQ ID NO: 451317 - RNA, 32 nt, Human
ggaccacacugagguuggguuucagaccaaga

SEQ ID NO: 451318 - RNA, 32 nt, Human
ggaccacacugcagccuggcuucuucuaucug

SEQ ID NO: 451319 - RNA, 32 nt, Human
ggaccacagaggaaguggaucgugcggcagag

SEQ ID NO: 451320 - RNA, 32 nt, Human
ggaccacagcaaacaccauucuuuuugccgua

SEQ ID NO: 451321 - RNA, 24 nt, Human
ggaccacagcaucaggagacggga

SEQ ID NO: 451322 - RNA, 22 nt, Human
ggaccacagcugccagggacuu

SEQ ID NO: 451323 - RNA, 32 nt, Human
ggaccacaggcacgugccaccauguugcccag

SEQ ID NO: 451324 - RNA, 32 nt, Human
ggaccacaggcgagugucaccaugcugggcag

SEQ ID NO: 451325 - RNA, 32 nt, Human
ggaccacaggcgcccaccaccacgcccagcua

SEQ ID NO: 451326 - RNA, 32 nt, Human
ggaccacaggcgcccccaccauguccggcuaa

SEQ ID NO: 451327 - RNA, 32 nt, Human
ggaccacaggcgcccgccaccacgcccggcua

SEQ ID NO: 451328 - RNA, 32 nt, Human
ggaccacaggcgugcaccaccaugcauagcua

SEQ ID NO: 451329 - RNA, 32 nt, Human
ggaccacaggcgugcaccaccaugcccaccua

SEQ ID NO: 451330 - RNA, 18 nt, Human
ggaccacaggcucaggca

SEQ ID NO: 451331 - RNA, 19 nt, Human
ggaccacagggccucuucc

SEQ ID NO: 451332 - RNA, 32 nt, Human
ggaccacagguaugcaccaccacgcccagcua

SEQ ID NO: 451333 - RNA, 32 nt, Human
ggaccacaggugccuaccaccaugccaggcua

SEQ ID NO: 451334 - RNA, 32 nt, Human
ggaccacaggugcgugucaccaugcuuggcua

SEQ ID NO: 451335 - RNA, 32 nt, Human
ggaccacaggugugcaccaccacgcccggcua

SEQ ID NO: 451336 - RNA, 32 nt, Human
ggaccacaugccacugccugcaccuuucggca

SEQ ID NO: 451337 - RNA, 21 nt, Human
ggaccacauucaagggugugg

SEQ ID NO: 451338 - RNA, 32 nt, Human
ggaccacauuuugcuuaauguaaaggagccac

SEQ ID NO: 451339 - RNA, 32 nt, Human
ggaccaccaagcucuaggucauccaucucugc

SEQ ID NO: 451340 - RNA, 32 nt, Human
ggaccaccagagaggagagggaaccagauaug

SEQ ID NO: 451341 - RNA, 20 nt, Human
ggaccaccagccccagcaag

SEQ ID NO: 451342 - RNA, 32 nt, Human
ggaccaccagccccagcaagagcacaagagga

SEQ ID NO: 451343 - RNA, 32 nt, Human
ggaccaccagccccaguaagagcacaagagga

SEQ ID NO: 451344 - RNA, 32 nt, Human
ggaccaccauggccaagaaccgcagggacaga

SEQ ID NO: 451345 - RNA, 32 nt, Human
ggaccacccacugcuucuccccaacccugaug

SEQ ID NO: 451346 - RNA, 32 nt, Human
ggaccacccaggcuugaggcagcggcgggaac

SEQ ID NO: 451347 - RNA, 19 nt, Human
ggaccaccccucccuucca

SEQ ID NO: 451348 - RNA, 24 nt, Human
ggaccaccgccguccccaccgcca

SEQ ID NO: 451349 - RNA, 18 nt, Human
ggaccaccgugcuggcug

SEQ ID NO: 451350 - RNA, 32 nt, Human
ggaccaccuccaggggcuaagugauggaucuu

SEQ ID NO: 451351 - RNA, 17 nt, Human
ggaccaccuccucugcc

SEQ ID NO: 451352 - RNA, 32 nt, Human
ggaccaccugcagggcugccuguuuauugaca

SEQ ID NO: 451353 - RNA, 19 nt, Human
ggaccacgucuuccugagg

SEQ ID NO: 451354 - RNA, 32 nt, Human
ggaccacuaagcuggggacaggaaccaagucc

SEQ ID NO: 451355 - RNA, 24 nt, Human
ggaccacuaaggaagcccagcaaa

SEQ ID NO: 451356 - RNA, 32 nt, Human
ggaccacuaccugcagcuaagcagugagcaga

SEQ ID NO: 451357 - RNA, 32 nt, Human
ggaccacuauacuccagccuggcaacagagca

SEQ ID NO: 451358 - RNA, 32 nt, Human
ggaccacucagggcaucagggggcguggucug

SEQ ID NO: 451359 - RNA, 32 nt, Human
ggaccacuccauccucuccacagcauccccuc

SEQ ID NO: 451360 - RNA, 21 nt, Human
ggaccacucggauggcacuca

SEQ ID NO: 451361 - RNA, 32 nt, Human
ggaccacugaggaccacaucacugcagaccca

SEQ ID NO: 451362 - RNA, 32 nt, Human
ggaccacugcucuccagccugggcaacagagu

SEQ ID NO: 451363 - RNA, 32 nt, Human
ggaccacugggagcacaaugcccacaucaucu

SEQ ID NO: 451364 - RNA, 32 nt, Human
ggaccacugugugcagcaccucccagacggcu

SEQ ID NO: 451365 - RNA, 32 nt, Human
ggaccagaaacaccucccuucuccaacaaaag

SEQ ID NO: 451366 - RNA, 20 nt, Human
ggaccagaaccauccauuga

SEQ ID NO: 451367 - RNA, 21 nt, Human
ggaccagaaccccugccucca

SEQ ID NO: 451368 - RNA, 32 nt, Human
ggaccagaccaaguagaggccuuggugcuggu

SEQ ID NO: 451369 - RNA, 20 nt, Human
ggaccagacccccaucccca

SEQ ID NO: 451370 - RNA, 32 nt, Human
ggaccagacccccauccccaccccuccugguc

SEQ ID NO: 451371 - RNA, 32 nt, Human
ggaccagaccuggccaaggucagccagcgggg

SEQ ID NO: 451372 - RNA, 32 nt, Human
ggaccagacuggcgugggugagcuccacaccc

SEQ ID NO: 451373 - RNA, 32 nt, Human
ggaccagagagaggagaaagcggagacaggua

SEQ ID NO: 451374 - RNA, 32 nt, Human
ggaccagaggagagagagcaccgagaggggca

SEQ ID NO: 451375 - RNA, 32 nt, Human
ggaccagaggagcagaccagcacuucaaccua

SEQ ID NO: 451376 - RNA, 32 nt, Human
ggaccagaucucccccucuccccacuacuuca

SEQ ID NO: 451377 - RNA, 32 nt, Human
ggaccagaucuggguguugugccugcuuucga

SEQ ID NO: 451378 - RNA, 32 nt, Human
ggaccagaugaggaucugaaauggcagccuuu

SEQ ID NO: 451379 - RNA, 32 nt, Human
ggaccagcacuggacgaagacaaggaucccac

SEQ ID NO: 451380 - RNA, 32 nt, Human
ggaccagcacuggaggaagacaaggaucccac

SEQ ID NO: 451381 - RNA, 32 nt, Human
ggaccagcagagggcacucucacccacgggga

SEQ ID NO: 451382 - RNA, 32 nt, Human
ggaccagcagcaaacaaaacguuuggucuucu

SEQ ID NO: 451383 - RNA, 32 nt, Human
ggaccagcaggcacagcaccuccagaacagug

SEQ ID NO: 451384 - RNA, 32 nt, Human
ggaccagccagaccagcagagcagggagccac

SEQ ID NO: 451385 - RNA, 32 nt, Human
ggaccagccagccagcaaggacccagucggcc

SEQ ID NO: 451386 - RNA, 32 nt, Human
ggaccagccagcgcuccucaggagucucacug

SEQ ID NO: 451387 - RNA, 32 nt, Human
ggaccagcccagccugcauacuugccacuugg

SEQ ID NO: 451388 - RNA, 32 nt, Human
ggaccagcccagguggggcaggcagaaaacuc

SEQ ID NO: 451389 - RNA, 32 nt, Human
ggaccagccccuaguguggguugugggggcgg

SEQ ID NO: 451390 - RNA, 32 nt, Human
ggaccagcccucucgguuugggaauaaggcau

SEQ ID NO: 451391 - RNA, 32 nt, Human
ggaccagccugaccaacauggugaaaccccgu

SEQ ID NO: 451392 - RNA, 32 nt, Human
ggaccagccugaccaacauggugaaauauaca

SEQ ID NO: 451393 - RNA, 32 nt, Human
ggaccagccugaccagcguggagaaacucugu

SEQ ID NO: 451394 - RNA, 32 nt, Human
ggaccagcgucuccccuucaaccgccuggccc

SEQ ID NO: 451395 - RNA, 18 nt, Human
ggaccagcgugcugcugc

SEQ ID NO: 451396 - RNA, 32 nt, Human
ggaccagcuccaccuccagccaccccaggucu

SEQ ID NO: 451397 - RNA, 18 nt, Human
ggaccagcugagacuaag

SEQ ID NO: 451398 - RNA, 21 nt, Human
ggaccagcugagacuaagaag

SEQ ID NO: 451399 - RNA, 22 nt, Human
ggaccagcugcagggucaggca

SEQ ID NO: 451400 - RNA, 21 nt, Human
ggaccagcuuccccaccuuca

SEQ ID NO: 451401 - RNA, 32 nt, Human
ggaccaggaaauucaaaucccucucaugauac

SEQ ID NO: 451402 - RNA, 24 nt, Human
ggaccaggaaguagagcagcaggu

SEQ ID NO: 451403 - RNA, 26 nt, Human
ggaccaggacaucggcuacuucgagg

SEQ ID NO: 451404 - RNA, 24 nt, Human
ggaccaggagaaaggggggcggug

SEQ ID NO: 451405 - RNA, 32 nt, Human
ggaccaggagaagagcaaagaaaagcagcccg

SEQ ID NO: 451406 - RNA, 32 nt, Human
ggaccaggagaggaucaaugcuuacauugaag

SEQ ID NO: 451407 - RNA, 32 nt, Human
ggaccaggaggaggaggaggaggaggaggaga

SEQ ID NO: 451408 - RNA, 32 nt, Human
ggaccaggagugcagggcaccugcugaggacu

SEQ ID NO: 451409 - RNA, 24 nt, Human
ggaccaggauuuucuacccagaga

SEQ ID NO: 451410 - RNA, 24 nt, Human
ggaccaggcaaaaaccacccaaga

SEQ ID NO: 451411 - RNA, 24 nt, Human
ggaccaggcacgcggcccaugggg

SEQ ID NO: 451412 - RNA, 25 nt, Human
ggaccaggcacuaggcaaccagggg

SEQ ID NO: 451413 - RNA, 24 nt, Human
ggaccaggcagaaaccacccaaga

SEQ ID NO: 451414 - RNA, 32 nt, Human
ggaccaggcagcugaccaggguggcagguguu

SEQ ID NO: 451415 - RNA, 23 nt, Human
ggaccaggcaguggcugcagagg

SEQ ID NO: 451416 - RNA, 26 nt, Human
ggaccaggcauuuagcuaguuagaga

SEQ ID NO: 451417 - RNA, 22 nt, Human
ggaccaggccuggagggcacuu

SEQ ID NO: 451418 - RNA, 23 nt, Human
ggaccaggccuggugcccagugg

SEQ ID NO: 451419 - RNA, 24 nt, Human
ggaccaggcucagccgcccagugg

SEQ ID NO: 451420 - RNA, 32 nt, Human
ggaccagggaccaggccagggugcgggcaggc

SEQ ID NO: 451421 - RNA, 32 nt, Human
ggaccagggaggacaggaugcugggcagggga

SEQ ID NO: 451422 - RNA, 32 nt, Human
ggaccagggaggacgcgcggugcgggagcaga

SEQ ID NO: 451423 - RNA, 32 nt, Human
ggaccagggaggugcaggugucugcaguguca

SEQ ID NO: 451424 - RNA, 25 nt, Human
ggaccagggcaccacucucuaggga

SEQ ID NO: 451425 - RNA, 32 nt, Human
ggaccagggcuggcagauguugucuaccugcu

SEQ ID NO: 451426 - RNA, 32 nt, Human
ggaccaggggaucaugucuccagguaacccga

SEQ ID NO: 451427 - RNA, 32 nt, Human
ggaccagggugaggacccgccggaugacagcc

SEQ ID NO: 451428 - RNA, 17 nt, Human
ggaccaggucucagaga

SEQ ID NO: 451429 - RNA, 32 nt, Human
ggaccagguggaggcggcggcggcagaggagu

SEQ ID NO: 451430 - RNA, 32 nt, Human
ggaccaggugggaacaaaggaggcucagagag

SEQ ID NO: 451431 - RNA, 21 nt, Human
ggaccaggugguggccagaga

SEQ ID NO: 451432 - RNA, 21 nt, Human
ggaccaggugucgcgcagaga

SEQ ID NO: 451433 - RNA, 32 nt, Human
ggaccaguacaaacucauggccaaucagcucc

SEQ ID NO: 451434 - RNA, 32 nt, Human
ggaccaguaggacucaagguggacgugcguuc

SEQ ID NO: 451435 - RNA, 32 nt, Human
ggaccaguaggugcccuuccagccugaagauc

SEQ ID NO: 451436 - RNA, 32 nt, Human
ggaccagugaaccaaggacugucagaucgcca

SEQ ID NO: 451437 - RNA, 32 nt, Human
ggaccagugacagcccuucaguuuccucacug

SEQ ID NO: 451438 - RNA, 32 nt, Human
ggaccagugcagccgccgccucccaggaucgu

SEQ ID NO: 451439 - RNA, 25 nt, Human
ggaccagugcgccccaucccaggga

SEQ ID NO: 451440 - RNA, 32 nt, Human
ggaccagugcucuucaggaauguggcugcaag

SEQ ID NO: 451441 - RNA, 32 nt, Human
ggaccagugucuucugucucagggcuuauuau

SEQ ID NO: 451442 - RNA, 32 nt, Human
ggaccaguucaguucuggucagcuagagggcc

SEQ ID NO: 451443 - RNA, 32 nt, Human
ggaccaguugcucgauaccauccggagccuga

SEQ ID NO: 451444 - RNA, 32 nt, Human
ggaccauacaggcuguauauuuugguggauuc

SEQ ID NO: 451445 - RNA, 32 nt, Human
ggaccauaggcgugcaccaccauacucagcua

SEQ ID NO: 451446 - RNA, 32 nt, Human
ggaccaucagccaggccccggggagggagcca

SEQ ID NO: 451447 - RNA, 20 nt, Human
ggaccaucauccccacucca

SEQ ID NO: 451448 - RNA, 32 nt, Human
ggaccaucucuguccccuccacccucacucca

SEQ ID NO: 451449 - RNA, 32 nt, Human
ggaccaucugggauuucuacagccuggguacc

SEQ ID NO: 451450 - RNA, 32 nt, Human
ggaccaucugucccuguccacccuucacagcu

SEQ ID NO: 451451 - RNA, 19 nt, Human
ggaccaugaccugcuggug

SEQ ID NO: 451452 - RNA, 30 nt, Human
ggaccaugagggcgcuggaggggccaggcc

SEQ ID NO: 451453 - RNA, 30 nt, Human
ggaccaugcagcuagagaucaaaguggccc

SEQ ID NO: 451454 - RNA, 32 nt, Human
ggaccaugccagauucugccucucuggaaaga

SEQ ID NO: 451455 - RNA, 32 nt, Human
ggaccauggcagagaaaagcaggagaggagca

SEQ ID NO: 451456 - RNA, 32 nt, Human
ggaccaugggaagucagucucuugcguguccu

SEQ ID NO: 451457 - RNA, 30 nt, Human
ggaccaugucggcggcgggagcgggcgcgg

SEQ ID NO: 451458 - RNA, 21 nt, Human
ggaccauucaccugucugcug

SEQ ID NO: 451459 - RNA, 32 nt, Human
ggaccauuccaucuuauauguaaagaaaucug

SEQ ID NO: 451460 - RNA, 32 nt, Human
ggaccauugcagcauccuccccuccucggacu

SEQ ID NO: 451461 - RNA, 32 nt, Human
ggacccaaacaaugugcuggacgccgagaagg

SEQ ID NO: 451462 - RNA, 18 nt, Human
ggacccaaacucuccuua

SEQ ID NO: 451463 - RNA, 24 nt, Human
ggacccaaccccuagaucccacca

SEQ ID NO: 451464 - RNA, 23 nt, Human
ggacccaaccgccgccuacccca

SEQ ID NO: 451465 - RNA, 24 nt, Human
ggacccaacuccuggaccuuucca

SEQ ID NO: 451466 - RNA, 24 nt, Human
ggacccaagacucugaaccuucca

SEQ ID NO: 451467 - RNA, 32 nt, Human
ggacccaagaggagcaggcagggacgggggca

SEQ ID NO: 451468 - RNA, 23 nt, Human
ggacccaagcgauccuccugucu

SEQ ID NO: 451469 - RNA, 32 nt, Human
ggacccaaggaguggggauacagugagaauua

SEQ ID NO: 451470 - RNA, 32 nt, Human
ggacccaaggcaggcuguuccuuggggcgguc

SEQ ID NO: 451471 - RNA, 32 nt, Human
ggacccaaggccacuuucaacucuuauggggu

SEQ ID NO: 451472 - RNA, 32 nt, Human
ggacccaauagagagggcaagcugagcaucug

SEQ ID NO: 451473 - RNA, 32 nt, Human
ggacccacacuggguugaggccagugucuccu

SEQ ID NO: 451474 - RNA, 32 nt, Human
ggacccacagaaacagccugacagcagcuggu

SEQ ID NO: 451475 - RNA, 32 nt, Human
ggacccacagaauuacagggaaguuacaggga

SEQ ID NO: 451476 - RNA, 32 nt, Human
ggacccaccagcugcacgggcugcugcugcgc

SEQ ID NO: 451477 - RNA, 32 nt, Human
ggacccacccaccacagcccaucacccuccau

SEQ ID NO: 451478 - RNA, 32 nt, Human
ggacccaccugggugcaguugccuucagggac

SEQ ID NO: 451479 - RNA, 32 nt, Human
ggacccacgccacggccaggagcccagagcag

SEQ ID NO: 451480 - RNA, 32 nt, Human
ggacccacucaucugcugcuucuucgugcgcc

SEQ ID NO: 451481 - RNA, 19 nt, Human
ggacccacuggacacaggg

SEQ ID NO: 451482 - RNA, 32 nt, Human
ggacccagaaaaccacacuggcuccaacuucc

SEQ ID NO: 451483 - RNA, 18 nt, Human
ggacccagaacuucucca

SEQ ID NO: 451484 - RNA, 23 nt, Human
ggacccagaagagaagggcacug

SEQ ID NO: 451485 - RNA, 32 nt, Human
ggacccagaagcuuaccagcggugucuuacac

SEQ ID NO: 451486 - RNA, 23 nt, Human
ggacccagacauaggcuuggugg

SEQ ID NO: 451487 - RNA, 20 nt, Human
ggacccagacgcaggacaga

SEQ ID NO: 451488 - RNA, 32 nt, Human
ggacccagagaaccgggccgggcacagcgugg

SEQ ID NO: 451489 - RNA, 32 nt, Human
ggacccagaggggcugccugaccucagggcuc

SEQ ID NO: 451490 - RNA, 23 nt, Human
ggacccagaguccaggcggcugg

SEQ ID NO: 451491 - RNA, 21 nt, Human
ggacccagaugcaagacacug

SEQ ID NO: 451492 - RNA, 32 nt, Human
ggacccagauggggcuuucccuuuguagccau

SEQ ID NO: 451493 - RNA, 25 nt, Human
ggacccagcagccuggauccuucca

SEQ ID NO: 451494 - RNA, 32 nt, Human
ggacccagcagugggcgcuggugacaguggcg

SEQ ID NO: 451495 - RNA, 22 nt, Human
ggacccagcauguaggugccgg

SEQ ID NO: 451496 - RNA, 32 nt, Human
ggacccagcccagcucccguccucuugguggc

SEQ ID NO: 451497 - RNA, 24 nt, Human
ggacccagccccuccucucugaga

SEQ ID NO: 451498 - RNA, 32 nt, Human
ggacccagccgccaucagcccaacggaagcaa

SEQ ID NO: 451499 - RNA, 32 nt, Human
ggacccagcucgagccgccaggacacagacgu

SEQ ID NO: 451500 - RNA, 23 nt, Human
ggacccagcucugcaggcaccca

SEQ ID NO: 451501 - RNA, 19 nt, Human
ggacccagcucuuccugag

SEQ ID NO: 451502 - RNA, 32 nt, Human
ggacccagcugguuuauaacuucagaagaaau

SEQ ID NO: 451503 - RNA, 32 nt, Human
ggacccagcuguagugagguugcagugauuga

SEQ ID NO: 451504 - RNA, 32 nt, Human
ggacccaggaggcagagcuugcagugagccga

SEQ ID NO: 451505 - RNA, 23 nt, Human
ggacccaggagggagggcagcug

SEQ ID NO: 451506 - RNA, 32 nt, Human
ggacccaggauuugaacccagcuucagugugc

SEQ ID NO: 451507 - RNA, 32 nt, Human
ggacccaggcagggcagagcaauaccuuccga

SEQ ID NO: 451508 - RNA, 16 nt, Human
ggacccaggcuggcug

SEQ ID NO: 451509 - RNA, 32 nt, Human
ggacccagggagaggagccagugacacaggca

SEQ ID NO: 451510 - RNA, 22 nt, Human
ggacccagggcaaggugacugg

SEQ ID NO: 451511 - RNA, 32 nt, Human
ggacccaggggagguuuagggguccuaucucc

SEQ ID NO: 451512 - RNA, 32 nt, Human
ggacccaggucugcucccugggaugcuuucuc

SEQ ID NO: 451513 - RNA, 23 nt, Human
ggacccaguauuuccccuccuug

SEQ ID NO: 451514 - RNA, 19 nt, Human
ggacccagugcccucugca

SEQ ID NO: 451515 - RNA, 32 nt, Human
ggacccagugggcaguaauuuaaucauggugg

SEQ ID NO: 451516 - RNA, 21 nt, Human
ggacccagugggucccacagc

SEQ ID NO: 451517 - RNA, 32 nt, Human
ggacccaguucagaaucucgacacaagaauca

SEQ ID NO: 451518 - RNA, 32 nt, Human
ggacccaguucuggcaagauucaucaccuacu

SEQ ID NO: 451519 - RNA, 32 nt, Human
ggacccauccagcugagugaacccaggguggu

SEQ ID NO: 451520 - RNA, 32 nt, Human
ggacccaugaauccugaccacucuugaaccca

SEQ ID NO: 451521 - RNA, 32 nt, Human
ggacccaugugugggcaugauccuguggaaca

SEQ ID NO: 451522 - RNA, 32 nt, Human
ggacccauuuaugaggagguggcuuaugaaag

SEQ ID NO: 451523 - RNA, 32 nt, Human
ggaccccaaaaagaagagagcucagaagcccu

SEQ ID NO: 451524 - RNA, 32 nt, Human
ggaccccaaagcagccccuuggagcugcaggg

SEQ ID NO: 451525 - RNA, 32 nt, Human
ggaccccaaaugguggucguugucccuucugu

SEQ ID NO: 451526 - RNA, 32 nt, Human
ggaccccaaugcccccacagagcaauacacug

SEQ ID NO: 451527 - RNA, 32 nt, Human
ggaccccaccaccacccgcaacacugccgcug

SEQ ID NO: 451528 - RNA, 32 nt, Human
ggaccccaccacugcacuccagccuggaugac

SEQ ID NO: 451529 - RNA, 32 nt, Human
ggaccccagaguccuguucugcugagguuuga

SEQ ID NO: 451530 - RNA, 32 nt, Human
ggaccccagaugggggaggggaugacaaggcu

SEQ ID NO: 451531 - RNA, 30 nt, Human
ggaccccagauucacagggcacaaaugcau

SEQ ID NO: 451532 - RNA, 32 nt, Human
ggaccccagccggcugcuggagcccagaggcc

SEQ ID NO: 451533 - RNA, 32 nt, Human
ggaccccaggaggagaggcuugccgugccucc

SEQ ID NO: 451534 - RNA, 21 nt, Human
ggaccccaggccacucugaga

SEQ ID NO: 451535 - RNA, 32 nt, Human
ggaccccagggagaaacgcucuccccacccac

SEQ ID NO: 451536 - RNA, 32 nt, Human
ggaccccagggugggagggaaggugcgguggg

SEQ ID NO: 451537 - RNA, 32 nt, Human
ggaccccagugaaaugaugugcauaugaaaau

SEQ ID NO: 451538 - RNA, 32 nt, Human
ggaccccaguuuaaaagaguuugaaggagcaa

SEQ ID NO: 451539 - RNA, 32 nt, Human
ggaccccauaaucugcccaucugggacuuggc

SEQ ID NO: 451540 - RNA, 19 nt, Human
ggaccccauccccacccca

SEQ ID NO: 451541 - RNA, 32 nt, Human
ggaccccauggccaugguugagcggccgaggc

SEQ ID NO: 451542 - RNA, 32 nt, Human
ggacccccaaagugcugggauuccagguguga

SEQ ID NO: 451543 - RNA, 32 nt, Human
ggacccccaagagugagugagggggcaaggcu

SEQ ID NO: 451544 - RNA, 32 nt, Human
ggacccccaccaccagccucuugaaguggcuc

SEQ ID NO: 451545 - RNA, 32 nt, Human
ggacccccagaacuaagaagggagggcgagug

SEQ ID NO: 451546 - RNA, 32 nt, Human
ggacccccagaagaggagcggggcacccccga

SEQ ID NO: 451547 - RNA, 21 nt, Human
ggacccccgcaccugcccucu

SEQ ID NO: 451548 - RNA, 18 nt, Human
ggacccccgggcuggcug

SEQ ID NO: 451549 - RNA, 32 nt, Human
ggacccccucauuccugccgcugccgucccug

SEQ ID NO: 451550 - RNA, 32 nt, Human
ggacccccuccccauugucaggcucuccaugu

SEQ ID NO: 451551 - RNA, 21 nt, Human
ggacccccuggcccacccugg

SEQ ID NO: 451552 - RNA, 28 nt, Human
ggacccccuggcccugccucauccacca

SEQ ID NO: 451553 - RNA, 32 nt, Human
ggaccccgagagaagcaggggagcucggcggg

SEQ ID NO: 451554 - RNA, 19 nt, Human
ggaccccgaggaggacugc

SEQ ID NO: 451555 - RNA, 32 nt, Human
ggaccccgcccaggcagggagcugcugugagu

SEQ ID NO: 451556 - RNA, 21 nt, Human
ggaccccgccuggacucccca

SEQ ID NO: 451557 - RNA, 32 nt, Human
ggaccccgcguuccuccucccugccggucccc

SEQ ID NO: 451558 - RNA, 32 nt, Human
ggaccccggagcugggcugggcuguggcccuu

SEQ ID NO: 451559 - RNA, 24 nt, Human
ggaccccggccucucgagggcugg

SEQ ID NO: 451560 - RNA, 32 nt, Human
ggaccccggcgccgucuccgcguggcucugga

SEQ ID NO: 451561 - RNA, 26 nt, Human
ggaccccgggaaccucuccugccgga

SEQ ID NO: 451562 - RNA, 32 nt, Human
ggaccccgggaagggaaggcagccugguuucu

SEQ ID NO: 451563 - RNA, 32 nt, Human
ggaccccguggauauggagcagucgccgccgc

SEQ ID NO: 451564 - RNA, 32 nt, Human
ggaccccuaggagccagguccuacggauaggu

SEQ ID NO: 451565 - RNA, 21 nt, Human
ggaccccucacaaacacacuu

SEQ ID NO: 451566 - RNA, 32 nt, Human
ggaccccuccacccacgcucacaagucaucca

SEQ ID NO: 451567 - RNA, 30 nt, Human
ggaccccuccccuacaugcaccaaugcacg

SEQ ID NO: 451568 - RNA, 32 nt, Human
ggaccccucugccugccccaaccccuuuggag

SEQ ID NO: 451569 - RNA, 32 nt, Human
ggaccccucugccuuccuccccaauccugacu

SEQ ID NO: 451570 - RNA, 32 nt, Human
ggaccccucuucuccaaccacucaggaaaccu

SEQ ID NO: 451571 - RNA, 32 nt, Human
ggaccccucuuucuaggcugaaccuugagucc

SEQ ID NO: 451572 - RNA, 32 nt, Human
ggaccccugcagcugcagacaucugcuucacc

SEQ ID NO: 451573 - RNA, 32 nt, Human
ggaccccugcaguuggcugggcccgcagcacu

SEQ ID NO: 451574 - RNA, 20 nt, Human
ggaccccugcccacuccaca

SEQ ID NO: 451575 - RNA, 32 nt, Human
ggaccccugccuggaggccuccguguccucag

SEQ ID NO: 451576 - RNA, 32 nt, Human
ggaccccugcggcccccugccuagaggagcac

SEQ ID NO: 451577 - RNA, 32 nt, Human
ggaccccugcugauucuuucugcuucuaagac

SEQ ID NO: 451578 - RNA, 32 nt, Human
ggaccccugcugcugcuccugcucagcuccug

SEQ ID NO: 451579 - RNA, 32 nt, Human
ggaccccuggcccacugacuccuggggauggg

SEQ ID NO: 451580 - RNA, 32 nt, Human
ggaccccuggggaccuguacacuagcaggaug

SEQ ID NO: 451581 - RNA, 23 nt, Human
ggaccccugucugcacaccaggg

SEQ ID NO: 451582 - RNA, 32 nt, Human
ggaccccuugaggacaucgccaggcucugugg

SEQ ID NO: 451583 - RNA, 32 nt, Human
ggaccccuuucugcaacccacccaucccuccc

SEQ ID NO: 451584 - RNA, 32 nt, Human
ggacccgacucagcuugagacacuccagccaa

SEQ ID NO: 451585 - RNA, 21 nt, Human
ggacccgacuggcugggcuuc

SEQ ID NO: 451586 - RNA, 32 nt, Human
ggacccgagaagcagagagcgagagggggaag

SEQ ID NO: 451587 - RNA, 32 nt, Human
ggacccgagagagagcgccgccgccaucuuag

SEQ ID NO: 451588 - RNA, 32 nt, Human
ggacccgagggagggaggguggggaagcgagg

SEQ ID NO: 451589 - RNA, 32 nt, Human
ggacccgaggguggaacccacccccugggcuc

SEQ ID NO: 451590 - RNA, 32 nt, Human
ggacccgcagccgccgccgccgccuccucccc

SEQ ID NO: 451591 - RNA, 32 nt, Human
ggacccgcagccgccucgucaccuccaguugg

SEQ ID NO: 451592 - RNA, 17 nt, Human
ggacccgcccccuccuu

SEQ ID NO: 451593 - RNA, 32 nt, Human
ggacccgccugcggucugcaucagccucuggg

SEQ ID NO: 451594 - RNA, 32 nt, Human
ggacccgcucuuucgccaccuuccccagccgc

SEQ ID NO: 451595 - RNA, 23 nt, Human
ggacccggacaggacugauggcc

SEQ ID NO: 451596 - RNA, 21 nt, Human
ggacccggacccaggacccuc

SEQ ID NO: 451597 - RNA, 32 nt, Human
ggacccggaugugaauggcaugcugaaacucg

SEQ ID NO: 451598 - RNA, 21 nt, Human
ggacccggcccaaggaucugg

SEQ ID NO: 451599 - RNA, 32 nt, Human
ggacccggccgccagccucucccuccaccucu

SEQ ID NO: 451600 - RNA, 32 nt, Human
ggacccggcuacgacaaccucuacgugaccuc

SEQ ID NO: 451601 - RNA, 32 nt, Human
ggacccgggaggcagagguugcagugagccga

SEQ ID NO: 451602 - RNA, 32 nt, Human
ggacccgggaggcggagguugcagugagccaa

SEQ ID NO: 451603 - RNA, 32 nt, Human
ggacccgggaggcggagguugcagugagccga

SEQ ID NO: 451604 - RNA, 19 nt, Human
ggacccgggagugggucuc

SEQ ID NO: 451605 - RNA, 23 nt, Human
ggacccggucucccacaggugac

SEQ ID NO: 451606 - RNA, 32 nt, Human
ggacccgugagguuuguguggaccccgaguuc

SEQ ID NO: 451607 - RNA, 32 nt, Human
ggacccuaagaugcgugaggcaggcucucuaa

SEQ ID NO: 451608 - RNA, 32 nt, Human
ggacccuagccacgcugaccuccugccucucc

SEQ ID NO: 451609 - RNA, 32 nt, Human
ggacccuagcugugguaggaaguggcccucag

SEQ ID NO: 451610 - RNA, 32 nt, Human
ggacccuaggagaccugacuggaacuggcucc

SEQ ID NO: 451611 - RNA, 32 nt, Human
ggacccuaggcuuggagcuggagcugggguaa

SEQ ID NO: 451612 - RNA, 32 nt, Human
ggacccucaccaacuuuccccaccucaggcag

SEQ ID NO: 451613 - RNA, 24 nt, Human
ggacccucaccacgaaucucauga

SEQ ID NO: 451614 - RNA, 32 nt, Human
ggacccucacugcugucucugccuccuuucug

SEQ ID NO: 451615 - RNA, 32 nt, Human
ggacccucagcagcucuggcucugccucagga

SEQ ID NO: 451616 - RNA, 24 nt, Human
ggacccucaggccagcagcacccu

SEQ ID NO: 451617 - RNA, 32 nt, Human
ggacccuccugcacaacaucuccaggggaccg

SEQ ID NO: 451618 - RNA, 32 nt, Human
ggacccucgaaaccccagccccuagggaguuu

SEQ ID NO: 451619 - RNA, 32 nt, Human
ggacccucgucuuuaccacgcuccugaggaau

SEQ ID NO: 451620 - RNA, 32 nt, Human
ggacccucgugaaggaugcaagcagcugccca

SEQ ID NO: 451621 - RNA, 32 nt, Human
ggacccucuccaccaugggcccaccagaccaa

SEQ ID NO: 451622 - RNA, 32 nt, Human
ggacccucucccuggcugccucaggcuucucu

SEQ ID NO: 451623 - RNA, 32 nt, Human
ggacccugacaccugccaacagccccucugcc

SEQ ID NO: 451624 - RNA, 32 nt, Human
ggacccugagcaacccccuccugggcuccuuu

SEQ ID NO: 451625 - RNA, 19 nt, Human
ggacccugagcacccccuu

SEQ ID NO: 451626 - RNA, 32 nt, Human
ggacccugagccacagugaguuggucaaaugc

SEQ ID NO: 451627 - RNA, 32 nt, Human
ggacccugcaguccucggccagccuggcuguc

SEQ ID NO: 451628 - RNA, 19 nt, Human
ggacccugcccacaccccu

SEQ ID NO: 451629 - RNA, 20 nt, Human
ggacccugccgagggggcug

SEQ ID NO: 451630 - RNA, 29 nt, Human
ggacccugccuucaaucaucccuccucuu

SEQ ID NO: 451631 - RNA, 32 nt, Human
ggacccugcucacaggcaggcuuuuccuccaa

SEQ ID NO: 451632 - RNA, 32 nt, Human
ggacccugcuucugaaguacaugaaccuugag

SEQ ID NO: 451633 - RNA, 32 nt, Human
ggacccugcuucugagugacggaccagcucac

SEQ ID NO: 451634 - RNA, 20 nt, Human
ggacccuggacuuugccaga

SEQ ID NO: 451635 - RNA, 32 nt, Human
ggacccuggaggggcaagcaugugguuccuuu

SEQ ID NO: 451636 - RNA, 32 nt, Human
ggacccuggagguagaggcugcagugagccaa

SEQ ID NO: 451637 - RNA, 19 nt, Human
ggacccuggcagccucccu

SEQ ID NO: 451638 - RNA, 18 nt, Human
ggacccuggccccuccuu

SEQ ID NO: 451639 - RNA, 32 nt, Human
ggacccuggccgcuucccaccaucuucugcag

SEQ ID NO: 451640 - RNA, 32 nt, Human
ggacccugggcccucaccgcaggcagcaguuu

SEQ ID NO: 451641 - RNA, 32 nt, Human
ggacccuggggaaggcagggagggcagguagc

SEQ ID NO: 451642 - RNA, 32 nt, Human
ggacccugggguggagggugagggauucugug

SEQ ID NO: 451643 - RNA, 32 nt, Human
ggacccuggugcucaucuucucuugucauuca

SEQ ID NO: 451644 - RNA, 18 nt, Human
ggacccugugcccuccuu

SEQ ID NO: 451645 - RNA, 32 nt, Human
ggacccugugugccucauaagggcuauucuuu

SEQ ID NO: 451646 - RNA, 24 nt, Human
ggacccuuaacugccucacccuga

SEQ ID NO: 451647 - RNA, 32 nt, Human
ggacccuucaucuucuccucugccaggggagg

SEQ ID NO: 451648 - RNA, 23 nt, Human
ggacccuuccagaccucacccug

SEQ ID NO: 451649 - RNA, 32 nt, Human
ggacccuuccccuccaggggugcaguggggug

SEQ ID NO: 451650 - RNA, 32 nt, Human
ggacccuugcagggcuuugcagcugcucaucu

SEQ ID NO: 451651 - RNA, 20 nt, Human
ggacccuugcaggucugccc

SEQ ID NO: 451652 - RNA, 32 nt, Human
ggacccuugccucaccccucccccuggccuca

SEQ ID NO: 451653 - RNA, 17 nt, Human
ggacccuuucccuccuu

SEQ ID NO: 451654 - RNA, 18 nt, Human
ggacccuuuucuaugcaa

SEQ ID NO: 451655 - RNA, 32 nt, Human
ggaccgacgcggagaggaagggaagccgcauc

SEQ ID NO: 451656 - RNA, 32 nt, Human
ggaccgagacuguaccuuccagccuucagcgc

SEQ ID NO: 451657 - RNA, 32 nt, Human
ggaccgagagcaucaugggcagcacugucccg

SEQ ID NO: 451658 - RNA, 20 nt, Human
ggaccgagcacguccaggga

SEQ ID NO: 451659 - RNA, 19 nt, Human
ggaccgagccccagcaagg

SEQ ID NO: 451660 - RNA, 24 nt, Human
ggaccgagccccgucucccaggga

SEQ ID NO: 451661 - RNA, 32 nt, Human
ggaccgagcugcuggggaggaccucaguuaac

SEQ ID NO: 451662 - RNA, 32 nt, Human
ggaccgagcugggcuucucuuccucccuacag

SEQ ID NO: 451663 - RNA, 32 nt, Human
ggaccgaggcagcggcggcaccugccggccga

SEQ ID NO: 451664 - RNA, 32 nt, Human
ggaccgaggccaggacucuccuugggguuugg

SEQ ID NO: 451665 - RNA, 21 nt, Human
ggaccgaggggcucccaaggg

SEQ ID NO: 451666 - RNA, 32 nt, Human
ggaccgaugccugcugugccuuccugcugagg

SEQ ID NO: 451667 - RNA, 32 nt, Human
ggaccgcaugcccuaaacacacaauccgugaa

SEQ ID NO: 451668 - RNA, 32 nt, Human
ggaccgccacccccugagaggcucccuucccc

SEQ ID NO: 451669 - RNA, 19 nt, Human
ggaccgccacgccccggag

SEQ ID NO: 451670 - RNA, 20 nt, Human
ggaccgccccccuccugcca

SEQ ID NO: 451671 - RNA, 32 nt, Human
ggaccgcccugggccagccuccggcggggacc

SEQ ID NO: 451672 - RNA, 32 nt, Human
ggaccgccgggccaccaccggccgccucagcc

SEQ ID NO: 451673 - RNA, 32 nt, Human
ggaccgccucggaggcagaagagccgcgagga

SEQ ID NO: 451674 - RNA, 32 nt, Human
ggaccgccugcagcugggcuguaaggagugug

SEQ ID NO: 451675 - RNA, 32 nt, Human
ggaccgcgcagcccggugugugcaguggccuc

SEQ ID NO: 451676 - RNA, 17 nt, Human
ggaccgcgcccccuccu

SEQ ID NO: 451677 - RNA, 22 nt, Human
ggaccgcggagcugaggagcgg

SEQ ID NO: 451678 - RNA, 32 nt, Human
ggaccgcggccucagcgagcaggaagccuggg

SEQ ID NO: 451679 - RNA, 24 nt, Human
ggaccgcggggcggacgggagcga

SEQ ID NO: 451680 - RNA, 32 nt, Human
ggaccgcucggcuuccugcucucgccggaguu

SEQ ID NO: 451681 - RNA, 20 nt, Human
ggaccgcuggacagacgcac

SEQ ID NO: 451682 - RNA, 32 nt, Human
ggaccgcuggcuuauaagcgaucauguuucuc

SEQ ID NO: 451683 - RNA, 32 nt, Human
ggagccuaagacccucccagagcccaggggcu

SEQ ID NO: 451684 - RNA, 32 nt, Human
ggagccuaagacccucccagagcccaggugcu

SEQ ID NO: 451685 - RNA, 32 nt, Human
ggagccuaagucugugguggacagauaauaau

SEQ ID NO: 451686 - RNA, 32 nt, Human
ggagccuacaucuucauaagcuuuuuagcagg

SEQ ID NO: 451687 - RNA, 32 nt, Human
ggagccuaccaccacgucuggcuaauuuuugu

SEQ ID NO: 451688 - RNA, 32 nt, Human
ggagccuaccuuccccuccccuuccccacgcu

SEQ ID NO: 451689 - RNA, 32 nt, Human
ggagccuagagcugcucagcuucggugggggu

SEQ ID NO: 451690 - RNA, 32 nt, Human
ggagccuauccugaauuuuguaaaauauccca

SEQ ID NO: 451691 - RNA, 32 nt, Human
ggagccuauuuguuuguuaucacauugacuuc

SEQ ID NO: 451692 - RNA, 32 nt, Human
ggagccucaaauacuuguguucauuugggaaa

SEQ ID NO: 451693 - RNA, 32 nt, Human
ggagccucacuuccagcccagccugggcccgc

SEQ ID NO: 451694 - RNA, 32 nt, Human
ggagccucagacacacuggaguucagggcugg

SEQ ID NO: 451695 - RNA, 32 nt, Human
ggagccucagggaugggcucaggcugaugguc

SEQ ID NO: 451696 - RNA, 32 nt, Human
ggagccucagucugacauuccacgccggggug

SEQ ID NO: 451697 - RNA, 32 nt, Human
ggagccucauugagacaggggagagagaaaga

SEQ ID NO: 451698 - RNA, 32 nt, Human
ggagccucccuggaguggagcagcccugaagc

SEQ ID NO: 451699 - RNA, 32 nt, Human
ggagccuccgccugcuuccuccagaagacacg

SEQ ID NO: 451700 - RNA, 32 nt, Human
ggagccuccucucucaagcuggggccucccug

SEQ ID NO: 451701 - RNA, 32 nt, Human
ggagccuccugccucaaagugcuccccuaagu

SEQ ID NO: 451702 - RNA, 32 nt, Human
ggagccucgguuggcuccucuggaacagggag

SEQ ID NO: 451703 - RNA, 32 nt, Human
ggagccucuccacuucaugauuuucagcuaac

SEQ ID NO: 451704 - RNA, 17 nt, Human
ggagccucuuccuugcc

SEQ ID NO: 451705 - RNA, 32 nt, Human
ggagccucuugggugucaaacaagcacccugg

SEQ ID NO: 451706 - RNA, 32 nt, Human
ggagccugaagauggcacagcucugugauuca

SEQ ID NO: 451707 - RNA, 32 nt, Human
ggagccugagaacuccuccuccugggacucuc

SEQ ID NO: 451708 - RNA, 19 nt, Human
ggagccugagaagaggcag

SEQ ID NO: 451709 - RNA, 32 nt, Human
ggagccugagagguggaggaguucugaucccc

SEQ ID NO: 451710 - RNA, 32 nt, Human
ggagccugagcagccugaugggcgagcggcgc

SEQ ID NO: 451711 - RNA, 32 nt, Human
ggagccugaggcaggagaauugcuugaacacg

SEQ ID NO: 451712 - RNA, 32 nt, Human
ggagccugaggcaggagaauugcuugaaccca

SEQ ID NO: 451713 - RNA, 32 nt, Human
ggagccugaggcaggaggauugcuugagcuca

SEQ ID NO: 451714 - RNA, 32 nt, Human
ggagccugaggcagggcaauugcuugaacucg

SEQ ID NO: 451715 - RNA, 32 nt, Human
ggagccugaggcaugagaaucacuugaacucg

SEQ ID NO: 451716 - RNA, 32 nt, Human
ggagccugaggcgggagaauugcuugaacccg

SEQ ID NO: 451717 - RNA, 32 nt, Human
ggagccugaggugggaggauugcuugagucug

SEQ ID NO: 451718 - RNA, 32 nt, Human
ggagccugaucaccugcccugcugagucccag

SEQ ID NO: 451719 - RNA, 32 nt, Human
ggagccugcacuccacagacccucuccuugcc

SEQ ID NO: 451720 - RNA, 32 nt, Human
ggagccugcaggaagcugaacuuugaaagauu

SEQ ID NO: 451721 - RNA, 32 nt, Human
ggagccugcaugggcgcacucucucuuucuga

SEQ ID NO: 451722 - RNA, 32 nt, Human
ggagccugccacccucuuccugcccuaccucc

SEQ ID NO: 451723 - RNA, 32 nt, Human
ggagccugcccagcccccuggucuuugagcuc

SEQ ID NO: 451724 - RNA, 32 nt, Human
ggagccugcccugauugccuucaccucauuuc

SEQ ID NO: 451725 - RNA, 32 nt, Human
ggagccugccuggggccugccucugccagaag

SEQ ID NO: 451726 - RNA, 17 nt, Human
ggagccugcgcgccgag

SEQ ID NO: 451727 - RNA, 19 nt, Human
ggagccugcgugugguggg

SEQ ID NO: 451728 - RNA, 32 nt, Human
ggagccugcuaaggaacaaugccgccugucaa

SEQ ID NO: 451729 - RNA, 32 nt, Human
ggagccugcuccagcccgccucccggagccag

SEQ ID NO: 451730 - RNA, 32 nt, Human
ggagccugcuccugaagcugccacugccccac

SEQ ID NO: 451731 - RNA, 32 nt, Human
ggagccugcugguacccuggggguugugggga

SEQ ID NO: 451732 - RNA, 32 nt, Human
ggagccugcuuggagccagcuuccugccccug

SEQ ID NO: 451733 - RNA, 32 nt, Human
ggagccuggaagcagaugagauggggccgcag

SEQ ID NO: 451734 - RNA, 32 nt, Human
ggagccuggagaaagaggcgaccuuccuuggg

SEQ ID NO: 451735 - RNA, 32 nt, Human
ggagccuggagcuguuggucagaugggcagcc

SEQ ID NO: 451736 - RNA, 16 nt, Human
ggagccuggagguggg

SEQ ID NO: 451737 - RNA, 21 nt, Human
ggagccuggccgcggaccccu

SEQ ID NO: 451738 - RNA, 32 nt, Human
ggagccuggcuccccucuucguuccuucccug

SEQ ID NO: 451739 - RNA, 32 nt, Human
ggagccuggcucugcugccuaaugcuggagca

SEQ ID NO: 451740 - RNA, 32 nt, Human
ggagccugggaggcagagguugcagugagcca

SEQ ID NO: 451741 - RNA, 32 nt, Human
ggagccugggaggucaaggcugcagugagcca

SEQ ID NO: 451742 - RNA, 32 nt, Human
ggagccugggcaacaagagcgaaacuccgucu

SEQ ID NO: 451743 - RNA, 32 nt, Human
ggagccugggccaugguacagcuggcuccugc

SEQ ID NO: 451744 - RNA, 32 nt, Human
ggagccugggccucccugaaccccuggcuucc

SEQ ID NO: 451745 - RNA, 32 nt, Human
ggagccugggccugacauggcccaggaggccc

SEQ ID NO: 451746 - RNA, 18 nt, Human
ggagccugggcggccuuc

SEQ ID NO: 451747 - RNA, 32 nt, Human
ggagccugggcuccaggcagaucugcuccuua

SEQ ID NO: 451748 - RNA, 32 nt, Human
ggagccugggcugacugguugggacucaccga

SEQ ID NO: 451749 - RNA, 32 nt, Human
ggagccugggcuggaagaggcagcaaaaggga

SEQ ID NO: 451750 - RNA, 32 nt, Human
ggagccugggguccccugggguggggugguca

SEQ ID NO: 451751 - RNA, 32 nt, Human
ggagccugggugcagcagagacagaggaagca

SEQ ID NO: 451752 - RNA, 32 nt, Human
ggagccuggugcuguaguguugugcugggacu

SEQ ID NO: 451753 - RNA, 32 nt, Human
ggagccuguaaucccagcuacacaggaggcug

SEQ ID NO: 451754 - RNA, 32 nt, Human
ggagccuguaaucccagcuguucgggaggcug

SEQ ID NO: 451755 - RNA, 32 nt, Human
ggagccuguaccagccugccuucuccaggagg

SEQ ID NO: 451756 - RNA, 32 nt, Human
ggagccuguagucccagcuacacgggaggcua

SEQ ID NO: 451757 - RNA, 32 nt, Human
ggagccuguagucccagcuacucaggaggcug

SEQ ID NO: 451758 - RNA, 32 nt, Human
ggagccugugagccaccggcccacgugaaagu

SEQ ID NO: 451759 - RNA, 32 nt, Human
ggagccugugucccuagcgcaggugugucugu

SEQ ID NO: 451760 - RNA, 32 nt, Human
ggagccuguuuaccuguguucaaaaucuggca

SEQ ID NO: 451761 - RNA, 32 nt, Human
ggagccuuacugaugaaccccugcagagaagg

SEQ ID NO: 451762 - RNA, 32 nt, Human
ggagccuuaggaugcagcaugccuucaggaga

SEQ ID NO: 451763 - RNA, 32 nt, Human
ggagccuucccaagccuucuccucagcccgac

SEQ ID NO: 451764 - RNA, 21 nt, Human
ggagccuugaggccaggaggg

SEQ ID NO: 451765 - RNA, 32 nt, Human
ggagccuugccucagagaccaacugguggcug

SEQ ID NO: 451766 - RNA, 32 nt, Human
ggagccuugcugcucaucagcauccagguccu

SEQ ID NO: 451767 - RNA, 32 nt, Human
ggagccuuggaggcggguggccuggcugugcu

SEQ ID NO: 451768 - RNA, 32 nt, Human
ggagccuuggcuccugagcauccccaaagugu

SEQ ID NO: 451769 - RNA, 32 nt, Human
ggagccuugggccugaguccuggcucccucac

SEQ ID NO: 451770 - RNA, 32 nt, Human
ggagccuugugagauccuucacaggcagugca

SEQ ID NO: 451771 - RNA, 32 nt, Human
ggagccuugugccuugagacuccuggaaagac

SEQ ID NO: 451772 - RNA, 32 nt, Human
ggagccuuucaggcuggcauggagagcuuaag

SEQ ID NO: 451773 - RNA, 32 nt, Human
ggagccuuugggcugagcaagcacugaggagg

SEQ ID NO: 451774 - RNA, 32 nt, Human
ggagcgaccagcacaacaccaaaugggaaugu

SEQ ID NO: 451775 - RNA, 32 nt, Human
ggagcgagacaggcgaccaacacagaggagag

SEQ ID NO: 451776 - RNA, 32 nt, Human
ggagcgagcaugucguggacacacacagacua

SEQ ID NO: 451777 - RNA, 32 nt, Human
ggagcgagcgaagcuguggccuuggugaagcu

SEQ ID NO: 451778 - RNA, 32 nt, Human
ggagcgagcucccucauggcaucuggaacgcu

SEQ ID NO: 451779 - RNA, 32 nt, Human
ggagcgagcugugcggggcagcgcgggcuggc

SEQ ID NO: 451780 - RNA, 32 nt, Human
ggagcgaggacaacguuggcccagaugggggc

SEQ ID NO: 451781 - RNA, 18 nt, Human
ggagcgaggaugauuuca

SEQ ID NO: 451782 - RNA, 32 nt, Human
ggagcgagggaagcggcuagaggaucggggag

SEQ ID NO: 451783 - RNA, 32 nt, Human
ggagcgagggcaaggagagagcagugaggccg

SEQ ID NO: 451784 - RNA, 32 nt, Human
ggagcgaggggcuggcaugguuggccucgccc

SEQ ID NO: 451785 - RNA, 17 nt, Human
ggagcgauccucagaga

SEQ ID NO: 451786 - RNA, 31 nt, Human
ggagcgaugggaggccuugagaagaagaagu

SEQ ID NO: 451787 - RNA, 22 nt, Human
ggagcgcagggcggccgcugca

SEQ ID NO: 451788 - RNA, 32 nt, Human
ggagcgcaggggcagaggccgagacgcuggac

SEQ ID NO: 451789 - RNA, 32 nt, Human
ggagcgccaaccucgaagacaacucagcacug

SEQ ID NO: 451790 - RNA, 20 nt, Human
ggagcgccagcggcugcagg

SEQ ID NO: 451791 - RNA, 25 nt, Human
ggagcgcccaaacacuccaaagggg

SEQ ID NO: 451792 - RNA, 26 nt, Human
ggagcgcccaaacucugcaaaugggc

SEQ ID NO: 451793 - RNA, 26 nt, Human
ggagcgcccagacacugcaaaggcgc

SEQ ID NO: 451794 - RNA, 26 nt, Human
ggagcgcccgagcucugcagaagggc

SEQ ID NO: 451795 - RNA, 17 nt, Human
ggagcgcccgcagacua

SEQ ID NO: 451796 - RNA, 32 nt, Human
ggagcgcccgccgcgguccccaccuccaugga

SEQ ID NO: 451797 - RNA, 21 nt, Human
ggagcgccggggagggggcgg

SEQ ID NO: 451798 - RNA, 23 nt, Human
ggagcgccuacaccucccuggag

SEQ ID NO: 451799 - RNA, 32 nt, Human
ggagcgccuggaggagcuuagagaccccagcc

SEQ ID NO: 451800 - RNA, 32 nt, Human
ggagcgccuggcagcagcaggagcagcagcag

SEQ ID NO: 451801 - RNA, 32 nt, Human
ggagcgccuggcccucccucccuagcccuucc

SEQ ID NO: 451802 - RNA, 22 nt, Human
ggagcgcgacgcggcggcagca

SEQ ID NO: 451803 - RNA, 20 nt, Human
ggagcgcgagcggcgggcgg

SEQ ID NO: 451804 - RNA, 17 nt, Human
ggagcgcgcugggaagg

SEQ ID NO: 451805 - RNA, 32 nt, Human
ggagcgcggagaggaggcuggaagaggaagau

SEQ ID NO: 451806 - RNA, 32 nt, Human
ggagcgcgggcgcgcagagccgaggccgggac

SEQ ID NO: 451807 - RNA, 18 nt, Human
ggagcgcggucucugagg

SEQ ID NO: 451808 - RNA, 32 nt, Human
ggagcgcguggcgggcgucagcgcgguggcca

SEQ ID NO: 451809 - RNA, 32 nt, Human
ggagcgcucagaccucccucccucgcgcaucu

SEQ ID NO: 451810 - RNA, 32 nt, Human
ggagcgcuccacucgcugccgccggagggccg

SEQ ID NO: 451811 - RNA, 32 nt, Human
ggagcgcugggcccaggcaggggcuucugauu

SEQ ID NO: 451812 - RNA, 32 nt, Human
ggagcgcuuuaggcuggccggcggcgcuggga

SEQ ID NO: 451813 - RNA, 32 nt, Human
ggagcggaagggagccacuggccgcgguggca

SEQ ID NO: 451814 - RNA, 32 nt, Human
ggagcggagaaaagaaaccgcuuuggaaaaug

SEQ ID NO: 451815 - RNA, 32 nt, Human
ggagcggagagggaaggaggaggaggaggagc

SEQ ID NO: 451816 - RNA, 32 nt, Human
ggagcggagagggagcgcgcccgccccagccc

SEQ ID NO: 451817 - RNA, 32 nt, Human
ggagcggagaggggaggggagagaguugggcg

SEQ ID NO: 451818 - RNA, 32 nt, Human
ggagcggagccgcggcucgacggcggugcgcu

SEQ ID NO: 451819 - RNA, 32 nt, Human
ggagcggagcgcugcagccaagccgauagcac

SEQ ID NO: 451820 - RNA, 32 nt, Human
ggagcggagcuugccugccugccuguggagac

SEQ ID NO: 451821 - RNA, 32 nt, Human
ggagcggagcuuggcccugcgcccugugcagg

SEQ ID NO: 451822 - RNA, 19 nt, Human
ggagcggaggcgggcgcgg

SEQ ID NO: 451823 - RNA, 32 nt, Human
ggagcggagguggcggcggcggcgguagcggu

SEQ ID NO: 451824 - RNA, 32 nt, Human
ggagcggaucccggggcugggauugcgcgccc

SEQ ID NO: 451825 - RNA, 32 nt, Human
ggagcggcaacuucuaacuuugcuccaagcca

SEQ ID NO: 451826 - RNA, 32 nt, Human
ggagcggcaggagcugcggcuggagaaggaga

SEQ ID NO: 451827 - RNA, 16 nt, Human
ggagcggccccagcca

SEQ ID NO: 451828 - RNA, 32 nt, Human
ggagcggcgccgcgcacuccaacccggcgggc

SEQ ID NO: 451829 - RNA, 19 nt, Human
ggagcggcgcguccuggca

SEQ ID NO: 451830 - RNA, 32 nt, Human
ggagcggcgcugggcgaccagagcagggucga

SEQ ID NO: 451831 - RNA, 20 nt, Human
ggagcggcggccccacaaga

SEQ ID NO: 451832 - RNA, 21 nt, Human
ggagcggcggcgccucaaaga

SEQ ID NO: 451833 - RNA, 19 nt, Human
ggagcggcggcgggggcgg

SEQ ID NO: 451834 - RNA, 22 nt, Human
ggagcggcggcucaugccugua

SEQ ID NO: 451835 - RNA, 32 nt, Human
ggagcggcugcaacgccggugccugaggagcg

SEQ ID NO: 451836 - RNA, 32 nt, Human
ggagcggcugggauggcgcguccgcggccccg

SEQ ID NO: 451837 - RNA, 32 nt, Human
ggagcgggaagaggagaugacaggaagcgacg

SEQ ID NO: 451838 - RNA, 32 nt, Human
ggagcgggagcaccguccagccuccgugcagc

SEQ ID NO: 451839 - RNA, 32 nt, Human
ggagcgggagcgggagccggagcgagagcgcg

SEQ ID NO: 451840 - RNA, 18 nt, Human
ggagcgggagcggugcag

SEQ ID NO: 451841 - RNA, 22 nt, Human
ggagcgggaggagcgcgggcgg

SEQ ID NO: 451842 - RNA, 20 nt, Human
ggagcgggaggagcuggcag

SEQ ID NO: 451843 - RNA, 32 nt, Human
ggagcgggaggcggugguagagagagauaaaa

SEQ ID NO: 451844 - RNA, 22 nt, Human
ggagcgggagggcccgggucgg

SEQ ID NO: 451845 - RNA, 22 nt, Human
ggagcgggagggcgggcggcgg

SEQ ID NO: 451846 - RNA, 22 nt, Human
ggagcgggcagagcgggggcag

SEQ ID NO: 451847 - RNA, 32 nt, Human
ggagcgggcggcggcgggggaggcagaggcgg

SEQ ID NO: 451848 - RNA, 19 nt, Human
ggagcgggcggcugggaga

SEQ ID NO: 451849 - RNA, 19 nt, Human
ggagcgggcgggccugcag

SEQ ID NO: 451850 - RNA, 32 nt, Human
ggagcggggaagcagaagccagagaggggaag

SEQ ID NO: 451851 - RNA, 32 nt, Human
ggagcggggaccgguagccgacugccucuggg

SEQ ID NO: 451852 - RNA, 32 nt, Human
ggagcggggaggcgaggagggggcugugaguc

SEQ ID NO: 451853 - RNA, 32 nt, Human
ggagcggggcaggacuuccaggaggaccccaa

SEQ ID NO: 451854 - RNA, 21 nt, Human
ggagcggggcgggcgggcgcg

SEQ ID NO: 451855 - RNA, 32 nt, Human
ggagcggggcggggcgugcugggaucucgagg

SEQ ID NO: 451856 - RNA, 22 nt, Human
ggagcgggggcggcgggggcgg

SEQ ID NO: 451857 - RNA, 32 nt, Human
ggagcggguggaaaaaggaggcuuugaccagg

SEQ ID NO: 451858 - RNA, 22 nt, Human
ggagcgguggcucacaccugua

SEQ ID NO: 451859 - RNA, 32 nt, Human
ggagcggugugcagaggagguggccugcccgg

SEQ ID NO: 451860 - RNA, 32 nt, Human
ggagcgugagccacuucugcaguccaagcuga

SEQ ID NO: 451861 - RNA, 32 nt, Human
ggagcguggcgcucuguaacuuccugccgucu

SEQ ID NO: 451862 - RNA, 32 nt, Human
ggagcgugggaggcgggaguggaguggaagaa

SEQ ID NO: 451863 - RNA, 32 nt, Human
ggagcguggggaggggguaagggagccagcca

SEQ ID NO: 451864 - RNA, 32 nt, Human
ggagcguugucuggagguuccagggacagggc

SEQ ID NO: 451865 - RNA, 32 nt, Human
ggagcuaaccgcaccccucucccuuucacgga

SEQ ID NO: 451866 - RNA, 32 nt, Human
ggagcuaaggccuucaguguccccuuccuuac

SEQ ID NO: 451867 - RNA, 24 nt, Human
ggagcuaaggugggagaauugcuu

SEQ ID NO: 451868 - RNA, 32 nt, Human
ggagcuaaugguagagcguccuugaggcucca

SEQ ID NO: 451869 - RNA, 32 nt, Human
ggagcuacaccgcugagcugggcagagcugcg

SEQ ID NO: 451870 - RNA, 32 nt, Human
ggagcuacacguggaaauaugagggaagaacc

SEQ ID NO: 451871 - RNA, 32 nt, Human
ggagcuacagagcauuaacaaauacucaucuu

SEQ ID NO: 451872 - RNA, 32 nt, Human
ggagcuacaugcaccucuccuccccucagcca

SEQ ID NO: 451873 - RNA, 32 nt, Human
ggagcuacucucaggcugcaaguaaguaugaa

SEQ ID NO: 451874 - RNA, 32 nt, Human
ggagcuacugcaggaccagaagcacaaagugc

SEQ ID NO: 451875 - RNA, 32 nt, Human
ggagcuagaagaguggccaggagaugaaagca

SEQ ID NO: 451876 - RNA, 19 nt, Human
ggagcuagaaggcuggcug

SEQ ID NO: 451877 - RNA, 32 nt, Human
ggagcuagccugggggcgagccaggguccccc

SEQ ID NO: 451878 - RNA, 32 nt, Human
ggagcuaggacuagccaggacccgcagccgcc

SEQ ID NO: 451879 - RNA, 32 nt, Human
ggagcuagggcugcugccucagcuccaagaca

SEQ ID NO: 451880 - RNA, 32 nt, Human
ggagcuagggcuggagcucugcccaggugccc

SEQ ID NO: 451881 - RNA, 31 nt, Human
ggagcuagugagaggaggaggaggugggcag

SEQ ID NO: 451882 - RNA, 32 nt, Human
ggagcuaucaacaauccuguacucacuugaag

SEQ ID NO: 451883 - RNA, 18 nt, Human
ggagcucacaaauccagu

SEQ ID NO: 451884 - RNA, 32 nt, Human
ggagcucacagaagaccccuggaacccagagc

SEQ ID NO: 451885 - RNA, 32 nt, Human
ggagcucacagaaggggagggagcaccaggcc

SEQ ID NO: 451886 - RNA, 32 nt, Human
ggagcucacugcacuccagcagucaugggacc

SEQ ID NO: 451887 - RNA, 32 nt, Human
ggagcucagagcaucgcugggccugcgccaga

SEQ ID NO: 451888 - RNA, 32 nt, Human
ggagcucagcaaccacuuugcaccaugaggca

SEQ ID NO: 451889 - RNA, 32 nt, Human
ggagcucagcccuccaccuccacagcucaaga

SEQ ID NO: 451890 - RNA, 21 nt, Human
ggagcucagccucucuccuca

SEQ ID NO: 451891 - RNA, 32 nt, Human
ggagcucagccuugccccucaggagcugcaug

SEQ ID NO: 451892 - RNA, 32 nt, Human
ggagcucagcuguguuguguggcaguuuauua

SEQ ID NO: 451893 - RNA, 17 nt, Human
ggagcucaggaaccgag

SEQ ID NO: 451894 - RNA, 32 nt, Human
ggagcucaggaggccgaggcugccuugagcug

SEQ ID NO: 451895 - RNA, 32 nt, Human
ggagcucaggaguucaagagcagccugggcaa

SEQ ID NO: 451896 - RNA, 32 nt, Human
ggagcucagggguggagggcgaugggucggga

SEQ ID NO: 451897 - RNA, 32 nt, Human
ggagcucagucagccacaccuuccugcauccu

SEQ ID NO: 451898 - RNA, 21 nt, Human
ggagcucaguucaucaacuca

SEQ ID NO: 451899 - RNA, 19 nt, Human
ggagcucaguuuucaacuc

SEQ ID NO: 451900 - RNA, 32 nt, Human
ggagcucaucccuuguguucugccaggguggg

SEQ ID NO: 451901 - RNA, 32 nt, Human
ggagcucaugccgaccuuuccccaccaccgca

SEQ ID NO: 451902 - RNA, 24 nt, Human
ggagcucauuugauucauacccca

SEQ ID NO: 451903 - RNA, 32 nt, Human
ggagcuccaagaaaggccacccauagagcuca

SEQ ID NO: 451904 - RNA, 32 nt, Human
ggagcuccaaggcugcagccaggagccccgua

SEQ ID NO: 451905 - RNA, 32 nt, Human
ggagcuccagaagggccagcugggcauauucu

SEQ ID NO: 451906 - RNA, 32 nt, Human
ggagcuccagaggguguuccagggccuggaga

SEQ ID NO: 451907 - RNA, 18 nt, Human
ggagcuccagcucuggga

SEQ ID NO: 451908 - RNA, 32 nt, Human
ggagcucccagaggaaacucuugaccaccagu

SEQ ID NO: 451909 - RNA, 22 nt, Human
ggagcuccccaacuuggacccc

SEQ ID NO: 451910 - RNA, 32 nt, Human
ggagcuccccaaugccuuucugauacaucgcu

SEQ ID NO: 451911 - RNA, 26 nt, Human
ggagcucccugaagauggggcugugu

SEQ ID NO: 451912 - RNA, 32 nt, Human
ggagcuccuccaggagcaggcugggaucccaa

SEQ ID NO: 451913 - RNA, 32 nt, Human
ggagcuccugggaagcccugggugcaggacac

SEQ ID NO: 451914 - RNA, 32 nt, Human
ggagcuccugucccauccacaccagcucccca

SEQ ID NO: 451915 - RNA, 20 nt, Human
ggagcuccugucucccaaaa

SEQ ID NO: 451916 - RNA, 32 nt, Human
ggagcuccuucugccuccuuuccugccccaug

SEQ ID NO: 451917 - RNA, 17 nt, Human
ggagcucgcacggcgcc

SEQ ID NO: 451918 - RNA, 22 nt, Human
ggagcucgcauaccaggccgag

SEQ ID NO: 451919 - RNA, 32 nt, Human
ggagcucgccccuccccucagccugcccgccu

SEQ ID NO: 451920 - RNA, 32 nt, Human
ggagcucgcuucugugcugaagaugcuuugca

SEQ ID NO: 451921 - RNA, 32 nt, Human
ggagcucggauuuuaaggcaguagcuugccga

SEQ ID NO: 451922 - RNA, 32 nt, Human
ggagcucggcggagaccucucccgccagcccu

SEQ ID NO: 451923 - RNA, 32 nt, Human
ggagcucgggaguucaagaccagccugggcaa

SEQ ID NO: 451924 - RNA, 32 nt, Human
ggagcucggucgccgaagcggagggagacucu

SEQ ID NO: 451925 - RNA, 21 nt, Human
ggagcucuaggacaaggggac

SEQ ID NO: 451926 - RNA, 32 nt, Human
ggagcucuccacccacucacauuccguccccg

SEQ ID NO: 451927 - RNA, 32 nt, Human
ggagcucucuaaggagcuaagguccaugggaa

SEQ ID NO: 451928 - RNA, 32 nt, Human
ggagcucucuaaugaagggauaccaaagucuu

SEQ ID NO: 451929 - RNA, 32 nt, Human
ggagcucucuuuuucccguccugcuuucuuuc

SEQ ID NO: 451930 - RNA, 32 nt, Human
ggagcucugaacccagcccacagggaagcaga

SEQ ID NO: 451931 - RNA, 32 nt, Human
ggagcucugagacgccuccugucccacgcucu

SEQ ID NO: 451932 - RNA, 23 nt, Human
ggagcucugcaggagucugcagg

SEQ ID NO: 451933 - RNA, 32 nt, Human
ggagcucugcaggagucugcaggucacccgga

SEQ ID NO: 451934 - RNA, 32 nt, Human
ggagcucugcaguaccacagggccaagaaggu

SEQ ID NO: 451935 - RNA, 21 nt, Human
ggagcucugccagaggggcag

SEQ ID NO: 451936 - RNA, 32 nt, Human
ggagcucugcuggcuccugucugaaccuccuc

SEQ ID NO: 451937 - RNA, 22 nt, Human
ggagcucuggagcccccagagg

SEQ ID NO: 451938 - RNA, 23 nt, Human
ggagcucuggagcccccagagga

SEQ ID NO: 451939 - RNA, 32 nt, Human
ggagcucuggaggcggggcuucgagcguggcu

SEQ ID NO: 451940 - RNA, 20 nt, Human
ggagcucuggagucagagga

SEQ ID NO: 451941 - RNA, 32 nt, Human
ggagcucuggccacugcuucccaugagcugag

SEQ ID NO: 451942 - RNA, 24 nt, Human
ggagcucugggaauuuggagugac

SEQ ID NO: 451943 - RNA, 20 nt, Human
ggagcucugggagcaaggac

SEQ ID NO: 451944 - RNA, 32 nt, Human
ggagcucugggcaacaggaggaggcccggugc

SEQ ID NO: 451945 - RNA, 21 nt, Human
ggagcucuggggaaaaaggac

SEQ ID NO: 451946 - RNA, 32 nt, Human
ggagcucugucgucgguggcugaggcccgagu

SEQ ID NO: 451947 - RNA, 32 nt, Human
ggagcucuguucucgcuccugagcagcugcua

SEQ ID NO: 451948 - RNA, 32 nt, Human
ggagcucuuccugcuucucuccccaucaccau

SEQ ID NO: 451949 - RNA, 32 nt, Human
ggagcucuugcagccagaggcugcaggaaaaa

SEQ ID NO: 451950 - RNA, 32 nt, Human
ggagcucuuggcuggggcugacccugggcagg

SEQ ID NO: 451951 - RNA, 20 nt, Human
ggagcugaacauucaauuca

SEQ ID NO: 451952 - RNA, 32 nt, Human
ggagcugaaccauccccaccucaggguuauau

SEQ ID NO: 451953 - RNA, 32 nt, Human
ggagcugaagguggaggagcuggaggagaagg

SEQ ID NO: 451954 - RNA, 32 nt, Human
ggagcugaagugacagcggaggcggaagcaac

SEQ ID NO: 451955 - RNA, 20 nt, Human
ggagcugaauaugccacuua

SEQ ID NO: 451956 - RNA, 19 nt, Human
ggagcugaaucuucaccca

SEQ ID NO: 451957 - RNA, 20 nt, Human
ggagcugaauuccaagccca

SEQ ID NO: 451958 - RNA, 32 nt, Human
ggagcugagaaaccgagucacugugaaaagau

SEQ ID NO: 451959 - RNA, 21 nt, Human
ggagcugagagaggggggcag

SEQ ID NO: 451960 - RNA, 20 nt, Human
ggagcugagagaucacugca

SEQ ID NO: 451961 - RNA, 19 nt, Human
ggagcugagagggagcuca

SEQ ID NO: 451962 - RNA, 18 nt, Human
ggagcugagaucacacca

SEQ ID NO: 451963 - RNA, 18 nt, Human
ggagcugagaucacgcca

SEQ ID NO: 451964 - RNA, 19 nt, Human
ggagcugagauccagccca

SEQ ID NO: 451965 - RNA, 20 nt, Human
ggagcugagauccagcccag

SEQ ID NO: 451966 - RNA, 19 nt, Human
ggagcugagaugcacguca

SEQ ID NO: 451967 - RNA, 20 nt, Human
ggagcugagcaagaggcuca

SEQ ID NO: 451968 - RNA, 31 nt, Human
ggagcugagcaagggucgcucacuuagaaau

SEQ ID NO: 451969 - RNA, 21 nt, Human
ggagcugagcacaacaugcca

SEQ ID NO: 451970 - RNA, 20 nt, Human
ggagcugagcauaggagcuc

SEQ ID NO: 451971 - RNA, 32 nt, Human
ggagcugagccccagcgugaugcccgaggcuc

SEQ ID NO: 451972 - RNA, 32 nt, Human
ggagcugagcccguggccgcucacaggugucc

SEQ ID NO: 451973 - RNA, 19 nt, Human
ggagcugagccgguccuca

SEQ ID NO: 451974 - RNA, 32 nt, Human
ggagcugagccuaagcccuggcggggcuuugg

SEQ ID NO: 451975 - RNA, 32 nt, Human
ggagcugagcugggaucaccacauggugcugg

SEQ ID NO: 451976 - RNA, 19 nt, Human
ggagcugaggccacacuca

SEQ ID NO: 451977 - RNA, 21 nt, Human
ggagcugagggcaccacccag

SEQ ID NO: 451978 - RNA, 32 nt, Human
ggagcugaggggcagugcggaugccccaggaa

SEQ ID NO: 451979 - RNA, 18 nt, Human
ggagcugaguaguagcca

SEQ ID NO: 451980 - RNA, 18 nt, Human
ggagcugagucccagcca

SEQ ID NO: 451981 - RNA, 21 nt, Human
ggagcugauaccuguguucag

SEQ ID NO: 451982 - RNA, 32 nt, Human
ggagcugauggcuugggaaggagggagucaga

SEQ ID NO: 451983 - RNA, 32 nt, Human
ggagcugcaaggggaaaggacccacuuccaca

SEQ ID NO: 451984 - RNA, 32 nt, Human
ggagcugcagacgcuggcuaggaagcacaggg

SEQ ID NO: 451985 - RNA, 32 nt, Human
ggagcugcaguuggagcuggcauuccugggga

SEQ ID NO: 451986 - RNA, 32 nt, Human
ggagcugccaagagugaagggaagagacagcc

SEQ ID NO: 451987 - RNA, 32 nt, Human
ggagcugccagccugaggugcccacuccgcca

SEQ ID NO: 451988 - RNA, 19 nt, Human
ggagcugccagcgaggcuu

SEQ ID NO: 451989 - RNA, 32 nt, Human
ggagcugccccaccagccauccuugaagagac

SEQ ID NO: 451990 - RNA, 32 nt, Human
ggagcugccccaggcuuuagugcagcugccaa

SEQ ID NO: 451991 - RNA, 32 nt, Human
ggagcugccccaggggcuggacaagcugaccc

SEQ ID NO: 451992 - RNA, 32 nt, Human
ggagcugccuccucucaagagcaguugguugg

SEQ ID NO: 451993 - RNA, 32 nt, Human
ggagcugccugcagagaggccugccacugggg

SEQ ID NO: 451994 - RNA, 32 nt, Human
ggagcugccugggcuccgugucucugagcccc

SEQ ID NO: 451995 - RNA, 32 nt, Human
ggagcugccuggggacguuugccuuggggccc

SEQ ID NO: 451996 - RNA, 32 nt, Human
ggagcugccuggggcagggcucuaccuccccu

SEQ ID NO: 451997 - RNA, 32 nt, Human
ggagcugccugugcuggaggaaucacuuuuua

SEQ ID NO: 451998 - RNA, 32 nt, Human
ggagcugccuuugcaaaccugccuguuggcau

SEQ ID NO: 451999 - RNA, 32 nt, Human
ggagcugcggaggaggggcccgucucuaggag

SEQ ID NO: 452000 - RNA, 24 nt, Human
ggagcugcguuuguuuugccauca

SEQ ID NO: 452001 - RNA, 22 nt, Human
ggagcugcuagaacaaugcuga

SEQ ID NO: 452002 - RNA, 32 nt, Human
ggagcugcugaacuccgagcacagggugaaga

SEQ ID NO: 452003 - RNA, 32 nt, Human
ggagcugcugacuggggcaaagcacucaacag

SEQ ID NO: 452004 - RNA, 32 nt, Human
ggagcugcugccgucagacuccugccucaagc

SEQ ID NO: 452005 - RNA, 32 nt, Human
ggagcugcugcgggcuccccucaggcucugcu

SEQ ID NO: 452006 - RNA, 18 nt, Human
ggagcugcugcugcucca

SEQ ID NO: 452007 - RNA, 32 nt, Human
ggagcugcuggcugagcugcucacacacugga

SEQ ID NO: 452008 - RNA, 32 nt, Human
ggagcugcugggucucagccucguguagacga

SEQ ID NO: 452009 - RNA, 32 nt, Human
ggagcugcugguuuagccuugcaccuggggaa

SEQ ID NO: 452010 - RNA, 32 nt, Human
ggagcugcuguggagccucauccaccgcuucu

SEQ ID NO: 452011 - RNA, 32 nt, Human
ggagcugcuguggcaggugcccccagagugaa

SEQ ID NO: 452012 - RNA, 32 nt, Human
ggagcugcuugcugagguguaaagggucuucu

SEQ ID NO: 452013 - RNA, 32 nt, Human
ggagcugcuuuccugagggacucgaaauucuc

SEQ ID NO: 452014 - RNA, 32 nt, Human
ggagcugcuuucuccccacuggcugggcugca

SEQ ID NO: 452015 - RNA, 32 nt, Human
ggagcuggaaaccugggguggguuggccaaag

SEQ ID NO: 452016 - RNA, 32 nt, Human
ggagcuggaagaggaggaggaggagaggcggc

SEQ ID NO: 452017 - RNA, 32 nt, Human
ggagcuggaagaggccgugggccgcauccacc

SEQ ID NO: 452018 - RNA, 30 nt, Human
ggagcuggaagccacguggggccagacagg

SEQ ID NO: 452019 - RNA, 32 nt, Human
ggagcuggacacugcccccacccuugaccuca

SEQ ID NO: 452020 - RNA, 32 nt, Human
ggagcuggaccacagugggacaaggacaccuc

SEQ ID NO: 452021 - RNA, 32 nt, Human
ggagcuggaccaggagguggaggcucagggga

SEQ ID NO: 452022 - RNA, 32 nt, Human
ggagcuggaccuggaggcgccgccgcgacagc

SEQ ID NO: 452023 - RNA, 32 nt, Human
ggagcuggagaaacaacaucuucuggaaggga

SEQ ID NO: 452024 - RNA, 32 nt, Human
ggagcuggaggccgcccaggagcgggccaagc

SEQ ID NO: 452025 - RNA, 32 nt, Human
ggagcuggaggcggaggcagcuggggaggucc

SEQ ID NO: 452026 - RNA, 32 nt, Human
ggagcuggaggggacacuggcccagggagagc

SEQ ID NO: 452027 - RNA, 32 nt, Human
ggagcuggagucucccccuuccuccugugccc

SEQ ID NO: 452028 - RNA, 32 nt, Human
ggagcuggagugagcugagcagaaguuuugug

SEQ ID NO: 452029 - RNA, 32 nt, Human
ggagcuggagugauuccgaggacagauuccau

SEQ ID NO: 452030 - RNA, 32 nt, Human
ggagcuggauuugggagcucugcuugccgacu

SEQ ID NO: 452031 - RNA, 32 nt, Human
ggagcuggccaauucucccaggaguccuggcc

SEQ ID NO: 452032 - RNA, 18 nt, Human
ggagcuggcccucaacuc

SEQ ID NO: 452033 - RNA, 32 nt, Human
ggagcuggcggcagugacaggaggcgcgaacc

SEQ ID NO: 452034 - RNA, 32 nt, Human
ggagcuggcugcagacacccacucaguccagu

SEQ ID NO: 452035 - RNA, 19 nt, Human
ggagcuggcuggcugggag

SEQ ID NO: 452036 - RNA, 32 nt, Human
ggagcuggcuugaguuucucaaaagccaucgg

SEQ ID NO: 452037 - RNA, 32 nt, Human
ggagcugggaaaagggaggcagaggaggcaga

SEQ ID NO: 452038 - RNA, 19 nt, Human
ggagcugggaaguggggug

SEQ ID NO: 452039 - RNA, 32 nt, Human
ggagcugggaccccuccccuccaacacacaua

SEQ ID NO: 452040 - RNA, 32 nt, Human
ggagcugggagagaggccgggguuagggugau

SEQ ID NO: 452041 - RNA, 16 nt, Human
ggagcugggagccugg

SEQ ID NO: 452042 - RNA, 32 nt, Human
ggagcugggauuauaggugcaugcuaccacgc

SEQ ID NO: 452043 - RNA, 32 nt, Human
ggagcugggauuugaaccaggaucugucagcg

SEQ ID NO: 452044 - RNA, 16 nt, Human
ggagcugggcacucca

SEQ ID NO: 452045 - RNA, 19 nt, Human
ggagcugggcagagccugg

SEQ ID NO: 452046 - RNA, 32 nt, Human
ggagcugggcagggcacagcagggcaggagug

SEQ ID NO: 452047 - RNA, 20 nt, Human
ggagcugggccaaguacgac

SEQ ID NO: 452048 - RNA, 19 nt, Human
ggagcugggccaccugcca

SEQ ID NO: 452049 - RNA, 20 nt, Human
ggagcugggccccaaccuca

SEQ ID NO: 452050 - RNA, 32 nt, Human
ggagcugggcccugccacccaggccgggcuag

SEQ ID NO: 452051 - RNA, 32 nt, Human
ggagcugggccugggaacagcccuggcuuggu

SEQ ID NO: 452052 - RNA, 32 nt, Human
ggagcuggggagaaggaaggggagcaaggaga

SEQ ID NO: 452053 - RNA, 32 nt, Human
ggagcuggggagacaaaaauguggauaacaac

SEQ ID NO: 452054 - RNA, 32 nt, Human
ggagcuggggagucugcuggaggccugggaug

SEQ ID NO: 452055 - RNA, 32 nt, Human
ggagcuggggcugagaugcuccagguuuugag

SEQ ID NO: 452056 - RNA, 32 nt, Human
ggagcuggggcugcagcuggugguguuuccaa

SEQ ID NO: 452057 - RNA, 32 nt, Human
ggagcugggggaggcaguggcggcuggaguag

SEQ ID NO: 452058 - RNA, 32 nt, Human
ggagcuggggugcggcccugugcuccaggccc

SEQ ID NO: 452059 - RNA, 31 nt, Human
ggagcugggguggaagaggggagggggacac

SEQ ID NO: 452060 - RNA, 32 nt, Human
ggagcuggguauuguuaaaaacugcauuaugc

SEQ ID NO: 452061 - RNA, 32 nt, Human
ggagcugggucaccagggccaucagcugagcu

SEQ ID NO: 452062 - RNA, 32 nt, Human
ggagcugggucugagccccagcugaagggacu

SEQ ID NO: 452063 - RNA, 32 nt, Human
ggagcugggugagucaugaggggucagggggu

SEQ ID NO: 452064 - RNA, 18 nt, Human
ggagcuggguucaucuca

SEQ ID NO: 452065 - RNA, 32 nt, Human
ggagcugguaucacagaugaagauuauagagg

SEQ ID NO: 452066 - RNA, 32 nt, Human
ggagcuggugagagagagcaguuaaggcaagc

SEQ ID NO: 452067 - RNA, 32 nt, Human
ggagcugguggaggggagggaggagacaucuc

SEQ ID NO: 452068 - RNA, 32 nt, Human
ggagcugguggccagacccagaaaggccagau

SEQ ID NO: 452069 - RNA, 32 nt, Human
ggagcugguggugggagaaugacggcagggac

SEQ ID NO: 452070 - RNA, 32 nt, Human
ggagcugguguggcccacaaagggucggagag

SEQ ID NO: 452071 - RNA, 32 nt, Human
ggagcugguguuuuucagccagacagaggcau

SEQ ID NO: 452072 - RNA, 32 nt, Human
ggagcugguguuuuuccugccuaggcggagac

SEQ ID NO: 452073 - RNA, 32 nt, Human
ggagcugguuccucucucccacccuaagggca

SEQ ID NO: 452074 - RNA, 32 nt, Human
ggagcugguugcuucucugcugugcuuaucua

SEQ ID NO: 452075 - RNA, 21 nt, Human
ggagcugucagcaaggagcag

SEQ ID NO: 452076 - RNA, 16 nt, Human
ggagcugucaggugga

SEQ ID NO: 452077 - RNA, 32 nt, Human
ggagcuguccccucacagaggcagguuccggg

SEQ ID NO: 452078 - RNA, 18 nt, Human
ggagcuguccucaacuca

SEQ ID NO: 452079 - RNA, 32 nt, Human
ggagcugucucagcaagaggagaccuggggcu

SEQ ID NO: 452080 - RNA, 23 nt, Human
ggagcugugacagcagagagcag

SEQ ID NO: 452081 - RNA, 23 nt, Human
ggagcugugcccggugccugcag

SEQ ID NO: 452082 - RNA, 32 nt, Human
ggagcuguggccucggcagcugugggaaugcg

SEQ ID NO: 452083 - RNA, 32 nt, Human
ggagcuguggggagcucagagcugagauccua

SEQ ID NO: 452084 - RNA, 32 nt, Human
ggagcuguggucagaggaggagccggcgccug

SEQ ID NO: 452085 - RNA, 32 nt, Human
ggagcuguguaccaaucgucucagccuucauu

SEQ ID NO: 452086 - RNA, 32 nt, Human
ggagcugugucaccaggcucuugcuucguggc

SEQ ID NO: 452087 - RNA, 32 nt, Human
ggagcuuaaccaugccuccauugggaagucua

SEQ ID NO: 452088 - RNA, 32 nt, Human
ggagcuuacaauccuggcuggaggcaggggag

SEQ ID NO: 452089 - RNA, 32 nt, Human
ggagcuuagcuggcucuuauccugugauaagc

SEQ ID NO: 452090 - RNA, 32 nt, Human
ggagcuuaggguuugugagacagaacaucagg

SEQ ID NO: 452091 - RNA, 32 nt, Human
ggagcuuauggucuagugagggagacagagga

SEQ ID NO: 452092 - RNA, 32 nt, Human
ggagcuucaaaacucggccauggccaaggucu

SEQ ID NO: 452093 - RNA, 32 nt, Human
ggagcuucacacaacagaaacugccucgcagu

SEQ ID NO: 452094 - RNA, 32 nt, Human
ggagcuucaccaagggcuuuucagcagugaag

SEQ ID NO: 452095 - RNA, 32 nt, Human
ggagcuucaccuuuuugucuuggcuuuucuuu

SEQ ID NO: 452096 - RNA, 23 nt, Human
ggagcuucacgcaggccacccag

SEQ ID NO: 452097 - RNA, 32 nt, Human
ggagcuucagugcugugugcucuuggccucca

SEQ ID NO: 452098 - RNA, 32 nt, Human
ggagcuucauagaccgauugcaucagaaucuc

SEQ ID NO: 452099 - RNA, 32 nt, Human
ggagcuucauuuccuucaagugggccuuccug

SEQ ID NO: 452100 - RNA, 19 nt, Human
ggagcuuccuccccucuca

SEQ ID NO: 452101 - RNA, 32 nt, Human
ggagcuuccucuuucccugaacuaacucaguc

SEQ ID NO: 452102 - RNA, 32 nt, Human
ggagcuuccugagggcagggaggcagauggga

SEQ ID NO: 452103 - RNA, 32 nt, Human
ggagcuuccugcagccccgaccucucagguua

SEQ ID NO: 452104 - RNA, 32 nt, Human
ggagcuuccugccucugcuccgacacccggca

SEQ ID NO: 452105 - RNA, 32 nt, Human
ggagcuuccugggcccuucccugggccucagg

SEQ ID NO: 452106 - RNA, 22 nt, Human
ggagcuucggcagggccugcag

SEQ ID NO: 452107 - RNA, 32 nt, Human
ggagcuucucggccauccgcugugaguuuugc

SEQ ID NO: 452108 - RNA, 32 nt, Human
ggagcuucucugcuucaugucuugcuucccac

SEQ ID NO: 452109 - RNA, 19 nt, Human
ggagcuucucuuuaacuca

SEQ ID NO: 452110 - RNA, 32 nt, Human
ggagcuugaaguuuauaucuaaaucauucaaa

SEQ ID NO: 452111 - RNA, 32 nt, Human
ggagcuugaauccagcacccaccucaugucug

SEQ ID NO: 452112 - RNA, 32 nt, Human
ggagcuugaggcaggccgauugcuugagccca

SEQ ID NO: 452113 - RNA, 32 nt, Human
ggagcuugcaggaaccagcaaugagaaggcca

SEQ ID NO: 452114 - RNA, 32 nt, Human
ggagcuugcccucagccccuucaucugccgag

SEQ ID NO: 452115 - RNA, 32 nt, Human
ggagcuugcccuucugggguccugguuccuga

SEQ ID NO: 452116 - RNA, 32 nt, Human
ggagcuugcugaggcaaggccgaggauaagga

SEQ ID NO: 452117 - RNA, 32 nt, Human
ggagcuugcugggagccaccucccaggucauu

SEQ ID NO: 452118 - RNA, 32 nt, Human
ggagcuuggauuuuaaggcaguagcuugcuga

SEQ ID NO: 452119 - RNA, 19 nt, Human
ggagcuuggcaggguccca

SEQ ID NO: 452120 - RNA, 32 nt, Human
ggagcuuggggagaggaugggagugggcagag

SEQ ID NO: 452121 - RNA, 32 nt, Human
ggagcuuggugaggagggugggccuagggcuu

SEQ ID NO: 452122 - RNA, 32 nt, Human
ggagcuugucaccauuggacagucucccugau

SEQ ID NO: 452123 - RNA, 32 nt, Human
ggagcuugucaggcuuaucuugcugaagaugg

SEQ ID NO: 452124 - RNA, 32 nt, Human
ggagcuugugauguauuucugccuccuggagu

SEQ ID NO: 452125 - RNA, 32 nt, Human
ggagcuuuacucuucucucucuuacacaaugc

SEQ ID NO: 452126 - RNA, 32 nt, Human
ggagcuuucauaauuaccuuaguucuccaugc

SEQ ID NO: 452127 - RNA, 32 nt, Human
ggagcuuuccaggccagcuuugaggauaagcu

SEQ ID NO: 452128 - RNA, 32 nt, Human
ggagcuuucugggccagcuuugaggauaagcu

SEQ ID NO: 452129 - RNA, 32 nt, Human
ggagcuuugccucucuaggccggcagcgccuc

SEQ ID NO: 452130 - RNA, 32 nt, Human
ggagcuuuuccccuuugcucagcagguuucuc

SEQ ID NO: 452131 - RNA, 32 nt, Human
ggagcuuuugauugcugaccugugucguacca

SEQ ID NO: 452132 - RNA, 32 nt, Human
ggagcuuuuucagaaacagggcagcagugggg

SEQ ID NO: 452133 - RNA, 32 nt, Human
ggaggaaaaauuaaggggagagaggaaaacaa

SEQ ID NO: 452134 - RNA, 32 nt, Human
ggaggaaaaauuagcucuuugaagagaaagua

SEQ ID NO: 452135 - RNA, 32 nt, Human
ggaggaaaacucaguaagaauuauauuagucu

SEQ ID NO: 452136 - RNA, 32 nt, Human
ggaggaaaagagaguccugcuucugccuggcu

SEQ ID NO: 452137 - RNA, 32 nt, Human
ggaggaaaagcagucaggccacacaacauugu

SEQ ID NO: 452138 - RNA, 24 nt, Human
ggaggaaacauuauaaagugcucu

SEQ ID NO: 452139 - RNA, 32 nt, Human
ggaggaaacuuccuuccaucuucucugcauaa

SEQ ID NO: 452140 - RNA, 32 nt, Human
ggaggaaagagacagagacaaaggcacagcgg

SEQ ID NO: 452141 - RNA, 22 nt, Human
ggaggaaaggcgggacacagcg

SEQ ID NO: 452142 - RNA, 32 nt, Human
ggaggaaagggggagauugaggugggagagag

SEQ ID NO: 452143 - RNA, 32 nt, Human
ggaggaaauacagcuagaacaaaggggaggaa

SEQ ID NO: 452144 - RNA, 32 nt, Human
ggaggaaauaccaaaugcauuguuguucugcu

SEQ ID NO: 452145 - RNA, 32 nt, Human
ggaggaaauagcaagguuaagaugugugaaua

SEQ ID NO: 452146 - RNA, 19 nt, Human
ggaggaaauggcggggagg

SEQ ID NO: 452147 - RNA, 32 nt, Human
ggaggaaauguucauucagugguagcuauuuc

SEQ ID NO: 452148 - RNA, 20 nt, Human
ggaggaacaggaagagaaga

SEQ ID NO: 452149 - RNA, 31 nt, Human
ggaggaacauagcaaaguaggagggacagag

SEQ ID NO: 452150 - RNA, 32 nt, Human
ggaggaacaugcagucuccugucucaugguuu

SEQ ID NO: 452151 - RNA, 32 nt, Human
ggaggaacauggagaggagagcagcgggccca

SEQ ID NO: 452152 - RNA, 32 nt, Human
ggaggaaccagaaaaguggccucuucccccaa

SEQ ID NO: 452153 - RNA, 32 nt, Human
ggaggaacccuccaccaaugagagaugggaau

SEQ ID NO: 452154 - RNA, 32 nt, Human
ggaggaaccuugagcccgggaggcagagguug

SEQ ID NO: 452155 - RNA, 32 nt, Human
ggaggaacguggucaacucacaccugccucuu

SEQ ID NO: 452156 - RNA, 32 nt, Human
ggaggaacucaagcucagcuucugccuccugu

SEQ ID NO: 452157 - RNA, 32 nt, Human
ggaggaacucagaagagaacagccuggggcaa

SEQ ID NO: 452158 - RNA, 32 nt, Human
ggaggaacucuacaaccugaguuugccuuugu

SEQ ID NO: 452159 - RNA, 21 nt, Human
ggaggaacuggaaggugcuuu

SEQ ID NO: 452160 - RNA, 32 nt, Human
ggaggaacugggaggcagguuuggaggcugca

SEQ ID NO: 452161 - RNA, 32 nt, Human
ggaggaacugggccuccgcuucccagcaacgc

SEQ ID NO: 452162 - RNA, 32 nt, Human
ggaggaacuguacugcccccgugucacccccg

SEQ ID NO: 452163 - RNA, 32 nt, Human
ggaggaacuuaaagggcugaguucugaggcgc

SEQ ID NO: 452164 - RNA, 22 nt, Human
ggaggaagaaagggagagaggg

SEQ ID NO: 452165 - RNA, 32 nt, Human
ggaggaagaagaaaaagugcucagggauuuau

SEQ ID NO: 452166 - RNA, 32 nt, Human
ggaggaagaagaggaggaggagaaagaagcag

SEQ ID NO: 452167 - RNA, 32 nt, Human
ggaggaagaagaggaggaggaggagauggugg

SEQ ID NO: 452168 - RNA, 26 nt, Human
ggaggaagaagaggaggaggaggagg

SEQ ID NO: 452169 - RNA, 32 nt, Human
ggaggaagaagaggaggaggaggaggaggagg

SEQ ID NO: 452170 - RNA, 21 nt, Human
ggaggaagaagaggaggaggg

SEQ ID NO: 452171 - RNA, 32 nt, Human
ggaggaagaagaggcgagaacgauccccgaac

SEQ ID NO: 452172 - RNA, 32 nt, Human
ggaggaagaagccagaugacagucaggagcuc

SEQ ID NO: 452173 - RNA, 17 nt, Human
ggaggaagaagcgggug

SEQ ID NO: 452174 - RNA, 32 nt, Human
ggaggaagaaggaagagaggcagaagacuagg

SEQ ID NO: 452175 - RNA, 24 nt, Human
ggaggaagaccuggggugggggug

SEQ ID NO: 452176 - RNA, 32 nt, Human
ggaggaagacugccucuccaucgcugucagag

SEQ ID NO: 452177 - RNA, 32 nt, Human
ggaggaagagagaggaagggugagggugaggc

SEQ ID NO: 452178 - RNA, 32 nt, Human
ggaggaagagaugacccaagauuaggcagaug

SEQ ID NO: 452179 - RNA, 32 nt, Human
ggaggaagaggaagaguggggauggagaaagg

SEQ ID NO: 452180 - RNA, 32 nt, Human
ggaggaagaggaaggaugaagaaaaggaagaa

SEQ ID NO: 452181 - RNA, 32 nt, Human
ggaggaagaggaaguaggaagaaugcaggagg

SEQ ID NO: 452182 - RNA, 32 nt, Human
ggaggaagaggagaaagagggagggagauggg

SEQ ID NO: 452183 - RNA, 32 nt, Human
ggaggaagaggaggacaaaaagggggaggaga

SEQ ID NO: 452184 - RNA, 32 nt, Human
ggaggaagaggaggagaagguagcuacagcaa

SEQ ID NO: 452185 - RNA, 32 nt, Human
ggaggaagaggaggaggaagaggacuucucac

SEQ ID NO: 452186 - RNA, 32 nt, Human
ggaggaagaggaggaggaagaggaggaagagg

SEQ ID NO: 452187 - RNA, 32 nt, Human
ggaggaagaggaggaggaggaagaggggagca

SEQ ID NO: 452188 - RNA, 32 nt, Human
ggaggaagaggaggaggaggaagggagcacca

SEQ ID NO: 452189 - RNA, 32 nt, Human
ggaggaagaggaggaggaggaggaggaagcug

SEQ ID NO: 452190 - RNA, 32 nt, Human
ggaggaagaggaggaggaggaggaggcugggu

SEQ ID NO: 452191 - RNA, 26 nt, Human
ggaggaagaggggaaugcacaucuuu

SEQ ID NO: 452192 - RNA, 32 nt, Human
ggaggaagagguggaggaggaggaggaagagg

SEQ ID NO: 452193 - RNA, 32 nt, Human
ggaggaagagguggaggaggaggaggaggagg

SEQ ID NO: 452194 - RNA, 32 nt, Human
ggaggaagagucaggcucacagcugggguggc

SEQ ID NO: 452195 - RNA, 32 nt, Human
ggaggaagagugggagggagggcuggggaugg

SEQ ID NO: 452196 - RNA, 32 nt, Human
ggaggaagaguuugggggcuguggagggaagg

SEQ ID NO: 452197 - RNA, 21 nt, Human
ggaggaagcagagcagugcuu

SEQ ID NO: 452198 - RNA, 32 nt, Human
ggaggaagcagcacuaaagcacucugaaucaa

SEQ ID NO: 452199 - RNA, 32 nt, Human
ggaggaagcagcacuaaagcacucugagucaa

SEQ ID NO: 452200 - RNA, 21 nt, Human
ggaggaagccggccacacucu

SEQ ID NO: 452201 - RNA, 20 nt, Human
ggaggaagcgguuagugcuu

SEQ ID NO: 452202 - RNA, 20 nt, Human
ggaggaagcgucagugcccu

SEQ ID NO: 452203 - RNA, 24 nt, Human
ggaggaagcucuggaucacaguug

SEQ ID NO: 452204 - RNA, 32 nt, Human
ggaggaagcugaagcgggcagaucacuugagg

SEQ ID NO: 452205 - RNA, 22 nt, Human
ggaggaagcugacacggagaug

SEQ ID NO: 452206 - RNA, 32 nt, Human
ggaggaagcuggagagagcacagugaaauuga

SEQ ID NO: 452207 - RNA, 21 nt, Human
ggaggaagcuggguaggcccu

SEQ ID NO: 452208 - RNA, 32 nt, Human
ggaggaagcuguccuugcaccccuggucucgg

SEQ ID NO: 452209 - RNA, 32 nt, Human
ggaggaagcuguucuccccaccccaggugccu

SEQ ID NO: 452210 - RNA, 32 nt, Human
ggaggaagcuuauuagguucacuguugaauga

SEQ ID NO: 452211 - RNA, 24 nt, Human
ggaggaaggaaacgaacgaggggg

SEQ ID NO: 452212 - RNA, 24 nt, Human
ggaggaaggaagcagggaagaggg

SEQ ID NO: 452213 - RNA, 23 nt, Human
ggaggaaggaagccaagagaggg

SEQ ID NO: 452214 - RNA, 32 nt, Human
ggaggaaggaagcgcagugacagugccuaagu

SEQ ID NO: 452215 - RNA, 32 nt, Human
ggaggaaggaagcggcggcgcggcgggcacag

SEQ ID NO: 452216 - RNA, 32 nt, Human
ggaggaaggaaggaagaaggaugggucaauga

SEQ ID NO: 452217 - RNA, 22 nt, Human
ggaggaaggaaggacuggaagg

SEQ ID NO: 452218 - RNA, 23 nt, Human
ggaggaaggaagggagggagggg

SEQ ID NO: 452219 - RNA, 32 nt, Human
ggaggaaggagaagaaguaaaagugcgaagag

SEQ ID NO: 452220 - RNA, 22 nt, Human
ggaggaaggagagaaggggagg

SEQ ID NO: 452221 - RNA, 32 nt, Human
ggaggaaggagagaaggggaggagggcggggg

SEQ ID NO: 452222 - RNA, 23 nt, Human
ggaggaaggagagaggaagcagg

SEQ ID NO: 452223 - RNA, 32 nt, Human
ggaggaaggagagaggaagcaggugagggccg

SEQ ID NO: 452224 - RNA, 32 nt, Human
ggaggaaggagaggaggaugaaggagaagaug

SEQ ID NO: 452225 - RNA, 24 nt, Human
ggaggaaggaggacccaggacagg

SEQ ID NO: 452226 - RNA, 21 nt, Human
ggaggaaggaggacccgugcg

SEQ ID NO: 452227 - RNA, 22 nt, Human
ggaggaaggaggagacagaagg

SEQ ID NO: 452228 - RNA, 23 nt, Human
ggaggaaggaggcacagaccggg

SEQ ID NO: 452229 - RNA, 24 nt, Human
ggaggaaggaggccacggagcggg

SEQ ID NO: 452230 - RNA, 32 nt, Human
ggaggaaggagggagagggaaguaggaaagaa

SEQ ID NO: 452231 - RNA, 32 nt, Human
ggaggaaggagguggguguuaagcgauuggug

SEQ ID NO: 452232 - RNA, 32 nt, Human
ggaggaaggcagcuagaaaugggagggaagcu

SEQ ID NO: 452233 - RNA, 32 nt, Human
ggaggaaggccucuguaucaccccaguacucu

SEQ ID NO: 452234 - RNA, 32 nt, Human
ggaggaaggcggggaguccagguuccgccccg

SEQ ID NO: 452235 - RNA, 18 nt, Human
ggaggaaggcgggggagg

SEQ ID NO: 452236 - RNA, 21 nt, Human
ggaggaaggcguauaaggaug

SEQ ID NO: 452237 - RNA, 32 nt, Human
ggaggaaggcugccaggagcugaggggcuggc

SEQ ID NO: 452238 - RNA, 19 nt, Human
ggaggaaggggacagaggg

SEQ ID NO: 452239 - RNA, 32 nt, Human
ggaggaaggggcaggaggaaggguugagguua

SEQ ID NO: 452240 - RNA, 19 nt, Human
ggaggaaggggcugggagg

SEQ ID NO: 452241 - RNA, 20 nt, Human
ggaggaagggggcauggagc

SEQ ID NO: 452242 - RNA, 32 nt, Human
ggaggaagguaaaggagaagagagggaggggu

SEQ ID NO: 452243 - RNA, 23 nt, Human
ggaggaagguacuugaugggaug

SEQ ID NO: 452244 - RNA, 24 nt, Human
ggaggaaggucuggcauugggaug

SEQ ID NO: 452245 - RNA, 21 nt, Human
ggaggaagguggccauggaug

SEQ ID NO: 452246 - RNA, 24 nt, Human
ggaggaaguagcuggacaggcccu

SEQ ID NO: 452247 - RNA, 32 nt, Human
ggaggaaguauacacccccgugugagaugguc

SEQ ID NO: 452248 - RNA, 31 nt, Human
ggaggaagugagaggugaacucagccuggga

SEQ ID NO: 452249 - RNA, 32 nt, Human
ggaggaagugagcguggggcucagggaccagg

SEQ ID NO: 452250 - RNA, 32 nt, Human
ggaggaagugggcucugaggcugcagggcugg

SEQ ID NO: 452251 - RNA, 19 nt, Human
ggaggaagugggugagcuc

SEQ ID NO: 452252 - RNA, 32 nt, Human
ggaggaaguuccugcagaugaagcgcaggaaa

SEQ ID NO: 452253 - RNA, 24 nt, Human
ggaggaaguucugcccggcgcucu

SEQ ID NO: 452254 - RNA, 24 nt, Human
ggaggaaguucugccgggcgcucu

SEQ ID NO: 452255 - RNA, 23 nt, Human
ggaggaaguuuuggaaagaguuc

SEQ ID NO: 452256 - RNA, 26 nt, Human
ggaggaauaccagggccacggagggg

SEQ ID NO: 452257 - RNA, 32 nt, Human
ggaggaauaugggagcguuucgcucuccuugu

SEQ ID NO: 452258 - RNA, 32 nt, Human
ggaggaaucacuucccucagaacccagccaag

SEQ ID NO: 452259 - RNA, 32 nt, Human
ggaggaaucacuuuuuaggcgcuuguuuugga

SEQ ID NO: 452260 - RNA, 20 nt, Human
ggaggaaugagaggugggga

SEQ ID NO: 452261 - RNA, 32 nt, Human
ggaggaaugccauuaaagugaacuccccaccu

SEQ ID NO: 452262 - RNA, 18 nt, Human
ggaggaaugccuggggga

SEQ ID NO: 452263 - RNA, 22 nt, Human
ggaggaauguuugguugggaga

SEQ ID NO: 452264 - RNA, 32 nt, Human
ggaggaauucugaagccauugucuccuugagu

SEQ ID NO: 452265 - RNA, 24 nt, Human
ggaggaauucuuggaugguguccu

SEQ ID NO: 452266 - RNA, 32 nt, Human
ggaggaauugggcagcuguugcuuuggaucug

SEQ ID NO: 452267 - RNA, 32 nt, Human
ggaggaauuucuguugagcugaaaugcaccug

SEQ ID NO: 452268 - RNA, 32 nt, Human
ggaggaauuuuacugacccagcauccagauga

SEQ ID NO: 452269 - RNA, 32 nt, Human
ggaggacaacacugccuuucaaacuuuuuacu

SEQ ID NO: 452270 - RNA, 32 nt, Human
ggaggacaagagccuuagccaaugacaacuca

SEQ ID NO: 452271 - RNA, 32 nt, Human
ggaggacaaggcaggcacacaaauggccagga

SEQ ID NO: 452272 - RNA, 32 nt, Human
ggaggacacacguugcacauucuccaaauauc

SEQ ID NO: 452273 - RNA, 32 nt, Human
ggaggacacucccaucagaacuuggcagccuu

SEQ ID NO: 452274 - RNA, 32 nt, Human
ggaggacagagggagacagggcugcuccccaa

SEQ ID NO: 452275 - RNA, 32 nt, Human
ggaggacagcacagaucaaugaaaccagcaga

SEQ ID NO: 452276 - RNA, 32 nt, Human
ggaggacagcagcauggagaaagauccuagaa

SEQ ID NO: 452277 - RNA, 32 nt, Human
ggaggacagcgagaagaaaggaagagaaaugc

SEQ ID NO: 452278 - RNA, 32 nt, Human
ggaggacaggguggcccuggggacaagaggga

SEQ ID NO: 452279 - RNA, 20 nt, Human
ggaggacaggucaggugagg

SEQ ID NO: 452280 - RNA, 32 nt, Human
ggaggacagucacugcaaucucuuuaccaccu

SEQ ID NO: 452281 - RNA, 32 nt, Human
ggaggacagucugcauuacucagucuacugau

SEQ ID NO: 452282 - RNA, 32 nt, Human
ggaggacagugccaaccuccuccuggggaucc

SEQ ID NO: 452283 - RNA, 32 nt, Human
ggaggacauguggccucaggaagccugggggu

SEQ ID NO: 452284 - RNA, 32 nt, Human
ggaggacauguggccucaggaagccugggugu

SEQ ID NO: 452285 - RNA, 17 nt, Human
ggaggacauucaaacca

SEQ ID NO: 452286 - RNA, 32 nt, Human
ggaggacauuuccacugucuucccuggcagcu

SEQ ID NO: 452287 - RNA, 32 nt, Human
ggaggaccacagaagcuuuggcaccgaggauc

SEQ ID NO: 452288 - RNA, 32 nt, Human
ggaggaccagcagaggauuaaaggugacuggg

SEQ ID NO: 452289 - RNA, 32 nt, Human
ggaggaccaggaucugaacccaacugggucuc

SEQ ID NO: 452290 - RNA, 23 nt, Human
ggaggacccagacagcgugcccc

SEQ ID NO: 452291 - RNA, 32 nt, Human
ggaggacccagaggaggagacgaaggggaagg

SEQ ID NO: 452292 - RNA, 32 nt, Human
ggaggacccagccacccaagggucgucuucug

SEQ ID NO: 452293 - RNA, 32 nt, Human
ggaggaccccgagggcugaggagcagccagga

SEQ ID NO: 452294 - RNA, 32 nt, Human
ggaggacccuggccugagcgagcugcugaagg

SEQ ID NO: 452295 - RNA, 32 nt, Human
ggaggacccuggccugagcgagcugcugcagg

SEQ ID NO: 452296 - RNA, 32 nt, Human
ggaggacccugggcgugauucucccucccugg

SEQ ID NO: 452297 - RNA, 32 nt, Human
ggaggaccgagaggggucucaggcuggcgauu

SEQ ID NO: 452298 - RNA, 21 nt, Human
ggaggaccgcuugagcccagg

SEQ ID NO: 452299 - RNA, 22 nt, Human
ggaggaccguucucugucccca

SEQ ID NO: 452300 - RNA, 32 nt, Human
ggaggaccuccaggacugagacugggcucugu

SEQ ID NO: 452301 - RNA, 32 nt, Human
ggaggaccugcucugcccucuccccaccccuu

SEQ ID NO: 452302 - RNA, 24 nt, Human
ggaggaccugcugcagcugggagg

SEQ ID NO: 452303 - RNA, 32 nt, Human
ggaggaccuggguuugaguccuggaucacccc

SEQ ID NO: 452304 - RNA, 32 nt, Human
ggaggaccugguggccuccucauucucuuuug

SEQ ID NO: 452305 - RNA, 32 nt, Human
ggaggaccugguggggaggaggccguguuaca

SEQ ID NO: 452306 - RNA, 19 nt, Human
ggaggacgcagcccacugc

SEQ ID NO: 452307 - RNA, 21 nt, Human
ggaggacgccugucgacgacc

SEQ ID NO: 452308 - RNA, 32 nt, Human
ggaggacgcggaagaggagcugugggaagggg

SEQ ID NO: 452309 - RNA, 32 nt, Human
ggaggacuacugggggcuggccagucagggag

SEQ ID NO: 452310 - RNA, 32 nt, Human
ggaggacucauuuuaccugacuucaagacuua

SEQ ID NO: 452311 - RNA, 32 nt, Human
ggaggacucccaucaccuucucucagaacaaa

SEQ ID NO: 452312 - RNA, 32 nt, Human
ggaggacuccugccuuuccuguuuagacaccc

SEQ ID NO: 452313 - RNA, 19 nt, Human
ggaggacucugggggcuag

SEQ ID NO: 452314 - RNA, 32 nt, Human
ggaggacugcuugaagccagaaguucaagacc

SEQ ID NO: 452315 - RNA, 21 nt, Human
ggaggacugcuugagcccagg

SEQ ID NO: 452316 - RNA, 32 nt, Human
ggaggacuggccucuaggaguugaggaccuca

SEQ ID NO: 452317 - RNA, 32 nt, Human
ggaggacuggcguugccuuuucucccagcuac

SEQ ID NO: 452318 - RNA, 32 nt, Human
ggaggacugguuuccagccauaccuguucugg

SEQ ID NO: 452319 - RNA, 19 nt, Human
ggaggacuuccaauggaga

SEQ ID NO: 452320 - RNA, 32 nt, Human
ggaggacuucuuggaggaggugguggcugggc

SEQ ID NO: 452321 - RNA, 32 nt, Human
ggaggacuugcuggggaccagaauccaaacgg

SEQ ID NO: 452322 - RNA, 32 nt, Human
ggaggacuugucacccuccaccccacauugcu

SEQ ID NO: 452323 - RNA, 23 nt, Human
ggaggagaaagcugacaggcgug

SEQ ID NO: 452324 - RNA, 32 nt, Human
ggaggagaaaggggaaaggaagaaagaaggag

SEQ ID NO: 452325 - RNA, 32 nt, Human
ggaggagaaagggugucugcugccuggugagg

SEQ ID NO: 452326 - RNA, 32 nt, Human
ggaggagaagacggaggaaggcucaggccccu

SEQ ID NO: 452327 - RNA, 32 nt, Human
ggaggagaagcacaguugucccauugaauuau

SEQ ID NO: 452328 - RNA, 32 nt, Human
ggaggagaagcagugccuucccucucgugugg

SEQ ID NO: 452329 - RNA, 21 nt, Human
ggaggagaagcugagcacgug

SEQ ID NO: 452330 - RNA, 32 nt, Human
ggaggagaaggagcccccagcccagccucauc

SEQ ID NO: 452331 - RNA, 32 nt, Human
ggaggagaaggaggaggaagccauggaugaca

SEQ ID NO: 452332 - RNA, 32 nt, Human
ggaggagaaggaggaggaggaagaggaggagc

SEQ ID NO: 452333 - RNA, 32 nt, Human
ggaggagaagggccucaaacugugcauguaag

SEQ ID NO: 452334 - RNA, 32 nt, Human
ggaggagaaggugguugaacugaguacugaga

SEQ ID NO: 452335 - RNA, 32 nt, Human
ggaggagaaugaagaaagauggagucaaacag

SEQ ID NO: 452336 - RNA, 32 nt, Human
ggaggagacagaugauaaguaaacaaauaaau

SEQ ID NO: 452337 - RNA, 20 nt, Human
ggaggagacaggggaugagg

SEQ ID NO: 452338 - RNA, 32 nt, Human
ggaggagaccucagauccucuucaucccuuua

SEQ ID NO: 452339 - RNA, 32 nt, Human
ggaggagagaacgcugccucuccucuggauug

SEQ ID NO: 452340 - RNA, 32 nt, Human
ggaggagagaagguagagcuguucuuaaauuu

SEQ ID NO: 452341 - RNA, 32 nt, Human
ggaggagagaagugcggcugugaucuggggaa

SEQ ID NO: 452342 - RNA, 32 nt, Human
ggaggagagagaggagaagggaggcaagggag

SEQ ID NO: 452343 - RNA, 32 nt, Human
ggaggagagagaggagaagggaggcaggggag

SEQ ID NO: 452344 - RNA, 32 nt, Human
ggaggagagaggaaagagcggagcagccauug

SEQ ID NO: 452345 - RNA, 22 nt, Human
ggaggagagagggcacaucucc

SEQ ID NO: 452346 - RNA, 32 nt, Human
ggaggagagcaucaucacuuuccauuagcugu

SEQ ID NO: 452347 - RNA, 32 nt, Human
ggaggagaggagaggagagggaggauccugga

SEQ ID NO: 452348 - RNA, 21 nt, Human
ggaggagaggaggagccgaga

SEQ ID NO: 452349 - RNA, 22 nt, Human
ggaggagaggcaacgugaacag

SEQ ID NO: 452350 - RNA, 20 nt, Human
ggaggagaggcagcgagcgg

SEQ ID NO: 452351 - RNA, 32 nt, Human
ggaggagaggccaggaagggagagggagaaaa

SEQ ID NO: 452352 - RNA, 20 nt, Human
ggaggagaggcgcggggagc

SEQ ID NO: 452353 - RNA, 20 nt, Human
ggaggagaggcugacuacag

SEQ ID NO: 452354 - RNA, 18 nt, Human
ggaggagaggcugaggga

SEQ ID NO: 452355 - RNA, 20 nt, Human
ggaggagaggcugagggagg

SEQ ID NO: 452356 - RNA, 32 nt, Human
ggaggagagggagggggaggacauggcaccau

SEQ ID NO: 452357 - RNA, 32 nt, Human
ggaggagagggcagaggaagacccccucuccu

SEQ ID NO: 452358 - RNA, 32 nt, Human
ggaggagaggguaagggaaagguggaggggcu

SEQ ID NO: 452359 - RNA, 20 nt, Human
ggaggagagguggcaggagg

SEQ ID NO: 452360 - RNA, 32 nt, Human
ggaggagaguagcucccuucucacacaaacgc

SEQ ID NO: 452361 - RNA, 32 nt, Human
ggaggagagucaccuccagacaacaucugcuc

SEQ ID NO: 452362 - RNA, 32 nt, Human
ggaggagaguggcggcugacacugugaaggag

SEQ ID NO: 452363 - RNA, 32 nt, Human
ggaggagaugauugagcugcuucuacuaagau

SEQ ID NO: 452364 - RNA, 32 nt, Human
ggaggagauggcuggcaccugggaacgcuaug

SEQ ID NO: 452365 - RNA, 19 nt, Human
ggaggagauguugagggga

SEQ ID NO: 452366 - RNA, 32 nt, Human
ggaggagcaaacugaggggcaggcuacugggg

SEQ ID NO: 452367 - RNA, 32 nt, Human
ggaggagcaagggacaagaggagcagaggaca

SEQ ID NO: 452368 - RNA, 18 nt, Human
ggaggagcaagggggcca

SEQ ID NO: 452369 - RNA, 32 nt, Human
ggaggagcacacggcaccuuuccccagagccc

SEQ ID NO: 452370 - RNA, 32 nt, Human
ggaggagcaccacucacuucugcagggagcaa

SEQ ID NO: 452371 - RNA, 16 nt, Human
ggaggagcagaagcca

SEQ ID NO: 452372 - RNA, 32 nt, Human
ggaggagcagaggcgggcgccgcaccgccccg

SEQ ID NO: 452373 - RNA, 32 nt, Human
ggaggagcagagggagaaagcgagggggcggg

SEQ ID NO: 452374 - RNA, 21 nt, Human
ggaggagcagcacggagcggg

SEQ ID NO: 452375 - RNA, 32 nt, Human
ggaggagcagcagaggcggucgggagcgauga

SEQ ID NO: 452376 - RNA, 32 nt, Human
ggaggagcagcagcuuggggagagggauuucc

SEQ ID NO: 452377 - RNA, 24 nt, Human
ggaggagcagccgaguacuuucag

SEQ ID NO: 452378 - RNA, 32 nt, Human
ggaggagcaggaaggugaccaggguguuuggg

SEQ ID NO: 452379 - RNA, 32 nt, Human
ggaggagcagggcugagcuggccacgccaccu

SEQ ID NO: 452380 - RNA, 32 nt, Human
ggaggagcaguuacccaacaaggacuguuuca

SEQ ID NO: 452381 - RNA, 32 nt, Human
ggaggagccaaggaauucuguggcugugcugc

SEQ ID NO: 452382 - RNA, 22 nt, Human
ggaggagccagaagcugggaga

SEQ ID NO: 452383 - RNA, 32 nt, Human
ggaggagccagcugcaguaguauccgccugua

SEQ ID NO: 452384 - RNA, 32 nt, Human
ggaggagcccaccagccccuucuucuugugaa

SEQ ID NO: 452385 - RNA, 32 nt, Human
ggaggagcccaggaaggaggcuccgcugguuc

SEQ ID NO: 452386 - RNA, 19 nt, Human
ggaggagcccagggcccuc

SEQ ID NO: 452387 - RNA, 32 nt, Human
ggaggagcccgggggagagggaccaggagggg

SEQ ID NO: 452388 - RNA, 32 nt, Human
ggaggagccggagccucugccucagcagccgc

SEQ ID NO: 452389 - RNA, 32 nt, Human
ggaggagccuccugccucuuccgggcuccggg

SEQ ID NO: 452390 - RNA, 22 nt, Human
ggaggagccucugucccaccag

SEQ ID NO: 452391 - RNA, 32 nt, Human
ggaggagcgacaccuccaggcuuccgggagcc

SEQ ID NO: 452392 - RNA, 23 nt, Human
ggaggagcgaugcaguugggaga

SEQ ID NO: 452393 - RNA, 32 nt, Human
ggaggagcuacagaugauucagccugagaagc

SEQ ID NO: 452394 - RNA, 32 nt, Human
ggaggagcuagcagacacauccaguaucuccu

SEQ ID NO: 452395 - RNA, 32 nt, Human
ggaggagcucacacccucaaacuccucaauaa

SEQ ID NO: 452396 - RNA, 32 nt, Human
ggaggagcuccaggaagcaggcaggccuuggu

SEQ ID NO: 452397 - RNA, 24 nt, Human
ggaggagcugacccggcuggggga

SEQ ID NO: 452398 - RNA, 32 nt, Human
ggaggagcugccgauggucccagugccauauu

SEQ ID NO: 452399 - RNA, 18 nt, Human
ggaggagcugucacgcug

SEQ ID NO: 452400 - RNA, 32 nt, Human
ggaggagcuuaggacaaaccucucugaugaag

SEQ ID NO: 452401 - RNA, 32 nt, Human
ggaggagcuucaucuguucccuucccaccucc

SEQ ID NO: 452402 - RNA, 32 nt, Human
ggaggaggaaaaggaggaagaggaggacaaaa

SEQ ID NO: 452403 - RNA, 32 nt, Human
ggaggaggaaagaggaggacauggucuccgag

SEQ ID NO: 452404 - RNA, 32 nt, Human
ggaggaggaagagaagcaggagagagaaagcc

SEQ ID NO: 452405 - RNA, 32 nt, Human
ggaggaggaagaggaaaacaagacaaacagcc

SEQ ID NO: 452406 - RNA, 32 nt, Human
ggaggaggaagaggaaacaagauaugacaagg

SEQ ID NO: 452407 - RNA, 32 nt, Human
ggaggaggaagaggagaauaaggaggagcagg

SEQ ID NO: 452408 - RNA, 32 nt, Human
ggaggaggaagaggagaggaggaagcaaagaa

SEQ ID NO: 452409 - RNA, 32 nt, Human
ggaggaggaagaggaggaagaggaugaccuga

SEQ ID NO: 452410 - RNA, 32 nt, Human
ggaggaggaagaggaggaggaagaggacuucu

SEQ ID NO: 452411 - RNA, 32 nt, Human
ggaggaggaagaggaggaggaggaagggagca

SEQ ID NO: 452412 - RNA, 23 nt, Human
ggaggaggaagaggaggcgauag

SEQ ID NO: 452413 - RNA, 32 nt, Human
ggaggaggaagagggcaguggggaaggggccu

SEQ ID NO: 452414 - RNA, 32 nt, Human
ggaggaggaaggaaagaaagaaagcgagggag

SEQ ID NO: 452415 - RNA, 32 nt, Human
ggaggaggaagggagcaccagugaagaaucag

SEQ ID NO: 452416 - RNA, 20 nt, Human
ggaggaggaaguggugaggu

SEQ ID NO: 452417 - RNA, 32 nt, Human
ggaggaggacacgaaagugaacuccaccguca

SEQ ID NO: 452418 - RNA, 32 nt, Human
ggaggaggagaaagcugaccgcuuaggcccgg

SEQ ID NO: 452419 - RNA, 32 nt, Human
ggaggaggagaaagguggaggagaagggaggg

SEQ ID NO: 452420 - RNA, 32 nt, Human
ggaggaggagagaaaggcggcucuucccgugc

SEQ ID NO: 452421 - RNA, 32 nt, Human
ggaggaggagagaauggaauggcuggacuuug

SEQ ID NO: 452422 - RNA, 32 nt, Human
ggaggaggagcagcaccuccuacuggccugac

SEQ ID NO: 452423 - RNA, 32 nt, Human
ggaggaggagccgugacccuguggaaggugcg

SEQ ID NO: 452424 - RNA, 32 nt, Human
ggaggaggaggaagaaaaugagagugggaagg

SEQ ID NO: 452425 - RNA, 32 nt, Human
ggaggaggaggaagaagaggaggaggaggagg

SEQ ID NO: 452426 - RNA, 32 nt, Human
ggaggaggaggaagaagaggaggagggaggaa

SEQ ID NO: 452427 - RNA, 32 nt, Human
ggaggaggaggaagaggaggagaagguagcua

SEQ ID NO: 452428 - RNA, 32 nt, Human
ggaggaggaggaagaggaggagcgcagucgga

SEQ ID NO: 452429 - RNA, 32 nt, Human
ggaggaggaggaagaggaggaggaggaaggga

SEQ ID NO: 452430 - RNA, 32 nt, Human
ggaggaggaggaagagggcaguggggaagggg

SEQ ID NO: 452431 - RNA, 32 nt, Human
ggaggaggaggaagaggggagcacaaaggauc

SEQ ID NO: 452432 - RNA, 32 nt, Human
ggaggaggaggaagaggggauggagcaggggc

SEQ ID NO: 452433 - RNA, 32 nt, Human
ggaggaggaggaagagguauggcaugggagga

SEQ ID NO: 452434 - RNA, 32 nt, Human
ggaggaggaggaagagguggaggaggaggagg

SEQ ID NO: 452435 - RNA, 32 nt, Human
ggaggaggaggagagcgcgagugagcaggggc

SEQ ID NO: 452436 - RNA, 32 nt, Human
ggaggaggaggagagcgcgggcuggcgcuugc

SEQ ID NO: 452437 - RNA, 32 nt, Human
ggaggaggaggaggagaaggaggagagagagg

SEQ ID NO: 452438 - RNA, 32 nt, Human
ggaggaggaggaggagaaggaggaggaggaag

SEQ ID NO: 452439 - RNA, 32 nt, Human
ggaggaggaggaggagaaggaggagggcagcu

SEQ ID NO: 452440 - RNA, 32 nt, Human
ggaggaggaggaggagcgcgagcucagcgaca

SEQ ID NO: 452441 - RNA, 32 nt, Human
ggaggaggaggaggagcgcgagcucagcgaua

SEQ ID NO: 452442 - RNA, 32 nt, Human
ggaggaggaggaggaggaagaagagguagcgg

SEQ ID NO: 452443 - RNA, 32 nt, Human
ggaggaggaggaggaggaagaggaggagaagg

SEQ ID NO: 452444 - RNA, 32 nt, Human
ggaggaggaggaggaggaagagggcagugggg

SEQ ID NO: 452445 - RNA, 32 nt, Human
ggaggaggaggaggaggaagagguggaggagg

SEQ ID NO: 452446 - RNA, 32 nt, Human
ggaggaggaggaggaggaggaagaagagguag

SEQ ID NO: 452447 - RNA, 32 nt, Human
ggaggaggaggaggaggaggaagagggcagug

SEQ ID NO: 452448 - RNA, 32 nt, Human
ggaggaggaggaggaggaggacgcgggccugg

SEQ ID NO: 452449 - RNA, 32 nt, Human
ggaggaggaggaggaggaggagaggggccucg

SEQ ID NO: 452450 - RNA, 32 nt, Human
ggaggaggaggaggaggaggaggagagcgcgg

SEQ ID NO: 452451 - RNA, 32 nt, Human
ggaggaggaggaggaggaggaggaggaggagg

SEQ ID NO: 452452 - RNA, 32 nt, Human
ggaggaggaggaggaggaggaggaggaggggg

SEQ ID NO: 452453 - RNA, 32 nt, Human
ggaggaggaggaggaggaggaggaggccaggu

SEQ ID NO: 452454 - RNA, 32 nt, Human
ggaggaggaggaggaggaggaggaggcggcgg

SEQ ID NO: 452455 - RNA, 32 nt, Human
ggaggaggaggaggaggaggaggagggggccg

SEQ ID NO: 452456 - RNA, 32 nt, Human
ggaggaggaggaggaggaggaggagggggcgg

SEQ ID NO: 452457 - RNA, 32 nt, Human
ggaggaggaggaggaggaggaggagguggcgg

SEQ ID NO: 452458 - RNA, 32 nt, Human
ggaggaggaggaggaggaggaggcaaaguuag

SEQ ID NO: 452459 - RNA, 32 nt, Human
ggaggaggaggaggaggaggagggggccgaga

SEQ ID NO: 452460 - RNA, 32 nt, Human
ggaggaggaggaggaggaggagggggcggcca

SEQ ID NO: 452461 - RNA, 32 nt, Human
ggaggaggaggaggaggaggaggucguggaug

SEQ ID NO: 452462 - RNA, 32 nt, Human
ggaggaggaggaggaggagggggccgagaaga

SEQ ID NO: 452463 - RNA, 32 nt, Human
ggaggaggaggaggaggagggggcggccaugg

SEQ ID NO: 452464 - RNA, 32 nt, Human
ggaggaggaggaggaggaggugguggaggagg

SEQ ID NO: 452465 - RNA, 32 nt, Human
ggaggaggaggaggagguugcagugagccgag

SEQ ID NO: 452466 - RNA, 32 nt, Human
ggaggaggaggcagagaggaguggagggcgga

SEQ ID NO: 452467 - RNA, 32 nt, Human
ggaggaggaggcggaggaggcggaggaggagg

SEQ ID NO: 452468 - RNA, 32 nt, Human
ggaggaggaggcggaggaggcgguggagggga

SEQ ID NO: 452469 - RNA, 32 nt, Human
ggaggaggaggcggcggcggcggugggccccg

SEQ ID NO: 452470 - RNA, 32 nt, Human
ggaggaggaggcggcgugcagggaggagaaaa

SEQ ID NO: 452471 - RNA, 32 nt, Human
ggaggaggagggaaggaagauggcggccgugg

SEQ ID NO: 452472 - RNA, 32 nt, Human
ggaggaggagggcacgugucugccuccccugg

SEQ ID NO: 452473 - RNA, 21 nt, Human
ggaggaggaggggagugcucu

SEQ ID NO: 452474 - RNA, 32 nt, Human
ggaggaggagggggaggaagaggagguggaga

SEQ ID NO: 452475 - RNA, 32 nt, Human
ggaggaggagggggaggagggagcggagaucu

SEQ ID NO: 452476 - RNA, 20 nt, Human
ggaggaggagguugcaguga

SEQ ID NO: 452477 - RNA, 32 nt, Human
ggaggaggagugaaggcggcggcggcggagga

SEQ ID NO: 452478 - RNA, 32 nt, Human
ggaggaggaguuccgccccacccucuacagcc

SEQ ID NO: 452479 - RNA, 22 nt, Human
ggaggaggaguugacagucucu

SEQ ID NO: 452480 - RNA, 18 nt, Human
ggaggaggaucuggggga

SEQ ID NO: 452481 - RNA, 17 nt, Human
ggaggaggaugaggagg

SEQ ID NO: 452482 - RNA, 32 nt, Human
ggaggaggauucugccuuuccuccagugccau

SEQ ID NO: 452483 - RNA, 32 nt, Human
ggaggaggcaaaguuagaguuggggcuggcgc

SEQ ID NO: 452484 - RNA, 26 nt, Human
ggaggaggcaggcccaagccccccaa

SEQ ID NO: 452485 - RNA, 32 nt, Human
ggaggaggcaggcggcggccccgguggcuccc

SEQ ID NO: 452486 - RNA, 32 nt, Human
ggaggaggcaucuccccucaugccccgcaaag

SEQ ID NO: 452487 - RNA, 19 nt, Human
ggaggaggccaggagggag

SEQ ID NO: 452488 - RNA, 32 nt, Human
ggaggaggccccggaggaggaggcguuggagg

SEQ ID NO: 452489 - RNA, 32 nt, Human
ggaggaggccgacacaccacaccuacacuccc

SEQ ID NO: 452490 - RNA, 20 nt, Human
ggaggaggccgagcgggagg

SEQ ID NO: 452491 - RNA, 19 nt, Human
ggaggaggccggccggagg

SEQ ID NO: 452492 - RNA, 32 nt, Human
ggaggaggccuuggaagaguccggccuggcuu

SEQ ID NO: 452493 - RNA, 32 nt, Human
ggaggaggcgaggaggagagacugcuccauaa

SEQ ID NO: 452494 - RNA, 20 nt, Human
ggaggaggcggaggaggagg

SEQ ID NO: 452495 - RNA, 18 nt, Human
ggaggaggcggcggcggg

SEQ ID NO: 452496 - RNA, 20 nt, Human
ggaggaggcggcggcugcgg

SEQ ID NO: 452497 - RNA, 32 nt, Human
ggaggaggcggcgugcagggaggagaaaaagc

SEQ ID NO: 452498 - RNA, 18 nt, Human
ggaggaggcgugguggga

SEQ ID NO: 452499 - RNA, 20 nt, Human
ggaggaggcguugugaggug

SEQ ID NO: 452500 - RNA, 24 nt, Human
ggaggaggcucuggaguccugcuc

SEQ ID NO: 452501 - RNA, 21 nt, Human
ggaggaggcucuguauguccu

SEQ ID NO: 452502 - RNA, 32 nt, Human
ggaggaggcugcagccgugguccaaccaggag

SEQ ID NO: 452503 - RNA, 24 nt, Human
ggaggaggcugggaguaguuuucu

SEQ ID NO: 452504 - RNA, 23 nt, Human
ggaggaggcuuuuaugugacuuu

SEQ ID NO: 452505 - RNA, 32 nt, Human
ggaggagggaaacugcccagcuuucccccggc

SEQ ID NO: 452506 - RNA, 32 nt, Human
ggaggagggaaagggguggcucuggcaggaaa

SEQ ID NO: 452507 - RNA, 32 nt, Human
ggaggagggaagagaaauaaacguggcagcgc

SEQ ID NO: 452508 - RNA, 32 nt, Human
ggaggagggagagagauggagaggaggggaga

SEQ ID NO: 452509 - RNA, 31 nt, Human
ggaggagggagagggaggucacuggaaaggg

SEQ ID NO: 452510 - RNA, 32 nt, Human
ggaggagggagaugccuggggaggggcuccug

SEQ ID NO: 452511 - RNA, 32 nt, Human
ggaggagggagccaggcuucgcuucaaggcgg

SEQ ID NO: 452512 - RNA, 32 nt, Human
ggaggagggaggaggaagagagggagggaggc

SEQ ID NO: 452513 - RNA, 32 nt, Human
ggaggagggaggauuuccucugugcagcuuuc

SEQ ID NO: 452514 - RNA, 32 nt, Human
ggaggagggaggcaggaggugagguuggaagu

SEQ ID NO: 452515 - RNA, 32 nt, Human
ggaggagggaggugcugugagccuagcgagau

SEQ ID NO: 452516 - RNA, 18 nt, Human
ggaggagggagguggaga

SEQ ID NO: 452517 - RNA, 32 nt, Human
ggaggagggaguggagagacugacuggccgug

SEQ ID NO: 452518 - RNA, 18 nt, Human
ggaggagggaugcggagg

SEQ ID NO: 452519 - RNA, 17 nt, Human
ggaggagggccaggaga

SEQ ID NO: 452520 - RNA, 18 nt, Human
ggaggagggcugaauaga

SEQ ID NO: 452521 - RNA, 32 nt, Human
ggaggagggcugggaguaugacaccuucggcu

SEQ ID NO: 452522 - RNA, 32 nt, Human
ggaggagggcuggucuccgcuccucaggggcu

SEQ ID NO: 452523 - RNA, 18 nt, Human
ggaggaggggacggauga

SEQ ID NO: 452524 - RNA, 16 nt, Human
ggaggaggggaggaga

SEQ ID NO: 452525 - RNA, 32 nt, Human
ggaggaggggagggaggaagaaggaagagagg

SEQ ID NO: 452526 - RNA, 32 nt, Human
ggaggaggggcagagccaggaggcaguggggc

SEQ ID NO: 452527 - RNA, 18 nt, Human
ggaggaggggccagggca

SEQ ID NO: 452528 - RNA, 32 nt, Human
ggaggagggggaggaggaagaagagaaggaag

SEQ ID NO: 452529 - RNA, 32 nt, Human
ggaggagggggaggaggagcgggaggagggac

SEQ ID NO: 452530 - RNA, 17 nt, Human
ggaggagggggccgaga

SEQ ID NO: 452531 - RNA, 32 nt, Human
ggaggagggggcggccggcuucugcugcagcc

SEQ ID NO: 452532 - RNA, 17 nt, Human
ggaggaggggugagaga

SEQ ID NO: 452533 - RNA, 32 nt, Human
ggaggaggguaccacucaggaggcuagguaac

SEQ ID NO: 452534 - RNA, 32 nt, Human
ggaggagggugagagagaagcugggagagcag

SEQ ID NO: 452535 - RNA, 18 nt, Human
ggaggaggguggcggaga

SEQ ID NO: 452536 - RNA, 32 nt, Human
ggaggaggguuggauaccuguggugugacacc

SEQ ID NO: 452537 - RNA, 23 nt, Human
ggaggagguaaacauuggagaug

SEQ ID NO: 452538 - RNA, 19 nt, Human
ggaggagguauggggauga

SEQ ID NO: 452539 - RNA, 18 nt, Human
ggaggaggucguggauga

SEQ ID NO: 452540 - RNA, 17 nt, Human
ggaggaggugccagaga

SEQ ID NO: 452541 - RNA, 18 nt, Human
ggaggaggugccuagagg

SEQ ID NO: 452542 - RNA, 20 nt, Human
ggaggagguggaggaggaga

SEQ ID NO: 452543 - RNA, 32 nt, Human
ggaggagguggaggaggagagguggcaggagg

SEQ ID NO: 452544 - RNA, 32 nt, Human
ggaggagguggaggaggaggaagaggagaagg

SEQ ID NO: 452545 - RNA, 19 nt, Human
ggaggagguggcggcgaga

SEQ ID NO: 452546 - RNA, 17 nt, Human
ggaggagguggcggcgg

SEQ ID NO: 452547 - RNA, 32 nt, Human
ggaggagguuccgucagcagcuggcaguagcc

SEQ ID NO: 452548 - RNA, 18 nt, Human
ggaggagguugggaggug

SEQ ID NO: 452549 - RNA, 31 nt, Human
ggaggagucauguuggagguuggggaagaac

SEQ ID NO: 452550 - RNA, 32 nt, Human
ggaggagugauuuggaaaacuauaggcuggaa

SEQ ID NO: 452551 - RNA, 32 nt, Human
ggaggaguggaguggagcucuugccuuguuac

SEQ ID NO: 452552 - RNA, 32 nt, Human
ggaggaguggcagaagaaagauagguuggaga

SEQ ID NO: 452553 - RNA, 32 nt, Human
ggaggagugggagugccugcagccugaucaga

SEQ ID NO: 452554 - RNA, 32 nt, Human
ggaggaguguggaggaagcgggguccucagcu

SEQ ID NO: 452555 - RNA, 32 nt, Human
ggaggaguuagacuugccucgugggaugagag

SEQ ID NO: 452556 - RNA, 32 nt, Human
ggaggaguuagaggaggaggaggaggaggaag

SEQ ID NO: 452557 - RNA, 20 nt, Human
ggaggaguuccgggggccag

SEQ ID NO: 452558 - RNA, 20 nt, Human
ggaggaguuucaccauguug

SEQ ID NO: 452559 - RNA, 24 nt, Human
ggaggaguuucaccauguuggcca

SEQ ID NO: 452560 - RNA, 32 nt, Human
ggaggauacaggcugaccggguggcgagaugu

SEQ ID NO: 452561 - RNA, 20 nt, Human
ggaggauacaguucaggaua

SEQ ID NO: 452562 - RNA, 21 nt, Human
ggaggauagcuugagcccagg

SEQ ID NO: 452563 - RNA, 32 nt, Human
ggaggauagguuaagaaaggaaagggacagaa

SEQ ID NO: 452564 - RNA, 32 nt, Human
ggaggauaguaagagagggagcagggagacca

SEQ ID NO: 452565 - RNA, 32 nt, Human
ggaggaucaaacacugucagaauugcugaaau

SEQ ID NO: 452566 - RNA, 32 nt, Human
ggaggaucacaaggucaggagaucgagaccau

SEQ ID NO: 452567 - RNA, 32 nt, Human
ggaggaucacaugaggccaggaauucaagacc

SEQ ID NO: 452568 - RNA, 32 nt, Human
ggaggaucacugagaccagccugggcaacaua

SEQ ID NO: 452569 - RNA, 32 nt, Human
ggaggaucacuggaguucgaggcugcagugag

SEQ ID NO: 452570 - RNA, 32 nt, Human
ggaggaucacuugaagccaggaguuccagacc

SEQ ID NO: 452571 - RNA, 32 nt, Human
ggaggaucacuugaagccaggaguuuaaaacc

SEQ ID NO: 452572 - RNA, 21 nt, Human
ggaggaucacuugagcccagg

SEQ ID NO: 452573 - RNA, 32 nt, Human
ggaggaucacuugagcccaggagauuaagacu

SEQ ID NO: 452574 - RNA, 32 nt, Human
ggaggaucacuugagcccaggagauugaggcu

SEQ ID NO: 452575 - RNA, 32 nt, Human
ggaggaucacuugagcccuggagaucgaggcu

SEQ ID NO: 452576 - RNA, 32 nt, Human
ggaggaucacuugagccuaggaauucaagacc

SEQ ID NO: 452577 - RNA, 32 nt, Human
ggaggaucacuugagccugaguucaacacugc

SEQ ID NO: 452578 - RNA, 32 nt, Human
ggaggaucacuugagccugggggacugaggcu

SEQ ID NO: 452579 - RNA, 32 nt, Human
ggaggaucacuugaggccaagaguuugagacc

SEQ ID NO: 452580 - RNA, 32 nt, Human
ggaggaucacuugaggccaggacuuugagacc

SEQ ID NO: 452581 - RNA, 32 nt, Human
ggaggaucacuugaggccaggagucugagaca

SEQ ID NO: 452582 - RNA, 32 nt, Human
ggaggaucacuugaggccaggaguucaagacc

SEQ ID NO: 452583 - RNA, 32 nt, Human
ggaggaucacuugaggccaggaguucaagauc

SEQ ID NO: 452584 - RNA, 32 nt, Human
ggaggaucacuugaggccaggaguuugagacc

SEQ ID NO: 452585 - RNA, 32 nt, Human
ggaggaucacuugaggccaggaguuugggacc

SEQ ID NO: 452586 - RNA, 32 nt, Human
ggaggaucacuugaggccagugagcugugauc

SEQ ID NO: 452587 - RNA, 32 nt, Human
ggaggaucacuuggagccaggaguuugagacc

SEQ ID NO: 452588 - RNA, 32 nt, Human
ggaggaucagccacaguugacucaacaaagac

SEQ ID NO: 452589 - RNA, 32 nt, Human
ggaggaucauuugagccugggaauuugagccc

SEQ ID NO: 452590 - RNA, 32 nt, Human
ggaggaucauuugaggccaggaguuugagacc

SEQ ID NO: 452591 - RNA, 32 nt, Human
ggaggauccaugucggcucugccugcagugac

SEQ ID NO: 452592 - RNA, 32 nt, Human
ggaggaucccacccuucugcucugaugucuuc

SEQ ID NO: 452593 - RNA, 21 nt, Human
ggaggaucccuugagcccagg

SEQ ID NO: 452594 - RNA, 32 nt, Human
ggaggaucccuugaucccuuguggccaggagu

SEQ ID NO: 452595 - RNA, 32 nt, Human
ggaggauccugaggacccccugguugcagcca

SEQ ID NO: 452596 - RNA, 32 nt, Human
ggaggaucgcagucagcagagcagggcugagg

SEQ ID NO: 452597 - RNA, 21 nt, Human
ggaggaucgcuugagcccagg

SEQ ID NO: 452598 - RNA, 32 nt, Human
ggaggaucgcuugaggccagaaguucaagacc

SEQ ID NO: 452599 - RNA, 32 nt, Human
ggaggaucgcuugaggccaggaguuugagacc

SEQ ID NO: 452600 - RNA, 32 nt, Human
ggaggaucguuugagccugagaguuugagacc

SEQ ID NO: 452601 - RNA, 21 nt, Human
ggaggaucucuugagcccagg

SEQ ID NO: 452602 - RNA, 32 nt, Human
ggaggaucucuugaggccaggaguugcagacc

SEQ ID NO: 452603 - RNA, 21 nt, Human
ggaggaucuggagagcugcug

SEQ ID NO: 452604 - RNA, 32 nt, Human
ggaggaugacuugaggccaggaguuggagacc

SEQ ID NO: 452605 - RNA, 32 nt, Human
ggaggaugaggcaagagaaucgcuugaaccua

SEQ ID NO: 452606 - RNA, 32 nt, Human
ggaggaugaggcaggagaaucgcuugaaccug

SEQ ID NO: 452607 - RNA, 32 nt, Human
ggaggaugaggcaggagaauugcuugaaaccc

SEQ ID NO: 452608 - RNA, 32 nt, Human
ggaggaugaggcaggagaauugcuugaacccg

SEQ ID NO: 452609 - RNA, 32 nt, Human
ggaggaugaggcaggaggaucucuugagccca

SEQ ID NO: 452610 - RNA, 32 nt, Human
ggaggaugagucaggagaauugcuugaaccca

SEQ ID NO: 452611 - RNA, 20 nt, Human
ggaggaugcauguggaucau

SEQ ID NO: 452612 - RNA, 32 nt, Human
ggaggaugccguggcgucuccucccaggagcc

SEQ ID NO: 452613 - RNA, 32 nt, Human
ggaggaugccuagaagauguugggaacagaag

SEQ ID NO: 452614 - RNA, 32 nt, Human
ggaggaugcuguuuaucugucaccuccacuug

SEQ ID NO: 452615 - RNA, 21 nt, Human
ggaggauggagaagagagaga

SEQ ID NO: 452616 - RNA, 32 nt, Human
ggaggauggcaaagagagucgcaucucagugc

SEQ ID NO: 452617 - RNA, 32 nt, Human
ggaggauggcauuccauacagcaaaggagaag

SEQ ID NO: 452618 - RNA, 32 nt, Human
ggaggauggcucgaagccaggaguucgaaacc

SEQ ID NO: 452619 - RNA, 30 nt, Human
ggaggauggcuggggccaggggucugggag

SEQ ID NO: 452620 - RNA, 32 nt, Human
ggaggauggcuugaagccaguaguucaagacc

SEQ ID NO: 452621 - RNA, 21 nt, Human
ggaggauggcuugagcccagg

SEQ ID NO: 452622 - RNA, 32 nt, Human
ggaggauggcuugaggccagagguuugagacc

SEQ ID NO: 452623 - RNA, 30 nt, Human
ggaggaugggucaucuggaacccacuuaca

SEQ ID NO: 452624 - RNA, 32 nt, Human
ggaggauggucagccuuggagcaucucucaau

SEQ ID NO: 452625 - RNA, 32 nt, Human
ggaggauguccaccuugcuugguggcucuggg

SEQ ID NO: 452626 - RNA, 22 nt, Human
ggaggaugugauauguggggga

SEQ ID NO: 452627 - RNA, 32 nt, Human
ggaggaugugguucuggaugacgagaauccac

SEQ ID NO: 452628 - RNA, 19 nt, Human
ggaggauuacuccaugcca

SEQ ID NO: 452629 - RNA, 32 nt, Human
ggaggauuacuugagcccuggaggucaaagcu

SEQ ID NO: 452630 - RNA, 19 nt, Human
ggaggauuacuugaggcca

SEQ ID NO: 452631 - RNA, 32 nt, Human
ggaggauuacuugaggccagaaguuugagacu

SEQ ID NO: 452632 - RNA, 32 nt, Human
ggaggauuacuugaggccaggaguucaagacc

SEQ ID NO: 452633 - RNA, 32 nt, Human
ggaggauucaguacaggggcugagggaggagg

SEQ ID NO: 452634 - RNA, 21 nt, Human
ggaggauugccugagcccagg

SEQ ID NO: 452635 - RNA, 32 nt, Human
ggaggauugccugaggccaggaguuugacacc

SEQ ID NO: 452636 - RNA, 32 nt, Human
ggaggauugccugaggccagggguuugagacc

SEQ ID NO: 452637 - RNA, 21 nt, Human
ggaggauugcuuaagcccagg

SEQ ID NO: 452638 - RNA, 19 nt, Human
ggaggauugcuugaagcca

SEQ ID NO: 452639 - RNA, 20 nt, Human
ggaggauugcuugagcccag

SEQ ID NO: 452640 - RNA, 21 nt, Human
ggaggauugcuugagcccagg

SEQ ID NO: 452641 - RNA, 21 nt, Human
ggaggauugcuugagcccugg

SEQ ID NO: 452642 - RNA, 32 nt, Human
ggaggauugcuugagcccuggaguucaaggcu

SEQ ID NO: 452643 - RNA, 21 nt, Human
ggaggauugcuugagcucagg

SEQ ID NO: 452644 - RNA, 21 nt, Human
ggaggauugcuugaggccagg

SEQ ID NO: 452645 - RNA, 32 nt, Human
ggaggauugcuugaggccaggaauucgagacc

SEQ ID NO: 452646 - RNA, 32 nt, Human
ggaggauugcuugaggccaggaguuugagacc

SEQ ID NO: 452647 - RNA, 20 nt, Human
ggaggauugcuugaguccag

SEQ ID NO: 452648 - RNA, 32 nt, Human
ggaggauuugagggagcucacugccuaccugg

SEQ ID NO: 452649 - RNA, 32 nt, Human
ggaggauuuggaauuaguccugggcgaccuga

SEQ ID NO: 452650 - RNA, 32 nt, Human
ggaggauuuguucaucagaugcugggaaggaa

SEQ ID NO: 452651 - RNA, 32 nt, Human
ggaggcaaagccaggccaggguacagugagaa

SEQ ID NO: 452652 - RNA, 32 nt, Human
ggaggcaaaggcaggagaguugcuugaacuga

SEQ ID NO: 452653 - RNA, 32 nt, Human
ggaggcaaaggugggagaaucgcgugagccca

SEQ ID NO: 452654 - RNA, 32 nt, Human
ggaggcaaaucagcugggcccugcccucacag

SEQ ID NO: 452655 - RNA, 18 nt, Human
ggaggcaacaucuccucu

SEQ ID NO: 452656 - RNA, 32 nt, Human
ggaggcaacauguacagaugaaggugaaccac

SEQ ID NO: 452657 - RNA, 32 nt, Human
ggaggcaacgcaagccugaguccuuucuuccu

SEQ ID NO: 452658 - RNA, 32 nt, Human
ggaggcaagggaggggcagcagaaccaagaca

SEQ ID NO: 452659 - RNA, 17 nt, Human
ggaggcaauggcuccaa

SEQ ID NO: 452660 - RNA, 17 nt, Human
ggaggcacaaaacccca

SEQ ID NO: 452661 - RNA, 32 nt, Human
ggaggcacaagccugaagcacucuucuaccaa

SEQ ID NO: 452662 - RNA, 32 nt, Human
ggaggcacagcagccaaguggggaggcaggug

SEQ ID NO: 452663 - RNA, 32 nt, Human
ggaggcacagcaguuucaccaucuuugaggug

SEQ ID NO: 452664 - RNA, 32 nt, Human
ggaggcacaggcccucauccacccucuggcac

SEQ ID NO: 452665 - RNA, 32 nt, Human
ggaggcacagggccgcccucugugcugaggcc

SEQ ID NO: 452666 - RNA, 32 nt, Human
ggaggcacaugguccugucucacgucacaggg

SEQ ID NO: 452667 - RNA, 32 nt, Human
ggaggcaccacugucacuggccaagggcuggc

SEQ ID NO: 452668 - RNA, 32 nt, Human
ggaggcaccuuuggguucccagugcccagcac

SEQ ID NO: 452669 - RNA, 32 nt, Human
ggaggcacgcggagcugugcaggcagaagcgg

SEQ ID NO: 452670 - RNA, 32 nt, Human
ggaggcacggcagaggaggcagggccgacggc

SEQ ID NO: 452671 - RNA, 32 nt, Human
ggaggcacgucaggcaaugacacaccauuccu

SEQ ID NO: 452672 - RNA, 32 nt, Human
ggaggcacuuaggggagacucggauggggaca

SEQ ID NO: 452673 - RNA, 32 nt, Human
ggaggcagaagagccgcgaggagccagcggag

SEQ ID NO: 452674 - RNA, 32 nt, Human
ggaggcagaagaggaagucagagcgaugugcu

SEQ ID NO: 452675 - RNA, 32 nt, Human
ggaggcagacagguuucugggcagaagggggu

SEQ ID NO: 452676 - RNA, 32 nt, Human
ggaggcagagacaggcaggucgcuugagcuca

SEQ ID NO: 452677 - RNA, 23 nt, Human
ggaggcagagagagggaggcaga

SEQ ID NO: 452678 - RNA, 32 nt, Human
ggaggcagagauuacugugggccaaggaaugg

SEQ ID NO: 452679 - RNA, 32 nt, Human
ggaggcagagcgcggcccugcgucagagcgag

SEQ ID NO: 452680 - RNA, 19 nt, Human
ggaggcagaggaccuggag

SEQ ID NO: 452681 - RNA, 22 nt, Human
ggaggcagaggacggcccggag

SEQ ID NO: 452682 - RNA, 21 nt, Human
ggaggcagaggcagaggcaga

SEQ ID NO: 452683 - RNA, 32 nt, Human
ggaggcagaggcaggagaaucgcuugaaccca

SEQ ID NO: 452684 - RNA, 32 nt, Human
ggaggcagaggcaggagaaucguuugaaccca

SEQ ID NO: 452685 - RNA, 32 nt, Human
ggaggcagaggcaggagaauugcuugaacucg

SEQ ID NO: 452686 - RNA, 32 nt, Human
ggaggcagaggcaggagaauugcuugagcccg

SEQ ID NO: 452687 - RNA, 32 nt, Human
ggaggcagaggcaggaggauagcuugagccca

SEQ ID NO: 452688 - RNA, 32 nt, Human
ggaggcagaggcaggaggaucgcuugagccca

SEQ ID NO: 452689 - RNA, 32 nt, Human
ggaggcagaggcaggaggauugcuuaaggcca

SEQ ID NO: 452690 - RNA, 32 nt, Human
ggaggcagaggccaggccuccucaaguuggcc

SEQ ID NO: 452691 - RNA, 32 nt, Human
ggaggcagaggcgggaggauugcuugaggccg

SEQ ID NO: 452692 - RNA, 32 nt, Human
ggaggcagaggcugcacucuagccugggcaac

SEQ ID NO: 452693 - RNA, 20 nt, Human
ggaggcagaggcugcaguga

SEQ ID NO: 452694 - RNA, 32 nt, Human
ggaggcagaggcugggaaugggagcaguaagc

SEQ ID NO: 452695 - RNA, 22 nt, Human
ggaggcagagggggcccuggag

SEQ ID NO: 452696 - RNA, 22 nt, Human
ggaggcagaggggugccuggag

SEQ ID NO: 452697 - RNA, 32 nt, Human
ggaggcagaggugagagaaucgcuugagccca

SEQ ID NO: 452698 - RNA, 32 nt, Human
ggaggcagaggugagagaaucgugcuugaaca

SEQ ID NO: 452699 - RNA, 32 nt, Human
ggaggcagagguggaggcgcuuugaaagccgu

SEQ ID NO: 452700 - RNA, 32 nt, Human
ggaggcagaggugggagaaucgcuugaacaug

SEQ ID NO: 452701 - RNA, 32 nt, Human
ggaggcagaggugggaggauugcuugguccca

SEQ ID NO: 452702 - RNA, 20 nt, Human
ggaggcagagguugcaauga

SEQ ID NO: 452703 - RNA, 21 nt, Human
ggaggcagagguugcaaugag

SEQ ID NO: 452704 - RNA, 20 nt, Human
ggaggcagagguugcagcga

SEQ ID NO: 452705 - RNA, 21 nt, Human
ggaggcagagguugcagcgag

SEQ ID NO: 452706 - RNA, 20 nt, Human
ggaggcagagguugcaguga

SEQ ID NO: 452707 - RNA, 21 nt, Human
ggaggcagagguugcagugag

SEQ ID NO: 452708 - RNA, 32 nt, Human
ggaggcagagguugcagugaggugagauagcg

SEQ ID NO: 452709 - RNA, 32 nt, Human
ggaggcagaguccucgcguggucuccugccuc

SEQ ID NO: 452710 - RNA, 32 nt, Human
ggaggcagaguuugcagugagcugagaucaug

SEQ ID NO: 452711 - RNA, 32 nt, Human
ggaggcagaguuugcagugagcugagauggug

SEQ ID NO: 452712 - RNA, 32 nt, Human
ggaggcagaguuugccgugagcugagauugug

SEQ ID NO: 452713 - RNA, 32 nt, Human
ggaggcagaucuuuccaagguggaaagguaau

SEQ ID NO: 452714 - RNA, 32 nt, Human
ggaggcagaugaucauggucugccucaacugu

SEQ ID NO: 452715 - RNA, 32 nt, Human
ggaggcagauguccugucugugagccaguucc

SEQ ID NO: 452716 - RNA, 32 nt, Human
ggaggcagcaacggagaguggggaaguggagc

SEQ ID NO: 452717 - RNA, 20 nt, Human
ggaggcagcagacacuggag

SEQ ID NO: 452718 - RNA, 21 nt, Human
ggaggcagcagccagaugaga

SEQ ID NO: 452719 - RNA, 20 nt, Human
ggaggcagcaggagcaguga

SEQ ID NO: 452720 - RNA, 32 nt, Human
ggaggcagcaggggucagccugggcaggaacc

SEQ ID NO: 452721 - RNA, 19 nt, Human
ggaggcagccaaggcggag

SEQ ID NO: 452722 - RNA, 21 nt, Human
ggaggcagccacaggcgagug

SEQ ID NO: 452723 - RNA, 19 nt, Human
ggaggcagccaugcugggg

SEQ ID NO: 452724 - RNA, 22 nt, Human
ggaggcagccaugggcugggag

SEQ ID NO: 452725 - RNA, 23 nt, Human
ggaggcagccaugggcugggaga

SEQ ID NO: 452726 - RNA, 18 nt, Human
ggaggcagcccccuguga

SEQ ID NO: 452727 - RNA, 18 nt, Human
ggaggcagccccuaggag

SEQ ID NO: 452728 - RNA, 25 nt, Human
ggaggcagccgaacagaacugcaga

SEQ ID NO: 452729 - RNA, 32 nt, Human
ggaggcagccuccuaguugcugaaaguuaagg

SEQ ID NO: 452730 - RNA, 32 nt, Human
ggaggcagccugggugggugagccauggggca

SEQ ID NO: 452731 - RNA, 32 nt, Human
ggaggcagccuucggggccugcauuugagaau

SEQ ID NO: 452732 - RNA, 21 nt, Human
ggaggcagcggaggcugcucg

SEQ ID NO: 452733 - RNA, 32 nt, Human
ggaggcagcggccagggcugggccagggcgag

SEQ ID NO: 452734 - RNA, 32 nt, Human
ggaggcagcggcggcagcaggagacgcagcgg

SEQ ID NO: 452735 - RNA, 32 nt, Human
ggaggcagcggcuggagaauugcuugaaccug

SEQ ID NO: 452736 - RNA, 32 nt, Human
ggaggcagcgugaaagaacagaagggcaucug

SEQ ID NO: 452737 - RNA, 18 nt, Human
ggaggcagcucacuggag

SEQ ID NO: 452738 - RNA, 18 nt, Human
ggaggcagcuccacguca

SEQ ID NO: 452739 - RNA, 32 nt, Human
ggaggcaggaagaucacuugagccugggaugu

SEQ ID NO: 452740 - RNA, 32 nt, Human
ggaggcaggagauggcaauggaagcgacagcu

SEQ ID NO: 452741 - RNA, 32 nt, Human
ggaggcaggagccacggguggggccaggccac

SEQ ID NO: 452742 - RNA, 23 nt, Human
ggaggcaggagcggcggcgacgg

SEQ ID NO: 452743 - RNA, 32 nt, Human
ggaggcaggagcuggggagugggagccuauga

SEQ ID NO: 452744 - RNA, 32 nt, Human
ggaggcaggaggaucacuugagcccaggaguu

SEQ ID NO: 452745 - RNA, 23 nt, Human
ggaggcaggaggcggcugcgcgg

SEQ ID NO: 452746 - RNA, 32 nt, Human
ggaggcaggaggugagguuggaaguugagcaa

SEQ ID NO: 452747 - RNA, 19 nt, Human
ggaggcaggauaccuggag

SEQ ID NO: 452748 - RNA, 20 nt, Human
ggaggcaggcauggcccugg

SEQ ID NO: 452749 - RNA, 19 nt, Human
ggaggcaggcgccgcggag

SEQ ID NO: 452750 - RNA, 32 nt, Human
ggaggcaggcugggugcaguggcucaugccua

SEQ ID NO: 452751 - RNA, 32 nt, Human
ggaggcaggcuggugguggagucauggcugca

SEQ ID NO: 452752 - RNA, 32 nt, Human
ggaggcagggaaaugcgguauuuacugggaac

SEQ ID NO: 452753 - RNA, 32 nt, Human
ggaggcagggagccaccuccucagcuucccug

SEQ ID NO: 452754 - RNA, 26 nt, Human
ggaggcagggagucuggugccugcag

SEQ ID NO: 452755 - RNA, 32 nt, Human
ggaggcagggauggggacaggguggguggcuu

SEQ ID NO: 452756 - RNA, 22 nt, Human
ggaggcagggcagagccucagg

SEQ ID NO: 452757 - RNA, 32 nt, Human
ggaggcagggcaggagguuggagcagcccugc

SEQ ID NO: 452758 - RNA, 22 nt, Human
ggaggcagggcagggccucugg

SEQ ID NO: 452759 - RNA, 24 nt, Human
ggaggcagggcagggccucuggga

SEQ ID NO: 452760 - RNA, 32 nt, Human
ggaggcaggggaggggcagcagaaccaaggca

SEQ ID NO: 452761 - RNA, 32 nt, Human
ggaggcaggggcagaggucagaaggggugucu

SEQ ID NO: 452762 - RNA, 17 nt, Human
ggaggcaggggccgagg

SEQ ID NO: 452763 - RNA, 32 nt, Human
ggaggcaggggcuuccuggugcuggagguugg

SEQ ID NO: 452764 - RNA, 23 nt, Human
ggaggcagggggcaggccugcgg

SEQ ID NO: 452765 - RNA, 32 nt, Human
ggaggcagggguuccagcacaaaguuuacuuc

SEQ ID NO: 452766 - RNA, 19 nt, Human
ggaggcagggucucugggg

SEQ ID NO: 452767 - RNA, 32 nt, Human
ggaggcaggucgggaggaagaagagguggagg

SEQ ID NO: 452768 - RNA, 32 nt, Human
ggaggcagguucugcaaagcaagugcaagagg

SEQ ID NO: 452769 - RNA, 32 nt, Human
ggaggcaguagacauggagaaauccuaucuuu

SEQ ID NO: 452770 - RNA, 32 nt, Human
ggaggcagucacaggagugaggugcaguugcu

SEQ ID NO: 452771 - RNA, 19 nt, Human
ggaggcaguccucaccucu

SEQ ID NO: 452772 - RNA, 32 nt, Human
ggaggcaguggaggcaggagaggcuggggagg

SEQ ID NO: 452773 - RNA, 32 nt, Human
ggaggcaguggcagagggguugagggacaggg

SEQ ID NO: 452774 - RNA, 20 nt, Human
ggaggcaguggcgggcuccc

SEQ ID NO: 452775 - RNA, 32 nt, Human
ggaggcagugggcuggcagcuuccugcugcuc

SEQ ID NO: 452776 - RNA, 32 nt, Human
ggaggcauaugcuuguguguguacauggggug

SEQ ID NO: 452777 - RNA, 32 nt, Human
ggaggcaucacugaggccaggagcucugccca

SEQ ID NO: 452778 - RNA, 32 nt, Human
ggaggcaucauugaggccaggagcucugcccg

SEQ ID NO: 452779 - RNA, 32 nt, Human
ggaggcaucccauccagccucagagggcccag

SEQ ID NO: 452780 - RNA, 32 nt, Human
ggaggcauggcuguaauucuuuagcuuucucc

SEQ ID NO: 452781 - RNA, 32 nt, Human
ggaggcauuagcagcagcaccucugggucaac

SEQ ID NO: 452782 - RNA, 32 nt, Human
ggaggcauugcugcaggugagccugggaugcc

SEQ ID NO: 452783 - RNA, 32 nt, Human
ggaggcauuuaaggaaaucuguuucucuuuug

SEQ ID NO: 452784 - RNA, 32 nt, Human
ggaggcauuuacacacagcacacuccagcucu

SEQ ID NO: 452785 - RNA, 32 nt, Human
ggaggcauuuggauccauugggccacauguga

SEQ ID NO: 452786 - RNA, 32 nt, Human
ggaggccaaagcaggagaauugcuugaacccg

SEQ ID NO: 452787 - RNA, 32 nt, Human
ggaggccaaagcaggaggauagcuugaggcca

SEQ ID NO: 452788 - RNA, 32 nt, Human
ggaggccaaagcaggaggaucacuugagccua

SEQ ID NO: 452789 - RNA, 32 nt, Human
ggaggccaaagcaggaggaucgcuugagccca

SEQ ID NO: 452790 - RNA, 24 nt, Human
ggaggccaaagcaggcaaaucucu

SEQ ID NO: 452791 - RNA, 23 nt, Human
ggaggccaaaggaaaggaucucu

SEQ ID NO: 452792 - RNA, 24 nt, Human
ggaggccaaagggcugcagucacc

SEQ ID NO: 452793 - RNA, 24 nt, Human
ggaggccaaaugggagaauugcuu

SEQ ID NO: 452794 - RNA, 23 nt, Human
ggaggccaaaugggccaccccuu

SEQ ID NO: 452795 - RNA, 32 nt, Human
ggaggccaacacaggaggaucacuugagacug

SEQ ID NO: 452796 - RNA, 32 nt, Human
ggaggccaacuaaggguaucaccaagaagcca

SEQ ID NO: 452797 - RNA, 21 nt, Human
ggaggccaacugaugcucucc

SEQ ID NO: 452798 - RNA, 26 nt, Human
ggaggccaagaagaggaagauugcuu

SEQ ID NO: 452799 - RNA, 32 nt, Human
ggaggccaagacaggaggaucacuugaggcca

SEQ ID NO: 452800 - RNA, 32 nt, Human
ggaggccaagacgggaugauugcuugagcuca

SEQ ID NO: 452801 - RNA, 32 nt, Human
ggaggccaagagucugagaccagccuggcuaa

SEQ ID NO: 452802 - RNA, 32 nt, Human
ggaggccaagaguuggagagcagacugggcaa

SEQ ID NO: 452803 - RNA, 24 nt, Human
ggaggccaagaucgcaagcugcuu

SEQ ID NO: 452804 - RNA, 24 nt, Human
ggaggccaagauggaggauugcuu

SEQ ID NO: 452805 - RNA, 25 nt, Human
ggaggccaagaugggaggagugcuu

SEQ ID NO: 452806 - RNA, 25 nt, Human
ggaggccaagaugggaggaucgcuu

SEQ ID NO: 452807 - RNA, 32 nt, Human
ggaggccaagaugggcagauugcuugaggcca

SEQ ID NO: 452808 - RNA, 32 nt, Human
ggaggccaagaugggcggauugcuugagguca

SEQ ID NO: 452809 - RNA, 32 nt, Human
ggaggccaagcugccagguuuggggcuggggg

SEQ ID NO: 452810 - RNA, 24 nt, Human
ggaggccaagcuuuaaacaucucu

SEQ ID NO: 452811 - RNA, 25 nt, Human
ggaggccaaggaaggaggacugcuu

SEQ ID NO: 452812 - RNA, 32 nt, Human
ggaggccaaggaaggaggauugcuugagcuca

SEQ ID NO: 452813 - RNA, 24 nt, Human
ggaggccaaggaaggcagaucacc

SEQ ID NO: 452814 - RNA, 25 nt, Human
ggaggccaaggcaaaaggauugcuu

SEQ ID NO: 452815 - RNA, 32 nt, Human
ggaggccaaggcaaaaggauugcuugagugca

SEQ ID NO: 452816 - RNA, 32 nt, Human
ggaggccaaggcacaagaaucgcuugaaccag

SEQ ID NO: 452817 - RNA, 25 nt, Human
ggaggccaaggcaggaagauugcuu

SEQ ID NO: 452818 - RNA, 32 nt, Human
ggaggccaaggcaggagaaucgcucgaaacca

SEQ ID NO: 452819 - RNA, 32 nt, Human
ggaggccaaggcaggagaaucgcuugaaccug

SEQ ID NO: 452820 - RNA, 25 nt, Human
ggaggccaaggcaggaggacugcuu

SEQ ID NO: 452821 - RNA, 32 nt, Human
ggaggccaaggcaggaggacugcuugagccca

SEQ ID NO: 452822 - RNA, 32 nt, Human
ggaggccaaggcaggaggaucacuugagccua

SEQ ID NO: 452823 - RNA, 32 nt, Human
ggaggccaaggcaggaggaucacuugagccug

SEQ ID NO: 452824 - RNA, 32 nt, Human
ggaggccaaggcaggaggaucacuugaggcca

SEQ ID NO: 452825 - RNA, 32 nt, Human
ggaggccaaggcaggaggaucacuugaggcua

SEQ ID NO: 452826 - RNA, 32 nt, Human
ggaggccaaggcaggaggaucacuugaguccu

SEQ ID NO: 452827 - RNA, 32 nt, Human
ggaggccaaggcaggaggaucgcuugagccca

SEQ ID NO: 452828 - RNA, 32 nt, Human
ggaggccaaggcaggaggaucgcuugagguca

SEQ ID NO: 452829 - RNA, 32 nt, Human
ggaggccaaggcaggaggaucguuugaggcca

SEQ ID NO: 452830 - RNA, 32 nt, Human
ggaggccaaggcaggaggaucucuugagccca

SEQ ID NO: 452831 - RNA, 32 nt, Human
ggaggccaaggcaggaggauggcuugaagcca

SEQ ID NO: 452832 - RNA, 32 nt, Human
ggaggccaaggcaggaggauggcuugagccca

SEQ ID NO: 452833 - RNA, 32 nt, Human
ggaggccaaggcaggaggauggcuugagcuca

SEQ ID NO: 452834 - RNA, 25 nt, Human
ggaggccaaggcaggaggauugcuu

SEQ ID NO: 452835 - RNA, 32 nt, Human
ggaggccaaggcaggaggauugcuugagaccu

SEQ ID NO: 452836 - RNA, 32 nt, Human
ggaggccaaggcaggaggauugcuugagccca

SEQ ID NO: 452837 - RNA, 32 nt, Human
ggaggccaaggcaggaggauugcuugaggcga

SEQ ID NO: 452838 - RNA, 32 nt, Human
ggaggccaaggcaggaggauugcuugagguca

SEQ ID NO: 452839 - RNA, 32 nt, Human
ggaggccaaggcaggcagaucgcuugagccca

SEQ ID NO: 452840 - RNA, 32 nt, Human
ggaggccaaggcaggcugauugcuugagguca

SEQ ID NO: 452841 - RNA, 23 nt, Human
ggaggccaaggcagguggaucau

SEQ ID NO: 452842 - RNA, 22 nt, Human
ggaggccaaggcagguggaucg

SEQ ID NO: 452843 - RNA, 32 nt, Human
ggaggccaaggcagguggaucgcuugaggcca

SEQ ID NO: 452844 - RNA, 25 nt, Human
ggaggccaaggccagaggauugcuu

SEQ ID NO: 452845 - RNA, 32 nt, Human
ggaggccaaggccagaggauugcuugagucua

SEQ ID NO: 452846 - RNA, 32 nt, Human
ggaggccaaggcgaguggauugcuugagccca

SEQ ID NO: 452847 - RNA, 25 nt, Human
ggaggccaaggcgggaggaucacuu

SEQ ID NO: 452848 - RNA, 25 nt, Human
ggaggccaaggcgggaggaucgcuu

SEQ ID NO: 452849 - RNA, 32 nt, Human
ggaggccaaggcgggaggaucgcuugagccca

SEQ ID NO: 452850 - RNA, 25 nt, Human
ggaggccaaggcgggaggauugcuu

SEQ ID NO: 452851 - RNA, 32 nt, Human
ggaggccaaggcgggaggauugcuugagccca

SEQ ID NO: 452852 - RNA, 32 nt, Human
ggaggccaaggcgggaggguugcuugagcuca

SEQ ID NO: 452853 - RNA, 32 nt, Human
ggaggccaaggcgggucgauuacuugagguca

SEQ ID NO: 452854 - RNA, 22 nt, Human
ggaggccaaggcggguggauca

SEQ ID NO: 452855 - RNA, 32 nt, Human
ggaggccaagguaagaggaucgcuugagguca

SEQ ID NO: 452856 - RNA, 32 nt, Human
ggaggccaagguaggaggauggcuugaggcca

SEQ ID NO: 452857 - RNA, 25 nt, Human
ggaggccaagguaggaggauugcuu

SEQ ID NO: 452858 - RNA, 32 nt, Human
ggaggccaagguaggaggauugcuugaagcua

SEQ ID NO: 452859 - RNA, 32 nt, Human
ggaggccaaggugagcccaaggugggaggauc

SEQ ID NO: 452860 - RNA, 22 nt, Human
ggaggccaaggugcaacuuucu

SEQ ID NO: 452861 - RNA, 32 nt, Human
ggaggccaaggugcaaggcgggcagaucauuu

SEQ ID NO: 452862 - RNA, 32 nt, Human
ggaggccaaggugggaacaucgcuugaggcca

SEQ ID NO: 452863 - RNA, 25 nt, Human
ggaggccaaggugggaagaucacuu

SEQ ID NO: 452864 - RNA, 25 nt, Human
ggaggccaaggugggaagaucgcuu

SEQ ID NO: 452865 - RNA, 23 nt, Human
ggaggccaaggugggaagauugc

SEQ ID NO: 452866 - RNA, 25 nt, Human
ggaggccaaggugggaggacgacuu

SEQ ID NO: 452867 - RNA, 20 nt, Human
ggaggccaaggugggaggau

SEQ ID NO: 452868 - RNA, 24 nt, Human
ggaggccaaggugggaggaucacu

SEQ ID NO: 452869 - RNA, 25 nt, Human
ggaggccaaggugggaggaucacuu

SEQ ID NO: 452870 - RNA, 32 nt, Human
ggaggccaaggugggaggaucaguugagcccc

SEQ ID NO: 452871 - RNA, 25 nt, Human
ggaggccaaggugggaggaucgcuu

SEQ ID NO: 452872 - RNA, 32 nt, Human
ggaggccaaggugggaggaucgcuugagacca

SEQ ID NO: 452873 - RNA, 32 nt, Human
ggaggccaaggugggaggaucgcuugagccca

SEQ ID NO: 452874 - RNA, 25 nt, Human
ggaggccaaggugggaggauuacuu

SEQ ID NO: 452875 - RNA, 32 nt, Human
ggaggccaaggugggaggauuacuugagacca

SEQ ID NO: 452876 - RNA, 25 nt, Human
ggaggccaaggugggaggauugcuu

SEQ ID NO: 452877 - RNA, 32 nt, Human
ggaggccaaggugggaggauugcuugaaccca

SEQ ID NO: 452878 - RNA, 32 nt, Human
ggaggccaaggugggaggauugcuugagccca

SEQ ID NO: 452879 - RNA, 32 nt, Human
ggaggccaaggugggaggauugcuugagcgua

SEQ ID NO: 452880 - RNA, 32 nt, Human
ggaggccaaggugggaggauugcuugagcuca

SEQ ID NO: 452881 - RNA, 32 nt, Human
ggaggccaaggugggaggauugcuugagcucg

SEQ ID NO: 452882 - RNA, 32 nt, Human
ggaggccaaggugggaggauugcuugaggcca

SEQ ID NO: 452883 - RNA, 32 nt, Human
ggaggccaaggugggagggaagaucgauugag

SEQ ID NO: 452884 - RNA, 32 nt, Human
ggaggccaaggugggaguuuugcuugaggcca

SEQ ID NO: 452885 - RNA, 32 nt, Human
ggaggccaaggugggcagauugcuugaacccc

SEQ ID NO: 452886 - RNA, 32 nt, Human
ggaggccaaggugggcggauugcuugagcuua

SEQ ID NO: 452887 - RNA, 32 nt, Human
ggaggccaaggugggugaauugcuugagguca

SEQ ID NO: 452888 - RNA, 25 nt, Human
ggaggccaaguaaggacgauugcuu

SEQ ID NO: 452889 - RNA, 18 nt, Human
ggaggccaaguccacugc

SEQ ID NO: 452890 - RNA, 32 nt, Human
ggaggccaaguugucagcuuuuugauccucua

SEQ ID NO: 452891 - RNA, 32 nt, Human
ggaggccaaugcggaaggaucgcuugagccca

SEQ ID NO: 452892 - RNA, 21 nt, Human
ggaggccaauggcggcuuccc

SEQ ID NO: 452893 - RNA, 32 nt, Human
ggaggccacaaugggacaccugagggaaaagg

SEQ ID NO: 452894 - RNA, 32 nt, Human
ggaggccacagugggcagauugcuugagccca

SEQ ID NO: 452895 - RNA, 32 nt, Human
ggaggccacaguucugugagcagaggaagagc

SEQ ID NO: 452896 - RNA, 18 nt, Human
ggaggccacaucccgggg

SEQ ID NO: 452897 - RNA, 32 nt, Human
ggaggccacauccugaauaugaauguucuacu

SEQ ID NO: 452898 - RNA, 32 nt, Human
ggaggccaccaucgugaaagagugagaucugu

SEQ ID NO: 452899 - RNA, 32 nt, Human
ggaggccaccgagaagaaggaggaagcagggg

SEQ ID NO: 452900 - RNA, 21 nt, Human
ggaggccaccugcacauucuc

SEQ ID NO: 452901 - RNA, 21 nt, Human
ggaggccacggagcuggggga

SEQ ID NO: 452902 - RNA, 32 nt, Human
ggaggccacucagcccagggaggcaggacuca

SEQ ID NO: 452903 - RNA, 32 nt, Human
ggaggccacugcacugcucacuuguggcccag

SEQ ID NO: 452904 - RNA, 22 nt, Human
ggaggccagacaccagccccca

SEQ ID NO: 452905 - RNA, 18 nt, Human
ggaggccagagagaggca

SEQ ID NO: 452906 - RNA, 32 nt, Human
ggaggccagagccuuucucugccaucagcccu

SEQ ID NO: 452907 - RNA, 32 nt, Human
ggaggccagagggagaggaggaucucagcagg

SEQ ID NO: 452908 - RNA, 32 nt, Human
ggaggccagccccuggcucacuggcacagggc

SEQ ID NO: 452909 - RNA, 32 nt, Human
ggaggccagccuggaagaggcagcaguggcuc

SEQ ID NO: 452910 - RNA, 32 nt, Human
ggaggccagccuggcccugagcugcuggauac

SEQ ID NO: 452911 - RNA, 32 nt, Human
ggaggccaggagccauccuguguucagauggu

SEQ ID NO: 452912 - RNA, 32 nt, Human
ggaggccaggaguucaauaccagccugggcaa

SEQ ID NO: 452913 - RNA, 32 nt, Human
ggaggccaggaguuuugagaccagccugggaa

SEQ ID NO: 452914 - RNA, 24 nt, Human
ggaggccaggcaggaggauugcuu

SEQ ID NO: 452915 - RNA, 32 nt, Human
ggaggccaggccaggacguccuugcucccugc

SEQ ID NO: 452916 - RNA, 32 nt, Human
ggaggccaggccgagccccuggaaccaucccg

SEQ ID NO: 452917 - RNA, 32 nt, Human
ggaggccagggaggcaggggaggcaggagagg

SEQ ID NO: 452918 - RNA, 32 nt, Human
ggaggccagggaggcaguggaggcaggagagg

SEQ ID NO: 452919 - RNA, 20 nt, Human
ggaggccagggcaggccugc

SEQ ID NO: 452920 - RNA, 25 nt, Human
ggaggccagggcgggaggauugcuu

SEQ ID NO: 452921 - RNA, 32 nt, Human
ggaggccagggcgggaggauugcuugggcuca

SEQ ID NO: 452922 - RNA, 32 nt, Human
ggaggccagggugggaggaucguuugagccca

SEQ ID NO: 452923 - RNA, 32 nt, Human
ggaggccagggugggcagaucaugaggucaga

SEQ ID NO: 452924 - RNA, 31 nt, Human
ggaggccagugccagcaccugcccagugggc

SEQ ID NO: 452925 - RNA, 22 nt, Human
ggaggccaguucgagaacugcu

SEQ ID NO: 452926 - RNA, 31 nt, Human
ggaggccaguuucaggaacuuuugccacaag

SEQ ID NO: 452927 - RNA, 32 nt, Human
ggaggccaguuucaggaacuuuugccacaagu

SEQ ID NO: 452928 - RNA, 32 nt, Human
ggaggccauagcaggaggauugcucgagccca

SEQ ID NO: 452929 - RNA, 22 nt, Human
ggaggccaucggggagccggga

SEQ ID NO: 452930 - RNA, 32 nt, Human
ggaggcccaacugaggagagugugcuggagca

SEQ ID NO: 452931 - RNA, 32 nt, Human
ggaggcccacucucccccugccgcggccuccc

SEQ ID NO: 452932 - RNA, 26 nt, Human
ggaggcccagauggggaggaucacuu

SEQ ID NO: 452933 - RNA, 32 nt, Human
ggaggcccagcuagccccagacuucggcccca

SEQ ID NO: 452934 - RNA, 32 nt, Human
ggaggcccagcuccgcaggcagguguggaugc

SEQ ID NO: 452935 - RNA, 32 nt, Human
ggaggcccaggacagaaccccaggaacaccgc

SEQ ID NO: 452936 - RNA, 32 nt, Human
ggaggcccaggaguagaggcugcagcgcccgg

SEQ ID NO: 452937 - RNA, 32 nt, Human
ggaggcccaggaguguggcugcaagagaaaag

SEQ ID NO: 452938 - RNA, 19 nt, Human
ggaggcccaggcugggaga

SEQ ID NO: 452939 - RNA, 32 nt, Human
ggaggcccagggagaacggggaagggacauuu

SEQ ID NO: 452940 - RNA, 25 nt, Human
ggaggcccaggugggaggaucgcuu

SEQ ID NO: 452941 - RNA, 32 nt, Human
ggaggcccauccgagcucagcacuggaagugu

SEQ ID NO: 452942 - RNA, 32 nt, Human
ggaggcccaucugaggagagugugcuggagca

SEQ ID NO: 452943 - RNA, 21 nt, Human
ggaggccccaauggcaucuuc

SEQ ID NO: 452944 - RNA, 19 nt, Human
ggaggccccaccccagagg

SEQ ID NO: 452945 - RNA, 28 nt, Human
ggaggccccagcacagccucaucuccau

SEQ ID NO: 452946 - RNA, 32 nt, Human
ggaggccccaggauugguccugagguacagag

SEQ ID NO: 452947 - RNA, 32 nt, Human
ggaggcccccggcggcuggagcgcggcggcag

SEQ ID NO: 452948 - RNA, 18 nt, Human
ggaggccccgcccccucc

SEQ ID NO: 452949 - RNA, 32 nt, Human
ggaggccccucaggcccgugcgggccacuguc

SEQ ID NO: 452950 - RNA, 32 nt, Human
ggaggccccucgggggcagcacaucuuccucc

SEQ ID NO: 452951 - RNA, 32 nt, Human
ggaggccccuggcauaggggacagcccugggc

SEQ ID NO: 452952 - RNA, 32 nt, Human
ggaggccccuuuccuagucucauccuccccug

SEQ ID NO: 452953 - RNA, 32 nt, Human
ggaggcccgcagagcacagagcaggagaaggg

SEQ ID NO: 452954 - RNA, 20 nt, Human
ggaggcccggaggccugcag

SEQ ID NO: 452955 - RNA, 32 nt, Human
ggaggcccggggcgcugagcucaggcccagaa

SEQ ID NO: 452956 - RNA, 32 nt, Human
ggaggcccguggacuccgcacagggaagaaac

SEQ ID NO: 452957 - RNA, 32 nt, Human
ggaggcccuagagcagagcagagcagcugugg

SEQ ID NO: 452958 - RNA, 32 nt, Human
ggaggcccuagaggagcaccaaaggagaagau

SEQ ID NO: 452959 - RNA, 32 nt, Human
ggaggcccuaucucccauccuguggaacccgc

SEQ ID NO: 452960 - RNA, 32 nt, Human
ggaggcccugaccucugcugcaguggccgccc

SEQ ID NO: 452961 - RNA, 32 nt, Human
ggaggcccugcagggucucggcuggguccgca

SEQ ID NO: 452962 - RNA, 22 nt, Human
ggaggcccugggcucccagggg

SEQ ID NO: 452963 - RNA, 32 nt, Human
ggaggccgaagcaggaggauugcuugaaucca

SEQ ID NO: 452964 - RNA, 32 nt, Human
ggaggccgaagcaggcggaucacuugagguca

SEQ ID NO: 452965 - RNA, 32 nt, Human
ggaggccgaagcagguggaucacuugaggcca

SEQ ID NO: 452966 - RNA, 25 nt, Human
ggaggccgaagugggaggacugcuu

SEQ ID NO: 452967 - RNA, 22 nt, Human
ggaggccgaagugguggcucau

SEQ ID NO: 452968 - RNA, 25 nt, Human
ggaggccgacgcaggaggauugcuu

SEQ ID NO: 452969 - RNA, 32 nt, Human
ggaggccgacgcaggaggauugcuugaggcca

SEQ ID NO: 452970 - RNA, 18 nt, Human
ggaggccgacgcagucau

SEQ ID NO: 452971 - RNA, 25 nt, Human
ggaggccgagaagggaggaucacuu

SEQ ID NO: 452972 - RNA, 32 nt, Human
ggaggccgagacaggcagauugcuugagccca

SEQ ID NO: 452973 - RNA, 32 nt, Human
ggaggccgagaggggcggggucgcggcggggc

SEQ ID NO: 452974 - RNA, 23 nt, Human
ggaggccgaggacuucaugcucc

SEQ ID NO: 452975 - RNA, 32 nt, Human
ggaggccgaggcaagagaaucgcuugaaccug

SEQ ID NO: 452976 - RNA, 32 nt, Human
ggaggccgaggcacgagaaucgcuugaacccg

SEQ ID NO: 452977 - RNA, 32 nt, Human
ggaggccgaggcacgagaauugcuugaaccca

SEQ ID NO: 452978 - RNA, 22 nt, Human
ggaggccgaggcagaaaaauca

SEQ ID NO: 452979 - RNA, 32 nt, Human
ggaggccgaggcagaagaauugcuugaacugg

SEQ ID NO: 452980 - RNA, 32 nt, Human
ggaggccgaggcaggaaaaucgcuugaaccug

SEQ ID NO: 452981 - RNA, 25 nt, Human
ggaggccgaggcaggaagacugcuu

SEQ ID NO: 452982 - RNA, 25 nt, Human
ggaggccgaggcaggaagauugcuu

SEQ ID NO: 452983 - RNA, 32 nt, Human
ggaggccgaggcaggaagauugcuugaacuca

SEQ ID NO: 452984 - RNA, 32 nt, Human
ggaggccgaggcaggagaaucgcuugaaccug

SEQ ID NO: 452985 - RNA, 32 nt, Human
ggaggccgaggcaggagaaucgcuugagccca

SEQ ID NO: 452986 - RNA, 32 nt, Human
ggaggccgaggcaggagaauugcuugaacccg

SEQ ID NO: 452987 - RNA, 32 nt, Human
ggaggccgaggcaggagaauugcuugaaccug

SEQ ID NO: 452988 - RNA, 32 nt, Human
ggaggccgaggcaggagcaucgcuugagccca

SEQ ID NO: 452989 - RNA, 32 nt, Human
ggaggccgaggcaggaggaucacuugaggcca

SEQ ID NO: 452990 - RNA, 32 nt, Human
ggaggccgaggcaggaggaucacuugaggcua

SEQ ID NO: 452991 - RNA, 32 nt, Human
ggaggccgaggcaggaggaucacuugagguca

SEQ ID NO: 452992 - RNA, 32 nt, Human
ggaggccgaggcaggaggaucgcuugagccca

SEQ ID NO: 452993 - RNA, 32 nt, Human
ggaggccgaggcaggaggauugcuugaacccg

SEQ ID NO: 452994 - RNA, 32 nt, Human
ggaggccgaggcaggaggauugcuugaggcca

SEQ ID NO: 452995 - RNA, 22 nt, Human
ggaggccgaggcaggcggauca

SEQ ID NO: 452996 - RNA, 21 nt, Human
ggaggccgaggcaggcggauu

SEQ ID NO: 452997 - RNA, 25 nt, Human
ggaggccgaggcagggggacugcuu

SEQ ID NO: 452998 - RNA, 32 nt, Human
ggaggccgaggcagggggauugcuugagcuca

SEQ ID NO: 452999 - RNA, 32 nt, Human
ggaggccgaggcagguggaucgcuugagccag

SEQ ID NO: 453000 - RNA, 32 nt, Human
ggaggccgaggcagguggaucgcuugagcuca

SEQ ID NO: 453001 - RNA, 32 nt, Human
ggaggccgaggcaguuggauuacuugaggcca

SEQ ID NO: 453002 - RNA, 32 nt, Human
ggaggccgaggcaugagaaucacuugaacccg

SEQ ID NO: 453003 - RNA, 21 nt, Human
ggaggccgaggcccacucucc

SEQ ID NO: 453004 - RNA, 23 nt, Human
ggaggccgaggcggcgagggcgg

SEQ ID NO: 453005 - RNA, 25 nt, Human
ggaggccgaggcgggaggaucacuu

SEQ ID NO: 453006 - RNA, 22 nt, Human
ggaggccgaggcgggcggauca

SEQ ID NO: 453007 - RNA, 32 nt, Human
ggaggccgaggcgggcggaucgcuugagccca

SEQ ID NO: 453008 - RNA, 32 nt, Human
ggaggccgaggcgggcggaucgcuugagguca

SEQ ID NO: 453009 - RNA, 23 nt, Human
ggaggccgaggcggguggaucau

SEQ ID NO: 453010 - RNA, 32 nt, Human
ggaggccgaggcggguggaucgcuugagcaca

SEQ ID NO: 453011 - RNA, 22 nt, Human
ggaggccgaggcuggcagauca

SEQ ID NO: 453012 - RNA, 32 nt, Human
ggaggccgaggcugggggauugcuugacguca

SEQ ID NO: 453013 - RNA, 32 nt, Human
ggaggccgaggugaguggauugcuugaguccu

SEQ ID NO: 453014 - RNA, 25 nt, Human
ggaggccgaggugggaagaucacuu

SEQ ID NO: 453015 - RNA, 25 nt, Human
ggaggccgaggugggaggagcgcuu

SEQ ID NO: 453016 - RNA, 22 nt, Human
ggaggccgaggugggaggauca

SEQ ID NO: 453017 - RNA, 25 nt, Human
ggaggccgaggugggaggaucacuu

SEQ ID NO: 453018 - RNA, 25 nt, Human
ggaggccgaggugggaggaucgcuu

SEQ ID NO: 453019 - RNA, 32 nt, Human
ggaggccgaggugggaggaucgcuugagccca

SEQ ID NO: 453020 - RNA, 25 nt, Human
ggaggccgaggugggaggauugcuu

SEQ ID NO: 453021 - RNA, 32 nt, Human
ggaggccgaggugggaggauugcuugagcuca

SEQ ID NO: 453022 - RNA, 32 nt, Human
ggaggccgaggugggaggauugcuugaggcca

SEQ ID NO: 453023 - RNA, 32 nt, Human
ggaggccgaggugggaggauugcuugagucca

SEQ ID NO: 453024 - RNA, 32 nt, Human
ggaggccgagucggaaggauugcuugagccca

SEQ ID NO: 453025 - RNA, 22 nt, Human
ggaggccgagugggaggauugc

SEQ ID NO: 453026 - RNA, 32 nt, Human
ggaggccgaucccggugcacacggugcccgug

SEQ ID NO: 453027 - RNA, 32 nt, Human
ggaggccgcagcaccuucuggaagacuuggcc

SEQ ID NO: 453028 - RNA, 32 nt, Human
ggaggccgcaggcaggugguucagugguuagg

SEQ ID NO: 453029 - RNA, 20 nt, Human
ggaggccgccugaggacugc

SEQ ID NO: 453030 - RNA, 23 nt, Human
ggaggccggagcugagccugcag

SEQ ID NO: 453031 - RNA, 19 nt, Human
ggaggccggccggccugca

SEQ ID NO: 453032 - RNA, 27 nt, Human
ggaggccggcgcuccgcuccgcuccag

SEQ ID NO: 453033 - RNA, 32 nt, Human
ggaggccgggacgucaaggggcuuccaacucc

SEQ ID NO: 453034 - RNA, 32 nt, Human
ggaggccgggagacagggacuggugagaaugg

SEQ ID NO: 453035 - RNA, 19 nt, Human
ggaggccgggaggccggga

SEQ ID NO: 453036 - RNA, 22 nt, Human
ggaggccgggcaugguggcuca

SEQ ID NO: 453037 - RNA, 22 nt, Human
ggaggccgggccugguggcuca

SEQ ID NO: 453038 - RNA, 23 nt, Human
ggaggccgggccuugggccacag

SEQ ID NO: 453039 - RNA, 22 nt, Human
ggaggccgggcgcgguggcuca

SEQ ID NO: 453040 - RNA, 20 nt, Human
ggaggccgggcugcgccugc

SEQ ID NO: 453041 - RNA, 24 nt, Human
ggaggccggggacgacaccaucuc

SEQ ID NO: 453042 - RNA, 18 nt, Human
ggaggccggggccugcag

SEQ ID NO: 453043 - RNA, 22 nt, Human
ggaggccggggcggcgggcgcg

SEQ ID NO: 453044 - RNA, 21 nt, Human
ggaggccggggcucccaggaa

SEQ ID NO: 453045 - RNA, 32 nt, Human
ggaggccgucugggaaaagauuaaggaaauug

SEQ ID NO: 453046 - RNA, 32 nt, Human
ggaggccgugaggacgcuggcuggcagaggcu

SEQ ID NO: 453047 - RNA, 32 nt, Human
ggaggccgugcugccugcucaugugggcuguu

SEQ ID NO: 453048 - RNA, 32 nt, Human
ggaggccuagacaggaggauugauugaggcua

SEQ ID NO: 453049 - RNA, 25 nt, Human
ggaggccuaggcaggaggauugcuu

SEQ ID NO: 453050 - RNA, 32 nt, Human
ggaggccuaggcaggaggauugcuugagccug

SEQ ID NO: 453051 - RNA, 32 nt, Human
ggaggccuaggugggaggauugcuugaguccg

SEQ ID NO: 453052 - RNA, 23 nt, Human
ggaggccucaccgugagaccuua

SEQ ID NO: 453053 - RNA, 32 nt, Human
ggaggccucagcaaccugcucuuccgcugcuc

SEQ ID NO: 453054 - RNA, 32 nt, Human
ggaggccuccacuccuuccaucucuuccuuca

SEQ ID NO: 453055 - RNA, 32 nt, Human
ggaggccucccaggcuggucugcuccacuggc

SEQ ID NO: 453056 - RNA, 32 nt, Human
ggaggccucccauccaggacacugggggcagg

SEQ ID NO: 453057 - RNA, 32 nt, Human
ggaggccuccuugggccuggucccccuuugcc

SEQ ID NO: 453058 - RNA, 32 nt, Human
ggaggccucgcaaucaugguggaaggcaagaa

SEQ ID NO: 453059 - RNA, 18 nt, Human
ggaggccucggcggauca

SEQ ID NO: 453060 - RNA, 32 nt, Human
ggaggccucuagugaacaccuuuaucuccaug

SEQ ID NO: 453061 - RNA, 20 nt, Human
ggaggccucuggaacccagg

SEQ ID NO: 453062 - RNA, 32 nt, Human
ggaggccucuggucucugccugcccugggugc

SEQ ID NO: 453063 - RNA, 32 nt, Human
ggaggccucuguccuccacuuugaggcucugg

SEQ ID NO: 453064 - RNA, 32 nt, Human
ggaggccugagcgggaagcauuggcguccgag

SEQ ID NO: 453065 - RNA, 32 nt, Human
ggaggccugagggcuugagggaggcuggggaa

SEQ ID NO: 453066 - RNA, 32 nt, Human
ggaggccugcacaggcuggaggaggguuuggg

SEQ ID NO: 453067 - RNA, 32 nt, Human
ggaggccugcacuuggaccugaccucaagccu

SEQ ID NO: 453068 - RNA, 32 nt, Human
ggaggccugcagaaccugagcugugacuggca

SEQ ID NO: 453069 - RNA, 32 nt, Human
ggaggccugcagccucuaacugaugccccugc

SEQ ID NO: 453070 - RNA, 22 nt, Human
ggaggccugccugccucuggag

SEQ ID NO: 453071 - RNA, 32 nt, Human
ggaggccugccugccucuguaggcuccaccuc

SEQ ID NO: 453072 - RNA, 32 nt, Human
ggaggccugccuggcaggugugcgugccucgu

SEQ ID NO: 453073 - RNA, 18 nt, Human
ggaggccuggcucuggga

SEQ ID NO: 453074 - RNA, 22 nt, Human
ggaggccugggccgcccagagg

SEQ ID NO: 453075 - RNA, 26 nt, Human
ggaggccugggcugagacagugcucu

SEQ ID NO: 453076 - RNA, 32 nt, Human
ggaggccuggggcacugcuuucugcuacaccu

SEQ ID NO: 453077 - RNA, 32 nt, Human
ggaggccuggggcagggcaccagugacaggca

SEQ ID NO: 453078 - RNA, 32 nt, Human
ggaggccugggggcagggagaggagugacuga

SEQ ID NO: 453079 - RNA, 32 nt, Human
ggaggccugugagagcugccucugccucagug

SEQ ID NO: 453080 - RNA, 32 nt, Human
ggaggccuuauuuucaaaaaugugaaauauaa

SEQ ID NO: 453081 - RNA, 32 nt, Human
ggaggccuucaaggaggugggcacagggugag

SEQ ID NO: 453082 - RNA, 32 nt, Human
ggaggccuuccucugcgaggugacaucagcug

SEQ ID NO: 453083 - RNA, 20 nt, Human
ggaggccuuggggcccucag

SEQ ID NO: 453084 - RNA, 32 nt, Human
ggaggccuuuaccaggacagagcuagaaucga

SEQ ID NO: 453085 - RNA, 23 nt, Human
ggaggccuuugaaaugcaucuuu

SEQ ID NO: 453086 - RNA, 32 nt, Human
ggaggcgaaucuguaacaagcuccucugccuu

SEQ ID NO: 453087 - RNA, 31 nt, Human
ggaggcgacaaguccaucagcagaaagucac

SEQ ID NO: 453088 - RNA, 32 nt, Human
ggaggcgaggcagggcagggcacuuucguccc

SEQ ID NO: 453089 - RNA, 22 nt, Human
ggaggcgaggcagggccugcag

SEQ ID NO: 453090 - RNA, 32 nt, Human
ggaggcgaggcagggccugcagcggucucuga

SEQ ID NO: 453091 - RNA, 22 nt, Human
ggaggcgcaaucagacugcaga

SEQ ID NO: 453092 - RNA, 32 nt, Human
ggaggcgcaggcaaugcucagcccuggaugua

SEQ ID NO: 453093 - RNA, 32 nt, Human
ggaggcgccaggcugaaaccaccaccuccacc

SEQ ID NO: 453094 - RNA, 20 nt, Human
ggaggcgcccagcaucccuc

SEQ ID NO: 453095 - RNA, 24 nt, Human
ggaggcgccgagcaccgagcgccg

SEQ ID NO: 453096 - RNA, 25 nt, Human
ggaggcgccggggcgggggaugcgg

SEQ ID NO: 453097 - RNA, 32 nt, Human
ggaggcgccugggaagggcucccuaccggccc

SEQ ID NO: 453098 - RNA, 22 nt, Human
ggaggcgcgagccguccagguc

SEQ ID NO: 453099 - RNA, 32 nt, Human
ggaggcgcgggagauguccacccugggcuggu

SEQ ID NO: 453100 - RNA, 32 nt, Human
ggaggcgcugcgcccccggccccagccgaucg

SEQ ID NO: 453101 - RNA, 32 nt, Human
ggaggcgcuggccuccugggccuugccgucca

SEQ ID NO: 453102 - RNA, 19 nt, Human
ggaggcgcuggcucuggga

SEQ ID NO: 453103 - RNA, 32 nt, Human
ggaggcgcuggcugagucggccucgugcaggc

SEQ ID NO: 453104 - RNA, 32 nt, Human
ggaggcgcuugccuucagcuugugggaaaucc

SEQ ID NO: 453105 - RNA, 32 nt, Human
ggaggcggaagcaggaguaucccuugagucug

SEQ ID NO: 453106 - RNA, 20 nt, Human
ggaggcggaaguugcgguga

SEQ ID NO: 453107 - RNA, 21 nt, Human
ggaggcggaaguugcggugag

SEQ ID NO: 453108 - RNA, 32 nt, Human
ggaggcggaauuccuaccgcugggaacugaaa

SEQ ID NO: 453109 - RNA, 32 nt, Human
ggaggcggagcgccacaaggaggacuugaagc

SEQ ID NO: 453110 - RNA, 23 nt, Human
ggaggcggaggagaggccugcgg

SEQ ID NO: 453111 - RNA, 32 nt, Human
ggaggcggaggagggcgcauugcuugagccua

SEQ ID NO: 453112 - RNA, 32 nt, Human
ggaggcggaggcagaggcugcagugacccaag

SEQ ID NO: 453113 - RNA, 32 nt, Human
ggaggcggaggcagagguggaggcgcuuugaa

SEQ ID NO: 453114 - RNA, 32 nt, Human
ggaggcggaggcagcggcuggaggagcgcgag

SEQ ID NO: 453115 - RNA, 32 nt, Human
ggaggcggaggcaggaggaucucuugaaguca

SEQ ID NO: 453116 - RNA, 32 nt, Human
ggaggcggaggcaggcggguugcuugagcucc

SEQ ID NO: 453117 - RNA, 22 nt, Human
ggaggcggaggcccggaggcgg

SEQ ID NO: 453118 - RNA, 20 nt, Human
ggaggcggaggcggaggcgg

SEQ ID NO: 453119 - RNA, 32 nt, Human
ggaggcggaggcggagggcgaggggcggggag

SEQ ID NO: 453120 - RNA, 32 nt, Human
ggaggcggaggcggagguugcagugagccaag

SEQ ID NO: 453121 - RNA, 20 nt, Human
ggaggcggaggcggccgcgg

SEQ ID NO: 453122 - RNA, 21 nt, Human
ggaggcggaggcggggguacg

SEQ ID NO: 453123 - RNA, 32 nt, Human
ggaggcggagguaguggugagcaaagaucgua

SEQ ID NO: 453124 - RNA, 32 nt, Human
ggaggcggagguggagcuggcggagagcggga

SEQ ID NO: 453125 - RNA, 20 nt, Human
ggaggcggagguugcagcga

SEQ ID NO: 453126 - RNA, 21 nt, Human
ggaggcggagguugcagcgag

SEQ ID NO: 453127 - RNA, 20 nt, Human
ggaggcggagguugcaguga

SEQ ID NO: 453128 - RNA, 21 nt, Human
ggaggcggagguugcagugag

SEQ ID NO: 453129 - RNA, 32 nt, Human
ggaggcggagucucacucuguugcccaggcug

SEQ ID NO: 453130 - RNA, 20 nt, Human
ggaggcggaguuugcaguga

SEQ ID NO: 453131 - RNA, 24 nt, Human
ggaggcggcaacggcgggcgccgg

SEQ ID NO: 453132 - RNA, 22 nt, Human
ggaggcggcacccaggggccgg

SEQ ID NO: 453133 - RNA, 21 nt, Human
ggaggcggcagaggcugcccg

SEQ ID NO: 453134 - RNA, 32 nt, Human
ggaggcggcagcgguuggaggcuucgcccggc

SEQ ID NO: 453135 - RNA, 21 nt, Human
ggaggcggcaggcccggguca

SEQ ID NO: 453136 - RNA, 22 nt, Human
ggaggcggcaggugcacgggaa

SEQ ID NO: 453137 - RNA, 32 nt, Human
ggaggcggcccaggcugccuuggugauucugg

SEQ ID NO: 453138 - RNA, 32 nt, Human
ggaggcggccccggacggggauggucagcggc

SEQ ID NO: 453139 - RNA, 32 nt, Human
ggaggcggccgugggccgccugggcagaaugu

SEQ ID NO: 453140 - RNA, 32 nt, Human
ggaggcggccucuccccuguugcugcccgugu

SEQ ID NO: 453141 - RNA, 32 nt, Human
ggaggcggcgaagggcgcaggagcaucgcucg

SEQ ID NO: 453142 - RNA, 22 nt, Human
ggaggcggcgagagaggacugc

SEQ ID NO: 453143 - RNA, 23 nt, Human
ggaggcggcggccacggcgcggg

SEQ ID NO: 453144 - RNA, 20 nt, Human
ggaggcggcggcggaggcgg

SEQ ID NO: 453145 - RNA, 24 nt, Human
ggaggcggcggcggcgaagggagg

SEQ ID NO: 453146 - RNA, 22 nt, Human
ggaggcggcggcggcgcgcgga

SEQ ID NO: 453147 - RNA, 20 nt, Human
ggaggcggcggcgggaacgg

SEQ ID NO: 453148 - RNA, 19 nt, Human
ggaggcggcggcgggagcg

SEQ ID NO: 453149 - RNA, 24 nt, Human
ggaggcggcgggccacggcgcgaa

SEQ ID NO: 453150 - RNA, 32 nt, Human
ggaggcggcgggcggaggcggcgggagcggug

SEQ ID NO: 453151 - RNA, 32 nt, Human
ggaggcggcggggucuuugucucgcugcagcg

SEQ ID NO: 453152 - RNA, 23 nt, Human
ggaggcggcgguggcucccgggg

SEQ ID NO: 453153 - RNA, 32 nt, Human
ggaggcggcugggauagaggccagucccaaac

SEQ ID NO: 453154 - RNA, 21 nt, Human
ggaggcgggacuucgggugcg

SEQ ID NO: 453155 - RNA, 32 nt, Human
ggaggcgggagaugcagccaggaggaacagcu

SEQ ID NO: 453156 - RNA, 20 nt, Human
ggaggcgggagccgugugcg

SEQ ID NO: 453157 - RNA, 26 nt, Human
ggaggcgggaggacgcgcaggggcgg

SEQ ID NO: 453158 - RNA, 32 nt, Human
ggaggcgggaggaucaugaggucaggagaucg

SEQ ID NO: 453159 - RNA, 23 nt, Human
ggaggcgggaggcggcggcggcg

SEQ ID NO: 453160 - RNA, 23 nt, Human
ggaggcgggaggcgggaggccgg

SEQ ID NO: 453161 - RNA, 23 nt, Human
ggaggcgggagggcgggcgcugg

SEQ ID NO: 453162 - RNA, 32 nt, Human
ggaggcgggagggugggcucuauauuuucauu

SEQ ID NO: 453163 - RNA, 21 nt, Human
ggaggcgggagucgccugcgg

SEQ ID NO: 453164 - RNA, 23 nt, Human
ggaggcgggaugccggggggcgg

SEQ ID NO: 453165 - RNA, 32 nt, Human
ggaggcgggaugggacacccaacacuuuuucc

SEQ ID NO: 453166 - RNA, 32 nt, Human
ggaggcgggcggcccgggccucaggccccucc

SEQ ID NO: 453167 - RNA, 32 nt, Human
ggaggcgggcggggccgguggaucuggagccg

SEQ ID NO: 453168 - RNA, 32 nt, Human
ggaggcgggcgugagacaagcccagcccgcac

SEQ ID NO: 453169 - RNA, 22 nt, Human
ggaggcggggcagggcugagca

SEQ ID NO: 453170 - RNA, 32 nt, Human
ggaggcggggcccugcaggacgucauguucuc

SEQ ID NO: 453171 - RNA, 22 nt, Human
ggaggcggggcggcgggggcgg

SEQ ID NO: 453172 - RNA, 19 nt, Human
ggaggcgggggcggggcgg

SEQ ID NO: 453173 - RNA, 32 nt, Human
ggaggcggggguggacagggaggcagcuugug

SEQ ID NO: 453174 - RNA, 32 nt, Human
ggaggcggugaugucggugcagguugugucag

SEQ ID NO: 453175 - RNA, 19 nt, Human
ggaggcggugguccuggga

SEQ ID NO: 453176 - RNA, 20 nt, Human
ggaggcggugguggaggagg

SEQ ID NO: 453177 - RNA, 32 nt, Human
ggaggcgugagaguccaugaagggggugugag

SEQ ID NO: 453178 - RNA, 32 nt, Human
ggaggcguucaucgaacugcacugccugccca

SEQ ID NO: 453179 - RNA, 32 nt, Human
ggaggcuaaagcaggagaauugcuugaaccug

SEQ ID NO: 453180 - RNA, 25 nt, Human
ggaggcuaaagugggaggauuacuu

SEQ ID NO: 453181 - RNA, 32 nt, Human
ggaggcuaagauaggaggaucacuugagccca

SEQ ID NO: 453182 - RNA, 32 nt, Human
ggaggcuaagaugaguggauugcuugagccua

SEQ ID NO: 453183 - RNA, 32 nt, Human
ggaggcuaagccaggaggacuguuugagccca

SEQ ID NO: 453184 - RNA, 32 nt, Human
ggaggcuaagcccaguucaaggcugcagugaa

SEQ ID NO: 453185 - RNA, 22 nt, Human
ggaggcuaaggaacucgucuuu

SEQ ID NO: 453186 - RNA, 32 nt, Human
ggaggcuaaggcaagagaauugcuugaacccg

SEQ ID NO: 453187 - RNA, 32 nt, Human
ggaggcuaaggcaggaaaauuguuugaaccca

SEQ ID NO: 453188 - RNA, 32 nt, Human
ggaggcuaaggcaggagaauagcaugaacccg

SEQ ID NO: 453189 - RNA, 32 nt, Human
ggaggcuaaggcaggagaaucacuugaaccca

SEQ ID NO: 453190 - RNA, 32 nt, Human
ggaggcuaaggcaggagaaucacuugaacccu

SEQ ID NO: 453191 - RNA, 32 nt, Human
ggaggcuaaggcaggagaaucacuugaaccug

SEQ ID NO: 453192 - RNA, 32 nt, Human
ggaggcuaaggcaggagaaucacuugaaucca

SEQ ID NO: 453193 - RNA, 32 nt, Human
ggaggcuaaggcaggagaaucgcuugaaccca

SEQ ID NO: 453194 - RNA, 32 nt, Human
ggaggcuaaggcaggagaaucgcuugaacccc

SEQ ID NO: 453195 - RNA, 32 nt, Human
ggaggcuaaggcaggagaaucgcuugaacccg

SEQ ID NO: 453196 - RNA, 32 nt, Human
ggaggcuaaggcaggagaaucgcuugacggga

SEQ ID NO: 453197 - RNA, 32 nt, Human
ggaggcuaaggcaggagaauggcgugaacccg

SEQ ID NO: 453198 - RNA, 32 nt, Human
ggaggcuaaggcaggagaauugcuugaaccug

SEQ ID NO: 453199 - RNA, 32 nt, Human
ggaggcuaaggcaggagaauugcuugagccca

SEQ ID NO: 453200 - RNA, 32 nt, Human
ggaggcuaaggcaggagcaucguuugagccca

SEQ ID NO: 453201 - RNA, 25 nt, Human
ggaggcuaaggcaggaggauugcuu

SEQ ID NO: 453202 - RNA, 32 nt, Human
ggaggcuaaggcaggaggauugcuugagcaua

SEQ ID NO: 453203 - RNA, 32 nt, Human
ggaggcuaaggcaggaggauugcuugagccca

SEQ ID NO: 453204 - RNA, 32 nt, Human
ggaggcuaaggcaggcagaucacuugagacca

SEQ ID NO: 453205 - RNA, 32 nt, Human
ggaggcuaaggcaggcggaucacuugagguca

SEQ ID NO: 453206 - RNA, 32 nt, Human
ggaggcuaaggcaggcugaucacuugagguca

SEQ ID NO: 453207 - RNA, 32 nt, Human
ggaggcuaaggcagggagaacugcuugaacuc

SEQ ID NO: 453208 - RNA, 32 nt, Human
ggaggcuaaggcagggagaaucgcuugaagua

SEQ ID NO: 453209 - RNA, 32 nt, Human
ggaggcuaaggcagggagaauugcuuaaaccg

SEQ ID NO: 453210 - RNA, 32 nt, Human
ggaggcuaaggcagggagauggcuugagacca

SEQ ID NO: 453211 - RNA, 32 nt, Human
ggaggcuaaggcaggggaaucgcuugaaccug

SEQ ID NO: 453212 - RNA, 32 nt, Human
ggaggcuaaggcaugagaaucgcuugaaccug

SEQ ID NO: 453213 - RNA, 32 nt, Human
ggaggcuaaggcgggagaaucgcuugaauugg

SEQ ID NO: 453214 - RNA, 22 nt, Human
ggaggcuaaggcugcccaggag

SEQ ID NO: 453215 - RNA, 19 nt, Human
ggaggcuaaggcugggaga

SEQ ID NO: 453216 - RNA, 32 nt, Human
ggaggcuaagguaagagaauugcuugacccca

SEQ ID NO: 453217 - RNA, 32 nt, Human
ggaggcuaagguagaagaauugcuugaaccug

SEQ ID NO: 453218 - RNA, 25 nt, Human
ggaggcuaaggugggagaauugcuu

SEQ ID NO: 453219 - RNA, 32 nt, Human
ggaggcuaaggugggagaauugcuugaacccg

SEQ ID NO: 453220 - RNA, 32 nt, Human
ggaggcuaaggugggagaauugcuugaaccug

SEQ ID NO: 453221 - RNA, 25 nt, Human
ggaggcuaaggugggaggaucacuu

SEQ ID NO: 453222 - RNA, 32 nt, Human
ggaggcuaaugcaggagaaucgcuugaaccca

SEQ ID NO: 453223 - RNA, 32 nt, Human
ggaggcuacagcaggagaauugcuugaacucg

SEQ ID NO: 453224 - RNA, 32 nt, Human
ggaggcuaccagggccagagacagggaauggg

SEQ ID NO: 453225 - RNA, 32 nt, Human
ggaggcuaggcacggcaccagccugggaugcc

SEQ ID NO: 453226 - RNA, 32 nt, Human
ggaggcucagcagcaggacgacuugagcccaa

SEQ ID NO: 453227 - RNA, 32 nt, Human
ggaggcucagcaggucuuggagcugggagagg

SEQ ID NO: 453228 - RNA, 32 nt, Human
ggaggcucagcaguggucuugagggguaaagg

SEQ ID NO: 453229 - RNA, 32 nt, Human
ggaggcucaggcacgagaaucgcuugagucug

SEQ ID NO: 453230 - RNA, 32 nt, Human
ggaggcucaggcaggaggaucacuugaaccca

SEQ ID NO: 453231 - RNA, 25 nt, Human
ggaggcucaggcaggaggauugcuu

SEQ ID NO: 453232 - RNA, 32 nt, Human
ggaggcucaggcaggaggauugcuugagccca

SEQ ID NO: 453233 - RNA, 25 nt, Human
ggaggcucaggugggaggaucacuu

SEQ ID NO: 453234 - RNA, 25 nt, Human
ggaggcucaggugggaggauugcuu

SEQ ID NO: 453235 - RNA, 32 nt, Human
ggaggcucaggugggaggauugcuugaggcca

SEQ ID NO: 453236 - RNA, 32 nt, Human
ggaggcucaggugggcgaauugcuugagccca

SEQ ID NO: 453237 - RNA, 32 nt, Human
ggaggcucagugaccugcccugggugacacgg

SEQ ID NO: 453238 - RNA, 20 nt, Human
ggaggcucaugccuguaauc

SEQ ID NO: 453239 - RNA, 32 nt, Human
ggaggcuccacaguccuugccugcucauggac

SEQ ID NO: 453240 - RNA, 32 nt, Human
ggaggcuccagccauagcgccugguguaucca

SEQ ID NO: 453241 - RNA, 32 nt, Human
ggaggcuccaguuugggaaaggacugacugag

SEQ ID NO: 453242 - RNA, 32 nt, Human
ggaggcucccucugcugacccccugcagccug

SEQ ID NO: 453243 - RNA, 32 nt, Human
ggaggcucccugugccuggggccugagugcug

SEQ ID NO: 453244 - RNA, 32 nt, Human
ggaggcuccucugugagcucuaccugccuccc

SEQ ID NO: 453245 - RNA, 21 nt, Human
ggaggcucgagugacaucuuc

SEQ ID NO: 453246 - RNA, 21 nt, Human
ggaggcucggcuucucugcug

SEQ ID NO: 453247 - RNA, 32 nt, Human
ggaggcucuccugagugucugccccugcagug

SEQ ID NO: 453248 - RNA, 32 nt, Human
ggaggcucugggcggaggugcagugaccccgc

SEQ ID NO: 453249 - RNA, 32 nt, Human
ggaggcucugugggaugcuguugccuuggucc

SEQ ID NO: 453250 - RNA, 32 nt, Human
ggaggcugaaacaggagaauugcuugaaccug

SEQ ID NO: 453251 - RNA, 25 nt, Human
ggaggcugaaaugggaggaucacuu

SEQ ID NO: 453252 - RNA, 32 nt, Human
ggaggcugaaccaggagaauugcuugaaccgg

SEQ ID NO: 453253 - RNA, 32 nt, Human
ggaggcugaagcaagagaaucgcuugaaccca

SEQ ID NO: 453254 - RNA, 32 nt, Human
ggaggcugaagcaccagaaucucuugaaccca

SEQ ID NO: 453255 - RNA, 32 nt, Human
ggaggcugaagcagaagaaucgcuugaacccg

SEQ ID NO: 453256 - RNA, 32 nt, Human
ggaggcugaagcagaagaauugcuugaaccca

SEQ ID NO: 453257 - RNA, 32 nt, Human
ggaggcugaagcaggaaaaucgcuugaacuga

SEQ ID NO: 453258 - RNA, 32 nt, Human
ggaggcugaagcaggagaacugccugaaccca

SEQ ID NO: 453259 - RNA, 32 nt, Human
ggaggcugaagcaggagaaucacuugaaccca

SEQ ID NO: 453260 - RNA, 32 nt, Human
ggaggcugaagcaggagaaucacuugaacccg

SEQ ID NO: 453261 - RNA, 32 nt, Human
ggaggcugaagcaggagaaucacuugaaccug

SEQ ID NO: 453262 - RNA, 32 nt, Human
ggaggcugaagcaggagaaucacuugaacuca

SEQ ID NO: 453263 - RNA, 32 nt, Human
ggaggcugaagcaggagaaucccuugaaccug

SEQ ID NO: 453264 - RNA, 32 nt, Human
ggaggcugaagcaggagaaucgcuggaaccca

SEQ ID NO: 453265 - RNA, 32 nt, Human
ggaggcugaagcaggagaaucgcuugaacccg

SEQ ID NO: 453266 - RNA, 32 nt, Human
ggaggcugaagcaggagaaucgcuugaaccug

SEQ ID NO: 453267 - RNA, 32 nt, Human
ggaggcugaagcaggagaaucgcuugagccca

SEQ ID NO: 453268 - RNA, 32 nt, Human
ggaggcugaagcaggagaaucguuugaauucg

SEQ ID NO: 453269 - RNA, 32 nt, Human
ggaggcugaagcaggagaauggcaugaacccg

SEQ ID NO: 453270 - RNA, 32 nt, Human
ggaggcugaagcaggagaauggcgugaaccug

SEQ ID NO: 453271 - RNA, 32 nt, Human
ggaggcugaagcaggagaauugccugaaccca

SEQ ID NO: 453272 - RNA, 32 nt, Human
ggaggcugaagcaggagaauugccugaaccug

SEQ ID NO: 453273 - RNA, 32 nt, Human
ggaggcugaagcaggagaauugcucaaaccug

SEQ ID NO: 453274 - RNA, 32 nt, Human
ggaggcugaagcaggagaauugcucgaaccug

SEQ ID NO: 453275 - RNA, 32 nt, Human
ggaggcugaagcaggagaauugcuugaacccg

SEQ ID NO: 453276 - RNA, 32 nt, Human
ggaggcugaagcaggagagucacuugaaccug

SEQ ID NO: 453277 - RNA, 32 nt, Human
ggaggcugaagcaggagauuugcuugaaccug

SEQ ID NO: 453278 - RNA, 32 nt, Human
ggaggcugaagcaggagcauggcgugaaccug

SEQ ID NO: 453279 - RNA, 25 nt, Human
ggaggcugaagcaggaggacugcuu

SEQ ID NO: 453280 - RNA, 32 nt, Human
ggaggcugaagcaggaggacugcuugagcuga

SEQ ID NO: 453281 - RNA, 32 nt, Human
ggaggcugaagcaggaggacugcuugaggcca

SEQ ID NO: 453282 - RNA, 32 nt, Human
ggaggcugaagcaggaggauagcuagagccca

SEQ ID NO: 453283 - RNA, 32 nt, Human
ggaggcugaagcaggaggauagcuugagccca

SEQ ID NO: 453284 - RNA, 32 nt, Human
ggaggcugaagcaggaggaucacuugagccca

SEQ ID NO: 453285 - RNA, 32 nt, Human
ggaggcugaagcaggaggaucacuugagccug

SEQ ID NO: 453286 - RNA, 32 nt, Human
ggaggcugaagcaggaggaucacuugagcuug

SEQ ID NO: 453287 - RNA, 32 nt, Human
ggaggcugaagcaggaggaucacuugaggcca

SEQ ID NO: 453288 - RNA, 32 nt, Human
ggaggcugaagcaggaggauugaggaagaggu

SEQ ID NO: 453289 - RNA, 32 nt, Human
ggaggcugaagcaggaggauugauugagccug

SEQ ID NO: 453290 - RNA, 32 nt, Human
ggaggcugaagcaggaggauugcuugagccug

SEQ ID NO: 453291 - RNA, 32 nt, Human
ggaggcugaagcaggauaaucgcuugaacccg

SEQ ID NO: 453292 - RNA, 32 nt, Human
ggaggcugaagcaggaugauagcuugauuacc

SEQ ID NO: 453293 - RNA, 32 nt, Human
ggaggcugaagcaggcagauugcuugaggcca

SEQ ID NO: 453294 - RNA, 32 nt, Human
ggaggcugaagcaugagaaucacuugaauccu

SEQ ID NO: 453295 - RNA, 32 nt, Human
ggaggcugaagcgacgccggaggcaggcaaag

SEQ ID NO: 453296 - RNA, 25 nt, Human
ggaggcugaagcgggaggaucgcuu

SEQ ID NO: 453297 - RNA, 32 nt, Human
ggaggcugaaggcagauuggaggagaaacagc

SEQ ID NO: 453298 - RNA, 32 nt, Human
ggaggcugaaguaggaggaucauuuaugcuug

SEQ ID NO: 453299 - RNA, 32 nt, Human
ggaggcugaaguaggaggaucgucuugagccc

SEQ ID NO: 453300 - RNA, 25 nt, Human
ggaggcugaagugggaagaucacuu

SEQ ID NO: 453301 - RNA, 25 nt, Human
ggaggcugaagugggagaauuacuu

SEQ ID NO: 453302 - RNA, 25 nt, Human
ggaggcugaagugggaggaucgcuu

SEQ ID NO: 453303 - RNA, 32 nt, Human
ggaggcugaagugggaggauuacuugagcccg

SEQ ID NO: 453304 - RNA, 25 nt, Human
ggaggcugaagugggaggauugcuu

SEQ ID NO: 453305 - RNA, 32 nt, Human
ggaggcugacauaggagaauugcuugaauaua

SEQ ID NO: 453306 - RNA, 32 nt, Human
ggaggcugacgcaggagaaucgcuugaaccug

SEQ ID NO: 453307 - RNA, 25 nt, Human
ggaggcugacgcaggaggauugcuu

SEQ ID NO: 453308 - RNA, 32 nt, Human
ggaggcugacgcaggggaauugcuugaaccag

SEQ ID NO: 453309 - RNA, 32 nt, Human
ggaggcugacggaggaggaucacuugagccca

SEQ ID NO: 453310 - RNA, 25 nt, Human
ggaggcugacgugggaggauugcuu

SEQ ID NO: 453311 - RNA, 32 nt, Human
ggaggcugacgugggaggauugcuugugccca

SEQ ID NO: 453312 - RNA, 32 nt, Human
ggaggcugagacacaagaauugcuugaaucca

SEQ ID NO: 453313 - RNA, 32 nt, Human
ggaggcugagacagaagaaucgcuugaaccug

SEQ ID NO: 453314 - RNA, 32 nt, Human
ggaggcugagacagaagaauugcuugaaccug

SEQ ID NO: 453315 - RNA, 32 nt, Human
ggaggcugagacaggacaaucgcuugaaccug

SEQ ID NO: 453316 - RNA, 32 nt, Human
ggaggcugagacaggacacuugcuugaacccg

SEQ ID NO: 453317 - RNA, 32 nt, Human
ggaggcugagacaggagaaucgcuugaaccca

SEQ ID NO: 453318 - RNA, 32 nt, Human
ggaggcugagacaggagaaucgcuugaacccg

SEQ ID NO: 453319 - RNA, 32 nt, Human
ggaggcugagacaggagaaucgcuugaacccu

SEQ ID NO: 453320 - RNA, 32 nt, Human
ggaggcugagacaggagaaucgcuugaaccug

SEQ ID NO: 453321 - RNA, 32 nt, Human
ggaggcugagacaggagaaucgcuugaauccg

SEQ ID NO: 453322 - RNA, 32 nt, Human
ggaggcugagacaggagaauugcuugaaccca

SEQ ID NO: 453323 - RNA, 32 nt, Human
ggaggcugagacaggagaauugcuugaacccg

SEQ ID NO: 453324 - RNA, 32 nt, Human
ggaggcugagacaggagaauugcuugaaccug

SEQ ID NO: 453325 - RNA, 32 nt, Human
ggaggcugagacaggagacuugcuugaaugug

SEQ ID NO: 453326 - RNA, 32 nt, Human
ggaggcugagacaggagagucgcuugaaccug

SEQ ID NO: 453327 - RNA, 32 nt, Human
ggaggcugagacaggagauuugcuugaacccg

SEQ ID NO: 453328 - RNA, 32 nt, Human
ggaggcugagacaggaggauuccuugagcccu

SEQ ID NO: 453329 - RNA, 32 nt, Human
ggaggcugagacaggaggauugccugaggcca

SEQ ID NO: 453330 - RNA, 25 nt, Human
ggaggcugagacaggaggauugcuu

SEQ ID NO: 453331 - RNA, 32 nt, Human
ggaggcugagacaggcgaauugcuugaaccug

SEQ ID NO: 453332 - RNA, 32 nt, Human
ggaggcugagagaggagauuugcuugaaccca

SEQ ID NO: 453333 - RNA, 32 nt, Human
ggaggcugagaggugggaggaugccuugagcu

SEQ ID NO: 453334 - RNA, 32 nt, Human
ggaggcugagauaggagaaucgcuugaaccug

SEQ ID NO: 453335 - RNA, 32 nt, Human
ggaggcugagauaggaggaucacuugaacccg

SEQ ID NO: 453336 - RNA, 25 nt, Human
ggaggcugagaugggaggaucacuu

SEQ ID NO: 453337 - RNA, 25 nt, Human
ggaggcugagaugggaggaucgcuu

SEQ ID NO: 453338 - RNA, 23 nt, Human
ggaggcugagaugggaggauugc

SEQ ID NO: 453339 - RNA, 32 nt, Human
ggaggcugagaugggaggauugccugagccca

SEQ ID NO: 453340 - RNA, 25 nt, Human
ggaggcugagaugggaggauugcuu

SEQ ID NO: 453341 - RNA, 32 nt, Human
ggaggcugagaugggaggauugcuugagccca

SEQ ID NO: 453342 - RNA, 32 nt, Human
ggaggcugagaugggaggauugcuugagccug

SEQ ID NO: 453343 - RNA, 32 nt, Human
ggaggcugagauggguggauugcuugagccca

SEQ ID NO: 453344 - RNA, 32 nt, Human
ggaggcugagaugugagaaucacuugaaccug

SEQ ID NO: 453345 - RNA, 32 nt, Human
ggaggcugagaugugagaauugcuugagccca

SEQ ID NO: 453346 - RNA, 32 nt, Human
ggaggcugagauugcagugagccgaaaucacg

SEQ ID NO: 453347 - RNA, 32 nt, Human
ggaggcugagccacgagaggcuaggcacuucc

SEQ ID NO: 453348 - RNA, 32 nt, Human
ggaggcugagccacucagcaucuccugguccu

SEQ ID NO: 453349 - RNA, 32 nt, Human
ggaggcugagccaggagaaucgcuugaacccg

SEQ ID NO: 453350 - RNA, 32 nt, Human
ggaggcugagccaggagaauugcuugaaccca

SEQ ID NO: 453351 - RNA, 32 nt, Human
ggaggcugagccaggaggaucacuugagcccg

SEQ ID NO: 453352 - RNA, 32 nt, Human
ggaggcugagccuugucaggcccagccacauc

SEQ ID NO: 453353 - RNA, 32 nt, Human
ggaggcugagcuucgaggauugauugagccag

SEQ ID NO: 453354 - RNA, 32 nt, Human
ggaggcugaggaaggagaaucgcuugaacccg

SEQ ID NO: 453355 - RNA, 32 nt, Human
ggaggcugaggaaggagaaucgcuugaagccu

SEQ ID NO: 453356 - RNA, 32 nt, Human
ggaggcugaggaaggagaauugcuugaacuug

SEQ ID NO: 453357 - RNA, 32 nt, Human
ggaggcugaggagggagaaucgguugaaccug

SEQ ID NO: 453358 - RNA, 32 nt, Human
ggaggcugaggcaagagaaucgcuugaaacug

SEQ ID NO: 453359 - RNA, 32 nt, Human
ggaggcugaggcaagagaaucgcuugaaccca

SEQ ID NO: 453360 - RNA, 32 nt, Human
ggaggcugaggcaagagaaucgcuugaacccg

SEQ ID NO: 453361 - RNA, 32 nt, Human
ggaggcugaggcaagagaaucgcuugaaccug

SEQ ID NO: 453362 - RNA, 32 nt, Human
ggaggcugaggcaagagaaucgcuugaacuca

SEQ ID NO: 453363 - RNA, 32 nt, Human
ggaggcugaggcaagagaaucgcuugaaucug

SEQ ID NO: 453364 - RNA, 32 nt, Human
ggaggcugaggcaagagaaucguuugaaccug

SEQ ID NO: 453365 - RNA, 32 nt, Human
ggaggcugaggcaagagaauugcuugaaccca

SEQ ID NO: 453366 - RNA, 32 nt, Human
ggaggcugaggcaagagaauugcuugaacccg

SEQ ID NO: 453367 - RNA, 32 nt, Human
ggaggcugaggcaagagaauugcuugaacuca

SEQ ID NO: 453368 - RNA, 32 nt, Human
ggaggcugaggcaagagaauugcuuggacccg

SEQ ID NO: 453369 - RNA, 32 nt, Human
ggaggcugaggcaagagaauugcuuggacuca

SEQ ID NO: 453370 - RNA, 32 nt, Human
ggaggcugaggcaagagaguugcuugaaccca

SEQ ID NO: 453371 - RNA, 22 nt, Human
ggaggcugaggcaagaggauca

SEQ ID NO: 453372 - RNA, 32 nt, Human
ggaggcugaggcaagaggaucgcuugagccca

SEQ ID NO: 453373 - RNA, 25 nt, Human
ggaggcugaggcaagaggauugcuu

SEQ ID NO: 453374 - RNA, 32 nt, Human
ggaggcugaggcaagaggauugcuugaguuaa

SEQ ID NO: 453375 - RNA, 32 nt, Human
ggaggcugaggcaagaggauugcuugggcccg

SEQ ID NO: 453376 - RNA, 32 nt, Human
ggaggcugaggcacaagaaucgcuugaaccca

SEQ ID NO: 453377 - RNA, 32 nt, Human
ggaggcugaggcacaagaaucgcuugaacccg

SEQ ID NO: 453378 - RNA, 32 nt, Human
ggaggcugaggcacaagaaucgcuugaaucca

SEQ ID NO: 453379 - RNA, 32 nt, Human
ggaggcugaggcacaagaauugcuugaaccag

SEQ ID NO: 453380 - RNA, 32 nt, Human
ggaggcugaggcacaagaauugcuugaaccug

SEQ ID NO: 453381 - RNA, 32 nt, Human
ggaggcugaggcacaggaauugcuugaaccca

SEQ ID NO: 453382 - RNA, 32 nt, Human
ggaggcugaggcaccagaauugcuugaaccca

SEQ ID NO: 453383 - RNA, 32 nt, Human
ggaggcugaggcacgagaaucgcuugaaccug

SEQ ID NO: 453384 - RNA, 32 nt, Human
ggaggcugaggcacgagaaucgcuugagcccg

SEQ ID NO: 453385 - RNA, 32 nt, Human
ggaggcugaggcacgagaaucgcuugagcccu

SEQ ID NO: 453386 - RNA, 32 nt, Human
ggaggcugaggcacgagaaucgcuugagccug

SEQ ID NO: 453387 - RNA, 32 nt, Human
ggaggcugaggcacgagaauugcuugaaccca

SEQ ID NO: 453388 - RNA, 32 nt, Human
ggaggcugaggcacgagacuugcuugaaccca

SEQ ID NO: 453389 - RNA, 32 nt, Human
ggaggcugaggcacuagaaucgcuugagccug

SEQ ID NO: 453390 - RNA, 22 nt, Human
ggaggcugaggcagaacugcuu

SEQ ID NO: 453391 - RNA, 22 nt, Human
ggaggcugaggcagaagaauca

SEQ ID NO: 453392 - RNA, 32 nt, Human
ggaggcugaggcagaagaaucgcuugaaccca

SEQ ID NO: 453393 - RNA, 32 nt, Human
ggaggcugaggcagaagaaucgcuugaacccg

SEQ ID NO: 453394 - RNA, 32 nt, Human
ggaggcugaggcagaagaaucgcuugaacccu

SEQ ID NO: 453395 - RNA, 32 nt, Human
ggaggcugaggcagaagaaucgcuugaaccgg

SEQ ID NO: 453396 - RNA, 32 nt, Human
ggaggcugaggcagaagaaucgcuugaaccug

SEQ ID NO: 453397 - RNA, 32 nt, Human
ggaggcugaggcagaagaaucgcuugagcccg

SEQ ID NO: 453398 - RNA, 32 nt, Human
ggaggcugaggcagaagaauugcuugaaccca

SEQ ID NO: 453399 - RNA, 25 nt, Human
ggaggcugaggcagaaggauugcuu

SEQ ID NO: 453400 - RNA, 32 nt, Human
ggaggcugaggcagaaggauugcuugaacccg

SEQ ID NO: 453401 - RNA, 32 nt, Human
ggaggcugaggcagaaguauugcuugaaccca

SEQ ID NO: 453402 - RNA, 32 nt, Human
ggaggcugaggcagaauaaucgcuugaaccca

SEQ ID NO: 453403 - RNA, 25 nt, Human
ggaggcugaggcagauggacugcuu

SEQ ID NO: 453404 - RNA, 22 nt, Human
ggaggcugaggcaggaaaauca

SEQ ID NO: 453405 - RNA, 32 nt, Human
ggaggcugaggcaggaaaaucgcuugaaccca

SEQ ID NO: 453406 - RNA, 32 nt, Human
ggaggcugaggcaggaaaaucgcuugcaccca

SEQ ID NO: 453407 - RNA, 32 nt, Human
ggaggcugaggcaggaaaauugcuugaacccg

SEQ ID NO: 453408 - RNA, 32 nt, Human
ggaggcugaggcaggaagcucgcuugagcuca

SEQ ID NO: 453409 - RNA, 32 nt, Human
ggaggcugaggcaggacaaucgcuugaaccug

SEQ ID NO: 453410 - RNA, 24 nt, Human
ggaggcugaggcaggagaacugcu

SEQ ID NO: 453411 - RNA, 22 nt, Human
ggaggcugaggcaggagaauca

SEQ ID NO: 453412 - RNA, 32 nt, Human
ggaggcugaggcaggagaaucgccugaaccca

SEQ ID NO: 453413 - RNA, 32 nt, Human
ggaggcugaggcaggagaaucgccugaacccg

SEQ ID NO: 453414 - RNA, 32 nt, Human
ggaggcugaggcaggagaaucgccugaaccug

SEQ ID NO: 453415 - RNA, 32 nt, Human
ggaggcugaggcaggagaaucgcgugaaccca

SEQ ID NO: 453416 - RNA, 32 nt, Human
ggaggcugaggcaggagaaucgcgugaacccg

SEQ ID NO: 453417 - RNA, 32 nt, Human
ggaggcugaggcaggagaaucgcuagaacccg

SEQ ID NO: 453418 - RNA, 32 nt, Human
ggaggcugaggcaggagaaucgcuagaaccug

SEQ ID NO: 453419 - RNA, 32 nt, Human
ggaggcugaggcaggagaaucgcuggaaccca

SEQ ID NO: 453420 - RNA, 32 nt, Human
ggaggcugaggcaggagaaucgcuggaacccg

SEQ ID NO: 453421 - RNA, 32 nt, Human
ggaggcugaggcaggagaaucgcuggaaccug

SEQ ID NO: 453422 - RNA, 32 nt, Human
ggaggcugaggcaggagaaucgcuggagcccg

SEQ ID NO: 453423 - RNA, 32 nt, Human
ggaggcugaggcaggagaaucgcuuaaaccug

SEQ ID NO: 453424 - RNA, 32 nt, Human
ggaggcugaggcaggagaaucgcuuaaacucg

SEQ ID NO: 453425 - RNA, 32 nt, Human
ggaggcugaggcaggagaaucgcuugaaaaca

SEQ ID NO: 453426 - RNA, 32 nt, Human
ggaggcugaggcaggagaaucgcuugaaacug

SEQ ID NO: 453427 - RNA, 32 nt, Human
ggaggcugaggcaggagaaucgcuugaaccag

SEQ ID NO: 453428 - RNA, 32 nt, Human
ggaggcugaggcaggagaaucgcuugaaccca

SEQ ID NO: 453429 - RNA, 32 nt, Human
ggaggcugaggcaggagaaucgcuugaacccg

SEQ ID NO: 453430 - RNA, 32 nt, Human
ggaggcugaggcaggagaaucgcuugaaccgg

SEQ ID NO: 453431 - RNA, 32 nt, Human
ggaggcugaggcaggagaaucgcuugaaccua

SEQ ID NO: 453432 - RNA, 32 nt, Human
ggaggcugaggcaggagaaucgcuugaaccug

SEQ ID NO: 453433 - RNA, 32 nt, Human
ggaggcugaggcaggagaaucgcuugaacuca

SEQ ID NO: 453434 - RNA, 32 nt, Human
ggaggcugaggcaggagaaucgcuugaacucg

SEQ ID NO: 453435 - RNA, 32 nt, Human
ggaggcugaggcaggagaaucgcuugaaucca

SEQ ID NO: 453436 - RNA, 32 nt, Human
ggaggcugaggcaggagaaucgcuugaauccg

SEQ ID NO: 453437 - RNA, 32 nt, Human
ggaggcugaggcaggagaaucgcuugaaucug

SEQ ID NO: 453438 - RNA, 32 nt, Human
ggaggcugaggcaggagaaucgcuugacucca

SEQ ID NO: 453439 - RNA, 32 nt, Human
ggaggcugaggcaggagaaucgcuugagccca

SEQ ID NO: 453440 - RNA, 32 nt, Human
ggaggcugaggcaggagaaucgcuugagcccg

SEQ ID NO: 453441 - RNA, 32 nt, Human
ggaggcugaggcaggagaaucgcuugagccug

SEQ ID NO: 453442 - RNA, 32 nt, Human
ggaggcugaggcaggagaaucgcuuggaccug

SEQ ID NO: 453443 - RNA, 32 nt, Human
ggaggcugaggcaggagaaucgcuuguaccca

SEQ ID NO: 453444 - RNA, 32 nt, Human
ggaggcugaggcaggagaaucgguugaaccag

SEQ ID NO: 453445 - RNA, 32 nt, Human
ggaggcugaggcaggagaaucgguugaacccg

SEQ ID NO: 453446 - RNA, 32 nt, Human
ggaggcugaggcaggagaaucguuugaaccca

SEQ ID NO: 453447 - RNA, 32 nt, Human
ggaggcugaggcaggagaaucguuugaacccg

SEQ ID NO: 453448 - RNA, 32 nt, Human
ggaggcugaggcaggagaaucguuugaaccug

SEQ ID NO: 453449 - RNA, 32 nt, Human
ggaggcugaggcaggagaaugaagugaaccga

SEQ ID NO: 453450 - RNA, 32 nt, Human
ggaggcugaggcaggagaaugaugugaacccg

SEQ ID NO: 453451 - RNA, 32 nt, Human
ggaggcugaggcaggagaauggcgggaaccug

SEQ ID NO: 453452 - RNA, 32 nt, Human
ggaggcugaggcaggagaauguggugaaccug

SEQ ID NO: 453453 - RNA, 32 nt, Human
ggaggcugaggcaggagaauugcuugaaaccc

SEQ ID NO: 453454 - RNA, 32 nt, Human
ggaggcugaggcaggagaauugcuugaaccaa

SEQ ID NO: 453455 - RNA, 32 nt, Human
ggaggcugaggcaggagaauugcuugaaccag

SEQ ID NO: 453456 - RNA, 32 nt, Human
ggaggcugaggcaggagaauugcuugaaccca

SEQ ID NO: 453457 - RNA, 32 nt, Human
ggaggcugaggcaggagaauugcuugaacccg

SEQ ID NO: 453458 - RNA, 32 nt, Human
ggaggcugaggcaggagaauugcuugaacccu

SEQ ID NO: 453459 - RNA, 32 nt, Human
ggaggcugaggcaggagaauugcuugaaccua

SEQ ID NO: 453460 - RNA, 32 nt, Human
ggaggcugaggcaggagaauugcuugaaccug

SEQ ID NO: 453461 - RNA, 32 nt, Human
ggaggcugaggcaggagaauugcuugaacuca

SEQ ID NO: 453462 - RNA, 32 nt, Human
ggaggcugaggcaggagaauugcuugaacucg

SEQ ID NO: 453463 - RNA, 32 nt, Human
ggaggcugaggcaggagaauugcuugaacugg

SEQ ID NO: 453464 - RNA, 32 nt, Human
ggaggcugaggcaggagaauugcuugaacuug

SEQ ID NO: 453465 - RNA, 32 nt, Human
ggaggcugaggcaggagaauugcuugaagaug

SEQ ID NO: 453466 - RNA, 32 nt, Human
ggaggcugaggcaggagaauugcuugaauccc

SEQ ID NO: 453467 - RNA, 32 nt, Human
ggaggcugaggcaggagaauugcuugaauccg

SEQ ID NO: 453468 - RNA, 32 nt, Human
ggaggcugaggcaggagaauugcuugaaucua

SEQ ID NO: 453469 - RNA, 32 nt, Human
ggaggcugaggcaggagaauugcuugaaucug

SEQ ID NO: 453470 - RNA, 32 nt, Human
ggaggcugaggcaggagaauugcuugagccca

SEQ ID NO: 453471 - RNA, 32 nt, Human
ggaggcugaggcaggagaauugcuugagcccg

SEQ ID NO: 453472 - RNA, 32 nt, Human
ggaggcugaggcaggagaauugcuugagccug

SEQ ID NO: 453473 - RNA, 32 nt, Human
ggaggcugaggcaggagaauugcuugagucca

SEQ ID NO: 453474 - RNA, 32 nt, Human
ggaggcugaggcaggagaauugcuuggaccua

SEQ ID NO: 453475 - RNA, 32 nt, Human
ggaggcugaggcaggagacucgcuugaaccca

SEQ ID NO: 453476 - RNA, 32 nt, Human
ggaggcugaggcaggagacucgcuugaaccug

SEQ ID NO: 453477 - RNA, 32 nt, Human
ggaggcugaggcaggagauucgcuugaaccug

SEQ ID NO: 453478 - RNA, 32 nt, Human
ggaggcugaggcaggagauucgcuugaacuca

SEQ ID NO: 453479 - RNA, 32 nt, Human
ggaggcugaggcaggagcaucgcuugaaccug

SEQ ID NO: 453480 - RNA, 32 nt, Human
ggaggcugaggcaggagcauugcuugaacccg

SEQ ID NO: 453481 - RNA, 24 nt, Human
ggaggcugaggcaggaggaccgcu

SEQ ID NO: 453482 - RNA, 32 nt, Human
ggaggcugaggcaggaggaccgcuugagccca

SEQ ID NO: 453483 - RNA, 25 nt, Human
ggaggcugaggcaggaggacugcuu

SEQ ID NO: 453484 - RNA, 32 nt, Human
ggaggcugaggcaggaggacugcuugagccca

SEQ ID NO: 453485 - RNA, 25 nt, Human
ggaggcugaggcaggaggacuguuu

SEQ ID NO: 453486 - RNA, 32 nt, Human
ggaggcugaggcaggaggacuguuugaguuca

SEQ ID NO: 453487 - RNA, 32 nt, Human
ggaggcugaggcaggaggaggauaacuugaac

SEQ ID NO: 453488 - RNA, 32 nt, Human
ggaggcugaggcaggaggauagcuugaggcug

SEQ ID NO: 453489 - RNA, 22 nt, Human
ggaggcugaggcaggaggauca

SEQ ID NO: 453490 - RNA, 32 nt, Human
ggaggcugaggcaggaggaucacucgagcuca

SEQ ID NO: 453491 - RNA, 32 nt, Human
ggaggcugaggcaggaggaucacuugaaccug

SEQ ID NO: 453492 - RNA, 32 nt, Human
ggaggcugaggcaggaggaucacuugaacugg

SEQ ID NO: 453493 - RNA, 32 nt, Human
ggaggcugaggcaggaggaucacuugagacca

SEQ ID NO: 453494 - RNA, 32 nt, Human
ggaggcugaggcaggaggaucacuugagccaa

SEQ ID NO: 453495 - RNA, 32 nt, Human
ggaggcugaggcaggaggaucacuugagccca

SEQ ID NO: 453496 - RNA, 32 nt, Human
ggaggcugaggcaggaggaucacuugagccua

SEQ ID NO: 453497 - RNA, 32 nt, Human
ggaggcugaggcaggaggaucacuugaggcca

SEQ ID NO: 453498 - RNA, 32 nt, Human
ggaggcugaggcaggaggaucacuugagguca

SEQ ID NO: 453499 - RNA, 23 nt, Human
ggaggcugaggcaggaggaucau

SEQ ID NO: 453500 - RNA, 32 nt, Human
ggaggcugaggcaggaggaucauuugagccca

SEQ ID NO: 453501 - RNA, 32 nt, Human
ggaggcugaggcaggaggaucauuugagguca

SEQ ID NO: 453502 - RNA, 32 nt, Human
ggaggcugaggcaggaggaucccuugagccca

SEQ ID NO: 453503 - RNA, 32 nt, Human
ggaggcugaggcaggaggaucccuugagucca

SEQ ID NO: 453504 - RNA, 32 nt, Human
ggaggcugaggcaggaggaucccuugaguuca

SEQ ID NO: 453505 - RNA, 32 nt, Human
ggaggcugaggcaggaggaucccuuggguuca

SEQ ID NO: 453506 - RNA, 32 nt, Human
ggaggcugaggcaggaggaucgccugagccca

SEQ ID NO: 453507 - RNA, 32 nt, Human
ggaggcugaggcaggaggaucgcuugaaccca

SEQ ID NO: 453508 - RNA, 32 nt, Human
ggaggcugaggcaggaggaucgcuugagccca

SEQ ID NO: 453509 - RNA, 32 nt, Human
ggaggcugaggcaggaggaucgcuugaggcca

SEQ ID NO: 453510 - RNA, 32 nt, Human
ggaggcugaggcaggaggaucgcuugagugug

SEQ ID NO: 453511 - RNA, 32 nt, Human
ggaggcugaggcaggaggaucgcuugggccug

SEQ ID NO: 453512 - RNA, 32 nt, Human
ggaggcugaggcaggaggaucucuugagccca

SEQ ID NO: 453513 - RNA, 32 nt, Human
ggaggcugaggcaggaggauggcgugaacccg

SEQ ID NO: 453514 - RNA, 32 nt, Human
ggaggcugaggcaggaggauggcuugaaccug

SEQ ID NO: 453515 - RNA, 32 nt, Human
ggaggcugaggcaggaggauggugugaaccug

SEQ ID NO: 453516 - RNA, 32 nt, Human
ggaggcugaggcaggaggauugccugagccca

SEQ ID NO: 453517 - RNA, 32 nt, Human
ggaggcugaggcaggaggauugccugaggcca

SEQ ID NO: 453518 - RNA, 24 nt, Human
ggaggcugaggcaggaggauugcu

SEQ ID NO: 453519 - RNA, 25 nt, Human
ggaggcugaggcaggaggauugcuu

SEQ ID NO: 453520 - RNA, 32 nt, Human
ggaggcugaggcaggaggauugcuugaacccg

SEQ ID NO: 453521 - RNA, 32 nt, Human
ggaggcugaggcaggaggauugcuugaacccu

SEQ ID NO: 453522 - RNA, 32 nt, Human
ggaggcugaggcaggaggauugcuugagccca

SEQ ID NO: 453523 - RNA, 32 nt, Human
ggaggcugaggcaggaggauugcuugaggcca

SEQ ID NO: 453524 - RNA, 32 nt, Human
ggaggcugaggcaggaggauugcuugagucua

SEQ ID NO: 453525 - RNA, 32 nt, Human
ggaggcugaggcaggaggauuguuugaggcca

SEQ ID NO: 453526 - RNA, 32 nt, Human
ggaggcugaggcaggagggucucuugagccca

SEQ ID NO: 453527 - RNA, 32 nt, Human
ggaggcugaggcaggaggguugcuugagacua

SEQ ID NO: 453528 - RNA, 32 nt, Human
ggaggcugaggcaggaguauugcuugaacccg

SEQ ID NO: 453529 - RNA, 32 nt, Human
ggaggcugaggcaggauaaucgcuugaauccg

SEQ ID NO: 453530 - RNA, 32 nt, Human
ggaggcugaggcaggauaauugcuugaaccca

SEQ ID NO: 453531 - RNA, 32 nt, Human
ggaggcugaggcaggauaauugcuugagccug

SEQ ID NO: 453532 - RNA, 32 nt, Human
ggaggcugaggcaggauaauugcuuggaccug

SEQ ID NO: 453533 - RNA, 32 nt, Human
ggaggcugaggcaggcagauugcuugagcuca

SEQ ID NO: 453534 - RNA, 32 nt, Human
ggaggcugaggcaggcggaucgcuugagcuca

SEQ ID NO: 453535 - RNA, 32 nt, Human
ggaggcugaggcaggggaaucgcuugaaccug

SEQ ID NO: 453536 - RNA, 32 nt, Human
ggaggcugaggcaggggaauugcuugaaccag

SEQ ID NO: 453537 - RNA, 32 nt, Human
ggaggcugaggcaggggaauugcuugaacccg

SEQ ID NO: 453538 - RNA, 32 nt, Human
ggaggcugaggcaggggcauugcuugggcccg

SEQ ID NO: 453539 - RNA, 22 nt, Human
ggaggcugaggcaggugaauca

SEQ ID NO: 453540 - RNA, 32 nt, Human
ggaggcugaggcaggugaaucgcuugaaccca

SEQ ID NO: 453541 - RNA, 32 nt, Human
ggaggcugaggcagguggauugcuugaaccca

SEQ ID NO: 453542 - RNA, 32 nt, Human
ggaggcugaggcagguggauugcuuugaggcc

SEQ ID NO: 453543 - RNA, 32 nt, Human
ggaggcugaggcaguagaaucgcuugaaccca

SEQ ID NO: 453544 - RNA, 32 nt, Human
ggaggcugaggcauaagaaucgccugaacccg

SEQ ID NO: 453545 - RNA, 32 nt, Human
ggaggcugaggcaugagaaucaauugaacccg

SEQ ID NO: 453546 - RNA, 32 nt, Human
ggaggcugaggcaugagaaucacuuaaaccug

SEQ ID NO: 453547 - RNA, 32 nt, Human
ggaggcugaggcaugagaaucacuugaacccu

SEQ ID NO: 453548 - RNA, 32 nt, Human
ggaggcugaggcaugagaaucacuugaaccug

SEQ ID NO: 453549 - RNA, 32 nt, Human
ggaggcugaggcaugagaaucgcugcaacuug

SEQ ID NO: 453550 - RNA, 32 nt, Human
ggaggcugaggcaugagaaucgcuugaaccua

SEQ ID NO: 453551 - RNA, 32 nt, Human
ggaggcugaggcaugagaaucgcuugaaccug

SEQ ID NO: 453552 - RNA, 32 nt, Human
ggaggcugaggcaugagaaucgcuugagccgg

SEQ ID NO: 453553 - RNA, 32 nt, Human
ggaggcugaggcaugagaaucgcuuggacccg

SEQ ID NO: 453554 - RNA, 32 nt, Human
ggaggcugaggcaugagaaucgcuugggccca

SEQ ID NO: 453555 - RNA, 32 nt, Human
ggaggcugaggcaugagaauuacuugaaccca

SEQ ID NO: 453556 - RNA, 32 nt, Human
ggaggcugaggcaugagaauugcuugaaccag

SEQ ID NO: 453557 - RNA, 32 nt, Human
ggaggcugaggcaugagaauugcuugaaccca

SEQ ID NO: 453558 - RNA, 32 nt, Human
ggaggcugaggcaugagaauugcuugaacccg

SEQ ID NO: 453559 - RNA, 32 nt, Human
ggaggcugaggcaugagaauugcuugaaccug

SEQ ID NO: 453560 - RNA, 32 nt, Human
ggaggcugaggcaugagacuugccugaaccca

SEQ ID NO: 453561 - RNA, 32 nt, Human
ggaggcugaggccagagaaucgcuugaaccug

SEQ ID NO: 453562 - RNA, 32 nt, Human
ggaggcugaggccaggaggauggguggacgcu

SEQ ID NO: 453563 - RNA, 32 nt, Human
ggaggcugaggcccgagaaucgcuugagcccu

SEQ ID NO: 453564 - RNA, 32 nt, Human
ggaggcugaggccggagaaucgcuugagcccg

SEQ ID NO: 453565 - RNA, 32 nt, Human
ggaggcugaggccggaggauugcuugagccca

SEQ ID NO: 453566 - RNA, 32 nt, Human
ggaggcugaggccugagacucgcuugaaccca

SEQ ID NO: 453567 - RNA, 32 nt, Human
ggaggcugaggcgagagaaucgcuugagccug

SEQ ID NO: 453568 - RNA, 25 nt, Human
ggaggcugaggcgagaggauugcuu

SEQ ID NO: 453569 - RNA, 32 nt, Human
ggaggcugaggcggaacgaucgcuugagccuu

SEQ ID NO: 453570 - RNA, 32 nt, Human
ggaggcugaggcggaagauucgcuugagccca

SEQ ID NO: 453571 - RNA, 32 nt, Human
ggaggcugaggcggaugaauugcuugaaucca

SEQ ID NO: 453572 - RNA, 32 nt, Human
ggaggcugaggcgggagaaucgcuugaaccca

SEQ ID NO: 453573 - RNA, 32 nt, Human
ggaggcugaggcgggagaaucgcuugaacccg

SEQ ID NO: 453574 - RNA, 32 nt, Human
ggaggcugaggcgggagaauugcuugaacagg

SEQ ID NO: 453575 - RNA, 32 nt, Human
ggaggcugaggcgggagaauugcuugaacccg

SEQ ID NO: 453576 - RNA, 25 nt, Human
ggaggcugaggcgggaggaucacuu

SEQ ID NO: 453577 - RNA, 25 nt, Human
ggaggcugaggcgggaggaucgcuu

SEQ ID NO: 453578 - RNA, 32 nt, Human
ggaggcugaggcgggaggaucgcuugagccca

SEQ ID NO: 453579 - RNA, 25 nt, Human
ggaggcugaggcgggaggauugcuu

SEQ ID NO: 453580 - RNA, 32 nt, Human
ggaggcugaggcgggaggauugcuugaggcca

SEQ ID NO: 453581 - RNA, 32 nt, Human
ggaggcugaggcgggcagauugcuugagguca

SEQ ID NO: 453582 - RNA, 32 nt, Human
ggaggcugaggcggguggauugcuugagacca

SEQ ID NO: 453583 - RNA, 32 nt, Human
ggaggcugaggcggguggauugcuugagccca

SEQ ID NO: 453584 - RNA, 32 nt, Human
ggaggcugaggcggguggauugcuugaggcca

SEQ ID NO: 453585 - RNA, 32 nt, Human
ggaggcugaggcgugagaaucgcuugaacccg

SEQ ID NO: 453586 - RNA, 32 nt, Human
ggaggcugaggcuggagaaucgcuugaaccca

SEQ ID NO: 453587 - RNA, 32 nt, Human
ggaggcugaggcuggagaaucgcuugaggcua

SEQ ID NO: 453588 - RNA, 32 nt, Human
ggaggcugaggcuggagaaucguuugaggcua

SEQ ID NO: 453589 - RNA, 32 nt, Human
ggaggcugaggcuggagaauggugugaaccca

SEQ ID NO: 453590 - RNA, 32 nt, Human
ggaggcugaggcuggagaauugcuugaggcua

SEQ ID NO: 453591 - RNA, 32 nt, Human
ggaggcugaggcuggagaguugcucaaacccg

SEQ ID NO: 453592 - RNA, 32 nt, Human
ggaggcugaggcuggaggaucgcuugaaccug

SEQ ID NO: 453593 - RNA, 32 nt, Human
ggaggcugaggcuggaggauugguugagcuua

SEQ ID NO: 453594 - RNA, 22 nt, Human
ggaggcugaggcugguggauca

SEQ ID NO: 453595 - RNA, 32 nt, Human
ggaggcugaggggcaaggauugcuugaggcug

SEQ ID NO: 453596 - RNA, 32 nt, Human
ggaggcugagggggaagaauugcuugggccca

SEQ ID NO: 453597 - RNA, 32 nt, Human
ggaggcugaggggguggaucaccugaggucgg

SEQ ID NO: 453598 - RNA, 32 nt, Human
ggaggcugaggguggagaaucgcuugaaccug

SEQ ID NO: 453599 - RNA, 32 nt, Human
ggaggcugagguaggagaaucgcuugaaccca

SEQ ID NO: 453600 - RNA, 32 nt, Human
ggaggcugagguaggagaaucgcuugaacccg

SEQ ID NO: 453601 - RNA, 32 nt, Human
ggaggcugagguaggagaaucguuugaacuca

SEQ ID NO: 453602 - RNA, 32 nt, Human
ggaggcugagguaggagaauggcgugaacccg

SEQ ID NO: 453603 - RNA, 32 nt, Human
ggaggcugagguaggagaauugcuugaaccca

SEQ ID NO: 453604 - RNA, 32 nt, Human
ggaggcugagguaggagaauugcuugaaccug

SEQ ID NO: 453605 - RNA, 32 nt, Human
ggaggcugagguaggagaauugcuugacccug

SEQ ID NO: 453606 - RNA, 32 nt, Human
ggaggcugagguaggagaauugcuugagccug

SEQ ID NO: 453607 - RNA, 32 nt, Human
ggaggcugagguaggagagucgcuugagccug

SEQ ID NO: 453608 - RNA, 25 nt, Human
ggaggcugagguaggaggacugcuu

SEQ ID NO: 453609 - RNA, 32 nt, Human
ggaggcugagguaggaggaucacuuaagccug

SEQ ID NO: 453610 - RNA, 32 nt, Human
ggaggcugagguaggaggaucacuugggccaa

SEQ ID NO: 453611 - RNA, 32 nt, Human
ggaggcugagguaggaggaucgccugagcaug

SEQ ID NO: 453612 - RNA, 32 nt, Human
ggaggcugagguaggaggaucgcuugaaccca

SEQ ID NO: 453613 - RNA, 32 nt, Human
ggaggcugagguaggaggaucgcuugagccug

SEQ ID NO: 453614 - RNA, 32 nt, Human
ggaggcugagguaggaggaucgcuugaggcca

SEQ ID NO: 453615 - RNA, 32 nt, Human
ggaggcugagguaggaggauugauugaggcca

SEQ ID NO: 453616 - RNA, 32 nt, Human
ggaggcugagguaggcagaucacuugagcuca

SEQ ID NO: 453617 - RNA, 32 nt, Human
ggaggcugagguaguagaauugcuugaaccag

SEQ ID NO: 453618 - RNA, 32 nt, Human
ggaggcugagguaugaggauugcuugagccug

SEQ ID NO: 453619 - RNA, 25 nt, Human
ggaggcugaggugaaaggauugcuu

SEQ ID NO: 453620 - RNA, 32 nt, Human
ggaggcugaggugaaaggauugcuugagccag

SEQ ID NO: 453621 - RNA, 32 nt, Human
ggaggcugaggugagaggaucgcuugagcuca

SEQ ID NO: 453622 - RNA, 32 nt, Human
ggaggcugaggugagaggauuccuugaggcca

SEQ ID NO: 453623 - RNA, 32 nt, Human
ggaggcugaggugagcagguugcuugagccca

SEQ ID NO: 453624 - RNA, 32 nt, Human
ggaggcugaggugaguggauugcuugaguccg

SEQ ID NO: 453625 - RNA, 32 nt, Human
ggaggcugagguggaaagauggcccaggaauu

SEQ ID NO: 453626 - RNA, 32 nt, Human
ggaggcugagguggaaggaucgcuugagccca

SEQ ID NO: 453627 - RNA, 32 nt, Human
ggaggcugagguggaaggauugcuugagccug

SEQ ID NO: 453628 - RNA, 32 nt, Human
ggaggcugagguggacagaucgcuugagccca

SEQ ID NO: 453629 - RNA, 32 nt, Human
ggaggcugagguggagggaucgcuugaaucca

SEQ ID NO: 453630 - RNA, 25 nt, Human
ggaggcugaggugggaaaaucacuu

SEQ ID NO: 453631 - RNA, 25 nt, Human
ggaggcugaggugggagaaucacuu

SEQ ID NO: 453632 - RNA, 25 nt, Human
ggaggcugaggugggagaaucgcuu

SEQ ID NO: 453633 - RNA, 32 nt, Human
ggaggcugaggugggagaaucgcuugaaccca

SEQ ID NO: 453634 - RNA, 23 nt, Human
ggaggcugaggugggagaauugc

SEQ ID NO: 453635 - RNA, 24 nt, Human
ggaggcugaggugggagaauugcu

SEQ ID NO: 453636 - RNA, 25 nt, Human
ggaggcugaggugggagaauugcuu

SEQ ID NO: 453637 - RNA, 32 nt, Human
ggaggcugaggugggagaauugcuugaaccca

SEQ ID NO: 453638 - RNA, 32 nt, Human
ggaggcugaggugggagaauugcuugaaccug

SEQ ID NO: 453639 - RNA, 32 nt, Human
ggaggcugaggugggagaauugcuugagccca

SEQ ID NO: 453640 - RNA, 32 nt, Human
ggaggcugaggugggagccugggaggucaagg

SEQ ID NO: 453641 - RNA, 25 nt, Human
ggaggcugaggugggaggacugcuu

SEQ ID NO: 453642 - RNA, 25 nt, Human
ggaggcugaggugggaggaucacuu

SEQ ID NO: 453643 - RNA, 32 nt, Human
ggaggcugaggugggaggaucccaggaguuca

SEQ ID NO: 453644 - RNA, 23 nt, Human
ggaggcugaggugggaggaucgc

SEQ ID NO: 453645 - RNA, 25 nt, Human
ggaggcugaggugggaggaucgcuu

SEQ ID NO: 453646 - RNA, 32 nt, Human
ggaggcugaggugggaggaucgcuugaaccca

SEQ ID NO: 453647 - RNA, 32 nt, Human
ggaggcugaggugggaggaucgcuugagccca

SEQ ID NO: 453648 - RNA, 32 nt, Human
ggaggcugaggugggaggaucgcuugagccug

SEQ ID NO: 453649 - RNA, 32 nt, Human
ggaggcugaggugggaggaucgcuugaggcaa

SEQ ID NO: 453650 - RNA, 23 nt, Human
ggaggcugaggugggaggauugc

SEQ ID NO: 453651 - RNA, 32 nt, Human
ggaggcugaggugggaggauugccugagccca

SEQ ID NO: 453652 - RNA, 25 nt, Human
ggaggcugaggugggaggauugcuu

SEQ ID NO: 453653 - RNA, 32 nt, Human
ggaggcugaggugggaggauugcuugaaccca

SEQ ID NO: 453654 - RNA, 32 nt, Human
ggaggcugaggugggaggauugcuugaacccg

SEQ ID NO: 453655 - RNA, 32 nt, Human
ggaggcugaggugggaggauugcuugagacca

SEQ ID NO: 453656 - RNA, 32 nt, Human
ggaggcugaggugggaggauugcuugagccaa

SEQ ID NO: 453657 - RNA, 32 nt, Human
ggaggcugaggugggaggauugcuugagccca

SEQ ID NO: 453658 - RNA, 32 nt, Human
ggaggcugaggugggaggauugcuugagcccu

SEQ ID NO: 453659 - RNA, 32 nt, Human
ggaggcugaggugggaggauugcuugagccua

SEQ ID NO: 453660 - RNA, 32 nt, Human
ggaggcugaggugggaggauugcuugagccug

SEQ ID NO: 453661 - RNA, 32 nt, Human
ggaggcugaggugggaggauugcuugagucca

SEQ ID NO: 453662 - RNA, 32 nt, Human
ggaggcugaggugggaggauugcuugggccug

SEQ ID NO: 453663 - RNA, 32 nt, Human
ggaggcugaggugggaggauuguuugagccca

SEQ ID NO: 453664 - RNA, 32 nt, Human
ggaggcugaggugggaggauuguuugagccug

SEQ ID NO: 453665 - RNA, 32 nt, Human
ggaggcugaggugggagggucgcuugaguuca

SEQ ID NO: 453666 - RNA, 32 nt, Human
ggaggcugaggugggaggguugcuugagccca

SEQ ID NO: 453667 - RNA, 32 nt, Human
ggaggcugaggugggcagaucgcuugagccca

SEQ ID NO: 453668 - RNA, 32 nt, Human
ggaggcugaggugggcggauugcuugaggucg

SEQ ID NO: 453669 - RNA, 32 nt, Human
ggaggcugagguggguggauugcuugagccca

SEQ ID NO: 453670 - RNA, 32 nt, Human
ggaggcugaggugguuguauugcuugaggcca

SEQ ID NO: 453671 - RNA, 32 nt, Human
ggaggcugagguugcaggaucgcuugagccca

SEQ ID NO: 453672 - RNA, 32 nt, Human
ggaggcugagguuggagaaucgcuugaggcca

SEQ ID NO: 453673 - RNA, 32 nt, Human
ggaggcugagguuggaggauugcuugagccca

SEQ ID NO: 453674 - RNA, 32 nt, Human
ggaggcugagucaggagaaucgcuugaaccug

SEQ ID NO: 453675 - RNA, 32 nt, Human
ggaggcugagucaggauaauugcuugaaccug

SEQ ID NO: 453676 - RNA, 32 nt, Human
ggaggcugaguccccuuccucacugcucucua

SEQ ID NO: 453677 - RNA, 32 nt, Human
ggaggcugagucugaaauaaacucugucgucu

SEQ ID NO: 453678 - RNA, 24 nt, Human
ggaggcugagugggaugaccgcuu

SEQ ID NO: 453679 - RNA, 32 nt, Human
ggaggcugaugcaagaggaucgcuugagccca

SEQ ID NO: 453680 - RNA, 32 nt, Human
ggaggcugaugcaugagaauugcuugaaccca

SEQ ID NO: 453681 - RNA, 32 nt, Human
ggaggcugcacuggagccacaggcagggguga

SEQ ID NO: 453682 - RNA, 32 nt, Human
ggaggcugcagaggaggagcagggugggguuu

SEQ ID NO: 453683 - RNA, 32 nt, Human
ggaggcugcagcugaagguggcaggaacccac

SEQ ID NO: 453684 - RNA, 32 nt, Human
ggaggcugcccacauccccacaugugcacugu

SEQ ID NO: 453685 - RNA, 32 nt, Human
ggaggcugccggaacucaagaggcagaaaaag

SEQ ID NO: 453686 - RNA, 32 nt, Human
ggaggcugccgggcagaguggagcagcuuggg

SEQ ID NO: 453687 - RNA, 32 nt, Human
ggaggcugcgacaggaaaauugcuugaacuca

SEQ ID NO: 453688 - RNA, 32 nt, Human
ggaggcugcgccccuccaguucugccuucaua

SEQ ID NO: 453689 - RNA, 32 nt, Human
ggaggcugcggcaggagaauugcuugaacccg

SEQ ID NO: 453690 - RNA, 32 nt, Human
ggaggcugcggcgggagaaucgcuugaaccgg

SEQ ID NO: 453691 - RNA, 32 nt, Human
ggaggcugcgguucugcuuccuccuggggcug

SEQ ID NO: 453692 - RNA, 32 nt, Human
ggaggcugcuguuacugagcuguggggaccag

SEQ ID NO: 453693 - RNA, 32 nt, Human
ggaggcuggacaccuguucugcuguugugucc

SEQ ID NO: 453694 - RNA, 18 nt, Human
ggaggcuggacagcucca

SEQ ID NO: 453695 - RNA, 32 nt, Human
ggaggcuggagguggagauggggucaggaaca

SEQ ID NO: 453696 - RNA, 32 nt, Human
ggaggcuggcacaggagaaucgcuugaaucug

SEQ ID NO: 453697 - RNA, 32 nt, Human
ggaggcuggcagcugaaagagcagggaaggcu

SEQ ID NO: 453698 - RNA, 32 nt, Human
ggaggcuggccuuucaucucagcaccagggug

SEQ ID NO: 453699 - RNA, 23 nt, Human
ggaggcuggcggacaggcgacag

SEQ ID NO: 453700 - RNA, 22 nt, Human
ggaggcuggcggguugcuucag

SEQ ID NO: 453701 - RNA, 32 nt, Human
ggaggcuggcucugcuggccgucacgagcacu

SEQ ID NO: 453702 - RNA, 29 nt, Human
ggaggcuggcugcugcccaccucucucgc

SEQ ID NO: 453703 - RNA, 32 nt, Human
ggaggcuggcugcugcccaccucucucgcacc

SEQ ID NO: 453704 - RNA, 32 nt, Human
ggaggcuggcuggcugucucucucacacagau

SEQ ID NO: 453705 - RNA, 32 nt, Human
ggaggcugggacaggagaaucgcuugaacccg

SEQ ID NO: 453706 - RNA, 32 nt, Human
ggaggcugggagagcagcaagggggaccaggu

SEQ ID NO: 453707 - RNA, 32 nt, Human
ggaggcugggagaggggaacgugggaauagca

SEQ ID NO: 453708 - RNA, 32 nt, Human
ggaggcugggagguggcugucuccuagugucu

SEQ ID NO: 453709 - RNA, 32 nt, Human
ggaggcugggccauuaugagcucugcauuucc

SEQ ID NO: 453710 - RNA, 19 nt, Human
ggaggcugggccccuggga

SEQ ID NO: 453711 - RNA, 32 nt, Human
ggaggcugggccggugggagagggaggcgagc

SEQ ID NO: 453712 - RNA, 32 nt, Human
ggaggcugggccugaaugggggcaaguugagg

SEQ ID NO: 453713 - RNA, 24 nt, Human
ggaggcugggccugcccacuccag

SEQ ID NO: 453714 - RNA, 32 nt, Human
ggaggcugggcugcagcccugccccuuccugg

SEQ ID NO: 453715 - RNA, 32 nt, Human
ggaggcugggcuggcacaguggagagcaacag

SEQ ID NO: 453716 - RNA, 18 nt, Human
ggaggcugggcugggaga

SEQ ID NO: 453717 - RNA, 32 nt, Human
ggaggcugggcugggagaggaggcaaggaaca

SEQ ID NO: 453718 - RNA, 32 nt, Human
ggaggcuggggcagcagaaucgcuugaaccug

SEQ ID NO: 453719 - RNA, 32 nt, Human
ggaggcuggggcaggagaaucgcuugaaccca

SEQ ID NO: 453720 - RNA, 32 nt, Human
ggaggcuggggcaggagaauggcaugaaccca

SEQ ID NO: 453721 - RNA, 32 nt, Human
ggaggcuggggcaggagaauugcuugaaccca

SEQ ID NO: 453722 - RNA, 32 nt, Human
ggaggcuggggcaugagaauugcuuuaacccg

SEQ ID NO: 453723 - RNA, 32 nt, Human
ggaggcuggggccagaugacagcuagugaggg

SEQ ID NO: 453724 - RNA, 25 nt, Human
ggaggcuggggcgagaggauugcuu

SEQ ID NO: 453725 - RNA, 32 nt, Human
ggaggcuggggcgagaggauugcuugagccca

SEQ ID NO: 453726 - RNA, 32 nt, Human
ggaggcuggggcggguggauugcuugaugcca

SEQ ID NO: 453727 - RNA, 25 nt, Human
ggaggcuggggugggaggacugcuu

SEQ ID NO: 453728 - RNA, 32 nt, Human
ggaggcuggggugggaggaucgcuugaaccca

SEQ ID NO: 453729 - RNA, 20 nt, Human
ggaggcugggugcagcucca

SEQ ID NO: 453730 - RNA, 32 nt, Human
ggaggcugguucugcugccucuacacaggggc

SEQ ID NO: 453731 - RNA, 32 nt, Human
ggaggcuguccaccuugcuuggcucacuggga

SEQ ID NO: 453732 - RNA, 32 nt, Human
ggaggcugugagacccacagggcuaggcccag

SEQ ID NO: 453733 - RNA, 22 nt, Human
ggaggcugugcugcagcuccag

SEQ ID NO: 453734 - RNA, 24 nt, Human
ggaggcuguggcaggagaacugcu

SEQ ID NO: 453735 - RNA, 32 nt, Human
ggaggcuguggcaggagaaucgcuagaaccug

SEQ ID NO: 453736 - RNA, 32 nt, Human
ggaggcuguggcaggagaaucgcuugaaccca

SEQ ID NO: 453737 - RNA, 32 nt, Human
ggaggcuguggcaggagaauugcuugaaccca

SEQ ID NO: 453738 - RNA, 32 nt, Human
ggaggcuguggcggacuccuuccaacucacga

SEQ ID NO: 453739 - RNA, 22 nt, Human
ggaggcugugguagguggauca

SEQ ID NO: 453740 - RNA, 25 nt, Human
ggaggcuguggugggaggauugcuu

SEQ ID NO: 453741 - RNA, 32 nt, Human
ggaggcuguggugggaggauugcuugagucca

SEQ ID NO: 453742 - RNA, 32 nt, Human
ggaggcuguguccgugggugugcagugcccag

SEQ ID NO: 453743 - RNA, 32 nt, Human
ggaggcuguuauauucucacugggcgagagaa

SEQ ID NO: 453744 - RNA, 32 nt, Human
ggaggcuguuuccuccccugguggauuuaaga

SEQ ID NO: 453745 - RNA, 32 nt, Human
ggaggcuuagacaugagaaucacuugaaccca

SEQ ID NO: 453746 - RNA, 32 nt, Human
ggaggcuuaggcaggagaauugcuugaaccca

SEQ ID NO: 453747 - RNA, 32 nt, Human
ggaggcuuagucaggaggaucucuugagccug

SEQ ID NO: 453748 - RNA, 32 nt, Human
ggaggcuuauucaauucuucugaccucagaac

SEQ ID NO: 453749 - RNA, 32 nt, Human
ggaggcuucacagagaaggcugugguuccccu

SEQ ID NO: 453750 - RNA, 32 nt, Human
ggaggcuucaggggacuguucucaccuuaacu

SEQ ID NO: 453751 - RNA, 19 nt, Human
ggaggcuucauguggggga

SEQ ID NO: 453752 - RNA, 19 nt, Human
ggaggcuuccuuccagccc

SEQ ID NO: 453753 - RNA, 21 nt, Human
ggaggcuucugguagugcucu

SEQ ID NO: 453754 - RNA, 32 nt, Human
ggaggcuugagaauggaaggauccucauuucu

SEQ ID NO: 453755 - RNA, 26 nt, Human
ggaggcuugaggcgggaggaucacuu

SEQ ID NO: 453756 - RNA, 32 nt, Human
ggaggcuugcucauggugacauccucaucucc

SEQ ID NO: 453757 - RNA, 32 nt, Human
ggaggcuuggaggaggugagaguggaguggcu

SEQ ID NO: 453758 - RNA, 32 nt, Human
ggaggcuuggaucugaggucuugcuguccacu

SEQ ID NO: 453759 - RNA, 32 nt, Human
ggaggcuugggaacagggaaagagggaaaugu

SEQ ID NO: 453760 - RNA, 23 nt, Human
ggaggcuugggaugcagccccag

SEQ ID NO: 453761 - RNA, 23 nt, Human
ggaggcuugggugggaggauugc

SEQ ID NO: 453762 - RNA, 32 nt, Human
ggaggcuugggugggaggauugccugagacca

SEQ ID NO: 453763 - RNA, 32 nt, Human
ggaggcuuugacugggcugccugccugugagg

SEQ ID NO: 453764 - RNA, 32 nt, Human
ggaggcuuugggaggcugaggugggaggauug

SEQ ID NO: 453765 - RNA, 32 nt, Human
ggagggaaacacccucccggauccagagcccg

SEQ ID NO: 453766 - RNA, 32 nt, Human
ggagggaaaccugaacuuuuccugcacuuucu

SEQ ID NO: 453767 - RNA, 18 nt, Human
ggagggaaagaaaccagg

SEQ ID NO: 453768 - RNA, 32 nt, Human
ggagggaaauccuucagccaaaagucacacau

SEQ ID NO: 453769 - RNA, 32 nt, Human
ggagggaacaggcaggaagaucagggcagaau

SEQ ID NO: 453770 - RNA, 32 nt, Human
ggagggaacccuaccuguuucccugauaacug

SEQ ID NO: 453771 - RNA, 24 nt, Human
ggagggaacccugggcagggcucu

SEQ ID NO: 453772 - RNA, 32 nt, Human
ggagggaagaggaggagaggggaggggaccug

SEQ ID NO: 453773 - RNA, 32 nt, Human
ggagggaagaggagggaaacuaggagagacuu

SEQ ID NO: 453774 - RNA, 32 nt, Human
ggagggaagaucuugaugguguuucuuuuccc

SEQ ID NO: 453775 - RNA, 32 nt, Human
ggagggaagcacugucauguggacguggauga

SEQ ID NO: 453776 - RNA, 32 nt, Human
ggagggaaggagcaggagagcaggaaggaaac

SEQ ID NO: 453777 - RNA, 27 nt, Human
ggagggaaggcgaaaggggggcgagga

SEQ ID NO: 453778 - RNA, 32 nt, Human
ggagggaaggcggugaacacagcccccgugcc

SEQ ID NO: 453779 - RNA, 32 nt, Human
ggagggaaggguggguaaggaggagagagcgg

SEQ ID NO: 453780 - RNA, 18 nt, Human
ggagggaaggucaacaga

SEQ ID NO: 453781 - RNA, 32 nt, Human
ggagggaaguccuuguuggcagagggaugugg

SEQ ID NO: 453782 - RNA, 32 nt, Human
ggagggaaguggcugagagcucacaggcaccc

SEQ ID NO: 453783 - RNA, 32 nt, Human
ggagggaaugagccucagggaggagugagcac

SEQ ID NO: 453784 - RNA, 32 nt, Human
ggagggaaugcagaggaaagaaugaguauccu

SEQ ID NO: 453785 - RNA, 31 nt, Human
ggagggaaugggagagaaagcugagauuuca

SEQ ID NO: 453786 - RNA, 32 nt, Human
ggagggaauuggggcaucagaggcuuugaagc

SEQ ID NO: 453787 - RNA, 32 nt, Human
ggagggacaagugugcaugcagauguccucag

SEQ ID NO: 453788 - RNA, 32 nt, Human
ggagggacacuggagagcagggggaggccacg

SEQ ID NO: 453789 - RNA, 32 nt, Human
ggagggacagagagacagggagagucagccuc

SEQ ID NO: 453790 - RNA, 32 nt, Human
ggagggacagagcagaggggccagggacugag

SEQ ID NO: 453791 - RNA, 32 nt, Human
ggagggacagucucaccauuuccccagggcac

SEQ ID NO: 453792 - RNA, 20 nt, Human
ggagggacaucuccgggugu

SEQ ID NO: 453793 - RNA, 32 nt, Human
ggagggaccaaagccgugaggaugaggacaac

SEQ ID NO: 453794 - RNA, 32 nt, Human
ggagggaccacagagcaccagccugcauggaa

SEQ ID NO: 453795 - RNA, 32 nt, Human
ggagggaccccugguguaggccugggcgauag

SEQ ID NO: 453796 - RNA, 32 nt, Human
ggagggacccuccagccccaggaaucugcuuu

SEQ ID NO: 453797 - RNA, 32 nt, Human
ggagggaccgaggugacacagagccggcccug

SEQ ID NO: 453798 - RNA, 32 nt, Human
ggagggaccuccugccuacuccagccccuacc

SEQ ID NO: 453799 - RNA, 31 nt, Human
ggagggaccuugucucccagcucagggcucu

SEQ ID NO: 453800 - RNA, 32 nt, Human
ggagggacgcggaggaggaagaggguagacag

SEQ ID NO: 453801 - RNA, 32 nt, Human
ggagggacugaugcgaggucccccaggccuca

SEQ ID NO: 453802 - RNA, 22 nt, Human
ggagggacugcugacccaccaa

SEQ ID NO: 453803 - RNA, 32 nt, Human
ggagggacuggagaggaaugagauuggccaaa

SEQ ID NO: 453804 - RNA, 32 nt, Human
ggagggagaaaggagaaauuuugguuuuucaa

SEQ ID NO: 453805 - RNA, 32 nt, Human
ggagggagaagagagauaguggguaugcuucu

SEQ ID NO: 453806 - RNA, 32 nt, Human
ggagggagaagggaagaaagaaacaaugucua

SEQ ID NO: 453807 - RNA, 32 nt, Human
ggagggagacauccagcuugggcuuuccccuu

SEQ ID NO: 453808 - RNA, 32 nt, Human
ggagggagacggcuagggcagcaagugaagga

SEQ ID NO: 453809 - RNA, 22 nt, Human
ggagggagacgggauaguguuu

SEQ ID NO: 453810 - RNA, 32 nt, Human
ggagggagagaaagggguggcggagaggagga

SEQ ID NO: 453811 - RNA, 32 nt, Human
ggagggagagagagggagggagagggagugaa

SEQ ID NO: 453812 - RNA, 24 nt, Human
ggagggagagcggagaaacuggga

SEQ ID NO: 453813 - RNA, 32 nt, Human
ggagggagaggaaggcaggggaguugaugcau

SEQ ID NO: 453814 - RNA, 20 nt, Human
ggagggagaggaggggagcc

SEQ ID NO: 453815 - RNA, 25 nt, Human
ggagggagaggauggagagcgggga

SEQ ID NO: 453816 - RNA, 32 nt, Human
ggagggagaggcaccaugcaugugggugauua

SEQ ID NO: 453817 - RNA, 32 nt, Human
ggagggagagggcaggaaggaggcagagcugu

SEQ ID NO: 453818 - RNA, 32 nt, Human
ggagggagcagcggggagcuugcagugaccaa

SEQ ID NO: 453819 - RNA, 32 nt, Human
ggagggagcaggauggagagcaggaugaaguc

SEQ ID NO: 453820 - RNA, 32 nt, Human
ggagggagcaguccagaugccaacaaggaaau

SEQ ID NO: 453821 - RNA, 20 nt, Human
ggagggagccacccccaagg

SEQ ID NO: 453822 - RNA, 32 nt, Human
ggagggagccacgggcccugccccaaccgcuc

SEQ ID NO: 453823 - RNA, 32 nt, Human
ggagggagccacgggcccugccccaccugcuc

SEQ ID NO: 453824 - RNA, 32 nt, Human
ggagggagccgacacuugaauguaguaauagg

SEQ ID NO: 453825 - RNA, 32 nt, Human
ggagggagccgcacgcggcccagggcagcggu

SEQ ID NO: 453826 - RNA, 32 nt, Human
ggagggagccggggcagccacagggagagaca

SEQ ID NO: 453827 - RNA, 32 nt, Human
ggagggagccugcucccugccacacacguaca

SEQ ID NO: 453828 - RNA, 22 nt, Human
ggagggagcggcggcaggcucu

SEQ ID NO: 453829 - RNA, 32 nt, Human
ggagggagcugacagauaaggaaacugaggcc

SEQ ID NO: 453830 - RNA, 32 nt, Human
ggagggagcugcagaggguccaucgccgccgu

SEQ ID NO: 453831 - RNA, 32 nt, Human
ggagggagcugccuguggcccuaaggagcuga

SEQ ID NO: 453832 - RNA, 32 nt, Human
ggagggaggaaaggguaggaagggugggaagg

SEQ ID NO: 453833 - RNA, 32 nt, Human
ggagggaggaagaauagaggaaaacaaugggc

SEQ ID NO: 453834 - RNA, 24 nt, Human
ggagggaggacagggaaggccagg

SEQ ID NO: 453835 - RNA, 21 nt, Human
ggagggaggacagggagucgg

SEQ ID NO: 453836 - RNA, 32 nt, Human
ggagggaggacgugcgaggccggugcguggag

SEQ ID NO: 453837 - RNA, 22 nt, Human
ggagggaggagaggacccagga

SEQ ID NO: 453838 - RNA, 32 nt, Human
ggagggaggaggaagagagggagggaggcggg

SEQ ID NO: 453839 - RNA, 32 nt, Human
ggagggaggaggaggaggaagaagagcggaga

SEQ ID NO: 453840 - RNA, 32 nt, Human
ggagggaggaggaggaggaagagguauggcau

SEQ ID NO: 453841 - RNA, 32 nt, Human
ggagggaggcaccccuuccaggaacaaggcgg

SEQ ID NO: 453842 - RNA, 23 nt, Human
ggagggaggcagaagagccaggg

SEQ ID NO: 453843 - RNA, 32 nt, Human
ggagggaggcagggaggcagggaggcagggag

SEQ ID NO: 453844 - RNA, 24 nt, Human
ggagggaggcgcugcugguguucu

SEQ ID NO: 453845 - RNA, 32 nt, Human
ggagggaggcugagagggccgggccgggcggc

SEQ ID NO: 453846 - RNA, 21 nt, Human
ggagggaggcuggagcgggga

SEQ ID NO: 453847 - RNA, 32 nt, Human
ggagggaggcuggagcggggaggcgaggaggg

SEQ ID NO: 453848 - RNA, 32 nt, Human
ggagggagggacaaacacucccaaucauccac

SEQ ID NO: 453849 - RNA, 22 nt, Human
ggagggagggacagagccugga

SEQ ID NO: 453850 - RNA, 32 nt, Human
ggagggagggagggaaagcuuccuccuaaauc

SEQ ID NO: 453851 - RNA, 18 nt, Human
ggagggagggauucuggg

SEQ ID NO: 453852 - RNA, 24 nt, Human
ggagggagggcaggaauggagggg

SEQ ID NO: 453853 - RNA, 23 nt, Human
ggagggagggcaggguggagggc

SEQ ID NO: 453854 - RNA, 32 nt, Human
ggagggagggccccuugcucuccagcaaaagc

SEQ ID NO: 453855 - RNA, 22 nt, Human
ggagggagggcgggcgcggggg

SEQ ID NO: 453856 - RNA, 21 nt, Human
ggagggagggcgggcggcgcg

SEQ ID NO: 453857 - RNA, 18 nt, Human
ggagggagggcgggugcc

SEQ ID NO: 453858 - RNA, 32 nt, Human
ggagggagggcuggucccccucugagggggcu

SEQ ID NO: 453859 - RNA, 32 nt, Human
ggagggaggggauuuaaaaaccugcagcaaca

SEQ ID NO: 453860 - RNA, 32 nt, Human
ggagggaggggcccuggaggccacauccugcc

SEQ ID NO: 453861 - RNA, 32 nt, Human
ggagggagggugaguuagggggagacccggcc

SEQ ID NO: 453862 - RNA, 16 nt, Human
ggagggagguggugaa

SEQ ID NO: 453863 - RNA, 32 nt, Human
ggagggaguccagcccagcugccugcaggaag

SEQ ID NO: 453864 - RNA, 32 nt, Human
ggagggagugagccagcagcuuaaguccagcu

SEQ ID NO: 453865 - RNA, 22 nt, Human
ggagggaguggcucugugcuuu

SEQ ID NO: 453866 - RNA, 32 nt, Human
ggagggaguguauggaccuggccccauggcuu

SEQ ID NO: 453867 - RNA, 32 nt, Human
ggagggauauuuccugguuuuccagagguuag

SEQ ID NO: 453868 - RNA, 32 nt, Human
ggagggaugaagauggaguuauccucugcaga

SEQ ID NO: 453869 - RNA, 32 nt, Human
ggagggaugaggagguggagugcaggggaugu

SEQ ID NO: 453870 - RNA, 32 nt, Human
ggagggauggccugacugaaacaggugagagu

SEQ ID NO: 453871 - RNA, 32 nt, Human
ggagggaugggggcaggaaugagggaaggucu

SEQ ID NO: 453872 - RNA, 32 nt, Human
ggagggauuccacuggugaaacccacucacag

SEQ ID NO: 453873 - RNA, 21 nt, Human
ggagggauugaucuucagggc

SEQ ID NO: 453874 - RNA, 32 nt, Human
ggagggauugggcugaagcugcuccaccucau

SEQ ID NO: 453875 - RNA, 32 nt, Human
ggagggcaacaggcugccgggccccgcuggcc

SEQ ID NO: 453876 - RNA, 32 nt, Human
ggagggcaaggcggcagaaucgcuugagcccc

SEQ ID NO: 453877 - RNA, 32 nt, Human
ggagggcacagcaggugcagcuaacccucugu

SEQ ID NO: 453878 - RNA, 32 nt, Human
ggagggcacugguugcagaggcuggaagugaa

SEQ ID NO: 453879 - RNA, 32 nt, Human
ggagggcacuuccuccacagucccccacccac

SEQ ID NO: 453880 - RNA, 20 nt, Human
ggagggcacuuggcugggag

SEQ ID NO: 453881 - RNA, 32 nt, Human
ggagggcagagcaggcccugcggagagcucac

SEQ ID NO: 453882 - RNA, 22 nt, Human
ggagggcagagggcagagcucu

SEQ ID NO: 453883 - RNA, 23 nt, Human
ggagggcagagggcagagcucug

SEQ ID NO: 453884 - RNA, 32 nt, Human
ggagggcagaggugaggagggggaagauguuu

SEQ ID NO: 453885 - RNA, 32 nt, Human
ggagggcagauuuguaaccucugguucucugc

SEQ ID NO: 453886 - RNA, 32 nt, Human
ggagggcagcaaaugcugacaaggaugaaaag

SEQ ID NO: 453887 - RNA, 32 nt, Human
ggagggcagcagaggcagagaacgaggacagg

SEQ ID NO: 453888 - RNA, 32 nt, Human
ggagggcagccaacagcccucuucccaccugg

SEQ ID NO: 453889 - RNA, 21 nt, Human
ggagggcagccacggaguggg

SEQ ID NO: 453890 - RNA, 22 nt, Human
ggagggcagccuucaaacgugu

SEQ ID NO: 453891 - RNA, 19 nt, Human
ggagggcaggacucuggga

SEQ ID NO: 453892 - RNA, 31 nt, Human
ggagggcagggccagcaccucaccccacaca

SEQ ID NO: 453893 - RNA, 32 nt, Human
ggagggcaggggugaggagggagcaggagaac

SEQ ID NO: 453894 - RNA, 32 nt, Human
ggagggcaggggugaggagggagcaggagggc

SEQ ID NO: 453895 - RNA, 32 nt, Human
ggagggcagggugagccagcgggcaagggucc

SEQ ID NO: 453896 - RNA, 32 nt, Human
ggagggcaggguggggcugaggaacugacgug

SEQ ID NO: 453897 - RNA, 20 nt, Human
ggagggcaucuacucuggga

SEQ ID NO: 453898 - RNA, 21 nt, Human
ggagggcauggugucgggggg

SEQ ID NO: 453899 - RNA, 32 nt, Human
ggagggcaugucccuuugggagcccgccuugu

SEQ ID NO: 453900 - RNA, 32 nt, Human
ggagggcauuugcugccccagcuacuaaggug

SEQ ID NO: 453901 - RNA, 32 nt, Human
ggagggccaaguguccauucagacucggguau

SEQ ID NO: 453902 - RNA, 32 nt, Human
ggagggccagagaggcaguuggaagauggcgg

SEQ ID NO: 453903 - RNA, 18 nt, Human
ggagggccagcucuggga

SEQ ID NO: 453904 - RNA, 32 nt, Human
ggagggccaggggcgugcaugccaggccgggc

SEQ ID NO: 453905 - RNA, 32 nt, Human
ggagggccagugugggaccccugcugccaccu

SEQ ID NO: 453906 - RNA, 32 nt, Human
ggagggccauggagaagaggcugggagucaag

SEQ ID NO: 453907 - RNA, 32 nt, Human
ggagggcccaggagccagaccucgguuuugcg

SEQ ID NO: 453908 - RNA, 32 nt, Human
ggagggcccccagacagcucccaggcacguca

SEQ ID NO: 453909 - RNA, 32 nt, Human
ggagggccccuggguaauggggcagagagaug

SEQ ID NO: 453910 - RNA, 32 nt, Human
ggagggcccgggagcgugggagcaggagggug

SEQ ID NO: 453911 - RNA, 16 nt, Human
ggagggcccucugggg

SEQ ID NO: 453912 - RNA, 32 nt, Human
ggagggcccuggccugagcgagcugcugcagg

SEQ ID NO: 453913 - RNA, 32 nt, Human
ggagggccggaagaggaaagaaaccagaguuu

SEQ ID NO: 453914 - RNA, 32 nt, Human
ggagggccggaggcauguggccucccagaccu

SEQ ID NO: 453915 - RNA, 32 nt, Human
ggagggccuccaggugagugccgggcucggcg

SEQ ID NO: 453916 - RNA, 32 nt, Human
ggagggccuggcagagacugagcacuggcccc

SEQ ID NO: 453917 - RNA, 19 nt, Human
ggagggccuggcuggguga

SEQ ID NO: 453918 - RNA, 32 nt, Human
ggagggccuugccucuucccggcugccaucuc

SEQ ID NO: 453919 - RNA, 32 nt, Human
ggagggcgaagaggaggaggaaggggaggacg

SEQ ID NO: 453920 - RNA, 32 nt, Human
ggagggcgacccagaggagggggaagaugccg

SEQ ID NO: 453921 - RNA, 32 nt, Human
ggagggcgacucagagaucacagggagcgugg

SEQ ID NO: 453922 - RNA, 22 nt, Human
ggagggcgaggggcuauuacca

SEQ ID NO: 453923 - RNA, 32 nt, Human
ggagggcgcauugcuugagccuaggaguucga

SEQ ID NO: 453924 - RNA, 17 nt, Human
ggagggcgccucuggga

SEQ ID NO: 453925 - RNA, 20 nt, Human
ggagggcgcggccucgggga

SEQ ID NO: 453926 - RNA, 32 nt, Human
ggagggcggaaacagcggaggggccagucucc

SEQ ID NO: 453927 - RNA, 32 nt, Human
ggagggcggagcaggcggcggugcaggaggcc

SEQ ID NO: 453928 - RNA, 22 nt, Human
ggagggcggcaggggccuggag

SEQ ID NO: 453929 - RNA, 19 nt, Human
ggagggcgggagcucggcg

SEQ ID NO: 453930 - RNA, 21 nt, Human
ggagggcgggaguguggagga

SEQ ID NO: 453931 - RNA, 32 nt, Human
ggagggcgggcugccuuuccagguuccucagc

SEQ ID NO: 453932 - RNA, 32 nt, Human
ggagggcggggcaagggucucccagcgcgaca

SEQ ID NO: 453933 - RNA, 18 nt, Human
ggagggcguuucucggga

SEQ ID NO: 453934 - RNA, 32 nt, Human
ggagggcuacagcccacaucccacccccucgu

SEQ ID NO: 453935 - RNA, 32 nt, Human
ggagggcuagccccgggacuuggggccaauac

SEQ ID NO: 453936 - RNA, 32 nt, Human
ggagggcuagggggcagguggggaggggaagc

SEQ ID NO: 453937 - RNA, 32 nt, Human
ggagggcuauguguccuggaccaugaagaagg

SEQ ID NO: 453938 - RNA, 17 nt, Human
ggagggcuccucuggga

SEQ ID NO: 453939 - RNA, 32 nt, Human
ggagggcucucuucuuucuuccucauccuacu

SEQ ID NO: 453940 - RNA, 32 nt, Human
ggagggcucugcaggccgccucccggaacggg

SEQ ID NO: 453941 - RNA, 22 nt, Human
ggagggcugcagagccugcagg

SEQ ID NO: 453942 - RNA, 32 nt, Human
ggagggcugcugcaguggggucugaggagggc

SEQ ID NO: 453943 - RNA, 32 nt, Human
ggagggcuggaaugguacaucacauaggcaag

SEQ ID NO: 453944 - RNA, 32 nt, Human
ggagggcuggacggcgagcugggagccagccc

SEQ ID NO: 453945 - RNA, 20 nt, Human
ggagggcuggagagccgggg

SEQ ID NO: 453946 - RNA, 32 nt, Human
ggagggcuggaggcagagaguguaagugugca

SEQ ID NO: 453947 - RNA, 32 nt, Human
ggagggcuggucucccugggggcuccccagug

SEQ ID NO: 453948 - RNA, 21 nt, Human
ggagggcugguggcugggagg

SEQ ID NO: 453949 - RNA, 24 nt, Human
ggagggcuguccuuggggacucua

SEQ ID NO: 453950 - RNA, 16 nt, Human
ggagggcuuccuggga

SEQ ID NO: 453951 - RNA, 32 nt, Human
ggaggggaaaaauguguguggcucuuacguuu

SEQ ID NO: 453952 - RNA, 32 nt, Human
ggaggggaaagaagggcuucugccauuauagg

SEQ ID NO: 453953 - RNA, 32 nt, Human
ggaggggaacaggagccagacaugacagggac

SEQ ID NO: 453954 - RNA, 32 nt, Human
ggaggggaacugguauccugccaagccugguu

SEQ ID NO: 453955 - RNA, 21 nt, Human
ggaggggaacuuauuggggga

SEQ ID NO: 453956 - RNA, 32 nt, Human
ggaggggaaggcagcaagccuguccaucacau

SEQ ID NO: 453957 - RNA, 32 nt, Human
ggaggggaaggggugucacugccccucugugg

SEQ ID NO: 453958 - RNA, 32 nt, Human
ggaggggacagcuucacccuuggaaguccugg

SEQ ID NO: 453959 - RNA, 19 nt, Human
ggaggggaccaggggucag

SEQ ID NO: 453960 - RNA, 32 nt, Human
ggaggggaccaucaccaccaucaccacucggc

SEQ ID NO: 453961 - RNA, 32 nt, Human
ggaggggacgcugggacccuugccuuagauuu

SEQ ID NO: 453962 - RNA, 31 nt, Human
ggaggggacugucacuuuccugugucuuugg

SEQ ID NO: 453963 - RNA, 32 nt, Human
ggaggggagaggaggggaaggggaggcagagg

SEQ ID NO: 453964 - RNA, 32 nt, Human
ggaggggagaggggaagguggcuggccgggug

SEQ ID NO: 453965 - RNA, 32 nt, Human
ggaggggagcagccgggaguuggggcuucccc

SEQ ID NO: 453966 - RNA, 32 nt, Human
ggaggggagcaggggagggaaagaaaccaggc

SEQ ID NO: 453967 - RNA, 19 nt, Human
ggaggggagccaaggccag

SEQ ID NO: 453968 - RNA, 32 nt, Human
ggaggggagcucaagguuuggguggggacuca

SEQ ID NO: 453969 - RNA, 32 nt, Human
ggaggggagcugcuccugccagaagcuggugg

SEQ ID NO: 453970 - RNA, 32 nt, Human
ggaggggaggaagguuagggaggcggagaggg

SEQ ID NO: 453971 - RNA, 32 nt, Human
ggaggggaggagaaggaggaggaagccaugga

SEQ ID NO: 453972 - RNA, 32 nt, Human
ggaggggaggagagcagagaacguccccaggg

SEQ ID NO: 453973 - RNA, 32 nt, Human
ggaggggaggagaggagaggagaggaaccguc

SEQ ID NO: 453974 - RNA, 32 nt, Human
ggaggggaggagaggagaggagagggaggauc

SEQ ID NO: 453975 - RNA, 32 nt, Human
ggaggggaggaggaggaggaggaggaggucgu

SEQ ID NO: 453976 - RNA, 32 nt, Human
ggaggggaggcaggaggaggccgagggcccca

SEQ ID NO: 453977 - RNA, 32 nt, Human
ggaggggagggaagggaagggaagggaagggg

SEQ ID NO: 453978 - RNA, 32 nt, Human
ggaggggagggaggaagaaggaagagaggcag

SEQ ID NO: 453979 - RNA, 19 nt, Human
ggaggggagggaggacugc

SEQ ID NO: 453980 - RNA, 32 nt, Human
ggaggggagggaggcaauaagcaaagaaauaa

SEQ ID NO: 453981 - RNA, 16 nt, Human
ggaggggagggaggug

SEQ ID NO: 453982 - RNA, 32 nt, Human
ggaggggagggcaguggcagaggagauggaga

SEQ ID NO: 453983 - RNA, 32 nt, Human
ggaggggaggggcaggaagaggugagaagauc

SEQ ID NO: 453984 - RNA, 32 nt, Human
ggaggggaggggcagggggcggugccacggcc

SEQ ID NO: 453985 - RNA, 32 nt, Human
ggaggggagguggcaggcgcguuugcaggagg

SEQ ID NO: 453986 - RNA, 32 nt, Human
ggaggggauauuguggugaacaugacaggcau

SEQ ID NO: 453987 - RNA, 17 nt, Human
ggaggggauccagcgag

SEQ ID NO: 453988 - RNA, 32 nt, Human
ggaggggaugcacacauuagaguaggaaagag

SEQ ID NO: 453989 - RNA, 32 nt, Human
ggaggggauggcccugagcccagcggcuccuc

SEQ ID NO: 453990 - RNA, 32 nt, Human
ggaggggauuagggguggggcaguuuuugucu

SEQ ID NO: 453991 - RNA, 32 nt, Human
ggaggggcaaagcccguugacacagcugcuag

SEQ ID NO: 453992 - RNA, 21 nt, Human
ggaggggcaaggccccagcaa

SEQ ID NO: 453993 - RNA, 32 nt, Human
ggaggggcacgagaagagaggagcagggagga

SEQ ID NO: 453994 - RNA, 21 nt, Human
ggaggggcacugcagggccgg

SEQ ID NO: 453995 - RNA, 32 nt, Human
ggaggggcagaggccaacggaucccccugccu

SEQ ID NO: 453996 - RNA, 32 nt, Human
ggaggggcagcgagcaggugggguggauuucc

SEQ ID NO: 453997 - RNA, 26 nt, Human
ggaggggcagcgcagccucccaccaa

SEQ ID NO: 453998 - RNA, 17 nt, Human
ggaggggcagcuucuga

SEQ ID NO: 453999 - RNA, 23 nt, Human
ggaggggcaggagugguucagga

SEQ ID NO: 454000 - RNA, 22 nt, Human
ggaggggcaggauggcccccaa

SEQ ID NO: 454001 - RNA, 32 nt, Human
ggaggggcagggaagagguggcacuugugauu

SEQ ID NO: 454002 - RNA, 32 nt, Human
ggaggggcaguggggcugggccuggguggccc

SEQ ID NO: 454003 - RNA, 32 nt, Human
ggaggggcauguuaaagggaugacugugcauu

SEQ ID NO: 454004 - RNA, 32 nt, Human
ggaggggccaacacccucaucagagcccuccu

SEQ ID NO: 454005 - RNA, 22 nt, Human
ggaggggccagcaguccucccu

SEQ ID NO: 454006 - RNA, 32 nt, Human
ggaggggccagccugcaggguggguuccaguu

SEQ ID NO: 454007 - RNA, 32 nt, Human
ggaggggccagccugggaccagcagaguggaa

SEQ ID NO: 454008 - RNA, 17 nt, Human
ggaggggccccaggggu

SEQ ID NO: 454009 - RNA, 32 nt, Human
ggaggggccccugcuucuccagccuggacccc

SEQ ID NO: 454010 - RNA, 32 nt, Human
ggaggggcccgccuuagccaugugaaggugga

SEQ ID NO: 454011 - RNA, 24 nt, Human
ggaggggcccguugucucccuggc

SEQ ID NO: 454012 - RNA, 32 nt, Human
ggaggggccggagcggagaagcugcccaccuu

SEQ ID NO: 454013 - RNA, 23 nt, Human
ggaggggccggugaccucuuggc

SEQ ID NO: 454014 - RNA, 21 nt, Human
ggaggggccgugccugggaga

SEQ ID NO: 454015 - RNA, 32 nt, Human
ggaggggccugggcagagggccuggaccuggg

SEQ ID NO: 454016 - RNA, 32 nt, Human
ggaggggccuucauaccugcggccccaaagcc

SEQ ID NO: 454017 - RNA, 18 nt, Human
ggaggggcgagaagccag

SEQ ID NO: 454018 - RNA, 19 nt, Human
ggaggggcgagcugggagg

SEQ ID NO: 454019 - RNA, 21 nt, Human
ggaggggcgagggcgggccag

SEQ ID NO: 454020 - RNA, 32 nt, Human
ggaggggcgcaaggcagacggucuccagccac

SEQ ID NO: 454021 - RNA, 32 nt, Human
ggaggggcgcaggaccauggacuggggguggg

SEQ ID NO: 454022 - RNA, 32 nt, Human
ggaggggcggcugcugccuggugacggcaccc

SEQ ID NO: 454023 - RNA, 32 nt, Human
ggaggggcgggagggagguguugccgucacug

SEQ ID NO: 454024 - RNA, 32 nt, Human
ggaggggcgggagguggagcagggucccaggc

SEQ ID NO: 454025 - RNA, 32 nt, Human
ggaggggcuacaaaugcuugacucagugaugc

SEQ ID NO: 454026 - RNA, 22 nt, Human
ggaggggcuacugucccuuggc

SEQ ID NO: 454027 - RNA, 32 nt, Human
ggaggggcuagaacaagggcccaggggacugg

SEQ ID NO: 454028 - RNA, 32 nt, Human
ggaggggcucaagggagcccagcugggagggc

SEQ ID NO: 454029 - RNA, 23 nt, Human
ggaggggcucagcucccugugca

SEQ ID NO: 454030 - RNA, 32 nt, Human
ggaggggcucagggcacccugaggcggagguu

SEQ ID NO: 454031 - RNA, 32 nt, Human
ggaggggcucugccacucccagccugggaaug

SEQ ID NO: 454032 - RNA, 22 nt, Human
ggaggggcucugccgcuuagca

SEQ ID NO: 454033 - RNA, 32 nt, Human
ggaggggcucugcguuggcuucucccugggga

SEQ ID NO: 454034 - RNA, 23 nt, Human
ggaggggcuggaggaggagcaga

SEQ ID NO: 454035 - RNA, 32 nt, Human
ggaggggcuggggguagaaaugucauggguga

SEQ ID NO: 454036 - RNA, 21 nt, Human
ggaggggcuguccucuccgca

SEQ ID NO: 454037 - RNA, 18 nt, Human
ggaggggcugugggccag

SEQ ID NO: 454038 - RNA, 18 nt, Human
ggaggggcuucucugggg

SEQ ID NO: 454039 - RNA, 32 nt, Human
ggagggggaagagaucccaggaggugcagugg

SEQ ID NO: 454040 - RNA, 32 nt, Human
ggagggggaaggacagagggggaggggaagga

SEQ ID NO: 454041 - RNA, 22 nt, Human
ggagggggaaggaggaaacagg

SEQ ID NO: 454042 - RNA, 32 nt, Human
ggagggggaaggaggaaacaggaagcccagag

SEQ ID NO: 454043 - RNA, 19 nt, Human
ggagggggacgcccggggu

SEQ ID NO: 454044 - RNA, 32 nt, Human
ggagggggagacgaggaggaggaggacaugac

SEQ ID NO: 454045 - RNA, 32 nt, Human
ggagggggagagaagcagagggagagagaagg

SEQ ID NO: 454046 - RNA, 32 nt, Human
ggagggggagagagaggaggacaggcugcgac

SEQ ID NO: 454047 - RNA, 32 nt, Human
ggagggggagagagcaaggagaucgguaucuu

SEQ ID NO: 454048 - RNA, 32 nt, Human
ggagggggagagaggucaggccaggcccgugg

SEQ ID NO: 454049 - RNA, 18 nt, Human
ggagggggagcugagaga

SEQ ID NO: 454050 - RNA, 21 nt, Human
ggagggggagcuguuaggggg

SEQ ID NO: 454051 - RNA, 32 nt, Human
ggagggggaggaagaggagguggagaaggagg

SEQ ID NO: 454052 - RNA, 21 nt, Human
ggagggggaggaggaagaaga

SEQ ID NO: 454053 - RNA, 32 nt, Human
ggagggggaggcaggaggauugcugucagccu

SEQ ID NO: 454054 - RNA, 32 nt, Human
ggagggggaggggaagaagaaggccucacuuu

SEQ ID NO: 454055 - RNA, 32 nt, Human
ggagggggaggggcaggagcuuggaccuuggu

SEQ ID NO: 454056 - RNA, 32 nt, Human
ggagggggaugcagaggugaugcagcuggggu

SEQ ID NO: 454057 - RNA, 20 nt, Human
ggagggggauguggcguuuc

SEQ ID NO: 454058 - RNA, 32 nt, Human
ggagggggauguuggccucucccaggcuccuc

SEQ ID NO: 454059 - RNA, 32 nt, Human
ggagggggcacaguuggauucucuccagugaa

SEQ ID NO: 454060 - RNA, 32 nt, Human
ggagggggcaccgccucccacccacugagggc

SEQ ID NO: 454061 - RNA, 18 nt, Human
ggagggggcagaggccag

SEQ ID NO: 454062 - RNA, 32 nt, Human
ggagggggcaggcaaagucaaagugaaugacc

SEQ ID NO: 454063 - RNA, 22 nt, Human
ggagggggcaggccuguguucu

SEQ ID NO: 454064 - RNA, 32 nt, Human
ggagggggcaggcuuccccugggcagacaggc

SEQ ID NO: 454065 - RNA, 24 nt, Human
ggagggggcaguuugcugugcucu

SEQ ID NO: 454066 - RNA, 32 nt, Human
ggagggggcaucuucugacagccugccucugc

SEQ ID NO: 454067 - RNA, 32 nt, Human
ggagggggccacaccacccacccagggggcug

SEQ ID NO: 454068 - RNA, 32 nt, Human
ggagggggccagcaggucacggggcagaaucu

SEQ ID NO: 454069 - RNA, 32 nt, Human
ggagggggccagugucauucaaagauguggcu

SEQ ID NO: 454070 - RNA, 23 nt, Human
ggagggggccgggcgcggugcuc

SEQ ID NO: 454071 - RNA, 32 nt, Human
ggagggggccucucauggcccuucccuggccu

SEQ ID NO: 454072 - RNA, 32 nt, Human
ggagggggccuggacuggcauggauccagugu

SEQ ID NO: 454073 - RNA, 18 nt, Human
ggagggggcggggaggug

SEQ ID NO: 454074 - RNA, 32 nt, Human
ggagggggcuaaagaggaaggaggggaggagg

SEQ ID NO: 454075 - RNA, 23 nt, Human
ggagggggcuagggauaugcucu

SEQ ID NO: 454076 - RNA, 20 nt, Human
ggagggggcucugcgcgcuc

SEQ ID NO: 454077 - RNA, 22 nt, Human
ggagggggcucuggucuuuucu

SEQ ID NO: 454078 - RNA, 32 nt, Human
ggagggggcugguggagauuugagguggguuu

SEQ ID NO: 454079 - RNA, 23 nt, Human
ggagggggcuguggugguguucu

SEQ ID NO: 454080 - RNA, 22 nt, Human
ggagggggcuuugcuggucuuu

SEQ ID NO: 454081 - RNA, 32 nt, Human
ggaggggguagagggagccaggagcacugggu

SEQ ID NO: 454082 - RNA, 19 nt, Human
ggagggggucaggggucag

SEQ ID NO: 454083 - RNA, 32 nt, Human
ggagggggugggccuggccuaaucaggugagc

SEQ ID NO: 454084 - RNA, 32 nt, Human
ggaggggguuccggguggaggcuugcagcugc

SEQ ID NO: 454085 - RNA, 23 nt, Human
ggaggggguucucuaucugcucu

SEQ ID NO: 454086 - RNA, 32 nt, Human
ggagggguaggugagggucgcgaggcugccug

SEQ ID NO: 454087 - RNA, 32 nt, Human
ggaggggucaccaagccagagcugggcuccac

SEQ ID NO: 454088 - RNA, 32 nt, Human
ggaggggucauugaugcagucauucucagucu

SEQ ID NO: 454089 - RNA, 32 nt, Human
ggagggguccccaacauggauguguugccccu

SEQ ID NO: 454090 - RNA, 16 nt, Human
ggaggggucccugggg

SEQ ID NO: 454091 - RNA, 32 nt, Human
ggaggggugccacaugucucagaucugccauu

SEQ ID NO: 454092 - RNA, 32 nt, Human
ggaggggugcuacuguuuuccaagugaauggg

SEQ ID NO: 454093 - RNA, 32 nt, Human
ggaggggugcuggccccucugccuggcccugg

SEQ ID NO: 454094 - RNA, 31 nt, Human
ggagggguggagcugccucauaaucugcuuu

SEQ ID NO: 454095 - RNA, 32 nt, Human
ggaggggugggaggggcugagauggcugcugg

SEQ ID NO: 454096 - RNA, 32 nt, Human
ggagggguggggaggaagccggggcagucacc

SEQ ID NO: 454097 - RNA, 32 nt, Human
ggagggguggggauugggggacaugggcauuu

SEQ ID NO: 454098 - RNA, 20 nt, Human
ggaggggugguuggcguuuc

SEQ ID NO: 454099 - RNA, 32 nt, Human
ggaggggugugcuugcucccguacacaggagu

SEQ ID NO: 454100 - RNA, 32 nt, Human
ggagggguuggguugggcucuuaucuucaugg

SEQ ID NO: 454101 - RNA, 23 nt, Human
ggagggguuggucuuggugucuc

SEQ ID NO: 454102 - RNA, 32 nt, Human
ggagggguuguugaccaggcagaggaaucugg

SEQ ID NO: 454103 - RNA, 32 nt, Human
ggaggguagagagaaggaaccauuaaggaccu

SEQ ID NO: 454104 - RNA, 32 nt, Human
ggaggguaggagcagcuggagacucugcucua

SEQ ID NO: 454105 - RNA, 32 nt, Human
ggaggguaggcaggauuggggaagagagccug

SEQ ID NO: 454106 - RNA, 32 nt, Human
ggaggguagggagagaagcugagaccaggacc

SEQ ID NO: 454107 - RNA, 32 nt, Human
ggaggguaugauugccugaccaggacagccag

SEQ ID NO: 454108 - RNA, 32 nt, Human
ggagggucagaagcagaaagaaaucaaagcuc

SEQ ID NO: 454109 - RNA, 32 nt, Human
ggagggucagaggcagaaucuacuuacagugg

SEQ ID NO: 454110 - RNA, 32 nt, Human
ggagggucagccagggccugcgagggcagcgg

SEQ ID NO: 454111 - RNA, 32 nt, Human
ggaggguccagaaaagcagcuccccaagccug

SEQ ID NO: 454112 - RNA, 21 nt, Human
ggagggucccagccccaccaa

SEQ ID NO: 454113 - RNA, 32 nt, Human
ggagggucccccacacccucaggcucaugccc

SEQ ID NO: 454114 - RNA, 32 nt, Human
ggagggucccuugggcucgagcuccacaucag

SEQ ID NO: 454115 - RNA, 32 nt, Human
ggagggucucaaacuccugaccucaggcgauc

SEQ ID NO: 454116 - RNA, 24 nt, Human
ggagggucuggcacgccccaccaa

SEQ ID NO: 454117 - RNA, 32 nt, Human
ggagggucuugcagucaucuacauacuucccu

SEQ ID NO: 454118 - RNA, 32 nt, Human
ggagggugaacaaaccccgagggaggcccggc

SEQ ID NO: 454119 - RNA, 32 nt, Human
ggagggugaggcaggagauuugcuugaaccug

SEQ ID NO: 454120 - RNA, 21 nt, Human
ggagggugaggcgguggggga

SEQ ID NO: 454121 - RNA, 19 nt, Human
ggagggugaggcucagaga

SEQ ID NO: 454122 - RNA, 32 nt, Human
ggagggugagggugaccccaucugcuauuuuu

SEQ ID NO: 454123 - RNA, 32 nt, Human
ggagggugagucaagagaauugcuugaaccug

SEQ ID NO: 454124 - RNA, 32 nt, Human
ggagggugagucaggcccugcuucacccacgc

SEQ ID NO: 454125 - RNA, 32 nt, Human
ggagggugagucccucacaaagggcggagcgg

SEQ ID NO: 454126 - RNA, 32 nt, Human
ggagggugcagagcucugcagagccaugggcc

SEQ ID NO: 454127 - RNA, 32 nt, Human
ggagggugcagggagaggggaggcggggacgg

SEQ ID NO: 454128 - RNA, 32 nt, Human
ggagggugcagugauagcuccuccucacugcc

SEQ ID NO: 454129 - RNA, 32 nt, Human
ggagggugccacccucucccugccaggggccu

SEQ ID NO: 454130 - RNA, 18 nt, Human
ggagggugcgcuggagga

SEQ ID NO: 454131 - RNA, 32 nt, Human
ggagggugcucuggguuuccgugagguaacca

SEQ ID NO: 454132 - RNA, 32 nt, Human
ggagggugcugaggcagcagggggcuggugua

SEQ ID NO: 454133 - RNA, 22 nt, Human
ggagggugcuuuauugggugga

SEQ ID NO: 454134 - RNA, 32 nt, Human
ggaggguggcugcccacggccuggguguggcu

SEQ ID NO: 454135 - RNA, 32 nt, Human
ggagggugggcaaggcugggagggauaucaac

SEQ ID NO: 454136 - RNA, 32 nt, Human
ggagggugggcccacugcuuuggaggugaugg

SEQ ID NO: 454137 - RNA, 32 nt, Human
ggagggugggggcgcaggcccgggagggggca

SEQ ID NO: 454138 - RNA, 32 nt, Human
ggagggugggugcagacacaggcugaggacca

SEQ ID NO: 454139 - RNA, 31 nt, Human
ggaggguggguggagcagguggacuggaguu

SEQ ID NO: 454140 - RNA, 31 nt, Human
ggaggguggguggggaaggcugagcaaaggg

SEQ ID NO: 454141 - RNA, 23 nt, Human
ggagggugggugguugcagggga

SEQ ID NO: 454142 - RNA, 32 nt, Human
ggagggugguuagagaagguuucacuaaguga

SEQ ID NO: 454143 - RNA, 21 nt, Human
ggaggguguaaguuuagggga

SEQ ID NO: 454144 - RNA, 22 nt, Human
ggagggugugcuuggcaggggg

SEQ ID NO: 454145 - RNA, 32 nt, Human
ggaggguguuacugggcaccaguggacucgcc

SEQ ID NO: 454146 - RNA, 32 nt, Human
ggaggguguugugguuugucuuucuaauuagg

SEQ ID NO: 454147 - RNA, 21 nt, Human
ggaggguuacuugagcccagg

SEQ ID NO: 454148 - RNA, 32 nt, Human
ggaggguucuggguggaagcuggcaggcauac

SEQ ID NO: 454149 - RNA, 32 nt, Human
ggaggguugcauggcggcugggcaaaggugcu

SEQ ID NO: 454150 - RNA, 32 nt, Human
ggaggguugccugggaaccccaggaauugacc

SEQ ID NO: 454151 - RNA, 23 nt, Human
ggaggguugcuggagggugcuuu

SEQ ID NO: 454152 - RNA, 24 nt, Human
ggaggguuggucccaccccuggag

SEQ ID NO: 454153 - RNA, 32 nt, Human
ggaggguuucuggcauuuuccacaccugucca

SEQ ID NO: 454154 - RNA, 32 nt, Human
ggaggguuugcucuccaaaaagaauuguaaua

SEQ ID NO: 454155 - RNA, 21 nt, Human
ggagguaaacagcccugcagg

SEQ ID NO: 454156 - RNA, 31 nt, Human
ggagguaaagggagguuuucacugugggugu

SEQ ID NO: 454157 - RNA, 32 nt, Human
ggagguaaagggagguuuucacuguggguguu

SEQ ID NO: 454158 - RNA, 22 nt, Human
ggagguaacgggacgggcgcga

SEQ ID NO: 454159 - RNA, 32 nt, Human
ggagguacagaaguuccaauucccuuuuuauu

SEQ ID NO: 454160 - RNA, 32 nt, Human
ggagguaccaauucuggacaaagugccacuac

SEQ ID NO: 454161 - RNA, 32 nt, Human
ggagguacugacuccagcccuuccagcccaaa

SEQ ID NO: 454162 - RNA, 32 nt, Human
ggagguagaagaggggaaggaagaugguuucu

SEQ ID NO: 454163 - RNA, 32 nt, Human
ggagguagaccucacauacacacacauagacg

SEQ ID NO: 454164 - RNA, 21 nt, Human
ggagguagagauugcaaugag

SEQ ID NO: 454165 - RNA, 17 nt, Human
ggagguagauccuggga

SEQ ID NO: 454166 - RNA, 32 nt, Human
ggagguagcaagcagaguugggggaggagggg

SEQ ID NO: 454167 - RNA, 32 nt, Human
ggagguagcacaaagggaggaccauggucuuc

SEQ ID NO: 454168 - RNA, 32 nt, Human
ggagguagcaccacaggaagcaggcaucacac

SEQ ID NO: 454169 - RNA, 32 nt, Human
ggagguagcuuugagguggaagagggcugcaa

SEQ ID NO: 454170 - RNA, 32 nt, Human
ggagguaggaaggggaggaagucugaguaagc

SEQ ID NO: 454171 - RNA, 32 nt, Human
ggagguaggaggaucacuugagcccaggagug

SEQ ID NO: 454172 - RNA, 32 nt, Human
ggagguaggcgggaacacucaccccgcgauuu

SEQ ID NO: 454173 - RNA, 32 nt, Human
ggagguagggaggggagcaggagcaagagcug

SEQ ID NO: 454174 - RNA, 32 nt, Human
ggagguaggggcugggcaugcaccuugguuaa

SEQ ID NO: 454175 - RNA, 32 nt, Human
ggagguaggggugggcccuggagaugaggagg

SEQ ID NO: 454176 - RNA, 32 nt, Human
ggagguaguaggggcagggaaaggucagcaua

SEQ ID NO: 454177 - RNA, 32 nt, Human
ggagguauaaauauuucaggccaagguucaau

SEQ ID NO: 454178 - RNA, 32 nt, Human
ggagguaugccauuaaugaaauccacuguccu

SEQ ID NO: 454179 - RNA, 32 nt, Human
ggaggucaacaucuaucuaauuuaaaagcuau

SEQ ID NO: 454180 - RNA, 32 nt, Human
ggaggucaagaugggaggauugcuugagccca

SEQ ID NO: 454181 - RNA, 32 nt, Human
ggaggucaagccuacagugagccaugaucuca

SEQ ID NO: 454182 - RNA, 25 nt, Human
ggaggucaaggugggaggauugcuu

SEQ ID NO: 454183 - RNA, 32 nt, Human
ggaggucaaggugggaggauugcuugagccag

SEQ ID NO: 454184 - RNA, 27 nt, Human
ggaggucaaggugugagcgacgucucc

SEQ ID NO: 454185 - RNA, 32 nt, Human
ggaggucacacagcagguuucugcaccacgca

SEQ ID NO: 454186 - RNA, 32 nt, Human
ggaggucacagcugcuccuuuuuggucaauga

SEQ ID NO: 454187 - RNA, 31 nt, Human
ggaggucacagcugggcucacagaagcucuu

SEQ ID NO: 454188 - RNA, 21 nt, Human
ggaggucacauacacagcucu

SEQ ID NO: 454189 - RNA, 31 nt, Human
ggaggucaccgaugcuugacauuccugccuc

SEQ ID NO: 454190 - RNA, 32 nt, Human
ggaggucacugcacuaccacccaccucuggaa

SEQ ID NO: 454191 - RNA, 23 nt, Human
ggaggucagaggaucccacuucc

SEQ ID NO: 454192 - RNA, 24 nt, Human
ggaggucagaggauguauguggcc

SEQ ID NO: 454193 - RNA, 32 nt, Human
ggaggucagaugggaacuuggaacugggcaug

SEQ ID NO: 454194 - RNA, 32 nt, Human
ggaggucagcacaagauacacgucacaaagac

SEQ ID NO: 454195 - RNA, 32 nt, Human
ggaggucaggucaaggcugcagugagccaugg

SEQ ID NO: 454196 - RNA, 32 nt, Human
ggaggucaguaguucaagaccagccuggccaa

SEQ ID NO: 454197 - RNA, 20 nt, Human
ggaggucaucggggccucag

SEQ ID NO: 454198 - RNA, 32 nt, Human
ggagguccacacaagccaaaauaucucuauau

SEQ ID NO: 454199 - RNA, 32 nt, Human
ggagguccagccgccgcgcccgcuacccggag

SEQ ID NO: 454200 - RNA, 19 nt, Human
ggagguccagguggacugc

SEQ ID NO: 454201 - RNA, 18 nt, Human
ggagguccauguggggga

SEQ ID NO: 454202 - RNA, 32 nt, Human
ggaggucgaggcaggaggaucacuugagucca

SEQ ID NO: 454203 - RNA, 32 nt, Human
ggaggucgaggcaggaguauugcuugagcccg

SEQ ID NO: 454204 - RNA, 32 nt, Human
ggaggucgaggcagguggaucgcuugagccca

SEQ ID NO: 454205 - RNA, 24 nt, Human
ggaggucgaggcgggcagaucucc

SEQ ID NO: 454206 - RNA, 32 nt, Human
ggaggucggcagugugaggagcugcuauggug

SEQ ID NO: 454207 - RNA, 32 nt, Human
ggaggucgggacuagggugggagaggcacuau

SEQ ID NO: 454208 - RNA, 21 nt, Human
ggaggucuccaaaaagauauu

SEQ ID NO: 454209 - RNA, 22 nt, Human
ggaggucuccaggggccugcag

SEQ ID NO: 454210 - RNA, 32 nt, Human
ggaggucuccaggggccugcagaaggaaagaa

SEQ ID NO: 454211 - RNA, 32 nt, Human
ggaggucugacagccccucccucccagagcug

SEQ ID NO: 454212 - RNA, 32 nt, Human
ggaggucugcagcuggaagcccagcccacagc

SEQ ID NO: 454213 - RNA, 32 nt, Human
ggaggucugggaagggcuggaaaucacugggg

SEQ ID NO: 454214 - RNA, 32 nt, Human
ggaggucugggcagccacccagggggcccucc

SEQ ID NO: 454215 - RNA, 32 nt, Human
ggaggucuggggcucugguggcuuccauagcu

SEQ ID NO: 454216 - RNA, 32 nt, Human
ggaggucugggggcuggagucuggugguggca

SEQ ID NO: 454217 - RNA, 32 nt, Human
ggaggucuggucaggaugggggugcaguccca

SEQ ID NO: 454218 - RNA, 32 nt, Human
ggaggucuguaauuccugucuccuggacucuc

SEQ ID NO: 454219 - RNA, 32 nt, Human
ggaggucugucugcacugggagccucaggagg

SEQ ID NO: 454220 - RNA, 32 nt, Human
ggaggucuucccacgcccugucauuaggcugc

SEQ ID NO: 454221 - RNA, 32 nt, Human
ggaggucuuguggugugugucuccucucuucu

SEQ ID NO: 454222 - RNA, 20 nt, Human
ggaggugaacguuccaggca

SEQ ID NO: 454223 - RNA, 18 nt, Human
ggaggugaagucggguca

SEQ ID NO: 454224 - RNA, 22 nt, Human
ggaggugacaggggcccggagg

SEQ ID NO: 454225 - RNA, 32 nt, Human
ggaggugacaucagguguuccucuccagcagu

SEQ ID NO: 454226 - RNA, 32 nt, Human
ggaggugagaggugauuuccugccauucuucu

SEQ ID NO: 454227 - RNA, 32 nt, Human
ggaggugaggagcaacucugcccagccgcccc

SEQ ID NO: 454228 - RNA, 32 nt, Human
ggaggugaggcugcacuucgcuguguuugagg

SEQ ID NO: 454229 - RNA, 32 nt, Human
ggaggugaggggcgccucugcccagcugcccc

SEQ ID NO: 454230 - RNA, 32 nt, Human
ggaggugagggugucugacgugcacugagggc

SEQ ID NO: 454231 - RNA, 32 nt, Human
ggaggugaguuccguucuuccuugugagauga

SEQ ID NO: 454232 - RNA, 32 nt, Human
ggaggugaucccucccuccugccugcccgcca

SEQ ID NO: 454233 - RNA, 32 nt, Human
ggaggugcacuuuacuuccugacuccuuuccu

SEQ ID NO: 454234 - RNA, 32 nt, Human
ggaggugcagccagggcaaggaggaguccucc

SEQ ID NO: 454235 - RNA, 20 nt, Human
ggaggugcagcuaaaggcca

SEQ ID NO: 454236 - RNA, 32 nt, Human
ggaggugcagggccaggaggaacaugagguga

SEQ ID NO: 454237 - RNA, 32 nt, Human
ggaggugcaguggagggggcaagcuuugcucc

SEQ ID NO: 454238 - RNA, 17 nt, Human
ggaggugcaguuagguc

SEQ ID NO: 454239 - RNA, 32 nt, Human
ggaggugccuggagugcccacccugggagaca

SEQ ID NO: 454240 - RNA, 20 nt, Human
ggaggugcggcugcaggccg

SEQ ID NO: 454241 - RNA, 32 nt, Human
ggaggugcguccuuguuuuccaggaaauguuc

SEQ ID NO: 454242 - RNA, 32 nt, Human
ggcaagaggagguggcggcggugguaguggug

SEQ ID NO: 454243 - RNA, 32 nt, Human
ggcaagaggcuggagggcccaauggcugcaaa

SEQ ID NO: 454244 - RNA, 32 nt, Human
ggcaagagggaaggcgagacagcagugaacag

SEQ ID NO: 454245 - RNA, 32 nt, Human
ggcaagaggggguggagggguguggcaguggu

SEQ ID NO: 454246 - RNA, 32 nt, Human
ggcaagaggucuucugaacacauccaccagau

SEQ ID NO: 454247 - RNA, 32 nt, Human
ggcaagagugcccgcuacaaccgcuucuccgg

SEQ ID NO: 454248 - RNA, 32 nt, Human
ggcaagagugugaggcaggaagacugagucag

SEQ ID NO: 454249 - RNA, 19 nt, Human
ggcaagauaaaccaauguc

SEQ ID NO: 454250 - RNA, 22 nt, Human
ggcaagaugauuucagauuuuc

SEQ ID NO: 454251 - RNA, 20 nt, Human
ggcaagaugccuagaucuuc

SEQ ID NO: 454252 - RNA, 31 nt, Human
ggcaagauggcagaaguagagcagaagaaga

SEQ ID NO: 454253 - RNA, 32 nt, Human
ggcaagaugggagcugguuggggaaggggauc

SEQ ID NO: 454254 - RNA, 32 nt, Human
ggcaagauugagggcccgggagagggaggccc

SEQ ID NO: 454255 - RNA, 32 nt, Human
ggcaagcaagacacaccagagcucuucccucg

SEQ ID NO: 454256 - RNA, 32 nt, Human
ggcaagcaaggaauggcugugccugaggcugc

SEQ ID NO: 454257 - RNA, 24 nt, Human
ggcaagcaauucuaagaucuucca

SEQ ID NO: 454258 - RNA, 32 nt, Human
ggcaagcacaauauuacagaggaacucucaaa

SEQ ID NO: 454259 - RNA, 16 nt, Human
ggcaagcacugggguc

SEQ ID NO: 454260 - RNA, 32 nt, Human
ggcaagcagaagcagcggccgcagcgaagcug

SEQ ID NO: 454261 - RNA, 32 nt, Human
ggcaagcagggugcucugggaccgcacuucau

SEQ ID NO: 454262 - RNA, 32 nt, Human
ggcaagcaggucacagaugccagggcucauuu

SEQ ID NO: 454263 - RNA, 32 nt, Human
ggcaagcaggugugaagagcagggcucagcag

SEQ ID NO: 454264 - RNA, 32 nt, Human
ggcaagcagucgucccuguccugggcaucccu

SEQ ID NO: 454265 - RNA, 32 nt, Human
ggcaagccaagugcccucucugaaccucaguu

SEQ ID NO: 454266 - RNA, 32 nt, Human
ggcaagcccaaggagccagcugugguggcggc

SEQ ID NO: 454267 - RNA, 32 nt, Human
ggcaagcgacugguuggaucaaaagccaguau

SEQ ID NO: 454268 - RNA, 32 nt, Human
ggcaagcggcuuucugggucucagcccucucu

SEQ ID NO: 454269 - RNA, 32 nt, Human
ggcaagcucugcugcgaugccucugccucauc

SEQ ID NO: 454270 - RNA, 32 nt, Human
ggcaagcugcugcuuauggccugggugucaug

SEQ ID NO: 454271 - RNA, 32 nt, Human
ggcaagcuggaacuuggguggggaggggacau

SEQ ID NO: 454272 - RNA, 32 nt, Human
ggcaagcugugacuucuccaggucucacgggc

SEQ ID NO: 454273 - RNA, 18 nt, Human
ggcaagcuguucagauuc

SEQ ID NO: 454274 - RNA, 32 nt, Human
ggcaagcuugcagcugcccugauggugcaggu

SEQ ID NO: 454275 - RNA, 19 nt, Human
ggcaaggaaacagauucuc

SEQ ID NO: 454276 - RNA, 32 nt, Human
ggcaaggaaagaggccggucaccagaagccag

SEQ ID NO: 454277 - RNA, 32 nt, Human
ggcaaggaacaccacaccacugcuuuucagca

SEQ ID NO: 454278 - RNA, 32 nt, Human
ggcaaggaagaaugugagcaagaguagagaga

SEQ ID NO: 454279 - RNA, 32 nt, Human
ggcaaggaaggagccaggauggccugggcucu

SEQ ID NO: 454280 - RNA, 17 nt, Human
ggcaaggaaugucugcu

SEQ ID NO: 454281 - RNA, 32 nt, Human
ggcaaggacaggagagcagugcagugacacag

SEQ ID NO: 454282 - RNA, 32 nt, Human
ggcaaggaccagcugcccauucugagcccagg

SEQ ID NO: 454283 - RNA, 32 nt, Human
ggcaaggacuccucccaucuucacaccugaac

SEQ ID NO: 454284 - RNA, 32 nt, Human
ggcaaggagcagaagacauaacguugaaacag

SEQ ID NO: 454285 - RNA, 32 nt, Human
ggcaaggagccaaggaccacagagccucagcc

SEQ ID NO: 454286 - RNA, 32 nt, Human
ggcaaggaggugggggccgcaggguuggggcg

SEQ ID NO: 454287 - RNA, 32 nt, Human
ggcaaggagugauuuuauucuguauuacucca

SEQ ID NO: 454288 - RNA, 23 nt, Human
ggcaaggaucacagcugcccuug

SEQ ID NO: 454289 - RNA, 32 nt, Human
ggcaaggaugcccaaagacaccagguuggaga

SEQ ID NO: 454290 - RNA, 32 nt, Human
ggcaaggauggaaauucaccucaguuugcugu

SEQ ID NO: 454291 - RNA, 32 nt, Human
ggcaaggcauguugguuugcgugugggaaucc

SEQ ID NO: 454292 - RNA, 32 nt, Human
ggcaaggccaagaagugaggccagcagggagg

SEQ ID NO: 454293 - RNA, 32 nt, Human
ggcaaggccacaaccuccauucucccagaaaa

SEQ ID NO: 454294 - RNA, 32 nt, Human
ggcaaggccaggagugcccaccagcuugcccc

SEQ ID NO: 454295 - RNA, 17 nt, Human
ggcaaggcccaauggcc

SEQ ID NO: 454296 - RNA, 32 nt, Human
ggcaaggccugacaggcugaagucaccuggaa

SEQ ID NO: 454297 - RNA, 32 nt, Human
ggcaaggcggaggggccaggguggggguagcc

SEQ ID NO: 454298 - RNA, 32 nt, Human
ggcaaggcuccucacaguauccuugagaggug

SEQ ID NO: 454299 - RNA, 32 nt, Human
ggcaaggcuggguggggaagaaagagaaaaac

SEQ ID NO: 454300 - RNA, 17 nt, Human
ggcaaggcuuccaggcc

SEQ ID NO: 454301 - RNA, 21 nt, Human
ggcaaggcuuguggggcgcuu

SEQ ID NO: 454302 - RNA, 32 nt, Human
ggcaagggaaaaccggcuguggagaaggaaau

SEQ ID NO: 454303 - RNA, 32 nt, Human
ggcaagggagaaggcaggaugaugaggagacu

SEQ ID NO: 454304 - RNA, 32 nt, Human
ggcaagggcgagcggcggggacuggggaaggg

SEQ ID NO: 454305 - RNA, 32 nt, Human
ggcaagggcugaaggaggccacuccaucucac

SEQ ID NO: 454306 - RNA, 32 nt, Human
ggcaagggcuguagacauucugcucuggucac

SEQ ID NO: 454307 - RNA, 18 nt, Human
ggcaagggcuugggggga

SEQ ID NO: 454308 - RNA, 17 nt, Human
ggcaaggggaaccacca

SEQ ID NO: 454309 - RNA, 32 nt, Human
ggcaaggggaaucugucaucauucauugcaaa

SEQ ID NO: 454310 - RNA, 32 nt, Human
ggcaaggggaggcaggaggguggccuggaccu

SEQ ID NO: 454311 - RNA, 32 nt, Human
ggcaaggggauuucucaggucauuuggagaac

SEQ ID NO: 454312 - RNA, 32 nt, Human
ggcaaggggcucuuugaugaugaggacgagga

SEQ ID NO: 454313 - RNA, 32 nt, Human
ggcaagggggaguguagagcagagcagaagcc

SEQ ID NO: 454314 - RNA, 32 nt, Human
ggcaaggggugaggauaggacagagggauuuu

SEQ ID NO: 454315 - RNA, 32 nt, Human
ggcaagggucaaacugacucacucuaccagga

SEQ ID NO: 454316 - RNA, 32 nt, Human
ggcaaggguuugcccaguuugcagaugagaaa

SEQ ID NO: 454317 - RNA, 32 nt, Human
ggcaagguaccgucacugacaccagcagcauu

SEQ ID NO: 454318 - RNA, 19 nt, Human
ggcaagguagcccugggca

SEQ ID NO: 454319 - RNA, 32 nt, Human
ggcaagguaggaacaagaugagcuugaaauau

SEQ ID NO: 454320 - RNA, 32 nt, Human
ggcaaggucagacuuagaguacagcuguuuuc

SEQ ID NO: 454321 - RNA, 32 nt, Human
ggcaaggucauuaaauuugccaccucacacgu

SEQ ID NO: 454322 - RNA, 32 nt, Human
ggcaaggucauuggccgggccuggccugugga

SEQ ID NO: 454323 - RNA, 32 nt, Human
ggcaaggucccucuccagcugcaggugaggcc

SEQ ID NO: 454324 - RNA, 32 nt, Human
ggcaaggucugagggcccaccgaugagagaga

SEQ ID NO: 454325 - RNA, 32 nt, Human
ggcaaggugaugaccagcuggagagagaucag

SEQ ID NO: 454326 - RNA, 32 nt, Human
ggcaaggugcugcucagagaggaggaccucau

SEQ ID NO: 454327 - RNA, 32 nt, Human
ggcaagguggaggcagaguuugagcugcugac

SEQ ID NO: 454328 - RNA, 23 nt, Human
ggcaagguggugacaggcagcag

SEQ ID NO: 454329 - RNA, 32 nt, Human
ggcaagguucaaggcagacuaaccucaugcau

SEQ ID NO: 454330 - RNA, 32 nt, Human
ggcaaguagcaagaauagagcaaaauaucaaa

SEQ ID NO: 454331 - RNA, 32 nt, Human
ggcaagucaguuaaccuuucuggccuguuacc

SEQ ID NO: 454332 - RNA, 32 nt, Human
ggcaagucauuuucaucucuuugccccaguuu

SEQ ID NO: 454333 - RNA, 32 nt, Human
ggcaaguccaccacuacuggccaucugaccua

SEQ ID NO: 454334 - RNA, 32 nt, Human
ggcaaguccaccacuacuggccaucugaucua

SEQ ID NO: 454335 - RNA, 32 nt, Human
ggcaagucuccuacggcuuccugggccugcac

SEQ ID NO: 454336 - RNA, 32 nt, Human
ggcaagugagccaagaaccuaggagcagggcc

SEQ ID NO: 454337 - RNA, 32 nt, Human
ggcaagugagccugcaccauggagguggccac

SEQ ID NO: 454338 - RNA, 28 nt, Human
ggcaagugaggugcugccgucauccagg

SEQ ID NO: 454339 - RNA, 32 nt, Human
ggcaagugccaguaaucccagcuacucuugga

SEQ ID NO: 454340 - RNA, 32 nt, Human
ggcaagugccugaaaucccagguacucaggag

SEQ ID NO: 454341 - RNA, 24 nt, Human
ggcaaguggcuguggcggccgcag

SEQ ID NO: 454342 - RNA, 32 nt, Human
ggcaaguguguggaagcugagcguugucgccg

SEQ ID NO: 454343 - RNA, 32 nt, Human
ggcaaguuacuuaucuuccuccauuuauucac

SEQ ID NO: 454344 - RNA, 32 nt, Human
ggcaaguuacuuuaucuaucugccucaccucc

SEQ ID NO: 454345 - RNA, 32 nt, Human
ggcaauaagagucccaauuccaaccugacucu

SEQ ID NO: 454346 - RNA, 32 nt, Human
ggcaauaagcuuuuggaaaaacuauuccagaa

SEQ ID NO: 454347 - RNA, 32 nt, Human
ggcaauaaguaggggaaggaagaauuucauuu

SEQ ID NO: 454348 - RNA, 32 nt, Human
ggcaauaccauccuggacacaggaacuggcaa

SEQ ID NO: 454349 - RNA, 32 nt, Human
ggcaauagaacccaggggucugagcauggagc

SEQ ID NO: 454350 - RNA, 23 nt, Human
ggcaauagaguaagacucugucu

SEQ ID NO: 454351 - RNA, 32 nt, Human
ggcaauagcccccauuccugggucuuuagaga

SEQ ID NO: 454352 - RNA, 20 nt, Human
ggcaauagcucucagaucuc

SEQ ID NO: 454353 - RNA, 32 nt, Human
ggcaauaggaugagguuucuucaggguaaacu

SEQ ID NO: 454354 - RNA, 32 nt, Human
ggcaauaggccugggaaagucgcacuuucauc

SEQ ID NO: 454355 - RNA, 32 nt, Human
ggcaaucacucacuggcaaugagggaggcagg

SEQ ID NO: 454356 - RNA, 32 nt, Human
ggcaaucagcacaaaaauuauuuagaaaucuu

SEQ ID NO: 454357 - RNA, 32 nt, Human
ggcaaucagugaaguuuauguaaugaagcccu

SEQ ID NO: 454358 - RNA, 32 nt, Human
ggcaaucauagauuucuuuuccauuuugcaua

SEQ ID NO: 454359 - RNA, 17 nt, Human
ggcaaucauuugagguc

SEQ ID NO: 454360 - RNA, 32 nt, Human
ggcaauccaauacagacaggaagauaaaacuc

SEQ ID NO: 454361 - RNA, 32 nt, Human
ggcaauccucugaccaccacagagcccucgca

SEQ ID NO: 454362 - RNA, 32 nt, Human
ggcaaucgggcagugaaacuugauauuguauu

SEQ ID NO: 454363 - RNA, 32 nt, Human
ggcaaucuccaucucccggguucaagcgauuu

SEQ ID NO: 454364 - RNA, 20 nt, Human
ggcaaucucggcucacugca

SEQ ID NO: 454365 - RNA, 32 nt, Human
ggcaaucucugccucugcaacagggcacuugc

SEQ ID NO: 454366 - RNA, 22 nt, Human
ggcaaucugaggcgacugguga

SEQ ID NO: 454367 - RNA, 32 nt, Human
ggcaaucuugaacccucuaugcagugagagca

SEQ ID NO: 454368 - RNA, 32 nt, Human
ggcaaugacaaguuuaacauauacaaauucgu

SEQ ID NO: 454369 - RNA, 32 nt, Human
ggcaaugagcaguucuguagaggauucaugug

SEQ ID NO: 454370 - RNA, 32 nt, Human
ggcaaugaggucgaucacccuuuugcuauagc

SEQ ID NO: 454371 - RNA, 32 nt, Human
ggcaaugcaaaugcaggugcaguuuucuguua

SEQ ID NO: 454372 - RNA, 32 nt, Human
ggcaaugcaucuuuccaaccugagcgaguggg

SEQ ID NO: 454373 - RNA, 32 nt, Human
ggcaaugcuccuggggagucuguggggaagau

SEQ ID NO: 454374 - RNA, 32 nt, Human
ggcaaugcuuuccagaggauggaguccuuuuu

SEQ ID NO: 454375 - RNA, 32 nt, Human
ggcaauggacaaggaaggaauaaagggagaag

SEQ ID NO: 454376 - RNA, 32 nt, Human
ggcaauggagaaggcaggaaggcaggggccuu

SEQ ID NO: 454377 - RNA, 32 nt, Human
ggcaauggcaggcaggaaagacagaggaagga

SEQ ID NO: 454378 - RNA, 31 nt, Human
ggcaauggcgccaucucagcucacugcaacg

SEQ ID NO: 454379 - RNA, 32 nt, Human
ggcaauggcgugaacccgggaggcagagcuug

SEQ ID NO: 454380 - RNA, 32 nt, Human
ggcaauggcuccaagccuugccauagggcugc

SEQ ID NO: 454381 - RNA, 32 nt, Human
ggcaauggcugcacaacauuacaaauguauuu

SEQ ID NO: 454382 - RNA, 29 nt, Human
ggcaauggcugcagacucuauuccgacau

SEQ ID NO: 454383 - RNA, 32 nt, Human
ggcaaugggacccagcuccaucagacacuugu

SEQ ID NO: 454384 - RNA, 32 nt, Human
ggcaaugggcaaaggggcugugccuugcagcc

SEQ ID NO: 454385 - RNA, 31 nt, Human
ggcaauggugcaaucucagcucacugcaacc

SEQ ID NO: 454386 - RNA, 32 nt, Human
ggcaaugucucugcuucuuccugggcugucau

SEQ ID NO: 454387 - RNA, 32 nt, Human
ggcaauguggugaagcugaguuucuguccaau

SEQ ID NO: 454388 - RNA, 32 nt, Human
ggcaauguucccccucuccucucuuccucccu

SEQ ID NO: 454389 - RNA, 20 nt, Human
ggcaauguuuccauuaagua

SEQ ID NO: 454390 - RNA, 32 nt, Human
ggcaauguuuguccuuaccaggauuuaaucua

SEQ ID NO: 454391 - RNA, 32 nt, Human
ggcaauucaaaacaggcugacauacagagggc

SEQ ID NO: 454392 - RNA, 32 nt, Human
ggcaauucauaugcacaugcaaguuugagaac

SEQ ID NO: 454393 - RNA, 32 nt, Human
ggcaauuccagaaaucuuaguagcccauguua

SEQ ID NO: 454394 - RNA, 32 nt, Human
ggcaauuccucuucauugucuacauagugaca

SEQ ID NO: 454395 - RNA, 32 nt, Human
ggcaauugagguggguggucaaaagagaagca

SEQ ID NO: 454396 - RNA, 31 nt, Human
ggcaauuguacaaucucggcucauuacaacc

SEQ ID NO: 454397 - RNA, 32 nt, Human
ggcaauuguuuauagugaaacuuuuuaaauua

SEQ ID NO: 454398 - RNA, 32 nt, Human
ggcaauuucaugguguuucaccagagggcgcu

SEQ ID NO: 454399 - RNA, 32 nt, Human
ggcaauuugacagaguguuggaugugucaugu

SEQ ID NO: 454400 - RNA, 32 nt, Human
ggcaauuugcuugagcuacuucuugccagcaa

SEQ ID NO: 454401 - RNA, 32 nt, Human
ggcaauuugggaugccuccuggggaagguuuc

SEQ ID NO: 454402 - RNA, 32 nt, Human
ggcaauuugggcugggcucaacagggcaguuc

SEQ ID NO: 454403 - RNA, 32 nt, Human
ggcacaaaauacuuagacuagaugcugaucca

SEQ ID NO: 454404 - RNA, 32 nt, Human
ggcacaaacaaucuggaagccaaaaauugcac

SEQ ID NO: 454405 - RNA, 32 nt, Human
ggcacaaagcaagcuaaugucaccugagacca

SEQ ID NO: 454406 - RNA, 32 nt, Human
ggcacaaauuauacugucaaccuacuguugcu

SEQ ID NO: 454407 - RNA, 32 nt, Human
ggcacaacaaucacuugagccuaggaggccca

SEQ ID NO: 454408 - RNA, 32 nt, Human
ggcacaaccaagaacugggauuaaugaagcau

SEQ ID NO: 454409 - RNA, 24 nt, Human
ggcacaaccagacgcccagucaca

SEQ ID NO: 454410 - RNA, 32 nt, Human
ggcacaaccagcuuccuggaguuaccucagca

SEQ ID NO: 454411 - RNA, 32 nt, Human
ggcacaacucaaauguguaaagaaggaagagc

SEQ ID NO: 454412 - RNA, 32 nt, Human
ggcacaacuccaggaauucucuagcuccuggu

SEQ ID NO: 454413 - RNA, 32 nt, Human
ggcacaacugacugguucacagcacuccuuac

SEQ ID NO: 454414 - RNA, 32 nt, Human
ggcacaagacucagugcugggccuggcaugca

SEQ ID NO: 454415 - RNA, 32 nt, Human
ggcacaagagcaaagagaugggccagugacuc

SEQ ID NO: 454416 - RNA, 32 nt, Human
ggcacaagaucauuccuguuguacauggggag

SEQ ID NO: 454417 - RNA, 32 nt, Human
ggcacaagccucccacugccccuuuccccgcc

SEQ ID NO: 454418 - RNA, 32 nt, Human
ggcacaagccuguaaucucugcacuuugggau

SEQ ID NO: 454419 - RNA, 32 nt, Human
ggcacaagcucccuagccucuuuggauccauu

SEQ ID NO: 454420 - RNA, 32 nt, Human
ggcacaaggaagaaaguaugggaaggaggaau

SEQ ID NO: 454421 - RNA, 24 nt, Human
ggcacaagugauccuccugcuuca

SEQ ID NO: 454422 - RNA, 32 nt, Human
ggcacaagugcacacacaucuaugcagacaag

SEQ ID NO: 454423 - RNA, 22 nt, Human
ggcacaaucucagcucacugca

SEQ ID NO: 454424 - RNA, 32 nt, Human
ggcacaauggcuggacaugggugggcucugau

SEQ ID NO: 454425 - RNA, 32 nt, Human
ggcacaauguauacuucagugcucacccguag

SEQ ID NO: 454426 - RNA, 32 nt, Human
ggcacaauugcacuccagcccgagugacagaa

SEQ ID NO: 454427 - RNA, 32 nt, Human
ggcacacacacagcucugugccugugugggca

SEQ ID NO: 454428 - RNA, 32 nt, Human
ggcacacacaugcacacacccauaaacacaca

SEQ ID NO: 454429 - RNA, 32 nt, Human
ggcacacaccaccacauccagcuuauuuuugu

SEQ ID NO: 454430 - RNA, 32 nt, Human
ggcacacaccuauaaucucagcacuuugggag

SEQ ID NO: 454431 - RNA, 32 nt, Human
ggcacacaccuguaaucccagcuacucaggaa

SEQ ID NO: 454432 - RNA, 32 nt, Human
ggcacacaccuguaaucccagcuacucaggag

SEQ ID NO: 454433 - RNA, 32 nt, Human
ggcacacaccuguaaucccagcuacucggagg

SEQ ID NO: 454434 - RNA, 32 nt, Human
ggcacacaccuguaaucccagcuacucgggag

SEQ ID NO: 454435 - RNA, 32 nt, Human
ggcacacaccuguaaucccaguuacucaggag

SEQ ID NO: 454436 - RNA, 19 nt, Human
ggcacacacgacacaggga

SEQ ID NO: 454437 - RNA, 19 nt, Human
ggcacacacguccagccca

SEQ ID NO: 454438 - RNA, 32 nt, Human
ggcacacacugggaugccgcagccuggccggc

SEQ ID NO: 454439 - RNA, 32 nt, Human
ggcacacagauccccuggaaacccaccucucu

SEQ ID NO: 454440 - RNA, 21 nt, Human
ggcacacagcaugcguggcgu

SEQ ID NO: 454441 - RNA, 32 nt, Human
ggcacacagcauggcagaaaaccgagagcccc

SEQ ID NO: 454442 - RNA, 32 nt, Human
ggcacacagggagggggaggucaggggcagag

SEQ ID NO: 454443 - RNA, 21 nt, Human
ggcacacagggcccggccaca

SEQ ID NO: 454444 - RNA, 32 nt, Human
ggcacacagggcccggccacacccagcggccc

SEQ ID NO: 454445 - RNA, 18 nt, Human
ggcacacagggcuggcuc

SEQ ID NO: 454446 - RNA, 21 nt, Human
ggcacacagggucacugcuga

SEQ ID NO: 454447 - RNA, 31 nt, Human
ggcacacagguguccauucagaugagaguug

SEQ ID NO: 454448 - RNA, 32 nt, Human
ggcacacauuuaccuauguaacaaaccugcac

SEQ ID NO: 454449 - RNA, 32 nt, Human
ggcacacauuuuccuauguaacaaauuugcaa

SEQ ID NO: 454450 - RNA, 32 nt, Human
ggcacaccaccagugaggcacauguugccuuu

SEQ ID NO: 454451 - RNA, 32 nt, Human
ggcacaccacuccuuccagcaguagucgcuuu

SEQ ID NO: 454452 - RNA, 32 nt, Human
ggcacaccagaggcaggucuucaauacccacu

SEQ ID NO: 454453 - RNA, 32 nt, Human
ggcacaccauacuagaauucacacuggagaga

SEQ ID NO: 454454 - RNA, 32 nt, Human
ggcacaccauuaacaaaugacagacuugggcu

SEQ ID NO: 454455 - RNA, 32 nt, Human
ggcacacccacccucaaucugggugggcauca

SEQ ID NO: 454456 - RNA, 32 nt, Human
ggcacacccauucucucaugcuuggaagaagc

SEQ ID NO: 454457 - RNA, 32 nt, Human
ggcacacccuacuguccuugugccucacgccc

SEQ ID NO: 454458 - RNA, 32 nt, Human
ggcacacccugccuguuuucucuuuuuagaca

SEQ ID NO: 454459 - RNA, 32 nt, Human
ggcacaccuucucccgggcacugaggcccagg

SEQ ID NO: 454460 - RNA, 32 nt, Human
ggcacacgaaggagguggggaggugaagaugg

SEQ ID NO: 454461 - RNA, 20 nt, Human
ggcacacgcaccugcucucc

SEQ ID NO: 454462 - RNA, 32 nt, Human
ggcacacgccuguaauaccagcuacucaggug

SEQ ID NO: 454463 - RNA, 32 nt, Human
ggcacacgccuguaaucccagcuacucagaug

SEQ ID NO: 454464 - RNA, 32 nt, Human
ggcacacgccuguaaucccagcuacucaggag

SEQ ID NO: 454465 - RNA, 32 nt, Human
ggcacacgccuguaaucccagcuacucgggaa

SEQ ID NO: 454466 - RNA, 32 nt, Human
ggcacacgccuguaaucccagcuacucuggag

SEQ ID NO: 454467 - RNA, 32 nt, Human
ggcacacgccuguaaucccagguacuuggaag

SEQ ID NO: 454468 - RNA, 32 nt, Human
ggcacacgccuguaaucccaguuacuugggag

SEQ ID NO: 454469 - RNA, 32 nt, Human
ggcacacgccuguaaucucagcuacucaggag

SEQ ID NO: 454470 - RNA, 32 nt, Human
ggcacacgccugucaucccagcuacucgguag

SEQ ID NO: 454471 - RNA, 18 nt, Human
ggcacacgccuuguucuu

SEQ ID NO: 454472 - RNA, 32 nt, Human
ggcacacggcccuucggagccugggcagccug

SEQ ID NO: 454473 - RNA, 32 nt, Human
ggcacacggcuguaaucccagcacuuugggag

SEQ ID NO: 454474 - RNA, 32 nt, Human
ggcacacguacgcacacacgcacaugcacaga

SEQ ID NO: 454475 - RNA, 32 nt, Human
ggcacacguggggcucuuuacccacuuggguu

SEQ ID NO: 454476 - RNA, 32 nt, Human
ggcacacguuuaccuguguaaccugcacaucc

SEQ ID NO: 454477 - RNA, 32 nt, Human
ggcacacuccuguaaucccagcuacuuaggag

SEQ ID NO: 454478 - RNA, 32 nt, Human
ggcacacugcaaccuucgccucccagauucaa

SEQ ID NO: 454479 - RNA, 32 nt, Human
ggcacacuggagucagaaaaacagaaauuaag

SEQ ID NO: 454480 - RNA, 32 nt, Human
ggcacacuggggagacaagaggcuccacaaca

SEQ ID NO: 454481 - RNA, 32 nt, Human
ggcacacuucacuucccacauucuccaggagg

SEQ ID NO: 454482 - RNA, 32 nt, Human
ggcacacuuuaacccagucucuguugcuguug

SEQ ID NO: 454483 - RNA, 19 nt, Human
ggcacagaaagggcagcuu

SEQ ID NO: 454484 - RNA, 20 nt, Human
ggcacagaaaucgagcaagg

SEQ ID NO: 454485 - RNA, 32 nt, Human
ggcacagaaggacugugugccugggucuaaca

SEQ ID NO: 454486 - RNA, 32 nt, Human
ggcacagaagggcugagagaccuggccuagug

SEQ ID NO: 454487 - RNA, 32 nt, Human
ggcacagaccucuuucccucugccucaaagcc

SEQ ID NO: 454488 - RNA, 32 nt, Human
ggcacagacuucggguuggauuugucagcaag

SEQ ID NO: 454489 - RNA, 25 nt, Human
ggcacagacuugccucuguugcugu

SEQ ID NO: 454490 - RNA, 19 nt, Human
ggcacagagaagagacagg

SEQ ID NO: 454491 - RNA, 32 nt, Human
ggcacagagagacagagguucauggacugagg

SEQ ID NO: 454492 - RNA, 19 nt, Human
ggcacagagagauauuuaa

SEQ ID NO: 454493 - RNA, 32 nt, Human
ggcacagagcagagaggagggcacuggugguc

SEQ ID NO: 454494 - RNA, 32 nt, Human
ggcacagagcgguagacccugcuucucuaagu

SEQ ID NO: 454495 - RNA, 32 nt, Human
ggcacagagcugggcaugggagagaaacgggc

SEQ ID NO: 454496 - RNA, 32 nt, Human
ggcacagaucucuuucccucugccucaaagcc

SEQ ID NO: 454497 - RNA, 32 nt, Human
ggcacagaugagagacagaggcagagaaguua

SEQ ID NO: 454498 - RNA, 32 nt, Human
ggcacagauggcugggacgggugacaguguga

SEQ ID NO: 454499 - RNA, 32 nt, Human
ggcacagauugguauuuguucuguaaagccca

SEQ ID NO: 454500 - RNA, 18 nt, Human
ggcacagcacaaaggcuu

SEQ ID NO: 454501 - RNA, 22 nt, Human
ggcacagcagccagcggguggg

SEQ ID NO: 454502 - RNA, 32 nt, Human
ggcacagcaguggcuggaaggugccccgugga

SEQ ID NO: 454503 - RNA, 32 nt, Human
ggcacagcaucacuugaacccaggaggcagag

SEQ ID NO: 454504 - RNA, 22 nt, Human
ggcacagcaugcuuguacuuga

SEQ ID NO: 454505 - RNA, 32 nt, Human
ggcacagccaggcuggagucagugucugcccc

SEQ ID NO: 454506 - RNA, 32 nt, Human
ggcacagcccucacagcucaaacgcccacccc

SEQ ID NO: 454507 - RNA, 32 nt, Human
ggcacagcccugacacagguguggcuacugga

SEQ ID NO: 454508 - RNA, 32 nt, Human
ggcacagccugggggcccucaggcugggcgcg

SEQ ID NO: 454509 - RNA, 32 nt, Human
ggcacagccugugcagagagggugggucaccc

SEQ ID NO: 454510 - RNA, 18 nt, Human
ggcacagcgccgcaucca

SEQ ID NO: 454511 - RNA, 19 nt, Human
ggcacagcggaacuccggg

SEQ ID NO: 454512 - RNA, 32 nt, Human
ggcacagcuacuccuggcuggggguggggccu

SEQ ID NO: 454513 - RNA, 32 nt, Human
ggcacagcuccccagucuuugcuuaugcccac

SEQ ID NO: 454514 - RNA, 32 nt, Human
ggcacagcucuaggcugggaggggagaaccag

SEQ ID NO: 454515 - RNA, 32 nt, Human
ggcacagcugccacgggcucuccugggcuuau

SEQ ID NO: 454516 - RNA, 32 nt, Human
ggcacagcugcucucccaugggugauggugau

SEQ ID NO: 454517 - RNA, 32 nt, Human
ggcacagcuucaaaaugacaucuaaguagcug

SEQ ID NO: 454518 - RNA, 18 nt, Human
ggcacaggaagggaaggg

SEQ ID NO: 454519 - RNA, 23 nt, Human
ggcacaggaucaauaaugccuga

SEQ ID NO: 454520 - RNA, 31 nt, Human
ggcacaggcaaaggguguggcuucagagaag

SEQ ID NO: 454521 - RNA, 32 nt, Human
ggcacaggcagaaggacuucagcugcuggucu

SEQ ID NO: 454522 - RNA, 32 nt, Human
ggcacaggccacugcaaacccugcugcugccg

SEQ ID NO: 454523 - RNA, 32 nt, Human
ggcacaggccccggaguggagggggcagggga

SEQ ID NO: 454524 - RNA, 21 nt, Human
ggcacaggccuguaguccuag

SEQ ID NO: 454525 - RNA, 19 nt, Human
ggcacaggcuaaaaccuga

SEQ ID NO: 454526 - RNA, 32 nt, Human
ggcacaggcuggacacaggaaugggggcgccu

SEQ ID NO: 454527 - RNA, 32 nt, Human
ggcacaggcugugagccagggugcugggaaac

SEQ ID NO: 454528 - RNA, 32 nt, Human
ggcacagggacagcaugucuccagccagcgcc

SEQ ID NO: 454529 - RNA, 32 nt, Human
ggcacagggacuccgggagacucagagggcga

SEQ ID NO: 454530 - RNA, 32 nt, Human
ggcacagggagaugcucaggggccagucccug

SEQ ID NO: 454531 - RNA, 32 nt, Human
ggcacagggagguggguuggggugaggccaca

SEQ ID NO: 454532 - RNA, 32 nt, Human
ggcacagggccaucugucaccaggggcuuagg

SEQ ID NO: 454533 - RNA, 32 nt, Human
ggcacaggggacuaggggcauguagaguauau

SEQ ID NO: 454534 - RNA, 32 nt, Human
ggcacaggggcuccuggaaagacagcaggcuu

SEQ ID NO: 454535 - RNA, 32 nt, Human
ggcacagggggucaggcacuguggaaagaagg

SEQ ID NO: 454536 - RNA, 32 nt, Human
ggcacaggugccagaaucuaucuuuugcccua

SEQ ID NO: 454537 - RNA, 19 nt, Human
ggcacagguggcugcuuag

SEQ ID NO: 454538 - RNA, 32 nt, Human
ggcacaggugugagugugugagcaacaguacc

SEQ ID NO: 454539 - RNA, 20 nt, Human
ggcacagguuauaaacuuaa

SEQ ID NO: 454540 - RNA, 18 nt, Human
ggcacagguucauaucca

SEQ ID NO: 454541 - RNA, 22 nt, Human
ggcacagguugauaauuaucua

SEQ ID NO: 454542 - RNA, 32 nt, Human
ggcacaguacccuuugguuuguugacuguuuu

SEQ ID NO: 454543 - RNA, 32 nt, Human
ggcacaguccccucugccccugccucagucga

SEQ ID NO: 454544 - RNA, 32 nt, Human
ggcacagucucuaggucucugacaggcaggua

SEQ ID NO: 454545 - RNA, 32 nt, Human
ggcacagucugugucauuggugcacaugugcg

SEQ ID NO: 454546 - RNA, 32 nt, Human
ggcacagugagggggagccaggucagcaaguu

SEQ ID NO: 454547 - RNA, 32 nt, Human
ggcacagugaugggcaaagauuagcugcuucc

SEQ ID NO: 454548 - RNA, 32 nt, Human
ggcacagugcagcuuggugaagccacacgcug

SEQ ID NO: 454549 - RNA, 32 nt, Human
ggcacagugcaugucagcaucuaagauuccac

SEQ ID NO: 454550 - RNA, 32 nt, Human
ggcacaguggcucacaccuaaucccagcacuu

SEQ ID NO: 454551 - RNA, 22 nt, Human
ggcacaguggcucauaccugua

SEQ ID NO: 454552 - RNA, 21 nt, Human
ggcacaguggcucaugccuga

SEQ ID NO: 454553 - RNA, 22 nt, Human
ggcacaguggcucaugccugua

SEQ ID NO: 454554 - RNA, 32 nt, Human
ggcacagugggugaggagauggggacagguga

SEQ ID NO: 454555 - RNA, 25 nt, Human
ggcacagugguggcucaugccugua

SEQ ID NO: 454556 - RNA, 32 nt, Human
ggcacagugguggcucaugccuguaaucccag

SEQ ID NO: 454557 - RNA, 32 nt, Human
ggcacaguguagaucugaaaaguccugacuac

SEQ ID NO: 454558 - RNA, 32 nt, Human
ggcacagugucgcgccuguaaucccagcacuu

SEQ ID NO: 454559 - RNA, 32 nt, Human
ggcacaguguuuugaagggaggugggagcucu

SEQ ID NO: 454560 - RNA, 32 nt, Human
ggcacaguucaugcccuguaauccuagcacuu

SEQ ID NO: 454561 - RNA, 32 nt, Human
ggcacauaacauggaaccuggccaggcauggu

SEQ ID NO: 454562 - RNA, 32 nt, Human
ggcacauacagacucacauacagacacacaca

SEQ ID NO: 454563 - RNA, 32 nt, Human
ggcacauaccuguaaucccagcuacucgggag

SEQ ID NO: 454564 - RNA, 32 nt, Human
ggcacauaccuguaaucccagcuacuuggaau

SEQ ID NO: 454565 - RNA, 32 nt, Human
ggcacauacucagagcagucuucuuagccuau

SEQ ID NO: 454566 - RNA, 32 nt, Human
ggcacauagaagcccucacacacacaugcccg

SEQ ID NO: 454567 - RNA, 32 nt, Human
ggcacauaguacaguggauggaaggugcccgc

SEQ ID NO: 454568 - RNA, 32 nt, Human
ggcacaucaugcugcuggacagucugugcgaa

SEQ ID NO: 454569 - RNA, 24 nt, Human
ggcacauccaguugccaaggaaug

SEQ ID NO: 454570 - RNA, 32 nt, Human
ggcacaucgcuuuccccucuagaucuccauau

SEQ ID NO: 454571 - RNA, 32 nt, Human
ggcacaucugcuguccauuggggguucucagu

SEQ ID NO: 454572 - RNA, 32 nt, Human
ggcacaucugcugugguuucucaccagagaac

SEQ ID NO: 454573 - RNA, 32 nt, Human
ggcacaugacuguaaucccagcuacucaggag

SEQ ID NO: 454574 - RNA, 31 nt, Human
ggcacaugacuucucacagcuacaggugacc

SEQ ID NO: 454575 - RNA, 32 nt, Human
ggcacaugauagugcaaacugcucugacacca

SEQ ID NO: 454576 - RNA, 22 nt, Human
ggcacaugcacuacaagaggaa

SEQ ID NO: 454577 - RNA, 21 nt, Human
ggcacaugcauuggccuggca

SEQ ID NO: 454578 - RNA, 32 nt, Human
ggcacaugccaccacaccuagcuccuuacaac

SEQ ID NO: 454579 - RNA, 32 nt, Human
ggcacaugccuauaaucccagcuacucaggag

SEQ ID NO: 454580 - RNA, 32 nt, Human
ggcacaugccuauaaucccagcuacucgggag

SEQ ID NO: 454581 - RNA, 32 nt, Human
ggcacaugccuauaaucccagcuacuugggag

SEQ ID NO: 454582 - RNA, 32 nt, Human
ggcacaugccuaugaucccagcuacuggggag

SEQ ID NO: 454583 - RNA, 32 nt, Human
ggcacaugccugcaaucccagcuacuugagag

SEQ ID NO: 454584 - RNA, 32 nt, Human
ggcacaugccugccagcguugugucaugccug

SEQ ID NO: 454585 - RNA, 32 nt, Human
ggcacaugccuguaaaccuagcuacuugagag

SEQ ID NO: 454586 - RNA, 32 nt, Human
ggcacaugccuguaacccagcuacucgggagg

SEQ ID NO: 454587 - RNA, 32 nt, Human
ggcacaugccuguaacuccagcuacuugggag

SEQ ID NO: 454588 - RNA, 32 nt, Human
ggcacaugccuguaauaucagcuacucaggag

SEQ ID NO: 454589 - RNA, 20 nt, Human
ggcacaugccuguaauccca

SEQ ID NO: 454590 - RNA, 32 nt, Human
ggcacaugccuguaaucccaacuacuugggag

SEQ ID NO: 454591 - RNA, 32 nt, Human
ggcacaugccuguaaucccagauacuugggag

SEQ ID NO: 454592 - RNA, 32 nt, Human
ggcacaugccuguaaucccagcacuuugggaa

SEQ ID NO: 454593 - RNA, 32 nt, Human
ggcacaugccuguaaucccagcacuuugggag

SEQ ID NO: 454594 - RNA, 32 nt, Human
ggcacaugccuguaaucccagcacuuuggggg

SEQ ID NO: 454595 - RNA, 23 nt, Human
ggcacaugccuguaaucccagcu

SEQ ID NO: 454596 - RNA, 32 nt, Human
ggcacaugccuguaaucccagcuacaugggag

SEQ ID NO: 454597 - RNA, 32 nt, Human
ggcacaugccuguaaucccagcuacccgggga

SEQ ID NO: 454598 - RNA, 32 nt, Human
ggcacaugccuguaaucccagcuacgucagga

SEQ ID NO: 454599 - RNA, 28 nt, Human
ggcacaugccuguaaucccagcuacuca

SEQ ID NO: 454600 - RNA, 32 nt, Human
ggcacaugccuguaaucccagcuacucaggag

SEQ ID NO: 454601 - RNA, 32 nt, Human
ggcacaugccuguaaucccagcuacucagggg

SEQ ID NO: 454602 - RNA, 32 nt, Human
ggcacaugccuguaaucccagcuacucaugag

SEQ ID NO: 454603 - RNA, 32 nt, Human
ggcacaugccuguaaucccagcuacuccggaa

SEQ ID NO: 454604 - RNA, 32 nt, Human
ggcacaugccuguaaucccagcuacucggagg

SEQ ID NO: 454605 - RNA, 32 nt, Human
ggcacaugccuguaaucccagcuacucgggag

SEQ ID NO: 454606 - RNA, 32 nt, Human
ggcacaugccuguaaucccagcuacuuggcag

SEQ ID NO: 454607 - RNA, 32 nt, Human
ggcacaugccuguaaucccagcuacuugggag

SEQ ID NO: 454608 - RNA, 32 nt, Human
ggcacaugccuguaaucccagcugcucaggag

SEQ ID NO: 454609 - RNA, 32 nt, Human
ggcacaugccuguaaucccagcugcuggagag

SEQ ID NO: 454610 - RNA, 32 nt, Human
ggcacaugccuguaaucccgguauuugggagg

SEQ ID NO: 454611 - RNA, 32 nt, Human
ggcacaugccuguaauccgagugcuuugggag

SEQ ID NO: 454612 - RNA, 32 nt, Human
ggcacaugccuguaauccuagcacuuugggag

SEQ ID NO: 454613 - RNA, 32 nt, Human
ggcacaugccuguaauccuagcuacucgggag

SEQ ID NO: 454614 - RNA, 32 nt, Human
ggcacaugccuguaaucgcagcuacucaggag

SEQ ID NO: 454615 - RNA, 32 nt, Human
ggcacaugccuguaaucucagcgacuugggag

SEQ ID NO: 454616 - RNA, 32 nt, Human
ggcacaugccuguaaucucagcuacuagagag

SEQ ID NO: 454617 - RNA, 32 nt, Human
ggcacaugccuguaaucucagcuacucaggag

SEQ ID NO: 454618 - RNA, 32 nt, Human
ggcacaugccuguaaucucagcuacuugggag

SEQ ID NO: 454619 - RNA, 32 nt, Human
ggcacaugccuguaaugccagcuacucgggag

SEQ ID NO: 454620 - RNA, 32 nt, Human
ggcacaugccuguaauuccagcugcuugggag

SEQ ID NO: 454621 - RNA, 32 nt, Human
ggcacaugccuguagucccaccuacucgagaa

SEQ ID NO: 454622 - RNA, 32 nt, Human
ggcacaugccuguagucccaccuacuugggag

SEQ ID NO: 454623 - RNA, 32 nt, Human
ggcacaugccuguagucccaccuuugagcggc

SEQ ID NO: 454624 - RNA, 32 nt, Human
ggcacaugccuguagucccagauacuugggag

SEQ ID NO: 454625 - RNA, 32 nt, Human
ggcacaugccuguagucccagccacuagggcg

SEQ ID NO: 454626 - RNA, 32 nt, Human
ggcacaugccuguagucccagcuacgugggag

SEQ ID NO: 454627 - RNA, 32 nt, Human
ggcacaugccuguagucccagcuacucaagag

SEQ ID NO: 454628 - RNA, 32 nt, Human
ggcacaugccuguagucccagcuacuccagag

SEQ ID NO: 454629 - RNA, 32 nt, Human
ggcacaugccuguagucccagcuacucgggag

SEQ ID NO: 454630 - RNA, 32 nt, Human
ggcacaugccuguagucccagcuacuggggag

SEQ ID NO: 454631 - RNA, 32 nt, Human
ggcacaugccuguagucccagcuacuugagag

SEQ ID NO: 454632 - RNA, 32 nt, Human
ggcacaugccuguaguuccagcuacucaggag

SEQ ID NO: 454633 - RNA, 32 nt, Human
ggcacaugccuguauucccagcugcuugggag

SEQ ID NO: 454634 - RNA, 32 nt, Human
ggcacaugccugugaucccagcacuuugggau

SEQ ID NO: 454635 - RNA, 32 nt, Human
ggcacaugccugugaucccagcuacucaggaa

SEQ ID NO: 454636 - RNA, 32 nt, Human
ggcacaugccugugaucccagcuacucaggag

SEQ ID NO: 454637 - RNA, 32 nt, Human
ggcacaugccugugaucccagcuacugaggag

SEQ ID NO: 454638 - RNA, 32 nt, Human
ggcacaugccuguggucccagguacuugagag

SEQ ID NO: 454639 - RNA, 32 nt, Human
ggcacaugccugugguccuagccacuagaggc

SEQ ID NO: 454640 - RNA, 32 nt, Human
ggcacaugccuguggucgcagcugcucgggag

SEQ ID NO: 454641 - RNA, 32 nt, Human
ggcacaugccuguggucucagcuacuugggag

SEQ ID NO: 454642 - RNA, 32 nt, Human
ggcacaugccugugguuccagccacucaggag

SEQ ID NO: 454643 - RNA, 32 nt, Human
ggcacaugccuguugucccagcugcuugggag

SEQ ID NO: 454644 - RNA, 20 nt, Human
ggcacaugccuugaucccag

SEQ ID NO: 454645 - RNA, 32 nt, Human
ggcacaugcuuauaaucccagaaauuugggag

SEQ ID NO: 454646 - RNA, 32 nt, Human
ggcacaugcuuguaaucccagcuacucgggag

SEQ ID NO: 454647 - RNA, 21 nt, Human
ggcacauggaacuucacgggu

SEQ ID NO: 454648 - RNA, 32 nt, Human
ggcacauggaggguacaaggaggacucgccug

SEQ ID NO: 454649 - RNA, 18 nt, Human
ggcacauggauccauggc

SEQ ID NO: 454650 - RNA, 21 nt, Human
ggcacaugggacagccauggc

SEQ ID NO: 454651 - RNA, 32 nt, Human
ggcacauguaaucccagcuacuugggaggcug

SEQ ID NO: 454652 - RNA, 32 nt, Human
ggcacauguacugcaggugugcagugagcaca

SEQ ID NO: 454653 - RNA, 32 nt, Human
ggcacauguauacauacguaacaaaccugcac

SEQ ID NO: 454654 - RNA, 32 nt, Human
ggcacauguauacauauguaacaaaccugcac

SEQ ID NO: 454655 - RNA, 32 nt, Human
ggcacauguauacauauguaacaaaccugcau

SEQ ID NO: 454656 - RNA, 32 nt, Human
ggcacauguauacauauguaacaaaucugcac

SEQ ID NO: 454657 - RNA, 32 nt, Human
ggcacauguauacauauguaacuaaccugcac

SEQ ID NO: 454658 - RNA, 32 nt, Human
ggcacauguauaccuauguaacaaaccugcac

SEQ ID NO: 454659 - RNA, 32 nt, Human
ggcacauguauaccuguguaacaaaccugcac

SEQ ID NO: 454660 - RNA, 32 nt, Human
ggcacauguauacguauguaacuaaccugcac

SEQ ID NO: 454661 - RNA, 32 nt, Human
ggcacauguauucauauguaacaaaccugcac

SEQ ID NO: 454662 - RNA, 32 nt, Human
ggcacaugucuguaaucccagcuacucaggag

SEQ ID NO: 454663 - RNA, 32 nt, Human
ggcacaugucuguaaucccagcuacucgggag

SEQ ID NO: 454664 - RNA, 32 nt, Human
ggcacaugucuguaauccuagcacuuugggag

SEQ ID NO: 454665 - RNA, 32 nt, Human
ggcacauguggagagccagggagaagaagaga

SEQ ID NO: 454666 - RNA, 32 nt, Human
ggcacauguggagagccagggagaggaagaga

SEQ ID NO: 454667 - RNA, 32 nt, Human
ggcacauguguaccuauguaacaaaccugcac

SEQ ID NO: 454668 - RNA, 25 nt, Human
ggcacauguguggggaagccgguca

SEQ ID NO: 454669 - RNA, 32 nt, Human
ggcacauguuuaccuauguaacaaaccugcac

SEQ ID NO: 454670 - RNA, 32 nt, Human
ggcacauguuuaccuauguaacaaaccugcau

SEQ ID NO: 454671 - RNA, 32 nt, Human
ggcacauuacuuuugcaccaaccgaccuaaua

SEQ ID NO: 454672 - RNA, 32 nt, Human
ggcacauucacuucucccacucuuggcaugua

SEQ ID NO: 454673 - RNA, 32 nt, Human
ggcacauuccuguaaucccagcuacucgggag

SEQ ID NO: 454674 - RNA, 17 nt, Human
ggcacauuuaauaccca

SEQ ID NO: 454675 - RNA, 25 nt, Human
ggcaccaacaacauggacggccaca

SEQ ID NO: 454676 - RNA, 21 nt, Human
ggcaccaaggagcugacuaca

SEQ ID NO: 454677 - RNA, 21 nt, Human
ggcaccaaggggccaaccgcc

SEQ ID NO: 454678 - RNA, 23 nt, Human
ggcaccaaguccaccuggccuca

SEQ ID NO: 454679 - RNA, 19 nt, Human
ggcaccacagaugcucucc

SEQ ID NO: 454680 - RNA, 22 nt, Human
ggcaccacagccuccaaaaaug

SEQ ID NO: 454681 - RNA, 32 nt, Human
ggcaccacagugagcauuguguucuuggcaug

SEQ ID NO: 454682 - RNA, 20 nt, Human
ggcaccaccacacccggcua

SEQ ID NO: 454683 - RNA, 20 nt, Human
ggcaccaccacaccuggcua

SEQ ID NO: 454684 - RNA, 32 nt, Human
ggcaccaccaccucacagcugugugaccggga

SEQ ID NO: 454685 - RNA, 32 nt, Human
ggcaccacccaccccucaccuugcaggcugcc

SEQ ID NO: 454686 - RNA, 23 nt, Human
ggcaccacccccucauccaggga

SEQ ID NO: 454687 - RNA, 32 nt, Human
ggcaccacccuggcaguuccagccuguagggg

SEQ ID NO: 454688 - RNA, 32 nt, Human
ggcaccacccuugcccugaagccuggggcacu

SEQ ID NO: 454689 - RNA, 32 nt, Human
ggcaccaccugacagaauucucaagcaccuga

SEQ ID NO: 454690 - RNA, 32 nt, Human
ggcaccacguaagaccuccugcccuuagcucu

SEQ ID NO: 454691 - RNA, 32 nt, Human
ggcaccacuacacuccagcccgggcgacagag

SEQ ID NO: 454692 - RNA, 32 nt, Human
ggcaccacuacauuucagccugggcgaaagua

SEQ ID NO: 454693 - RNA, 32 nt, Human
ggcaccacugcacuccagccuaggugacagag

SEQ ID NO: 454694 - RNA, 23 nt, Human
ggcaccacugcacuccagccugg

SEQ ID NO: 454695 - RNA, 32 nt, Human
ggcaccacugcacuccagccuggacgacagag

SEQ ID NO: 454696 - RNA, 32 nt, Human
ggcaccacugcacuccagccugggagacacag

SEQ ID NO: 454697 - RNA, 32 nt, Human
ggcaccacugcacuccagccugggagacagag

SEQ ID NO: 454698 - RNA, 32 nt, Human
ggcaccacugcacuccagccugggcaacagag

SEQ ID NO: 454699 - RNA, 32 nt, Human
ggcaccacugcacuccagccugggugacagag

SEQ ID NO: 454700 - RNA, 32 nt, Human
ggcaccacugcacuccagccugggugagagag

SEQ ID NO: 454701 - RNA, 32 nt, Human
ggcaccacugcacuccagcuugggugacagag

SEQ ID NO: 454702 - RNA, 32 nt, Human
ggcaccacugcacuccauccugggugacagag

SEQ ID NO: 454703 - RNA, 32 nt, Human
ggcaccacugcacuccggccuaggcaacgaga

SEQ ID NO: 454704 - RNA, 32 nt, Human
ggcaccacugcacucuagccugggcaagagaa

SEQ ID NO: 454705 - RNA, 32 nt, Human
ggcaccacugcacuucagccugggugacagag

SEQ ID NO: 454706 - RNA, 32 nt, Human
ggcaccacugcauuccagccugggugacagag

SEQ ID NO: 454707 - RNA, 32 nt, Human
ggcaccacugcccuccagccuggaugacagag

SEQ ID NO: 454708 - RNA, 32 nt, Human
ggcaccacuggacuccagccugggcgacagag

SEQ ID NO: 454709 - RNA, 32 nt, Human
ggcaccacuguacuccagccugggugacagag

SEQ ID NO: 454710 - RNA, 32 nt, Human
ggcaccacuuauugcacuccagcccgggcgac

SEQ ID NO: 454711 - RNA, 32 nt, Human
ggcaccagagcaaaaccaacagagccacuggg

SEQ ID NO: 454712 - RNA, 32 nt, Human
ggcaccagagugaacagggcaggcagguagua

SEQ ID NO: 454713 - RNA, 24 nt, Human
ggcaccagaugaugucccaccaca

SEQ ID NO: 454714 - RNA, 22 nt, Human
ggcaccagcacaccuaaucaca

SEQ ID NO: 454715 - RNA, 24 nt, Human
ggcaccagcacuucauugacuaca

SEQ ID NO: 454716 - RNA, 21 nt, Human
ggcaccagcagggaugccaca

SEQ ID NO: 454717 - RNA, 21 nt, Human
ggcaccagccccagccuccca

SEQ ID NO: 454718 - RNA, 20 nt, Human
ggcaccagccccccaggguc

SEQ ID NO: 454719 - RNA, 32 nt, Human
ggcaccagccccugcuaaauucugagcauuga

SEQ ID NO: 454720 - RNA, 22 nt, Human
ggcaccagcccucccggccccg

SEQ ID NO: 454721 - RNA, 32 nt, Human
ggcaccagccucccacugcacagcuuccuucc

SEQ ID NO: 454722 - RNA, 25 nt, Human
ggcaccagcgaaucagacuuccaca

SEQ ID NO: 454723 - RNA, 24 nt, Human
ggcaccagcuaccucagggacaug

SEQ ID NO: 454724 - RNA, 22 nt, Human
ggcaccagcucagcuggcgcau

SEQ ID NO: 454725 - RNA, 32 nt, Human
ggcaccagcucaggacugcaucugccugccau

SEQ ID NO: 454726 - RNA, 19 nt, Human
ggcaccagcucccucagcc

SEQ ID NO: 454727 - RNA, 32 nt, Human
ggcaccagcuccuuggaccccaccucccaugc

SEQ ID NO: 454728 - RNA, 32 nt, Human
ggcaccagcuuccuccuggaaccagggucucu

SEQ ID NO: 454729 - RNA, 19 nt, Human
ggcaccaggacugcucucc

SEQ ID NO: 454730 - RNA, 24 nt, Human
ggcaccaggcaucugauggugcca

SEQ ID NO: 454731 - RNA, 19 nt, Human
ggcaccaggccugguccag

SEQ ID NO: 454732 - RNA, 25 nt, Human
ggcaccaggcugggaugagcugugu

SEQ ID NO: 454733 - RNA, 32 nt, Human
ggcaccaggcugggaugagcugugugcuugcg

SEQ ID NO: 454734 - RNA, 32 nt, Human
ggcaccagggcugcucccgagauucucagauc

SEQ ID NO: 454735 - RNA, 32 nt, Human
ggcaccaggucacuuuaugcugggugauauag

SEQ ID NO: 454736 - RNA, 32 nt, Human
ggcaccaggucaggcugggugcgccaugguug

SEQ ID NO: 454737 - RNA, 18 nt, Human
ggcaccaguccccuugcg

SEQ ID NO: 454738 - RNA, 32 nt, Human
ggcaccagugaaaucaggggaggcagaaaauc

SEQ ID NO: 454739 - RNA, 32 nt, Human
ggcaccagugacaggcacaggucccaggacca

SEQ ID NO: 454740 - RNA, 18 nt, Human
ggcaccagugcccugcca

SEQ ID NO: 454741 - RNA, 32 nt, Human
ggcaccagugggcuuggcacuccaccuugggc

SEQ ID NO: 454742 - RNA, 20 nt, Human
ggcaccaucccuucuggcca

SEQ ID NO: 454743 - RNA, 20 nt, Human
ggcaccaucugccaaugcca

SEQ ID NO: 454744 - RNA, 22 nt, Human
ggcaccaugacuccaagaugaa

SEQ ID NO: 454745 - RNA, 32 nt, Human
ggcaccaugccuggcuaauuuuuguauuuuua

SEQ ID NO: 454746 - RNA, 32 nt, Human
ggcaccauggacugagcaccucccagguucca

SEQ ID NO: 454747 - RNA, 19 nt, Human
ggcaccauggugacugcca

SEQ ID NO: 454748 - RNA, 32 nt, Human
ggcaccauuacacuccagccugggcaacagug

SEQ ID NO: 454749 - RNA, 18 nt, Human
ggcaccauuccugcagcc

SEQ ID NO: 454750 - RNA, 32 nt, Human
ggcaccauuccugcagcccuccagacuuccug

SEQ ID NO: 454751 - RNA, 19 nt, Human
ggcaccauucuagguacca

SEQ ID NO: 454752 - RNA, 22 nt, Human
ggcaccauucucaucuuucuca

SEQ ID NO: 454753 - RNA, 32 nt, Human
ggcaccauugcacccuagccugggcaacagag

SEQ ID NO: 454754 - RNA, 32 nt, Human
ggcaccauugcacuccagccugggugacaaga

SEQ ID NO: 454755 - RNA, 18 nt, Human
ggcaccauuggaacacca

SEQ ID NO: 454756 - RNA, 32 nt, Human
ggcacccaagucuuccuuccagcauuccugcu

SEQ ID NO: 454757 - RNA, 32 nt, Human
ggcacccacagcaacggagucucaacaggcag

SEQ ID NO: 454758 - RNA, 32 nt, Human
ggcacccacaggcugcugggaggagagcauaa

SEQ ID NO: 454759 - RNA, 32 nt, Human
ggcacccacaggcuggcugagaaugaggcaua

SEQ ID NO: 454760 - RNA, 32 nt, Human
ggcacccaccucuccgcuuccuaguuuccuag

SEQ ID NO: 454761 - RNA, 32 nt, Human
ggcacccacugacuccagccucauggaaccac

SEQ ID NO: 454762 - RNA, 24 nt, Human
ggcacccagagcgcugcgaccaca

SEQ ID NO: 454763 - RNA, 32 nt, Human
ggcacccagaucuuccagccauauguggaguc

SEQ ID NO: 454764 - RNA, 32 nt, Human
ggcacccaggcaggugcagggaagugcagagc

SEQ ID NO: 454765 - RNA, 32 nt, Human
ggcacccaggccugcccugccugcuggcuacu

SEQ ID NO: 454766 - RNA, 32 nt, Human
ggcacccagggcgaauggggcccagggcagac

SEQ ID NO: 454767 - RNA, 32 nt, Human
ggcacccaggugaguggcauucgggugagugg

SEQ ID NO: 454768 - RNA, 22 nt, Human
ggcacccaguguuguggccugg

SEQ ID NO: 454769 - RNA, 32 nt, Human
ggcacccauacagucaacacagugagccucag

SEQ ID NO: 454770 - RNA, 32 nt, Human
ggcacccauacccccaccuccagccuguugac

SEQ ID NO: 454771 - RNA, 32 nt, Human
ggcaccccaggccccugggaggugaguuagac

SEQ ID NO: 454772 - RNA, 32 nt, Human
ggcaccccaguagcuggccaccaccugcaguu

SEQ ID NO: 454773 - RNA, 26 nt, Human
ggcacccccagaaugaccuggccgca

SEQ ID NO: 454774 - RNA, 32 nt, Human
ggcacccccagaaugaccuggccgcagugagg

SEQ ID NO: 454775 - RNA, 21 nt, Human
ggcacccccagccuggguccc

SEQ ID NO: 454776 - RNA, 20 nt, Human
ggcaccccccugcugcugcc

SEQ ID NO: 454777 - RNA, 32 nt, Human
ggcacccccggaauugcucugccuuguguccc

SEQ ID NO: 454778 - RNA, 20 nt, Human
ggcaccccguguuccuuggc

SEQ ID NO: 454779 - RNA, 32 nt, Human
ggcaccccuccugcagcuccauggcugcccca

SEQ ID NO: 454780 - RNA, 19 nt, Human
ggcaccccuggucuugaug

SEQ ID NO: 454781 - RNA, 18 nt, Human
ggcaccccuucugccccc

SEQ ID NO: 454782 - RNA, 32 nt, Human
ggcacccgccuguaaucccagcuacucgggag

SEQ ID NO: 454783 - RNA, 32 nt, Human
ggcacccggcacacacccucccugccaccagg

SEQ ID NO: 454784 - RNA, 24 nt, Human
ggcacccggcgggcgcccgggcgc

SEQ ID NO: 454785 - RNA, 32 nt, Human
ggcacccgggagaaggaggaggcaaagaaaag

SEQ ID NO: 454786 - RNA, 32 nt, Human
ggcacccgggagaagggagaggguccuguuga

SEQ ID NO: 454787 - RNA, 32 nt, Human
ggcacccucacagacacgcggggcuggccccc

SEQ ID NO: 454788 - RNA, 32 nt, Human
ggcacccucagaccacacaguagccaaguucu

SEQ ID NO: 454789 - RNA, 32 nt, Human
ggcacccucagccgggcucuuugcagaagcag

SEQ ID NO: 454790 - RNA, 22 nt, Human
ggcacccucccacccggcugca

SEQ ID NO: 454791 - RNA, 32 nt, Human
ggcacccucgcaggguuugaauagcugcccuu

SEQ ID NO: 454792 - RNA, 32 nt, Human
ggcacccugaagccuccaugcccaggccaaaa

SEQ ID NO: 454793 - RNA, 32 nt, Human
ggcacccugagcuccaguaccaccacucacaa

SEQ ID NO: 454794 - RNA, 19 nt, Human
ggcacccugccgcccgacc

SEQ ID NO: 454795 - RNA, 32 nt, Human
ggcacccuggaucccccagagagcagauuggu

SEQ ID NO: 454796 - RNA, 20 nt, Human
ggcacccuggccgccuggac

SEQ ID NO: 454797 - RNA, 32 nt, Human
ggcacccuggguggcaggcaagccuugaaauc

SEQ ID NO: 454798 - RNA, 32 nt, Human
ggcacccugguuggaaagaggggugaggauuc

SEQ ID NO: 454799 - RNA, 32 nt, Human
ggcacccugucuucacacauaucucaucgugg

SEQ ID NO: 454800 - RNA, 32 nt, Human
ggcacccuuccucugugccccagugggcauca

SEQ ID NO: 454801 - RNA, 32 nt, Human
ggcaccgaagucagaugaguaucccuguaggu

SEQ ID NO: 454802 - RNA, 20 nt, Human
ggcaccgcaggaccggccac

SEQ ID NO: 454803 - RNA, 19 nt, Human
ggcaccgccgcuccgagua

SEQ ID NO: 454804 - RNA, 32 nt, Human
ggcaccgccugauccuuuugugcuucauaaau

SEQ ID NO: 454805 - RNA, 32 nt, Human
ggcaccgcgagcugggagacggcggcagccca

SEQ ID NO: 454806 - RNA, 32 nt, Human
ggcaccgcgccuggccaggccggcugcaguuu

SEQ ID NO: 454807 - RNA, 21 nt, Human
ggcaccgcgcugccggccgca

SEQ ID NO: 454808 - RNA, 32 nt, Human
ggcaccgcugcacuccaaccugggcaacagag

SEQ ID NO: 454809 - RNA, 23 nt, Human
ggcaccgcuggugccugcucuuu

SEQ ID NO: 454810 - RNA, 32 nt, Human
ggcaccggcggccccucugccucgcggaaaag

SEQ ID NO: 454811 - RNA, 32 nt, Human
ggcaccgggacccccucaccauccagugggcc

SEQ ID NO: 454812 - RNA, 32 nt, Human
ggcaccgggaggcgguggcggcggcggcggcg

SEQ ID NO: 454813 - RNA, 32 nt, Human
ggcaccgggccgcggcgccaccauggcggugc

SEQ ID NO: 454814 - RNA, 32 nt, Human
ggcaccggguuccgacagguccauaccagccc

SEQ ID NO: 454815 - RNA, 32 nt, Human
ggcaccguggugguggcucugccccuugcugc

SEQ ID NO: 454816 - RNA, 32 nt, Human
ggcaccuacucaguaucuuuuccucuuuauca

SEQ ID NO: 454817 - RNA, 32 nt, Human
ggcaccuacuccuuagagcuugcugauaccag

SEQ ID NO: 454818 - RNA, 32 nt, Human
ggcaccuaggauuggaaaacauggacagauca

SEQ ID NO: 454819 - RNA, 32 nt, Human
ggcaccuagggguguugcuaaauuauuaauag

SEQ ID NO: 454820 - RNA, 32 nt, Human
ggcaccuauaaucccagcuacaugggaggcug

SEQ ID NO: 454821 - RNA, 17 nt, Human
ggcaccuauaccuguac

SEQ ID NO: 454822 - RNA, 32 nt, Human
ggcaccucaaagcugggagccaggcccuggag

SEQ ID NO: 454823 - RNA, 31 nt, Human
ggcaccucaauaaacucuguugcaaaauugg

SEQ ID NO: 454824 - RNA, 32 nt, Human
ggcaccucaaucuacaccagagcccagggagu

SEQ ID NO: 454825 - RNA, 22 nt, Human
ggcaccucaccucacaccugcu

SEQ ID NO: 454826 - RNA, 20 nt, Human
ggcaccucacucaugcaagg

SEQ ID NO: 454827 - RNA, 32 nt, Human
ggcaccucagccgcccccaagcccagagcaca

SEQ ID NO: 454828 - RNA, 17 nt, Human
ggcaccucagucuggau

SEQ ID NO: 454829 - RNA, 19 nt, Human
ggcaccuccaaccaccaca

SEQ ID NO: 454830 - RNA, 32 nt, Human
ggcaccuccaccauugcccccggccuaagaag

SEQ ID NO: 454831 - RNA, 32 nt, Human
ggcaccuccacugacagaggcggccccuccca

SEQ ID NO: 454832 - RNA, 32 nt, Human
ggcaccuccagccaggcuccaggggauguucc

SEQ ID NO: 454833 - RNA, 32 nt, Human
ggcaccuccccggccucucucuucccagcugc

SEQ ID NO: 454834 - RNA, 32 nt, Human
ggcaccuccuacucccaucugaacaagagggg

SEQ ID NO: 454835 - RNA, 18 nt, Human
ggcaccuccuccauggcu

SEQ ID NO: 454836 - RNA, 32 nt, Human
ggcaccucuaaucccagcuacuugggaggcug

SEQ ID NO: 454837 - RNA, 19 nt, Human
ggcaccucugacccuggac

SEQ ID NO: 454838 - RNA, 32 nt, Human
ggcaccucuggggagcaaagagguggauccug

SEQ ID NO: 454839 - RNA, 32 nt, Human
ggcaccucuguaggcccugccugugccugucc

SEQ ID NO: 454840 - RNA, 32 nt, Human
ggcaccucuuccagggaugucucccucuaaga

SEQ ID NO: 454841 - RNA, 18 nt, Human
ggcaccucuuccuugaug

SEQ ID NO: 454842 - RNA, 32 nt, Human
ggcaccucuuucuccuucuccaaccacuauua

SEQ ID NO: 454843 - RNA, 32 nt, Human
ggcaccucuuucuuccucugucauauggcucc

SEQ ID NO: 454844 - RNA, 32 nt, Human
ggcaccucuuucuucugaccucagacggcucu

SEQ ID NO: 454845 - RNA, 32 nt, Human
ggcaccugaacacggggcucucagaagacauc

SEQ ID NO: 454846 - RNA, 32 nt, Human
ggcaccugaccagccacaggagagggcaguuc

SEQ ID NO: 454847 - RNA, 21 nt, Human
ggcaccugagcagccauuuca

SEQ ID NO: 454848 - RNA, 32 nt, Human
ggcaccugaggagagugagcagccuggaccac

SEQ ID NO: 454849 - RNA, 32 nt, Human
ggcaccugcaaucccagcuacaugggaggcug

SEQ ID NO: 454850 - RNA, 32 nt, Human
ggcaccugcaaucccagcuacuugggaggcug

SEQ ID NO: 454851 - RNA, 30 nt, Human
ggcaccugcaccuggccacgccgcgccgcc

SEQ ID NO: 454852 - RNA, 32 nt, Human
ggcaccugccacugugcagagccuggggcugc

SEQ ID NO: 454853 - RNA, 19 nt, Human
ggcaccugccagucuccac

SEQ ID NO: 454854 - RNA, 32 nt, Human
ggcaccugccccucagcuccgcuggucugucu

SEQ ID NO: 454855 - RNA, 32 nt, Human
ggcaccugccuauaaucccagcuauuugggag

SEQ ID NO: 454856 - RNA, 31 nt, Human
ggcaccugccucucugagucuugggucucag

SEQ ID NO: 454857 - RNA, 32 nt, Human
ggcaccugccuggcacaagugcagcaggccgg

SEQ ID NO: 454858 - RNA, 32 nt, Human
ggcaccugccuguaaucccagcuacuugggag

SEQ ID NO: 454859 - RNA, 32 nt, Human
ggcaccugccuguaaucucagcuacucaggag

SEQ ID NO: 454860 - RNA, 32 nt, Human
ggcaccugcggucccagcuacuugggaggcug

SEQ ID NO: 454861 - RNA, 32 nt, Human
ggcaccugcguccccucucccgggcuccccug

SEQ ID NO: 454862 - RNA, 32 nt, Human
ggcaccuggaacccguggcaagcgccgagccg

SEQ ID NO: 454863 - RNA, 32 nt, Human
ggcaccuggaacccuggacuucacugggaggg

SEQ ID NO: 454864 - RNA, 32 nt, Human
ggcaccuggaccccaucacaauacuccuucuu

SEQ ID NO: 454865 - RNA, 32 nt, Human
ggcaccuggagucccagcuacuccggaggcug

SEQ ID NO: 454866 - RNA, 32 nt, Human
ggcaccuggauggugacccugggccguccucu

SEQ ID NO: 454867 - RNA, 22 nt, Human
ggcaccuggcaccuggccugca

SEQ ID NO: 454868 - RNA, 32 nt, Human
ggcaccuggcaggaggcgggugugugaauagc

SEQ ID NO: 454869 - RNA, 16 nt, Human
ggcaccuggccugggc

SEQ ID NO: 454870 - RNA, 17 nt, Human
ggcaccuggcugggguc

SEQ ID NO: 454871 - RNA, 32 nt, Human
ggcaccugguugaagggacugggagcccgcac

SEQ ID NO: 454872 - RNA, 32 nt, Human
ggcaccuguaaccccagcuacucgggaggcug

SEQ ID NO: 454873 - RNA, 16 nt, Human
ggcaccuguaauccca

SEQ ID NO: 454874 - RNA, 19 nt, Human
ggcaccuguaaucccagcu

SEQ ID NO: 454875 - RNA, 32 nt, Human
ggcaccuguaaucccagcuaccugagaggcug

SEQ ID NO: 454876 - RNA, 32 nt, Human
ggcaccuguaaucccagcuacuagggagacug

SEQ ID NO: 454877 - RNA, 32 nt, Human
ggcaccuguaaucccagcuacucgagaggcug

SEQ ID NO: 454878 - RNA, 32 nt, Human
ggcaccuguaaucccagcuacucgggaggccg

SEQ ID NO: 454879 - RNA, 32 nt, Human
ggcaccuguaaucccagcuacucgggaggcug

SEQ ID NO: 454880 - RNA, 32 nt, Human
ggcaccuguaaucccagcuacucuggaggcug

SEQ ID NO: 454881 - RNA, 32 nt, Human
ggcaccuguaaucccagcuacuuggaaggcug

SEQ ID NO: 454882 - RNA, 32 nt, Human
ggcaccuguaaucccagcuacuugggagacug

SEQ ID NO: 454883 - RNA, 32 nt, Human
ggcaccuguaaucccagcuacuugggaggcua

SEQ ID NO: 454884 - RNA, 32 nt, Human
ggcaccuguaaucccagcuacuugggaggcug

SEQ ID NO: 454885 - RNA, 24 nt, Human
ggcaccuguaaucccagcugcucg

SEQ ID NO: 454886 - RNA, 16 nt, Human
ggcaccuguaguccca

SEQ ID NO: 454887 - RNA, 32 nt, Human
ggcaccuguagucccagccaccugggaggcug

SEQ ID NO: 454888 - RNA, 32 nt, Human
ggcaccuguagucccagcuacacgggaggcug

SEQ ID NO: 454889 - RNA, 32 nt, Human
ggcaccuguagucccagcuacacgggaggcuu

SEQ ID NO: 454890 - RNA, 32 nt, Human
ggcaccuguagucccagcuacccgggaggcug

SEQ ID NO: 454891 - RNA, 32 nt, Human
ggcaccuguagucccagcuacuagggaggcug

SEQ ID NO: 454892 - RNA, 32 nt, Human
ggcaccuguagucccagcuacucaggaggcug

SEQ ID NO: 454893 - RNA, 32 nt, Human
ggcaccuguagucccagcuacucgagaggcug

SEQ ID NO: 454894 - RNA, 32 nt, Human
ggcaccuguagucccagcuacucgggaggcug

SEQ ID NO: 454895 - RNA, 32 nt, Human
ggcaccuguagucccagcuacucuggaggcug

SEQ ID NO: 454896 - RNA, 32 nt, Human
ggcaccuguagucccagcuacuugggaggcug

SEQ ID NO: 454897 - RNA, 32 nt, Human
ggcaccuguagucucaacuauuugggaggcug

SEQ ID NO: 454898 - RNA, 19 nt, Human
ggcaccuguaguuccagcu

SEQ ID NO: 454899 - RNA, 32 nt, Human
ggcaccuguaguuccagcuacucggagacuga

SEQ ID NO: 454900 - RNA, 32 nt, Human
ggcaccuguauacauauguaacuaaccugcac

SEQ ID NO: 454901 - RNA, 17 nt, Human
ggcaccuguaucuggau

SEQ ID NO: 454902 - RNA, 32 nt, Human
ggcaccuguauucccagcuacuuggaaggcug

SEQ ID NO: 454903 - RNA, 32 nt, Human
ggcaccuguauucccagcuacuugggaggcug

SEQ ID NO: 454904 - RNA, 32 nt, Human
ggcaccugucaucccagcuacuugggaggcug

SEQ ID NO: 454905 - RNA, 16 nt, Human
ggcaccugugauccca

SEQ ID NO: 454906 - RNA, 32 nt, Human
ggcaccugugaucccagcuaccugggaggcug

SEQ ID NO: 454907 - RNA, 32 nt, Human
ggcaccugugaucccagcuacuuggaggcuga

SEQ ID NO: 454908 - RNA, 32 nt, Human
ggcaccugugcaccccucccaccucugccuca

SEQ ID NO: 454909 - RNA, 32 nt, Human
ggcaccugugguuuggugaguccuccagguaa

SEQ ID NO: 454910 - RNA, 23 nt, Human
ggcaccuucaaggaacccagggu

SEQ ID NO: 454911 - RNA, 17 nt, Human
ggcaccuucaccugggc

SEQ ID NO: 454912 - RNA, 32 nt, Human
ggcaccuucagccucagaguggaaucuuuuaa

SEQ ID NO: 454913 - RNA, 32 nt, Human
ggcaccuucccacuuucuagcucuggagaggu

SEQ ID NO: 454914 - RNA, 32 nt, Human
ggcaccuugcagccccuuccugcuggggcucc

SEQ ID NO: 454915 - RNA, 32 nt, Human
ggcaccuugcugggucuguggcauuuuccaag

SEQ ID NO: 454916 - RNA, 21 nt, Human
ggcaccuuucaccacuugguc

SEQ ID NO: 454917 - RNA, 32 nt, Human
ggcacgaagaaugccaagaguuuaccuggcca

SEQ ID NO: 454918 - RNA, 32 nt, Human
ggcacgaaggccaggccagggccugggccucu

SEQ ID NO: 454919 - RNA, 32 nt, Human
ggcacgaagucuccaagaagccacuuugccuc

SEQ ID NO: 454920 - RNA, 32 nt, Human
ggcacgaccagaaaggaacucccuuugcacgg

SEQ ID NO: 454921 - RNA, 32 nt, Human
ggcacgacuuuggcugggauggauaccauaua

SEQ ID NO: 454922 - RNA, 32 nt, Human
ggcacgagcgagggagccggaaagaugguggu

SEQ ID NO: 454923 - RNA, 32 nt, Human
ggcacgagcgaguuccugucucucugccaacg

SEQ ID NO: 454924 - RNA, 32 nt, Human
ggcacgagcucugugagacugagguggcgguc

SEQ ID NO: 454925 - RNA, 32 nt, Human
ggcacgaggaaagacugaccgacugacucuga

SEQ ID NO: 454926 - RNA, 32 nt, Human
ggcacgaggaagcgguugggaaagugucgguu

SEQ ID NO: 454927 - RNA, 32 nt, Human
ggcacgaggaaggagucggggucuuccccagu

SEQ ID NO: 454928 - RNA, 32 nt, Human
ggcacgaggagaauggccagcaggaaggcggg

SEQ ID NO: 454929 - RNA, 32 nt, Human
ggcacgaggaggagaagagcaaagaaaagcag

SEQ ID NO: 454930 - RNA, 32 nt, Human
ggcacgaggagugggccacagcaggaucucaa

SEQ ID NO: 454931 - RNA, 24 nt, Human
ggcacgaggcacgugguuaugcug

SEQ ID NO: 454932 - RNA, 32 nt, Human
ggcacgaggcagagguugugguaggaaccaca

SEQ ID NO: 454933 - RNA, 32 nt, Human
ggcacgaggcagaguggcgcagcaaguggccg

SEQ ID NO: 454934 - RNA, 32 nt, Human
ggcacgaggcagcaguggggcggggauggagg

SEQ ID NO: 454935 - RNA, 23 nt, Human
ggcacgaggcagcgcuggccgca

SEQ ID NO: 454936 - RNA, 32 nt, Human
ggcacgaggcaggccaggugugugcguccguc

SEQ ID NO: 454937 - RNA, 32 nt, Human
ggcacgaggcagggccggugggauccccucgg

SEQ ID NO: 454938 - RNA, 32 nt, Human
ggcacgaggcagugggcaggccaggcagggcg

SEQ ID NO: 454939 - RNA, 32 nt, Human
ggcacgaggcccgggccaggggcgggcgccgc

SEQ ID NO: 454940 - RNA, 32 nt, Human
ggcacgaggcccugccugccccgggcggccag

SEQ ID NO: 454941 - RNA, 32 nt, Human
ggcacgaggccgggaugaaaggagggaacgca

SEQ ID NO: 454942 - RNA, 32 nt, Human
ggcacgaggccgggcgcgagcccggauccagg

SEQ ID NO: 454943 - RNA, 18 nt, Human
ggcacgaggccugagcuc

SEQ ID NO: 454944 - RNA, 32 nt, Human
ggcacgaggccugcccacaacaccccagcuug

SEQ ID NO: 454945 - RNA, 20 nt, Human
ggcacgaggccugggcggcu

SEQ ID NO: 454946 - RNA, 32 nt, Human
ggcacgaggccugggcggcuccgcuagcuguu

SEQ ID NO: 454947 - RNA, 17 nt, Human
ggcacgaggccuggguc

SEQ ID NO: 454948 - RNA, 32 nt, Human
ggcacgaggcgaaacccagcgcuguugccaaa

SEQ ID NO: 454949 - RNA, 32 nt, Human
ggcacgaggcgccgagucugggcgcggggacg

SEQ ID NO: 454950 - RNA, 32 nt, Human
ggcacgaggcggaggaggcgaggagcgccggg

SEQ ID NO: 454951 - RNA, 32 nt, Human
ggcacgaggcggagugcaagugagcuucucgg

SEQ ID NO: 454952 - RNA, 32 nt, Human
ggcacgaggcggccucccugccccuucacggc

SEQ ID NO: 454953 - RNA, 21 nt, Human
ggcacgaggcggcgccggaag

SEQ ID NO: 454954 - RNA, 32 nt, Human
ggcacgaggcgggcggcugcugaggugagggc

SEQ ID NO: 454955 - RNA, 20 nt, Human
ggcacgaggcgggggcggcc

SEQ ID NO: 454956 - RNA, 32 nt, Human
ggcacgaggcucaguggugaaggcugugcgga

SEQ ID NO: 454957 - RNA, 32 nt, Human
ggcacgaggcugagggcagagcuguuugccug

SEQ ID NO: 454958 - RNA, 32 nt, Human
ggcacgaggcugcccuaguggccuaugucccu

SEQ ID NO: 454959 - RNA, 28 nt, Human
ggcacgaggcugccucagucuccugagu

SEQ ID NO: 454960 - RNA, 21 nt, Human
ggcacgaggcugcggcggccu

SEQ ID NO: 454961 - RNA, 32 nt, Human
ggcacgaggcuucccagaggcgcgagucgcuu

SEQ ID NO: 454962 - RNA, 32 nt, Human
ggcacgaggcuucuguagcucgcguugaagcc

SEQ ID NO: 454963 - RNA, 32 nt, Human
ggcacgagggaaagggagaaaaagauucuaca

SEQ ID NO: 454964 - RNA, 32 nt, Human
ggcacgagggaaaugcuguuugcucgaagacg

SEQ ID NO: 454965 - RNA, 32 nt, Human
ggcacgagggacgacuccacgcucgcuugccc

SEQ ID NO: 454966 - RNA, 32 nt, Human
ggcacgagggagacacgggagcgcuuggcacg

SEQ ID NO: 454967 - RNA, 32 nt, Human
ggcacgagggagagaucguccaggaggcggug

SEQ ID NO: 454968 - RNA, 32 nt, Human
ggcacgagggagagcgcagcgcgcagcccggu

SEQ ID NO: 454969 - RNA, 32 nt, Human
ggcacgagggagagcuggaggggcgugcgcgc

SEQ ID NO: 454970 - RNA, 32 nt, Human
ggcacgagggagaggucaggggucagcaggag

SEQ ID NO: 454971 - RNA, 32 nt, Human
ggcacgagggagcaaugggaaagacuggagua

SEQ ID NO: 454972 - RNA, 32 nt, Human
ggcacgagggagcggugcggaggcucugcucg

SEQ ID NO: 454973 - RNA, 32 nt, Human
ggcacgagggagggaggaggugagagugauua

SEQ ID NO: 454974 - RNA, 32 nt, Human
ggcacgagggagugccucaaggaguaugccca

SEQ ID NO: 454975 - RNA, 32 nt, Human
ggcacgagggccaggcugaggggaggguagag

SEQ ID NO: 454976 - RNA, 32 nt, Human
ggcacgagggccccaggagaggcagagaguga

SEQ ID NO: 454977 - RNA, 32 nt, Human
ggcacgagggcgagcugagguggaggcaggcu

SEQ ID NO: 454978 - RNA, 32 nt, Human
ggcacgagggcgcgccgagauggccgcgcucc

SEQ ID NO: 454979 - RNA, 32 nt, Human
ggcacgagggcggggaagauggcggaugacaa

SEQ ID NO: 454980 - RNA, 32 nt, Human
ggcacgagggcugagagggcccgcggguaggc

SEQ ID NO: 454981 - RNA, 32 nt, Human
ggcacgagggcugagcgccggaggagcguagg

SEQ ID NO: 454982 - RNA, 32 nt, Human
ggcacgagggcuggaguccacaggcuuuuacc

SEQ ID NO: 454983 - RNA, 32 nt, Human
ggcacgagggcuguggggaggauggaggcagg

SEQ ID NO: 454984 - RNA, 32 nt, Human
ggcacgaggggaggaggaggaggaggagagga

SEQ ID NO: 454985 - RNA, 32 nt, Human
ggcacgaggggaggccggggcggggcgggcgc

SEQ ID NO: 454986 - RNA, 32 nt, Human
ggcacgaggggagggggcaguugggcggggau

SEQ ID NO: 454987 - RNA, 32 nt, Human
ggcacgaggggauggcagaggaggugaggagg

SEQ ID NO: 454988 - RNA, 32 nt, Human
ggcacgaggggcugcuauagagccgggugaga

SEQ ID NO: 454989 - RNA, 32 nt, Human
ggcacgagggggaaauggcggccgcgggcuug

SEQ ID NO: 454990 - RNA, 32 nt, Human
ggcacgagggggaagaaaagggaauuccaacc

SEQ ID NO: 454991 - RNA, 21 nt, Human
ggcacgaggggucggcggccu

SEQ ID NO: 454992 - RNA, 32 nt, Human
ggcacgagggguucuggaagacggcagagcug

SEQ ID NO: 454993 - RNA, 21 nt, Human
ggcacgagggucaagcagccu

SEQ ID NO: 454994 - RNA, 32 nt, Human
ggcacgaggguggacgcgaggagccgggcgcu

SEQ ID NO: 454995 - RNA, 32 nt, Human
ggcacgaggguggucagcacaggggccggcac

SEQ ID NO: 454996 - RNA, 32 nt, Human
ggcacgagguaguggcgggaggcugugagcug

SEQ ID NO: 454997 - RNA, 32 nt, Human
ggcacgagguggagcaccgugaggaagaagcg

SEQ ID NO: 454998 - RNA, 32 nt, Human
ggcacgagguggagcugcgcguggaggagucc

SEQ ID NO: 454999 - RNA, 32 nt, Human
ggcacgagguggagggucucgcucugucacac

SEQ ID NO: 455000 - RNA, 32 nt, Human
ggcacgagguggggaagcugcuaacccgaccc

SEQ ID NO: 455001 - RNA, 32 nt, Human
ggcacgaguauggugagacaccagccccugca

SEQ ID NO: 455002 - RNA, 32 nt, Human
ggcacgaucauagcucacugcugcugcuccac

SEQ ID NO: 455003 - RNA, 22 nt, Human
ggcacgaucucagcucacugca

SEQ ID NO: 455004 - RNA, 22 nt, Human
ggcacgaucucggcucaccgca

SEQ ID NO: 455005 - RNA, 20 nt, Human
ggcacgcacacaugcucugc

SEQ ID NO: 455006 - RNA, 32 nt, Human
ggcacgcaccacuacugccuggcuaauuuuua

SEQ ID NO: 455007 - RNA, 32 nt, Human
ggcacgcaccacugcuucccacuggggccggc

SEQ ID NO: 455008 - RNA, 22 nt, Human
ggcacgcaccaucuguugccau

SEQ ID NO: 455009 - RNA, 32 nt, Human
ggcacgcaccuguaaucccagcuacucaggag

SEQ ID NO: 455010 - RNA, 32 nt, Human
ggcacgcaccuguaaucccagcuacucgggag

SEQ ID NO: 455011 - RNA, 24 nt, Human
ggcacgcacuggcaccuggcccca

SEQ ID NO: 455012 - RNA, 32 nt, Human
ggcacgcagagcuguguugaaggacauacuuu

SEQ ID NO: 455013 - RNA, 25 nt, Human
ggcacgcagaggagcagccgaccau

SEQ ID NO: 455014 - RNA, 18 nt, Human
ggcacgccagucugcacc

SEQ ID NO: 455015 - RNA, 32 nt, Human
ggcacgccuggcuggcugccucugccucuacu

SEQ ID NO: 455016 - RNA, 32 nt, Human
ggcacgccuguaaucccagcacuuugggaggc

SEQ ID NO: 455017 - RNA, 32 nt, Human
ggcacgcgccuguaauaccagcuacucaggag

SEQ ID NO: 455018 - RNA, 32 nt, Human
ggcacgcgccuguaaucccagccacucaggaa

SEQ ID NO: 455019 - RNA, 32 nt, Human
ggcacgcgccuguaaucccagcuacucaagag

SEQ ID NO: 455020 - RNA, 32 nt, Human
ggcacgcgccuguaaucccagcuacucaggag

SEQ ID NO: 455021 - RNA, 32 nt, Human
ggcacgcgccuguaaucccagcuacucgggag

SEQ ID NO: 455022 - RNA, 32 nt, Human
ggcacgcgccuguaaucccagcuacuugggag

SEQ ID NO: 455023 - RNA, 20 nt, Human
ggcacgcgccuguaguccca

SEQ ID NO: 455024 - RNA, 23 nt, Human
ggcacgcgccuguagucccagcu

SEQ ID NO: 455025 - RNA, 32 nt, Human
ggcacgcgcucggaagucgggggucggcgcgg

SEQ ID NO: 455026 - RNA, 17 nt, Human
ggcacgcggcccauggg

SEQ ID NO: 455027 - RNA, 22 nt, Human
ggcacgcuccacaccccuggag

SEQ ID NO: 455028 - RNA, 21 nt, Human
ggcacgcugauggagcccggg

SEQ ID NO: 455029 - RNA, 20 nt, Human
ggcacgcugguggggcagcu

SEQ ID NO: 455030 - RNA, 19 nt, Human
ggcacgcuguggcuggcua

SEQ ID NO: 455031 - RNA, 32 nt, Human
ggcacgcuucuacaacccuccugggaccccga

SEQ ID NO: 455032 - RNA, 27 nt, Human
ggcacgcuugcguaugucuguuaccau

SEQ ID NO: 455033 - RNA, 23 nt, Human
ggcacggacaagggccacugcag

SEQ ID NO: 455034 - RNA, 32 nt, Human
ggcacggacugcuccgugggccgcugcccuuc

SEQ ID NO: 455035 - RNA, 22 nt, Human
ggcacggaggcucaugccugua

SEQ ID NO: 455036 - RNA, 32 nt, Human
ggcacggagggagagacccugggugagacccc

SEQ ID NO: 455037 - RNA, 23 nt, Human
ggcacggagggucacugggcggc

SEQ ID NO: 455038 - RNA, 26 nt, Human
ggcacggauccaaguaccuggccaca

SEQ ID NO: 455039 - RNA, 32 nt, Human
ggcacggcaagaggagcaagagcaaggaccgc

SEQ ID NO: 455040 - RNA, 19 nt, Human
ggcacggcagaggaggcag

SEQ ID NO: 455041 - RNA, 32 nt, Human
ggcacggcaggcagcggcgccgucucccggug

SEQ ID NO: 455042 - RNA, 24 nt, Human
ggcacggccaaaaagaucugguua

SEQ ID NO: 455043 - RNA, 32 nt, Human
ggcacggccaaccuugucguucaucaaugccg

SEQ ID NO: 455044 - RNA, 32 nt, Human
ggcacggccccgucuucugccuccuccuccgu

SEQ ID NO: 455045 - RNA, 32 nt, Human
ggcacggcgcuguauccuaccugggcucuggc

SEQ ID NO: 455046 - RNA, 32 nt, Human
ggcacggcggcucuguucaagcacuuuaugcg

SEQ ID NO: 455047 - RNA, 32 nt, Human
ggcacgggacaggcaugugacacuaggccaca

SEQ ID NO: 455048 - RNA, 32 nt, Human
ggcacgggcagcuccuguucugccuuucccag

SEQ ID NO: 455049 - RNA, 18 nt, Human
ggcacgggcuccucagag

SEQ ID NO: 455050 - RNA, 22 nt, Human
ggcacggggacagccggccgca

SEQ ID NO: 455051 - RNA, 22 nt, Human
ggcacggggagucgggcggucu

SEQ ID NO: 455052 - RNA, 32 nt, Human
ggcacggggcugcugagggucuguggaacucc

SEQ ID NO: 455053 - RNA, 19 nt, Human
ggcacggggcuuaccaggg

SEQ ID NO: 455054 - RNA, 32 nt, Human
ggcacgggucggccgcaauccagccugggcgg

SEQ ID NO: 455055 - RNA, 32 nt, Human
ggcacgggugauccccguuccaccccaagaga

SEQ ID NO: 455056 - RNA, 32 nt, Human
ggcacggugaagcacuggccggggucuggcug

SEQ ID NO: 455057 - RNA, 22 nt, Human
ggcacgguggcccaugccugua

SEQ ID NO: 455058 - RNA, 32 nt, Human
ggcacgguggcgggcaccuguaguuccagcug

SEQ ID NO: 455059 - RNA, 22 nt, Human
ggcacgguggcucacaccugua

SEQ ID NO: 455060 - RNA, 32 nt, Human
ggcacgguggcucaccuguaaucccagcacuu

SEQ ID NO: 455061 - RNA, 22 nt, Human
ggcacgguggcucaugccugua

SEQ ID NO: 455062 - RNA, 32 nt, Human
ggcacggugguguggcuauagucugagcuacu

SEQ ID NO: 455063 - RNA, 32 nt, Human
ggcacguaccuguaaucucagcuacucaggag

SEQ ID NO: 455064 - RNA, 32 nt, Human
ggcacguccacaggcugggucgcgagguggcg

SEQ ID NO: 455065 - RNA, 32 nt, Human
ggcacgugccuauagucccagcaacuugggag

SEQ ID NO: 455066 - RNA, 32 nt, Human
ggcacgugccucucugaauccagccugccauu

SEQ ID NO: 455067 - RNA, 32 nt, Human
ggcacgugccuguaaucccagcuaccugggag

SEQ ID NO: 455068 - RNA, 32 nt, Human
ggcacgugccuguaaucccagcuacucaggag

SEQ ID NO: 455069 - RNA, 32 nt, Human
ggcacgugccuguaaucccagcuacucgggag

SEQ ID NO: 455070 - RNA, 32 nt, Human
ggcacgugccuguaaucccaguuacucaggag

SEQ ID NO: 455071 - RNA, 32 nt, Human
ggcacgugccuguaaucccaguuacuugggag

SEQ ID NO: 455072 - RNA, 32 nt, Human
ggcacgugccuguaaucucagcaacucaggag

SEQ ID NO: 455073 - RNA, 32 nt, Human
ggcacgugccuguaaucucagcuacucaggag

SEQ ID NO: 455074 - RNA, 32 nt, Human
ggcacgugccuguaauuccagcuacuugggag

SEQ ID NO: 455075 - RNA, 32 nt, Human
ggcacgugccuguagccccagcuacuugggag

SEQ ID NO: 455076 - RNA, 32 nt, Human
ggcacgugccuguagucccagcuacucaggag

SEQ ID NO: 455077 - RNA, 32 nt, Human
ggcacgugccuguagucccagcuacuccggag

SEQ ID NO: 455078 - RNA, 32 nt, Human
ggcacgugccuguagucccagcuacucgggaa

SEQ ID NO: 455079 - RNA, 32 nt, Human
ggcacgugccuguagugccggcuacucaggag

SEQ ID NO: 455080 - RNA, 32 nt, Human
ggcacgugccuguaguuccagcuacuugggag

SEQ ID NO: 455081 - RNA, 32 nt, Human
ggcacgugccuguauucccaucuacucgggag

SEQ ID NO: 455082 - RNA, 32 nt, Human
ggcacgugccugugaucccagcuacuugggag

SEQ ID NO: 455083 - RNA, 32 nt, Human
ggcacguggcugccauggagaaguaaagaagg

SEQ ID NO: 455084 - RNA, 32 nt, Human
ggcacgugggcaucacguaagcagcacacuag

SEQ ID NO: 455085 - RNA, 32 nt, Human
ggcacguguacguuucaggaagaagaagcaga

SEQ ID NO: 455086 - RNA, 22 nt, Human
ggcacgugucccaagccuguca

SEQ ID NO: 455087 - RNA, 20 nt, Human
ggcacgugucucagccuggu

SEQ ID NO: 455088 - RNA, 32 nt, Human
ggcacgugucuguaaucccagcuacucuggag

SEQ ID NO: 455089 - RNA, 17 nt, Human
ggcacgugugaccuggg

SEQ ID NO: 455090 - RNA, 23 nt, Human
ggcacgugugaccuggguaguca

SEQ ID NO: 455091 - RNA, 32 nt, Human
ggcacgugugaguacuaggcccaggggaagag

SEQ ID NO: 455092 - RNA, 32 nt, Human
ggcacuaaaccagguggucaaucagggagcac

SEQ ID NO: 455093 - RNA, 17 nt, Human
ggcacuaaccugccaua

SEQ ID NO: 455094 - RNA, 32 nt, Human
ggcacuaagggaguuuggggaaagccaaagaa

SEQ ID NO: 455095 - RNA, 32 nt, Human
ggcacuaauggaagaaagugcugcucaaagga

SEQ ID NO: 455096 - RNA, 32 nt, Human
ggcacuacacggggugcuggauucaaaucuca

SEQ ID NO: 455097 - RNA, 32 nt, Human
ggcacuaccaccccgcuccaucaucacuaugu

SEQ ID NO: 455098 - RNA, 32 nt, Human
ggcacuaccacccugcuccaucaucacuacgu

SEQ ID NO: 455099 - RNA, 32 nt, Human
ggcacuaccauauuuugcaugccaaauugcug

SEQ ID NO: 455100 - RNA, 32 nt, Human
ggcacuacccagacugccagagcccaggcugg

SEQ ID NO: 455101 - RNA, 22 nt, Human
ggcacuacugacuuuguucuua

SEQ ID NO: 455102 - RNA, 22 nt, Human
ggcacuacugccaccugccaca

SEQ ID NO: 455103 - RNA, 32 nt, Human
ggcacuagaaagggauuuggcauuuuaugucc

SEQ ID NO: 455104 - RNA, 32 nt, Human
ggcacuagagccauccagaaguggcagugccc

SEQ ID NO: 455105 - RNA, 22 nt, Human
ggcacuagaggcucccuugacg

SEQ ID NO: 455106 - RNA, 32 nt, Human
ggcacuaggcgaggaggaaaguggagaccacc

SEQ ID NO: 455107 - RNA, 32 nt, Human
ggcacuaucaccaccucucugccuucaugcca

SEQ ID NO: 455108 - RNA, 32 nt, Human
ggcacuauuugauaaugggccaggacauuccu

SEQ ID NO: 455109 - RNA, 19 nt, Human
ggcacucacagccccgcag

SEQ ID NO: 455110 - RNA, 32 nt, Human
ggcacucacauucacacacauacacacucauu

SEQ ID NO: 455111 - RNA, 19 nt, Human
ggcacucacgccucuuacg

SEQ ID NO: 455112 - RNA, 32 nt, Human
ggcacucacguagagcccaaggagcagucccc

SEQ ID NO: 455113 - RNA, 32 nt, Human
ggcacucacugcagacuuccucuuucaaggga

SEQ ID NO: 455114 - RNA, 21 nt, Human
ggcacucagaucuccauggcc

SEQ ID NO: 455115 - RNA, 32 nt, Human
ggcacucagggugggggacagcaggaucaaga

SEQ ID NO: 455116 - RNA, 20 nt, Human
ggcacucagucucccuggcg

SEQ ID NO: 455117 - RNA, 32 nt, Human
ggcacucaguggguggagaggaagcauaugug

SEQ ID NO: 455118 - RNA, 17 nt, Human
ggcacuccaaaaggggc

SEQ ID NO: 455119 - RNA, 32 nt, Human
ggcacuccaagugcauccuccacuggcaacag

SEQ ID NO: 455120 - RNA, 32 nt, Human
ggcacuccagccuggcgacaagagugagacuc

SEQ ID NO: 455121 - RNA, 32 nt, Human
ggcacuccagccugggcaacagagugagaccc

SEQ ID NO: 455122 - RNA, 32 nt, Human
ggcacuccagccugggcagcagagugagacuc

SEQ ID NO: 455123 - RNA, 32 nt, Human
ggcacuccagccugggugacagagugagacuc

SEQ ID NO: 455124 - RNA, 32 nt, Human
ggcacuccagccugggugacagagugagacug

SEQ ID NO: 455125 - RNA, 32 nt, Human
ggcacuccagccugggugacagugagacugug

SEQ ID NO: 455126 - RNA, 20 nt, Human
ggcacucccgaugccuggac

SEQ ID NO: 455127 - RNA, 32 nt, Human
ggcacucccucauccuggugggcacagagaua

SEQ ID NO: 455128 - RNA, 32 nt, Human
ggcacuccgcagccucuccaucugcuggcacu

SEQ ID NO: 455129 - RNA, 16 nt, Human
ggcacuccgccuggau

SEQ ID NO: 455130 - RNA, 32 nt, Human
ggcacuccuccccuccccucacuucucccacc

SEQ ID NO: 455131 - RNA, 32 nt, Human
ggcacuccuccuugcccugccagcugugccuu

SEQ ID NO: 455132 - RNA, 32 nt, Human
ggcacuccugcagguggcccggccugagguuc

SEQ ID NO: 455133 - RNA, 20 nt, Human
ggcacucgcaacuucucacg

SEQ ID NO: 455134 - RNA, 32 nt, Human
ggcacucgccuguccacuucugaguccaggug

SEQ ID NO: 455135 - RNA, 18 nt, Human
ggcacucgccuuaggacg

SEQ ID NO: 455136 - RNA, 20 nt, Human
ggcacucgcuacucccugcg

SEQ ID NO: 455137 - RNA, 19 nt, Human
ggcacucggaggccuuggc

SEQ ID NO: 455138 - RNA, 32 nt, Human
ggcacucucagcagcucaacugcccagcguga

SEQ ID NO: 455139 - RNA, 32 nt, Human
ggcacucucugccuucaugcaccuguccuuuc

SEQ ID NO: 455140 - RNA, 32 nt, Human
ggcacucugguuaaaugacucucuccagccuc

SEQ ID NO: 455141 - RNA, 32 nt, Human
ggcacucugucugcugguggcccucucggcuc

SEQ ID NO: 455142 - RNA, 22 nt, Human
ggcacucuugccacuccuugac

SEQ ID NO: 455143 - RNA, 21 nt, Human
ggcacugaauauccccuuggc

SEQ ID NO: 455144 - RNA, 32 nt, Human
ggcacugacaucuuugcuggacucuuuuaauc

SEQ ID NO: 455145 - RNA, 22 nt, Human
ggcacugaccggcccaccuggu

SEQ ID NO: 455146 - RNA, 18 nt, Human
ggcacugacuggggugcu

SEQ ID NO: 455147 - RNA, 23 nt, Human
ggcacugacugggucacugguga

SEQ ID NO: 455148 - RNA, 32 nt, Human
ggcacugagaccuccacccacuguggacucca

SEQ ID NO: 455149 - RNA, 32 nt, Human
ggcacugaggcagaggaggcaagggcuggucc

SEQ ID NO: 455150 - RNA, 32 nt, Human
ggcacugaggccagcauggcugugggaguuga

SEQ ID NO: 455151 - RNA, 32 nt, Human
ggcacugauugcaggcauguguuucaucauca

SEQ ID NO: 455152 - RNA, 32 nt, Human
ggcacugcaaaccugcucgcagcaccagccgg

SEQ ID NO: 455153 - RNA, 32 nt, Human
ggcacugcacuccagucugggugacagaguga

SEQ ID NO: 455154 - RNA, 17 nt, Human
ggcacugcagauccuga

SEQ ID NO: 455155 - RNA, 21 nt, Human
ggcacugcagcacacaacgca

SEQ ID NO: 455156 - RNA, 32 nt, Human
ggcacugcagcauuccaaucugggcaacauag

SEQ ID NO: 455157 - RNA, 17 nt, Human
ggcacugcagccugggc

SEQ ID NO: 455158 - RNA, 17 nt, Human
ggcacugcagcuauggg

SEQ ID NO: 455159 - RNA, 32 nt, Human
ggcacugcagcuaugggcacugccucagccua

SEQ ID NO: 455160 - RNA, 32 nt, Human
ggcacugcaggggugucacacagcaggcacac

SEQ ID NO: 455161 - RNA, 20 nt, Human
ggcacugccagugucuucca

SEQ ID NO: 455162 - RNA, 32 nt, Human
ggcacugccccagagccccgcagugagagccc

SEQ ID NO: 455163 - RNA, 21 nt, Human
ggcacugcccgccgggacaug

SEQ ID NO: 455164 - RNA, 31 nt, Human
ggcacugcccucucugugccuugguuucccc

SEQ ID NO: 455165 - RNA, 32 nt, Human
ggcacugcccuugccaacuuuuacccucccaa

SEQ ID NO: 455166 - RNA, 32 nt, Human
ggcacugcugcaacuucugcuuucaucccaug

SEQ ID NO: 455167 - RNA, 32 nt, Human
ggcacugcugcacuccagccugcgggacagag

SEQ ID NO: 455168 - RNA, 32 nt, Human
ggcacugcugccaugcugccuccccaggcugg

SEQ ID NO: 455169 - RNA, 32 nt, Human
ggcacugcugcuucccagcuguguggccucag

SEQ ID NO: 455170 - RNA, 32 nt, Human
ggcacugcuggugggaagaggcauuuuaccuu

SEQ ID NO: 455171 - RNA, 32 nt, Human
ggcacugcuuugcccagggcacauugacagaa

SEQ ID NO: 455172 - RNA, 32 nt, Human
ggcacuggacaagcuagugggcuuuucguugu

SEQ ID NO: 455173 - RNA, 32 nt, Human
ggcacuggacagaaacagccauccaaguggcu

SEQ ID NO: 455174 - RNA, 16 nt, Human
ggcacuggacuuggac

SEQ ID NO: 455175 - RNA, 32 nt, Human
ggcacuggagccccguaagugugcaggaguga

SEQ ID NO: 455176 - RNA, 32 nt, Human
ggcacuggagugagggaguagauaaaacagcu

SEQ ID NO: 455177 - RNA, 32 nt, Human
ggcacuggagugucagcggaggccccaggcag

SEQ ID NO: 455178 - RNA, 20 nt, Human
ggcacuggaucccaucaaag

SEQ ID NO: 455179 - RNA, 32 nt, Human
ggcacuggcacaagcucagcacaugcccagua

SEQ ID NO: 455180 - RNA, 32 nt, Human
ggcacuggcaggccuuaccucacauugcuaaa

SEQ ID NO: 455181 - RNA, 19 nt, Human
ggcacuggcagggggcaug

SEQ ID NO: 455182 - RNA, 32 nt, Human
ggcacuggccacucugccuggagagaggagua

SEQ ID NO: 455183 - RNA, 32 nt, Human
ggcacuggccagagggguuaggaggauuugga

SEQ ID NO: 455184 - RNA, 32 nt, Human
ggcacuggccuggacuccuccucugcccuccu

SEQ ID NO: 455185 - RNA, 32 nt, Human
ggcacuggccuggguagagccagggcgagcac

SEQ ID NO: 455186 - RNA, 32 nt, Human
ggcacugggaccccaaccucucccagaguggc

SEQ ID NO: 455187 - RNA, 17 nt, Human
ggcacugggaccuggau

SEQ ID NO: 455188 - RNA, 32 nt, Human
ggcacugggacuggucccugcccucauccuua

SEQ ID NO: 455189 - RNA, 22 nt, Human
ggcacugggaggacaguggcug

SEQ ID NO: 455190 - RNA, 32 nt, Human
ggcacugggcaaggcccccagagcagggcaag

SEQ ID NO: 455191 - RNA, 31 nt, Human
ggcacugggcacuucucacaaacuuucuagu

SEQ ID NO: 455192 - RNA, 32 nt, Human
ggcacugggccuugcugcaccuuggggcugac

SEQ ID NO: 455193 - RNA, 32 nt, Human
ggcacugggcucgccuugcacgcccaccagga

SEQ ID NO: 455194 - RNA, 17 nt, Human
ggcacugggcugggguc

SEQ ID NO: 455195 - RNA, 32 nt, Human
ggcacuggggacccugcacagucuggccaugu

SEQ ID NO: 455196 - RNA, 32 nt, Human
ggcacuggggagggggcuucaaggagggagug

SEQ ID NO: 455197 - RNA, 32 nt, Human
ggcacuggggguggagggugcacacgaauggc

SEQ ID NO: 455198 - RNA, 32 nt, Human
ggcacuggguaccucagggugagcagagggca

SEQ ID NO: 455199 - RNA, 32 nt, Human
ggcacugggugaggacagcugggcaggggcug

SEQ ID NO: 455200 - RNA, 32 nt, Human
ggcacuggucacuccuaugugcuaagacaagg

SEQ ID NO: 455201 - RNA, 31 nt, Human
ggcacuggugagagacaugaacacugacugg

SEQ ID NO: 455202 - RNA, 32 nt, Human
ggcacuggugaugucccaggagguagaccucc

SEQ ID NO: 455203 - RNA, 23 nt, Human
ggcacugguggggaauuugguca

SEQ ID NO: 455204 - RNA, 32 nt, Human
ggcacuguaggugagcgcgagaggacggagga

SEQ ID NO: 455205 - RNA, 32 nt, Human
ggcacugucacugcccaccuccuugggccucc

SEQ ID NO: 455206 - RNA, 32 nt, Human
ggcacugucaugucucuacugggaaauacaca

SEQ ID NO: 455207 - RNA, 32 nt, Human
ggcacugucuguggccccagggguugaggacc

SEQ ID NO: 455208 - RNA, 32 nt, Human
ggcacugugaugggagcugguggcgacugagu

SEQ ID NO: 455209 - RNA, 32 nt, Human
ggcacugugccacccucauuccuccagagcuu

SEQ ID NO: 455210 - RNA, 24 nt, Human
ggcacugugcgucugcagaggggc

SEQ ID NO: 455211 - RNA, 32 nt, Human
ggcacugugcugcugcuguggagcggcgccga

SEQ ID NO: 455212 - RNA, 32 nt, Human
ggcacugugggggugccugagcacacauaccg

SEQ ID NO: 455213 - RNA, 32 nt, Human
ggcacuguggugaucccauaaaaggccagucc

SEQ ID NO: 455214 - RNA, 32 nt, Human
ggcacuguucaauacuguaugccuucuguauu

SEQ ID NO: 455215 - RNA, 32 nt, Human
ggcacuuaacauccuuccacccacaugcccga

SEQ ID NO: 455216 - RNA, 32 nt, Human
ggcacuuacaauuuuuaaaauaguuuauguca

SEQ ID NO: 455217 - RNA, 32 nt, Human
ggcacuuaggugccuggcuggcccagggcuug

SEQ ID NO: 455218 - RNA, 24 nt, Human
ggcacuucauugagaguuuuguca

SEQ ID NO: 455219 - RNA, 21 nt, Human
ggcacuuccaaaaaauuggca

SEQ ID NO: 455220 - RNA, 32 nt, Human
ggcacuucccccuuggcuccugaggccagaac

SEQ ID NO: 455221 - RNA, 32 nt, Human
ggcacuucccuuuccuccuccuugggccaugc

SEQ ID NO: 455222 - RNA, 32 nt, Human
ggcacuuccucuucucuuuucuagucagggua

SEQ ID NO: 455223 - RNA, 32 nt, Human
ggcacuuccuuccuguuaaaccccuguuaacu

SEQ ID NO: 455224 - RNA, 32 nt, Human
ggcacuucggcugcuccacagggaaggcgaca

SEQ ID NO: 455225 - RNA, 32 nt, Human
ggcacuucuagguauuggacaagugacagaaa

SEQ ID NO: 455226 - RNA, 32 nt, Human
ggcacuucuaguuucacguaaauauucauauu

SEQ ID NO: 455227 - RNA, 32 nt, Human
ggcacuucuccccucccuggcccuucucaguu

SEQ ID NO: 455228 - RNA, 20 nt, Human
ggcacuucugccaagaaaug

SEQ ID NO: 455229 - RNA, 23 nt, Human
ggcacuucugggugugucaguca

SEQ ID NO: 455230 - RNA, 19 nt, Human
ggcacuucuuccugcugcc

SEQ ID NO: 455231 - RNA, 32 nt, Human
ggcacuugaauucucucauccugggccagaga

SEQ ID NO: 455232 - RNA, 32 nt, Human
ggcacuugauggggguuaguugcuuggcagcc

SEQ ID NO: 455233 - RNA, 32 nt, Human
ggcacuugcauccugagucggggaagaauccu

SEQ ID NO: 455234 - RNA, 32 nt, Human
ggcacuugccuguagucucagcuacuuaggag

SEQ ID NO: 455235 - RNA, 32 nt, Human
ggcacuugcucccugggcaacuccuuucccag

SEQ ID NO: 455236 - RNA, 22 nt, Human
ggcacuuggaacccugaucaca

SEQ ID NO: 455237 - RNA, 32 nt, Human
ggcacuuggcccaugggaaagaggguguggug

SEQ ID NO: 455238 - RNA, 19 nt, Human
ggcacuugggaguggggug

SEQ ID NO: 455239 - RNA, 32 nt, Human
ggcacuuguauuccagccucgcugcauuugcu

SEQ ID NO: 455240 - RNA, 19 nt, Human
ggcacuuguuccugagguc

SEQ ID NO: 455241 - RNA, 32 nt, Human
ggcacuuucauccucaagcucagggcccaucc

SEQ ID NO: 455242 - RNA, 32 nt, Human
ggcacuuucccuaccugcugugguauuucaua

SEQ ID NO: 455243 - RNA, 19 nt, Human
ggcacuuucucccuugagg

SEQ ID NO: 455244 - RNA, 32 nt, Human
ggcacuuucucuaguuuaaccucuugcuauuu

SEQ ID NO: 455245 - RNA, 22 nt, Human
ggcacuuugaaccuugaccaca

SEQ ID NO: 455246 - RNA, 32 nt, Human
ggcacuuuuccuuaagaaauagaacuugauuu

SEQ ID NO: 455247 - RNA, 21 nt, Human
ggcacuuuugcuuuuguguua

SEQ ID NO: 455248 - RNA, 32 nt, Human
ggcacuuuuuccaauuugacugaucucuaaac

SEQ ID NO: 455249 - RNA, 32 nt, Human
ggcagaaaaaugguggucauuggccgacauca

SEQ ID NO: 455250 - RNA, 32 nt, Human
ggcagaaaacagcucuggcaggaagggacugc

SEQ ID NO: 455251 - RNA, 32 nt, Human
ggcagaaaagaagggagagaaccucaugggca

SEQ ID NO: 455252 - RNA, 32 nt, Human
ggcagaaaaggauccuaggaaauaagucucuu

SEQ ID NO: 455253 - RNA, 18 nt, Human
ggcagaaacaccucaaag

SEQ ID NO: 455254 - RNA, 18 nt, Human
ggcagaaacuggggcagc

SEQ ID NO: 455255 - RNA, 32 nt, Human
ggcagaaagacauuuuucuccucaguagcaua

SEQ ID NO: 455256 - RNA, 19 nt, Human
ggcagaaagaccugaguuc

SEQ ID NO: 455257 - RNA, 32 nt, Human
ggcagaaagaggaggacaaagaggaggaaagc

SEQ ID NO: 455258 - RNA, 32 nt, Human
ggcagaaagauaaaaauuucagugaagaagaa

SEQ ID NO: 455259 - RNA, 32 nt, Human
ggcagaaagcaggguugcccccagaugucucu

SEQ ID NO: 455260 - RNA, 32 nt, Human
ggcagaaagcuggagccccuggaguuggcugu

SEQ ID NO: 455261 - RNA, 32 nt, Human
ggcagaaaucaaaagaaauccuugagggcugg

SEQ ID NO: 455262 - RNA, 19 nt, Human
ggcagaaauccccuugaug

SEQ ID NO: 455263 - RNA, 32 nt, Human
ggcagaacaggcagaagggauggaauuuggcu

SEQ ID NO: 455264 - RNA, 32 nt, Human
ggcagaaccaaucaccaccacagccugcaagu

SEQ ID NO: 455265 - RNA, 21 nt, Human
ggcagaaccugcgggggcagg

SEQ ID NO: 455266 - RNA, 32 nt, Human
ggcagaacuauccgcugaggaaccuggcagaa

SEQ ID NO: 455267 - RNA, 23 nt, Human
ggcagaacucaaauggaaggagg

SEQ ID NO: 455268 - RNA, 23 nt, Human
ggcagaacuggcuggagcugcuu

SEQ ID NO: 455269 - RNA, 32 nt, Human
ggcagaacugucucccccuugucaccuaccuc

SEQ ID NO: 455270 - RNA, 19 nt, Human
ggcagaagaagcugggagg

SEQ ID NO: 455271 - RNA, 32 nt, Human
ggcagaagaaugggagaggaaaaagaaagaaa

SEQ ID NO: 455272 - RNA, 19 nt, Human
ggcagaagacucugggcca

SEQ ID NO: 455273 - RNA, 16 nt, Human
ggcagaagagaaagga

SEQ ID NO: 455274 - RNA, 32 nt, Human
ggcagaagaugccccacuccagccugcaucca

SEQ ID NO: 455275 - RNA, 32 nt, Human
ggcagaagcaagaagagauuguuuugaagcca

SEQ ID NO: 455276 - RNA, 32 nt, Human
ggcagaagccccgugaaccgugaaagagaaaa

SEQ ID NO: 455277 - RNA, 32 nt, Human
ggcagaagccugggucacagcacccagaacug

SEQ ID NO: 455278 - RNA, 16 nt, Human
ggcagaagcugagguc

SEQ ID NO: 455279 - RNA, 32 nt, Human
ggcagaagcugggagccucccuucccuuugaa

SEQ ID NO: 455280 - RNA, 20 nt, Human
ggcagaaggacgcugagguc

SEQ ID NO: 455281 - RNA, 32 nt, Human
ggcagaaggauggggacaacuuggaagccaga

SEQ ID NO: 455282 - RNA, 32 nt, Human
ggcagaagggagagagggaggggcagcuaugc

SEQ ID NO: 455283 - RNA, 32 nt, Human
ggcagaagggccauaguucauccagcuccucc

SEQ ID NO: 455284 - RNA, 32 nt, Human
ggcagaaggggcucuccagaccccuuuuccau

SEQ ID NO: 455285 - RNA, 32 nt, Human
ggcagaaggucuaugggggcagcugggacucc

SEQ ID NO: 455286 - RNA, 32 nt, Human
ggcagaaggugaaagagguuguguugacugug

SEQ ID NO: 455287 - RNA, 32 nt, Human
ggcagaaguacaaaccagauuuagagaauuga

SEQ ID NO: 455288 - RNA, 22 nt, Human
ggcagaauacuggcaagaaaug

SEQ ID NO: 455289 - RNA, 32 nt, Human
ggcagaaucaccaggauggaacacaggucuug

SEQ ID NO: 455290 - RNA, 32 nt, Human
ggcagaaugagaaaggcccaggggcccccauu

SEQ ID NO: 455291 - RNA, 32 nt, Human
ggcagacaacucagggagaaacucaggagugc

SEQ ID NO: 455292 - RNA, 32 nt, Human
ggcagacaagcagacagauguccuuauguggu

SEQ ID NO: 455293 - RNA, 32 nt, Human
ggcagacaagggcuaagauuuccuuagcagua

SEQ ID NO: 455294 - RNA, 32 nt, Human
ggcagacacagcccuaugggucaugguuugac

SEQ ID NO: 455295 - RNA, 31 nt, Human
ggcagacaccgagcuagcuguaggaguuuuu

SEQ ID NO: 455296 - RNA, 32 nt, Human
ggcagacagaaccucugggacacacaccaagg

SEQ ID NO: 455297 - RNA, 32 nt, Human
ggcagacagacccugauaaugagccuggcagg

SEQ ID NO: 455298 - RNA, 32 nt, Human
ggcagacagagagcuguuauccuaacugauuu

SEQ ID NO: 455299 - RNA, 32 nt, Human
ggcagacagcaggggauuaaguaacucauaac

SEQ ID NO: 455300 - RNA, 19 nt, Human
ggcagacagcauugggguc

SEQ ID NO: 455301 - RNA, 32 nt, Human
ggcagacagcgggcuggugaacaggaagagca

SEQ ID NO: 455302 - RNA, 32 nt, Human
ggcagacaggcagagggccagagcagaggaca

SEQ ID NO: 455303 - RNA, 32 nt, Human
ggcagacaggcagggaggguguggcugggcug

SEQ ID NO: 455304 - RNA, 32 nt, Human
ggcagacaucuaacccugaaaaccacucgcuu

SEQ ID NO: 455305 - RNA, 32 nt, Human
ggcagacauuugguuuaucugugucauugguc

SEQ ID NO: 455306 - RNA, 32 nt, Human
ggcagacccacccuuaaucuggguaggaacca

SEQ ID NO: 455307 - RNA, 32 nt, Human
ggcagacccacccuuaaucuggguaggcacca

SEQ ID NO: 455308 - RNA, 32 nt, Human
ggcagaccccucuaccuccuccaggcugggag

SEQ ID NO: 455309 - RNA, 32 nt, Human
ggcagacccgggagcugagaauagaggaauac

SEQ ID NO: 455310 - RNA, 20 nt, Human
ggcagacccgugucuuucca

SEQ ID NO: 455311 - RNA, 32 nt, Human
ggcagaccuggacucacagccuggcugugaug

SEQ ID NO: 455312 - RNA, 22 nt, Human
ggcagacggaucacuugagguc

SEQ ID NO: 455313 - RNA, 32 nt, Human
ggcagacggcucucccccuuaaagcuguuccc

SEQ ID NO: 455314 - RNA, 32 nt, Human
ggcagacggcucuugggcucuuuuccccaccu

SEQ ID NO: 455315 - RNA, 32 nt, Human
ggcagacggugacuucugaagcugggacacaa

SEQ ID NO: 455316 - RNA, 32 nt, Human
ggcagacguuuacccucuaucacagaccuuuc

SEQ ID NO: 455317 - RNA, 32 nt, Human
ggcagacucugaauuaugcacagggaaugcca

SEQ ID NO: 455318 - RNA, 18 nt, Human
ggcagacugcccguggcc

SEQ ID NO: 455319 - RNA, 32 nt, Human
ggcagacuugcagagcaaauaagggaccuggc

SEQ ID NO: 455320 - RNA, 32 nt, Human
ggcagagaaaacagcaauagugaaugaaugca

SEQ ID NO: 455321 - RNA, 32 nt, Human
ggcagagaaaaccugcauccucugggcuuguu

SEQ ID NO: 455322 - RNA, 32 nt, Human
ggcagagaaagccgagcagagcuggguggcgu

SEQ ID NO: 455323 - RNA, 32 nt, Human
ggcagagaaagcuccuguuaauaaaagaggag

SEQ ID NO: 455324 - RNA, 32 nt, Human
ggcagagaaagcuucaggaguaccuugcagcc

SEQ ID NO: 455325 - RNA, 32 nt, Human
ggcagagaaaugccagcugcaccagggcucag

SEQ ID NO: 455326 - RNA, 32 nt, Human
ggcagagaaggcuuccuccagcggcugggugg

SEQ ID NO: 455327 - RNA, 20 nt, Human
ggcagagaagggccucaaga

SEQ ID NO: 455328 - RNA, 32 nt, Human
ggcagagaauggauuuauucucugcuagguuu

SEQ ID NO: 455329 - RNA, 23 nt, Human
ggcagagacaagagaagaggaga

SEQ ID NO: 455330 - RNA, 19 nt, Human
ggcagagacacagcuguca

SEQ ID NO: 455331 - RNA, 32 nt, Human
ggcagagaccauaagagaaaccugccaaggag

SEQ ID NO: 455332 - RNA, 32 nt, Human
ggcagagaccuguggaccuggccuccccacuc

SEQ ID NO: 455333 - RNA, 21 nt, Human
ggcagagacggagaagaugaa

SEQ ID NO: 455334 - RNA, 20 nt, Human
ggcagagacggaggggcagc

SEQ ID NO: 455335 - RNA, 32 nt, Human
ggcagagacucgggggugcucagcagcagccc

SEQ ID NO: 455336 - RNA, 32 nt, Human
ggcagagagaaagagagagaaagaguaugugg

SEQ ID NO: 455337 - RNA, 32 nt, Human
ggcagagagaaagggaaaccagaucuuacucc

SEQ ID NO: 455338 - RNA, 20 nt, Human
ggcagagagcaaaaagggga

SEQ ID NO: 455339 - RNA, 32 nt, Human
ggcagagagcaagggggacgaggcagaugacg

SEQ ID NO: 455340 - RNA, 32 nt, Human
ggcagagagcuagcuccucccuuucuuucuuu

SEQ ID NO: 455341 - RNA, 20 nt, Human
ggcagagaggcuccauggcc

SEQ ID NO: 455342 - RNA, 32 nt, Human
ggcagagagguuuccaggcagugagagguggc

SEQ ID NO: 455343 - RNA, 32 nt, Human
ggcagagaucacaaaacuaacagcucuuucug

SEQ ID NO: 455344 - RNA, 32 nt, Human
ggcagagauggaccaggcgguggacagauggg

SEQ ID NO: 455345 - RNA, 32 nt, Human
ggcagagaugggugugugaggggugaggaggc

SEQ ID NO: 455346 - RNA, 32 nt, Human
ggcagagauuaguauccuggcacuccagugac

SEQ ID NO: 455347 - RNA, 18 nt, Human
ggcagagauugcuugcga

SEQ ID NO: 455348 - RNA, 23 nt, Human
ggcagagauuggaaugggcagcu

SEQ ID NO: 455349 - RNA, 32 nt, Human
ggcagagcaacuugcacaacagccuggaccug

SEQ ID NO: 455350 - RNA, 17 nt, Human
ggcagagcaaggggagc

SEQ ID NO: 455351 - RNA, 32 nt, Human
ggcagagcaccacugugauuuguucuccuggu

SEQ ID NO: 455352 - RNA, 20 nt, Human
ggcagagcagaaagcggcuu

SEQ ID NO: 455353 - RNA, 32 nt, Human
ggcagagcagcccaggcucagcauggagccca

SEQ ID NO: 455354 - RNA, 32 nt, Human
ggcagagcagcgucugccugacggggagggcg

SEQ ID NO: 455355 - RNA, 18 nt, Human
ggcagagcagguaggcgc

SEQ ID NO: 455356 - RNA, 32 nt, Human
ggcagagcauguggucugagggcccacaguga

SEQ ID NO: 455357 - RNA, 21 nt, Human
ggcagagcauuuaagagugaa

SEQ ID NO: 455358 - RNA, 19 nt, Human
ggcagagccacggggagcu

SEQ ID NO: 455359 - RNA, 20 nt, Human
ggcagagccacugggcacuu

SEQ ID NO: 455360 - RNA, 32 nt, Human
ggcagagccaggaagaucccccagaaaagaaa

SEQ ID NO: 455361 - RNA, 32 nt, Human
ggcagagccaggacccaggaggugugauuccu

SEQ ID NO: 455362 - RNA, 22 nt, Human
ggcagagccaggacuggagcuu

SEQ ID NO: 455363 - RNA, 22 nt, Human
ggcagagccaguggaggugagu

SEQ ID NO: 455364 - RNA, 21 nt, Human
ggcagagcccagaugcuuuug

SEQ ID NO: 455365 - RNA, 32 nt, Human
ggcagagccccaugcuguccucugccuuugag

SEQ ID NO: 455366 - RNA, 22 nt, Human
ggcagagcccuggcagggcgcu

SEQ ID NO: 455367 - RNA, 21 nt, Human
ggcagagccggcuguacagcu

SEQ ID NO: 455368 - RNA, 21 nt, Human
ggcagagccggugcgacguuu

SEQ ID NO: 455369 - RNA, 21 nt, Human
ggcagagccgugccucacuga

SEQ ID NO: 455370 - RNA, 19 nt, Human
ggcagagccgugcgggcgc

SEQ ID NO: 455371 - RNA, 19 nt, Human
ggcagagccucugagauga

SEQ ID NO: 455372 - RNA, 22 nt, Human
ggcagagccugaggaagcugaa

SEQ ID NO: 455373 - RNA, 19 nt, Human
ggcagagccugcagcagcu

SEQ ID NO: 455374 - RNA, 18 nt, Human
ggcagagccugggugguc

SEQ ID NO: 455375 - RNA, 21 nt, Human
ggcagagcgcgcggccagcuu

SEQ ID NO: 455376 - RNA, 18 nt, Human
ggcagagcggcgcaggca

SEQ ID NO: 455377 - RNA, 21 nt, Human
ggcagagcggcgcaggcagcu

SEQ ID NO: 455378 - RNA, 19 nt, Human
ggcagagcguguggcaucu

SEQ ID NO: 455379 - RNA, 20 nt, Human
ggcagagcuauaaagacgag

SEQ ID NO: 455380 - RNA, 32 nt, Human
ggcagagcuaucucucucauagcuuuuaugcc

SEQ ID NO: 455381 - RNA, 32 nt, Human
ggcagagcucaggugggaaugcuugcucccca

SEQ ID NO: 455382 - RNA, 23 nt, Human
ggcagagcuccacaacccaagga

SEQ ID NO: 455383 - RNA, 23 nt, Human
ggcagagcucggagccucauuga

SEQ ID NO: 455384 - RNA, 18 nt, Human
ggcagagcucgugcaugc

SEQ ID NO: 455385 - RNA, 19 nt, Human
ggcagagcucuggccacuu

SEQ ID NO: 455386 - RNA, 21 nt, Human
ggcagagcucugggaagugaa

SEQ ID NO: 455387 - RNA, 20 nt, Human
ggcagagcugacuccaggcc

SEQ ID NO: 455388 - RNA, 21 nt, Human
ggcagagcugagagagaagaa

SEQ ID NO: 455389 - RNA, 22 nt, Human
ggcagagcugagagccgcaguu

SEQ ID NO: 455390 - RNA, 32 nt, Human
ggcagagcugcagggccugggcuaagagguag

SEQ ID NO: 455391 - RNA, 21 nt, Human
ggcagagcugccgcccaaaga

SEQ ID NO: 455392 - RNA, 22 nt, Human
ggcagagcugcuguuuucugaa

SEQ ID NO: 455393 - RNA, 19 nt, Human
ggcagagcuggaagaggaa

SEQ ID NO: 455394 - RNA, 23 nt, Human
ggcagagcuggacucugaucaca

SEQ ID NO: 455395 - RNA, 19 nt, Human
ggcagagcuggagccaguu

SEQ ID NO: 455396 - RNA, 32 nt, Human
ggcagagcuggcaccggaugggaacgauggag

SEQ ID NO: 455397 - RNA, 22 nt, Human
ggcagagcuggcuggcucagcu

SEQ ID NO: 455398 - RNA, 21 nt, Human
ggcagagcugggacuccagcu

SEQ ID NO: 455399 - RNA, 23 nt, Human
ggcagagcugggagcaagaugga

SEQ ID NO: 455400 - RNA, 32 nt, Human
ggcagagcugggguaucccaugaugucaccac

SEQ ID NO: 455401 - RNA, 20 nt, Human
ggcagagcuggguggcagcu

SEQ ID NO: 455402 - RNA, 32 nt, Human
ggcagagcuggguucuccuccugggggcccag

SEQ ID NO: 455403 - RNA, 19 nt, Human
ggcagagcuggucaugagc

SEQ ID NO: 455404 - RNA, 20 nt, Human
ggcagagcuggugggggcag

SEQ ID NO: 455405 - RNA, 22 nt, Human
ggcagagcuggugugagacgag

SEQ ID NO: 455406 - RNA, 32 nt, Human
ggcagagcuggugugagacgagacaauccugc

SEQ ID NO: 455407 - RNA, 19 nt, Human
ggcagagcuguccucagcu

SEQ ID NO: 455408 - RNA, 21 nt, Human
ggcagagcuguggcggaagaa

SEQ ID NO: 455409 - RNA, 32 nt, Human
ggcagagcuguugcccacaagcgccuuuuauu

SEQ ID NO: 455410 - RNA, 20 nt, Human
ggcagagcuugagggcaguu

SEQ ID NO: 455411 - RNA, 32 nt, Human
ggcagagcuuguaaggcuagagcccaggucug

SEQ ID NO: 455412 - RNA, 18 nt, Human
ggcagagcuuucagauga

SEQ ID NO: 455413 - RNA, 20 nt, Human
ggcagagcuuugugagagaa

SEQ ID NO: 455414 - RNA, 32 nt, Human
ggcagaggaagggagagaggcggcggcgacac

SEQ ID NO: 455415 - RNA, 32 nt, Human
ggcagaggaagguggggagagcccagaaggac

SEQ ID NO: 455416 - RNA, 32 nt, Human
ggcagaggacggugcagccaagccacacagag

SEQ ID NO: 455417 - RNA, 32 nt, Human
ggcagaggagcagagaugcaucagcucgccug

SEQ ID NO: 455418 - RNA, 32 nt, Human
ggcagaggagcccaagggacugaagauggcca

SEQ ID NO: 455419 - RNA, 32 nt, Human
ggcagaggagcugaccagggagggagguaccc

SEQ ID NO: 455420 - RNA, 18 nt, Human
ggcagaggagcugggguc

SEQ ID NO: 455421 - RNA, 32 nt, Human
ggcagaggaggcaagggcugguccagagagcc

SEQ ID NO: 455422 - RNA, 32 nt, Human
ggcagaggaggcaccuguaggggguggugggc

SEQ ID NO: 455423 - RNA, 32 nt, Human
ggcagaggaggcagaggcagaggcagaggcag

SEQ ID NO: 455424 - RNA, 32 nt, Human
ggcagaggagguggaguucuuccaugcaggag

SEQ ID NO: 455425 - RNA, 32 nt, Human
ggcagaggagugagaggacugugccagaggag

SEQ ID NO: 455426 - RNA, 32 nt, Human
ggcagaggaguuucuucaggaagaaccagggc

SEQ ID NO: 455427 - RNA, 32 nt, Human
ggcagaggcaagagaagaggaaagcgggcggc

SEQ ID NO: 455428 - RNA, 19 nt, Human
ggcagaggcagccucccca

SEQ ID NO: 455429 - RNA, 19 nt, Human
ggcagaggcauccauggcu

SEQ ID NO: 455430 - RNA, 15 nt, Human
ggcagaggccugggc

SEQ ID NO: 455431 - RNA, 32 nt, Human
ggcagaggccuguaaucccagcuacuugggag

SEQ ID NO: 455432 - RNA, 32 nt, Human
ggcagaggcgagggagguugcggguaggaagg

SEQ ID NO: 455433 - RNA, 32 nt, Human
ggcagaggcuagugcugaccuacgggcugaug

SEQ ID NO: 455434 - RNA, 32 nt, Human
ggcagaggcugcaagggguggaggcugagcug

SEQ ID NO: 455435 - RNA, 32 nt, Human
ggcagaggcugcacucuagccugggcaacaga

SEQ ID NO: 455436 - RNA, 32 nt, Human
ggcagaggcugcagagagccaaggagugcacc

SEQ ID NO: 455437 - RNA, 32 nt, Human
ggcagaggcugcggagccccagaagggucuac

SEQ ID NO: 455438 - RNA, 32 nt, Human
ggcagaggcugugcucccuccucagguggccu

SEQ ID NO: 455439 - RNA, 32 nt, Human
ggcagagggaaagggguacacugagggagaaa

SEQ ID NO: 455440 - RNA, 32 nt, Human
ggcagagggaaaggguggucagggugaggaug

SEQ ID NO: 455441 - RNA, 32 nt, Human
ggcagagggaaugacguggcaauucugagccc

SEQ ID NO: 455442 - RNA, 32 nt, Human
ggcagagggcagcaguagcagugggaugcuuu

SEQ ID NO: 455443 - RNA, 21 nt, Human
ggcagagggcagcgggcagcu

SEQ ID NO: 455444 - RNA, 20 nt, Human
ggcagaggggcuuccaggcc

SEQ ID NO: 455445 - RNA, 32 nt, Human
ggcagagggggagggggacgaagcugguggcg

SEQ ID NO: 455446 - RNA, 19 nt, Human
ggcagagggguccauggcu

SEQ ID NO: 455447 - RNA, 32 nt, Human
ggcagagggguguggagcagccuggaguacag

SEQ ID NO: 455448 - RNA, 32 nt, Human
ggcagagggugguggagaggagagggagaaag

SEQ ID NO: 455449 - RNA, 32 nt, Human
ggcagagguagcugaggguagcauggcagagg

SEQ ID NO: 455450 - RNA, 32 nt, Human
ggcagaggucaccaggcuggucuaccagguag

SEQ ID NO: 455451 - RNA, 20 nt, Human
ggcagagguccccugagguc

SEQ ID NO: 455452 - RNA, 32 nt, Human
ggcagaggucucucacuguguugcccagacaa

SEQ ID NO: 455453 - RNA, 32 nt, Human
ggcagaggucucucauuguguugcccagacaa

SEQ ID NO: 455454 - RNA, 32 nt, Human
ggcagagguggugagaagaagaggaggagauu

SEQ ID NO: 455455 - RNA, 32 nt, Human
ggcagagguuacagguuacagugagcaaagau

SEQ ID NO: 455456 - RNA, 18 nt, Human
ggcagagguugcagugag

SEQ ID NO: 455457 - RNA, 32 nt, Human
ggcagagguugcagugagcugagguugcggug

SEQ ID NO: 455458 - RNA, 32 nt, Human
ggcagaguagggggugguuggagagcaguuag

SEQ ID NO: 455459 - RNA, 32 nt, Human
ggcagaguauugaacccugccucccaguuaaa

SEQ ID NO: 455460 - RNA, 23 nt, Human
ggcagagucacacuggggcagcu

SEQ ID NO: 455461 - RNA, 19 nt, Human
ggcagaguccagggcagcu

SEQ ID NO: 455462 - RNA, 32 nt, Human
ggcagaguccccaucacguggcaagccaggcg

SEQ ID NO: 455463 - RNA, 32 nt, Human
ggcagaguccuggagcuggcucuauaaggcag

SEQ ID NO: 455464 - RNA, 16 nt, Human
ggcagagucugggguc

SEQ ID NO: 455465 - RNA, 20 nt, Human
ggcagagucugugggugcag

SEQ ID NO: 455466 - RNA, 32 nt, Human
ggcagagucuucauauggaaacaguuuuuauu

SEQ ID NO: 455467 - RNA, 19 nt, Human
ggcagagugaauugggguc

SEQ ID NO: 455468 - RNA, 22 nt, Human
ggcagaguggaacccugccucc

SEQ ID NO: 455469 - RNA, 18 nt, Human
ggcagaguggagcagcuu

SEQ ID NO: 455470 - RNA, 21 nt, Human
ggcagaguggagcccagggug

SEQ ID NO: 455471 - RNA, 32 nt, Human
ggcagaguggucacugcacgcaccuggccucc

SEQ ID NO: 455472 - RNA, 32 nt, Human
ggcagaguguugaacccugccucccaguuaaa

SEQ ID NO: 455473 - RNA, 32 nt, Human
ggcagaguucacuauucuaucugccauuagac

SEQ ID NO: 455474 - RNA, 32 nt, Human
ggcagaguucagcccacaucuccgucucgagc

SEQ ID NO: 455475 - RNA, 32 nt, Human
ggcagaguuccccagccuggaggcucuggugg

SEQ ID NO: 455476 - RNA, 32 nt, Human
ggcagaguugacacggaaccccaaagcaagga

SEQ ID NO: 455477 - RNA, 18 nt, Human
ggcagaguuggaagcagc

SEQ ID NO: 455478 - RNA, 20 nt, Human
ggcagaguuuaucccaauga

SEQ ID NO: 455479 - RNA, 22 nt, Human
ggcagaguuugggggcaagcuu

SEQ ID NO: 455480 - RNA, 32 nt, Human
ggcagauaaacccaaaguaaguguuggcuaaa

SEQ ID NO: 455481 - RNA, 18 nt, Human
ggcagauaaccugagguc

SEQ ID NO: 455482 - RNA, 18 nt, Human
ggcagauaaccugcgguc

SEQ ID NO: 455483 - RNA, 15 nt, Human
ggcagauaacggggc

SEQ ID NO: 455484 - RNA, 32 nt, Human
ggcagauaauauaugaauaaaguucagccaaa

SEQ ID NO: 455485 - RNA, 25 nt, Human
ggcagauacagcacacuugaccgca

SEQ ID NO: 455486 - RNA, 18 nt, Human
ggcagauacuuucagguu

SEQ ID NO: 455487 - RNA, 32 nt, Human
ggcagauagaggaaaagaaauuaauaugaaag

SEQ ID NO: 455488 - RNA, 16 nt, Human
ggcagauagcagaggc

SEQ ID NO: 455489 - RNA, 20 nt, Human
ggcagauagguggcuggguc

SEQ ID NO: 455490 - RNA, 32 nt, Human
ggcagauaucugagaaaugguuuaauucaugc

SEQ ID NO: 455491 - RNA, 16 nt, Human
ggcagauauugaaguu

SEQ ID NO: 455492 - RNA, 32 nt, Human
ggcagauauuuugccccauggcuauuuacggu

SEQ ID NO: 455493 - RNA, 32 nt, Human
ggcagauauuuugccccauggcuauuuacugu

SEQ ID NO: 455494 - RNA, 32 nt, Human
ggcagaucaagcaauucucuugccucagccuc

SEQ ID NO: 455495 - RNA, 32 nt, Human
ggcagaucaauaaagaaaggcuucuucaggac

SEQ ID NO: 455496 - RNA, 32 nt, Human
ggcagaucacaaggucaggagaucgagaccau

SEQ ID NO: 455497 - RNA, 32 nt, Human
ggcagaucacaugaggccaggaguucaagacc

SEQ ID NO: 455498 - RNA, 19 nt, Human
ggcagaucaccaagaaaug

SEQ ID NO: 455499 - RNA, 32 nt, Human
ggcagaucaccugaggccagaaguucgagacc

SEQ ID NO: 455500 - RNA, 32 nt, Human
ggcagaucaccugaggccaggaguucacaacc

SEQ ID NO: 455501 - RNA, 32 nt, Human
ggcagaucaccugaggccaggaguucgagacc

SEQ ID NO: 455502 - RNA, 32 nt, Human
ggcagaucaccugaggccaggcuggucucgaa

SEQ ID NO: 455503 - RNA, 18 nt, Human
ggcagaucaccugagguc

SEQ ID NO: 455504 - RNA, 32 nt, Human
ggcagaucaccugaggucagagcucgagacca

SEQ ID NO: 455505 - RNA, 18 nt, Human
ggcagaucaccugagguu

SEQ ID NO: 455506 - RNA, 18 nt, Human
ggcagaucaccugggguc

SEQ ID NO: 455507 - RNA, 18 nt, Human
ggcagaucaccuuagguc

SEQ ID NO: 455508 - RNA, 18 nt, Human
ggcagaucacgugagguc

SEQ ID NO: 455509 - RNA, 18 nt, Human
ggcagaucacuagagguc

SEQ ID NO: 455510 - RNA, 18 nt, Human
ggcagaucacuuaagguc

SEQ ID NO: 455511 - RNA, 18 nt, Human
ggcagaucacuugaaguc

SEQ ID NO: 455512 - RNA, 32 nt, Human
ggcagaucacuugaggccaauaguucgagauc

SEQ ID NO: 455513 - RNA, 32 nt, Human
ggcagaucacuugaggccaggaguucaagacc

SEQ ID NO: 455514 - RNA, 32 nt, Human
ggcagaucacuugaggccaggaguuccagacc

SEQ ID NO: 455515 - RNA, 32 nt, Human
ggcagaucacuugaggccaggaguucgagacc

SEQ ID NO: 455516 - RNA, 32 nt, Human
ggcagaucacuugaggccaggaguucugagac

SEQ ID NO: 455517 - RNA, 18 nt, Human
ggcagaucacuugagguc

SEQ ID NO: 455518 - RNA, 18 nt, Human
ggcagaucacuugagguu

SEQ ID NO: 455519 - RNA, 32 nt, Human
ggcagaucacuuggugccaggaguucuagacc

SEQ ID NO: 455520 - RNA, 32 nt, Human
ggcagaucagcuccugaacacaaugcagucac

SEQ ID NO: 455521 - RNA, 18 nt, Human
ggcagaucagcugagguc

SEQ ID NO: 455522 - RNA, 18 nt, Human
ggcagaucaguugagguc

SEQ ID NO: 455523 - RNA, 32 nt, Human
ggcagaucaucugaggccaggaguucaagacc

SEQ ID NO: 455524 - RNA, 32 nt, Human
ggcagaucaucugaggccaggaguucgagacc

SEQ ID NO: 455525 - RNA, 18 nt, Human
ggcagaucaucugagguc

SEQ ID NO: 455526 - RNA, 18 nt, Human
ggcagaucaucugggguc

SEQ ID NO: 455527 - RNA, 32 nt, Human
ggcagaucaugcaucuuugagugcaguuuggu

SEQ ID NO: 455528 - RNA, 32 nt, Human
ggcagaucauuugaggccaggaguucaagacc

SEQ ID NO: 455529 - RNA, 18 nt, Human
ggcagaucauuugagguc

SEQ ID NO: 455530 - RNA, 19 nt, Human
ggcagauccaggggcaguu

SEQ ID NO: 455531 - RNA, 32 nt, Human
ggcagauccaggguucagcuggguggccgccu

SEQ ID NO: 455532 - RNA, 32 nt, Human
ggcagaucccucugcugaauauauagcaggac

SEQ ID NO: 455533 - RNA, 32 nt, Human
ggcagauccuacagggugaccgacuccugcag

SEQ ID NO: 455534 - RNA, 18 nt, Human
ggcagaucgccugagguc

SEQ ID NO: 455535 - RNA, 21 nt, Human
ggcagaucgcuugagcccagg

SEQ ID NO: 455536 - RNA, 18 nt, Human
ggcagaucgcuugagguc

SEQ ID NO: 455537 - RNA, 32 nt, Human
ggcagaucucaaacuccaggcucagaacugug

SEQ ID NO: 455538 - RNA, 32 nt, Human
ggcagaucucaaacuccugaccucgugaugca

SEQ ID NO: 455539 - RNA, 32 nt, Human
ggcagaucucaaacuucugaccucgugaugca

SEQ ID NO: 455540 - RNA, 32 nt, Human
ggcagaucucagacuccugggcucaagcgauc

SEQ ID NO: 455541 - RNA, 19 nt, Human
ggcagaucucgcccagguc

SEQ ID NO: 455542 - RNA, 18 nt, Human
ggcagaucucuugagguc

SEQ ID NO: 455543 - RNA, 18 nt, Human
ggcagaucugcccagguc

SEQ ID NO: 455544 - RNA, 18 nt, Human
ggcagaucuucugagguc

SEQ ID NO: 455545 - RNA, 32 nt, Human
ggcagaugaacccagcaggcuuaggagguggc

SEQ ID NO: 455546 - RNA, 32 nt, Human
ggcagaugacacuuuuucccacccuuuuaaag

SEQ ID NO: 455547 - RNA, 18 nt, Human
ggcagaugacuugagguc

SEQ ID NO: 455548 - RNA, 17 nt, Human
ggcagaugaucaugguc

SEQ ID NO: 455549 - RNA, 32 nt, Human
ggcagaugauuauuacccucagaaagguugca

SEQ ID NO: 455550 - RNA, 16 nt, Human
ggcagaugcagagguc

SEQ ID NO: 455551 - RNA, 17 nt, Human
ggcagaugccugagguc

SEQ ID NO: 455552 - RNA, 17 nt, Human
ggcagaugccuguaguc

SEQ ID NO: 455553 - RNA, 32 nt, Human
ggcagaugccuguagucccagcaacucaggag

SEQ ID NO: 455554 - RNA, 19 nt, Human
ggcagaugcucuccaggcc

SEQ ID NO: 455555 - RNA, 32 nt, Human
ggcagaugcuguucugguuaaaaggcuuucca

SEQ ID NO: 455556 - RNA, 18 nt, Human
ggcagauggcaguggguc

SEQ ID NO: 455557 - RNA, 32 nt, Human
ggcagaugggagaagccaaugggaacuucuca

SEQ ID NO: 455558 - RNA, 31 nt, Human
ggcagaugggcugagauaaaagacuguuggg

SEQ ID NO: 455559 - RNA, 32 nt, Human
ggcagauggucagacccaggaggaggcauugc

SEQ ID NO: 455560 - RNA, 18 nt, Human
ggcagaugguccuagguc

SEQ ID NO: 455561 - RNA, 22 nt, Human
ggcagaugguggaaggcagcuu

SEQ ID NO: 455562 - RNA, 32 nt, Human
ggcagauguguccugaggaacaguugguaaau

SEQ ID NO: 455563 - RNA, 18 nt, Human
ggcagauuauuugagcuc

SEQ ID NO: 455564 - RNA, 32 nt, Human
ggcagauuccaaaggcuuggggcacucugggg

SEQ ID NO: 455565 - RNA, 21 nt, Human
ggcagauuccagccccaaugg

SEQ ID NO: 455566 - RNA, 32 nt, Human
ggcagauuccuuaccugucugcccucaugauu

SEQ ID NO: 455567 - RNA, 32 nt, Human
ggcagauucuggaaagccccugggcuuucuuc

SEQ ID NO: 455568 - RNA, 18 nt, Human
ggcagauugcccgagcuc

SEQ ID NO: 455569 - RNA, 18 nt, Human
ggcagauugccugagcuc

SEQ ID NO: 455570 - RNA, 21 nt, Human
ggcagauugcuugagcccagg

SEQ ID NO: 455571 - RNA, 21 nt, Human
ggcagauugcuugagcucagg

SEQ ID NO: 455572 - RNA, 21 nt, Human
ggcagauugcuugaggccagg

SEQ ID NO: 455573 - RNA, 32 nt, Human
ggcagauugcuugaggccaggaguuugagacc

SEQ ID NO: 455574 - RNA, 19 nt, Human
ggcagauugcuugauccua

SEQ ID NO: 455575 - RNA, 32 nt, Human
ggcagauuuccugucugugcuuucuuuuucca

SEQ ID NO: 455576 - RNA, 32 nt, Human
ggcagcaaaccaccauggcacauguguaccua

SEQ ID NO: 455577 - RNA, 32 nt, Human
ggcagcaacauggcaagaagguggugggccaa

SEQ ID NO: 455578 - RNA, 32 nt, Human
ggcagcaacccccaucucagccccgagccugg

SEQ ID NO: 455579 - RNA, 32 nt, Human
ggcagcaacuguccaugaagaggggaagagug

SEQ ID NO: 455580 - RNA, 32 nt, Human
ggcagcaagaaggugaggcaucagggaacggg

SEQ ID NO: 455581 - RNA, 32 nt, Human
ggcagcaagacuagagcaaaagaaaaaucugu

SEQ ID NO: 455582 - RNA, 32 nt, Human
ggcagcaagcaaucaucagagcauagagcuga

SEQ ID NO: 455583 - RNA, 32 nt, Human
ggcagcaagcggauuuucagguuguggcagcu

SEQ ID NO: 455584 - RNA, 32 nt, Human
ggcagcaagugugucauucacacacaucauuc

SEQ ID NO: 455585 - RNA, 32 nt, Human
ggcagcaaugggguuccugcagcugcuggucg

SEQ ID NO: 455586 - RNA, 32 nt, Human
ggcagcacagcccaaggaccaaaggagggggu

SEQ ID NO: 455587 - RNA, 32 nt, Human
ggcagcacagccgccugcguugagcgcccacg

SEQ ID NO: 455588 - RNA, 32 nt, Human
ggcagcacaggcaacaguucagagguaguggu

SEQ ID NO: 455589 - RNA, 32 nt, Human
ggcagcacagggccucaggccugggugccacc

SEQ ID NO: 455590 - RNA, 32 nt, Human
ggcagcaccacugccugcucccuggaagguag

SEQ ID NO: 455591 - RNA, 32 nt, Human
ggcagcaccagcagggguccaccaagagccca

SEQ ID NO: 455592 - RNA, 21 nt, Human
ggcagcaccgaggccuggcca

SEQ ID NO: 455593 - RNA, 23 nt, Human
ggcagcaccgaggccuggccaca

SEQ ID NO: 455594 - RNA, 32 nt, Human
ggcagcaccgcagccucugccccagccccggc

SEQ ID NO: 455595 - RNA, 32 nt, Human
ggcagcaccgugaacacugugcaccugucuuc

SEQ ID NO: 455596 - RNA, 32 nt, Human
ggcagcaccuccaggauacauaaauucaaugg

SEQ ID NO: 455597 - RNA, 32 nt, Human
ggcagcaccuugcccuccccaggggaucacuc

SEQ ID NO: 455598 - RNA, 32 nt, Human
ggcagcacggcacuucagccuaggugacagag

SEQ ID NO: 455599 - RNA, 23 nt, Human
ggcagcacgugggggcgugguca

SEQ ID NO: 455600 - RNA, 30 nt, Human
ggcagcacuaaaugcuuuggugguguuugc

SEQ ID NO: 455601 - RNA, 32 nt, Human
ggcagcacucgugggagccacagggcaggggc

SEQ ID NO: 455602 - RNA, 31 nt, Human
ggcagcacugccuagaauaucaugcugucuc

SEQ ID NO: 455603 - RNA, 32 nt, Human
ggcagcacuugaaaauucugcccucuacugau

SEQ ID NO: 455604 - RNA, 32 nt, Human
ggcagcagaagcuuccucugggcucagacuca

SEQ ID NO: 455605 - RNA, 32 nt, Human
ggcagcagaaguccuggagccagugccucagu

SEQ ID NO: 455606 - RNA, 21 nt, Human
ggcagcagacacacacaggga

SEQ ID NO: 455607 - RNA, 32 nt, Human
ggcagcagagauccaagugccugcugacuccc

SEQ ID NO: 455608 - RNA, 21 nt, Human
ggcagcagagcccucuccuca

SEQ ID NO: 455609 - RNA, 18 nt, Human
ggcagcagagccugggca

SEQ ID NO: 455610 - RNA, 32 nt, Human
ggcagcagagguggaguagggaggaggcaagg

SEQ ID NO: 455611 - RNA, 32 nt, Human
ggcagcagcagccuuaccaguccuccaugauc

SEQ ID NO: 455612 - RNA, 19 nt, Human
ggcagcagcccccaugguc

SEQ ID NO: 455613 - RNA, 32 nt, Human
ggcagcagccuuggaagcagggugugcuccuc

SEQ ID NO: 455614 - RNA, 32 nt, Human
ggcagcagcuagagucuguaauucucugcguc

SEQ ID NO: 455615 - RNA, 32 nt, Human
ggcagcagcucagagcgggcagcuucuuccag

SEQ ID NO: 455616 - RNA, 32 nt, Human
ggcagcagcugaggcccuguccaaagagaacu

SEQ ID NO: 455617 - RNA, 32 nt, Human
ggcagcagcugcagcuguuucacaggcugucc

SEQ ID NO: 455618 - RNA, 32 nt, Human
ggcagcagcuuagaaucaguauuugugguugg

SEQ ID NO: 455619 - RNA, 32 nt, Human
ggcagcaggaagggcacagcugucugagaccc

SEQ ID NO: 455620 - RNA, 32 nt, Human
ggcagcaggacuagcuggagagcuagaccugg

SEQ ID NO: 455621 - RNA, 32 nt, Human
ggcagcaggagcaggaggagcgugaacgagaa

SEQ ID NO: 455622 - RNA, 32 nt, Human
ggcagcaggaggcggagcucuuuugcuuggau

SEQ ID NO: 455623 - RNA, 32 nt, Human
ggcagcaggagggcagagggcagagcucuggc

SEQ ID NO: 455624 - RNA, 32 nt, Human
ggcagcaggcagcaggcgggcgcgcuguggcu

SEQ ID NO: 455625 - RNA, 32 nt, Human
ggcagcaggccucugaggguucuggaaucugu

SEQ ID NO: 455626 - RNA, 32 nt, Human
ggcagcaggccugguugcagcuggcguggggg

SEQ ID NO: 455627 - RNA, 32 nt, Human
ggcagcagggacagaaaacaacagagauacau

SEQ ID NO: 455628 - RNA, 32 nt, Human
ggcagcagggagaggaaggaggugggggagag

SEQ ID NO: 455629 - RNA, 32 nt, Human
ggcagcagggaucccuccuccuccaggggauc

SEQ ID NO: 455630 - RNA, 32 nt, Human
ggcagcagggcagaggagacuauggggagccc

SEQ ID NO: 455631 - RNA, 32 nt, Human
ggcagcagggccagugucaccugcugaccucu

SEQ ID NO: 455632 - RNA, 18 nt, Human
ggcagcagggcuauggcc

SEQ ID NO: 455633 - RNA, 32 nt, Human
ggcagcagggcucaguggaggucuggaaugac

SEQ ID NO: 455634 - RNA, 19 nt, Human
ggcagcaggggccauggcc

SEQ ID NO: 455635 - RNA, 32 nt, Human
ggcagcaggggccggcccugugcacaaggaug

SEQ ID NO: 455636 - RNA, 18 nt, Human
ggcagcagggugagggag

SEQ ID NO: 455637 - RNA, 21 nt, Human
ggcagcagguagcucuuccca

SEQ ID NO: 455638 - RNA, 32 nt, Human
ggcagcaguagacucugcaggagcuggagagg

SEQ ID NO: 455639 - RNA, 19 nt, Human
ggcagcagucagcuggggg

SEQ ID NO: 455640 - RNA, 32 nt, Human
ggcagcagugagucucggccugggcagaaaug

SEQ ID NO: 455641 - RNA, 21 nt, Human
ggcagcagugcggucgugguc

SEQ ID NO: 455642 - RNA, 32 nt, Human
ggcagcaguggccgcacaucuggauggaagcg

SEQ ID NO: 455643 - RNA, 32 nt, Human
ggcagcauccacccauucugguuaccaugcca

SEQ ID NO: 455644 - RNA, 17 nt, Human
ggcagcauuucauggcc

SEQ ID NO: 455645 - RNA, 32 nt, Human
ggcagccaaaagcagaggagcuugcaggaagg

SEQ ID NO: 455646 - RNA, 20 nt, Human
ggcagccaaacagcuggcaa

SEQ ID NO: 455647 - RNA, 22 nt, Human
ggcagccaaacugcagcuucaa

SEQ ID NO: 455648 - RNA, 32 nt, Human
ggcagccaaaugguuccagauacuucagcuuu

SEQ ID NO: 455649 - RNA, 17 nt, Human
ggcagccaacccuggcu

SEQ ID NO: 455650 - RNA, 26 nt, Human
ggcagccaacuauaaugucuuccuca

SEQ ID NO: 455651 - RNA, 18 nt, Human
ggcagccaacucccagcc

SEQ ID NO: 455652 - RNA, 20 nt, Human
ggcagccaacugcaggugcc

SEQ ID NO: 455653 - RNA, 17 nt, Human
ggcagccaacuugcgcc

SEQ ID NO: 455654 - RNA, 32 nt, Human
ggcagccaacuugcgccucuuagaaggaucag

SEQ ID NO: 455655 - RNA, 24 nt, Human
ggcagccaagaacgagcagccaag

SEQ ID NO: 455656 - RNA, 22 nt, Human
ggcagccaagggggacugcaag

SEQ ID NO: 455657 - RNA, 20 nt, Human
ggcagccaaggugaccagcc

SEQ ID NO: 455658 - RNA, 17 nt, Human
ggcagccaaguccagcc

SEQ ID NO: 455659 - RNA, 32 nt, Human
ggcagccaaguggauaaaaccuuuaggagccc

SEQ ID NO: 455660 - RNA, 17 nt, Human
ggcagccaaucuguacc

SEQ ID NO: 455661 - RNA, 17 nt, Human
ggcagccacagcagcug

SEQ ID NO: 455662 - RNA, 19 nt, Human
ggcagccaccauccuggcc

SEQ ID NO: 455663 - RNA, 32 nt, Human
ggcagccaccaugagccucagugaggagcagg

SEQ ID NO: 455664 - RNA, 32 nt, Human
ggcagccacccaagugcugaggggagcccucc

SEQ ID NO: 455665 - RNA, 32 nt, Human
ggcagccaccgccaccaccgccgccgccacca

SEQ ID NO: 455666 - RNA, 32 nt, Human
ggcagccacgggcagagcaccaugcccauccc

SEQ ID NO: 455667 - RNA, 32 nt, Human
ggcagccacucccuauugccccucucuccccu

SEQ ID NO: 455668 - RNA, 17 nt, Human
ggcagccacuccuagcc

SEQ ID NO: 455669 - RNA, 22 nt, Human
ggcagccacugagcccuuggca

SEQ ID NO: 455670 - RNA, 23 nt, Human
ggcagccacugcccuccguggcc

SEQ ID NO: 455671 - RNA, 19 nt, Human
ggcagccacuggccaggcc

SEQ ID NO: 455672 - RNA, 19 nt, Human
ggcagccagaaccauaucc

SEQ ID NO: 455673 - RNA, 32 nt, Human
ggcagccagaagccggcggcaguggcggcacc

SEQ ID NO: 455674 - RNA, 32 nt, Human
ggcagccagaagggagcucauagugucuagga

SEQ ID NO: 455675 - RNA, 16 nt, Human
ggcagccagaccagcu

SEQ ID NO: 455676 - RNA, 19 nt, Human
ggcagccagacccagagcc

SEQ ID NO: 455677 - RNA, 32 nt, Human
ggcagccagaccccugaccacccuccgaaccu

SEQ ID NO: 455678 - RNA, 32 nt, Human
ggcagccagacggacggcaggagccagccccg

SEQ ID NO: 455679 - RNA, 32 nt, Human
ggcagccagagaagccccugagagggaaugau

SEQ ID NO: 455680 - RNA, 19 nt, Human
ggcagccagagggcagcug

SEQ ID NO: 455681 - RNA, 19 nt, Human
ggcagccagauaucgggcc

SEQ ID NO: 455682 - RNA, 22 nt, Human
ggcagccagauaucgggccaua

SEQ ID NO: 455683 - RNA, 18 nt, Human
ggcagccagaugguggcu

SEQ ID NO: 455684 - RNA, 19 nt, Human
ggcagccagcaacaaagcc

SEQ ID NO: 455685 - RNA, 19 nt, Human
ggcagccagcaccaugggc

SEQ ID NO: 455686 - RNA, 17 nt, Human
ggcagccagcaccgggc

SEQ ID NO: 455687 - RNA, 18 nt, Human
ggcagccagcacugugcc

SEQ ID NO: 455688 - RNA, 18 nt, Human
ggcagccagcacuucgcc

SEQ ID NO: 455689 - RNA, 32 nt, Human
ggcagccagcacuucgccccugacuguccugc

SEQ ID NO: 455690 - RNA, 32 nt, Human
ggcagccagcagaggcagcagcacagagccac

SEQ ID NO: 455691 - RNA, 17 nt, Human
ggcagccagcagcagcu

SEQ ID NO: 455692 - RNA, 19 nt, Human
ggcagccagcaggcagguc

SEQ ID NO: 455693 - RNA, 21 nt, Human
ggcagccagcaguaccgggcc

SEQ ID NO: 455694 - RNA, 19 nt, Human
ggcagccagcaucugggcc

SEQ ID NO: 455695 - RNA, 17 nt, Human
ggcagccagccacagcc

SEQ ID NO: 455696 - RNA, 18 nt, Human
ggcagccagccacaggcu

SEQ ID NO: 455697 - RNA, 16 nt, Human
ggcagccagcccaggu

SEQ ID NO: 455698 - RNA, 17 nt, Human
ggcagccagccccuggc

SEQ ID NO: 455699 - RNA, 18 nt, Human
ggcagccagcccucaagc

SEQ ID NO: 455700 - RNA, 23 nt, Human
ggcagccagcccuggcuuccaag

SEQ ID NO: 455701 - RNA, 19 nt, Human
ggcagccagccucccacgg

SEQ ID NO: 455702 - RNA, 20 nt, Human
ggcagccagccucuguuucu

SEQ ID NO: 455703 - RNA, 18 nt, Human
ggcagccagccugccgcc

SEQ ID NO: 455704 - RNA, 18 nt, Human
ggcagccagccugccggc

SEQ ID NO: 455705 - RNA, 18 nt, Human
ggcagccagcuacaggcu

SEQ ID NO: 455706 - RNA, 19 nt, Human
ggcagccagcucugucucc

SEQ ID NO: 455707 - RNA, 32 nt, Human
ggcagccagcugagaagaguugagggaaagug

SEQ ID NO: 455708 - RNA, 19 nt, Human
ggcagccagcugcagggcc

SEQ ID NO: 455709 - RNA, 19 nt, Human
ggcagccagcuucuacgcu

SEQ ID NO: 455710 - RNA, 19 nt, Human
ggcagccagcuucuuaguu

SEQ ID NO: 455711 - RNA, 18 nt, Human
ggcagccagcuuugggcu

SEQ ID NO: 455712 - RNA, 25 nt, Human
ggcagccaggacccacccaugggga

SEQ ID NO: 455713 - RNA, 21 nt, Human
ggcagccaggacggcaccaag

SEQ ID NO: 455714 - RNA, 18 nt, Human
ggcagccaggagccagcu

SEQ ID NO: 455715 - RNA, 20 nt, Human
ggcagccaggaguccugacc

SEQ ID NO: 455716 - RNA, 20 nt, Human
ggcagccaggaucccugacc

SEQ ID NO: 455717 - RNA, 19 nt, Human
ggcagccaggauucuggcc

SEQ ID NO: 455718 - RNA, 32 nt, Human
ggcagccaggcaggcccgggugguggugccag

SEQ ID NO: 455719 - RNA, 17 nt, Human
ggcagccaggccaggcc

SEQ ID NO: 455720 - RNA, 17 nt, Human
ggcagccaggcccagcc

SEQ ID NO: 455721 - RNA, 17 nt, Human
ggcagccaggcugggcc

SEQ ID NO: 455722 - RNA, 18 nt, Human
ggcagccagggcagggcc

SEQ ID NO: 455723 - RNA, 17 nt, Human
ggcagccagguaaggcc

SEQ ID NO: 455724 - RNA, 19 nt, Human
ggcagccaggucccaggcc

SEQ ID NO: 455725 - RNA, 32 nt, Human
ggcagccagguggcucaugggcuguagugagc

SEQ ID NO: 455726 - RNA, 18 nt, Human
ggcagccaguuaccagcu

SEQ ID NO: 455727 - RNA, 21 nt, Human
ggcagccaguuggugagggcc

SEQ ID NO: 455728 - RNA, 32 nt, Human
ggcagccauaauaagagucuucagagagauga

SEQ ID NO: 455729 - RNA, 32 nt, Human
ggcagccauccugggaaugucugcaagggucu

SEQ ID NO: 455730 - RNA, 18 nt, Human
ggcagccaucuacaagcc

SEQ ID NO: 455731 - RNA, 18 nt, Human
ggcagccauggccauggc

SEQ ID NO: 455732 - RNA, 19 nt, Human
ggcagccauggccugaagu

SEQ ID NO: 455733 - RNA, 32 nt, Human
ggcagccauggugcgguucaagcacagguacc

SEQ ID NO: 455734 - RNA, 32 nt, Human
ggcagccauucaaggaaaacccagcccuggcu

SEQ ID NO: 455735 - RNA, 32 nt, Human
ggcagcccaagagcucagggagccagggaccc

SEQ ID NO: 455736 - RNA, 20 nt, Human
ggcagcccagcccuggccgc

SEQ ID NO: 455737 - RNA, 32 nt, Human
ggcagcccagccgccgccaccgcgccgcggcc

SEQ ID NO: 455738 - RNA, 32 nt, Human
ggcagcccagcuucgcgaaggcuguaggcaca

SEQ ID NO: 455739 - RNA, 17 nt, Human
ggcagcccaucguggcc

SEQ ID NO: 455740 - RNA, 32 nt, Human
ggcagccccagagggaucccgcccuccagcau

SEQ ID NO: 455741 - RNA, 32 nt, Human
ggcagccccagcaccaccaggucucccgggaa

SEQ ID NO: 455742 - RNA, 21 nt, Human
ggcagcccccacccccacccc

SEQ ID NO: 455743 - RNA, 32 nt, Human
ggcagcccccagcccccugaggcccuguccau

SEQ ID NO: 455744 - RNA, 32 nt, Human
ggcagcccccaucugcucaauaucacugcucu

SEQ ID NO: 455745 - RNA, 32 nt, Human
ggcagcccccuucauugcaccuaucuccccca

SEQ ID NO: 455746 - RNA, 21 nt, Human
ggcagccccgcgaccaccccu

SEQ ID NO: 455747 - RNA, 23 nt, Human
ggcagccccggagcccagcggcc

SEQ ID NO: 455748 - RNA, 32 nt, Human
ggcagccccggcugcacucuagccgccugggu

SEQ ID NO: 455749 - RNA, 19 nt, Human
ggcagccccggucccggcg

SEQ ID NO: 455750 - RNA, 23 nt, Human
ggcagccccgugcucccguggcc

SEQ ID NO: 455751 - RNA, 32 nt, Human
ggcagccccucaggccccacagguggguccug

SEQ ID NO: 455752 - RNA, 21 nt, Human
ggcagccccuccacacccacc

SEQ ID NO: 455753 - RNA, 21 nt, Human
ggcagccccucccacgacccc

SEQ ID NO: 455754 - RNA, 24 nt, Human
ggcagccccucccagccugccccu

SEQ ID NO: 455755 - RNA, 32 nt, Human
ggcagccccucccagccugccccuucugcgcu

SEQ ID NO: 455756 - RNA, 23 nt, Human
ggcagccccucgucaccuacucc

SEQ ID NO: 455757 - RNA, 32 nt, Human
ggcagccccucuggcccugccagcugccugcg

SEQ ID NO: 455758 - RNA, 32 nt, Human
ggcagccccugcccacucccaugcugguggcc

SEQ ID NO: 455759 - RNA, 32 nt, Human
ggcagccccugcccucggugagacgcagccca

SEQ ID NO: 455760 - RNA, 32 nt, Human
ggcagccccuggccugcacacuacucaugaca

SEQ ID NO: 455761 - RNA, 32 nt, Human
ggcagccccuggguagcuucaggauggggcug

SEQ ID NO: 455762 - RNA, 22 nt, Human
ggcagccccuucugcccacccc

SEQ ID NO: 455763 - RNA, 17 nt, Human
ggcagccccuucuggcc

SEQ ID NO: 455764 - RNA, 32 nt, Human
ggcagccccuugccagcauccccacacccacc

SEQ ID NO: 455765 - RNA, 32 nt, Human
ggcagcccgccucucccccugcugagacuuua

SEQ ID NO: 455766 - RNA, 32 nt, Human
ggcagcccuagccucugcuggcuaucgggaca

SEQ ID NO: 455767 - RNA, 23 nt, Human
ggcagcccucacuuuucauggcc

SEQ ID NO: 455768 - RNA, 17 nt, Human
ggcagcccuccaugguc

SEQ ID NO: 455769 - RNA, 32 nt, Human
ggcagcccucccccuuuccuucucucccugau

SEQ ID NO: 455770 - RNA, 32 nt, Human
ggcagcccuccccgccccucuccuucaaggag

SEQ ID NO: 455771 - RNA, 23 nt, Human
ggcagcccucucaccccagggcc

SEQ ID NO: 455772 - RNA, 21 nt, Human
ggcagcccuggagcccacccu

SEQ ID NO: 455773 - RNA, 32 nt, Human
ggcagcccugggcagucuucuggccccuugcu

SEQ ID NO: 455774 - RNA, 32 nt, Human
ggcagcccugguagcaggcggggaagaggucg

SEQ ID NO: 455775 - RNA, 32 nt, Human
ggcagcccuguaucaccccuggcagugaggug

SEQ ID NO: 455776 - RNA, 32 nt, Human
ggcagcccuucuuuguccucugggguaaauga

SEQ ID NO: 455777 - RNA, 18 nt, Human
ggcagcccuuuccaugcc

SEQ ID NO: 455778 - RNA, 18 nt, Human
ggcagccgaggccuggcc

SEQ ID NO: 455779 - RNA, 18 nt, Human
ggcagccgccaccaggcc

SEQ ID NO: 455780 - RNA, 17 nt, Human
ggcagccgcccgcagcc

SEQ ID NO: 455781 - RNA, 17 nt, Human
ggcagccgcccucggcc

SEQ ID NO: 455782 - RNA, 32 nt, Human
ggcagccgcgagguggacggggcgguggggcc

SEQ ID NO: 455783 - RNA, 32 nt, Human
ggcagccgcgcguccuggaauauggggucgcu

SEQ ID NO: 455784 - RNA, 20 nt, Human
ggcagccgcggaucccggcc

SEQ ID NO: 455785 - RNA, 18 nt, Human
ggcagccggaacagggcc

SEQ ID NO: 455786 - RNA, 32 nt, Human
ggcagccggaagcagcugggcccacacaccuc

SEQ ID NO: 455787 - RNA, 18 nt, Human
ggcagccggagcgcggcc

SEQ ID NO: 455788 - RNA, 32 nt, Human
ggcagccggagggagugagagccaccccgugc

SEQ ID NO: 455789 - RNA, 18 nt, Human
ggcagccggaucgcagcc

SEQ ID NO: 455790 - RNA, 18 nt, Human
ggcagccggcacccagcc

SEQ ID NO: 455791 - RNA, 17 nt, Human
ggcagccggcaguggcc

SEQ ID NO: 455792 - RNA, 17 nt, Human
ggcagccggccaaggcc

SEQ ID NO: 455793 - RNA, 20 nt, Human
ggcagccgggccccagggcc

SEQ ID NO: 455794 - RNA, 32 nt, Human
ggcagccggggacagaagagaccccgccguug

SEQ ID NO: 455795 - RNA, 32 nt, Human
ggcagccggggcagccauugguggugucaaga

SEQ ID NO: 455796 - RNA, 17 nt, Human
ggcagccggggcauggc

SEQ ID NO: 455797 - RNA, 19 nt, Human
ggcagccgugcaccugacc

SEQ ID NO: 455798 - RNA, 32 nt, Human
ggcagccucagcaaucaaacuauucccucacu

SEQ ID NO: 455799 - RNA, 32 nt, Human
ggcagccucagcucugugccccucacccugcu

SEQ ID NO: 455800 - RNA, 32 nt, Human
ggcagccuccacccuuucucuaugccugcaac

SEQ ID NO: 455801 - RNA, 32 nt, Human
ggcagccuccacucugggagcucccaucccuc

SEQ ID NO: 455802 - RNA, 20 nt, Human
ggcagccuccugcccaggcc

SEQ ID NO: 455803 - RNA, 32 nt, Human
ggcagccuccugccugcccuggccuugcuggg

SEQ ID NO: 455804 - RNA, 32 nt, Human
ggcagccuccuucccuguucaugagaauucuu

SEQ ID NO: 455805 - RNA, 17 nt, Human
ggcagccucuccauggc

SEQ ID NO: 455806 - RNA, 19 nt, Human
ggcagccucucccauggcc

SEQ ID NO: 455807 - RNA, 32 nt, Human
ggcagccucucuuauuugguucuugggcugcu

SEQ ID NO: 455808 - RNA, 32 nt, Human
ggcagccugagccccagcccacaugccacuca

SEQ ID NO: 455809 - RNA, 32 nt, Human
ggcagccugcagcaacuggaacaaggccccac

SEQ ID NO: 455810 - RNA, 32 nt, Human
ggcagccugcagcugcccacccaaccuggucu

SEQ ID NO: 455811 - RNA, 19 nt, Human
ggcagccugcagggcagcu

SEQ ID NO: 455812 - RNA, 32 nt, Human
ggcagccugccuggcccgcacagucugccugu

SEQ ID NO: 455813 - RNA, 32 nt, Human
ggcagccuggaaaguugugucuucugggaaag

SEQ ID NO: 455814 - RNA, 32 nt, Human
ggcagccuggacaacaugaccugcauccuggu

SEQ ID NO: 455815 - RNA, 32 nt, Human
ggcagccugggaguuggacguggcucaggcag

SEQ ID NO: 455816 - RNA, 32 nt, Human
ggcagccugguucggggcagguugugaggcca

SEQ ID NO: 455817 - RNA, 32 nt, Human
ggcagccuguugguccacaccuacuugcucag

SEQ ID NO: 455818 - RNA, 23 nt, Human
ggcagccuucgaaguccugggca

SEQ ID NO: 455819 - RNA, 32 nt, Human
ggcagccuucgaaguccugggcauugggugag

SEQ ID NO: 455820 - RNA, 18 nt, Human
ggcagccuucucucauag

SEQ ID NO: 455821 - RNA, 32 nt, Human
ggcagccuugaagacaccacaggccaaaacau

SEQ ID NO: 455822 - RNA, 18 nt, Human
ggcagccuugcccuggag

SEQ ID NO: 455823 - RNA, 20 nt, Human
ggcagccuuggccuccagca

SEQ ID NO: 455824 - RNA, 19 nt, Human
ggcagccuuuuccauggcc

SEQ ID NO: 455825 - RNA, 19 nt, Human
ggcagcgaaacuuuuccca

SEQ ID NO: 455826 - RNA, 32 nt, Human
ggcagcgaccuccagggccuccuaccugcuga

SEQ ID NO: 455827 - RNA, 32 nt, Human
ggcagcgagaggagaccaggaggcuaggaccc

SEQ ID NO: 455828 - RNA, 22 nt, Human
ggcagcgagaggagcuucccca

SEQ ID NO: 455829 - RNA, 32 nt, Human
ggcagcgagagucacagacaagacagcaagca

SEQ ID NO: 455830 - RNA, 20 nt, Human
ggcagcgaggaggagccaca

SEQ ID NO: 455831 - RNA, 32 nt, Human
ggcagcgauggaaauuucagcucuacuuuuuc

SEQ ID NO: 455832 - RNA, 17 nt, Human
ggcagcgcagccaggcc

SEQ ID NO: 455833 - RNA, 25 nt, Human
ggcagcgcaggaaacgcccggccgc

SEQ ID NO: 455834 - RNA, 19 nt, Human
ggcagcgcauggggggcug

SEQ ID NO: 455835 - RNA, 32 nt, Human
ggcagcgcccccaggauugaacguggggagcc

SEQ ID NO: 455836 - RNA, 20 nt, Human
ggcagcgcccgaaggccugg

SEQ ID NO: 455837 - RNA, 16 nt, Human
ggcagcgcccgcgccc

SEQ ID NO: 455838 - RNA, 23 nt, Human
ggcagcgcccuucguccaggcuc

SEQ ID NO: 455839 - RNA, 32 nt, Human
ggcagcgccgggugccuguccugcugccuuuc

SEQ ID NO: 455840 - RNA, 32 nt, Human
ggcagcgcggccggggcccaggaaggggaggg

SEQ ID NO: 455841 - RNA, 32 nt, Human
ggcagcgcugcacuugccaugcuggaaaccag

SEQ ID NO: 455842 - RNA, 21 nt, Human
ggcagcgcugcuccaucagcc

SEQ ID NO: 455843 - RNA, 32 nt, Human
ggcagcgcuuccucuggcagggccgaggcucg

SEQ ID NO: 455844 - RNA, 32 nt, Human
ggcagcggaagaugguguugcugagaguguua

SEQ ID NO: 455845 - RNA, 32 nt, Human
ggcagcggaggcagcggcggcagcaggagacg

SEQ ID NO: 455846 - RNA, 24 nt, Human
ggcagcggaggcugcucggccgca

SEQ ID NO: 455847 - RNA, 19 nt, Human
ggcagcggagggucucccc

SEQ ID NO: 455848 - RNA, 32 nt, Human
ggcagcggcaccauccucacaccucugcauuc

SEQ ID NO: 455849 - RNA, 19 nt, Human
ggcagcggcagccguggcc

SEQ ID NO: 455850 - RNA, 21 nt, Human
ggcagcggcagcggcagcgga

SEQ ID NO: 455851 - RNA, 19 nt, Human
ggcagcggccaccauggcc

SEQ ID NO: 455852 - RNA, 32 nt, Human
ggcagcggccccggaggaagaggaagaaggga

SEQ ID NO: 455853 - RNA, 32 nt, Human
ggcagcggcgccgcagccugggcuggcggaac

SEQ ID NO: 455854 - RNA, 32 nt, Human
ggcagcggcgcugcgccuccucaguguucugc

SEQ ID NO: 455855 - RNA, 18 nt, Human
ggcagcggcggcagcgga

SEQ ID NO: 455856 - RNA, 32 nt, Human
ggcagcggcggcggcgugccugccuggcggcc

SEQ ID NO: 455857 - RNA, 32 nt, Human
ggcagcggcggcgguugccaggagcccgcguu

SEQ ID NO: 455858 - RNA, 20 nt, Human
ggcagcggcugcagaggggc

SEQ ID NO: 455859 - RNA, 32 nt, Human
ggcagcggcugcagaggggcgagccgggcgca

SEQ ID NO: 455860 - RNA, 32 nt, Human
ggcagcggcuggaagaagaguugcugucugug

SEQ ID NO: 455861 - RNA, 32 nt, Human
ggcagcgggcccagccugagcaauggcaggau

SEQ ID NO: 455862 - RNA, 19 nt, Human
ggcagcgggccucucccca

SEQ ID NO: 455863 - RNA, 32 nt, Human
ggcagcggggauagacagggaauggggagaag

SEQ ID NO: 455864 - RNA, 17 nt, Human
ggcagcggguggggcgc

SEQ ID NO: 455865 - RNA, 21 nt, Human
ggcagcguaagcgccauggcc

SEQ ID NO: 455866 - RNA, 24 nt, Human
ggcagcguaagcgccauggccaua

SEQ ID NO: 455867 - RNA, 32 nt, Human
ggcagcgucuagggguggauguuuacagcucc

SEQ ID NO: 455868 - RNA, 32 nt, Human
ggcagcgugcacacucggauuugcuacguuuc

SEQ ID NO: 455869 - RNA, 20 nt, Human
ggcagcgugugccugugguc

SEQ ID NO: 455870 - RNA, 19 nt, Human
ggcagcguuagggcugcuu

SEQ ID NO: 455871 - RNA, 32 nt, Human
ggcagcguucagggaugcaaggggcagagcgg

SEQ ID NO: 455872 - RNA, 32 nt, Human
ggcagcguuuugcucacacagcagcuuuugca

SEQ ID NO: 455873 - RNA, 32 nt, Human
ggcagcuaaacccauagaaggaguuggaccaa

SEQ ID NO: 455874 - RNA, 32 nt, Human
ggcagcuaagaagucuuaggcagcagcccaga

SEQ ID NO: 455875 - RNA, 32 nt, Human
ggcagcuaaugcucucaccgcggcgggggaag

SEQ ID NO: 455876 - RNA, 32 nt, Human
ggcagcuaauuggccccagugccaucuugccc

SEQ ID NO: 455877 - RNA, 20 nt, Human
ggcagcuacauuccuuggcc

SEQ ID NO: 455878 - RNA, 20 nt, Human
ggcagcuacugcccagggcc

SEQ ID NO: 455879 - RNA, 32 nt, Human
ggcagcuagccuggccaguggcugucccgugg

SEQ ID NO: 455880 - RNA, 32 nt, Human
ggcagcuaggccugaauagagcugugcagccc

SEQ ID NO: 455881 - RNA, 19 nt, Human
ggcagcuauaugccaugga

SEQ ID NO: 455882 - RNA, 32 nt, Human
ggcagcucacagugaggguccuggaggcgcgg

SEQ ID NO: 455883 - RNA, 18 nt, Human
ggcagcucaccugagguc

SEQ ID NO: 455884 - RNA, 32 nt, Human
ggcagcucacuggagagccuacauuccuuaca

SEQ ID NO: 455885 - RNA, 32 nt, Human
ggcagcucagaauuauucuggaaagaaagccu

SEQ ID NO: 455886 - RNA, 32 nt, Human
ggcagcucagcuuuccugaguccugacugcug

SEQ ID NO: 455887 - RNA, 18 nt, Human
ggcagcucaggcccggca

SEQ ID NO: 455888 - RNA, 23 nt, Human
ggcagcucaugacuguaauccca

SEQ ID NO: 455889 - RNA, 32 nt, Human
ggcagcucauuuccucaaauucuguccucagu

SEQ ID NO: 455890 - RNA, 32 nt, Human
ggcagcuccaacccaacucggcuuaacuccgc

SEQ ID NO: 455891 - RNA, 32 nt, Human
ggcagcuccagccugggggacaggugacccca

SEQ ID NO: 455892 - RNA, 32 nt, Human
ggcagcucccagaccggagaggaccuuggacc

SEQ ID NO: 455893 - RNA, 19 nt, Human
ggcagcucccagccugcug

SEQ ID NO: 455894 - RNA, 32 nt, Human
ggcagcuccccuggaagaagcugauggaauuc

SEQ ID NO: 455895 - RNA, 32 nt, Human
ggcagcucccugcuuuguccugcaugaacaga

SEQ ID NO: 455896 - RNA, 21 nt, Human
ggcagcuccguccccauggcc

SEQ ID NO: 455897 - RNA, 32 nt, Human
ggcagcuccuccucauccccugccuuaagucc

SEQ ID NO: 455898 - RNA, 32 nt, Human
ggcagcuccuggaagcuccaccaggacccacg

SEQ ID NO: 455899 - RNA, 32 nt, Human
ggcagcucgaaggagauggaucuguuucucag

SEQ ID NO: 455900 - RNA, 32 nt, Human
ggcagcucgcccagacuccgggcagugagagg

SEQ ID NO: 455901 - RNA, 32 nt, Human
ggcagcucggaaggcagaugcacuucuacaga

SEQ ID NO: 455902 - RNA, 32 nt, Human
ggcagcucgguaacugacaucagcaacuuuug

SEQ ID NO: 455903 - RNA, 32 nt, Human
ggcagcucuccccucacucuccuccaccugcc

SEQ ID NO: 455904 - RNA, 32 nt, Human
ggcagcucuccucauuuuccccaaaacaggga

SEQ ID NO: 455905 - RNA, 19 nt, Human
ggcagcucugccuguggga

SEQ ID NO: 455906 - RNA, 32 nt, Human
ggcagcucugcucugugccguccugugccugu

SEQ ID NO: 455907 - RNA, 32 nt, Human
ggcagcucuggacugacugcaggugaugucca

SEQ ID NO: 455908 - RNA, 32 nt, Human
ggcagcucuggcugcaacccgcuggcucggaa

SEQ ID NO: 455909 - RNA, 32 nt, Human
ggcagcucugggagagaaaggaggccagccug

SEQ ID NO: 455910 - RNA, 24 nt, Human
ggcagcucuguccccuccugcucu

SEQ ID NO: 455911 - RNA, 21 nt, Human
ggcagcucugugcccuuggcc

SEQ ID NO: 455912 - RNA, 32 nt, Human
ggcagcucugugggggcucugcuacugcuggc

SEQ ID NO: 455913 - RNA, 32 nt, Human
ggcagcucuugaguuaugcacugugaagaaug

SEQ ID NO: 455914 - RNA, 32 nt, Human
ggcagcugaagccuugagauccugggccagcu

SEQ ID NO: 455915 - RNA, 32 nt, Human
ggcagcugacacagcagaccuugaauccugag

SEQ ID NO: 455916 - RNA, 20 nt, Human
ggcagcugacgaggcagcug

SEQ ID NO: 455917 - RNA, 18 nt, Human
ggcagcugagcccuggcc

SEQ ID NO: 455918 - RNA, 32 nt, Human
ggcagcugagucugcagguggagaggugcagg

SEQ ID NO: 455919 - RNA, 18 nt, Human
ggcagcugauuccaggcc

SEQ ID NO: 455920 - RNA, 21 nt, Human
ggcagcugcacauccacggcc

SEQ ID NO: 455921 - RNA, 18 nt, Human
ggcagcugcaccacugcc

SEQ ID NO: 455922 - RNA, 32 nt, Human
ggcagcugcacggcuccuggccccggagcaug

SEQ ID NO: 455923 - RNA, 32 nt, Human
ggcagcugcagagaggcccugccugaacccac

SEQ ID NO: 455924 - RNA, 18 nt, Human
ggcagcugcaggccacag

SEQ ID NO: 455925 - RNA, 32 nt, Human
ggcagcugcagguacccccagcacuuuagccc

SEQ ID NO: 455926 - RNA, 32 nt, Human
ggcagcugcaguggcuucuccuuucccaggcu

SEQ ID NO: 455927 - RNA, 32 nt, Human
ggcagcugcaugcucccucucuccagaccagc

SEQ ID NO: 455928 - RNA, 17 nt, Human
ggcagcugccacaggcc

SEQ ID NO: 455929 - RNA, 17 nt, Human
ggcagcugccccaggcc

SEQ ID NO: 455930 - RNA, 22 nt, Human
ggcagcugccguccucauggcc

SEQ ID NO: 455931 - RNA, 32 nt, Human
ggcagcugcggggagcccggcagccacgcucu

SEQ ID NO: 455932 - RNA, 32 nt, Human
ggcagcugcuaccucgcugggacaggcucugg

SEQ ID NO: 455933 - RNA, 32 nt, Human
ggcagcugcuaccucucccucugccccuuuau

SEQ ID NO: 455934 - RNA, 32 nt, Human
ggcagcugcuccaugcagaacugaagcugguu

SEQ ID NO: 455935 - RNA, 19 nt, Human
ggcagcugcucccuuggca

SEQ ID NO: 455936 - RNA, 19 nt, Human
ggcagcugcugccagagcc

SEQ ID NO: 455937 - RNA, 21 nt, Human
ggcagcugcugcuggggcagc

SEQ ID NO: 455938 - RNA, 19 nt, Human
ggcagcugcuggccaugga

SEQ ID NO: 455939 - RNA, 17 nt, Human
ggcagcugcuugagguc

SEQ ID NO: 455940 - RNA, 32 nt, Human
ggcagcugcuugugggagagcugaggucuaga

SEQ ID NO: 455941 - RNA, 19 nt, Human
ggcagcuggaagccucccc

SEQ ID NO: 455942 - RNA, 32 nt, Human
ggcagcuggagcagcaagaugcugucgagacc

SEQ ID NO: 455943 - RNA, 32 nt, Human
ggcagcuggaggagcugggacggcggcaugag

SEQ ID NO: 455944 - RNA, 32 nt, Human
ggcagcuggagugggagaaagguggcucggac

SEQ ID NO: 455945 - RNA, 32 nt, Human
ggcagcuggauccacguggaaaacacgccacc

SEQ ID NO: 455946 - RNA, 32 nt, Human
ggcagcuggcauggucagguaacacuaguggc

SEQ ID NO: 455947 - RNA, 32 nt, Human
ggcagcuggcucuucugcugaccucagauacc

SEQ ID NO: 455948 - RNA, 19 nt, Human
ggcagcugggaccauggcc

SEQ ID NO: 455949 - RNA, 32 nt, Human
ggcagcugggauuacaggugcacaccaccaug

SEQ ID NO: 455950 - RNA, 32 nt, Human
ggcagcugggcugaggacuggaacauucugug

SEQ ID NO: 455951 - RNA, 32 nt, Human
ggcagcuggggaggggcugcggaaggaggagg

SEQ ID NO: 455952 - RNA, 32 nt, Human
ggcagcuggggcccuggugcacagggccagau

SEQ ID NO: 455953 - RNA, 32 nt, Human
ggcagcuggguccugggcuggaggacuaaaau

SEQ ID NO: 455954 - RNA, 32 nt, Human
ggcagcugguguuucgcuccuggagugugccu

SEQ ID NO: 455955 - RNA, 18 nt, Human
ggcagcuguagccuggcc

SEQ ID NO: 455956 - RNA, 32 nt, Human
ggcagcugugaagaaaguucccaauagugagg

SEQ ID NO: 455957 - RNA, 19 nt, Human
ggcagcugugccccuggcc

SEQ ID NO: 455958 - RNA, 32 nt, Human
ggcagcugugccugcccugccucugccugagg

SEQ ID NO: 455959 - RNA, 20 nt, Human
ggcagcugugcuccucggcc

SEQ ID NO: 455960 - RNA, 17 nt, Human
ggcagcuuccacaccca

SEQ ID NO: 455961 - RNA, 32 nt, Human
ggcagcuuccagccugggggcuggugaccaca

SEQ ID NO: 455962 - RNA, 32 nt, Human
ggcagcuucccgggcagacacucucucccuca

SEQ ID NO: 455963 - RNA, 32 nt, Human
ggcagcuucccugaacacucaucccccaucag

SEQ ID NO: 455964 - RNA, 32 nt, Human
ggcagcuucucaggucagccuccuccgggccu

SEQ ID NO: 455965 - RNA, 32 nt, Human
ggcagcuucuccuccagacuccuagccccgag

SEQ ID NO: 455966 - RNA, 32 nt, Human
ggcagcuucugacacaccagccccaggaccug

SEQ ID NO: 455967 - RNA, 32 nt, Human
ggcagcuucugccucuccugucaccccugccc

SEQ ID NO: 455968 - RNA, 32 nt, Human
ggcagcuucugccugggaugggccacaaagcc

SEQ ID NO: 455969 - RNA, 32 nt, Human
ggcagcuucuguccucacccuacccugcucuc

SEQ ID NO: 455970 - RNA, 32 nt, Human
ggcagcuucuuucugcccucaggagccuuguu

SEQ ID NO: 455971 - RNA, 32 nt, Human
ggcagcuugccacccccuccucucccuucacc

SEQ ID NO: 455972 - RNA, 32 nt, Human
ggcagcuuuccacagaauuugcauuuagagga

SEQ ID NO: 455973 - RNA, 32 nt, Human
ggcagcuuucuuuggggcuucagugagaacuc

SEQ ID NO: 455974 - RNA, 30 nt, Human
ggcagcuuugaaugcaguccaacagaaauu

SEQ ID NO: 455975 - RNA, 32 nt, Human
ggcagcuuugaaugcaguccaacagaaauuaa

SEQ ID NO: 455976 - RNA, 32 nt, Human
ggcagcuuugaggacaaaaaggcaacauuaaa

SEQ ID NO: 455977 - RNA, 32 nt, Human
ggcagcuuugcagccccugccccaccagcccc

SEQ ID NO: 455978 - RNA, 32 nt, Human
ggcagcuuuucugcuuuuucccuuccucugug

SEQ ID NO: 455979 - RNA, 32 nt, Human
ggcaggaaaccagguuucgccuauuccacugu

SEQ ID NO: 455980 - RNA, 32 nt, Human
ggcaggaaagacagaggaaggaaggagggaga

SEQ ID NO: 455981 - RNA, 32 nt, Human
ggcaggaaaguuggggaccaggccuguugucu

SEQ ID NO: 455982 - RNA, 32 nt, Human
ggcaggaacagagagacagagccugaguaauu

SEQ ID NO: 455983 - RNA, 32 nt, Human
ggcaggaacaugcuccccaagucacagucugc

SEQ ID NO: 455984 - RNA, 32 nt, Human
ggcaggaacuccaagugcccaggccucuuggg

SEQ ID NO: 455985 - RNA, 32 nt, Human
ggcaggaagaaaggaaggaaggaaagaaggaa

SEQ ID NO: 455986 - RNA, 32 nt, Human
ggcaggaagaggagcagaaaagaagggcuggg

SEQ ID NO: 455987 - RNA, 18 nt, Human
ggcaggaagccuauggcc

SEQ ID NO: 455988 - RNA, 32 nt, Human
ggcaggaaggaggcagagcuguccgugggagg

SEQ ID NO: 455989 - RNA, 19 nt, Human
ggcaggaaggaggggcagc

SEQ ID NO: 455990 - RNA, 32 nt, Human
ggcaggaaggcccuguccagccacucagccug

SEQ ID NO: 455991 - RNA, 18 nt, Human
ggcaggaaggcugagagg

SEQ ID NO: 455992 - RNA, 18 nt, Human
ggcaggaagggugggguc

SEQ ID NO: 455993 - RNA, 32 nt, Human
ggcaggaaggguuccagggccacccagugugg

SEQ ID NO: 455994 - RNA, 32 nt, Human
ggcaggaauaagaagucagacagagacagcaa

SEQ ID NO: 455995 - RNA, 32 nt, Human
ggcaggaaugacaggagaugagcuugagggac

SEQ ID NO: 455996 - RNA, 32 nt, Human
ggcaggaaugugccuccuggcccucgaugcuu

SEQ ID NO: 455997 - RNA, 32 nt, Human
ggcaggacacagagcacagcugugcuggaagu

SEQ ID NO: 455998 - RNA, 32 nt, Human
ggcaggacagagggaaggcaaaaagaagaagc

SEQ ID NO: 455999 - RNA, 32 nt, Human
ggcaggacagcagaggaugugcugggauuaaa

SEQ ID NO: 456000 - RNA, 32 nt, Human
ggcaggacaggcggggguggucuggagugcgc

SEQ ID NO: 456001 - RNA, 17 nt, Human
ggcaggacaugagaguc

SEQ ID NO: 456002 - RNA, 23 nt, Human
ggcaggaccaaggagucgggagg

SEQ ID NO: 456003 - RNA, 32 nt, Human
ggcaggaccagaggcccacauggaugccacuc

SEQ ID NO: 456004 - RNA, 20 nt, Human
ggcaggaccaggucaggagg

SEQ ID NO: 456005 - RNA, 32 nt, Human
ggcaggaccauccgaacagauccucaaagcug

SEQ ID NO: 456006 - RNA, 18 nt, Human
ggcaggaccccagagagg

SEQ ID NO: 456007 - RNA, 17 nt, Human
ggcaggaccccauggcc

SEQ ID NO: 456008 - RNA, 32 nt, Human
ggcaggaccgccacccucccaugcaaaucacc

SEQ ID NO: 456009 - RNA, 32 nt, Human
ggcaggaccugggcccucccacccaucagagc

SEQ ID NO: 456010 - RNA, 17 nt, Human
ggcaggacucugagguu

SEQ ID NO: 456011 - RNA, 32 nt, Human
ggcaggacuggaagcuggcucugggugaguca

SEQ ID NO: 456012 - RNA, 21 nt, Human
ggcaggacugggagccggagg

SEQ ID NO: 456013 - RNA, 32 nt, Human
ggcaggacugggagguggcggcagcgggcgag

SEQ ID NO: 456014 - RNA, 32 nt, Human
ggcaggagaacugaagaacucuuucagugaag

SEQ ID NO: 456015 - RNA, 28 nt, Human
ggcaggagaaucacaucaaccugggagg

SEQ ID NO: 456016 - RNA, 32 nt, Human
ggcaggagaaucagagguugcagugaaccgag

SEQ ID NO: 456017 - RNA, 20 nt, Human
ggcaggagaaucgcuagaac

SEQ ID NO: 456018 - RNA, 20 nt, Human
ggcaggagaaucguuugaac

SEQ ID NO: 456019 - RNA, 32 nt, Human
ggcaggagaaucucgggaggcagagguugcag

SEQ ID NO: 456020 - RNA, 20 nt, Human
ggcaggagaauugcuugaac

SEQ ID NO: 456021 - RNA, 32 nt, Human
ggcaggagagagggaaaaagaaaagaaggaac

SEQ ID NO: 456022 - RNA, 32 nt, Human
ggcaggagaggaaggaaagcagcucucucagc

SEQ ID NO: 456023 - RNA, 32 nt, Human
ggcaggagagugagcuuugccgcggcagacgc

SEQ ID NO: 456024 - RNA, 32 nt, Human
ggcaggagagugcuugaacccaggaggcggag

SEQ ID NO: 456025 - RNA, 32 nt, Human
ggcaggagauagacucuggcccuuguuucuag

SEQ ID NO: 456026 - RNA, 32 nt, Human
ggcaggagauggcaauggaagcgacagcuccc

SEQ ID NO: 456027 - RNA, 32 nt, Human
ggcaggagcaaaccacaggaaggcuucauaau

SEQ ID NO: 456028 - RNA, 32 nt, Human
ggcaggagcaaggagagagggaagaaggaccc

SEQ ID NO: 456029 - RNA, 32 nt, Human
ggcaggagcaagggaggaagccaggggcgagg

SEQ ID NO: 456030 - RNA, 31 nt, Human
ggcaggagcagacugccucagcccaugugcc

SEQ ID NO: 456031 - RNA, 32 nt, Human
ggcaggagcagagcagacacagcagcaaugga

SEQ ID NO: 456032 - RNA, 18 nt, Human
ggcaggagccccagggcc

SEQ ID NO: 456033 - RNA, 32 nt, Human
ggcaggagcccuggcacuaaugcuguacaggu

SEQ ID NO: 456034 - RNA, 32 nt, Human
ggcaggagccgggacugucacuuuggagacaa

SEQ ID NO: 456035 - RNA, 32 nt, Human
ggcaggagccuguaauccuagcuacucaggag

SEQ ID NO: 456036 - RNA, 32 nt, Human
ggcaggagccuugccucucagguggcgggcuc

SEQ ID NO: 456037 - RNA, 19 nt, Human
ggcaggagcgcccauggcu

SEQ ID NO: 456038 - RNA, 32 nt, Human
ggcaggagcucccuggccagcucaguggaugg

SEQ ID NO: 456039 - RNA, 32 nt, Human
ggcaggagcuccugccccucugccucccaccc

SEQ ID NO: 456040 - RNA, 32 nt, Human
ggcaggagcuggccaguaauaggcugacgagg

SEQ ID NO: 456041 - RNA, 16 nt, Human
ggcaggagcugggguc

SEQ ID NO: 456042 - RNA, 32 nt, Human
ggcaggaggagaagaugcgggagcaggaagug

SEQ ID NO: 456043 - RNA, 32 nt, Human
ggcaggaggagaagaugugggagcaggaagug

SEQ ID NO: 456044 - RNA, 32 nt, Human
ggcaggaggagaagcaugaagagaaaaccugu

SEQ ID NO: 456045 - RNA, 32 nt, Human
ggcaggaggagagacugguggagggaagagcu

SEQ ID NO: 456046 - RNA, 32 nt, Human
ggcaggaggagcaggagaggcugcuggagagg

SEQ ID NO: 456047 - RNA, 32 nt, Human
ggcaggaggagccacaugagagagggagaagg

SEQ ID NO: 456048 - RNA, 32 nt, Human
ggcaggaggauggagaagugccagcagcuggg

SEQ ID NO: 456049 - RNA, 32 nt, Human
ggcaggaggccagccccaucucaggcucacgu

SEQ ID NO: 456050 - RNA, 32 nt, Human
ggcaggagggcaagacgacagcaagagaacaa

SEQ ID NO: 456051 - RNA, 21 nt, Human
ggcaggagggcacugaccaca

SEQ ID NO: 456052 - RNA, 32 nt, Human
ggcaggagggccugaggucugagguaccccug

SEQ ID NO: 456053 - RNA, 32 nt, Human
ggcaggaggggugggaccaggcugggaggaca

SEQ ID NO: 456054 - RNA, 20 nt, Human
ggcaggaggguuccaugggc

SEQ ID NO: 456055 - RNA, 32 nt, Human
ggcaggaggucauuuucaaguaagaauuuucc

SEQ ID NO: 456056 - RNA, 32 nt, Human
ggcaggaguugggggagcaggagggcaggggu

SEQ ID NO: 456057 - RNA, 32 nt, Human
ggcaggauccaagcagaucagcccagccuagc

SEQ ID NO: 456058 - RNA, 23 nt, Human
ggcaggauccucaggccccagcc

SEQ ID NO: 456059 - RNA, 32 nt, Human
ggcaggaucuggaaggagggagcugcccagac

SEQ ID NO: 456060 - RNA, 32 nt, Human
ggcaggaugcagugagccagccccagggccag

SEQ ID NO: 456061 - RNA, 32 nt, Human
ggcaggauggacaugguagaggauguggauac

SEQ ID NO: 456062 - RNA, 31 nt, Human
ggcaggauggcagagggcaaggcaggcggcg

SEQ ID NO: 456063 - RNA, 32 nt, Human
ggcaggauggccuuuccuucccucucugaugu

SEQ ID NO: 456064 - RNA, 17 nt, Human
ggcaggaugggggcagc

SEQ ID NO: 456065 - RNA, 32 nt, Human
ggcaggcaacugcagcucgccaccucccucac

SEQ ID NO: 456066 - RNA, 32 nt, Human
ggcaggcaagccuugaaaucaagugcacgagc

SEQ ID NO: 456067 - RNA, 24 nt, Human
ggcaggcaauucuaagaucuucca

SEQ ID NO: 456068 - RNA, 32 nt, Human
ggcaggcacacgagcccaugcccgacagccac

SEQ ID NO: 456069 - RNA, 32 nt, Human
ggcaggcacagaaaaucuauccaucugguagc

SEQ ID NO: 456070 - RNA, 32 nt, Human
ggcaggcacagcccgguuggcgugggccagag

SEQ ID NO: 456071 - RNA, 32 nt, Human
ggcaggcaccuggauguugagaguggagaugu

SEQ ID NO: 456072 - RNA, 32 nt, Human
ggcaggcaccuguaaucccagcuacucaggaa

SEQ ID NO: 456073 - RNA, 32 nt, Human
ggcaggcaccuguaaucccagcuacucaggag

SEQ ID NO: 456074 - RNA, 32 nt, Human
ggcaggcaccuguaaucccagcuacucgggag

SEQ ID NO: 456075 - RNA, 32 nt, Human
ggcaggcaccuguaaucccagcuacuugggag

SEQ ID NO: 456076 - RNA, 32 nt, Human
ggcaggcacucgggaagggaagauggauguaa

SEQ ID NO: 456077 - RNA, 32 nt, Human
ggcaggcagacuuuccaggaagaggcuccaug

SEQ ID NO: 456078 - RNA, 32 nt, Human
ggcaggcagaggagagcaagcuacuucuggga

SEQ ID NO: 456079 - RNA, 24 nt, Human
ggcaggcagaguggaacccugccu

SEQ ID NO: 456080 - RNA, 32 nt, Human
ggcaggcagcaaagacugggaaagacacacca

SEQ ID NO: 456081 - RNA, 32 nt, Human
ggcaggcagcucagcccagccugggcacagcc

SEQ ID NO: 456082 - RNA, 32 nt, Human
ggcaggcaggaaagaguggggauccuaagguu

SEQ ID NO: 456083 - RNA, 32 nt, Human
ggcaggcaggagccccgcccucccaggcacag

SEQ ID NO: 456084 - RNA, 32 nt, Human
ggcaggcaggagguggaguugcagcuguuggc

SEQ ID NO: 456085 - RNA, 32 nt, Human
ggcaggcaggauugggcuuuucuggcuucuac

SEQ ID NO: 456086 - RNA, 32 nt, Human
ggcaggcaggcagggcauagcgacaguguggg

SEQ ID NO: 456087 - RNA, 32 nt, Human
ggcaggcaggcaggugguuggauggggaggca

SEQ ID NO: 456088 - RNA, 32 nt, Human
ggcaggcagggugggccacggaacuggguccc

SEQ ID NO: 456089 - RNA, 32 nt, Human
ggcaggcaggguggggcacugugagcugucgg

SEQ ID NO: 456090 - RNA, 32 nt, Human
ggcaggcagguggaucaccugaggucaggagu

SEQ ID NO: 456091 - RNA, 32 nt, Human
ggcaggcaucggagcuuccagccuggggagac

SEQ ID NO: 456092 - RNA, 24 nt, Human
ggcaggccaagggccucgaccaca

SEQ ID NO: 456093 - RNA, 32 nt, Human
ggcaggccaguucuaauuuccaauagauaagu

SEQ ID NO: 456094 - RNA, 32 nt, Human
ggcaggccaucaggcugggggcugugcuaugu

SEQ ID NO: 456095 - RNA, 32 nt, Human
ggcaggccauguuggggagacuccagcaccgu

SEQ ID NO: 456096 - RNA, 21 nt, Human
ggcaggcccagcccauccccu

SEQ ID NO: 456097 - RNA, 18 nt, Human
ggcaggcccagggcagcu

SEQ ID NO: 456098 - RNA, 32 nt, Human
ggcaggcccaggggaggguggggccuuggugc

SEQ ID NO: 456099 - RNA, 32 nt, Human
ggcaggcccauggagggccuucaacucauugg

SEQ ID NO: 456100 - RNA, 22 nt, Human
ggcaggcccucagccagcuucc

SEQ ID NO: 456101 - RNA, 32 nt, Human
ggcaggcccugcucccccuaccuccuugccag

SEQ ID NO: 456102 - RNA, 32 nt, Human
ggcaggcccuggaggaugagaagguggcagga

SEQ ID NO: 456103 - RNA, 23 nt, Human
ggcaggccgaggcagguggauca

SEQ ID NO: 456104 - RNA, 23 nt, Human
ggcaggccgaggcgggcagauca

SEQ ID NO: 456105 - RNA, 20 nt, Human
ggcaggccggaguggggcgc

SEQ ID NO: 456106 - RNA, 32 nt, Human
ggcaggccucgccccucccuugcucacccagu

SEQ ID NO: 456107 - RNA, 25 nt, Human
ggcaggccuggcucagacuggaagg

SEQ ID NO: 456108 - RNA, 32 nt, Human
ggcaggccugggauggagcccaucucuccagu

SEQ ID NO: 456109 - RNA, 23 nt, Human
ggcaggccugggcccagcuccgg

SEQ ID NO: 456110 - RNA, 24 nt, Human
ggcaggccuggguaggggcagcuu

SEQ ID NO: 456111 - RNA, 32 nt, Human
ggcaggccuuccggaagaaaaagagccauugg

SEQ ID NO: 456112 - RNA, 32 nt, Human
ggcaggccuugaauugggagcagcagccaccu

SEQ ID NO: 456113 - RNA, 18 nt, Human
ggcaggcgagcugggguc

SEQ ID NO: 456114 - RNA, 32 nt, Human
ggcaggcgcagaggucccagccccaggccugg

SEQ ID NO: 456115 - RNA, 32 nt, Human
ggcaggcgccuauaaucccagcuacucaggag

SEQ ID NO: 456116 - RNA, 32 nt, Human
ggcaggcgccugaaaucccagcuacucaagag

SEQ ID NO: 456117 - RNA, 32 nt, Human
ggcaggcgccuguaauccagcuacucgggagg

SEQ ID NO: 456118 - RNA, 32 nt, Human
ggcaggcgccuguaaucccagcuacucaggag

SEQ ID NO: 456119 - RNA, 32 nt, Human
ggcaggcgccuguaaucccagcuacucgggag

SEQ ID NO: 456120 - RNA, 32 nt, Human
ggcaggcgccuguaaucccagcuacuggggag

SEQ ID NO: 456121 - RNA, 32 nt, Human
ggcaggcgccuguaaucccagcuacuuggaag

SEQ ID NO: 456122 - RNA, 32 nt, Human
ggcaggcgccuguaaucccagcuacuugggag

SEQ ID NO: 456123 - RNA, 32 nt, Human
ggcaggcgccuguaaucccagcuauuugggag

SEQ ID NO: 456124 - RNA, 32 nt, Human
ggcaggcgccuguaaucccaguuacucaguag

SEQ ID NO: 456125 - RNA, 32 nt, Human
ggcaggcgccuguagucccagcacuuugggag

SEQ ID NO: 456126 - RNA, 20 nt, Human
ggcaggcggcggcggaggag

SEQ ID NO: 456127 - RNA, 19 nt, Human
ggcaggcggcgggcgcuca

SEQ ID NO: 456128 - RNA, 25 nt, Human
ggcaggcggguacaggggccagcag

SEQ ID NO: 456129 - RNA, 32 nt, Human
ggcaggcgggucaucugacaucaggagaauca

SEQ ID NO: 456130 - RNA, 32 nt, Human
ggcaggcgggucaucugacaucaggaguuuga

SEQ ID NO: 456131 - RNA, 22 nt, Human
ggcaggcggucaaggccggcag

SEQ ID NO: 456132 - RNA, 32 nt, Human
ggcaggcgguccccauccccaccagcucguuu

SEQ ID NO: 456133 - RNA, 19 nt, Human
ggcaggcggugggggcagc

SEQ ID NO: 456134 - RNA, 32 nt, Human
ggcaggcgucuguaaucccagcugcuugggag

SEQ ID NO: 456135 - RNA, 32 nt, Human
ggcaggcgugacagcagaugcagaggacagag

SEQ ID NO: 456136 - RNA, 32 nt, Human
ggcaggcgugagcaaccauggccgggcagcac

SEQ ID NO: 456137 - RNA, 32 nt, Human
ggcaggcucaaccuucagauucccagggccuc

SEQ ID NO: 456138 - RNA, 32 nt, Human
ggcaggcucaagcccaggucuccugaccugca

SEQ ID NO: 456139 - RNA, 32 nt, Human
ggcaggcucacugccaggccagccuccgagag

SEQ ID NO: 456140 - RNA, 32 nt, Human
ggcaggcucacugcccgcuucuuuuccuucuu

SEQ ID NO: 456141 - RNA, 32 nt, Human
ggcaggcucccucugcaguggggucugggccu

SEQ ID NO: 456142 - RNA, 32 nt, Human
ggcaggcucguggccuccccucccagaagcgc

SEQ ID NO: 456143 - RNA, 32 nt, Human
ggcaggcucugccacucagaucaccauguaca

SEQ ID NO: 456144 - RNA, 20 nt, Human
ggcaggcucuggagcugcuu

SEQ ID NO: 456145 - RNA, 32 nt, Human
ggcaggcucugguccuguccagcugcuggaga

SEQ ID NO: 456146 - RNA, 32 nt, Human
ggcaggcugagcgugcagcaacuccaggcauc

SEQ ID NO: 456147 - RNA, 32 nt, Human
ggcaggcugcagccucaugccaugucucucuc

SEQ ID NO: 456148 - RNA, 32 nt, Human
ggcaggcugcagcuguccccggguggccuggc

SEQ ID NO: 456149 - RNA, 32 nt, Human
ggcaggcugggagcauggaggacagcuuaugg

SEQ ID NO: 456150 - RNA, 32 nt, Human
ggcaggcuggggcugcgggcugagggggaccg

SEQ ID NO: 456151 - RNA, 32 nt, Human
ggcaggcugggugggagggaggagggccgaga

SEQ ID NO: 456152 - RNA, 32 nt, Human
ggcaggcugucucucaagguggucuuuucugc

SEQ ID NO: 456153 - RNA, 32 nt, Human
ggcaggcugugcaggaggguuacuugagccca

SEQ ID NO: 456154 - RNA, 32 nt, Human
ggcaggcuguggauggggcggagcagggcaga

SEQ ID NO: 456155 - RNA, 32 nt, Human
ggcaggcuuggggaaaauggccauacaggagg

SEQ ID NO: 456156 - RNA, 32 nt, Human
ggcaggcuugugcuccccuuggagaagggcug

SEQ ID NO: 456157 - RNA, 32 nt, Human
ggcagggaaaggcucugaaagccagcugccga

SEQ ID NO: 456158 - RNA, 32 nt, Human
ggcagggaaauuccccuucuccccagugauuc

SEQ ID NO: 456159 - RNA, 32 nt, Human
ggcagggaagacucacagcagagcaggagggg

SEQ ID NO: 456160 - RNA, 20 nt, Human
ggcagggaagccuugagguc

SEQ ID NO: 456161 - RNA, 32 nt, Human
ggcagggaaggagccuccccuacagguuucag

SEQ ID NO: 456162 - RNA, 32 nt, Human
ggcagggaaucagcuaacccggcugcccaugg

SEQ ID NO: 456163 - RNA, 16 nt, Human
ggcagggaauuauggg

SEQ ID NO: 456164 - RNA, 32 nt, Human
ggcagggaauuaugggggcugugcccagggug

SEQ ID NO: 456165 - RNA, 32 nt, Human
ggcagggacagggacagcccaggucacacgug

SEQ ID NO: 456166 - RNA, 32 nt, Human
ggcagggacggaacuccuauucagcaguuuuu

SEQ ID NO: 456167 - RNA, 32 nt, Human
ggcagggacggguggagaggcgcagggacccc

SEQ ID NO: 456168 - RNA, 32 nt, Human
ggcagggacuagaacagagggagccaccugga

SEQ ID NO: 456169 - RNA, 32 nt, Human
ggcagggacuggcgcccugugccugagugggu

SEQ ID NO: 456170 - RNA, 20 nt, Human
ggcagggacuguggcagcuu

SEQ ID NO: 456171 - RNA, 32 nt, Human
ggcagggacuugcccaagggcauauagugaga

SEQ ID NO: 456172 - RNA, 32 nt, Human
ggcagggagaagagaaggcauuaguaagaaaa

SEQ ID NO: 456173 - RNA, 18 nt, Human
ggcagggagaccuggguc

SEQ ID NO: 456174 - RNA, 32 nt, Human
ggcagggagagggcggaagggcuggcgaucgc

SEQ ID NO: 456175 - RNA, 32 nt, Human
ggcagggagagggucuuggggacagcccuccu

SEQ ID NO: 456176 - RNA, 32 nt, Human
ggcagggagauagacccagcugugcugucaug

SEQ ID NO: 456177 - RNA, 32 nt, Human
ggcagggagcaguguugggagagggcucccca

SEQ ID NO: 456178 - RNA, 32 nt, Human
ggcagggagccaccuccucagcuucccugagg

SEQ ID NO: 456179 - RNA, 32 nt, Human
ggcagggagcuagggccggaugaggcagggca

SEQ ID NO: 456180 - RNA, 32 nt, Human
ggcagggaggaggcagggccuguucugcaguu

SEQ ID NO: 456181 - RNA, 22 nt, Human
ggcagggaggaugggggcagcu

SEQ ID NO: 456182 - RNA, 32 nt, Human
ggcagggaggcacgcagguacugugaaaaucc

SEQ ID NO: 456183 - RNA, 32 nt, Human
ggcagggaggcagggaggcugcagagucagag

SEQ ID NO: 456184 - RNA, 32 nt, Human
ggcagggaggcgccugcuccaccagcuggugg

SEQ ID NO: 456185 - RNA, 32 nt, Human
ggcagggaggcugcagagucagagucgcgggc

SEQ ID NO: 456186 - RNA, 32 nt, Human
ggcagggaggggcaggguguucuagaggugag

SEQ ID NO: 456187 - RNA, 32 nt, Human
ggcagggaggggcaucccucccugccggccuc

SEQ ID NO: 456188 - RNA, 32 nt, Human
ggcagggagguggggguugggggaguaguggg

SEQ ID NO: 456189 - RNA, 32 nt, Human
ggcagggauguugaaguaucccaagggcuuaa

SEQ ID NO: 456190 - RNA, 32 nt, Human
ggcagggauuacaggaacccaccaccaugcug

SEQ ID NO: 456191 - RNA, 19 nt, Human
ggcagggcaaagcuagcuu

SEQ ID NO: 456192 - RNA, 32 nt, Human
ggcagggcaagggccccagcuggcaagcugga

SEQ ID NO: 456193 - RNA, 32 nt, Human
ggcagggcaagggugggagugugcaaagcccu

SEQ ID NO: 456194 - RNA, 32 nt, Human
ggcagggcacagcagagcaggcuggagaagcg

SEQ ID NO: 456195 - RNA, 32 nt, Human
ggcagggcagaggcacgucuggguccccuccc

SEQ ID NO: 456196 - RNA, 32 nt, Human
ggcagggcagccaggggcugcagugaaaugaa

SEQ ID NO: 456197 - RNA, 32 nt, Human
ggcagggcagccaggggcugcagugaaaugga

SEQ ID NO: 456198 - RNA, 32 nt, Human
ggcagggcagccgcccccgcucccagccaggc

SEQ ID NO: 456199 - RNA, 32 nt, Human
ggcagggcaggcagagcucagcacagccucac

SEQ ID NO: 456200 - RNA, 32 nt, Human
ggcagggcaggcgauuccagugggguugggcc

SEQ ID NO: 456201 - RNA, 16 nt, Human
ggcagggcagggcagc

SEQ ID NO: 456202 - RNA, 32 nt, Human
ggcagggcagggcgauguagaccuggaauuug

SEQ ID NO: 456203 - RNA, 32 nt, Human
ggcagggcaugaguuagggagacugaagagua

SEQ ID NO: 456204 - RNA, 18 nt, Human
ggcagggccaacgggagg

SEQ ID NO: 456205 - RNA, 32 nt, Human
ggcagggccaagagcaggaaccagccucagaa

SEQ ID NO: 456206 - RNA, 32 nt, Human
ggcagggccacugagcccuccucagaugguua

SEQ ID NO: 456207 - RNA, 20 nt, Human
ggcagggccagcccauggcu

SEQ ID NO: 456208 - RNA, 32 nt, Human
ggcagggccaggcagagagagaugcuggggac

SEQ ID NO: 456209 - RNA, 18 nt, Human
ggcagggccagggcagcu

SEQ ID NO: 456210 - RNA, 19 nt, Human
ggcagggcccagugagagg

SEQ ID NO: 456211 - RNA, 32 nt, Human
ggcagggcccuugcccucacaccccgcugccc

SEQ ID NO: 456212 - RNA, 21 nt, Human
ggcagggccgcagccgaaaga

SEQ ID NO: 456213 - RNA, 32 nt, Human
ggcagggccgcugacgugugcccaugggaugu

SEQ ID NO: 456214 - RNA, 20 nt, Human
ggcagggccgcuggccagca

SEQ ID NO: 456215 - RNA, 20 nt, Human
ggcagggccggcggggcagc

SEQ ID NO: 456216 - RNA, 19 nt, Human
ggcagggccggggcaagcu

SEQ ID NO: 456217 - RNA, 32 nt, Human
ggcagggccucgcccacaccaaaccuguggac

SEQ ID NO: 456218 - RNA, 19 nt, Human
ggcagggccucuccaugcc

SEQ ID NO: 456219 - RNA, 32 nt, Human
ggcagggccugccuccucuggcucagugugag

SEQ ID NO: 456220 - RNA, 32 nt, Human
ggcagggccugcuucccauaagaagggcuaaa

SEQ ID NO: 456221 - RNA, 32 nt, Human
ggcagggccuggcggagguggaguggccacug

SEQ ID NO: 456222 - RNA, 32 nt, Human
ggcagggccuuccacaccuauaccuucucaaa

SEQ ID NO: 456223 - RNA, 32 nt, Human
ggcagggccuuggggagccccagcacaaugau

SEQ ID NO: 456224 - RNA, 32 nt, Human
ggcagggcgacggucagccacuacgaaugccu

SEQ ID NO: 456225 - RNA, 32 nt, Human
ggcagggcgagcaggauguccuuguccaggga

SEQ ID NO: 456226 - RNA, 32 nt, Human
ggcagggcgaguugugugugaguuggcugccc

SEQ ID NO: 456227 - RNA, 21 nt, Human
ggcagggcgcuggccgcgcug

SEQ ID NO: 456228 - RNA, 32 nt, Human
ggcagggcucacacuccugggcucugaacaca

SEQ ID NO: 456229 - RNA, 32 nt, Human
ggcagggcucuggugggagagggagacagaug

SEQ ID NO: 456230 - RNA, 32 nt, Human
ggcagggcugacugaauagccagggggugcca

SEQ ID NO: 456231 - RNA, 32 nt, Human
ggcagggcugcugaagcgcggaguucgggguc

SEQ ID NO: 456232 - RNA, 32 nt, Human
ggcagggcuggguggaggagagaguggcaccc

SEQ ID NO: 456233 - RNA, 32 nt, Human
ggcagggcuguagcccacgccgggugcuauuc

SEQ ID NO: 456234 - RNA, 30 nt, Human
ggcaggggaagagacagggcacagcuggcc

SEQ ID NO: 456235 - RNA, 19 nt, Human
ggcaggggaaggaccugau

SEQ ID NO: 456236 - RNA, 32 nt, Human
ggcaggggaaggggccuggccgccaccugcuc

SEQ ID NO: 456237 - RNA, 32 nt, Human
ggcaggggacauagacaaggagggaggaagcu

SEQ ID NO: 456238 - RNA, 32 nt, Human
ggcaggggagagagggaaaugccaaaaacuug

SEQ ID NO: 456239 - RNA, 32 nt, Human
ggcaggggaggacuguggggucugggcucugu

SEQ ID NO: 456240 - RNA, 32 nt, Human
ggcaggggaggcauccuuacuggagaggcagg

SEQ ID NO: 456241 - RNA, 32 nt, Human
ggcaggggcagcugggcuggcucccggggaac

SEQ ID NO: 456242 - RNA, 20 nt, Human
ggcaggggcagggcaagcuu

SEQ ID NO: 456243 - RNA, 19 nt, Human
ggcaggggcaggggcagcu

SEQ ID NO: 456244 - RNA, 32 nt, Human
ggcaggggcccagcccugccuuccacugugcu

SEQ ID NO: 456245 - RNA, 32 nt, Human
ggcaggggcgggcggagggaggggagggguga

SEQ ID NO: 456246 - RNA, 32 nt, Human
ggcaggggcgguggaggacucaggaacugccc

SEQ ID NO: 456247 - RNA, 32 nt, Human
ggcaggggcugaggggacuguggaagccacga

SEQ ID NO: 456248 - RNA, 32 nt, Human
ggcaggggcugcaggaagggggaaugaggaau

SEQ ID NO: 456249 - RNA, 32 nt, Human
ggcagggggaagaaggaggagaagaugaagaa

SEQ ID NO: 456250 - RNA, 32 nt, Human
ggcagggggacacggcccugcauucuggacag

SEQ ID NO: 456251 - RNA, 32 nt, Human
ggcagggggagggccagcucugggagacgagg

SEQ ID NO: 456252 - RNA, 32 nt, Human
ggcagggggaggguaggagcagcuggagacuc

SEQ ID NO: 456253 - RNA, 32 nt, Human
ggcagggggauggccauggaaggguugagggg

SEQ ID NO: 456254 - RNA, 32 nt, Human
ggcagggggcagggggcagagagcagagagga

SEQ ID NO: 456255 - RNA, 22 nt, Human
ggcagggggcgaagugcagugg

SEQ ID NO: 456256 - RNA, 32 nt, Human
ggcagggggcuggggacugcagccccacuccc

SEQ ID NO: 456257 - RNA, 32 nt, Human
ggcagggggugagggaggacagcagagggcua

SEQ ID NO: 456258 - RNA, 32 nt, Human
ggcagggggugaggggcaggucuaguguuccu

SEQ ID NO: 456259 - RNA, 32 nt, Human
ggcaggggguuccagaguggggugggccgugc

SEQ ID NO: 456260 - RNA, 32 nt, Human
ggcagggguagaggcucguagauggaacuggu

SEQ ID NO: 456261 - RNA, 32 nt, Human
ggcaggggucauagauccuaagccauaaaaua

SEQ ID NO: 456262 - RNA, 32 nt, Human
ggcaggggugagagcacccacugaauugacau

SEQ ID NO: 456263 - RNA, 32 nt, Human
ggcaggggugagaguggagcugaguggggucu

SEQ ID NO: 456264 - RNA, 20 nt, Human
ggcaggggugccccauggcu

SEQ ID NO: 456265 - RNA, 26 nt, Human
ggcagggguuaccaacuggccagcag

SEQ ID NO: 456266 - RNA, 32 nt, Human
ggcagggguuccaacaccagcacagggcuccc

SEQ ID NO: 456267 - RNA, 20 nt, Human
ggcaggguacacucucccca

SEQ ID NO: 456268 - RNA, 16 nt, Human
ggcaggguccugggaa

SEQ ID NO: 456269 - RNA, 16 nt, Human
ggcagggucugggguc

SEQ ID NO: 456270 - RNA, 32 nt, Human
ggcagggucuugaggcagccacugugaugcuc

SEQ ID NO: 456271 - RNA, 20 nt, Human
ggcagggugauggggagcuu

SEQ ID NO: 456272 - RNA, 32 nt, Human
ggcagggugcacgcgcuggcccugccacucca

SEQ ID NO: 456273 - RNA, 19 nt, Human
ggcagggugcucugagguc

SEQ ID NO: 456274 - RNA, 32 nt, Human
ggcaggguggaguggagggggagcuacuaggc

SEQ ID NO: 456275 - RNA, 22 nt, Human
ggcaggguggcucacaccugua

SEQ ID NO: 456276 - RNA, 32 nt, Human
ggcagggugggauggaggagaagaauuuucag

SEQ ID NO: 456277 - RNA, 32 nt, Human
ggcaggguggggcaggaugcagugagccagcc

SEQ ID NO: 456278 - RNA, 32 nt, Human
ggcaggguguggggcaaggcagugagugaaga

SEQ ID NO: 456279 - RNA, 32 nt, Human
ggcaggguguggggcagggcagugagugaaga

SEQ ID NO: 456280 - RNA, 32 nt, Human
ggcaggguuccugccuuggacccccagucugg

SEQ ID NO: 456281 - RNA, 19 nt, Human
ggcaggguucuccaaggcc

SEQ ID NO: 456282 - RNA, 32 nt, Human
ggcaggguuuccuccuuagacacugacagcau

SEQ ID NO: 456283 - RNA, 32 nt, Human
ggcagguaccuguaaucccagcuacucgggag

SEQ ID NO: 456284 - RNA, 32 nt, Human
ggcagguagaagccuccgucccuaccuuauag

SEQ ID NO: 456285 - RNA, 18 nt, Human
ggcaggucacuugagguc

SEQ ID NO: 456286 - RNA, 32 nt, Human
ggcaggucagggccuggucccuuuguaggugg

SEQ ID NO: 456287 - RNA, 32 nt, Human
ggcaggucaggguuguccgcucugauuagcag

SEQ ID NO: 456288 - RNA, 32 nt, Human
ggcaggucagucuccgugcaggaugugagcag

SEQ ID NO: 456289 - RNA, 17 nt, Human
ggcagguccaccugggc

SEQ ID NO: 456290 - RNA, 32 nt, Human
ggcagguccagcucugugggcccuacccuccu

SEQ ID NO: 456291 - RNA, 18 nt, Human
ggcaggucccccuuagcg

SEQ ID NO: 456292 - RNA, 32 nt, Human
ggcagguccuuagugggcuagaccuaccuuuc

SEQ ID NO: 456293 - RNA, 32 nt, Human
ggcaggucgucggcugcaaccacacacuugga

SEQ ID NO: 456294 - RNA, 32 nt, Human
ggcaggucuccagcugaaucugugccuacaaa

SEQ ID NO: 456295 - RNA, 32 nt, Human
ggcaggucuccagcugaaucugugccuacgaa

SEQ ID NO: 456296 - RNA, 32 nt, Human
ggcaggucuccucugggaggucuuggccgacu

SEQ ID NO: 456297 - RNA, 32 nt, Human
ggcaggucuuaagaaagguacuuagcaagugc

SEQ ID NO: 456298 - RNA, 32 nt, Human
ggcaggugacaccuccugcagcccccagcaug

SEQ ID NO: 456299 - RNA, 32 nt, Human
ggcaggugacccaagacagagcugaccccucc

SEQ ID NO: 456300 - RNA, 32 nt, Human
ggcaggugagaagggaaucauccugagaggcu

SEQ ID NO: 456301 - RNA, 32 nt, Human
ggcaggugaggcuuggccugcccagccugucc

SEQ ID NO: 456302 - RNA, 19 nt, Human
ggcaggugcacacaccucc

SEQ ID NO: 456303 - RNA, 32 nt, Human
ggcaggugcacacaccuccacagugaccucug

SEQ ID NO: 456304 - RNA, 32 nt, Human
ggcaggugcaccacugggcuccuggguagugu

SEQ ID NO: 456305 - RNA, 32 nt, Human
ggcaggugccuauaaucccagcuacuccagag

SEQ ID NO: 456306 - RNA, 32 nt, Human
ggcaggugccuguaaucccaacuacucaggag

SEQ ID NO: 456307 - RNA, 32 nt, Human
ggcaggugccuguaaucccagcacuuugggaa

SEQ ID NO: 456308 - RNA, 32 nt, Human
ggcaggugccuguaaucccagcuacucaggag

SEQ ID NO: 456309 - RNA, 32 nt, Human
ggcaggugccuguaaucccagcuacucagggg

SEQ ID NO: 456310 - RNA, 32 nt, Human
ggcaggugccuguaaucccagcuacucgggag

SEQ ID NO: 456311 - RNA, 32 nt, Human
ggcaggugccuguaaucccagcuacucugucu

SEQ ID NO: 456312 - RNA, 32 nt, Human
ggcaggugccuguaaucccagcuacuugagag

SEQ ID NO: 456313 - RNA, 32 nt, Human
ggcaggugccuguaaucccagcuacuugggag

SEQ ID NO: 456314 - RNA, 32 nt, Human
ggcaggugccuguaaucccauguacucuggag

SEQ ID NO: 456315 - RNA, 32 nt, Human
ggcaggugccuguaauccuagcuacuuggcag

SEQ ID NO: 456316 - RNA, 17 nt, Human
ggcaggugccuguaguc

SEQ ID NO: 456317 - RNA, 32 nt, Human
ggcaggugccuguagucccagcuacucggcag

SEQ ID NO: 456318 - RNA, 32 nt, Human
ggcaggugccuguagucccagcuacucgggaa

SEQ ID NO: 456319 - RNA, 32 nt, Human
ggcaggugccuguagucccagcuacucgggag

SEQ ID NO: 456320 - RNA, 32 nt, Human
ggcaggugccuguagucccagcuacucuggag

SEQ ID NO: 456321 - RNA, 32 nt, Human
ggcaggugccuguagucccagcuacuugggac

SEQ ID NO: 456322 - RNA, 32 nt, Human
ggcaggugccuguagucccagcuacuugggag

SEQ ID NO: 456323 - RNA, 32 nt, Human
ggcaggugccuguagucucagcuacucaggag

SEQ ID NO: 456324 - RNA, 22 nt, Human
ggcaggugcuauuuccauggcc

SEQ ID NO: 456325 - RNA, 17 nt, Human
ggcaggugcuggagguc

SEQ ID NO: 456326 - RNA, 32 nt, Human
ggcaggugcuuguaaucccagcuacuugggag

SEQ ID NO: 456327 - RNA, 32 nt, Human
ggcagguggaaaaccaucucccagaaaccuga

SEQ ID NO: 456328 - RNA, 32 nt, Human
ggcagguggagacagcuuauuaggcagccugc

SEQ ID NO: 456329 - RNA, 32 nt, Human
ggcagguggagaggaggauggggaccagcagc

SEQ ID NO: 456330 - RNA, 32 nt, Human
ggcagguggagaguccagggaggcaggaugga

SEQ ID NO: 456331 - RNA, 20 nt, Human
ggcagguggaucacaagguc

SEQ ID NO: 456332 - RNA, 32 nt, Human
ggcagguggaucacaaugucaggaguuugaga

SEQ ID NO: 456333 - RNA, 32 nt, Human
ggcagguggaucaccugaggucaggggcucaa

SEQ ID NO: 456334 - RNA, 32 nt, Human
ggcagguggaucaccugaggucgggagcucga

SEQ ID NO: 456335 - RNA, 32 nt, Human
ggcagguggaucaccugaggucgggaguucaa

SEQ ID NO: 456336 - RNA, 32 nt, Human
ggcagguggaucaccugaggucgggaguucga

SEQ ID NO: 456337 - RNA, 32 nt, Human
ggcagguggaucaccugaggucgggaguuuga

SEQ ID NO: 456338 - RNA, 32 nt, Human
ggcagguggaucaccugaggucgggauuuuga

SEQ ID NO: 456339 - RNA, 20 nt, Human
ggcagguggaucacgagguc

SEQ ID NO: 456340 - RNA, 32 nt, Human
ggcagguggaucaucugaggucaggaguuuga

SEQ ID NO: 456341 - RNA, 32 nt, Human
ggcagguggaucaugaggucaugagauugaga

SEQ ID NO: 456342 - RNA, 18 nt, Human
ggcagguggccacagcag

SEQ ID NO: 456343 - RNA, 20 nt, Human
ggcagguggccaccaggguc

SEQ ID NO: 456344 - RNA, 32 nt, Human
ggcaggugggaggcacgggguugcggaucccg

SEQ ID NO: 456345 - RNA, 32 nt, Human
ggcagguggggcaauccagagcugugggggcu

SEQ ID NO: 456346 - RNA, 21 nt, Human
ggcagguggggggagccacca

SEQ ID NO: 456347 - RNA, 32 nt, Human
ggcagguggguggagggggaugcugggaguuc

SEQ ID NO: 456348 - RNA, 32 nt, Human
ggcagguggugaggaagagugggguagagcca

SEQ ID NO: 456349 - RNA, 19 nt, Human
ggcagguguccaccagcag

SEQ ID NO: 456350 - RNA, 32 nt, Human
ggcaggugucugcaugcuacccgggucucgga

SEQ ID NO: 456351 - RNA, 32 nt, Human
ggcaggugucugcugcucaccuggcucuggag

SEQ ID NO: 456352 - RNA, 17 nt, Human
ggcaggugucuguaguc

SEQ ID NO: 456353 - RNA, 32 nt, Human
ggcaggugugagccaucgcgcccggccaacuu

SEQ ID NO: 456354 - RNA, 32 nt, Human
ggcaggugugggagcacagcuggaacaaugug

SEQ ID NO: 456355 - RNA, 32 nt, Human
ggcagguucacaggcgaggccuggaguaacac

SEQ ID NO: 456356 - RNA, 32 nt, Human
ggcagguuccacccuucucuaccagccccgcu

SEQ ID NO: 456357 - RNA, 32 nt, Human
ggcagguuccagagaaucgaguagaccuuuug

SEQ ID NO: 456358 - RNA, 32 nt, Human
ggcagguuccagagaaugcaguagaccuuuug

SEQ ID NO: 456359 - RNA, 19 nt, Human
ggcagguucggcuggaagg

SEQ ID NO: 456360 - RNA, 32 nt, Human
ggcagguugccccuuucuggguuuguggugac

SEQ ID NO: 456361 - RNA, 23 nt, Human
ggcagguuucagggugccagugg

SEQ ID NO: 456362 - RNA, 21 nt, Human
ggcagguuuccaagagcaggg

SEQ ID NO: 456363 - RNA, 32 nt, Human
ggcagguuuuccaggcuggagucgguuccacc

SEQ ID NO: 456364 - RNA, 32 nt, Human
ggcaguaaugagcgccccagagccuccaucau

SEQ ID NO: 456365 - RNA, 32 nt, Human
ggcaguaccaggaggagguacauguauguccg

SEQ ID NO: 456366 - RNA, 32 nt, Human
ggcaguacucaucuuggcccugggaagaaacu

SEQ ID NO: 456367 - RNA, 32 nt, Human
ggcaguacugacugggcacugccucugccccc

SEQ ID NO: 456368 - RNA, 32 nt, Human
ggcaguacuguggcccaccaguguaaucuccc

SEQ ID NO: 456369 - RNA, 32 nt, Human
ggcaguagaauggccagcauuccugccuguaa

SEQ ID NO: 456370 - RNA, 32 nt, Human
ggcaguagacuuccgggauggcugucgugggg

SEQ ID NO: 456371 - RNA, 32 nt, Human
ggcaguagcagcuguguuugaguuucuggcug

SEQ ID NO: 456372 - RNA, 32 nt, Human
ggcaguagcucugccaacuggggcuccucucu

SEQ ID NO: 456373 - RNA, 32 nt, Human
ggcaguagggaaaugagugaggcugcccugag

SEQ ID NO: 456374 - RNA, 32 nt, Human
ggcaguagggauuggguugggggaagauaacu

SEQ ID NO: 456375 - RNA, 32 nt, Human
ggcaguagggcuggaaccaaaguauuacucuc

SEQ ID NO: 456376 - RNA, 32 nt, Human
ggcaguaucggccagaucaguguuacauugau

SEQ ID NO: 456377 - RNA, 32 nt, Human
ggcaguauuuuagugcucaucaacauugugac

SEQ ID NO: 456378 - RNA, 32 nt, Human
ggcagucaaccaggaacaggucgcagccaggc

SEQ ID NO: 456379 - RNA, 24 nt, Human
ggcagucaagcgagcaucaggaga

SEQ ID NO: 456380 - RNA, 32 nt, Human
ggcagucaaguguggcuacuucuaccuggagu

SEQ ID NO: 456381 - RNA, 20 nt, Human
ggcagucaaugcccauaacc

SEQ ID NO: 456382 - RNA, 32 nt, Human
ggcagucacaucuggaaauggaaagccgaccu

SEQ ID NO: 456383 - RNA, 32 nt, Human
ggcagucacaugcuucccugguuuuagcacac

SEQ ID NO: 456384 - RNA, 32 nt, Human
ggcagucaccacccagcccuuccuugggcguc

SEQ ID NO: 456385 - RNA, 32 nt, Human
ggcagucaccuguaaucccagcuacuugggag

SEQ ID NO: 456386 - RNA, 32 nt, Human
ggcagucacugggacaaggagggacuugccuc

SEQ ID NO: 456387 - RNA, 21 nt, Human
ggcagucagaaagcccagggu

SEQ ID NO: 456388 - RNA, 21 nt, Human
ggcagucagaggcgcuggaga

SEQ ID NO: 456389 - RNA, 32 nt, Human
ggcagucagccagcaaaucaguaggauaaaca

SEQ ID NO: 456390 - RNA, 18 nt, Human
ggcagucagcccauagcu

SEQ ID NO: 456391 - RNA, 19 nt, Human
ggcagucagccucccagcc

SEQ ID NO: 456392 - RNA, 32 nt, Human
ggcagucaggcagaaaugggcaaguucagggu

SEQ ID NO: 456393 - RNA, 20 nt, Human
ggcagucaggcuccagggcc

SEQ ID NO: 456394 - RNA, 22 nt, Human
ggcagucaggggacacuagaga

SEQ ID NO: 456395 - RNA, 32 nt, Human
ggcagucaguccagagaugcuggcccucgccc

SEQ ID NO: 456396 - RNA, 32 nt, Human
ggcagucaugaggaaacaggucagggcgaagc

SEQ ID NO: 456397 - RNA, 20 nt, Human
ggcaguccagccucucccca

SEQ ID NO: 456398 - RNA, 19 nt, Human
ggcaguccaggcucagaca

SEQ ID NO: 456399 - RNA, 32 nt, Human
ggcagucccagcaggacccauggaguguccuu

SEQ ID NO: 456400 - RNA, 32 nt, Human
ggcagucccaggaguucugaccaucaagccua

SEQ ID NO: 456401 - RNA, 19 nt, Human
ggcaguccccagccuccca

SEQ ID NO: 456402 - RNA, 32 nt, Human
ggcaguccuaggcgugggggcagaugggugga

SEQ ID NO: 456403 - RNA, 32 nt, Human
ggcaguccucaccucugccucccucgcuccuc

SEQ ID NO: 456404 - RNA, 32 nt, Human
ggcaguccugcacuccuucuggaggcucuagg

SEQ ID NO: 456405 - RNA, 32 nt, Human
ggcaguccuggaggcagggggugaggggcagg

SEQ ID NO: 456406 - RNA, 32 nt, Human
ggcaguccuggccuguugagcuuguccagacg

SEQ ID NO: 456407 - RNA, 32 nt, Human
ggcagucgcuuuucugaauucuccccuccggc

SEQ ID NO: 456408 - RNA, 21 nt, Human
ggcagucggggcucgcggaga

SEQ ID NO: 456409 - RNA, 32 nt, Human
ggcagucuccaaacuauagaacuccuaacgcu

SEQ ID NO: 456410 - RNA, 32 nt, Human
ggcagucucgcgcggcuacugcagcacugggg

SEQ ID NO: 456411 - RNA, 32 nt, Human
ggcagucugaacggcaagcuugagucaggacc

SEQ ID NO: 456412 - RNA, 22 nt, Human
ggcagucugccuugucugugga

SEQ ID NO: 456413 - RNA, 32 nt, Human
ggcagucuggaggggcauggccagcagcuugc

SEQ ID NO: 456414 - RNA, 32 nt, Human
ggcagucugggcaauauagugaggcucccauc

SEQ ID NO: 456415 - RNA, 32 nt, Human
ggcagucuguagagcagcucccagaggcugcc

SEQ ID NO: 456416 - RNA, 25 nt, Human
ggcagucugucgcugcucauggaga

SEQ ID NO: 456417 - RNA, 32 nt, Human
ggcagucuuugaggcccccaucagagaccccc

SEQ ID NO: 456418 - RNA, 32 nt, Human
ggcagucuuuuuccaucucuaccgaaguugau

SEQ ID NO: 456419 - RNA, 25 nt, Human
ggcagugaaugucuugcucuuccca

SEQ ID NO: 456420 - RNA, 32 nt, Human
ggcagugacaacacacacucggcuucaguucu

SEQ ID NO: 456421 - RNA, 32 nt, Human
ggcagugaccacccacccuggagccauggucc

SEQ ID NO: 456422 - RNA, 32 nt, Human
ggcagugaccuacucugcuccccagaggcucc

SEQ ID NO: 456423 - RNA, 32 nt, Human
ggcagugacuaguccaggagugcagcugggag

SEQ ID NO: 456424 - RNA, 18 nt, Human
ggcagugacugcucaaag

SEQ ID NO: 456425 - RNA, 32 nt, Human
ggcagugacuuggagcccugaagaagggacca

SEQ ID NO: 456426 - RNA, 17 nt, Human
ggcagugagcugcgguc

SEQ ID NO: 456427 - RNA, 21 nt, Human
ggcagugaucuccuguucccu

SEQ ID NO: 456428 - RNA, 32 nt, Human
ggcagugaugggagaaggggaggcaugauucu

SEQ ID NO: 456429 - RNA, 32 nt, Human
ggcagugcaacaaccccagaccugccuuuggg

SEQ ID NO: 456430 - RNA, 32 nt, Human
ggcagugcaaggaagggacggggaagagaagc

SEQ ID NO: 456431 - RNA, 32 nt, Human
ggcagugcaauauuuagcugcuaacaagacug

SEQ ID NO: 456432 - RNA, 32 nt, Human
ggcagugcagccgccucacaggucggcggacg

SEQ ID NO: 456433 - RNA, 32 nt, Human
ggcagugcagugagcugucuggccuuuugucc

SEQ ID NO: 456434 - RNA, 32 nt, Human
ggcagugcagugugccugggagcugucuggaa

SEQ ID NO: 456435 - RNA, 32 nt, Human
ggcagugccaugggggcaacagccaaaauagg

SEQ ID NO: 456436 - RNA, 32 nt, Human
ggcagugccuguaaucccagcuauuugggagg

SEQ ID NO: 456437 - RNA, 32 nt, Human
ggcagugccuguagucccagcugcucgggagg

SEQ ID NO: 456438 - RNA, 32 nt, Human
ggcagugcgguggaggugagggggugagccug

SEQ ID NO: 456439 - RNA, 31 nt, Human
ggcagugcgucuggagggccugugcgagcuc

SEQ ID NO: 456440 - RNA, 32 nt, Human
ggcagugcugagggcugggaugcucugugacc

SEQ ID NO: 456441 - RNA, 18 nt, Human
ggcaguggaaaaaguccu

SEQ ID NO: 456442 - RNA, 19 nt, Human
ggcaguggaaccgacuccc

SEQ ID NO: 456443 - RNA, 32 nt, Human
ggcaguggagacuguagugugugcgugugugc

SEQ ID NO: 456444 - RNA, 32 nt, Human
ggcaguggagagugcugcuggguguacgcugc

SEQ ID NO: 456445 - RNA, 22 nt, Human
ggcaguggagaugcugucccca

SEQ ID NO: 456446 - RNA, 32 nt, Human
ggcaguggcaccuccgcugagcuuuuaaacca

SEQ ID NO: 456447 - RNA, 31 nt, Human
ggcaguggcacgaucucagcucacugcaagc

SEQ ID NO: 456448 - RNA, 32 nt, Human
ggcaguggcaggcaguagugaagucggcucua

SEQ ID NO: 456449 - RNA, 32 nt, Human
ggcaguggccaagccugcuguguccuuccucc

SEQ ID NO: 456450 - RNA, 19 nt, Human
ggcaguggcccuggcagcu

SEQ ID NO: 456451 - RNA, 32 nt, Human
ggcaguggcucacaccuauaaucccagcacuu

SEQ ID NO: 456452 - RNA, 32 nt, Human
ggcaguggcucacaccuauaaucccagccaag

SEQ ID NO: 456453 - RNA, 32 nt, Human
ggcaguggcucaugccuauaaucccagcacuu

SEQ ID NO: 456454 - RNA, 32 nt, Human
ggcaguggcugugggagcaggaauggcgcagc

SEQ ID NO: 456455 - RNA, 32 nt, Human
ggcagugggaagagggugguucccuggggguc

SEQ ID NO: 456456 - RNA, 20 nt, Human
ggcagugggaaguaguugaa

SEQ ID NO: 456457 - RNA, 32 nt, Human
ggcagugggaauguucuuucugcucuauacug

SEQ ID NO: 456458 - RNA, 32 nt, Human
ggcagugggaggcaagagugaagcagaggaga

SEQ ID NO: 456459 - RNA, 32 nt, Human
ggcagugggaggggcuguauggagaggagcug

SEQ ID NO: 456460 - RNA, 32 nt, Human
ggcagugggcaggccaggcagggcggguacgg

SEQ ID NO: 456461 - RNA, 32 nt, Human
ggcagugggcagguauggcugagggcguguga

SEQ ID NO: 456462 - RNA, 24 nt, Human
ggcagugggcucagccucucccca

SEQ ID NO: 456463 - RNA, 32 nt, Human
ggcaguggggacugccuggugaacacagaugu

SEQ ID NO: 456464 - RNA, 32 nt, Human
ggcagugggggaugugggauggcagcagccag

SEQ ID NO: 456465 - RNA, 32 nt, Human
ggcaguggggugagaggagggguuuacagggu

SEQ ID NO: 456466 - RNA, 22 nt, Human
ggcagugggguuugagauugga

SEQ ID NO: 456467 - RNA, 32 nt, Human
ggcagugggugaggggaccaggagguggcucc

SEQ ID NO: 456468 - RNA, 32 nt, Human
ggcaguggguggagagagaauggggagacgac

SEQ ID NO: 456469 - RNA, 31 nt, Human
ggcaguggugcgaucucagcucacugcaacc

SEQ ID NO: 456470 - RNA, 32 nt, Human
ggcaguggugcuggccucacagcccuggccau

SEQ ID NO: 456471 - RNA, 32 nt, Human
ggcagugguggaggugggcauuggcggggcuu

SEQ ID NO: 456472 - RNA, 32 nt, Human
ggcagugguggcacgggagcaggcuaggcggg

SEQ ID NO: 456473 - RNA, 32 nt, Human
ggcaguguagcaucucuuccacaaucagacag

SEQ ID NO: 456474 - RNA, 32 nt, Human
ggcagugucauccucauguucugccuuccagg

SEQ ID NO: 456475 - RNA, 32 nt, Human
ggcagugucucccacagacccaggagcgccac

SEQ ID NO: 456476 - RNA, 32 nt, Human
ggcagugugagcuguaggcagggacggggagg

SEQ ID NO: 456477 - RNA, 32 nt, Human
ggcagugugcaggcagguccugaggccugggg

SEQ ID NO: 456478 - RNA, 32 nt, Human
ggcagugugcggcucuggcggcugcguggcgg

SEQ ID NO: 456479 - RNA, 32 nt, Human
ggcagugugggaugggagggagcccugaaaca

SEQ ID NO: 456480 - RNA, 32 nt, Human
ggcaguguggugggaaggaagcucuggaagcu

SEQ ID NO: 456481 - RNA, 32 nt, Human
ggcaguguguauauaauaaacauguauggaaa

SEQ ID NO: 456482 - RNA, 32 nt, Human
ggcaguguuccuauuuggggcuugcaugccaa

SEQ ID NO: 456483 - RNA, 32 nt, Human
ggcaguguucugacagauguauaguguuuuga

SEQ ID NO: 456484 - RNA, 32 nt, Human
ggcaguuaacaugcaugggcugguuuguuucu

SEQ ID NO: 456485 - RNA, 24 nt, Human
ggcaguuaacuaaagaguacuccu

SEQ ID NO: 456486 - RNA, 21 nt, Human
ggcaguuaacuuaauaucccu

SEQ ID NO: 456487 - RNA, 32 nt, Human
ggcaguuaaguaugguuuaaagagauguuuau

SEQ ID NO: 456488 - RNA, 32 nt, Human
ggcaguuagccagcucaaguucuuuuucagag

SEQ ID NO: 456489 - RNA, 32 nt, Human
ggcaguuaugcuguuacuagugauuuuagggc

SEQ ID NO: 456490 - RNA, 32 nt, Human
ggcaguucacugcaugugcugcccccuugggu

SEQ ID NO: 456491 - RNA, 32 nt, Human
ggcaguucaggcagaucggaaaccacuggcug

SEQ ID NO: 456492 - RNA, 32 nt, Human
ggcaguucaggucauauggugacuugaugacc

SEQ ID NO: 456493 - RNA, 32 nt, Human
ggcaguuccaggacacagggaagugaguguga

SEQ ID NO: 456494 - RNA, 32 nt, Human
ggcaguuccugaccagcaccccaccaaguccu

SEQ ID NO: 456495 - RNA, 32 nt, Human
ggcaguucugcacccagccaaacacauaacaa

SEQ ID NO: 456496 - RNA, 32 nt, Human
ggcaguugaaaccaguuggacggcccagcuug

SEQ ID NO: 456497 - RNA, 32 nt, Human
ggcaguugaaggaggcagagaagggguuggug

SEQ ID NO: 456498 - RNA, 17 nt, Human
ggcaguugaccuggguc

SEQ ID NO: 456499 - RNA, 32 nt, Human
ggcaguugccuguaauccuagcuacucaggag

SEQ ID NO: 456500 - RNA, 32 nt, Human
ggcaguuggaggaaggccagaggaacagcuuu

SEQ ID NO: 456501 - RNA, 23 nt, Human
ggcaguuggaucaccugagguua

SEQ ID NO: 456502 - RNA, 32 nt, Human
ggcaguuguggagggagagggagcaaggaaua

SEQ ID NO: 456503 - RNA, 32 nt, Human
ggcaguuucaguuucagccuaagagacuggug

SEQ ID NO: 456504 - RNA, 32 nt, Human
ggcaguuugaagcaguucuucaugccacuuag

SEQ ID NO: 456505 - RNA, 32 nt, Human
ggcaguuugagaccagccugaccaacguggag

SEQ ID NO: 456506 - RNA, 32 nt, Human
ggcaguuuguaauccuggacuagcuuugcuga

SEQ ID NO: 456507 - RNA, 32 nt, Human
ggcauaaacuuagacacagucuugcauuuuug

SEQ ID NO: 456508 - RNA, 32 nt, Human
ggcauaaauguucaaucuaacggcuuugguug

SEQ ID NO: 456509 - RNA, 24 nt, Human
ggcauaagcaauccucccacuuca

SEQ ID NO: 456510 - RNA, 32 nt, Human
ggcauaaugacagcaccugccuggugaugcuc

SEQ ID NO: 456511 - RNA, 32 nt, Human
ggcauacacaugcacgcuuacauguacacgug

SEQ ID NO: 456512 - RNA, 32 nt, Human
ggcauacaccuguaauuccagcuacucauagg

SEQ ID NO: 456513 - RNA, 32 nt, Human
ggcauacagcauggugacuggaauggaugagc

SEQ ID NO: 456514 - RNA, 32 nt, Human
ggcauacaggcagcgagcgcuaagggacgcac

SEQ ID NO: 456515 - RNA, 32 nt, Human
ggcauacauauaauacauaccuaauuauagua

SEQ ID NO: 456516 - RNA, 32 nt, Human
ggcauacauaugcacacaagcaugcacagagg

SEQ ID NO: 456517 - RNA, 32 nt, Human
ggcauaccuuucaauuucucugaucucuaugg

SEQ ID NO: 456518 - RNA, 32 nt, Human
ggcauacgccuguaaucccagcuacucgggag

SEQ ID NO: 456519 - RNA, 32 nt, Human
ggcauacgccuguaauccuagcuacuugggag

SEQ ID NO: 456520 - RNA, 32 nt, Human
ggcauacguggugggaggguggagggcucccu

SEQ ID NO: 456521 - RNA, 32 nt, Human
ggcauacguguucacaggcagaguaguugauc

SEQ ID NO: 456522 - RNA, 17 nt, Human
ggcauacucaccuggau

SEQ ID NO: 456523 - RNA, 32 nt, Human
ggcauagaauuccaaagaaaauggugcugggu

SEQ ID NO: 456524 - RNA, 32 nt, Human
ggcauagagguugggcuggaggccuguccacu

SEQ ID NO: 456525 - RNA, 32 nt, Human
ggcauagcucacuguaggcuagccucugcuua

SEQ ID NO: 456526 - RNA, 32 nt, Human
ggcauaggccuguaaucguagcgcuuugagag

SEQ ID NO: 456527 - RNA, 32 nt, Human
ggcauaggcucuagugcugaaaggauccaggu

SEQ ID NO: 456528 - RNA, 32 nt, Human
ggcauagggaaaucucugcagccuugauuagu

SEQ ID NO: 456529 - RNA, 32 nt, Human
ggcauagggcagccuaccaccuccaagggggc

SEQ ID NO: 456530 - RNA, 32 nt, Human
ggcauagucauuuucuguaucuuuucaccuca

SEQ ID NO: 456531 - RNA, 22 nt, Human
ggcauaguggcucauacuugua

SEQ ID NO: 456532 - RNA, 32 nt, Human
ggcauaguggugagccaaacgcauuauagcau

SEQ ID NO: 456533 - RNA, 18 nt, Human
ggcauaucaccugagguc

SEQ ID NO: 456534 - RNA, 32 nt, Human
ggcauaucucaaccuccccuuccucaggggca

SEQ ID NO: 456535 - RNA, 32 nt, Human
ggcauaugaagugcuuucagauccaaagaaaa

SEQ ID NO: 456536 - RNA, 20 nt, Human
ggcauaugacuuuauacuua

SEQ ID NO: 456537 - RNA, 32 nt, Human
ggcauaugagaauaggugagcaagauauugcu

SEQ ID NO: 456538 - RNA, 32 nt, Human
ggcauaugcaauauuuacauuuuuaauuuagu

SEQ ID NO: 456539 - RNA, 32 nt, Human
ggcauaugccuguaaaucccagcuauuuggga

SEQ ID NO: 456540 - RNA, 32 nt, Human
ggcauaugccuguagucccaguuacuugggag

SEQ ID NO: 456541 - RNA, 32 nt, Human
ggcauaugggcaacaaagcuauggaaccuaug

SEQ ID NO: 456542 - RNA, 32 nt, Human
ggcauauggggcccugccaacaccacuuccuc

SEQ ID NO: 456543 - RNA, 32 nt, Human
ggcauauguauacauauguaacaaaccugcau

SEQ ID NO: 456544 - RNA, 22 nt, Human
ggcauauugaaagggcugcacc

SEQ ID NO: 456545 - RNA, 32 nt, Human
ggcauauugcauucuaaauaagaugcuaaaua

SEQ ID NO: 456546 - RNA, 32 nt, Human
ggcauauuggggaccugggaaugugugaagga

SEQ ID NO: 456547 - RNA, 32 nt, Human
ggcauauuguagcugcucaguggacguuagcu

SEQ ID NO: 456548 - RNA, 22 nt, Human
ggcaucaaccccaggccacgcu

SEQ ID NO: 456549 - RNA, 32 nt, Human
ggcaucaacuggagccacuucacagcuuguuu

SEQ ID NO: 456550 - RNA, 32 nt, Human
ggcaucaacuuaggugacagguacgauaagca

SEQ ID NO: 456551 - RNA, 32 nt, Human
ggcaucaaggaguacgagugcaaggagugcca

SEQ ID NO: 456552 - RNA, 32 nt, Human
ggcaucaaucacacagcaagcuuuucaaagga

SEQ ID NO: 456553 - RNA, 32 nt, Human
ggcaucaaucacauagcaagcuuuucaaagga

SEQ ID NO: 456554 - RNA, 25 nt, Human
ggcaucacacgccaguggccaccug

SEQ ID NO: 456555 - RNA, 32 nt, Human
ggcaucacagaagugaaaugaaaacaaaauua

SEQ ID NO: 456556 - RNA, 32 nt, Human
ggcaucacagaucauuguggacuuggcacgcu

SEQ ID NO: 456557 - RNA, 32 nt, Human
ggcaucacagugagcagugagcacagagggag

SEQ ID NO: 456558 - RNA, 23 nt, Human
ggcaucaccagccgaaccugccu

SEQ ID NO: 456559 - RNA, 18 nt, Human
ggcaucaccaggauucua

SEQ ID NO: 456560 - RNA, 32 nt, Human
ggcaucacccgcucggcucugaagcggacgcc

SEQ ID NO: 456561 - RNA, 22 nt, Human
ggcaucacgcuaccugacuuca

SEQ ID NO: 456562 - RNA, 22 nt, Human
ggcaucacgcugccugacuuca

SEQ ID NO: 456563 - RNA, 19 nt, Human
ggcaucacguccacaugca

SEQ ID NO: 456564 - RNA, 32 nt, Human
ggcaucacuggcagaggauucguguagguggc

SEQ ID NO: 456565 - RNA, 32 nt, Human
ggcaucacuuucuccuccuccucaugcccugc

SEQ ID NO: 456566 - RNA, 19 nt, Human
ggcaucagagccucacaga

SEQ ID NO: 456567 - RNA, 23 nt, Human
ggcaucagauggagcacacaggu

SEQ ID NO: 456568 - RNA, 22 nt, Human
ggcaucagauuccugauccaca

SEQ ID NO: 456569 - RNA, 32 nt, Human
ggcaucagcagucacagagcaccaagccaaaa

SEQ ID NO: 456570 - RNA, 32 nt, Human
ggcaucagcaucagcccuuccucccagagccc

SEQ ID NO: 456571 - RNA, 32 nt, Human
ggcaucagccaccacacccagccaacuuaacu

SEQ ID NO: 456572 - RNA, 32 nt, Human
ggcaucagccaccacacccagccgucauugga

SEQ ID NO: 456573 - RNA, 32 nt, Human
ggcaucagccaccacaccuggccuugaacauu

SEQ ID NO: 456574 - RNA, 32 nt, Human
ggcaucagccaucuugcuugagaaccaccaag

SEQ ID NO: 456575 - RNA, 20 nt, Human
ggcaucagccucauaccuaa

SEQ ID NO: 456576 - RNA, 24 nt, Human
ggcaucagccugcuguugaucaca

SEQ ID NO: 456577 - RNA, 32 nt, Human
ggcaucagcguuucaugcucugccuuuuagcu

SEQ ID NO: 456578 - RNA, 18 nt, Human
ggcaucagcuaccugggc

SEQ ID NO: 456579 - RNA, 32 nt, Human
ggcaucagcuguuggaaaccugggcagcccuc

SEQ ID NO: 456580 - RNA, 32 nt, Human
ggcaucaggccccagccuuggccugaaaccuc

SEQ ID NO: 456581 - RNA, 19 nt, Human
ggcaucaggcugcuuggac

SEQ ID NO: 456582 - RNA, 24 nt, Human
ggcaucagggaaauauuuguuaca

SEQ ID NO: 456583 - RNA, 32 nt, Human
ggcaucagggccuuucuccuccccaccuguag

SEQ ID NO: 456584 - RNA, 32 nt, Human
ggcaucagguucuaaaauaagcucguaauuuu

SEQ ID NO: 456585 - RNA, 32 nt, Human
ggcaucaguacacaucauccuccucacuccag

SEQ ID NO: 456586 - RNA, 32 nt, Human
ggcaucaguguccaggaguagcuguauuugag

SEQ ID NO: 456587 - RNA, 32 nt, Human
ggcaucauccaauuuucuucccaaaccucugc

SEQ ID NO: 456588 - RNA, 23 nt, Human
ggcaucaucugcccccggcuaca

SEQ ID NO: 456589 - RNA, 32 nt, Human
ggcaucaugaucuuugccuuccuugaaaauac

SEQ ID NO: 456590 - RNA, 32 nt, Human
ggcaucaugcaucuguacuguaccaaaagugu

SEQ ID NO: 456591 - RNA, 32 nt, Human
ggcaucauggggacaaaaggaaaccucugacu

SEQ ID NO: 456592 - RNA, 32 nt, Human
ggcaucauugcauuccagccugggcaacagag

SEQ ID NO: 456593 - RNA, 22 nt, Human
ggcaucauuuauaguagcaaaa

SEQ ID NO: 456594 - RNA, 32 nt, Human
ggcauccaauccagagggguccacucuagagg

SEQ ID NO: 456595 - RNA, 22 nt, Human
ggcauccacaccuccauuuuau

SEQ ID NO: 456596 - RNA, 32 nt, Human
ggcauccacuugugguaaccccuuacgaugau

SEQ ID NO: 456597 - RNA, 32 nt, Human
ggcauccagaagcagcugcaguguugcugcca

SEQ ID NO: 456598 - RNA, 32 nt, Human
ggcauccaggcagagggauugauguccgaaga

SEQ ID NO: 456599 - RNA, 32 nt, Human
ggcauccaggcagguccagcaguccuggcggg

SEQ ID NO: 456600 - RNA, 32 nt, Human
ggcauccagggugauuagggggcagucgagga

SEQ ID NO: 456601 - RNA, 32 nt, Human
ggcauccaguacagaggggcuggacuuggacc

SEQ ID NO: 456602 - RNA, 32 nt, Human
ggcauccauacaccccagaagacuucccaaau

SEQ ID NO: 456603 - RNA, 32 nt, Human
ggcauccaucaucuguagcauuucuccuuugu

SEQ ID NO: 456604 - RNA, 32 nt, Human
ggcauccauuccaaucaagaaaugauggugcu

SEQ ID NO: 456605 - RNA, 32 nt, Human
ggcaucccaaagugcugggauuacaagaauga

SEQ ID NO: 456606 - RNA, 32 nt, Human
ggcaucccaaagugcugggauuacagcauccc

SEQ ID NO: 456607 - RNA, 32 nt, Human
ggcaucccaaagugcugggauuacgagcguga

SEQ ID NO: 456608 - RNA, 32 nt, Human
ggcaucccaaaguguugggauuauaggcacga

SEQ ID NO: 456609 - RNA, 32 nt, Human
ggcaucccaagaccucaucugccugcaguguc

SEQ ID NO: 456610 - RNA, 32 nt, Human
ggcaucccaggauuuggaauucagcugugagc

SEQ ID NO: 456611 - RNA, 32 nt, Human
ggcaucccaggccuuccuccugacugacuucu

SEQ ID NO: 456612 - RNA, 32 nt, Human
ggcaucccaugcacuccacuucucaggaucua

SEQ ID NO: 456613 - RNA, 32 nt, Human
ggcauccccaggcugcccagaccuaagggcuu

SEQ ID NO: 456614 - RNA, 32 nt, Human
ggcauccccucccagguuuucagccagugccu

SEQ ID NO: 456615 - RNA, 18 nt, Human
ggcauccccucgccugga

SEQ ID NO: 456616 - RNA, 32 nt, Human
ggcauccccuucuccaccugguaaaugcugcc

SEQ ID NO: 456617 - RNA, 32 nt, Human
ggcaucccuaaagcucacucugaagauguuag

SEQ ID NO: 456618 - RNA, 19 nt, Human
ggcaucccuaccgccugga

SEQ ID NO: 456619 - RNA, 32 nt, Human
ggcaucccuccugguaccaagcugcugggugc

SEQ ID NO: 456620 - RNA, 32 nt, Human
ggcaucccugcccugccuccagccuugguggc

SEQ ID NO: 456621 - RNA, 32 nt, Human
ggcaucccugcucccugcccugggucccagac

SEQ ID NO: 456622 - RNA, 21 nt, Human
ggcaucccuggggaccugggc

SEQ ID NO: 456623 - RNA, 19 nt, Human
ggcauccgagaugcugggc

SEQ ID NO: 456624 - RNA, 32 nt, Human
ggcauccgcuuuggcuggagcucucagugcgu

SEQ ID NO: 456625 - RNA, 32 nt, Human
ggcauccggagcuuccugaggacacaccagca

SEQ ID NO: 456626 - RNA, 32 nt, Human
ggcauccggcuaccugcccucccugccuuccc

SEQ ID NO: 456627 - RNA, 32 nt, Human
ggcauccgggcccgcuacucgcccacugggag

SEQ ID NO: 456628 - RNA, 32 nt, Human
ggcauccuaaagugcugagaugacaggcauga

SEQ ID NO: 456629 - RNA, 32 nt, Human
ggcauccuaaagugcugggauuacaggcguga

SEQ ID NO: 456630 - RNA, 32 nt, Human
ggcauccuaccaacagcaccaucaaggcacgu

SEQ ID NO: 456631 - RNA, 19 nt, Human
ggcauccucagaugucagc

SEQ ID NO: 456632 - RNA, 18 nt, Human
ggcauccucauccuguac

SEQ ID NO: 456633 - RNA, 32 nt, Human
ggcauccuccuccugggauuccuguggccucc

SEQ ID NO: 456634 - RNA, 32 nt, Human
ggcauccucgugaaagugcacacacuucaugg

SEQ ID NO: 456635 - RNA, 32 nt, Human
ggcauccucucucugcuggucaacccugucca

SEQ ID NO: 456636 - RNA, 32 nt, Human
ggcauccugacaggcacagugagacccuugcu

SEQ ID NO: 456637 - RNA, 18 nt, Human
ggcauccugacgcuggac

SEQ ID NO: 456638 - RNA, 32 nt, Human
ggcauccugaguccuggcccuccugggaucug

SEQ ID NO: 456639 - RNA, 16 nt, Human
ggcauccugccugggc

SEQ ID NO: 456640 - RNA, 18 nt, Human
ggcauccuggcgcuggac

SEQ ID NO: 456641 - RNA, 32 nt, Human
ggcauccuucaguucaaucaaguugugccuaa

SEQ ID NO: 456642 - RNA, 32 nt, Human
ggcauccuugaggaccuccaccugggagaugc

SEQ ID NO: 456643 - RNA, 32 nt, Human
ggcaucgcuugguuccugaugcccauguucca

SEQ ID NO: 456644 - RNA, 32 nt, Human
ggcaucggcaagaaaaagaaggugguggccgu

SEQ ID NO: 456645 - RNA, 32 nt, Human
ggcaucgggccagggaaaaccucggauuagca

SEQ ID NO: 456646 - RNA, 32 nt, Human
ggcaucgguucuccucacucuccagccuguug

SEQ ID NO: 456647 - RNA, 32 nt, Human
ggcaucgucuaugcuucccuugcccucuccag

SEQ ID NO: 456648 - RNA, 32 nt, Human
ggcaucgucucugggcccuccuuucccccuuu

SEQ ID NO: 456649 - RNA, 19 nt, Human
ggcaucguguccacgcuca

SEQ ID NO: 456650 - RNA, 20 nt, Human
ggcaucuacacagccuggac

SEQ ID NO: 456651 - RNA, 32 nt, Human
ggcaucuagcauuugccuccuccacaaagaag

SEQ ID NO: 456652 - RNA, 32 nt, Human
ggcaucuagggagggugugggaaggucaagau

SEQ ID NO: 456653 - RNA, 32 nt, Human
ggcaucuauuccugcccccaucaugccccaca

SEQ ID NO: 456654 - RNA, 31 nt, Human
ggcaucucaauaaaacuguuucgaaaagaag

SEQ ID NO: 456655 - RNA, 32 nt, Human
ggcaucucacguacccccaucugagaccucuu

SEQ ID NO: 456656 - RNA, 32 nt, Human
ggcaucuccagccucaggccggcagguccuau

SEQ ID NO: 456657 - RNA, 32 nt, Human
ggcaucuccuacucuccauuuauauucuaugg

SEQ ID NO: 456658 - RNA, 32 nt, Human
ggcaucuccugucacauugggaaaugaagaau

SEQ ID NO: 456659 - RNA, 16 nt, Human
ggcaucuccuucugca

SEQ ID NO: 456660 - RNA, 32 nt, Human
ggcaucucggcccuggcuccagcuccggcucc

SEQ ID NO: 456661 - RNA, 23 nt, Human
ggcaucucgguccauucugccca

SEQ ID NO: 456662 - RNA, 32 nt, Human
ggcaucucucuagccugguagaaucuuacuau

SEQ ID NO: 456663 - RNA, 32 nt, Human
ggcaucucugagaaaguggccccagggagaga

SEQ ID NO: 456664 - RNA, 32 nt, Human
ggcaucucugggcuggaugagcucccacaagc

SEQ ID NO: 456665 - RNA, 32 nt, Human
ggcaucugacuucacacugagcugagccuauc

SEQ ID NO: 456666 - RNA, 32 nt, Human
ggcaucugagugaaguguccccagggacaucu

SEQ ID NO: 456667 - RNA, 32 nt, Human
ggcaucugcacuccagcccaggacuguggucu

SEQ ID NO: 456668 - RNA, 32 nt, Human
ggcaucugccacugcugcugacugccacuacc

SEQ ID NO: 456669 - RNA, 32 nt, Human
ggcaucugcccaggacagaagccauggcauau

SEQ ID NO: 456670 - RNA, 32 nt, Human
ggcaucugccuguagucccagcuacucgggag

SEQ ID NO: 456671 - RNA, 32 nt, Human
ggcaucugccuuccagaaucucucucuggcuu

SEQ ID NO: 456672 - RNA, 19 nt, Human
ggcaucuggaagccugggc

SEQ ID NO: 456673 - RNA, 32 nt, Human
ggcaucuggcagcaagaaggugaggcaucagg

SEQ ID NO: 456674 - RNA, 32 nt, Human
ggcaucugggguuguggcuggggaaggacggg

SEQ ID NO: 456675 - RNA, 32 nt, Human
ggcaucugguuacugguuauuuuaaaaagaau

SEQ ID NO: 456676 - RNA, 32 nt, Human
ggcaucugguugaccccagccuggggaggagg

SEQ ID NO: 456677 - RNA, 32 nt, Human
ggcaucugguuucuaaaaauuuauuugaaaca

SEQ ID NO: 456678 - RNA, 32 nt, Human
ggcaucuguagucccagcuaauuggaagggug

SEQ ID NO: 456679 - RNA, 32 nt, Human
ggcaucuguagucccagcuacucaggaggcug

SEQ ID NO: 456680 - RNA, 32 nt, Human
ggcaucuguagucccagcuacuugggaagcug

SEQ ID NO: 456681 - RNA, 32 nt, Human
ggcaucuguccacccaugugguuccagacacg

SEQ ID NO: 456682 - RNA, 32 nt, Human
ggcaucuguggacucaaggaguccaggugacg

SEQ ID NO: 456683 - RNA, 23 nt, Human
ggcaucuguguccaaccugguca

SEQ ID NO: 456684 - RNA, 31 nt, Human
ggcaucuuaauagacuucuguugaaaacuuc

SEQ ID NO: 456685 - RNA, 32 nt, Human
ggcaucuuaucuagguccgugcagcccaaggg

SEQ ID NO: 456686 - RNA, 32 nt, Human
ggcaucuucucaggcagaggugcaaccugucg

SEQ ID NO: 456687 - RNA, 32 nt, Human
ggcaucuucuugugguguaguccccuuggaac

SEQ ID NO: 456688 - RNA, 18 nt, Human
ggcaucuugccccuugac

SEQ ID NO: 456689 - RNA, 22 nt, Human
ggcaucuugcucaccgcccuga

SEQ ID NO: 456690 - RNA, 20 nt, Human
ggcaucuuuagacaccugga

SEQ ID NO: 456691 - RNA, 32 nt, Human
ggcaucuuugcaugaagaaagcagaaguuuac

SEQ ID NO: 456692 - RNA, 32 nt, Human
ggcaucuuugccugcccugccuugcuuggccc

SEQ ID NO: 456693 - RNA, 32 nt, Human
ggcaugaaaaccuuggcuucagccucugagau

SEQ ID NO: 456694 - RNA, 32 nt, Human
ggcaugaaccaccacgccuggccuaaaauguu

SEQ ID NO: 456695 - RNA, 32 nt, Human
ggcaugaaccccaggcuggagugcaguggcuc

SEQ ID NO: 456696 - RNA, 32 nt, Human
ggcaugaagcugcauaugauagaugacaaauu

SEQ ID NO: 456697 - RNA, 32 nt, Human
ggcaugaauauggcagagucuucauauggaaa

SEQ ID NO: 456698 - RNA, 17 nt, Human
ggcaugaaugccugggc

SEQ ID NO: 456699 - RNA, 32 nt, Human
ggcaugacaagaaaaucuuaaaaacaggaaaa

SEQ ID NO: 456700 - RNA, 32 nt, Human
ggcaugacagcccuuggcuugcugggggagga

SEQ ID NO: 456701 - RNA, 25 nt, Human
ggcaugaccaagaacaccuggcuac

SEQ ID NO: 456702 - RNA, 32 nt, Human
ggcaugacccagccuaugguuugccauacucc

SEQ ID NO: 456703 - RNA, 32 nt, Human
ggcaugaccucagcuccacuuuugaggcugca

SEQ ID NO: 456704 - RNA, 32 nt, Human
ggcaugacucuucaaccccgaggucccuguug

SEQ ID NO: 456705 - RNA, 32 nt, Human
ggcaugacugacauacauacucaaauauaggc

SEQ ID NO: 456706 - RNA, 32 nt, Human
ggcaugacuuaggcucuuuacccuccaacuua

SEQ ID NO: 456707 - RNA, 32 nt, Human
ggcaugacuuccuggcaccacagggaaaaucg

SEQ ID NO: 456708 - RNA, 32 nt, Human
ggcaugagccaccacacccagccccuuuccaa

SEQ ID NO: 456709 - RNA, 32 nt, Human
ggcaugagccaccacacccagcccggacagcu

SEQ ID NO: 456710 - RNA, 32 nt, Human
ggcaugagccaccacacccagccuccucuucu

SEQ ID NO: 456711 - RNA, 32 nt, Human
ggcaugagccaccacacccagccuucagcugu

SEQ ID NO: 456712 - RNA, 32 nt, Human
ggcaugagccaccacacccagccuuuauugca

SEQ ID NO: 456713 - RNA, 32 nt, Human
ggcaugagccaccacacccagcuccucccccu

SEQ ID NO: 456714 - RNA, 32 nt, Human
ggcaugagccaccacacccggccugaguagag

SEQ ID NO: 456715 - RNA, 32 nt, Human
ggcaugagccaccacacccugcccauguguuc

SEQ ID NO: 456716 - RNA, 32 nt, Human
ggcaugagccaccacaccuggauugccauauu

SEQ ID NO: 456717 - RNA, 32 nt, Human
ggcaugagccaccacaccuggcuacuuuauau

SEQ ID NO: 456718 - RNA, 32 nt, Human
ggcaugagccaccacaccuugccacaaaugug

SEQ ID NO: 456719 - RNA, 32 nt, Human
ggcaugagccaccacacuggcaaaugucuaca

SEQ ID NO: 456720 - RNA, 32 nt, Human
ggcaugagccaccacauccggccuaauuacuu

SEQ ID NO: 456721 - RNA, 32 nt, Human
ggcaugagccaccacaucuggccuaggaccuu

SEQ ID NO: 456722 - RNA, 19 nt, Human
ggcaugagccaccacggcc

SEQ ID NO: 456723 - RNA, 32 nt, Human
ggcaugagccaccgcacccagccugguuauug

SEQ ID NO: 456724 - RNA, 32 nt, Human
ggcaugagccacugcacccaaccccuggaaaa

SEQ ID NO: 456725 - RNA, 32 nt, Human
ggcaugagccacugcacccagccuuggcgggc

SEQ ID NO: 456726 - RNA, 32 nt, Human
ggcaugagccacugcacccggccgguggaaag

SEQ ID NO: 456727 - RNA, 32 nt, Human
ggcaugagccacugcaccuggcccacuuuaac

SEQ ID NO: 456728 - RNA, 32 nt, Human
ggcaugagccacugcaccuggccgguuauucu

SEQ ID NO: 456729 - RNA, 32 nt, Human
ggcaugagccacugcaccuggccuacguauua

SEQ ID NO: 456730 - RNA, 32 nt, Human
ggcaugagccacugcaccuggccuaggacugg

SEQ ID NO: 456731 - RNA, 32 nt, Human
ggcaugagccacugugccuggccaacauaaug

SEQ ID NO: 456732 - RNA, 32 nt, Human
ggcaugaguuagucgcagacauggacaccaaa

SEQ ID NO: 456733 - RNA, 22 nt, Human
ggcaugaucucagcucacugca

SEQ ID NO: 456734 - RNA, 32 nt, Human
ggcaugaucucagcuccgccuccuggguucac

SEQ ID NO: 456735 - RNA, 32 nt, Human
ggcaugaucucggcucacuacaagcucugccu

SEQ ID NO: 456736 - RNA, 32 nt, Human
ggcaugauggggagagaccagacugaaucuac

SEQ ID NO: 456737 - RNA, 32 nt, Human
ggcaugauguucugcuucugucaguuauucuu

SEQ ID NO: 456738 - RNA, 32 nt, Human
ggcaugauucucucaggcuucugccccgaggc

SEQ ID NO: 456739 - RNA, 19 nt, Human
ggcaugcaaccacaaggug

SEQ ID NO: 456740 - RNA, 19 nt, Human
ggcaugcacacauaucucc

SEQ ID NO: 456741 - RNA, 32 nt, Human
ggcaugcaccaccacaccuggcuaguuuuugu

SEQ ID NO: 456742 - RNA, 32 nt, Human
ggcaugcaccaccacgcccagcuuauuuugua

SEQ ID NO: 456743 - RNA, 32 nt, Human
ggcaugcaccaccacgcccagcuuugaauccg

SEQ ID NO: 456744 - RNA, 32 nt, Human
ggcaugcaccuguaaucccagcuacuugggag

SEQ ID NO: 456745 - RNA, 32 nt, Human
ggcaugcagccugucggcagagugucuuaaca

SEQ ID NO: 456746 - RNA, 32 nt, Human
ggcaugcaggagguggaggaauuaagugaaac

SEQ ID NO: 456747 - RNA, 32 nt, Human
ggcaugcagggaaucccauccagcgucccucu

SEQ ID NO: 456748 - RNA, 32 nt, Human
ggcaugcaggguggaaccaggccugccuucca

SEQ ID NO: 456749 - RNA, 32 nt, Human
ggcaugcaucugugagcuuuagaucauuaaau

SEQ ID NO: 456750 - RNA, 18 nt, Human
ggcaugccaagggggcug

SEQ ID NO: 456751 - RNA, 19 nt, Human
ggcaugccaaguccugcug

SEQ ID NO: 456752 - RNA, 32 nt, Human
ggcaugccagccugggcgaugcugcagugacc

SEQ ID NO: 456753 - RNA, 32 nt, Human
ggcaugccauuacauugcuuuuucuuguuugu

SEQ ID NO: 456754 - RNA, 32 nt, Human
ggcaugcccaagggaggaagcagagggaggca

SEQ ID NO: 456755 - RNA, 32 nt, Human
ggcaugccccuggguuggggugggugggagga

SEQ ID NO: 456756 - RNA, 32 nt, Human
ggcaugcccugguccaaguccucugucuuugu

SEQ ID NO: 456757 - RNA, 32 nt, Human
ggcaugcccuucucccccaucuccguguccuc

SEQ ID NO: 456758 - RNA, 32 nt, Human
ggcaugccuguaaucccagaauuuugggaggc

SEQ ID NO: 456759 - RNA, 32 nt, Human
ggcaugccuguacugcccucucccaagaaugc

SEQ ID NO: 456760 - RNA, 32 nt, Human
ggcaugccuuacuccaggugccuguguuuggc

SEQ ID NO: 456761 - RNA, 32 nt, Human
ggcaugcgccuguaaucccagcuacucaggaa

SEQ ID NO: 456762 - RNA, 32 nt, Human
ggcaugcgccuguaaucccagcuacucaggag

SEQ ID NO: 456763 - RNA, 32 nt, Human
ggcaugcgccuguaaucccagcuacucgggag

SEQ ID NO: 456764 - RNA, 32 nt, Human
ggcaugcgccuguaaucccagcuacuucggag

SEQ ID NO: 456765 - RNA, 32 nt, Human
ggcaugcgccuguaaucccggcuacucgggag

SEQ ID NO: 456766 - RNA, 32 nt, Human
ggcaugcgccugugaucccagcuacuuggaag

SEQ ID NO: 456767 - RNA, 32 nt, Human
ggcaugcggacccuucagggugccccaggcgc

SEQ ID NO: 456768 - RNA, 32 nt, Human
ggcaugcuccccucccccacagccucuuccuc

SEQ ID NO: 456769 - RNA, 32 nt, Human
ggcaugcugcaaggaucagagccagacaccag

SEQ ID NO: 456770 - RNA, 32 nt, Human
ggcaugcuggccucaugggcuugggggccuac

SEQ ID NO: 456771 - RNA, 22 nt, Human
ggcaugcuggcucaugccugua

SEQ ID NO: 456772 - RNA, 32 nt, Human
ggcaugcuuggaugcccagcuguguccagagg

SEQ ID NO: 456773 - RNA, 32 nt, Human
ggcauggaaggcagaggcuggguggggugggg

SEQ ID NO: 456774 - RNA, 19 nt, Human
ggcauggaauaaugccuag

SEQ ID NO: 456775 - RNA, 32 nt, Human
ggcauggaaucaggaccgugaacugccuagug

SEQ ID NO: 456776 - RNA, 32 nt, Human
ggcauggacugcugccaggcugcgugcgcccu

SEQ ID NO: 456777 - RNA, 17 nt, Human
ggcauggagcagaguga

SEQ ID NO: 456778 - RNA, 32 nt, Human
ggcauggaggagggugcaaagauauggguugc

SEQ ID NO: 456779 - RNA, 28 nt, Human
ggcauggaggggccccggagcuccaccc

SEQ ID NO: 456780 - RNA, 32 nt, Human
ggcauggagguggcaggcccugguucccucag

SEQ ID NO: 456781 - RNA, 28 nt, Human
ggcauggagguggcgcugcagacugagc

SEQ ID NO: 456782 - RNA, 32 nt, Human
ggcauggcacagcaguugcugcacaggagccc

SEQ ID NO: 456783 - RNA, 28 nt, Human
ggcauggcagaggcgcgaucccagcccu

SEQ ID NO: 456784 - RNA, 32 nt, Human
ggcauggcagcacuuaugcucugugacaguau

SEQ ID NO: 456785 - RNA, 32 nt, Human
ggcauggcaguggccucagccuuaaacuuuug

SEQ ID NO: 456786 - RNA, 32 nt, Human
ggcauggcauuacauauuauauguucuagaaa

SEQ ID NO: 456787 - RNA, 17 nt, Human
ggcauggcccugggguc

SEQ ID NO: 456788 - RNA, 32 nt, Human
ggcauggccuccaccaagcucagcccuuggga

SEQ ID NO: 456789 - RNA, 32 nt, Human
ggcauggcucuaccucccaaccccucccaacc

SEQ ID NO: 456790 - RNA, 32 nt, Human
ggcauggcugaguaccccagacgucuggucca

SEQ ID NO: 456791 - RNA, 32 nt, Human
ggcauggcugcugugguggacaagauacgaga

SEQ ID NO: 456792 - RNA, 28 nt, Human
ggcauggcuggaaaugugcagcuuugcu

SEQ ID NO: 456793 - RNA, 32 nt, Human
ggcauggcuuguaucugcaguguccuugcugu

SEQ ID NO: 456794 - RNA, 32 nt, Human
ggcaugggaagcccucucuaggaggaugcugu

SEQ ID NO: 456795 - RNA, 32 nt, Human
ggcaugggaaugaaugucagugugacugaucu

SEQ ID NO: 456796 - RNA, 32 nt, Human
ggcaugggacuggcccaggcacacaggucccg

SEQ ID NO: 456797 - RNA, 32 nt, Human
ggcaugggagagaaacgggcuggggagugagg

SEQ ID NO: 456798 - RNA, 32 nt, Human
ggcaugggagagaagggaggaggugggcacag

SEQ ID NO: 456799 - RNA, 32 nt, Human
ggcaugggagagagugggaugaacagaccucu

SEQ ID NO: 456800 - RNA, 32 nt, Human
ggcaugggagcuaaaaauccugugauacuaag

SEQ ID NO: 456801 - RNA, 32 nt, Human
ggcaugggaugcuccaggaggucugggguacc

SEQ ID NO: 456802 - RNA, 32 nt, Human
ggcauggggaaagaggaggaagagcauuagga

SEQ ID NO: 456803 - RNA, 32 nt, Human
ggcauggggcacuccuagccagugagucaugg

SEQ ID NO: 456804 - RNA, 32 nt, Human
ggcauggggcaggaggcagccacccacaccuu

SEQ ID NO: 456805 - RNA, 32 nt, Human
ggcaugggggcagaggugaaucagaugacagc

SEQ ID NO: 456806 - RNA, 31 nt, Human
ggcauggggguggggccucagaugcuggggc

SEQ ID NO: 456807 - RNA, 31 nt, Human
ggcauggguaccugcauuucacuggaauggg

SEQ ID NO: 456808 - RNA, 22 nt, Human
ggcaugguagcucaugccugua

SEQ ID NO: 456809 - RNA, 19 nt, Human
ggcaugguaguucacaccu

SEQ ID NO: 456810 - RNA, 28 nt, Human
ggcaugguccaagaacuggaccuuaccc

SEQ ID NO: 456811 - RNA, 32 nt, Human
ggcauggucccucccauucuggcuccaccugc

SEQ ID NO: 456812 - RNA, 32 nt, Human
ggcaugguccucaagugaguucuuaguauuuu

SEQ ID NO: 456813 - RNA, 32 nt, Human
ggcaugguccuggaggaugaccaggacuaaug

SEQ ID NO: 456814 - RNA, 32 nt, Human
ggcauggucucaucuccgcaucaggaauucac

SEQ ID NO: 456815 - RNA, 24 nt, Human
ggcauggucugcccucugcauccu

SEQ ID NO: 456816 - RNA, 22 nt, Human
ggcauggugacucauaccugua

SEQ ID NO: 456817 - RNA, 31 nt, Human
ggcauggugcuuuucugagcagaucaauacu

SEQ ID NO: 456818 - RNA, 22 nt, Human
ggcaugguggcaaguaccugua

SEQ ID NO: 456819 - RNA, 22 nt, Human
ggcaugguggcacaugccugua

SEQ ID NO: 456820 - RNA, 22 nt, Human
ggcaugguggcacaugcuugua

SEQ ID NO: 456821 - RNA, 22 nt, Human
ggcaugguggcauaugccugua

SEQ ID NO: 456822 - RNA, 22 nt, Human
ggcaugguggcgcaugccugua

SEQ ID NO: 456823 - RNA, 22 nt, Human
ggcaugguggcgcgugccugua

SEQ ID NO: 456824 - RNA, 22 nt, Human
ggcaugguggcguaugccugua

SEQ ID NO: 456825 - RNA, 22 nt, Human
ggcaugguggcucaagccugua

SEQ ID NO: 456826 - RNA, 22 nt, Human
ggcaugguggcucacaccugua

SEQ ID NO: 456827 - RNA, 22 nt, Human
ggcaugguggcucacgccugua

SEQ ID NO: 456828 - RNA, 32 nt, Human
ggcaugguggcucagagguuugggaggcccag

SEQ ID NO: 456829 - RNA, 22 nt, Human
ggcaugguggcucaggccugua

SEQ ID NO: 456830 - RNA, 22 nt, Human
ggcaugguggcucaugccugua

SEQ ID NO: 456831 - RNA, 22 nt, Human
ggcaugguggcucaugccugug

SEQ ID NO: 456832 - RNA, 22 nt, Human
ggcaugguggcucaugcuugua

SEQ ID NO: 456833 - RNA, 22 nt, Human
ggcaugguggugcaugccugua

SEQ ID NO: 456834 - RNA, 32 nt, Human
ggcauggugguggcacccaucuguagucccag

SEQ ID NO: 456835 - RNA, 20 nt, Human
ggcauggugguuuacaccua

SEQ ID NO: 456836 - RNA, 32 nt, Human
ggcaugguuacaucauuugaacucucugacaa

SEQ ID NO: 456837 - RNA, 32 nt, Human
ggcaugguuucacagagacucauuccagugga

SEQ ID NO: 456838 - RNA, 22 nt, Human
ggcaugguuugcggagguuaga

SEQ ID NO: 456839 - RNA, 32 nt, Human
ggcccugcuucaggaagcaucaggacuaacua

SEQ ID NO: 456840 - RNA, 23 nt, Human
ggcccugcuucccauccuccucu

SEQ ID NO: 456841 - RNA, 18 nt, Human
ggcccugcuuccccaggg

SEQ ID NO: 456842 - RNA, 32 nt, Human
ggcccugcuucucugcuccccugggugauggg

SEQ ID NO: 456843 - RNA, 32 nt, Human
ggcccugcuugccuggccccagaagcuguuuu

SEQ ID NO: 456844 - RNA, 32 nt, Human
ggcccugcuugggaacaucucacgagcuuucc

SEQ ID NO: 456845 - RNA, 21 nt, Human
ggcccugcuuuccccagggug

SEQ ID NO: 456846 - RNA, 32 nt, Human
ggcccuggaagacaagggaggagccugugagc

SEQ ID NO: 456847 - RNA, 32 nt, Human
ggcccuggaagagacccgggucgccuccggag

SEQ ID NO: 456848 - RNA, 32 nt, Human
ggcccuggaagagacgucgccucgccuucauc

SEQ ID NO: 456849 - RNA, 22 nt, Human
ggcccuggaauugugggugagg

SEQ ID NO: 456850 - RNA, 21 nt, Human
ggcccuggacacccugccuga

SEQ ID NO: 456851 - RNA, 20 nt, Human
ggcccuggacaugcugcaga

SEQ ID NO: 456852 - RNA, 21 nt, Human
ggcccuggacccgucaggugc

SEQ ID NO: 456853 - RNA, 20 nt, Human
ggcccuggaccggcggcaga

SEQ ID NO: 456854 - RNA, 32 nt, Human
ggcccuggagagugggccugggugguaccugc

SEQ ID NO: 456855 - RNA, 32 nt, Human
ggcccuggagcagccaccccaugcuggccuug

SEQ ID NO: 456856 - RNA, 32 nt, Human
ggcccuggaggucaaggcugcagugagucaag

SEQ ID NO: 456857 - RNA, 18 nt, Human
ggcccuggagucgccaga

SEQ ID NO: 456858 - RNA, 32 nt, Human
ggcccuggauggcagcucuggcccagacauga

SEQ ID NO: 456859 - RNA, 18 nt, Human
ggcccuggcaggcagcca

SEQ ID NO: 456860 - RNA, 32 nt, Human
ggcccuggccagacguuuucuuugauuuuuaa

SEQ ID NO: 456861 - RNA, 32 nt, Human
ggcccuggcccagcucuggagugcaugugugu

SEQ ID NO: 456862 - RNA, 18 nt, Human
ggcccuggcccugagcca

SEQ ID NO: 456863 - RNA, 19 nt, Human
ggcccuggcccugcgcaga

SEQ ID NO: 456864 - RNA, 32 nt, Human
ggcccuggcccuggcccugauccugcuccuga

SEQ ID NO: 456865 - RNA, 32 nt, Human
ggcccuggccugauuccaagccaggcuuacuc

SEQ ID NO: 456866 - RNA, 32 nt, Human
ggcccuggccuuucacuccaguucugggugag

SEQ ID NO: 456867 - RNA, 19 nt, Human
ggcccuggcggggcaggcu

SEQ ID NO: 456868 - RNA, 20 nt, Human
ggcccuggcucaccagcguc

SEQ ID NO: 456869 - RNA, 18 nt, Human
ggcccuggcucugccaga

SEQ ID NO: 456870 - RNA, 18 nt, Human
ggcccuggcucugcuguc

SEQ ID NO: 456871 - RNA, 32 nt, Human
ggcccuggcucuguaaccauuaaccucuuccc

SEQ ID NO: 456872 - RNA, 32 nt, Human
ggcccuggcugcagagaccuucagugccaucc

SEQ ID NO: 456873 - RNA, 32 nt, Human
ggcccuggcugcagcuauggcucaagguggau

SEQ ID NO: 456874 - RNA, 23 nt, Human
ggcccuggcugcuucaugccaga

SEQ ID NO: 456875 - RNA, 32 nt, Human
ggcccuggcuuccuggguggcggugcggacug

SEQ ID NO: 456876 - RNA, 32 nt, Human
ggcccugggacgcugggcugcccgcucugccc

SEQ ID NO: 456877 - RNA, 32 nt, Human
ggcccugggacugcuucuccagccaggcuggg

SEQ ID NO: 456878 - RNA, 32 nt, Human
ggcccugggagagccguguccugagaagggcc

SEQ ID NO: 456879 - RNA, 32 nt, Human
ggcccugggaggaagcuggcugugguagcgua

SEQ ID NO: 456880 - RNA, 32 nt, Human
ggcccugggaggagagaagggggcagagucuu

SEQ ID NO: 456881 - RNA, 32 nt, Human
ggcccugggaggagguugagccuggggaagga

SEQ ID NO: 456882 - RNA, 19 nt, Human
ggcccugggagggcagcuu

SEQ ID NO: 456883 - RNA, 32 nt, Human
ggcccugggaggggcgcccggagccagccgcg

SEQ ID NO: 456884 - RNA, 32 nt, Human
ggcccugggaggucuugugaggucacacagag

SEQ ID NO: 456885 - RNA, 32 nt, Human
ggcccugggaucagccaaggcuugccugacug

SEQ ID NO: 456886 - RNA, 23 nt, Human
ggcccugggcagacccuggcaga

SEQ ID NO: 456887 - RNA, 32 nt, Human
ggcccugggcagccuccaggugcagugcccuc

SEQ ID NO: 456888 - RNA, 32 nt, Human
ggcccugggcaggcgguagccauggagcugug

SEQ ID NO: 456889 - RNA, 32 nt, Human
ggcccugggccaguggguuggaaggggagggu

SEQ ID NO: 456890 - RNA, 23 nt, Human
ggcccugggcccuuccuaucaga

SEQ ID NO: 456891 - RNA, 32 nt, Human
ggcccugggccuuaagagccagcucuuccuau

SEQ ID NO: 456892 - RNA, 18 nt, Human
ggcccugggcugggccuc

SEQ ID NO: 456893 - RNA, 32 nt, Human
ggcccugggcugggccuucucaccccuuccug

SEQ ID NO: 456894 - RNA, 32 nt, Human
ggcccuggggacccaugggagggggcugcugc

SEQ ID NO: 456895 - RNA, 32 nt, Human
ggcccuggggacgcauggcugaggcaggaaca

SEQ ID NO: 456896 - RNA, 23 nt, Human
ggcccuggggagcagccuucccu

SEQ ID NO: 456897 - RNA, 32 nt, Human
ggcccuggggaggcagggguuggugcccugac

SEQ ID NO: 456898 - RNA, 32 nt, Human
ggcccuggggagugucagaugggaagugcuuu

SEQ ID NO: 456899 - RNA, 32 nt, Human
ggcccuggggcaucucacagggaccaagcccu

SEQ ID NO: 456900 - RNA, 32 nt, Human
ggcccuggggccagcccgcacacaccaugccu

SEQ ID NO: 456901 - RNA, 18 nt, Human
ggcccuggggccccgggg

SEQ ID NO: 456902 - RNA, 20 nt, Human
ggcccuggggcccugccgga

SEQ ID NO: 456903 - RNA, 25 nt, Human
ggcccugggggucuaggggugcagg

SEQ ID NO: 456904 - RNA, 32 nt, Human
ggcccuggggucuugcuggggcccauaggcau

SEQ ID NO: 456905 - RNA, 32 nt, Human
ggcccugggguuuuagccucuggcccaggagu

SEQ ID NO: 456906 - RNA, 32 nt, Human
ggcccugggguuuuagccucuggcccgggagu

SEQ ID NO: 456907 - RNA, 32 nt, Human
ggcccuggguggguaccaacagcugcucgcug

SEQ ID NO: 456908 - RNA, 32 nt, Human
ggcccuggguuagagucugggcguggacgcgc

SEQ ID NO: 456909 - RNA, 23 nt, Human
ggcccuggguucuugcugcugcc

SEQ ID NO: 456910 - RNA, 32 nt, Human
ggcccuggucccagcaugucaguccucucuug

SEQ ID NO: 456911 - RNA, 22 nt, Human
ggcccugguggacuccagggug

SEQ ID NO: 456912 - RNA, 23 nt, Human
ggcccugguggaggagcccaggg

SEQ ID NO: 456913 - RNA, 22 nt, Human
ggcccugguggccuccagggug

SEQ ID NO: 456914 - RNA, 19 nt, Human
ggcccugguuccugcuguc

SEQ ID NO: 456915 - RNA, 32 nt, Human
ggcccugucaccgacgggucaccucgcccaca

SEQ ID NO: 456916 - RNA, 21 nt, Human
ggcccugucacuccacagaug

SEQ ID NO: 456917 - RNA, 32 nt, Human
ggcccugucacugacccuggccuguggugguc

SEQ ID NO: 456918 - RNA, 32 nt, Human
ggcccuguccuggcccaggccucugcccucug

SEQ ID NO: 456919 - RNA, 21 nt, Human
ggcccuguccuugcugccaga

SEQ ID NO: 456920 - RNA, 32 nt, Human
ggcccugucgauggacuuaacugugaaaauca

SEQ ID NO: 456921 - RNA, 32 nt, Human
ggcccugucgcccaggcuggagugccauggcg

SEQ ID NO: 456922 - RNA, 32 nt, Human
ggcccugucucccagccacuuucccuccuggc

SEQ ID NO: 456923 - RNA, 32 nt, Human
ggcccugucuucugaagucucaggcuuagaag

SEQ ID NO: 456924 - RNA, 22 nt, Human
ggcccugugauuuugccuccca

SEQ ID NO: 456925 - RNA, 32 nt, Human
ggcccugugcaggagugcgauccgggcugggc

SEQ ID NO: 456926 - RNA, 32 nt, Human
ggcccugugcaggugcccggggcaugaggggc

SEQ ID NO: 456927 - RNA, 32 nt, Human
ggcccugugccacccuuccccucacauguagg

SEQ ID NO: 456928 - RNA, 32 nt, Human
ggcccugugccagugaggacaggagacccuaa

SEQ ID NO: 456929 - RNA, 18 nt, Human
ggcccugugccccuugac

SEQ ID NO: 456930 - RNA, 32 nt, Human
ggcccugugcccucgaucuauuuccuucuucc

SEQ ID NO: 456931 - RNA, 32 nt, Human
ggcccugugcuagacagugcuggagacauagu

SEQ ID NO: 456932 - RNA, 32 nt, Human
ggcccugugcugccugccucauaguaucugcc

SEQ ID NO: 456933 - RNA, 32 nt, Human
ggcccugugcugggggugguagaaaggaugcu

SEQ ID NO: 456934 - RNA, 32 nt, Human
ggcccuguggacuuucacccagcacugugggg

SEQ ID NO: 456935 - RNA, 23 nt, Human
ggcccuguggccaggcaccagcc

SEQ ID NO: 456936 - RNA, 32 nt, Human
ggcccuguggcuccaggagcagcgugcaggag

SEQ ID NO: 456937 - RNA, 32 nt, Human
ggcccuguggucacagccucagggggccaggc

SEQ ID NO: 456938 - RNA, 20 nt, Human
ggcccugugguggggcagcu

SEQ ID NO: 456939 - RNA, 32 nt, Human
ggcccugugugggcauaacagaaggcucgcac

SEQ ID NO: 456940 - RNA, 21 nt, Human
ggcccuguucaaccccagggu

SEQ ID NO: 456941 - RNA, 32 nt, Human
ggcccuguucucucuggggucccacacugggg

SEQ ID NO: 456942 - RNA, 19 nt, Human
ggcccuguucuugccccag

SEQ ID NO: 456943 - RNA, 32 nt, Human
ggcccuguuggggaggggaggggagcucaagg

SEQ ID NO: 456944 - RNA, 32 nt, Human
ggcccuguugggggaggugggcccggagcugg

SEQ ID NO: 456945 - RNA, 32 nt, Human
ggcccuuagggaggaggaggcgagaagauggc

SEQ ID NO: 456946 - RNA, 18 nt, Human
ggcccuuauccuguuacc

SEQ ID NO: 456947 - RNA, 32 nt, Human
ggcccuucacccagagccaguguggucaguau

SEQ ID NO: 456948 - RNA, 18 nt, Human
ggcccuucagccccaggg

SEQ ID NO: 456949 - RNA, 32 nt, Human
ggcccuucagccuuugggaacagggucagcau

SEQ ID NO: 456950 - RNA, 32 nt, Human
ggcccuucaggggauggccacugugaaggacg

SEQ ID NO: 456951 - RNA, 18 nt, Human
ggcccuucaucugcugcu

SEQ ID NO: 456952 - RNA, 32 nt, Human
ggcccuucaugaccuugcugggcacagaaaac

SEQ ID NO: 456953 - RNA, 32 nt, Human
ggcccuuccagcagccaugagggaaggacagg

SEQ ID NO: 456954 - RNA, 20 nt, Human
ggcccuuccagccccagccu

SEQ ID NO: 456955 - RNA, 32 nt, Human
ggcccuuccagcuccaguucugcccaggucac

SEQ ID NO: 456956 - RNA, 32 nt, Human
ggcccuuccaggagucauggucugccugccug

SEQ ID NO: 456957 - RNA, 32 nt, Human
ggcccuuccauuucucuucuuugaccgugcua

SEQ ID NO: 456958 - RNA, 26 nt, Human
ggcccuucccauucugccccagagug

SEQ ID NO: 456959 - RNA, 32 nt, Human
ggcccuucccauucugccccagagugggucuu

SEQ ID NO: 456960 - RNA, 17 nt, Human
ggcccuucccccagcug

SEQ ID NO: 456961 - RNA, 18 nt, Human
ggcccuuccccugccagg

SEQ ID NO: 456962 - RNA, 20 nt, Human
ggcccuucccuucugcugcc

SEQ ID NO: 456963 - RNA, 20 nt, Human
ggcccuuccucaccaggguc

SEQ ID NO: 456964 - RNA, 32 nt, Human
ggcccuuccuggccgccugccacaccgcaagc

SEQ ID NO: 456965 - RNA, 32 nt, Human
ggcccuucgcucucccccagccccaccaugau

SEQ ID NO: 456966 - RNA, 20 nt, Human
ggcccuucgcucuugcugcc

SEQ ID NO: 456967 - RNA, 32 nt, Human
ggcccuucucagccacacuucccaccccaggg

SEQ ID NO: 456968 - RNA, 19 nt, Human
ggcccuucucagccccucc

SEQ ID NO: 456969 - RNA, 32 nt, Human
ggcccuucucaguuuucucccacauucacccc

SEQ ID NO: 456970 - RNA, 32 nt, Human
ggcccuucuccucuuccuggacucaaggcucu

SEQ ID NO: 456971 - RNA, 32 nt, Human
ggcccuucucuaggaagcaggagucgcggcga

SEQ ID NO: 456972 - RNA, 32 nt, Human
ggcccuucucugcuuggauggugucuuccucu

SEQ ID NO: 456973 - RNA, 32 nt, Human
ggcccuucucuucugugggucugcaccaggua

SEQ ID NO: 456974 - RNA, 32 nt, Human
ggcccuucuuuauuccagggacuuagaaacuu

SEQ ID NO: 456975 - RNA, 32 nt, Human
ggcccuugaagcuccuugaggggcaaggccca

SEQ ID NO: 456976 - RNA, 32 nt, Human
ggcccuugccaagagaggacaagagggagcca

SEQ ID NO: 456977 - RNA, 22 nt, Human
ggcccuugcccucuccuugcca

SEQ ID NO: 456978 - RNA, 19 nt, Human
ggcccuugcccuggcugcc

SEQ ID NO: 456979 - RNA, 32 nt, Human
ggcccuugccuguagucucagcacuuugggag

SEQ ID NO: 456980 - RNA, 32 nt, Human
ggcccuugcuuugcacgauuccugccucgacg

SEQ ID NO: 456981 - RNA, 32 nt, Human
ggcccuuggauggugccugugugccuggccuu

SEQ ID NO: 456982 - RNA, 19 nt, Human
ggcccuuggcccgcugcag

SEQ ID NO: 456983 - RNA, 20 nt, Human
ggcccuugggguguccugcc

SEQ ID NO: 456984 - RNA, 32 nt, Human
ggcccuuggucagagugggcagugccaggcuc

SEQ ID NO: 456985 - RNA, 32 nt, Human
ggcccuuggucuggacugaauugcccaagccc

SEQ ID NO: 456986 - RNA, 18 nt, Human
ggcccuugguggggagcu

SEQ ID NO: 456987 - RNA, 21 nt, Human
ggcccuuguugcccuagagug

SEQ ID NO: 456988 - RNA, 23 nt, Human
ggcccuuguuggggcacaaggug

SEQ ID NO: 456989 - RNA, 32 nt, Human
ggcccuuucacucccccgcccugggccucugc

SEQ ID NO: 456990 - RNA, 32 nt, Human
ggcccuuucuuauucuuuggcuccucauccac

SEQ ID NO: 456991 - RNA, 32 nt, Human
ggcccuuugaacugccuuguguucugugagaa

SEQ ID NO: 456992 - RNA, 32 nt, Human
ggcccuuugugcagugaacagcccuggcuggg

SEQ ID NO: 456993 - RNA, 32 nt, Human
ggcccuuuucagacuccugggcccuuggauac

SEQ ID NO: 456994 - RNA, 32 nt, Human
ggcccuuuuccuagucccugcaaccuguuuca

SEQ ID NO: 456995 - RNA, 32 nt, Human
ggcccuuuuccugcaugugccaccuccagugg

SEQ ID NO: 456996 - RNA, 32 nt, Human
ggcccuuuucuuccucuuccaagcucugagca

SEQ ID NO: 456997 - RNA, 32 nt, Human
ggcccuuuugucuggcugauucuguccucaaa

SEQ ID NO: 456998 - RNA, 18 nt, Human
ggccgaaccuccgcgaag

SEQ ID NO: 456999 - RNA, 32 nt, Human
ggccgaaccugauaccugccugggacagccac

SEQ ID NO: 457000 - RNA, 32 nt, Human
ggccgaagcaugcagaagcucaucaugggauu

SEQ ID NO: 457001 - RNA, 20 nt, Human
ggccgaagcccccagccagg

SEQ ID NO: 457002 - RNA, 32 nt, Human
ggccgaaggagaaggaggaagaggagaaggcg

SEQ ID NO: 457003 - RNA, 32 nt, Human
ggccgacaccacuccugccagcccggcucggc

SEQ ID NO: 457004 - RNA, 31 nt, Human
ggccgacacuuucauuaaaaaguuuccugag

SEQ ID NO: 457005 - RNA, 32 nt, Human
ggccgacagagcaagauucugucucaaaaaua

SEQ ID NO: 457006 - RNA, 32 nt, Human
ggccgacaugguaaaaccccacgucuaccaaa

SEQ ID NO: 457007 - RNA, 29 nt, Human
ggccgacauggugaaaccccaucucuacu

SEQ ID NO: 457008 - RNA, 32 nt, Human
ggccgacauggugaaaccccaucucuacuaaa

SEQ ID NO: 457009 - RNA, 32 nt, Human
ggccgacauggugaaacccugucucuacuaaa

SEQ ID NO: 457010 - RNA, 21 nt, Human
ggccgacgacucuucccgccg

SEQ ID NO: 457011 - RNA, 32 nt, Human
ggccgacuacaaucccgagcccugccagccgg

SEQ ID NO: 457012 - RNA, 32 nt, Human
ggccgacuaccugagcggcuccgaggacccac

SEQ ID NO: 457013 - RNA, 32 nt, Human
ggccgacuccuucuccccuccuggcagucagg

SEQ ID NO: 457014 - RNA, 32 nt, Human
ggccgacucguucuccccuccuggcagucagg

SEQ ID NO: 457015 - RNA, 32 nt, Human
ggccgacucugcacucuccacccuggcuggga

SEQ ID NO: 457016 - RNA, 32 nt, Human
ggccgagaaccucuggccucaggaagcgcaug

SEQ ID NO: 457017 - RNA, 32 nt, Human
ggccgagaaggguggaucaugaggucaggaga

SEQ ID NO: 457018 - RNA, 32 nt, Human
ggccgagagaucuggaaucggggucagcgggg

SEQ ID NO: 457019 - RNA, 19 nt, Human
ggccgagaguagggcagcu

SEQ ID NO: 457020 - RNA, 21 nt, Human
ggccgagaguugcccgugccg

SEQ ID NO: 457021 - RNA, 32 nt, Human
ggccgagauaaauacaagacccugugccagau

SEQ ID NO: 457022 - RNA, 32 nt, Human
ggccgagaugacgccgagcccccuguugcugc

SEQ ID NO: 457023 - RNA, 32 nt, Human
ggccgagaugagcguucccacagggaaaguga

SEQ ID NO: 457024 - RNA, 32 nt, Human
ggccgagaugcugcagauggaccugaucgacg

SEQ ID NO: 457025 - RNA, 32 nt, Human
ggccgagaugggugaaucaugaggucaggagu

SEQ ID NO: 457026 - RNA, 32 nt, Human
ggccgagauggguggaucaugaggucagcagu

SEQ ID NO: 457027 - RNA, 23 nt, Human
ggccgagcaaagccggagccgga

SEQ ID NO: 457028 - RNA, 32 nt, Human
ggccgagcaagcggaggcaggagcggcggcga

SEQ ID NO: 457029 - RNA, 32 nt, Human
ggccgagcaaugaggaguacacccuccgggcc

SEQ ID NO: 457030 - RNA, 32 nt, Human
ggccgagcagaggcgccccucaccucccggac

SEQ ID NO: 457031 - RNA, 18 nt, Human
ggccgagcagagggggca

SEQ ID NO: 457032 - RNA, 32 nt, Human
ggccgagcaggaggaggaggaagccggagcug

SEQ ID NO: 457033 - RNA, 32 nt, Human
ggccgagcaguggcagcagagaguggccucgg

SEQ ID NO: 457034 - RNA, 32 nt, Human
ggccgagcauuuugcacuaaugugucccacgg

SEQ ID NO: 457035 - RNA, 32 nt, Human
ggccgagccagccccuucaccaccagccggcc

SEQ ID NO: 457036 - RNA, 32 nt, Human
ggccgagcccacaccaucuggcccaggcuggc

SEQ ID NO: 457037 - RNA, 21 nt, Human
ggccgagccggggagcccggg

SEQ ID NO: 457038 - RNA, 32 nt, Human
ggccgagcggaggaggcgucccagggacacgc

SEQ ID NO: 457039 - RNA, 32 nt, Human
ggccgagcggggcaggugaggagggugagccg

SEQ ID NO: 457040 - RNA, 32 nt, Human
ggccgagcuccuggggagcuccugggacccuu

SEQ ID NO: 457041 - RNA, 32 nt, Human
ggccgagcuguucauagcccucacagcaguca

SEQ ID NO: 457042 - RNA, 20 nt, Human
ggccgaggaccaccagcagg

SEQ ID NO: 457043 - RNA, 32 nt, Human
ggccgaggaggaagaagaggggcagugggagc

SEQ ID NO: 457044 - RNA, 32 nt, Human
ggccgaggaggaggaggaggaggaggaggagg

SEQ ID NO: 457045 - RNA, 32 nt, Human
ggccgaggaggguggaucaugaggucagaagu

SEQ ID NO: 457046 - RNA, 32 nt, Human
ggccgaggauggaugcccugugccagugacca

SEQ ID NO: 457047 - RNA, 32 nt, Human
ggccgaggcaggcagaucacgaggucaggaga

SEQ ID NO: 457048 - RNA, 32 nt, Human
ggccgaggcaggcagaucacgaggucaggagg

SEQ ID NO: 457049 - RNA, 32 nt, Human
ggccgaggcaggcagaucacggggucaggaga

SEQ ID NO: 457050 - RNA, 32 nt, Human
ggccgaggcaggcggaucaugaggucaggaga

SEQ ID NO: 457051 - RNA, 32 nt, Human
ggccgaggcaggcggaucaugaggucaggagu

SEQ ID NO: 457052 - RNA, 32 nt, Human
ggccgaggcaggcggaucaugaggucgagaga

SEQ ID NO: 457053 - RNA, 32 nt, Human
ggccgaggcaggggcugggcagaggggaggag

SEQ ID NO: 457054 - RNA, 19 nt, Human
ggccgaggcagggggacug

SEQ ID NO: 457055 - RNA, 32 nt, Human
ggccgaggcagguagaucaugaggucaggaga

SEQ ID NO: 457056 - RNA, 32 nt, Human
ggccgaggcagguggaucaugaggucaggaga

SEQ ID NO: 457057 - RNA, 32 nt, Human
ggccgaggcagguggaucaugaggucaggagu

SEQ ID NO: 457058 - RNA, 32 nt, Human
ggccgaggcagguggaucaugaggucaugaga

SEQ ID NO: 457059 - RNA, 21 nt, Human
ggccgaggcccuccgcccuga

SEQ ID NO: 457060 - RNA, 22 nt, Human
ggccgaggccggcagaagacag

SEQ ID NO: 457061 - RNA, 32 nt, Human
ggccgaggcgggcagaucaugaggucaggaga

SEQ ID NO: 457062 - RNA, 32 nt, Human
ggccgaggcgggcggaucaugaggucagcaga

SEQ ID NO: 457063 - RNA, 32 nt, Human
ggccgaggcgggcggaucaugaggucaggaga

SEQ ID NO: 457064 - RNA, 32 nt, Human
ggccgaggcgggcggaucaugaggucaggagu

SEQ ID NO: 457065 - RNA, 32 nt, Human
ggccgaggcgggugaaucaugaggucaggaga

SEQ ID NO: 457066 - RNA, 32 nt, Human
ggccgaggcggguggaucaugaggucaggaga

SEQ ID NO: 457067 - RNA, 32 nt, Human
ggccgaggcggguggaucaugaggucaggagg

SEQ ID NO: 457068 - RNA, 32 nt, Human
ggccgaggcugcagcucagggcaacggcaggc

SEQ ID NO: 457069 - RNA, 32 nt, Human
ggccgaggcugugcuccaagaugaggaggacg

SEQ ID NO: 457070 - RNA, 32 nt, Human
ggccgagggcugggguuccacuuagacccuug

SEQ ID NO: 457071 - RNA, 32 nt, Human
ggccgagggcuggucggcgcccauccugaccc

SEQ ID NO: 457072 - RNA, 32 nt, Human
ggccgaggggcagagguggcucucggcccugc

SEQ ID NO: 457073 - RNA, 21 nt, Human
ggccgaggugagacgggaaga

SEQ ID NO: 457074 - RNA, 32 nt, Human
ggccgaggugcacaccccaacccacugggcca

SEQ ID NO: 457075 - RNA, 32 nt, Human
ggccgaggugggcaaaucaugaggucaggaga

SEQ ID NO: 457076 - RNA, 32 nt, Human
ggccgaggugggcagaucaugaggucagaaga

SEQ ID NO: 457077 - RNA, 32 nt, Human
ggccgaggugggcagaucaugaggucaggaga

SEQ ID NO: 457078 - RNA, 32 nt, Human
ggccgagguggguggaucaugaggucaggaga

SEQ ID NO: 457079 - RNA, 32 nt, Human
ggccgagguggguggaucaugaggucaguagu

SEQ ID NO: 457080 - RNA, 32 nt, Human
ggccgagucguagcccccuggagcccagcuuc

SEQ ID NO: 457081 - RNA, 32 nt, Human
ggccgauagucccagaugagguuccagcaaca

SEQ ID NO: 457082 - RNA, 32 nt, Human
ggccgaucccucuccucacuguaagcugagcc

SEQ ID NO: 457083 - RNA, 32 nt, Human
ggccgauggagacaccaaccgacaggcccugg

SEQ ID NO: 457084 - RNA, 32 nt, Human
ggccgaugggagggcgguggaggcucuguacc

SEQ ID NO: 457085 - RNA, 32 nt, Human
ggccgauuccaggguguuccacuuuuccagug

SEQ ID NO: 457086 - RNA, 21 nt, Human
ggccgauugcuugagcccagg

SEQ ID NO: 457087 - RNA, 32 nt, Human
ggccgcaaaacacacagucaggcuuccagcac

SEQ ID NO: 457088 - RNA, 32 nt, Human
ggccgcaacauuagcaagacccgcggguggca

SEQ ID NO: 457089 - RNA, 32 nt, Human
ggccgcacaccacguccugcucuggcuuuugc

SEQ ID NO: 457090 - RNA, 32 nt, Human
ggccgcaccacugcacuccagccugggugaca

SEQ ID NO: 457091 - RNA, 32 nt, Human
ggccgcagaccagacaaaaugagaauccaguu

SEQ ID NO: 457092 - RNA, 31 nt, Human
ggccgcagaggauccaucacagacggauacu

SEQ ID NO: 457093 - RNA, 32 nt, Human
ggccgcagcaagaggggcaagugccuucagag

SEQ ID NO: 457094 - RNA, 20 nt, Human
ggccgcagcccccugcugcc

SEQ ID NO: 457095 - RNA, 19 nt, Human
ggccgcagccugugugauc

SEQ ID NO: 457096 - RNA, 32 nt, Human
ggccgcagcucaccacuggccuagagaugccc

SEQ ID NO: 457097 - RNA, 32 nt, Human
ggccgcagcugcagagagccacuucaccugag

SEQ ID NO: 457098 - RNA, 32 nt, Human
ggccgcagggagaggagcaggacacgcaccuu

SEQ ID NO: 457099 - RNA, 21 nt, Human
ggccgcagggcagggggacug

SEQ ID NO: 457100 - RNA, 32 nt, Human
ggccgcaggggaggcaggggauggucagcccc

SEQ ID NO: 457101 - RNA, 19 nt, Human
ggccgcaggggucugggca

SEQ ID NO: 457102 - RNA, 32 nt, Human
ggccgcaggguaggggagagacucugcagugu

SEQ ID NO: 457103 - RNA, 32 nt, Human
ggccgcagugugcugagacauggcuaacaacc

SEQ ID NO: 457104 - RNA, 32 nt, Human
ggccgcauccaccggggcccugccuccagucg

SEQ ID NO: 457105 - RNA, 32 nt, Human
ggccgcaucugccuccccuuacagaaccagug

SEQ ID NO: 457106 - RNA, 32 nt, Human
ggccgcaugguccugcccuuccucgcucccug

SEQ ID NO: 457107 - RNA, 32 nt, Human
ggccgccaccaaggagcagcagcuggggcaga

SEQ ID NO: 457108 - RNA, 32 nt, Human
ggccgccaccaccaccaccacccacugccugc

SEQ ID NO: 457109 - RNA, 32 nt, Human
ggccgccaccacugcuccuugacucugccguu

SEQ ID NO: 457110 - RNA, 32 nt, Human
ggccgccaccgcccaucccagaccauggagcg

SEQ ID NO: 457111 - RNA, 20 nt, Human
ggccgccacggcagcgcggg

SEQ ID NO: 457112 - RNA, 28 nt, Human
ggccgccagaaagaugccucauccucga

SEQ ID NO: 457113 - RNA, 23 nt, Human
ggccgccagaacauccgccugca

SEQ ID NO: 457114 - RNA, 19 nt, Human
ggccgccagccgccgcagc

SEQ ID NO: 457115 - RNA, 32 nt, Human
ggccgccaggcaggccaagggccgaggugacu

SEQ ID NO: 457116 - RNA, 32 nt, Human
ggccgccagggaggucugggcccagcggggcu

SEQ ID NO: 457117 - RNA, 19 nt, Human
ggccgccagugcgcgcgga

SEQ ID NO: 457118 - RNA, 32 nt, Human
ggccgccaucccucggcgccccgcccggaacc

SEQ ID NO: 457119 - RNA, 20 nt, Human
ggccgccaucuuggucccag

SEQ ID NO: 457120 - RNA, 32 nt, Human
ggccgccaugcugaguguggccgcgccuuaaa

SEQ ID NO: 457121 - RNA, 32 nt, Human
ggccgccauggggcagacucucugaugccagu

SEQ ID NO: 457122 - RNA, 32 nt, Human
ggccgcccaaagcgcugggauuacaggcguga

SEQ ID NO: 457123 - RNA, 32 nt, Human
ggccgcccaagugcccuguccagugucugcuu

SEQ ID NO: 457124 - RNA, 19 nt, Human
ggccgcccaccccgugccg

SEQ ID NO: 457125 - RNA, 32 nt, Human
ggccgcccacuggaugagcggugagacgaaca

SEQ ID NO: 457126 - RNA, 32 nt, Human
ggccgccccaaaagagccacuuugaccaggcu

SEQ ID NO: 457127 - RNA, 32 nt, Human
ggccgccccaaaagagccgcuuugaccaggcu

SEQ ID NO: 457128 - RNA, 32 nt, Human
ggccgccccacagcccgagccggagagggagc

SEQ ID NO: 457129 - RNA, 20 nt, Human
ggccgccccaccaucuggga

SEQ ID NO: 457130 - RNA, 32 nt, Human
ggccgccccacccuccccacccggggaagcca

SEQ ID NO: 457131 - RNA, 20 nt, Human
ggccgccccaccgucuggga

SEQ ID NO: 457132 - RNA, 32 nt, Human
ggccgccccagccgggcgcagcagccggaggu

SEQ ID NO: 457133 - RNA, 18 nt, Human
ggccgcccccgccaggcg

SEQ ID NO: 457134 - RNA, 18 nt, Human
ggccgccccgcggcuggu

SEQ ID NO: 457135 - RNA, 21 nt, Human
ggccgccccugccccccggga

SEQ ID NO: 457136 - RNA, 32 nt, Human
ggccgccccugcccgucgcccgcccgcugcug

SEQ ID NO: 457137 - RNA, 32 nt, Human
ggccgccccuggcgaggguccugucuauagca

SEQ ID NO: 457138 - RNA, 32 nt, Human
ggccgcccgccccuucagccccggcucuccgu

SEQ ID NO: 457139 - RNA, 18 nt, Human
ggccgcccgccucugaga

SEQ ID NO: 457140 - RNA, 32 nt, Human
ggccgcccggggccauggcgacacucagcuuc

SEQ ID NO: 457141 - RNA, 32 nt, Human
ggccgcccuccccuccugcucucuucccagca

SEQ ID NO: 457142 - RNA, 32 nt, Human
ggccgcccucccggcuggagagcucaggugcu

SEQ ID NO: 457143 - RNA, 32 nt, Human
ggccgcccuccuggcccugaagcugcgccggc

SEQ ID NO: 457144 - RNA, 19 nt, Human
ggccgcccucuccucggga

SEQ ID NO: 457145 - RNA, 21 nt, Human
ggccgcccugccuucccgccg

SEQ ID NO: 457146 - RNA, 32 nt, Human
ggccgcccugcucccccaaugaaaggccagcu

SEQ ID NO: 457147 - RNA, 32 nt, Human
ggccgccgaacucaucuccugccugcaggccc

SEQ ID NO: 457148 - RNA, 24 nt, Human
ggccgccgcagaggcccggccgca

SEQ ID NO: 457149 - RNA, 24 nt, Human
ggccgccgccaguccccgccccga

SEQ ID NO: 457150 - RNA, 32 nt, Human
ggccgccgccuccccgcugaccccgcgaucug

SEQ ID NO: 457151 - RNA, 32 nt, Human
ggccgccgcgcuccgagguccccgggccucug

SEQ ID NO: 457152 - RNA, 32 nt, Human
ggccgccgcugcugcuugggccugguauguac

SEQ ID NO: 457153 - RNA, 28 nt, Human
ggccgccgcuuuccuguucucuggcugu

SEQ ID NO: 457154 - RNA, 32 nt, Human
ggccgccggcgccaugggcaaccgcgggaugg

SEQ ID NO: 457155 - RNA, 32 nt, Human
ggccgccggcgccgcgggaggugguggaggcc

SEQ ID NO: 457156 - RNA, 32 nt, Human
ggccgccggcuuagggcgcagcgcgguugguc

SEQ ID NO: 457157 - RNA, 23 nt, Human
ggccgccgggcuccuuuccgcga

SEQ ID NO: 457158 - RNA, 22 nt, Human
ggccgccuagggugauuggcug

SEQ ID NO: 457159 - RNA, 21 nt, Human
ggccgccucagcccaccagcc

SEQ ID NO: 457160 - RNA, 23 nt, Human
ggccgccucauugguccgcgcug

SEQ ID NO: 457161 - RNA, 16 nt, Human
ggccgccuccacaccc

SEQ ID NO: 457162 - RNA, 32 nt, Human
ggccgccuccaggaagcggaaaagcaagcggc

SEQ ID NO: 457163 - RNA, 32 nt, Human
ggccgccuccucggggcuccaggcuggcuugc

SEQ ID NO: 457164 - RNA, 17 nt, Human
ggccgccuccucuggga

SEQ ID NO: 457165 - RNA, 32 nt, Human
ggccgccucguggagaaggcagugccacgugg

SEQ ID NO: 457166 - RNA, 32 nt, Human
ggccgccucuacuccgagagcucacgccgcgu

SEQ ID NO: 457167 - RNA, 32 nt, Human
ggccgccucuuccgcucccugccaucagucaa

SEQ ID NO: 457168 - RNA, 32 nt, Human
ggccgccugaaggugagcgggcaucucacaug

SEQ ID NO: 457169 - RNA, 32 nt, Human
ggccgccugaugaccugcagccuggaccugga

SEQ ID NO: 457170 - RNA, 32 nt, Human
ggccgccugcagucuccucucugggugauugc

SEQ ID NO: 457171 - RNA, 32 nt, Human
ggccgccugcccccucugccaccuggggcggu

SEQ ID NO: 457172 - RNA, 32 nt, Human
ggccgccugccugcccgcccgcccgcagcccc

SEQ ID NO: 457173 - RNA, 32 nt, Human
ggccgccugccugucauuccugacucaccacc

SEQ ID NO: 457174 - RNA, 32 nt, Human
ggccgccugcugggaagugcuaccucagcuaa

SEQ ID NO: 457175 - RNA, 32 nt, Human
ggccgccugggguccccugccuccugccuguc

SEQ ID NO: 457176 - RNA, 21 nt, Human
ggccgccuggucccugcgaag

SEQ ID NO: 457177 - RNA, 32 nt, Human
ggccgccuguaaucccagcuacucaggaggcu

SEQ ID NO: 457178 - RNA, 32 nt, Human
ggccgccuguagucccagcuacucgggaggcu

SEQ ID NO: 457179 - RNA, 32 nt, Human
ggccgccuguggccaccaugucggcccucuuu

SEQ ID NO: 457180 - RNA, 32 nt, Human
ggccgccugugggaacagcuauucucugcaca

SEQ ID NO: 457181 - RNA, 22 nt, Human
ggccgccugugucgcgcuccug

SEQ ID NO: 457182 - RNA, 20 nt, Human
ggccgcgaccugcugcugcc

SEQ ID NO: 457183 - RNA, 22 nt, Human
ggccgcgacgcccagccugcca

SEQ ID NO: 457184 - RNA, 32 nt, Human
ggccgcgacuccgcuccaggcaggacccccaa

SEQ ID NO: 457185 - RNA, 32 nt, Human
ggccgcgagugcaucuuccacgaaccuaauuc

SEQ ID NO: 457186 - RNA, 31 nt, Human
ggccgcgcaaugucgcacggagccgggcucg

SEQ ID NO: 457187 - RNA, 19 nt, Human
ggccgcgcagcagcaggag

SEQ ID NO: 457188 - RNA, 32 nt, Human
ggccgcgcaggagagcgcgcguccgccgggug

SEQ ID NO: 457189 - RNA, 19 nt, Human
ggccgcgcccagccccagc

SEQ ID NO: 457190 - RNA, 18 nt, Human
ggccgcgcccccuuggcg

SEQ ID NO: 457191 - RNA, 23 nt, Human
ggccgcgcccgcgcccccucccg

SEQ ID NO: 457192 - RNA, 19 nt, Human
ggccgcgccucugcgggag

SEQ ID NO: 457193 - RNA, 32 nt, Human
ggccgcgcggaugcagaucuguggauccagcg

SEQ ID NO: 457194 - RNA, 22 nt, Human
ggccgcgcugcccgcgcuccug

SEQ ID NO: 457195 - RNA, 18 nt, Human
ggccgcggaagccuggag

SEQ ID NO: 457196 - RNA, 32 nt, Human
ggccgcggaggaggaggaaggggaggagggcg

SEQ ID NO: 457197 - RNA, 32 nt, Human
ggccgcggaggaggaggagguggaguugcugc

SEQ ID NO: 457198 - RNA, 32 nt, Human
ggccgcggagugugcugggcuuggggguaagg

SEQ ID NO: 457199 - RNA, 19 nt, Human
ggccgcggcagagcucccu

SEQ ID NO: 457200 - RNA, 32 nt, Human
ggccgcggcaggcgaagagagaagagacuauc

SEQ ID NO: 457201 - RNA, 19 nt, Human
ggccgcggccggcgggccu

SEQ ID NO: 457202 - RNA, 32 nt, Human
ggccgcggcgcaaugucagagcagacgccggc

SEQ ID NO: 457203 - RNA, 32 nt, Human
ggccgcggcggcggaggcagcagcggcggcgg

SEQ ID NO: 457204 - RNA, 20 nt, Human
ggccgcggcggcggcgcagg

SEQ ID NO: 457205 - RNA, 23 nt, Human
ggccgcggcggcucaugccugua

SEQ ID NO: 457206 - RNA, 18 nt, Human
ggccgcggcggggcagcu

SEQ ID NO: 457207 - RNA, 32 nt, Human
ggccgcgggacccugggcugagcaccgaccca

SEQ ID NO: 457208 - RNA, 21 nt, Human
ggccgcgggaggcagcggggc

SEQ ID NO: 457209 - RNA, 17 nt, Human
ggccgcgggcgcgcggg

SEQ ID NO: 457210 - RNA, 24 nt, Human
ggccgcggggagcaccuggcuaca

SEQ ID NO: 457211 - RNA, 32 nt, Human
ggccgcgggguugguuuccacccuggagguug

SEQ ID NO: 457212 - RNA, 32 nt, Human
ggccgcgggugcaggccgcagugacagggccg

SEQ ID NO: 457213 - RNA, 32 nt, Human
ggccgcgguggagcgagggcccaggcgaggcg

SEQ ID NO: 457214 - RNA, 32 nt, Human
ggccgcgucacuucucugauuaugugcccugg

SEQ ID NO: 457215 - RNA, 32 nt, Human
ggccgcgucgaccugcaguggauuuccuuccu

SEQ ID NO: 457216 - RNA, 32 nt, Human
ggccgcuaacagacaggagccgaacgggggcu

SEQ ID NO: 457217 - RNA, 32 nt, Human
ggccgcuacacguguacggccgccaacagccu

SEQ ID NO: 457218 - RNA, 20 nt, Human
ggccgcuagcagcgcagcgg

SEQ ID NO: 457219 - RNA, 32 nt, Human
ggccgcuagcgcacaggaaaauccuaccugau

SEQ ID NO: 457220 - RNA, 32 nt, Human
ggccgcuccaaaccacaaaaucuccaacgccg

SEQ ID NO: 457221 - RNA, 32 nt, Human
ggccgcuccccgaggcgcgggcucuggcggcc

SEQ ID NO: 457222 - RNA, 32 nt, Human
ggccgcuccccucuccccgcgggccgggggac

SEQ ID NO: 457223 - RNA, 32 nt, Human
ggccgcuccuccccucuccccacccuccuccu

SEQ ID NO: 457224 - RNA, 16 nt, Human
ggccgcuccugagcug

SEQ ID NO: 457225 - RNA, 32 nt, Human
ggccgcuccugagcugcugucucccucucuga

SEQ ID NO: 457226 - RNA, 32 nt, Human
ggccgcucgcccaggauggagaggcggguccc

SEQ ID NO: 457227 - RNA, 32 nt, Human
ggccgcucucucucacuuuuucuggaacucau

SEQ ID NO: 457228 - RNA, 32 nt, Human
ggccgcucuguggaugcuuccaucuguaucca

SEQ ID NO: 457229 - RNA, 32 nt, Human
ggccgcucuuugcaucuugucuugcccacagc

SEQ ID NO: 457230 - RNA, 19 nt, Human
ggccgcugacggcgggaag

SEQ ID NO: 457231 - RNA, 32 nt, Human
ggccgcugacggcgggaaggaaaaugagugag

SEQ ID NO: 457232 - RNA, 32 nt, Human
ggccgcugacugccagcuccagccuggccccg

SEQ ID NO: 457233 - RNA, 32 nt, Human
ggccgcugacuggccucggucaccucccgggg

SEQ ID NO: 457234 - RNA, 32 nt, Human
ggccgcugagccacaguccuccuaggcaaugc

SEQ ID NO: 457235 - RNA, 32 nt, Human
ggccgcugaggggcuccccugccccuccuggg

SEQ ID NO: 457236 - RNA, 32 nt, Human
ggccgcugcacuccagccugggggacagagcg

SEQ ID NO: 457237 - RNA, 32 nt, Human
ggccgcugcagcccuggcagcgggcacacccc

SEQ ID NO: 457238 - RNA, 22 nt, Human
ggccgcugccccccggguccgg

SEQ ID NO: 457239 - RNA, 19 nt, Human
ggccgcugccggaggcucg

SEQ ID NO: 457240 - RNA, 18 nt, Human
ggccgcugccucccggga

SEQ ID NO: 457241 - RNA, 32 nt, Human
ggccgcugcucuccagacccaggaugccgggg

SEQ ID NO: 457242 - RNA, 32 nt, Human
ggccgcugcugccgcuccuugugguggccgcg

SEQ ID NO: 457243 - RNA, 19 nt, Human
ggccgcugcugccucuccu

SEQ ID NO: 457244 - RNA, 32 nt, Human
ggccgcugcugccucuccuugugguggccgcg

SEQ ID NO: 457245 - RNA, 32 nt, Human
ggccgcugcugcgggccaggggacgggggcgg

SEQ ID NO: 457246 - RNA, 19 nt, Human
ggccgcugcugcuccggga

SEQ ID NO: 457247 - RNA, 32 nt, Human
ggccgcugcuuugcgcugguggaccacaggca

SEQ ID NO: 457248 - RNA, 32 nt, Human
ggccgcuggcuggcuggacaggcgggugugag

SEQ ID NO: 457249 - RNA, 32 nt, Human
ggccgcugggcacuuggcaccuccccaagagc

SEQ ID NO: 457250 - RNA, 32 nt, Human
ggccgcuggggucacccaagagaagcagcccu

SEQ ID NO: 457251 - RNA, 32 nt, Human
ggccgcuucccaccaucuucugcaguugccuc

SEQ ID NO: 457252 - RNA, 32 nt, Human
ggccgcuuccuuggcuaccugguuccaggggg

SEQ ID NO: 457253 - RNA, 23 nt, Human
ggccggaagccuccucgccgccg

SEQ ID NO: 457254 - RNA, 19 nt, Human
ggccggaagucuaucccgc

SEQ ID NO: 457255 - RNA, 32 nt, Human
ggccggacacaggcucacaggucuccacauug

SEQ ID NO: 457256 - RNA, 32 nt, Human
ggccggacacauauguauaaacuuuucagcag

SEQ ID NO: 457257 - RNA, 24 nt, Human
ggccggacagcuccaucuacagcc

SEQ ID NO: 457258 - RNA, 32 nt, Human
ggccggaccggagauggcgccgccagcgggcg

SEQ ID NO: 457259 - RNA, 32 nt, Human
ggccggacgagagagcgcgccuuuucggcgug

SEQ ID NO: 457260 - RNA, 22 nt, Human
ggccggagagacgcggaggagg

SEQ ID NO: 457261 - RNA, 32 nt, Human
ggccggagaggaccggcggcucggaggaagcc

SEQ ID NO: 457262 - RNA, 19 nt, Human
ggccggagaggaguucagg

SEQ ID NO: 457263 - RNA, 18 nt, Human
ggccggagccagcucccu

SEQ ID NO: 457264 - RNA, 32 nt, Human
ggccggagcgcccgccgcucacggucaggggu

SEQ ID NO: 457265 - RNA, 32 nt, Human
ggccggagcugcugccgccgucuacacggucc

SEQ ID NO: 457266 - RNA, 32 nt, Human
ggccggagcuggucgggucaagagucgggauu

SEQ ID NO: 457267 - RNA, 32 nt, Human
ggccggaggaagagagaguuuaccaagagaga

SEQ ID NO: 457268 - RNA, 32 nt, Human
ggccggaggccacacaaauggucuccaugcug

SEQ ID NO: 457269 - RNA, 16 nt, Human
ggccggaggcgcggug

SEQ ID NO: 457270 - RNA, 32 nt, Human
ggccggaggcuggcccgggcagugagugugga

SEQ ID NO: 457271 - RNA, 32 nt, Human
ggccggagggaggcggaggaaccgguguucgc

SEQ ID NO: 457272 - RNA, 32 nt, Human
ggccggaguaggagcacuggggugggggcgga

SEQ ID NO: 457273 - RNA, 32 nt, Human
ggccggcacaacagguguuacaucagggguuu

SEQ ID NO: 457274 - RNA, 18 nt, Human
ggccggcagcagcagcag

SEQ ID NO: 457275 - RNA, 32 nt, Human
ggccggcagccccagccugcuagcuagcucaa

SEQ ID NO: 457276 - RNA, 32 nt, Human
ggccggcagcccugggcugaggcacagacuca

SEQ ID NO: 457277 - RNA, 22 nt, Human
ggccggcaggcgggggcugggg

SEQ ID NO: 457278 - RNA, 32 nt, Human
ggccggccaauacauaggaacacuuggguccc

SEQ ID NO: 457279 - RNA, 32 nt, Human
ggccggccaccugccacugggcccacagcugg

SEQ ID NO: 457280 - RNA, 32 nt, Human
ggccggccaccuggaccgccgacacacagccu

SEQ ID NO: 457281 - RNA, 32 nt, Human
ggccggccagccagggcaggcaggggcggccu

SEQ ID NO: 457282 - RNA, 32 nt, Human
ggccggcccucagagcaaacccucuccccaca

SEQ ID NO: 457283 - RNA, 32 nt, Human
ggccggcccugccuccacguggcuccggcucc

SEQ ID NO: 457284 - RNA, 32 nt, Human
ggccggcccugccuugcgcuagcagagccucu

SEQ ID NO: 457285 - RNA, 32 nt, Human
ggccggccugcuggcauggcugggcaucccca

SEQ ID NO: 457286 - RNA, 32 nt, Human
ggccggccugggggcugggagggccaggggca

SEQ ID NO: 457287 - RNA, 18 nt, Human
ggccggccuucugccgcu

SEQ ID NO: 457288 - RNA, 32 nt, Human
ggccggcgccuguaaucccagcuacuagggag

SEQ ID NO: 457289 - RNA, 32 nt, Human
ggccggcgccuguaaucccagcuacucgggag

SEQ ID NO: 457290 - RNA, 32 nt, Human
ggccggcgcggguauggagcuugggggucacu

SEQ ID NO: 457291 - RNA, 23 nt, Human
ggccggcggaucacgaggucagg

SEQ ID NO: 457292 - RNA, 20 nt, Human
ggccggcggccacugcugcc

SEQ ID NO: 457293 - RNA, 32 nt, Human
ggccggcgggcggggcgcagagccaggcagcg

SEQ ID NO: 457294 - RNA, 32 nt, Human
ggccggcgugagccaccaugcccggcuccacg

SEQ ID NO: 457295 - RNA, 32 nt, Human
ggccggcuagaaacauuuuccccaagcggcuc

SEQ ID NO: 457296 - RNA, 23 nt, Human
ggccggcucaccucauuccugcc

SEQ ID NO: 457297 - RNA, 32 nt, Human
ggccggcuccgcgcccccuccgcggcccccgc

SEQ ID NO: 457298 - RNA, 32 nt, Human
ggccggcuccguugcugaccgccgacugucaa

SEQ ID NO: 457299 - RNA, 32 nt, Human
ggccggcuccugcaggaucaugcagcuggggc

SEQ ID NO: 457300 - RNA, 32 nt, Human
ggccggcuggacugugcugggguuuguuguga

SEQ ID NO: 457301 - RNA, 32 nt, Human
ggccggcugggaguaggcggcagugaguuucc

SEQ ID NO: 457302 - RNA, 32 nt, Human
ggccgggaaggaaaugggacuggaguccagag

SEQ ID NO: 457303 - RNA, 32 nt, Human
ggccgggaagggucaguuggaggcaggcgcuc

SEQ ID NO: 457304 - RNA, 20 nt, Human
ggccgggacccucugcugcu

SEQ ID NO: 457305 - RNA, 17 nt, Human
ggccgggacucucagca

SEQ ID NO: 457306 - RNA, 32 nt, Human
ggccgggagagggaggaagaggauggcagggc

SEQ ID NO: 457307 - RNA, 32 nt, Human
ggccgggagaugauggcugaugaagaggaaga

SEQ ID NO: 457308 - RNA, 32 nt, Human
ggccgggagcagucaucuguggugaggcugau

SEQ ID NO: 457309 - RNA, 32 nt, Human
ggccgggagcccggcugcacaccaggcugcug

SEQ ID NO: 457310 - RNA, 32 nt, Human
ggccgggagcccuuugggaggaagggaggcgu

SEQ ID NO: 457311 - RNA, 32 nt, Human
ggccgggagccgcggaaagaguagggcucccc

SEQ ID NO: 457312 - RNA, 19 nt, Human
ggccgggagcgcgcgcgga

SEQ ID NO: 457313 - RNA, 32 nt, Human
ggccgggagggcgcggccggaggcagaggcca

SEQ ID NO: 457314 - RNA, 32 nt, Human
ggccgggaugcagcacgcauccauguucuguu

SEQ ID NO: 457315 - RNA, 32 nt, Human
ggccgggcacggcggaucaugaggucaggaaa

SEQ ID NO: 457316 - RNA, 32 nt, Human
ggccgggcagaggcaccccucaccucccggac

SEQ ID NO: 457317 - RNA, 32 nt, Human
ggccgggcagaggcaccccucaccuccuggac

SEQ ID NO: 457318 - RNA, 28 nt, Human
ggccgggcagaggcgccccucaccuccc

SEQ ID NO: 457319 - RNA, 32 nt, Human
ggccgggcagaggcgccccucaccuccccgau

SEQ ID NO: 457320 - RNA, 32 nt, Human
ggccgggcagaggcgccccucaccucccggac

SEQ ID NO: 457321 - RNA, 32 nt, Human
ggccgggcagaggcgccccucaccucccggau

SEQ ID NO: 457322 - RNA, 32 nt, Human
ggccgggcagaggcgccccucaccuccuggac

SEQ ID NO: 457323 - RNA, 32 nt, Human
ggccgggcagaggcgccccucaccuccuggau

SEQ ID NO: 457324 - RNA, 32 nt, Human
ggccgggcagaggcgccccucaccugccggac

SEQ ID NO: 457325 - RNA, 32 nt, Human
ggccgggcagaggcgccccucacuucccggac

SEQ ID NO: 457326 - RNA, 31 nt, Human
ggccgggcagaggcgcuccucacaucccaga

SEQ ID NO: 457327 - RNA, 32 nt, Human
ggccgggcagaggcgcuccucacaucccagau

SEQ ID NO: 457328 - RNA, 32 nt, Human
ggccgggcagaggugcuccucacuucccagag

SEQ ID NO: 457329 - RNA, 32 nt, Human
ggccgggcagaggugcuccucacuucccagua

SEQ ID NO: 457330 - RNA, 32 nt, Human
ggccgggcaggcguggugcgcgguaggagcug

SEQ ID NO: 457331 - RNA, 15 nt, Human
ggccgggcaggggga

SEQ ID NO: 457332 - RNA, 18 nt, Human
ggccgggcagggggccug

SEQ ID NO: 457333 - RNA, 32 nt, Human
ggccgggccaacuccggcuucugccgcgcgug

SEQ ID NO: 457334 - RNA, 19 nt, Human
ggccgggccccuccugcca

SEQ ID NO: 457335 - RNA, 32 nt, Human
ggccgggccgagguaaugcacaagggucacgu

SEQ ID NO: 457336 - RNA, 32 nt, Human
ggccgggccugcggcgcugagcgcggcggcgg

SEQ ID NO: 457337 - RNA, 32 nt, Human
ggccgggcgagucucccgccuccucaggcccu

SEQ ID NO: 457338 - RNA, 32 nt, Human
ggccgggcgcaguggcuguaaucccagcacuu

SEQ ID NO: 457339 - RNA, 32 nt, Human
ggccgggcgcccgcucuuccuuccgcuugcgc

SEQ ID NO: 457340 - RNA, 23 nt, Human
ggccgggcggagccagagccaga

SEQ ID NO: 457341 - RNA, 32 nt, Human
ggccgggcggcgcuccagccucggggcaggug

SEQ ID NO: 457342 - RNA, 32 nt, Human
ggccgggcggggcgcaggcgggcgggcgggua

SEQ ID NO: 457343 - RNA, 25 nt, Human
ggccgggcggugcacagcucugugg

SEQ ID NO: 457344 - RNA, 20 nt, Human
ggccgggcucccgccccagc

SEQ ID NO: 457345 - RNA, 32 nt, Human
ggccgggcuccgaggcgagaggcugcauggag

SEQ ID NO: 457346 - RNA, 32 nt, Human
ggccgggcucucaugguacuuccucugugaac

SEQ ID NO: 457347 - RNA, 32 nt, Human
ggccgggcugccucccuguggcuccugcgcgc

SEQ ID NO: 457348 - RNA, 32 nt, Human
ggccgggcugcguucgcuccagccgcggcucu

SEQ ID NO: 457349 - RNA, 16 nt, Human
ggccgggcugcugcag

SEQ ID NO: 457350 - RNA, 32 nt, Human
ggccgggcugcugcugcugcugcuccaggugc

SEQ ID NO: 457351 - RNA, 32 nt, Human
ggccgggcugggaggcggcggcggcggcucgg

SEQ ID NO: 457352 - RNA, 32 nt, Human
ggccggggaaagcaggagggagaggggccgcc

SEQ ID NO: 457353 - RNA, 20 nt, Human
ggccggggaagagcccgggg

SEQ ID NO: 457354 - RNA, 32 nt, Human
ggccggggacagcuccagcagcucaggcucca

SEQ ID NO: 457355 - RNA, 25 nt, Human
ggccggggacccagcguggaggaag

SEQ ID NO: 457356 - RNA, 32 nt, Human
ggccggggagaagguguuguugccggagcuga

SEQ ID NO: 457357 - RNA, 32 nt, Human
ggccggggaggcggcggcggcggcaggauucc

SEQ ID NO: 457358 - RNA, 32 nt, Human
ggccggggcagcugguaccugggaucgggcag

SEQ ID NO: 457359 - RNA, 30 nt, Human
ggccggggcaggcuuagggcacaguuaggg

SEQ ID NO: 457360 - RNA, 19 nt, Human
ggccggggcccagcuccag

SEQ ID NO: 457361 - RNA, 32 nt, Human
ggccggggcccaggcaggagcugacagcccac

SEQ ID NO: 457362 - RNA, 20 nt, Human
ggccggggccccccagggug

SEQ ID NO: 457363 - RNA, 18 nt, Human
ggccggggccccgcgaag

SEQ ID NO: 457364 - RNA, 32 nt, Human
ggccggggccccucccuuccacauauaccuug

SEQ ID NO: 457365 - RNA, 20 nt, Human
ggccggggcgcggcacgcgg

SEQ ID NO: 457366 - RNA, 18 nt, Human
ggccggggcucgccagca

SEQ ID NO: 457367 - RNA, 21 nt, Human
ggccggggcugaauggaggga

SEQ ID NO: 457368 - RNA, 32 nt, Human
ggccggggcugagggugcccuuuuccagccuc

SEQ ID NO: 457369 - RNA, 32 nt, Human
ggccggggcuggagcggagaccccagggccuc

SEQ ID NO: 457370 - RNA, 32 nt, Human
ggccgggggcugggguguggggcagucugggu

SEQ ID NO: 457371 - RNA, 20 nt, Human
ggccggggguggggcugcuu

SEQ ID NO: 457372 - RNA, 24 nt, Human
ggccgggguccuccacagccccca

SEQ ID NO: 457373 - RNA, 32 nt, Human
ggccgggguggugaaaccccaucucuacuaaa

SEQ ID NO: 457374 - RNA, 32 nt, Human
ggccgggguucccaggguucacgccacacucu

SEQ ID NO: 457375 - RNA, 32 nt, Human
ggccgggguuucacccgggcccucucuguuug

SEQ ID NO: 457376 - RNA, 32 nt, Human
ggccggguagcagcuguuugugccucuugccc

SEQ ID NO: 457377 - RNA, 32 nt, Human
ggccggguccuccaccaucaggaagaucccau

SEQ ID NO: 457378 - RNA, 32 nt, Human
ggccgggugcaguggcucacacuguaaugcca

SEQ ID NO: 457379 - RNA, 32 nt, Human
ggccgggugcgguggcucaugccugaaauucu

SEQ ID NO: 457380 - RNA, 32 nt, Human
ggccggucacaauccagcacucagacagagcc

SEQ ID NO: 457381 - RNA, 32 nt, Human
ggccggucaucuucccugucgcaggucccugc

SEQ ID NO: 457382 - RNA, 32 nt, Human
ggccgguccuagcagggauuguccccauuucc

SEQ ID NO: 457383 - RNA, 19 nt, Human
ggccggucgccugcugacc

SEQ ID NO: 457384 - RNA, 32 nt, Human
ggccggucuaggacuugccucaggaggaagga

SEQ ID NO: 457385 - RNA, 32 nt, Human
ggccggucucaaacuccugaccucaggugauc

SEQ ID NO: 457386 - RNA, 32 nt, Human
ggccggucucaaacuccugaccucaggugaug

SEQ ID NO: 457387 - RNA, 32 nt, Human
ggccggucuccuccucuccgccguccuccgcc

SEQ ID NO: 457388 - RNA, 20 nt, Human
ggccggugaggcccaggcug

SEQ ID NO: 457389 - RNA, 21 nt, Human
ggccggugagggcccaggcug

SEQ ID NO: 457390 - RNA, 32 nt, Human
ggccggugauucacaaggucaggaguucaaga

SEQ ID NO: 457391 - RNA, 21 nt, Human
ggccgguggcucaugccugua

SEQ ID NO: 457392 - RNA, 32 nt, Human
ggccggugggcgcugccucuucaucugaugga

SEQ ID NO: 457393 - RNA, 32 nt, Human
ggccgguggggaggggcaugaggcgcucgcag

SEQ ID NO: 457394 - RNA, 32 nt, Human
ggccgguuccuggucugugcugcucuccugga

SEQ ID NO: 457395 - RNA, 32 nt, Human
ggccgguucuccccaucaccucucuggggcag

SEQ ID NO: 457396 - RNA, 32 nt, Human
ggccguagagggaaacagccacugugacaacc

SEQ ID NO: 457397 - RNA, 21 nt, Human
ggccguagauuuucacaucca

SEQ ID NO: 457398 - RNA, 32 nt, Human
ggccguaggcagccaugacgcccagccggaau

SEQ ID NO: 457399 - RNA, 32 nt, Human
ggccguaggcagccauggcgcccagccggaau

SEQ ID NO: 457400 - RNA, 32 nt, Human
ggccguagggaccagaccccacccuaagccca

SEQ ID NO: 457401 - RNA, 32 nt, Human
ggccguagggacccccucacacaccaccgaga

SEQ ID NO: 457402 - RNA, 32 nt, Human
ggccgucaggacccaccaugucugccccauca

SEQ ID NO: 457403 - RNA, 20 nt, Human
ggccgucccaaagcuggcug

SEQ ID NO: 457404 - RNA, 32 nt, Human
ggccguccccucuccccuugguucugcacugu

SEQ ID NO: 457405 - RNA, 19 nt, Human
ggccgucccggaggccgcg

SEQ ID NO: 457406 - RNA, 19 nt, Human
ggccguccgcucugcugcc

SEQ ID NO: 457407 - RNA, 32 nt, Human
ggccguccucccgggcccucccuuggaaaccu

SEQ ID NO: 457408 - RNA, 32 nt, Human
ggccguccuccuccucuucaaauuggcuugaa

SEQ ID NO: 457409 - RNA, 32 nt, Human
ggccguccugagcgaaagaaccgcccccagca

SEQ ID NO: 457410 - RNA, 21 nt, Human
ggccgucgcccaagccaagcc

SEQ ID NO: 457411 - RNA, 21 nt, Human
ggccgucucaguucacugcag

SEQ ID NO: 457412 - RNA, 32 nt, Human
ggccgucuccaucgcugccuucugcaccuucc

SEQ ID NO: 457413 - RNA, 32 nt, Human
ggccgucuccccucuucugcgucuguuccgug

SEQ ID NO: 457414 - RNA, 32 nt, Human
ggccgucucugccucuggauugcacacuggcc

SEQ ID NO: 457415 - RNA, 32 nt, Human
ggccgucugccucacccgccaccucaccgccu

SEQ ID NO: 457416 - RNA, 32 nt, Human
ggccgugaagaagauagaagaaaacaacacgc

SEQ ID NO: 457417 - RNA, 32 nt, Human
ggccgugaaugagaagaagugcaacugccucc

SEQ ID NO: 457418 - RNA, 32 nt, Human
ggccgugaccagcccucugccuccagggaggc

SEQ ID NO: 457419 - RNA, 32 nt, Human
ggccgugacuuaggcagaggagugcagaggag

SEQ ID NO: 457420 - RNA, 32 nt, Human
ggccgugagauaguaucccuacccacaacugu

SEQ ID NO: 457421 - RNA, 32 nt, Human
ggccgugaguccccgccccagcaaagacuucc

SEQ ID NO: 457422 - RNA, 22 nt, Human
ggccgugagugcgugcuggacc

SEQ ID NO: 457423 - RNA, 31 nt, Human
ggccgugcagagcagcaccuccaucaggcug

SEQ ID NO: 457424 - RNA, 32 nt, Human
ggccgugcaggacagccuggagagugaccucc

SEQ ID NO: 457425 - RNA, 16 nt, Human
ggccgugcagggggcu

SEQ ID NO: 457426 - RNA, 32 nt, Human
ggccgugcagggggcucaguucugagccccag

SEQ ID NO: 457427 - RNA, 32 nt, Human
ggccgugcaggugggaggugggacaggggcaa

SEQ ID NO: 457428 - RNA, 32 nt, Human
ggccgugcccuugcuguugcugggcagugucc

SEQ ID NO: 457429 - RNA, 32 nt, Human
ggccgugcccuugcuguugcugggcagugucu

SEQ ID NO: 457430 - RNA, 32 nt, Human
ggccgugccugggcauggccucuuccugcaau

SEQ ID NO: 457431 - RNA, 32 nt, Human
ggccgugccuucucucgcuucggacugcgcaa

SEQ ID NO: 457432 - RNA, 19 nt, Human
ggccgugccuugaggccag

SEQ ID NO: 457433 - RNA, 23 nt, Human
ggccgugcgcgcgcccucccccg

SEQ ID NO: 457434 - RNA, 32 nt, Human
ggccgugcgcuacuuccacuccagcgccaacu

SEQ ID NO: 457435 - RNA, 32 nt, Human
ggccgugcgcucugcacuccggagcgguuccc

SEQ ID NO: 457436 - RNA, 32 nt, Human
ggccgugcggcacuggaccucgcuauuauuuu

SEQ ID NO: 457437 - RNA, 24 nt, Human
ggccgugcucgggcucgccugcuc

SEQ ID NO: 457438 - RNA, 22 nt, Human
ggccgugcuuaggccucugugg

SEQ ID NO: 457439 - RNA, 32 nt, Human
ggccguggaccucuaugucuccaccuccuaug

SEQ ID NO: 457440 - RNA, 32 nt, Human
ggccguggacguggccccugcccacucaccug

SEQ ID NO: 457441 - RNA, 22 nt, Human
ggccguggcccgccagaccacc

SEQ ID NO: 457442 - RNA, 31 nt, Human
ggccguggccguuuggagcacgcuguagaca

SEQ ID NO: 457443 - RNA, 24 nt, Human
ggccguggccugcaugaacuacca

SEQ ID NO: 457444 - RNA, 18 nt, Human
ggccguggcggccugagc

SEQ ID NO: 457445 - RNA, 32 nt, Human
ggccgugggaauuauuuagaaugugaucugcc

SEQ ID NO: 457446 - RNA, 32 nt, Human
ggccgugggaggcuuccugaggugggggccgg

SEQ ID NO: 457447 - RNA, 32 nt, Human
ggccgugguggucaugugccucgugucuauca

SEQ ID NO: 457448 - RNA, 32 nt, Human
ggccgugguggugagaggaagcaaucaguaug

SEQ ID NO: 457449 - RNA, 32 nt, Human
ggccgugguuaggaaggacggagaaggggcgu

SEQ ID NO: 457450 - RNA, 32 nt, Human
ggccgugucuuccucucucucugccauuuucu

SEQ ID NO: 457451 - RNA, 32 nt, Human
ggccgugugcgugagaccagagcccaggacug

SEQ ID NO: 457452 - RNA, 32 nt, Human
ggccgugugugcuggggaagccccaggaaacg

SEQ ID NO: 457453 - RNA, 32 nt, Human
ggccguguucguguuggcaaagaaggucggcu

SEQ ID NO: 457454 - RNA, 32 nt, Human
ggccguguugcagaaucggggcaggggguugc

SEQ ID NO: 457455 - RNA, 32 nt, Human
ggccguuaaccgcccuugccggagcccuaggc

SEQ ID NO: 457456 - RNA, 32 nt, Human
ggccguuccaaggagcgcgaggucgggaugga

SEQ ID NO: 457457 - RNA, 32 nt, Human
ggccguucguggaggaguacauccccacacag

SEQ ID NO: 457458 - RNA, 32 nt, Human
ggccguucuuccccagccuccccacugcuccc

SEQ ID NO: 457459 - RNA, 15 nt, Human
ggccguucuugcagu

SEQ ID NO: 457460 - RNA, 32 nt, Human
ggccguucuuuuccacccuguuucuuccccca

SEQ ID NO: 457461 - RNA, 32 nt, Human
ggccguugauguuggcugggaacucaccuggg

SEQ ID NO: 457462 - RNA, 20 nt, Human
ggccguugccgccaccaggg

SEQ ID NO: 457463 - RNA, 32 nt, Human
ggccguugcugccuggaggccaugucaguguc

SEQ ID NO: 457464 - RNA, 32 nt, Human
ggccguugcuguggagacgccuggagaguugu

SEQ ID NO: 457465 - RNA, 32 nt, Human
ggccguuuccugacacuaccagccugggaggc

SEQ ID NO: 457466 - RNA, 32 nt, Human
ggccguuuuaagacaacuaaagccugaaugcu

SEQ ID NO: 457467 - RNA, 32 nt, Human
ggccguuuuuccucuuguccaggcucacgagu

SEQ ID NO: 457468 - RNA, 19 nt, Human
ggccuaaacacagcugccu

SEQ ID NO: 457469 - RNA, 32 nt, Human
ggccuaaaccaggacuaucccaggaagccugg

SEQ ID NO: 457470 - RNA, 18 nt, Human
ggccuaaacugucaggua

SEQ ID NO: 457471 - RNA, 32 nt, Human
ggccuaaagaagccggugcugaaggagguggc

SEQ ID NO: 457472 - RNA, 32 nt, Human
ggccuaaagagccccacagggaaagggaggag

SEQ ID NO: 457473 - RNA, 32 nt, Human
ggccuaacaacaacaaaaauacuuacagguca

SEQ ID NO: 457474 - RNA, 32 nt, Human
ggccuaacaacaaggcacuuugcccuuaaucc

SEQ ID NO: 457475 - RNA, 32 nt, Human
ggccuaacacugaccuuggacuggauuugcag

SEQ ID NO: 457476 - RNA, 16 nt, Human
ggccuaacacuuggac

SEQ ID NO: 457477 - RNA, 32 nt, Human
ggccuaacauauggcauaucccagaaaauguu

SEQ ID NO: 457478 - RNA, 32 nt, Human
ggccuaaccaggcuggagugcaguggugggau

SEQ ID NO: 457479 - RNA, 32 nt, Human
ggccuaaccuggcuaauuuuuauauuuuuagu

SEQ ID NO: 457480 - RNA, 32 nt, Human
ggccuaagaacaaaccuuuucccuucaugaua

SEQ ID NO: 457481 - RNA, 32 nt, Human
ggccuaagaccggaagcaggaaggagggcgca

SEQ ID NO: 457482 - RNA, 32 nt, Human
ggccuaagagacccuauaauuucuuuggaauu

SEQ ID NO: 457483 - RNA, 32 nt, Human
ggccuaagaggagagggaaccagggagaaaag

SEQ ID NO: 457484 - RNA, 23 nt, Human
ggccuaagccccauagcagcugg

SEQ ID NO: 457485 - RNA, 32 nt, Human
ggccuaaggagguugucucaguuuuugucagc

SEQ ID NO: 457486 - RNA, 32 nt, Human
ggccuaagggaugggcacggagcccaggcugu

SEQ ID NO: 457487 - RNA, 32 nt, Human
ggccuaaguucagcuuuucugaagacacucga

SEQ ID NO: 457488 - RNA, 31 nt, Human
ggccuaaugggugaccugcaggauuuauccc

SEQ ID NO: 457489 - RNA, 32 nt, Human
ggccuaauuguaccaacaaagguagaagauac

SEQ ID NO: 457490 - RNA, 32 nt, Human
ggccuacacaccgggcucuagagccauaauuu

SEQ ID NO: 457491 - RNA, 31 nt, Human
ggccuacacagacaaaucaggagggaacaga

SEQ ID NO: 457492 - RNA, 32 nt, Human
ggccuacagagguguggcaagcagagcaccuc

SEQ ID NO: 457493 - RNA, 32 nt, Human
ggccuacaggggccugguuuucucccaucuaa

SEQ ID NO: 457494 - RNA, 32 nt, Human
ggccuacaggguggguaggcgggcgugccgca

SEQ ID NO: 457495 - RNA, 32 nt, Human
ggccuacaugggcccaagacugggugagaguc

SEQ ID NO: 457496 - RNA, 32 nt, Human
ggccuacauggugaaaccccgucucuacuaaa

SEQ ID NO: 457497 - RNA, 32 nt, Human
ggccuacaugguugaaaccccaucucuacuaa

SEQ ID NO: 457498 - RNA, 32 nt, Human
ggccuaccaaagugcugggauuacaggcguga

SEQ ID NO: 457499 - RNA, 20 nt, Human
ggccuaccagcaacugcagc

SEQ ID NO: 457500 - RNA, 32 nt, Human
ggccuacccugccuccggcccagcaugcgccu

SEQ ID NO: 457501 - RNA, 32 nt, Human
ggccuaccgaagugcuaggauuacagacguaa

SEQ ID NO: 457502 - RNA, 32 nt, Human
ggccuaccgaguagcugggacuacaggcacgc

SEQ ID NO: 457503 - RNA, 32 nt, Human
ggccuaccugccugccccaggccaugccugcc

SEQ ID NO: 457504 - RNA, 20 nt, Human
ggccuacgagugaaguggga

SEQ ID NO: 457505 - RNA, 32 nt, Human
ggccuacuaaagugcugggauuacaggcguga

SEQ ID NO: 457506 - RNA, 32 nt, Human
ggccuacucaguuggccaaggugcagguggcu

SEQ ID NO: 457507 - RNA, 32 nt, Human
ggccuacuucacagaaugauguggaaaucagu

SEQ ID NO: 457508 - RNA, 32 nt, Human
ggccuagaaagcaguguggguccuccaugggg

SEQ ID NO: 457509 - RNA, 32 nt, Human
ggccuagaaagccaagugcaaagaugagggca

SEQ ID NO: 457510 - RNA, 32 nt, Human
ggccuagaaaugucacugagggcagccacauc

SEQ ID NO: 457511 - RNA, 32 nt, Human
ggccuagaagcaguuauucucucuccauauug

SEQ ID NO: 457512 - RNA, 20 nt, Human
ggccuagacccccugcugcc

SEQ ID NO: 457513 - RNA, 32 nt, Human
ggccuagagauauuucacaaugccuucuguaa

SEQ ID NO: 457514 - RNA, 32 nt, Human
ggccuagagccaggaguacugcauucaguuga

SEQ ID NO: 457515 - RNA, 32 nt, Human
ggccuagaugguacuucuccagccuuccguuu

SEQ ID NO: 457516 - RNA, 32 nt, Human
ggccuagcagccaggcccggcccagggagcua

SEQ ID NO: 457517 - RNA, 32 nt, Human
ggccuagcagccauuccacuccaugucucacu

SEQ ID NO: 457518 - RNA, 32 nt, Human
ggccuagcccuuguagucagaaccaccaggga

SEQ ID NO: 457519 - RNA, 17 nt, Human
ggccuagcuuugaacug

SEQ ID NO: 457520 - RNA, 26 nt, Human
ggccuaggagcagauauccugccaca

SEQ ID NO: 457521 - RNA, 17 nt, Human
ggccuaggcccgggcca

SEQ ID NO: 457522 - RNA, 18 nt, Human
ggccuagggcgggcagcu

SEQ ID NO: 457523 - RNA, 32 nt, Human
ggccuagggugggaagauggcaggugggggcg

SEQ ID NO: 457524 - RNA, 32 nt, Human
ggccuaggugggcagaucaugaggucaggagu

SEQ ID NO: 457525 - RNA, 32 nt, Human
ggccuagucuagcaagaggacauagcacccuc

SEQ ID NO: 457526 - RNA, 32 nt, Human
ggccuagucugaaucuggacaggggaggugcc

SEQ ID NO: 457527 - RNA, 32 nt, Human
ggccuagugccacccuccucccuccaagccug

SEQ ID NO: 457528 - RNA, 32 nt, Human
ggccuagugcuucgcgcuuccggagaaaauca

SEQ ID NO: 457529 - RNA, 32 nt, Human
ggccuaguggugcugagggccccuuucugcuu

SEQ ID NO: 457530 - RNA, 32 nt, Human
ggccuaguguggauugacuccuuuccaccaca

SEQ ID NO: 457531 - RNA, 32 nt, Human
ggccuaguuacuggcccugcagcuugucucca

SEQ ID NO: 457532 - RNA, 32 nt, Human
ggccuaguuuaaaucacaauuccgaaucuggg

SEQ ID NO: 457533 - RNA, 32 nt, Human
ggccuauaccggcuggcucuuucagaaucaug

SEQ ID NO: 457534 - RNA, 32 nt, Human
ggccuauaugccagcgcccagggaggagucag

SEQ ID NO: 457535 - RNA, 32 nt, Human
ggccuaucaaaguguugggauuacaggcuuga

SEQ ID NO: 457536 - RNA, 32 nt, Human
ggccuaucacccuugucagagauauaaauuac

SEQ ID NO: 457537 - RNA, 32 nt, Human
ggccuaucaggaggacacaggcugcagccugg

SEQ ID NO: 457538 - RNA, 32 nt, Human
ggccuaucgugggagagccugggcaggauccc

SEQ ID NO: 457539 - RNA, 21 nt, Human
ggccuaugccaccugcagcgu

SEQ ID NO: 457540 - RNA, 32 nt, Human
ggccuauggaccuggcccaucugccacucuag

SEQ ID NO: 457541 - RNA, 20 nt, Human
ggccuauggcgaaacuccgu

SEQ ID NO: 457542 - RNA, 32 nt, Human
ggccuauugcugugaaacagagagaagguaaa

SEQ ID NO: 457543 - RNA, 32 nt, Human
ggccuauuuucauauuuauccuaagccaucaa

SEQ ID NO: 457544 - RNA, 20 nt, Human
ggccuauuuucugcuggauc

SEQ ID NO: 457545 - RNA, 32 nt, Human
ggccucaaaguauugagauuacaggcaugagc

SEQ ID NO: 457546 - RNA, 22 nt, Human
ggccucaaccuucagggcucaa

SEQ ID NO: 457547 - RNA, 21 nt, Human
ggccucaacguccucaucugu

SEQ ID NO: 457548 - RNA, 25 nt, Human
ggccucaagcaauccucccaccuca

SEQ ID NO: 457549 - RNA, 25 nt, Human
ggccucaagcaauccuuccaccuca

SEQ ID NO: 457550 - RNA, 20 nt, Human
ggccucaagcaauccuuccu

SEQ ID NO: 457551 - RNA, 21 nt, Human
ggccucaagcaguccccaccu

SEQ ID NO: 457552 - RNA, 19 nt, Human
ggccucaagcaguccuccc

SEQ ID NO: 457553 - RNA, 25 nt, Human
ggccucaagcgauccucccaccuca

SEQ ID NO: 457554 - RNA, 32 nt, Human
ggccucaaggagaccgagggggcagauagccc

SEQ ID NO: 457555 - RNA, 32 nt, Human
ggccucaaggagcagaggaaggggcuggugac

SEQ ID NO: 457556 - RNA, 32 nt, Human
ggccucaaggagcuggccugaccugaggcugg

SEQ ID NO: 457557 - RNA, 32 nt, Human
ggccucaaggcagagauggaggacaugcgggg

SEQ ID NO: 457558 - RNA, 32 nt, Human
ggccucaagggcaccaucugaagaucccauaa

SEQ ID NO: 457559 - RNA, 25 nt, Human
ggccucaagugauccacccaccuca

SEQ ID NO: 457560 - RNA, 20 nt, Human
ggccucaagugauccuccca

SEQ ID NO: 457561 - RNA, 32 nt, Human
ggccucaagugugggaacuuccccuacucccu

SEQ ID NO: 457562 - RNA, 22 nt, Human
ggccucaaucucccaucuguga

SEQ ID NO: 457563 - RNA, 23 nt, Human
ggccucaaucucccaucugugaa

SEQ ID NO: 457564 - RNA, 32 nt, Human
ggccucacaaagugcugggauuacaggcguga

SEQ ID NO: 457565 - RNA, 32 nt, Human
ggccucacaaagugcugggauuacagguguaa

SEQ ID NO: 457566 - RNA, 32 nt, Human
ggccucacaaagugcugggauuauaggcaaga

SEQ ID NO: 457567 - RNA, 32 nt, Human
ggccucacacucauucagcagacuggaaaguc

SEQ ID NO: 457568 - RNA, 32 nt, Human
ggccucacccgcucaggagcaaugcugccuuc

SEQ ID NO: 457569 - RNA, 32 nt, Human
ggccucacccugccaccaacaggaagccacac

SEQ ID NO: 457570 - RNA, 18 nt, Human
ggccucacccuguccccu

SEQ ID NO: 457571 - RNA, 32 nt, Human
ggccucaccgccucccgggccugcugucagcu

SEQ ID NO: 457572 - RNA, 21 nt, Human
ggccucaccugccacucaacc

SEQ ID NO: 457573 - RNA, 32 nt, Human
ggccucaccuuggacagaggucaauccuugau

SEQ ID NO: 457574 - RNA, 23 nt, Human
ggccucacgcccagccuccuccc

SEQ ID NO: 457575 - RNA, 21 nt, Human
ggccucacgccuguaauccca

SEQ ID NO: 457576 - RNA, 32 nt, Human
ggccucacgccuguaaucccagcacuuuggga

SEQ ID NO: 457577 - RNA, 32 nt, Human
ggccucacuccaggaaggggcuggacuggcug

SEQ ID NO: 457578 - RNA, 32 nt, Human
ggccucacucuuuucccugacccuuggggccc

SEQ ID NO: 457579 - RNA, 32 nt, Human
ggccucacugcaacacaaagcuccaccaggag

SEQ ID NO: 457580 - RNA, 32 nt, Human
ggccucacugcaauuugauaugccugcugauc

SEQ ID NO: 457581 - RNA, 32 nt, Human
ggccucacuguaccagugguucccucucugcc

SEQ ID NO: 457582 - RNA, 32 nt, Human
ggccucacuguggcuccucuguuuuacauacu

SEQ ID NO: 457583 - RNA, 32 nt, Human
ggccucacuguuucccuggccugcugucagcu

SEQ ID NO: 457584 - RNA, 32 nt, Human
ggccucacuuccuuugagccugaggcccuugg

SEQ ID NO: 457585 - RNA, 32 nt, Human
ggccucagaagcaggagagcugggugguauaa

SEQ ID NO: 457586 - RNA, 32 nt, Human
ggccucagaaguuuggccggagagggggcagc

SEQ ID NO: 457587 - RNA, 32 nt, Human
ggccucagaauccaccccgugccugcagggga

SEQ ID NO: 457588 - RNA, 32 nt, Human
ggccucagaaugcgccucaccucucccucccc

SEQ ID NO: 457589 - RNA, 19 nt, Human
ggccucagaccaaggucac

SEQ ID NO: 457590 - RNA, 20 nt, Human
ggccucagagccacucccag

SEQ ID NO: 457591 - RNA, 21 nt, Human
ggccucagagcgucuggugag

SEQ ID NO: 457592 - RNA, 32 nt, Human
ggccucagaggcuucucagacuguaagaggcc

SEQ ID NO: 457593 - RNA, 32 nt, Human
ggccucagccaagcauugaacuugcccucccc

SEQ ID NO: 457594 - RNA, 32 nt, Human
ggccucagccaggaauaauccaggaagugucc

SEQ ID NO: 457595 - RNA, 23 nt, Human
ggccucagcccgccacaucaccc

SEQ ID NO: 457596 - RNA, 17 nt, Human
ggccucagccucaggau

SEQ ID NO: 457597 - RNA, 32 nt, Human
ggccucagccucccuucccugcuccucugaga

SEQ ID NO: 457598 - RNA, 32 nt, Human
ggccucagccuccggcccuggaacccucucca

SEQ ID NO: 457599 - RNA, 32 nt, Human
ggccucagccuggcuggacccugcugccugug

SEQ ID NO: 457600 - RNA, 32 nt, Human
ggccucagcgaagaugggccgggcagggacca

SEQ ID NO: 457601 - RNA, 20 nt, Human
ggccucagcgcggcggcggg

SEQ ID NO: 457602 - RNA, 32 nt, Human
ggccucagcucccuccagugguggccgcccug

SEQ ID NO: 457603 - RNA, 18 nt, Human
ggccucagcuucccagcc

SEQ ID NO: 457604 - RNA, 22 nt, Human
ggccucagcuucccagccucca

SEQ ID NO: 457605 - RNA, 32 nt, Human
ggccucaggaagaggcgaguccuguucacgca

SEQ ID NO: 457606 - RNA, 32 nt, Human
ggccucaggaauacgaggaaaagagcuggagc

SEQ ID NO: 457607 - RNA, 22 nt, Human
ggccucaggauugucugcugaa

SEQ ID NO: 457608 - RNA, 32 nt, Human
ggccucaggcagcaguggacaguggccaggag

SEQ ID NO: 457609 - RNA, 22 nt, Human
ggccucagggacuauuggugaa

SEQ ID NO: 457610 - RNA, 19 nt, Human
ggccucagggccucuggug

SEQ ID NO: 457611 - RNA, 18 nt, Human
ggccucaggucagggaga

SEQ ID NO: 457612 - RNA, 32 nt, Human
ggccucaggucuggccagccagggcuggugcu

SEQ ID NO: 457613 - RNA, 24 nt, Human
ggccucaggugauccacccaccuc

SEQ ID NO: 457614 - RNA, 32 nt, Human
ggccucagguguugaguccagacuucugcuuu

SEQ ID NO: 457615 - RNA, 20 nt, Human
ggccucagucuccacugugg

SEQ ID NO: 457616 - RNA, 20 nt, Human
ggccucagucuccugucugu

SEQ ID NO: 457617 - RNA, 32 nt, Human
ggccucagucuggagugggauaggagcaguga

SEQ ID NO: 457618 - RNA, 23 nt, Human
ggccucagugccagcagccccgc

SEQ ID NO: 457619 - RNA, 21 nt, Human
ggccucaguggcuucugugga

SEQ ID NO: 457620 - RNA, 21 nt, Human
ggccucaguggugaccaggaa

SEQ ID NO: 457621 - RNA, 19 nt, Human
ggccucaguguccucaucu

SEQ ID NO: 457622 - RNA, 21 nt, Human
ggccucagugugcccaucugu

SEQ ID NO: 457623 - RNA, 32 nt, Human
ggccucaguguggaagagaaggcagcaggauu

SEQ ID NO: 457624 - RNA, 24 nt, Human
ggccucaguguuccccgccuggga

SEQ ID NO: 457625 - RNA, 23 nt, Human
ggccucaguuaagccuuugugga

SEQ ID NO: 457626 - RNA, 24 nt, Human
ggccucaguucgcucaccugugaa

SEQ ID NO: 457627 - RNA, 22 nt, Human
ggccucaguuucccucugugaa

SEQ ID NO: 457628 - RNA, 19 nt, Human
ggccucaucgucccgggag

SEQ ID NO: 457629 - RNA, 32 nt, Human
ggccucaucugcuccuagcccagcagagagag

SEQ ID NO: 457630 - RNA, 18 nt, Human
ggccucaugccaggguga

SEQ ID NO: 457631 - RNA, 21 nt, Human
ggccucaugccuauaauccca

SEQ ID NO: 457632 - RNA, 32 nt, Human
ggccucaugccuauaaucccagcacuuuggaa

SEQ ID NO: 457633 - RNA, 32 nt, Human
ggccucauuccaugugugccugugccuggggc

SEQ ID NO: 457634 - RNA, 32 nt, Human
ggccucauuguggagcugcaaacacgaacguc

SEQ ID NO: 457635 - RNA, 32 nt, Human
ggccucauuucacuagagacaaaucuuuaaga

SEQ ID NO: 457636 - RNA, 32 nt, Human
ggccuccaaaagugcuggaauuacaggcguga

SEQ ID NO: 457637 - RNA, 32 nt, Human
ggccuccaaaagugcugggauuacaggcauga

SEQ ID NO: 457638 - RNA, 32 nt, Human
ggccuccaaaagugcugggauuacagguguca

SEQ ID NO: 457639 - RNA, 32 nt, Human
ggccuccaaaagugcugggauuacuagcacga

SEQ ID NO: 457640 - RNA, 32 nt, Human
ggccuccaaaaguucugggauuauaggugcga

SEQ ID NO: 457641 - RNA, 32 nt, Human
ggccuccaaagccacagauguuggccggccca

SEQ ID NO: 457642 - RNA, 32 nt, Human
ggccuccaaaguucccuuaacacuugcaaagu

SEQ ID NO: 457643 - RNA, 32 nt, Human
ggccuccaagaguucuggacaggaggcagaca

SEQ ID NO: 457644 - RNA, 22 nt, Human
ggccuccaagccaggugccacc

SEQ ID NO: 457645 - RNA, 22 nt, Human
ggccuccaagcugcugcucacc

SEQ ID NO: 457646 - RNA, 32 nt, Human
ggccuccacaagugcugggauuacagguguga

SEQ ID NO: 457647 - RNA, 32 nt, Human
ggccuccacagcccagguggccccagaaaaug

SEQ ID NO: 457648 - RNA, 21 nt, Human
ggccuccaccagccucucacc

SEQ ID NO: 457649 - RNA, 18 nt, Human
ggccuccaccccugcacc

SEQ ID NO: 457650 - RNA, 18 nt, Human
ggccuccaccccugcgcc

SEQ ID NO: 457651 - RNA, 32 nt, Human
ggccuccaccgccuuccccggcugcccggcag

SEQ ID NO: 457652 - RNA, 32 nt, Human
ggccuccaccugccauggagaaguuuccgcua

SEQ ID NO: 457653 - RNA, 32 nt, Human
ggccuccacuggaagcuuuggaacuuuauucc

SEQ ID NO: 457654 - RNA, 32 nt, Human
ggccuccacuucuugaggucugaggcccagca

SEQ ID NO: 457655 - RNA, 24 nt, Human
ggccuccacuuguccaucugugaa

SEQ ID NO: 457656 - RNA, 32 nt, Human
ggccuccagcagcccccacaucugccagcggg

SEQ ID NO: 457657 - RNA, 17 nt, Human
ggccuccagcccacccc

SEQ ID NO: 457658 - RNA, 32 nt, Human
ggccuccagccccuguacacacagaggcaagc

SEQ ID NO: 457659 - RNA, 19 nt, Human
ggccuccagcgcccugccc

SEQ ID NO: 457660 - RNA, 32 nt, Human
ggccuccagcggugagaucacauacugguagg

SEQ ID NO: 457661 - RNA, 18 nt, Human
ggccuccagcugcgcagg

SEQ ID NO: 457662 - RNA, 21 nt, Human
ggccuccagcuuccccugccc

SEQ ID NO: 457663 - RNA, 32 nt, Human
ggccuccaggauuugccugcagcuuucucccu

SEQ ID NO: 457664 - RNA, 32 nt, Human
ggccuccaggcaggccgggcuggaccgcguga

SEQ ID NO: 457665 - RNA, 17 nt, Human
ggccuccaggcuggcug

SEQ ID NO: 457666 - RNA, 32 nt, Human
ggccuccagugaacuguagacuccugcauagc

SEQ ID NO: 457667 - RNA, 31 nt, Human
ggccuccaguuucaccccuuaacccauccca

SEQ ID NO: 457668 - RNA, 32 nt, Human
ggccucccaaaaccauuagggcucagaggaag

SEQ ID NO: 457669 - RNA, 32 nt, Human
ggccucccaaaauacugggauuacagggguga

SEQ ID NO: 457670 - RNA, 32 nt, Human
ggccucccaaaaugcugagauuacagguguga

SEQ ID NO: 457671 - RNA, 32 nt, Human
ggccucccaaaaugcugggauuacaggcauga

SEQ ID NO: 457672 - RNA, 32 nt, Human
ggccucccaaaaugcugggauuacaggccuga

SEQ ID NO: 457673 - RNA, 32 nt, Human
ggccucccaaaaugcugggauuacaggcguga

SEQ ID NO: 457674 - RNA, 32 nt, Human
ggccucccaaaaugcugggauuacagggguaa

SEQ ID NO: 457675 - RNA, 32 nt, Human
ggccucccaaaaugcugggauuacagguguga

SEQ ID NO: 457676 - RNA, 32 nt, Human
ggccucccaaaaugcugggauuacaugcauga

SEQ ID NO: 457677 - RNA, 32 nt, Human
ggccucccaaaaugcugggauuaccgguguga

SEQ ID NO: 457678 - RNA, 32 nt, Human
ggccucccaaaaugcugggauuagagguguga

SEQ ID NO: 457679 - RNA, 32 nt, Human
ggccucccaaaaugcugggauuauaggcauga

SEQ ID NO: 457680 - RNA, 32 nt, Human
ggccucccaaaauguugggauuacaggcauga

SEQ ID NO: 457681 - RNA, 32 nt, Human
ggccucccaaaauucugggauuacaggcauga

SEQ ID NO: 457682 - RNA, 32 nt, Human
ggccucccaaacugcuggcauuacagguguga

SEQ ID NO: 457683 - RNA, 32 nt, Human
ggccucccaaacugcugggauuacaggcguga

SEQ ID NO: 457684 - RNA, 32 nt, Human
ggccucccaaagaacugggauuacaggcauga

SEQ ID NO: 457685 - RNA, 32 nt, Human
ggccucccaaagagcugagauuacaggcguga

SEQ ID NO: 457686 - RNA, 32 nt, Human
ggccucccaaagagcuggaauuacaggagaag

SEQ ID NO: 457687 - RNA, 32 nt, Human
ggccucccaaagagcugggauuacaggcauga

SEQ ID NO: 457688 - RNA, 32 nt, Human
ggccucccaaagcacuaggauuacaggcguga

SEQ ID NO: 457689 - RNA, 32 nt, Human
ggccucccaaagcacugggauuacaggcaucu

SEQ ID NO: 457690 - RNA, 32 nt, Human
ggccucccaaagcacugggauuacaggcauga

SEQ ID NO: 457691 - RNA, 32 nt, Human
ggccucccaaagcacugggauuacaggcguga

SEQ ID NO: 457692 - RNA, 32 nt, Human
ggccucccaaagcagugguauuacaggcauga

SEQ ID NO: 457693 - RNA, 32 nt, Human
ggccucccaaagcgauaggauuacaggcguaa

SEQ ID NO: 457694 - RNA, 32 nt, Human
ggccucccaaagcgcuaggauuacagguguga

SEQ ID NO: 457695 - RNA, 32 nt, Human
ggccucccaaagcgcugggauuacaggcauga

SEQ ID NO: 457696 - RNA, 32 nt, Human
ggccucccaaagcgcugggauuacaggcguga

SEQ ID NO: 457697 - RNA, 32 nt, Human
ggccucccaaagcgcugggauuacagguguga

SEQ ID NO: 457698 - RNA, 32 nt, Human
ggccucccaaagcgcugggauuauaggcguga

SEQ ID NO: 457699 - RNA, 32 nt, Human
ggccucccaaagcgcugggauuauaggucugu

SEQ ID NO: 457700 - RNA, 32 nt, Human
ggccucccaaagcgcugguauuacagguguga

SEQ ID NO: 457701 - RNA, 32 nt, Human
ggccucccaaagcguugggauuauaggcauga

SEQ ID NO: 457702 - RNA, 32 nt, Human
ggccucccaaagggcugugauuacaggcguga

SEQ ID NO: 457703 - RNA, 32 nt, Human
ggccucccaaaggguugggauuacagguguaa

SEQ ID NO: 457704 - RNA, 32 nt, Human
ggccucccaaaguacugggauuacaggcauga

SEQ ID NO: 457705 - RNA, 32 nt, Human
ggccucccaaaguacugggauuacaggccuga

SEQ ID NO: 457706 - RNA, 32 nt, Human
ggccucccaaaguacugggauuacaggcguga

SEQ ID NO: 457707 - RNA, 32 nt, Human
ggccucccaaaguacugggauuauaggcguga

SEQ ID NO: 457708 - RNA, 32 nt, Human
ggccucccaaaguacugggauuauagguguga

SEQ ID NO: 457709 - RNA, 32 nt, Human
ggccucccaaaguauugggauuacccgcguga

SEQ ID NO: 457710 - RNA, 32 nt, Human
ggccucccaaaguccucggauuacaggcauga

SEQ ID NO: 457711 - RNA, 32 nt, Human
ggccucccaaaguccuggaauuacaggcauga

SEQ ID NO: 457712 - RNA, 32 nt, Human
ggccucccaaaguccugggauuacaggcguga

SEQ ID NO: 457713 - RNA, 32 nt, Human
ggccucccaaagugauggaauuacagguguga

SEQ ID NO: 457714 - RNA, 32 nt, Human
ggccucccaaagugaugggauuacaggcauga

SEQ ID NO: 457715 - RNA, 32 nt, Human
ggccucccaaagugccaggauuacaggcauga

SEQ ID NO: 457716 - RNA, 32 nt, Human
ggccucccaaagugccaggauuacaggcguga

SEQ ID NO: 457717 - RNA, 32 nt, Human
ggccucccaaagugccgagauuacagguguga

SEQ ID NO: 457718 - RNA, 32 nt, Human
ggccucccaaagugccgggauuacaggcauaa

SEQ ID NO: 457719 - RNA, 32 nt, Human
ggccucccaaagugccgggauuacaggcauga

SEQ ID NO: 457720 - RNA, 32 nt, Human
ggccucccaaagugccgggauuacaggcguga

SEQ ID NO: 457721 - RNA, 32 nt, Human
ggccucccaaagugcuaagauuacaggcaugg

SEQ ID NO: 457722 - RNA, 32 nt, Human
ggccucccaaagugcuaagauuacaggcguga

SEQ ID NO: 457723 - RNA, 32 nt, Human
ggccucccaaagugcuagaauuacagguguga

SEQ ID NO: 457724 - RNA, 32 nt, Human
ggccucccaaagugcuaggauuacaggaguga

SEQ ID NO: 457725 - RNA, 32 nt, Human
ggccucccaaagugcuaggauuacaggcauca

SEQ ID NO: 457726 - RNA, 32 nt, Human
ggccucccaaagugcuaggauuacaggcauga

SEQ ID NO: 457727 - RNA, 32 nt, Human
ggccucccaaagugcuaggauuacaggcccgu

SEQ ID NO: 457728 - RNA, 32 nt, Human
ggccucccaaagugcuaggauuacaggcguga

SEQ ID NO: 457729 - RNA, 32 nt, Human
ggccucccaaagugcuaggauuacaggcugga

SEQ ID NO: 457730 - RNA, 32 nt, Human
ggccucccaaagugcuaggauuacagguauga

SEQ ID NO: 457731 - RNA, 32 nt, Human
ggccucccaaagugcuaggauuacagguguga

SEQ ID NO: 457732 - RNA, 32 nt, Human
ggccucccaaagugcugacauuacaggccuga

SEQ ID NO: 457733 - RNA, 32 nt, Human
ggccucccaaagugcugagauuacagaaguga

SEQ ID NO: 457734 - RNA, 32 nt, Human
ggccucccaaagugcugagauuacagacguga

SEQ ID NO: 457735 - RNA, 32 nt, Human
ggccucccaaagugcugagauuacagauguga

SEQ ID NO: 457736 - RNA, 32 nt, Human
ggccucccaaagugcugagauuacaggcauga

SEQ ID NO: 457737 - RNA, 32 nt, Human
ggccucccaaagugcugagauuacaggccuga

SEQ ID NO: 457738 - RNA, 32 nt, Human
ggccucccaaagugcugagauuacaggcguga

SEQ ID NO: 457739 - RNA, 32 nt, Human
ggccucccaaagugcugagauuacaggcuuga

SEQ ID NO: 457740 - RNA, 32 nt, Human
ggccucccaaagugcugagauuacagggguga

SEQ ID NO: 457741 - RNA, 32 nt, Human
ggccucccaaagugcugagauuacagguguaa

SEQ ID NO: 457742 - RNA, 32 nt, Human
ggccucccaaagugcugagauuacagguguga

SEQ ID NO: 457743 - RNA, 32 nt, Human
ggccucccaaagugcugagauuacgggcauga

SEQ ID NO: 457744 - RNA, 32 nt, Human
ggccucccaaagugcugagauuauaggcauga

SEQ ID NO: 457745 - RNA, 32 nt, Human
ggccucccaaagugcugcgauuacaggcauga

SEQ ID NO: 457746 - RNA, 32 nt, Human
ggccucccaaagugcugcgauuacaggcguga

SEQ ID NO: 457747 - RNA, 32 nt, Human
ggccucccaaagugcuggaauuacaggcauga

SEQ ID NO: 457748 - RNA, 32 nt, Human
ggccucccaaagugcuggaauuacaggcgaac

SEQ ID NO: 457749 - RNA, 32 nt, Human
ggccucccaaagugcuggaauuacaggcguga

SEQ ID NO: 457750 - RNA, 32 nt, Human
ggccucccaaagugcuggcauuacaggcguga

SEQ ID NO: 457751 - RNA, 32 nt, Human
ggccucccaaagugcuggcauuacagguauga

SEQ ID NO: 457752 - RNA, 32 nt, Human
ggccucccaaagugcuggcauuacagguggga

SEQ ID NO: 457753 - RNA, 32 nt, Human
ggccucccaaagugcuggcauuacagguguga

SEQ ID NO: 457754 - RNA, 32 nt, Human
ggccucccaaagugcugggauaauagguguca

SEQ ID NO: 457755 - RNA, 32 nt, Human
ggccucccaaagugcugggaucacaggcauga

SEQ ID NO: 457756 - RNA, 32 nt, Human
ggccucccaaagugcugggaucacaggcgcca

SEQ ID NO: 457757 - RNA, 32 nt, Human
ggccucccaaagugcugggaucacaggcguga

SEQ ID NO: 457758 - RNA, 32 nt, Human
ggccucccaaagugcugggaugacaggcauga

SEQ ID NO: 457759 - RNA, 32 nt, Human
ggccucccaaagugcugggaugacaggcguga

SEQ ID NO: 457760 - RNA, 32 nt, Human
ggccucccaaagugcugggauuaaaggcguga

SEQ ID NO: 457761 - RNA, 32 nt, Human
ggccucccaaagugcugggauuaaagguguga

SEQ ID NO: 457762 - RNA, 32 nt, Human
ggccucccaaagugcugggauuaaggcgugag

SEQ ID NO: 457763 - RNA, 32 nt, Human
ggccucccaaagugcugggauuacaagcauga

SEQ ID NO: 457764 - RNA, 32 nt, Human
ggccucccaaagugcugggauuacaagcguga

SEQ ID NO: 457765 - RNA, 32 nt, Human
ggccucccaaagugcugggauuacaaggguga

SEQ ID NO: 457766 - RNA, 32 nt, Human
ggccucccaaagugcugggauuacacgcguga

SEQ ID NO: 457767 - RNA, 32 nt, Human
ggccucccaaagugcugggauuacagacacga

SEQ ID NO: 457768 - RNA, 32 nt, Human
ggccucccaaagugcugggauuacagacauga

SEQ ID NO: 457769 - RNA, 32 nt, Human
ggccucccaaagugcugggauuacagacguga

SEQ ID NO: 457770 - RNA, 32 nt, Human
ggccucccaaagugcugggauuacagagugug

SEQ ID NO: 457771 - RNA, 32 nt, Human
ggccucccaaagugcugggauuacagauguga

SEQ ID NO: 457772 - RNA, 32 nt, Human
ggccucccaaagugcugggauuacagccacug

SEQ ID NO: 457773 - RNA, 32 nt, Human
ggccucccaaagugcugggauuacagccguga

SEQ ID NO: 457774 - RNA, 32 nt, Human
ggccucccaaagugcugggauuacagcuguga

SEQ ID NO: 457775 - RNA, 32 nt, Human
ggccucccaaagugcugggauuacaggaguga

SEQ ID NO: 457776 - RNA, 32 nt, Human
ggccucccaaagugcugggauuacaggcaccg

SEQ ID NO: 457777 - RNA, 32 nt, Human
ggccucccaaagugcugggauuacaggcacga

SEQ ID NO: 457778 - RNA, 32 nt, Human
ggccucccaaagugcugggauuacaggcagga

SEQ ID NO: 457779 - RNA, 32 nt, Human
ggccucccaaagugcugggauuacaggcauaa

SEQ ID NO: 457780 - RNA, 32 nt, Human
ggccucccaaagugcugggauuacaggcauca

SEQ ID NO: 457781 - RNA, 32 nt, Human
ggccucccaaagugcugggauuacaggcauga

SEQ ID NO: 457782 - RNA, 32 nt, Human
ggccucccaaagugcugggauuacaggcaugg

SEQ ID NO: 457783 - RNA, 32 nt, Human
ggccucccaaagugcugggauuacaggccuga

SEQ ID NO: 457784 - RNA, 32 nt, Human
ggccucccaaagugcugggauuacaggccugg

SEQ ID NO: 457785 - RNA, 32 nt, Human
ggccucccaaagugcugggauuacaggcgcaa

SEQ ID NO: 457786 - RNA, 32 nt, Human
ggccucccaaagugcugggauuacaggcgcca

SEQ ID NO: 457787 - RNA, 32 nt, Human
ggccucccaaagugcugggauuacaggcgcga

SEQ ID NO: 457788 - RNA, 32 nt, Human
ggccucccaaagugcugggauuacaggcggga

SEQ ID NO: 457789 - RNA, 32 nt, Human
ggccucccaaagugcugggauuacaggcguca

SEQ ID NO: 457790 - RNA, 32 nt, Human
ggccucccaaagugcugggauuacaggcguga

SEQ ID NO: 457791 - RNA, 32 nt, Human
ggccucccaaagugcugggauuacaggcgugg

SEQ ID NO: 457792 - RNA, 32 nt, Human
ggccucccaaagugcugggauuacaggcguua

SEQ ID NO: 457793 - RNA, 32 nt, Human
ggccucccaaagugcugggauuacaggcucau

SEQ ID NO: 457794 - RNA, 32 nt, Human
ggccucccaaagugcugggauuacaggcugua

SEQ ID NO: 457795 - RNA, 32 nt, Human
ggccucccaaagugcugggauuacaggcuuga

SEQ ID NO: 457796 - RNA, 32 nt, Human
ggccucccaaagugcugggauuacagggauga

SEQ ID NO: 457797 - RNA, 32 nt, Human
ggccucccaaagugcugggauuacagggcacu

SEQ ID NO: 457798 - RNA, 32 nt, Human
ggccucccaaagugcugggauuacaggggagc

SEQ ID NO: 457799 - RNA, 32 nt, Human
ggccucccaaagugcugggauuacagguacga

SEQ ID NO: 457800 - RNA, 32 nt, Human
ggccucccaaagugcugggauuacaggugcga

SEQ ID NO: 457801 - RNA, 32 nt, Human
ggccucccaaagugcugggauuacagguggga

SEQ ID NO: 457802 - RNA, 32 nt, Human
ggccucccaaagugcugggauuacagguguaa

SEQ ID NO: 457803 - RNA, 32 nt, Human
ggccucccaaagugcugggauuacagguguca

SEQ ID NO: 457804 - RNA, 32 nt, Human
ggccucccaaagugcugggauuacagguguga

SEQ ID NO: 457805 - RNA, 32 nt, Human
ggccucccaaagugcugggauuacaggugugc

SEQ ID NO: 457806 - RNA, 32 nt, Human
ggccucccaaagugcugggauuacaggugugg

SEQ ID NO: 457807 - RNA, 32 nt, Human
ggccucccaaagugcugggauuacagguuuga

SEQ ID NO: 457808 - RNA, 32 nt, Human
ggccucccaaagugcugggauuacagucauga

SEQ ID NO: 457809 - RNA, 32 nt, Human
ggccucccaaagugcugggauuacaugcguga

SEQ ID NO: 457810 - RNA, 32 nt, Human
ggccucccaaagugcugggauuaccagcauaa

SEQ ID NO: 457811 - RNA, 32 nt, Human
ggccucccaaagugcugggauuaccggcauga

SEQ ID NO: 457812 - RNA, 32 nt, Human
ggccucccaaagugcugggauuacgggcauga

SEQ ID NO: 457813 - RNA, 32 nt, Human
ggccucccaaagugcugggauuacggguguga

SEQ ID NO: 457814 - RNA, 32 nt, Human
ggccucccaaagugcugggauuacuggcauga

SEQ ID NO: 457815 - RNA, 32 nt, Human
ggccucccaaagugcugggauuacugguauga

SEQ ID NO: 457816 - RNA, 32 nt, Human
ggccucccaaagugcugggauuacuuuacagg

SEQ ID NO: 457817 - RNA, 32 nt, Human
ggccucccaaagugcugggauuagaagcguga

SEQ ID NO: 457818 - RNA, 32 nt, Human
ggccucccaaagugcugggauuagaggcauga

SEQ ID NO: 457819 - RNA, 32 nt, Human
ggccucccaaagugcugggauuagaggcguga

SEQ ID NO: 457820 - RNA, 32 nt, Human
ggccucccaaagugcugggauuagaggcuuga

SEQ ID NO: 457821 - RNA, 32 nt, Human
ggccucccaaagugcugggauuauacauguga

SEQ ID NO: 457822 - RNA, 32 nt, Human
ggccucccaaagugcugggauuauagauguga

SEQ ID NO: 457823 - RNA, 32 nt, Human
ggccucccaaagugcugggauuauaggaguga

SEQ ID NO: 457824 - RNA, 32 nt, Human
ggccucccaaagugcugggauuauaggcacaa

SEQ ID NO: 457825 - RNA, 32 nt, Human
ggccucccaaagugcugggauuauaggcauga

SEQ ID NO: 457826 - RNA, 32 nt, Human
ggccucccaaagugcugggauuauaggcaugc

SEQ ID NO: 457827 - RNA, 32 nt, Human
ggccucccaaagugcugggauuauaggcguaa

SEQ ID NO: 457828 - RNA, 32 nt, Human
ggccucccaaagugcugggauuauaggcguga

SEQ ID NO: 457829 - RNA, 32 nt, Human
ggccucccaaagugcugggauuauaggcgugu

SEQ ID NO: 457830 - RNA, 32 nt, Human
ggccucccaaagugcugggauuauagguguga

SEQ ID NO: 457831 - RNA, 32 nt, Human
ggccucccaaagugcugggauuauggacguga

SEQ ID NO: 457832 - RNA, 32 nt, Human
ggccucccaaagugcugggauuccaggcguga

SEQ ID NO: 457833 - RNA, 32 nt, Human
ggccucccaaagugcugggauucccggcguga

SEQ ID NO: 457834 - RNA, 32 nt, Human
ggccucccaaagugcugggauugcagccguga

SEQ ID NO: 457835 - RNA, 32 nt, Human
ggccucccaaagugcugggauugcaggcauga

SEQ ID NO: 457836 - RNA, 32 nt, Human
ggccucccaaagugcugggauugcaggcguga

SEQ ID NO: 457837 - RNA, 32 nt, Human
ggccucccaaagugcugggauugcagguguga

SEQ ID NO: 457838 - RNA, 32 nt, Human
ggccucccaaagugcugggauuguggguguga

SEQ ID NO: 457839 - RNA, 32 nt, Human
ggccucccaaagugcugggauuucaggcguga

SEQ ID NO: 457840 - RNA, 32 nt, Human
ggccucccaaagugcuguaauuacaggcauga

SEQ ID NO: 457841 - RNA, 32 nt, Human
ggccucccaaagugcugugauuacagguguga

SEQ ID NO: 457842 - RNA, 32 nt, Human
ggccucccaaagugcuuggauuacaggcauga

SEQ ID NO: 457843 - RNA, 32 nt, Human
ggccucccaaagugcuuggauuacagguguaa

SEQ ID NO: 457844 - RNA, 32 nt, Human
ggccucccaaaguggugggauuacagacguga

SEQ ID NO: 457845 - RNA, 32 nt, Human
ggccucccaaaguguagggauuacaggcguga

SEQ ID NO: 457846 - RNA, 32 nt, Human
ggccucccaaaguguggggauuacggguguga

SEQ ID NO: 457847 - RNA, 32 nt, Human
ggccucccaaaguguuaggauuacaggcauga

SEQ ID NO: 457848 - RNA, 32 nt, Human
ggccucccaaaguguuaggauuacaggcguga

SEQ ID NO: 457849 - RNA, 32 nt, Human
ggccucccaaaguguugggauuacaggcaaga

SEQ ID NO: 457850 - RNA, 32 nt, Human
ggccucccaaaguguugggauuacaggcauga

SEQ ID NO: 457851 - RNA, 32 nt, Human
ggccucccaaaguguugggauuacaggcguga

SEQ ID NO: 457852 - RNA, 32 nt, Human
ggccucccaaaguguugggauuacagguguga

SEQ ID NO: 457853 - RNA, 32 nt, Human
ggccucccaaaguguugggauuacaugcauga

SEQ ID NO: 457854 - RNA, 32 nt, Human
ggccucccaaaguguugggauuauaggcauga

SEQ ID NO: 457855 - RNA, 32 nt, Human
ggccucccaaaguguugggauuauaggcguga

SEQ ID NO: 457856 - RNA, 32 nt, Human
ggccucccaaaguguugggauuauagguauga

SEQ ID NO: 457857 - RNA, 32 nt, Human
ggccucccaaaguucagggauuacaggcauga

SEQ ID NO: 457858 - RNA, 32 nt, Human
ggccucccaaaguucuaggauuacagguguga

SEQ ID NO: 457859 - RNA, 32 nt, Human
ggccucccaaaguucucggauuacaggcguga

SEQ ID NO: 457860 - RNA, 32 nt, Human
ggccucccaaaguucugggauuaaaugcguga

SEQ ID NO: 457861 - RNA, 32 nt, Human
ggccucccaaaguucugggauuacaggcauga

SEQ ID NO: 457862 - RNA, 32 nt, Human
ggccucccaaaguucugggauuacaggcguga

SEQ ID NO: 457863 - RNA, 32 nt, Human
ggccucccaaaguucugggauuacaggcuuga

SEQ ID NO: 457864 - RNA, 32 nt, Human
ggccucccaaaguucugggauuacagggguga

SEQ ID NO: 457865 - RNA, 32 nt, Human
ggccucccaaaguucugggauuacaggguguu

SEQ ID NO: 457866 - RNA, 32 nt, Human
ggccucccaaaguucugggauuacagguauga

SEQ ID NO: 457867 - RNA, 32 nt, Human
ggccucccaaaguucugggauuacagguguga

SEQ ID NO: 457868 - RNA, 32 nt, Human
ggccucccaaaguucugggauuacgggcguga

SEQ ID NO: 457869 - RNA, 32 nt, Human
ggccucccaaaguucugggauuauggguguga

SEQ ID NO: 457870 - RNA, 32 nt, Human
ggccucccaaauugcugggauuacagguguga

SEQ ID NO: 457871 - RNA, 32 nt, Human
ggccucccaaauuguugggauuauaggcguga

SEQ ID NO: 457872 - RNA, 32 nt, Human
ggccucccaacaugcugggauuacaggcguga

SEQ ID NO: 457873 - RNA, 32 nt, Human
ggccucccaacgugcuggaauuacaggcauga

SEQ ID NO: 457874 - RNA, 32 nt, Human
ggccucccaacgugcugggauuacagguguga

SEQ ID NO: 457875 - RNA, 32 nt, Human
ggccucccaacgugcugggauuauaggcguga

SEQ ID NO: 457876 - RNA, 22 nt, Human
ggccucccaacucaccccagcc

SEQ ID NO: 457877 - RNA, 32 nt, Human
ggccucccaagcccugauaacaacauggccaa

SEQ ID NO: 457878 - RNA, 32 nt, Human
ggccucccaaggugcuaggauuacaggcauga

SEQ ID NO: 457879 - RNA, 32 nt, Human
ggccucccaaggugcuggaauuacagguguga

SEQ ID NO: 457880 - RNA, 32 nt, Human
ggccucccaaggugcugggauuacaggcauga

SEQ ID NO: 457881 - RNA, 32 nt, Human
ggccucccaaggugcugggauugcaggcguga

SEQ ID NO: 457882 - RNA, 32 nt, Human
ggccucccaaguagcugagacuacaggcacac

SEQ ID NO: 457883 - RNA, 32 nt, Human
ggccucccaaguagcugggacuacaagcgcgc

SEQ ID NO: 457884 - RNA, 32 nt, Human
ggccucccaaguagcugggacuacaggcgccu

SEQ ID NO: 457885 - RNA, 32 nt, Human
ggccucccaaguagcugggacuauaggugcgu

SEQ ID NO: 457886 - RNA, 32 nt, Human
ggccucccaaguagcugggauuacaggugccu

SEQ ID NO: 457887 - RNA, 32 nt, Human
ggccucccaaguagcugggauuacaggugugu

SEQ ID NO: 457888 - RNA, 32 nt, Human
ggccucccaaguagcugggauugcaggugccc

SEQ ID NO: 457889 - RNA, 32 nt, Human
ggccucccaaguaguugggucuacaggcacgc

SEQ ID NO: 457890 - RNA, 32 nt, Human
ggccucccaaguaugugggacuacagguacuc

SEQ ID NO: 457891 - RNA, 32 nt, Human
ggccucccaaguugcugggauuacugacacaa

SEQ ID NO: 457892 - RNA, 32 nt, Human
ggccucccaaguuuugaaaggcuuuccucagc

SEQ ID NO: 457893 - RNA, 32 nt, Human
ggccucccaaugugcuaggauuacaggcgugg

SEQ ID NO: 457894 - RNA, 32 nt, Human
ggccucccaauguguugggauuacaggcguga

SEQ ID NO: 457895 - RNA, 32 nt, Human
ggccucccacaaugcuggaauuacagguguua

SEQ ID NO: 457896 - RNA, 32 nt, Human
ggccucccacagugcugagauuacagguggga

SEQ ID NO: 457897 - RNA, 32 nt, Human
ggccucccacagugcugggauuacaggaguga

SEQ ID NO: 457898 - RNA, 32 nt, Human
ggccucccacagugcugggauuacaggccuga

SEQ ID NO: 457899 - RNA, 32 nt, Human
ggccucccacagugcugggauuacaggcguga

SEQ ID NO: 457900 - RNA, 32 nt, Human
ggccucccacagugcugggauuaccggcguga

SEQ ID NO: 457901 - RNA, 26 nt, Human
ggccucccacaugcccucuuuccucu

SEQ ID NO: 457902 - RNA, 22 nt, Human
ggccucccaccacugcccagcc

SEQ ID NO: 457903 - RNA, 23 nt, Human
ggccucccacccguacaccugcc

SEQ ID NO: 457904 - RNA, 21 nt, Human
ggccucccaccuuaaguucag

SEQ ID NO: 457905 - RNA, 24 nt, Human
ggccucccacgagccccuccagcc

SEQ ID NO: 457906 - RNA, 23 nt, Human
ggccucccacuacagagaugcgu

SEQ ID NO: 457907 - RNA, 24 nt, Human
ggccucccacucagagucuggguc

SEQ ID NO: 457908 - RNA, 21 nt, Human
ggccucccacuccucccagcc

SEQ ID NO: 457909 - RNA, 32 nt, Human
ggccucccagaaccugcuggucugcaggacac

SEQ ID NO: 457910 - RNA, 32 nt, Human
ggccucccagaaugcugggauuacaggcguga

SEQ ID NO: 457911 - RNA, 32 nt, Human
ggccucccagaguauugggauuacagacauga

SEQ ID NO: 457912 - RNA, 32 nt, Human
ggccucccagagugcugagauuacagacguga

SEQ ID NO: 457913 - RNA, 32 nt, Human
ggccucccagagugcugagauuacaggcguga

SEQ ID NO: 457914 - RNA, 32 nt, Human
ggccucccagagugcugagauuuacaggcgug

SEQ ID NO: 457915 - RNA, 32 nt, Human
ggccucccagagugcugggauuacaggcauga

SEQ ID NO: 457916 - RNA, 32 nt, Human
ggccucccagagugcugggauuacaggcguga

SEQ ID NO: 457917 - RNA, 32 nt, Human
ggccucccagagugcugggauuacagggggag

SEQ ID NO: 457918 - RNA, 32 nt, Human
ggccucccagagugcugggauuacagguguga

SEQ ID NO: 457919 - RNA, 32 nt, Human
ggccucccagagugcugggauuagucgucauc

SEQ ID NO: 457920 - RNA, 32 nt, Human
ggccucccagagugcugggauuauaggcguga

SEQ ID NO: 457921 - RNA, 32 nt, Human
ggccucccagagugcugggauuuacaggcaug

SEQ ID NO: 457922 - RNA, 32 nt, Human
ggccucccagcagagcuggaggagggggugac

SEQ ID NO: 457923 - RNA, 24 nt, Human
ggccucccagcagugccgcagcgu

SEQ ID NO: 457924 - RNA, 25 nt, Human
ggccucccagccacauggaacugug

SEQ ID NO: 457925 - RNA, 24 nt, Human
ggccucccagccauguggaacugc

SEQ ID NO: 457926 - RNA, 24 nt, Human
ggccucccagcccaaaucaagcca

SEQ ID NO: 457927 - RNA, 21 nt, Human
ggccucccagcuucccuagcc

SEQ ID NO: 457928 - RNA, 32 nt, Human
ggccucccaggaagugcugggauuacaggcau

SEQ ID NO: 457929 - RNA, 32 nt, Human
ggccucccagguagcugggauuauaggcgugu

SEQ ID NO: 457930 - RNA, 32 nt, Human
ggccucccauaaugcugggauuacaggcguga

SEQ ID NO: 457931 - RNA, 32 nt, Human
ggccucccauagugcugggauuacaggcauga

SEQ ID NO: 457932 - RNA, 32 nt, Human
ggccucccauagugcugggauuacagguguga

SEQ ID NO: 457933 - RNA, 32 nt, Human
ggccucccaugcagaggucagugagagcccaa

SEQ ID NO: 457934 - RNA, 32 nt, Human
ggccuccccaagugcuaggauuacagauguga

SEQ ID NO: 457935 - RNA, 32 nt, Human
ggccuccccaagugcugggauuauaggcauga

SEQ ID NO: 457936 - RNA, 32 nt, Human
ggccuccccaaguguugggauuacaggcguga

SEQ ID NO: 457937 - RNA, 21 nt, Human
ggccuccccaccacaccagcc

SEQ ID NO: 457938 - RNA, 22 nt, Human
ggccuccccacuucuuuccucu

SEQ ID NO: 457939 - RNA, 32 nt, Human
ggccuccccagccaugugaaacugagucaauu

SEQ ID NO: 457940 - RNA, 32 nt, Human
ggccuccccagccauguggaacagugagucaa

SEQ ID NO: 457941 - RNA, 32 nt, Human
ggccuccccagccauguuaaacuuugaguuaa

SEQ ID NO: 457942 - RNA, 32 nt, Human
ggccuccccagccucccucuccaccucccugc

SEQ ID NO: 457943 - RNA, 21 nt, Human
ggccucccccagcuggacccu

SEQ ID NO: 457944 - RNA, 32 nt, Human
ggccuccccugccaugccuccuguacagccug

SEQ ID NO: 457945 - RNA, 32 nt, Human
ggccuccccugccccuccccgcccugccuggc

SEQ ID NO: 457946 - RNA, 32 nt, Human
ggccuccccugccgcugugccaggcaggcagu

SEQ ID NO: 457947 - RNA, 32 nt, Human
ggccuccccugccuuuucuccgguggggauga

SEQ ID NO: 457948 - RNA, 20 nt, Human
ggccuccccugggacugcgu

SEQ ID NO: 457949 - RNA, 32 nt, Human
ggccucccgaaaugcugggauuacaggcauga

SEQ ID NO: 457950 - RNA, 32 nt, Human
ggccucccgaaauguugguauuacaggcauga

SEQ ID NO: 457951 - RNA, 32 nt, Human
ggccucccgaaguccugaagcugggcggcagu

SEQ ID NO: 457952 - RNA, 32 nt, Human
ggccucccgaagugaugagauuauaggcguga

SEQ ID NO: 457953 - RNA, 32 nt, Human
ggccucccgaagugcuaagauuacaggcguga

SEQ ID NO: 457954 - RNA, 32 nt, Human
ggccucccgaagugcuggaauuacaggcguga

SEQ ID NO: 457955 - RNA, 32 nt, Human
ggccucccgaagugcuggcauuacaggcauga

SEQ ID NO: 457956 - RNA, 32 nt, Human
ggccucccgaagugcugggauuacagaaguga

SEQ ID NO: 457957 - RNA, 32 nt, Human
ggccucccgaagugcugggauuacaggcauga

SEQ ID NO: 457958 - RNA, 32 nt, Human
ggccucccgaagugcugggauuacaggcggga

SEQ ID NO: 457959 - RNA, 32 nt, Human
ggccucccgaagugcugggauuacaggcguga

SEQ ID NO: 457960 - RNA, 32 nt, Human
ggccucccgaagugcugggauuauagguguga

SEQ ID NO: 457961 - RNA, 32 nt, Human
ggccucccgaagugcugggauugcaggcauaa

SEQ ID NO: 457962 - RNA, 32 nt, Human
ggccucccgaagugcugggauugcaggcguga

SEQ ID NO: 457963 - RNA, 26 nt, Human
ggccucccgaaucgccuucuuccucu

SEQ ID NO: 457964 - RNA, 32 nt, Human
ggccucccgaguagcuggaaguacagauaauc

SEQ ID NO: 457965 - RNA, 32 nt, Human
ggccucccgaguagcugggacuggaggcgugu

SEQ ID NO: 457966 - RNA, 32 nt, Human
ggccucccgaguagcugggauuacaggugugc

SEQ ID NO: 457967 - RNA, 32 nt, Human
ggccucccgcaaugcugcaauuacagguguua

SEQ ID NO: 457968 - RNA, 23 nt, Human
ggccucccgcacgccccgcaggu

SEQ ID NO: 457969 - RNA, 21 nt, Human
ggccucccgcagccgccgcgg

SEQ ID NO: 457970 - RNA, 22 nt, Human
ggccucccgcaguacgagaagc

SEQ ID NO: 457971 - RNA, 22 nt, Human
ggccucccgccccauccccgcc

SEQ ID NO: 457972 - RNA, 20 nt, Human
ggccucccgcgaucacagcg

SEQ ID NO: 457973 - RNA, 22 nt, Human
ggccucccggcgaccgccgcag

SEQ ID NO: 457974 - RNA, 23 nt, Human
ggccucccggggaccccgcagcg

SEQ ID NO: 457975 - RNA, 32 nt, Human
ggccucccggggugcugggauuauaggcguga

SEQ ID NO: 457976 - RNA, 32 nt, Human
ggccucccggguggcugggauugcaggcaccc

SEQ ID NO: 457977 - RNA, 18 nt, Human
ggccucccgucugucacc

SEQ ID NO: 457978 - RNA, 24 nt, Human
ggccucccgucuugugaacuucaa

SEQ ID NO: 457979 - RNA, 32 nt, Human
ggccucccuaaaugccgggauuacaggcauga

SEQ ID NO: 457980 - RNA, 32 nt, Human
ggccucccuaacagcugggauuacaggcguga

SEQ ID NO: 457981 - RNA, 32 nt, Human
ggccucccuaacagcugggauuuacaggcgug

SEQ ID NO: 457982 - RNA, 32 nt, Human
ggccucccuaagugcugagauuccaggccuga

SEQ ID NO: 457983 - RNA, 32 nt, Human
ggccucccuaagugcugggauuauaggcguga

SEQ ID NO: 457984 - RNA, 32 nt, Human
ggccucccuaaguguugggauuauagguguga

SEQ ID NO: 457985 - RNA, 32 nt, Human
ggccucccuagguguugggauuacaggcguga

SEQ ID NO: 457986 - RNA, 32 nt, Human
ggccucccuaguagcugggauuacaggcgcac

SEQ ID NO: 457987 - RNA, 32 nt, Human
ggccucccuaguaucugugauuacaggcacgu

SEQ ID NO: 457988 - RNA, 17 nt, Human
ggccucccucccacccc

SEQ ID NO: 457989 - RNA, 32 nt, Human
ggccucccuccccugugacucccuccacacag

SEQ ID NO: 457990 - RNA, 32 nt, Human
ggccucccucccgcacacuccugcugcccccg

SEQ ID NO: 457991 - RNA, 22 nt, Human
ggccucccucucccuucccucu

SEQ ID NO: 457992 - RNA, 24 nt, Human
ggccucccucugaugaccccagcc

SEQ ID NO: 457993 - RNA, 23 nt, Human
ggccucccucuuacuaaaaacaa

SEQ ID NO: 457994 - RNA, 19 nt, Human
ggccucccugaaacacugc

SEQ ID NO: 457995 - RNA, 32 nt, Human
ggccucccugaggagcagaggccaacagcacg

SEQ ID NO: 457996 - RNA, 32 nt, Human
ggccucccuggaccagcagcucugacucacac

SEQ ID NO: 457997 - RNA, 20 nt, Human
ggccucccugggcugcugug

SEQ ID NO: 457998 - RNA, 20 nt, Human
ggccucccuggggacauugu

SEQ ID NO: 457999 - RNA, 24 nt, Human
ggccucccuuccccagaggcuggu

SEQ ID NO: 458000 - RNA, 32 nt, Human
ggccucccuuccccucuucuuucuuuguucuc

SEQ ID NO: 458001 - RNA, 32 nt, Human
ggccucccuucccuuacaaugugccuuugggg

SEQ ID NO: 458002 - RNA, 32 nt, Human
ggccucccuugaauucaccacacacauaccag

SEQ ID NO: 458003 - RNA, 32 nt, Human
ggccuccgaaaaugcugggauuacaggcguga

SEQ ID NO: 458004 - RNA, 32 nt, Human
ggccuccgaaaaugcugggauuacagguguga

SEQ ID NO: 458005 - RNA, 32 nt, Human
ggccuccgaaagugcuaggauuacagguguga

SEQ ID NO: 458006 - RNA, 32 nt, Human
ggccuccgaaagugcugggauuacaggcguga

SEQ ID NO: 458007 - RNA, 25 nt, Human
ggccuccgcagguucugcgcuccag

SEQ ID NO: 458008 - RNA, 21 nt, Human
ggccuccgccaugaaccccag

SEQ ID NO: 458009 - RNA, 22 nt, Human
ggccuccgcccucuccuccucu

SEQ ID NO: 458010 - RNA, 32 nt, Human
ggccuccgccuggggaaggcuugugcggcggu

SEQ ID NO: 458011 - RNA, 32 nt, Human
ggccuccgcuggaaaugcaaagugauucuaga

SEQ ID NO: 458012 - RNA, 25 nt, Human
ggccuccgcuuuccucucucccccu

SEQ ID NO: 458013 - RNA, 32 nt, Human
ggccuccggaagugcugggauuacaggcguga

SEQ ID NO: 458014 - RNA, 19 nt, Human
ggccuccguccccauggcc

SEQ ID NO: 458015 - RNA, 32 nt, Human
ggccuccgucugcacacaguguucgucugcac

SEQ ID NO: 458016 - RNA, 32 nt, Human
ggccuccuaaagugcugagauuacagguguga

SEQ ID NO: 458017 - RNA, 28 nt, Human
ggccuccuaaagugcuggcauuacaggc

SEQ ID NO: 458018 - RNA, 32 nt, Human
ggccuccuaaagugcugggauaacaggcguga

SEQ ID NO: 458019 - RNA, 32 nt, Human
ggccuccuaaagugcugggaucacaggcguga

SEQ ID NO: 458020 - RNA, 32 nt, Human
ggccuccuaaagugcugggauuacaggcacgc

SEQ ID NO: 458021 - RNA, 32 nt, Human
ggccuccuaaagugcugggauuacaggcaucu

SEQ ID NO: 458022 - RNA, 32 nt, Human
ggccuccuaaagugcugggauuacaggcauga

SEQ ID NO: 458023 - RNA, 32 nt, Human
ggccuccuaaagugcugggauuacaggcguga

SEQ ID NO: 458024 - RNA, 32 nt, Human
ggccuccuaaagugcugggauuacagguguga

SEQ ID NO: 458025 - RNA, 32 nt, Human
ggccuccuaaagugcugggauuacaugagcca

SEQ ID NO: 458026 - RNA, 32 nt, Human
ggccuccuaaagugcugggauuccagguguga

SEQ ID NO: 458027 - RNA, 32 nt, Human
ggccuccuaaaguucugggauuacaggaguga

SEQ ID NO: 458028 - RNA, 32 nt, Human
ggccuccuaaguagcagggauuacaggcaugc

SEQ ID NO: 458029 - RNA, 22 nt, Human
ggccuccuacaagaccaagcca

SEQ ID NO: 458030 - RNA, 22 nt, Human
ggccuccuaccuccacgagguc

SEQ ID NO: 458031 - RNA, 32 nt, Human
ggccuccuagagugcugggauuacagguguga

SEQ ID NO: 458032 - RNA, 32 nt, Human
ggccuccuagggugcugggauugcaggccuga

SEQ ID NO: 458033 - RNA, 21 nt, Human
ggccuccucacgggagcugcg

SEQ ID NO: 458034 - RNA, 22 nt, Human
ggccuccucagccucuuuccuc

SEQ ID NO: 458035 - RNA, 32 nt, Human
ggccuccucaugcuggccuuucuuggaagaag

SEQ ID NO: 458036 - RNA, 20 nt, Human
ggccuccuccagcagagacc

SEQ ID NO: 458037 - RNA, 18 nt, Human
ggccuccucccugcugcc

SEQ ID NO: 458038 - RNA, 32 nt, Human
ggccuccucccuucugagcacacacacaaccg

SEQ ID NO: 458039 - RNA, 22 nt, Human
ggccuccucucugccaccaccc

SEQ ID NO: 458040 - RNA, 23 nt, Human
ggccuccucuugcuaccucuuua

SEQ ID NO: 458041 - RNA, 32 nt, Human
ggccuccugaagugcugggauuacaggcauga

SEQ ID NO: 458042 - RNA, 32 nt, Human
ggccuccugaagugcugggauuacaggcgugg

SEQ ID NO: 458043 - RNA, 32 nt, Human
ggccuccugaaguguuaggauuacaggcguga

SEQ ID NO: 458044 - RNA, 32 nt, Human
ggccuccugaaguguugggauuacaggcguga

SEQ ID NO: 458045 - RNA, 32 nt, Human
ggccuccugagcagcugggacuacaggcgcau

SEQ ID NO: 458046 - RNA, 23 nt, Human
ggccuccugagcguggagcugcg

SEQ ID NO: 458047 - RNA, 21 nt, Human
ggccuccugaggaccacagcc

SEQ ID NO: 458048 - RNA, 21 nt, Human
ggccuccugaguaccugggau

SEQ ID NO: 458049 - RNA, 32 nt, Human
ggccuccugaguaccugggauuauaggcacaa

SEQ ID NO: 458050 - RNA, 32 nt, Human
ggccuccugaguagcuaagaccacaggugugu

SEQ ID NO: 458051 - RNA, 32 nt, Human
ggccuccugaguagcuaagggaggagucuuga

SEQ ID NO: 458052 - RNA, 32 nt, Human
ggccuccugaguagcugggacgacaggcgugc

SEQ ID NO: 458053 - RNA, 32 nt, Human
ggccuccugaguagcugggacuacagggacua

SEQ ID NO: 458054 - RNA, 32 nt, Human
ggccuccugaguagcugggacugcaguuguaa

SEQ ID NO: 458055 - RNA, 32 nt, Human
ggccuccugaguagcugggauuacaggcaugc

SEQ ID NO: 458056 - RNA, 32 nt, Human
ggccuccugaguagcugggauugcagguaugc

SEQ ID NO: 458057 - RNA, 32 nt, Human
ggccuccugaguagcugggauuucaggccaug

SEQ ID NO: 458058 - RNA, 32 nt, Human
ggccuccugaguagcugggguugcaggugugc

SEQ ID NO: 458059 - RNA, 32 nt, Human
ggccuccugaguggcugggauugcaggugugc

SEQ ID NO: 458060 - RNA, 32 nt, Human
ggccuccugauuagcugggauuacaggcaugu

SEQ ID NO: 458061 - RNA, 32 nt, Human
ggccuccugcagccccuacuuccacgccaugu

SEQ ID NO: 458062 - RNA, 32 nt, Human
ggccuccugcagcuggacuccagcgccugccc

SEQ ID NO: 458063 - RNA, 32 nt, Human
ggccuccugccugaacagguaguugggguugg

SEQ ID NO: 458064 - RNA, 30 nt, Human
ggccuccugccuggcacuucauguuucucu

SEQ ID NO: 458065 - RNA, 32 nt, Human
ggccuccugccuggccgcccagggcuggccgc

SEQ ID NO: 458066 - RNA, 32 nt, Human
ggccuccugccugggccugccuugcagcuggc

SEQ ID NO: 458067 - RNA, 32 nt, Human
ggccuccuggaggaggaaguggaggccgcugc

SEQ ID NO: 458068 - RNA, 20 nt, Human
ggccuccuggccucucccuc

SEQ ID NO: 458069 - RNA, 23 nt, Human
ggccuccuggggugcucucgcca

SEQ ID NO: 458070 - RNA, 32 nt, Human
ggccuccuguaaucccagcuacuugggaggcu

SEQ ID NO: 458071 - RNA, 21 nt, Human
ggccuccugucgcaacugcgu

SEQ ID NO: 458072 - RNA, 32 nt, Human
ggccuccugucuacagcagcuuccucaguuuc

SEQ ID NO: 458073 - RNA, 32 nt, Human
ggccuccugugcagaacuggaccccaggggug

SEQ ID NO: 458074 - RNA, 26 nt, Human
ggccuccuucacaaugugaagcugug

SEQ ID NO: 458075 - RNA, 32 nt, Human
ggccuccuucagcccccuccuccugggggaug

SEQ ID NO: 458076 - RNA, 32 nt, Human
ggccuccuuccugcccuucugccugccugugu

SEQ ID NO: 458077 - RNA, 19 nt, Human
ggccuccuugcugacugcg

SEQ ID NO: 458078 - RNA, 32 nt, Human
ggccuccuuggcuggcaugguucuguguuacg

SEQ ID NO: 458079 - RNA, 19 nt, Human
ggccuccuuuccuccuccu

SEQ ID NO: 458080 - RNA, 32 nt, Human
ggccucgagauggcagagcggaggcguucccu

SEQ ID NO: 458081 - RNA, 32 nt, Human
ggccucgagccgggaggaagggggcuuccgga

SEQ ID NO: 458082 - RNA, 32 nt, Human
ggccucgaggcagguggaucaccugaggucag

SEQ ID NO: 458083 - RNA, 20 nt, Human
ggccucgaggggccucccgg

SEQ ID NO: 458084 - RNA, 23 nt, Human
ggccucgaggugccaggcagcau

SEQ ID NO: 458085 - RNA, 19 nt, Human
ggccucgauccgccuuccc

SEQ ID NO: 458086 - RNA, 24 nt, Human
ggccucgaucuccugaccucguga

SEQ ID NO: 458087 - RNA, 24 nt, Human
ggccucgaucucuugaccucguga

SEQ ID NO: 458088 - RNA, 32 nt, Human
ggccucgcaguggauggaggaggcccagcccu

SEQ ID NO: 458089 - RNA, 32 nt, Human
ggccucgccaugaggcucuuccugucgcuccc

SEQ ID NO: 458090 - RNA, 25 nt, Human
ggccucgccugggcccuucuuccuc

SEQ ID NO: 458091 - RNA, 22 nt, Human
ggccucgcggaaggcccgcucg

SEQ ID NO: 458092 - RNA, 23 nt, Human
ggccucgcucccucccuucaccu

SEQ ID NO: 458093 - RNA, 32 nt, Human
ggccucgcucucgccucaccccggcuccuggg

SEQ ID NO: 458094 - RNA, 21 nt, Human
ggccucgcucuguuuuuucca

SEQ ID NO: 458095 - RNA, 32 nt, Human
ggccucgcugcacucauggcuucuccuagcaa

SEQ ID NO: 458096 - RNA, 16 nt, Human
ggccucgcugcugcug

SEQ ID NO: 458097 - RNA, 32 nt, Human
ggccucgcugggacucccugggagaugaggcc

SEQ ID NO: 458098 - RNA, 21 nt, Human
ggccucggaaaacaauggagu

SEQ ID NO: 458099 - RNA, 32 nt, Human
ggccucggaaagugcugggauuacggggguga

SEQ ID NO: 458100 - RNA, 32 nt, Human
ggccucggaaccagcuuuucucucuuacgaug

SEQ ID NO: 458101 - RNA, 32 nt, Human
ggccucggaccagccauuucgguguagaagug

SEQ ID NO: 458102 - RNA, 19 nt, Human
ggccucggaccgcccacuc

SEQ ID NO: 458103 - RNA, 21 nt, Human
ggccucggacuccgccgcucg

SEQ ID NO: 458104 - RNA, 32 nt, Human
ggccucggagacuuggaggaggacgcucugga

SEQ ID NO: 458105 - RNA, 32 nt, Human
ggccucggagccgccuccgccgggaggggucg

SEQ ID NO: 458106 - RNA, 21 nt, Human
ggccucggcagccaugcccgc

SEQ ID NO: 458107 - RNA, 21 nt, Human
ggccucggcgcgcccgccucg

SEQ ID NO: 458108 - RNA, 32 nt, Human
ggccucgggauguccagcccagugcuccuucc

SEQ ID NO: 458109 - RNA, 21 nt, Human
ggccucgggauucgcccgccg

SEQ ID NO: 458110 - RNA, 21 nt, Human
ggccucgggcuccucugccca

SEQ ID NO: 458111 - RNA, 32 nt, Human
ggccucggggcuguccuucauugcccacaugg

SEQ ID NO: 458112 - RNA, 32 nt, Human
ggccucgggguuucccccugugcccugacagc

SEQ ID NO: 458113 - RNA, 32 nt, Human
ggccucggucccuccugcaccugcugccugga

SEQ ID NO: 458114 - RNA, 32 nt, Human
ggccucggucugcgggcggugcagcccggaac

SEQ ID NO: 458115 - RNA, 23 nt, Human
ggccucggugcaccccagccucc

SEQ ID NO: 458116 - RNA, 22 nt, Human
ggccucggugcagguacagcuc

SEQ ID NO: 458117 - RNA, 21 nt, Human
ggccucggugccacccagccg

SEQ ID NO: 458118 - RNA, 21 nt, Human
ggccucgguguccuuaucugu

SEQ ID NO: 458119 - RNA, 17 nt, Human
ggccucgucccucugcu

SEQ ID NO: 458120 - RNA, 32 nt, Human
ggccucgugcagggacgcucaggcugcuccca

SEQ ID NO: 458121 - RNA, 21 nt, Human
ggccucuacuaggucugcucc

SEQ ID NO: 458122 - RNA, 32 nt, Human
ggccucuacucucuccucccucuggcucugcc

SEQ ID NO: 458123 - RNA, 32 nt, Human
ggccucuacugcccuggcugcagucagugccc

SEQ ID NO: 458124 - RNA, 20 nt, Human
ggccucuagccuccauggcu

SEQ ID NO: 458125 - RNA, 32 nt, Human
ggccucucaaaaugcugggauuacagguguga

SEQ ID NO: 458126 - RNA, 32 nt, Human
ggccucucaaacugcugggauuacaggcacgc

SEQ ID NO: 458127 - RNA, 32 nt, Human
ggccucucaaagcacugggauuacagguguga

SEQ ID NO: 458128 - RNA, 32 nt, Human
ggccucucaaagugcugggauuaaaggcguaa

SEQ ID NO: 458129 - RNA, 32 nt, Human
ggccucucaaagugcugggauuacaggcauga

SEQ ID NO: 458130 - RNA, 32 nt, Human
ggccucucaaagugcugggauuacaggcguga

SEQ ID NO: 458131 - RNA, 32 nt, Human
ggccucucaaagugcugggauuacaggcgugg

SEQ ID NO: 458132 - RNA, 32 nt, Human
ggccucucaaagugcugggauuacaggcuuac

SEQ ID NO: 458133 - RNA, 32 nt, Human
ggccucucaaagugcugggauuacagguguga

SEQ ID NO: 458134 - RNA, 32 nt, Human
ggccucucaaagugcugggauuacgggcguga

SEQ ID NO: 458135 - RNA, 32 nt, Human
ggccucucaaagugcugggauuauaggcauga

SEQ ID NO: 458136 - RNA, 32 nt, Human
ggccucucaaagugcugggauuauaggcguga

SEQ ID NO: 458137 - RNA, 32 nt, Human
ggccucucaaaguguugggauuacaggcguga

SEQ ID NO: 458138 - RNA, 32 nt, Human
ggccucucaaaguguugggauuacguguguaa

SEQ ID NO: 458139 - RNA, 32 nt, Human
ggccucucacuccugccgucauggccuccaaa

SEQ ID NO: 458140 - RNA, 32 nt, Human
ggccucucagaaccauguuccccagccaggug

SEQ ID NO: 458141 - RNA, 21 nt, Human
ggccucucaucccccuucuuc

SEQ ID NO: 458142 - RNA, 32 nt, Human
ggccucucauuuccuuacacucugacaugaau

SEQ ID NO: 458143 - RNA, 23 nt, Human
ggccucuccacccucagcccccu

SEQ ID NO: 458144 - RNA, 23 nt, Human
ggccucuccacugucuccacucu

SEQ ID NO: 458145 - RNA, 32 nt, Human
ggccucuccacugucuccacucuccagcgccc

SEQ ID NO: 458146 - RNA, 20 nt, Human
ggccucuccagcccuccucu

SEQ ID NO: 458147 - RNA, 23 nt, Human
ggccucuccagccucagcccccu

SEQ ID NO: 458148 - RNA, 18 nt, Human
ggccucuccaggugcaaa

SEQ ID NO: 458149 - RNA, 32 nt, Human
ggccucuccaguagcugggauuacaggugugc

SEQ ID NO: 458150 - RNA, 19 nt, Human
ggccucuccaguuugcacc

SEQ ID NO: 458151 - RNA, 32 nt, Human
ggccucuccccaucccccucuucuccgcacgu

SEQ ID NO: 458152 - RNA, 17 nt, Human
ggccucucccccacccc

SEQ ID NO: 458153 - RNA, 32 nt, Human
ggccucuccccugcaggacuggcauugcacua

SEQ ID NO: 458154 - RNA, 32 nt, Human
ggccucuccccuuuaccccuccagagaagggg

SEQ ID NO: 458155 - RNA, 20 nt, Human
ggccucucccucccucccuc

SEQ ID NO: 458156 - RNA, 32 nt, Human
ggccucucccucccucccucccucucuguccc

SEQ ID NO: 458157 - RNA, 32 nt, Human
ggccucucccuuucuccuuuaaaacaaaugaa

SEQ ID NO: 458158 - RNA, 21 nt, Human
ggccucucccuuuuccccccu

SEQ ID NO: 458159 - RNA, 21 nt, Human
ggccucuccuccccuccccuc

SEQ ID NO: 458160 - RNA, 21 nt, Human
ggccucuccuccucauccucu

SEQ ID NO: 458161 - RNA, 20 nt, Human
ggccucuccuccucccuucc

SEQ ID NO: 458162 - RNA, 24 nt, Human
ggccucuccucggccugcuccucu

SEQ ID NO: 458163 - RNA, 23 nt, Human
ggccucuccugaugucccucucc

SEQ ID NO: 458164 - RNA, 32 nt, Human
ggccucuccugcugcugaccugaucaccucug

SEQ ID NO: 458165 - RNA, 32 nt, Human
ggccucuccuuuccuuucccugccuggagccu

SEQ ID NO: 458166 - RNA, 32 nt, Human
ggccucucgaagugcugggauuccaggcguga

SEQ ID NO: 458167 - RNA, 32 nt, Human
ggccucucgaguagaugggauuauaggcaugu

SEQ ID NO: 458168 - RNA, 32 nt, Human
ggccucucgcucacuccucccagcccaguaau

SEQ ID NO: 458169 - RNA, 18 nt, Human
ggccucucgucuacugcc

SEQ ID NO: 458170 - RNA, 32 nt, Human
ggccucucuaaaugcugggauugcaggcguga

SEQ ID NO: 458171 - RNA, 31 nt, Human
ggccucucuagcuugcggccugugucuaugg

SEQ ID NO: 458172 - RNA, 23 nt, Human
ggccucucuagggaagucugguu

SEQ ID NO: 458173 - RNA, 24 nt, Human
ggccucucuauccucucuuccucu

SEQ ID NO: 458174 - RNA, 32 nt, Human
ggccucucucagaacaaccugcgggugcacua

SEQ ID NO: 458175 - RNA, 32 nt, Human
ggccucucucaggugaguccagguuaaacugu

SEQ ID NO: 458176 - RNA, 32 nt, Human
ggccucucuccccucucucuuuuccuccuucu

SEQ ID NO: 458177 - RNA, 23 nt, Human
ggccucucuccgaacccuuucuc

SEQ ID NO: 458178 - RNA, 32 nt, Human
ggccucucuccucucaucgggccugauaaggg

SEQ ID NO: 458179 - RNA, 32 nt, Human
ggccucucuccugccugcccugccucagccag

SEQ ID NO: 458180 - RNA, 18 nt, Human
ggccucucuccugcugcu

SEQ ID NO: 458181 - RNA, 32 nt, Human
ggccucucucucgcucucucucccucuaaucu

SEQ ID NO: 458182 - RNA, 23 nt, Human
ggccucucucuguuccucccucu

SEQ ID NO: 458183 - RNA, 22 nt, Human
ggccucucugaggacucugggu

SEQ ID NO: 458184 - RNA, 22 nt, Human
ggccucucugcagaccucuucc

SEQ ID NO: 458185 - RNA, 26 nt, Human
ggccucucugcaguccucucacccuc

SEQ ID NO: 458186 - RNA, 32 nt, Human
ggccucucugcaguccucucacccucccucag

SEQ ID NO: 458187 - RNA, 23 nt, Human
ggccucucugcggggcucacucu

SEQ ID NO: 458188 - RNA, 22 nt, Human
ggccucucugcucacccacucu

SEQ ID NO: 458189 - RNA, 23 nt, Human
ggccucucuggcuauggaugugu

SEQ ID NO: 458190 - RNA, 22 nt, Human
ggccucucugggccuuuccucu

SEQ ID NO: 458191 - RNA, 21 nt, Human
ggccucucugggccuuugugu

SEQ ID NO: 458192 - RNA, 21 nt, Human
ggccucucuuacuagacugcg

SEQ ID NO: 458193 - RNA, 32 nt, Human
ggccucucuuauaucagacugcagcuccuggu

SEQ ID NO: 458194 - RNA, 32 nt, Human
ggccucugaaagugcugggauuacaggcguga

SEQ ID NO: 458195 - RNA, 32 nt, Human
ggccucugaagggauuccucacugugggcagc

SEQ ID NO: 458196 - RNA, 24 nt, Human
ggccucugacaaauaaacaagcca

SEQ ID NO: 458197 - RNA, 32 nt, Human
ggccucugacccugcugcccauucuuuccaac

SEQ ID NO: 458198 - RNA, 32 nt, Human
ggccucugagcaccuucuagcucacggguagu

SEQ ID NO: 458199 - RNA, 22 nt, Human
ggccucugagcccaagccaagc

SEQ ID NO: 458200 - RNA, 24 nt, Human
ggccucugagcccaagccaagcca

SEQ ID NO: 458201 - RNA, 24 nt, Human
ggccucugagcccaagcuaagcca

SEQ ID NO: 458202 - RNA, 32 nt, Human
ggccucugaggaugucagcuccuggcucccug

SEQ ID NO: 458203 - RNA, 32 nt, Human
ggccucugagugugucuggcucugagagaguc

SEQ ID NO: 458204 - RNA, 23 nt, Human
ggccucugaucagcugguucccu

SEQ ID NO: 458205 - RNA, 32 nt, Human
ggccucugauugcuguccucucuuguccucuu

SEQ ID NO: 458206 - RNA, 20 nt, Human
ggccucugcaccugggucca

SEQ ID NO: 458207 - RNA, 32 nt, Human
ggccucugcacuccagccugggugacagagug

SEQ ID NO: 458208 - RNA, 32 nt, Human
ggccucugcagaagccaagggaagacaguggu

SEQ ID NO: 458209 - RNA, 32 nt, Human
ggccucugcaggagcaaaacugccucaagucg

SEQ ID NO: 458210 - RNA, 32 nt, Human
ggccucugcaucccuggcuggagaaugcgcac

SEQ ID NO: 458211 - RNA, 32 nt, Human
ggccucugccaaggaaauaauauggaccauuu

SEQ ID NO: 458212 - RNA, 32 nt, Human
ggccucugccaguguccccagcacuuuuaggu

SEQ ID NO: 458213 - RNA, 32 nt, Human
ggccucugccccaagagcaggaggugccugaa

SEQ ID NO: 458214 - RNA, 22 nt, Human
ggccucugcgcgccucgccccg

SEQ ID NO: 458215 - RNA, 20 nt, Human
ggccucugcggagcccuggg

SEQ ID NO: 458216 - RNA, 18 nt, Human
ggccucugcguccgggag

SEQ ID NO: 458217 - RNA, 22 nt, Human
ggccucugcuucucucuugcuc

SEQ ID NO: 458218 - RNA, 28 nt, Human
ggccucugcuuuggggaugggaaugugu

SEQ ID NO: 458219 - RNA, 32 nt, Human
ggccucuggaguagcugggacuacaggugccc

SEQ ID NO: 458220 - RNA, 23 nt, Human
ggccucuggcaccaccaccaccg

SEQ ID NO: 458221 - RNA, 20 nt, Human
ggccucuggcgugccugcca

SEQ ID NO: 458222 - RNA, 23 nt, Human
ggccucuggcuccuucuuccucu

SEQ ID NO: 458223 - RNA, 32 nt, Human
ggccucuggcugcagugaugccgcagaauccu

SEQ ID NO: 458224 - RNA, 29 nt, Human
ggccucuggcugcucacacccugccagag

SEQ ID NO: 458225 - RNA, 19 nt, Human
ggccucuggcuuccaggcc

SEQ ID NO: 458226 - RNA, 32 nt, Human
ggccucugggacugaaggcuuccccaagauca

SEQ ID NO: 458227 - RNA, 32 nt, Human
ggccucugggagccaccuccaaucccucacca

SEQ ID NO: 458228 - RNA, 32 nt, Human
ggccucugggaggccaggauggcacuguuggc

SEQ ID NO: 458229 - RNA, 32 nt, Human
ggccucugggcagaggaugcaauggcacggac

SEQ ID NO: 458230 - RNA, 32 nt, Human
ggccucugggccaccagcgucugaaucccgga

SEQ ID NO: 458231 - RNA, 32 nt, Human
ggccucuggggagggggugcaaaagaggagcg

SEQ ID NO: 458232 - RNA, 22 nt, Human
ggccucuguaaagccaccagcc

SEQ ID NO: 458233 - RNA, 24 nt, Human
ggccucuguagcuccaucugugga

SEQ ID NO: 458234 - RNA, 32 nt, Human
ggccucugucccggaagagucaugggagguga

SEQ ID NO: 458235 - RNA, 32 nt, Human
ggccucugucuccaucucugcccuuugaaaca

SEQ ID NO: 458236 - RNA, 32 nt, Human
ggccucugucugagcaaaccugggugugaauu

SEQ ID NO: 458237 - RNA, 32 nt, Human
ggccucugugaccugcuagggugcaggaggcu

SEQ ID NO: 458238 - RNA, 32 nt, Human
ggccucugugaucuccccugggaacaggacgg

SEQ ID NO: 458239 - RNA, 32 nt, Human
ggccucugugcagccucaucuccuggaaucug

SEQ ID NO: 458240 - RNA, 32 nt, Human
ggccucuguguggggagagaucaggaauguuc

SEQ ID NO: 458241 - RNA, 24 nt, Human
ggccucuguuucuuuaucugugaa

SEQ ID NO: 458242 - RNA, 24 nt, Human
ggccucuguuuucucaucugugaa

SEQ ID NO: 458243 - RNA, 32 nt, Human
ggccucuuaaagugcugggauuacaggcguga

SEQ ID NO: 458244 - RNA, 32 nt, Human
ggccucuucagucugucucaggagacugggag

SEQ ID NO: 458245 - RNA, 19 nt, Human
ggccucuuccacccaccca

SEQ ID NO: 458246 - RNA, 21 nt, Human
ggccucuucccccuucccucu

SEQ ID NO: 458247 - RNA, 19 nt, Human
ggccucuuccccucuuccu

SEQ ID NO: 458248 - RNA, 32 nt, Human
ggccucuuccgugacgucacuggaccacuggg

SEQ ID NO: 458249 - RNA, 32 nt, Human
ggccucuuccucagcuuuaucucccuuuccuu

SEQ ID NO: 458250 - RNA, 32 nt, Human
ggccucuucuacccauccauguuucuaccucc

SEQ ID NO: 458251 - RNA, 20 nt, Human
ggccucuucucccuucacuc

SEQ ID NO: 458252 - RNA, 32 nt, Human
ggccucuucuuucccagcuccugccuccuggu

SEQ ID NO: 458253 - RNA, 32 nt, Human
ggccucuucuuuguaccagcagcccugcauac

SEQ ID NO: 458254 - RNA, 20 nt, Human
ggccucuugagccaggggga

SEQ ID NO: 458255 - RNA, 24 nt, Human
ggccucuugcugaaagccaaggca

SEQ ID NO: 458256 - RNA, 32 nt, Human
ggccucuuggcagaggcuggaggacucugggg

SEQ ID NO: 458257 - RNA, 24 nt, Human
ggccucuuuauuucucuccacccu

SEQ ID NO: 458258 - RNA, 32 nt, Human
ggccucuuucccucugucugugcuuguguugu

SEQ ID NO: 458259 - RNA, 32 nt, Human
ggccucuuucuucucaagcuccuccugacagc

SEQ ID NO: 458260 - RNA, 32 nt, Human
ggccucuuugaagaaauggccagaagugagcg

SEQ ID NO: 458261 - RNA, 21 nt, Human
ggccucuuugcucuccccucu

SEQ ID NO: 458262 - RNA, 32 nt, Human
ggccucuuugcucuccccucuugccucaggaa

SEQ ID NO: 458263 - RNA, 32 nt, Human
ggccucuuugcugccaggacagcaucagcuca

SEQ ID NO: 458264 - RNA, 32 nt, Human
ggccucuuuguuacaaaaugauuugcaaagaa

SEQ ID NO: 458265 - RNA, 32 nt, Human
ggccucuuuugucacauauugcucaucuguga

SEQ ID NO: 458266 - RNA, 32 nt, Human
ggccugaaacagcccugccagccccggcgguc

SEQ ID NO: 458267 - RNA, 30 nt, Human
ggccugaacagcuggguggucagugaaccc

SEQ ID NO: 458268 - RNA, 32 nt, Human
ggccugaagaacugaaagaaccucuuauuuug

SEQ ID NO: 458269 - RNA, 32 nt, Human
ggccugaagccuaggcuggaggguucagucgg

SEQ ID NO: 458270 - RNA, 32 nt, Human
ggccugaagggaaaugaggcagcugcuguguc

SEQ ID NO: 458271 - RNA, 32 nt, Human
ggccugaagggagaguuucaguucuucauuga

SEQ ID NO: 458272 - RNA, 22 nt, Human
ggccugaaguccuggguuccag

SEQ ID NO: 458273 - RNA, 32 nt, Human
ggccugacacuggcugccccagcggggaccac

SEQ ID NO: 458274 - RNA, 32 nt, Human
ggccugacagacaagcagaugaccucacagga

SEQ ID NO: 458275 - RNA, 21 nt, Human
ggccugacaugcugggccccu

SEQ ID NO: 458276 - RNA, 32 nt, Human
ggccugacccagcauccucugccuucuaggaa

SEQ ID NO: 458277 - RNA, 18 nt, Human
ggccugaccccagagugg

SEQ ID NO: 458278 - RNA, 32 nt, Human
ggccugaccuggcuguugauguucuagagagg

SEQ ID NO: 458279 - RNA, 32 nt, Human
ggccugaccuucagcaaaguucuugaaauuua

SEQ ID NO: 458280 - RNA, 18 nt, Human
ggccugacgcagcucccu

SEQ ID NO: 458281 - RNA, 32 nt, Human
ggccugacucagacugcauucuccacuucuug

SEQ ID NO: 458282 - RNA, 32 nt, Human
ggccugacuccaauuaacaaagaaggacgugg

SEQ ID NO: 458283 - RNA, 19 nt, Human
ggccugacugaaaggagac

SEQ ID NO: 458284 - RNA, 32 nt, Human
ggccugacuggggucugaagaucagggucagu

SEQ ID NO: 458285 - RNA, 32 nt, Human
ggccugacuguauuuuucauccaucuuuucug

SEQ ID NO: 458286 - RNA, 18 nt, Human
ggccugacuucugcuggc

SEQ ID NO: 458287 - RNA, 20 nt, Human
ggccugagacaccugcccca

SEQ ID NO: 458288 - RNA, 32 nt, Human
ggccugagaccacccaaggucuuuuaacagaa

SEQ ID NO: 458289 - RNA, 32 nt, Human
ggccugagagcugaagagcaccagguuuggug

SEQ ID NO: 458290 - RNA, 32 nt, Human
ggccugagauucugcauuuuucccaagucccu

SEQ ID NO: 458291 - RNA, 32 nt, Human
ggccugagcaggaggaagaggaggaggcccgu

SEQ ID NO: 458292 - RNA, 17 nt, Human
ggccugagccaggguga

SEQ ID NO: 458293 - RNA, 20 nt, Human
ggccugagcccccugcugcc

SEQ ID NO: 458294 - RNA, 22 nt, Human
ggccugagccccuccaccugcu

SEQ ID NO: 458295 - RNA, 19 nt, Human
ggccugagccgcugcugcc

SEQ ID NO: 458296 - RNA, 32 nt, Human
ggccugagccuccugaaguugcugcugugaau

SEQ ID NO: 458297 - RNA, 31 nt, Human
ggccugagccucucucccugugucucuguau

SEQ ID NO: 458298 - RNA, 17 nt, Human
ggccugagcuccagguc

SEQ ID NO: 458299 - RNA, 32 nt, Human
ggccugagcucccuccagcuguuuucacucau

SEQ ID NO: 458300 - RNA, 32 nt, Human
ggccugagcuuagucacauggccacacccagc

SEQ ID NO: 458301 - RNA, 17 nt, Human
ggccugaggacuauaga

SEQ ID NO: 458302 - RNA, 32 nt, Human
ggccugaggagcagcaguugcugguggcuaau

SEQ ID NO: 458303 - RNA, 32 nt, Human
ggccugaggagcagcccugccugcugcucuuc

SEQ ID NO: 458304 - RNA, 22 nt, Human
ggccugaggccaucgccaggua

SEQ ID NO: 458305 - RNA, 32 nt, Human
ggccugaggccucgcucaguggcgucuggggu

SEQ ID NO: 458306 - RNA, 17 nt, Human
ggccugaggccugugcc

SEQ ID NO: 458307 - RNA, 32 nt, Human
ggccugaggcuucacaguaccuggaccagcag

SEQ ID NO: 458308 - RNA, 32 nt, Human
ggccugagggagaagcagggauaggugggcug

SEQ ID NO: 458309 - RNA, 32 nt, Human
ggccugagggccucggacgcgggugccuacac

SEQ ID NO: 458310 - RNA, 32 nt, Human
ggccugaggggccugggcucagaguccacguc

SEQ ID NO: 458311 - RNA, 32 nt, Human
ggccugagguagcagugggucacuuugaucca

SEQ ID NO: 458312 - RNA, 16 nt, Human
ggccugaguggccagg

SEQ ID NO: 458313 - RNA, 22 nt, Human
ggccugaguuuccagccuacca

SEQ ID NO: 458314 - RNA, 32 nt, Human
ggccugaugacauccaauacagaguucuggua

SEQ ID NO: 458315 - RNA, 32 nt, Human
ggccugaugcagccccucccagccucucccgc

SEQ ID NO: 458316 - RNA, 32 nt, Human
ggccugcaauggcuguguguacacuacaucua

SEQ ID NO: 458317 - RNA, 21 nt, Human
ggccugcacacagcucugugg

SEQ ID NO: 458318 - RNA, 32 nt, Human
ggccugcacacagcugcucagcaccauuucau

SEQ ID NO: 458319 - RNA, 32 nt, Human
ggccugcacagcuguggccguggagcugaccu

SEQ ID NO: 458320 - RNA, 21 nt, Human
ggccugcacaucccgccacga

SEQ ID NO: 458321 - RNA, 32 nt, Human
ggccugcacaugacccccuccuuggguuaggc

SEQ ID NO: 458322 - RNA, 19 nt, Human
ggccugcaccugaugugga

SEQ ID NO: 458323 - RNA, 32 nt, Human
ggccugcaccugcugcucaagugggccccggc

SEQ ID NO: 458324 - RNA, 22 nt, Human
ggccugcacuccacacaaugca

SEQ ID NO: 458325 - RNA, 23 nt, Human
ggccugcagccaggcacugggca

SEQ ID NO: 458326 - RNA, 20 nt, Human
ggccugcagccccugcugcc

SEQ ID NO: 458327 - RNA, 23 nt, Human
ggccugcagccucccccagggug

SEQ ID NO: 458328 - RNA, 22 nt, Human
ggccugcagcgcggggcccgga

SEQ ID NO: 458329 - RNA, 24 nt, Human
ggccugcagcgcucccacccccgg

SEQ ID NO: 458330 - RNA, 32 nt, Human
ggccugcagcucccuucuccugggacuuagag

SEQ ID NO: 458331 - RNA, 22 nt, Human
ggccugcagcuucauuugcgag

SEQ ID NO: 458332 - RNA, 23 nt, Human
ggccugcaggagcuguuuuucca

SEQ ID NO: 458333 - RNA, 32 nt, Human
ggccugcagggaccugagcuuugcuacccaac

SEQ ID NO: 458334 - RNA, 32 nt, Human
ggccugcagggcgggguaggggagggcagggg

SEQ ID NO: 458335 - RNA, 22 nt, Human
ggccugcaggugggcgccccga

SEQ ID NO: 458336 - RNA, 32 nt, Human
ggccugcagguguggcgccgaggggagaucag

SEQ ID NO: 458337 - RNA, 22 nt, Human
ggccugcagugccagacucuga

SEQ ID NO: 458338 - RNA, 32 nt, Human
ggccugcagugggagagcaggaugggggcucc

SEQ ID NO: 458339 - RNA, 32 nt, Human
ggccugcaguguauuauauguuuuuaauauau

SEQ ID NO: 458340 - RNA, 31 nt, Human
ggccugcaguuuccaucacccacugcaacca

SEQ ID NO: 458341 - RNA, 22 nt, Human
ggccugcauagcgacauuuuca

SEQ ID NO: 458342 - RNA, 32 nt, Human
ggccugcauagugccaugauuggaacccagga

SEQ ID NO: 458343 - RNA, 32 nt, Human
ggccugcauccucaggcucccaauacugccug

SEQ ID NO: 458344 - RNA, 32 nt, Human
ggccugcaugcacucuggccugcauggcagaa

SEQ ID NO: 458345 - RNA, 32 nt, Human
ggccugcauggugggagcugguugaauugucu

SEQ ID NO: 458346 - RNA, 32 nt, Human
ggccugccaaacugcugggauuauaggcguga

SEQ ID NO: 458347 - RNA, 32 nt, Human
ggccugccaaagcugcagccagcauccuuauc

SEQ ID NO: 458348 - RNA, 32 nt, Human
ggccugccaaagugcugggauuacaggcuuga

SEQ ID NO: 458349 - RNA, 32 nt, Human
ggccugccaaguagcugggacuacaagugcac

SEQ ID NO: 458350 - RNA, 32 nt, Human
ggccugccacagagaacugagcucuuuuauua

SEQ ID NO: 458351 - RNA, 18 nt, Human
ggccugccaccacagcac

SEQ ID NO: 458352 - RNA, 16 nt, Human
ggccugccaccuggac

SEQ ID NO: 458353 - RNA, 32 nt, Human
ggccugccagugccccugagcuugcuuuccac

SEQ ID NO: 458354 - RNA, 32 nt, Human
ggccugccauggaauuuuggcugcaauuuugg

SEQ ID NO: 458355 - RNA, 32 nt, Human
ggccugccaugggucaucagacugcuuccuaa

SEQ ID NO: 458356 - RNA, 32 nt, Human
ggccugcccacacaacuccaggguucccuccc

SEQ ID NO: 458357 - RNA, 32 nt, Human
ggccugcccagccucaaugucacuuggcggcg

SEQ ID NO: 458358 - RNA, 32 nt, Human
ggccugcccagccuccuggaacugcgcccugg

SEQ ID NO: 458359 - RNA, 21 nt, Human
ggccugccccauccuagcugg

SEQ ID NO: 458360 - RNA, 20 nt, Human
ggccugccccucauacgcca

SEQ ID NO: 458361 - RNA, 21 nt, Human
ggccugccccucaucugcgaa

SEQ ID NO: 458362 - RNA, 32 nt, Human
ggccugccccugcccccaccuccuggagggcc

SEQ ID NO: 458363 - RNA, 32 nt, Human
ggccugcccuaccugaggggaaccagccaucc

SEQ ID NO: 458364 - RNA, 20 nt, Human
ggccugcccucccugcugcc

SEQ ID NO: 458365 - RNA, 32 nt, Human
ggccugcccugcucugagcacuuccguggacu

SEQ ID NO: 458366 - RNA, 32 nt, Human
ggccugcccuggauccuggaggcuacacagcu

SEQ ID NO: 458367 - RNA, 32 nt, Human
ggccugccgaagccagcugccugcugccucag

SEQ ID NO: 458368 - RNA, 32 nt, Human
ggccugccggacacagcaccgugccaacccca

SEQ ID NO: 458369 - RNA, 29 nt, Human
ggccugccggguagcugggacuacaggca

SEQ ID NO: 458370 - RNA, 21 nt, Human
ggccugccucccagcccugcc

SEQ ID NO: 458371 - RNA, 32 nt, Human
ggccugccucccagcccugccagggggcugcg

SEQ ID NO: 458372 - RNA, 19 nt, Human
ggccugccuccugcuggcc

SEQ ID NO: 458373 - RNA, 32 nt, Human
ggccugccugcaccagcugccugggccccacc

SEQ ID NO: 458374 - RNA, 26 nt, Human
ggccugccugccccacccaccccaca

SEQ ID NO: 458375 - RNA, 20 nt, Human
ggccugccugccugccagcc

SEQ ID NO: 458376 - RNA, 32 nt, Human
ggccugccugcucuggccaagaggaccagcca

SEQ ID NO: 458377 - RNA, 17 nt, Human
ggccugccuggguccag

SEQ ID NO: 458378 - RNA, 32 nt, Human
ggccugccugugugacugucaugcaggccugu

SEQ ID NO: 458379 - RNA, 22 nt, Human
ggccugccuucucccuuccucu

SEQ ID NO: 458380 - RNA, 32 nt, Human
ggccugcgaggaagggcugagguggggccggc

SEQ ID NO: 458381 - RNA, 17 nt, Human
ggccugcgccagaguga

SEQ ID NO: 458382 - RNA, 19 nt, Human
ggccugcgccuucccgcca

SEQ ID NO: 458383 - RNA, 32 nt, Human
ggccugcgcuccucagccuggcgguucuaccu

SEQ ID NO: 458384 - RNA, 32 nt, Human
ggccugcggagccucaagaagccagaccgcaa

SEQ ID NO: 458385 - RNA, 32 nt, Human
ggccugcggagggaggggacagcuggacccgc

SEQ ID NO: 458386 - RNA, 32 nt, Human
ggccugcggccuaggccucagcgcggcggcgg

SEQ ID NO: 458387 - RNA, 19 nt, Human
ggccugcgggcugacccag

SEQ ID NO: 458388 - RNA, 32 nt, Human
ggccugcggugagcucgcgcugggcgggcugu

SEQ ID NO: 458389 - RNA, 18 nt, Human
ggccugcuaccugcugcc

SEQ ID NO: 458390 - RNA, 32 nt, Human
ggccugcuagcgcuucaaauucccaggugucc

SEQ ID NO: 458391 - RNA, 21 nt, Human
ggccugcuaggguuaggaggu

SEQ ID NO: 458392 - RNA, 32 nt, Human
ggccugcucacagacagcauggagcagggaag

SEQ ID NO: 458393 - RNA, 32 nt, Human
ggccugcucacuccucagcugcaggagccaga

SEQ ID NO: 458394 - RNA, 32 nt, Human
ggccugcuccacccuccucagcgccugagaau

SEQ ID NO: 458395 - RNA, 32 nt, Human
ggccugcucccagcucugccuccugcccgccu

SEQ ID NO: 458396 - RNA, 32 nt, Human
ggccugcucccuccuggacggccugaccgcgg

SEQ ID NO: 458397 - RNA, 32 nt, Human
ggccugcuccucugggccaccucucuccaccu

SEQ ID NO: 458398 - RNA, 23 nt, Human
ggccugcuccugucucucuggca

SEQ ID NO: 458399 - RNA, 32 nt, Human
ggccugcucuacuggguggccucucggaccca

SEQ ID NO: 458400 - RNA, 32 nt, Human
ggccugcucuccccagcucuuuuccaguccuc

SEQ ID NO: 458401 - RNA, 22 nt, Human
ggccugcugagcugauucucca

SEQ ID NO: 458402 - RNA, 19 nt, Human
ggccugcugaucuuucaaa

SEQ ID NO: 458403 - RNA, 32 nt, Human
ggccugcugcagccaccaacacugcccaggac

SEQ ID NO: 458404 - RNA, 32 nt, Human
ggccugcugccugcacaccacaucgccuaccu

SEQ ID NO: 458405 - RNA, 20 nt, Human
ggccugcugccugcuauacc

SEQ ID NO: 458406 - RNA, 21 nt, Human
ggccugcugcuccugcuggcc

SEQ ID NO: 458407 - RNA, 32 nt, Human
ggccugcugcuggugaagacgccccuuacuag

SEQ ID NO: 458408 - RNA, 32 nt, Human
ggccugcugcugugcuucagugacacaguaaa

SEQ ID NO: 458409 - RNA, 32 nt, Human
ggccugcuggccugggcgucagggcgcaucaa

SEQ ID NO: 458410 - RNA, 32 nt, Human
ggccugcugggaggaggagggggaagaggagg

SEQ ID NO: 458411 - RNA, 32 nt, Human
ggccugcugguguggacagagauuccagcaac

SEQ ID NO: 458412 - RNA, 32 nt, Human
ggccugcuguccaggcuccagcuccccugccc

SEQ ID NO: 458413 - RNA, 32 nt, Human
ggccugcuucccagcacacacuucuuuggccu

SEQ ID NO: 458414 - RNA, 23 nt, Human
ggccugcuuccucuucuuccucu

SEQ ID NO: 458415 - RNA, 32 nt, Human
ggccugcuugacuuuccagaaugaccuugagu

SEQ ID NO: 458416 - RNA, 32 nt, Human
ggccugcuuguguccuccagcccagcccaccc

SEQ ID NO: 458417 - RNA, 23 nt, Human
ggccugcuuugcucaccagcguc

SEQ ID NO: 458418 - RNA, 32 nt, Human
ggccugcuuuucuaccagacaugggagcagca

SEQ ID NO: 458419 - RNA, 32 nt, Human
ggccugcuuuuuguuuuugaagacaggacuua

SEQ ID NO: 458420 - RNA, 32 nt, Human
ggccuggaaagugccccugccuggugcucugg

SEQ ID NO: 458421 - RNA, 32 nt, Human
ggccuggaaccagcagagccacauggaggaca

SEQ ID NO: 458422 - RNA, 32 nt, Human
ggccuggaaggcaggccaaccagcaaaauccu

SEQ ID NO: 458423 - RNA, 32 nt, Human
ggccuggaagggagguggagguccaguaaggg

SEQ ID NO: 458424 - RNA, 19 nt, Human
ggccuggaaggucugcacc

SEQ ID NO: 458425 - RNA, 19 nt, Human
ggccuggaaguuagaguga

SEQ ID NO: 458426 - RNA, 23 nt, Human
ggccuggacagccaggggcuccu

SEQ ID NO: 458427 - RNA, 32 nt, Human
ggccuggacaggugaagugaccagagagcaaa

SEQ ID NO: 458428 - RNA, 32 nt, Human
ggccuggaccccacccuccacacucucaggcc

SEQ ID NO: 458429 - RNA, 20 nt, Human
ggccuggaccguuggagugg

SEQ ID NO: 458430 - RNA, 32 nt, Human
ggccuggaccuccugggcaggaaagggugcag

SEQ ID NO: 458431 - RNA, 32 nt, Human
ggccuggaccugggcuggacaguguaucccuu

SEQ ID NO: 458432 - RNA, 17 nt, Human
ggccuggacgggagugg

SEQ ID NO: 458433 - RNA, 21 nt, Human
ggccuggacucccuuugcuca

SEQ ID NO: 458434 - RNA, 19 nt, Human
ggccuggacugcagagugg

SEQ ID NO: 458435 - RNA, 19 nt, Human
ggccuggagaacccaggag

SEQ ID NO: 458436 - RNA, 32 nt, Human
ggccuggagaggacaggagcugguaaggacuc

SEQ ID NO: 458437 - RNA, 32 nt, Human
ggccuggagaggguuagcacaggagccaggcu

SEQ ID NO: 458438 - RNA, 32 nt, Human
ggccuggagauggagcugcagucccagcucag

SEQ ID NO: 458439 - RNA, 17 nt, Human
ggccuggagcaggguga

SEQ ID NO: 458440 - RNA, 32 nt, Human
ggccuggagcccaagcccuguguuccugggga

SEQ ID NO: 458441 - RNA, 19 nt, Human
ggccuggagcuugggguga

SEQ ID NO: 458442 - RNA, 32 nt, Human
ggccuggaggaaaugcuagagcagagggaaag

SEQ ID NO: 458443 - RNA, 32 nt, Human
ggccuggaggagcccgggucaggcuggggagg

SEQ ID NO: 458444 - RNA, 21 nt, Human
ggccuggaggagcucagagug

SEQ ID NO: 458445 - RNA, 32 nt, Human
ggccuggaggagggagguugugguuggaugga

SEQ ID NO: 458446 - RNA, 32 nt, Human
ggccuggagggcaguggcauuggucagaggca

SEQ ID NO: 458447 - RNA, 20 nt, Human
ggccuggaggggccagagga

SEQ ID NO: 458448 - RNA, 32 nt, Human
ggccuggaguacgaggggcacccugggggcuc

SEQ ID NO: 458449 - RNA, 32 nt, Human
ggccuggagugaggacugaacacugggguagg

SEQ ID NO: 458450 - RNA, 21 nt, Human
ggccuggauccgaguccugcc

SEQ ID NO: 458451 - RNA, 32 nt, Human
ggccuggaugaugaggaggaggaugaggauga

SEQ ID NO: 458452 - RNA, 32 nt, Human
ggccuggaugucgauggaaugccugagggugg

SEQ ID NO: 458453 - RNA, 32 nt, Human
ggccuggcaaaaugcugggauuacaggcauaa

SEQ ID NO: 458454 - RNA, 32 nt, Human
ggccuggcacugggaggugggggugagccccu

SEQ ID NO: 458455 - RNA, 21 nt, Human
ggccuggcaggcggcgcgcgg

SEQ ID NO: 458456 - RNA, 32 nt, Human
ggccuggcagggcgcaagaccugugcacagag

SEQ ID NO: 458457 - RNA, 32 nt, Human
ggccuggcaguccugcucacaguguucugugc

SEQ ID NO: 458458 - RNA, 32 nt, Human
ggccuggcaugaaagagaauguucacaacacu

SEQ ID NO: 458459 - RNA, 32 nt, Human
ggccuggcaugaaccuggccucccggggagcu

SEQ ID NO: 458460 - RNA, 32 nt, Human
ggccuggcauuuuccagacaucuauucugcaa

SEQ ID NO: 458461 - RNA, 32 nt, Human
ggccuggccaaccuccgccuccuggguucaag

SEQ ID NO: 458462 - RNA, 32 nt, Human
ggccuggccagccugcacagcgugcuguuccg

SEQ ID NO: 458463 - RNA, 32 nt, Human
ggccuggccaguggcugaaagccaggccucca

SEQ ID NO: 458464 - RNA, 19 nt, Human
ggccuggcccagcaagccc

SEQ ID NO: 458465 - RNA, 24 nt, Human
ggccuggcccagcuuccagaggga

SEQ ID NO: 458466 - RNA, 21 nt, Human
ggccuggcccagggugccgua

SEQ ID NO: 458467 - RNA, 32 nt, Human
ggccuggcccaguugcaccacgagcgcugcgg

SEQ ID NO: 458468 - RNA, 19 nt, Human
ggccuggccccagcgcccg

SEQ ID NO: 458469 - RNA, 23 nt, Human
ggccuggccccagggcagcuggu

SEQ ID NO: 458470 - RNA, 18 nt, Human
ggccuggccccugcugcc

SEQ ID NO: 458471 - RNA, 32 nt, Human
ggccuggcccgagcugucucuguggugcuuuu

SEQ ID NO: 458472 - RNA, 21 nt, Human
ggccuggcccgcgcccucccg

SEQ ID NO: 458473 - RNA, 18 nt, Human
ggccuggcccggagcccg

SEQ ID NO: 458474 - RNA, 32 nt, Human
ggccuggcccucacucaagaccaggcugcagc

SEQ ID NO: 458475 - RNA, 32 nt, Human
ggccuggccuaaucaggugagccacucacccu

SEQ ID NO: 458476 - RNA, 21 nt, Human
ggccuggccucccugcccuga

SEQ ID NO: 458477 - RNA, 32 nt, Human
ggccuggccucguucucucuucuugcccuugg

SEQ ID NO: 458478 - RNA, 18 nt, Human
ggccuggccucuucugcc

SEQ ID NO: 458479 - RNA, 21 nt, Human
ggccuggccuuccucugccug

SEQ ID NO: 458480 - RNA, 18 nt, Human
ggccuggccuuucugccc

SEQ ID NO: 458481 - RNA, 32 nt, Human
ggccuggcgacugccccugccuuuuagacccg

SEQ ID NO: 458482 - RNA, 19 nt, Human
ggccuggcggagcuguagc

SEQ ID NO: 458483 - RNA, 23 nt, Human
ggccuggcggcccuccuuccucu

SEQ ID NO: 458484 - RNA, 32 nt, Human
ggccuggcucaaggugaccucaccuucaccau

SEQ ID NO: 458485 - RNA, 32 nt, Human
ggccuggcucccaggaccaguccaguccucua

SEQ ID NO: 458486 - RNA, 32 nt, Human
ggccuggcugacuggagcagagucauuugcuu

SEQ ID NO: 458487 - RNA, 32 nt, Human
ggccuggcugggaagaggcggggagaugucuc

SEQ ID NO: 458488 - RNA, 32 nt, Human
ggccuggcuugcccucugggccuuugcucccc

SEQ ID NO: 458489 - RNA, 32 nt, Human
ggccugggaaggagggugcuguggagggggcu

SEQ ID NO: 458490 - RNA, 17 nt, Human
ggccugggaauggggug

SEQ ID NO: 458491 - RNA, 32 nt, Human
ggccugggacagagccucccacggagccucaa

SEQ ID NO: 458492 - RNA, 32 nt, Human
ggccugggacuucugccucugccgccuccaga

SEQ ID NO: 458493 - RNA, 32 nt, Human
ggccugggagacacacagaggccaggccuuag

SEQ ID NO: 458494 - RNA, 32 nt, Human
ggccugggagcugagagaaggcacugagaggg

SEQ ID NO: 458495 - RNA, 32 nt, Human
ggccugggaggcauagguugcagugagccgag

SEQ ID NO: 458496 - RNA, 32 nt, Human
ggccugggaggcggagguugcagugagccgag

SEQ ID NO: 458497 - RNA, 32 nt, Human
ggccugggaggcgggggccggcgggagccaag

SEQ ID NO: 458498 - RNA, 32 nt, Human
ggccugggaggucgaggcugcagugagcugug

SEQ ID NO: 458499 - RNA, 21 nt, Human
ggccugggaucccccacccca

SEQ ID NO: 458500 - RNA, 32 nt, Human
ggccugggauggagguggccagagucuuuggg

SEQ ID NO: 458501 - RNA, 32 nt, Human
ggccugggcacccuccugggagcaggccuucc

SEQ ID NO: 458502 - RNA, 32 nt, Human
ggccugggcaccuguccuccugcugugccguc

SEQ ID NO: 458503 - RNA, 32 nt, Human
ggccugggcagcagguguggccagucccucug

SEQ ID NO: 458504 - RNA, 21 nt, Human
ggccugggcagcgcucgcccg

SEQ ID NO: 458505 - RNA, 32 nt, Human
ggccugggccacccuucuuccuucacugggca

SEQ ID NO: 458506 - RNA, 32 nt, Human
ggccugggccagggccccagagcuccugccug

SEQ ID NO: 458507 - RNA, 19 nt, Human
ggccugggccauauuccag

SEQ ID NO: 458508 - RNA, 22 nt, Human
ggccugggcccagcgagccccc

SEQ ID NO: 458509 - RNA, 21 nt, Human
ggccugggcccagggcgcccu

SEQ ID NO: 458510 - RNA, 18 nt, Human
ggccugggcccaggguuc

SEQ ID NO: 458511 - RNA, 32 nt, Human
ggccugggcccccugcacugccugguccagaa

SEQ ID NO: 458512 - RNA, 21 nt, Human
ggccugggcccggggccuccc

SEQ ID NO: 458513 - RNA, 25 nt, Human
ggccugggcccucaguggacugccu

SEQ ID NO: 458514 - RNA, 20 nt, Human
ggccugggccuccugcugcu

SEQ ID NO: 458515 - RNA, 32 nt, Human
ggccugggccucucugccugcuguagccgucu

SEQ ID NO: 458516 - RNA, 18 nt, Human
ggccugggccucuggcca

SEQ ID NO: 458517 - RNA, 22 nt, Human
ggccugggccucugggauucca

SEQ ID NO: 458518 - RNA, 32 nt, Human
ggccugggccugccaggcagaggcgcucuugc

SEQ ID NO: 458519 - RNA, 21 nt, Human
ggccugggccuggcucccuca

SEQ ID NO: 458520 - RNA, 22 nt, Human
ggccugggcgggcccugcguca

SEQ ID NO: 458521 - RNA, 32 nt, Human
ggccugggcucugccagaggcugaggugccca

SEQ ID NO: 458522 - RNA, 32 nt, Human
ggccugggcugaacccccuccuggggagccag

SEQ ID NO: 458523 - RNA, 32 nt, Human
ggccugggcugcaggagggcggagcuggggcc

SEQ ID NO: 458524 - RNA, 32 nt, Human
ggccugggcugcucugagacauggaggaagcc

SEQ ID NO: 458525 - RNA, 32 nt, Human
ggccugggcugggaaucuuuguugacuucuuu

SEQ ID NO: 458526 - RNA, 22 nt, Human
ggccugggcugggcacacucca

SEQ ID NO: 458527 - RNA, 32 nt, Human
ggccugggcugggucucacugcucugaaaaga

SEQ ID NO: 458528 - RNA, 32 nt, Human
ggccugggcuguuggguauuucauggccccga

SEQ ID NO: 458529 - RNA, 32 nt, Human
ggccugggcuuccuggccugaguggguagacg

SEQ ID NO: 458530 - RNA, 32 nt, Human
ggccuggggagcccacugaggggccagggagg

SEQ ID NO: 458531 - RNA, 32 nt, Human
ggccuggggagucggaacagggcuaggagggg

SEQ ID NO: 458532 - RNA, 23 nt, Human
ggccuggggcagggcuucugaug

SEQ ID NO: 458533 - RNA, 32 nt, Human
ggccuggggcagggguguggccccuaaauguc

SEQ ID NO: 458534 - RNA, 21 nt, Human
ggccuggggcccgggcuccag

SEQ ID NO: 458535 - RNA, 32 nt, Human
ggccuggggccuccucuucaucuuggcacaga

SEQ ID NO: 458536 - RNA, 22 nt, Human
ggccuggggcuccgaaauucca

SEQ ID NO: 458537 - RNA, 18 nt, Human
ggccuggggcugggcagc

SEQ ID NO: 458538 - RNA, 21 nt, Human
ggccuggggcuggggcugccc

SEQ ID NO: 458539 - RNA, 32 nt, Human
ggccugggggaggcgggacagugggagaggcg

SEQ ID NO: 458540 - RNA, 32 nt, Human
ggccugggggcaguuugagccuccucucccuu

SEQ ID NO: 458541 - RNA, 21 nt, Human
ggccugggggccacugcugcc

SEQ ID NO: 458542 - RNA, 22 nt, Human
ggccugggggccucucccgccg

SEQ ID NO: 458543 - RNA, 20 nt, Human
ggccugggggcggggcggga

SEQ ID NO: 458544 - RNA, 22 nt, Human
ggccugggggguggggccuccu

SEQ ID NO: 458545 - RNA, 32 nt, Human
ggccuggggguagugucaaugccccuccaggg

SEQ ID NO: 458546 - RNA, 22 nt, Human
ggccugggggucgcgucgggag

SEQ ID NO: 458547 - RNA, 23 nt, Human
ggccugggguggggccccgggug

SEQ ID NO: 458548 - RNA, 32 nt, Human
ggccugggguugggguggagggugcggcccgg

SEQ ID NO: 458549 - RNA, 22 nt, Human
ggccuggguagagccagggcga

SEQ ID NO: 458550 - RNA, 32 nt, Human
ggccugggucucucaacccccugucaugagcu

SEQ ID NO: 458551 - RNA, 19 nt, Human
ggccugggucuuugcugcc

SEQ ID NO: 458552 - RNA, 19 nt, Human
ggccugggugacagaguga

SEQ ID NO: 458553 - RNA, 32 nt, Human
ggccugggugagggcaggcuggcugcucugac

SEQ ID NO: 458554 - RNA, 32 nt, Human
ggccugggugcuggcugcccagacccucuggc

SEQ ID NO: 458555 - RNA, 32 nt, Human
ggccuggguguccaccuaggaaccugauguau

SEQ ID NO: 458556 - RNA, 32 nt, Human
ggccugggugugccaccugggucacuggagga

SEQ ID NO: 458557 - RNA, 32 nt, Human
ggccuggguuuuguugcauaccacagauuguc

SEQ ID NO: 458558 - RNA, 32 nt, Human
ggccugguacccauccucuuuccacugugagc

SEQ ID NO: 458559 - RNA, 32 nt, Human
ggccugguacccgugccgggcagccuuacacc

SEQ ID NO: 458560 - RNA, 19 nt, Human
ggccugguacucggaggga

SEQ ID NO: 458561 - RNA, 32 nt, Human
ggccuggucacugcaguguaccccacuuuccc

SEQ ID NO: 458562 - RNA, 32 nt, Human
ggccuggucagccugcaguaccucuaccucca

SEQ ID NO: 458563 - RNA, 17 nt, Human
ggccugguccaggagga

SEQ ID NO: 458564 - RNA, 32 nt, Human
ggccuggucccagcagguaugggcagguugcu

SEQ ID NO: 458565 - RNA, 21 nt, Human
ggccugguccuagcccugccu

SEQ ID NO: 458566 - RNA, 18 nt, Human
ggccugguccucgcugcc

SEQ ID NO: 458567 - RNA, 32 nt, Human
ggccugguccugcugcucauuugccaggugac

SEQ ID NO: 458568 - RNA, 32 nt, Human
ggccuggucuccggcugccagaccaugcugag

SEQ ID NO: 458569 - RNA, 32 nt, Human
ggccuggugaccucgccgcucuucuugaauca

SEQ ID NO: 458570 - RNA, 32 nt, Human
ggccuggugcaagcccaugcaggauggggccc

SEQ ID NO: 458571 - RNA, 32 nt, Human
ggccugguggagaaggaggugcuggcugcgag

SEQ ID NO: 458572 - RNA, 17 nt, Human
ggccugguggaggagga

SEQ ID NO: 458573 - RNA, 32 nt, Human
ggccugguggagggggaggggagaagccaagg

SEQ ID NO: 458574 - RNA, 20 nt, Human
ggccugguggcagugugggg

SEQ ID NO: 458575 - RNA, 22 nt, Human
ggccugguggcucacgccugua

SEQ ID NO: 458576 - RNA, 32 nt, Human
ggccugguggcugaucacuuguggggucaguc

SEQ ID NO: 458577 - RNA, 28 nt, Human
ggccuggugggcgggguggggggugcgg

SEQ ID NO: 458578 - RNA, 32 nt, Human
ggccugguguucuaccccaucuggccccuggc

SEQ ID NO: 458579 - RNA, 19 nt, Human
ggccugguguucuguggga

SEQ ID NO: 458580 - RNA, 24 nt, Human
ggccuguaaucccagcuacucggg

SEQ ID NO: 458581 - RNA, 24 nt, Human
ggccuguaaucccagcuacuuggg

SEQ ID NO: 458582 - RNA, 32 nt, Human
ggccuguacagcuguuuccuaccuacucuucu

SEQ ID NO: 458583 - RNA, 32 nt, Human
ggccuguaccccugcaccuccagccuccaccc

SEQ ID NO: 458584 - RNA, 32 nt, Human
ggccuguacugaccagccugcgccuugcaggc

SEQ ID NO: 458585 - RNA, 32 nt, Human
ggccuguagacagaugggccaccaggcaggag

SEQ ID NO: 458586 - RNA, 24 nt, Human
ggccuguagucccagcuacuuggg

SEQ ID NO: 458587 - RNA, 32 nt, Human
ggccuguauuagaccccguaaacgccugaacu

SEQ ID NO: 458588 - RNA, 23 nt, Human
ggccugucacauccugcuggacc

SEQ ID NO: 458589 - RNA, 32 nt, Human
ggccugucaccggcugagacacggugauaggc

SEQ ID NO: 458590 - RNA, 32 nt, Human
ggccugucaccuccugaaaggcugcuuuagcu

SEQ ID NO: 458591 - RNA, 21 nt, Human
ggccugucagccugcuggucc

SEQ ID NO: 458592 - RNA, 32 nt, Human
ggccuguccagcccucucccgccauccuuccc

SEQ ID NO: 458593 - RNA, 32 nt, Human
ggccuguccgcauugcccugugcccacaagca

SEQ ID NO: 458594 - RNA, 19 nt, Human
ggccuguccucugcuggcc

SEQ ID NO: 458595 - RNA, 21 nt, Human
ggccuguccuuuccagcugcc

SEQ ID NO: 458596 - RNA, 32 nt, Human
ggccugucgaccucuuuacccauuccauuguu

SEQ ID NO: 458597 - RNA, 22 nt, Human
ggccugucggccgaccccaccu

SEQ ID NO: 458598 - RNA, 32 nt, Human
ggccugucgugcugaagcucuuggggaccguu

SEQ ID NO: 458599 - RNA, 32 nt, Human
ggccugucuauaucucaggaagcgccaggguc

SEQ ID NO: 458600 - RNA, 32 nt, Human
ggccugucugcguggguuuuuguauccagagc

SEQ ID NO: 458601 - RNA, 26 nt, Human
ggccugucuucucguucaggccugcc

SEQ ID NO: 458602 - RNA, 32 nt, Human
ggccugucuucugggguauagcuuggaugucu

SEQ ID NO: 458603 - RNA, 18 nt, Human
ggccugugaagaauggga

SEQ ID NO: 458604 - RNA, 32 nt, Human
ggccugugaauaagaugagcaugugaaccaaa

SEQ ID NO: 458605 - RNA, 32 nt, Human
ggccugugacuaugggcucugagggggcagga

SEQ ID NO: 458606 - RNA, 19 nt, Human
ggccugugaggcagugggg

SEQ ID NO: 458607 - RNA, 16 nt, Human
ggccugugaggcuggg

SEQ ID NO: 458608 - RNA, 32 nt, Human
ggccugugcacacaccagcccacccugagaga

SEQ ID NO: 458609 - RNA, 32 nt, Human
ggccugugcagaauguaaacagcagacucaua

SEQ ID NO: 458610 - RNA, 21 nt, Human
ggccugugcagcugggcccuu

SEQ ID NO: 458611 - RNA, 32 nt, Human
ggccugugcaggacacggggagaaguguagcc

SEQ ID NO: 458612 - RNA, 32 nt, Human
ggccugugcaugcucucccaugacaucuccau

SEQ ID NO: 458613 - RNA, 32 nt, Human
ggccugugccaaccccuccuuguugcgccuca

SEQ ID NO: 458614 - RNA, 32 nt, Human
ggccugugccagcuugcagagcucaccaggug

SEQ ID NO: 458615 - RNA, 32 nt, Human
ggccugugcccacucccuaucuccuucccacc

SEQ ID NO: 458616 - RNA, 20 nt, Human
ggccugugcccacugcugcc

SEQ ID NO: 458617 - RNA, 32 nt, Human
ggccugugccuguaaacccagcuacucaggag

SEQ ID NO: 458618 - RNA, 21 nt, Human
ggccugugcugcgaggggcug

SEQ ID NO: 458619 - RNA, 18 nt, Human
ggccuguggaugggggga

SEQ ID NO: 458620 - RNA, 24 nt, Human
ggccuguggcagcgccgcuggacc

SEQ ID NO: 458621 - RNA, 32 nt, Human
ggccuguggcagggacccucaugguugagccc

SEQ ID NO: 458622 - RNA, 18 nt, Human
ggccuguggcggugguga

SEQ ID NO: 458623 - RNA, 32 nt, Human
ggccuguggcgguggugagcagcagcgucugg

SEQ ID NO: 458624 - RNA, 32 nt, Human
ggccuguggcugaccucugccccagcccucuu

SEQ ID NO: 458625 - RNA, 32 nt, Human
ggccugugggagccuacuggagcccagcacuu

SEQ ID NO: 458626 - RNA, 18 nt, Human
ggccuguggguagugggg

SEQ ID NO: 458627 - RNA, 31 nt, Human
ggccuguggguggaaggucucuggccuugga

SEQ ID NO: 458628 - RNA, 22 nt, Human
ggccuguggucccagcugcucg

SEQ ID NO: 458629 - RNA, 32 nt, Human
ggccuguggugacugcacacagcucgcaaaac

SEQ ID NO: 458630 - RNA, 32 nt, Human
ggccuguguagagcccccuccugugcccucag

SEQ ID NO: 458631 - RNA, 32 nt, Human
ggccugugucccucccgaacccagggucaacc

SEQ ID NO: 458632 - RNA, 19 nt, Human
ggccugugucucagcucuc

SEQ ID NO: 458633 - RNA, 32 nt, Human
ggccugugugagccaggauggcugccugcgcg

SEQ ID NO: 458634 - RNA, 32 nt, Human
ggccugugugauacaagagucagcaucauuaa

SEQ ID NO: 458635 - RNA, 32 nt, Human
ggccuguguucauacacagaaggggccugaga

SEQ ID NO: 458636 - RNA, 17 nt, Human
ggccuguguucuggggg

SEQ ID NO: 458637 - RNA, 25 nt, Human
ggccuguguuuugagucucuuucca

SEQ ID NO: 458638 - RNA, 32 nt, Human
ggccuguucugguggggagacgccagaggagc

SEQ ID NO: 458639 - RNA, 32 nt, Human
ggccuguuguacccuggagccuggguguaaac

SEQ ID NO: 458640 - RNA, 32 nt, Human
ggccuguuguacccuggagccuggguguacac

SEQ ID NO: 458641 - RNA, 32 nt, Human
ggccuguugugggacagucucuguaaucgcga

SEQ ID NO: 458642 - RNA, 22 nt, Human
ggccuguugugugugugcguuc

SEQ ID NO: 458643 - RNA, 21 nt, Human
ggccuguuuagccacauggug

SEQ ID NO: 458644 - RNA, 32 nt, Human
ggccuguuucuccugcugucugggugagugag

SEQ ID NO: 458645 - RNA, 32 nt, Human
ggccuguuucugcuuuuuagccucacccuauu

SEQ ID NO: 458646 - RNA, 32 nt, Human
ggccuuaaaacauuucagacacuauuaaauac

SEQ ID NO: 458647 - RNA, 22 nt, Human
ggccuuaaaauucuucugugaa

SEQ ID NO: 458648 - RNA, 32 nt, Human
ggccuuaagagcaaaaccaguuucuuggagag

SEQ ID NO: 458649 - RNA, 32 nt, Human
ggccuuaagccccugaggguccuggugacuca

SEQ ID NO: 458650 - RNA, 21 nt, Human
ggccuuaaggacaugggccuc

SEQ ID NO: 458651 - RNA, 32 nt, Human
ggccuuaagggcccuuggaccagugucugucu

SEQ ID NO: 458652 - RNA, 25 nt, Human
ggccuuaagugauccucccaccuca

SEQ ID NO: 458653 - RNA, 32 nt, Human
ggccuuaauucugcaaacauuuccuguuguua

SEQ ID NO: 458654 - RNA, 32 nt, Human
ggccuuacuaauccauaccaaauuagccuaaa

SEQ ID NO: 458655 - RNA, 32 nt, Human
ggccuuacucuguuguucaaagccacuuugga

SEQ ID NO: 458656 - RNA, 32 nt, Human
ggccuuagacuccacauguccauuuuuguuca

SEQ ID NO: 458657 - RNA, 32 nt, Human
ggccuuagaggauuuuauuugaguaaauuaua

SEQ ID NO: 458658 - RNA, 32 nt, Human
ggccuuagagucagagguaagguagcaacaga

SEQ ID NO: 458659 - RNA, 32 nt, Human
ggccuuagcucuagagugagggguggguggaa

SEQ ID NO: 458660 - RNA, 32 nt, Human
ggccuuaggaggcggccggagcggugggcaca

SEQ ID NO: 458661 - RNA, 32 nt, Human
ggccuuaguagaaaucucugaaggcagcagcc

SEQ ID NO: 458662 - RNA, 21 nt, Human
ggccuuagugaguuuguugaa

SEQ ID NO: 458663 - RNA, 23 nt, Human
ggccuuaguguccacaggaugaa

SEQ ID NO: 458664 - RNA, 32 nt, Human
ggccuuaguugccuccaggucuucccagggug

SEQ ID NO: 458665 - RNA, 32 nt, Human
ggccuuauaaaaggcuugacugagggagcuca

SEQ ID NO: 458666 - RNA, 32 nt, Human
ggccuuauauuuacagcucccuucccuuccug

SEQ ID NO: 458667 - RNA, 32 nt, Human
ggccuuaugaccagugagaacucucucccugg

SEQ ID NO: 458668 - RNA, 32 nt, Human
ggccuuaugcaaaccucagugggugaugcagg

SEQ ID NO: 458669 - RNA, 21 nt, Human
ggccuuauucucucuuucuca

SEQ ID NO: 458670 - RNA, 32 nt, Human
ggccuuauuucuucccugucaccuccccuccu

SEQ ID NO: 458671 - RNA, 32 nt, Human
ggccuucaaacaguggccgagcugcagaacuc

SEQ ID NO: 458672 - RNA, 32 nt, Human
ggccuucacagccuccauccuuagcuuuggcg

SEQ ID NO: 458673 - RNA, 21 nt, Human
ggccuucaccuggucugugga

SEQ ID NO: 458674 - RNA, 32 nt, Human
ggccuucacugcagccccaucuccuccuccuc

SEQ ID NO: 458675 - RNA, 22 nt, Human
ggccuucagacuuggacugugu

SEQ ID NO: 458676 - RNA, 32 nt, Human
ggccuucagcacuuuaguaguggaugucagcg

SEQ ID NO: 458677 - RNA, 25 nt, Human
ggccuucagcaguucuuuuugugaa

SEQ ID NO: 458678 - RNA, 32 nt, Human
ggccuucagccccgaacuuggagcucagcuau

SEQ ID NO: 458679 - RNA, 32 nt, Human
ggccuucagcccucugugguccccucuccccg

SEQ ID NO: 458680 - RNA, 20 nt, Human
ggccuucagcuggagcugug

SEQ ID NO: 458681 - RNA, 32 nt, Human
ggccuucaggcagagcagcaaguggcccuuag

SEQ ID NO: 458682 - RNA, 32 nt, Human
ggccuucaggggugcugggauuacaggcauca

SEQ ID NO: 458683 - RNA, 32 nt, Human
ggccuucaggguggacagagggaggaucgguc

SEQ ID NO: 458684 - RNA, 31 nt, Human
ggccuucaguuucaguuucucauccaggaag

SEQ ID NO: 458685 - RNA, 32 nt, Human
ggccuucaguuuccauccccaggauccacuug

SEQ ID NO: 458686 - RNA, 32 nt, Human
ggccuucaucccucucuacgauaagguugcag

SEQ ID NO: 458687 - RNA, 32 nt, Human
ggccuucaugccauggccuguggauggagaau

SEQ ID NO: 458688 - RNA, 32 nt, Human
ggccuuccaaagugcugagauuacaggcguga

SEQ ID NO: 458689 - RNA, 32 nt, Human
ggccuuccaaagugcugggauaucaggcacug

SEQ ID NO: 458690 - RNA, 32 nt, Human
ggccuuccaaagugcugggauuacaaguuuga

SEQ ID NO: 458691 - RNA, 32 nt, Human
ggccuuccaaagugcugggauuacaggcauga

SEQ ID NO: 458692 - RNA, 32 nt, Human
ggccuuccaaagugcugggauuacaggccuga

SEQ ID NO: 458693 - RNA, 32 nt, Human
ggccuuccaaagugcugggauuacaggcguga

SEQ ID NO: 458694 - RNA, 32 nt, Human
ggccuuccaaagugcugggauuacagguguga

SEQ ID NO: 458695 - RNA, 32 nt, Human
ggccuuccaaagugcugggauuacggacguga

SEQ ID NO: 458696 - RNA, 32 nt, Human
ggccuuccaaagugcugggauuccagaugcga

SEQ ID NO: 458697 - RNA, 32 nt, Human
ggccuuccaaaguguuggaauuacaggcguga

SEQ ID NO: 458698 - RNA, 32 nt, Human
ggccuuccaaaguguugggauuacaggcauga

SEQ ID NO: 458699 - RNA, 32 nt, Human
ggccuuccaaaguguugggauuacaggcguga

SEQ ID NO: 458700 - RNA, 32 nt, Human
ggccuuccaaaguguugggauuaccggcguga

SEQ ID NO: 458701 - RNA, 32 nt, Human
ggccuuccaaaguguugggauuaugggcguga

SEQ ID NO: 458702 - RNA, 32 nt, Human
ggccuuccaaaguucugggauuacaggcguga

SEQ ID NO: 458703 - RNA, 32 nt, Human
ggccuuccaaguagcugggacuacaggugccc

SEQ ID NO: 458704 - RNA, 32 nt, Human
ggccuuccacacacaaacacuucuagaguugc

SEQ ID NO: 458705 - RNA, 32 nt, Human
ggccuuccagaagcgccagcagcagcagagcg

SEQ ID NO: 458706 - RNA, 32 nt, Human
ggccuuccagagugcugggauuacaggcguga

SEQ ID NO: 458707 - RNA, 32 nt, Human
ggccuuccagagugcugggauuauaggcguga

SEQ ID NO: 458708 - RNA, 32 nt, Human
ggccuuccagugaucuggaccaggaagacgga

SEQ ID NO: 458709 - RNA, 32 nt, Human
ggccuucccaaucaagucucuucaggcccuca

SEQ ID NO: 458710 - RNA, 32 nt, Human
ggccuucccaguagcugggauuacaggcacau

SEQ ID NO: 458711 - RNA, 23 nt, Human
ggccuucccgccggaggccagcu

SEQ ID NO: 458712 - RNA, 32 nt, Human
ggccuucccucgggucccuggcagaaagacau

SEQ ID NO: 458713 - RNA, 32 nt, Human
ggccuucccugacccagccaggaacaaacaag

SEQ ID NO: 458714 - RNA, 23 nt, Human
ggccuucccuggcgccugccccu

SEQ ID NO: 458715 - RNA, 32 nt, Human
ggccuuccgaguagcugggauugcaggcgugu

SEQ ID NO: 458716 - RNA, 32 nt, Human
ggccuuccuagaggacacuaugucuuccugaa

SEQ ID NO: 458717 - RNA, 32 nt, Human
ggccuuccucaggggcucugcagcacaguggc

SEQ ID NO: 458718 - RNA, 32 nt, Human
ggccuuccuccagggaaggaggcugggguggg

SEQ ID NO: 458719 - RNA, 32 nt, Human
ggccuuccugcaggcccugccccugugcuggg

SEQ ID NO: 458720 - RNA, 23 nt, Human
ggccuuccugccuuugaacugcg

SEQ ID NO: 458721 - RNA, 23 nt, Human
ggccuuccuggugacggagcugc

SEQ ID NO: 458722 - RNA, 32 nt, Human
ggccuuccugucacccccuccgugccacgcac

SEQ ID NO: 458723 - RNA, 20 nt, Human
ggccuuccuguuggcugugu

SEQ ID NO: 458724 - RNA, 22 nt, Human
ggccuuccuucccuagcugugu

SEQ ID NO: 458725 - RNA, 32 nt, Human
ggccuuccuuccucagcuccugcagccucauc

SEQ ID NO: 458726 - RNA, 32 nt, Human
ggccuuccuuuccucuuuccuccucacucucc

SEQ ID NO: 458727 - RNA, 32 nt, Human
ggccuucgaccucggaccuccgucuuccagaa

SEQ ID NO: 458728 - RNA, 32 nt, Human
ggccuucgggaggcgcggcccgggaggaggcc

SEQ ID NO: 458729 - RNA, 23 nt, Human
ggccuucgggcaguggacugugu

SEQ ID NO: 458730 - RNA, 32 nt, Human
ggccuucggggugacaaagcacacuucaggag

SEQ ID NO: 458731 - RNA, 32 nt, Human
ggccuucgugaacuuugcuccaacacacugau

SEQ ID NO: 458732 - RNA, 32 nt, Human
ggccuucuaaagugcugggauuacaggcguga

SEQ ID NO: 458733 - RNA, 32 nt, Human
ggccuucuaacguugguggaaguggcuuuggc

SEQ ID NO: 458734 - RNA, 32 nt, Human
ggccuucucagccucacaccccuuccucccag

SEQ ID NO: 458735 - RNA, 32 nt, Human
ggccuucuccauaggaagaggaggcgaguccc

SEQ ID NO: 458736 - RNA, 32 nt, Human
ggccuucucccagggugugcucggugggcagu

SEQ ID NO: 458737 - RNA, 32 nt, Human
ggccuucuccccucuucugagcuaguugguug

SEQ ID NO: 458738 - RNA, 32 nt, Human
ggccuucuccuggccuuguucuugcucauaaa

SEQ ID NO: 458739 - RNA, 19 nt, Human
ggccuucucgggcccugcc

SEQ ID NO: 458740 - RNA, 32 nt, Human
ggccuucucugcaggccagcaagccugcagca

SEQ ID NO: 458741 - RNA, 32 nt, Human
ggccuucugaagugcugggauucaggugugag

SEQ ID NO: 458742 - RNA, 32 nt, Human
ggccuucugccaccuuugccucccagggugcu

SEQ ID NO: 458743 - RNA, 32 nt, Human
ggccuucugccuccuucagccucaguuuccuc

SEQ ID NO: 458744 - RNA, 21 nt, Human
ggccuucuggcuggagcucgu

SEQ ID NO: 458745 - RNA, 32 nt, Human
ggccuucugggaaccuauggagaaagggaauc

SEQ ID NO: 458746 - RNA, 32 nt, Human
ggccuucuggucuaaagcuguguccugaauau

SEQ ID NO: 458747 - RNA, 32 nt, Human
ggccuucuguaucugugccuggccaguggcag

SEQ ID NO: 458748 - RNA, 32 nt, Human
ggccuucuugcagcaaggcaggggcuugaugg

SEQ ID NO: 458749 - RNA, 32 nt, Human
ggccuugaaaacaggccgaaccuggagggccu

SEQ ID NO: 458750 - RNA, 32 nt, Human
ggccuugaaggaugagaaagaucuggcugaga

SEQ ID NO: 458751 - RNA, 32 nt, Human
ggccuugaagucagagacucuccugcaggauu

SEQ ID NO: 458752 - RNA, 32 nt, Human
ggccuugaaguccuggggcucuccaggcagug

SEQ ID NO: 458753 - RNA, 32 nt, Human
ggccuugacucugcccuugaggggccuagggg

SEQ ID NO: 458754 - RNA, 32 nt, Human
ggccuugagagacagagaaaacagguaucugc

SEQ ID NO: 458755 - RNA, 32 nt, Human
ggccuugaguagcuuugggugcagagccagga

SEQ ID NO: 458756 - RNA, 32 nt, Human
ggccuugaguggagagguaauaaaauaauacc

SEQ ID NO: 458757 - RNA, 32 nt, Human
ggccuugauagaauagaguuggaaaagauggu

SEQ ID NO: 458758 - RNA, 20 nt, Human
ggccuugaucccuuccgcca

SEQ ID NO: 458759 - RNA, 18 nt, Human
ggccuugauccuccugcc

SEQ ID NO: 458760 - RNA, 32 nt, Human
ggccuugcaaaaugcugggauuacaggcauga

SEQ ID NO: 458761 - RNA, 32 nt, Human
ggccuugcacaagaaccacuaaccccaggcaa

SEQ ID NO: 458762 - RNA, 32 nt, Human
ggccuugcagaagaagcuggaagagcuagagc

SEQ ID NO: 458763 - RNA, 32 nt, Human
ggccuugcagaggcgccucucaaggccccauc

SEQ ID NO: 458764 - RNA, 22 nt, Human
ggccuugcagcugaagcugcgu

SEQ ID NO: 458765 - RNA, 19 nt, Human
ggccuugcccccgcccgcc

SEQ ID NO: 458766 - RNA, 31 nt, Human
ggccuugcccucucuggucugggcugucuac

SEQ ID NO: 458767 - RNA, 32 nt, Human
ggccuugcgcccguuccaccucccaggccacc

SEQ ID NO: 458768 - RNA, 17 nt, Human
ggccuugcucccccagg

SEQ ID NO: 458769 - RNA, 32 nt, Human
ggccuugcuguggagcuccacugccauguacc

SEQ ID NO: 458770 - RNA, 32 nt, Human
ggccuugcuugauccagugacuaugcauccau

SEQ ID NO: 458771 - RNA, 32 nt, Human
ggccuugcuuucuagcagaggucaccugaagu

SEQ ID NO: 458772 - RNA, 32 nt, Human
ggccuuggaaccugagcugccaaugccagccc

SEQ ID NO: 458773 - RNA, 32 nt, Human
ggccuuggacaagccauguagguucucugggc

SEQ ID NO: 458774 - RNA, 32 nt, Human
ggccuuggauuccaacacaguuucuuccacau

SEQ ID NO: 458775 - RNA, 32 nt, Human
ggccuuggcagaggcagguguggccucguaga

SEQ ID NO: 458776 - RNA, 25 nt, Human
ggccuuggccaagcugcugcuuuga

SEQ ID NO: 458777 - RNA, 32 nt, Human
ggccuuggcccaggggucagcagagcuucaga

SEQ ID NO: 458778 - RNA, 23 nt, Human
ggccuuggccccgcccacucuga

SEQ ID NO: 458779 - RNA, 32 nt, Human
ggccuuggcgagggcuggucugugcauagaag

SEQ ID NO: 458780 - RNA, 32 nt, Human
ggccuuggcugcauuugugcacaaggagcagg

SEQ ID NO: 458781 - RNA, 32 nt, Human
ggccuugggagguggucauguccagggggaug

SEQ ID NO: 458782 - RNA, 32 nt, Human
ggccuugggcaggggcagggagagcugcugag

SEQ ID NO: 458783 - RNA, 32 nt, Human
ggccuugggccaguggguuggaagggaggggg

SEQ ID NO: 458784 - RNA, 32 nt, Human
ggccuugggcucagccacugggagacaguugg

SEQ ID NO: 458785 - RNA, 32 nt, Human
ggccuugggcuggccgggguugcuggguggcc

SEQ ID NO: 458786 - RNA, 32 nt, Human
ggccuugggggucugggcugggcauccauggu

SEQ ID NO: 458787 - RNA, 21 nt, Human
ggccuugggucacagcucccu

SEQ ID NO: 458788 - RNA, 32 nt, Human
ggccuuggguccccauccucuggaaccagggg

SEQ ID NO: 458789 - RNA, 32 nt, Human
ggccuugggucgcguuccgagcuccaggacgg

SEQ ID NO: 458790 - RNA, 32 nt, Human
ggccuugggugaguggcucaggaacaguuugc

SEQ ID NO: 458791 - RNA, 32 nt, Human
ggccuugguauucucauccaguauaugcaaga

SEQ ID NO: 458792 - RNA, 32 nt, Human
ggccuugguccucacagcuccaaaaagaaaca

SEQ ID NO: 458793 - RNA, 19 nt, Human
ggccuuggucuaccugcca

SEQ ID NO: 458794 - RNA, 23 nt, Human
ggccuuggucuaccugccaggcc

SEQ ID NO: 458795 - RNA, 32 nt, Human
ggccuuggugagguggacaggaagggaccucg

SEQ ID NO: 458796 - RNA, 32 nt, Human
ggccuuggugcuaggauucaaagaggaaagga

SEQ ID NO: 458797 - RNA, 32 nt, Human
ggccuugguggacagaggauggggaaaggggu

SEQ ID NO: 458798 - RNA, 32 nt, Human
ggccuuggugggggugggggaggagguugagg

SEQ ID NO: 458799 - RNA, 22 nt, Human
ggccuuguaggaaaaggccccg

SEQ ID NO: 458800 - RNA, 23 nt, Human
ggccuugucaaggccucagaggc

SEQ ID NO: 458801 - RNA, 32 nt, Human
ggccuuguccuccuuguguucauacacugugg

SEQ ID NO: 458802 - RNA, 32 nt, Human
ggccuugugagagacuccaggagcaaagagcg

SEQ ID NO: 458803 - RNA, 32 nt, Human
ggccuuguggcuccuccccucgcuccucgccc

SEQ ID NO: 458804 - RNA, 32 nt, Human
ggccuuguguguggagagcuuucuaucuuacc

SEQ ID NO: 458805 - RNA, 32 nt, Human
ggccuuguuccuucacccucaguuccaugagc

SEQ ID NO: 458806 - RNA, 32 nt, Human
ggccuuguucugacagcauucuggcugaggcu

SEQ ID NO: 458807 - RNA, 32 nt, Human
ggccuuguuuccaaauccugucuuccauguug

SEQ ID NO: 458808 - RNA, 32 nt, Human
ggccuuuaaccagcuccugagcugcugcaacu

SEQ ID NO: 458809 - RNA, 20 nt, Human
ggccuuuacacagcaucacc

SEQ ID NO: 458810 - RNA, 32 nt, Human
ggccuuuacauacauuuucuccacuucuaauu

SEQ ID NO: 458811 - RNA, 32 nt, Human
ggccuuuauuucuccucuuccagugggaguuu

SEQ ID NO: 458812 - RNA, 32 nt, Human
ggccuuucaaagugcugggauuacaggcauga

SEQ ID NO: 458813 - RNA, 32 nt, Human
ggccuuucacuggguccagcucugauucgggu

SEQ ID NO: 458814 - RNA, 21 nt, Human
ggccuuucccccucucccuuu

SEQ ID NO: 458815 - RNA, 22 nt, Human
ggccuuucccucaacaccugcu

SEQ ID NO: 458816 - RNA, 32 nt, Human
ggccuuucccucagguuuuccucuuccccacu

SEQ ID NO: 458817 - RNA, 32 nt, Human
ggccuuucccuccaucccuugaggcacggggc

SEQ ID NO: 458818 - RNA, 32 nt, Human
ggccuuucccuuccuuuccuuucucaggccuu

SEQ ID NO: 458819 - RNA, 32 nt, Human
ggccuuuccuacaggggguggagagaccagcc

SEQ ID NO: 458820 - RNA, 19 nt, Human
ggccuuucuagccuggcua

SEQ ID NO: 458821 - RNA, 32 nt, Human
ggccuuucucucugcauagcaucucauccucu

SEQ ID NO: 458822 - RNA, 20 nt, Human
ggccuuucugaacuauuucc

SEQ ID NO: 458823 - RNA, 22 nt, Human
ggccuuucugauuuugccucca

SEQ ID NO: 458824 - RNA, 19 nt, Human
ggccuuucugcccuguucc

SEQ ID NO: 458825 - RNA, 17 nt, Human
ggccuuucuuccugagg

SEQ ID NO: 458826 - RNA, 32 nt, Human
ggccuuucuuucucccucuugcaaccaagauc

SEQ ID NO: 458827 - RNA, 20 nt, Human
ggccuuugaaggggcagcuu

SEQ ID NO: 458828 - RNA, 21 nt, Human
ggccuuugcccuucugccacu

SEQ ID NO: 458829 - RNA, 21 nt, Human
ggccuuugcggcgcgcagggg

SEQ ID NO: 458830 - RNA, 32 nt, Human
ggccuuugcucagggcugucugugcugcuccu

SEQ ID NO: 458831 - RNA, 32 nt, Human
ggccuuugcuguggcuggagcuggacagugca

SEQ ID NO: 458832 - RNA, 18 nt, Human
ggccuuugcuucucugcc

SEQ ID NO: 458833 - RNA, 32 nt, Human
ggccuuugucucucgcugcagucgcagcucca

SEQ ID NO: 458834 - RNA, 32 nt, Human
ggccuuugucugucccugucauggcuuuggac

SEQ ID NO: 458835 - RNA, 32 nt, Human
ggccuuuguuauauacaugcuuugcaauguac

SEQ ID NO: 458836 - RNA, 32 nt, Human
ggccuuuucccuagguuucugccuccucguuu

SEQ ID NO: 458837 - RNA, 27 nt, Human
ggccuuuuccugcccccugccuugcca

SEQ ID NO: 458838 - RNA, 32 nt, Human
ggccuuuuccugcccccugccuugccaaagac

SEQ ID NO: 458839 - RNA, 23 nt, Human
ggccuuuucuccuuacugcaucu

SEQ ID NO: 458840 - RNA, 32 nt, Human
ggccuuuugcuauccuuccugcuaugccugaa

SEQ ID NO: 458841 - RNA, 32 nt, Human
ggccuuuugcuuccagccaaagaacaccgcca

SEQ ID NO: 458842 - RNA, 32 nt, Human
ggccuuuuggggcaaucagaggcugccacaag

SEQ ID NO: 458843 - RNA, 23 nt, Human
ggccuuuuugcaaaaagcugugu

SEQ ID NO: 458844 - RNA, 24 nt, Human
ggccuuuuuguucugaauuuucca

SEQ ID NO: 458845 - RNA, 18 nt, Human
ggcgaaacagccagguga

SEQ ID NO: 458846 - RNA, 21 nt, Human
ggcgaaaccccaucucuacua

SEQ ID NO: 458847 - RNA, 21 nt, Human
ggcgaaaccccaucucugcua

SEQ ID NO: 458848 - RNA, 21 nt, Human
ggcgaaaccccauuucuacua

SEQ ID NO: 458849 - RNA, 21 nt, Human
ggcgaaaccccgucucuacua

SEQ ID NO: 458850 - RNA, 20 nt, Human
ggcgaaaccccucucuacua

SEQ ID NO: 458851 - RNA, 21 nt, Human
ggcgaaacccugucucuacua

SEQ ID NO: 458852 - RNA, 21 nt, Human
ggcgaaaccucaucucuacua

SEQ ID NO: 458853 - RNA, 32 nt, Human
ggcgaaaggagagagggagggaagggugggua

SEQ ID NO: 458854 - RNA, 32 nt, Human
ggcgaacagaacuucuuccucccaaacaauga

SEQ ID NO: 458855 - RNA, 32 nt, Human
ggcgaacauggugaaaccccaucucuacuaaa

SEQ ID NO: 458856 - RNA, 32 nt, Human
ggcgaacauggugagacccaucucuacuaaaa

SEQ ID NO: 458857 - RNA, 32 nt, Human
ggcgaacccacuguuggaccugaggagccagc

SEQ ID NO: 458858 - RNA, 32 nt, Human
ggcgaaccuaggaggcagaguuugcagugagc

SEQ ID NO: 458859 - RNA, 32 nt, Human
ggcgaagaaagcccagcggacgagccuccuuu

SEQ ID NO: 458860 - RNA, 32 nt, Human
ggcgaagacagcccgguagcugcgucgcccga

SEQ ID NO: 458861 - RNA, 32 nt, Human
ggcgaagacggaguuguaaacuucuuaaaauu

SEQ ID NO: 458862 - RNA, 32 nt, Human
ggcgaagcaggugauaucaagcccagagcccc

SEQ ID NO: 458863 - RNA, 18 nt, Human
ggcgaagcaguugugcuu

SEQ ID NO: 458864 - RNA, 32 nt, Human
ggcgaagcccaauggcgcgacagggaaggcgg

SEQ ID NO: 458865 - RNA, 32 nt, Human
ggcgaagcuggcugggcuccugagucaggugg

SEQ ID NO: 458866 - RNA, 32 nt, Human
ggcgaaggaaugaagauaggagggaagaggau

SEQ ID NO: 458867 - RNA, 32 nt, Human
ggcgaaggaggaagaggaggaggaggaagagg

SEQ ID NO: 458868 - RNA, 32 nt, Human
ggcgaaggcaggaaggggagugagaaagaggc

SEQ ID NO: 458869 - RNA, 21 nt, Human
ggcgaaggccugcggccgcgg

SEQ ID NO: 458870 - RNA, 32 nt, Human
ggcgaagggauaaugagcuggggaugggagca

SEQ ID NO: 458871 - RNA, 32 nt, Human
ggcgaagggggcaggccagggagaggcgcagg

SEQ ID NO: 458872 - RNA, 32 nt, Human
ggcgaaggugaugggauaucacucccuugauc

SEQ ID NO: 458873 - RNA, 32 nt, Human
ggcgaaggugugagcaugagccuaucggacac

SEQ ID NO: 458874 - RNA, 32 nt, Human
ggcgaagucgcugagacucugccugcuucuca

SEQ ID NO: 458875 - RNA, 32 nt, Human
ggcgaaguuuucuagaggguucuugggcucuu

SEQ ID NO: 458876 - RNA, 32 nt, Human
ggcgaaucccuaaggcggggcauccccaaucc

SEQ ID NO: 458877 - RNA, 32 nt, Human
ggcgaaucgccugaggccaggaauucaagacc

SEQ ID NO: 458878 - RNA, 32 nt, Human
ggcgaaucugcugcuaccaauguaaaggucag

SEQ ID NO: 458879 - RNA, 32 nt, Human
ggcgaaugacuguaaucccagcuacucaggag

SEQ ID NO: 458880 - RNA, 32 nt, Human
ggcgacaaccgaggaggaggggcgggacgccg

SEQ ID NO: 458881 - RNA, 32 nt, Human
ggcgacaauguucauuacucacaaauuguguu

SEQ ID NO: 458882 - RNA, 32 nt, Human
ggcgacacaggcacccagcuuugggguggugc

SEQ ID NO: 458883 - RNA, 24 nt, Human
ggcgacaccacgaguuauuuccca

SEQ ID NO: 458884 - RNA, 32 nt, Human
ggcgacacccacccaacuccucccucuccgcc

SEQ ID NO: 458885 - RNA, 21 nt, Human
ggcgacacggugaaaccccgu

SEQ ID NO: 458886 - RNA, 32 nt, Human
ggcgacacugcacugcaggcugggcuacaaag

SEQ ID NO: 458887 - RNA, 32 nt, Human
ggcgacacuuggccucacucccggcuaggcgc

SEQ ID NO: 458888 - RNA, 32 nt, Human
ggcgacagaacaugauguugacacgggcuggg

SEQ ID NO: 458889 - RNA, 23 nt, Human
ggcgacagagcaagacucugucu

SEQ ID NO: 458890 - RNA, 23 nt, Human
ggcgacagagcgagacucugucu

SEQ ID NO: 458891 - RNA, 23 nt, Human
ggcgacagagugagacccugucu

SEQ ID NO: 458892 - RNA, 23 nt, Human
ggcgacagagugagacuccaucu

SEQ ID NO: 458893 - RNA, 23 nt, Human
ggcgacagagugagacuccgucu

SEQ ID NO: 458894 - RNA, 22 nt, Human
ggcgacagagugagacucuguc

SEQ ID NO: 458895 - RNA, 22 nt, Human
ggcgacagcuccucuaguucca

SEQ ID NO: 458896 - RNA, 32 nt, Human
ggcgacauuguuuggaaugcugguucugcuuu

SEQ ID NO: 458897 - RNA, 32 nt, Human
ggcgaccacggugucuucaaaagccccgucag

SEQ ID NO: 458898 - RNA, 20 nt, Human
ggcgaccagaguccaggcug

SEQ ID NO: 458899 - RNA, 32 nt, Human
ggcgaccccugcccucagugcucucugucucu

SEQ ID NO: 458900 - RNA, 32 nt, Human
ggcgaccccuucugccaagugucccaaaauga

SEQ ID NO: 458901 - RNA, 32 nt, Human
ggcgacccggagguagcauuucccaggaggca

SEQ ID NO: 458902 - RNA, 32 nt, Human
ggcgacccugaccccaccacacugccuugagg

SEQ ID NO: 458903 - RNA, 32 nt, Human
ggcgaccggccagcaaccgcagcgucggcgcc

SEQ ID NO: 458904 - RNA, 32 nt, Human
ggcgaccggugcaggugcacgacgccagcucc

SEQ ID NO: 458905 - RNA, 23 nt, Human
ggcgaccgugcucgccguuggca

SEQ ID NO: 458906 - RNA, 32 nt, Human
ggcgaccuccacccucaucacccugcuggugc

SEQ ID NO: 458907 - RNA, 32 nt, Human
ggcgaccugaaggacguggccaaggaacuuaa

SEQ ID NO: 458908 - RNA, 32 nt, Human
ggcgacgccaaggacuuuccacaucaacugcu

SEQ ID NO: 458909 - RNA, 31 nt, Human
ggcgacggcaaaggagcggaauucuccacga

SEQ ID NO: 458910 - RNA, 32 nt, Human
ggcgacggcagaggcgaagggagccggaucgc

SEQ ID NO: 458911 - RNA, 23 nt, Human
ggcgacggggcaagacucugucu

SEQ ID NO: 458912 - RNA, 32 nt, Human
ggcgacgggugaggcacagcugagcgccaaag

SEQ ID NO: 458913 - RNA, 32 nt, Human
ggcgacgguggaggaggguggucugggaccgg

SEQ ID NO: 458914 - RNA, 32 nt, Human
ggcgacuccagagggugagcugagggcaagcu

SEQ ID NO: 458915 - RNA, 32 nt, Human
ggcgacuccgggaggcacagggcgcgcgaggu

SEQ ID NO: 458916 - RNA, 32 nt, Human
ggcgacugccugccaggcagacgcugcagcua

SEQ ID NO: 458917 - RNA, 32 nt, Human
ggcgacuggaggaagccaggcgaguggggccc

SEQ ID NO: 458918 - RNA, 32 nt, Human
ggcgacugggaggggcagcggcagcaguggca

SEQ ID NO: 458919 - RNA, 32 nt, Human
ggcgacugggggcugaagagcgcgccgcccuc

SEQ ID NO: 458920 - RNA, 28 nt, Human
ggcgacuguagucccagcuacucaggag

SEQ ID NO: 458921 - RNA, 32 nt, Human
ggcgagaagagggaaguuggagagggaaaagu

SEQ ID NO: 458922 - RNA, 32 nt, Human
ggcgagaaggggaagagcaggcugcgccaggg

SEQ ID NO: 458923 - RNA, 32 nt, Human
ggcgagagaaugaucuggccucaggggacagg

SEQ ID NO: 458924 - RNA, 32 nt, Human
ggcgagagccccucuucuucccgagcaguggg

SEQ ID NO: 458925 - RNA, 32 nt, Human
ggcgagagccugggguggggcgggagggggaa

SEQ ID NO: 458926 - RNA, 32 nt, Human
ggcgagagcuaguggggugcagagggccccau

SEQ ID NO: 458927 - RNA, 32 nt, Human
ggcgagaggaggaggaggaggaggagaaggcu

SEQ ID NO: 458928 - RNA, 18 nt, Human
ggcgagaggaggaggcag

SEQ ID NO: 458929 - RNA, 32 nt, Human
ggcgagaggaguuugaccuggaugugauugcu

SEQ ID NO: 458930 - RNA, 23 nt, Human
ggcgagaggauugcuugagccca

SEQ ID NO: 458931 - RNA, 32 nt, Human
ggcgagaggcggagcuggcccggcgcgccccg

SEQ ID NO: 458932 - RNA, 32 nt, Human
ggcgagaggugagcccucccuccuggagaggu

SEQ ID NO: 458933 - RNA, 32 nt, Human
ggcgagaguagggaccaggaagagccggaaaa

SEQ ID NO: 458934 - RNA, 20 nt, Human
ggcgagcaccuguaauccca

SEQ ID NO: 458935 - RNA, 32 nt, Human
ggcgagcaccuguaaucccagcuacucgggag

SEQ ID NO: 458936 - RNA, 32 nt, Human
ggcgagcaccuguaaucucagcacuuugggag

SEQ ID NO: 458937 - RNA, 32 nt, Human
ggcgagcagcuggcagagagcccagugccggc

SEQ ID NO: 458938 - RNA, 32 nt, Human
ggcgagcagggugggcaagugggaggagggga

SEQ ID NO: 458939 - RNA, 32 nt, Human
ggcgagcagguucuacccucucugcuaagggc

SEQ ID NO: 458940 - RNA, 32 nt, Human
ggcgagccccaaucucuagccucccaacuugg

SEQ ID NO: 458941 - RNA, 32 nt, Human
ggcgagcccuggaggagggaggccacaacucc

SEQ ID NO: 458942 - RNA, 32 nt, Human
ggcgagccggagcgaggaagggaaagcgcaag

SEQ ID NO: 458943 - RNA, 32 nt, Human
ggcgagccuccaccgcaaacccaauccagaug

SEQ ID NO: 458944 - RNA, 32 nt, Human
ggcgagcgacagcggccucagccccggcagcg

SEQ ID NO: 458945 - RNA, 32 nt, Human
ggcgagcgccuguaaucccagguauuccggaa

SEQ ID NO: 458946 - RNA, 32 nt, Human
ggcgagcggggcgccggaggaagaggaggacc

SEQ ID NO: 458947 - RNA, 32 nt, Human
ggcgagcgugcgggccaacaccuauugccgcc

SEQ ID NO: 458948 - RNA, 32 nt, Human
ggcgagcuccccucugucuggggcaggguggg

SEQ ID NO: 458949 - RNA, 32 nt, Human
ggcgagcugcaacaagucgugugggacgaacc

SEQ ID NO: 458950 - RNA, 32 nt, Human
ggcgagcuggaaauauguguaacacaggcuug

SEQ ID NO: 458951 - RNA, 32 nt, Human
ggcgagcugguccgcaccacuaguucugcuuc

SEQ ID NO: 458952 - RNA, 21 nt, Human
ggcgagcuugccaucguggcc

SEQ ID NO: 458953 - RNA, 32 nt, Human
ggcgaggagacaccuugaucagcgucccaguu

SEQ ID NO: 458954 - RNA, 32 nt, Human
ggcgaggagagggaagggggcggaggagacag

SEQ ID NO: 458955 - RNA, 21 nt, Human
ggcgaggagccgccgcagccg

SEQ ID NO: 458956 - RNA, 22 nt, Human
ggcgaggagccuccgcccccca

SEQ ID NO: 458957 - RNA, 32 nt, Human
ggcgaggaggaaaguggagaccaccuggcacg

SEQ ID NO: 458958 - RNA, 19 nt, Human
ggcgaggaggaggaggaga

SEQ ID NO: 458959 - RNA, 32 nt, Human
ggcgaggaggaggcggagguggagcuggcgga

SEQ ID NO: 458960 - RNA, 32 nt, Human
ggcgaggaggcguuuccacccccuggugccua

SEQ ID NO: 458961 - RNA, 32 nt, Human
ggcgaggaggcugacugagguucagagccugg

SEQ ID NO: 458962 - RNA, 32 nt, Human
ggcgaggagguggaggaggaggaggaggagga

SEQ ID NO: 458963 - RNA, 32 nt, Human
ggcgaggaguccagagagccauggccgcccug

SEQ ID NO: 458964 - RNA, 32 nt, Human
ggcgaggcacuggccagcccagcuccacgagg

SEQ ID NO: 458965 - RNA, 32 nt, Human
ggcgaggcaggcggacgaggcgcagagacagc

SEQ ID NO: 458966 - RNA, 32 nt, Human
ggcgaggcccaccugggcucuguccucugcca

SEQ ID NO: 458967 - RNA, 19 nt, Human
ggcgaggccccucccagua

SEQ ID NO: 458968 - RNA, 32 nt, Human
ggcgaggccugagcccucacacaugcccacgc

SEQ ID NO: 458969 - RNA, 32 nt, Human
ggcgaggcgggcagagccagaggcacgcagcc

SEQ ID NO: 458970 - RNA, 32 nt, Human
ggcgaggcuguggagaaaaaggaaugcuuaua

SEQ ID NO: 458971 - RNA, 32 nt, Human
ggcgagggcgagcggcggggacuggggaaggg

SEQ ID NO: 458972 - RNA, 32 nt, Human
ggcgagggcgcacagguucuguuuuucgccgg

SEQ ID NO: 458973 - RNA, 19 nt, Human
ggcgagggcgccgcaccca

SEQ ID NO: 458974 - RNA, 32 nt, Human
ggcgagggcucaggaacagccccuuuccugug

SEQ ID NO: 458975 - RNA, 32 nt, Human
ggcgagggcugccucuuguucucccgccgcug

SEQ ID NO: 458976 - RNA, 32 nt, Human
ggcgagggcugcgggaaggaaagggggcggcg

SEQ ID NO: 458977 - RNA, 32 nt, Human
ggcgaggggaggguggcaggugaccuucuggg

SEQ ID NO: 458978 - RNA, 22 nt, Human
ggcgaggggccgagucccgccu

SEQ ID NO: 458979 - RNA, 32 nt, Human
ggcgaggggcggggcagauggcgagggagcgg

SEQ ID NO: 458980 - RNA, 32 nt, Human
ggcgagggggagaaagggagagagggaggggg

SEQ ID NO: 458981 - RNA, 32 nt, Human
ggcgaggguggcugaggcuguugugcaguagg

SEQ ID NO: 458982 - RNA, 32 nt, Human
ggcgagggugucuauggagaggcggcggccgc

SEQ ID NO: 458983 - RNA, 32 nt, Human
ggcgaggugccuggccugccauguaggggcuc

SEQ ID NO: 458984 - RNA, 22 nt, Human
ggcgagguggcucacaccugua

SEQ ID NO: 458985 - RNA, 32 nt, Human
ggcgagguuuuauacaccugaaagaagagaau

SEQ ID NO: 458986 - RNA, 32 nt, Human
ggcgaguagggagugggggagguggguccaag

SEQ ID NO: 458987 - RNA, 27 nt, Human
ggcgaguccacgugcuccccgcggccg

SEQ ID NO: 458988 - RNA, 32 nt, Human
ggcgagugucuguaaucccagcuacucaggag

SEQ ID NO: 458989 - RNA, 32 nt, Human
ggcgaguuaaauaggcaagguacccagugaua

SEQ ID NO: 458990 - RNA, 32 nt, Human
ggcgaguucagcuuggggugugagugagacag

SEQ ID NO: 458991 - RNA, 32 nt, Human
ggcgaguuguuggaaacagucauuuucuuaga

SEQ ID NO: 458992 - RNA, 32 nt, Human
ggcgauccaccugucucagccucccagagugc

SEQ ID NO: 458993 - RNA, 32 nt, Human
ggcgauccaggcgcuccagacuuaccagagcc

SEQ ID NO: 458994 - RNA, 32 nt, Human
ggcgaucccucaccugcuuacucacucagcag

SEQ ID NO: 458995 - RNA, 32 nt, Human
ggcgaucggagugggccuuuucuuucuuuuug

SEQ ID NO: 458996 - RNA, 32 nt, Human
ggcgaucucccagggcucucuggaccauacgc

SEQ ID NO: 458997 - RNA, 32 nt, Human
ggcgaucugagcacucaggcugaucuagagga

SEQ ID NO: 458998 - RNA, 21 nt, Human
ggcgaucugccugccuuggca

SEQ ID NO: 458999 - RNA, 32 nt, Human
ggcgaucuucuggggcccacagcuggugauau

SEQ ID NO: 459000 - RNA, 32 nt, Human
ggcgauggcaggacacagcauaauguuuggcu

SEQ ID NO: 459001 - RNA, 32 nt, Human
ggcgauggcauccuuccuuuccauccuaagac

SEQ ID NO: 459002 - RNA, 29 nt, Human
ggcgauggccacucucccagcagcagaaa

SEQ ID NO: 459003 - RNA, 22 nt, Human
ggcgauggccucuucugcaucu

SEQ ID NO: 459004 - RNA, 32 nt, Human
ggcgauggccuuuggagauugcgugugguguu

SEQ ID NO: 459005 - RNA, 32 nt, Human
ggcgaugggauuauaggacucuccccaucucg

SEQ ID NO: 459006 - RNA, 32 nt, Human
ggcgaugggauuauggggcagaguccucacaa

SEQ ID NO: 459007 - RNA, 32 nt, Human
ggcgauguccccacauggagggaacacccgac

SEQ ID NO: 459008 - RNA, 29 nt, Human
ggcgauguuccacugcaucccccuguggc

SEQ ID NO: 459009 - RNA, 32 nt, Human
ggcgauucuggugcaagugcccagggccuccg

SEQ ID NO: 459010 - RNA, 32 nt, Human
ggcgauugaggguucaccucugccuuggggag

SEQ ID NO: 459011 - RNA, 32 nt, Human
ggcgauuggcaucgaucucuccaucccuuccg

SEQ ID NO: 459012 - RNA, 32 nt, Human
ggcgauuuacaaagggggaugcuuacagaagg

SEQ ID NO: 459013 - RNA, 32 nt, Human
ggcgauuugggggcucggggaggcagagaauc

SEQ ID NO: 459014 - RNA, 32 nt, Human
ggcgcaaauuccucucguucaggcuggagaga

SEQ ID NO: 459015 - RNA, 32 nt, Human
ggcgcaacauggccgcagccucgccucugcgc

SEQ ID NO: 459016 - RNA, 32 nt, Human
ggcgcaagccuguaaucccagcuacucaggag

SEQ ID NO: 459017 - RNA, 32 nt, Human
ggcgcaagccuguaaucccagcuauuugggag

SEQ ID NO: 459018 - RNA, 32 nt, Human
ggcgcaaggagaggagggauccaguggggccg

SEQ ID NO: 459019 - RNA, 21 nt, Human
ggcgcaagggugagggcggcc

SEQ ID NO: 459020 - RNA, 22 nt, Human
ggcgcaaucucagcucacugca

SEQ ID NO: 459021 - RNA, 32 nt, Human
ggcgcaauuacggcccgacuccugggcucaag

SEQ ID NO: 459022 - RNA, 32 nt, Human
ggcgcacaccaccacacuggcuaauuuuugua

SEQ ID NO: 459023 - RNA, 32 nt, Human
ggcgcacaccaccacauccagcuuauuuuugu

SEQ ID NO: 459024 - RNA, 32 nt, Human
ggcgcacaccuguaaucccagcuacucaggaa

SEQ ID NO: 459025 - RNA, 32 nt, Human
ggcgcacaccuguaaucccagcuacucaggag

SEQ ID NO: 459026 - RNA, 32 nt, Human
ggcgcacaccuguaaucccagcuacucgggag

SEQ ID NO: 459027 - RNA, 32 nt, Human
ggcgcacaccuguaauccuagcuacucgggag

SEQ ID NO: 459028 - RNA, 32 nt, Human
ggcgcacaccuguaaucucagcuacucgggag

SEQ ID NO: 459029 - RNA, 20 nt, Human
ggcgcacacguguaauccca

SEQ ID NO: 459030 - RNA, 32 nt, Human
ggcgcacacucccggucuccacucgcucuucc

SEQ ID NO: 459031 - RNA, 24 nt, Human
ggcgcacagcgcggggccaggcug

SEQ ID NO: 459032 - RNA, 32 nt, Human
ggcgcacaucuguaaucccagcuacucgggag

SEQ ID NO: 459033 - RNA, 32 nt, Human
ggcgcaccacggucacuuuggccuggaaacca

SEQ ID NO: 459034 - RNA, 32 nt, Human
ggcgcaccgcaagcccugccuccuggguucaa

SEQ ID NO: 459035 - RNA, 32 nt, Human
ggcgcacgccuguaaucccagcuacucaagag

SEQ ID NO: 459036 - RNA, 32 nt, Human
ggcgcacgccuguaaucccagcuacucgggag

SEQ ID NO: 459037 - RNA, 32 nt, Human
ggcgcacgccuguaaugccagcuacuugggag

SEQ ID NO: 459038 - RNA, 32 nt, Human
ggcgcacgcugggcaguggccugggcaacccc

SEQ ID NO: 459039 - RNA, 21 nt, Human
ggcgcacggaggcccgcgcug

SEQ ID NO: 459040 - RNA, 32 nt, Human
ggcgcacggggugggagcggagcccaggccgg

SEQ ID NO: 459041 - RNA, 32 nt, Human
ggcgcacgucaaacccugccuuuccuuuacuu

SEQ ID NO: 459042 - RNA, 32 nt, Human
ggcgcacguguuuguucacauguccagcguug

SEQ ID NO: 459043 - RNA, 32 nt, Human
ggcgcacuccgacuccgagcagucucuguccu

SEQ ID NO: 459044 - RNA, 24 nt, Human
ggcgcacugcagccuugaccuccu

SEQ ID NO: 459045 - RNA, 32 nt, Human
ggcgcacugcagccuugaccuccugagcucaa

SEQ ID NO: 459046 - RNA, 25 nt, Human
ggcgcacuuuuuauuuuuauuuuau

SEQ ID NO: 459047 - RNA, 22 nt, Human
ggcgcagaaggguugggggccu

SEQ ID NO: 459048 - RNA, 17 nt, Human
ggcgcagaccugaggcg

SEQ ID NO: 459049 - RNA, 32 nt, Human
ggcgcagacucucccagcuggcaccaaagccu

SEQ ID NO: 459050 - RNA, 32 nt, Human
ggcgcagaggccucgccuccugaaggacgcag

SEQ ID NO: 459051 - RNA, 18 nt, Human
ggcgcagagggccgggca

SEQ ID NO: 459052 - RNA, 32 nt, Human
ggcgcagaugccgcaucugaggaaggugcgag

SEQ ID NO: 459053 - RNA, 19 nt, Human
ggcgcagauggcuaacuga

SEQ ID NO: 459054 - RNA, 32 nt, Human
ggcgcagauguuuguguugccuccucaggcac

SEQ ID NO: 459055 - RNA, 32 nt, Human
ggcgcagauugcagcgcagcuguguuggaggc

SEQ ID NO: 459056 - RNA, 21 nt, Human
ggcgcagcacuggagcggggg

SEQ ID NO: 459057 - RNA, 23 nt, Human
ggcgcagcagcagguggcagggg

SEQ ID NO: 459058 - RNA, 21 nt, Human
ggcgcagcagcccagcggagg

SEQ ID NO: 459059 - RNA, 21 nt, Human
ggcgcagcaguuccuggcgag

SEQ ID NO: 459060 - RNA, 32 nt, Human
ggcgcagccagcccugaagugccugucuggcu

SEQ ID NO: 459061 - RNA, 32 nt, Human
ggcgcagcccaggaggcgggagccccugcaca

SEQ ID NO: 459062 - RNA, 32 nt, Human
ggcgcagccgacaucagcacccuagaccagaa

SEQ ID NO: 459063 - RNA, 20 nt, Human
ggcgcagccugccaccuccc

SEQ ID NO: 459064 - RNA, 32 nt, Human
ggcgcagcgacggcccguuccaccucgcgauc

SEQ ID NO: 459065 - RNA, 21 nt, Human
ggcgcagcggagcgcgguccc

SEQ ID NO: 459066 - RNA, 16 nt, Human
ggcgcagcggcuggcu

SEQ ID NO: 459067 - RNA, 32 nt, Human
ggcgcagcgggcggaggcggccgugggccgcc

SEQ ID NO: 459068 - RNA, 24 nt, Human
ggcgcagcggggagcugcucccca

SEQ ID NO: 459069 - RNA, 21 nt, Human
ggcgcagcuuggccaccuccc

SEQ ID NO: 459070 - RNA, 18 nt, Human
ggcgcaggaagggggcgg

SEQ ID NO: 459071 - RNA, 32 nt, Human
ggcgcaggaauaagcaaagagacccuggaccc

SEQ ID NO: 459072 - RNA, 20 nt, Human
ggcgcaggaggcgggcggcc

SEQ ID NO: 459073 - RNA, 32 nt, Human
ggcgcaggauucagccggagggaagggacggg

SEQ ID NO: 459074 - RNA, 32 nt, Human
ggcgcaggccgaguuccagaccagccugggaa

SEQ ID NO: 459075 - RNA, 23 nt, Human
ggcgcagggcacggugggcgccu

SEQ ID NO: 459076 - RNA, 32 nt, Human
ggcgcagggucugggacgcaguugggagugca

SEQ ID NO: 459077 - RNA, 32 nt, Human
ggcgcaguggccgaggcuggagcggcaggcgg

SEQ ID NO: 459078 - RNA, 22 nt, Human
ggcgcaguggcucaugccugua

SEQ ID NO: 459079 - RNA, 32 nt, Human
ggcgcaguggcuguaaucccagcacuuuggga

SEQ ID NO: 459080 - RNA, 31 nt, Human
ggcgcaguguuucagcaucuaggggucaaaa

SEQ ID NO: 459081 - RNA, 32 nt, Human
ggcgcaguucccagcuaucuccccugcuccuc

SEQ ID NO: 459082 - RNA, 32 nt, Human
ggcgcaguuugagagaauggacucccauuuua

SEQ ID NO: 459083 - RNA, 32 nt, Human
ggcgcauaccuguaaucccagcuacuugggag

SEQ ID NO: 459084 - RNA, 32 nt, Human
ggcgcauacuuguaaucccagcuacucaggag

SEQ ID NO: 459085 - RNA, 32 nt, Human
ggcgcauauggaguagaugcucaccagaggcu

SEQ ID NO: 459086 - RNA, 18 nt, Human
ggcgcaucaccugagguc

SEQ ID NO: 459087 - RNA, 32 nt, Human
ggcgcaucccuguaaucccagcuacuuuacuu

SEQ ID NO: 459088 - RNA, 32 nt, Human
ggcgcauccucccaggccaccaacccagccau

SEQ ID NO: 459089 - RNA, 32 nt, Human
ggcgcaucggaaacucgcuuccuaugggucag

SEQ ID NO: 459090 - RNA, 30 nt, Human
ggcgcaugacuguaaucccagcuacucggg

SEQ ID NO: 459091 - RNA, 32 nt, Human
ggcgcaugccuauaaucccagcuacucgagug

SEQ ID NO: 459092 - RNA, 32 nt, Human
ggcgcaugccuauaaucccagcuacuugggag

SEQ ID NO: 459093 - RNA, 32 nt, Human
ggcgcaugccuauaaucccagguacucaggag

SEQ ID NO: 459094 - RNA, 23 nt, Human
ggcgcaugccugcaaucccagcu

SEQ ID NO: 459095 - RNA, 32 nt, Human
ggcgcaugccugcaaucccagcuacuuggaag

SEQ ID NO: 459096 - RNA, 32 nt, Human
ggcgcaugccuguaaucccaacuacucaggag

SEQ ID NO: 459097 - RNA, 32 nt, Human
ggcgcaugccuguaaucccagaacuuugggag

SEQ ID NO: 459098 - RNA, 32 nt, Human
ggcgcaugccuguaaucccagcacuuugggag

SEQ ID NO: 459099 - RNA, 32 nt, Human
ggcgcaugccuguaaucccagcuacuagagag

SEQ ID NO: 459100 - RNA, 32 nt, Human
ggcgcaugccuguaaucccagcuacucaggaa

SEQ ID NO: 459101 - RNA, 32 nt, Human
ggcgcaugccuguaaucccagcuacucaggag

SEQ ID NO: 459102 - RNA, 32 nt, Human
ggcgcaugccuguaaucccagcuacucgggag

SEQ ID NO: 459103 - RNA, 32 nt, Human
ggcgcaugccuguaaucccagcuacugggaag

SEQ ID NO: 459104 - RNA, 32 nt, Human
ggcgcaugccuguaaucccagcuacuuaggag

SEQ ID NO: 459105 - RNA, 32 nt, Human
ggcgcaugccuguaaucccagcuacuugggag

SEQ ID NO: 459106 - RNA, 32 nt, Human
ggcgcaugccuguaaucccagcugcuugggag

SEQ ID NO: 459107 - RNA, 32 nt, Human
ggcgcaugccuguaaucccaguuacucaggag

SEQ ID NO: 459108 - RNA, 32 nt, Human
ggcgcaugccuguaauccuagcuacucaggag

SEQ ID NO: 459109 - RNA, 32 nt, Human
ggcgcaugccuguaauccuagcuacucgggag

SEQ ID NO: 459110 - RNA, 32 nt, Human
ggcgcaugccuguaaucucagcuacucaggag

SEQ ID NO: 459111 - RNA, 32 nt, Human
ggcgcaugccuguagucccagcuaacugggag

SEQ ID NO: 459112 - RNA, 32 nt, Human
ggcgcaugccuguagucccagcuacuugggag

SEQ ID NO: 459113 - RNA, 32 nt, Human
ggcgcaugccuguagucccagguacucaggag

SEQ ID NO: 459114 - RNA, 32 nt, Human
ggcgcaugccuguaguuccagcuacucaggag

SEQ ID NO: 459115 - RNA, 32 nt, Human
ggcgcaugccuguaguuccagcuacuugugag

SEQ ID NO: 459116 - RNA, 32 nt, Human
ggcgcaugccugugaucccagcuacuugagag

SEQ ID NO: 459117 - RNA, 32 nt, Human
ggcgcaugccuguggucccgguuacucaggag

SEQ ID NO: 459118 - RNA, 32 nt, Human
ggcgcaugccuguuguagccccagcuacucaa

SEQ ID NO: 459119 - RNA, 32 nt, Human
ggcgcaugcuuguaaucccagcuacucgggag

SEQ ID NO: 459120 - RNA, 32 nt, Human
ggcgcaugucuguaaucccagcuacuggggaa

SEQ ID NO: 459121 - RNA, 32 nt, Human
ggcgcaugucuguaaucccagcuacuggggag

SEQ ID NO: 459122 - RNA, 32 nt, Human
ggcgcauucccacacuccagucuggauccagg

SEQ ID NO: 459123 - RNA, 32 nt, Human
ggcgcauugccuguaaucccagcuacuaggga

SEQ ID NO: 459124 - RNA, 21 nt, Human
ggcgccaacugucccuuggca

SEQ ID NO: 459125 - RNA, 32 nt, Human
ggcgccaccaaccccacccacacugcugccug

SEQ ID NO: 459126 - RNA, 32 nt, Human
ggcgccaccacugaugccacccaggaccucgg

SEQ ID NO: 459127 - RNA, 20 nt, Human
ggcgccaccgucuccaagga

SEQ ID NO: 459128 - RNA, 19 nt, Human
ggcgccaccuucugcugcc

SEQ ID NO: 459129 - RNA, 23 nt, Human
ggcgccacgccgccguggccgca

SEQ ID NO: 459130 - RNA, 32 nt, Human
ggcgccacuacacuccagccugggcaacagag

SEQ ID NO: 459131 - RNA, 32 nt, Human
ggcgccacuacacuccagccugggcgacagag

SEQ ID NO: 459132 - RNA, 23 nt, Human
ggcgccacucaggaguccuaccc

SEQ ID NO: 459133 - RNA, 32 nt, Human
ggcgccacucucugcccugccaugcggcuggu

SEQ ID NO: 459134 - RNA, 32 nt, Human
ggcgccacugcacuccagcccgggcgacagag

SEQ ID NO: 459135 - RNA, 32 nt, Human
ggcgccacugcacuccagccuaggcaacagag

SEQ ID NO: 459136 - RNA, 32 nt, Human
ggcgccacugcacuccagccugagugacagag

SEQ ID NO: 459137 - RNA, 32 nt, Human
ggcgccacugcacuccagccugggcgacagag

SEQ ID NO: 459138 - RNA, 32 nt, Human
ggcgccacugcacuccagccugggcgucagag

SEQ ID NO: 459139 - RNA, 32 nt, Human
ggcgccacugcacuccagccuggguaacagag

SEQ ID NO: 459140 - RNA, 32 nt, Human
ggcgccacugcacuccagccugggugacagag

SEQ ID NO: 459141 - RNA, 32 nt, Human
ggcgccacugcacuccagccugggugagagag

SEQ ID NO: 459142 - RNA, 32 nt, Human
ggcgccacugcacuccagucugggcaacagag

SEQ ID NO: 459143 - RNA, 32 nt, Human
ggcgccacugcacuccagucugggcgauagag

SEQ ID NO: 459144 - RNA, 32 nt, Human
ggcgccacugcacucccgucugggggagagag

SEQ ID NO: 459145 - RNA, 32 nt, Human
ggcgccacugcacuucagccuuggagacaggg

SEQ ID NO: 459146 - RNA, 32 nt, Human
ggcgccacugcauuccagccugggcaacagag

SEQ ID NO: 459147 - RNA, 32 nt, Human
ggcgccacugcgcuccagccugggcaacagag

SEQ ID NO: 459148 - RNA, 32 nt, Human
ggcgccacuucacugcagccuggguggcagag

SEQ ID NO: 459149 - RNA, 32 nt, Human
ggcgccagaaguggcggcagcagcagccgcag

SEQ ID NO: 459150 - RNA, 32 nt, Human
ggcgccagcagguggagcuugacgugacgucu

SEQ ID NO: 459151 - RNA, 28 nt, Human
ggcgccagcagguggcgcuggacgcgca

SEQ ID NO: 459152 - RNA, 24 nt, Human
ggcgccagccaacacacccggcua

SEQ ID NO: 459153 - RNA, 25 nt, Human
ggcgccagccacugcgcccggccca

SEQ ID NO: 459154 - RNA, 21 nt, Human
ggcgccagccggcggauuaca

SEQ ID NO: 459155 - RNA, 22 nt, Human
ggcgccagcgaggccucggcca

SEQ ID NO: 459156 - RNA, 23 nt, Human
ggcgccagcgcuuccccgaccac

SEQ ID NO: 459157 - RNA, 17 nt, Human
ggcgccagcguggacgg

SEQ ID NO: 459158 - RNA, 21 nt, Human
ggcgccagcucccaggccgca

SEQ ID NO: 459159 - RNA, 21 nt, Human
ggcgccagcucgcuccaggga

SEQ ID NO: 459160 - RNA, 21 nt, Human
ggcgccaggacacaguggcug

SEQ ID NO: 459161 - RNA, 23 nt, Human
ggcgccaggcagccgugaucaca

SEQ ID NO: 459162 - RNA, 23 nt, Human
ggcgccagggaaaauucugguua

SEQ ID NO: 459163 - RNA, 19 nt, Human
ggcgccagggccucuggug

SEQ ID NO: 459164 - RNA, 32 nt, Human
ggcgccaguagucccagcuacuugggaggccu

SEQ ID NO: 459165 - RNA, 32 nt, Human
ggcgccauagccacagcaacgguaccaaguuc

SEQ ID NO: 459166 - RNA, 18 nt, Human
ggcgccaucuucgugccc

SEQ ID NO: 459167 - RNA, 32 nt, Human
ggcgccauugcacuccagccugggcaaaaaga

SEQ ID NO: 459168 - RNA, 32 nt, Human
ggcgccauugcacuccagccugggugacaaga

SEQ ID NO: 459169 - RNA, 32 nt, Human
ggcgccauuucacuccagccugggcgacagag

SEQ ID NO: 459170 - RNA, 31 nt, Human
ggcgcccacaaugcucccaugacaaggagcu

SEQ ID NO: 459171 - RNA, 32 nt, Human
ggcgcccacacuggcccugcagugaugcaggg

SEQ ID NO: 459172 - RNA, 32 nt, Human
ggcgcccaccuguaauccuagcugcucagggg

SEQ ID NO: 459173 - RNA, 32 nt, Human
ggcgcccacggagagaaaagaaagggcugaga

SEQ ID NO: 459174 - RNA, 32 nt, Human
ggcgcccacucccacuuuaaugagggugaaga

SEQ ID NO: 459175 - RNA, 32 nt, Human
ggcgcccagccugucaaguccucuucugccuc

SEQ ID NO: 459176 - RNA, 32 nt, Human
ggcgcccagccugugucugaauccuccuacug

SEQ ID NO: 459177 - RNA, 16 nt, Human
ggcgcccagcuggcug

SEQ ID NO: 459178 - RNA, 24 nt, Human
ggcgcccaggcucggugcuggaga

SEQ ID NO: 459179 - RNA, 24 nt, Human
ggcgcccagguccugcaaaggagc

SEQ ID NO: 459180 - RNA, 32 nt, Human
ggcgccccaccaccacccaguuuggggaccca

SEQ ID NO: 459181 - RNA, 32 nt, Human
ggcgccccaggaggaggaagaaaccagggccc

SEQ ID NO: 459182 - RNA, 21 nt, Human
ggcgcccccuucuuucaccca

SEQ ID NO: 459183 - RNA, 21 nt, Human
ggcgccccgcgcagcuggcug

SEQ ID NO: 459184 - RNA, 32 nt, Human
ggcgccccuaggacagcgucccuucacgucgg

SEQ ID NO: 459185 - RNA, 32 nt, Human
ggcgccccucccucccuguccccucuucuggc

SEQ ID NO: 459186 - RNA, 25 nt, Human
ggcgcccgagcaccugcagaggagc

SEQ ID NO: 459187 - RNA, 32 nt, Human
ggcgcccgagugagccuuaacauccaggggcu

SEQ ID NO: 459188 - RNA, 21 nt, Human
ggcgcccgcacgccccgggug

SEQ ID NO: 459189 - RNA, 19 nt, Human
ggcgcccgccaccacggcc

SEQ ID NO: 459190 - RNA, 32 nt, Human
ggcgcccgcgcagaaccagcugucugagcugc

SEQ ID NO: 459191 - RNA, 25 nt, Human
ggcgcccggcugggggagccccggg

SEQ ID NO: 459192 - RNA, 32 nt, Human
ggcgcccgggagcuggcugagcgccggggccc

SEQ ID NO: 459193 - RNA, 22 nt, Human
ggcgcccgggcugccuggccgc

SEQ ID NO: 459194 - RNA, 16 nt, Human
ggcgcccguaauccca

SEQ ID NO: 459195 - RNA, 32 nt, Human
ggcgcccguucccagcauccuccuuggcaggu

SEQ ID NO: 459196 - RNA, 32 nt, Human
ggcgcccuagggcagcggcgugcaguguucgg

SEQ ID NO: 459197 - RNA, 32 nt, Human
ggcgcccuccuggacuuacuggcuccauugag

SEQ ID NO: 459198 - RNA, 32 nt, Human
ggcgcccugaggggaagagcggcccggcccga

SEQ ID NO: 459199 - RNA, 32 nt, Human
ggcgcccugcagauggggcgggcagggaacgg

SEQ ID NO: 459200 - RNA, 32 nt, Human
ggcgcccugcagcugucuccucggccauccug

SEQ ID NO: 459201 - RNA, 32 nt, Human
ggcgcccuggacccacuuucucucucaaacug

SEQ ID NO: 459202 - RNA, 32 nt, Human
ggcgcccuucguuccuccucugcuucccuucc

SEQ ID NO: 459203 - RNA, 32 nt, Human
ggcgccgcacacacacauuaacacacuugagc

SEQ ID NO: 459204 - RNA, 23 nt, Human
ggcgccgcagcccgcucggcccg

SEQ ID NO: 459205 - RNA, 32 nt, Human
ggcgccgcagccgccugcguuucgguuuguga

SEQ ID NO: 459206 - RNA, 23 nt, Human
ggcgccgccacuguccggccaca

SEQ ID NO: 459207 - RNA, 21 nt, Human
ggcgccgccccacccggccca

SEQ ID NO: 459208 - RNA, 20 nt, Human
ggcgccgcccgggucccugc

SEQ ID NO: 459209 - RNA, 32 nt, Human
ggcgccgccggggccuccagacuggccuuccg

SEQ ID NO: 459210 - RNA, 32 nt, Human
ggcgccgccucccagcccagagcccagcgcuc

SEQ ID NO: 459211 - RNA, 21 nt, Human
ggcgccgccuccccuccccca

SEQ ID NO: 459212 - RNA, 32 nt, Human
ggcgccgccucuccacccgcagccugcggagg

SEQ ID NO: 459213 - RNA, 19 nt, Human
ggcgccgcgcuucccagcc

SEQ ID NO: 459214 - RNA, 32 nt, Human
ggcgccgcugcgcgcaugggccuguuccuggc

SEQ ID NO: 459215 - RNA, 22 nt, Human
ggcgccgcugcugucccccgcc

SEQ ID NO: 459216 - RNA, 32 nt, Human
ggcgccgcuggcaggagcgcuuggggauccuc

SEQ ID NO: 459217 - RNA, 32 nt, Human
ggcgccgcuucuuccgcuuucucgucaggcuc

SEQ ID NO: 459218 - RNA, 20 nt, Human
ggcgccggaaauccucaaag

SEQ ID NO: 459219 - RNA, 32 nt, Human
ggcgccggacaagaggagggggcgugcagcgg

SEQ ID NO: 459220 - RNA, 24 nt, Human
ggcgccggcccccugcccgaccgc

SEQ ID NO: 459221 - RNA, 25 nt, Human
ggcgccggcccguccgucugccgca

SEQ ID NO: 459222 - RNA, 26 nt, Human
ggcgccggcgaggacuccccggccac

SEQ ID NO: 459223 - RNA, 32 nt, Human
ggcgccgggaggccgagccagcgacuaagagg

SEQ ID NO: 459224 - RNA, 32 nt, Human
ggcgccgggaggcgcgggcuuugcuccugggg

SEQ ID NO: 459225 - RNA, 23 nt, Human
ggcgccgggcaaagacggcugcg

SEQ ID NO: 459226 - RNA, 23 nt, Human
ggcgccgggcccugccggccaca

SEQ ID NO: 459227 - RNA, 29 nt, Human
ggcgccgggcugcuauucuucccccgggu

SEQ ID NO: 459228 - RNA, 32 nt, Human
ggcgccggggagaagagacauggagccggccc

SEQ ID NO: 459229 - RNA, 32 nt, Human
ggcgccgucuucuccuccuugucacccgcggu

SEQ ID NO: 459230 - RNA, 32 nt, Human
ggcgccguggcggaauggcggcuuccaucucu

SEQ ID NO: 459231 - RNA, 20 nt, Human
ggcgccguggggccgggaca

SEQ ID NO: 459232 - RNA, 32 nt, Human
ggcgccuauaaccccagcuauuugggaggcug

SEQ ID NO: 459233 - RNA, 16 nt, Human
ggcgccuauaauccca

SEQ ID NO: 459234 - RNA, 32 nt, Human
ggcgccuauaaucccagcuacuugggaggcca

SEQ ID NO: 459235 - RNA, 32 nt, Human
ggcgccuauaaucccagcuacuugggaggcug

SEQ ID NO: 459236 - RNA, 32 nt, Human
ggcgccuauaaucccagcuauucuggaggcug

SEQ ID NO: 459237 - RNA, 32 nt, Human
ggcgccuauagucccagcuacuugggaggcug

SEQ ID NO: 459238 - RNA, 32 nt, Human
ggcgccucagccgccucacuccugggccugcu

SEQ ID NO: 459239 - RNA, 32 nt, Human
ggcgccucagccgccucacuccugguucugcu

SEQ ID NO: 459240 - RNA, 32 nt, Human
ggcgccucaucugcaucucugccucaccccau

SEQ ID NO: 459241 - RNA, 32 nt, Human
ggcgccuccacccacccuccugccucaccccu

SEQ ID NO: 459242 - RNA, 32 nt, Human
ggcgccuccucccagaggcuuccaggagcacg

SEQ ID NO: 459243 - RNA, 32 nt, Human
ggcgccucggcagccuugccagggaggccggg

SEQ ID NO: 459244 - RNA, 32 nt, Human
ggcgccucggcugccuggcaggaggaccucgg

SEQ ID NO: 459245 - RNA, 32 nt, Human
ggcgccucuagucccagcuacccgggaggcug

SEQ ID NO: 459246 - RNA, 32 nt, Human
ggcgccugaggaggaggaggagaagcggauga

SEQ ID NO: 459247 - RNA, 32 nt, Human
ggcgccugauugcugagugucaucucaacccc

SEQ ID NO: 459248 - RNA, 32 nt, Human
ggcgccugcagcucucccuggaguucgacuuu

SEQ ID NO: 459249 - RNA, 32 nt, Human
ggcgccugccuguaaucccagcuacuaaggag

SEQ ID NO: 459250 - RNA, 32 nt, Human
ggcgccugcucagcgacugaugcacagacugc

SEQ ID NO: 459251 - RNA, 23 nt, Human
ggcgccuggaucaccugagguca

SEQ ID NO: 459252 - RNA, 32 nt, Human
ggcgccuggccuggccggugcugcacauccac

SEQ ID NO: 459253 - RNA, 32 nt, Human
ggcgccuggcucuuaccagcgucuggccuaga

SEQ ID NO: 459254 - RNA, 29 nt, Human
ggcgccuggcugccaucuuuuccuccaga

SEQ ID NO: 459255 - RNA, 32 nt, Human
ggcgccugggcugggggcggggaccaggcggg

SEQ ID NO: 459256 - RNA, 18 nt, Human
ggcgccuggguggauggg

SEQ ID NO: 459257 - RNA, 16 nt, Human
ggcgccuguaauccca

SEQ ID NO: 459258 - RNA, 18 nt, Human
ggcgccuguaaucccagc

SEQ ID NO: 459259 - RNA, 19 nt, Human
ggcgccuguaaucccagcu

SEQ ID NO: 459260 - RNA, 32 nt, Human
ggcgccuguaaucccagcuaaaggaggcugag

SEQ ID NO: 459261 - RNA, 32 nt, Human
ggcgccuguaaucccagcuaaucaggaggcug

SEQ ID NO: 459262 - RNA, 32 nt, Human
ggcgccuguaaucccagcuacuagggaggcug

SEQ ID NO: 459263 - RNA, 32 nt, Human
ggcgccuguaaucccagcuacucgggaagcug

SEQ ID NO: 459264 - RNA, 32 nt, Human
ggcgccuguaaucccagcuacucgggagacug

SEQ ID NO: 459265 - RNA, 32 nt, Human
ggcgccuguaaucccagcuacucgggaggcca

SEQ ID NO: 459266 - RNA, 32 nt, Human
ggcgccuguaaucccagcuacucgggaggcug

SEQ ID NO: 459267 - RNA, 32 nt, Human
ggcgccuguaaucccagcuacucgggagguuu

SEQ ID NO: 459268 - RNA, 32 nt, Human
ggcgccuguaaucccagcuacugagggggcug

SEQ ID NO: 459269 - RNA, 32 nt, Human
ggcgccuguaaucccagcuacuggggaggcug

SEQ ID NO: 459270 - RNA, 32 nt, Human
ggcgccuguaaucccagcuacuuggaaggcug

SEQ ID NO: 459271 - RNA, 32 nt, Human
ggcgccuguaaucccagcuacuugggaagcug

SEQ ID NO: 459272 - RNA, 32 nt, Human
ggcgccuguaaucccagcuacuugggaggcug

SEQ ID NO: 459273 - RNA, 32 nt, Human
ggcgccuguaaucccagcuaggaggcugagac

SEQ ID NO: 459274 - RNA, 32 nt, Human
ggcgccuguaaucccagcuauuugggaggcug

SEQ ID NO: 459275 - RNA, 19 nt, Human
ggcgccuguaaucccaguu

SEQ ID NO: 459276 - RNA, 16 nt, Human
ggcgccuguaauccua

SEQ ID NO: 459277 - RNA, 16 nt, Human
ggcgccuguaauucca

SEQ ID NO: 459278 - RNA, 19 nt, Human
ggcgccuguaauuccagcu

SEQ ID NO: 459279 - RNA, 32 nt, Human
ggcgccuguagccccagcuacuugggaggcug

SEQ ID NO: 459280 - RNA, 16 nt, Human
ggcgccuguaguccca

SEQ ID NO: 459281 - RNA, 32 nt, Human
ggcgccuguagucccaacuacuugggaggcug

SEQ ID NO: 459282 - RNA, 32 nt, Human
ggcgccuguagucccagcacuuugggaggccg

SEQ ID NO: 459283 - RNA, 32 nt, Human
ggcgccuguagucccagcagcuugggaggcug

SEQ ID NO: 459284 - RNA, 19 nt, Human
ggcgccuguagucccagcu

SEQ ID NO: 459285 - RNA, 32 nt, Human
ggcgccuguagucccagcuacgugggaggcug

SEQ ID NO: 459286 - RNA, 32 nt, Human
ggcgccuguagucccagcuacucaggaggcug

SEQ ID NO: 459287 - RNA, 32 nt, Human
ggcgccuguagucccagcuacucggaaggcua

SEQ ID NO: 459288 - RNA, 32 nt, Human
ggcgccuguagucccagcuacucggaggcuga

SEQ ID NO: 459289 - RNA, 32 nt, Human
ggcgccuguagucccagcuacucgggagacug

SEQ ID NO: 459290 - RNA, 32 nt, Human
ggcgccuguagucccagcuacucgggaggcug

SEQ ID NO: 459291 - RNA, 32 nt, Human
ggcgccuguagucccagcuacucugaagacug

SEQ ID NO: 459292 - RNA, 32 nt, Human
ggcgccuguagucccagcuacucuggaggcug

SEQ ID NO: 459293 - RNA, 32 nt, Human
ggcgccuguagucccagcuacuggggaggcug

SEQ ID NO: 459294 - RNA, 32 nt, Human
ggcgccuguagucccagcuacuuggaaggcug

SEQ ID NO: 459295 - RNA, 32 nt, Human
ggcgccuguagucccagcuacuugggaagcug

SEQ ID NO: 459296 - RNA, 32 nt, Human
ggcgccuguagucccagcuacuugggaggcag

SEQ ID NO: 459297 - RNA, 32 nt, Human
ggcgccuguagucccagcuacuugggaggcca

SEQ ID NO: 459298 - RNA, 32 nt, Human
ggcgccuguagucccagcuacuugggaggcug

SEQ ID NO: 459299 - RNA, 32 nt, Human
ggcgccuguagucccagcuaugcgagaggcug

SEQ ID NO: 459300 - RNA, 32 nt, Human
ggcgccuguagucccagcuauucgggaggcug

SEQ ID NO: 459301 - RNA, 32 nt, Human
ggcgccuguagucccagcuauuugggaggcua

SEQ ID NO: 459302 - RNA, 32 nt, Human
ggcgccuguagucccagcugcucgggaggcug

SEQ ID NO: 459303 - RNA, 16 nt, Human
ggcgccugugauccca

SEQ ID NO: 459304 - RNA, 19 nt, Human
ggcgccugugaucccagcu

SEQ ID NO: 459305 - RNA, 32 nt, Human
ggcgccuguggaauguccagggcucugguccg

SEQ ID NO: 459306 - RNA, 32 nt, Human
ggcgccugugggcuccagggccuccggcuucc

SEQ ID NO: 459307 - RNA, 32 nt, Human
ggcgccuguggucccagcuacucgggaggcug

SEQ ID NO: 459308 - RNA, 32 nt, Human
ggcgccuguggucccagcuacuggggaggcug

SEQ ID NO: 459309 - RNA, 32 nt, Human
ggcgccugugguggccagcuacucaggaggcu

SEQ ID NO: 459310 - RNA, 32 nt, Human
ggcgccuguuaucccagcuacuugggaggcua

SEQ ID NO: 459311 - RNA, 32 nt, Human
ggcgccuguucccccaggcucucagugccacc

SEQ ID NO: 459312 - RNA, 19 nt, Human
ggcgccuguuuccucagag

SEQ ID NO: 459313 - RNA, 32 nt, Human
ggcgccuucagcccaaccuccccagccccacg

SEQ ID NO: 459314 - RNA, 32 nt, Human
ggcgccuuccucccaccugccagcccagggua

SEQ ID NO: 459315 - RNA, 32 nt, Human
ggcgccuuccuggagcgcggggagauguaaag

SEQ ID NO: 459316 - RNA, 32 nt, Human
ggcgccuuuuuccucagcugucuuccaaguau

SEQ ID NO: 459317 - RNA, 32 nt, Human
ggcgcgaacccaccaugcagcugcaguuccgg

SEQ ID NO: 459318 - RNA, 32 nt, Human
ggcgcgaaccgcccaucuccccagacccgccc

SEQ ID NO: 459319 - RNA, 20 nt, Human
ggcgcgaagcccggguggcc

SEQ ID NO: 459320 - RNA, 32 nt, Human
ggcgcgaccucaggacucuccguguccccucc

SEQ ID NO: 459321 - RNA, 32 nt, Human
ggcgcgacucggcugcacuccucacgcgccug

SEQ ID NO: 459322 - RNA, 32 nt, Human
ggcgcgacugcacuccagccugggcgagagag

SEQ ID NO: 459323 - RNA, 32 nt, Human
ggcgcgagaacagcacuacuacugcggcgaga

SEQ ID NO: 459324 - RNA, 32 nt, Human
ggcgcgagaggaggggaugggcggggcgcgcg

SEQ ID NO: 459325 - RNA, 24 nt, Human
ggcgcgagcagcgcagggcggccu

SEQ ID NO: 459326 - RNA, 32 nt, Human
ggcgcgaggcccgggcccugagcaccuaucgc

SEQ ID NO: 459327 - RNA, 25 nt, Human
ggcgcgaggcggagcgcgggcggcc

SEQ ID NO: 459328 - RNA, 32 nt, Human
ggcgcgauucagcucacugcaaucuccgccuc

SEQ ID NO: 459329 - RNA, 32 nt, Human
ggcgcgcacagcugcacucagcggcuuccuuc

SEQ ID NO: 459330 - RNA, 32 nt, Human
ggcgcgcacaggcaggagguugcaguugggcg

SEQ ID NO: 459331 - RNA, 32 nt, Human
ggcgcgcaccuguaaucccagcuacucgggag

SEQ ID NO: 459332 - RNA, 32 nt, Human
ggcgcgcaccuguaaucccagcuacuugggag

SEQ ID NO: 459333 - RNA, 32 nt, Human
ggcgcgcaccuguaaucccagcugcucgggag

SEQ ID NO: 459334 - RNA, 20 nt, Human
ggcgcgcacuuggccaggua

SEQ ID NO: 459335 - RNA, 32 nt, Human
ggcgcgcagcacacccggggaccaugggcucc

SEQ ID NO: 459336 - RNA, 32 nt, Human
ggcgcgcaugguccgccagggcugugggccgu

SEQ ID NO: 459337 - RNA, 32 nt, Human
ggcgcgccagggcggggcugaccugcccgcga

SEQ ID NO: 459338 - RNA, 32 nt, Human
ggcgcgcccaccgcuguguccucucugcccag

SEQ ID NO: 459339 - RNA, 32 nt, Human
ggcgcgcccagccugccagccgcgcugcugcu

SEQ ID NO: 459340 - RNA, 18 nt, Human
ggcgcgcccugcagaggg

SEQ ID NO: 459341 - RNA, 32 nt, Human
ggcgcgcccugccucuguggcucugccugugg

SEQ ID NO: 459342 - RNA, 32 nt, Human
ggcgcgccgagggcggagguggugcgugcgug

SEQ ID NO: 459343 - RNA, 32 nt, Human
ggcgcgccgcggaacccggaaguggucacgga

SEQ ID NO: 459344 - RNA, 32 nt, Human
ggcgcgccuggaccccugccccucucugggug

SEQ ID NO: 459345 - RNA, 32 nt, Human
ggcgcgcggaagucugaaggugcccuccagac

SEQ ID NO: 459346 - RNA, 19 nt, Human
ggcgcgcggcagcgcgggg

SEQ ID NO: 459347 - RNA, 32 nt, Human
ggcgcgcggcaggcgacaggucucagcccgga

SEQ ID NO: 459348 - RNA, 32 nt, Human
ggcgcgcggcgccgcggccauuggcccgaggc

SEQ ID NO: 459349 - RNA, 32 nt, Human
ggcgcgcgggcugaggccgcccgggauggcgc

SEQ ID NO: 459350 - RNA, 32 nt, Human
ggcgcgcggucccagcccucccgcucggccgg

SEQ ID NO: 459351 - RNA, 32 nt, Human
ggcgcgcgugagcucgggcugcccggccgggc

SEQ ID NO: 459352 - RNA, 32 nt, Human
ggcgcgcucucauucauagcagccucuucaug

SEQ ID NO: 459353 - RNA, 32 nt, Human
ggcgcgcugagggaaaaccuugcugaagcugu

SEQ ID NO: 459354 - RNA, 32 nt, Human
ggcgcgcugcuccuuccgccucgcggaccccg

SEQ ID NO: 459355 - RNA, 32 nt, Human
ggcgcggacucugccagccccagcuucagccc

SEQ ID NO: 459356 - RNA, 21 nt, Human
ggcgcggagcagagucccggg

SEQ ID NO: 459357 - RNA, 20 nt, Human
ggcgcggagcucgggcggcc

SEQ ID NO: 459358 - RNA, 32 nt, Human
ggcgcggagcuugggagcggagcccaggccgu

SEQ ID NO: 459359 - RNA, 21 nt, Human
ggcgcggaggagcgggcggcc

SEQ ID NO: 459360 - RNA, 32 nt, Human
ggcgcggaggcagaaggcgguguccgaguagg

SEQ ID NO: 459361 - RNA, 24 nt, Human
ggcgcggaggcuccccgggcggcu

SEQ ID NO: 459362 - RNA, 32 nt, Human
ggcgcggaguuccaggucgagcaguuaggccg

SEQ ID NO: 459363 - RNA, 26 nt, Human
ggcgcggcagccaggaacccgacuac

SEQ ID NO: 459364 - RNA, 16 nt, Human
ggcgcggcaggggggc

SEQ ID NO: 459365 - RNA, 22 nt, Human
ggcgcggccaccgcauccgugg

SEQ ID NO: 459366 - RNA, 32 nt, Human
ggcgcggccgccgugcuggacauggugcggcc

SEQ ID NO: 459367 - RNA, 20 nt, Human
ggcgcggccucagaguccca

SEQ ID NO: 459368 - RNA, 24 nt, Human
ggcgcggccugagcgcccggcccg

SEQ ID NO: 459369 - RNA, 22 nt, Human
ggcgcggcgcccagagcucagg

SEQ ID NO: 459370 - RNA, 25 nt, Human
ggcgcggcggcaggcgccccaccac

SEQ ID NO: 459371 - RNA, 32 nt, Human
ggcgcggcggcugggagccgggcgcgggcggc

SEQ ID NO: 459372 - RNA, 32 nt, Human
ggcgcggcguagccccgcucuccugagagcuc

SEQ ID NO: 459373 - RNA, 32 nt, Human
ggcgcggcucgcagcggcgggugcaggggcga

SEQ ID NO: 459374 - RNA, 18 nt, Human
ggcgcggcugccccgggg

SEQ ID NO: 459375 - RNA, 32 nt, Human
ggcgcgggagacauuguauacacaucaugcua

SEQ ID NO: 459376 - RNA, 32 nt, Human
ggcgcgggagagagcgcgggcggccgccgggg

SEQ ID NO: 459377 - RNA, 19 nt, Human
ggcgcgggagccagagcgg

SEQ ID NO: 459378 - RNA, 32 nt, Human
ggcgcgggaggaagaggaggaggaggaggagg

SEQ ID NO: 459379 - RNA, 32 nt, Human
ggcgcgggaggcggcagccgcagcgaggaggc

SEQ ID NO: 459380 - RNA, 32 nt, Human
ggcgcgggagugagagagggugagucagccac

SEQ ID NO: 459381 - RNA, 31 nt, Human
ggcgcgggaguuggcauucggugguccuggc

SEQ ID NO: 459382 - RNA, 32 nt, Human
ggcgcgggcagccucuugauucuuuuacaguc

SEQ ID NO: 459383 - RNA, 23 nt, Human
ggcgcgggcgggcgcaggcggcc

SEQ ID NO: 459384 - RNA, 20 nt, Human
ggcgcgggcgugcgggcggc

SEQ ID NO: 459385 - RNA, 23 nt, Human
ggcgcgggcucggcggagcggcc

SEQ ID NO: 459386 - RNA, 32 nt, Human
ggcgcgggcuuccuuccguggccguggacggg

SEQ ID NO: 459387 - RNA, 21 nt, Human
ggcgcgggcuugccccgggcc

SEQ ID NO: 459388 - RNA, 32 nt, Human
ggcgcggggacgaagcagcacagccaucgggg

SEQ ID NO: 459389 - RNA, 24 nt, Human
ggcgcggggagagcugggcgggcc

SEQ ID NO: 459390 - RNA, 22 nt, Human
ggcgcggggagcugagcugccu

SEQ ID NO: 459391 - RNA, 32 nt, Human
ggcgcggggagcugugggcggcagcugcgucu

SEQ ID NO: 459392 - RNA, 32 nt, Human
ggcgcggggcacacaggccggccggcagccgc

SEQ ID NO: 459393 - RNA, 19 nt, Human
ggcgcggggcaggggcggc

SEQ ID NO: 459394 - RNA, 19 nt, Human
ggcgcggggccacgcagcc

SEQ ID NO: 459395 - RNA, 21 nt, Human
ggcgcggggcccgcugcggcc

SEQ ID NO: 459396 - RNA, 23 nt, Human
ggcgcggggcccugcgguagccu

SEQ ID NO: 459397 - RNA, 22 nt, Human
ggcgcggggccugcgggcggcu

SEQ ID NO: 459398 - RNA, 22 nt, Human
ggcgcggggcgcgaugagcggc

SEQ ID NO: 459399 - RNA, 21 nt, Human
ggcgcggggcgggcggcggcc

SEQ ID NO: 459400 - RNA, 18 nt, Human
ggcgcggggcucggcggc

SEQ ID NO: 459401 - RNA, 21 nt, Human
ggcgcggggcugacgcggacc

SEQ ID NO: 459402 - RNA, 16 nt, Human
ggcgcggggcuggcug

SEQ ID NO: 459403 - RNA, 21 nt, Human
ggcgcggggcugguagcggcc

SEQ ID NO: 459404 - RNA, 24 nt, Human
ggcgcggggggugcagggcaggcc

SEQ ID NO: 459405 - RNA, 23 nt, Human
ggcgcggggugggccuucgggga

SEQ ID NO: 459406 - RNA, 20 nt, Human
ggcgcgggugcugcgccuag

SEQ ID NO: 459407 - RNA, 22 nt, Human
ggcgcgguggcucaagccugua

SEQ ID NO: 459408 - RNA, 22 nt, Human
ggcgcgguggcucacaccugua

SEQ ID NO: 459409 - RNA, 22 nt, Human
ggcgcgguggcucacaccugug

SEQ ID NO: 459410 - RNA, 22 nt, Human
ggcgcgguggcucaggccugua

SEQ ID NO: 459411 - RNA, 22 nt, Human
ggcgcgguggcucaugccugua

SEQ ID NO: 459412 - RNA, 22 nt, Human
ggcgcgguggcucgugccugua

SEQ ID NO: 459413 - RNA, 22 nt, Human
ggcgcgguggcucuugccugua

SEQ ID NO: 459414 - RNA, 22 nt, Human
ggcgcggugguucaugccugua

SEQ ID NO: 459415 - RNA, 32 nt, Human
ggcgcguccggcggaggguugaggggagcggg

SEQ ID NO: 459416 - RNA, 22 nt, Human
ggcgcgucggcuuuggcggcuc

SEQ ID NO: 459417 - RNA, 32 nt, Human
ggcgcgugacugguugagcgggcaggccagcc

SEQ ID NO: 459418 - RNA, 32 nt, Human
ggcgcgugcagcccugguucugcagggaacag

SEQ ID NO: 459419 - RNA, 32 nt, Human
ggcgcgugccuauaaucccagcuacucgggag

SEQ ID NO: 459420 - RNA, 32 nt, Human
ggcgcgugccuguaaucccagcuacuaggggg

SEQ ID NO: 459421 - RNA, 32 nt, Human
ggcgcgugccuguaaucccagcuacucgggaa

SEQ ID NO: 459422 - RNA, 32 nt, Human
ggcgcgugccuguaaucccagcuacuugggag

SEQ ID NO: 459423 - RNA, 32 nt, Human
ggcgcgugccuguaauccuagcuacucaggag

SEQ ID NO: 459424 - RNA, 24 nt, Human
ggcucaggugauccucccaccuca

SEQ ID NO: 459425 - RNA, 24 nt, Human
ggcucaggugauccucccaucuca

SEQ ID NO: 459426 - RNA, 24 nt, Human
ggcucaggugauccucuugccuca

SEQ ID NO: 459427 - RNA, 24 nt, Human
ggcucaggugauucucccaucuca

SEQ ID NO: 459428 - RNA, 24 nt, Human
ggcucaggugauucucccgccuca

SEQ ID NO: 459429 - RNA, 32 nt, Human
ggcucaggugcgcuucucccaccuggcagcuc

SEQ ID NO: 459430 - RNA, 32 nt, Human
ggcucagguucacacuucugcuuugagaccag

SEQ ID NO: 459431 - RNA, 18 nt, Human
ggcucagguugggucuag

SEQ ID NO: 459432 - RNA, 32 nt, Human
ggcucaguaaaugacagaacuauuuuucauua

SEQ ID NO: 459433 - RNA, 32 nt, Human
ggcucaguaccgcuccagcagccugggccccg

SEQ ID NO: 459434 - RNA, 23 nt, Human
ggcucagucggacugggguccag

SEQ ID NO: 459435 - RNA, 32 nt, Human
ggcucagugcaaccuccccaccccgggcucca

SEQ ID NO: 459436 - RNA, 24 nt, Human
ggcucagugcaaccuccgccuccu

SEQ ID NO: 459437 - RNA, 32 nt, Human
ggcucagugcaaccuccgccuccuggguucaa

SEQ ID NO: 459438 - RNA, 23 nt, Human
ggcucagugcaaccucugccucc

SEQ ID NO: 459439 - RNA, 32 nt, Human
ggcucagugcaaccucugccucccagguugaa

SEQ ID NO: 459440 - RNA, 32 nt, Human
ggcucagugcaaccuugaccuccugggcucaa

SEQ ID NO: 459441 - RNA, 32 nt, Human
ggcucagugcaauccgccucccagguucaagc

SEQ ID NO: 459442 - RNA, 32 nt, Human
ggcucagugcagccucaaacucuugggcucaa

SEQ ID NO: 459443 - RNA, 18 nt, Human
ggcucagugccucacaga

SEQ ID NO: 459444 - RNA, 17 nt, Human
ggcucaguggcuccaga

SEQ ID NO: 459445 - RNA, 32 nt, Human
ggcucagugggaaacaaaggaagcacuugggc

SEQ ID NO: 459446 - RNA, 32 nt, Human
ggcucaguucagcagagcuggaguugaacaac

SEQ ID NO: 459447 - RNA, 32 nt, Human
ggcucaguuggacuccauagcagaugaaaugg

SEQ ID NO: 459448 - RNA, 32 nt, Human
ggcucaguugucuggggcugggagaaguuccc

SEQ ID NO: 459449 - RNA, 19 nt, Human
ggcucauaauagggcccag

SEQ ID NO: 459450 - RNA, 32 nt, Human
ggcucauaauguccgaccagagguggacaaag

SEQ ID NO: 459451 - RNA, 32 nt, Human
ggcucauaccuguaaaucccagcacuuuggga

SEQ ID NO: 459452 - RNA, 20 nt, Human
ggcucauaccuguaauccca

SEQ ID NO: 459453 - RNA, 32 nt, Human
ggcucauaccuguaaucccagcacuuugggaa

SEQ ID NO: 459454 - RNA, 32 nt, Human
ggcucauaccuguaaucccagcacuuugggag

SEQ ID NO: 459455 - RNA, 32 nt, Human
ggcucauaccuguaaucccagcaguuugggag

SEQ ID NO: 459456 - RNA, 32 nt, Human
ggcucauaccuguaaucccggcacuuugggag

SEQ ID NO: 459457 - RNA, 32 nt, Human
ggcucauaccuguaaugccagcacuuugggag

SEQ ID NO: 459458 - RNA, 22 nt, Human
ggcucauaccuguuaauuccag

SEQ ID NO: 459459 - RNA, 32 nt, Human
ggcucauaccuguuaauuccagcacuuuggga

SEQ ID NO: 459460 - RNA, 32 nt, Human
ggcucauaccuguuauaccagcacuuugggag

SEQ ID NO: 459461 - RNA, 20 nt, Human
ggcucauaccuuuaauccca

SEQ ID NO: 459462 - RNA, 21 nt, Human
ggcucauaccuuuaaucccag

SEQ ID NO: 459463 - RNA, 32 nt, Human
ggcucauacguguaaucccaguacuuuggaag

SEQ ID NO: 459464 - RNA, 32 nt, Human
ggcucauagcaagcuccgccuccuggguucau

SEQ ID NO: 459465 - RNA, 32 nt, Human
ggcucauaucugugauuccagcacuuugagag

SEQ ID NO: 459466 - RNA, 32 nt, Human
ggcucauaugugaaggcacguucuccagccau

SEQ ID NO: 459467 - RNA, 24 nt, Human
ggcucauauuucuuuucuaucuca

SEQ ID NO: 459468 - RNA, 24 nt, Human
ggcucauauuucuuuucuuucuca

SEQ ID NO: 459469 - RNA, 32 nt, Human
ggcucauauuucuuuucuuucucaucuugaug

SEQ ID NO: 459470 - RNA, 32 nt, Human
ggcucaucacaaccucugcuuccuggguucaa

SEQ ID NO: 459471 - RNA, 32 nt, Human
ggcucaucacgaccuucgccucccagguucaa

SEQ ID NO: 459472 - RNA, 32 nt, Human
ggcucaucagacugaaacuugcucacagacuu

SEQ ID NO: 459473 - RNA, 32 nt, Human
ggcucaucccuguaaucccagcacuuaaggag

SEQ ID NO: 459474 - RNA, 32 nt, Human
ggcucaucccuguaaucccagugcuuugggag

SEQ ID NO: 459475 - RNA, 32 nt, Human
ggcucaucccuguaauuccagcacuuuggaag

SEQ ID NO: 459476 - RNA, 32 nt, Human
ggcucauccuaccuguuaggagcagguagggc

SEQ ID NO: 459477 - RNA, 23 nt, Human
ggcucaucguaaccuccaccucc

SEQ ID NO: 459478 - RNA, 32 nt, Human
ggcucaucguaaccuccaccucccggguucaa

SEQ ID NO: 459479 - RNA, 32 nt, Human
ggcucaucucaaaauccugggcucaagugauc

SEQ ID NO: 459480 - RNA, 24 nt, Human
ggcucaucuuuucucuccccugcc

SEQ ID NO: 459481 - RNA, 32 nt, Human
ggcucaucuuuucucuccccugccuucuccuc

SEQ ID NO: 459482 - RNA, 32 nt, Human
ggcucaugacuguaaucccaacacuuuggagg

SEQ ID NO: 459483 - RNA, 32 nt, Human
ggcucaugacuguaaucccagcacuuugggag

SEQ ID NO: 459484 - RNA, 32 nt, Human
ggcucaugacuguaaucccaguacuuugggaa

SEQ ID NO: 459485 - RNA, 32 nt, Human
ggcucaugcaauccuccugccuuggccuccca

SEQ ID NO: 459486 - RNA, 32 nt, Human
ggcucaugcauguaaucccagcacuuugggag

SEQ ID NO: 459487 - RNA, 32 nt, Human
ggcucaugccacaggaucccagcacuuuggga

SEQ ID NO: 459488 - RNA, 32 nt, Human
ggcucaugccagcaauccuagcacuuugggag

SEQ ID NO: 459489 - RNA, 32 nt, Human
ggcucaugccaguuaucccagcacuuugggag

SEQ ID NO: 459490 - RNA, 20 nt, Human
ggcucaugcccauaauccca

SEQ ID NO: 459491 - RNA, 32 nt, Human
ggcucaugcccauaaucccagcacuuugggag

SEQ ID NO: 459492 - RNA, 32 nt, Human
ggcucaugcccauaaucccagcccuuugggaa

SEQ ID NO: 459493 - RNA, 20 nt, Human
ggcucaugcccguaauccca

SEQ ID NO: 459494 - RNA, 32 nt, Human
ggcucaugcccguaaucccagcacuuugggag

SEQ ID NO: 459495 - RNA, 32 nt, Human
ggcucaugcccguaaucucagcacuuugggag

SEQ ID NO: 459496 - RNA, 20 nt, Human
ggcucaugccgauaauccca

SEQ ID NO: 459497 - RNA, 20 nt, Human
ggcucaugccuacaauccca

SEQ ID NO: 459498 - RNA, 20 nt, Human
ggcucaugccuauaacccca

SEQ ID NO: 459499 - RNA, 19 nt, Human
ggcucaugccuauaauccc

SEQ ID NO: 459500 - RNA, 20 nt, Human
ggcucaugccuauaauccca

SEQ ID NO: 459501 - RNA, 32 nt, Human
ggcucaugccuauaaucccaacacuuuggaag

SEQ ID NO: 459502 - RNA, 22 nt, Human
ggcucaugccuauaaucccagc

SEQ ID NO: 459503 - RNA, 32 nt, Human
ggcucaugccuauaaucccagcacuuuaggag

SEQ ID NO: 459504 - RNA, 32 nt, Human
ggcucaugccuauaaucccagcacuuugagag

SEQ ID NO: 459505 - RNA, 32 nt, Human
ggcucaugccuauaaucccagcacuuuggcag

SEQ ID NO: 459506 - RNA, 32 nt, Human
ggcucaugccuauaaucccagcacuuugggaa

SEQ ID NO: 459507 - RNA, 32 nt, Human
ggcucaugccuauaaucccagcacuuugggag

SEQ ID NO: 459508 - RNA, 32 nt, Human
ggcucaugccuauaaucccagcacuuuuggag

SEQ ID NO: 459509 - RNA, 32 nt, Human
ggcucaugccuauaaucccagcucuuagggag

SEQ ID NO: 459510 - RNA, 32 nt, Human
ggcucaugccuauaaucccagugcuuugggaa

SEQ ID NO: 459511 - RNA, 20 nt, Human
ggcucaugccuauaauccua

SEQ ID NO: 459512 - RNA, 32 nt, Human
ggcucaugccuauaauccuagcacuuugagag

SEQ ID NO: 459513 - RNA, 32 nt, Human
ggcucaugccuauaauccuagcacuuugggag

SEQ ID NO: 459514 - RNA, 20 nt, Human
ggcucaugccuauaaucuca

SEQ ID NO: 459515 - RNA, 32 nt, Human
ggcucaugccuauaaucucagcacuuuuggga

SEQ ID NO: 459516 - RNA, 32 nt, Human
ggcucaugccuauaaucuuagcacuuugggag

SEQ ID NO: 459517 - RNA, 20 nt, Human
ggcucaugccuauaauucca

SEQ ID NO: 459518 - RNA, 32 nt, Human
ggcucaugccuauaauuccagcacuuuggagg

SEQ ID NO: 459519 - RNA, 32 nt, Human
ggcucaugccuauaauuccagcacuuugggag

SEQ ID NO: 459520 - RNA, 32 nt, Human
ggcucaugccuauagucccagcacuuugggag

SEQ ID NO: 459521 - RNA, 32 nt, Human
ggcucaugccuauauuccagcacuuugggagg

SEQ ID NO: 459522 - RNA, 32 nt, Human
ggcucaugccuauauucccagcacuuugagag

SEQ ID NO: 459523 - RNA, 32 nt, Human
ggcucaugccuauuaucccagcacuuugggag

SEQ ID NO: 459524 - RNA, 21 nt, Human
ggcucaugccuccaaucccag

SEQ ID NO: 459525 - RNA, 21 nt, Human
ggcucaugccucuaaucccag

SEQ ID NO: 459526 - RNA, 32 nt, Human
ggcucaugccucuaaucccagcacuuugggag

SEQ ID NO: 459527 - RNA, 32 nt, Human
ggcucaugccugaaauccuagcacuuugggaa

SEQ ID NO: 459528 - RNA, 20 nt, Human
ggcucaugccugaaucucag

SEQ ID NO: 459529 - RNA, 32 nt, Human
ggcucaugccugaaucucagcacuuugggagg

SEQ ID NO: 459530 - RNA, 32 nt, Human
ggcucaugccugcaaucccagcacuguagaag

SEQ ID NO: 459531 - RNA, 32 nt, Human
ggcucaugccugcaaucccagcacuuugggag

SEQ ID NO: 459532 - RNA, 32 nt, Human
ggcucaugccugcaauuccagcacuuugggag

SEQ ID NO: 459533 - RNA, 32 nt, Human
ggcucaugccuggaaucccagcacuuugagag

SEQ ID NO: 459534 - RNA, 32 nt, Human
ggcucaugccuggaaucccagcacuuugggag

SEQ ID NO: 459535 - RNA, 21 nt, Human
ggcucaugccuguaaacccag

SEQ ID NO: 459536 - RNA, 32 nt, Human
ggcucaugccuguaaacccagcacuuugggag

SEQ ID NO: 459537 - RNA, 32 nt, Human
ggcucaugccuguaaaucccagcacuuuggua

SEQ ID NO: 459538 - RNA, 20 nt, Human
ggcucaugccuguaacccca

SEQ ID NO: 459539 - RNA, 32 nt, Human
ggcucaugccuguaaccccagcacuuugggag

SEQ ID NO: 459540 - RNA, 20 nt, Human
ggcucaugccuguaaccuca

SEQ ID NO: 459541 - RNA, 22 nt, Human
ggcucaugccuguaaccucagc

SEQ ID NO: 459542 - RNA, 32 nt, Human
ggcucaugccuguaaccucagcacuuugggag

SEQ ID NO: 459543 - RNA, 20 nt, Human
ggcucaugccuguaagccca

SEQ ID NO: 459544 - RNA, 32 nt, Human
ggcucaugccuguaagcccaacacuuugggag

SEQ ID NO: 459545 - RNA, 21 nt, Human
ggcucaugccuguaagcccag

SEQ ID NO: 459546 - RNA, 32 nt, Human
ggcucaugccuguaagcccagcacuuugggag

SEQ ID NO: 459547 - RNA, 32 nt, Human
ggcucaugccuguaauagcagcuacucgggag

SEQ ID NO: 459548 - RNA, 32 nt, Human
ggcucaugccuguaaucaaucccagcacuuug

SEQ ID NO: 459549 - RNA, 32 nt, Human
ggcucaugccuguaauccaagcauuuugagag

SEQ ID NO: 459550 - RNA, 20 nt, Human
ggcucaugccuguaauccag

SEQ ID NO: 459551 - RNA, 32 nt, Human
ggcucaugccuguaauccagcacuuugggagg

SEQ ID NO: 459552 - RNA, 32 nt, Human
ggcucaugccuguaauccaguacuuuaggagg

SEQ ID NO: 459553 - RNA, 20 nt, Human
ggcucaugccuguaauccca

SEQ ID NO: 459554 - RNA, 32 nt, Human
ggcucaugccuguaaucccaaaacuuugggag

SEQ ID NO: 459555 - RNA, 32 nt, Human
ggcucaugccuguaaucccaacacucugggag

SEQ ID NO: 459556 - RNA, 32 nt, Human
ggcucaugccuguaaucccaacacuuagggag

SEQ ID NO: 459557 - RNA, 32 nt, Human
ggcucaugccuguaaucccaacacuuagggug

SEQ ID NO: 459558 - RNA, 32 nt, Human
ggcucaugccuguaaucccaacacuuugagaa

SEQ ID NO: 459559 - RNA, 32 nt, Human
ggcucaugccuguaaucccaacacuuugagag

SEQ ID NO: 459560 - RNA, 32 nt, Human
ggcucaugccuguaaucccaacacuuugggag

SEQ ID NO: 459561 - RNA, 32 nt, Human
ggcucaugccuguaaucccaacacuuuuggga

SEQ ID NO: 459562 - RNA, 32 nt, Human
ggcucaugccuguaaucccaacauucugggag

SEQ ID NO: 459563 - RNA, 32 nt, Human
ggcucaugccuguaaucccaccacugagguca

SEQ ID NO: 459564 - RNA, 32 nt, Human
ggcucaugccuguaaucccaccacuuugggag

SEQ ID NO: 459565 - RNA, 32 nt, Human
ggcucaugccuguaaucccaccacuuugggug

SEQ ID NO: 459566 - RNA, 21 nt, Human
ggcucaugccuguaaucccag

SEQ ID NO: 459567 - RNA, 32 nt, Human
ggcucaugccuguaaucccagaacuuugggag

SEQ ID NO: 459568 - RNA, 32 nt, Human
ggcucaugccuguaaucccagaauuuugggag

SEQ ID NO: 459569 - RNA, 22 nt, Human
ggcucaugccuguaaucccagc

SEQ ID NO: 459570 - RNA, 32 nt, Human
ggcucaugccuguaaucccagcacauugggaa

SEQ ID NO: 459571 - RNA, 32 nt, Human
ggcucaugccuguaaucccagcacccugggag

SEQ ID NO: 459572 - RNA, 32 nt, Human
ggcucaugccuguaaucccagcaccuugaagg

SEQ ID NO: 459573 - RNA, 32 nt, Human
ggcucaugccuguaaucccagcaccuugggag

SEQ ID NO: 459574 - RNA, 32 nt, Human
ggcucaugccuguaaucccagcacuaugggag

SEQ ID NO: 459575 - RNA, 32 nt, Human
ggcucaugccuguaaucccagcacucuggaag

SEQ ID NO: 459576 - RNA, 32 nt, Human
ggcucaugccuguaaucccagcacucugggag

SEQ ID NO: 459577 - RNA, 32 nt, Human
ggcucaugccuguaaucccagcacuguaggcg

SEQ ID NO: 459578 - RNA, 32 nt, Human
ggcucaugccuguaaucccagcacugugggag

SEQ ID NO: 459579 - RNA, 32 nt, Human
ggcucaugccuguaaucccagcacuuauuuua

SEQ ID NO: 459580 - RNA, 32 nt, Human
ggcucaugccuguaaucccagcacuucaggag

SEQ ID NO: 459581 - RNA, 32 nt, Human
ggcucaugccuguaaucccagcacuuggagag

SEQ ID NO: 459582 - RNA, 32 nt, Human
ggcucaugccuguaaucccagcacuugggagg

SEQ ID NO: 459583 - RNA, 32 nt, Human
ggcucaugccuguaaucccagcacuuggggag

SEQ ID NO: 459584 - RNA, 32 nt, Human
ggcucaugccuguaaucccagcacuuucaaag

SEQ ID NO: 459585 - RNA, 32 nt, Human
ggcucaugccuguaaucccagcacuuucagag

SEQ ID NO: 459586 - RNA, 32 nt, Human
ggcucaugccuguaaucccagcacuuucggag

SEQ ID NO: 459587 - RNA, 32 nt, Human
ggcucaugccuguaaucccagcacuuugagag

SEQ ID NO: 459588 - RNA, 32 nt, Human
ggcucaugccuguaaucccagcacuuugauag

SEQ ID NO: 459589 - RNA, 32 nt, Human
ggcucaugccuguaaucccagcacuuugcgag

SEQ ID NO: 459590 - RNA, 32 nt, Human
ggcucaugccuguaaucccagcacuuuggaag

SEQ ID NO: 459591 - RNA, 32 nt, Human
ggcucaugccuguaaucccagcacuuuggcag

SEQ ID NO: 459592 - RNA, 32 nt, Human
ggcucaugccuguaaucccagcacuuugggaa

SEQ ID NO: 459593 - RNA, 32 nt, Human
ggcucaugccuguaaucccagcacuuugggag

SEQ ID NO: 459594 - RNA, 32 nt, Human
ggcucaugccuguaaucccagcacuuugggau

SEQ ID NO: 459595 - RNA, 32 nt, Human
ggcucaugccuguaaucccagcacuuugggga

SEQ ID NO: 459596 - RNA, 32 nt, Human
ggcucaugccuguaaucccagcacuuuggggg

SEQ ID NO: 459597 - RNA, 32 nt, Human
ggcucaugccuguaaucccagcacuuugguag

SEQ ID NO: 459598 - RNA, 32 nt, Human
ggcucaugccuguaaucccagcacuuuucgga

SEQ ID NO: 459599 - RNA, 32 nt, Human
ggcucaugccuguaaucccagcacuuuugagg

SEQ ID NO: 459600 - RNA, 32 nt, Human
ggcucaugccuguaaucccagcacuuuuggag

SEQ ID NO: 459601 - RNA, 32 nt, Human
ggcucaugccuguaaucccagcauuuugagag

SEQ ID NO: 459602 - RNA, 32 nt, Human
ggcucaugccuguaaucccagcauuuuggaag

SEQ ID NO: 459603 - RNA, 32 nt, Human
ggcucaugccuguaaucccagcauuuugggag

SEQ ID NO: 459604 - RNA, 32 nt, Human
ggcucaugccuguaaucccagcauuuugguag

SEQ ID NO: 459605 - RNA, 32 nt, Human
ggcucaugccuguaaucccagcccuuugggag

SEQ ID NO: 459606 - RNA, 32 nt, Human
ggcucaugccuguaaucccagcgcuuugggag

SEQ ID NO: 459607 - RNA, 23 nt, Human
ggcucaugccuguaaucccagcu

SEQ ID NO: 459608 - RNA, 32 nt, Human
ggcucaugccuguaaucccagcuacgcaggag

SEQ ID NO: 459609 - RNA, 32 nt, Human
ggcucaugccuguaaucccagcuacucaggag

SEQ ID NO: 459610 - RNA, 32 nt, Human
ggcucaugccuguaaucccaggacuuugggag

SEQ ID NO: 459611 - RNA, 32 nt, Human
ggcucaugccuguaaucccaggacuuugguag

SEQ ID NO: 459612 - RNA, 32 nt, Human
ggcucaugccuguaaucccaguacuuugggag

SEQ ID NO: 459613 - RNA, 32 nt, Human
ggcucaugccuguaaucccagugcuuugggag

SEQ ID NO: 459614 - RNA, 32 nt, Human
ggcucaugccuguaaucccgacacuuugggag

SEQ ID NO: 459615 - RNA, 32 nt, Human
ggcucaugccuguaaucccggcacuuugggag

SEQ ID NO: 459616 - RNA, 32 nt, Human
ggcucaugccuguaaucccugcacuuugggag

SEQ ID NO: 459617 - RNA, 32 nt, Human
ggcucaugccuguaaucccugcacuuugggau

SEQ ID NO: 459618 - RNA, 32 nt, Human
ggcucaugccuguaauccgagcacuucgggaa

SEQ ID NO: 459619 - RNA, 32 nt, Human
ggcucaugccuguaauccgagcacuuugggag

SEQ ID NO: 459620 - RNA, 32 nt, Human
ggcucaugccuguaauccuaacacuuugggag

SEQ ID NO: 459621 - RNA, 32 nt, Human
ggcucaugccuguaauccuagcacuuugagag

SEQ ID NO: 459622 - RNA, 32 nt, Human
ggcucaugccuguaauccuagcacuuuggaag

SEQ ID NO: 459623 - RNA, 32 nt, Human
ggcucaugccuguaauccuagcacuuugggaa

SEQ ID NO: 459624 - RNA, 32 nt, Human
ggcucaugccuguaauccuagcacuuugggag

SEQ ID NO: 459625 - RNA, 32 nt, Human
ggcucaugccuguaauccuagcacuuuggggg

SEQ ID NO: 459626 - RNA, 32 nt, Human
ggcucaugccuguaauccuagcacuuugggug

SEQ ID NO: 459627 - RNA, 32 nt, Human
ggcucaugccuguaauccuagcagcuugggag

SEQ ID NO: 459628 - RNA, 32 nt, Human
ggcucaugccuguaauccuagcauuuugggag

SEQ ID NO: 459629 - RNA, 32 nt, Human
ggcucaugccuguaauccuggcacuuugggag

SEQ ID NO: 459630 - RNA, 32 nt, Human
ggcucaugccuguaaucgcagcacuuugggag

SEQ ID NO: 459631 - RNA, 32 nt, Human
ggcucaugccuguaaucguagcacuuugagag

SEQ ID NO: 459632 - RNA, 32 nt, Human
ggcucaugccuguaaucucaacacuuugggaa

SEQ ID NO: 459633 - RNA, 32 nt, Human
ggcucaugccuguaaucucagaacuuugggag

SEQ ID NO: 459634 - RNA, 32 nt, Human
ggcucaugccuguaaucucagcacuguaggag

SEQ ID NO: 459635 - RNA, 32 nt, Human
ggcucaugccuguaaucucagcacuuugagag

SEQ ID NO: 459636 - RNA, 32 nt, Human
ggcucaugccuguaaucucagcacuuugggag

SEQ ID NO: 459637 - RNA, 32 nt, Human
ggcucaugccuguaaucucagcuacuuggcug

SEQ ID NO: 459638 - RNA, 32 nt, Human
ggcucaugccuguaaucucaguacauugggag

SEQ ID NO: 459639 - RNA, 32 nt, Human
ggcucaugccuguaaucucaguacuuugggag

SEQ ID NO: 459640 - RNA, 32 nt, Human
ggcucaugccuguaaucugagcacuuugggag

SEQ ID NO: 459641 - RNA, 32 nt, Human
ggcucaugccuguaaucuuaucacuuugggag

SEQ ID NO: 459642 - RNA, 32 nt, Human
ggcucaugccuguaaugccagcacuuugccaa

SEQ ID NO: 459643 - RNA, 32 nt, Human
ggcucaugccuguaauuccagcacuuuaggag

SEQ ID NO: 459644 - RNA, 32 nt, Human
ggcucaugccuguaauuccagcacuuugggag

SEQ ID NO: 459645 - RNA, 32 nt, Human
ggcucaugccuguaauuccggcacuuugggag

SEQ ID NO: 459646 - RNA, 32 nt, Human
ggcucaugccuguaauuucaguacuuugggag

SEQ ID NO: 459647 - RNA, 32 nt, Human
ggcucaugccuguagucccagcacucgggaag

SEQ ID NO: 459648 - RNA, 32 nt, Human
ggcucaugccuguagucccagcacucuguggg

SEQ ID NO: 459649 - RNA, 32 nt, Human
ggcucaugccuguagucccagcacuuugggag

SEQ ID NO: 459650 - RNA, 32 nt, Human
ggcucaugccuguagucccagcacuuuggggg

SEQ ID NO: 459651 - RNA, 32 nt, Human
ggcucaugccuguagucccagcuacucuggag

SEQ ID NO: 459652 - RNA, 32 nt, Human
ggcucaugccuguagucccagcuacuugggag

SEQ ID NO: 459653 - RNA, 32 nt, Human
ggcucaugccuguagucccugcuacuugggag

SEQ ID NO: 459654 - RNA, 32 nt, Human
ggcucaugccuguaguccuagcacuuugggag

SEQ ID NO: 459655 - RNA, 32 nt, Human
ggcucaugccuguaguuccagcgcuuugggag

SEQ ID NO: 459656 - RNA, 32 nt, Human
ggcucaugccuguauaaucccagcacuuuggg

SEQ ID NO: 459657 - RNA, 32 nt, Human
ggcucaugccuguauccagcacuuugggaggc

SEQ ID NO: 459658 - RNA, 32 nt, Human
ggcucaugccuguaucccagcacuuugggagg

SEQ ID NO: 459659 - RNA, 32 nt, Human
ggcucaugccuguauucccaccacuuugggag

SEQ ID NO: 459660 - RNA, 32 nt, Human
ggcucaugccuguauucccaguacuuugggag

SEQ ID NO: 459661 - RNA, 32 nt, Human
ggcucaugccugucaucccagcacuuugggaa

SEQ ID NO: 459662 - RNA, 32 nt, Human
ggcucaugccugucaucccagcacuuugggag

SEQ ID NO: 459663 - RNA, 32 nt, Human
ggcucaugccugucaucccagcauuugggagg

SEQ ID NO: 459664 - RNA, 32 nt, Human
ggcucaugccugugaucccaacacuuugggag

SEQ ID NO: 459665 - RNA, 32 nt, Human
ggcucaugccugugaucccagcacuuugggag

SEQ ID NO: 459666 - RNA, 32 nt, Human
ggcucaugccugugaucccagcacuuugggug

SEQ ID NO: 459667 - RNA, 32 nt, Human
ggcucaugccugugaucccagcuacucgggag

SEQ ID NO: 459668 - RNA, 32 nt, Human
ggcucaugccugugauccuagcacuuugcgag

SEQ ID NO: 459669 - RNA, 32 nt, Human
ggcucaugccugugauccuagcacuuugggag

SEQ ID NO: 459670 - RNA, 32 nt, Human
ggcucaugccugugaucgcagcacuuugggag

SEQ ID NO: 459671 - RNA, 32 nt, Human
ggcucaugccuguggucccaacauuuugggag

SEQ ID NO: 459672 - RNA, 32 nt, Human
ggcucaugccuguggucccagcacuuugggag

SEQ ID NO: 459673 - RNA, 32 nt, Human
ggcucaugccuguggucccagcgcuuugggag

SEQ ID NO: 459674 - RNA, 32 nt, Human
ggcucaugccuguggucccagcuacuugagag

SEQ ID NO: 459675 - RNA, 32 nt, Human
ggcucaugccuguuaucccaacacuuugggag

SEQ ID NO: 459676 - RNA, 32 nt, Human
ggcucaugccuuaaucccagcacuuugggagg

SEQ ID NO: 459677 - RNA, 32 nt, Human
ggcucaugccuuaaucccagcacuuuuggagg

SEQ ID NO: 459678 - RNA, 21 nt, Human
ggcucaugccuuuaaucccag

SEQ ID NO: 459679 - RNA, 32 nt, Human
ggcucaugccuuuaaucccagcacuuugggag

SEQ ID NO: 459680 - RNA, 32 nt, Human
ggcucaugccuuuaaucccagcauuuugggag

SEQ ID NO: 459681 - RNA, 32 nt, Human
ggcucaugcguguaaucccagcacuuugggag

SEQ ID NO: 459682 - RNA, 32 nt, Human
ggcucaugcucuggggcagcagcuccaucguu

SEQ ID NO: 459683 - RNA, 32 nt, Human
ggcucaugcucugggucagcagcuccaugguu

SEQ ID NO: 459684 - RNA, 32 nt, Human
ggcucaugcuuguaaucccaacacuuugggaa

SEQ ID NO: 459685 - RNA, 32 nt, Human
ggcucaugcuuguaaucccagcacuuggggag

SEQ ID NO: 459686 - RNA, 32 nt, Human
ggcucaugcuuguaaucccagcacuuugggaa

SEQ ID NO: 459687 - RNA, 32 nt, Human
ggcucaugcuuguaaucccagcacuuugggag

SEQ ID NO: 459688 - RNA, 32 nt, Human
ggcucaugcuuguaaucccagcacuuugguag

SEQ ID NO: 459689 - RNA, 32 nt, Human
ggcucaugcuuguaaucccaguacuuuaggag

SEQ ID NO: 459690 - RNA, 32 nt, Human
ggcucaugcuuguaauccuagcacuuuuugag

SEQ ID NO: 459691 - RNA, 32 nt, Human
ggcucaugcuuguaaucucagcacuuugggag

SEQ ID NO: 459692 - RNA, 32 nt, Human
ggcucaugcuuguaauuccagcacuguggaag

SEQ ID NO: 459693 - RNA, 32 nt, Human
ggcucauggcaagcuccgccuccuggauucaa

SEQ ID NO: 459694 - RNA, 24 nt, Human
ggcucaugggugccuccugcccca

SEQ ID NO: 459695 - RNA, 32 nt, Human
ggcucaugucuauaaucccagcacuuugggag

SEQ ID NO: 459696 - RNA, 32 nt, Human
ggcucaugucucuaaucccagcacuuugggag

SEQ ID NO: 459697 - RNA, 32 nt, Human
ggcucaugucugaaaaaugccugcugcugcca

SEQ ID NO: 459698 - RNA, 32 nt, Human
ggcucaugucuguaaucccagcacucuggggg

SEQ ID NO: 459699 - RNA, 32 nt, Human
ggcucaugucuguaaucccagcacuuugggag

SEQ ID NO: 459700 - RNA, 24 nt, Human
ggcucaugugauccucccaccuca

SEQ ID NO: 459701 - RNA, 24 nt, Human
ggcucaugugauccucccaucuca

SEQ ID NO: 459702 - RNA, 18 nt, Human
ggcucaugugggccccag

SEQ ID NO: 459703 - RNA, 32 nt, Human
ggcucauguggugcugccuggugucagagccu

SEQ ID NO: 459704 - RNA, 32 nt, Human
ggcucauguguguaaucccagcacucugggag

SEQ ID NO: 459705 - RNA, 18 nt, Human
ggcucauguugggaccag

SEQ ID NO: 459706 - RNA, 32 nt, Human
ggcucauguuuguaaaucccagcacuuuggga

SEQ ID NO: 459707 - RNA, 32 nt, Human
ggcucauguuuguaaucccagcacuuuggggg

SEQ ID NO: 459708 - RNA, 32 nt, Human
ggcucauguuuguaauccuagcacuuugggag

SEQ ID NO: 459709 - RNA, 22 nt, Human
ggcucauuaaaagccaugaaaa

SEQ ID NO: 459710 - RNA, 32 nt, Human
ggcucauuaagcucugucccccugacuggauu

SEQ ID NO: 459711 - RNA, 32 nt, Human
ggcucauuacaaccuccaccucccggguucag

SEQ ID NO: 459712 - RNA, 32 nt, Human
ggcucauuacagccuccgccuccugggcucaa

SEQ ID NO: 459713 - RNA, 32 nt, Human
ggcucauuccuguaaucccagcacuuugggag

SEQ ID NO: 459714 - RNA, 32 nt, Human
ggcucauuccuguaaucccagcucuuugggag

SEQ ID NO: 459715 - RNA, 32 nt, Human
ggcucauucucuccaagcugcuuuucauuuac

SEQ ID NO: 459716 - RNA, 32 nt, Human
ggcucauugcaaccuccaccuuccagauucuc

SEQ ID NO: 459717 - RNA, 23 nt, Human
ggcucauugcaaccuccgccucc

SEQ ID NO: 459718 - RNA, 32 nt, Human
ggcucauugcaaccuccgccucccggcuucaa

SEQ ID NO: 459719 - RNA, 32 nt, Human
ggcucauugcaaccuccgccucccggguucaa

SEQ ID NO: 459720 - RNA, 32 nt, Human
ggcucauugcaaccuccgccucccucccaggu

SEQ ID NO: 459721 - RNA, 32 nt, Human
ggcucauugcaaccuccgccuccuggguucaa

SEQ ID NO: 459722 - RNA, 32 nt, Human
ggcucauugcaaccuccgccuuccggguucac

SEQ ID NO: 459723 - RNA, 23 nt, Human
ggcucauugcaaccucugccucc

SEQ ID NO: 459724 - RNA, 32 nt, Human
ggcucauugcaaccucugccucccaggucagc

SEQ ID NO: 459725 - RNA, 32 nt, Human
ggcucauugcaaccucugccucccggguucaa

SEQ ID NO: 459726 - RNA, 32 nt, Human
ggcucauugcaaccucugcuuccugggcucaa

SEQ ID NO: 459727 - RNA, 32 nt, Human
ggcucauugcaaccuugaauuccugggcacaa

SEQ ID NO: 459728 - RNA, 32 nt, Human
ggcucauugcaacuuccacuucccagguucaa

SEQ ID NO: 459729 - RNA, 32 nt, Human
ggcucauugcaagcuccgccucccagguucaa

SEQ ID NO: 459730 - RNA, 32 nt, Human
ggcucauugcagccucgaacuccugggcucau

SEQ ID NO: 459731 - RNA, 32 nt, Human
ggcucauugcagccucgaccucccaggugauc

SEQ ID NO: 459732 - RNA, 32 nt, Human
ggcucauugcagccucgaccugcugggcucgg

SEQ ID NO: 459733 - RNA, 32 nt, Human
ggcucauugcagccucgacuucucggggccaa

SEQ ID NO: 459734 - RNA, 32 nt, Human
ggcucauugcaucuuugaccuccugggcucag

SEQ ID NO: 459735 - RNA, 32 nt, Human
ggcucauuguaaccuccgucucccagguucaa

SEQ ID NO: 459736 - RNA, 32 nt, Human
ggcucauuguagccucaaacucccaggcucaa

SEQ ID NO: 459737 - RNA, 32 nt, Human
ggcucauuuccuggccgcuccugggcuucgcg

SEQ ID NO: 459738 - RNA, 24 nt, Human
ggcucauuuguacucucuuccccu

SEQ ID NO: 459739 - RNA, 32 nt, Human
ggcuccaaaauggcagcucaucagaggagucc

SEQ ID NO: 459740 - RNA, 32 nt, Human
ggcuccaaaccagcaaacaucugggccucagu

SEQ ID NO: 459741 - RNA, 32 nt, Human
ggcuccaaacuuccuuucugugccucaucaug

SEQ ID NO: 459742 - RNA, 24 nt, Human
ggcuccaacaauccucccaucuca

SEQ ID NO: 459743 - RNA, 32 nt, Human
ggcuccaacaccuuucgcuaggucuggcucug

SEQ ID NO: 459744 - RNA, 32 nt, Human
ggcuccaacagccucugugagagaugccccac

SEQ ID NO: 459745 - RNA, 19 nt, Human
ggcuccaaccaaccccucc

SEQ ID NO: 459746 - RNA, 32 nt, Human
ggcuccaacccaacaugccaccauguugacau

SEQ ID NO: 459747 - RNA, 32 nt, Human
ggcuccaagaaaagaaccaaagagggcagagg

SEQ ID NO: 459748 - RNA, 32 nt, Human
ggcuccaaggauugacaaauauauuuaugauc

SEQ ID NO: 459749 - RNA, 32 nt, Human
ggcuccaccacugauauccuccuuuggggaaa

SEQ ID NO: 459750 - RNA, 32 nt, Human
ggcuccacccacccuggcuuccuccagcucac

SEQ ID NO: 459751 - RNA, 32 nt, Human
ggcuccacccaccuucuugcucuaccaguucg

SEQ ID NO: 459752 - RNA, 21 nt, Human
ggcuccacccagaggccaguc

SEQ ID NO: 459753 - RNA, 32 nt, Human
ggcuccaccuccagagaucgggauuuuaaaug

SEQ ID NO: 459754 - RNA, 32 nt, Human
ggcuccaccucucacuagcuguguggccuugg

SEQ ID NO: 459755 - RNA, 32 nt, Human
ggcuccaccugcucacauuucucccucccaua

SEQ ID NO: 459756 - RNA, 32 nt, Human
ggcuccacgaacagaaaagcaagagcaaaaac

SEQ ID NO: 459757 - RNA, 32 nt, Human
ggcuccacgacccugagagaaggguugagaag

SEQ ID NO: 459758 - RNA, 22 nt, Human
ggcuccacucuguagccaggug

SEQ ID NO: 459759 - RNA, 22 nt, Human
ggcuccacugaaacaccagcuc

SEQ ID NO: 459760 - RNA, 32 nt, Human
ggcuccacuggcugaugggaucaaagacccuc

SEQ ID NO: 459761 - RNA, 32 nt, Human
ggcuccacugggccccuggccucgggagcggc

SEQ ID NO: 459762 - RNA, 32 nt, Human
ggcuccagaaggauuucuagaucgcuucaagc

SEQ ID NO: 459763 - RNA, 32 nt, Human
ggcuccagacaaggaggaaggggcccugcuca

SEQ ID NO: 459764 - RNA, 21 nt, Human
ggcuccagacaaugccuuucc

SEQ ID NO: 459765 - RNA, 32 nt, Human
ggcuccagacaggaggagugggacagacagca

SEQ ID NO: 459766 - RNA, 32 nt, Human
ggcuccagacauacucaccucuaccucgacca

SEQ ID NO: 459767 - RNA, 21 nt, Human
ggcuccagagcaugccuucca

SEQ ID NO: 459768 - RNA, 32 nt, Human
ggcuccagagucccucgggucucaggucaugg

SEQ ID NO: 459769 - RNA, 23 nt, Human
ggcuccagcaccauccgccaggg

SEQ ID NO: 459770 - RNA, 24 nt, Human
ggcuccagcagacccacuguccca

SEQ ID NO: 459771 - RNA, 22 nt, Human
ggcuccagcaggugggcagggg

SEQ ID NO: 459772 - RNA, 23 nt, Human
ggcuccagccagaccuucagugg

SEQ ID NO: 459773 - RNA, 21 nt, Human
ggcuccagcccaaugccccag

SEQ ID NO: 459774 - RNA, 23 nt, Human
ggcuccagcccucugccuuuuca

SEQ ID NO: 459775 - RNA, 24 nt, Human
ggcuccagccggcgcggcgcgagg

SEQ ID NO: 459776 - RNA, 22 nt, Human
ggcuccagccuccccgcgaggg

SEQ ID NO: 459777 - RNA, 32 nt, Human
ggcuccagccugggcgacagagugagagucug

SEQ ID NO: 459778 - RNA, 18 nt, Human
ggcuccagccugguccag

SEQ ID NO: 459779 - RNA, 32 nt, Human
ggcuccagccugguccagagagaaagagacag

SEQ ID NO: 459780 - RNA, 18 nt, Human
ggcuccagccuuggccag

SEQ ID NO: 459781 - RNA, 19 nt, Human
ggcuccagcgagcgcgcgg

SEQ ID NO: 459782 - RNA, 32 nt, Human
ggcuccagcguccucgucccuccugggccugu

SEQ ID NO: 459783 - RNA, 19 nt, Human
ggcuccagcuaggaagggg

SEQ ID NO: 459784 - RNA, 22 nt, Human
ggcuccagcucuggcacagugg

SEQ ID NO: 459785 - RNA, 21 nt, Human
ggcuccagcucuucgccgggg

SEQ ID NO: 459786 - RNA, 32 nt, Human
ggcuccagcugccaacccuggagcccagaccg

SEQ ID NO: 459787 - RNA, 20 nt, Human
ggcuccagcugcccuuggua

SEQ ID NO: 459788 - RNA, 21 nt, Human
ggcuccagcuggagggauggg

SEQ ID NO: 459789 - RNA, 19 nt, Human
ggcuccagcuggcgcacag

SEQ ID NO: 459790 - RNA, 32 nt, Human
ggcuccagcuggucccuccauucagggucccu

SEQ ID NO: 459791 - RNA, 32 nt, Human
ggcuccaggaauagaaccaaaagaagcugaac

SEQ ID NO: 459792 - RNA, 21 nt, Human
ggcuccaggcagggcgggcug

SEQ ID NO: 459793 - RNA, 20 nt, Human
ggcuccaggcccugugcacg

SEQ ID NO: 459794 - RNA, 23 nt, Human
ggcuccaggcggcagagcaaggg

SEQ ID NO: 459795 - RNA, 22 nt, Human
ggcuccaggcggcagggcaagg

SEQ ID NO: 459796 - RNA, 32 nt, Human
ggcuccaggcuagccuggaggcugagcaggaa

SEQ ID NO: 459797 - RNA, 32 nt, Human
ggcuccagggagcagugucagggccagggaga

SEQ ID NO: 459798 - RNA, 19 nt, Human
ggcuccagggcccagcaug

SEQ ID NO: 459799 - RNA, 22 nt, Human
ggcuccagggccuggacagggg

SEQ ID NO: 459800 - RNA, 32 nt, Human
ggcuccaggguaagacagggcuggcaggagca

SEQ ID NO: 459801 - RNA, 32 nt, Human
ggcuccaggugaggagccagcaggcaggggag

SEQ ID NO: 459802 - RNA, 22 nt, Human
ggcuccagucugcugcccucca

SEQ ID NO: 459803 - RNA, 24 nt, Human
ggcuccagugauccucucaccuca

SEQ ID NO: 459804 - RNA, 32 nt, Human
ggcuccagugccagugccuguccugggaagau

SEQ ID NO: 459805 - RNA, 20 nt, Human
ggcuccaguggcgaggcagg

SEQ ID NO: 459806 - RNA, 32 nt, Human
ggcuccagugugaagggugcccuggggcugag

SEQ ID NO: 459807 - RNA, 32 nt, Human
ggcuccaguucggaggaggaggaggaagauua

SEQ ID NO: 459808 - RNA, 23 nt, Human
ggcuccauccaccucaccaguug

SEQ ID NO: 459809 - RNA, 32 nt, Human
ggcuccauccccaaagcggccgccagcuucgg

SEQ ID NO: 459810 - RNA, 32 nt, Human
ggcuccauccuucuccccaaggucuguggcuc

SEQ ID NO: 459811 - RNA, 32 nt, Human
ggcuccaucuucccuucucugccagccgcgug

SEQ ID NO: 459812 - RNA, 32 nt, Human
ggcuccaugaaagguacgucugaaaaguuucu

SEQ ID NO: 459813 - RNA, 32 nt, Human
ggcuccauggcagaaggguuccaagaaggcag

SEQ ID NO: 459814 - RNA, 32 nt, Human
ggcuccauggcauaaggaaagggagaugcugg

SEQ ID NO: 459815 - RNA, 18 nt, Human
ggcuccauggccagauga

SEQ ID NO: 459816 - RNA, 32 nt, Human
ggcuccaugggcagaccuacaaggcugcgcaa

SEQ ID NO: 459817 - RNA, 32 nt, Human
ggcucccaauccaguccuccaaguacucagag

SEQ ID NO: 459818 - RNA, 32 nt, Human
ggcucccacacagccgccucugcuccagcaag

SEQ ID NO: 459819 - RNA, 24 nt, Human
ggcucccacaccgucagguacucc

SEQ ID NO: 459820 - RNA, 32 nt, Human
ggcucccacagcacccugccucccucucucca

SEQ ID NO: 459821 - RNA, 32 nt, Human
ggcucccacaggcuggagugcaauggugugau

SEQ ID NO: 459822 - RNA, 32 nt, Human
ggcucccaccaccaccaccaccagcaccacca

SEQ ID NO: 459823 - RNA, 32 nt, Human
ggcucccaccuauaaucccagcaguuugggag

SEQ ID NO: 459824 - RNA, 32 nt, Human
ggcucccaccuauaauccuagcacuuugggag

SEQ ID NO: 459825 - RNA, 32 nt, Human
ggcucccaccuguagucccagcacuuugggag

SEQ ID NO: 459826 - RNA, 19 nt, Human
ggcucccacugccaccacc

SEQ ID NO: 459827 - RNA, 32 nt, Human
ggcucccacugccaccaccgccaucgccucac

SEQ ID NO: 459828 - RNA, 32 nt, Human
ggcucccacuuccuuuuccuuaauaagaacca

SEQ ID NO: 459829 - RNA, 23 nt, Human
ggcucccacuugccucccgugcc

SEQ ID NO: 459830 - RNA, 32 nt, Human
ggcucccagaccccugagcuuugagucagugg

SEQ ID NO: 459831 - RNA, 17 nt, Human
ggcucccagcagaguga

SEQ ID NO: 459832 - RNA, 18 nt, Human
ggcucccagcagccaccc

SEQ ID NO: 459833 - RNA, 21 nt, Human
ggcucccagcagugcuucccu

SEQ ID NO: 459834 - RNA, 32 nt, Human
ggcucccagcauuuugggaggcugaggugggu

SEQ ID NO: 459835 - RNA, 32 nt, Human
ggcucccaggaagggccgcugcuggagauggg

SEQ ID NO: 459836 - RNA, 20 nt, Human
ggcucccaggagccugccca

SEQ ID NO: 459837 - RNA, 32 nt, Human
ggcucccaggaggcaguagugugugccugucu

SEQ ID NO: 459838 - RNA, 21 nt, Human
ggcucccaggcgcccggcgca

SEQ ID NO: 459839 - RNA, 32 nt, Human
ggcucccagggagggggaagagaaguccucag

SEQ ID NO: 459840 - RNA, 32 nt, Human
ggcucccaguuggccaagcacuccugcgcuga

SEQ ID NO: 459841 - RNA, 31 nt, Human
ggcucccaguuucagcguggccgcauuugga

SEQ ID NO: 459842 - RNA, 17 nt, Human
ggcucccauccauggcc

SEQ ID NO: 459843 - RNA, 32 nt, Human
ggcucccaucguccuucugucccaggccuugc

SEQ ID NO: 459844 - RNA, 32 nt, Human
ggcucccaugccacacagugagaacuguagcc

SEQ ID NO: 459845 - RNA, 24 nt, Human
ggcucccauggcccacauacccag

SEQ ID NO: 459846 - RNA, 32 nt, Human
ggcucccauucaaccuccuuagccaggaggac

SEQ ID NO: 459847 - RNA, 32 nt, Human
ggcuccccaaagugcugggauugcaggcguga

SEQ ID NO: 459848 - RNA, 32 nt, Human
ggcuccccacugcacuugccaccugagucaca

SEQ ID NO: 459849 - RNA, 32 nt, Human
ggcuccccagcagccaagaggagaggaauguc

SEQ ID NO: 459850 - RNA, 32 nt, Human
ggcucccccagccucagguugcuggagcuguc

SEQ ID NO: 459851 - RNA, 18 nt, Human
ggcuccccccggguauca

SEQ ID NO: 459852 - RNA, 21 nt, Human
ggcucccccgugcccugccuc

SEQ ID NO: 459853 - RNA, 18 nt, Human
ggcucccccuucauggcc

SEQ ID NO: 459854 - RNA, 32 nt, Human
ggcuccccgcuucucuggaggggaggcggugc

SEQ ID NO: 459855 - RNA, 32 nt, Human
ggcuccccggccgccuccacccggggaacgcg

SEQ ID NO: 459856 - RNA, 21 nt, Human
ggcuccccucagccgcagggg

SEQ ID NO: 459857 - RNA, 32 nt, Human
ggcuccccugcaggagggaggcuccaggguaa

SEQ ID NO: 459858 - RNA, 32 nt, Human
ggcuccccugcucccucccagguccugcacac

SEQ ID NO: 459859 - RNA, 32 nt, Human
ggcuccccugggaggcugcaguugugguacac

SEQ ID NO: 459860 - RNA, 32 nt, Human
ggcuccccuggguggccugccagcacagccag

SEQ ID NO: 459861 - RNA, 32 nt, Human
ggcuccccuuccucugggcaagagcacccacu

SEQ ID NO: 459862 - RNA, 32 nt, Human
ggcuccccuuuccuuggguccuuguguuccuu

SEQ ID NO: 459863 - RNA, 32 nt, Human
ggcuccccuuucucucccuaacccaccacccc

SEQ ID NO: 459864 - RNA, 32 nt, Human
ggcucccgaagaaugaacccaagagcaagggc

SEQ ID NO: 459865 - RNA, 30 nt, Human
ggcucccgaagccacaggccacaguccccc

SEQ ID NO: 459866 - RNA, 32 nt, Human
ggcucccgccuguaaucccagaacuuugggag

SEQ ID NO: 459867 - RNA, 32 nt, Human
ggcucccgccuguaaucccagcacuuugggaa

SEQ ID NO: 459868 - RNA, 32 nt, Human
ggcucccgccuguaaucccagcacuuugggag

SEQ ID NO: 459869 - RNA, 32 nt, Human
ggcucccgccuguaaucccaguacuuugggaa

SEQ ID NO: 459870 - RNA, 32 nt, Human
ggcucccgccuguaaucccauuacuuugggag

SEQ ID NO: 459871 - RNA, 32 nt, Human
ggcucccgccuguaauccuagcacuuugggag

SEQ ID NO: 459872 - RNA, 32 nt, Human
ggcucccgcggcagcucuuccuccagggcgug

SEQ ID NO: 459873 - RNA, 32 nt, Human
ggcucccgcggcgugggcugggcagcagccgg

SEQ ID NO: 459874 - RNA, 22 nt, Human
ggcucccggcugagcgccccag

SEQ ID NO: 459875 - RNA, 20 nt, Human
ggcucccggcuucagcacuc

SEQ ID NO: 459876 - RNA, 18 nt, Human
ggcucccgggccucaaga

SEQ ID NO: 459877 - RNA, 32 nt, Human
ggcucccgggcugggcagggaccaugggcugu

SEQ ID NO: 459878 - RNA, 32 nt, Human
ggcucccggggcugagguggagccgcgggacg

SEQ ID NO: 459879 - RNA, 32 nt, Human
ggcucccgggucuccccucccucgccacccca

SEQ ID NO: 459880 - RNA, 32 nt, Human
ggcucccgguuccuugggaagagggugcccau

SEQ ID NO: 459881 - RNA, 32 nt, Human
ggcucccuaagagaggauggagagggagagac

SEQ ID NO: 459882 - RNA, 32 nt, Human
ggcucccuacaacuuccaccucccagguucaa

SEQ ID NO: 459883 - RNA, 21 nt, Human
ggcucccuagccaccgcggcc

SEQ ID NO: 459884 - RNA, 32 nt, Human
ggcucccucaggcugcagcccugacccccaag

SEQ ID NO: 459885 - RNA, 32 nt, Human
ggcucccucaucgcccccuccuggguccucuc

SEQ ID NO: 459886 - RNA, 32 nt, Human
ggcucccucccuccuucucuccuuccuuccuu

SEQ ID NO: 459887 - RNA, 32 nt, Human
ggcucccucuccucacccuccugcaccuaacu

SEQ ID NO: 459888 - RNA, 32 nt, Human
ggcucccucuuggucuucccaggcuggggcug

SEQ ID NO: 459889 - RNA, 19 nt, Human
ggcucccugagggccaggc

SEQ ID NO: 459890 - RNA, 23 nt, Human
ggcucccugcaaccuccaccucc

SEQ ID NO: 459891 - RNA, 32 nt, Human
ggcucccugcaaccuccaccucccggguucaa

SEQ ID NO: 459892 - RNA, 32 nt, Human
ggcucccugcaaccuccaccuccuggguucaa

SEQ ID NO: 459893 - RNA, 24 nt, Human
ggcucccugcaaccuccgccuccu

SEQ ID NO: 459894 - RNA, 32 nt, Human
ggcucccugcaaccuccgccuccuggauucca

SEQ ID NO: 459895 - RNA, 32 nt, Human
ggcucccugcaaccucugcuuccuggguucag

SEQ ID NO: 459896 - RNA, 32 nt, Human
ggcucccugcaaccuucgccucccggguucaa

SEQ ID NO: 459897 - RNA, 32 nt, Human
ggcucccugcaaucuccaccucccagguucaa

SEQ ID NO: 459898 - RNA, 32 nt, Human
ggcucccugcagccucaaacuccugggcucaa

SEQ ID NO: 459899 - RNA, 32 nt, Human
ggcucccugcagccuugaccuccugggcucaa

SEQ ID NO: 459900 - RNA, 32 nt, Human
ggcucccugccuggauccagcucugggagccc

SEQ ID NO: 459901 - RNA, 32 nt, Human
ggcucccugccugucccauccccaugccccgu

SEQ ID NO: 459902 - RNA, 32 nt, Human
ggcucccugcuggcccucuugggccucugcuc

SEQ ID NO: 459903 - RNA, 32 nt, Human
ggcucccuggaacuucccugcagcugcaggcc

SEQ ID NO: 459904 - RNA, 32 nt, Human
ggcucccuggagccgacgcagagcagcgcccu

SEQ ID NO: 459905 - RNA, 32 nt, Human
ggcucccuggggagccagacagaggcuggggg

SEQ ID NO: 459906 - RNA, 32 nt, Human
ggcucccuggugcaaaacaauuagcaguuaug

SEQ ID NO: 459907 - RNA, 32 nt, Human
ggcucccuuccagcuguggcaaagcuauauuu

SEQ ID NO: 459908 - RNA, 32 nt, Human
ggcucccuucuuggugggcugggagccucagu

SEQ ID NO: 459909 - RNA, 23 nt, Human
ggcucccuuucccucagcagccg

SEQ ID NO: 459910 - RNA, 32 nt, Human
ggcucccuuugguuugggggucugccugaggu

SEQ ID NO: 459911 - RNA, 32 nt, Human
ggcuccgaggggcacagguccaggcuccugcg

SEQ ID NO: 459912 - RNA, 32 nt, Human
ggcuccgcaggugggagcccauggggcgggca

SEQ ID NO: 459913 - RNA, 32 nt, Human
ggcuccgccacugcaugcucccgccggaccga

SEQ ID NO: 459914 - RNA, 32 nt, Human
ggcuccgccagccugcugcugcccucccgccc

SEQ ID NO: 459915 - RNA, 32 nt, Human
ggcuccgcccacccugcucccuuccggacaau

SEQ ID NO: 459916 - RNA, 32 nt, Human
ggcuccgcccaggaggcggcugcacgguucuc

SEQ ID NO: 459917 - RNA, 24 nt, Human
ggcuccgcccccaccugcuggacc

SEQ ID NO: 459918 - RNA, 21 nt, Human
ggcuccgcccgagucccaccu

SEQ ID NO: 459919 - RNA, 32 nt, Human
ggcuccgcgggaugcaccgugguagccgaggg

SEQ ID NO: 459920 - RNA, 32 nt, Human
ggcuccggacgcagagguggcaguggcaccag

SEQ ID NO: 459921 - RNA, 22 nt, Human
ggcuccggacggcagccagagg

SEQ ID NO: 459922 - RNA, 32 nt, Human
ggcuccggaucccagccucuccccugcucccg

SEQ ID NO: 459923 - RNA, 32 nt, Human
ggcuccggccuccugccaaggcucuugucccc

SEQ ID NO: 459924 - RNA, 20 nt, Human
ggcuccggcggccagagugg

SEQ ID NO: 459925 - RNA, 32 nt, Human
ggcuccggcugcuggaggaagcagcuauccac

SEQ ID NO: 459926 - RNA, 32 nt, Human
ggcuccggcuucaagaucaaaggaaauguuuc

SEQ ID NO: 459927 - RNA, 32 nt, Human
ggcuccgggacgccugcgguucccuggucccg

SEQ ID NO: 459928 - RNA, 32 nt, Human
ggcuccgggaggugcugccugccaggggaagc

SEQ ID NO: 459929 - RNA, 18 nt, Human
ggcuccgggccaggguga

SEQ ID NO: 459930 - RNA, 32 nt, Human
ggcuccgggccuggcccaauugcuucucaagc

SEQ ID NO: 459931 - RNA, 19 nt, Human
ggcuccgggcuuuccccca

SEQ ID NO: 459932 - RNA, 32 nt, Human
ggcuccggggagaaggaccuggagucacagcg

SEQ ID NO: 459933 - RNA, 32 nt, Human
ggcuccgguacccucgacccuccuggguguug

SEQ ID NO: 459934 - RNA, 32 nt, Human
ggcuccgugcagcuguggacucgagugccauc

SEQ ID NO: 459935 - RNA, 32 nt, Human
ggcuccgugcaggagccaugcccacucuccug

SEQ ID NO: 459936 - RNA, 18 nt, Human
ggcuccgugugacuuccg

SEQ ID NO: 459937 - RNA, 32 nt, Human
ggcuccguucaaaggcucggggugucuuugag

SEQ ID NO: 459938 - RNA, 32 nt, Human
ggcuccuaacucucaggaaacacuugucggcu

SEQ ID NO: 459939 - RNA, 32 nt, Human
ggcuccuacauuggaccuuggagcacccccac

SEQ ID NO: 459940 - RNA, 32 nt, Human
ggcuccuagaggcagagggauggagguaauga

SEQ ID NO: 459941 - RNA, 32 nt, Human
ggcuccuagcagggaauuccaggaagccuccu

SEQ ID NO: 459942 - RNA, 16 nt, Human
ggcuccuauaauccca

SEQ ID NO: 459943 - RNA, 32 nt, Human
ggcuccuauugaaggaaccacccccauuccua

SEQ ID NO: 459944 - RNA, 32 nt, Human
ggcuccucaaccacaacuucugaccucccagg

SEQ ID NO: 459945 - RNA, 32 nt, Human
ggcuccucaagggacuuccuggagaguagcgc

SEQ ID NO: 459946 - RNA, 32 nt, Human
ggcuccucacggggguggagggagccggagcc

SEQ ID NO: 459947 - RNA, 31 nt, Human
ggcuccucagaacuggagcauuuguauaaua

SEQ ID NO: 459948 - RNA, 32 nt, Human
ggcuccucagccaggacacagggugaggcccc

SEQ ID NO: 459949 - RNA, 32 nt, Human
ggcuccuccacuaaauugcugugugacuucag

SEQ ID NO: 459950 - RNA, 32 nt, Human
ggcuccuccagcucccccugggaccuccagca

SEQ ID NO: 459951 - RNA, 27 nt, Human
ggcuccuccagcuucgccgccgcagcc

SEQ ID NO: 459952 - RNA, 32 nt, Human
ggcuccuccauggcuucuauggaggacuccuc

SEQ ID NO: 459953 - RNA, 32 nt, Human
ggcuccucccgaggaggaaggaaggagagacc

SEQ ID NO: 459954 - RNA, 32 nt, Human
ggcuccuccuccuccucccggcggugggugcc

SEQ ID NO: 459955 - RNA, 32 nt, Human
ggcuccuccucuuccuucugcuccaagaagcc

SEQ ID NO: 459956 - RNA, 32 nt, Human
ggcuccuccuguccuguccugccuguggaggg

SEQ ID NO: 459957 - RNA, 32 nt, Human
ggcuccuccuucugucuuaagagaaagccaag

SEQ ID NO: 459958 - RNA, 32 nt, Human
ggcuccuccuucuguuucccagaccgagagcc

SEQ ID NO: 459959 - RNA, 32 nt, Human
ggcuccuccuugcccagacuacagggcuuagg

SEQ ID NO: 459960 - RNA, 32 nt, Human
ggcuccucucaggguucacccugucaccgggg

SEQ ID NO: 459961 - RNA, 32 nt, Human
ggcuccucuccucuuuggggaucaccagcucu

SEQ ID NO: 459962 - RNA, 32 nt, Human
ggcuccucucgaccccacaccgccggucgaca

SEQ ID NO: 459963 - RNA, 32 nt, Human
ggcuccucucuccaccaaauuaggauagaaua

SEQ ID NO: 459964 - RNA, 22 nt, Human
ggcuccucucugcugcuggacc

SEQ ID NO: 459965 - RNA, 32 nt, Human
ggcuccucugcagccugcccugccuucccccg

SEQ ID NO: 459966 - RNA, 32 nt, Human
ggcuccucuggaacagggaguagugagaagac

SEQ ID NO: 459967 - RNA, 32 nt, Human
ggcuccucuggcccagcuuggauggcugaggg

SEQ ID NO: 459968 - RNA, 32 nt, Human
ggcuccucugggaguuucucccagagaaacca

SEQ ID NO: 459969 - RNA, 32 nt, Human
ggcuccucugucccacugcugcuucuugagug

SEQ ID NO: 459970 - RNA, 32 nt, Human
ggcuccucuuguagaacugccucuuugaaauu

SEQ ID NO: 459971 - RNA, 21 nt, Human
ggcuccucuuguggccaugua

SEQ ID NO: 459972 - RNA, 32 nt, Human
ggcuccugacaaccuccuccccucggcggacg

SEQ ID NO: 459973 - RNA, 22 nt, Human
ggcuccugacccgacccagccc

SEQ ID NO: 459974 - RNA, 32 nt, Human
ggcuccugagcagcaauaaaggaccaagaaga

SEQ ID NO: 459975 - RNA, 32 nt, Human
ggcuccugaggcuagcuugucacuuucugcaa

SEQ ID NO: 459976 - RNA, 32 nt, Human
ggcuccugaguagcuggggauuacaggugccu

SEQ ID NO: 459977 - RNA, 32 nt, Human
ggcuccugaguguguagggaaggacacgggag

SEQ ID NO: 459978 - RNA, 32 nt, Human
ggcuccugcaccugcuggauauucuccuuuuc

SEQ ID NO: 459979 - RNA, 32 nt, Human
ggcuccugcaggcggaggccccggcggagaau

SEQ ID NO: 459980 - RNA, 32 nt, Human
ggcuccugcaggcgugaauacacacaugcaca

SEQ ID NO: 459981 - RNA, 32 nt, Human
ggcuccugcagucccagcuacuugggaggcug

SEQ ID NO: 459982 - RNA, 32 nt, Human
ggcuccugcauagcucaccccaccucaucaug

SEQ ID NO: 459983 - RNA, 17 nt, Human
ggcuccugcccuugaac

SEQ ID NO: 459984 - RNA, 24 nt, Human
ggcuccugccgaggagcccaaggg

SEQ ID NO: 459985 - RNA, 32 nt, Human
ggcuccugccuauaaucccagcacuuugggag

SEQ ID NO: 459986 - RNA, 32 nt, Human
ggcuccugccuguaaucccagcacuuugggag

SEQ ID NO: 459987 - RNA, 32 nt, Human
ggcuccugccuguaaucgcagcacuuugggag

SEQ ID NO: 459988 - RNA, 32 nt, Human
ggcuccugccugugauccuagcacuuugggag

SEQ ID NO: 459989 - RNA, 19 nt, Human
ggcuccugcgggcucacca

SEQ ID NO: 459990 - RNA, 32 nt, Human
ggcuccugcucugauuuccuccuugccuuucu

SEQ ID NO: 459991 - RNA, 32 nt, Human
ggcuccuggaaccaugggccucaggcccugag

SEQ ID NO: 459992 - RNA, 32 nt, Human
ggcuccuggcagagcacauagcaggaguuugu

SEQ ID NO: 459993 - RNA, 29 nt, Human
ggcuccuggcugcgucagccucccccacc

SEQ ID NO: 459994 - RNA, 32 nt, Human
ggcuccugggaaauuaaggagggauuugcaca

SEQ ID NO: 459995 - RNA, 32 nt, Human
ggcuccugggccugggcuuuagucugggcuac

SEQ ID NO: 459996 - RNA, 32 nt, Human
ggcuccugggcuguggccguggagagacacug

SEQ ID NO: 459997 - RNA, 32 nt, Human
ggcuccugggcuugggcugcagguuugggggu

SEQ ID NO: 459998 - RNA, 22 nt, Human
ggcuccuggggauggccaggua

SEQ ID NO: 459999 - RNA, 32 nt, Human
ggcuccugguagcauccuuuuccuucaccauc

SEQ ID NO: 460000 - RNA, 32 nt, Human
ggcuccuguaacccuccuccaggaugaaccac

SEQ ID NO: 460001 - RNA, 16 nt, Human
ggcuccuguaguccca

SEQ ID NO: 460002 - RNA, 32 nt, Human
ggcuccuguagucccagccaagcuggaggcug

SEQ ID NO: 460003 - RNA, 19 nt, Human
ggcuccuguagucccagcu

SEQ ID NO: 460004 - RNA, 32 nt, Human
ggcuccuguagucccagcuacucaggaggcua

SEQ ID NO: 460005 - RNA, 32 nt, Human
ggcuccuguagucccagcuacuugggaggcug

SEQ ID NO: 460006 - RNA, 20 nt, Human
ggcuccugucaccugggucc

SEQ ID NO: 460007 - RNA, 32 nt, Human
ggcuccugucuauaaucgcagcacuuugggag

SEQ ID NO: 460008 - RNA, 32 nt, Human
ggcuccugugugggucuucauccugccugacc

SEQ ID NO: 460009 - RNA, 23 nt, Human
ggcuccuguuucucauuugugag

SEQ ID NO: 460010 - RNA, 32 nt, Human
ggcuccuuacugcaccuguggcugacagagaa

SEQ ID NO: 460011 - RNA, 32 nt, Human
ggcuccuucgcccucuggcuccuggucauguu

SEQ ID NO: 460012 - RNA, 32 nt, Human
ggcuccuucucggcugccccugcccacccagu

SEQ ID NO: 460013 - RNA, 32 nt, Human
ggcuccuucucucugggguggcagcagggaca

SEQ ID NO: 460014 - RNA, 32 nt, Human
ggcuccuucucuucucccaucugcuaccagag

SEQ ID NO: 460015 - RNA, 32 nt, Human
ggcuccuucuuaguggauucucuucucuacug

SEQ ID NO: 460016 - RNA, 32 nt, Human
ggcuccuugaagcugcucagucagaggccccc

SEQ ID NO: 460017 - RNA, 32 nt, Human
ggcuccuugggcaagccauuguguccacccga

SEQ ID NO: 460018 - RNA, 32 nt, Human
ggcuccuuggguggauuagagagcuggccgag

SEQ ID NO: 460019 - RNA, 32 nt, Human
ggcuccuuuaucucccuguguccccuuccugc

SEQ ID NO: 460020 - RNA, 32 nt, Human
ggcuccuuuccuuuuugaccacgaccuuggcc

SEQ ID NO: 460021 - RNA, 23 nt, Human
ggcucgaauaugggggccaggug

SEQ ID NO: 460022 - RNA, 32 nt, Human
ggcucgacuggaggggaggaggaggagcaggc

SEQ ID NO: 460023 - RNA, 24 nt, Human
ggcucgagcaauccucccacuuca

SEQ ID NO: 460024 - RNA, 18 nt, Human
ggcucgagugcagcgcgg

SEQ ID NO: 460025 - RNA, 18 nt, Human
ggcucgaugccugugcca

SEQ ID NO: 460026 - RNA, 32 nt, Human
ggcucgcacagccuccccauccuuccuuccca

SEQ ID NO: 460027 - RNA, 32 nt, Human
ggcucgcaccuguaaucccagcacuuugggag

SEQ ID NO: 460028 - RNA, 32 nt, Human
ggcucgcaccuguaaucccagcacuuuggggg

SEQ ID NO: 460029 - RNA, 17 nt, Human
ggcucgcacgaguccgg

SEQ ID NO: 460030 - RNA, 32 nt, Human
ggcucgcacucuucuggucucccaggcccaac

SEQ ID NO: 460031 - RNA, 32 nt, Human
ggcucgcagaugcauccugcaucccagucccc

SEQ ID NO: 460032 - RNA, 32 nt, Human
ggcucgcagggugcaggagcgccucguucucu

SEQ ID NO: 460033 - RNA, 18 nt, Human
ggcucgcccaugguguca

SEQ ID NO: 460034 - RNA, 32 nt, Human
ggcucgcccauuggcuaaccaggcuccgagag

SEQ ID NO: 460035 - RNA, 32 nt, Human
ggcucgccccguguccucucaccaacaccaca

SEQ ID NO: 460036 - RNA, 23 nt, Human
ggcucgccgcccgcgcccgcucg

SEQ ID NO: 460037 - RNA, 32 nt, Human
ggcucgccgugucucagccucugccagcgcca

SEQ ID NO: 460038 - RNA, 32 nt, Human
ggcucgccucucuggccgggugcagugaacgg

SEQ ID NO: 460039 - RNA, 32 nt, Human
ggcucgccuggcaccaccacacggccacagcc

SEQ ID NO: 460040 - RNA, 32 nt, Human
ggcucgccuguaaucccagcacuuugggaggc

SEQ ID NO: 460041 - RNA, 32 nt, Human
ggcucgcgagcugagaggagcagguagagggg

SEQ ID NO: 460042 - RNA, 32 nt, Human
ggcucgcgccuguaaucccagcacuuugggag

SEQ ID NO: 460043 - RNA, 18 nt, Human
ggcucgcgcggaccccag

SEQ ID NO: 460044 - RNA, 32 nt, Human
ggcucgcgcgggagagcagggaagagaaacuu

SEQ ID NO: 460045 - RNA, 20 nt, Human
ggcucgcgcucucccgugcc

SEQ ID NO: 460046 - RNA, 21 nt, Human
ggcucgcgcugagucccgccu

SEQ ID NO: 460047 - RNA, 32 nt, Human
ggcucgcgcuugugaucccagcacuuugggag

SEQ ID NO: 460048 - RNA, 21 nt, Human
ggcucgcggauccagcugcag

SEQ ID NO: 460049 - RNA, 24 nt, Human
ggcucgcggccgcgcccgccgccg

SEQ ID NO: 460050 - RNA, 32 nt, Human
ggcucgcggggccggagccaggccugcguccg

SEQ ID NO: 460051 - RNA, 22 nt, Human
ggcucgcgucauccugcccccg

SEQ ID NO: 460052 - RNA, 21 nt, Human
ggcucgcgucgcgcgcgcacg

SEQ ID NO: 460053 - RNA, 32 nt, Human
ggcucgcguggugcugggguugcugugugagc

SEQ ID NO: 460054 - RNA, 23 nt, Human
ggcucgcuacaaccuccaccucc

SEQ ID NO: 460055 - RNA, 32 nt, Human
ggcucgcuacaaccuccaccucccagcaaccc

SEQ ID NO: 460056 - RNA, 32 nt, Human
ggcucgcucccuguagcucugccucccucucc

SEQ ID NO: 460057 - RNA, 21 nt, Human
ggcucgcucgcuucugcaucc

SEQ ID NO: 460058 - RNA, 32 nt, Human
ggcucgcugcaaacucugccucccagguucac

SEQ ID NO: 460059 - RNA, 32 nt, Human
ggcucgcugcaaccucagcuuccagaguucaa

SEQ ID NO: 460060 - RNA, 23 nt, Human
ggcucgcugcaaccuccgccucc

SEQ ID NO: 460061 - RNA, 32 nt, Human
ggcucgcugcaaccuccgccucccagguucaa

SEQ ID NO: 460062 - RNA, 32 nt, Human
ggcucgcugcaaccuccgccucccggguucaa

SEQ ID NO: 460063 - RNA, 32 nt, Human
ggcucgcugcaaccuccuccuccuggguucaa

SEQ ID NO: 460064 - RNA, 32 nt, Human
ggcucgcugcaaccucugacucccugguucaa

SEQ ID NO: 460065 - RNA, 26 nt, Human
ggcucgcugcaaccucugccuccugg

SEQ ID NO: 460066 - RNA, 32 nt, Human
ggcucgcugcaaccuucacccuucaccuccca

SEQ ID NO: 460067 - RNA, 32 nt, Human
ggcucgcugcagccacugccuccuggguucag

SEQ ID NO: 460068 - RNA, 20 nt, Human
ggcucgcugcagcccaaaca

SEQ ID NO: 460069 - RNA, 32 nt, Human
ggcucgcugcagccuccaccucccagguucaa

SEQ ID NO: 460070 - RNA, 32 nt, Human
ggcucgcugcagccucugccuccuggguucaa

SEQ ID NO: 460071 - RNA, 21 nt, Human
ggcucgcugcccccugcugcc

SEQ ID NO: 460072 - RNA, 32 nt, Human
ggcucgcugcccgccuuccucaagcucuggau

SEQ ID NO: 460073 - RNA, 31 nt, Human
ggcucgcugcucucugggccucaguuucccc

SEQ ID NO: 460074 - RNA, 32 nt, Human
ggcucgcuggaaggcacugcucagagccugaa

SEQ ID NO: 460075 - RNA, 32 nt, Human
ggcucgcuggcccugcacuccgccuuaguccu

SEQ ID NO: 460076 - RNA, 20 nt, Human
ggcucggacagagggggcgg

SEQ ID NO: 460077 - RNA, 22 nt, Human
ggcucggaggagaguuugcugg

SEQ ID NO: 460078 - RNA, 32 nt, Human
ggcucggaggcagcgguugggcucgcggcgag

SEQ ID NO: 460079 - RNA, 32 nt, Human
ggcucggcacaugcagagaugacagggcaggg

SEQ ID NO: 460080 - RNA, 19 nt, Human
ggcucggcaggucugcagc

SEQ ID NO: 460081 - RNA, 32 nt, Human
ggcucggcaguguggcuaguuuguguggcccu

SEQ ID NO: 460082 - RNA, 32 nt, Human
ggcucggccucaaggacagggugcucggcuga

SEQ ID NO: 460083 - RNA, 32 nt, Human
ggcucggccuucgccucugggcucgggagagu

SEQ ID NO: 460084 - RNA, 32 nt, Human
ggcucggcugcuucuguccaccucuuacacuu

SEQ ID NO: 460085 - RNA, 32 nt, Human
ggcucggcugggccccaccccagauccggccu

SEQ ID NO: 460086 - RNA, 32 nt, Human
ggcucgggagagagggacgcgggcugcaggcg

SEQ ID NO: 460087 - RNA, 32 nt, Human
ggcucgggaggcgggcagugggcacaggcucc

SEQ ID NO: 460088 - RNA, 32 nt, Human
ggcucgggaggcguuccuggggccaaggccau

SEQ ID NO: 460089 - RNA, 32 nt, Human
ggcucgggcaaggcuagaaagaugcuacguug

SEQ ID NO: 460090 - RNA, 17 nt, Human
ggcucgggccagagugg

SEQ ID NO: 460091 - RNA, 22 nt, Human
ggcucgggcccugacacugcca

SEQ ID NO: 460092 - RNA, 32 nt, Human
ggcucgggccuguaaucccagcacuuucggag

SEQ ID NO: 460093 - RNA, 21 nt, Human
ggcucgggcucuggggccuac

SEQ ID NO: 460094 - RNA, 19 nt, Human
ggcucggggcccagagaga

SEQ ID NO: 460095 - RNA, 32 nt, Human
ggcucggggccugggauggccuguaaucagcu

SEQ ID NO: 460096 - RNA, 32 nt, Human
ggcucggggcuuccucuccucugauggggcuc

SEQ ID NO: 460097 - RNA, 32 nt, Human
ggcucggggguggaggagccuuagugugucca

SEQ ID NO: 460098 - RNA, 32 nt, Human
ggcucggggucugccaugaauucuuggcuccu

SEQ ID NO: 460099 - RNA, 24 nt, Human
ggcucgggugauccuccugucuua

SEQ ID NO: 460100 - RNA, 32 nt, Human
ggcucgggugugggcuggagaggcagaagccc

SEQ ID NO: 460101 - RNA, 32 nt, Human
ggcucggucauccccagucccgucgcggccac

SEQ ID NO: 460102 - RNA, 20 nt, Human
ggcucggugcagcagcccug

SEQ ID NO: 460103 - RNA, 32 nt, Human
ggcucggugcugcaccugccuccuggcgccug

SEQ ID NO: 460104 - RNA, 32 nt, Human
ggcucggugcugcugcucgucagcgaccccag

SEQ ID NO: 460105 - RNA, 20 nt, Human
ggcucguaccuguaauccag

SEQ ID NO: 460106 - RNA, 32 nt, Human
ggcucguaccuguaauccagcacuuugggaag

SEQ ID NO: 460107 - RNA, 19 nt, Human
ggcucguagcuggguucag

SEQ ID NO: 460108 - RNA, 32 nt, Human
ggcucguaucuguaaucccagcacuuugagag

SEQ ID NO: 460109 - RNA, 21 nt, Human
ggcucgucccccaggccugcc

SEQ ID NO: 460110 - RNA, 32 nt, Human
ggcucgucccuccuccccaucucggcccugag

SEQ ID NO: 460111 - RNA, 32 nt, Human
ggcucgucccuggcuagggaggugagacucuc

SEQ ID NO: 460112 - RNA, 32 nt, Human
ggcucgucuaacucuguuccccuggccuccug

SEQ ID NO: 460113 - RNA, 32 nt, Human
ggcucgucucaaacuccugaccucaggugauc

SEQ ID NO: 460114 - RNA, 32 nt, Human
ggcucgucucggaacuccugaccucaggugau

SEQ ID NO: 460115 - RNA, 22 nt, Human
ggcucgugauccuccugccuca

SEQ ID NO: 460116 - RNA, 32 nt, Human
ggcucgugcauguaauccuagcacuuugggag

SEQ ID NO: 460117 - RNA, 19 nt, Human
ggcucgugcccuguugugg

SEQ ID NO: 460118 - RNA, 32 nt, Human
ggcucgugccuacaaucccagcacuuugggag

SEQ ID NO: 460119 - RNA, 32 nt, Human
ggcucgugccuguaaucccagcacuuugggag

SEQ ID NO: 460120 - RNA, 32 nt, Human
ggcucgugccuguacucccagcacuuugggag

SEQ ID NO: 460121 - RNA, 32 nt, Human
ggcucgugccuguagucccagcacuuugggag

SEQ ID NO: 460122 - RNA, 32 nt, Human
ggcucgugccugucaucccagcacuuugggag

SEQ ID NO: 460123 - RNA, 32 nt, Human
ggcucgugccugugaucucagcacuugggaaa

SEQ ID NO: 460124 - RNA, 32 nt, Human
ggcucgugcuuguaaucccagcacuuugggag

SEQ ID NO: 460125 - RNA, 32 nt, Human
ggcucgugggauguccuacuaucacugaacaa

SEQ ID NO: 460126 - RNA, 23 nt, Human
ggcucguuccagcccucccagug

SEQ ID NO: 460127 - RNA, 32 nt, Human
ggcucuaagcuagauaucuuucccucuuuuuc

SEQ ID NO: 460128 - RNA, 31 nt, Human
ggcucuaauaauagaauuuuguuucucacuc

SEQ ID NO: 460129 - RNA, 32 nt, Human
ggcucuaaugagaaauuccucucuccccaggu

SEQ ID NO: 460130 - RNA, 32 nt, Human
ggcucuaccccaggaaccucccggccugggcu

SEQ ID NO: 460131 - RNA, 32 nt, Human
ggcucuacgagauguugcuggggcuccaccuu

SEQ ID NO: 460132 - RNA, 32 nt, Human
ggcucuacucagagaccugaaaccacuucaga

SEQ ID NO: 460133 - RNA, 32 nt, Human
ggcucuacuucccuugcugguucuuauuucua

SEQ ID NO: 460134 - RNA, 32 nt, Human
ggcucuagagggaaagguuacaugggggaggu

SEQ ID NO: 460135 - RNA, 32 nt, Human
ggcucuagcaauccuccugccuuggccuccca

SEQ ID NO: 460136 - RNA, 23 nt, Human
ggcucuagcucugugggugaagg

SEQ ID NO: 460137 - RNA, 32 nt, Human
ggcucuagcugguaaccuuucugcuauuuccu

SEQ ID NO: 460138 - RNA, 32 nt, Human
ggcucuagcuguccuccagcacuuugggcccu

SEQ ID NO: 460139 - RNA, 32 nt, Human
ggcucuaggaaggcuuccaugcagugacaacu

SEQ ID NO: 460140 - RNA, 32 nt, Human
ggcucuaggacaucuguccaggaggcugggcg

SEQ ID NO: 460141 - RNA, 31 nt, Human
ggcucuaugauggagcccccgaagcccgagc

SEQ ID NO: 460142 - RNA, 20 nt, Human
ggcucuaugcaaccuccacc

SEQ ID NO: 460143 - RNA, 24 nt, Human
ggcucuaugcaaccuccaccuccu

SEQ ID NO: 460144 - RNA, 32 nt, Human
ggcucuaugcaaccuccaccuccuggguucau

SEQ ID NO: 460145 - RNA, 32 nt, Human
ggcucucaaauuuucuauagaaucaagauaga

SEQ ID NO: 460146 - RNA, 32 nt, Human
ggcucucaagccuuuagccuugaacuuaguua

SEQ ID NO: 460147 - RNA, 32 nt, Human
ggcucucaauccagcacaugcacauugaagca

SEQ ID NO: 460148 - RNA, 22 nt, Human
ggcucucacacuccagccuccu

SEQ ID NO: 460149 - RNA, 32 nt, Human
ggcucucacaguuguuucucaucuucauaaua

SEQ ID NO: 460150 - RNA, 32 nt, Human
ggcucucacauuccagccuccuccagggccca

SEQ ID NO: 460151 - RNA, 20 nt, Human
ggcucucaccacucagccuu

SEQ ID NO: 460152 - RNA, 32 nt, Human
ggcucucaccgcaaccuccgucuccuggguuc

SEQ ID NO: 460153 - RNA, 24 nt, Human
ggcucucaccugccaguuguuugc

SEQ ID NO: 460154 - RNA, 32 nt, Human
ggcucucagacaccucuguuuugucugcugug

SEQ ID NO: 460155 - RNA, 32 nt, Human
ggcucucagcagaggggaagaagagcagaggc

SEQ ID NO: 460156 - RNA, 32 nt, Human
ggcucucagcaggaaggagagcagaaaagggg

SEQ ID NO: 460157 - RNA, 21 nt, Human
ggcucucauucugacagcucc

SEQ ID NO: 460158 - RNA, 32 nt, Human
ggcucuccacauguaugcuuuucuuuuucccc

SEQ ID NO: 460159 - RNA, 32 nt, Human
ggcucuccagccugucccagucucagcaggga

SEQ ID NO: 460160 - RNA, 32 nt, Human
ggcucuccagcugcagaggcaggugugaugac

SEQ ID NO: 460161 - RNA, 32 nt, Human
ggcucuccauggcucuguccucaggcuguuuc

SEQ ID NO: 460162 - RNA, 32 nt, Human
ggcucuccauuucuggccucaguugucuacag

SEQ ID NO: 460163 - RNA, 32 nt, Human
ggcucuccauuuucuuuuuccucacuaaagug

SEQ ID NO: 460164 - RNA, 32 nt, Human
ggcucuccccacugcuucgugauuccagggcc

SEQ ID NO: 460165 - RNA, 20 nt, Human
ggcucucccuccuccugcca

SEQ ID NO: 460166 - RNA, 25 nt, Human
ggcucucccucuccucucucccucu

SEQ ID NO: 460167 - RNA, 32 nt, Human
ggcucucccugccucugagcucuggacucugu

SEQ ID NO: 460168 - RNA, 32 nt, Human
ggcucucccugcucccuucuauacaggaaucu

SEQ ID NO: 460169 - RNA, 32 nt, Human
ggcucucccuggcaaaaacgcgguccuguuug

SEQ ID NO: 460170 - RNA, 32 nt, Human
ggcucuccggaagcuucaggugugggcuagcu

SEQ ID NO: 460171 - RNA, 32 nt, Human
ggcucuccuaacccucuccacacauuccauuu

SEQ ID NO: 460172 - RNA, 32 nt, Human
ggcucuccuacucugcuuccaggcuggggccu

SEQ ID NO: 460173 - RNA, 32 nt, Human
ggcucuccucaccccaugcccugggccaaggu

SEQ ID NO: 460174 - RNA, 32 nt, Human
ggcucuccuccaccgcucccccggagccuccc

SEQ ID NO: 460175 - RNA, 32 nt, Human
ggcucuccucugguucaccuuuacagagcaua

SEQ ID NO: 460176 - RNA, 32 nt, Human
ggcucuccugcagggagaaugcaggggucugu

SEQ ID NO: 460177 - RNA, 32 nt, Human
ggcucuccuugcagcugcuuagacgcuggauu

SEQ ID NO: 460178 - RNA, 20 nt, Human
ggcucucgccuguaauccca

SEQ ID NO: 460179 - RNA, 22 nt, Human
ggcucucgccuguaaucccagc

SEQ ID NO: 460180 - RNA, 32 nt, Human
ggcucucgccuguaaucccagcacuuugggag

SEQ ID NO: 460181 - RNA, 32 nt, Human
ggcucucgccuguaaucucagcacuuugggag

SEQ ID NO: 460182 - RNA, 32 nt, Human
ggcucucuagaagcugcauccccagcccuuuc

SEQ ID NO: 460183 - RNA, 32 nt, Human
ggcucucuccaccacgcugccucaggcccuag

SEQ ID NO: 460184 - RNA, 32 nt, Human
ggcucucuccauccuccuuuucuccuugccuu

SEQ ID NO: 460185 - RNA, 32 nt, Human
ggcucucuccccuccccuccccuccccuccuc

SEQ ID NO: 460186 - RNA, 32 nt, Human
ggcucucucuccccacugucucucuucuuucu

SEQ ID NO: 460187 - RNA, 28 nt, Human
ggcucucucucugcugccucuucauacg

SEQ ID NO: 460188 - RNA, 32 nt, Human
ggcucucucuucuccagggcaccaagaggcug

SEQ ID NO: 460189 - RNA, 32 nt, Human
ggcucucucuuuuccccucuugcuccuuucuu

SEQ ID NO: 460190 - RNA, 23 nt, Human
ggcucucugcaaccuccgccucc

SEQ ID NO: 460191 - RNA, 32 nt, Human
ggcucucugcaaccuccgccucccagguucaa

SEQ ID NO: 460192 - RNA, 23 nt, Human
ggcucucugcaaccucugccucc

SEQ ID NO: 460193 - RNA, 32 nt, Human
ggcucucugcaaccucugccucccagguucaa

SEQ ID NO: 460194 - RNA, 32 nt, Human
ggcucucugcaaccucugccucccggguucaa

SEQ ID NO: 460195 - RNA, 32 nt, Human
ggcucucugcaaccucugucucccggguucaa

SEQ ID NO: 460196 - RNA, 32 nt, Human
ggcucucugcaaccugggccucccggguucaa

SEQ ID NO: 460197 - RNA, 32 nt, Human
ggcucucugcaacuuccgccuccuggguucaa

SEQ ID NO: 460198 - RNA, 32 nt, Human
ggcucucugccuucucuucauguuggccucug

SEQ ID NO: 460199 - RNA, 32 nt, Human
ggcucucuggugagcuagugucuccacagccu

SEQ ID NO: 460200 - RNA, 18 nt, Human
ggcucucuguaggcacag

SEQ ID NO: 460201 - RNA, 32 nt, Human
ggcucucugucgcccaggcuggagugcagugg

SEQ ID NO: 460202 - RNA, 32 nt, Human
ggcucucuguucuucaccuccacgcgcccucu

SEQ ID NO: 460203 - RNA, 32 nt, Human
ggcucucuuccugucuuuguggcuccggaaag

SEQ ID NO: 460204 - RNA, 32 nt, Human
ggcucucuucuuucuuccucauccuacucaaa

SEQ ID NO: 460205 - RNA, 32 nt, Human
ggcucucuugacagucagcgugccaucuugau

SEQ ID NO: 460206 - RNA, 32 nt, Human
ggcucucuuugguagggagaggggcuccaaua

SEQ ID NO: 460207 - RNA, 32 nt, Human
ggcucugaaaacacaggaauggacaagguaau

SEQ ID NO: 460208 - RNA, 21 nt, Human
ggcucugaaaucuggggcagg

SEQ ID NO: 460209 - RNA, 32 nt, Human
ggcucugaacagccccgguccagacagcagcc

SEQ ID NO: 460210 - RNA, 21 nt, Human
ggcucugaaggcgcucucugc

SEQ ID NO: 460211 - RNA, 32 nt, Human
ggcucugaaggcucagcccugccuuguucucu

SEQ ID NO: 460212 - RNA, 32 nt, Human
ggcucugaaggugauuuuagguagaagaguuu

SEQ ID NO: 460213 - RNA, 32 nt, Human
ggcucugaccacaaacuccccuccaggcugcc

SEQ ID NO: 460214 - RNA, 32 nt, Human
ggcucugacccagugagauuacagaggaaguu

SEQ ID NO: 460215 - RNA, 32 nt, Human
ggcucugaccuggccccugccccaccagcccc

SEQ ID NO: 460216 - RNA, 17 nt, Human
ggcucugaccugggguc

SEQ ID NO: 460217 - RNA, 32 nt, Human
ggcucugacugcaagcccuggcugaggccaau

SEQ ID NO: 460218 - RNA, 32 nt, Human
ggcucugagagggacagacggugcucagccug

SEQ ID NO: 460219 - RNA, 32 nt, Human
ggcucugagauagcuguccacgcccacguguu

SEQ ID NO: 460220 - RNA, 24 nt, Human
ggcucugagcccggcgugggcagg

SEQ ID NO: 460221 - RNA, 20 nt, Human
ggcucugagcuggcaggcgg

SEQ ID NO: 460222 - RNA, 21 nt, Human
ggcucugagcugggggcucag

SEQ ID NO: 460223 - RNA, 21 nt, Human
ggcucugaggaggggguaagg

SEQ ID NO: 460224 - RNA, 22 nt, Human
ggcucugaggagugggcgcugg

SEQ ID NO: 460225 - RNA, 20 nt, Human
ggcucugagucucaggucag

SEQ ID NO: 460226 - RNA, 22 nt, Human
ggcucugagucucugcuugagg

SEQ ID NO: 460227 - RNA, 21 nt, Human
ggcucugaguguucacaucca

SEQ ID NO: 460228 - RNA, 25 nt, Human
ggcucugaguuggacugaggacagg

SEQ ID NO: 460229 - RNA, 20 nt, Human
ggcucugaucagcgcagggg

SEQ ID NO: 460230 - RNA, 32 nt, Human
ggcucugaucccaggcuggauggaguggcugg

SEQ ID NO: 460231 - RNA, 32 nt, Human
ggcucugaucuaccagcccugguguaguuuau

SEQ ID NO: 460232 - RNA, 32 nt, Human
ggcucugaucuccaucagcaucagggcccaua

SEQ ID NO: 460233 - RNA, 32 nt, Human
ggcucugaucugcuaagguugguguccuuaua

SEQ ID NO: 460234 - RNA, 32 nt, Human
ggcucugauggagccaguuaaaaugcuucauu

SEQ ID NO: 460235 - RNA, 32 nt, Human
ggcucugcaaacuggggcaauaggugagcagg

SEQ ID NO: 460236 - RNA, 32 nt, Human
ggcucugcacaguggcuagaccccaaaaagcc

SEQ ID NO: 460237 - RNA, 32 nt, Human
ggcucugcacauuauucaucuccuggaauuuc

SEQ ID NO: 460238 - RNA, 32 nt, Human
ggcucugcagacccagagguaaggcugccugg

SEQ ID NO: 460239 - RNA, 32 nt, Human
ggcucugcagcccucuggggagccugcggaau

SEQ ID NO: 460240 - RNA, 32 nt, Human
ggcucugcagcgccaaggaggcggcguggcgu

SEQ ID NO: 460241 - RNA, 32 nt, Human
ggcucugcaguggaugcagccauugcagcccu

SEQ ID NO: 460242 - RNA, 21 nt, Human
ggcucugcauagccaggauga

SEQ ID NO: 460243 - RNA, 32 nt, Human
ggcucugccaaaggaagccugugaucucuagg

SEQ ID NO: 460244 - RNA, 32 nt, Human
ggcucugccacuugccuggccaugucaccuug

SEQ ID NO: 460245 - RNA, 19 nt, Human
ggcucugccagcagaguga

SEQ ID NO: 460246 - RNA, 32 nt, Human
ggcucugccaggacaccacaugggagggggcu

SEQ ID NO: 460247 - RNA, 22 nt, Human
ggcucugccaggucggugcagg

SEQ ID NO: 460248 - RNA, 32 nt, Human
ggcucugccauuuacugaucauggcccuuggg

SEQ ID NO: 460249 - RNA, 32 nt, Human
ggcucugccccauccugucacuccuggaauaa

SEQ ID NO: 460250 - RNA, 32 nt, Human
ggcucugcccugcccagugaccaacugcacug

SEQ ID NO: 460251 - RNA, 20 nt, Human
ggcucugcggggcaggggug

SEQ ID NO: 460252 - RNA, 32 nt, Human
ggcucugcgugcaggcgcuccugcugcucugg

SEQ ID NO: 460253 - RNA, 32 nt, Human
ggcucugcuccaggacuccuuccuucuuccuu

SEQ ID NO: 460254 - RNA, 32 nt, Human
ggcucugcugcccaggcuggaaugcaguggug

SEQ ID NO: 460255 - RNA, 18 nt, Human
ggcucugcugcccgggau

SEQ ID NO: 460256 - RNA, 32 nt, Human
ggcucugcugugcccuuuucaaaugcauauuu

SEQ ID NO: 460257 - RNA, 32 nt, Human
ggcucugcuuacacuuucucuccaucaccaaa

SEQ ID NO: 460258 - RNA, 32 nt, Human
ggcucuggaaaccacauggcuucaccuguccc

SEQ ID NO: 460259 - RNA, 32 nt, Human
ggcucuggaaccugggcugagauggauucggg

SEQ ID NO: 460260 - RNA, 32 nt, Human
ggcucuggaacugauugcucccaggaucuccu

SEQ ID NO: 460261 - RNA, 32 nt, Human
ggcucuggaagcucccagguccuugaagaacu

SEQ ID NO: 460262 - RNA, 20 nt, Human
ggcucuggaccagcggcagg

SEQ ID NO: 460263 - RNA, 32 nt, Human
ggcucuggacgaagacaaggaggcagaaggug

SEQ ID NO: 460264 - RNA, 32 nt, Human
ggcucuggagauuguuaccaucugcuacauau

SEQ ID NO: 460265 - RNA, 18 nt, Human
ggcucuggagccagagga

SEQ ID NO: 460266 - RNA, 32 nt, Human
ggcucuggagcuaugaaaggccccacuuucaa

SEQ ID NO: 460267 - RNA, 32 nt, Human
ggcucuggagugagggccagguucaggucucc

SEQ ID NO: 460268 - RNA, 32 nt, Human
ggcucuggcaccacuaggguccuggcccucuu

SEQ ID NO: 460269 - RNA, 32 nt, Human
ggcucuggccacacccucaggauuuccaaggu

SEQ ID NO: 460270 - RNA, 32 nt, Human
ggcucuggccagagggagagaggacucuggac

SEQ ID NO: 460271 - RNA, 32 nt, Human
ggcucuggcccaggcuagagugcaguggugcg

SEQ ID NO: 460272 - RNA, 32 nt, Human
ggcucuggccgagggcgagacaggaguauucu

SEQ ID NO: 460273 - RNA, 32 nt, Human
ggcucuggccugaucacugggcucaggucagg

SEQ ID NO: 460274 - RNA, 22 nt, Human
ggcucuggcuaaacccaccuca

SEQ ID NO: 460275 - RNA, 32 nt, Human
ggcucugggaaggcugaggcuggagaagcgua

SEQ ID NO: 460276 - RNA, 18 nt, Human
ggcucugggacccagggg

SEQ ID NO: 460277 - RNA, 32 nt, Human
ggcucugggacccuaccccuuccaaccuuccc

SEQ ID NO: 460278 - RNA, 32 nt, Human
ggcucugggaccugggcugggccggaccuggg

SEQ ID NO: 460279 - RNA, 32 nt, Human
ggcucugggagaccccagcuucccaggcuccg

SEQ ID NO: 460280 - RNA, 32 nt, Human
ggcucugggagccaugauuuuaaucacauucu

SEQ ID NO: 460281 - RNA, 32 nt, Human
ggcucugggaucucccccuuguggggcaggcu

SEQ ID NO: 460282 - RNA, 32 nt, Human
ggcucugggccaagccaccaauccagagcucc

SEQ ID NO: 460283 - RNA, 17 nt, Human
ggcucugggccucaaug

SEQ ID NO: 460284 - RNA, 32 nt, Human
ggcucugggcggggcucccgagggucuuggcg

SEQ ID NO: 460285 - RNA, 21 nt, Human
ggcucuggggacaggggcagg

SEQ ID NO: 460286 - RNA, 32 nt, Human
ggcucuggggagccauggaaggugcuggauaa

SEQ ID NO: 460287 - RNA, 32 nt, Human
ggcucuggggcuaaguaaggcaaauggucuau

SEQ ID NO: 460288 - RNA, 22 nt, Human
ggcucuggggcugcggggcagg

SEQ ID NO: 460289 - RNA, 32 nt, Human
ggcucugggggcagagguggcaggaauggugc

SEQ ID NO: 460290 - RNA, 32 nt, Human
ggcucugggugagguaggcgggaaaggaugga

SEQ ID NO: 460291 - RNA, 32 nt, Human
ggcucuggguuccucugcccuggaagggcucc

SEQ ID NO: 460292 - RNA, 32 nt, Human
ggcucuggucaucagaaggacuggucacagag

SEQ ID NO: 460293 - RNA, 32 nt, Human
ggcucuggugaagcccucugagcccaggagga

SEQ ID NO: 460294 - RNA, 24 nt, Human
ggcucuguaaaaucagaccauagu

SEQ ID NO: 460295 - RNA, 32 nt, Human
ggcucugucaccaaggcuggagugcaggggca

SEQ ID NO: 460296 - RNA, 32 nt, Human
ggcucugucacccaggcuagagugcaauggca

SEQ ID NO: 460297 - RNA, 32 nt, Human
ggcucugucacccaggcugaagugcaguggag

SEQ ID NO: 460298 - RNA, 32 nt, Human
ggcucugucacccaggcuggagugcaguggag

SEQ ID NO: 460299 - RNA, 32 nt, Human
ggcucugucacccaggcuggagugcaguggca

SEQ ID NO: 460300 - RNA, 32 nt, Human
ggcucugucacccaggcuggagugcaguggcg

SEQ ID NO: 460301 - RNA, 32 nt, Human
ggcucugucacccgggcuggagugcaguggcg

SEQ ID NO: 460302 - RNA, 32 nt, Human
ggcucugucacuuaggcuggagugcaguggcg

SEQ ID NO: 460303 - RNA, 32 nt, Human
ggcucugucauccaggcuggagugcaguggcg

SEQ ID NO: 460304 - RNA, 32 nt, Human
ggcucugucaucugaaauuuuaaccacuuaau

SEQ ID NO: 460305 - RNA, 32 nt, Human
ggcucugucccccaggcuggcgugcaguagca

SEQ ID NO: 460306 - RNA, 32 nt, Human
ggcucugucgcccaggcuggagcgcaauggca

SEQ ID NO: 460307 - RNA, 32 nt, Human
ggcucugucgcccaggcuggagugcaggggcg

SEQ ID NO: 460308 - RNA, 32 nt, Human
ggcucugucgcccaggcuggagugcagugccg

SEQ ID NO: 460309 - RNA, 32 nt, Human
ggcucugucuacccccuuccuucuuugucuug

SEQ ID NO: 460310 - RNA, 32 nt, Human
ggcucugucucccaggcuggagugcaguggcg

SEQ ID NO: 460311 - RNA, 23 nt, Human
ggcucugucuccuuccugcugcc

SEQ ID NO: 460312 - RNA, 32 nt, Human
ggcucugucugaguaagaaacagaauccucug

SEQ ID NO: 460313 - RNA, 21 nt, Human
ggcucugugccuccugccuca

SEQ ID NO: 460314 - RNA, 32 nt, Human
ggcucugugccuuggucucuccuuccucuugg

SEQ ID NO: 460315 - RNA, 22 nt, Human
ggcucugugcgaaacagaguga

SEQ ID NO: 460316 - RNA, 32 nt, Human
ggcucuguggacaccaggaggucagggcacag

SEQ ID NO: 460317 - RNA, 32 nt, Human
ggcucuguggcccaggcugagagcagcagggu

SEQ ID NO: 460318 - RNA, 32 nt, Human
ggcucuguggcgagccauuugucccaagugcc

SEQ ID NO: 460319 - RNA, 32 nt, Human
ggcucugugggcucccccugggcucugugggc

SEQ ID NO: 460320 - RNA, 32 nt, Human
ggcucuguuagaacucuguccaaaaagugcau

SEQ ID NO: 460321 - RNA, 32 nt, Human
ggcucuguuaucagcugggcagugccagccaa

SEQ ID NO: 460322 - RNA, 20 nt, Human
ggcucuguuuuguguauuua

SEQ ID NO: 460323 - RNA, 32 nt, Human
ggcucuuaaagauggcacagacccaaagagug

SEQ ID NO: 460324 - RNA, 32 nt, Human
ggcucuuaccagcgucuggccuagaggaagcc

SEQ ID NO: 460325 - RNA, 32 nt, Human
ggcucuuaggguaaugagauggaugguggccc

SEQ ID NO: 460326 - RNA, 32 nt, Human
ggcucuuagggucuugacacaggacgggccug

SEQ ID NO: 460327 - RNA, 32 nt, Human
ggcucuucacuguggggcaugggagaggagua

SEQ ID NO: 460328 - RNA, 32 nt, Human
ggcucuucagccccuggacggacgccuuggcu

SEQ ID NO: 460329 - RNA, 32 nt, Human
ggcucuucagcccuccugggagcucaguggcu

SEQ ID NO: 460330 - RNA, 32 nt, Human
ggcucuucaggcagcaccucagccuggcaccc

SEQ ID NO: 460331 - RNA, 15 nt, Human
ggcucuucuggacug

SEQ ID NO: 460332 - RNA, 22 nt, Human
ggcucuucugggggccaggcug

SEQ ID NO: 460333 - RNA, 32 nt, Human
ggcucuucuggucagccccacccugggggcca

SEQ ID NO: 460334 - RNA, 32 nt, Human
ggcucuugaacccauagaccccaguugaagau

SEQ ID NO: 460335 - RNA, 32 nt, Human
ggcucuugagccacuugcucuagcccacuccc

SEQ ID NO: 460336 - RNA, 20 nt, Human
ggcucuugauuuugucugcc

SEQ ID NO: 460337 - RNA, 19 nt, Human
ggcucuugcaacaucuccc

SEQ ID NO: 460338 - RNA, 31 nt, Human
ggcucuugcagcuagaguugacucagaagcc

SEQ ID NO: 460339 - RNA, 32 nt, Human
ggcucuugcccgaggugcccugaaccauugug

SEQ ID NO: 460340 - RNA, 32 nt, Human
ggcucuugccuguaaucccagcacuuugauag

SEQ ID NO: 460341 - RNA, 32 nt, Human
ggcucuugccuguaaucccagcacuuugggag

SEQ ID NO: 460342 - RNA, 32 nt, Human
ggcucuugccuguaaucccagcacuuugggga

SEQ ID NO: 460343 - RNA, 32 nt, Human
ggcucuugccuguaaucccagcauucugggag

SEQ ID NO: 460344 - RNA, 32 nt, Human
ggcucuugccuguaaucuuagcacuuugggag

SEQ ID NO: 460345 - RNA, 32 nt, Human
ggcucuugccuguaauuccagcuacuugggag

SEQ ID NO: 460346 - RNA, 32 nt, Human
ggcucuugccuguagucccggcacuuugggag

SEQ ID NO: 460347 - RNA, 31 nt, Human
ggcucuugucucucugggucuuagucccacu

SEQ ID NO: 460348 - RNA, 32 nt, Human
ggcucuugucuguaaucccagcgcucugggag

SEQ ID NO: 460349 - RNA, 32 nt, Human
ggcucuuuaaggcuuuguaggugagguuucca

SEQ ID NO: 460350 - RNA, 32 nt, Human
ggcucuuuacagggguguucucaccagguaga

SEQ ID NO: 460351 - RNA, 32 nt, Human
ggcucuuuaccaggaaccgcugcuuggauggu

SEQ ID NO: 460352 - RNA, 32 nt, Human
ggcucuuucucuaaucgccuuacuuagcuuuu

SEQ ID NO: 460353 - RNA, 32 nt, Human
ggcucuuucucucccgucucaguggcuucucu

SEQ ID NO: 460354 - RNA, 32 nt, Human
ggcucuuugauuugagucucagguuaauccuc

SEQ ID NO: 460355 - RNA, 32 nt, Human
ggcucuuugcaaccucugccuccugggcucaa

SEQ ID NO: 460356 - RNA, 32 nt, Human
ggcucuuugccuggccccgccuucccaucugu

SEQ ID NO: 460357 - RNA, 32 nt, Human
ggcucuuuggcugcucccacugccucagccaa

SEQ ID NO: 460358 - RNA, 32 nt, Human
ggcucuuuggggucagccagggccaggggucu

SEQ ID NO: 460359 - RNA, 32 nt, Human
ggcucuuugguuucccugcucuguuucauuua

SEQ ID NO: 460360 - RNA, 32 nt, Human
ggcucuuuuccccaggagagugaugauggagc

SEQ ID NO: 460361 - RNA, 22 nt, Human
ggcucuuuuucccaagccgcca

SEQ ID NO: 460362 - RNA, 32 nt, Human
ggcucuuuuuggacggucccaaaggaggcagc

SEQ ID NO: 460363 - RNA, 32 nt, Human
ggcugaaaaagcuguuucuggaaucaccccua

SEQ ID NO: 460364 - RNA, 21 nt, Human
ggcugaaaacgagggcccagg

SEQ ID NO: 460365 - RNA, 32 nt, Human
ggcugaaaccaccaccuccaccaccuugggac

SEQ ID NO: 460366 - RNA, 32 nt, Human
ggcugaaacuacaggcacaugccaccaugccc

SEQ ID NO: 460367 - RNA, 32 nt, Human
ggcugaaacugcuuucuuaggcauuuucuuaa

SEQ ID NO: 460368 - RNA, 32 nt, Human
ggcugaaagagucccuggugcgcagugcaggu

SEQ ID NO: 460369 - RNA, 28 nt, Human
ggcugaaauaguaaagcaccugaccaca

SEQ ID NO: 460370 - RNA, 32 nt, Human
ggcugaaauuaaagagaaagauccucacucaa

SEQ ID NO: 460371 - RNA, 32 nt, Human
ggcugaacacccugcggagcgggugagaucgg

SEQ ID NO: 460372 - RNA, 32 nt, Human
ggcugaacaccucgaccuucucugcacagcag

SEQ ID NO: 460373 - RNA, 32 nt, Human
ggcugaaccagccccggcugggcagcagcggg

SEQ ID NO: 460374 - RNA, 32 nt, Human
ggcugaacuaagugggcucuaggggaagguau

SEQ ID NO: 460375 - RNA, 18 nt, Human
ggcugaagaaacuauaga

SEQ ID NO: 460376 - RNA, 32 nt, Human
ggcugaagaagaacccgcacagcuaugugguc

SEQ ID NO: 460377 - RNA, 31 nt, Human
ggcugaagaagaccuguuggacuggaucuuc

SEQ ID NO: 460378 - RNA, 32 nt, Human
ggcugaagaauagaauuggccaggaccuaggu

SEQ ID NO: 460379 - RNA, 31 nt, Human
ggcugaagacaaggggccggcauucaguggg

SEQ ID NO: 460380 - RNA, 21 nt, Human
ggcugaagaggaggaggaaga

SEQ ID NO: 460381 - RNA, 32 nt, Human
ggcugaagcagcagaaccacagagguggcuga

SEQ ID NO: 460382 - RNA, 32 nt, Human
ggcugaagccaacagagucccaaccagugggc

SEQ ID NO: 460383 - RNA, 32 nt, Human
ggcugaagccaauaaucccagcacuuugagag

SEQ ID NO: 460384 - RNA, 24 nt, Human
ggcugaagcgauccucccaccuca

SEQ ID NO: 460385 - RNA, 24 nt, Human
ggcugaagcgauccucccaucuca

SEQ ID NO: 460386 - RNA, 32 nt, Human
ggcugaagcggguggaucaugaggucagaaga

SEQ ID NO: 460387 - RNA, 32 nt, Human
ggcugaagcugggaggugagccagucuccugg

SEQ ID NO: 460388 - RNA, 32 nt, Human
ggcugaaggagguggagcuggggaggaagaug

SEQ ID NO: 460389 - RNA, 32 nt, Human
ggcugaaggccccaccacccagccuguggaug

SEQ ID NO: 460390 - RNA, 32 nt, Human
ggcugaagggaaaaguacacagaggaagauau

SEQ ID NO: 460391 - RNA, 32 nt, Human
ggcugaagggagggaaaggcggcuugggccuc

SEQ ID NO: 460392 - RNA, 22 nt, Human
ggcugaaggugaagggaggaag

SEQ ID NO: 460393 - RNA, 32 nt, Human
ggcugaagucuguaauccuagcacuuugggag

SEQ ID NO: 460394 - RNA, 24 nt, Human
ggcugaagugauucucccaucuca

SEQ ID NO: 460395 - RNA, 32 nt, Human
ggcugaaucuuucuccucuaagcagucugguc

SEQ ID NO: 460396 - RNA, 23 nt, Human
ggcugaaugagugcguggaggaa

SEQ ID NO: 460397 - RNA, 32 nt, Human
ggcugaauguccagcagagcuauuuccuucca

SEQ ID NO: 460398 - RNA, 32 nt, Human
ggcugaauucuuuugcagaacuacuguguguc

SEQ ID NO: 460399 - RNA, 32 nt, Human
ggcugaauuugccuuuucccauguggaaugga

SEQ ID NO: 460400 - RNA, 32 nt, Human
ggcugacaaaggaaguagccuggggcauccuu

SEQ ID NO: 460401 - RNA, 32 nt, Human
ggcugacaacacucccucuccugggaccuccu

SEQ ID NO: 460402 - RNA, 32 nt, Human
ggcugacaauauugcugccuccccuaaauuga

SEQ ID NO: 460403 - RNA, 24 nt, Human
ggcugacaaugacuccuguuuuca

SEQ ID NO: 460404 - RNA, 32 nt, Human
ggcugacacagcagcagccuuucccacccagc

SEQ ID NO: 460405 - RNA, 32 nt, Human
ggcugacacccccauucccucucuucuuccac

SEQ ID NO: 460406 - RNA, 32 nt, Human
ggcugacaccgugaaaccuugucucuacuaaa

SEQ ID NO: 460407 - RNA, 32 nt, Human
ggcugacaccuauaaucucagcacuuugggag

SEQ ID NO: 460408 - RNA, 32 nt, Human
ggcugacaccuguaaucccagcacuuugggag

SEQ ID NO: 460409 - RNA, 32 nt, Human
ggcugacaccuguaaucccagcauuuugggag

SEQ ID NO: 460410 - RNA, 24 nt, Human
ggcugacagagcaagacucugucu

SEQ ID NO: 460411 - RNA, 32 nt, Human
ggcugacagagcucuggguugugcacauuucu

SEQ ID NO: 460412 - RNA, 32 nt, Human
ggcugacagcccugaagugaggcugcacacac

SEQ ID NO: 460413 - RNA, 32 nt, Human
ggcugacagggugaggcccaagccuggagcuu

SEQ ID NO: 460414 - RNA, 32 nt, Human
ggcugacaucuguaauccccgcacuuugugag

SEQ ID NO: 460415 - RNA, 32 nt, Human
ggcugacauggugaaacuccaucucuacuaaa

SEQ ID NO: 460416 - RNA, 32 nt, Human
ggcugacaugugccauuauauguaguauguaa

SEQ ID NO: 460417 - RNA, 18 nt, Human
ggcugaccaagcgccaaa

SEQ ID NO: 460418 - RNA, 32 nt, Human
ggcugaccaccagaaugagcauucagggcugu

SEQ ID NO: 460419 - RNA, 32 nt, Human
ggcugacccaaguguugaggggaccaaagcca

SEQ ID NO: 460420 - RNA, 32 nt, Human
ggcugacccaggcuggaggacaggaccagcca

SEQ ID NO: 460421 - RNA, 22 nt, Human
ggcugaccccauccuccucucc

SEQ ID NO: 460422 - RNA, 32 nt, Human
ggcugaccccauccuccucucccuccaggagc

SEQ ID NO: 460423 - RNA, 32 nt, Human
ggcugacccccacaccucccuccuggacgggg

SEQ ID NO: 460424 - RNA, 20 nt, Human
ggcugacccuccugcuggug

SEQ ID NO: 460425 - RNA, 32 nt, Human
ggcugacccugccuugggcgccgagggguugg

SEQ ID NO: 460426 - RNA, 32 nt, Human
ggcugaccgcgccagacccagacagagcaucg

SEQ ID NO: 460427 - RNA, 32 nt, Human
ggcugaccucaaacuccugaccucaggugauc

SEQ ID NO: 460428 - RNA, 32 nt, Human
ggcugaccuugaacuccugggcucaagcaguc

SEQ ID NO: 460429 - RNA, 32 nt, Human
ggcugaccuugagcucuugggcucaggugauc

SEQ ID NO: 460430 - RNA, 32 nt, Human
ggcugacgccuguaaucccagcacuuugggag

SEQ ID NO: 460431 - RNA, 32 nt, Human
ggcugacgcuacaccuuggucuuuccgggucc

SEQ ID NO: 460432 - RNA, 32 nt, Human
ggcugacgugggcagaucaugaggucaggaga

SEQ ID NO: 460433 - RNA, 32 nt, Human
ggcugacuccagcuucugguggaccuggauau

SEQ ID NO: 460434 - RNA, 32 nt, Human
ggcugacucccccaccucccuccuggacgggg

SEQ ID NO: 460435 - RNA, 32 nt, Human
ggcugacuccuccucugaggccuguguuggcc

SEQ ID NO: 460436 - RNA, 32 nt, Human
ggcugacuccuugagaaucuugcccaguccca

SEQ ID NO: 460437 - RNA, 32 nt, Human
ggcugacucugcugccccaaccuuucaaggag

SEQ ID NO: 460438 - RNA, 32 nt, Human
ggcugacugaauugcugacccuucaagcucug

SEQ ID NO: 460439 - RNA, 32 nt, Human
ggcugacugagcucaaaggaacaggauggcac

SEQ ID NO: 460440 - RNA, 32 nt, Human
ggcugacugcaaacucugccucccagguuuaa

SEQ ID NO: 460441 - RNA, 32 nt, Human
ggcugacugcaaccacugccuccaggguucaa

SEQ ID NO: 460442 - RNA, 23 nt, Human
ggcugacugcaaccuccaccucc

SEQ ID NO: 460443 - RNA, 32 nt, Human
ggcugacugcaaccuccaccucccgggugcaa

SEQ ID NO: 460444 - RNA, 24 nt, Human
ggcugacugcaaccuccaccuccu

SEQ ID NO: 460445 - RNA, 32 nt, Human
ggcugacugcaaccuccaccuccuggguucaa

SEQ ID NO: 460446 - RNA, 32 nt, Human
ggcugacugcaacuucugccuccuggguucaa

SEQ ID NO: 460447 - RNA, 32 nt, Human
ggcugacugcaaggcugucuccuuaaggcacu

SEQ ID NO: 460448 - RNA, 32 nt, Human
ggcugacugcaaucugugccuccugggcucaa

SEQ ID NO: 460449 - RNA, 32 nt, Human
ggcugacugcagucugugccuccugggcucaa

SEQ ID NO: 460450 - RNA, 32 nt, Human
ggcugacuggcagaggaagauugcagugacag

SEQ ID NO: 460451 - RNA, 32 nt, Human
ggcugacugggggccucugccuccaggagggc

SEQ ID NO: 460452 - RNA, 32 nt, Human
ggcugagaaauguaagaauuuuccaugguguu

SEQ ID NO: 460453 - RNA, 32 nt, Human
ggcugagaaccuuucagacccucugugugggc

SEQ ID NO: 460454 - RNA, 18 nt, Human
ggcugagaacucguucac

SEQ ID NO: 460455 - RNA, 18 nt, Human
ggcugagaaggggcagcu

SEQ ID NO: 460456 - RNA, 32 nt, Human
ggcugagaaucccagaggaggccgugaacugu

SEQ ID NO: 460457 - RNA, 32 nt, Human
ggcugagacuacaggugcuugccacuaugccc

SEQ ID NO: 460458 - RNA, 32 nt, Human
ggcugagacugcagaggagccaccugggcugg

SEQ ID NO: 460459 - RNA, 21 nt, Human
ggcugagagaagagcuugcgg

SEQ ID NO: 460460 - RNA, 32 nt, Human
ggcugagagagggagggcgacgggggugagaa

SEQ ID NO: 460461 - RNA, 32 nt, Human
ggcugagagauaugaugacaucgcagccugca

SEQ ID NO: 460462 - RNA, 32 nt, Human
ggcugagagauggaaggggugggauuugcucc

SEQ ID NO: 460463 - RNA, 32 nt, Human
ggcugagagauugagccugcagugagcuauga

SEQ ID NO: 460464 - RNA, 32 nt, Human
ggcugagagcugacaugaggaugaggaugggu

SEQ ID NO: 460465 - RNA, 20 nt, Human
ggcugagagcugggagccgg

SEQ ID NO: 460466 - RNA, 23 nt, Human
ggcugagaggacaccuggccgca

SEQ ID NO: 460467 - RNA, 32 nt, Human
ggcugagaggccucugggaaccccugugccaa

SEQ ID NO: 460468 - RNA, 32 nt, Human
ggcugagagggugggggcuggaaccccucccc

SEQ ID NO: 460469 - RNA, 20 nt, Human
ggcugagaggucaagguugc

SEQ ID NO: 460470 - RNA, 32 nt, Human
ggcugagaggucaagguugcagugagccauaa

SEQ ID NO: 460471 - RNA, 32 nt, Human
ggcugagaguuggagcucuccagcaacaugcc

SEQ ID NO: 460472 - RNA, 32 nt, Human
ggcugagauaggaucacuugggcccaggaguu

SEQ ID NO: 460473 - RNA, 32 nt, Human
ggcugagauggaaaacaagcccuuuauugaau

SEQ ID NO: 460474 - RNA, 32 nt, Human
ggcugagauggggugggcagggcagagcugau

SEQ ID NO: 460475 - RNA, 32 nt, Human
ggcugagauggguggccagcuuguacaccagu

SEQ ID NO: 460476 - RNA, 23 nt, Human
ggcugagaugucgacaggcagug

SEQ ID NO: 460477 - RNA, 21 nt, Human
ggcugagauugcagcccaugg

SEQ ID NO: 460478 - RNA, 32 nt, Human
ggcugagauuuaugggucuuccuugcccucca

SEQ ID NO: 460479 - RNA, 32 nt, Human
ggcugagcaagguggguggaucacuugaggcc

SEQ ID NO: 460480 - RNA, 32 nt, Human
ggcugagcaggagcugaaagugaacagcucac

SEQ ID NO: 460481 - RNA, 32 nt, Human
ggcugagcagugagcucugauuaugccagugc

SEQ ID NO: 460482 - RNA, 20 nt, Human
ggcugagcauccuccugccc

SEQ ID NO: 460483 - RNA, 32 nt, Human
ggcugagcauuuagugugagccagugacccau

SEQ ID NO: 460484 - RNA, 32 nt, Human
ggcugagcauuuccuuuugugcauccucucca

SEQ ID NO: 460485 - RNA, 32 nt, Human
ggcugagccaggacccaccacacucaacuccc

SEQ ID NO: 460486 - RNA, 32 nt, Human
ggcugagcccuccacaggcugcuuagugaggg

SEQ ID NO: 460487 - RNA, 18 nt, Human
ggcugagccgggguccag

SEQ ID NO: 460488 - RNA, 32 nt, Human
ggcugagccugaggccuuccagaaagcaggag

SEQ ID NO: 460489 - RNA, 32 nt, Human
ggcugagccugucagcauccucgacgcacccu

SEQ ID NO: 460490 - RNA, 32 nt, Human
ggcugagccuugggaguuucagcucuuuggcg

SEQ ID NO: 460491 - RNA, 32 nt, Human
ggcugagcggcugucuugccucuugucauugu

SEQ ID NO: 460492 - RNA, 32 nt, Human
ggcugagcugagaccaguugcuggugaaacug

SEQ ID NO: 460493 - RNA, 32 nt, Human
ggcugagcugcugaagcugcacuacaugcagg

SEQ ID NO: 460494 - RNA, 32 nt, Human
ggcugagcugggcagcuggaaguggcucuggg

SEQ ID NO: 460495 - RNA, 32 nt, Human
ggcugagcuuucugugcuucuagguggagcug

SEQ ID NO: 460496 - RNA, 32 nt, Human
ggcugaggaaagcaggaggagguggcggcggc

SEQ ID NO: 460497 - RNA, 32 nt, Human
ggcugaggaaagcaggaggaggugguggcggc

SEQ ID NO: 460498 - RNA, 32 nt, Human
ggcugaggacaccacugucagcacagacagug

SEQ ID NO: 460499 - RNA, 32 nt, Human
ggcugaggacagaugugccugcuuguggagac

SEQ ID NO: 460500 - RNA, 32 nt, Human
ggcugaggacaggggagggagugaaguugguu

SEQ ID NO: 460501 - RNA, 32 nt, Human
ggcugaggagagaaaagggugauuagcguggg

SEQ ID NO: 460502 - RNA, 32 nt, Human
ggcugaggaggacaagccagacgggcaggcac

SEQ ID NO: 460503 - RNA, 32 nt, Human
ggcugaggaggcgggaaggcggcagugguuga

SEQ ID NO: 460504 - RNA, 32 nt, Human
ggcugaggaggcugaggggcugaggggcugag

SEQ ID NO: 460505 - RNA, 21 nt, Human
ggcugaggagggaagccaggg

SEQ ID NO: 460506 - RNA, 24 nt, Human
ggcugaggagggacgcggaggagg

SEQ ID NO: 460507 - RNA, 32 nt, Human
ggcugaggaggugaaaguuucuccccaggaag

SEQ ID NO: 460508 - RNA, 32 nt, Human
ggcugaggcagaagaauugaacccaggaggug

SEQ ID NO: 460509 - RNA, 23 nt, Human
ggcugaggcagaaggaucacugg

SEQ ID NO: 460510 - RNA, 32 nt, Human
ggcugaggcaggaggaggauaacuugaaccca

SEQ ID NO: 460511 - RNA, 32 nt, Human
ggcugaggcaggaggaucgcuugaguguguga

SEQ ID NO: 460512 - RNA, 32 nt, Human
ggcugaggcaggcagaucacgaggucaggagu

SEQ ID NO: 460513 - RNA, 32 nt, Human
ggcugaggcaggcagaucaugaggucaagaga

SEQ ID NO: 460514 - RNA, 32 nt, Human
ggcugaggcaggcagauugcuugagcucagga

SEQ ID NO: 460515 - RNA, 32 nt, Human
ggcugaggcaggcggaucaugaggucaggaga

SEQ ID NO: 460516 - RNA, 32 nt, Human
ggcugaggcauggagaaucgcuugaacccagg

SEQ ID NO: 460517 - RNA, 32 nt, Human
ggcugaggccagagucaccuuuucuguggcug

SEQ ID NO: 460518 - RNA, 17 nt, Human
ggcugaggccaggguga

SEQ ID NO: 460519 - RNA, 32 nt, Human
ggcugaggccauggcaggacagcugcuguggg

SEQ ID NO: 460520 - RNA, 32 nt, Human
ggcugaggcccaaaccgucuuuucucucagag

SEQ ID NO: 460521 - RNA, 32 nt, Human
ggcugaggcccccacccuccccuggaacgcgc

SEQ ID NO: 460522 - RNA, 32 nt, Human
ggcugaggcggaggcaggauugcuugauauga

SEQ ID NO: 460523 - RNA, 32 nt, Human
ggcugaggcgggcagaucaugaggucagaaga

SEQ ID NO: 460524 - RNA, 32 nt, Human
ggcugaggcgggcagaucaugaggucaggaga

SEQ ID NO: 460525 - RNA, 32 nt, Human
ggcugaggcgggcggaucaugaggucaggaga

SEQ ID NO: 460526 - RNA, 32 nt, Human
ggcugaggcgggcggaucaugaggucaggagu

SEQ ID NO: 460527 - RNA, 32 nt, Human
ggcugaggcgggugaaucaugaggucaggagu

SEQ ID NO: 460528 - RNA, 32 nt, Human
ggcugaggcggguggaucaugaggucaagaga

SEQ ID NO: 460529 - RNA, 32 nt, Human
ggcugaggcggguggaucaugaggucaggagu

SEQ ID NO: 460530 - RNA, 32 nt, Human
ggcugaggcuugagcccaggagguggagguug

SEQ ID NO: 460531 - RNA, 32 nt, Human
ggcugagggaaaggaagaggagugggccugag

SEQ ID NO: 460532 - RNA, 32 nt, Human
ggcugagggaauuguccucuguggaagggacu

SEQ ID NO: 460533 - RNA, 32 nt, Human
ggcugagggacacguccaagcugcagucggcu

SEQ ID NO: 460534 - RNA, 32 nt, Human
ggcugagggagaaucacuugggcucaggagcu

SEQ ID NO: 460535 - RNA, 32 nt, Human
ggcugagggaggcagaaagggaaaguauuagc

SEQ ID NO: 460536 - RNA, 32 nt, Human
ggcugagggcccugugugcucacugaaggcug

SEQ ID NO: 460537 - RNA, 21 nt, Human
ggcugagggccuuguggagga

SEQ ID NO: 460538 - RNA, 32 nt, Human
ggcugagggcggaggggccggggaagagcccg

SEQ ID NO: 460539 - RNA, 32 nt, Human
ggcugagggcgggugguacagauguguauggg

SEQ ID NO: 460540 - RNA, 32 nt, Human
ggcugaggggcugaggaggcugaggggcugag

SEQ ID NO: 460541 - RNA, 32 nt, Human
ggcugaggggcugaggcggcugaggggcugag

SEQ ID NO: 460542 - RNA, 32 nt, Human
ggcugaggggucgggggaagaaaacagaugac

SEQ ID NO: 460543 - RNA, 32 nt, Human
ggcugaggggugggagggagggcagagcucug

SEQ ID NO: 460544 - RNA, 32 nt, Human
ggcugaggguaaggaaaagaagagacuaggaa

SEQ ID NO: 460545 - RNA, 32 nt, Human
ggcugagggucugagagcaggacaggaaaacc

SEQ ID NO: 460546 - RNA, 32 nt, Human
ggcugagggugagggaacagccuggaugugag

SEQ ID NO: 460547 - RNA, 32 nt, Human
ggcugagggugagguguggaagggacaggggg

SEQ ID NO: 460548 - RNA, 32 nt, Human
ggcugaggguggucacaccugagccuucagca

SEQ ID NO: 460549 - RNA, 32 nt, Human
ggcugaggguucugcuguccugugccacccca

SEQ ID NO: 460550 - RNA, 23 nt, Human
ggcugaggguuggggggaggaag

SEQ ID NO: 460551 - RNA, 23 nt, Human
ggcugagguacaagaauugcugg

SEQ ID NO: 460552 - RNA, 32 nt, Human
ggcugagguagguggaucaugaggucaggaga

SEQ ID NO: 460553 - RNA, 32 nt, Human
ggcugaggugcugggcaaccagccugcuccca

SEQ ID NO: 460554 - RNA, 21 nt, Human
ggcugagguggacggaucacg

SEQ ID NO: 460555 - RNA, 23 nt, Human
ggcugagguggaggcggagggag

SEQ ID NO: 460556 - RNA, 32 nt, Human
ggcugagguggaggcggagggaggcggcggcg

SEQ ID NO: 460557 - RNA, 32 nt, Human
ggcugaggugggaggauccucugaucugggga

SEQ ID NO: 460558 - RNA, 32 nt, Human
ggcugaggugggggacacaggagaaaccaggc

SEQ ID NO: 460559 - RNA, 32 nt, Human
ggcugagguggguggaugccgaggugagugga

SEQ ID NO: 460560 - RNA, 32 nt, Human
ggcugaggugugaggaucauuuaggccuggaa

SEQ ID NO: 460561 - RNA, 32 nt, Human
ggcugaggugugaggaucuuugagcccgggag

SEQ ID NO: 460562 - RNA, 32 nt, Human
ggcugagucacuccucgggucucuccauaauu

SEQ ID NO: 460563 - RNA, 32 nt, Human
ggcugagucagccagauccucccccuacuucu

SEQ ID NO: 460564 - RNA, 24 nt, Human
ggcugagucuacccagcucaaggu

SEQ ID NO: 460565 - RNA, 20 nt, Human
ggcugagucucagcccaagg

SEQ ID NO: 460566 - RNA, 22 nt, Human
ggcugagucuccagcucaaggu

SEQ ID NO: 460567 - RNA, 32 nt, Human
ggcugagugaaauggacgucaccagaacuuuc

SEQ ID NO: 460568 - RNA, 32 nt, Human
ggcugagugaacauacacauugccaauauucu

SEQ ID NO: 460569 - RNA, 32 nt, Human
ggcugagugaauuuggauagauauaauaugca

SEQ ID NO: 460570 - RNA, 32 nt, Human
ggcugagugagggugaguaaagagguagagga

SEQ ID NO: 460571 - RNA, 32 nt, Human
ggcugaguguaugccaccucagauucauaugu

SEQ ID NO: 460572 - RNA, 32 nt, Human
ggcugaguuggcagccaaggagaacucgccaa

SEQ ID NO: 460573 - RNA, 32 nt, Human
ggcugaguugggggcccuaggcagggguaagc

SEQ ID NO: 460574 - RNA, 32 nt, Human
ggcugaguuuuccuccccagacucuccugcgu

SEQ ID NO: 460575 - RNA, 20 nt, Human
ggcugauaccaccuaccuca

SEQ ID NO: 460576 - RNA, 16 nt, Human
ggcugauaccugaggc

SEQ ID NO: 460577 - RNA, 32 nt, Human
ggcugauaccuuugugaaguugcccaccaaaa

SEQ ID NO: 460578 - RNA, 32 nt, Human
ggcugauagcugguaucacauaguuggaguca

SEQ ID NO: 460579 - RNA, 32 nt, Human
ggcugaucaaagaacucugacugcagaacugc

SEQ ID NO: 460580 - RNA, 32 nt, Human
ggcugauccuggcucgagcacacacaucuaag

SEQ ID NO: 460581 - RNA, 32 nt, Human
ggcugaucgcuguuccuugagcaaggcgcuua

SEQ ID NO: 460582 - RNA, 32 nt, Human
ggcugaucucaaacuccugaccucaugaucca

SEQ ID NO: 460583 - RNA, 32 nt, Human
ggcugaucucaaacuccugaucucaagugauc

SEQ ID NO: 460584 - RNA, 32 nt, Human
ggcugaucucaaacuccuggacucaagcgauc

SEQ ID NO: 460585 - RNA, 32 nt, Human
ggcugaucucaaacuccuggccucaagugauc

SEQ ID NO: 460586 - RNA, 32 nt, Human
ggcugaucucaaacuccugggcuccaacgauc

SEQ ID NO: 460587 - RNA, 32 nt, Human
ggcugaucucaaacuucugaccucaggugauc

SEQ ID NO: 460588 - RNA, 32 nt, Human
ggcugaucucagaaaggaauaaggaugaggca

SEQ ID NO: 460589 - RNA, 25 nt, Human
ggcugaucucgaacuccugaccgca

SEQ ID NO: 460590 - RNA, 32 nt, Human
ggcugaucucgaacuccugacuuuaggugauc

SEQ ID NO: 460591 - RNA, 32 nt, Human
ggcugaucucgagcuccugaccucaggugauc

SEQ ID NO: 460592 - RNA, 32 nt, Human
ggcugaucucgagcuccugggcucaagugauc

SEQ ID NO: 460593 - RNA, 32 nt, Human
ggcugaucuggaacuccugaccucaggugauc

SEQ ID NO: 460594 - RNA, 32 nt, Human
ggcugaucuugaacuccugaccucaggugauc

SEQ ID NO: 460595 - RNA, 32 nt, Human
ggcugaucuugaacuccugaccucgggaucca

SEQ ID NO: 460596 - RNA, 32 nt, Human
ggcugaucuugaacuccugagcucaugaucca

SEQ ID NO: 460597 - RNA, 32 nt, Human
ggcugaucuugaacuccugaggucaggcaauc

SEQ ID NO: 460598 - RNA, 32 nt, Human
ggcugaucuugaacuccugggcucaagagauc

SEQ ID NO: 460599 - RNA, 32 nt, Human
ggcugaucuugcacucccagccucaggugauc

SEQ ID NO: 460600 - RNA, 32 nt, Human
ggcugaugagacuaauuauucccacuagccag

SEQ ID NO: 460601 - RNA, 32 nt, Human
ggcugaugagauacugagcucauuaucaguuc

SEQ ID NO: 460602 - RNA, 22 nt, Human
ggcugaugaggaaggaugacgg

SEQ ID NO: 460603 - RNA, 32 nt, Human
ggcugaugagugugugggguauggggcagcag

SEQ ID NO: 460604 - RNA, 32 nt, Human
ggcugaugcagcgcugcugggcccucagcccc

SEQ ID NO: 460605 - RNA, 32 nt, Human
ggcugaugccuguaaucccagcacuuugggag

SEQ ID NO: 460606 - RNA, 32 nt, Human
ggcugaugccugucaucccaacgcuuugggag

SEQ ID NO: 460607 - RNA, 32 nt, Human
ggcugaugcuuggagcagagaugaggacucag

SEQ ID NO: 460608 - RNA, 32 nt, Human
ggcugaugcuuguauucccagcauuuggggag

SEQ ID NO: 460609 - RNA, 32 nt, Human
ggcugauggaaaugaccucugugcagcuaagg

SEQ ID NO: 460610 - RNA, 32 nt, Human
ggcugauggcagcuaggcccuaggaaggagcc

SEQ ID NO: 460611 - RNA, 32 nt, Human
ggcugaugggagcagugagcgggcuccgcugc

SEQ ID NO: 460612 - RNA, 21 nt, Human
ggcugauggggaagggggcug

SEQ ID NO: 460613 - RNA, 23 nt, Human
ggcugauugcagagcacuaugag

SEQ ID NO: 460614 - RNA, 32 nt, Human
ggcugauugcagccuugaccuccuugacucaa

SEQ ID NO: 460615 - RNA, 32 nt, Human
ggcugauuggcugggcaggaacagcgccgggg

SEQ ID NO: 460616 - RNA, 31 nt, Human
ggcugauugguggaaaguaggguggaccaaa

SEQ ID NO: 460617 - RNA, 19 nt, Human
ggcugauugucuuuuauca

SEQ ID NO: 460618 - RNA, 18 nt, Human
ggcugauuucagauucuc

SEQ ID NO: 460619 - RNA, 32 nt, Human
ggcugauuucaggaugauuacaugggccaggg

SEQ ID NO: 460620 - RNA, 32 nt, Human
ggcugauuucgaacuccugaccucagaugacc

SEQ ID NO: 460621 - RNA, 32 nt, Human
ggcugauuuugaacuccugaccucaggugauc

SEQ ID NO: 460622 - RNA, 32 nt, Human
ggcugcaaaaggugaaaagcaccaagagguuu

SEQ ID NO: 460623 - RNA, 32 nt, Human
ggcugcaaacaccucccugugcuccaccugcc

SEQ ID NO: 460624 - RNA, 32 nt, Human
ggcugcaaagcgagaagagagccgguggagug

SEQ ID NO: 460625 - RNA, 32 nt, Human
ggcugcaacacccagaccuccaggagagacca

SEQ ID NO: 460626 - RNA, 32 nt, Human
ggcugcaagcucugcugccuccuugccuuucc

SEQ ID NO: 460627 - RNA, 32 nt, Human
ggcugcaagggguggaggcugagcuggaaggg

SEQ ID NO: 460628 - RNA, 32 nt, Human
ggcugcacaccuagacucgcccugccagggcc

SEQ ID NO: 460629 - RNA, 19 nt, Human
ggcugcacacgcagaguga

SEQ ID NO: 460630 - RNA, 32 nt, Human
ggcugcacagcccaaccaggaggggucugccu

SEQ ID NO: 460631 - RNA, 32 nt, Human
ggcugcacagcccgagggucucuggcugcggg

SEQ ID NO: 460632 - RNA, 32 nt, Human
ggcugcacagggaagggaaagacugggcuuug

SEQ ID NO: 460633 - RNA, 32 nt, Human
ggcugcaccacaccccuuccccuagaugacug

SEQ ID NO: 460634 - RNA, 32 nt, Human
ggcugcacccaccuccuccccuuccuaccccc

SEQ ID NO: 460635 - RNA, 24 nt, Human
ggcugcaccggcagaggcugcggg

SEQ ID NO: 460636 - RNA, 32 nt, Human
ggcugcacggccguccuggccaugccucugcc

SEQ ID NO: 460637 - RNA, 19 nt, Human
ggcugcacggcucgugcca

SEQ ID NO: 460638 - RNA, 24 nt, Human
ggcugcacugcuacuugugcuguc

SEQ ID NO: 460639 - RNA, 32 nt, Human
ggcugcacuggcccaagccaaggggucuccuu

SEQ ID NO: 460640 - RNA, 19 nt, Human
ggcugcacuuuggguccag

SEQ ID NO: 460641 - RNA, 32 nt, Human
ggcugcagaaauaccuggugcucaagucaugg

SEQ ID NO: 460642 - RNA, 21 nt, Human
ggcugcagaacauccgccgca

SEQ ID NO: 460643 - RNA, 32 nt, Human
ggcugcagaagaaaguugucacuccagugagu

SEQ ID NO: 460644 - RNA, 21 nt, Human
ggcugcagaaugcgcuuuaga

SEQ ID NO: 460645 - RNA, 21 nt, Human
ggcugcagaccccugcaucag

SEQ ID NO: 460646 - RNA, 21 nt, Human
ggcugcagaccccugugccag

SEQ ID NO: 460647 - RNA, 32 nt, Human
ggcugcagagcaaggaugaagccucaggaggg

SEQ ID NO: 460648 - RNA, 32 nt, Human
ggcugcagagccugggcucagccccagggagg

SEQ ID NO: 460649 - RNA, 19 nt, Human
ggcugcagagccuguggca

SEQ ID NO: 460650 - RNA, 22 nt, Human
ggcugcagagcuuggggggcug

SEQ ID NO: 460651 - RNA, 32 nt, Human
ggcugcagaggaaguguggggaggaaggaagu

SEQ ID NO: 460652 - RNA, 22 nt, Human
ggcugcagaggccaucgcagcu

SEQ ID NO: 460653 - RNA, 32 nt, Human
ggcugcagagggcuccagguucugggccccug

SEQ ID NO: 460654 - RNA, 32 nt, Human
ggcugcagagugggcucccugccccucucugc

SEQ ID NO: 460655 - RNA, 26 nt, Human
ggcugcagauucuuuccaccauggcc

SEQ ID NO: 460656 - RNA, 23 nt, Human
ggcugcagcacccagcugugguc

SEQ ID NO: 460657 - RNA, 32 nt, Human
ggcugcagcaggagcuggacgacgccaccaug

SEQ ID NO: 460658 - RNA, 32 nt, Human
ggcugcagccaucugaagcuuggcuggagcug

SEQ ID NO: 460659 - RNA, 20 nt, Human
ggcugcagcccaggccaugg

SEQ ID NO: 460660 - RNA, 23 nt, Human
ggcugcagccucaugccaugucu

SEQ ID NO: 460661 - RNA, 32 nt, Human
ggcugcagccuccccagcucuccucugccagc

SEQ ID NO: 460662 - RNA, 32 nt, Human
ggcugcagccuccucuuucugucucugaucag

SEQ ID NO: 460663 - RNA, 32 nt, Human
ggcugcagccugaccccucugccaucggccuc

SEQ ID NO: 460664 - RNA, 32 nt, Human
ggcugcagccugggugacagagcaagacccug

SEQ ID NO: 460665 - RNA, 19 nt, Human
ggcugcagcgacaccaugg

SEQ ID NO: 460666 - RNA, 32 nt, Human
ggcugcagcgcagcagcacccaacgcaaggca

SEQ ID NO: 460667 - RNA, 23 nt, Human
ggcugcagcgcuaccgcccggcc

SEQ ID NO: 460668 - RNA, 19 nt, Human
ggcugcagcggcaccgcgg

SEQ ID NO: 460669 - RNA, 26 nt, Human
ggcugcagcggcaggaccgccauggu

SEQ ID NO: 460670 - RNA, 32 nt, Human
ggcugcagcucaccauguaugccugaccaggc

SEQ ID NO: 460671 - RNA, 23 nt, Human
ggcugcagcucgggacuucggcc

SEQ ID NO: 460672 - RNA, 23 nt, Human
ggcugcagcucgggccuucggcc

SEQ ID NO: 460673 - RNA, 26 nt, Human
ggcugcagcugcaggacccuguggcc

SEQ ID NO: 460674 - RNA, 27 nt, Human
ggcugcagcugccgcggcuaccauggc

SEQ ID NO: 460675 - RNA, 27 nt, Human
ggcugcagcuuacugcccgccgcggcc

SEQ ID NO: 460676 - RNA, 25 nt, Human
ggcugcagcuucaggggccauggcu

SEQ ID NO: 460677 - RNA, 19 nt, Human
ggcugcagcuuccacagcc

SEQ ID NO: 460678 - RNA, 25 nt, Human
ggcugcagcuuccacagccacugcc

SEQ ID NO: 460679 - RNA, 20 nt, Human
ggcugcagcuuuuugcucuc

SEQ ID NO: 460680 - RNA, 32 nt, Human
ggcugcaggacccucuacacacagacagcugu

SEQ ID NO: 460681 - RNA, 32 nt, Human
ggcugcaggacgcucucuucuugagugcaggu

SEQ ID NO: 460682 - RNA, 32 nt, Human
ggcugcaggagcaagugaccaggagcaggacu

SEQ ID NO: 460683 - RNA, 32 nt, Human
ggcugcaggagcaggcuucggacauuaaagga

SEQ ID NO: 460684 - RNA, 32 nt, Human
ggcugcaggaggccaugaagguggccguggac

SEQ ID NO: 460685 - RNA, 22 nt, Human
ggcugcaggcaucuccauggcc

SEQ ID NO: 460686 - RNA, 21 nt, Human
ggcugcaggcuagugcucuca

SEQ ID NO: 460687 - RNA, 24 nt, Human
ggcugcaggcugagcucuaaccag

SEQ ID NO: 460688 - RNA, 32 nt, Human
ggcugcaggcuggagugcagugggacagcgcu

SEQ ID NO: 460689 - RNA, 21 nt, Human
ggcugcaggcuucauuaggcu

SEQ ID NO: 460690 - RNA, 22 nt, Human
ggcugcagggagccgcugggcc

SEQ ID NO: 460691 - RNA, 23 nt, Human
ggcugcagggauggggggaguuu

SEQ ID NO: 460692 - RNA, 32 nt, Human
ggcugcagggcaggggacagcagagcagagag

SEQ ID NO: 460693 - RNA, 26 nt, Human
ggcugcagggcgugcaccgcgcggcc

SEQ ID NO: 460694 - RNA, 25 nt, Human
ggcugcaggggauucuguguuuuca

SEQ ID NO: 460695 - RNA, 19 nt, Human
ggcugcaggggcugggcca

SEQ ID NO: 460696 - RNA, 32 nt, Human
ggcugcaggggguagcccugccgcacuuuguc

SEQ ID NO: 460697 - RNA, 32 nt, Human
ggcugcaguauugacuccagugacauaaaguu

SEQ ID NO: 460698 - RNA, 32 nt, Human
ggcugcagucgcugcauuuguaccgcugccag

SEQ ID NO: 460699 - RNA, 22 nt, Human
ggcugcagucugggccggggcc

SEQ ID NO: 460700 - RNA, 32 nt, Human
ggcugcagugagccaugaucauuccacugcau

SEQ ID NO: 460701 - RNA, 20 nt, Human
ggcugcagugagccaugguu

SEQ ID NO: 460702 - RNA, 22 nt, Human
ggcugcagugagcuaucauggu

SEQ ID NO: 460703 - RNA, 32 nt, Human
ggcugcagugagcugggauuacaccauugcau

SEQ ID NO: 460704 - RNA, 23 nt, Human
ggcugcagugagcugugcuccca

SEQ ID NO: 460705 - RNA, 23 nt, Human
ggcugcaguggcggcgugucuca

SEQ ID NO: 460706 - RNA, 22 nt, Human
ggcugcagugggaccacuggcc

SEQ ID NO: 460707 - RNA, 32 nt, Human
ggcugcagugggagccgccagucugacccuug

SEQ ID NO: 460708 - RNA, 18 nt, Human
ggcugcagugggggguca

SEQ ID NO: 460709 - RNA, 18 nt, Human
ggcugcagugggguccag

SEQ ID NO: 460710 - RNA, 21 nt, Human
ggcugcaguucuacucaggcu

SEQ ID NO: 460711 - RNA, 32 nt, Human
ggcugcaguucuggacgggcuggccgagcugc

SEQ ID NO: 460712 - RNA, 22 nt, Human
ggcugcaguugcaccuccggcc

SEQ ID NO: 460713 - RNA, 24 nt, Human
ggcugcaguuuugcuaucugggcu

SEQ ID NO: 460714 - RNA, 32 nt, Human
ggcugcauccugcaaagccacaggggaagagc

SEQ ID NO: 460715 - RNA, 32 nt, Human
ggcugcaucugaaucggaaguuuagcggugag

SEQ ID NO: 460716 - RNA, 32 nt, Human
ggcugcaucuguggggcccugggagagacuca

SEQ ID NO: 460717 - RNA, 32 nt, Human
ggcugcaucuuaagacuucuugucccauuagu

SEQ ID NO: 460718 - RNA, 24 nt, Human
ggcugcaugaggacagcccugugg

SEQ ID NO: 460719 - RNA, 18 nt, Human
ggcugcaugcaggggagg

SEQ ID NO: 460720 - RNA, 25 nt, Human
ggcugcaugccccacagcccugugg

SEQ ID NO: 460721 - RNA, 32 nt, Human
ggcugcaugcucugcuuggccuugccaugccg

SEQ ID NO: 460722 - RNA, 32 nt, Human
ggcugcauggaggacgacgcaccccacaagag

SEQ ID NO: 460723 - RNA, 32 nt, Human
ggcugcaugggagagccagggaggggaguuuc

SEQ ID NO: 460724 - RNA, 21 nt, Human
ggcugcaugugccacuugguc

SEQ ID NO: 460725 - RNA, 32 nt, Human
ggcugcauucccagacaggccaugcucucgug

SEQ ID NO: 460726 - RNA, 32 nt, Human
ggcugccaacacccugcacuccugcuugcgcc

SEQ ID NO: 460727 - RNA, 32 nt, Human
ggcugccaaccugauccugccugggcaacccu

SEQ ID NO: 460728 - RNA, 32 nt, Human
ggcugccaagaguccaagccaucuggcccaac

SEQ ID NO: 460729 - RNA, 32 nt, Human
ggcugccacagcuggacccagccuuguucuca

SEQ ID NO: 460730 - RNA, 32 nt, Human
ggcugccaccagcgaaugaaacuuuuguauga

SEQ ID NO: 460731 - RNA, 32 nt, Human
ggcugccacccucccuccugccugugucccag

SEQ ID NO: 460732 - RNA, 32 nt, Human
ggcugccacugcacuuagcacuuucaggcucc

SEQ ID NO: 460733 - RNA, 32 nt, Human
ggcugccagacagcugcccuggcguugccguc

SEQ ID NO: 460734 - RNA, 32 nt, Human
ggcugccagacgucacuccacccgccagggag

SEQ ID NO: 460735 - RNA, 17 nt, Human
ggcugccagcagcgggc

SEQ ID NO: 460736 - RNA, 32 nt, Human
ggcugccagcagcugcugcaccugugugucca

SEQ ID NO: 460737 - RNA, 32 nt, Human
ggcugccagcguccuuguagcagagcaguuuc

SEQ ID NO: 460738 - RNA, 21 nt, Human
ggcugccagcuaaggucccuu

SEQ ID NO: 460739 - RNA, 32 nt, Human
ggcugccagcuggaaccugaguugucagcuca

SEQ ID NO: 460740 - RNA, 20 nt, Human
ggcugccagcuguuuuacca

SEQ ID NO: 460741 - RNA, 32 nt, Human
ggcugccaggaagcagagaugcagaccccaag

SEQ ID NO: 460742 - RNA, 32 nt, Human
ggcugccaggacgcgagccacugaggagccgc

SEQ ID NO: 460743 - RNA, 32 nt, Human
ggcugccaggccccaaauugaggaaguugacu

SEQ ID NO: 460744 - RNA, 32 nt, Human
ggcugccaggccugcugcuccugccgagaagc

SEQ ID NO: 460745 - RNA, 32 nt, Human
ggcugccagggaccucacuuucccagggccuc

SEQ ID NO: 460746 - RNA, 32 nt, Human
ggcugccagggaccuucagcucccagaggcag

SEQ ID NO: 460747 - RNA, 32 nt, Human
ggcugccagggacugcucacucugcagagcca

SEQ ID NO: 460748 - RNA, 32 nt, Human
ggcugccagguaaguucuucaaagaggcucuc

SEQ ID NO: 460749 - RNA, 31 nt, Human
ggcugccauaggugaaucacagcagaggccu

SEQ ID NO: 460750 - RNA, 32 nt, Human
ggcugccaucccucggggcccaggcccucacc

SEQ ID NO: 460751 - RNA, 32 nt, Human
ggcugccauggaggaggaagaggaggcgauag

SEQ ID NO: 460752 - RNA, 32 nt, Human
ggcugccauggucuccuugccugcuccaaggc

SEQ ID NO: 460753 - RNA, 32 nt, Human
ggcugccaugguuauucuguuuggaaaacacu

SEQ ID NO: 460754 - RNA, 32 nt, Human
ggcugccauuggaggcuguuaucugugaagaa

SEQ ID NO: 460755 - RNA, 32 nt, Human
ggcugccauuuccagcaugcaggugacuucca

SEQ ID NO: 460756 - RNA, 22 nt, Human
ggcugcccaaaccaccacugcu

SEQ ID NO: 460757 - RNA, 32 nt, Human
ggcugcccaaagcagaacuacuccuucaauga

SEQ ID NO: 460758 - RNA, 32 nt, Human
ggcugcccaaagugcugggauuacaggcaaga

SEQ ID NO: 460759 - RNA, 32 nt, Human
ggcugcccaaccagcuccaacacugcuggagg

SEQ ID NO: 460760 - RNA, 32 nt, Human
ggcugcccaacuguguggaggcugagugauug

SEQ ID NO: 460761 - RNA, 32 nt, Human
ggcugcccacaagaccaugagccacccuguga

SEQ ID NO: 460762 - RNA, 32 nt, Human
ggcugcccagaacccugccaaccaaggcacgg

SEQ ID NO: 460763 - RNA, 32 nt, Human
ggcugcccagagagguggagucgguagcgggg

SEQ ID NO: 460764 - RNA, 32 nt, Human
ggcugcccagcccuggcaccugcuucacacgg

SEQ ID NO: 460765 - RNA, 21 nt, Human
ggcugcccaggaggccuugga

SEQ ID NO: 460766 - RNA, 19 nt, Human
ggcugcccaggcccugccu

SEQ ID NO: 460767 - RNA, 23 nt, Human
ggcugcccagugcccacccccgg

SEQ ID NO: 460768 - RNA, 32 nt, Human
ggcugccccagcccugggggucgugggcagcu

SEQ ID NO: 460769 - RNA, 23 nt, Human
ggcugccccagcuacgcugggag

SEQ ID NO: 460770 - RNA, 28 nt, Human
ggcugccccagugcugccacagucccac

SEQ ID NO: 460771 - RNA, 32 nt, Human
ggcugccccagugcugccacagucccacuucu

SEQ ID NO: 460772 - RNA, 28 nt, Human
ggcugccccagugcugccacagucccau

SEQ ID NO: 460773 - RNA, 32 nt, Human
ggcugccccagugcugccacagucccauuucu

SEQ ID NO: 460774 - RNA, 32 nt, Human
ggcugccccuccucccugggccugcuggggcc

SEQ ID NO: 460775 - RNA, 32 nt, Human
ggcugccccucggcgggcgccccgccauguac

SEQ ID NO: 460776 - RNA, 32 nt, Human
ggcugccccugaccuucuggccagagagacau

SEQ ID NO: 460777 - RNA, 32 nt, Human
ggcugccccugccacuccccugguaaugcaua

SEQ ID NO: 460778 - RNA, 32 nt, Human
ggcugccccugcccuggcugagcucauggugu

SEQ ID NO: 460779 - RNA, 32 nt, Human
ggcugccccugccucccaucacagacagcaga

SEQ ID NO: 460780 - RNA, 32 nt, Human
ggcugccccuggcuucuuccucccuuucccgc

SEQ ID NO: 460781 - RNA, 32 nt, Human
ggcugcccgccgccccuccacccauccagugg

SEQ ID NO: 460782 - RNA, 20 nt, Human
ggcugcccgccucccugcca

SEQ ID NO: 460783 - RNA, 21 nt, Human
ggcugcccgcggcacggcggg

SEQ ID NO: 460784 - RNA, 32 nt, Human
ggcugcccgcucccagugucuuccuguggggg

SEQ ID NO: 460785 - RNA, 23 nt, Human
ggcugcccggccgggcgugcggg

SEQ ID NO: 460786 - RNA, 19 nt, Human
ggcugcccuagccaaucca

SEQ ID NO: 460787 - RNA, 32 nt, Human
ggcugcccucaccugucccccuugccugugaa

SEQ ID NO: 460788 - RNA, 32 nt, Human
ggcugcccuccacccucacccuccacccuuug

SEQ ID NO: 460789 - RNA, 32 nt, Human
ggcugcccuccagaaagccgggguaggaacuc

SEQ ID NO: 460790 - RNA, 32 nt, Human
ggcugcccuccccucacaguuccugcaccuca

SEQ ID NO: 460791 - RNA, 22 nt, Human
ggcugcccucgccgccaagguc

SEQ ID NO: 460792 - RNA, 17 nt, Human
ggcugcccucugcugcc

SEQ ID NO: 460793 - RNA, 32 nt, Human
ggcugcccugacucaaccccagccuggggcuu

SEQ ID NO: 460794 - RNA, 32 nt, Human
ggcugcccugcagaggccaggucugcccagca

SEQ ID NO: 460795 - RNA, 24 nt, Human
ggcugcccugcccauacugugcag

SEQ ID NO: 460796 - RNA, 32 nt, Human
ggcugcccugcucacucucauugucuggccuc

SEQ ID NO: 460797 - RNA, 31 nt, Human
ggcugcccugcuugugggccuguguggcaca

SEQ ID NO: 460798 - RNA, 32 nt, Human
ggcugcccuggaacugggagacagggagaauc

SEQ ID NO: 460799 - RNA, 28 nt, Human
ggcugcccuggugcugccacacuucagg

SEQ ID NO: 460800 - RNA, 32 nt, Human
ggcugccgcaccuguccagacacacauguucu

SEQ ID NO: 460801 - RNA, 32 nt, Human
ggcugccgcaucugccuggagccugggcagca

SEQ ID NO: 460802 - RNA, 32 nt, Human
ggcugccgccaucucggcuucuucccaccagc

SEQ ID NO: 460803 - RNA, 32 nt, Human
ggcugccgccgcaccagccucaguggcagaug

SEQ ID NO: 460804 - RNA, 32 nt, Human
ggcugccgcgcagacccagcugcguccugcgc

SEQ ID NO: 460805 - RNA, 23 nt, Human
ggcugccgcucggcgccgcgguc

SEQ ID NO: 460806 - RNA, 22 nt, Human
ggcugccggacaccuggucaca

SEQ ID NO: 460807 - RNA, 32 nt, Human
ggcugccggacaccuggucacagggagccacg

SEQ ID NO: 460808 - RNA, 32 nt, Human
ggcugccggagggcgggaggcaggagcgggcc

SEQ ID NO: 460809 - RNA, 22 nt, Human
ggcugccgugcccaccacggcu

SEQ ID NO: 460810 - RNA, 20 nt, Human
ggcugccuaaggaggaguuu

SEQ ID NO: 460811 - RNA, 32 nt, Human
ggcugccucagaccacacagggugcagcuccu

SEQ ID NO: 460812 - RNA, 32 nt, Human
ggcugccucauauagcacuuuugaagaggccu

SEQ ID NO: 460813 - RNA, 32 nt, Human
ggcugccucauugccaccuccaccugcaggaa

SEQ ID NO: 460814 - RNA, 32 nt, Human
ggcugccuccagauaauccuggcuccaggcca

SEQ ID NO: 460815 - RNA, 31 nt, Human
ggcugccuccagcccgggccugugucuugga

SEQ ID NO: 460816 - RNA, 32 nt, Human
ggcugccuccagccugcacgcuggcuggcucg

SEQ ID NO: 460817 - RNA, 23 nt, Human
ggcugccuccgggagcacuugag

SEQ ID NO: 460818 - RNA, 19 nt, Human
ggcugccucgcaggggcug

SEQ ID NO: 460819 - RNA, 32 nt, Human
ggcugccucugaagaggaguugcuugauuuua

SEQ ID NO: 460820 - RNA, 32 nt, Human
ggcugccucugagugugguguugaacuucggg

SEQ ID NO: 460821 - RNA, 17 nt, Human
ggcugccucugggucca

SEQ ID NO: 460822 - RNA, 25 nt, Human
ggcugccugcauucauuccacgguc

SEQ ID NO: 460823 - RNA, 19 nt, Human
ggcugccugcccugggcca

SEQ ID NO: 460824 - RNA, 32 nt, Human
ggcugccugccugccagccucaguuuauuucc

SEQ ID NO: 460825 - RNA, 32 nt, Human
ggcugccugccugccgggcccagcucagcgcc

SEQ ID NO: 460826 - RNA, 32 nt, Human
ggcugccugccugccugccugccucaguuuau

SEQ ID NO: 460827 - RNA, 32 nt, Human
ggcugccugccugggccagccuguuugggagc

SEQ ID NO: 460828 - RNA, 22 nt, Human
ggcugccugcugugcacuuggg

SEQ ID NO: 460829 - RNA, 20 nt, Human
ggcugccuggaggaggcggc

SEQ ID NO: 460830 - RNA, 32 nt, Human
ggcugccuggccuaucccuccuggcucagugc

SEQ ID NO: 460831 - RNA, 17 nt, Human
ggcugccuguaauccca

SEQ ID NO: 460832 - RNA, 19 nt, Human
ggcugccuguaaucccagc

SEQ ID NO: 460833 - RNA, 32 nt, Human
ggcugccuguaaucccagcacuuugggaggcu

SEQ ID NO: 460834 - RNA, 32 nt, Human
ggcugccuguaaucccagcuacuccagaagcu

SEQ ID NO: 460835 - RNA, 17 nt, Human
ggcugccuguaguccca

SEQ ID NO: 460836 - RNA, 20 nt, Human
ggcugccuguagucccagcu

SEQ ID NO: 460837 - RNA, 32 nt, Human
ggcugccuguagucccagcuacucagaaggcc

SEQ ID NO: 460838 - RNA, 23 nt, Human
ggcugccugucaccacuguggcc

SEQ ID NO: 460839 - RNA, 32 nt, Human
ggcugccugugcuuuugcucauggccuugaca

SEQ ID NO: 460840 - RNA, 32 nt, Human
ggcugccuguggagaacuggugugaggaggaa

SEQ ID NO: 460841 - RNA, 32 nt, Human
ggcugccuguucccaacucuuucacucuguaa

SEQ ID NO: 460842 - RNA, 18 nt, Human
ggcugccuguuuuacuca

SEQ ID NO: 460843 - RNA, 32 nt, Human
ggcugccuuccccucagccucuccccacacca

SEQ ID NO: 460844 - RNA, 20 nt, Human
ggcugccuuccucuuauuua

SEQ ID NO: 460845 - RNA, 32 nt, Human
ggcugccuuccucuuauuuauuuggggacauu

SEQ ID NO: 460846 - RNA, 18 nt, Human
ggcugccuucugcauuua

SEQ ID NO: 460847 - RNA, 32 nt, Human
ggcugccuugcacaggcccuucccagggcgcu

SEQ ID NO: 460848 - RNA, 32 nt, Human
ggcugcgaauagcguguuccucuccggcggaa

SEQ ID NO: 460849 - RNA, 32 nt, Human
ggcugcgacaccccaaccccagcccucuaauc

SEQ ID NO: 460850 - RNA, 32 nt, Human
ggcugcgacauguagaagcauuggcuuaaggu

SEQ ID NO: 460851 - RNA, 32 nt, Human
ggcugcgacuaggagcagggcugccucuucuc

SEQ ID NO: 460852 - RNA, 32 nt, Human
ggcugcgagaggagggcgggcgggaggcuagc

SEQ ID NO: 460853 - RNA, 32 nt, Human
ggcugcgaggcuggggaagggguuggaggggg

SEQ ID NO: 460854 - RNA, 32 nt, Human
ggcugcgaugagccaugaaugccccacugcac

SEQ ID NO: 460855 - RNA, 32 nt, Human
ggcugcgauggcggaggccguggagcgcacug

SEQ ID NO: 460856 - RNA, 32 nt, Human
ggcugcgcagcgggcuggccgggggucuccug

SEQ ID NO: 460857 - RNA, 32 nt, Human
ggcugcgcaggguggagggaguggccagcggc

SEQ ID NO: 460858 - RNA, 32 nt, Human
ggcugcgcagugaagaaaaugaguagcagcuc

SEQ ID NO: 460859 - RNA, 22 nt, Human
ggcugcgcccucccccgcggcc

SEQ ID NO: 460860 - RNA, 17 nt, Human
ggcugcgcccugggucc

SEQ ID NO: 460861 - RNA, 23 nt, Human
ggcugcgccgccaggccccaaca

SEQ ID NO: 460862 - RNA, 32 nt, Human
ggcugcgccucuccugacuccagcuugcccgu

SEQ ID NO: 460863 - RNA, 21 nt, Human
ggcugcgcgacggcgcagggg

SEQ ID NO: 460864 - RNA, 32 nt, Human
ggcugcgcgaggcagagaucgaagccguggag

SEQ ID NO: 460865 - RNA, 32 nt, Human
ggcugcgcgcccggaagagcuggagagaugaa

SEQ ID NO: 460866 - RNA, 32 nt, Human
ggcugcgcgccgggaaccucgcggggcuggcg

SEQ ID NO: 460867 - RNA, 21 nt, Human
ggcugcgcgcgggugcggggc

SEQ ID NO: 460868 - RNA, 23 nt, Human
ggcugcgcggccgccgcugugcu

SEQ ID NO: 460869 - RNA, 32 nt, Human
ggcugcgcugggugcugaggccacugcuguca

SEQ ID NO: 460870 - RNA, 32 nt, Human
ggcugcgcuucucaaugaacucugaggcagaa

SEQ ID NO: 460871 - RNA, 23 nt, Human
ggcugcgcuuucucagcccuggg

SEQ ID NO: 460872 - RNA, 32 nt, Human
ggcugcggaacggguguggauuugaaugugga

SEQ ID NO: 460873 - RNA, 32 nt, Human
ggcugcggacacacuggcggagggcuugaggc

SEQ ID NO: 460874 - RNA, 32 nt, Human
ggcugcggacacagcaggcccccuacagccuc

SEQ ID NO: 460875 - RNA, 32 nt, Human
ggcugcggagaggcgggccgggccaagcggag

SEQ ID NO: 460876 - RNA, 32 nt, Human
ggcugcggaggaacccucauuuccucaaaagu

SEQ ID NO: 460877 - RNA, 32 nt, Human
ggcugcggagugaacgcggccaggagcccgcc

SEQ ID NO: 460878 - RNA, 21 nt, Human
ggcugcggcagcaccagggcc

SEQ ID NO: 460879 - RNA, 21 nt, Human
ggcugcggcagggacucggcc

SEQ ID NO: 460880 - RNA, 32 nt, Human
ggcugcggccauggcagcaucuucccugacgg

SEQ ID NO: 460881 - RNA, 22 nt, Human
ggcugcggccccggcuccggcc

SEQ ID NO: 460882 - RNA, 23 nt, Human
ggcugcggcccgccgcccugguc

SEQ ID NO: 460883 - RNA, 21 nt, Human
ggcugcggccuccucgcggcc

SEQ ID NO: 460884 - RNA, 20 nt, Human
ggcugcggcgcugccgcggc

SEQ ID NO: 460885 - RNA, 22 nt, Human
ggcugcggcgcuuugugcucca

SEQ ID NO: 460886 - RNA, 20 nt, Human
ggcugcggcggcggcgcagg

SEQ ID NO: 460887 - RNA, 28 nt, Human
ggcugcggcgggcagaucacuugcgguc

SEQ ID NO: 460888 - RNA, 23 nt, Human
ggcugcggcggucucgcucggcu

SEQ ID NO: 460889 - RNA, 22 nt, Human
ggcugcggcuaagacuggggcc

SEQ ID NO: 460890 - RNA, 22 nt, Human
ggcugcggcuccauccucggcu

SEQ ID NO: 460891 - RNA, 25 nt, Human
ggcugcggcucccgcccccgcggcc

SEQ ID NO: 460892 - RNA, 22 nt, Human
ggcugcggcuccgcucccggcc

SEQ ID NO: 460893 - RNA, 22 nt, Human
ggcugcggcucgaggccacgcc

SEQ ID NO: 460894 - RNA, 23 nt, Human
ggcugcggcuucgcgagagggcc

SEQ ID NO: 460895 - RNA, 20 nt, Human
ggcugcggcuucgggcggcc

SEQ ID NO: 460896 - RNA, 32 nt, Human
ggcugcgggaggcggggguuggcgugccugag

SEQ ID NO: 460897 - RNA, 32 nt, Human
ggcugcgggaggggaggagagcagagaacguc

SEQ ID NO: 460898 - RNA, 32 nt, Human
ggcugcgggcaccugcaauccccgacccccga

SEQ ID NO: 460899 - RNA, 32 nt, Human
ggcugcgggccucugagcaggugcaggcugug

SEQ ID NO: 460900 - RNA, 23 nt, Human
ggcugcggggcacuguguucuca

SEQ ID NO: 460901 - RNA, 23 nt, Human
ggcugcggggcuucccugcggcu

SEQ ID NO: 460902 - RNA, 19 nt, Human
ggcugcggggggcugcacc

SEQ ID NO: 460903 - RNA, 32 nt, Human
ggcugcggugacugcacuuucccuggagugga

SEQ ID NO: 460904 - RNA, 23 nt, Human
ggcugcggugcaggcaccuggcc

SEQ ID NO: 460905 - RNA, 32 nt, Human
ggcugcggugcaggcaccuggccaugcuggcu

SEQ ID NO: 460906 - RNA, 32 nt, Human
ggcugcgguggaggccgaggacagccaggacc

SEQ ID NO: 460907 - RNA, 21 nt, Human
ggcugcgguggccaccgcggc

SEQ ID NO: 460908 - RNA, 32 nt, Human
ggcugcggugucugcugcuacucuccgagcuu

SEQ ID NO: 460909 - RNA, 32 nt, Human
ggcugcgguucugcuuccuccuggggcugagc

SEQ ID NO: 460910 - RNA, 32 nt, Human
ggcugcguaaagggagugggugcgcuugaagg

SEQ ID NO: 460911 - RNA, 31 nt, Human
ggcugcguccuuucugggccuuuucuuuuug

SEQ ID NO: 460912 - RNA, 19 nt, Human
ggcugcgucggaggagcug

SEQ ID NO: 460913 - RNA, 18 nt, Human
ggcugcgucuggaggggc

SEQ ID NO: 460914 - RNA, 32 nt, Human
ggcugcgugaaaaacccagcugggccuggggu

SEQ ID NO: 460915 - RNA, 32 nt, Human
ggcugcgugaccgccccuccuccagucuacug

SEQ ID NO: 460916 - RNA, 16 nt, Human
ggcugcgugcaggugc

SEQ ID NO: 460917 - RNA, 32 nt, Human
ggcugcgugccacaucgcuacgcccaggaggu

SEQ ID NO: 460918 - RNA, 19 nt, Human
ggcugcguguuuuucauuu

SEQ ID NO: 460919 - RNA, 32 nt, Human
ggcugcuaaaggacaguggaugcugcugggcc

SEQ ID NO: 460920 - RNA, 32 nt, Human
ggcugcuaaggccugugcuccaaagcaacggg

SEQ ID NO: 460921 - RNA, 32 nt, Human
ggcugcuaauaaacacauacuugagacugggu

SEQ ID NO: 460922 - RNA, 19 nt, Human
ggcugcuaggagccaggua

SEQ ID NO: 460923 - RNA, 32 nt, Human
ggcugcuaggaggcaccgaggcagcggcgggg

SEQ ID NO: 460924 - RNA, 31 nt, Human
ggcugcucaauaaacacuuguugaaccauca

SEQ ID NO: 460925 - RNA, 32 nt, Human
ggcugcucacuggcuuuagcugcugucuuccc

SEQ ID NO: 460926 - RNA, 32 nt, Human
ggcugcucagcagccacuggguggauccaggg

SEQ ID NO: 460927 - RNA, 24 nt, Human
ggcugcucagcgcgcuccgcgguc

SEQ ID NO: 460928 - RNA, 32 nt, Human
ggcugcucagcgguuauaacaggccugacugc

SEQ ID NO: 460929 - RNA, 32 nt, Human
ggcugcucagugcuuugguagcacaaggugac

SEQ ID NO: 460930 - RNA, 32 nt, Human
ggcugcuccaccuccagcacggagaacauagc

SEQ ID NO: 460931 - RNA, 32 nt, Human
ggcugcuccagccccacuucuuagcauucuua

SEQ ID NO: 460932 - RNA, 32 nt, Human
ggcugcuccagccugcaacuuaguggaaggaa

SEQ ID NO: 460933 - RNA, 32 nt, Human
ggcugcuccaggaguaaggagcccagucuuug

SEQ ID NO: 460934 - RNA, 32 nt, Human
ggcugcuccaguucauggccucccaggggugc

SEQ ID NO: 460935 - RNA, 32 nt, Human
ggcugcuccaugagcccuuuguggaccacaug

SEQ ID NO: 460936 - RNA, 23 nt, Human
ggcugcucccacaccugcgccag

SEQ ID NO: 460937 - RNA, 32 nt, Human
ggcugcucccagagguggggaacccuucauag

SEQ ID NO: 460938 - RNA, 22 nt, Human
ggcugcuccccaggacuaugag

SEQ ID NO: 460939 - RNA, 32 nt, Human
ggcugcuccccuuuuagaauuuaccucuuaug

SEQ ID NO: 460940 - RNA, 32 nt, Human
ggcugcucccuugcuggggcucagcuggaguc

SEQ ID NO: 460941 - RNA, 22 nt, Human
ggcugcucgaacagauugcgag

SEQ ID NO: 460942 - RNA, 32 nt, Human
ggcugcucgcgccuccccaacucggguaaagc

SEQ ID NO: 460943 - RNA, 23 nt, Human
ggcugcucgcgcgcaccugcggg

SEQ ID NO: 460944 - RNA, 32 nt, Human
ggcugcucgcgcucgggcaggcgggcugagga

SEQ ID NO: 460945 - RNA, 32 nt, Human
ggcugcucucaaacuccugaccucaggugauc

SEQ ID NO: 460946 - RNA, 32 nt, Human
ggcugcucucagaacuccugagcucaggcagu

SEQ ID NO: 460947 - RNA, 32 nt, Human
ggcugcucucaugccaggaagggagcuuccau

SEQ ID NO: 460948 - RNA, 32 nt, Human
ggcugcucuccuggugcagccugugggcucuu

SEQ ID NO: 460949 - RNA, 32 nt, Human
ggcugcucucgaacuccugaccucaggugauc

SEQ ID NO: 460950 - RNA, 32 nt, Human
ggcugcucucgaacuccugaccucaugauccg

SEQ ID NO: 460951 - RNA, 32 nt, Human
ggcugcucugacaccauggggagcugcugcag

SEQ ID NO: 460952 - RNA, 19 nt, Human
ggcugcucugcacccggac

SEQ ID NO: 460953 - RNA, 32 nt, Human
ggcugcucugcagauucuaguuuggcuuucag

SEQ ID NO: 460954 - RNA, 21 nt, Human
ggcugcucugccauacgcggg

SEQ ID NO: 460955 - RNA, 21 nt, Human
ggcugcucugcggacugcgag

SEQ ID NO: 460956 - RNA, 32 nt, Human
ggcugcucuuccagacuggcugugccugccug

SEQ ID NO: 460957 - RNA, 32 nt, Human
ggcugcucuuccuggcaggccugggccaucag

SEQ ID NO: 460958 - RNA, 32 nt, Human
ggcugcucuugaacuccugaccucagguaauc

SEQ ID NO: 460959 - RNA, 32 nt, Human
ggcugcucuugaacuccugaccucaggugauc

SEQ ID NO: 460960 - RNA, 22 nt, Human
ggcugcucuuggggacugcgag

SEQ ID NO: 460961 - RNA, 32 nt, Human
ggcugcugacugacuccagccaaggugcaaag

SEQ ID NO: 460962 - RNA, 32 nt, Human
ggcugcugaggcaggcgaauugcuugaaccug

SEQ ID NO: 460963 - RNA, 32 nt, Human
ggcugcugagggcagaggaugcaacacuagaa

SEQ ID NO: 460964 - RNA, 32 nt, Human
ggcugcugcaccugaacagagucaucaugccu

SEQ ID NO: 460965 - RNA, 32 nt, Human
ggcugcugcacguuugggcuugaauaaagaag

SEQ ID NO: 460966 - RNA, 32 nt, Human
ggcugcugcaggaggccccugggaagcugagc

SEQ ID NO: 460967 - RNA, 32 nt, Human
ggcugcugcagucucuucccagccuggcccug

SEQ ID NO: 460968 - RNA, 32 nt, Human
ggcugcugcauggcacugaccgccgcuuccag

SEQ ID NO: 460969 - RNA, 22 nt, Human
ggcugcugccaccaccgccgcu

SEQ ID NO: 460970 - RNA, 19 nt, Human
ggcugcugcccccuccuug

SEQ ID NO: 460971 - RNA, 32 nt, Human
ggcugcugccccgucucccaccccuguccccg

SEQ ID NO: 460972 - RNA, 32 nt, Human
ggcugcugcccuucucugggcauguucugaau

SEQ ID NO: 460973 - RNA, 22 nt, Human
ggcugcugccgccgccgccgcc

SEQ ID NO: 460974 - RNA, 32 nt, Human
ggcugcugccgcugccuccuccuggguaaggg

SEQ ID NO: 460975 - RNA, 32 nt, Human
ggcugcugccuaacugagccucccggggaaca

SEQ ID NO: 460976 - RNA, 32 nt, Human
ggcugcugccuuccuguccucuggagagaacc

SEQ ID NO: 460977 - RNA, 20 nt, Human
ggcugcugccuugggcccgg

SEQ ID NO: 460978 - RNA, 23 nt, Human
ggcugcugcgcccccuccugcca

SEQ ID NO: 460979 - RNA, 32 nt, Human
ggcugcugcuacaauguccuaacugaaagaug

SEQ ID NO: 460980 - RNA, 19 nt, Human
ggcugcugcuccugcugcc

SEQ ID NO: 460981 - RNA, 22 nt, Human
ggcugcugcugccaccgcugcu

SEQ ID NO: 460982 - RNA, 32 nt, Human
ggcugcugcugcugcugacgcugcugcugccc

SEQ ID NO: 460983 - RNA, 18 nt, Human
ggcugcugcuggguccag

SEQ ID NO: 460984 - RNA, 22 nt, Human
ggcugcugcugugcagucccug

SEQ ID NO: 460985 - RNA, 32 nt, Human
ggcugcuggaagaaggaagaagccagacuggu

SEQ ID NO: 460986 - RNA, 19 nt, Human
ggcugcuggaaggcagcuu

SEQ ID NO: 460987 - RNA, 32 nt, Human
ggcugcuggacaagggguaggagcugcuggaa

SEQ ID NO: 460988 - RNA, 32 nt, Human
ggcugcuggacuugaggcagagccugcagcag

SEQ ID NO: 460989 - RNA, 22 nt, Human
ggcugcuggagccauucauuca

SEQ ID NO: 460990 - RNA, 19 nt, Human
ggcugcuggagcccagagg

SEQ ID NO: 460991 - RNA, 32 nt, Human
ggcugcuggagugcaguggcacaaucucggcc

SEQ ID NO: 460992 - RNA, 32 nt, Human
ggcugcuggaucagggcagccggggagguggc

SEQ ID NO: 460993 - RNA, 32 nt, Human
ggcugcuggcaggccagcuugaagauauaggg

SEQ ID NO: 460994 - RNA, 32 nt, Human
ggcugcuggccggauucuuguuacucugggga

SEQ ID NO: 460995 - RNA, 32 nt, Human
ggcugcuggccuggcccuugaguggggcagcc

SEQ ID NO: 460996 - RNA, 32 nt, Human
ggcugcugggagagcccaugggaaccuugcuu

SEQ ID NO: 460997 - RNA, 32 nt, Human
ggcugcugggagagggcuguggaggaaggagc

SEQ ID NO: 460998 - RNA, 32 nt, Human
ggcugcugggaggugcgggacuggguguggcc

SEQ ID NO: 460999 - RNA, 21 nt, Human
ggcugcugggccaggacacuu

SEQ ID NO: 461000 - RNA, 32 nt, Human
ggcugcugggcugagugacacaagcacuuuaa

SEQ ID NO: 461001 - RNA, 32 nt, Human
ggcugcuggggccuccacaccugccucaucac

SEQ ID NO: 461002 - RNA, 32 nt, Human
ggcugcugggugcacagaugaggggagguggg

SEQ ID NO: 461003 - RNA, 25 nt, Human
ggcugcuggugcgggacacuccggg

SEQ ID NO: 461004 - RNA, 32 nt, Human
ggcugcuguaagccaugauggcagcacggcac

SEQ ID NO: 461005 - RNA, 32 nt, Human
ggcugcuguagugcugggugaaugugggcagu

SEQ ID NO: 461006 - RNA, 20 nt, Human
ggcugcuguauuuucauuua

SEQ ID NO: 461007 - RNA, 23 nt, Human
ggcugcuguccaccaggcagcug

SEQ ID NO: 461008 - RNA, 32 nt, Human
ggcugcugugggcuccuggggagguggcccuc

SEQ ID NO: 461009 - RNA, 25 nt, Human
ggcugcuuacucaacuugugucuua

SEQ ID NO: 461010 - RNA, 18 nt, Human
ggcugcuuacuucccuua

SEQ ID NO: 461011 - RNA, 32 nt, Human
ggcugcuuagagucagccuggguggcaccagg

SEQ ID NO: 461012 - RNA, 22 nt, Human
ggcugcuuaugccuuucguuua

SEQ ID NO: 461013 - RNA, 32 nt, Human
ggcugcuuccucugcugacuucuguccuuuuu

SEQ ID NO: 461014 - RNA, 32 nt, Human
ggcugcuucucacauccugggcuggauguggg

SEQ ID NO: 461015 - RNA, 18 nt, Human
ggcugcuucuccucuuca

SEQ ID NO: 461016 - RNA, 32 nt, Human
ggcugcuucugagcuucagccugggagcaagc

SEQ ID NO: 461017 - RNA, 32 nt, Human
ggcugcuucuggacucaaggaggaggagagag

SEQ ID NO: 461018 - RNA, 32 nt, Human
ggcugcuucuucaagcaaaccaccucaccaca

SEQ ID NO: 461019 - RNA, 18 nt, Human
ggcugcuucuuuggccca

SEQ ID NO: 461020 - RNA, 32 nt, Human
ggcugcuugagauugguucugcucuuuucuuc

SEQ ID NO: 461021 - RNA, 18 nt, Human
ggcugcuugauuauguca

SEQ ID NO: 461022 - RNA, 32 nt, Human
ggcugcuuggugucaaccauucuggcucuucu

SEQ ID NO: 461023 - RNA, 20 nt, Human
ggcugcuuucuccuuuacuu

SEQ ID NO: 461024 - RNA, 31 nt, Human
ggcugcuuucucucugggcuguuuucuuacu

SEQ ID NO: 461025 - RNA, 21 nt, Human
ggcugcuuugugguuuuauuu

SEQ ID NO: 461026 - RNA, 32 nt, Human
ggcugcuuuugcucgcuuuggccagagagcug

SEQ ID NO: 461027 - RNA, 18 nt, Human
ggcuggaaaaggaguggg

SEQ ID NO: 461028 - RNA, 19 nt, Human
ggcuggaaaagggagugug

SEQ ID NO: 461029 - RNA, 32 nt, Human
ggcuggaaaauguaugaauucuucaacugucu

SEQ ID NO: 461030 - RNA, 32 nt, Human
ggcuggaaagaauggacuggcagagugugggc

SEQ ID NO: 461031 - RNA, 32 nt, Human
ggcuggaaaugcaaagacacauuuuucuauaa

SEQ ID NO: 461032 - RNA, 32 nt, Human
ggcuggaacaugggaucuccucuuccaccucu

SEQ ID NO: 461033 - RNA, 32 nt, Human
ggcuggaaccacaggcacgugccaccaugccu

SEQ ID NO: 461034 - RNA, 32 nt, Human
ggcuggaaccacugcgccgccuggagguggca

SEQ ID NO: 461035 - RNA, 32 nt, Human
ggcuggaacccaagccccuuccuccacagcug

SEQ ID NO: 461036 - RNA, 32 nt, Human
ggcuggaacucucucccuuucucccuccaucc

SEQ ID NO: 461037 - RNA, 32 nt, Human
ggcuggaacugacccaggcuggacuugcgggg

SEQ ID NO: 461038 - RNA, 32 nt, Human
ggcuggaagaugaaggcaggaggcagcagcuc

SEQ ID NO: 461039 - RNA, 32 nt, Human
ggcuggaagcauauuccccaagagcacugccc

SEQ ID NO: 461040 - RNA, 32 nt, Human
ggcuggaagcuugggcuugcaaguggauccgg

SEQ ID NO: 461041 - RNA, 32 nt, Human
ggcuggaaggcagagccuggggagggcacccg

SEQ ID NO: 461042 - RNA, 17 nt, Human
ggcuggaaggggacggu

SEQ ID NO: 461043 - RNA, 32 nt, Human
ggcuggaauaagaggacacuagaugauauuac

SEQ ID NO: 461044 - RNA, 32 nt, Human
ggcuggaaucauuuucuuucucucugccaggg

SEQ ID NO: 461045 - RNA, 32 nt, Human
ggcuggaaugaugggccaggguguaggauuca

SEQ ID NO: 461046 - RNA, 32 nt, Human
ggcuggacacaauccugaagcaugcagauucc

SEQ ID NO: 461047 - RNA, 32 nt, Human
ggcuggacagagggucuccaggcccuucugac

SEQ ID NO: 461048 - RNA, 17 nt, Human
ggcuggacagggcgcgg

SEQ ID NO: 461049 - RNA, 21 nt, Human
ggcuggacaugcagacagugg

SEQ ID NO: 461050 - RNA, 32 nt, Human
ggcuggaccagccggccagcgggagcccccuu

SEQ ID NO: 461051 - RNA, 32 nt, Human
ggcuggaccggcuccggcaggcuggcugggag

SEQ ID NO: 461052 - RNA, 32 nt, Human
ggcuggacgcugucugagccccggcugugaug

SEQ ID NO: 461053 - RNA, 32 nt, Human
ggcuggacggggacgaggcgcggagaggaggc

SEQ ID NO: 461054 - RNA, 32 nt, Human
ggcuggacgguggaggaccugcuggggucucc

SEQ ID NO: 461055 - RNA, 32 nt, Human
ggcuggacucaaugcaaccuucucccacgagc

SEQ ID NO: 461056 - RNA, 32 nt, Human
ggcuggacuuaucuugugauuuggggccaugg

SEQ ID NO: 461057 - RNA, 32 nt, Human
ggcuggagaacagcguccacgcaguccugccu

SEQ ID NO: 461058 - RNA, 32 nt, Human
ggcuggagaagaaggugccagcuguagccuau

SEQ ID NO: 461059 - RNA, 32 nt, Human
ggcuggagaagaccgggaaaaagggaguacug

SEQ ID NO: 461060 - RNA, 32 nt, Human
ggcuggagaaggacaugagaucagggccugcc

SEQ ID NO: 461061 - RNA, 32 nt, Human
ggcuggagaaucgcuugaggcuagugagcugu

SEQ ID NO: 461062 - RNA, 20 nt, Human
ggcuggagaauugcuugaac

SEQ ID NO: 461063 - RNA, 32 nt, Human
ggcuggagaauugcuugaggcuagugagcugu

SEQ ID NO: 461064 - RNA, 32 nt, Human
ggcuggagacacacagccacaauuacgaagag

SEQ ID NO: 461065 - RNA, 32 nt, Human
ggcuggagacaggcaccauugccauggggcug

SEQ ID NO: 461066 - RNA, 32 nt, Human
ggcuggagagaagcagaucugugcaacgugca

SEQ ID NO: 461067 - RNA, 32 nt, Human
ggcuggagagagaagcgaugguuuugccagag

SEQ ID NO: 461068 - RNA, 32 nt, Human
ggcuggagagagaggaccaucccaggcugcag

SEQ ID NO: 461069 - RNA, 32 nt, Human
ggcuggagaggaaggggcaccacccacucaac

SEQ ID NO: 461070 - RNA, 32 nt, Human
ggcuggagaggaaggugugggguggaacaggu

SEQ ID NO: 461071 - RNA, 20 nt, Human
ggcuggagaggcagacggug

SEQ ID NO: 461072 - RNA, 32 nt, Human
ggcuggagaggggugcggggcagugaugccca

SEQ ID NO: 461073 - RNA, 32 nt, Human
ggcuggagauccugccugugccccagagucag

SEQ ID NO: 461074 - RNA, 32 nt, Human
ggcuggagcacaccuugggccucagugguuuc

SEQ ID NO: 461075 - RNA, 32 nt, Human
ggcuggagcagcugaggaggaggcaggagaga

SEQ ID NO: 461076 - RNA, 22 nt, Human
ggcuggagccaagauccugccu

SEQ ID NO: 461077 - RNA, 32 nt, Human
ggcuggagccuccugauuggguuucggagucc

SEQ ID NO: 461078 - RNA, 32 nt, Human
ggcuggagcgccguaagagcucugccucccuc

SEQ ID NO: 461079 - RNA, 16 nt, Human
ggcuggagcgcgcggu

SEQ ID NO: 461080 - RNA, 32 nt, Human
ggcuggagcggcugugccagagggucccuaug

SEQ ID NO: 461081 - RNA, 18 nt, Human
ggcuggagcgggcggggu

SEQ ID NO: 461082 - RNA, 21 nt, Human
ggcuggagcguggacgcggug

SEQ ID NO: 461083 - RNA, 32 nt, Human
ggcuggagcuagggugacaucuccagggcaga

SEQ ID NO: 461084 - RNA, 15 nt, Human
ggcuggagcugcagc

SEQ ID NO: 461085 - RNA, 32 nt, Human
ggcuggaggacaaccugaaaugcugagggcag

SEQ ID NO: 461086 - RNA, 18 nt, Human
ggcuggaggagcgcagug

SEQ ID NO: 461087 - RNA, 32 nt, Human
ggcuggaggagggcaacagccacugggugagc

SEQ ID NO: 461088 - RNA, 32 nt, Human
ggcuggaggagucagagugagagccaguggcc

SEQ ID NO: 461089 - RNA, 32 nt, Human
ggcuggaggauuaggagaaggaagagggaacg

SEQ ID NO: 461090 - RNA, 32 nt, Human
ggcuggaggccugggagucacaggugcuugga

SEQ ID NO: 461091 - RNA, 32 nt, Human
ggcuggaggcugcacagacaggaguucaaguu

SEQ ID NO: 461092 - RNA, 32 nt, Human
ggcuggaggcuucucuuucucagucccugccu

SEQ ID NO: 461093 - RNA, 32 nt, Human
ggcuggagggaccagauggaggaggccagcag

SEQ ID NO: 461094 - RNA, 17 nt, Human
ggcuggagggcaggcgg

SEQ ID NO: 461095 - RNA, 17 nt, Human
ggcuggagggcagggug

SEQ ID NO: 461096 - RNA, 32 nt, Human
ggcuggagguccaggccagggugacugggaga

SEQ ID NO: 461097 - RNA, 32 nt, Human
ggcuggagucuaugacuucuuccuucagauug

SEQ ID NO: 461098 - RNA, 21 nt, Human
ggcuggagugagguggaagga

SEQ ID NO: 461099 - RNA, 32 nt, Human
ggcuggagugauuuuuagacauuucucuaccu

SEQ ID NO: 461100 - RNA, 32 nt, Human
ggcuggagugcaaugugcaauggcacaaucuu

SEQ ID NO: 461101 - RNA, 31 nt, Human
ggcuggagugcaguagagugaucucagcuca

SEQ ID NO: 461102 - RNA, 32 nt, Human
ggcuggagugcaguagcaugaucagggaucac

SEQ ID NO: 461103 - RNA, 32 nt, Human
ggcuggagugcagugauccacucaccucagcc

SEQ ID NO: 461104 - RNA, 31 nt, Human
ggcuggagugcaguggagugaucucggcuca

SEQ ID NO: 461105 - RNA, 32 nt, Human
ggcuggagugguagccgggagacucugcacau

SEQ ID NO: 461106 - RNA, 32 nt, Human
ggcuggaguguagugacaugaucucgguucac

SEQ ID NO: 461107 - RNA, 32 nt, Human
ggcuggauccaccaaggcagcucacagcggga

SEQ ID NO: 461108 - RNA, 32 nt, Human
ggcuggauccagacugcagauccagagcugcg

SEQ ID NO: 461109 - RNA, 32 nt, Human
ggcuggauccugcucagccucugccucggcug

SEQ ID NO: 461110 - RNA, 32 nt, Human
ggcuggaucugggggcuagcagugaguacccg

SEQ ID NO: 461111 - RNA, 20 nt, Human
ggcuggaugcagagguggaa

SEQ ID NO: 461112 - RNA, 32 nt, Human
ggcuggaugccaugguaaggaucccgcaaugc

SEQ ID NO: 461113 - RNA, 32 nt, Human
ggcuggauggggaccuggcugaagacaucugg

SEQ ID NO: 461114 - RNA, 23 nt, Human
ggcuggauuaaacacacacuguu

SEQ ID NO: 461115 - RNA, 32 nt, Human
ggcuggauuuucugguuguggaagugggggcg

SEQ ID NO: 461116 - RNA, 32 nt, Human
ggcuggcaaaagagcagugcugaaggaggaga

SEQ ID NO: 461117 - RNA, 32 nt, Human
ggcuggcaacauggcucagcaggcuugcccca

SEQ ID NO: 461118 - RNA, 19 nt, Human
ggcuggcaaccccacccca

SEQ ID NO: 461119 - RNA, 18 nt, Human
ggcuggcaagcucugggc

SEQ ID NO: 461120 - RNA, 32 nt, Human
ggcuggcaauggcugcucucaaucccuugagg

SEQ ID NO: 461121 - RNA, 32 nt, Human
ggcuggcacagccccaggcuuggugaggaaga

SEQ ID NO: 461122 - RNA, 16 nt, Human
ggcuggcacaggugac

SEQ ID NO: 461123 - RNA, 20 nt, Human
ggcuggcaccuauaauccca

SEQ ID NO: 461124 - RNA, 25 nt, Human
ggcuggcaccugggaacgcuauggg

SEQ ID NO: 461125 - RNA, 32 nt, Human
ggcuggcaccuguaaucccagcauuuugggag

SEQ ID NO: 461126 - RNA, 32 nt, Human
ggcuggcaccuugaucuuggacuucccaugcu

SEQ ID NO: 461127 - RNA, 32 nt, Human
ggcuggcaccuugucugcucaucccuaacucc

SEQ ID NO: 461128 - RNA, 32 nt, Human
ggcuggcacugcacccgggcaugaggacacau

SEQ ID NO: 461129 - RNA, 22 nt, Human
ggcuggcagacaccccguggcu

SEQ ID NO: 461130 - RNA, 32 nt, Human
ggcuggcagagcuggagccaguuggggagcac

SEQ ID NO: 461131 - RNA, 32 nt, Human
ggcuggcagaggcgagggagguugcggguagg

SEQ ID NO: 461132 - RNA, 21 nt, Human
ggcuggcagcagaaccagcag

SEQ ID NO: 461133 - RNA, 32 nt, Human
ggcuggcagcugcucuguggaggaccuccagg

SEQ ID NO: 461134 - RNA, 32 nt, Human
ggcuggcagggacuggcaggaggcaggugcag

SEQ ID NO: 461135 - RNA, 32 nt, Human
ggcuggcaguccugccuggugccccaaggggc

SEQ ID NO: 461136 - RNA, 18 nt, Human
ggcuggcaguggcgcggu

SEQ ID NO: 461137 - RNA, 32 nt, Human
ggcuggcaugaauaaauuuuuaucucagcuug

SEQ ID NO: 461138 - RNA, 32 nt, Human
ggcuggcauuggcacugggcugugcugaccua

SEQ ID NO: 461139 - RNA, 32 nt, Human
ggcuggccacagaaagcuguuaaagaaaugag

SEQ ID NO: 461140 - RNA, 32 nt, Human
ggcuggccacucucugccucaguggccucccu

SEQ ID NO: 461141 - RNA, 32 nt, Human
ggcuggccagaggcacucuucacuucccagac

SEQ ID NO: 461142 - RNA, 21 nt, Human
ggcuggccagcccucagcggg

SEQ ID NO: 461143 - RNA, 32 nt, Human
ggcuggcccacaauaccugcucccccgacccc

SEQ ID NO: 461144 - RNA, 32 nt, Human
ggcuggcccagccaacugccccgggugccuca

SEQ ID NO: 461145 - RNA, 32 nt, Human
ggcuggcccagccugugcuccccgggcugcua

SEQ ID NO: 461146 - RNA, 32 nt, Human
ggcuggcccaucucccccagagggcuguccca

SEQ ID NO: 461147 - RNA, 32 nt, Human
ggcuggccccgagcacagacucucccccaagg

SEQ ID NO: 461148 - RNA, 32 nt, Human
ggcuggcccgggaggggagugacagagggacg

SEQ ID NO: 461149 - RNA, 32 nt, Human
ggcuggcccugaggcugcacuguggcagucua

SEQ ID NO: 461150 - RNA, 20 nt, Human
ggcuggcccugcaauggggc

SEQ ID NO: 461151 - RNA, 32 nt, Human
ggcuggccgcccgccugggccgcuggccccgc

SEQ ID NO: 461152 - RNA, 32 nt, Human
ggcuggccgggacugcugcucucccaaggguu

SEQ ID NO: 461153 - RNA, 22 nt, Human
ggcuggccgggcaggcguggug

SEQ ID NO: 461154 - RNA, 32 nt, Human
ggcuggccgggggcaaagucaccucccagugu

SEQ ID NO: 461155 - RNA, 16 nt, Human
ggcuggccgggucugg

SEQ ID NO: 461156 - RNA, 32 nt, Human
ggcuggccucaaacucccgaccucaggugauc

SEQ ID NO: 461157 - RNA, 32 nt, Human
ggcuggccucaaacuccggagcucaagcaguc

SEQ ID NO: 461158 - RNA, 32 nt, Human
ggcuggccucaaacuccugaccucaggugauc

SEQ ID NO: 461159 - RNA, 32 nt, Human
ggcuggccucaaacuccugggcucaagcaauc

SEQ ID NO: 461160 - RNA, 32 nt, Human
ggcuggccucaaacuccugggcucaagugauc

SEQ ID NO: 461161 - RNA, 32 nt, Human
ggcuggccucaaaguccugaccucaggugauc

SEQ ID NO: 461162 - RNA, 32 nt, Human
ggcuggccucaaauuccugggcucaagccauc

SEQ ID NO: 461163 - RNA, 32 nt, Human
ggcuggccucaagugauccuccugccuuggcc

SEQ ID NO: 461164 - RNA, 22 nt, Human
ggcuggccucaccaccaccguc

SEQ ID NO: 461165 - RNA, 32 nt, Human
ggcuggccucagaacccagcauuccuguuauu

SEQ ID NO: 461166 - RNA, 32 nt, Human
ggcuggccucaucugcaccauguccccggacc

SEQ ID NO: 461167 - RNA, 32 nt, Human
ggcuggccucgaacuccugaccccaggugauc

SEQ ID NO: 461168 - RNA, 32 nt, Human
ggcuggccucgaacuccugaccucaggugauc

SEQ ID NO: 461169 - RNA, 32 nt, Human
ggcuggccucuccagaccaguucccaggcugg

SEQ ID NO: 461170 - RNA, 32 nt, Human
ggcuggccucucuggcugggugcagugaaugg

SEQ ID NO: 461171 - RNA, 32 nt, Human
ggcuggccugaggauggcccugccuggcagag

SEQ ID NO: 461172 - RNA, 32 nt, Human
ggcuggccugcaggugucuagggucucagcuu

SEQ ID NO: 461173 - RNA, 32 nt, Human
ggcuggccugcgcagagauuggcugugggccu

SEQ ID NO: 461174 - RNA, 32 nt, Human
ggcuggccuggaccauggugcugcucugggag

SEQ ID NO: 461175 - RNA, 32 nt, Human
ggcuggccuuccuucucuucugagcccucccc

SEQ ID NO: 461176 - RNA, 32 nt, Human
ggcuggccuugaaauccugggcucaggcgauu

SEQ ID NO: 461177 - RNA, 32 nt, Human
ggcuggccuugaacuccugaccucaggugauc

SEQ ID NO: 461178 - RNA, 32 nt, Human
ggcuggccuugaacuccugggcucaagcaauc

SEQ ID NO: 461179 - RNA, 32 nt, Human
ggcuggcgagcuacuguaaacuuuaaagaauu

SEQ ID NO: 461180 - RNA, 32 nt, Human
ggcuggcgccuguaaucccagcuacucaggag

SEQ ID NO: 461181 - RNA, 32 nt, Human
ggcuggcggaggaggagagacggaggaggccg

SEQ ID NO: 461182 - RNA, 17 nt, Human
ggcuggcggaggcccgg

SEQ ID NO: 461183 - RNA, 32 nt, Human
ggcuggcggccggcgggggucgcggcggcggc

SEQ ID NO: 461184 - RNA, 32 nt, Human
ggcuggcgggaggcauggaggcugaguccccu

SEQ ID NO: 461185 - RNA, 32 nt, Human
ggcuggcgggguggguucacagcuggacuggg

SEQ ID NO: 461186 - RNA, 18 nt, Human
ggcuggcgugcagugggc

SEQ ID NO: 461187 - RNA, 23 nt, Human
ggcuggcgugggccauccgggga

SEQ ID NO: 461188 - RNA, 32 nt, Human
ggcuggcucacugucuccaguucucaauggcc

SEQ ID NO: 461189 - RNA, 32 nt, Human
ggcuggcucagaggggcccaccuugcguggaa

SEQ ID NO: 461190 - RNA, 32 nt, Human
ggcuggcucccucuuggucuucccaggcuggg

SEQ ID NO: 461191 - RNA, 32 nt, Human
ggcuggcucugccugcgccucacucucuccug

SEQ ID NO: 461192 - RNA, 32 nt, Human
ggcuggcucugccuucccagggaccguucugc

SEQ ID NO: 461193 - RNA, 32 nt, Human
ggcuggcugagggcaguucgcagccacccuga

SEQ ID NO: 461194 - RNA, 32 nt, Human
ggcuggcugcagagaaaccgcagggagagccu

SEQ ID NO: 461195 - RNA, 32 nt, Human
ggcuggcugcagccucuauuucccaggcucaa

SEQ ID NO: 461196 - RNA, 32 nt, Human
ggcuggcugccucuguuccuacuguacuguaa

SEQ ID NO: 461197 - RNA, 32 nt, Human
ggcuggcugcugagaugaaugugaaccagguu

SEQ ID NO: 461198 - RNA, 32 nt, Human
ggcuggcugcuuggagcgcugccucgaaggga

SEQ ID NO: 461199 - RNA, 32 nt, Human
ggcuggcuggacugagcccaggccuguugccc

SEQ ID NO: 461200 - RNA, 32 nt, Human
ggcuggcugggcagcacgucucuccccacagg

SEQ ID NO: 461201 - RNA, 32 nt, Human
ggcuggcuggguccucugcccucucuggaguu

SEQ ID NO: 461202 - RNA, 31 nt, Human
ggcuggcugucucccaagccuguguuucucu

SEQ ID NO: 461203 - RNA, 32 nt, Human
ggcuggcuucaaacuccuggccucaagugauc

SEQ ID NO: 461204 - RNA, 32 nt, Human
ggcuggcuucucccucccuccugccgaggucu

SEQ ID NO: 461205 - RNA, 32 nt, Human
ggcuggcuugugagggguuaaggcugggaggc

SEQ ID NO: 461206 - RNA, 17 nt, Human
ggcuggcuuuacuaaca

SEQ ID NO: 461207 - RNA, 32 nt, Human
ggcuggcuuugaacuccugaccucaggugauc

SEQ ID NO: 461208 - RNA, 21 nt, Human
ggcuggcuuuguuuuucauuu

SEQ ID NO: 461209 - RNA, 32 nt, Human
ggcugggaaagaaaugugugugucuaaaagca

SEQ ID NO: 461210 - RNA, 32 nt, Human
ggcugggaacugggccagcagagcauguugga

SEQ ID NO: 461211 - RNA, 32 nt, Human
ggcugggaagggcggggcccugccuggggauu

SEQ ID NO: 461212 - RNA, 32 nt, Human
ggcugggaauaccucacccacgcccaguucca

SEQ ID NO: 461213 - RNA, 32 nt, Human
ggcugggaaucaccuuucgaggcccuucagac

SEQ ID NO: 461214 - RNA, 32 nt, Human
ggcugggaauggaggggcagagccaggaagau

SEQ ID NO: 461215 - RNA, 32 nt, Human
ggcugggaauuugccauucugcuguacagaca

SEQ ID NO: 461216 - RNA, 32 nt, Human
ggcugggacaagggaucccccuucccuguggu

SEQ ID NO: 461217 - RNA, 32 nt, Human
ggcugggaccacagaagugcaccaccaugccu

SEQ ID NO: 461218 - RNA, 32 nt, Human
ggcugggaccgcaggugugugccaccauuucu

SEQ ID NO: 461219 - RNA, 32 nt, Human
ggcugggaccuguaaucccagcuacuugggag

SEQ ID NO: 461220 - RNA, 20 nt, Human
ggcugggacggcgggugcgg

SEQ ID NO: 461221 - RNA, 32 nt, Human
ggcugggacuacagauguuugccaccaugccc

SEQ ID NO: 461222 - RNA, 32 nt, Human
ggcugggacuacaggcacccaccaccacgccu

SEQ ID NO: 461223 - RNA, 32 nt, Human
ggcugggacuacaggcgcgugccaccacgcca

SEQ ID NO: 461224 - RNA, 32 nt, Human
ggcugggacuauaggugcaugccaccacaccc

SEQ ID NO: 461225 - RNA, 32 nt, Human
ggcugggacucacucuagcuugcccagcaacu

SEQ ID NO: 461226 - RNA, 32 nt, Human
ggcugggacucgaacuccugaccuugugaucu

SEQ ID NO: 461227 - RNA, 32 nt, Human
ggcugggacugcaggagcaugccaucaugccc

SEQ ID NO: 461228 - RNA, 32 nt, Human
ggcugggacugcaggcaugugccaccacgccu

SEQ ID NO: 461229 - RNA, 32 nt, Human
ggcugggacugcaggugcaugcacuaccaugc

SEQ ID NO: 461230 - RNA, 32 nt, Human
ggcugggacuugguugggcaugcugugguugc

SEQ ID NO: 461231 - RNA, 21 nt, Human
ggcugggacuuuacuccgggu

SEQ ID NO: 461232 - RNA, 32 nt, Human
ggcugggagagggagcagggcggcggcccggg

SEQ ID NO: 461233 - RNA, 32 nt, Human
ggcugggagaggggaacgugggaauagcacag

SEQ ID NO: 461234 - RNA, 32 nt, Human
ggcugggagaggguaccacaggggaguaugau

SEQ ID NO: 461235 - RNA, 32 nt, Human
ggcugggagcagagagggaggggacucuguua

SEQ ID NO: 461236 - RNA, 32 nt, Human
ggcugggagcagauguggaggcugacagccag

SEQ ID NO: 461237 - RNA, 32 nt, Human
ggcugggagcagugcuggaggaucaaggaagc

SEQ ID NO: 461238 - RNA, 32 nt, Human
ggcugggaggagaaggagcccccagcccagcc

SEQ ID NO: 461239 - RNA, 32 nt, Human
ggcugggaggagaagggaggggcuggggguuc

SEQ ID NO: 461240 - RNA, 21 nt, Human
ggcugggaggagggcccaggg

SEQ ID NO: 461241 - RNA, 25 nt, Human
ggcugggaggcagagguugcaguga

SEQ ID NO: 461242 - RNA, 32 nt, Human
ggcugggaggcagagguugcagugagcugaga

SEQ ID NO: 461243 - RNA, 25 nt, Human
ggcugggaggcggagguugcaguga

SEQ ID NO: 461244 - RNA, 32 nt, Human
ggcugggaggcggagguugcagugagcugaga

SEQ ID NO: 461245 - RNA, 32 nt, Human
ggcugggagggaguuggagaccagccuggaug

SEQ ID NO: 461246 - RNA, 32 nt, Human
ggcugggaggggaagugaugaggaucacuucu

SEQ ID NO: 461247 - RNA, 32 nt, Human
ggcugggaggggcgaggucacgcuagcaaccu

SEQ ID NO: 461248 - RNA, 32 nt, Human
ggcugggaggggcugaguguacuugguggagg

SEQ ID NO: 461249 - RNA, 32 nt, Human
ggcugggaggggcugugaggggcuggcaccuc

SEQ ID NO: 461250 - RNA, 32 nt, Human
ggcugggaucauaggugugagccaccucaccc

SEQ ID NO: 461251 - RNA, 32 nt, Human
ggcugggauccugggagccggggcacugauug

SEQ ID NO: 461252 - RNA, 21 nt, Human
ggcugggaucuucucugugaa

SEQ ID NO: 461253 - RNA, 32 nt, Human
ggcugggaugaggcuaauacauucaugcaaua

SEQ ID NO: 461254 - RNA, 32 nt, Human
ggcugggaugaggguggagacaaguagucuug

SEQ ID NO: 461255 - RNA, 32 nt, Human
ggcugggauuacaggcauccgccaccaugccc

SEQ ID NO: 461256 - RNA, 32 nt, Human
ggcugggauuacaggcaugagccacugcaccc

SEQ ID NO: 461257 - RNA, 32 nt, Human
ggcugggauuacaggcaugcaccaccaugccc

SEQ ID NO: 461258 - RNA, 32 nt, Human
ggcugggauuacaggcaugcaccaccugacug

SEQ ID NO: 461259 - RNA, 32 nt, Human
ggcugggauuacaggcaugugccaccacaccc

SEQ ID NO: 461260 - RNA, 32 nt, Human
ggcugggauuacagguaugcaccaccacgccc

SEQ ID NO: 461261 - RNA, 32 nt, Human
ggcugggauuagcggcaugcaccaccacgccc

SEQ ID NO: 461262 - RNA, 32 nt, Human
ggcugggauuauaggcgugcaccaccacgccc

SEQ ID NO: 461263 - RNA, 32 nt, Human
ggcugggauuauaggugugugccaccaugcac

SEQ ID NO: 461264 - RNA, 32 nt, Human
ggcugggauugcaggcacccaccaccacgucc

SEQ ID NO: 461265 - RNA, 32 nt, Human
ggcugggauugcaggcaugagcuaccacgccu

SEQ ID NO: 461266 - RNA, 32 nt, Human
ggcugggauuguaggagugugccaccacgcau

SEQ ID NO: 461267 - RNA, 32 nt, Human
ggcugggcaauauuuucucucaucuaacaaac

SEQ ID NO: 461268 - RNA, 32 nt, Human
ggcugggcaaugacugggagacuugccugggu

SEQ ID NO: 461269 - RNA, 32 nt, Human
ggcugggcacaguggcucaugccugaaauccu

SEQ ID NO: 461270 - RNA, 32 nt, Human
ggcugggcaccguguccuccucugaggaagca

SEQ ID NO: 461271 - RNA, 22 nt, Human
ggcugggcaccuggcuguccca

SEQ ID NO: 461272 - RNA, 18 nt, Human
ggcugggcagaagggcug

SEQ ID NO: 461273 - RNA, 32 nt, Human
ggcugggcagagcagaggggcagcgauagacu

SEQ ID NO: 461274 - RNA, 28 nt, Human
ggcugggcagaggcgccccucaccuccc

SEQ ID NO: 461275 - RNA, 32 nt, Human
ggcugggcagaggcgccccucaccucccggac

SEQ ID NO: 461276 - RNA, 32 nt, Human
ggcugggcagaggggaggaggaagcacaagaa

SEQ ID NO: 461277 - RNA, 32 nt, Human
ggcugggcaggcaggggcuugccucuugcuga

SEQ ID NO: 461278 - RNA, 32 nt, Human
ggcugggcagggcacucucagcagcucaacug

SEQ ID NO: 461279 - RNA, 32 nt, Human
ggcugggcauggacaggaggagggaaaaggga

SEQ ID NO: 461280 - RNA, 32 nt, Human
ggcugggccagccugcugcugucugcuucagg

SEQ ID NO: 461281 - RNA, 32 nt, Human
ggcugggcccaggagcgagccugcagaccggg

SEQ ID NO: 461282 - RNA, 32 nt, Human
ggcugggcccaggaggucagguucauuuuguu

SEQ ID NO: 461283 - RNA, 16 nt, Human
ggcugggccccugggg

SEQ ID NO: 461284 - RNA, 21 nt, Human
ggcugggcccgagggucccaa

SEQ ID NO: 461285 - RNA, 20 nt, Human
ggcugggccggacucggggc

SEQ ID NO: 461286 - RNA, 32 nt, Human
ggcugggccgugagcaggugggccguugaguu

SEQ ID NO: 461287 - RNA, 32 nt, Human
ggcugggccugggacaggcuccuccucucccu

SEQ ID NO: 461288 - RNA, 18 nt, Human
ggcugggcgacagaguga

SEQ ID NO: 461289 - RNA, 32 nt, Human
ggcugggcgagcuccacugacaaguggguagg

SEQ ID NO: 461290 - RNA, 20 nt, Human
ggcugggcggaaggaugcgg

SEQ ID NO: 461291 - RNA, 32 nt, Human
ggcugggcgggccuggccgggccagcggaggg

SEQ ID NO: 461292 - RNA, 32 nt, Human
ggcugggcggggcaggccuccuuuguucucca

SEQ ID NO: 461293 - RNA, 32 nt, Human
ggcugggcgugcuagagguugcagcaugagac

SEQ ID NO: 461294 - RNA, 32 nt, Human
ggcugggcucaagaaccugauaccuggguuga

SEQ ID NO: 461295 - RNA, 32 nt, Human
ggcugggcucagagggccagggcaucaagaac

SEQ ID NO: 461296 - RNA, 32 nt, Human
ggcugggcucagcucagcucuccuccucuagc

SEQ ID NO: 461297 - RNA, 21 nt, Human
ggcugggcucucagcccgcca

SEQ ID NO: 461298 - RNA, 32 nt, Human
ggcugggcucuggccugaucacugggcucagg

SEQ ID NO: 461299 - RNA, 32 nt, Human
ggcugggcugaggcacggaucccugggccaca

SEQ ID NO: 461300 - RNA, 32 nt, Human
ggcugggcuggcacaguggagagcgacaggug

SEQ ID NO: 461301 - RNA, 32 nt, Human
ggcugggcuggcugcaccaugggcaggguuga

SEQ ID NO: 461302 - RNA, 32 nt, Human
ggcugggcugguagcaggggccaguccucccc

SEQ ID NO: 461303 - RNA, 32 nt, Human
ggcugggcugugcugcacacugggcaggaggc

SEQ ID NO: 461304 - RNA, 32 nt, Human
ggcugggcuuuucuguaauaagcuuccuuuua

SEQ ID NO: 461305 - RNA, 32 nt, Human
ggcuggggaaaaugacagcgcuucuccuaauc

SEQ ID NO: 461306 - RNA, 32 nt, Human
ggcuggggaaaucauuuucauuuuugagagua

SEQ ID NO: 461307 - RNA, 32 nt, Human
ggcuggggacagggacacuaggagggccuggc

SEQ ID NO: 461308 - RNA, 32 nt, Human
ggcuggggacccagagggaaggcagaaggaga

SEQ ID NO: 461309 - RNA, 20 nt, Human
ggcuggggacgggcccggug

SEQ ID NO: 461310 - RNA, 32 nt, Human
ggcuggggagaacuaaaacaccuucacuggug

SEQ ID NO: 461311 - RNA, 32 nt, Human
ggcuggggagagaagggugaccaggcgaggag

SEQ ID NO: 461312 - RNA, 32 nt, Human
ggcuggggagaggaaggggcagagggaccggu

SEQ ID NO: 461313 - RNA, 32 nt, Human
ggcuggggagagguggaggcugacagcugaga

SEQ ID NO: 461314 - RNA, 32 nt, Human
ggcuggggagcagggagguccgggagggugcg

SEQ ID NO: 461315 - RNA, 32 nt, Human
ggcuggggagccuuggaugggguggggaccug

SEQ ID NO: 461316 - RNA, 32 nt, Human
ggcuggggaggcaccucccuggugcgcaggaa

SEQ ID NO: 461317 - RNA, 21 nt, Human
ggcuggggaggcacggaggaa

SEQ ID NO: 461318 - RNA, 32 nt, Human
ggcuggggaggcaggggcccagcaucagaggg

SEQ ID NO: 461319 - RNA, 32 nt, Human
ggcuggggaggccucaaaauagugguggaagg

SEQ ID NO: 461320 - RNA, 21 nt, Human
ggcuggggagggcagagcaag

SEQ ID NO: 461321 - RNA, 32 nt, Human
ggcuggggagugagaggaugagcuagugagug

SEQ ID NO: 461322 - RNA, 32 nt, Human
ggcuggggauggagagaguugcucugggaguu

SEQ ID NO: 461323 - RNA, 21 nt, Human
ggcuggggauuuguggaggga

SEQ ID NO: 461324 - RNA, 24 nt, Human
ggcuggggcaagcgaguagagaag

SEQ ID NO: 461325 - RNA, 20 nt, Human
ggcuggggcaggggagaaag

SEQ ID NO: 461326 - RNA, 32 nt, Human
ggcuggggcaggggagaaagacagcagacuca

SEQ ID NO: 461327 - RNA, 21 nt, Human
ggcuggggcaucaccgcgggc

SEQ ID NO: 461328 - RNA, 32 nt, Human
ggcuggggcaucucaauagcacugagggcagc

SEQ ID NO: 461329 - RNA, 21 nt, Human
ggcuggggcauggaaggcaag

SEQ ID NO: 461330 - RNA, 32 nt, Human
ggcuggggcauguggggccaggaggcagcuca

SEQ ID NO: 461331 - RNA, 32 nt, Human
ggcuggggccaaggacucugcugagaggcccc

SEQ ID NO: 461332 - RNA, 32 nt, Human
ggcuggggccaguggaccugacaguaccuuac

SEQ ID NO: 461333 - RNA, 32 nt, Human
ggcuggggcccaggcaccugugccggccauuc

SEQ ID NO: 461334 - RNA, 23 nt, Human
ggcuggggccuggaaagaggaag

SEQ ID NO: 461335 - RNA, 32 nt, Human
ggcuggggcgagcggaucaugaggucaacgga

SEQ ID NO: 461336 - RNA, 17 nt, Human
ggcuggggcggcaggug

SEQ ID NO: 461337 - RNA, 20 nt, Human
ggcuggggcgggguggggaa

SEQ ID NO: 461338 - RNA, 32 nt, Human
ggcuggggcugcagccauggggcugggucagc

SEQ ID NO: 461339 - RNA, 32 nt, Human
ggcuggggcugcagccugcagggagaagcaag

SEQ ID NO: 461340 - RNA, 32 nt, Human
ggcuggggcuguuccggggcauggaagauucc

SEQ ID NO: 461341 - RNA, 32 nt, Human
ggcuggggcuuccugggaaaaggaaggccaug

SEQ ID NO: 461342 - RNA, 32 nt, Human
ggcugggggaguucuggcuggggaaugacaac

SEQ ID NO: 461343 - RNA, 23 nt, Human
ggcugggggaucaccugagguca

SEQ ID NO: 461344 - RNA, 20 nt, Human
ggcugggggccauggaggaa

SEQ ID NO: 461345 - RNA, 21 nt, Human
ggcugggggccgagccuggga

SEQ ID NO: 461346 - RNA, 32 nt, Human
ggcugggggcugggcaugcugcaucuuaaccu

SEQ ID NO: 461347 - RNA, 23 nt, Human
ggcuggggggcuacacaaggaag

SEQ ID NO: 461348 - RNA, 23 nt, Human
ggcugggggguggcagagagaag

SEQ ID NO: 461349 - RNA, 32 nt, Human
ggcugggggugaggagucccuggcuucucuua

SEQ ID NO: 461350 - RNA, 23 nt, Human
ggcugggggugggauugaaggaa

SEQ ID NO: 461351 - RNA, 32 nt, Human
ggcugggguacugccacuguuguuaucagcua

SEQ ID NO: 461352 - RNA, 32 nt, Human
ggcuggggucaggagaggagaauaggagugac

SEQ ID NO: 461353 - RNA, 21 nt, Human
ggcuggggucagggaaggaag

SEQ ID NO: 461354 - RNA, 32 nt, Human
ggcuggggucucaaggcuggagucaaggugau

SEQ ID NO: 461355 - RNA, 32 nt, Human
ggcuggggucugcagugcagcauuaaugggcc

SEQ ID NO: 461356 - RNA, 22 nt, Human
ggcuggggugauggguaaggag

SEQ ID NO: 461357 - RNA, 23 nt, Human
ggcuggggugcgcuccggaggaa

SEQ ID NO: 461358 - RNA, 26 nt, Human
ggcuggggugcugggguugaaggaag

SEQ ID NO: 461359 - RNA, 32 nt, Human
ggcuggggugggaacaggauggcgggcaauag

SEQ ID NO: 461360 - RNA, 21 nt, Human
ggcuggggugggagaaggaag

SEQ ID NO: 461361 - RNA, 32 nt, Human
ggcuggggugggguguggcaggaggacaggaa

SEQ ID NO: 461362 - RNA, 21 nt, Human
ggcuggggugugaaaaagaag

SEQ ID NO: 461363 - RNA, 32 nt, Human
ggcuggggugugugggguggucugagccccag

SEQ ID NO: 461364 - RNA, 32 nt, Human
ggcugggguugugggugccucuucugaaaggu

SEQ ID NO: 461365 - RNA, 32 nt, Human
ggcugggguuugaaccuuuaggauuucacagc

SEQ ID NO: 461366 - RNA, 32 nt, Human
ggcuggguaguuaccggaggaggcagagccgg

SEQ ID NO: 461367 - RNA, 32 nt, Human
ggcuggguccuugggccuggccagucuuccuc

SEQ ID NO: 461368 - RNA, 32 nt, Human
ggcugggucgcucccauuuggccugggcuuca

SEQ ID NO: 461369 - RNA, 32 nt, Human
ggcugggucucccccuaccucuuccagcuccc

SEQ ID NO: 461370 - RNA, 32 nt, Human
ggcugggucuguagguuguugcagugaacgac

SEQ ID NO: 461371 - RNA, 32 nt, Human
ggcugggucuuuccucauuucugcuucuggga

SEQ ID NO: 461372 - RNA, 18 nt, Human
ggcugggugacagaguga

SEQ ID NO: 461373 - RNA, 32 nt, Human
ggcugggugacagauuaagcaagacucugucu

SEQ ID NO: 461374 - RNA, 32 nt, Human
ggcugggugacugggucuagccccugauccca

SEQ ID NO: 461375 - RNA, 32 nt, Human
ggcugggugcagcuccaacaccacagcaaggg

SEQ ID NO: 461376 - RNA, 32 nt, Human
ggcugggugcauaggggccacccuggagacuu

SEQ ID NO: 461377 - RNA, 32 nt, Human
ggcugggugcccaccaugccccuuccucuuuc

SEQ ID NO: 461378 - RNA, 20 nt, Human
ggcugggugccugccagacc

SEQ ID NO: 461379 - RNA, 32 nt, Human
ggcugggugcgguggcucacaccugucauccc

SEQ ID NO: 461380 - RNA, 32 nt, Human
ggcugggugcugggaaugagaauaauccuaau

SEQ ID NO: 461381 - RNA, 32 nt, Human
ggcugggugcuguggcucaugccuguaauccc

SEQ ID NO: 461382 - RNA, 16 nt, Human
ggcugggugggcgcgg

SEQ ID NO: 461383 - RNA, 32 nt, Human
ggcugggugggugggaaguguggcugguaacc

SEQ ID NO: 461384 - RNA, 32 nt, Human
ggcuggguggguggguggggaagaaaugggcc

SEQ ID NO: 461385 - RNA, 19 nt, Human
ggcugggugugcagagcug

SEQ ID NO: 461386 - RNA, 32 nt, Human
ggcuggguugggcgguaaacaggccgugggua

SEQ ID NO: 461387 - RNA, 32 nt, Human
ggcuggguuggggguuggguggggcuggacgg

SEQ ID NO: 461388 - RNA, 32 nt, Human
ggcuggguuucuaccuagguugccagguuauc

SEQ ID NO: 461389 - RNA, 32 nt, Human
ggcugguaaagagcaggaccagaggaagaauc

SEQ ID NO: 461390 - RNA, 32 nt, Human
ggcugguacccaggccuggagcagcgguacag

SEQ ID NO: 461391 - RNA, 32 nt, Human
ggcugguagagcaggaagcucugugaugucag

SEQ ID NO: 461392 - RNA, 19 nt, Human
ggcugguaugaagcccagg

SEQ ID NO: 461393 - RNA, 19 nt, Human
ggcugguauucuuugcuua

SEQ ID NO: 461394 - RNA, 32 nt, Human
ggcuggucacaaacuccagagcucaggcaauc

SEQ ID NO: 461395 - RNA, 32 nt, Human
ggcuggucacaaacuccugaccucaggugauc

SEQ ID NO: 461396 - RNA, 32 nt, Human
ggcuggucaucugcugaccacaccccagaucc

SEQ ID NO: 461397 - RNA, 32 nt, Human
ggcuggucaugaacuccugaccucaggugauc

SEQ ID NO: 461398 - RNA, 32 nt, Human
ggcugguccagggccugcccaggcuggggcac

SEQ ID NO: 461399 - RNA, 32 nt, Human
ggcuggucccaagccugcugugcuccuguggc

SEQ ID NO: 461400 - RNA, 22 nt, Human
ggcuggucccaggccaccaggc

SEQ ID NO: 461401 - RNA, 32 nt, Human
ggcugguccccaggcugggccggggcgcacgu

SEQ ID NO: 461402 - RNA, 32 nt, Human
ggcuggucccgaacuccugaccucaggugauc

SEQ ID NO: 461403 - RNA, 32 nt, Human
ggcugguccgaaguuggccacauugcugccag

SEQ ID NO: 461404 - RNA, 32 nt, Human
ggcugguccgggacauggaaauucggacucag

SEQ ID NO: 461405 - RNA, 16 nt, Human
ggcugguccugggguc

SEQ ID NO: 461406 - RNA, 32 nt, Human
ggcuggucgcgaacuccugagcucaggcaauc

SEQ ID NO: 461407 - RNA, 32 nt, Human
ggcuggucgggaguucgagaccagccugacca

SEQ ID NO: 461408 - RNA, 32 nt, Human
ggcuggucucaaaacuccugaccucaagugau

SEQ ID NO: 461409 - RNA, 32 nt, Human
ggcuggucucaaaacuccugaccucaggugau

SEQ ID NO: 461410 - RNA, 32 nt, Human
ggcuggucucaaaacuccugagcucaagugau

SEQ ID NO: 461411 - RNA, 32 nt, Human
ggcuggucucaaacuccagaccucaugauuua

SEQ ID NO: 461412 - RNA, 32 nt, Human
ggcuggucucaaacuccagagcucaagagauc

SEQ ID NO: 461413 - RNA, 32 nt, Human
ggcuggucucaaacuccagggcucaagcaguc

SEQ ID NO: 461414 - RNA, 32 nt, Human
ggcuggucucaaacucccaaccucaggugauc

SEQ ID NO: 461415 - RNA, 32 nt, Human
ggcuggucucaaacucccgaccucaggugauc

SEQ ID NO: 461416 - RNA, 32 nt, Human
ggcuggucucaaacucccgacuucaggugauc

SEQ ID NO: 461417 - RNA, 32 nt, Human
ggcuggucucaaacuccuaaccucgugauccg

SEQ ID NO: 461418 - RNA, 32 nt, Human
ggcuggucucaaacuccuaaccuugugauucg

SEQ ID NO: 461419 - RNA, 32 nt, Human
ggcuggucucaaacuccuagguucacuuuggc

SEQ ID NO: 461420 - RNA, 32 nt, Human
ggcuggucucaaacuccucgguucaagcaauu

SEQ ID NO: 461421 - RNA, 32 nt, Human
ggcuggucucaaacuccugaccuagugaucca

SEQ ID NO: 461422 - RNA, 32 nt, Human
ggcuggucucaaacuccugaccucagaugauc

SEQ ID NO: 461423 - RNA, 32 nt, Human
ggcuggucucaaacuccugaccucagaugauu

SEQ ID NO: 461424 - RNA, 32 nt, Human
ggcuggucucaaacuccugaccucaggcaauc

SEQ ID NO: 461425 - RNA, 32 nt, Human
ggcuggucucaaacuccugaccucaggcgauc

SEQ ID NO: 461426 - RNA, 32 nt, Human
ggcuggucucaaacuccugaccucaggggauc

SEQ ID NO: 461427 - RNA, 32 nt, Human
ggcuggucucaaacuccugaccucagguaauc

SEQ ID NO: 461428 - RNA, 32 nt, Human
ggcuggucucaaacuccugaccucagguacuc

SEQ ID NO: 461429 - RNA, 32 nt, Human
ggcuggucucaaacuccugaccucaggugauc

SEQ ID NO: 461430 - RNA, 32 nt, Human
ggcuggucucaaacuccugaccucaggugauu

SEQ ID NO: 461431 - RNA, 32 nt, Human
ggcuggucucaaacuccugaccucagguguuc

SEQ ID NO: 461432 - RNA, 32 nt, Human
ggcuggucucaaacuccugaccucaugaucca

SEQ ID NO: 461433 - RNA, 32 nt, Human
ggcuggucucaaacuccugaccucaugaucug

SEQ ID NO: 461434 - RNA, 32 nt, Human
ggcuggucucaaacuccugaccuccggugauc

SEQ ID NO: 461435 - RNA, 32 nt, Human
ggcuggucucaaacuccugaccucgugauacg

SEQ ID NO: 461436 - RNA, 32 nt, Human
ggcuggucucaaacuccugaccucgugaucca

SEQ ID NO: 461437 - RNA, 32 nt, Human
ggcuggucucaaacuccugaccucuggugauc

SEQ ID NO: 461438 - RNA, 32 nt, Human
ggcuggucucaaacuccugaccucuugauccg

SEQ ID NO: 461439 - RNA, 32 nt, Human
ggcuggucucaaacuccugaccuugugaucca

SEQ ID NO: 461440 - RNA, 32 nt, Human
ggcuggucucaaacuccugaccuugugauccg

SEQ ID NO: 461441 - RNA, 32 nt, Human
ggcuggucucaaacuccugaccuugugaucug

SEQ ID NO: 461442 - RNA, 32 nt, Human
ggcuggucucaaacuccugacgccaggugauc

SEQ ID NO: 461443 - RNA, 32 nt, Human
ggcuggucucaaacuccugacuucaggugauc

SEQ ID NO: 461444 - RNA, 32 nt, Human
ggcuggucucaaacuccugacuucgugaucug

SEQ ID NO: 461445 - RNA, 32 nt, Human
ggcuggucucaaacuccugagcucaagcaauc

SEQ ID NO: 461446 - RNA, 32 nt, Human
ggcuggucucaaacuccugagcucaagccauc

SEQ ID NO: 461447 - RNA, 32 nt, Human
ggcuggucucaaacuccugagcucaagcgauc

SEQ ID NO: 461448 - RNA, 32 nt, Human
ggcuggucucaaacuccugagcucaggcaauc

SEQ ID NO: 461449 - RNA, 32 nt, Human
ggcuggucucaaacuccugagcucaggcagau

SEQ ID NO: 461450 - RNA, 32 nt, Human
ggcuggucucaaacuccugagcucaggccauc

SEQ ID NO: 461451 - RNA, 32 nt, Human
ggcuggucucaaacuccugaucucaagagaug

SEQ ID NO: 461452 - RNA, 32 nt, Human
ggcuggucucaaacuccugauuucuuagucug

SEQ ID NO: 461453 - RNA, 32 nt, Human
ggcuggucucaaacuccugcccucaggugauc

SEQ ID NO: 461454 - RNA, 32 nt, Human
ggcuggucucaaacuccuggacucaagcaauc

SEQ ID NO: 461455 - RNA, 32 nt, Human
ggcuggucucaaacuccuggacucaagggauc

SEQ ID NO: 461456 - RNA, 32 nt, Human
ggcuggucucaaacuccuggccucaagcaauc

SEQ ID NO: 461457 - RNA, 32 nt, Human
ggcuggucucaaacuccuggccucaagugacc

SEQ ID NO: 461458 - RNA, 32 nt, Human
ggcuggucucaaacuccuggccucaagugauc

SEQ ID NO: 461459 - RNA, 32 nt, Human
ggcuggucucaaacuccuggccucaggugauc

SEQ ID NO: 461460 - RNA, 32 nt, Human
ggcuggucucaaacuccugggcacaagcaauc

SEQ ID NO: 461461 - RNA, 32 nt, Human
ggcuggucucaaacuccugggcucaagcaauc

SEQ ID NO: 461462 - RNA, 32 nt, Human
ggcuggucucaaacuccugggcucaagcaaug

SEQ ID NO: 461463 - RNA, 32 nt, Human
ggcuggucucaaacuccugggcucaagcgauc

SEQ ID NO: 461464 - RNA, 32 nt, Human
ggcuggucucaaacuccugggcucaagugaac

SEQ ID NO: 461465 - RNA, 32 nt, Human
ggcuggucucaaacuccugggcucaagugauc

SEQ ID NO: 461466 - RNA, 32 nt, Human
ggcuggucucaaacuccugggcucaggcgauc

SEQ ID NO: 461467 - RNA, 32 nt, Human
ggcuggucucaaacuccuggguucaagcaauc

SEQ ID NO: 461468 - RNA, 32 nt, Human
ggcuggucucaaacuccuggguucaagccuca

SEQ ID NO: 461469 - RNA, 32 nt, Human
ggcuggucucaaacuccuggguucaagugauc

SEQ ID NO: 461470 - RNA, 32 nt, Human
ggcuggucucaaacucucgggcucaagcaguc

SEQ ID NO: 461471 - RNA, 32 nt, Human
ggcuggucucaaacucuugaccucaggugauc

SEQ ID NO: 461472 - RNA, 32 nt, Human
ggcuggucucaaacucuugaccucgugauuug

SEQ ID NO: 461473 - RNA, 32 nt, Human
ggcuggucucaaacucuugacuucagaugauc

SEQ ID NO: 461474 - RNA, 32 nt, Human
ggcuggucucaaacucuugacuucagguaauc

SEQ ID NO: 461475 - RNA, 32 nt, Human
ggcuggucucaaacucuugagcucaagcccac

SEQ ID NO: 461476 - RNA, 32 nt, Human
ggcuggucucaaacucuuuggcucaagccauc

SEQ ID NO: 461477 - RNA, 32 nt, Human
ggcuggucucaaacugcugacuucaggugauc

SEQ ID NO: 461478 - RNA, 32 nt, Human
ggcuggucucaaacuucucacuucaggugauc

SEQ ID NO: 461479 - RNA, 32 nt, Human
ggcuggucucaaacuucugaccucaggugauc

SEQ ID NO: 461480 - RNA, 32 nt, Human
ggcuggucucaaacuucugaccucgugaucca

SEQ ID NO: 461481 - RNA, 32 nt, Human
ggcuggucucaaacuucugaccuugugaucug

SEQ ID NO: 461482 - RNA, 32 nt, Human
ggcuggucucaaacuucugaucucaagugauc

SEQ ID NO: 461483 - RNA, 32 nt, Human
ggcuggucucaaacuucugggcucaagcaauu

SEQ ID NO: 461484 - RNA, 32 nt, Human
ggcuggucucaaacuugugagcucaagaaauc

SEQ ID NO: 461485 - RNA, 32 nt, Human
ggcuggucucaaauuccugaccccaggugauc

SEQ ID NO: 461486 - RNA, 32 nt, Human
ggcuggucucaaauucuugaucucaagugauc

SEQ ID NO: 461487 - RNA, 32 nt, Human
ggcuggucucaaauuucugggcucaggugauc

SEQ ID NO: 461488 - RNA, 32 nt, Human
ggcuggucucaaccuccugggcucaagcaauc

SEQ ID NO: 461489 - RNA, 32 nt, Human
ggcuggucucagaauucuggugagugauccuc

SEQ ID NO: 461490 - RNA, 32 nt, Human
ggcuggucucaggcuccugggcucagaugguc

SEQ ID NO: 461491 - RNA, 20 nt, Human
ggcuggucuccaacuccucg

SEQ ID NO: 461492 - RNA, 32 nt, Human
ggcuggucuccaacuccugaccucaggcgauc

SEQ ID NO: 461493 - RNA, 32 nt, Human
ggcuggucuccaacuccugaccucaggugauc

SEQ ID NO: 461494 - RNA, 32 nt, Human
ggcuggucuccaacuccugaccucgggugauc

SEQ ID NO: 461495 - RNA, 32 nt, Human
ggcuggucuccaacuccugagcucaggugauc

SEQ ID NO: 461496 - RNA, 32 nt, Human
ggcuggucuccaacuccugggcucaagcaauc

SEQ ID NO: 461497 - RNA, 32 nt, Human
ggcuggucucgaacaccugggcucaacugauc

SEQ ID NO: 461498 - RNA, 32 nt, Human
ggcuggucucgaacuccuaaucucaaguuauc

SEQ ID NO: 461499 - RNA, 32 nt, Human
ggcuggucucgaacuccugaacuuaggugauu

SEQ ID NO: 461500 - RNA, 32 nt, Human
ggcuggucucgaacuccugacaucaggugauc

SEQ ID NO: 461501 - RNA, 32 nt, Human
ggcuggucucgaacuccugaccacagguaauc

SEQ ID NO: 461502 - RNA, 32 nt, Human
ggcuggucucgaacuccugaccccaggugauc

SEQ ID NO: 461503 - RNA, 32 nt, Human
ggcuggucucgaacuccugaccuagugaucug

SEQ ID NO: 461504 - RNA, 32 nt, Human
ggcuggucucgaacuccugaccucagacgauc

SEQ ID NO: 461505 - RNA, 32 nt, Human
ggcuggucucgaacuccugaccucagauaauc

SEQ ID NO: 461506 - RNA, 32 nt, Human
ggcuggucucgaacuccugaccucagaugauc

SEQ ID NO: 461507 - RNA, 32 nt, Human
ggcuggucucgaacuccugaccucaggcaauc

SEQ ID NO: 461508 - RNA, 32 nt, Human
ggcuggucucgaacuccugaccucaggcgauc

SEQ ID NO: 461509 - RNA, 32 nt, Human
ggcuggucucgaacuccugaccucaggggauc

SEQ ID NO: 461510 - RNA, 32 nt, Human
ggcuggucucgaacuccugaccucagguaauc

SEQ ID NO: 461511 - RNA, 29 nt, Human
ggcuggucucgaacuccugaccucaggug

SEQ ID NO: 461512 - RNA, 32 nt, Human
ggcuggucucgaacuccugaccucaggugagc

SEQ ID NO: 461513 - RNA, 32 nt, Human
ggcuggucucgaacuccugaccucaggugauc

SEQ ID NO: 461514 - RNA, 32 nt, Human
ggcuggucucgaacuccugaccucaggugaug

SEQ ID NO: 461515 - RNA, 32 nt, Human
ggcuggucucgaacuccugaccucaggugauu

SEQ ID NO: 461516 - RNA, 32 nt, Human
ggcuggucucgaacuccugaccucaguugauc

SEQ ID NO: 461517 - RNA, 32 nt, Human
ggcuggucucgaacuccugaccucaugagccg

SEQ ID NO: 461518 - RNA, 32 nt, Human
ggcuggucucgaacuccugaccucaugaucca

SEQ ID NO: 461519 - RNA, 32 nt, Human
ggcuggucucgaacuccugaccucaugauccg

SEQ ID NO: 461520 - RNA, 32 nt, Human
ggcuggucucgaacuccugaccucaugauccu

SEQ ID NO: 461521 - RNA, 32 nt, Human
ggcuggucucgaacuccugaccucaugaucug

SEQ ID NO: 461522 - RNA, 32 nt, Human
ggcuggucucgaacuccugaccucaugauuug

SEQ ID NO: 461523 - RNA, 32 nt, Human
ggcuggucucgaacuccugaccucgugaucca

SEQ ID NO: 461524 - RNA, 32 nt, Human
ggcuggucucgaacuccugaccucgugauccg

SEQ ID NO: 461525 - RNA, 32 nt, Human
ggcuggucucgaacuccugaccucgugaucga

SEQ ID NO: 461526 - RNA, 32 nt, Human
ggcuggucucgaacuccugaccucgugaucug

SEQ ID NO: 461527 - RNA, 32 nt, Human
ggcuggucucgaacuccugaccucgugauugg

SEQ ID NO: 461528 - RNA, 32 nt, Human
ggcuggucucgaacuccugaccucgugauuug

SEQ ID NO: 461529 - RNA, 32 nt, Human
ggcuggucucgaacuccugaccuuaggugauc

SEQ ID NO: 461530 - RNA, 32 nt, Human
ggcuggucucgaacuccugaccuuggguaauc

SEQ ID NO: 461531 - RNA, 32 nt, Human
ggcuggucucgaacuccugaccuugugauaca

SEQ ID NO: 461532 - RNA, 32 nt, Human
ggcuggucucgaacuccugaccuugugaucca

SEQ ID NO: 461533 - RNA, 32 nt, Human
ggcuggucucgaacuccugaccuugugauccg

SEQ ID NO: 461534 - RNA, 32 nt, Human
ggcuggucucgaacuccugaccuugugaucug

SEQ ID NO: 461535 - RNA, 32 nt, Human
ggcuggucucgaacuccugagcucaagugauc

SEQ ID NO: 461536 - RNA, 32 nt, Human
ggcuggucucgaacuccugagcucaggcaauc

SEQ ID NO: 461537 - RNA, 32 nt, Human
ggcuggucucgaacuccugagcucaggcaguc

SEQ ID NO: 461538 - RNA, 32 nt, Human
ggcuggucucgaacuccugagcucaggugauc

SEQ ID NO: 461539 - RNA, 32 nt, Human
ggcuggucucgaacuccugaucucaugauccg

SEQ ID NO: 461540 - RNA, 32 nt, Human
ggcuggucucgaacuccugcccucaggugauc

SEQ ID NO: 461541 - RNA, 32 nt, Human
ggcuggucucgaacuccuggccauaggugauc

SEQ ID NO: 461542 - RNA, 32 nt, Human
ggcuggucucgaacuccuggccuaaugaucug

SEQ ID NO: 461543 - RNA, 32 nt, Human
ggcuggucucgaacuccuggccuaggugaucc

SEQ ID NO: 461544 - RNA, 32 nt, Human
ggcuggucucgaacuccuggccucagguguga

SEQ ID NO: 461545 - RNA, 32 nt, Human
ggcuggucucgaacuccuggccucgugaucug

SEQ ID NO: 461546 - RNA, 32 nt, Human
ggcuggucucgaacuccugggcucaagccguu

SEQ ID NO: 461547 - RNA, 32 nt, Human
ggcuggucucgaacuccugggcucaagcgauc

SEQ ID NO: 461548 - RNA, 32 nt, Human
ggcuggucucgaacuccugggcucaagcgguc

SEQ ID NO: 461549 - RNA, 32 nt, Human
ggcuggucucgaacuccugggcucaagugauc

SEQ ID NO: 461550 - RNA, 32 nt, Human
ggcuggucucgaacuccugggcucgggugauc

SEQ ID NO: 461551 - RNA, 32 nt, Human
ggcuggucucgaacuccugggcuuaaaugacu

SEQ ID NO: 461552 - RNA, 32 nt, Human
ggcuggucucgaacuccuguccucagguaauc

SEQ ID NO: 461553 - RNA, 32 nt, Human
ggcuggucucgaacuucugagcucgagcgauc

SEQ ID NO: 461554 - RNA, 32 nt, Human
ggcuggucucgaacuucugggcucaagcaauu

SEQ ID NO: 461555 - RNA, 32 nt, Human
ggcuggucucgagcuccugagcucaggcaauc

SEQ ID NO: 461556 - RNA, 32 nt, Human
ggcuggucucggaacuccugacugcaggugau

SEQ ID NO: 461557 - RNA, 32 nt, Human
ggcuggucucggacuccugggcucaagcaauc

SEQ ID NO: 461558 - RNA, 32 nt, Human
ggcuggucucuaacuccugggcucagugaucc

SEQ ID NO: 461559 - RNA, 32 nt, Human
ggcuggucucucggcccugccggugucgcagc

SEQ ID NO: 461560 - RNA, 22 nt, Human
ggcuggucugaagcugcugggc

SEQ ID NO: 461561 - RNA, 32 nt, Human
ggcuggucuggaacuccugaccucaggugauc

SEQ ID NO: 461562 - RNA, 32 nt, Human
ggcuggucuggaacuccugaccuucaggugau

SEQ ID NO: 461563 - RNA, 32 nt, Human
ggcuggucuuaaacgccugggcucaagcaacc

SEQ ID NO: 461564 - RNA, 32 nt, Human
ggcuggucuuaaacuccugggcucaagugauc

SEQ ID NO: 461565 - RNA, 32 nt, Human
ggcuggucuucgaacucccaaccucaggugau

SEQ ID NO: 461566 - RNA, 32 nt, Human
ggcuggucuugaacucccgagcucaggugauc

SEQ ID NO: 461567 - RNA, 32 nt, Human
ggcuggucuugaacuccugaccucaggcgauc

SEQ ID NO: 461568 - RNA, 32 nt, Human
ggcuggucuugaacuccugaccucagguaauc

SEQ ID NO: 461569 - RNA, 32 nt, Human
ggcuggucuugaacuccugaccucaggugagc

SEQ ID NO: 461570 - RNA, 32 nt, Human
ggcuggucuugaacuccugaccucaggugaua

SEQ ID NO: 461571 - RNA, 32 nt, Human
ggcuggucuugaacuccugaccucaggugauc

SEQ ID NO: 461572 - RNA, 32 nt, Human
ggcuggucuugaacuccugaccucaugaucca

SEQ ID NO: 461573 - RNA, 32 nt, Human
ggcuggucuugaacuccugaccucgugaccca

SEQ ID NO: 461574 - RNA, 32 nt, Human
ggcuggucuugaacuccugaccucgugaucca

SEQ ID NO: 461575 - RNA, 32 nt, Human
ggcuggucuugaacuccugaccucgugauccg

SEQ ID NO: 461576 - RNA, 32 nt, Human
ggcuggucuugaacuccugaccucgugaucug

SEQ ID NO: 461577 - RNA, 32 nt, Human
ggcuggucuugaacuccugaccucgugauugu

SEQ ID NO: 461578 - RNA, 32 nt, Human
ggcuggucuugaacuccugacuucaggugacc

SEQ ID NO: 461579 - RNA, 32 nt, Human
ggcuggucuugaacuccugagccucgugaguc

SEQ ID NO: 461580 - RNA, 32 nt, Human
ggcuggucuugaacuccugagcucaggugauc

SEQ ID NO: 461581 - RNA, 32 nt, Human
ggcuggucuugaacuccuggacuuagacgauc

SEQ ID NO: 461582 - RNA, 32 nt, Human
ggcuggucuugaacuccuggcucaagaaauca

SEQ ID NO: 461583 - RNA, 32 nt, Human
ggcuggucuugaacuccuggcuucgggugauc

SEQ ID NO: 461584 - RNA, 32 nt, Human
ggcuggucuugaacuccugggcuccagugauc

SEQ ID NO: 461585 - RNA, 32 nt, Human
ggcuggucuugaacuccuugaccucagguaau

SEQ ID NO: 461586 - RNA, 32 nt, Human
ggcuggucuugaacugcuggccuaagcgaucc

SEQ ID NO: 461587 - RNA, 32 nt, Human
ggcuggucuuggaacuccugaccucgugagcc

SEQ ID NO: 461588 - RNA, 32 nt, Human
ggcuggucuuuaacuccugaccucagguguuc

SEQ ID NO: 461589 - RNA, 32 nt, Human
ggcuggucuuuaauuccugggcucgagagagc

SEQ ID NO: 461590 - RNA, 32 nt, Human
ggcuggucuuuacccuucuuccucacugucau

SEQ ID NO: 461591 - RNA, 32 nt, Human
ggcuggugagucuagaaugcucuggaacccua

SEQ ID NO: 461592 - RNA, 32 nt, Human
ggcuggugcagccuuuucucuccccuccugau

SEQ ID NO: 461593 - RNA, 32 nt, Human
ggcuggugccagugccccaggggccuccuggg

SEQ ID NO: 461594 - RNA, 32 nt, Human
ggcuggugccuguagucccagcuacucaggag

SEQ ID NO: 461595 - RNA, 32 nt, Human
ggcuggugccuugucccaggggagagggaaau

SEQ ID NO: 461596 - RNA, 32 nt, Human
ggcuggugcucacagcuguaaucccagcacuu

SEQ ID NO: 461597 - RNA, 18 nt, Human
ggcugguggagaggguug

SEQ ID NO: 461598 - RNA, 32 nt, Human
ggcugguggcuugcacugagggccuggcugcc

SEQ ID NO: 461599 - RNA, 32 nt, Human
ggcuggugggaaagaguuuguuuuuggggccu

SEQ ID NO: 461600 - RNA, 32 nt, Human
ggcuggugggacaguuuuggaccuggaaucau

SEQ ID NO: 461601 - RNA, 32 nt, Human
ggcuggugggaggcagggggcaggccugcgga

SEQ ID NO: 461602 - RNA, 32 nt, Human
ggcuggugggcaugcuguccacuguguggugc

SEQ ID NO: 461603 - RNA, 32 nt, Human
ggcuggugucaaacuccugacuucaggugauc

SEQ ID NO: 461604 - RNA, 32 nt, Human
ggcuggugucaaacuccugggcucagucaguc

SEQ ID NO: 461605 - RNA, 32 nt, Human
ggcuggugucgaacuccugaccucaggugauc

SEQ ID NO: 461606 - RNA, 32 nt, Human
ggcuggugucgaauuccugggcuccagggauc

SEQ ID NO: 461607 - RNA, 32 nt, Human
ggcuggugugagagcaggccuugggugagaug

SEQ ID NO: 461608 - RNA, 32 nt, Human
ggcugguguguagugaucucagcucacugcaa

SEQ ID NO: 461609 - RNA, 18 nt, Human
ggcugguguguggccagg

SEQ ID NO: 461610 - RNA, 19 nt, Human
ggcugguuccuggguccgg

SEQ ID NO: 461611 - RNA, 32 nt, Human
ggcugguucuucccaccacuucccaggcucug

SEQ ID NO: 461612 - RNA, 23 nt, Human
ggcugguugguggccuccagaua

SEQ ID NO: 461613 - RNA, 32 nt, Human
ggcugguugugaaaucaguuugagugcagaau

SEQ ID NO: 461614 - RNA, 32 nt, Human
ggcugguuguuccguugcgagcugcagcugcg

SEQ ID NO: 461615 - RNA, 32 nt, Human
ggcugguuuaaggggaacuugagggaaguagg

SEQ ID NO: 461616 - RNA, 32 nt, Human
ggcugguuucaaacuccugaccucaggugauc

SEQ ID NO: 461617 - RNA, 32 nt, Human
ggcugguuucaaacuccugaccucaguugauc

SEQ ID NO: 461618 - RNA, 32 nt, Human
ggcugguuucaaacuccugagcucaaaugauc

SEQ ID NO: 461619 - RNA, 32 nt, Human
ggcugguuuccuuuucuuuucccacaaaccuu

SEQ ID NO: 461620 - RNA, 32 nt, Human
ggcugguuucgaacuccugaccucaggugauc

SEQ ID NO: 461621 - RNA, 32 nt, Human
ggcugguuucgaacuccugaccucgugaucca

SEQ ID NO: 461622 - RNA, 32 nt, Human
ggcugguuucgaacuccuggccucaggugauc

SEQ ID NO: 461623 - RNA, 32 nt, Human
ggcugguuucgaacuccugggcuuaagugauu

SEQ ID NO: 461624 - RNA, 32 nt, Human
ggcugguuucgaacucuguaaucccagcacuu

SEQ ID NO: 461625 - RNA, 32 nt, Human
ggcugguuugagucucucaaaucauggauuag

SEQ ID NO: 461626 - RNA, 32 nt, Human
ggcugguuuugaacuccugaccucaggugagc

SEQ ID NO: 461627 - RNA, 32 nt, Human
ggcuguacaguuugaaaaagcauauucaauau

SEQ ID NO: 461628 - RNA, 32 nt, Human
ggcuguacauucagcacagcuguggugucccc

SEQ ID NO: 461629 - RNA, 32 nt, Human
ggcuguacccugcaaagccacagguggggagc

SEQ ID NO: 461630 - RNA, 22 nt, Human
ggcuguaccuggugcccugugg

SEQ ID NO: 461631 - RNA, 32 nt, Human
ggcuguacgcuaccacagcuucccaggccgug

SEQ ID NO: 461632 - RNA, 32 nt, Human
ggcuguagaaauuuaaaaacuacaaugugauu

SEQ ID NO: 461633 - RNA, 32 nt, Human
ggcuguagauuuaagggcacucaaggggaaaa

SEQ ID NO: 461634 - RNA, 26 nt, Human
ggcuguagcagugugccuccauggcc

SEQ ID NO: 461635 - RNA, 32 nt, Human
ggcuguagcugaugcaacuaacaaguacuggg

SEQ ID NO: 461636 - RNA, 26 nt, Human
ggcuguagcuuuccacagccacugcc

SEQ ID NO: 461637 - RNA, 23 nt, Human
ggcuguagcuuucuugcucauca

SEQ ID NO: 461638 - RNA, 32 nt, Human
ggcuguaggaagagggaagcucuuccuuggca

SEQ ID NO: 461639 - RNA, 21 nt, Human
ggcuguaggcacaccgcggcc

SEQ ID NO: 461640 - RNA, 20 nt, Human
ggcuguaggguucccgggaa

SEQ ID NO: 461641 - RNA, 32 nt, Human
ggcuguaguucugcagggagagccugaagucc

SEQ ID NO: 461642 - RNA, 32 nt, Human
ggcuguauaagaauacuuuucucuccacaacg

SEQ ID NO: 461643 - RNA, 32 nt, Human
ggcuguauggagucugcagguaaacaugccug

SEQ ID NO: 461644 - RNA, 32 nt, Human
ggcuguaugugggugggcauguggccuccccc

SEQ ID NO: 461645 - RNA, 32 nt, Human
ggcugucaaguauuccaugagccacauagccc

SEQ ID NO: 461646 - RNA, 32 nt, Human
ggcugucacagaggcuggagaaauaagcagug

SEQ ID NO: 461647 - RNA, 32 nt, Human
ggcugucaccacgugcaguaucucaagauauu

SEQ ID NO: 461648 - RNA, 23 nt, Human
ggcugucacccgaucgccagcaa

SEQ ID NO: 461649 - RNA, 32 nt, Human
ggcugucaccucccagcucacacacacucuuc

SEQ ID NO: 461650 - RNA, 21 nt, Human
ggcugucacugcagaagucuu

SEQ ID NO: 461651 - RNA, 32 nt, Human
ggcugucagcagcacuguguccaggcucuugu

SEQ ID NO: 461652 - RNA, 32 nt, Human
ggcugucagccucugggcaggcuugcuuuuau

SEQ ID NO: 461653 - RNA, 32 nt, Human
ggcugucagggagggccuggggugggggccag

SEQ ID NO: 461654 - RNA, 32 nt, Human
ggcugucaucaacagugggaccagcuucuuug

SEQ ID NO: 461655 - RNA, 32 nt, Human
ggcugucaucaggaaaaugguugggagauuuc

SEQ ID NO: 461656 - RNA, 32 nt, Human
ggcugucaugggcucccaggggcuccaggcau

SEQ ID NO: 461657 - RNA, 18 nt, Human
ggcugucauuucauugca

SEQ ID NO: 461658 - RNA, 32 nt, Human
ggcuguccacaguucucagauguguuaaugug

SEQ ID NO: 461659 - RNA, 32 nt, Human
ggcuguccagaacugcucacccugccuuuuuc

SEQ ID NO: 461660 - RNA, 32 nt, Human
ggcuguccauuggugaugaugacuguaacuuc

SEQ ID NO: 461661 - RNA, 32 nt, Human
ggcugucccacucccagcucuggcagaaucaa

SEQ ID NO: 461662 - RNA, 32 nt, Human
ggcugucccagagagguccgcguucuccccac

SEQ ID NO: 461663 - RNA, 32 nt, Human
ggcugucccauagagcccauuguaaaggacac

SEQ ID NO: 461664 - RNA, 32 nt, Human
ggcuguccccauccucauguggcuguguggag

SEQ ID NO: 461665 - RNA, 21 nt, Human
ggcugucccccggccccagcg

SEQ ID NO: 461666 - RNA, 32 nt, Human
ggcugucccgggcuguuacugucucuucuggu

SEQ ID NO: 461667 - RNA, 20 nt, Human
ggcugucccuggacagugac

SEQ ID NO: 461668 - RNA, 22 nt, Human
ggcuguccgucuuuacugugag

SEQ ID NO: 461669 - RNA, 24 nt, Human
ggcuguccuccugcagcccagugg

SEQ ID NO: 461670 - RNA, 22 nt, Human
ggcuguccugaaaacccugugg

SEQ ID NO: 461671 - RNA, 21 nt, Human
ggcuguccuggacacuguggg

SEQ ID NO: 461672 - RNA, 32 nt, Human
ggcuguccugggagccccugcccacccugaca

SEQ ID NO: 461673 - RNA, 22 nt, Human
ggcuguccugggccagcgggag

SEQ ID NO: 461674 - RNA, 32 nt, Human
ggcuguccugggcucccugacccacugaagcu

SEQ ID NO: 461675 - RNA, 21 nt, Human
ggcuguccuguacauuguggg

SEQ ID NO: 461676 - RNA, 25 nt, Human
ggcuguccuguuggagaacuaugag

SEQ ID NO: 461677 - RNA, 24 nt, Human
ggcuguccuuuuugacccaggggu

SEQ ID NO: 461678 - RNA, 32 nt, Human
ggcugucgaauagaggaggagagagaaauggu

SEQ ID NO: 461679 - RNA, 32 nt, Human
ggcugucgccuguaaugccagcgcuuugggag

SEQ ID NO: 461680 - RNA, 32 nt, Human
ggcugucgcugcuuuuuguccucugccguguu

SEQ ID NO: 461681 - RNA, 32 nt, Human
ggcugucggacugcgcucccagccugggcucu

SEQ ID NO: 461682 - RNA, 18 nt, Human
ggcugucggccagaggga

SEQ ID NO: 461683 - RNA, 21 nt, Human
ggcugucggcgcgccgcggcc

SEQ ID NO: 461684 - RNA, 32 nt, Human
ggcugucgggguggggcugagcugccggggag

SEQ ID NO: 461685 - RNA, 32 nt, Human
ggcugucgggucucccccucucugacccugcg

SEQ ID NO: 461686 - RNA, 32 nt, Human
ggcugucggucagguugguccagugaggggug

SEQ ID NO: 461687 - RNA, 32 nt, Human
ggcugucuccauucuguccccuucccauaaaa

SEQ ID NO: 461688 - RNA, 32 nt, Human
ggcugucucccaggccacuaggcaugggggcu

SEQ ID NO: 461689 - RNA, 18 nt, Human
ggcugucuccucauggcc

SEQ ID NO: 461690 - RNA, 32 nt, Human
ggcugucucucccuuucucccccucucucucu

SEQ ID NO: 461691 - RNA, 32 nt, Human
ggcugucucugucccucacugccuuccaggag

SEQ ID NO: 461692 - RNA, 32 nt, Human
ggcugucucuguuccuucuauuuugcugauuu

SEQ ID NO: 461693 - RNA, 31 nt, Human
ggcugucugagcagggagguugggaccccug

SEQ ID NO: 461694 - RNA, 20 nt, Human
ggcugucugaugcagaugau

SEQ ID NO: 461695 - RNA, 24 nt, Human
ggcugucugcccaccucagccucc

SEQ ID NO: 461696 - RNA, 32 nt, Human
ggcugucugccuguauuuucggacuuugacau

SEQ ID NO: 461697 - RNA, 23 nt, Human
ggcugucuggaaccuggaggaag

SEQ ID NO: 461698 - RNA, 32 nt, Human
ggcugucugggauggcuuccaauuuuaaugac

SEQ ID NO: 461699 - RNA, 32 nt, Human
ggcugucugucugucugucuaaccuggcauua

SEQ ID NO: 461700 - RNA, 32 nt, Human
ggcugucuuacugcuagcucuucuaacagggg

SEQ ID NO: 461701 - RNA, 32 nt, Human
ggcugucuuccuucuaagaaagcuauuuauaa

SEQ ID NO: 461702 - RNA, 22 nt, Human
ggcugucuuggaucccaacagg

SEQ ID NO: 461703 - RNA, 32 nt, Human
ggcugucuuggcucuggaauucaugcauccug

SEQ ID NO: 461704 - RNA, 32 nt, Human
ggcugucuugggugcacuggacuuggagcacu

SEQ ID NO: 461705 - RNA, 32 nt, Human
ggcugucuuucccauuccuuguccagcuagga

SEQ ID NO: 461706 - RNA, 32 nt, Human
ggcugucuuucuucccccucuucucccuaauc

SEQ ID NO: 461707 - RNA, 32 nt, Human
ggcugugaaagccacaggugggggcugagcga

SEQ ID NO: 461708 - RNA, 32 nt, Human
ggcugugaaaucugcaaaaagagcugacauuc

SEQ ID NO: 461709 - RNA, 19 nt, Human
ggcugugaacaggggaggc

SEQ ID NO: 461710 - RNA, 32 nt, Human
ggcugugaacuucacccaggaggaauggacuu

SEQ ID NO: 461711 - RNA, 18 nt, Human
ggcugugaaugguagaca

SEQ ID NO: 461712 - RNA, 32 nt, Human
ggcugugacacccagaggaauuccugugagag

SEQ ID NO: 461713 - RNA, 32 nt, Human
ggcugugacacuuaccuccacccccauccagc

SEQ ID NO: 461714 - RNA, 32 nt, Human
ggcugugacaucaguugucaggagaacuggga

SEQ ID NO: 461715 - RNA, 32 nt, Human
ggcugugacccaugggccucugaggaggcguu

SEQ ID NO: 461716 - RNA, 32 nt, Human
ggcugugaccccaggagggcccugccacgggc

SEQ ID NO: 461717 - RNA, 32 nt, Human
ggcugugacgucacuggauguguccugaucua

SEQ ID NO: 461718 - RNA, 32 nt, Human
ggcugugacuccacaucccgaggucgcugccu

SEQ ID NO: 461719 - RNA, 32 nt, Human
ggcugugacugcugcaagcucugccuucacca

SEQ ID NO: 461720 - RNA, 32 nt, Human
ggcugugacuuacuccugccuccaggggcggg

SEQ ID NO: 461721 - RNA, 32 nt, Human
ggcugugagacaagccacuggguucuucaaag

SEQ ID NO: 461722 - RNA, 32 nt, Human
ggcugugagaggacaggguggagaggaggaga

SEQ ID NO: 461723 - RNA, 32 nt, Human
ggcugugagaggaucaucuggggcaggcccuc

SEQ ID NO: 461724 - RNA, 32 nt, Human
ggcugugagagggaggcuggggugccugggcg

SEQ ID NO: 461725 - RNA, 32 nt, Human
ggcugugagcccgcagccuccucaaauguagc

SEQ ID NO: 461726 - RNA, 32 nt, Human
ggcugugagcugggcuucuguccuccucugug

SEQ ID NO: 461727 - RNA, 32 nt, Human
ggcugugaggacggcuuccagcagggagcuuc

SEQ ID NO: 461728 - RNA, 32 nt, Human
ggcugugaggggguuggauccaggaagcagcc

SEQ ID NO: 461729 - RNA, 32 nt, Human
ggcugugaggugaccccagacacugcagaacg

SEQ ID NO: 461730 - RNA, 32 nt, Human
ggcugugagguggcagcggcugcagcggcgga

SEQ ID NO: 461731 - RNA, 32 nt, Human
ggcugugagucaccucugccucaugugggugg

SEQ ID NO: 461732 - RNA, 18 nt, Human
ggcugugaguccagguca

SEQ ID NO: 461733 - RNA, 32 nt, Human
ggcugugauccaggcuggggcgagaccauguc

SEQ ID NO: 461734 - RNA, 32 nt, Human
ggcugugauggaaauucaaaagccccuucuca

SEQ ID NO: 461735 - RNA, 32 nt, Human
ggcugugaugggcaggaaguggucaggaccca

SEQ ID NO: 461736 - RNA, 32 nt, Human
ggcugugauuccauucccucugcuuucuugaa

SEQ ID NO: 461737 - RNA, 32 nt, Human
ggcugugcaccagcaaaccuccaggaaggauc

SEQ ID NO: 461738 - RNA, 17 nt, Human
ggcugugcaggaggguu

SEQ ID NO: 461739 - RNA, 18 nt, Human
ggcugugcaggggggcug

SEQ ID NO: 461740 - RNA, 23 nt, Human
ggcugugccaagugugcccaggg

SEQ ID NO: 461741 - RNA, 23 nt, Human
ggcugugccagcggcuccgcagg

SEQ ID NO: 461742 - RNA, 27 nt, Human
ggcugugccaggacagagcccugcugg

SEQ ID NO: 461743 - RNA, 22 nt, Human
ggcugugccaguggcguguagg

SEQ ID NO: 461744 - RNA, 32 nt, Human
ggcugugccauagccacacaggaagcugccuu

SEQ ID NO: 461745 - RNA, 21 nt, Human
ggcugugcccagagccccagg

SEQ ID NO: 461746 - RNA, 23 nt, Human
ggcugugcccagccagcccuggg

SEQ ID NO: 461747 - RNA, 24 nt, Human
ggcugugcccccuaugcccugugg

SEQ ID NO: 461748 - RNA, 26 nt, Human
ggcugugccccugaugcagccugugg

SEQ ID NO: 461749 - RNA, 21 nt, Human
ggcugugcccuggcuccgugg

SEQ ID NO: 461750 - RNA, 27 nt, Human
ggcugugccucuagucgcagcucugug

SEQ ID NO: 461751 - RNA, 32 nt, Human
ggcugugccugggaguggcuucagcccaggcg

SEQ ID NO: 461752 - RNA, 22 nt, Human
ggcugugcgcagcagccccagg

SEQ ID NO: 461753 - RNA, 32 nt, Human
ggcugugcggagcuggugcugccugaaacccc

SEQ ID NO: 461754 - RNA, 32 nt, Human
ggcugugcggccgcgcugccuccaggaagccu

SEQ ID NO: 461755 - RNA, 23 nt, Human
ggcugugcuagauuuucccaugg

SEQ ID NO: 461756 - RNA, 32 nt, Human
ggcugugcugagagcacuggccucugcacuca

SEQ ID NO: 461757 - RNA, 21 nt, Human
ggcugugcuggagcccggugg

SEQ ID NO: 461758 - RNA, 32 nt, Human
ggcugugcuggcacagaccugagaauggggac

SEQ ID NO: 461759 - RNA, 32 nt, Human
ggcugugcuggcugcacuggcccugcggcggg

SEQ ID NO: 461760 - RNA, 32 nt, Human
ggcugugcuguugccaacaguaaaccugcucu

SEQ ID NO: 461761 - RNA, 32 nt, Human
ggcugugcuuguucuuaaccucaggcucuguc

SEQ ID NO: 461762 - RNA, 32 nt, Human
ggcuguggaaguaccugucauuccugcaggag

SEQ ID NO: 461763 - RNA, 32 nt, Human
ggcuguggacacugucuugaggauguggacuu

SEQ ID NO: 461764 - RNA, 32 nt, Human
ggcuguggacuucacccaggaggagugggguc

SEQ ID NO: 461765 - RNA, 24 nt, Human
ggcuguggaggggaccaccugcca

SEQ ID NO: 461766 - RNA, 32 nt, Human
ggcuguggagguggagaacguugggccacgcu

SEQ ID NO: 461767 - RNA, 32 nt, Human
ggcuguggaugagagacauagacgagagagug

SEQ ID NO: 461768 - RNA, 24 nt, Human
ggcuguggaugucuucagccucug

SEQ ID NO: 461769 - RNA, 32 nt, Human
ggcuguggcacagggcagcgacaacuugggac

SEQ ID NO: 461770 - RNA, 32 nt, Human
ggcuguggccaggccagcugggcucggggagc

SEQ ID NO: 461771 - RNA, 20 nt, Human
ggcuguggccaggcucaggc

SEQ ID NO: 461772 - RNA, 32 nt, Human
ggcuguggcccaggcacuaccugcuggcuccc

SEQ ID NO: 461773 - RNA, 32 nt, Human
ggcuguggccgagaagaugcuccaguaccggc

SEQ ID NO: 461774 - RNA, 32 nt, Human
ggcuguggccgucaguggaaugcagcugucag

SEQ ID NO: 461775 - RNA, 20 nt, Human
ggcuguggcggcggcgggag

SEQ ID NO: 461776 - RNA, 32 nt, Human
ggcuguggcucuccaaggccccucucuuccau

SEQ ID NO: 461777 - RNA, 32 nt, Human
ggcuguggcugaagcuggcggaucgcuugagg

SEQ ID NO: 461778 - RNA, 23 nt, Human
ggcuguggcuguuccacgcggcc

SEQ ID NO: 461779 - RNA, 22 nt, Human
ggcuguggcuucagccgugguc

SEQ ID NO: 461780 - RNA, 32 nt, Human
ggcuguggcuucugacacucaggucauagccu

SEQ ID NO: 461781 - RNA, 32 nt, Human
ggcugugggagaguugaccguauucugggcaa

SEQ ID NO: 461782 - RNA, 32 nt, Human
ggcugugggagcagcaguggucaugguggguc

SEQ ID NO: 461783 - RNA, 32 nt, Human
ggcugugggaggagggaggaaagaugaaaaac

SEQ ID NO: 461784 - RNA, 32 nt, Human
ggcugugggaggcagcggagcaggcgaugaag

SEQ ID NO: 461785 - RNA, 25 nt, Human
ggcugugggcaaguuccugaccaca

SEQ ID NO: 461786 - RNA, 32 nt, Human
ggcugugggcaggagccagggguccugucuga

SEQ ID NO: 461787 - RNA, 32 nt, Human
ggcugugggcuggguggccccauccuaccagg

SEQ ID NO: 461788 - RNA, 32 nt, Human
ggcuguggggaccccaggugggccuggcagga

SEQ ID NO: 461789 - RNA, 32 nt, Human
ggcuguggggaccugucagagucuggggacuc

SEQ ID NO: 461790 - RNA, 32 nt, Human
ggcuguggggccagaagcugggccaagcccuc

SEQ ID NO: 461791 - RNA, 32 nt, Human
ggcuguggggcugaguggcaucauggcggcuc

SEQ ID NO: 461792 - RNA, 32 nt, Human
ggcugugggggcaucuguccugagcuuggcug

SEQ ID NO: 461793 - RNA, 32 nt, Human
ggcuguggguggcucaugucaccaucuggaag

SEQ ID NO: 461794 - RNA, 32 nt, Human
ggcugugguacaacaugguccuuggugaagac

SEQ ID NO: 461795 - RNA, 32 nt, Human
ggcuguggugcauggcuguggagcucagggug

SEQ ID NO: 461796 - RNA, 32 nt, Human
ggcuguggugugaaagguggccagccugguuc

SEQ ID NO: 461797 - RNA, 32 nt, Human
ggcugugguguuuggcaaugcuaauucaaugc

SEQ ID NO: 461798 - RNA, 32 nt, Human
ggcuguguacaugugugugcccaggggugagu

SEQ ID NO: 461799 - RNA, 32 nt, Human
ggcuguguccacaugagcuaccaccuugcguu

SEQ ID NO: 461800 - RNA, 32 nt, Human
ggcuguguccccaccaaauugaauuguguuaa

SEQ ID NO: 461801 - RNA, 20 nt, Human
ggcuguguccuuggcuccag

SEQ ID NO: 461802 - RNA, 32 nt, Human
ggcuguguccuuuccaugauucugcccaggau

SEQ ID NO: 461803 - RNA, 32 nt, Human
ggcugugucucuucacucuguuucuggggcug

SEQ ID NO: 461804 - RNA, 19 nt, Human
ggcugugucucuuuauuua

SEQ ID NO: 461805 - RNA, 21 nt, Human
ggcugugugaccccagccucc

SEQ ID NO: 461806 - RNA, 22 nt, Human
ggcugugugagacgcagggaag

SEQ ID NO: 461807 - RNA, 32 nt, Human
ggcugugugcaggagugugagugagcaagagc

SEQ ID NO: 461808 - RNA, 32 nt, Human
ggcugugugcaggcaagcaggcauaggccaag

SEQ ID NO: 461809 - RNA, 32 nt, Human
ggcugugugcaggcugcaggauaucuggguau

SEQ ID NO: 461810 - RNA, 32 nt, Human
ggcugugugcccucucugccuuccucugacua

SEQ ID NO: 461811 - RNA, 19 nt, Human
ggcugugugccuuuucuca

SEQ ID NO: 461812 - RNA, 32 nt, Human
ggcuguguggagccaccacuccuagccacagc

SEQ ID NO: 461813 - RNA, 32 nt, Human
ggcuguguggggagguggguggagaggugagc

SEQ ID NO: 461814 - RNA, 32 nt, Human
ggcugugugucaguguuugcugggcuuguggc

SEQ ID NO: 461815 - RNA, 32 nt, Human
ggcugugugugccuguguguaggucccacggc

SEQ ID NO: 461816 - RNA, 32 nt, Human
ggcuguguuccuucuggaggcuccagggcagg

SEQ ID NO: 461817 - RNA, 32 nt, Human
ggcuguguucucugaucuaggccuucccagag

SEQ ID NO: 461818 - RNA, 32 nt, Human
ggcuguguugcccaggcuggagugcaguagcu

SEQ ID NO: 461819 - RNA, 32 nt, Human
ggcuguguuggggcauggugagagagggucuu

SEQ ID NO: 461820 - RNA, 20 nt, Human
ggcuguguugucagcacugu

SEQ ID NO: 461821 - RNA, 22 nt, Human
ggcuguguuucucaccgcgguc

SEQ ID NO: 461822 - RNA, 32 nt, Human
ggcuguuaaaaagggaguugauuugaggaagu

SEQ ID NO: 461823 - RNA, 32 nt, Human
ggcuguuauaaauaaagcuguuaugaacauuu

SEQ ID NO: 461824 - RNA, 32 nt, Human
ggcuguuauggugauggauggauguggauuug

SEQ ID NO: 461825 - RNA, 32 nt, Human
ggcuguucacaggaacccacaggccaccggcu

SEQ ID NO: 461826 - RNA, 32 nt, Human
ggcuguucacuuacuaagcaccuacugugugc

SEQ ID NO: 461827 - RNA, 26 nt, Human
ggcuguuccgcuuagaaugcaauggg

SEQ ID NO: 461828 - RNA, 32 nt, Human
ggcuguucuaaaacuccugaacucagguaauc

SEQ ID NO: 461829 - RNA, 32 nt, Human
ggcuguucucaaacuccuggccucaggcgauc

SEQ ID NO: 461830 - RNA, 32 nt, Human
ggcuguucuccaccacgccaaacuccgggccc

SEQ ID NO: 461831 - RNA, 32 nt, Human
ggcuguucuccccucacugcugagucucccag

SEQ ID NO: 461832 - RNA, 32 nt, Human
ggcuguucucgaacuccugaccucaggugauc

SEQ ID NO: 461833 - RNA, 32 nt, Human
ggcuguucucuugagcagcguucauuuaucuc

SEQ ID NO: 461834 - RNA, 32 nt, Human
ggcuguucugcagcaccgcagggaagggagga

SEQ ID NO: 461835 - RNA, 32 nt, Human
ggcuguucuucaacuccugggcucaagcaguc

SEQ ID NO: 461836 - RNA, 32 nt, Human
ggcuguugagccuggauggguggaggcuuagg

SEQ ID NO: 461837 - RNA, 32 nt, Human
ggcuguugcccgguguuucagcacuuucaguu

SEQ ID NO: 461838 - RNA, 32 nt, Human
ggcuguugcgaucacagaaggugguggagugu

SEQ ID NO: 461839 - RNA, 32 nt, Human
ggcuguuggcauuuugggaggcugaggcaggu

SEQ ID NO: 461840 - RNA, 19 nt, Human
ggcuguuggguuucgcuca

SEQ ID NO: 461841 - RNA, 20 nt, Human
ggcuguugugcuucauggcc

SEQ ID NO: 461842 - RNA, 32 nt, Human
ggcuguuuaagcugccaauuguagcacucagc

SEQ ID NO: 461843 - RNA, 32 nt, Human
ggcuguuuacacaccacuuuccugccuccucu

SEQ ID NO: 461844 - RNA, 32 nt, Human
ggcuguuuagaaaacugcugcccaaauuuauu

SEQ ID NO: 461845 - RNA, 32 nt, Human
ggcuguuucccaggcugaagugcaguggcaug

SEQ ID NO: 461846 - RNA, 32 nt, Human
ggcuguuucggugucaggagacaaagcuggca

SEQ ID NO: 461847 - RNA, 32 nt, Human
ggcuguuucucuaggcuggaugcugucaggaa

SEQ ID NO: 461848 - RNA, 18 nt, Human
ggcuguuucuuccaauua

SEQ ID NO: 461849 - RNA, 32 nt, Human
ggcuguuugcccaggaacuuaggguggguacc

SEQ ID NO: 461850 - RNA, 32 nt, Human
ggcuguuuggcuuaggagaugcuguaguagua

SEQ ID NO: 461851 - RNA, 32 nt, Human
ggcuguuuguguccuugggcgcugcuuggaga

SEQ ID NO: 461852 - RNA, 32 nt, Human
ggcuguuuuaccugggcuucugaccaaccagc

SEQ ID NO: 461853 - RNA, 19 nt, Human
ggcuguuuucacaaaugac

SEQ ID NO: 461854 - RNA, 21 nt, Human
ggcuguuuucccucugcugcu

SEQ ID NO: 461855 - RNA, 32 nt, Human
ggcuguuuucccucugcugcuuuuggggaaug

SEQ ID NO: 461856 - RNA, 32 nt, Human
ggcuguuuugugaauaaaacgaaugcauguuu

SEQ ID NO: 461857 - RNA, 32 nt, Human
ggcuguuuuuccuuguugccccgcucuagacu

SEQ ID NO: 461858 - RNA, 19 nt, Human
ggcuuaaagguuggccagg

SEQ ID NO: 461859 - RNA, 32 nt, Human
ggcuuaaagguuggccagggauggaguaaacc

SEQ ID NO: 461860 - RNA, 32 nt, Human
ggcuuaaaucuguguaaagaaaaucugucuuu

SEQ ID NO: 461861 - RNA, 18 nt, Human
ggcuuaacccuccucaca

SEQ ID NO: 461862 - RNA, 32 nt, Human
ggcuuaacucacagguuucccaucagcuuucu

SEQ ID NO: 461863 - RNA, 32 nt, Human
ggcuuaagcuguuccuuggauacuuuugguaa

SEQ ID NO: 461864 - RNA, 32 nt, Human
ggcuuaaggagaggagaaacugagaaaugaau

SEQ ID NO: 461865 - RNA, 32 nt, Human
ggcuuaagggaguggguucauuaccuucuauc

SEQ ID NO: 461866 - RNA, 17 nt, Human
ggcuuaaggucagagga

SEQ ID NO: 461867 - RNA, 24 nt, Human
ggcuuaagugacccucccaccuca

SEQ ID NO: 461868 - RNA, 24 nt, Human
ggcuuaagugauccucccaccuca

SEQ ID NO: 461869 - RNA, 25 nt, Human
ggcuuaagugauuucuccugucuca

SEQ ID NO: 461870 - RNA, 32 nt, Human
ggcuuaaguucaguccuccugcccuggagcug

SEQ ID NO: 461871 - RNA, 32 nt, Human
ggcuuaaucuuaaaauugguggucauuucaau

SEQ ID NO: 461872 - RNA, 21 nt, Human
ggcuuaauucggggaagaaga

SEQ ID NO: 461873 - RNA, 32 nt, Human
ggcuuacaccaguaaucccagcacuuugggag

SEQ ID NO: 461874 - RNA, 32 nt, Human
ggcuuacaccuguaaccccagcacuuugggag

SEQ ID NO: 461875 - RNA, 21 nt, Human
ggcuuacaccuguaagcccag

SEQ ID NO: 461876 - RNA, 32 nt, Human
ggcuuacaccuguaagcccagcacuuugggag

SEQ ID NO: 461877 - RNA, 32 nt, Human
ggcuuacaccuguaaucccaacacuuugcgag

SEQ ID NO: 461878 - RNA, 32 nt, Human
ggcuuacaccuguaaucccaacacuuugggaa

SEQ ID NO: 461879 - RNA, 32 nt, Human
ggcuuacaccuguaaucccaaugcuuugggag

SEQ ID NO: 461880 - RNA, 32 nt, Human
ggcuuacaccuguaaucccagcacuuugggag

SEQ ID NO: 461881 - RNA, 32 nt, Human
ggcuuacaccuguaaucccagcuacucaggag

SEQ ID NO: 461882 - RNA, 32 nt, Human
ggcuuacaccuguaaucccaguacuuugggag

SEQ ID NO: 461883 - RNA, 32 nt, Human
ggcuuacaccuguaauccuaguacuuugggag

SEQ ID NO: 461884 - RNA, 32 nt, Human
ggcuuacaccuguaaucgcagcauuuugggag

SEQ ID NO: 461885 - RNA, 32 nt, Human
ggcuuacaccuguaauuccagcacuuugggac

SEQ ID NO: 461886 - RNA, 32 nt, Human
ggcuuacaccugugaucccagcacuuugggag

SEQ ID NO: 461887 - RNA, 30 nt, Human
ggcuuacacggugaaacccacgucucuacu

SEQ ID NO: 461888 - RNA, 32 nt, Human
ggcuuacaggcacccaccaccaugcccggcua

SEQ ID NO: 461889 - RNA, 32 nt, Human
ggcuuacaucuguaaucccagcacuuugggag

SEQ ID NO: 461890 - RNA, 32 nt, Human
ggcuuacauggugaaaccccaucucuacuaaa

SEQ ID NO: 461891 - RNA, 21 nt, Human
ggcuuacauuuucucugugga

SEQ ID NO: 461892 - RNA, 23 nt, Human
ggcuuacccagcacgggcucccu

SEQ ID NO: 461893 - RNA, 32 nt, Human
ggcuuacccagccucuucgucugcccugcuuu

SEQ ID NO: 461894 - RNA, 32 nt, Human
ggcuuaccccucucuaggguugcaguugcuuu

SEQ ID NO: 461895 - RNA, 24 nt, Human
ggcuuaccugacagccagccugcc

SEQ ID NO: 461896 - RNA, 32 nt, Human
ggcuuacgccuauaaucccagcacuuugggag

SEQ ID NO: 461897 - RNA, 32 nt, Human
ggcuuacgccuauaaucccagcuacucaggag

SEQ ID NO: 461898 - RNA, 32 nt, Human
ggcuuacgccuguaaucccaauacuuugggag

SEQ ID NO: 461899 - RNA, 32 nt, Human
ggcuuacgccuguaaucccagcacuuugggac

SEQ ID NO: 461900 - RNA, 32 nt, Human
ggcuuacgccuguaaucccagcacuuugggag

SEQ ID NO: 461901 - RNA, 32 nt, Human
ggcuuacgccuguaaucccagcgcuuugggag

SEQ ID NO: 461902 - RNA, 32 nt, Human
ggcuuacgccuguaaucccaggacuuugggag

SEQ ID NO: 461903 - RNA, 32 nt, Human
ggcuuacgccuguaauccuagcacuuugggag

SEQ ID NO: 461904 - RNA, 32 nt, Human
ggcuuacgccuguaauuccagcacuuugggag

SEQ ID NO: 461905 - RNA, 32 nt, Human
ggcuuacgcuuguagucccagcacuuugggag

SEQ ID NO: 461906 - RNA, 24 nt, Human
ggcuuacuacaaccuccgccuccu

SEQ ID NO: 461907 - RNA, 32 nt, Human
ggcuuacuacaaccuccgccuccuggguucaa

SEQ ID NO: 461908 - RNA, 32 nt, Human
ggcuuacuacagccuccaccuucagguucaag

SEQ ID NO: 461909 - RNA, 32 nt, Human
ggcuuacuacgaccucugccuccuggguucaa

SEQ ID NO: 461910 - RNA, 32 nt, Human
ggcuuacucagagauuugauugcucaacaugc

SEQ ID NO: 461911 - RNA, 23 nt, Human
ggcuuacuccaaccucugccucc

SEQ ID NO: 461912 - RNA, 32 nt, Human
ggcuuacugaaaccucugccucccagguucaa

SEQ ID NO: 461913 - RNA, 32 nt, Human
ggcuuacugagcaguggguugcaggaggagga

SEQ ID NO: 461914 - RNA, 23 nt, Human
ggcuuacugcaaccuccaccucc

SEQ ID NO: 461915 - RNA, 32 nt, Human
ggcuuacugcaaccuccaccucccaggugcaa

SEQ ID NO: 461916 - RNA, 32 nt, Human
ggcuuacugcaaccuccaccucccagguucaa

SEQ ID NO: 461917 - RNA, 32 nt, Human
ggcuuacugcaaccuccaccucccggguucaa

SEQ ID NO: 461918 - RNA, 24 nt, Human
ggcuuacugcaaccuccaccuccu

SEQ ID NO: 461919 - RNA, 32 nt, Human
ggcuuacugcaaccuccaccuccuggguucaa

SEQ ID NO: 461920 - RNA, 32 nt, Human
ggcuuacugcaaccuccgccuacuggguucaa

SEQ ID NO: 461921 - RNA, 23 nt, Human
ggcuuacugcaaccuccgccucc

SEQ ID NO: 461922 - RNA, 32 nt, Human
ggcuuacugcaaccuccgccucccagguucaa

SEQ ID NO: 461923 - RNA, 24 nt, Human
ggcuuacugcaaccuccgccuccu

SEQ ID NO: 461924 - RNA, 32 nt, Human
ggcuuacugcaaccuccgccuccuggguucaa

SEQ ID NO: 461925 - RNA, 32 nt, Human
ggcuuacugcaaccuccgccuucccagauuca

SEQ ID NO: 461926 - RNA, 32 nt, Human
ggcuuacugcaaccucugccucccagguuuaa

SEQ ID NO: 461927 - RNA, 32 nt, Human
ggcuuacugcaaccuuugccucccagguuuaa

SEQ ID NO: 461928 - RNA, 32 nt, Human
ggcuuacugcaacuuccagcuccuggguucga

SEQ ID NO: 461929 - RNA, 32 nt, Human
ggcuuacugcaacuuccgacucccagguucaa

SEQ ID NO: 461930 - RNA, 32 nt, Human
ggcuuacugcaagcuccgccucccagguucau

SEQ ID NO: 461931 - RNA, 32 nt, Human
ggcuuacugcaagcucugccuccuggguucaa

SEQ ID NO: 461932 - RNA, 32 nt, Human
ggcuuacugcagccuugaucucccaggcucaa

SEQ ID NO: 461933 - RNA, 32 nt, Human
ggcuuacugcagccuuugccuccccggcucga

SEQ ID NO: 461934 - RNA, 32 nt, Human
ggcuuacugugacauccgccuccuggguucaa

SEQ ID NO: 461935 - RNA, 32 nt, Human
ggcuuacuuccuccuguccucgguguuacuug

SEQ ID NO: 461936 - RNA, 32 nt, Human
ggcuuacuuccuggucuacuugaggcugcaau

SEQ ID NO: 461937 - RNA, 32 nt, Human
ggcuuagaggcucaccuacucuaacaggaccu

SEQ ID NO: 461938 - RNA, 19 nt, Human
ggcuuagagggcagagugg

SEQ ID NO: 461939 - RNA, 32 nt, Human
ggcuuagaggggcuggcucucaguccccgccu

SEQ ID NO: 461940 - RNA, 32 nt, Human
ggcuuagagugguaccugcuugcucaagcaac

SEQ ID NO: 461941 - RNA, 32 nt, Human
ggcuuagccaugaccucacagagcugagauga

SEQ ID NO: 461942 - RNA, 32 nt, Human
ggcuuagccggaggaagcacauuuugaaccug

SEQ ID NO: 461943 - RNA, 18 nt, Human
ggcuuagcuuggguucag

SEQ ID NO: 461944 - RNA, 24 nt, Human
ggcuuaggauaucccagccuacca

SEQ ID NO: 461945 - RNA, 32 nt, Human
ggcuuaggggcaacaguguguucaagaggacu

SEQ ID NO: 461946 - RNA, 32 nt, Human
ggcuuagggggugguuauguacuucacaagcc

SEQ ID NO: 461947 - RNA, 32 nt, Human
ggcuuaggucuggacuggucagcuguggcacc

SEQ ID NO: 461948 - RNA, 24 nt, Human
ggcuuaggugaccccccaaccuca

SEQ ID NO: 461949 - RNA, 32 nt, Human
ggcuuaggugagaucgugaggguggggcucgc

SEQ ID NO: 461950 - RNA, 17 nt, Human
ggcuuaguccagagugg

SEQ ID NO: 461951 - RNA, 32 nt, Human
ggcuuaguccagucugugcuccugggcuacaa

SEQ ID NO: 461952 - RNA, 32 nt, Human
ggcuuagugauggguaaauggaagacugguug

SEQ ID NO: 461953 - RNA, 32 nt, Human
ggcuuagugcagagcagccaauggguacugag

SEQ ID NO: 461954 - RNA, 19 nt, Human
ggcuuaguucccugaggca

SEQ ID NO: 461955 - RNA, 32 nt, Human
ggcuuauaaaguguuuggucacaguaagacaa

SEQ ID NO: 461956 - RNA, 20 nt, Human
ggcuuauaaguugcuuuuug

SEQ ID NO: 461957 - RNA, 32 nt, Human
ggcuuauccuuaaagaucaucucccauccucc

SEQ ID NO: 461958 - RNA, 32 nt, Human
ggcuuaucuggaacuccugggcucaagaggga

SEQ ID NO: 461959 - RNA, 32 nt, Human
ggcuuaugaguuuccaggugguuaucacugga

SEQ ID NO: 461960 - RNA, 19 nt, Human
ggcuuaugcccaggucuag

SEQ ID NO: 461961 - RNA, 32 nt, Human
ggcuuaugccuauaauccuagcacuuugggag

SEQ ID NO: 461962 - RNA, 32 nt, Human
ggcuuaugccuauaauuccagcacuuggggag

SEQ ID NO: 461963 - RNA, 32 nt, Human
ggcuuaugccuguaaucccacuuugggaggcc

SEQ ID NO: 461964 - RNA, 32 nt, Human
ggcuuaugccuguaaucccagcacucugggag

SEQ ID NO: 461965 - RNA, 32 nt, Human
ggcuuaugccuguaaucccagcacuuggggaa

SEQ ID NO: 461966 - RNA, 32 nt, Human
ggcuuaugccuguaaucccagcacuuugcagg

SEQ ID NO: 461967 - RNA, 32 nt, Human
ggcuuaugccuguaaucccagcacuuuggaag

SEQ ID NO: 461968 - RNA, 32 nt, Human
ggcuuaugccuguaaucccagcacuuugggag

SEQ ID NO: 461969 - RNA, 32 nt, Human
ggcuuaugccuguaaucccagcacuuugggug

SEQ ID NO: 461970 - RNA, 32 nt, Human
ggcuuaugccuguaaucccagcaugcugggag

SEQ ID NO: 461971 - RNA, 32 nt, Human
ggcuuaugccuguaaucccgguacuuugggag

SEQ ID NO: 461972 - RNA, 32 nt, Human
ggcuuaugccuguaaucccugcacuuugggaa

SEQ ID NO: 461973 - RNA, 19 nt, Human
gggaggagaugaaggauga

SEQ ID NO: 461974 - RNA, 19 nt, Human
gggaggagaugggaaggga

SEQ ID NO: 461975 - RNA, 16 nt, Human
gggaggagaugggagg

SEQ ID NO: 461976 - RNA, 19 nt, Human
gggaggagcagcccgggga

SEQ ID NO: 461977 - RNA, 19 nt, Human
gggaggagcagcgggaaga

SEQ ID NO: 461978 - RNA, 19 nt, Human
gggaggagcaggcaggaga

SEQ ID NO: 461979 - RNA, 18 nt, Human
gggaggagcaggcuagga

SEQ ID NO: 461980 - RNA, 18 nt, Human
gggaggagcaggcugaga

SEQ ID NO: 461981 - RNA, 31 nt, Human
gggaggagcaucaugaguaggagggaggcag

SEQ ID NO: 461982 - RNA, 20 nt, Human
gggaggagcccgccgggagg

SEQ ID NO: 461983 - RNA, 19 nt, Human
gggaggagcccgggggaga

SEQ ID NO: 461984 - RNA, 21 nt, Human
gggaggagccgcagccggagg

SEQ ID NO: 461985 - RNA, 32 nt, Human
gggaggagcgacaccuccaggcuuccgggagc

SEQ ID NO: 461986 - RNA, 19 nt, Human
gggaggagcgccggggagg

SEQ ID NO: 461987 - RNA, 18 nt, Human
gggaggagcggagguaga

SEQ ID NO: 461988 - RNA, 19 nt, Human
gggaggagcucuagggagg

SEQ ID NO: 461989 - RNA, 18 nt, Human
gggaggagcugaggggga

SEQ ID NO: 461990 - RNA, 32 nt, Human
gggaggagcugcagggagcugguggcggggca

SEQ ID NO: 461991 - RNA, 20 nt, Human
gggaggagcugguagggaga

SEQ ID NO: 461992 - RNA, 32 nt, Human
gggaggaggaacauucagguuucugagagcug

SEQ ID NO: 461993 - RNA, 32 nt, Human
gggaggaggaagaagagaaggaagaggagagg

SEQ ID NO: 461994 - RNA, 32 nt, Human
gggaggaggaagaggagaauaaggaggagcag

SEQ ID NO: 461995 - RNA, 32 nt, Human
gggaggaggaagaggagaggaggaagcaaaga

SEQ ID NO: 461996 - RNA, 18 nt, Human
gggaggaggaccgggaga

SEQ ID NO: 461997 - RNA, 20 nt, Human
gggaggaggacgcugaggag

SEQ ID NO: 461998 - RNA, 18 nt, Human
gggaggaggacuuggagg

SEQ ID NO: 461999 - RNA, 32 nt, Human
gggaggaggagaaagguggaggagaagggagg

SEQ ID NO: 462000 - RNA, 32 nt, Human
gggaggaggagaaggaggaggaggagagcgcg

SEQ ID NO: 462001 - RNA, 32 nt, Human
gggaggaggagagaugggugaagacaaaagag

SEQ ID NO: 462002 - RNA, 32 nt, Human
gggaggaggaggaggaagaagagcggagagag

SEQ ID NO: 462003 - RNA, 32 nt, Human
gggaggaggaggaggaagagguauggcauggg

SEQ ID NO: 462004 - RNA, 32 nt, Human
gggaggaggaggaggagaagguggagaggaag

SEQ ID NO: 462005 - RNA, 32 nt, Human
gggaggaggaggaggaggaagaggaggagaag

SEQ ID NO: 462006 - RNA, 32 nt, Human
gggaggaggaggaggaggagaggagcagucag

SEQ ID NO: 462007 - RNA, 32 nt, Human
gggaggaggaggaggaggaggaggucguggau

SEQ ID NO: 462008 - RNA, 32 nt, Human
gggaggaggaggaggagguugcagugagccga

SEQ ID NO: 462009 - RNA, 32 nt, Human
gggaggaggaggaggaucaugaaggccggagu

SEQ ID NO: 462010 - RNA, 32 nt, Human
gggaggaggaggcggaggaggcggaggaggag

SEQ ID NO: 462011 - RNA, 32 nt, Human
gggaggaggaggcggcagcggcggaggaaggc

SEQ ID NO: 462012 - RNA, 32 nt, Human
gggaggaggaggcggcggcggcgaagggaggc

SEQ ID NO: 462013 - RNA, 23 nt, Human
gggaggaggcaaggagggggaga

SEQ ID NO: 462014 - RNA, 20 nt, Human
gggaggaggcacggccgagg

SEQ ID NO: 462015 - RNA, 22 nt, Human
gggaggaggcacuucuggggga

SEQ ID NO: 462016 - RNA, 32 nt, Human
gggaggaggcagcagacacuggagaugacauu

SEQ ID NO: 462017 - RNA, 18 nt, Human
gggaggaggcagcugcgg

SEQ ID NO: 462018 - RNA, 20 nt, Human
gggaggaggcaggccagagg

SEQ ID NO: 462019 - RNA, 19 nt, Human
gggaggaggcagugggagg

SEQ ID NO: 462020 - RNA, 32 nt, Human
gggaggaggcagugggagggcggagggcgggg

SEQ ID NO: 462021 - RNA, 18 nt, Human
gggaggaggcaugagagg

SEQ ID NO: 462022 - RNA, 16 nt, Human
gggaggaggccgggag

SEQ ID NO: 462023 - RNA, 17 nt, Human
gggaggaggccugugga

SEQ ID NO: 462024 - RNA, 19 nt, Human
gggaggaggccuuggaaga

SEQ ID NO: 462025 - RNA, 21 nt, Human
gggaggaggcgaaggaggagg

SEQ ID NO: 462026 - RNA, 18 nt, Human
gggaggaggcgcggcugg

SEQ ID NO: 462027 - RNA, 18 nt, Human
gggaggaggcgcuccaga

SEQ ID NO: 462028 - RNA, 18 nt, Human
gggaggaggcggaggcag

SEQ ID NO: 462029 - RNA, 17 nt, Human
gggaggaggcggccgag

SEQ ID NO: 462030 - RNA, 18 nt, Human
gggaggaggcggcggcga

SEQ ID NO: 462031 - RNA, 18 nt, Human
gggaggaggcggcggcgg

SEQ ID NO: 462032 - RNA, 18 nt, Human
gggaggaggcggcugaga

SEQ ID NO: 462033 - RNA, 16 nt, Human
gggaggaggcgggaga

SEQ ID NO: 462034 - RNA, 20 nt, Human
gggaggaggcggugcggcga

SEQ ID NO: 462035 - RNA, 19 nt, Human
gggaggaggcugccggagg

SEQ ID NO: 462036 - RNA, 16 nt, Human
gggaggaggcugggga

SEQ ID NO: 462037 - RNA, 20 nt, Human
gggaggaggcugugaugaga

SEQ ID NO: 462038 - RNA, 18 nt, Human
gggaggagggacgggagg

SEQ ID NO: 462039 - RNA, 19 nt, Human
gggaggagggagagggagg

SEQ ID NO: 462040 - RNA, 32 nt, Human
gggaggagggagagggaggucacuggaaaggg

SEQ ID NO: 462041 - RNA, 32 nt, Human
gggaggagggagcccugaaaagagguacuaag

SEQ ID NO: 462042 - RNA, 18 nt, Human
gggaggagggagcggaga

SEQ ID NO: 462043 - RNA, 19 nt, Human
gggaggagggaggaggaga

SEQ ID NO: 462044 - RNA, 23 nt, Human
gggaggagggaggaggagacaga

SEQ ID NO: 462045 - RNA, 17 nt, Human
gggaggagggagggagg

SEQ ID NO: 462046 - RNA, 17 nt, Human
gggaggagggaggggga

SEQ ID NO: 462047 - RNA, 32 nt, Human
gggaggagggagggggaaguggagaggggagc

SEQ ID NO: 462048 - RNA, 32 nt, Human
gggaggagggagugacgagucaaggaggagac

SEQ ID NO: 462049 - RNA, 19 nt, Human
gggaggagggaguggaagg

SEQ ID NO: 462050 - RNA, 20 nt, Human
gggaggagggaguggagaga

SEQ ID NO: 462051 - RNA, 19 nt, Human
gggaggagggaguggggga

SEQ ID NO: 462052 - RNA, 18 nt, Human
gggaggagggcaggcaga

SEQ ID NO: 462053 - RNA, 32 nt, Human
gggaggagggcaggcgguaggaagggagaggg

SEQ ID NO: 462054 - RNA, 17 nt, Human
gggaggagggccagaga

SEQ ID NO: 462055 - RNA, 18 nt, Human
gggaggagggcgaagagg

SEQ ID NO: 462056 - RNA, 20 nt, Human
gggaggagggcgccuaggag

SEQ ID NO: 462057 - RNA, 18 nt, Human
gggaggagggcggggagg

SEQ ID NO: 462058 - RNA, 20 nt, Human
gggaggagggcggggggagg

SEQ ID NO: 462059 - RNA, 20 nt, Human
gggaggagggcggugggagg

SEQ ID NO: 462060 - RNA, 17 nt, Human
gggaggaggggaaggag

SEQ ID NO: 462061 - RNA, 17 nt, Human
gggaggaggggaggaga

SEQ ID NO: 462062 - RNA, 18 nt, Human
gggaggaggggagggagg

SEQ ID NO: 462063 - RNA, 17 nt, Human
gggaggaggggcagaga

SEQ ID NO: 462064 - RNA, 32 nt, Human
gggaggaggggccagguggacaggaggcccug

SEQ ID NO: 462065 - RNA, 19 nt, Human
gggaggaggggcucaagga

SEQ ID NO: 462066 - RNA, 19 nt, Human
gggaggaggggcugaggag

SEQ ID NO: 462067 - RNA, 32 nt, Human
gggaggaggggcugcccggaguuggguccuug

SEQ ID NO: 462068 - RNA, 18 nt, Human
gggaggaggggcugggga

SEQ ID NO: 462069 - RNA, 18 nt, Human
gggaggagggggaggagg

SEQ ID NO: 462070 - RNA, 19 nt, Human
gggaggagggggaggguga

SEQ ID NO: 462071 - RNA, 32 nt, Human
gggaggagggggcaucuucugacagccugccu

SEQ ID NO: 462072 - RNA, 19 nt, Human
gggaggagggggcugagga

SEQ ID NO: 462073 - RNA, 18 nt, Human
gggaggaggggggaggga

SEQ ID NO: 462074 - RNA, 18 nt, Human
gggaggaggggguagagg

SEQ ID NO: 462075 - RNA, 18 nt, Human
gggaggaggguaggaaga

SEQ ID NO: 462076 - RNA, 19 nt, Human
gggaggagggucuguagga

SEQ ID NO: 462077 - RNA, 18 nt, Human
gggaggaggguggggaga

SEQ ID NO: 462078 - RNA, 19 nt, Human
gggaggaggucagaggaga

SEQ ID NO: 462079 - RNA, 20 nt, Human
gggaggaggucuguugguga

SEQ ID NO: 462080 - RNA, 20 nt, Human
gggaggaggugaggcuccgg

SEQ ID NO: 462081 - RNA, 20 nt, Human
gggaggaggugccggccgag

SEQ ID NO: 462082 - RNA, 20 nt, Human
gggaggaggugcuuucggga

SEQ ID NO: 462083 - RNA, 18 nt, Human
gggaggagguggaggaga

SEQ ID NO: 462084 - RNA, 19 nt, Human
gggaggagguggcauugga

SEQ ID NO: 462085 - RNA, 19 nt, Human
gggaggagguggcccagag

SEQ ID NO: 462086 - RNA, 20 nt, Human
gggaggagguggcgccggga

SEQ ID NO: 462087 - RNA, 19 nt, Human
gggaggagguggggcgagg

SEQ ID NO: 462088 - RNA, 17 nt, Human
gggaggaggugguagag

SEQ ID NO: 462089 - RNA, 18 nt, Human
gggaggagguguaggaga

SEQ ID NO: 462090 - RNA, 19 nt, Human
gggaggaggugugaggagg

SEQ ID NO: 462091 - RNA, 18 nt, Human
gggaggagucgggggcga

SEQ ID NO: 462092 - RNA, 17 nt, Human
gggaggagucgugggag

SEQ ID NO: 462093 - RNA, 18 nt, Human
gggaggaguuguggggga

SEQ ID NO: 462094 - RNA, 21 nt, Human
gggaggauaaguaggcuggga

SEQ ID NO: 462095 - RNA, 18 nt, Human
gggaggauaccugggaga

SEQ ID NO: 462096 - RNA, 31 nt, Human
gggaggaucaagcuuugaaccaaagccaauc

SEQ ID NO: 462097 - RNA, 22 nt, Human
gggaggaucacaugagcccagg

SEQ ID NO: 462098 - RNA, 20 nt, Human
gggaggaucaccugauguca

SEQ ID NO: 462099 - RNA, 22 nt, Human
gggaggaucacuugagcccagg

SEQ ID NO: 462100 - RNA, 20 nt, Human
gggaggaucacuugaggcca

SEQ ID NO: 462101 - RNA, 32 nt, Human
gggaggaucacuugaguccaggaggcggaggc

SEQ ID NO: 462102 - RNA, 32 nt, Human
gggaggaucacuugaguccaggaguuugagac

SEQ ID NO: 462103 - RNA, 32 nt, Human
gggaggaucauucugacgucggggcagccauu

SEQ ID NO: 462104 - RNA, 32 nt, Human
gggaggaucccuugaggccaggaguucggguc

SEQ ID NO: 462105 - RNA, 32 nt, Human
gggaggaucccuugaucccaggaauuugaggu

SEQ ID NO: 462106 - RNA, 22 nt, Human
gggaggaucgccagagcccagg

SEQ ID NO: 462107 - RNA, 20 nt, Human
gggaggaucgcuugagacca

SEQ ID NO: 462108 - RNA, 32 nt, Human
gggaggaucgcuugagaccagccuggggaaca

SEQ ID NO: 462109 - RNA, 22 nt, Human
gggaggaucgcuugagccaagg

SEQ ID NO: 462110 - RNA, 21 nt, Human
gggaggaucgcuugagcccag

SEQ ID NO: 462111 - RNA, 22 nt, Human
gggaggaucgcuugagcccagg

SEQ ID NO: 462112 - RNA, 24 nt, Human
gggaggaugauaagggaucccgga

SEQ ID NO: 462113 - RNA, 32 nt, Human
gggaggaugccuggcucaaccuccugcccuag

SEQ ID NO: 462114 - RNA, 32 nt, Human
gggaggauggaggcaggagcuggucuggggag

SEQ ID NO: 462115 - RNA, 32 nt, Human
gggaggaugggacuuagguaugccugcuagac

SEQ ID NO: 462116 - RNA, 31 nt, Human
gggaggauguacuuaucucagaugcuagagc

SEQ ID NO: 462117 - RNA, 20 nt, Human
gggaggauuacuugagacca

SEQ ID NO: 462118 - RNA, 22 nt, Human
gggaggauuacuugagcccagg

SEQ ID NO: 462119 - RNA, 32 nt, Human
gggaggauuccagaacagcagcacugagcucc

SEQ ID NO: 462120 - RNA, 32 nt, Human
gggaggauucgagggucacagagcaggcugac

SEQ ID NO: 462121 - RNA, 20 nt, Human
gggaggauugccugagacca

SEQ ID NO: 462122 - RNA, 32 nt, Human
gggaggauugccugagaccaggagguugaggc

SEQ ID NO: 462123 - RNA, 20 nt, Human
gggaggauugcuuaaggcca

SEQ ID NO: 462124 - RNA, 22 nt, Human
gggaggauugcuugaauccagg

SEQ ID NO: 462125 - RNA, 20 nt, Human
gggaggauugcuugagacca

SEQ ID NO: 462126 - RNA, 19 nt, Human
gggaggauugcuugagcca

SEQ ID NO: 462127 - RNA, 22 nt, Human
gggaggauugcuugagcccagg

SEQ ID NO: 462128 - RNA, 20 nt, Human
gggaggauugcuugaggcca

SEQ ID NO: 462129 - RNA, 22 nt, Human
gggaggauugcuugaggccagg

SEQ ID NO: 462130 - RNA, 22 nt, Human
gggaggauugcuugaguccagg

SEQ ID NO: 462131 - RNA, 32 nt, Human
gggaggauugcuugaguccaggaauuugagac

SEQ ID NO: 462132 - RNA, 32 nt, Human
gggaggauugcuugaguccaggagguugaggc

SEQ ID NO: 462133 - RNA, 32 nt, Human
gggaggauugcuugaguccaggaguucaaggc

SEQ ID NO: 462134 - RNA, 32 nt, Human
gggaggauuuggagcuuuuaagccaguuucag

SEQ ID NO: 462135 - RNA, 32 nt, Human
gggaggauuuuucuuuucucucugucuuuagg

SEQ ID NO: 462136 - RNA, 23 nt, Human
gggaggcaaaggcagguggauca

SEQ ID NO: 462137 - RNA, 23 nt, Human
gggaggcaacagacacgcuggag

SEQ ID NO: 462138 - RNA, 23 nt, Human
gggaggcaaccacacaguuugga

SEQ ID NO: 462139 - RNA, 21 nt, Human
gggaggcaaccgguuccagag

SEQ ID NO: 462140 - RNA, 32 nt, Human
gggaggcaagaguucaccauuaguccaagucu

SEQ ID NO: 462141 - RNA, 32 nt, Human
gggaggcacagcacuccugagaccuggaagcc

SEQ ID NO: 462142 - RNA, 32 nt, Human
gggaggcacaggacagaaggaauuggaagggg

SEQ ID NO: 462143 - RNA, 32 nt, Human
gggaggcacagguuccagugggccaagguugu

SEQ ID NO: 462144 - RNA, 32 nt, Human
gggaggcaccuguaaucccagcuacuugggag

SEQ ID NO: 462145 - RNA, 31 nt, Human
gggaggcacuagcaagagguuggagggccgg

SEQ ID NO: 462146 - RNA, 32 nt, Human
gggaggcacucccaucugcgcaccaggcugca

SEQ ID NO: 462147 - RNA, 20 nt, Human
gggaggcagaaaguccugga

SEQ ID NO: 462148 - RNA, 32 nt, Human
gggaggcagagaaggucccccgggaggagcgg

SEQ ID NO: 462149 - RNA, 32 nt, Human
gggaggcagagccaggccuccucaaguuggcc

SEQ ID NO: 462150 - RNA, 19 nt, Human
gggaggcagagcuggggga

SEQ ID NO: 462151 - RNA, 24 nt, Human
gggaggcagaggcaggagaaucau

SEQ ID NO: 462152 - RNA, 23 nt, Human
gggaggcagaggcgggcagauca

SEQ ID NO: 462153 - RNA, 23 nt, Human
gggaggcagaggcgggcggauca

SEQ ID NO: 462154 - RNA, 32 nt, Human
gggaggcagaggcugcacucuagccugggcaa

SEQ ID NO: 462155 - RNA, 32 nt, Human
gggaggcagaggcugcagagagccaaggagug

SEQ ID NO: 462156 - RNA, 32 nt, Human
gggaggcagaggcugcagugagccgagaucgu

SEQ ID NO: 462157 - RNA, 32 nt, Human
gggaggcagaggcugcagugagccgagauugc

SEQ ID NO: 462158 - RNA, 32 nt, Human
gggaggcagagggaggagggaaggcugggcuu

SEQ ID NO: 462159 - RNA, 23 nt, Human
gggaggcagagguggcacuggag

SEQ ID NO: 462160 - RNA, 32 nt, Human
gggaggcagagguugcaaugagcugagaucgc

SEQ ID NO: 462161 - RNA, 18 nt, Human
gggaggcagagguugcag

SEQ ID NO: 462162 - RNA, 22 nt, Human
gggaggcagagguugcagugag

SEQ ID NO: 462163 - RNA, 22 nt, Human
gggaggcagagguugcggugag

SEQ ID NO: 462164 - RNA, 18 nt, Human
gggaggcagagguuguag

SEQ ID NO: 462165 - RNA, 32 nt, Human
gggaggcagaguuugcagugagcggagaugau

SEQ ID NO: 462166 - RNA, 23 nt, Human
gggaggcagcauggcaccgugga

SEQ ID NO: 462167 - RNA, 23 nt, Human
gggaggcagccacaguccuggag

SEQ ID NO: 462168 - RNA, 21 nt, Human
gggaggcagccagagucggag

SEQ ID NO: 462169 - RNA, 23 nt, Human
gggaggcagccagcggggcguga

SEQ ID NO: 462170 - RNA, 22 nt, Human
gggaggcagcccuucccaggga

SEQ ID NO: 462171 - RNA, 24 nt, Human
gggaggcagccgcgcagccccgag

SEQ ID NO: 462172 - RNA, 21 nt, Human
gggaggcagccucagcaccug

SEQ ID NO: 462173 - RNA, 22 nt, Human
gggaggcagccuucaccaggga

SEQ ID NO: 462174 - RNA, 32 nt, Human
gggaggcagcgcgggaguggggcguugagggg

SEQ ID NO: 462175 - RNA, 23 nt, Human
gggaggcagcuagcugcccagag

SEQ ID NO: 462176 - RNA, 21 nt, Human
gggaggcagcucaccccaggg

SEQ ID NO: 462177 - RNA, 19 nt, Human
gggaggcagcuggcugggg

SEQ ID NO: 462178 - RNA, 24 nt, Human
gggaggcaggagccacccagguga

SEQ ID NO: 462179 - RNA, 32 nt, Human
gggaggcaggaggguuagagugaguaguaaga

SEQ ID NO: 462180 - RNA, 32 nt, Human
gggaggcaggaggugagguuggaaguugagca

SEQ ID NO: 462181 - RNA, 32 nt, Human
gggaggcaggcagaaggugacaauugacacga

SEQ ID NO: 462182 - RNA, 32 nt, Human
gggaggcaggcagaucacgaugucaggagauc

SEQ ID NO: 462183 - RNA, 32 nt, Human
gggaggcaggcaggcaugcaugugggccucug

SEQ ID NO: 462184 - RNA, 32 nt, Human
gggaggcagggacuuggggcuguuggagccaa

SEQ ID NO: 462185 - RNA, 19 nt, Human
gggaggcagggcugagagg

SEQ ID NO: 462186 - RNA, 23 nt, Human
gggaggcaggggcggguggauca

SEQ ID NO: 462187 - RNA, 20 nt, Human
gggaggcaguagguccugga

SEQ ID NO: 462188 - RNA, 21 nt, Human
gggaggcagucauaccuguuc

SEQ ID NO: 462189 - RNA, 20 nt, Human
gggaggcagucgcccugcgg

SEQ ID NO: 462190 - RNA, 18 nt, Human
gggaggcaguggcugggg

SEQ ID NO: 462191 - RNA, 32 nt, Human
gggaggcauaagccaccaugcccagccacgug

SEQ ID NO: 462192 - RNA, 32 nt, Human
gggaggcaucagugaauuuucagcugacaccu

SEQ ID NO: 462193 - RNA, 32 nt, Human
gggaggcauucaucucacagccacuugcccac

SEQ ID NO: 462194 - RNA, 23 nt, Human
gggaggccaaagcaggacgauca

SEQ ID NO: 462195 - RNA, 23 nt, Human
gggaggccaaagcaggaggauca

SEQ ID NO: 462196 - RNA, 23 nt, Human
gggaggccaaagcaggaggaucg

SEQ ID NO: 462197 - RNA, 23 nt, Human
gggaggccaaagcaggcggauca

SEQ ID NO: 462198 - RNA, 23 nt, Human
gggaggccaaagcagguggauua

SEQ ID NO: 462199 - RNA, 23 nt, Human
gggaggccaaagugggagaucau

SEQ ID NO: 462200 - RNA, 23 nt, Human
gggaggccaaaguggguggauca

SEQ ID NO: 462201 - RNA, 32 nt, Human
gggaggccaaaugggagaauugcuugaagcca

SEQ ID NO: 462202 - RNA, 23 nt, Human
gggaggccaacacaggaggauca

SEQ ID NO: 462203 - RNA, 32 nt, Human
gggaggccaacgccgaggcgggcggaucauga

SEQ ID NO: 462204 - RNA, 24 nt, Human
gggaggccaacgccuaaagaucau

SEQ ID NO: 462205 - RNA, 23 nt, Human
gggaggccaacgggggcggauca

SEQ ID NO: 462206 - RNA, 23 nt, Human
gggaggccaacguggauggauca

SEQ ID NO: 462207 - RNA, 23 nt, Human
gggaggccaagacagaaggauca

SEQ ID NO: 462208 - RNA, 23 nt, Human
gggaggccaagacaggaggauca

SEQ ID NO: 462209 - RNA, 22 nt, Human
gggaggccaagacaggcggauc

SEQ ID NO: 462210 - RNA, 24 nt, Human
gggaggccaagacagguagacugu

SEQ ID NO: 462211 - RNA, 23 nt, Human
gggaggccaagacagguagauca

SEQ ID NO: 462212 - RNA, 23 nt, Human
gggaggccaagacaggugcauca

SEQ ID NO: 462213 - RNA, 23 nt, Human
gggaggccaagacagguggauca

SEQ ID NO: 462214 - RNA, 22 nt, Human
gggaggccaagacgggcggauc

SEQ ID NO: 462215 - RNA, 23 nt, Human
gggaggccaagacgggcggauca

SEQ ID NO: 462216 - RNA, 24 nt, Human
gggaggccaagacgggcggaucau

SEQ ID NO: 462217 - RNA, 32 nt, Human
gggaggccaagauggaggauugcuugaagcca

SEQ ID NO: 462218 - RNA, 23 nt, Human
gggaggccaagaugggcggauca

SEQ ID NO: 462219 - RNA, 24 nt, Human
gggaggccaagaugggcggaucau

SEQ ID NO: 462220 - RNA, 23 nt, Human
gggaggccaagauggguggauca

SEQ ID NO: 462221 - RNA, 23 nt, Human
gggaggccaagauggguggauua

SEQ ID NO: 462222 - RNA, 24 nt, Human
gggaggccaagccagauggaucau

SEQ ID NO: 462223 - RNA, 23 nt, Human
gggaggccaagcuugguggaucg

SEQ ID NO: 462224 - RNA, 32 nt, Human
gggaggccaaggaaggaggaaugcuugagccc

SEQ ID NO: 462225 - RNA, 32 nt, Human
gggaggccaaggaaggaggacugcuuaaagug

SEQ ID NO: 462226 - RNA, 32 nt, Human
gggaggccaaggaaggaggauugcuugagcuc

SEQ ID NO: 462227 - RNA, 23 nt, Human
gggaggccaaggaaggcagauca

SEQ ID NO: 462228 - RNA, 23 nt, Human
gggaggccaaggagggcagauca

SEQ ID NO: 462229 - RNA, 23 nt, Human
gggaggccaaggaggguggauca

SEQ ID NO: 462230 - RNA, 22 nt, Human
gggaggccaaggcaaaaggauu

SEQ ID NO: 462231 - RNA, 23 nt, Human
gggaggccaaggcaagaggauca

SEQ ID NO: 462232 - RNA, 23 nt, Human
gggaggccaaggcaagcaaauca

SEQ ID NO: 462233 - RNA, 23 nt, Human
gggaggccaaggcaagcagauca

SEQ ID NO: 462234 - RNA, 23 nt, Human
gggaggccaaggcaaggggauca

SEQ ID NO: 462235 - RNA, 23 nt, Human
gggaggccaaggcacauagguca

SEQ ID NO: 462236 - RNA, 21 nt, Human
gggaggccaaggcagaaggau

SEQ ID NO: 462237 - RNA, 23 nt, Human
gggaggccaaggcagaaggauca

SEQ ID NO: 462238 - RNA, 23 nt, Human
gggaggccaaggcagauggaaca

SEQ ID NO: 462239 - RNA, 24 nt, Human
gggaggccaaggcagauggaucau

SEQ ID NO: 462240 - RNA, 21 nt, Human
gggaggccaaggcaggaagau

SEQ ID NO: 462241 - RNA, 23 nt, Human
gggaggccaaggcaggaagauca

SEQ ID NO: 462242 - RNA, 22 nt, Human
gggaggccaaggcaggaagauu

SEQ ID NO: 462243 - RNA, 20 nt, Human
gggaggccaaggcaggagga

SEQ ID NO: 462244 - RNA, 23 nt, Human
gggaggccaaggcaggaggauca

SEQ ID NO: 462245 - RNA, 23 nt, Human
gggaggccaaggcaggaggaucg

SEQ ID NO: 462246 - RNA, 24 nt, Human
gggaggccaaggcaggaggaucgu

SEQ ID NO: 462247 - RNA, 22 nt, Human
gggaggccaaggcaggaggauu

SEQ ID NO: 462248 - RNA, 23 nt, Human
gggaggccaaggcaggcagacca

SEQ ID NO: 462249 - RNA, 21 nt, Human
gggaggccaaggcaggcagau

SEQ ID NO: 462250 - RNA, 23 nt, Human
gggaggccaaggcaggcagauca

SEQ ID NO: 462251 - RNA, 24 nt, Human
gggaggccaaggcaggcagaucau

SEQ ID NO: 462252 - RNA, 23 nt, Human
gggaggccaaggcaggcagaucg

SEQ ID NO: 462253 - RNA, 23 nt, Human
gggaggccaaggcaggcauauca

SEQ ID NO: 462254 - RNA, 23 nt, Human
gggaggccaaggcaggcggacca

SEQ ID NO: 462255 - RNA, 32 nt, Human
gggaggccaaggcaggcggaccaccugaaguc

SEQ ID NO: 462256 - RNA, 23 nt, Human
gggaggccaaggcaggcggauca

SEQ ID NO: 462257 - RNA, 23 nt, Human
gggaggccaaggcagggggauca

SEQ ID NO: 462258 - RNA, 23 nt, Human
gggaggccaaggcagggggauua

SEQ ID NO: 462259 - RNA, 23 nt, Human
gggaggccaaggcagguagauca

SEQ ID NO: 462260 - RNA, 21 nt, Human
gggaggccaaggcagguggau

SEQ ID NO: 462261 - RNA, 23 nt, Human
gggaggccaaggcagguggauca

SEQ ID NO: 462262 - RNA, 24 nt, Human
gggaggccaaggcagguggaucau

SEQ ID NO: 462263 - RNA, 32 nt, Human
gggaggccaaggccaaguagguggccaugagc

SEQ ID NO: 462264 - RNA, 23 nt, Human
gggaggccaaggccagcggauca

SEQ ID NO: 462265 - RNA, 24 nt, Human
gggaggccaaggcgagcggaucau

SEQ ID NO: 462266 - RNA, 32 nt, Human
gggaggccaaggcggacagaccaccugagguc

SEQ ID NO: 462267 - RNA, 23 nt, Human
gggaggccaaggcggacggauca

SEQ ID NO: 462268 - RNA, 23 nt, Human
gggaggccaaggcgggaggauca

SEQ ID NO: 462269 - RNA, 23 nt, Human
gggaggccaaggcgggaggaucg

SEQ ID NO: 462270 - RNA, 24 nt, Human
gggaggccaaggcgggcagaccau

SEQ ID NO: 462271 - RNA, 23 nt, Human
gggaggccaaggcgggcagauca

SEQ ID NO: 462272 - RNA, 23 nt, Human
gggaggccaaggcgggcagauua

SEQ ID NO: 462273 - RNA, 23 nt, Human
gggaggccaaggcgggcggauca

SEQ ID NO: 462274 - RNA, 24 nt, Human
gggaggccaaggcgggcggaucau

SEQ ID NO: 462275 - RNA, 23 nt, Human
gggaggccaaggcgggcguauca

SEQ ID NO: 462276 - RNA, 23 nt, Human
gggaggccaaggcgggucaauca

SEQ ID NO: 462277 - RNA, 22 nt, Human
gggaggccaaggcgggugaauc

SEQ ID NO: 462278 - RNA, 23 nt, Human
gggaggccaaggcgggugaauca

SEQ ID NO: 462279 - RNA, 21 nt, Human
gggaggccaaggcggguggau

SEQ ID NO: 462280 - RNA, 23 nt, Human
gggaggccaaggcggguggauca

SEQ ID NO: 462281 - RNA, 24 nt, Human
gggaggccaaggcggguggaucau

SEQ ID NO: 462282 - RNA, 23 nt, Human
gggaggccaaggcggguggauua

SEQ ID NO: 462283 - RNA, 23 nt, Human
gggaggccaaggcggguggcuca

SEQ ID NO: 462284 - RNA, 23 nt, Human
gggaggccaaggcggguggguca

SEQ ID NO: 462285 - RNA, 23 nt, Human
gggaggccaaggcguguggauca

SEQ ID NO: 462286 - RNA, 23 nt, Human
gggaggccaaggcuggcagauca

SEQ ID NO: 462287 - RNA, 23 nt, Human
gggaggccaaggcugguggauca

SEQ ID NO: 462288 - RNA, 23 nt, Human
gggaggccaagggagaaggauca

SEQ ID NO: 462289 - RNA, 22 nt, Human
gggaggccaagggaguggauca

SEQ ID NO: 462290 - RNA, 22 nt, Human
gggaggccaagggggcagauca

SEQ ID NO: 462291 - RNA, 22 nt, Human
gggaggccaaggggggagauca

SEQ ID NO: 462292 - RNA, 23 nt, Human
gggaggccaagguaggcagauca

SEQ ID NO: 462293 - RNA, 21 nt, Human
gggaggccaagguagguggau

SEQ ID NO: 462294 - RNA, 32 nt, Human
gggaggccaaggugagcaagucacuugagguc

SEQ ID NO: 462295 - RNA, 23 nt, Human
gggaggccaaggugagcggauca

SEQ ID NO: 462296 - RNA, 23 nt, Human
gggaggccaaggugaguggauca

SEQ ID NO: 462297 - RNA, 32 nt, Human
gggaggccaaggugggaggaccaccugagguc

SEQ ID NO: 462298 - RNA, 23 nt, Human
gggaggccaaggugggaggauca

SEQ ID NO: 462299 - RNA, 23 nt, Human
gggaggccaaggugggcagauca

SEQ ID NO: 462300 - RNA, 24 nt, Human
gggaggccaaggugggcagaucau

SEQ ID NO: 462301 - RNA, 23 nt, Human
gggaggccaaggugggcggauca

SEQ ID NO: 462302 - RNA, 24 nt, Human
gggaggccaaggugggcggaucau

SEQ ID NO: 462303 - RNA, 23 nt, Human
gggaggccaagguggggggauca

SEQ ID NO: 462304 - RNA, 24 nt, Human
gggaggccaagguggguagaucau

SEQ ID NO: 462305 - RNA, 23 nt, Human
gggaggccaaggugggucgauca

SEQ ID NO: 462306 - RNA, 23 nt, Human
gggaggccaaggugggugaauca

SEQ ID NO: 462307 - RNA, 23 nt, Human
gggaggccaagguggguggacca

SEQ ID NO: 462308 - RNA, 23 nt, Human
gggaggccaagguggguggauca

SEQ ID NO: 462309 - RNA, 24 nt, Human
gggaggccaagguggguggaucau

SEQ ID NO: 462310 - RNA, 23 nt, Human
gggaggccaagguggguggguca

SEQ ID NO: 462311 - RNA, 24 nt, Human
gggaggccaaggugggugggucau

SEQ ID NO: 462312 - RNA, 23 nt, Human
gggaggccaagguuggcagauca

SEQ ID NO: 462313 - RNA, 32 nt, Human
gggaggccaaguugucagcuuuuugauccucu

SEQ ID NO: 462314 - RNA, 19 nt, Human
gggaggccaaucccucccu

SEQ ID NO: 462315 - RNA, 23 nt, Human
gggaggccaaugcauguggauca

SEQ ID NO: 462316 - RNA, 24 nt, Human
gggaggccaauguggguggaucau

SEQ ID NO: 462317 - RNA, 32 nt, Human
gggaggccaauuuggaaagaacccaaaggcuc

SEQ ID NO: 462318 - RNA, 32 nt, Human
gggaggccaccaacuuggcuggcauguugcuu

SEQ ID NO: 462319 - RNA, 24 nt, Human
gggaggccacggcagguggaucau

SEQ ID NO: 462320 - RNA, 32 nt, Human
gggaggccagacggcacgaggucuccaaggcc

SEQ ID NO: 462321 - RNA, 21 nt, Human
gggaggccagagaagagccag

SEQ ID NO: 462322 - RNA, 32 nt, Human
gggaggccagagaagagccaggcagagaaaac

SEQ ID NO: 462323 - RNA, 18 nt, Human
gggaggccagcugggagg

SEQ ID NO: 462324 - RNA, 32 nt, Human
gggaggccaggaguucgagaccagccuggcca

SEQ ID NO: 462325 - RNA, 22 nt, Human
gggaggccaggcgggcggauca

SEQ ID NO: 462326 - RNA, 24 nt, Human
gggaggccagggcaggcagaucau

SEQ ID NO: 462327 - RNA, 32 nt, Human
gggaggccagguggagagaccuggaggaguga

SEQ ID NO: 462328 - RNA, 23 nt, Human
gggaggccagugcagguggauca

SEQ ID NO: 462329 - RNA, 24 nt, Human
gggaggccagugcgggcggaucau

SEQ ID NO: 462330 - RNA, 23 nt, Human
gggaggccauggcagguggauca

SEQ ID NO: 462331 - RNA, 23 nt, Human
gggaggccauuuccuguccugga

SEQ ID NO: 462332 - RNA, 22 nt, Human
gggaggcccaaaugauggauca

SEQ ID NO: 462333 - RNA, 23 nt, Human
gggaggcccagacuggcggauca

SEQ ID NO: 462334 - RNA, 19 nt, Human
gggaggcccagcugggagg

SEQ ID NO: 462335 - RNA, 24 nt, Human
gggaggcccaggcaagcagaucau

SEQ ID NO: 462336 - RNA, 23 nt, Human
gggaggcccaggcaggcagauca

SEQ ID NO: 462337 - RNA, 23 nt, Human
gggaggcccaggcaggcggauca

SEQ ID NO: 462338 - RNA, 24 nt, Human
gggaggcccaggcaggcgggucau

SEQ ID NO: 462339 - RNA, 23 nt, Human
gggaggcccaggccggcggauca

SEQ ID NO: 462340 - RNA, 23 nt, Human
gggaggcccaggcgggcagauca

SEQ ID NO: 462341 - RNA, 23 nt, Human
gggaggcccaggcgggcggauca

SEQ ID NO: 462342 - RNA, 32 nt, Human
gggaggcccaggcggguggaucaaaggucagg

SEQ ID NO: 462343 - RNA, 32 nt, Human
gggaggcccagggcuccucuggucccaagcga

SEQ ID NO: 462344 - RNA, 24 nt, Human
gggaggcccaggucaggggaucau

SEQ ID NO: 462345 - RNA, 24 nt, Human
gggaggcccaucccccaccugcca

SEQ ID NO: 462346 - RNA, 20 nt, Human
gggaggcccaugguggagca

SEQ ID NO: 462347 - RNA, 32 nt, Human
gggaggccccacccuucuccccuaggcgcugu

SEQ ID NO: 462348 - RNA, 19 nt, Human
gggaggccccagcaaccac

SEQ ID NO: 462349 - RNA, 20 nt, Human
gggaggccccggggcuggga

SEQ ID NO: 462350 - RNA, 18 nt, Human
gggaggccccuggccggg

SEQ ID NO: 462351 - RNA, 32 nt, Human
gggaggccccuggcuccaggaggcgggagucg

SEQ ID NO: 462352 - RNA, 32 nt, Human
gggaggcccuacugccuucucaaagcagagag

SEQ ID NO: 462353 - RNA, 32 nt, Human
gggaggcccugagaacuaaauuuugccccaaa

SEQ ID NO: 462354 - RNA, 32 nt, Human
gggaggcccuggaggguggauugccugagguc

SEQ ID NO: 462355 - RNA, 23 nt, Human
gggaggccgaaacaggcgaauca

SEQ ID NO: 462356 - RNA, 24 nt, Human
gggaggccgaagacagcggaucau

SEQ ID NO: 462357 - RNA, 23 nt, Human
gggaggccgaagcaggcagauca

SEQ ID NO: 462358 - RNA, 23 nt, Human
gggaggccgaagcaggcggauca

SEQ ID NO: 462359 - RNA, 23 nt, Human
gggaggccgaagcgggcggauca

SEQ ID NO: 462360 - RNA, 23 nt, Human
gggaggccgaagcggguggauca

SEQ ID NO: 462361 - RNA, 23 nt, Human
gggaggccgaagggggcgaauca

SEQ ID NO: 462362 - RNA, 23 nt, Human
gggaggccgaaguaagcagauca

SEQ ID NO: 462363 - RNA, 23 nt, Human
gggaggccgaagugggcggauca

SEQ ID NO: 462364 - RNA, 23 nt, Human
gggaggccgaaguggguggauca

SEQ ID NO: 462365 - RNA, 23 nt, Human
gggaggccgaaguggguggaucg

SEQ ID NO: 462366 - RNA, 22 nt, Human
gggaggccgaaugggcagauca

SEQ ID NO: 462367 - RNA, 23 nt, Human
gggaggccgagaagggaggauca

SEQ ID NO: 462368 - RNA, 24 nt, Human
gggaggccgagaaggguggaucau

SEQ ID NO: 462369 - RNA, 22 nt, Human
gggaggccgagacaggcagauu

SEQ ID NO: 462370 - RNA, 23 nt, Human
gggaggccgagacaggcggauca

SEQ ID NO: 462371 - RNA, 23 nt, Human
gggaggccgagacagguggauca

SEQ ID NO: 462372 - RNA, 23 nt, Human
gggaggccgagacgggcagauca

SEQ ID NO: 462373 - RNA, 23 nt, Human
gggaggccgagacgggcggauca

SEQ ID NO: 462374 - RNA, 23 nt, Human
gggaggccgagacggguggauca

SEQ ID NO: 462375 - RNA, 22 nt, Human
gggaggccgagaugggcggauc

SEQ ID NO: 462376 - RNA, 23 nt, Human
gggaggccgagaugggcggauca

SEQ ID NO: 462377 - RNA, 24 nt, Human
gggaggccgagaugggugaaucau

SEQ ID NO: 462378 - RNA, 23 nt, Human
gggaggccgagauggguggauca

SEQ ID NO: 462379 - RNA, 24 nt, Human
gggaggccgagauggguggaucau

SEQ ID NO: 462380 - RNA, 23 nt, Human
gggaggccgagccaaguggauca

SEQ ID NO: 462381 - RNA, 20 nt, Human
gggaggccgagccccgcgag

SEQ ID NO: 462382 - RNA, 23 nt, Human
gggaggccgagccgggcggauca

SEQ ID NO: 462383 - RNA, 19 nt, Human
gggaggccgagccugaauc

SEQ ID NO: 462384 - RNA, 23 nt, Human
gggaggccgaggagagaggauca

SEQ ID NO: 462385 - RNA, 23 nt, Human
gggaggccgaggagggaggauca

SEQ ID NO: 462386 - RNA, 23 nt, Human
gggaggccgaggagggcagauca

SEQ ID NO: 462387 - RNA, 23 nt, Human
gggaggccgaggaggguggauca

SEQ ID NO: 462388 - RNA, 24 nt, Human
gggaggccgaggaggguggaucau

SEQ ID NO: 462389 - RNA, 24 nt, Human
gggaggccgaggcaagagggucau

SEQ ID NO: 462390 - RNA, 23 nt, Human
gggaggccgaggcaagcagauca

SEQ ID NO: 462391 - RNA, 23 nt, Human
gggaggccgaggcaaguggauca

SEQ ID NO: 462392 - RNA, 23 nt, Human
gggaggccgaggcagacagauca

SEQ ID NO: 462393 - RNA, 23 nt, Human
gggaggccgaggcagacggauca

SEQ ID NO: 462394 - RNA, 23 nt, Human
gggaggccgaggcagauggauca

SEQ ID NO: 462395 - RNA, 24 nt, Human
gggaggccgaggcagccggaucau

SEQ ID NO: 462396 - RNA, 23 nt, Human
gggaggccgaggcaggaagauca

SEQ ID NO: 462397 - RNA, 24 nt, Human
gggaggccgaggcaggaagaucau

SEQ ID NO: 462398 - RNA, 22 nt, Human
gggaggccgaggcaggaagauu

SEQ ID NO: 462399 - RNA, 23 nt, Human
gggaggccgaggcaggagaaucg

SEQ ID NO: 462400 - RNA, 23 nt, Human
gggaggccgaggcaggagcaucg

SEQ ID NO: 462401 - RNA, 22 nt, Human
gggaggccgaggcaggaggauc

SEQ ID NO: 462402 - RNA, 23 nt, Human
gggaggccgaggcaggaggauca

SEQ ID NO: 462403 - RNA, 23 nt, Human
gggaggccgaggcaggcagauca

SEQ ID NO: 462404 - RNA, 24 nt, Human
gggaggccgaggcaggcagauuau

SEQ ID NO: 462405 - RNA, 23 nt, Human
gggaggccgaggcaggcagguca

SEQ ID NO: 462406 - RNA, 23 nt, Human
gggaggccgaggcaggcgaauca

SEQ ID NO: 462407 - RNA, 23 nt, Human
gggaggccgaggcaggcggacca

SEQ ID NO: 462408 - RNA, 23 nt, Human
gggaggccgaggcaggcggagca

SEQ ID NO: 462409 - RNA, 23 nt, Human
gggaggccgaggcaggcggauca

SEQ ID NO: 462410 - RNA, 24 nt, Human
gggaggccgaggcaggcggaucau

SEQ ID NO: 462411 - RNA, 23 nt, Human
gggaggccgaggcaggcggauua

SEQ ID NO: 462412 - RNA, 23 nt, Human
gggaggccgaggcaggcggcuca

SEQ ID NO: 462413 - RNA, 20 nt, Human
gggaggccgaggcaggggga

SEQ ID NO: 462414 - RNA, 23 nt, Human
gggaggccgaggcagggggauca

SEQ ID NO: 462415 - RNA, 23 nt, Human
gggaggccgaggcagguacauca

SEQ ID NO: 462416 - RNA, 24 nt, Human
gggaggccgaggcagguagaucau

SEQ ID NO: 462417 - RNA, 23 nt, Human
gggaggccgaggcagguggaaca

SEQ ID NO: 462418 - RNA, 21 nt, Human
gggaggccgaggcagguggau

SEQ ID NO: 462419 - RNA, 23 nt, Human
gggaggccgaggcagguggauca

SEQ ID NO: 462420 - RNA, 24 nt, Human
gggaggccgaggcagguggaucau

SEQ ID NO: 462421 - RNA, 23 nt, Human
gggaggccgaggcagguggaucg

SEQ ID NO: 462422 - RNA, 24 nt, Human
gggaggccgaggcagguggaucgu

SEQ ID NO: 462423 - RNA, 22 nt, Human
gggaggccgaggcagguggauu

SEQ ID NO: 462424 - RNA, 24 nt, Human
gggaggccgaggcaggugguucau

SEQ ID NO: 462425 - RNA, 23 nt, Human
gggaggccgaggcagguugauca

SEQ ID NO: 462426 - RNA, 23 nt, Human
gggaggccgaggcaguuggauca

SEQ ID NO: 462427 - RNA, 23 nt, Human
gggaggccgaggcaugagaauca

SEQ ID NO: 462428 - RNA, 23 nt, Human
gggaggccgaggccaguggauca

SEQ ID NO: 462429 - RNA, 23 nt, Human
gggaggccgaggccggugauuca

SEQ ID NO: 462430 - RNA, 23 nt, Human
gggaggccgaggcgagcagauca

SEQ ID NO: 462431 - RNA, 23 nt, Human
gggaggccgaggcgaguggauca

SEQ ID NO: 462432 - RNA, 23 nt, Human
gggaggccgaggcgccuggauca

SEQ ID NO: 462433 - RNA, 23 nt, Human
gggaggccgaggcggacagauca

SEQ ID NO: 462434 - RNA, 23 nt, Human
gggaggccgaggcggacggauca

SEQ ID NO: 462435 - RNA, 23 nt, Human
gggaggccgaggcggauggauca

SEQ ID NO: 462436 - RNA, 23 nt, Human
gggaggccgaggcggcugaauca

SEQ ID NO: 462437 - RNA, 23 nt, Human
gggaggccgaggcgggaagauca

SEQ ID NO: 462438 - RNA, 23 nt, Human
gggaggccgaggcgggaggauca

SEQ ID NO: 462439 - RNA, 24 nt, Human
gggaggccgaggcgggaggaucau

SEQ ID NO: 462440 - RNA, 21 nt, Human
gggaggccgaggcgggcagau

SEQ ID NO: 462441 - RNA, 23 nt, Human
gggaggccgaggcgggcagauca

SEQ ID NO: 462442 - RNA, 24 nt, Human
gggaggccgaggcgggcagaucau

SEQ ID NO: 462443 - RNA, 23 nt, Human
gggaggccgaggcgggccgauca

SEQ ID NO: 462444 - RNA, 23 nt, Human
gggaggccgaggcgggcgaauca

SEQ ID NO: 462445 - RNA, 23 nt, Human
gggaggccgaggcgggcgcauca

SEQ ID NO: 462446 - RNA, 21 nt, Human
gggaggccgaggcgggcggau

SEQ ID NO: 462447 - RNA, 22 nt, Human
gggaggccgaggcgggcggauc

SEQ ID NO: 462448 - RNA, 23 nt, Human
gggaggccgaggcgggcggauca

SEQ ID NO: 462449 - RNA, 24 nt, Human
gggaggccgaggcgggcggaucau

SEQ ID NO: 462450 - RNA, 23 nt, Human
gggaggccgaggcgggcggaucg

SEQ ID NO: 462451 - RNA, 23 nt, Human
gggaggccgaggcgggcggcuca

SEQ ID NO: 462452 - RNA, 23 nt, Human
gggaggccgaggcgggcggguca

SEQ ID NO: 462453 - RNA, 23 nt, Human
gggaggccgaggcggggagauca

SEQ ID NO: 462454 - RNA, 23 nt, Human
gggaggccgaggcggguggacca

SEQ ID NO: 462455 - RNA, 23 nt, Human
gggaggccgaggcggguggauca

SEQ ID NO: 462456 - RNA, 24 nt, Human
gggaggccgaggcggguggaucau

SEQ ID NO: 462457 - RNA, 23 nt, Human
gggaggccgaggcggguggaucg

SEQ ID NO: 462458 - RNA, 23 nt, Human
gggaggccgaggcgguuggauca

SEQ ID NO: 462459 - RNA, 23 nt, Human
gggaggccgaggcuggcggauca

SEQ ID NO: 462460 - RNA, 20 nt, Human
gggaggccgaggcuggggga

SEQ ID NO: 462461 - RNA, 23 nt, Human
gggaggccgaggcugguggauca

SEQ ID NO: 462462 - RNA, 23 nt, Human
gggaggccgaggggaguggauca

SEQ ID NO: 462463 - RNA, 24 nt, Human
gggaggccgaggggggcggaucgu

SEQ ID NO: 462464 - RNA, 23 nt, Human
gggaggccgagguaggcagauca

SEQ ID NO: 462465 - RNA, 22 nt, Human
gggaggccgagguaggcggauc

SEQ ID NO: 462466 - RNA, 23 nt, Human
gggaggccgagguaggcggauca

SEQ ID NO: 462467 - RNA, 23 nt, Human
gggaggccgagguagguggaucg

SEQ ID NO: 462468 - RNA, 23 nt, Human
gggaggccgaggugaaaggauca

SEQ ID NO: 462469 - RNA, 24 nt, Human
gggaggccgaggugacaggaucgu

SEQ ID NO: 462470 - RNA, 23 nt, Human
gggaggccgaggugagcagauca

SEQ ID NO: 462471 - RNA, 23 nt, Human
gggaggccgaggugagcggauca

SEQ ID NO: 462472 - RNA, 23 nt, Human
gggaggccgaggugaguggauca

SEQ ID NO: 462473 - RNA, 23 nt, Human
gggaggccgagguggauagauca

SEQ ID NO: 462474 - RNA, 23 nt, Human
gggaggccgagguggccagauca

SEQ ID NO: 462475 - RNA, 23 nt, Human
gggaggccgaggugggaagauca

SEQ ID NO: 462476 - RNA, 24 nt, Human
gggaggccgaggugggaagaucau

SEQ ID NO: 462477 - RNA, 23 nt, Human
gggaggccgaggugggagaauca

SEQ ID NO: 462478 - RNA, 23 nt, Human
gggaggccgaggugggaggauca

SEQ ID NO: 462479 - RNA, 24 nt, Human
gggaggccgaggugggaggaucau

SEQ ID NO: 462480 - RNA, 24 nt, Human
gggaggccgaggugggcaaaucau

SEQ ID NO: 462481 - RNA, 23 nt, Human
gggaggccgaggugggcagauca

SEQ ID NO: 462482 - RNA, 24 nt, Human
gggaggccgaggugggcagaucau

SEQ ID NO: 462483 - RNA, 23 nt, Human
gggaggccgaggugggccgauca

SEQ ID NO: 462484 - RNA, 23 nt, Human
gggaggccgaggugggcggauca

SEQ ID NO: 462485 - RNA, 21 nt, Human
gggaggccgagguggguagau

SEQ ID NO: 462486 - RNA, 23 nt, Human
gggaggccgagguggguagaucg

SEQ ID NO: 462487 - RNA, 22 nt, Human
gggaggccgaggugggugauca

SEQ ID NO: 462488 - RNA, 23 nt, Human
gggaggccgagguggguggacca

SEQ ID NO: 462489 - RNA, 32 nt, Human
gggaggccgagguggguggaccaccugagguu

SEQ ID NO: 462490 - RNA, 23 nt, Human
gggaggccgagguggguggauca

SEQ ID NO: 462491 - RNA, 24 nt, Human
gggaggccgagguggguggaucau

SEQ ID NO: 462492 - RNA, 23 nt, Human
gggaggccgaggugugcagauca

SEQ ID NO: 462493 - RNA, 24 nt, Human
gggaggccgagguugggggaucau

SEQ ID NO: 462494 - RNA, 23 nt, Human
gggaggccgagucagguggauca

SEQ ID NO: 462495 - RNA, 32 nt, Human
gggaggccgagucgguggauugcuugaggcua

SEQ ID NO: 462496 - RNA, 32 nt, Human
gggaggccgagugggaggauugccugagccua

SEQ ID NO: 462497 - RNA, 23 nt, Human
gggaggccgaguugggcggauca

SEQ ID NO: 462498 - RNA, 23 nt, Human
gggaggccgaugugggcagauca

SEQ ID NO: 462499 - RNA, 23 nt, Human
gggaggccgauguggguggauca

SEQ ID NO: 462500 - RNA, 23 nt, Human
gggaggccgcggcagaaggauca

SEQ ID NO: 462501 - RNA, 23 nt, Human
gggaggccgcggcggguggauca

SEQ ID NO: 462502 - RNA, 16 nt, Human
gggaggccgcggugag

SEQ ID NO: 462503 - RNA, 23 nt, Human
gggaggccgcgguggguggauca

SEQ ID NO: 462504 - RNA, 23 nt, Human
gggaggccgggacagguggauca

SEQ ID NO: 462505 - RNA, 24 nt, Human
gggaggccgggcaugguggcucau

SEQ ID NO: 462506 - RNA, 23 nt, Human
gggaggccggggcaggaggauca

SEQ ID NO: 462507 - RNA, 22 nt, Human
gggaggccggugggcagaucau

SEQ ID NO: 462508 - RNA, 23 nt, Human
gggaggccguggugggcggauca

SEQ ID NO: 462509 - RNA, 23 nt, Human
gggaggccuaggcaggcagauca

SEQ ID NO: 462510 - RNA, 23 nt, Human
gggaggccuaggcgggcagauca

SEQ ID NO: 462511 - RNA, 23 nt, Human
gggaggccuaggcgggcggauca

SEQ ID NO: 462512 - RNA, 23 nt, Human
gggaggccuaggcggguggauca

SEQ ID NO: 462513 - RNA, 25 nt, Human
gggaggccucgaggcagguggauca

SEQ ID NO: 462514 - RNA, 32 nt, Human
gggaggccucgaggcagguggaucaccugagg

SEQ ID NO: 462515 - RNA, 20 nt, Human
gggaggccugagugggagug

SEQ ID NO: 462516 - RNA, 32 nt, Human
gggaggccugggaacagagcccccacccucuc

SEQ ID NO: 462517 - RNA, 32 nt, Human
gggaggccugggccggagcagagcagagguga

SEQ ID NO: 462518 - RNA, 23 nt, Human
gggaggccuuggcagguggauca

SEQ ID NO: 462519 - RNA, 18 nt, Human
gggaggccuuggcuggga

SEQ ID NO: 462520 - RNA, 32 nt, Human
gggaggcgaccacuccuuaguuuccaagugcu

SEQ ID NO: 462521 - RNA, 22 nt, Human
gggaggcgaggaucccggcaga

SEQ ID NO: 462522 - RNA, 23 nt, Human
gggaggcgaggcagguagaucau

SEQ ID NO: 462523 - RNA, 23 nt, Human
gggaggcgauggccaccccagag

SEQ ID NO: 462524 - RNA, 32 nt, Human
gggaggcgaugggauuauggggcagaguccuc

SEQ ID NO: 462525 - RNA, 32 nt, Human
gggaggcgcagguugcagggaggcggagguug

SEQ ID NO: 462526 - RNA, 32 nt, Human
gggaggcgcaucuggcgcuucgguaccagcgg

SEQ ID NO: 462527 - RNA, 32 nt, Human
gggaggcgccacccauggcugcaguggagggg

SEQ ID NO: 462528 - RNA, 32 nt, Human
gggaggcgcccagcguggcugcagaggaaggg

SEQ ID NO: 462529 - RNA, 25 nt, Human
gggaggcgccuguggaauaggggga

SEQ ID NO: 462530 - RNA, 23 nt, Human
gggaggcggaggcaggagaauca

SEQ ID NO: 462531 - RNA, 23 nt, Human
gggaggcggaggcagguggauca

SEQ ID NO: 462532 - RNA, 23 nt, Human
gggaggcggaggcggguggauca

SEQ ID NO: 462533 - RNA, 32 nt, Human
gggaggcggagguuauggagagccaagaucgc

SEQ ID NO: 462534 - RNA, 32 nt, Human
gggaggcggagguuccagagagccaagaucgc

SEQ ID NO: 462535 - RNA, 18 nt, Human
gggaggcggagguugcag

SEQ ID NO: 462536 - RNA, 21 nt, Human
gggaggcggagguugcaguga

SEQ ID NO: 462537 - RNA, 22 nt, Human
gggaggcggagguugcagugag

SEQ ID NO: 462538 - RNA, 32 nt, Human
gggaggcggagguugcagugagccaaaaucgc

SEQ ID NO: 462539 - RNA, 32 nt, Human
gggaggcggagguugcagugagccaaaauuac

SEQ ID NO: 462540 - RNA, 32 nt, Human
gggaggcggaguuugcagugagccaagauagu

SEQ ID NO: 462541 - RNA, 32 nt, Human
gggaggcggcaacauuguuucaaguuggccaa

SEQ ID NO: 462542 - RNA, 32 nt, Human
gggaggcggccuggggagcccccaacuuaugc

SEQ ID NO: 462543 - RNA, 19 nt, Human
gggaggcgggaguggagug

SEQ ID NO: 462544 - RNA, 16 nt, Human
gggaggcgggugcaag

SEQ ID NO: 462545 - RNA, 32 nt, Human
gggaggcgugagccaccgcgccuguccaggaa

SEQ ID NO: 462546 - RNA, 23 nt, Human
gggaggcuaagacaggaagauca

SEQ ID NO: 462547 - RNA, 23 nt, Human
gggaggcuaagacaggcagauca

SEQ ID NO: 462548 - RNA, 23 nt, Human
gggaggcuaaggcaggagaauca

SEQ ID NO: 462549 - RNA, 23 nt, Human
gggaggcuaaggcaggcagauca

SEQ ID NO: 462550 - RNA, 23 nt, Human
gggaggcuaaggcaggcggacca

SEQ ID NO: 462551 - RNA, 23 nt, Human
gggaggcuaaggcaggcggauca

SEQ ID NO: 462552 - RNA, 23 nt, Human
gggaggcuaaggcagguggaucg

SEQ ID NO: 462553 - RNA, 20 nt, Human
gggaggcuaagguaggauca

SEQ ID NO: 462554 - RNA, 32 nt, Human
gggaggcuaggcacggcaccagccugggaugc

SEQ ID NO: 462555 - RNA, 32 nt, Human
gggaggcuagggcaauggagcaggccaccagc

SEQ ID NO: 462556 - RNA, 32 nt, Human
gggaggcucagcaggccaggaggcccaaggac

SEQ ID NO: 462557 - RNA, 23 nt, Human
gggaggcucaggcaggagaauca

SEQ ID NO: 462558 - RNA, 28 nt, Human
gggaggcucagggcugccuccucgaguu

SEQ ID NO: 462559 - RNA, 32 nt, Human
gggaggcucugacugucucgggugucagcuua

SEQ ID NO: 462560 - RNA, 32 nt, Human
gggaggcucuuucaaggcagcucacccaucag

SEQ ID NO: 462561 - RNA, 23 nt, Human
gggaggcugaaacaggagaauca

SEQ ID NO: 462562 - RNA, 32 nt, Human
gggaggcugaacaggagaaucgcuugaacccg

SEQ ID NO: 462563 - RNA, 23 nt, Human
gggaggcugaagcaagcagauca

SEQ ID NO: 462564 - RNA, 23 nt, Human
gggaggcugaagcaggagaauca

SEQ ID NO: 462565 - RNA, 23 nt, Human
gggaggcugaagcaggaggacca

SEQ ID NO: 462566 - RNA, 23 nt, Human
gggaggcugaagcaggaggauca

SEQ ID NO: 462567 - RNA, 23 nt, Human
gggaggcugaagcaggcagauca

SEQ ID NO: 462568 - RNA, 23 nt, Human
gggaggcugaagcggguagauca

SEQ ID NO: 462569 - RNA, 23 nt, Human
gggaggcugaagcggguggauca

SEQ ID NO: 462570 - RNA, 23 nt, Human
gggaggcugagacagaagaauca

SEQ ID NO: 462571 - RNA, 23 nt, Human
gggaggcugagacaggagaauca

SEQ ID NO: 462572 - RNA, 32 nt, Human
gggaggcugagacaggagacuugcuugaaugu

SEQ ID NO: 462573 - RNA, 23 nt, Human
gggaggcugagacaggcagauca

SEQ ID NO: 462574 - RNA, 23 nt, Human
gggaggcugagacaggcggauca

SEQ ID NO: 462575 - RNA, 24 nt, Human
gggaggcugagacagguagaucau

SEQ ID NO: 462576 - RNA, 23 nt, Human
gggaggcugagacagguggauca

SEQ ID NO: 462577 - RNA, 23 nt, Human
gggaggcugagacgggcagauca

SEQ ID NO: 462578 - RNA, 32 nt, Human
gggaggcugagcaggaggauggcuugggccca

SEQ ID NO: 462579 - RNA, 23 nt, Human
gggaggcugaggaaagcagauca

SEQ ID NO: 462580 - RNA, 23 nt, Human
gggaggcugaggaaggcaaauca

SEQ ID NO: 462581 - RNA, 32 nt, Human
gggaggcugaggagggagaaucgguugaaccu

SEQ ID NO: 462582 - RNA, 24 nt, Human
gggaggcugaggcaagagaaucau

SEQ ID NO: 462583 - RNA, 32 nt, Human
gggaggcugaggcaagagaguugcuugaaccc

SEQ ID NO: 462584 - RNA, 23 nt, Human
gggaggcugaggcaagaggauca

SEQ ID NO: 462585 - RNA, 23 nt, Human
gggaggcugaggcaagugaauca

SEQ ID NO: 462586 - RNA, 21 nt, Human
gggaggcugaggcaaguggau

SEQ ID NO: 462587 - RNA, 23 nt, Human
gggaggcugaggcaaguggauca

SEQ ID NO: 462588 - RNA, 32 nt, Human
gggaggcugaggcacgagacuugcuuaauacc

SEQ ID NO: 462589 - RNA, 23 nt, Human
gggaggcugaggcagaagaauca

SEQ ID NO: 462590 - RNA, 23 nt, Human
gggaggcugaggcagaaggauca

SEQ ID NO: 462591 - RNA, 32 nt, Human
gggaggcugaggcagaaguauugcuugaaccc

SEQ ID NO: 462592 - RNA, 32 nt, Human
gggaggcugaggcagaauugcuugaacccagg

SEQ ID NO: 462593 - RNA, 22 nt, Human
gggaggcugaggcagagaauca

SEQ ID NO: 462594 - RNA, 32 nt, Human
gggaggcugaggcagagaauugcuugaaccca

SEQ ID NO: 462595 - RNA, 32 nt, Human
gggaggcugaggcagagaauugcuugaacccu

SEQ ID NO: 462596 - RNA, 32 nt, Human
gggaggcugaggcagagaauugcuugaacgcg

SEQ ID NO: 462597 - RNA, 32 nt, Human
gggaggcugaggcagagaauugcuugaaucca

SEQ ID NO: 462598 - RNA, 23 nt, Human
gggaggcugaggcaggaaaauca

SEQ ID NO: 462599 - RNA, 23 nt, Human
gggaggcugaggcaggagaauca

SEQ ID NO: 462600 - RNA, 24 nt, Human
gggaggcugaggcaggagaaucau

SEQ ID NO: 462601 - RNA, 32 nt, Human
gggaggcugaggcaggagaauggugcgaaccc

SEQ ID NO: 462602 - RNA, 32 nt, Human
gggaggcugaggcaggagaauggugcggagcu

SEQ ID NO: 462603 - RNA, 23 nt, Human
gggaggcugaggcaggaggauca

SEQ ID NO: 462604 - RNA, 23 nt, Human
gggaggcugaggcaggcagauca

SEQ ID NO: 462605 - RNA, 24 nt, Human
gggaggcugaggcaggcagaucau

SEQ ID NO: 462606 - RNA, 23 nt, Human
gggaggcugaggcaggccaauca

SEQ ID NO: 462607 - RNA, 22 nt, Human
gggaggcugaggcaggcggaca

SEQ ID NO: 462608 - RNA, 22 nt, Human
gggaggcugaggcaggcggauc

SEQ ID NO: 462609 - RNA, 23 nt, Human
gggaggcugaggcaggcggauca

SEQ ID NO: 462610 - RNA, 24 nt, Human
gggaggcugaggcaggcggaucau

SEQ ID NO: 462611 - RNA, 23 nt, Human
gggaggcugaggcaggcggaucg

SEQ ID NO: 462612 - RNA, 23 nt, Human
gggaggcugaggcaggcggguca

SEQ ID NO: 462613 - RNA, 23 nt, Human
gggaggcugaggcaggggaauca

SEQ ID NO: 462614 - RNA, 23 nt, Human
gggaggcugaggcaggucgauca

SEQ ID NO: 462615 - RNA, 23 nt, Human
gggaggcugaggcaggugaaucg

SEQ ID NO: 462616 - RNA, 23 nt, Human
gggaggcugaggcagguggauca

SEQ ID NO: 462617 - RNA, 23 nt, Human
gggaggcugaggcagguggaucg

SEQ ID NO: 462618 - RNA, 23 nt, Human
gggaggcugaggcagguggcuca

SEQ ID NO: 462619 - RNA, 23 nt, Human
gggaggcugaggcaggugguuca

SEQ ID NO: 462620 - RNA, 23 nt, Human
gggaggcugaggccgguggauca

SEQ ID NO: 462621 - RNA, 23 nt, Human
gggaggcugaggcgggcagauca

SEQ ID NO: 462622 - RNA, 24 nt, Human
gggaggcugaggcgggcagaucau

SEQ ID NO: 462623 - RNA, 24 nt, Human
gggaggcugaggcgggcgaaucau

SEQ ID NO: 462624 - RNA, 23 nt, Human
gggaggcugaggcgggcggauca

SEQ ID NO: 462625 - RNA, 24 nt, Human
gggaggcugaggcgggcggaucau

SEQ ID NO: 462626 - RNA, 23 nt, Human
gggaggcugaggcggguagauca

SEQ ID NO: 462627 - RNA, 23 nt, Human
gggaggcugaggcgggugaauca

SEQ ID NO: 462628 - RNA, 24 nt, Human
gggaggcugaggcgggugaaucau

SEQ ID NO: 462629 - RNA, 23 nt, Human
gggaggcugaggcggguggauca

SEQ ID NO: 462630 - RNA, 24 nt, Human
gggaggcugaggcggguggaucau

SEQ ID NO: 462631 - RNA, 32 nt, Human
gggaggcugaggcuggagaauggugugaaccc

SEQ ID NO: 462632 - RNA, 32 nt, Human
gggaggcugaggcuggagaguugcucaaaccc

SEQ ID NO: 462633 - RNA, 32 nt, Human
gggaggcugaggcuggagguucaaucgcuuga

SEQ ID NO: 462634 - RNA, 24 nt, Human
gggaggcugaggcuggcggaucau

SEQ ID NO: 462635 - RNA, 20 nt, Human
gggaggcugaggcuggggga

SEQ ID NO: 462636 - RNA, 23 nt, Human
gggaggcugaggcugguggauca

SEQ ID NO: 462637 - RNA, 23 nt, Human
gggaggcugagggaggcggauca

SEQ ID NO: 462638 - RNA, 32 nt, Human
gggaggcugagguagagaaucgcuugaaccug

SEQ ID NO: 462639 - RNA, 32 nt, Human
gggaggcugagguaggagaauuacuugaaucu

SEQ ID NO: 462640 - RNA, 23 nt, Human
gggaggcugagguaggcagauca

SEQ ID NO: 462641 - RNA, 23 nt, Human
gggaggcugagguagguggauca

SEQ ID NO: 462642 - RNA, 24 nt, Human
gggaggcugagguagguggaucau

SEQ ID NO: 462643 - RNA, 32 nt, Human
gggaggcugagguggagaauugcuugaaccca

SEQ ID NO: 462644 - RNA, 32 nt, Human
gggaggcugaggugggcagaucacgagaccag

SEQ ID NO: 462645 - RNA, 23 nt, Human
gggaggcugagucaggcggauca

SEQ ID NO: 462646 - RNA, 32 nt, Human
gggaggcugcagagggugcugggagccccuag

SEQ ID NO: 462647 - RNA, 23 nt, Human
gggaggcugcggcaggcggauca

SEQ ID NO: 462648 - RNA, 32 nt, Human
gggaggcugcugcugcucuuggcuggacccag

SEQ ID NO: 462649 - RNA, 32 nt, Human
gggaggcuggagccccaggugcaguggcucuu

SEQ ID NO: 462650 - RNA, 32 nt, Human
gggaggcuggaggacuuucuuucccuuuaugg

SEQ ID NO: 462651 - RNA, 32 nt, Human
gggaggcuggagugcaauggugccaucuuggc

SEQ ID NO: 462652 - RNA, 18 nt, Human
gggaggcuggauucuggg

SEQ ID NO: 462653 - RNA, 32 nt, Human
gggaggcuggcauccaggucuuggcucugccc

SEQ ID NO: 462654 - RNA, 18 nt, Human
gggaggcuggcuggggga

SEQ ID NO: 462655 - RNA, 32 nt, Human
gggaggcugggaagaggugggaggaggggcag

SEQ ID NO: 462656 - RNA, 32 nt, Human
gggaggcugggagcugggccuccugcgugggg

SEQ ID NO: 462657 - RNA, 19 nt, Human
gggaggcugggcugggaga

SEQ ID NO: 462658 - RNA, 32 nt, Human
gggaggcuggggacccagacuuuuggccccag

SEQ ID NO: 462659 - RNA, 23 nt, Human
gggaggcuggggcaggagaauca

SEQ ID NO: 462660 - RNA, 23 nt, Human
gggaggcuggggcaggcggauca

SEQ ID NO: 462661 - RNA, 32 nt, Human
gggaggcuggugggugucggggguggagaugu

SEQ ID NO: 462662 - RNA, 32 nt, Human
gggaggcuguaauccuagcuacucgggaggcu

SEQ ID NO: 462663 - RNA, 32 nt, Human
gggaggcugugagacccacagggcuaggccca

SEQ ID NO: 462664 - RNA, 32 nt, Human
gggaggcugugcauauguuggggaaggugaua

SEQ ID NO: 462665 - RNA, 23 nt, Human
gggaggcuguggcaggaaaauca

SEQ ID NO: 462666 - RNA, 23 nt, Human
gggaggcuguggcagguggauca

SEQ ID NO: 462667 - RNA, 23 nt, Human
gggaggcuguggcgggcggauca

SEQ ID NO: 462668 - RNA, 32 nt, Human
gggaggcuguuucuucucaggauuccuugcca

SEQ ID NO: 462669 - RNA, 32 nt, Human
gggaggcuuccccucacuauccuaccccaccc

SEQ ID NO: 462670 - RNA, 32 nt, Human
gggaggcuuuugaacccaggaggcagagguug

SEQ ID NO: 462671 - RNA, 32 nt, Human
gggagggaaaaugugaaacacauuagcaauaa

SEQ ID NO: 462672 - RNA, 32 nt, Human
gggagggaaagaggaggaaggaagaugcgaga

SEQ ID NO: 462673 - RNA, 32 nt, Human
gggagggaaagccaaagcauggugcuucacca

SEQ ID NO: 462674 - RNA, 32 nt, Human
gggagggaaagcuuccuccuaaaucaagcauc

SEQ ID NO: 462675 - RNA, 32 nt, Human
gggagggaaauguuugccuguugaacuucuuu

SEQ ID NO: 462676 - RNA, 32 nt, Human
gggagggaacaccggcuucaguuuuucauguc

SEQ ID NO: 462677 - RNA, 32 nt, Human
gggagggaacacugggguuuaggaccacaacu

SEQ ID NO: 462678 - RNA, 19 nt, Human
gggagggaagaaaguacca

SEQ ID NO: 462679 - RNA, 32 nt, Human
gggagggaagagaagaaagcgagcgguuaggg

SEQ ID NO: 462680 - RNA, 18 nt, Human
gggagggaagagagcaga

SEQ ID NO: 462681 - RNA, 32 nt, Human
gggagggaagcggggaaggaaaggaaugaggg

SEQ ID NO: 462682 - RNA, 21 nt, Human
gggagggaaggaggcagcaga

SEQ ID NO: 462683 - RNA, 22 nt, Human
gggagggaaggggcugcaccag

SEQ ID NO: 462684 - RNA, 32 nt, Human
gggagggaagggggaggaaggagucggggacg

SEQ ID NO: 462685 - RNA, 22 nt, Human
gggagggaaggguggucacaga

SEQ ID NO: 462686 - RNA, 20 nt, Human
gggagggaaucaauccgggg

SEQ ID NO: 462687 - RNA, 20 nt, Human
gggagggacaagggggagga

SEQ ID NO: 462688 - RNA, 19 nt, Human
gggagggacacacugcggg

SEQ ID NO: 462689 - RNA, 19 nt, Human
gggagggacacagccuggg

SEQ ID NO: 462690 - RNA, 20 nt, Human
gggagggacacagccuggga

SEQ ID NO: 462691 - RNA, 15 nt, Human
gggagggacaccggg

SEQ ID NO: 462692 - RNA, 21 nt, Human
gggagggacacuuacccaagg

SEQ ID NO: 462693 - RNA, 22 nt, Human
gggagggacagaaaagagaaga

SEQ ID NO: 462694 - RNA, 32 nt, Human
gggagggacagaagccgagaacaccaggcaca

SEQ ID NO: 462695 - RNA, 19 nt, Human
gggagggacauggccccgg

SEQ ID NO: 462696 - RNA, 24 nt, Human
gggagggaccauggcccgcagggu

SEQ ID NO: 462697 - RNA, 32 nt, Human
gggagggacuggucagugcugaagucucacag

SEQ ID NO: 462698 - RNA, 32 nt, Human
gggagggagaaaaggugggggaaagagagaaa

SEQ ID NO: 462699 - RNA, 32 nt, Human
gggagggagacucaggcccacacuuggguauu

SEQ ID NO: 462700 - RNA, 32 nt, Human
gggagggagacucugcggccacacacaacaug

SEQ ID NO: 462701 - RNA, 18 nt, Human
gggagggagagcggagaa

SEQ ID NO: 462702 - RNA, 32 nt, Human
gggagggagaggcaccaugcaugugggugauu

SEQ ID NO: 462703 - RNA, 32 nt, Human
gggagggagagggaaugauaagcugcugcggc

SEQ ID NO: 462704 - RNA, 32 nt, Human
gggagggagagggagugaagagccugcccucc

SEQ ID NO: 462705 - RNA, 32 nt, Human
gggagggagagggcaggaaggaggcagagcug

SEQ ID NO: 462706 - RNA, 32 nt, Human
gggagggagagggcaguuuguaguauuugcug

SEQ ID NO: 462707 - RNA, 32 nt, Human
gggagggagaggggcuccggcuuucucugaaa

SEQ ID NO: 462708 - RNA, 32 nt, Human
gggagggagagggggcguguugaacauccugc

SEQ ID NO: 462709 - RNA, 32 nt, Human
gggagggagaguuugcggccacacacaacacg

SEQ ID NO: 462710 - RNA, 32 nt, Human
gggagggagcaggggaagguuguaugugucau

SEQ ID NO: 462711 - RNA, 21 nt, Human
gggagggagccacccggguga

SEQ ID NO: 462712 - RNA, 22 nt, Human
gggagggagcggaagucccggg

SEQ ID NO: 462713 - RNA, 32 nt, Human
gggagggaggagagaagggcggcagugggagg

SEQ ID NO: 462714 - RNA, 32 nt, Human
gggagggaggagagagaggagaagggaggcaa

SEQ ID NO: 462715 - RNA, 32 nt, Human
gggagggaggagagagaggagaagggaggcag

SEQ ID NO: 462716 - RNA, 32 nt, Human
gggagggaggagggagaaagggauaaugaugc

SEQ ID NO: 462717 - RNA, 32 nt, Human
gggagggaggcagugguggcuggagggugcgc

SEQ ID NO: 462718 - RNA, 32 nt, Human
gggagggaggccaaggcgggcagaucaccuga

SEQ ID NO: 462719 - RNA, 32 nt, Human
gggagggaggcgggagucgggggaagacgcgg

SEQ ID NO: 462720 - RNA, 32 nt, Human
gggagggaggcgggguuggggccacgugagca

SEQ ID NO: 462721 - RNA, 32 nt, Human
gggagggaggcugagggggcacugaggcagcu

SEQ ID NO: 462722 - RNA, 32 nt, Human
gggagggaggcugggcaucagggaucacauca

SEQ ID NO: 462723 - RNA, 23 nt, Human
gggagggagggagggaaggcaga

SEQ ID NO: 462724 - RNA, 32 nt, Human
gggagggagggagggaugaggcagcguccccc

SEQ ID NO: 462725 - RNA, 20 nt, Human
gggagggagggcgccccggg

SEQ ID NO: 462726 - RNA, 32 nt, Human
gggagggaggggagauggaggcccgguggagc

SEQ ID NO: 462727 - RNA, 32 nt, Human
gggagggaggggaggaagguuagggaggcgga

SEQ ID NO: 462728 - RNA, 32 nt, Human
gggagggaggggcagaguggagugucauucca

SEQ ID NO: 462729 - RNA, 32 nt, Human
gggagggaggggcagggagcugucuaccagcu

SEQ ID NO: 462730 - RNA, 32 nt, Human
gggagggaggggcccuggaggccacauccugc

SEQ ID NO: 462731 - RNA, 32 nt, Human
gggagggaggugggggcagcagaggccugggc

SEQ ID NO: 462732 - RNA, 32 nt, Human
gggagggaguaguuuggggaggagggugggaa

SEQ ID NO: 462733 - RNA, 32 nt, Human
gggagggaucacuguucuucuugcuuuuggcc

SEQ ID NO: 462734 - RNA, 23 nt, Human
gggagggaucuugguuccagggu

SEQ ID NO: 462735 - RNA, 32 nt, Human
gggagggauuccggaauugaggggcacgcagg

SEQ ID NO: 462736 - RNA, 32 nt, Human
gggagggcacgcgggcaagccuaggagaguag

SEQ ID NO: 462737 - RNA, 32 nt, Human
gggagggcagaggacagacagccccggggcug

SEQ ID NO: 462738 - RNA, 32 nt, Human
gggagggcagaggcaagguuaccagggcacca

SEQ ID NO: 462739 - RNA, 32 nt, Human
gggagggcagaggggaggcagcagggagagga

SEQ ID NO: 462740 - RNA, 32 nt, Human
gggagggcagggaggcuuuggugacaucauca

SEQ ID NO: 462741 - RNA, 32 nt, Human
gggagggcagggcaguuggaucacuugaggcc

SEQ ID NO: 462742 - RNA, 32 nt, Human
gggagggcagggcuggaucuucccugguggcu

SEQ ID NO: 462743 - RNA, 32 nt, Human
gggagggcaguuacaggagagaguagguggug

SEQ ID NO: 462744 - RNA, 19 nt, Human
gggagggccagcucuggga

SEQ ID NO: 462745 - RNA, 32 nt, Human
gggagggccaggauuccucucucaggucacuc

SEQ ID NO: 462746 - RNA, 32 nt, Human
gggagggccucauguuuuaucugguucuuaaa

SEQ ID NO: 462747 - RNA, 19 nt, Human
gggagggccuccugcggug

SEQ ID NO: 462748 - RNA, 32 nt, Human
gggagggccuggacugagggggaccaggucuu

SEQ ID NO: 462749 - RNA, 32 nt, Human
gggagggccuggcagagacugagcacuggccc

SEQ ID NO: 462750 - RNA, 32 nt, Human
gggagggcgaagaggaggaggaaggggaggac

SEQ ID NO: 462751 - RNA, 32 nt, Human
gggagggcgcugagggucacgcgaacaccgca

SEQ ID NO: 462752 - RNA, 32 nt, Human
gggagggcucccgagucucugccuucagcucc

SEQ ID NO: 462753 - RNA, 32 nt, Human
gggagggcugcccagcccuggccucacagccg

SEQ ID NO: 462754 - RNA, 19 nt, Human
gggagggcugccuggagga

SEQ ID NO: 462755 - RNA, 32 nt, Human
gggagggcugcugacuccaggcucagauuaaa

SEQ ID NO: 462756 - RNA, 17 nt, Human
gggagggcugcugggag

SEQ ID NO: 462757 - RNA, 32 nt, Human
gggagggcuggaagaaggggcagcagcuggca

SEQ ID NO: 462758 - RNA, 19 nt, Human
gggagggcuggggcuggga

SEQ ID NO: 462759 - RNA, 32 nt, Human
gggagggcuggggcuuucucugccugguacac

SEQ ID NO: 462760 - RNA, 32 nt, Human
gggagggcuguggugccggugcuuccaacaag

SEQ ID NO: 462761 - RNA, 22 nt, Human
gggaggggaaagaggaaacaga

SEQ ID NO: 462762 - RNA, 32 nt, Human
gggaggggaacagggaaggaagggauggaugg

SEQ ID NO: 462763 - RNA, 32 nt, Human
gggaggggacagaggcccugccacgucccgcu

SEQ ID NO: 462764 - RNA, 32 nt, Human
gggaggggaccuugguguucaggaagcgccag

SEQ ID NO: 462765 - RNA, 21 nt, Human
gggaggggacucgguccgggg

SEQ ID NO: 462766 - RNA, 32 nt, Human
gggaggggagaaaggggccaggggaugcgggg

SEQ ID NO: 462767 - RNA, 32 nt, Human
gggaggggagagaagagaaggagggaaggauu

SEQ ID NO: 462768 - RNA, 32 nt, Human
gggaggggagagaccacagccggguguguguc

SEQ ID NO: 462769 - RNA, 32 nt, Human
gggaggggagagaggugggggcaagggggaaa

SEQ ID NO: 462770 - RNA, 32 nt, Human
gggaggggagccuggcugcccugcugcuucuc

SEQ ID NO: 462771 - RNA, 18 nt, Human
gggaggggagcugaaagg

SEQ ID NO: 462772 - RNA, 32 nt, Human
gggaggggagcugcgcccucccugaccuccca

SEQ ID NO: 462773 - RNA, 32 nt, Human
gggaggggaggaggcaggagggcgcauggggc

SEQ ID NO: 462774 - RNA, 32 nt, Human
gggaggggaguguggcagggaggaggaagagg

SEQ ID NO: 462775 - RNA, 32 nt, Human
gggaggggcacgagaagagaggagcagggagg

SEQ ID NO: 462776 - RNA, 32 nt, Human
gggaggggcagaggaggggaaggaggagggcc

SEQ ID NO: 462777 - RNA, 20 nt, Human
gggaggggcagaguggagug

SEQ ID NO: 462778 - RNA, 32 nt, Human
gggaggggcaggaagaggugagaagaucagau

SEQ ID NO: 462779 - RNA, 24 nt, Human
gggaggggcaggggagaugugggg

SEQ ID NO: 462780 - RNA, 32 nt, Human
gggaggggcaggggagauguggggaaguccag

SEQ ID NO: 462781 - RNA, 32 nt, Human
gggaggggcagggggagaggcccccaucaggg

SEQ ID NO: 462782 - RNA, 32 nt, Human
gggaggggcccaggcagcugugcugguccaag

SEQ ID NO: 462783 - RNA, 32 nt, Human
gggaggggccccaguggcugagcuccaagugc

SEQ ID NO: 462784 - RNA, 32 nt, Human
gggaggggcccgccucggccccggcucagccc

SEQ ID NO: 462785 - RNA, 32 nt, Human
gggaggggccgccggcgaaaggagggggcccu

SEQ ID NO: 462786 - RNA, 26 nt, Human
gggaggggccggccggaccccggggu

SEQ ID NO: 462787 - RNA, 23 nt, Human
gggaggggccgguaaccccuggg

SEQ ID NO: 462788 - RNA, 32 nt, Human
gggaggggccgugcugaccucucccggggauc

SEQ ID NO: 462789 - RNA, 17 nt, Human
gggaggggcgccgggag

SEQ ID NO: 462790 - RNA, 32 nt, Human
gggaggggcgcgccauggaggcgccgggucgc

SEQ ID NO: 462791 - RNA, 32 nt, Human
gggaggggcggggcggggaggggccaggcggg

SEQ ID NO: 462792 - RNA, 20 nt, Human
gggaggggcuauagaguuuc

SEQ ID NO: 462793 - RNA, 32 nt, Human
gggaggggcucaagggagcccagcugggaggg

SEQ ID NO: 462794 - RNA, 32 nt, Human
gggaggggcuccauuuuaauauuauggcucag

SEQ ID NO: 462795 - RNA, 32 nt, Human
gggagggggaaagagcagcgaggagugaagcg

SEQ ID NO: 462796 - RNA, 18 nt, Human
gggagggggaagagcaga

SEQ ID NO: 462797 - RNA, 32 nt, Human
gggagggggacagaugugcuguguacaggaca

SEQ ID NO: 462798 - RNA, 32 nt, Human
gggagggggacaugaacagacacucuaccaca

SEQ ID NO: 462799 - RNA, 32 nt, Human
gggagggggagggagaaaauggggcuaugccu

SEQ ID NO: 462800 - RNA, 32 nt, Human
gggagggggagggagauagagggagagaugca

SEQ ID NO: 462801 - RNA, 32 nt, Human
gggagggggaggucaggggcagaggggaccca

SEQ ID NO: 462802 - RNA, 19 nt, Human
gggagggggcaccgggagg

SEQ ID NO: 462803 - RNA, 32 nt, Human
gggagggggcaggccaaugaggucugcauggc

SEQ ID NO: 462804 - RNA, 32 nt, Human
gggagggggcgcccaggagggguggggagggg

SEQ ID NO: 462805 - RNA, 19 nt, Human
gggagggggcggccggagg

SEQ ID NO: 462806 - RNA, 32 nt, Human
gggagggggcucaggccucagccucaagaucu

SEQ ID NO: 462807 - RNA, 21 nt, Human
gggagggggcugguugggaga

SEQ ID NO: 462808 - RNA, 32 nt, Human
gggagggggcuugaagccaaagaaaaauaacc

SEQ ID NO: 462809 - RNA, 20 nt, Human
gggaggggggaacuuacucu

SEQ ID NO: 462810 - RNA, 19 nt, Human
gggaggggggacugcgaga

SEQ ID NO: 462811 - RNA, 21 nt, Human
gggaggggggagggggaagca

SEQ ID NO: 462812 - RNA, 16 nt, Human
gggaggggggcaggga

SEQ ID NO: 462813 - RNA, 18 nt, Human
gggaggggggcgaggaga

SEQ ID NO: 462814 - RNA, 16 nt, Human
gggaggggggcuagga

SEQ ID NO: 462815 - RNA, 32 nt, Human
gggagggggucaggcugugcagaggagagaga

SEQ ID NO: 462816 - RNA, 32 nt, Human
gggagggggugagguggaauggggugggggaa

SEQ ID NO: 462817 - RNA, 32 nt, Human
gggagggggugcuuguauuuaucuuauuucca

SEQ ID NO: 462818 - RNA, 20 nt, Human
gggaggggguggccaaggga

SEQ ID NO: 462819 - RNA, 19 nt, Human
gggagggggugguaagaga

SEQ ID NO: 462820 - RNA, 32 nt, Human
gggaggggguuuuucccgcacccugggauggc

SEQ ID NO: 462821 - RNA, 32 nt, Human
gggagggguaggaggagagggaggaggguagg

SEQ ID NO: 462822 - RNA, 23 nt, Human
gggaggggucgcuggccccgggg

SEQ ID NO: 462823 - RNA, 21 nt, Human
gggaggggugaauaguguuuc

SEQ ID NO: 462824 - RNA, 32 nt, Human
gggaggggugccccagaggcaccagcuccugg

SEQ ID NO: 462825 - RNA, 18 nt, Human
gggaggggugcuggaaga

SEQ ID NO: 462826 - RNA, 19 nt, Human
gggaggggugugcuagaga

SEQ ID NO: 462827 - RNA, 20 nt, Human
gggagggguuaucugggaga

SEQ ID NO: 462828 - RNA, 32 nt, Human
gggaggguaaguggccuggugaguggagguag

SEQ ID NO: 462829 - RNA, 32 nt, Human
gggaggguaggcaggauuggggaagagagccu

SEQ ID NO: 462830 - RNA, 32 nt, Human
gggagggucccuuggaagcuggugaaguccug

SEQ ID NO: 462831 - RNA, 23 nt, Human
gggagggucgcuccacccuggag

SEQ ID NO: 462832 - RNA, 32 nt, Human
gggagggucugccuccccuuccucgcccugug

SEQ ID NO: 462833 - RNA, 32 nt, Human
gggagggugaacaguccccacagcagacagcu

SEQ ID NO: 462834 - RNA, 32 nt, Human
gggagggugacaggguggauagguacaggauu

SEQ ID NO: 462835 - RNA, 18 nt, Human
gggagggugacugggagg

SEQ ID NO: 462836 - RNA, 23 nt, Human
gggagggugaggcaggagaauca

SEQ ID NO: 462837 - RNA, 23 nt, Human
gggagggugaggcggguggauca

SEQ ID NO: 462838 - RNA, 32 nt, Human
gggagggugcggcagggcaggagcuuggcaga

SEQ ID NO: 462839 - RNA, 32 nt, Human
gggaggguggagggaggcaguguccuuccuga

SEQ ID NO: 462840 - RNA, 32 nt, Human
gggaggguggcauucuggacaugaggagcaaa

SEQ ID NO: 462841 - RNA, 32 nt, Human
gggaggguggccaggacaugcccgaggccgaa

SEQ ID NO: 462842 - RNA, 32 nt, Human
gggaggguggcguggcuuuaccccauggaggc

SEQ ID NO: 462843 - RNA, 23 nt, Human
gggagggugggaggccucggggu

SEQ ID NO: 462844 - RNA, 32 nt, Human
gggagggugggcaguggucuggaagcuugaug

SEQ ID NO: 462845 - RNA, 21 nt, Human
gggagggugggcccacugcuu

SEQ ID NO: 462846 - RNA, 32 nt, Human
gggaggguggggaugggaggggagagacagaa

SEQ ID NO: 462847 - RNA, 22 nt, Human
gggaggguguucaggacaggga

SEQ ID NO: 462848 - RNA, 32 nt, Human
gggaggguuagccugcaccgccgccacccugc

SEQ ID NO: 462849 - RNA, 32 nt, Human
gggaggguucagaaagaggaaugaagauguug

SEQ ID NO: 462850 - RNA, 32 nt, Human
gggaggguugggggaugugaggagggcaggga

SEQ ID NO: 462851 - RNA, 32 nt, Human
gggagguaaagaaaaaggacguuuacuaaaag

SEQ ID NO: 462852 - RNA, 22 nt, Human
gggagguagagguuacagcgag

SEQ ID NO: 462853 - RNA, 22 nt, Human
gggagguagauauaggccuguu

SEQ ID NO: 462854 - RNA, 19 nt, Human
gggagguagcugcuggcug

SEQ ID NO: 462855 - RNA, 22 nt, Human
gggagguaggacccgcuccgga

SEQ ID NO: 462856 - RNA, 32 nt, Human
gggagguagggaggggagcaggagcaagagcu

SEQ ID NO: 462857 - RNA, 32 nt, Human
gggagguaggguggggagcgggaacaagagcu

SEQ ID NO: 462858 - RNA, 32 nt, Human
gggagguaggguggggagcgggacgaagagcu

SEQ ID NO: 462859 - RNA, 32 nt, Human
gggagguaggguggggagcgggagaaagaccu

SEQ ID NO: 462860 - RNA, 32 nt, Human
gggaggucaaagaagaaagaauaugaaaaguu

SEQ ID NO: 462861 - RNA, 32 nt, Human
gggaggucaaagcugcagucagccaagaucuu

SEQ ID NO: 462862 - RNA, 23 nt, Human
gggaggucaaggcaggaagauca

SEQ ID NO: 462863 - RNA, 23 nt, Human
gggaggucaagguagguggauca

SEQ ID NO: 462864 - RNA, 32 nt, Human
gggaggucagggaacuccaggaccuuguucuc

SEQ ID NO: 462865 - RNA, 32 nt, Human
gggaggucagguggucaauguccuggugauuu

SEQ ID NO: 462866 - RNA, 23 nt, Human
gggagguccaggcaggaggauca

SEQ ID NO: 462867 - RNA, 22 nt, Human
gggagguccaggcagguggauc

SEQ ID NO: 462868 - RNA, 32 nt, Human
gggaggucccagaggugggaggcuggcaucca

SEQ ID NO: 462869 - RNA, 32 nt, Human
gggagguccugagugaggaaggcaugaccucu

SEQ ID NO: 462870 - RNA, 21 nt, Human
gggagguccuggccugggaga

SEQ ID NO: 462871 - RNA, 23 nt, Human
gggaggucgaggcaggaggauca

SEQ ID NO: 462872 - RNA, 23 nt, Human
gggaggucgaggcaggcagauca

SEQ ID NO: 462873 - RNA, 23 nt, Human
gggaggucgaggcaggcggauca

SEQ ID NO: 462874 - RNA, 23 nt, Human
gggaggucgaggcagguagauca

SEQ ID NO: 462875 - RNA, 23 nt, Human
gggaggucgaggcagguggauca

SEQ ID NO: 462876 - RNA, 23 nt, Human
gggaggucgaggcagguggaucg

SEQ ID NO: 462877 - RNA, 23 nt, Human
gggaggucgaggcgggcagauca

SEQ ID NO: 462878 - RNA, 23 nt, Human
gggaggucgagguaggcagauca

SEQ ID NO: 462879 - RNA, 23 nt, Human
gggaggucgagguagguggauca

SEQ ID NO: 462880 - RNA, 17 nt, Human
gggaggucgaguggggu

SEQ ID NO: 462881 - RNA, 32 nt, Human
gggaggucgucacuggggugggagaagagggg

SEQ ID NO: 462882 - RNA, 32 nt, Human
gggaggucgucucucaucccugccucaucuuc

SEQ ID NO: 462883 - RNA, 25 nt, Human
gggaggucugaucauuguuggugga

SEQ ID NO: 462884 - RNA, 20 nt, Human
gggaggucuggaccacccag

SEQ ID NO: 462885 - RNA, 32 nt, Human
gggaggucuugcuauguugcccaggcuggucu

SEQ ID NO: 462886 - RNA, 32 nt, Human
gggaggucuugucuccccuccugggcuuuccu

SEQ ID NO: 462887 - RNA, 32 nt, Human
gggaggugaaggcagagguggaggacauggac

SEQ ID NO: 462888 - RNA, 32 nt, Human
gggaggugacauagcaagacccugucaaagaa

SEQ ID NO: 462889 - RNA, 32 nt, Human
gggaggugacuccggcggaagaggacaaggca

SEQ ID NO: 462890 - RNA, 19 nt, Human
gggaggugagggagugggg

SEQ ID NO: 462891 - RNA, 23 nt, Human
gggaggugauuggaucauggggg

SEQ ID NO: 462892 - RNA, 24 nt, Human
gggaggugauuggaucauggggga

SEQ ID NO: 462893 - RNA, 23 nt, Human
gggaggugcaaugggaugggagg

SEQ ID NO: 462894 - RNA, 32 nt, Human
gggaggugcaaugggaugggaggcaggaugcu

SEQ ID NO: 462895 - RNA, 32 nt, Human
gggaggugcaauuucucagauugguaaaaauu

SEQ ID NO: 462896 - RNA, 24 nt, Human
gggaggugcauggggcaggcggga

SEQ ID NO: 462897 - RNA, 32 nt, Human
gggaggugcccagguggguggaccaguacucc

SEQ ID NO: 462898 - RNA, 32 nt, Human
gggaggugcugaccccucagaaaccccuuccc

SEQ ID NO: 462899 - RNA, 32 nt, Human
gggagguggaaguugcagugggccaagaucau

SEQ ID NO: 462900 - RNA, 32 nt, Human
gggagguggaggcaggcacugaauaagguccc

SEQ ID NO: 462901 - RNA, 32 nt, Human
gggagguggaggcagugagcugagaucgugcc

SEQ ID NO: 462902 - RNA, 23 nt, Human
gggagguggaggcggguggauca

SEQ ID NO: 462903 - RNA, 32 nt, Human
gggagguggaggcugcaaugagcugagaucau

SEQ ID NO: 462904 - RNA, 32 nt, Human
gggagguggagggagacaggagagaaacgaag

SEQ ID NO: 462905 - RNA, 32 nt, Human
gggagguggaggggaggcugcagugagcugag

SEQ ID NO: 462906 - RNA, 32 nt, Human
gggagguggagguggaaaacgugauugagugg

SEQ ID NO: 462907 - RNA, 32 nt, Human
gggagguggagguggagguugcagugagccga

SEQ ID NO: 462908 - RNA, 32 nt, Human
gggagguggagguggcagugagccgagauagc

SEQ ID NO: 462909 - RNA, 32 nt, Human
gggagguggagguggcagugagccgagaucac

SEQ ID NO: 462910 - RNA, 32 nt, Human
gggagguggagguggcagugagccgagauugc

SEQ ID NO: 462911 - RNA, 32 nt, Human
gggagguggaggugggaggauuauaaauagag

SEQ ID NO: 462912 - RNA, 32 nt, Human
gggagguggagguugaggugagcucagauugc

SEQ ID NO: 462913 - RNA, 32 nt, Human
gggagguggagguugcagugggccaagaucgc

SEQ ID NO: 462914 - RNA, 32 nt, Human
gggagguggagguugcagugggccaagaucgu

SEQ ID NO: 462915 - RNA, 32 nt, Human
gggagguggcacgggccagggcgcgggggccg

SEQ ID NO: 462916 - RNA, 32 nt, Human
gggagguggcucagaguccaccucucauugcu

SEQ ID NO: 462917 - RNA, 19 nt, Human
gggagguggcugcuggcug

SEQ ID NO: 462918 - RNA, 20 nt, Human
gggagguggggaccagcaga

SEQ ID NO: 462919 - RNA, 19 nt, Human
gggagguggggcuggggga

SEQ ID NO: 462920 - RNA, 32 nt, Human
gggaggugggguagggaggaguguaggaugcc

SEQ ID NO: 462921 - RNA, 32 nt, Human
gggaggugggugagacagaggguggggaggau

SEQ ID NO: 462922 - RNA, 32 nt, Human
gggagguggguggaucaccugaggucgggagu

SEQ ID NO: 462923 - RNA, 31 nt, Human
gggaggugggugggucaggugaguggaaggg

SEQ ID NO: 462924 - RNA, 24 nt, Human
gggagguggguggugugcuugcua

SEQ ID NO: 462925 - RNA, 32 nt, Human
gggaggugguaagaacaccugacaacuucuga

SEQ ID NO: 462926 - RNA, 23 nt, Human
gggagguggucauagagucaggg

SEQ ID NO: 462927 - RNA, 23 nt, Human
gggagguggucauguccaggggg

SEQ ID NO: 462928 - RNA, 24 nt, Human
gggagguggugcugccccaguggg

SEQ ID NO: 462929 - RNA, 32 nt, Human
gggaggugugugaccuggggaugguggagggu

SEQ ID NO: 462930 - RNA, 23 nt, Human
gggagguuaaggcaggcggauca

SEQ ID NO: 462931 - RNA, 32 nt, Human
gggagguuagggagguuugaagagugagaaga

SEQ ID NO: 462932 - RNA, 32 nt, Human
gggagguuauaugugguaggggagggcaugag

SEQ ID NO: 462933 - RNA, 32 nt, Human
gggagguuccaccgcaccccugcccucaaccg

SEQ ID NO: 462934 - RNA, 32 nt, Human
gggagguucuccugccucuccucggccaggag

SEQ ID NO: 462935 - RNA, 32 nt, Human
gggagguugagcaggaggauugcuugagccca

SEQ ID NO: 462936 - RNA, 23 nt, Human
gggagguugaggcaggagaauca

SEQ ID NO: 462937 - RNA, 24 nt, Human
gggagguugaggcaggagaaucau

SEQ ID NO: 462938 - RNA, 23 nt, Human
gggagguugaggcagguggauca

SEQ ID NO: 462939 - RNA, 23 nt, Human
gggagguugaggcggguggauca

SEQ ID NO: 462940 - RNA, 32 nt, Human
gggagguugaggcuacagggagccaugaucac

SEQ ID NO: 462941 - RNA, 32 nt, Human
gggagguugagugggcaucuuccugggaugca

SEQ ID NO: 462942 - RNA, 23 nt, Human
gggagguugaugcaggagaauca

SEQ ID NO: 462943 - RNA, 32 nt, Human
gggagguugcccauuguuugguugccagucau

SEQ ID NO: 462944 - RNA, 19 nt, Human
gggagguuucaugagcuca

SEQ ID NO: 462945 - RNA, 32 nt, Human
gggagguuugaaggggauccugggcuugggca

SEQ ID NO: 462946 - RNA, 32 nt, Human
gggagguuugcugggaccuuggcuccacccag

SEQ ID NO: 462947 - RNA, 19 nt, Human
gggagguuuuagggcccuc

SEQ ID NO: 462948 - RNA, 32 nt, Human
gggagguuuuccaacuguuggaggcgccuuug

SEQ ID NO: 462949 - RNA, 21 nt, Human
gggaguaaagggcugccuucc

SEQ ID NO: 462950 - RNA, 32 nt, Human
gggaguaaggagaaugaauuccaaucugugau

SEQ ID NO: 462951 - RNA, 32 nt, Human
gggaguagcagaggcccugucuucugaagucu

SEQ ID NO: 462952 - RNA, 30 nt, Human
gggaguagccucugauccuuuuguuacuua

SEQ ID NO: 462953 - RNA, 32 nt, Human
gggaguagcuacagcaagccucauaccaaaug

SEQ ID NO: 462954 - RNA, 32 nt, Human
gggaguaggaacgggagcaggagcgcgaccuu

SEQ ID NO: 462955 - RNA, 32 nt, Human
gggaguaggagaggggacaauuuaggacuggg

SEQ ID NO: 462956 - RNA, 19 nt, Human
gggaguaggaggccucagg

SEQ ID NO: 462957 - RNA, 32 nt, Human
gggaguaggcuugagcccuaccuuacacgucu

SEQ ID NO: 462958 - RNA, 32 nt, Human
gggaguagggcccggcagggaggcagggaggc

SEQ ID NO: 462959 - RNA, 32 nt, Human
gggagucaaaaugcuuccuggugccgggagug

SEQ ID NO: 462960 - RNA, 18 nt, Human
gggagucaaggcugcagu

SEQ ID NO: 462961 - RNA, 21 nt, Human
gggagucacaaaccugcucug

SEQ ID NO: 462962 - RNA, 31 nt, Human
gggagucacagcuaugccagcugggccauuu

SEQ ID NO: 462963 - RNA, 32 nt, Human
gggagucacccaagccuucuucucccagauac

SEQ ID NO: 462964 - RNA, 32 nt, Human
gggagucacugaugcugccucugccuucugau

SEQ ID NO: 462965 - RNA, 32 nt, Human
gggagucagagcccuggcuggguucagguccc

SEQ ID NO: 462966 - RNA, 32 nt, Human
gggagucagcugcucaucugcaggcuaauggc

SEQ ID NO: 462967 - RNA, 32 nt, Human
gggagucaggagacccggguucuuguguuggc

SEQ ID NO: 462968 - RNA, 32 nt, Human
gggagucaugccacuccccacuguggccauag

SEQ ID NO: 462969 - RNA, 32 nt, Human
gggaguccaaggagggggaucgcuugagucca

SEQ ID NO: 462970 - RNA, 32 nt, Human
gggaguccacaucuggcuuucucagccacugu

SEQ ID NO: 462971 - RNA, 32 nt, Human
gggaguccagagaggcaggaggauggagcucg

SEQ ID NO: 462972 - RNA, 20 nt, Human
gggaguccagccccaaggga

SEQ ID NO: 462973 - RNA, 32 nt, Human
gggaguccaugucccagccacaccucagggcu

SEQ ID NO: 462974 - RNA, 32 nt, Human
gggagucccugccucuccucccugggacaaua

SEQ ID NO: 462975 - RNA, 23 nt, Human
gggaguccgaggcagguggauca

SEQ ID NO: 462976 - RNA, 23 nt, Human
gggaguccgaggcaugcggauca

SEQ ID NO: 462977 - RNA, 23 nt, Human
gggaguccgaggcgagugaauca

SEQ ID NO: 462978 - RNA, 23 nt, Human
gggaguccgaggcgggcggauca

SEQ ID NO: 462979 - RNA, 32 nt, Human
gggaguccuccacgggcaucucucuccuggcg

SEQ ID NO: 462980 - RNA, 27 nt, Human
gggaguccuggggaggcaggaggcaga

SEQ ID NO: 462981 - RNA, 32 nt, Human
gggaguccugguuuguuuuguuuuguuauuuu

SEQ ID NO: 462982 - RNA, 32 nt, Human
gggagucgcccaggcuggagagcgguggcgcg

SEQ ID NO: 462983 - RNA, 32 nt, Human
gggagucgcugcccgagcggagcugcucagcc

SEQ ID NO: 462984 - RNA, 24 nt, Human
gggagucggaaggaggaggacaga

SEQ ID NO: 462985 - RNA, 20 nt, Human
gggagucggggucucagaga

SEQ ID NO: 462986 - RNA, 32 nt, Human
gggagucgggguggcggccaggaggaaaggca

SEQ ID NO: 462987 - RNA, 32 nt, Human
gggagucucagcggggaacuucuaucaguauc

SEQ ID NO: 462988 - RNA, 23 nt, Human
gggagucugaggcaaggggauca

SEQ ID NO: 462989 - RNA, 21 nt, Human
gggagucugccuacccuccua

SEQ ID NO: 462990 - RNA, 32 nt, Human
gggagucuggaauuuugguaugugccaggcag

SEQ ID NO: 462991 - RNA, 32 nt, Human
gggagucuggggacucagcgggccagagagcg

SEQ ID NO: 462992 - RNA, 24 nt, Human
gggagucuguggccguccagguga

SEQ ID NO: 462993 - RNA, 32 nt, Human
gggagucuucagaauagaaacuacccaucuca

SEQ ID NO: 462994 - RNA, 32 nt, Human
gggagucuugcugugccacacagcuccccacc

SEQ ID NO: 462995 - RNA, 32 nt, Human
gggagucuuguucugucacccaggcuggagug

SEQ ID NO: 462996 - RNA, 32 nt, Human
gggagugaacgguccaaccucugcauucaguu

SEQ ID NO: 462997 - RNA, 32 nt, Human
gggagugaagacaaucagaacuuugagaguuc

SEQ ID NO: 462998 - RNA, 24 nt, Human
gggagugaagagccugcccuccua

SEQ ID NO: 462999 - RNA, 19 nt, Human
gggagugaagcuccaggca

SEQ ID NO: 463000 - RNA, 32 nt, Human
gggagugaauaaggagacuuuuagguguugcc

SEQ ID NO: 463001 - RNA, 20 nt, Human
gggagugacaagcucagaga

SEQ ID NO: 463002 - RNA, 21 nt, Human
gggagugacaguggcuggaga

SEQ ID NO: 463003 - RNA, 21 nt, Human
gggagugagagccaccccgug

SEQ ID NO: 463004 - RNA, 32 nt, Human
gggagugagagggguauuuaauuccccuacua

SEQ ID NO: 463005 - RNA, 32 nt, Human
gggagugagccccagccguggcucaaggcaca

SEQ ID NO: 463006 - RNA, 32 nt, Human
gggagugagcggcuggcucucaguccccgccu

SEQ ID NO: 463007 - RNA, 21 nt, Human
gggagugaggaaugugggaga

SEQ ID NO: 463008 - RNA, 32 nt, Human
gggagugagggaagggacagggaggggaagcc

SEQ ID NO: 463009 - RNA, 32 nt, Human
gggagugaggggcaguggugcccuuccugcag

SEQ ID NO: 463010 - RNA, 31 nt, Human
gggagugcacuuuuugacuguagauuguucg

SEQ ID NO: 463011 - RNA, 32 nt, Human
gggagugcagaagucucagggccuggcugcga

SEQ ID NO: 463012 - RNA, 32 nt, Human
gggagugcagagccagggagagggguaccagg

SEQ ID NO: 463013 - RNA, 32 nt, Human
gggagugcagcaguuggccugcuugucuggcg

SEQ ID NO: 463014 - RNA, 32 nt, Human
gggagugcaguggcaguggcaugauaucagcu

SEQ ID NO: 463015 - RNA, 32 nt, Human
gggagugcaguggcaucauaggucacuguagc

SEQ ID NO: 463016 - RNA, 32 nt, Human
gggagugcaguggcaugaucucagcucacuga

SEQ ID NO: 463017 - RNA, 32 nt, Human
gggaguggaagaaggaucuaaagggaaaaacu

SEQ ID NO: 463018 - RNA, 21 nt, Human
gggaguggagcagcccgggcc

SEQ ID NO: 463019 - RNA, 32 nt, Human
gggaguggagcagcccgggccagccuucuccu

SEQ ID NO: 463020 - RNA, 32 nt, Human
gggaguggagccugggccugaggucuccugug

SEQ ID NO: 463021 - RNA, 32 nt, Human
gggaguggagcugggcuggcugggcaggcagg

SEQ ID NO: 463022 - RNA, 32 nt, Human
gggaguggaggcaccggcuggcgggcgggggu

SEQ ID NO: 463023 - RNA, 32 nt, Human
gggaguggaggguggaggaacguguggaguuu

SEQ ID NO: 463024 - RNA, 32 nt, Human
gggaguggcaacugucaggcagaggaaagaac

SEQ ID NO: 463025 - RNA, 32 nt, Human
gggaguggccagcggcccugcccagauuaagc

SEQ ID NO: 463026 - RNA, 32 nt, Human
gggaguggccaggucaggcaggccagucgucu

SEQ ID NO: 463027 - RNA, 32 nt, Human
gggaguggcgagcccagcugcccagcccugcc

SEQ ID NO: 463028 - RNA, 19 nt, Human
gggagugggcugaagggag

SEQ ID NO: 463029 - RNA, 26 nt, Human
gggagugggcugaaggugaagggagg

SEQ ID NO: 463030 - RNA, 17 nt, Human
gggaguggggcugggga

SEQ ID NO: 463031 - RNA, 32 nt, Human
gggagugggggaaacacuuuucacugcagagu

SEQ ID NO: 463032 - RNA, 28 nt, Human
gggagugggugaccugccucaucacugc

SEQ ID NO: 463033 - RNA, 32 nt, Human
gggaguggucguauuaacuucuugcccaaaga

SEQ ID NO: 463034 - RNA, 32 nt, Human
gggaguggugccuguggacacaggacuagacc

SEQ ID NO: 463035 - RNA, 32 nt, Human
gggagugguggagccggaggggauaguggggg

SEQ ID NO: 463036 - RNA, 32 nt, Human
gggagugguggagcugggccaggcaggaagac

SEQ ID NO: 463037 - RNA, 19 nt, Human
gggaguggugggaagggag

SEQ ID NO: 463038 - RNA, 20 nt, Human
gggaguguagagaagacaga

SEQ ID NO: 463039 - RNA, 32 nt, Human
gggagugucauccuuacaaaccacagcaugcc

SEQ ID NO: 463040 - RNA, 22 nt, Human
gggaguguccaucaucagggga

SEQ ID NO: 463041 - RNA, 32 nt, Human
gggagugucucauuuuucuacuucccucuuuc

SEQ ID NO: 463042 - RNA, 32 nt, Human
gggagugugaggagaggguggcaucaggagcu

SEQ ID NO: 463043 - RNA, 32 nt, Human
gggaguguuauuagaaugaaaaguaauuaguu

SEQ ID NO: 463044 - RNA, 32 nt, Human
gggaguguuuagagcaguuucaaagaugagag

SEQ ID NO: 463045 - RNA, 32 nt, Human
gggaguuaaagaccagccugaccgacauggag

SEQ ID NO: 463046 - RNA, 32 nt, Human
gggaguuaacacagcagcugacuccucuaggc

SEQ ID NO: 463047 - RNA, 22 nt, Human
gggaguuacggguggagggagg

SEQ ID NO: 463048 - RNA, 32 nt, Human
gggaguuagaaaccagccuggccaacauggca

SEQ ID NO: 463049 - RNA, 32 nt, Human
gggaguucaaaaccagccugggcaacauagca

SEQ ID NO: 463050 - RNA, 32 nt, Human
gggaguucaagaccagccuagcccacauggcc

SEQ ID NO: 463051 - RNA, 32 nt, Human
gggaguucaagaccagccugaccaacacggag

SEQ ID NO: 463052 - RNA, 32 nt, Human
gggaguucaagaccagccugaccaacauggag

SEQ ID NO: 463053 - RNA, 32 nt, Human
gggaguucaagaccagccugaccaacguggag

SEQ ID NO: 463054 - RNA, 32 nt, Human
gggaguucaagaccagccugaugaacauggag

SEQ ID NO: 463055 - RNA, 32 nt, Human
gggaguucaagaccagccuggccaacauagug

SEQ ID NO: 463056 - RNA, 32 nt, Human
gggaguucaagaccagccuggccaacauggcg

SEQ ID NO: 463057 - RNA, 32 nt, Human
gggaguucaagaccagccuggccaacaugggg

SEQ ID NO: 463058 - RNA, 32 nt, Human
gggaguucaagaccagccuggccaacauggug

SEQ ID NO: 463059 - RNA, 32 nt, Human
gggaguucaagaccagccuggccaacauguca

SEQ ID NO: 463060 - RNA, 32 nt, Human
gggaguucaagaccagccuggccaucauggug

SEQ ID NO: 463061 - RNA, 32 nt, Human
gggaguucaagaccagccugggcaacauagug

SEQ ID NO: 463062 - RNA, 32 nt, Human
gggaguucaagaccagccugggcaacauggca

SEQ ID NO: 463063 - RNA, 32 nt, Human
gggaguucaagaccagccuggucaacauggug

SEQ ID NO: 463064 - RNA, 32 nt, Human
gggaguucacaaccagccugaccaacauggag

SEQ ID NO: 463065 - RNA, 32 nt, Human
gggaguucagaaccagccuggacaacauagug

SEQ ID NO: 463066 - RNA, 32 nt, Human
gggaguucagcugcuucucuugccuaaguauu

SEQ ID NO: 463067 - RNA, 32 nt, Human
gggaguucagguaggcugggccugugccucua

SEQ ID NO: 463068 - RNA, 32 nt, Human
gggaguucagguaucuguugugacuggugaag

SEQ ID NO: 463069 - RNA, 32 nt, Human
gggaguucauuucugaccuccucgcucuucag

SEQ ID NO: 463070 - RNA, 20 nt, Human
gggaguuccuacacacacuu

SEQ ID NO: 463071 - RNA, 32 nt, Human
gggaguuccucugaggcccaguccuggccccg

SEQ ID NO: 463072 - RNA, 32 nt, Human
gggaguucgaaaccagccugaccaaccuggag

SEQ ID NO: 463073 - RNA, 32 nt, Human
gggaguucgaaaccagccuggccaacaaggug

SEQ ID NO: 463074 - RNA, 32 nt, Human
gggaguucgagaccaaccugaccaacauggag

SEQ ID NO: 463075 - RNA, 32 nt, Human
gggaguucgagaccacccugaccaacauagag

SEQ ID NO: 463076 - RNA, 32 nt, Human
gggaguucgagaccagccugaccaacacggag

SEQ ID NO: 463077 - RNA, 32 nt, Human
gggaguucgagaccagccugaccaacauggag

SEQ ID NO: 463078 - RNA, 32 nt, Human
gggaguucgagaccagccugaccaacauggug

SEQ ID NO: 463079 - RNA, 32 nt, Human
gggaguucgagaccagccugaccagcauggug

SEQ ID NO: 463080 - RNA, 32 nt, Human
gggaguucgagaccagccugagcaacauggcg

SEQ ID NO: 463081 - RNA, 32 nt, Human
gggaguucgagaccagccuggccaacacuggu

SEQ ID NO: 463082 - RNA, 32 nt, Human
gggaguucgagaccagccuggccaacauagca

SEQ ID NO: 463083 - RNA, 32 nt, Human
gggaguucgagaccagccuggccaacaugccu

SEQ ID NO: 463084 - RNA, 32 nt, Human
gggaguucgagaccagccuggccaacuuggug

SEQ ID NO: 463085 - RNA, 32 nt, Human
gggaguucgagaccagccuggccaauauggug

SEQ ID NO: 463086 - RNA, 32 nt, Human
gggaguucgagaccagccugggcaacauagug

SEQ ID NO: 463087 - RNA, 32 nt, Human
gggaguucgagaccagccugggcaacauggug

SEQ ID NO: 463088 - RNA, 32 nt, Human
gggaguucgagaccagccuguccaacauggcg

SEQ ID NO: 463089 - RNA, 32 nt, Human
gggaguucgagaccagccuuaccaacauggag

SEQ ID NO: 463090 - RNA, 32 nt, Human
gggaguucgagaccagcgugaccaacguggag

SEQ ID NO: 463091 - RNA, 32 nt, Human
gggaguucgagaccagucugaccaacacggag

SEQ ID NO: 463092 - RNA, 32 nt, Human
gggaguucgagacuaaacugaccaacauggag

SEQ ID NO: 463093 - RNA, 32 nt, Human
gggaguucgagacuagccugaccaacauggag

SEQ ID NO: 463094 - RNA, 32 nt, Human
gggaguucgaggccagccugaccaacauggag

SEQ ID NO: 463095 - RNA, 32 nt, Human
gggaguucgaggccagccugaccaacguggag

SEQ ID NO: 463096 - RNA, 32 nt, Human
gggaguucgcgaccagccugaccaacauggaa

SEQ ID NO: 463097 - RNA, 32 nt, Human
gggaguucgggaccagccuagccuacauggug

SEQ ID NO: 463098 - RNA, 32 nt, Human
gggaguucuaaaggaaauuaaacauagcauga

SEQ ID NO: 463099 - RNA, 32 nt, Human
gggaguucuagaccagccugaccaacauggag

SEQ ID NO: 463100 - RNA, 32 nt, Human
gggaguugaagcuggaggauuacuugaggcca

SEQ ID NO: 463101 - RNA, 32 nt, Human
gggaguugaggguaggguggugucagcaauuc

SEQ ID NO: 463102 - RNA, 32 nt, Human
gggaguugccccuucccaguaaaagaguugca

SEQ ID NO: 463103 - RNA, 32 nt, Human
gggaguugcucaggcauccaggaaaagugggg

SEQ ID NO: 463104 - RNA, 32 nt, Human
gggaguuggaagcuggugugaggcucucaugg

SEQ ID NO: 463105 - RNA, 32 nt, Human
gggaguuggagaccagccugaccaacauggag

SEQ ID NO: 463106 - RNA, 32 nt, Human
gggaguuggagaccagccugagcaacauagug

SEQ ID NO: 463107 - RNA, 32 nt, Human
gggaguuggagaccagccuggaugacauaaug

SEQ ID NO: 463108 - RNA, 32 nt, Human
gggaguuggagaccagccugggcaacauagca

SEQ ID NO: 463109 - RNA, 32 nt, Human
gggaguuggcugcugaggagccuagauacgga

SEQ ID NO: 463110 - RNA, 23 nt, Human
gggaguuggggagagaaggcaga

SEQ ID NO: 463111 - RNA, 32 nt, Human
gggaguuggugcuucuugucucugggucucca

SEQ ID NO: 463112 - RNA, 32 nt, Human
gggaguuuaagaccagccuggccaacuuggug

SEQ ID NO: 463113 - RNA, 32 nt, Human
gggaguuuagguccaauuugggcaagguuguu

SEQ ID NO: 463114 - RNA, 32 nt, Human
gggaguuucuauuuuccucccuucucagacag

SEQ ID NO: 463115 - RNA, 32 nt, Human
gggaguuugacagaggaaguggaugccuuugg

SEQ ID NO: 463116 - RNA, 32 nt, Human
gggaguuugagaccagccucaucaacacagug

SEQ ID NO: 463117 - RNA, 32 nt, Human
gggaguuugagaccagccugaccaacauggag

SEQ ID NO: 463118 - RNA, 32 nt, Human
gggaguuugagaccagccugaccaacauggug

SEQ ID NO: 463119 - RNA, 32 nt, Human
gggaguuugagaccagccugacuaacacagug

SEQ ID NO: 463120 - RNA, 32 nt, Human
gggaguuugagaccagccuggccaacauggug

SEQ ID NO: 463121 - RNA, 32 nt, Human
gggaguuugagaccagccugggcaacauagcg

SEQ ID NO: 463122 - RNA, 32 nt, Human
gggaguuugagaccagccugggcaacaugggg

SEQ ID NO: 463123 - RNA, 32 nt, Human
gggaguuugagaccagucugaccaacauggag

SEQ ID NO: 463124 - RNA, 32 nt, Human
gggaguuuuccuaaacgaucacucuggugcgg

SEQ ID NO: 463125 - RNA, 30 nt, Human
gggaguuuucuuuguuugcuccuguguuug

SEQ ID NO: 463126 - RNA, 32 nt, Human
gggauaaaagugggcugggcgcaguggcucac

SEQ ID NO: 463127 - RNA, 32 nt, Human
gggauaaagagcuuccucacuggaugggaccc

SEQ ID NO: 463128 - RNA, 32 nt, Human
gggauaaagcugucucaugggugcuccauaua

SEQ ID NO: 463129 - RNA, 32 nt, Human
gggauaagccaccacacccagccuagagaccu

SEQ ID NO: 463130 - RNA, 32 nt, Human
gggauaaggaaaaauaaugugaaaguugcagu

SEQ ID NO: 463131 - RNA, 32 nt, Human
gggauaaggcuaaguucagaggauguggggag

SEQ ID NO: 463132 - RNA, 32 nt, Human
gggauaagguaaagcaacucagcugcuacagg

SEQ ID NO: 463133 - RNA, 32 nt, Human
gggauaaucuguucuucccaucugagaaaaga

SEQ ID NO: 463134 - RNA, 32 nt, Human
gggauaaugagcuggagggugcugggcaggag

SEQ ID NO: 463135 - RNA, 32 nt, Human
gggauaauggauuggagauggcuauguguaaa

SEQ ID NO: 463136 - RNA, 32 nt, Human
gggauaauuguuauggacccaugugugggcau

SEQ ID NO: 463137 - RNA, 32 nt, Human
gggauacagagccaggaguggaacugcugagu

SEQ ID NO: 463138 - RNA, 25 nt, Human
gggauacagguguuauuucagguga

SEQ ID NO: 463139 - RNA, 25 nt, Human
gggauacauagggucaaauugagaa

SEQ ID NO: 463140 - RNA, 32 nt, Human
gggauacauaugcaaaacaugcauguuuguua

SEQ ID NO: 463141 - RNA, 32 nt, Human
gggauaccacuuccuguccacaccccgaccag

SEQ ID NO: 463142 - RNA, 32 nt, Human
gggauacccuuguugccuaccuccaaguaauu

SEQ ID NO: 463143 - RNA, 32 nt, Human
gggauaccugggaggaugggguggaaucugag

SEQ ID NO: 463144 - RNA, 32 nt, Human
gggauaccuuguuuauaguaccuucucuuugc

SEQ ID NO: 463145 - RNA, 32 nt, Human
gggauacggcucccguuccuccagcaggcccu

SEQ ID NO: 463146 - RNA, 22 nt, Human
gggauacgguuaaauccaguga

SEQ ID NO: 463147 - RNA, 28 nt, Human
gggauacuggauagggcugaccagguga

SEQ ID NO: 463148 - RNA, 32 nt, Human
gggauagagagggagccagacggacagccagc

SEQ ID NO: 463149 - RNA, 31 nt, Human
gggauaggcaaagggaccaguaucagguuau

SEQ ID NO: 463150 - RNA, 32 nt, Human
gggauaggggcagaggaggcgaggaggccguu

SEQ ID NO: 463151 - RNA, 32 nt, Human
gggauagguagaggagagagacagcaagaaaa

SEQ ID NO: 463152 - RNA, 21 nt, Human
gggauaggugccauuuggugg

SEQ ID NO: 463153 - RNA, 32 nt, Human
gggauagucgucucuucaucagucucccccga

SEQ ID NO: 463154 - RNA, 32 nt, Human
gggauagugauggacaucugaggaagagguaa

SEQ ID NO: 463155 - RNA, 21 nt, Human
gggauaguuaccaagaaccuc

SEQ ID NO: 463156 - RNA, 32 nt, Human
gggauauaauuucucuucuuggcuccaccagu

SEQ ID NO: 463157 - RNA, 30 nt, Human
gggauaugaauagcuucuucggaaccccag

SEQ ID NO: 463158 - RNA, 24 nt, Human
gggauaugacuuagaaccaggugg

SEQ ID NO: 463159 - RNA, 32 nt, Human
gggauauggcaggaaucaaaauaaacuuaucu

SEQ ID NO: 463160 - RNA, 20 nt, Human
gggauauggcuggcuggcug

SEQ ID NO: 463161 - RNA, 32 nt, Human
gggauauucuucuucuccugcccuuggacauc

SEQ ID NO: 463162 - RNA, 32 nt, Human
gggauauucuugaagccacacauggcuggcgg

SEQ ID NO: 463163 - RNA, 32 nt, Human
gggauauuuaagguagcuucagcuagcuuuua

SEQ ID NO: 463164 - RNA, 20 nt, Human
gggaucaaagcuauccaggu

SEQ ID NO: 463165 - RNA, 32 nt, Human
gggaucaaaugagauaaugucugggacaguac

SEQ ID NO: 463166 - RNA, 32 nt, Human
gggaucaagggacaggccaggagccaggagug

SEQ ID NO: 463167 - RNA, 32 nt, Human
gggaucaaugccggcggccucugugaugguug

SEQ ID NO: 463168 - RNA, 32 nt, Human
gggaucacaaauucuguucauuggaaaggguu

SEQ ID NO: 463169 - RNA, 32 nt, Human
gggaucacaccacugcacuccagccuggguga

SEQ ID NO: 463170 - RNA, 32 nt, Human
gggaucacaccacugcacuucagccugggcaa

SEQ ID NO: 463171 - RNA, 32 nt, Human
gggaucacagccccuccaggcaagggagaagu

SEQ ID NO: 463172 - RNA, 32 nt, Human
gggaucacagcugcaggccacgcccagcuucc

SEQ ID NO: 463173 - RNA, 19 nt, Human
gggaucacaggcaugagcc

SEQ ID NO: 463174 - RNA, 32 nt, Human
gggaucaccugagcccaggaguuuggaccagc

SEQ ID NO: 463175 - RNA, 32 nt, Human
gggaucacgccacugaacuccagccuggguga

SEQ ID NO: 463176 - RNA, 32 nt, Human
gggaucacgccacugcacuccagcuuggguga

SEQ ID NO: 463177 - RNA, 32 nt, Human
gggaucacgccuguaaucccagcacuuaggga

SEQ ID NO: 463178 - RNA, 32 nt, Human
gggaucacgucacugcauuccagccuggauaa

SEQ ID NO: 463179 - RNA, 32 nt, Human
gggaucacugcaaccucugccuccuggguuca

SEQ ID NO: 463180 - RNA, 32 nt, Human
gggaucagacacaccugucuucaguggcuugc

SEQ ID NO: 463181 - RNA, 32 nt, Human
gggaucagagcagaaaccuccuugucccucuc

SEQ ID NO: 463182 - RNA, 32 nt, Human
gggaucagcucauccaugagcuuguauugcuc

SEQ ID NO: 463183 - RNA, 22 nt, Human
gggaucaggaugacaguccuuc

SEQ ID NO: 463184 - RNA, 32 nt, Human
gggaucaggcaggaggaguuugggagaaaccu

SEQ ID NO: 463185 - RNA, 32 nt, Human
gggaucaggccccagagcuugcuguccccuga

SEQ ID NO: 463186 - RNA, 32 nt, Human
gggaucagggagguggagggacagugugaaua

SEQ ID NO: 463187 - RNA, 32 nt, Human
gggaucaucacuucucggaugcucugugcagg

SEQ ID NO: 463188 - RNA, 31 nt, Human
gggaucaugguggcguugcggggccuuggua

SEQ ID NO: 463189 - RNA, 32 nt, Human
gggaucauugcagacucugccucucaggcuca

SEQ ID NO: 463190 - RNA, 32 nt, Human
gggauccacuuguuuaccgacagccccaagga

SEQ ID NO: 463191 - RNA, 32 nt, Human
gggauccagcacucaaggcagcucccuagggc

SEQ ID NO: 463192 - RNA, 17 nt, Human
gggauccagcccccuuc

SEQ ID NO: 463193 - RNA, 32 nt, Human
gggauccaggaggagcaggggccagcaguggg

SEQ ID NO: 463194 - RNA, 32 nt, Human
gggauccaggggaccugguuccaaucucagcc

SEQ ID NO: 463195 - RNA, 18 nt, Human
gggauccaggguggggug

SEQ ID NO: 463196 - RNA, 32 nt, Human
gggauccagugcagagauggggaggaggggcu

SEQ ID NO: 463197 - RNA, 32 nt, Human
gggauccauucccuguccccugcccacuaccu

SEQ ID NO: 463198 - RNA, 32 nt, Human
gggaucccacaaagugcugggauuacaggugu

SEQ ID NO: 463199 - RNA, 32 nt, Human
gggauccccugccuggugcccacacugccucg

SEQ ID NO: 463200 - RNA, 22 nt, Human
gggaucccggccagccagguga

SEQ ID NO: 463201 - RNA, 32 nt, Human
gggaucccguggggagagguuauaucagacug

SEQ ID NO: 463202 - RNA, 32 nt, Human
gggaucccuaacgugcccagcauguagauucu

SEQ ID NO: 463203 - RNA, 25 nt, Human
gggaucccugggggccauucaggga

SEQ ID NO: 463204 - RNA, 19 nt, Human
gggauccgaccccgggccg

SEQ ID NO: 463205 - RNA, 32 nt, Human
gggauccggccaggguggagugggugaggcag

SEQ ID NO: 463206 - RNA, 32 nt, Human
gggauccgggaccucagacuacucggguuugg

SEQ ID NO: 463207 - RNA, 32 nt, Human
gggauccucccaucucagcuuccugaggagcu

SEQ ID NO: 463208 - RNA, 32 nt, Human
gggauccucccccagccgcaaguccacgaaga

SEQ ID NO: 463209 - RNA, 32 nt, Human
gggauccugauugauugaaauucauguuuucu

SEQ ID NO: 463210 - RNA, 32 nt, Human
gggauccugcccuccagccccaacaaaggguu

SEQ ID NO: 463211 - RNA, 32 nt, Human
gggauccugccugccccuacccuggacuugcc

SEQ ID NO: 463212 - RNA, 32 nt, Human
gggauccugcgggaggaaguggggaaguuggg

SEQ ID NO: 463213 - RNA, 32 nt, Human
gggauccugggcuggaagaaaguucauaaaug

SEQ ID NO: 463214 - RNA, 32 nt, Human
gggauccuguacaacccuuuguggacccuuuu

SEQ ID NO: 463215 - RNA, 32 nt, Human
gggauccugugcaggggccaccugggagauag

SEQ ID NO: 463216 - RNA, 32 nt, Human
gggauccuucuuccugucccuggcuguugcug

SEQ ID NO: 463217 - RNA, 32 nt, Human
gggauccuuucauggcgucuucccaggaccuc

SEQ ID NO: 463218 - RNA, 32 nt, Human
gggaucgauauggagucaagcagcgggaacua

SEQ ID NO: 463219 - RNA, 32 nt, Human
gggaucgcaccacugcacuccagccugggcua

SEQ ID NO: 463220 - RNA, 32 nt, Human
gggaucgcaccacugcacuccagccuggguua

SEQ ID NO: 463221 - RNA, 32 nt, Human
gggaucgcaccgcugcacuccagccuggguga

SEQ ID NO: 463222 - RNA, 32 nt, Human
gggaucgcaguuuggaaacuccggcggcugcg

SEQ ID NO: 463223 - RNA, 32 nt, Human
gggaucgcgccacugcauuccagccuggacga

SEQ ID NO: 463224 - RNA, 32 nt, Human
gggaucgcgccacuguacuccagccuggguga

SEQ ID NO: 463225 - RNA, 32 nt, Human
gggaucgcgccauugcacuccagccuggcuga

SEQ ID NO: 463226 - RNA, 32 nt, Human
gggaucggaccagccacuguggcagaugggag

SEQ ID NO: 463227 - RNA, 32 nt, Human
gggaucggcugggugaggcugggcaggccuga

SEQ ID NO: 463228 - RNA, 32 nt, Human
gggaucgggcugagcaggagaacaucaccggc

SEQ ID NO: 463229 - RNA, 32 nt, Human
gggaucguaccacugcacuccagccugggcua

SEQ ID NO: 463230 - RNA, 32 nt, Human
gggaucguacuacugcacuccagcauggaaga

SEQ ID NO: 463231 - RNA, 32 nt, Human
gggaucgugccgcugcauccagccugagcaac

SEQ ID NO: 463232 - RNA, 32 nt, Human
gggaucguguggcagugaugcugccccgagug

SEQ ID NO: 463233 - RNA, 32 nt, Human
gggaucuagggcugugcaggacuugccuuguu

SEQ ID NO: 463234 - RNA, 32 nt, Human
gggaucucacuagguugcccaggcuggugucg

SEQ ID NO: 463235 - RNA, 32 nt, Human
gggaucucacuccaucacucaggcuggaguac

SEQ ID NO: 463236 - RNA, 32 nt, Human
gggaucucauggaccagaauggcccguggaga

SEQ ID NO: 463237 - RNA, 32 nt, Human
gggaucuccaucucucuucccuuccugcuguc

SEQ ID NO: 463238 - RNA, 29 nt, Human
gggaucuccauggcucaggagggacauag

SEQ ID NO: 463239 - RNA, 32 nt, Human
gggaucucugaggacaucuuaguucugaccuu

SEQ ID NO: 463240 - RNA, 32 nt, Human
gggaucucugcugaggcccggggaguuggggg

SEQ ID NO: 463241 - RNA, 32 nt, Human
gggaucucuguggcacugggccaccucauugg

SEQ ID NO: 463242 - RNA, 32 nt, Human
gggaucucuucucuccccuucaccauuacuca

SEQ ID NO: 463243 - RNA, 32 nt, Human
gggaucucuugaggcugggaggcggagguugc

SEQ ID NO: 463244 - RNA, 32 nt, Human
gggaucucuuucaaaugaaaaaggacagagcc

SEQ ID NO: 463245 - RNA, 19 nt, Human
gggaucugaaaaguggggu

SEQ ID NO: 463246 - RNA, 32 nt, Human
gggaucugagcuuguucaucuccagucgugac

SEQ ID NO: 463247 - RNA, 32 nt, Human
gggaucugcauuucuaacaggcuccugccccc

SEQ ID NO: 463248 - RNA, 32 nt, Human
gggaucugcccaggaauguugucaaguguaau

SEQ ID NO: 463249 - RNA, 31 nt, Human
gggaucugccucucuguggucuccauccuga

SEQ ID NO: 463250 - RNA, 32 nt, Human
gggaucugcgccaccagaaccuagccuccugc

SEQ ID NO: 463251 - RNA, 18 nt, Human
gggaucugcugggguggg

SEQ ID NO: 463252 - RNA, 32 nt, Human
gggaucugcuguccucccuuuugagucaguuc

SEQ ID NO: 463253 - RNA, 20 nt, Human
gggaucuggacaccugcccc

SEQ ID NO: 463254 - RNA, 32 nt, Human
gggaucugggcaaggugggugauuccucccag

SEQ ID NO: 463255 - RNA, 19 nt, Human
gggaucuggggauggggug

SEQ ID NO: 463256 - RNA, 32 nt, Human
gggaucuguaggagcaggacugcuagggccuc

SEQ ID NO: 463257 - RNA, 29 nt, Human
gggaucugucugugcuugcaggaaagucc

SEQ ID NO: 463258 - RNA, 32 nt, Human
gggaucuguuggggauuugaggugagaugaga

SEQ ID NO: 463259 - RNA, 32 nt, Human
gggaucuuacucuuucaucugauaccuuguuc

SEQ ID NO: 463260 - RNA, 32 nt, Human
gggaucuucaggaacuucugaccucaccaagu

SEQ ID NO: 463261 - RNA, 32 nt, Human
gggaucuuggguuggagggacagugaagcuua

SEQ ID NO: 463262 - RNA, 21 nt, Human
gggaugaaaggaaacaacaga

SEQ ID NO: 463263 - RNA, 32 nt, Human
gggaugaaauuucacagaacuaccacacaauc

SEQ ID NO: 463264 - RNA, 32 nt, Human
gggaugaagaauugacugggagcugaggaggg

SEQ ID NO: 463265 - RNA, 23 nt, Human
gggaugaagaccccacugggguu

SEQ ID NO: 463266 - RNA, 32 nt, Human
gggaugaagucuuggaaacacaucacaaacuc

SEQ ID NO: 463267 - RNA, 31 nt, Human
gggaugaaguuucaggacuauuucacucccu

SEQ ID NO: 463268 - RNA, 32 nt, Human
gggaugacaggaaggaaggaacacugggcaga

SEQ ID NO: 463269 - RNA, 32 nt, Human
gggaugacagggguucaaagagacaggguggu

SEQ ID NO: 463270 - RNA, 22 nt, Human
gggaugaccccacucagcucca

SEQ ID NO: 463271 - RNA, 32 nt, Human
gggaugacuccacccucagcuacugcccgugc

SEQ ID NO: 463272 - RNA, 32 nt, Human
gggaugacugauucuccuccgccaggccaccc

SEQ ID NO: 463273 - RNA, 32 nt, Human
gggaugagccucccaagcaucuuucccacuug

SEQ ID NO: 463274 - RNA, 30 nt, Human
gggaugagccucuccuugccccaguccugg

SEQ ID NO: 463275 - RNA, 28 nt, Human
gggaugagcgagguggaggcggcagcgg

SEQ ID NO: 463276 - RNA, 32 nt, Human
gggaugagcuuuugauuucuucucacuccccu

SEQ ID NO: 463277 - RNA, 32 nt, Human
gggaugaggaaggcuucaacuucuggcacuga

SEQ ID NO: 463278 - RNA, 19 nt, Human
gggaugaggacagcugggg

SEQ ID NO: 463279 - RNA, 32 nt, Human
gggaugaggagaggagaacagagggaugguga

SEQ ID NO: 463280 - RNA, 32 nt, Human
gggaugaggagguggagugcaggggauguuag

SEQ ID NO: 463281 - RNA, 32 nt, Human
gggaugaggaugacagagcaacccuucuccug

SEQ ID NO: 463282 - RNA, 20 nt, Human
gggaugaggcaaggcugccu

SEQ ID NO: 463283 - RNA, 32 nt, Human
gggaugaggcagcagguaggacagugaccucg

SEQ ID NO: 463284 - RNA, 32 nt, Human
gggaugaggcugggguugggaucugauguaug

SEQ ID NO: 463285 - RNA, 32 nt, Human
gggaugagggagcagagucuagggcaggcucc

SEQ ID NO: 463286 - RNA, 32 nt, Human
gggaugagggcagagagaggggagcccccucu

SEQ ID NO: 463287 - RNA, 32 nt, Human
gggaugagggcagggcccugccgcuccaccgc

SEQ ID NO: 463288 - RNA, 32 nt, Human
gggaugagucaggaggccuggaggcuugggga

SEQ ID NO: 463289 - RNA, 32 nt, Human
gggaugagucuauucuuggauuuugauguuua

SEQ ID NO: 463290 - RNA, 32 nt, Human
gggaugagucuugguguguucugcagggacag

SEQ ID NO: 463291 - RNA, 32 nt, Human
gggaugaucuggaggaggaggaaaaagauaca

SEQ ID NO: 463292 - RNA, 32 nt, Human
gggaugaugauacugaauagucuggaaugugg

SEQ ID NO: 463293 - RNA, 32 nt, Human
gggaugauucaccuccauauuuccuaagcagg

SEQ ID NO: 463294 - RNA, 22 nt, Human
gggaugauugcuugagcucagg

SEQ ID NO: 463295 - RNA, 32 nt, Human
gggaugauuguaggucaagagacugaagcaau

SEQ ID NO: 463296 - RNA, 32 nt, Human
gggaugauuguuugaguccaggaguuggaggc

SEQ ID NO: 463297 - RNA, 32 nt, Human
gggaugcaaaggccaacuucagccuggcacgg

SEQ ID NO: 463298 - RNA, 32 nt, Human
gggaugcacagagagggaaaauaaccugucca

SEQ ID NO: 463299 - RNA, 19 nt, Human
gggaugcagagccucagag

SEQ ID NO: 463300 - RNA, 32 nt, Human
gggaugcagauggccaagcucccacccugggu

SEQ ID NO: 463301 - RNA, 28 nt, Human
gggaugcagcagagaggagcagcuggaa

SEQ ID NO: 463302 - RNA, 32 nt, Human
gggaugcagcgaggcccugccuuccuagcaga

SEQ ID NO: 463303 - RNA, 19 nt, Human
gggaugcaggagcccuaua

SEQ ID NO: 463304 - RNA, 32 nt, Human
gggaugcagucaacaacacagagugcuggaag

SEQ ID NO: 463305 - RNA, 32 nt, Human
gggaugcaguuccagggcaggcaguagaggcc

SEQ ID NO: 463306 - RNA, 32 nt, Human
gggaugcauaauacacaaaggccagggagccu

SEQ ID NO: 463307 - RNA, 32 nt, Human
gggaugcauccccagcccaagucuccagccca

SEQ ID NO: 463308 - RNA, 32 nt, Human
gggaugcaucugugacuguuacugcaaaaggu

SEQ ID NO: 463309 - RNA, 32 nt, Human
gggaugcauuaggacuggccuaugcaucgaaa

SEQ ID NO: 463310 - RNA, 31 nt, Human
gggaugcauuauuucugacacccacaagcag

SEQ ID NO: 463311 - RNA, 32 nt, Human
gggaugccaccuggagccccacccaggagcug

SEQ ID NO: 463312 - RNA, 32 nt, Human
gggaugccagccaggcuugcagcugcuccauc

SEQ ID NO: 463313 - RNA, 32 nt, Human
gggaugccagcucuccccuuugugcuucccug

SEQ ID NO: 463314 - RNA, 28 nt, Human
gggaugcccaggaacgccucaucucagc

SEQ ID NO: 463315 - RNA, 32 nt, Human
gggaugcccaggagaggccauacuuucagggu

SEQ ID NO: 463316 - RNA, 32 nt, Human
gggaugccccuggcaugggguggguggaggcc

SEQ ID NO: 463317 - RNA, 32 nt, Human
gggaugcccugaguugcuucccauuuccucuu

SEQ ID NO: 463318 - RNA, 32 nt, Human
gggaugcccuggagguggcugagccccugucu

SEQ ID NO: 463319 - RNA, 32 nt, Human
gggaugccgcaaccucgacuucucagccuccu

SEQ ID NO: 463320 - RNA, 18 nt, Human
gggaugccgcagccuggc

SEQ ID NO: 463321 - RNA, 32 nt, Human
gggaugccuaucucccccuggcugagagugcc

SEQ ID NO: 463322 - RNA, 32 nt, Human
gggaugccuggcugcuggaguacauguguuca

SEQ ID NO: 463323 - RNA, 32 nt, Human
gggaugccuuagacggggugugcaguauuuua

SEQ ID NO: 463324 - RNA, 32 nt, Human
gggaugccuugguuuuuacugcucugagaauu

SEQ ID NO: 463325 - RNA, 22 nt, Human
gggaugcgaagccagcaagcuu

SEQ ID NO: 463326 - RNA, 22 nt, Human
gggaugcgaggguggccaguga

SEQ ID NO: 463327 - RNA, 24 nt, Human
gggaugcgccugaucaccagguga

SEQ ID NO: 463328 - RNA, 32 nt, Human
gggaugcgggcccuucuuccucccagaacacu

SEQ ID NO: 463329 - RNA, 32 nt, Human
gggaugcggggucuuugacugaagggguaggc

SEQ ID NO: 463330 - RNA, 17 nt, Human
gggaugcgguagcggcc

SEQ ID NO: 463331 - RNA, 18 nt, Human
gggaugcuaacuacaaca

SEQ ID NO: 463332 - RNA, 32 nt, Human
gggaugcuacagaugucauuugucucccgccc

SEQ ID NO: 463333 - RNA, 32 nt, Human
gggaugcuagccccagagaugccagcccuuca

SEQ ID NO: 463334 - RNA, 32 nt, Human
gggaugcuaugggagcuccuugcagccugaga

SEQ ID NO: 463335 - RNA, 32 nt, Human
gggaugcucaaggagcccugaggagaggccca

SEQ ID NO: 463336 - RNA, 32 nt, Human
gggaugcucaggggacagagaggcagagggac

SEQ ID NO: 463337 - RNA, 32 nt, Human
gggaugcuccucccuucucuaccucauggggg

SEQ ID NO: 463338 - RNA, 32 nt, Human
gggaugcucggcccuggcucugugccaggccg

SEQ ID NO: 463339 - RNA, 23 nt, Human
gggaugcugaggcgggcggauca

SEQ ID NO: 463340 - RNA, 32 nt, Human
gggaugcugaguggcccuguuuguagcugcug

SEQ ID NO: 463341 - RNA, 32 nt, Human
gggaugcugauggguuggagugccuaauggcu

SEQ ID NO: 463342 - RNA, 32 nt, Human
gggaugcugccucugcugcuucugccuucuuu

SEQ ID NO: 463343 - RNA, 32 nt, Human
gggaugcugccugagucacccaugaagacagg

SEQ ID NO: 463344 - RNA, 32 nt, Human
gggaugcugcuggcugcgcggcgcugagggcc

SEQ ID NO: 463345 - RNA, 32 nt, Human
gggaugcugggaagaacuagacacugggguca

SEQ ID NO: 463346 - RNA, 32 nt, Human
gggaugcuugcucuccacuuuucaaguggguc

SEQ ID NO: 463347 - RNA, 32 nt, Human
gggaugcuugggccugggucucuccgccagca

SEQ ID NO: 463348 - RNA, 32 nt, Human
gggauggaaauggugauuuuuacauguguccu

SEQ ID NO: 463349 - RNA, 21 nt, Human
gggauggaagggagcgcggug

SEQ ID NO: 463350 - RNA, 32 nt, Human
gggauggaaugcuccacggagcuccaggcuua

SEQ ID NO: 463351 - RNA, 28 nt, Human
gggauggacaacaagggcauauacccag

SEQ ID NO: 463352 - RNA, 32 nt, Human
gggauggacaucgagcgagucaacaucgucuu

SEQ ID NO: 463353 - RNA, 32 nt, Human
gggauggagaaagagaaagauggagagaguau

SEQ ID NO: 463354 - RNA, 32 nt, Human
gggauggagaccugcuccccagcucuuccugu

SEQ ID NO: 463355 - RNA, 31 nt, Human
gggauggagcacuucuucugguccuucauuc

SEQ ID NO: 463356 - RNA, 32 nt, Human
gggauggagccccagccccaccacucaccagc

SEQ ID NO: 463357 - RNA, 20 nt, Human
gggauggagcgagcgccgag

SEQ ID NO: 463358 - RNA, 32 nt, Human
gggauggagcugcuccccucacggcagcacca

SEQ ID NO: 463359 - RNA, 28 nt, Human
gggauggaggggacagaggcggcggcgg

SEQ ID NO: 463360 - RNA, 32 nt, Human
gggauggagguggaugcagcaguaguccccag

SEQ ID NO: 463361 - RNA, 32 nt, Human
gggauggagugcagggagccagcuggaaggga

SEQ ID NO: 463362 - RNA, 32 nt, Human
gggauggaguuucgcuguuguugcccaggcug

SEQ ID NO: 463363 - RNA, 32 nt, Human
gggauggauaaauacaaacacaucacaacgcc

SEQ ID NO: 463364 - RNA, 32 nt, Human
gggauggcacacugauguguuuaugcaccugu

SEQ ID NO: 463365 - RNA, 32 nt, Human
gggauggcacaggcaccauccaugcagauggc

SEQ ID NO: 463366 - RNA, 32 nt, Human
gggauggcagaggaggugaggagggaggaagc

SEQ ID NO: 463367 - RNA, 32 nt, Human
gggauggccagagaugcuggacuugccuaaaa

SEQ ID NO: 463368 - RNA, 32 nt, Human
gggauggccagugcacuccaaugaugggacag

SEQ ID NO: 463369 - RNA, 32 nt, Human
gggauggcccgcagccucaucggggccaagga

SEQ ID NO: 463370 - RNA, 28 nt, Human
gggauggcgcggagcugccucuccggga

SEQ ID NO: 463371 - RNA, 32 nt, Human
gggauggcgucgggacacuccugcggggguag

SEQ ID NO: 463372 - RNA, 32 nt, Human
gggauggcugagaaagcggcgcuaggaccccc

SEQ ID NO: 463373 - RNA, 31 nt, Human
gggauggcuuaacuguaccuguuuggaugcu

SEQ ID NO: 463374 - RNA, 32 nt, Human
gggaugggacaagaaguagggaacaggcaggg

SEQ ID NO: 463375 - RNA, 32 nt, Human
gggaugggacacagcacugggcugccaggauu

SEQ ID NO: 463376 - RNA, 32 nt, Human
gggaugggacgucccggggcugugcugacccc

SEQ ID NO: 463377 - RNA, 32 nt, Human
gggaugggagagaaggugagggagccggcgag

SEQ ID NO: 463378 - RNA, 17 nt, Human
gggaugggagaggggug

SEQ ID NO: 463379 - RNA, 32 nt, Human
gggaugggagcgaugcuuaucucucacagugu

SEQ ID NO: 463380 - RNA, 32 nt, Human
gggaugggaggcggaggguagagaugaacuca

SEQ ID NO: 463381 - RNA, 32 nt, Human
gggaugggaggggguagagggagccaggagca

SEQ ID NO: 463382 - RNA, 16 nt, Human
gggaugggaguggggu

SEQ ID NO: 463383 - RNA, 32 nt, Human
gggaugggauuccaaguaaacaguggaccguc

SEQ ID NO: 463384 - RNA, 32 nt, Human
gggaugggcaaggccuuccaggauaggcucag

SEQ ID NO: 463385 - RNA, 32 nt, Human
gggaugggcugaaggggcuccaggcaacugag

SEQ ID NO: 463386 - RNA, 32 nt, Human
gggaugggcugcagaauggggucuggccaccu

SEQ ID NO: 463387 - RNA, 32 nt, Human
gggaugggcuucacuggcagagcuggguacug

SEQ ID NO: 463388 - RNA, 18 nt, Human
gggauggggaagggagga

SEQ ID NO: 463389 - RNA, 32 nt, Human
gggauggggacccagaggugcaguggccgccc

SEQ ID NO: 463390 - RNA, 32 nt, Human
gggauggggaggaagagagagacuguggagcu

SEQ ID NO: 463391 - RNA, 21 nt, Human
gggauggggaggaggagcaga

SEQ ID NO: 463392 - RNA, 32 nt, Human
gggauggggaggaggagcagagagguauggga

SEQ ID NO: 463393 - RNA, 21 nt, Human
gggauggggauaauacaggga

SEQ ID NO: 463394 - RNA, 32 nt, Human
gggauggggaugaaguaaggagagggacugga

SEQ ID NO: 463395 - RNA, 18 nt, Human
gggauggggauuggggug

SEQ ID NO: 463396 - RNA, 32 nt, Human
gggauggggcuaucaucuuuucuugaauaggg

SEQ ID NO: 463397 - RNA, 32 nt, Human
gggauggggcuugggaguugcagugaauguca

SEQ ID NO: 463398 - RNA, 32 nt, Human
gggaugggggauccggaggaaaguaggugugg

SEQ ID NO: 463399 - RNA, 20 nt, Human
gggaugggggaugggccagg

SEQ ID NO: 463400 - RNA, 32 nt, Human
gggaugggggucucaccauguugcccaggcug

SEQ ID NO: 463401 - RNA, 18 nt, Human
gggauggggucaggggga

SEQ ID NO: 463402 - RNA, 32 nt, Human
gggauggggucggggaaucugcauuuuaguag

SEQ ID NO: 463403 - RNA, 32 nt, Human
gggauggggugagugggcuccaggcaacagag

SEQ ID NO: 463404 - RNA, 32 nt, Human
gggauggggugcuguguaggaauggccucagc

SEQ ID NO: 463405 - RNA, 32 nt, Human
gggauggggugggacauugaacaggcaaagag

SEQ ID NO: 463406 - RNA, 19 nt, Human
gggaugggugaguggggug

SEQ ID NO: 463407 - RNA, 32 nt, Human
gggaugggugcugaaguaucaggcucuggcuc

SEQ ID NO: 463408 - RNA, 32 nt, Human
gggauggguguuccuuggaaauggcauuguau

SEQ ID NO: 463409 - RNA, 32 nt, Human
gggauggguugaaggggcuccaggcaacugag

SEQ ID NO: 463410 - RNA, 28 nt, Human
gggaugguaacagcaauggcucugagua

SEQ ID NO: 463411 - RNA, 24 nt, Human
gggauggucagcugugaggggagg

SEQ ID NO: 463412 - RNA, 32 nt, Human
gggaugguccugccaugaggaggcugcaacgc

SEQ ID NO: 463413 - RNA, 32 nt, Human
gggaugguccuuuuucacacagcuaggucuuu

SEQ ID NO: 463414 - RNA, 32 nt, Human
gggauggucggaucucacaggcugagaacucg

SEQ ID NO: 463415 - RNA, 32 nt, Human
gggauggucucgaucuccugaccucgugaucc

SEQ ID NO: 463416 - RNA, 32 nt, Human
gggauggucucgaucuccugaccuugucaucc

SEQ ID NO: 463417 - RNA, 32 nt, Human
gggauggucucgaucucuugaccucaugaucu

SEQ ID NO: 463418 - RNA, 32 nt, Human
gggauggucuugaucuccugaccucaugaucc

SEQ ID NO: 463419 - RNA, 20 nt, Human
gggauggugccauccaggga

SEQ ID NO: 463420 - RNA, 32 nt, Human
gggaugguggccaggccgugcccuugcuguug

SEQ ID NO: 463421 - RNA, 32 nt, Human
gggaugguucaagggcuucacuguccagugcu

SEQ ID NO: 463422 - RNA, 32 nt, Human
gggaugguuguugaccccucucuccuagagac

SEQ ID NO: 463423 - RNA, 32 nt, Human
gggaugguuucaucaacauaagaggccaggaa

SEQ ID NO: 463424 - RNA, 18 nt, Human
gggauguaauccagguca

SEQ ID NO: 463425 - RNA, 32 nt, Human
gggauguacaguuuacaguugaagagcaaaca

SEQ ID NO: 463426 - RNA, 20 nt, Human
gggauguacaucucucccuc

SEQ ID NO: 463427 - RNA, 32 nt, Human
gggauguaggagggggaaggaggaaacaggaa

SEQ ID NO: 463428 - RNA, 32 nt, Human
gggaugucagagccagggagcaaggcaugauc

SEQ ID NO: 463429 - RNA, 20 nt, Human
gggaugucaggugccaccca

SEQ ID NO: 463430 - RNA, 32 nt, Human
gggaugucaugaauuuaggcaauguuucucau

SEQ ID NO: 463431 - RNA, 32 nt, Human
gggaugugagcaugaguuuaggaaauggugua

SEQ ID NO: 463432 - RNA, 17 nt, Human
gggauguggaagugggg

SEQ ID NO: 463433 - RNA, 32 nt, Human
gggaugugggagggagcagacaggaggaauca

SEQ ID NO: 463434 - RNA, 21 nt, Human
gggaugugguagcucaugccu

SEQ ID NO: 463435 - RNA, 32 nt, Human
gggauguguccagggcagcacaggaggcaggu

SEQ ID NO: 463436 - RNA, 32 nt, Human
gggaugugugguuauaguucugugggagaaau

SEQ ID NO: 463437 - RNA, 32 nt, Human
gggauguguucuuugaaaugcaucacuacaug

SEQ ID NO: 463438 - RNA, 32 nt, Human
gggauguuccuauaugggagaaaguuggguua

SEQ ID NO: 463439 - RNA, 32 nt, Human
gggauguugcucguacuguugcucugagggga

SEQ ID NO: 463440 - RNA, 32 nt, Human
gggauguuuaggauaaguuagaugugugccac

SEQ ID NO: 463441 - RNA, 32 nt, Human
gggauuaaggcgccugccaccaugcccggcua

SEQ ID NO: 463442 - RNA, 32 nt, Human
gggauuacaaaccugccauucugcauuaucug

SEQ ID NO: 463443 - RNA, 32 nt, Human
gggauuacaccauugcauuccagccugggcaa

SEQ ID NO: 463444 - RNA, 32 nt, Human
gggauuacagaagugagccacuguaccuggcc

SEQ ID NO: 463445 - RNA, 32 nt, Human
gggauuacagacaggcaugugcuauuacaccu

SEQ ID NO: 463446 - RNA, 32 nt, Human
gggauuacagcacccgccaccaugccgagcua

SEQ ID NO: 463447 - RNA, 32 nt, Human
gggauuacagccacugcacccagccuaaucuu

SEQ ID NO: 463448 - RNA, 20 nt, Human
gggauuacaggcacaagcca

SEQ ID NO: 463449 - RNA, 32 nt, Human
gggauuacaggcagccaccacgcccagcuaau

SEQ ID NO: 463450 - RNA, 20 nt, Human
gggauuacaggcaugagcca

SEQ ID NO: 463451 - RNA, 20 nt, Human
gggauuacaggcgugagcca

SEQ ID NO: 463452 - RNA, 32 nt, Human
gggauuacaggcgugagccacccggccuggcc

SEQ ID NO: 463453 - RNA, 32 nt, Human
gggauuacaggcuugagccaccgcacccggcc

SEQ ID NO: 463454 - RNA, 32 nt, Human
gggauuacaggcuugagccaccgcaccuggcc

SEQ ID NO: 463455 - RNA, 32 nt, Human
gggauuacaggcuugagccacugcaccuagcc

SEQ ID NO: 463456 - RNA, 32 nt, Human
gggauuacaggcuugugccaccgcacccagcu

SEQ ID NO: 463457 - RNA, 32 nt, Human
gggauuacaggugggagccacaacacccggcc

SEQ ID NO: 463458 - RNA, 32 nt, Human
gggauuacaggugggagccacuacagcuggcc

SEQ ID NO: 463459 - RNA, 32 nt, Human
gggauuacagugccugccaccaugcccagcua

SEQ ID NO: 463460 - RNA, 32 nt, Human
gggauuacgccuguaaucccagcacuuuggga

SEQ ID NO: 463461 - RNA, 32 nt, Human
gggauuacgggcaugagccacugugcgcaauc

SEQ ID NO: 463462 - RNA, 32 nt, Human
gggauuagagucaggccagaaagagaacauuc

SEQ ID NO: 463463 - RNA, 32 nt, Human
gggauuagcaaggugaagggaaagcaucuggu

SEQ ID NO: 463464 - RNA, 16 nt, Human
gggauuaggggugggg

SEQ ID NO: 463465 - RNA, 32 nt, Human
gggauuagggguucugugcucuugccuaauua

SEQ ID NO: 463466 - RNA, 32 nt, Human
gggauucaagcaauucucccaccucagccucu

SEQ ID NO: 463467 - RNA, 32 nt, Human
gggauucacuggccucuccauccgccccgacu

SEQ ID NO: 463468 - RNA, 18 nt, Human
gggauucagaguggggug

SEQ ID NO: 463469 - RNA, 32 nt, Human
gggauucagcaaccugcuuaaagggacccagu

SEQ ID NO: 463470 - RNA, 32 nt, Human
gggauucagcacuuugggcaagugguugcaca

SEQ ID NO: 463471 - RNA, 32 nt, Human
gggauucagcaggagugccaggagaauucaac

SEQ ID NO: 463472 - RNA, 32 nt, Human
gggauucagcucuagaggucacaguauccucg

SEQ ID NO: 463473 - RNA, 32 nt, Human
gggauuccacaccucucuuccccagccggcaa

SEQ ID NO: 463474 - RNA, 32 nt, Human
gggauuccagccuucagaagguucuugggaua

SEQ ID NO: 463475 - RNA, 32 nt, Human
gggauuccauuuucuuuguucaccucuacuug

SEQ ID NO: 463476 - RNA, 25 nt, Human
gggauuccggggaaguggaggcaga

SEQ ID NO: 463477 - RNA, 32 nt, Human
gggauuccggggaaguggaggcagagggagcg

SEQ ID NO: 463478 - RNA, 32 nt, Human
gggauuccugcuuccuggcuguguggcagaga

SEQ ID NO: 463479 - RNA, 32 nt, Human
gggauuccugggcccuuuggaaaagaguuggu

SEQ ID NO: 463480 - RNA, 32 nt, Human
gggauuccuuucuccccucuuuguguggcccc

SEQ ID NO: 463481 - RNA, 32 nt, Human
gggauuccuuuucagaaguaccuguguguauc

SEQ ID NO: 463482 - RNA, 32 nt, Human
gggauucgagaagaaaauacaugugggaucuu

SEQ ID NO: 463483 - RNA, 32 nt, Human
gggauucgggaaguggcugaagagcacuggaa

SEQ ID NO: 463484 - RNA, 32 nt, Human
gggauucuaccauguugcccaggcuggucuca

SEQ ID NO: 463485 - RNA, 32 nt, Human
gggauucuaggaaacccaaggaacaagagaaa

SEQ ID NO: 463486 - RNA, 32 nt, Human
gggauucucaggggcuccauuauggcuugauu

SEQ ID NO: 463487 - RNA, 32 nt, Human
gggauucuccaccuguuacaucguucacugga

SEQ ID NO: 463488 - RNA, 32 nt, Human
gggauucuccagagcuagcacagggaaugugg

SEQ ID NO: 463489 - RNA, 32 nt, Human
gggauucuccccaccccagccccacaccugcu

SEQ ID NO: 463490 - RNA, 32 nt, Human
gggauucucuucagaaagauggcaucuaagug

SEQ ID NO: 463491 - RNA, 32 nt, Human
gggauucucuucugagugggugccaucccggc

SEQ ID NO: 463492 - RNA, 32 nt, Human
gggauucugaguagcaggggcagcaugcccag

SEQ ID NO: 463493 - RNA, 32 nt, Human
gggauucugaugcuggugaucucauaccugaa

SEQ ID NO: 463494 - RNA, 32 nt, Human
gggauucugcacuuuagccagccugggucggc

SEQ ID NO: 463495 - RNA, 32 nt, Human
gggauucuggcaucugccucccuagaccuccu

SEQ ID NO: 463496 - RNA, 32 nt, Human
gggauucugggaagcuugagccucccccaaag

SEQ ID NO: 463497 - RNA, 32 nt, Human
gggauucugggagcuuucugggaauucaguug

SEQ ID NO: 463498 - RNA, 32 nt, Human
gggauucuucauuucuucuuccuacugccucc

SEQ ID NO: 463499 - RNA, 32 nt, Human
gggauucuuuguaguccagggcagcaguucuu

SEQ ID NO: 463500 - RNA, 32 nt, Human
gggauugaacuagacacagacacaugagcagg

SEQ ID NO: 463501 - RNA, 32 nt, Human
gggauugacugagaucuuaacaacagcagcaa

SEQ ID NO: 463502 - RNA, 32 nt, Human
gggauugagacccaggccuggcugguccugcc

SEQ ID NO: 463503 - RNA, 32 nt, Human
gggauugauauuuccgcaggaaguuuggaagu

SEQ ID NO: 463504 - RNA, 32 nt, Human
gggauugcacagaacaccagaggcuggggauu

SEQ ID NO: 463505 - RNA, 32 nt, Human
gggauugcaccacugcacuccagccugggcua

SEQ ID NO: 463506 - RNA, 32 nt, Human
gggauugcaccuuccaaaucuguuucuguacc

SEQ ID NO: 463507 - RNA, 32 nt, Human
gggauugcaucacugcacuccagccuggguga

SEQ ID NO: 463508 - RNA, 32 nt, Human
gggauugccugggaccagaggaaaggucuaaa

SEQ ID NO: 463509 - RNA, 32 nt, Human
gggauugcgccacugcacuccagccuggguga

SEQ ID NO: 463510 - RNA, 21 nt, Human
gggauugcucacuccagguua

SEQ ID NO: 463511 - RNA, 32 nt, Human
gggauugcucacuccagguuacugcaacccua

SEQ ID NO: 463512 - RNA, 32 nt, Human
gggauugcuuaaccagagaaacagacacauuu

SEQ ID NO: 463513 - RNA, 32 nt, Human
gggauugcuugaguccagccugggcaguauag

SEQ ID NO: 463514 - RNA, 16 nt, Human
gggauuggaagugggg

SEQ ID NO: 463515 - RNA, 32 nt, Human
gggauuggacaguaguggugcaucugguccuu

SEQ ID NO: 463516 - RNA, 32 nt, Human
gggauuggagaaaggggaccugagggagggac

SEQ ID NO: 463517 - RNA, 32 nt, Human
gggauuggcccagcuuggagugcuuguguggu

SEQ ID NO: 463518 - RNA, 32 nt, Human
gggauugggaggacagaggggaagaaagcugg

SEQ ID NO: 463519 - RNA, 32 nt, Human
gggauugggcucuccugggccauggcagccga

SEQ ID NO: 463520 - RNA, 32 nt, Human
gggauuggggaggaggggaugggcagcggagg

SEQ ID NO: 463521 - RNA, 32 nt, Human
gggauugggggaggggccccagagggguuuua

SEQ ID NO: 463522 - RNA, 32 nt, Human
gggauuggggugagauggaugggagcccgcug

SEQ ID NO: 463523 - RNA, 32 nt, Human
gggauugggucacuuuugaauguggcuuucau

SEQ ID NO: 463524 - RNA, 32 nt, Human
gggauuguagaccuguaugcuccugggucuga

SEQ ID NO: 463525 - RNA, 32 nt, Human
gggauugucagaacugaacacauaucauuuga

SEQ ID NO: 463526 - RNA, 32 nt, Human
gggauugugggaggacacggaccuagacucca

SEQ ID NO: 463527 - RNA, 32 nt, Human
gggauuguggugagugagaaucaaggccaccu

SEQ ID NO: 463528 - RNA, 32 nt, Human
gggauugugugucuggggcaagugaccuuacc

SEQ ID NO: 463529 - RNA, 32 nt, Human
gggauuguugcgucccauaucuggacccagaa

SEQ ID NO: 463530 - RNA, 32 nt, Human
gggauuguuuggcugcuuagugggacuggugg

SEQ ID NO: 463531 - RNA, 32 nt, Human
gggauuuaaggagaauugagagaauguaccca

SEQ ID NO: 463532 - RNA, 32 nt, Human
gggauuuauaccaaauuauguauuugcuaaac

SEQ ID NO: 463533 - RNA, 32 nt, Human
gggauuuaugagaccaguaccugaacugucau

SEQ ID NO: 463534 - RNA, 21 nt, Human
gggauuucaccauguuggcca

SEQ ID NO: 463535 - RNA, 21 nt, Human
gggauuucaccauguuggccg

SEQ ID NO: 463536 - RNA, 32 nt, Human
gggauuucuccauguugaucaggcuggucaug

SEQ ID NO: 463537 - RNA, 32 nt, Human
gggauuucuccuccuaaucugggccucuuguc

SEQ ID NO: 463538 - RNA, 32 nt, Human
gggauuucucucuucaaggccauaacagugga

SEQ ID NO: 463539 - RNA, 32 nt, Human
gggauuucuggggcauaaggacaggaaaaggg

SEQ ID NO: 463540 - RNA, 22 nt, Human
gggauuucuguccugcagggug

SEQ ID NO: 463541 - RNA, 32 nt, Human
gggauuucuugagcuaggaaaggugguuggcu

SEQ ID NO: 463542 - RNA, 32 nt, Human
gggauuucuuuuucucuucuuucugcucuucc

SEQ ID NO: 463543 - RNA, 32 nt, Human
gggauuugacuuuucuuccuugccugcagcug

SEQ ID NO: 463544 - RNA, 32 nt, Human
gggauuugagcaucaggaaaacuguugaaggg

SEQ ID NO: 463545 - RNA, 32 nt, Human
gggauuugaggccagggggagagccaggcucu

SEQ ID NO: 463546 - RNA, 31 nt, Human
gggauuugcagagaugaaaaagacuggguga

SEQ ID NO: 463547 - RNA, 23 nt, Human
gggauuuggaagccauuugggga

SEQ ID NO: 463548 - RNA, 32 nt, Human
gggauuugggaaaggugaagcugugacuggag

SEQ ID NO: 463549 - RNA, 32 nt, Human
gggauuugggaggcuuccuagagcgcucagca

SEQ ID NO: 463550 - RNA, 32 nt, Human
gggauuuggggaggggcuggaggacuuccgca

SEQ ID NO: 463551 - RNA, 32 nt, Human
gggauuuggggugcuggaggcaguggccaagc

SEQ ID NO: 463552 - RNA, 32 nt, Human
gggauuuggucuucagcaguagacauccuucc

SEQ ID NO: 463553 - RNA, 32 nt, Human
gggauuugucgacucauuuugucugaauuuuc

SEQ ID NO: 463554 - RNA, 32 nt, Human
gggauuuugaccuuuuccccacccucaccuuc

SEQ ID NO: 463555 - RNA, 32 nt, Human
gggauuuugagaccagccugaccaacacugag

SEQ ID NO: 463556 - RNA, 32 nt, Human
gggauuuugccucccagccaaaaugcuccagg

SEQ ID NO: 463557 - RNA, 19 nt, Human
gggauuuugggcccaggag

SEQ ID NO: 463558 - RNA, 32 nt, Human
gggauuuuucugcugguaagugaggcauggag

SEQ ID NO: 463559 - RNA, 32 nt, Human
gggauuuuugcucaagaucacauagcugguaa

SEQ ID NO: 463560 - RNA, 20 nt, Human
gggcaaaacauuaguugaua

SEQ ID NO: 463561 - RNA, 32 nt, Human
gggcaaaauggugaaaccaugucucuacaaaa

SEQ ID NO: 463562 - RNA, 19 nt, Human
gggcaaaauucccagggaa

SEQ ID NO: 463563 - RNA, 32 nt, Human
gggcaaacagccgccaucaggguucaccucgg

SEQ ID NO: 463564 - RNA, 32 nt, Human
gggcaaaccacugcuccguucugagccucggu

SEQ ID NO: 463565 - RNA, 32 nt, Human
gggcaaaccgggccccucugcccacacaccuc

SEQ ID NO: 463566 - RNA, 32 nt, Human
gggcaaaccuaugucuaaccagauacagacca

SEQ ID NO: 463567 - RNA, 32 nt, Human
gggcaaacgaccucaacagacacuuuacagaa

SEQ ID NO: 463568 - RNA, 32 nt, Human
gggcaaacugaggcccagaggggcagggaguu

SEQ ID NO: 463569 - RNA, 32 nt, Human
gggcaaagcaagggguaugguugagccagaaa

SEQ ID NO: 463570 - RNA, 32 nt, Human
gggcaaaggcugauggccucuaccuuuguauc

SEQ ID NO: 463571 - RNA, 31 nt, Human
gggcaaagggcaggagggugggugaauucca

SEQ ID NO: 463572 - RNA, 32 nt, Human
gggcaaaguaaucaucguucaggcccaacccu

SEQ ID NO: 463573 - RNA, 20 nt, Human
gggcaaaguccuccagguga

SEQ ID NO: 463574 - RNA, 32 nt, Human
gggcaaagugagugaccugcuuuuggggguga

SEQ ID NO: 463575 - RNA, 32 nt, Human
gggcaaauccaucccucucucccucacaguuc

SEQ ID NO: 463576 - RNA, 32 nt, Human
gggcaaaucuuuaucagccacugccuucugcu

SEQ ID NO: 463577 - RNA, 22 nt, Human
gggcaacaaaccagggcagcug

SEQ ID NO: 463578 - RNA, 32 nt, Human
gggcaacaaagugagacccccaucucuacaaa

SEQ ID NO: 463579 - RNA, 31 nt, Human
gggcaacaaagugagacccccaucucuauag

SEQ ID NO: 463580 - RNA, 24 nt, Human
gggcaacaaagugagacuccaucu

SEQ ID NO: 463581 - RNA, 32 nt, Human
gggcaacaaagugagacuccaucucuauauaa

SEQ ID NO: 463582 - RNA, 24 nt, Human
gggcaacaaagugagacucuaucu

SEQ ID NO: 463583 - RNA, 24 nt, Human
gggcaacaaagugagacucugccu

SEQ ID NO: 463584 - RNA, 24 nt, Human
gggcaacaaagugagacucugucu

SEQ ID NO: 463585 - RNA, 32 nt, Human
gggcaacaaauugaggcccccaucucuacaaa

SEQ ID NO: 463586 - RNA, 32 nt, Human
gggcaacaacaacaaaaaugccagguguggug

SEQ ID NO: 463587 - RNA, 25 nt, Human
gggcaacaagagcaagacucugucu

SEQ ID NO: 463588 - RNA, 25 nt, Human
gggcaacaagagcgaaacucugccu

SEQ ID NO: 463589 - RNA, 25 nt, Human
gggcaacaagagcgaaacucugucu

SEQ ID NO: 463590 - RNA, 25 nt, Human
gggcaacaagaguaagacucugucu

SEQ ID NO: 463591 - RNA, 25 nt, Human
gggcaacaagagugaaacucugucu

SEQ ID NO: 463592 - RNA, 25 nt, Human
gggcaacaagagugagacuccaucu

SEQ ID NO: 463593 - RNA, 23 nt, Human
gggcaacaagcgaaacucugucu

SEQ ID NO: 463594 - RNA, 32 nt, Human
gggcaacacagcaagacaccgcaucuacagaa

SEQ ID NO: 463595 - RNA, 32 nt, Human
gggcaacacagcaagaccccaucuaagaaaaa

SEQ ID NO: 463596 - RNA, 32 nt, Human
gggcaacacagcaagaccccaucucuacaaaa

SEQ ID NO: 463597 - RNA, 24 nt, Human
gggcaacacagcaagacucugucu

SEQ ID NO: 463598 - RNA, 32 nt, Human
gggcaacacagcaagacucugucucaaaaaua

SEQ ID NO: 463599 - RNA, 32 nt, Human
gggcaacacagcaagauccugucuaaaaauaa

SEQ ID NO: 463600 - RNA, 32 nt, Human
gggcaacacaggaugaccccaucuuuacauuu

SEQ ID NO: 463601 - RNA, 24 nt, Human
gggcaacacagggagacucugucu

SEQ ID NO: 463602 - RNA, 32 nt, Human
gggcaacacagggcgacccccaucucuacaaa

SEQ ID NO: 463603 - RNA, 24 nt, Human
gggcaacacagugagacuccaucu

SEQ ID NO: 463604 - RNA, 32 nt, Human
gggcaacacagugagacuccaucucuuaaaaa

SEQ ID NO: 463605 - RNA, 28 nt, Human
gggcaacacagugagugagacccugucu

SEQ ID NO: 463606 - RNA, 32 nt, Human
gggcaacaccugggugacagagcaagacccca

SEQ ID NO: 463607 - RNA, 32 nt, Human
gggcaacacgaugaaaccccaucucuacuaaa

SEQ ID NO: 463608 - RNA, 32 nt, Human
gggcaacacggagcacaggucucugcugcuga

SEQ ID NO: 463609 - RNA, 32 nt, Human
gggcaacacggugaaaccccaucucuauuaaa

SEQ ID NO: 463610 - RNA, 32 nt, Human
gggcaacacggugaaaccccgucucuacuaaa

SEQ ID NO: 463611 - RNA, 24 nt, Human
gggcaacagaacaagauucugucu

SEQ ID NO: 463612 - RNA, 24 nt, Human
gggcaacagaacgagacucugucu

SEQ ID NO: 463613 - RNA, 24 nt, Human
gggcaacagaacgagauucugucu

SEQ ID NO: 463614 - RNA, 32 nt, Human
gggcaacagaacgagauucugucuuaaaugaa

SEQ ID NO: 463615 - RNA, 28 nt, Human
gggcaacagacagagcgagacucugucu

SEQ ID NO: 463616 - RNA, 28 nt, Human
gggcaacagacagagugagacuccaucu

SEQ ID NO: 463617 - RNA, 24 nt, Human
gggcaacagagcaaaacucugucu

SEQ ID NO: 463618 - RNA, 32 nt, Human
gggcaacagagcaagaccccaucucuaaauaa

SEQ ID NO: 463619 - RNA, 24 nt, Human
gggcaacagagcaagacucugccu

SEQ ID NO: 463620 - RNA, 24 nt, Human
gggcaacagagcaagacucugucu

SEQ ID NO: 463621 - RNA, 32 nt, Human
gggcaacagagcaagacucugucucgggggaa

SEQ ID NO: 463622 - RNA, 22 nt, Human
gggcaacagagcaagacugccu

SEQ ID NO: 463623 - RNA, 24 nt, Human
gggcaacagagccagacucugucu

SEQ ID NO: 463624 - RNA, 32 nt, Human
gggcaacagagcgagacuccaucucuaaauaa

SEQ ID NO: 463625 - RNA, 24 nt, Human
gggcaacagagcgagacucuaucu

SEQ ID NO: 463626 - RNA, 24 nt, Human
gggcaacagagcgagacucuguuu

SEQ ID NO: 463627 - RNA, 24 nt, Human
gggcaacagagcgaggcucugucu

SEQ ID NO: 463628 - RNA, 24 nt, Human
gggcaacagagggagacucugucu

SEQ ID NO: 463629 - RNA, 23 nt, Human
gggcaacagaguaaaacucuguc

SEQ ID NO: 463630 - RNA, 24 nt, Human
gggcaacagaguaagacucugucu

SEQ ID NO: 463631 - RNA, 24 nt, Human
gggcaacagagugaaacccuguuu

SEQ ID NO: 463632 - RNA, 24 nt, Human
gggcaacagagugaaacucugucu

SEQ ID NO: 463633 - RNA, 24 nt, Human
gggcaacagagugacacucugucu

SEQ ID NO: 463634 - RNA, 32 nt, Human
gggcaacagagugagaccccaucucuuuaaaa

SEQ ID NO: 463635 - RNA, 24 nt, Human
gggcaacagagugagacccugucu

SEQ ID NO: 463636 - RNA, 24 nt, Human
gggcaacagagugagacccuguuu

SEQ ID NO: 463637 - RNA, 23 nt, Human
gggcaacagagugagaccugucu

SEQ ID NO: 463638 - RNA, 24 nt, Human
gggcaacagagugagacuccaucu

SEQ ID NO: 463639 - RNA, 22 nt, Human
gggcaacagagugagacucccu

SEQ ID NO: 463640 - RNA, 24 nt, Human
gggcaacagagugagacuccgucu

SEQ ID NO: 463641 - RNA, 24 nt, Human
gggcaacagagugagacucuaucu

SEQ ID NO: 463642 - RNA, 22 nt, Human
gggcaacagagugagacucucu

SEQ ID NO: 463643 - RNA, 24 nt, Human
gggcaacagagugagacucugcuu

SEQ ID NO: 463644 - RNA, 23 nt, Human
gggcaacagagugagacucuguc

SEQ ID NO: 463645 - RNA, 24 nt, Human
gggcaacagagugagacucugucu

SEQ ID NO: 463646 - RNA, 24 nt, Human
gggcaacagagugagacucuguuu

SEQ ID NO: 463647 - RNA, 32 nt, Human
gggcaacagagugagacucuguuucuaaauaa

SEQ ID NO: 463648 - RNA, 24 nt, Human
gggcaacagagugagacugggucu

SEQ ID NO: 463649 - RNA, 22 nt, Human
gggcaacagagugagacugucu

SEQ ID NO: 463650 - RNA, 24 nt, Human
gggcaacagagugagacuucaucu

SEQ ID NO: 463651 - RNA, 24 nt, Human
gggcaacagagugagacuucgucu

SEQ ID NO: 463652 - RNA, 24 nt, Human
gggcaacagagugagacuuugucu

SEQ ID NO: 463653 - RNA, 24 nt, Human
gggcaacagagugagauccugacu

SEQ ID NO: 463654 - RNA, 24 nt, Human
gggcaacagagugagauucugucu

SEQ ID NO: 463655 - RNA, 32 nt, Human
gggcaacagagugagauucugucuccaaauaa

SEQ ID NO: 463656 - RNA, 20 nt, Human
gggcaacagagugaggcccu

SEQ ID NO: 463657 - RNA, 24 nt, Human
gggcaacagagugaggcugugucu

SEQ ID NO: 463658 - RNA, 24 nt, Human
gggcaacagagugagucccugucu

SEQ ID NO: 463659 - RNA, 24 nt, Human
gggcaacagagugagucucugucu

SEQ ID NO: 463660 - RNA, 24 nt, Human
gggcaacagagugggacuccaucu

SEQ ID NO: 463661 - RNA, 32 nt, Human
gggcaacagauggggcggcggggagcgcagag

SEQ ID NO: 463662 - RNA, 24 nt, Human
gggcaacagggcaagacucugucu

SEQ ID NO: 463663 - RNA, 24 nt, Human
gggcaacagggugagacucugucu

SEQ ID NO: 463664 - RNA, 23 nt, Human
gggcaacagguaagacucugucu

SEQ ID NO: 463665 - RNA, 20 nt, Human
gggcaacagugagacucugc

SEQ ID NO: 463666 - RNA, 25 nt, Human
gggcaacaguguuaagacucugucu

SEQ ID NO: 463667 - RNA, 32 nt, Human
gggcaacauaccaagacccccgucucuuuaaa

SEQ ID NO: 463668 - RNA, 32 nt, Human
gggcaacauaccgagaccccaucccuaccaaa

SEQ ID NO: 463669 - RNA, 32 nt, Human
gggcaacauagagagaccccaucucugcaaaa

SEQ ID NO: 463670 - RNA, 30 nt, Human
gggcaacauagcaaaaccucaucucuauuu

SEQ ID NO: 463671 - RNA, 32 nt, Human
gggcaacauagcaaaaucucaucucuacaaaa

SEQ ID NO: 463672 - RNA, 32 nt, Human
gggcaacauagcaagaccccaucucuacaaaa

SEQ ID NO: 463673 - RNA, 32 nt, Human
gggcaacauagcaagaccccaucucuaccaaa

SEQ ID NO: 463674 - RNA, 32 nt, Human
gggcaacauagcaagaccccaucucuauaaaa

SEQ ID NO: 463675 - RNA, 32 nt, Human
gggcaacauagcaagacccccaucucugcaaa

SEQ ID NO: 463676 - RNA, 32 nt, Human
gggcaacauagcaagacuccaucucuaaguaa

SEQ ID NO: 463677 - RNA, 24 nt, Human
gggcaacauagcaagacucugucu

SEQ ID NO: 463678 - RNA, 32 nt, Human
gggcaacauagcaagauucugucucuuaaaaa

SEQ ID NO: 463679 - RNA, 32 nt, Human
gggcaacauagcaggaccccaucucuacuauu

SEQ ID NO: 463680 - RNA, 32 nt, Human
gggcaacauagcgagaccccaucucuacaaaa

SEQ ID NO: 463681 - RNA, 32 nt, Human
gggcaacauagcgagacuccaucucuauaaau

SEQ ID NO: 463682 - RNA, 24 nt, Human
gggcaacauagcgagacucugucu

SEQ ID NO: 463683 - RNA, 32 nt, Human
gggcaacauagcgagacugcaucucuacaaaa

SEQ ID NO: 463684 - RNA, 32 nt, Human
gggcaacauagggagaccccaucucuacagaa

SEQ ID NO: 463685 - RNA, 32 nt, Human
gggcaacauagggggaucccaucucuacacac

SEQ ID NO: 463686 - RNA, 32 nt, Human
gggcaacauaguaagaccccaucucuaugaag

SEQ ID NO: 463687 - RNA, 32 nt, Human
gggcaacauaguaagacccccaucucuacaaa

SEQ ID NO: 463688 - RNA, 32 nt, Human
gggcaacauagugaaacccugucucuacuaaa

SEQ ID NO: 463689 - RNA, 28 nt, Human
gggcaacauagugaaaccuggucucugc

SEQ ID NO: 463690 - RNA, 32 nt, Human
gggcaacauagugaagccccaucucugcaaaa

SEQ ID NO: 463691 - RNA, 32 nt, Human
gggcaacauagugagaaugcaucucuacaaaa

SEQ ID NO: 463692 - RNA, 32 nt, Human
gggcaacauagugagaccccaucucuacaaag

SEQ ID NO: 463693 - RNA, 32 nt, Human
gggcaacauagugagaccccaucucuacaauu

SEQ ID NO: 463694 - RNA, 32 nt, Human
gggcaacauagugagaccccaucucuacaucc

SEQ ID NO: 463695 - RNA, 32 nt, Human
gggcaacauagugagaccccaucucuacuuaa

SEQ ID NO: 463696 - RNA, 32 nt, Human
gggcaacauagugagaccccaucucuuuaaaa

SEQ ID NO: 463697 - RNA, 32 nt, Human
gggcaacauagugagacccccaucucuacaaa

SEQ ID NO: 463698 - RNA, 32 nt, Human
gggcaacauagugagacccccaucucuacaau

SEQ ID NO: 463699 - RNA, 32 nt, Human
gggcaacauagugagacccccaucucuacaga

SEQ ID NO: 463700 - RNA, 24 nt, Human
gggcaacauagugagacccugucu

SEQ ID NO: 463701 - RNA, 28 nt, Human
gggcaacauagugagaccucaucucuac

SEQ ID NO: 463702 - RNA, 32 nt, Human
gggcaacauagugagaccuccaucucuacaaa

SEQ ID NO: 463703 - RNA, 22 nt, Human
gggcaacauagugagaccugcc

SEQ ID NO: 463704 - RNA, 24 nt, Human
gggcaacauagugagaccuugccu

SEQ ID NO: 463705 - RNA, 32 nt, Human
gggcaacauagugagaucccaucucuacaaaa

SEQ ID NO: 463706 - RNA, 32 nt, Human
gggcaacauagugagaucucaucucuaccaaa

SEQ ID NO: 463707 - RNA, 32 nt, Human
gggcaacauagugaggccccaucucuagaaaa

SEQ ID NO: 463708 - RNA, 32 nt, Human
gggcaacauagugauaccccaucucuuaaaaa

SEQ ID NO: 463709 - RNA, 32 nt, Human
gggcaacauagugggacuucaucucuaaaaca

SEQ ID NO: 463710 - RNA, 32 nt, Human
gggcaacaucaugagacgucaucucuaauaaa

SEQ ID NO: 463711 - RNA, 32 nt, Human
gggcaacaucgggagaccccaucucuacaaaa

SEQ ID NO: 463712 - RNA, 32 nt, Human
gggcaacaucuccagcaaucugaucuccuuca

SEQ ID NO: 463713 - RNA, 32 nt, Human
gggcaacaugacaagaccccaucucuacaaaa

SEQ ID NO: 463714 - RNA, 32 nt, Human
gggcaacaugaugaaaacuccgucucuaccaa

SEQ ID NO: 463715 - RNA, 31 nt, Human
gggcaacaugaugaaaccccaucuccacugc

SEQ ID NO: 463716 - RNA, 32 nt, Human
gggcaacauggagaaaccccaucuuuaccaaa

SEQ ID NO: 463717 - RNA, 32 nt, Human
gggcaacauggagaaaccccguuucuacuaaa

SEQ ID NO: 463718 - RNA, 19 nt, Human
gggcaacauggcaaaaccc

SEQ ID NO: 463719 - RNA, 32 nt, Human
gggcaacauggcaaaaccccaucucuacaaaa

SEQ ID NO: 463720 - RNA, 32 nt, Human
gggcaacauggcaaaaccccauuucuacaaaa

SEQ ID NO: 463721 - RNA, 32 nt, Human
gggcaacauggcaaagccccaucucuacaaaa

SEQ ID NO: 463722 - RNA, 32 nt, Human
gggcaacauggcgaaaacccaucucuacaaaa

SEQ ID NO: 463723 - RNA, 32 nt, Human
gggcaacauggcgaaaccccauuucuacuaaa

SEQ ID NO: 463724 - RNA, 32 nt, Human
gggcaacauggcgaaaccccgucucuacuaaa

SEQ ID NO: 463725 - RNA, 32 nt, Human
gggcaacauggcgagaccccaucucuacuaaa

SEQ ID NO: 463726 - RNA, 32 nt, Human
gggcaacauggggaaaccccagcucuacaaaa

SEQ ID NO: 463727 - RNA, 32 nt, Human
gggcaacauggggaaacuccaucucuacaaaa

SEQ ID NO: 463728 - RNA, 32 nt, Human
gggcaacauggugaaacacugucucuacaaaa

SEQ ID NO: 463729 - RNA, 32 nt, Human
gggcaacauggugaaacacugucucuacauaa

SEQ ID NO: 463730 - RNA, 32 nt, Human
gggcaacauggugaaacccaguuucuacaaag

SEQ ID NO: 463731 - RNA, 20 nt, Human
gggcaacauggugaaacccc

SEQ ID NO: 463732 - RNA, 32 nt, Human
gggcaacauggugaaaccccagcucuccuaaa

SEQ ID NO: 463733 - RNA, 32 nt, Human
gggcaacauggugaaaccccaucuccaccaaa

SEQ ID NO: 463734 - RNA, 28 nt, Human
gggcaacauggugaaaccccaucucuac

SEQ ID NO: 463735 - RNA, 32 nt, Human
gggcaacauggugaaaccccaucucuacaaaa

SEQ ID NO: 463736 - RNA, 32 nt, Human
gggcaacauggugaaaccccaucucuacuaaa

SEQ ID NO: 463737 - RNA, 22 nt, Human
gggcaacauggugaaaccccgu

SEQ ID NO: 463738 - RNA, 32 nt, Human
gggcaacauggugaaaccccgucucuacaaaa

SEQ ID NO: 463739 - RNA, 32 nt, Human
gggcaacauggugaaaccccgucucuaccaaa

SEQ ID NO: 463740 - RNA, 32 nt, Human
gggcaacauggugaaaccccgucucuaccccc

SEQ ID NO: 463741 - RNA, 32 nt, Human
gggcaacauggugaaaccccgucucuacuaaa

SEQ ID NO: 463742 - RNA, 32 nt, Human
gggcaacauggugaaaccccugucucuacaaa

SEQ ID NO: 463743 - RNA, 32 nt, Human
gggcaacauggugaaaccccuucucuacuaaa

SEQ ID NO: 463744 - RNA, 32 nt, Human
gggcaacauggugaaacccgucucuaccaaac

SEQ ID NO: 463745 - RNA, 32 nt, Human
gggcaacauggugaaacccuaucuccgugaaa

SEQ ID NO: 463746 - RNA, 32 nt, Human
gggcaacauggugaaacccugucuacuaaaau

SEQ ID NO: 463747 - RNA, 26 nt, Human
gggcaacauggugaaacccugucucu

SEQ ID NO: 463748 - RNA, 32 nt, Human
gggcaacauggugaaacccugucucuaccaaa

SEQ ID NO: 463749 - RNA, 32 nt, Human
gggcaacauggugaaacccugucucuacuaaa

SEQ ID NO: 463750 - RNA, 32 nt, Human
gggcaacauggugaaacccugucucuacugaa

SEQ ID NO: 463751 - RNA, 32 nt, Human
gggcaacauggugaaacccugucuuuacaaaa

SEQ ID NO: 463752 - RNA, 32 nt, Human
gggcaacauggugaaacccuguuucuacaaaa

SEQ ID NO: 463753 - RNA, 32 nt, Human
gggcaacauggugaaacccuguuucuauaaaa

SEQ ID NO: 463754 - RNA, 32 nt, Human
gggcaacauggugaaaccucaucucuacaaaa

SEQ ID NO: 463755 - RNA, 32 nt, Human
gggcaacauggugaaaccucgucucuacuaaa

SEQ ID NO: 463756 - RNA, 32 nt, Human
gggcaacauggugaaaccugucucuacaaaaa

SEQ ID NO: 463757 - RNA, 32 nt, Human
gggcaacauggugaaaccugucucuacuaaaa

SEQ ID NO: 463758 - RNA, 32 nt, Human
gggcaacauggugaaaccuugucucuacauaa

SEQ ID NO: 463759 - RNA, 32 nt, Human
gggcaacauggugaaaccuugucucuacuaaa

SEQ ID NO: 463760 - RNA, 24 nt, Human
gggcaacauggugaaacucugucu

SEQ ID NO: 463761 - RNA, 32 nt, Human
gggcaacauggugaaacugucucuaucaaaaa

SEQ ID NO: 463762 - RNA, 27 nt, Human
gggcaacauggugaaacuucucuacaa

SEQ ID NO: 463763 - RNA, 32 nt, Human
gggcaacauggugaaagcccgucucuaccgaa

SEQ ID NO: 463764 - RNA, 32 nt, Human
gggcaacauggugaaaucccaugucuacuaaa

SEQ ID NO: 463765 - RNA, 32 nt, Human
gggcaacauggugaaauccugucucuaccaaa

SEQ ID NO: 463766 - RNA, 32 nt, Human
gggcaacauggugaagccccaucucuacaaaa

SEQ ID NO: 463767 - RNA, 29 nt, Human
gggcaacauggugaagccucauaucuacc

SEQ ID NO: 463768 - RNA, 31 nt, Human
gggcaacauggugaccucccgucucucucgg

SEQ ID NO: 463769 - RNA, 32 nt, Human
gggcaacauggugagaccaauugacuguaggg

SEQ ID NO: 463770 - RNA, 32 nt, Human
gggcaacauggugagaccccaucucuacaaaa

SEQ ID NO: 463771 - RNA, 32 nt, Human
gggcaacauggugagaccccaucucuauuuaa

SEQ ID NO: 463772 - RNA, 32 nt, Human
gggcaacauggugagaccccgucucuacaaaa

SEQ ID NO: 463773 - RNA, 32 nt, Human
gggcaacauggugagacccucgucucuacaaa

SEQ ID NO: 463774 - RNA, 24 nt, Human
gggcaacauggugagacccugucu

SEQ ID NO: 463775 - RNA, 32 nt, Human
gggcaacauggugagaccucaucucuacaaaa

SEQ ID NO: 463776 - RNA, 24 nt, Human
gggcaacauggugagacucugccu

SEQ ID NO: 463777 - RNA, 32 nt, Human
gggcaacauggugagacucugccucuacaaaa

SEQ ID NO: 463778 - RNA, 28 nt, Human
gggcaacauggugagauuucaucucuac

SEQ ID NO: 463779 - RNA, 32 nt, Human
gggcaacaugguggagcccugucucuacagaa

SEQ ID NO: 463780 - RNA, 32 nt, Human
gggcaacauugggagacuccaucucuacaaaa

SEQ ID NO: 463781 - RNA, 32 nt, Human
gggcaaccaaccauugcacuggcuaaaucauu

SEQ ID NO: 463782 - RNA, 20 nt, Human
gggcaaccaagcccccagcg

SEQ ID NO: 463783 - RNA, 32 nt, Human
gggcaaccaauugccacagucaggguugggga

SEQ ID NO: 463784 - RNA, 21 nt, Human
gggcaaccccagccuaggcug

SEQ ID NO: 463785 - RNA, 23 nt, Human
gggcaaccugucgagcugggagg

SEQ ID NO: 463786 - RNA, 26 nt, Human
gggcaacgaaaagugaaacucugucu

SEQ ID NO: 463787 - RNA, 25 nt, Human
gggcaacgagagcgaaacucugucu

SEQ ID NO: 463788 - RNA, 32 nt, Human
gggcaacgaggguggaggucccacugagccuc

SEQ ID NO: 463789 - RNA, 32 nt, Human
gggcaacggaggggaaauaaaagggaacggcu

SEQ ID NO: 463790 - RNA, 24 nt, Human
gggcaacggagugagacccugucu

SEQ ID NO: 463791 - RNA, 24 nt, Human
gggcaacggagugagacuccaucu

SEQ ID NO: 463792 - RNA, 24 nt, Human
gggcaacggagugagacucugucu

SEQ ID NO: 463793 - RNA, 24 nt, Human
gggcaacggauugagacucugucu

SEQ ID NO: 463794 - RNA, 32 nt, Human
gggcaacguagucagaccccaucucuacaaaa

SEQ ID NO: 463795 - RNA, 32 nt, Human
gggcaacguagugaaacccugccucuagaaaa

SEQ ID NO: 463796 - RNA, 32 nt, Human
gggcaacgugacgaaaccccaucucuacgaaa

SEQ ID NO: 463797 - RNA, 24 nt, Human
gggcaacgugaugagacuccgucu

SEQ ID NO: 463798 - RNA, 32 nt, Human
gggcaacguggcgaaauccccgucuuuacaaa

SEQ ID NO: 463799 - RNA, 32 nt, Human
gggcaacguggugaaaccccaucucuacaaaa

SEQ ID NO: 463800 - RNA, 32 nt, Human
gggcaacguggugaaacccugucucuacuaaa

SEQ ID NO: 463801 - RNA, 22 nt, Human
gggcaacucucacaucuugcug

SEQ ID NO: 463802 - RNA, 32 nt, Human
gggcaacugaaggugaaguggaucaccaaugg

SEQ ID NO: 463803 - RNA, 32 nt, Human
gggcaacuggggccagggagaggggagggaga

SEQ ID NO: 463804 - RNA, 32 nt, Human
gggcaacuuccucuguccugugcucaaauaaa

SEQ ID NO: 463805 - RNA, 22 nt, Human
gggcaagaaauagaagucuccu

SEQ ID NO: 463806 - RNA, 21 nt, Human
gggcaagaaauggcgucugcu

SEQ ID NO: 463807 - RNA, 32 nt, Human
gggcaagaaccagcuggagauucagaaucuac

SEQ ID NO: 463808 - RNA, 32 nt, Human
gggcaagaacggaguugcuucuauaacauuau

SEQ ID NO: 463809 - RNA, 32 nt, Human
gggcaagaacugcuucaauuccuuaacaaaug

SEQ ID NO: 463810 - RNA, 21 nt, Human
gggcaagaagcugcuucugcc

SEQ ID NO: 463811 - RNA, 32 nt, Human
gggcaagacgagcugugcuugaaggaagaggg

SEQ ID NO: 463812 - RNA, 32 nt, Human
gggcaagacguuugguuucauuugucaccauu

SEQ ID NO: 463813 - RNA, 32 nt, Human
gggcaagacuccaugaccccucugauucugca

SEQ ID NO: 463814 - RNA, 32 nt, Human
gggcaagacugggcuguaggggagcuggacua

SEQ ID NO: 463815 - RNA, 32 nt, Human
gggcaagagacagagcaggucccugugucucc

SEQ ID NO: 463816 - RNA, 32 nt, Human
gggcaagagcccaggagacugugugguuuguc

SEQ ID NO: 463817 - RNA, 32 nt, Human
gggcaagaggagaaauagcuguaauguagggg

SEQ ID NO: 463818 - RNA, 32 nt, Human
gggcaagaggccacccuggaagcugccaaucu

SEQ ID NO: 463819 - RNA, 32 nt, Human
gggcaagagguggauugagcaggaucucaggg

SEQ ID NO: 463820 - RNA, 32 nt, Human
gggcaagauccagguggucccauaggucuugu

SEQ ID NO: 463821 - RNA, 32 nt, Human
gggcaagaucccuguccuccugggcccugagg

SEQ ID NO: 463822 - RNA, 32 nt, Human
gggcaagauggugaaaccccaucucuacugga

SEQ ID NO: 463823 - RNA, 32 nt, Human
gggcaagcaaaaacaauaacacugcuuauaaa

SEQ ID NO: 463824 - RNA, 32 nt, Human
gggcaagcagccgccgccauggccgagcaccu

SEQ ID NO: 463825 - RNA, 19 nt, Human
gggcaagcagguggggcug

SEQ ID NO: 463826 - RNA, 32 nt, Human
gggcaagccaguggcguggccucugccucuaa

SEQ ID NO: 463827 - RNA, 32 nt, Human
gggcaagcuacuuccccucuguuaccuguaaa

SEQ ID NO: 463828 - RNA, 32 nt, Human
gggcaagcuauagccauggcuguggcuguagc

SEQ ID NO: 463829 - RNA, 32 nt, Human
gggcaaggaagaaugugagcaagaguagagag

SEQ ID NO: 463830 - RNA, 32 nt, Human
gggcaaggaagaggaguuggccaacaggcagc

SEQ ID NO: 463831 - RNA, 32 nt, Human
gggcaaggagaaacaacuagcuggacaauacu

SEQ ID NO: 463832 - RNA, 32 nt, Human
gggcaaggagaccaccaacagcccucagguca

SEQ ID NO: 463833 - RNA, 32 nt, Human
gggcaaggagccaaggaccacagagccucagc

SEQ ID NO: 463834 - RNA, 18 nt, Human
gggcaaggagcuggggug

SEQ ID NO: 463835 - RNA, 32 nt, Human
gggcaaggaggaagaggggcagggguuaaaaa

SEQ ID NO: 463836 - RNA, 32 nt, Human
gggcaaggaggacuccaagaacuucgacgagc

SEQ ID NO: 463837 - RNA, 21 nt, Human
gggcaaggaggagcaggccag

SEQ ID NO: 463838 - RNA, 32 nt, Human
gggcaaggaggcaaggaccccgucucucccac

SEQ ID NO: 463839 - RNA, 32 nt, Human
gggcaaggauagaaaugccaucaggaaauagc

SEQ ID NO: 463840 - RNA, 32 nt, Human
gggcaaggauagaaaugucaucaggaaauagc

SEQ ID NO: 463841 - RNA, 32 nt, Human
gggcaaggcaaagcacuaagggccaguaccag

SEQ ID NO: 463842 - RNA, 32 nt, Human
gggcaaggccaagugggggugggcuuugggca

SEQ ID NO: 463843 - RNA, 32 nt, Human
gggcaaggcccaggacuuucagauuaacugag

SEQ ID NO: 463844 - RNA, 32 nt, Human
gggcaaggcccaucugucugcaaggcugguag

SEQ ID NO: 463845 - RNA, 32 nt, Human
gggcaaggcggguucuagcugcauagacagga

SEQ ID NO: 463846 - RNA, 32 nt, Human
gggcaaggcugaagaaaggggacuggguacuu

SEQ ID NO: 463847 - RNA, 32 nt, Human
gggcaagggagccgggcaagcccagggcagcc

SEQ ID NO: 463848 - RNA, 32 nt, Human
gggcaagggagggagaugacagccugggucac

SEQ ID NO: 463849 - RNA, 32 nt, Human
gggcaagggcugaaggaggccacuccaucuca

SEQ ID NO: 463850 - RNA, 32 nt, Human
gggcaagggggaacaaaucacaccucugggcu

SEQ ID NO: 463851 - RNA, 32 nt, Human
gggcaagggguuguuuccucccagcucagugg

SEQ ID NO: 463852 - RNA, 32 nt, Human
gggcaagggugggagguuuuuagaagaguaua

SEQ ID NO: 463853 - RNA, 32 nt, Human
gggcaaggucaggccagcucagaaaaauggau

SEQ ID NO: 463854 - RNA, 23 nt, Human
gggcaaggucgcagcaucugccu

SEQ ID NO: 463855 - RNA, 32 nt, Human
gggcaaggucugagggcccaccgaugagagag

SEQ ID NO: 463856 - RNA, 20 nt, Human
gggcaagucaguggcuccag

SEQ ID NO: 463857 - RNA, 32 nt, Human
gggcaagugaggcaagagaaaugaggaagaau

SEQ ID NO: 463858 - RNA, 32 nt, Human
gggcaaguuuguuguggacagaucugugccua

SEQ ID NO: 463859 - RNA, 32 nt, Human
gggcaaguuuuuaaauuaaaacuuucuauauu

SEQ ID NO: 463860 - RNA, 25 nt, Human
gggcaauaagagugaaacucugucu

SEQ ID NO: 463861 - RNA, 32 nt, Human
gggcaauacagcaagaccucaucucuacaaaa

SEQ ID NO: 463862 - RNA, 32 nt, Human
gggcaauacuuacuauccccuggguaacaguu

SEQ ID NO: 463863 - RNA, 24 nt, Human
gggcaauagagcaagacucugucu

SEQ ID NO: 463864 - RNA, 24 nt, Human
gggcaauagagugagacccugucu

SEQ ID NO: 463865 - RNA, 24 nt, Human
gggcaauagagugagacuccgucu

SEQ ID NO: 463866 - RNA, 24 nt, Human
gggcaauagagugagacucugucu

SEQ ID NO: 463867 - RNA, 32 nt, Human
gggcaauauaaggagaccccaucucuacaaaa

SEQ ID NO: 463868 - RNA, 32 nt, Human
gggcaauauagugaaaccccaucucuuaaaga

SEQ ID NO: 463869 - RNA, 32 nt, Human
gggcaauauagugagaccccaucucuagaaga

SEQ ID NO: 463870 - RNA, 32 nt, Human
gggcaauaucgugagaccccaucucuacaaaa

SEQ ID NO: 463871 - RNA, 32 nt, Human
gggcaauauggcaaaaccccaucuuuaccaaa

SEQ ID NO: 463872 - RNA, 28 nt, Human
gggcaauauggcgagaccucaucucuac

SEQ ID NO: 463873 - RNA, 32 nt, Human
gggcaauauggcgagaccucaucucuacaaaa

SEQ ID NO: 463874 - RNA, 32 nt, Human
gggcaauauggugacaccccaucucuacaaaa

SEQ ID NO: 463875 - RNA, 31 nt, Human
gggcaauaugucaucuaccuaccucaaaggg

SEQ ID NO: 463876 - RNA, 32 nt, Human
gggcaaugcaucuuuccaaccugagcgagugg

SEQ ID NO: 463877 - RNA, 32 nt, Human
gggcaaugcggaacuccuuuuuacagcccacc

SEQ ID NO: 463878 - RNA, 32 nt, Human
gggcaaugcugguacugugaggcugauggagc

SEQ ID NO: 463879 - RNA, 32 nt, Human
gggcaaugcugugagagccauuggaagacugu

SEQ ID NO: 463880 - RNA, 22 nt, Human
gggcaauggagcaggccaccag

SEQ ID NO: 463881 - RNA, 32 nt, Human
gggcaauggcgggcgccucucccccagccucg

SEQ ID NO: 463882 - RNA, 23 nt, Human
gggcaauguagcaagauccuguc

SEQ ID NO: 463883 - RNA, 32 nt, Human
gggcaaugugagagguaaaauagcccuugaca

SEQ ID NO: 463884 - RNA, 32 nt, Human
gggcaaugugauaaaaccccaucucuacaaaa

SEQ ID NO: 463885 - RNA, 32 nt, Human
gggcaauguggcgaaacuccaucucuacaaaa

SEQ ID NO: 463886 - RNA, 29 nt, Human
gggcaauguggggagaccccaucucuaca

SEQ ID NO: 463887 - RNA, 21 nt, Human
gggcaauugccagggcuccag

SEQ ID NO: 463888 - RNA, 20 nt, Human
gggcacaaagaugggggcag

SEQ ID NO: 463889 - RNA, 23 nt, Human
gggcacaacccaggggccaggcu

SEQ ID NO: 463890 - RNA, 23 nt, Human
gggcacaagcccagguccugcug

SEQ ID NO: 463891 - RNA, 23 nt, Human
gggcacaagcucagguccugcug

SEQ ID NO: 463892 - RNA, 32 nt, Human
gggcacaagggugagcucuucgcaggggcuga

SEQ ID NO: 463893 - RNA, 32 nt, Human
gggcacaagguggcaggaugucucagugguac

SEQ ID NO: 463894 - RNA, 32 nt, Human
gggcacaaguccuggauguuguguguaucgag

SEQ ID NO: 463895 - RNA, 32 nt, Human
gggcacaaucaaaaugagaugcacucauuuaa

SEQ ID NO: 463896 - RNA, 32 nt, Human
gggcacaaucaccacacacugccgcuucaauc

SEQ ID NO: 463897 - RNA, 32 nt, Human
gggcacacacaguggagagagcacaggacugg

SEQ ID NO: 463898 - RNA, 21 nt, Human
gggcacaccagcccucagaga

SEQ ID NO: 463899 - RNA, 32 nt, Human
gggcacacccucccacugccccucucugccuc

SEQ ID NO: 463900 - RNA, 32 nt, Human
gggcacacgcagguggaggugguugugggugc

SEQ ID NO: 463901 - RNA, 22 nt, Human
gggcacacgccucggcuauggg

SEQ ID NO: 463902 - RNA, 32 nt, Human
gggcacacgugcccuggcugaggccagcggca

SEQ ID NO: 463903 - RNA, 21 nt, Human
gggcacacguuagggcugccc

SEQ ID NO: 463904 - RNA, 22 nt, Human
gggcacacuaaggggccacaag

SEQ ID NO: 463905 - RNA, 32 nt, Human
gggcacacucccaugcugucacccucaggaag

SEQ ID NO: 463906 - RNA, 32 nt, Human
gggcacacugacaccucacacggcaggguauu

SEQ ID NO: 463907 - RNA, 32 nt, Human
gggcacacuggcagaggguaucugaaguggga

SEQ ID NO: 463908 - RNA, 20 nt, Human
gggcacagaaccaccagcaa

SEQ ID NO: 463909 - RNA, 17 nt, Human
gggcacagaacccugug

SEQ ID NO: 463910 - RNA, 32 nt, Human
gggcacagaaguagcucuggugaccuugauca

SEQ ID NO: 463911 - RNA, 32 nt, Human
gggcacagacuuuucuggaagcagagcgagcc

SEQ ID NO: 463912 - RNA, 32 nt, Human
gggcacagagagacagagguucauggacugag

SEQ ID NO: 463913 - RNA, 32 nt, Human
gggcacagagggcagagguugggcgggguggg

SEQ ID NO: 463914 - RNA, 32 nt, Human
gggcacagaugucuguucagcagguguguggg

SEQ ID NO: 463915 - RNA, 32 nt, Human
gggcacagauuaucuaaaauuagccagcucuu

SEQ ID NO: 463916 - RNA, 32 nt, Human
gggcacagauugcagagguaaugcuguggcau

SEQ ID NO: 463917 - RNA, 32 nt, Human
gggcacagcacugggaaaugggagcauaguac

SEQ ID NO: 463918 - RNA, 16 nt, Human
gggcacagcagagcag

SEQ ID NO: 463919 - RNA, 16 nt, Human
gggcacagcagggcag

SEQ ID NO: 463920 - RNA, 18 nt, Human
gggcacagcaggggacag

SEQ ID NO: 463921 - RNA, 32 nt, Human
gggcacagccagcagagccggggacugcagug

SEQ ID NO: 463922 - RNA, 32 nt, Human
gggcacagccaggcacaagugcaugugugagc

SEQ ID NO: 463923 - RNA, 32 nt, Human
gggcacagccuccgauuugagccucuccggcu

SEQ ID NO: 463924 - RNA, 32 nt, Human
gggcacagccugggcagaugggcuggggcuua

SEQ ID NO: 463925 - RNA, 30 nt, Human
gggcacagcgggaauacagaaagauacagc

SEQ ID NO: 463926 - RNA, 18 nt, Human
gggcacagcuagugcaaa

SEQ ID NO: 463927 - RNA, 23 nt, Human
gggcacagcugauuugaccucuu

SEQ ID NO: 463928 - RNA, 25 nt, Human
gggcacaggaccguggugcugcacc

SEQ ID NO: 463929 - RNA, 22 nt, Human
gggcacaggagggagagcugca

SEQ ID NO: 463930 - RNA, 19 nt, Human
gggcacaggcagagggcag

SEQ ID NO: 463931 - RNA, 32 nt, Human
gggcacagggagguggguuggggugaggccac

SEQ ID NO: 463932 - RNA, 32 nt, Human
gggcacagggccagggcaggcggggcagggcu

SEQ ID NO: 463933 - RNA, 32 nt, Human
gggcacagggccaucugucaccaggggcuuag

SEQ ID NO: 463934 - RNA, 32 nt, Human
gggcacagggccuggcccauguauggccagga

SEQ ID NO: 463935 - RNA, 32 nt, Human
gggcacaguggaagcuauggaggcagagacca

SEQ ID NO: 463936 - RNA, 32 nt, Human
gggcacaguggacagggagaccucacagagaa

SEQ ID NO: 463937 - RNA, 23 nt, Human
gggcacaguggcgcaugccugua

SEQ ID NO: 463938 - RNA, 23 nt, Human
gggcacaguggcucacaccugua

SEQ ID NO: 463939 - RNA, 23 nt, Human
gggcacaguggcucauaccugua

SEQ ID NO: 463940 - RNA, 23 nt, Human
gggcacaguggcucaugccugua

SEQ ID NO: 463941 - RNA, 23 nt, Human
gggcacaguggcucaugccugug

SEQ ID NO: 463942 - RNA, 32 nt, Human
gggcacauaaucaaacuagaccaaugagucuc

SEQ ID NO: 463943 - RNA, 22 nt, Human
gggcacaucauauguccaugaa

SEQ ID NO: 463944 - RNA, 32 nt, Human
gggcacauguaaucccagcuacuugggaggcu

SEQ ID NO: 463945 - RNA, 32 nt, Human
gggcacauguacugcaggugugcagugagcac

SEQ ID NO: 463946 - RNA, 32 nt, Human
gggcacaugucuucguucccucccgacuggga

SEQ ID NO: 463947 - RNA, 32 nt, Human
gggcaccaaacaggaagagaccagcaacuucg

SEQ ID NO: 463948 - RNA, 32 nt, Human
gggcaccaaagaccaggcccagagccagggga

SEQ ID NO: 463949 - RNA, 32 nt, Human
gggcaccaacccaucauggucgaaaaucugua

SEQ ID NO: 463950 - RNA, 22 nt, Human
gggcaccaagaccccaaaggcc

SEQ ID NO: 463951 - RNA, 21 nt, Human
gggcaccaaggaggguggcag

SEQ ID NO: 463952 - RNA, 32 nt, Human
gggcaccaagggcacaggccaagccuuggggg

SEQ ID NO: 463953 - RNA, 32 nt, Human
gggcaccacccuggcaguuccagccuguaggg

SEQ ID NO: 463954 - RNA, 22 nt, Human
gggcaccagagagguucacuug

SEQ ID NO: 463955 - RNA, 32 nt, Human
gggcaccagcuggccuugcccucucuggucug

SEQ ID NO: 463956 - RNA, 32 nt, Human
gggcaccagcuuuucuggacagccuggcuucu

SEQ ID NO: 463957 - RNA, 32 nt, Human
gggcaccaggagaggucucugaggauccccgg

SEQ ID NO: 463958 - RNA, 32 nt, Human
gggcaccaggagcagagggaagggaggauggc

SEQ ID NO: 463959 - RNA, 32 nt, Human
gggcaccagugggcauaggcacaggaugagcc

SEQ ID NO: 463960 - RNA, 32 nt, Human
gggcaccaucauuccugccgccuugggcacag

SEQ ID NO: 463961 - RNA, 32 nt, Human
gggcaccaucuucucauucaucuccaaggacg

SEQ ID NO: 463962 - RNA, 32 nt, Human
gggcaccaugggccacuccaggaugggacacg

SEQ ID NO: 463963 - RNA, 32 nt, Human
gggcaccauggugaaaccucgucuuuaccaaa

SEQ ID NO: 463964 - RNA, 32 nt, Human
gggcaccauggugagaccccaucucuauuauu

SEQ ID NO: 463965 - RNA, 32 nt, Human
gggcaccauuuuuaaucccagaacacauuuca

SEQ ID NO: 463966 - RNA, 32 nt, Human
gggcacccaagcucccuauuugucccgggcac

SEQ ID NO: 463967 - RNA, 28 nt, Human
gggcacccaagugcccccugucugcgaa

SEQ ID NO: 463968 - RNA, 32 nt, Human
gggcacccaagugcccccugucugcgaagucc

SEQ ID NO: 463969 - RNA, 20 nt, Human
gggcacccacaggcuggcug

SEQ ID NO: 463970 - RNA, 24 nt, Human
gggcacccaccaugagaaaggggc

SEQ ID NO: 463971 - RNA, 17 nt, Human
gggcacccagagcagca

SEQ ID NO: 463972 - RNA, 32 nt, Human
gggcacccagagccacccagccuggaagcccc

SEQ ID NO: 463973 - RNA, 32 nt, Human
gggcacccagcacucugcugggcaucacccuc

SEQ ID NO: 463974 - RNA, 32 nt, Human
gggcacccaugcuggccagcaguuucccaggg

SEQ ID NO: 463975 - RNA, 32 nt, Human
gggcacccauguccgagcccccuggcauuucu

SEQ ID NO: 463976 - RNA, 20 nt, Human
gggcaccccaaagagggggc

SEQ ID NO: 463977 - RNA, 32 nt, Human
gggcaccccagccacuccagaaacccaauggg

SEQ ID NO: 463978 - RNA, 20 nt, Human
gggcaccccauggcuggcug

SEQ ID NO: 463979 - RNA, 20 nt, Human
gggcaccccuguggaggggc

SEQ ID NO: 463980 - RNA, 32 nt, Human
gggcacccgcaacgugcugggcucugcuacug

SEQ ID NO: 463981 - RNA, 32 nt, Human
gggcacccguaaucccagcuacucaggaggcu

SEQ ID NO: 463982 - RNA, 32 nt, Human
gggcacccguauucccagcuacucagaggcug

SEQ ID NO: 463983 - RNA, 21 nt, Human
gggcacccucagcaaaggggc

SEQ ID NO: 463984 - RNA, 32 nt, Human
gggcacccuccaaacacugggcucugaggagu

SEQ ID NO: 463985 - RNA, 18 nt, Human
gggcacccuccccaggga

SEQ ID NO: 463986 - RNA, 32 nt, Human
gggcacccugcaggcaggcagaccacggugug

SEQ ID NO: 463987 - RNA, 32 nt, Human
gggcaccgaacuaagccagcucagccuuccaa

SEQ ID NO: 463988 - RNA, 27 nt, Human
gggcaccgaugagggcugguccuagga

SEQ ID NO: 463989 - RNA, 32 nt, Human
gggcaccgcggagcaagauggaagagaagagg

SEQ ID NO: 463990 - RNA, 32 nt, Human
gggcaccgcggaggcuggagccgcaauggugc

SEQ ID NO: 463991 - RNA, 32 nt, Human
gggcaccgcgggccauguguguuugcaugagg

SEQ ID NO: 463992 - RNA, 16 nt, Human
gggcaccggcuggcug

SEQ ID NO: 463993 - RNA, 32 nt, Human
gggcaccgggacccccucaccauccagugggc

SEQ ID NO: 463994 - RNA, 32 nt, Human
gggcaccgugggaggcagcggcuccuggccgu

SEQ ID NO: 463995 - RNA, 32 nt, Human
gggcaccuauaauaccagcuacuccggaggcu

SEQ ID NO: 463996 - RNA, 32 nt, Human
gggcaccuauuaucccagcuacucgggaggcc

SEQ ID NO: 463997 - RNA, 21 nt, Human
gggcaccucccucccacccuu

SEQ ID NO: 463998 - RNA, 21 nt, Human
gggcaccucgcucaugcaagg

SEQ ID NO: 463999 - RNA, 22 nt, Human
gggcaccucgcucuaccccagg

SEQ ID NO: 464000 - RNA, 32 nt, Human
gggcaccucuaaucccagcuacuugggaggcu

SEQ ID NO: 464001 - RNA, 32 nt, Human
gggcaccucuggcugcugcaggccucccaaga

SEQ ID NO: 464002 - RNA, 32 nt, Human
gggcaccucugucugguuuccucuuuggaaaa

SEQ ID NO: 464003 - RNA, 32 nt, Human
gggcaccucuuccagggaugccucccucuaag

SEQ ID NO: 464004 - RNA, 32 nt, Human
gggcaccucuuccagggaugucucccucuaag

SEQ ID NO: 464005 - RNA, 32 nt, Human
gggcaccucuuucuggccugugcaccucucuc

SEQ ID NO: 464006 - RNA, 32 nt, Human
gggcaccugcaaucccagcuacuugggaggcu

SEQ ID NO: 464007 - RNA, 32 nt, Human
gggcaccugcaauccccgacccccgacgcccu

SEQ ID NO: 464008 - RNA, 32 nt, Human
gggcaccugcagcugcugcuguggcugccagc

SEQ ID NO: 464009 - RNA, 18 nt, Human
gggcaccugcccccuccu

SEQ ID NO: 464010 - RNA, 32 nt, Human
gggcaccugcggucccagcuacuugggaggcu

SEQ ID NO: 464011 - RNA, 32 nt, Human
gggcaccuggacgcugaugguggccaggaugc

SEQ ID NO: 464012 - RNA, 32 nt, Human
gggcaccuggagucccagcuacuccggaggcu

SEQ ID NO: 464013 - RNA, 32 nt, Human
gggcaccugggcagccgccgcggcgcuggcua

SEQ ID NO: 464014 - RNA, 32 nt, Human
gggcaccuggugccugcccccugccgggcagc

SEQ ID NO: 464015 - RNA, 32 nt, Human
gggcaccuguaaccccagcuacucgggaggcu

SEQ ID NO: 464016 - RNA, 32 nt, Human
gggcaccuguaauaccaacuguucgggagggu

SEQ ID NO: 464017 - RNA, 32 nt, Human
gggcaccuguaaucccaccuacucgggaggcu

SEQ ID NO: 464018 - RNA, 32 nt, Human
gggcaccuguaaucccagauacucgggaggcu

SEQ ID NO: 464019 - RNA, 32 nt, Human
gggcaccuguaaucccagccacuugggaggcu

SEQ ID NO: 464020 - RNA, 32 nt, Human
gggcaccuguaaucccagcuacccgggaggcu

SEQ ID NO: 464021 - RNA, 32 nt, Human
gggcaccuguaaucccagcuacuagggagacu

SEQ ID NO: 464022 - RNA, 32 nt, Human
gggcaccuguaaucccagcuacucaggaggcu

SEQ ID NO: 464023 - RNA, 32 nt, Human
gggcaccuguaaucccagcuacucgagaggcu

SEQ ID NO: 464024 - RNA, 32 nt, Human
gggcaccuguaaucccagcuacucgggaggcc

SEQ ID NO: 464025 - RNA, 32 nt, Human
gggcaccuguaaucccagcuacucgggaggcu

SEQ ID NO: 464026 - RNA, 32 nt, Human
gggcaccuguaaucccagcuacucuggaggcu

SEQ ID NO: 464027 - RNA, 32 nt, Human
gggcaccuguaaucccagcuacuuggaaggcu

SEQ ID NO: 464028 - RNA, 32 nt, Human
gggcaccuguaaucccagcuacuugggaggcu

SEQ ID NO: 464029 - RNA, 32 nt, Human
gggcaccuguaaucccagcuacuuggguggcc

SEQ ID NO: 464030 - RNA, 32 nt, Human
gggcaccuguaaucccagguacucgggaggcu

SEQ ID NO: 464031 - RNA, 32 nt, Human
gggcaccuguaaucccaguuacucgggaggcu

SEQ ID NO: 464032 - RNA, 32 nt, Human
gggcaccuguaauccuggcuacucgggaggcu

SEQ ID NO: 464033 - RNA, 32 nt, Human
gggcaccuguaaucucagcuacucaggaggcu

SEQ ID NO: 464034 - RNA, 32 nt, Human
gggcaccuguaaucucagcuacuugggaggcu

SEQ ID NO: 464035 - RNA, 32 nt, Human
gggcaccuguagucccagcuacacgggaggcu

SEQ ID NO: 464036 - RNA, 32 nt, Human
gggcaccuguagucccagcuacuagggaggcu

SEQ ID NO: 464037 - RNA, 32 nt, Human
gggcaccuguagucccagcuacucaggaggcu

SEQ ID NO: 464038 - RNA, 32 nt, Human
gggcaccuguagucccagcuacucgagaggcu

SEQ ID NO: 464039 - RNA, 32 nt, Human
gggcaccuguagucccagcuacucgggaggcu

SEQ ID NO: 464040 - RNA, 32 nt, Human
gggcaccuguagucccagcuacuugggaggcu

SEQ ID NO: 464041 - RNA, 32 nt, Human
gggcaccuguaguccuagcuacucgagaggcu

SEQ ID NO: 464042 - RNA, 32 nt, Human
gggcaccuguagucucagcuacuugggaggcu

SEQ ID NO: 464043 - RNA, 32 nt, Human
gggcaccuguagugccagcuacucgggagguu

SEQ ID NO: 464044 - RNA, 32 nt, Human
gggcaccuguaguuccagcuacucggagacug

SEQ ID NO: 464045 - RNA, 32 nt, Human
gggcaccuguauucccagcuacuuggaaggcu

SEQ ID NO: 464046 - RNA, 32 nt, Human
gggcaccuguauucccagcuacuugggaggcu

SEQ ID NO: 464047 - RNA, 32 nt, Human
gggcaccugucaucccagcuacuugggaggcu

SEQ ID NO: 464048 - RNA, 32 nt, Human
gggcaccugucgucccagcuacuagggaggcu

SEQ ID NO: 464049 - RNA, 32 nt, Human
gggcaccugugaucccagcuaccugggaggcu

SEQ ID NO: 464050 - RNA, 32 nt, Human
gggcaccugugaucccagcuuccugggaggcu

SEQ ID NO: 464051 - RNA, 32 nt, Human
gggcaccuguggucucagcuacucagggggcu

SEQ ID NO: 464052 - RNA, 32 nt, Human
gggcaccuucaaggaacccaggguucuagaga

SEQ ID NO: 464053 - RNA, 32 nt, Human
gggcacgaacuggccaagacccccaucagccg

SEQ ID NO: 464054 - RNA, 19 nt, Human
gggcacgaaggccaggcca

SEQ ID NO: 464055 - RNA, 22 nt, Human
gggcacgaagggagagaggccu

SEQ ID NO: 464056 - RNA, 24 nt, Human
gggcacgagccagagugucugccu

SEQ ID NO: 464057 - RNA, 32 nt, Human
gggcacgaggagcugguacucuaccuucuggc

SEQ ID NO: 464058 - RNA, 32 nt, Human
gggcacgaggcuucccgccacacuccagagcg

SEQ ID NO: 464059 - RNA, 32 nt, Human
gggcacgagggcagagccaguuccuagcgcag

SEQ ID NO: 464060 - RNA, 32 nt, Human
gggcacgauguggucagccaggaagcauagga

SEQ ID NO: 464061 - RNA, 32 nt, Human
gggcacgcacacacggaagcacgccuccacuu

SEQ ID NO: 464062 - RNA, 32 nt, Human
gggcacgccccuggccccuugcuguucccaag

SEQ ID NO: 464063 - RNA, 32 nt, Human
gggcacgcccuucaccuuaucccccaccacuu

SEQ ID NO: 464064 - RNA, 19 nt, Human
gggcacgccuguaauccca

SEQ ID NO: 464065 - RNA, 32 nt, Human
gggcacgccuguaaucccagcuacucgggagg

SEQ ID NO: 464066 - RNA, 20 nt, Human
gggcacgcgccgucuccggg

SEQ ID NO: 464067 - RNA, 20 nt, Human
gggcacgcugaaacccuggg

SEQ ID NO: 464068 - RNA, 32 nt, Human
gggcacggcggaggccacggaggcaggcgcgg

SEQ ID NO: 464069 - RNA, 32 nt, Human
gggcacggcugcugcagucucuucccagccug

SEQ ID NO: 464070 - RNA, 32 nt, Human
gggcacgggauggagugaaagagcgagugccu

SEQ ID NO: 464071 - RNA, 18 nt, Human
gggcacgggcacccuggg

SEQ ID NO: 464072 - RNA, 32 nt, Human
gggcacggggacccacaacgacggcugucccu

SEQ ID NO: 464073 - RNA, 22 nt, Human
gggcacggugaagggcugcagc

SEQ ID NO: 464074 - RNA, 20 nt, Human
gggcacggugcaaagugggc

SEQ ID NO: 464075 - RNA, 32 nt, Human
gggcacgguggcaguggcuguuggaggaugau

SEQ ID NO: 464076 - RNA, 23 nt, Human
gggcacgguggcccaugccugua

SEQ ID NO: 464077 - RNA, 23 nt, Human
gggcacgguggcucaagccugua

SEQ ID NO: 464078 - RNA, 23 nt, Human
gggcacgguggcucacaccugua

SEQ ID NO: 464079 - RNA, 23 nt, Human
gggcacgguggcucacaccugug

SEQ ID NO: 464080 - RNA, 23 nt, Human
gggcacgguggcucacgccugua

SEQ ID NO: 464081 - RNA, 23 nt, Human
gggcacgguggcucaggccugua

SEQ ID NO: 464082 - RNA, 23 nt, Human
gggcacgguggcucaugccugua

SEQ ID NO: 464083 - RNA, 23 nt, Human
gggcacgguggcuuacaucugua

SEQ ID NO: 464084 - RNA, 32 nt, Human
gggcacguccauggggaggguggagaggcugc

SEQ ID NO: 464085 - RNA, 32 nt, Human
gggcacgugcgggaggaaguggagcucccugu

SEQ ID NO: 464086 - RNA, 32 nt, Human
gggcacgugcuggcuaggacaggaagccaggc

SEQ ID NO: 464087 - RNA, 22 nt, Human
gggcacguggcuucaugucagu

SEQ ID NO: 464088 - RNA, 32 nt, Human
gggcacuaacacccgccugccugccaggguga

SEQ ID NO: 464089 - RNA, 32 nt, Human
gggcacuaaggguggagaguugggggccagca

SEQ ID NO: 464090 - RNA, 32 nt, Human
gggcacuagaagcagcggggagggguucuaga

SEQ ID NO: 464091 - RNA, 24 nt, Human
gggcacuagagugagacucugucu

SEQ ID NO: 464092 - RNA, 16 nt, Human
gggcacuagggccuuc

SEQ ID NO: 464093 - RNA, 32 nt, Human
gggcacuauuaaaauacuucucuccuucccug

SEQ ID NO: 464094 - RNA, 32 nt, Human
gggcacucaaauaaugugauuuuaugaggcua

SEQ ID NO: 464095 - RNA, 32 nt, Human
gggcacucaccaggcugcaagaacagugcugg

SEQ ID NO: 464096 - RNA, 32 nt, Human
gggcacucauuucuuagcagccucucuacaua

SEQ ID NO: 464097 - RNA, 19 nt, Human
gggcacucccugcaggagc

SEQ ID NO: 464098 - RNA, 22 nt, Human
gggcacucgcacuggggggcug

SEQ ID NO: 464099 - RNA, 21 nt, Human
gggcacucgccccccuccuua

SEQ ID NO: 464100 - RNA, 32 nt, Human
gggcacucgcugccacaagugccuccuggaaa

SEQ ID NO: 464101 - RNA, 32 nt, Human
gggcacucugcagguucugccuuugaguccuc

SEQ ID NO: 464102 - RNA, 32 nt, Human
gggcacucugcauccucugucauuuuaaccuc

SEQ ID NO: 464103 - RNA, 32 nt, Human
gggcacugaaccuggugccgcccacaccuccu

SEQ ID NO: 464104 - RNA, 32 nt, Human
gggcacugaacucugggcugcuucucugugug

SEQ ID NO: 464105 - RNA, 32 nt, Human
gggcacugacaggacaggagagccaaguuccu

SEQ ID NO: 464106 - RNA, 32 nt, Human
gggcacugacgcugaauggugcagugagaaag

SEQ ID NO: 464107 - RNA, 32 nt, Human
gggcacugagcugccgccuggugaagggggcg

SEQ ID NO: 464108 - RNA, 32 nt, Human
gggcacugaggguggcacagcacaggccugca

SEQ ID NO: 464109 - RNA, 32 nt, Human
gggcacugcccuuuugaaaugaucauguagau

SEQ ID NO: 464110 - RNA, 32 nt, Human
gggcacugcuuuccccagaggcuuccucaugg

SEQ ID NO: 464111 - RNA, 32 nt, Human
gggcacuggaagcacaauacggugaccaaucu

SEQ ID NO: 464112 - RNA, 32 nt, Human
gggcacuggagcugucuuguccuugcugguuu

SEQ ID NO: 464113 - RNA, 32 nt, Human
gggcacuggcagucaaaguggagagaguggaa

SEQ ID NO: 464114 - RNA, 17 nt, Human
gggcacugggccucaga

SEQ ID NO: 464115 - RNA, 32 nt, Human
gggcacugggcugcaaugggccuaggccggag

SEQ ID NO: 464116 - RNA, 32 nt, Human
gggcacugggcugcagguuggagaggcagcau

SEQ ID NO: 464117 - RNA, 32 nt, Human
gggcacugggcugugccuggaaggcgagccuu

SEQ ID NO: 464118 - RNA, 32 nt, Human
gggcacuggggucuguucccccuuccccgucc

SEQ ID NO: 464119 - RNA, 32 nt, Human
gggcacugguaaucccagguacucaagaggcu

SEQ ID NO: 464120 - RNA, 32 nt, Human
gggcacugguaggggacagaggguuagggauc

SEQ ID NO: 464121 - RNA, 32 nt, Human
gggcacuguacuuuagccugggcgacagagag

SEQ ID NO: 464122 - RNA, 32 nt, Human
gggcacugucauguaggagucugcuuaggcug

SEQ ID NO: 464123 - RNA, 32 nt, Human
gggcacugucugaacuccugacugucaggaua

SEQ ID NO: 464124 - RNA, 32 nt, Human
gggcacugugggccgccugccugcugaugugg

SEQ ID NO: 464125 - RNA, 32 nt, Human
gggcacuguuaucuucguuuguuuucaaugau

SEQ ID NO: 464126 - RNA, 32 nt, Human
gggcacuuagcagccuggaggaagaugugggc

SEQ ID NO: 464127 - RNA, 32 nt, Human
gggcacuucauugagaguuuugucuugccaua

SEQ ID NO: 464128 - RNA, 32 nt, Human
gggcacuuccuugacaauuccuauuggcauca

SEQ ID NO: 464129 - RNA, 32 nt, Human
gggcacuucuccccaccucggccccgcgccca

SEQ ID NO: 464130 - RNA, 32 nt, Human
gggcacuuguaaucccagcuacucccaaggcu

SEQ ID NO: 464131 - RNA, 32 nt, Human
gggcacuuguagucccagcuacucaggaggcu

SEQ ID NO: 464132 - RNA, 32 nt, Human
gggcacuuguauuccagccucgcugcauuugc

SEQ ID NO: 464133 - RNA, 32 nt, Human
gggcacuuucuacuugugcaugggcuugguuu

SEQ ID NO: 464134 - RNA, 32 nt, Human
gggcacuuugggcuuggcuagaucacucacug

SEQ ID NO: 464135 - RNA, 32 nt, Human
gggcacuuugguuuuuguacugucuuuuguga

SEQ ID NO: 464136 - RNA, 32 nt, Human
gggcacuuuuaaaaauagagaaaugagugaau

SEQ ID NO: 464137 - RNA, 32 nt, Human
gggcagaaaaccaccaaaaggccagugccuca

SEQ ID NO: 464138 - RNA, 32 nt, Human
gggcagaaacuggauacaguucugagcacagc

SEQ ID NO: 464139 - RNA, 32 nt, Human
gggcagaaagcaaaccuaguuaaauaggugag

SEQ ID NO: 464140 - RNA, 20 nt, Human
gggcagaacuggguugggag

SEQ ID NO: 464141 - RNA, 32 nt, Human
gggcagaagcacaaacacacaugcugacaggg

SEQ ID NO: 464142 - RNA, 32 nt, Human
gggcagaauucacacugaagcugucguccugc

SEQ ID NO: 464143 - RNA, 32 nt, Human
gggcagacacacaaccuccuccuccucuucca

SEQ ID NO: 464144 - RNA, 32 nt, Human
gggcagacaggugggagauggagguagggcug

SEQ ID NO: 464145 - RNA, 32 nt, Human
gggcagaccagagagcucaaguuucagaguca

SEQ ID NO: 464146 - RNA, 20 nt, Human
gggcagaccgagggccaggu

SEQ ID NO: 464147 - RNA, 17 nt, Human
gggcagacgcggcgcug

SEQ ID NO: 464148 - RNA, 24 nt, Human
gggcagacggcggcaggagaagca

SEQ ID NO: 464149 - RNA, 21 nt, Human
gggcagagaaagccgagcaga

SEQ ID NO: 464150 - RNA, 32 nt, Human
gggcagagaacugucuuucauuuuugaacccu

SEQ ID NO: 464151 - RNA, 32 nt, Human
gggcagagaagcgguucugaccacagagcucc

SEQ ID NO: 464152 - RNA, 32 nt, Human
gggcagagaauacugaccucaccuugggaugu

SEQ ID NO: 464153 - RNA, 32 nt, Human
gggcagagacaucccuuccucagacgccuugu

SEQ ID NO: 464154 - RNA, 16 nt, Human
gggcagagagaggcag

SEQ ID NO: 464155 - RNA, 21 nt, Human
gggcagagaggauccagcgaa

SEQ ID NO: 464156 - RNA, 32 nt, Human
gggcagagaggcaagcucaggagcagccucgu

SEQ ID NO: 464157 - RNA, 32 nt, Human
gggcagagagggugguggacaccaggcuuauc

SEQ ID NO: 464158 - RNA, 32 nt, Human
gggcagagaguggugggaaugagggggugggc

SEQ ID NO: 464159 - RNA, 32 nt, Human
gggcagagaguuucugugagucccacugagaa

SEQ ID NO: 464160 - RNA, 32 nt, Human
gggcagagauggcccugcagagccaggugugg

SEQ ID NO: 464161 - RNA, 32 nt, Human
gggcagagcacaaccucauccucccagugguu

SEQ ID NO: 464162 - RNA, 32 nt, Human
gggcagagccgagcgcagcggaggcuccggcg

SEQ ID NO: 464163 - RNA, 32 nt, Human
gggcagagccugccaaguugaguucagcuuca

SEQ ID NO: 464164 - RNA, 32 nt, Human
gggcagagccugcugcagcccaacucugguug

SEQ ID NO: 464165 - RNA, 32 nt, Human
gggcagagccugcugcagcccagcucugguug

SEQ ID NO: 464166 - RNA, 32 nt, Human
gggcagagccuggguggucagaggccggggcu

SEQ ID NO: 464167 - RNA, 32 nt, Human
gggcagagcugguuccuaccacuccauucaca

SEQ ID NO: 464168 - RNA, 19 nt, Human
gggcagaggagacuauggg

SEQ ID NO: 464169 - RNA, 20 nt, Human
gggcagaggaggcggcgcgg

SEQ ID NO: 464170 - RNA, 32 nt, Human
gggcagaggccuccuuucaaggaguucacagu

SEQ ID NO: 464171 - RNA, 32 nt, Human
gggcagagggcagaggcuggaggcaggccuug

SEQ ID NO: 464172 - RNA, 32 nt, Human
gggcagaggggaggcagcagggagaggaagga

SEQ ID NO: 464173 - RNA, 32 nt, Human
gggcagaggggugggggcuggggagaggcgug

SEQ ID NO: 464174 - RNA, 22 nt, Human
gggcagagguggcgcccagggg

SEQ ID NO: 464175 - RNA, 19 nt, Human
gggcagagguugcagugag

SEQ ID NO: 464176 - RNA, 32 nt, Human
gggcagaguaaaaggugccaggaggagcaugg

SEQ ID NO: 464177 - RNA, 32 nt, Human
gggcagaguaauucaggcacauguguucagag

SEQ ID NO: 464178 - RNA, 32 nt, Human
gggcagaguagguccccuccauggcccugaau

SEQ ID NO: 464179 - RNA, 32 nt, Human
gggcagagucagcucugugcugagccuccugg

SEQ ID NO: 464180 - RNA, 24 nt, Human
gggcagaguccccugcaaggaggc

SEQ ID NO: 464181 - RNA, 32 nt, Human
gggcagagugcagcuuaacauguugcuauccc

SEQ ID NO: 464182 - RNA, 32 nt, Human
gggcagaguugcacuuuuccaggcuuuuuagg

SEQ ID NO: 464183 - RNA, 32 nt, Human
gggcagaguuugucccucugucaucagaggca

SEQ ID NO: 464184 - RNA, 32 nt, Human
gggcagauagugaaacacauuguuaggggaga

SEQ ID NO: 464185 - RNA, 17 nt, Human
gggcagaucacaagguc

SEQ ID NO: 464186 - RNA, 22 nt, Human
gggcagaucaccuaaggucagg

SEQ ID NO: 464187 - RNA, 22 nt, Human
gggcagaucaccugagaucggg

SEQ ID NO: 464188 - RNA, 22 nt, Human
gggcagaucaccugaggccagg

SEQ ID NO: 464189 - RNA, 21 nt, Human
gggcagaucaccugaggucag

SEQ ID NO: 464190 - RNA, 22 nt, Human
gggcagaucaccugaggucagg

SEQ ID NO: 464191 - RNA, 20 nt, Human
gggcagaucacgaggucagg

SEQ ID NO: 464192 - RNA, 22 nt, Human
gggcagaucacucaaggucagg

SEQ ID NO: 464193 - RNA, 32 nt, Human
gggcagaucacugaggucaggaguacgagauc

SEQ ID NO: 464194 - RNA, 22 nt, Human
gggcagaucacuugaagucagg

SEQ ID NO: 464195 - RNA, 22 nt, Human
gggcagaucacuugagaucagg

SEQ ID NO: 464196 - RNA, 22 nt, Human
gggcagaucacuugagcucagg

SEQ ID NO: 464197 - RNA, 22 nt, Human
gggcagaucacuugaggccagg

SEQ ID NO: 464198 - RNA, 22 nt, Human
gggcagaucacuugaggucagg

SEQ ID NO: 464199 - RNA, 22 nt, Human
gggcagaucgccugaggucagg

SEQ ID NO: 464200 - RNA, 32 nt, Human
gggcagaugaacacggaggcucucuguugucu

SEQ ID NO: 464201 - RNA, 32 nt, Human
gggcagaugcagcuuccaucuaccugagggcu

SEQ ID NO: 464202 - RNA, 32 nt, Human
gggcagaugggcuggggcuuagcaccacccac

SEQ ID NO: 464203 - RNA, 32 nt, Human
gggcagaugguggagucaagggugggcagcgu

SEQ ID NO: 464204 - RNA, 22 nt, Human
gggcagauucaagagccagcag

SEQ ID NO: 464205 - RNA, 32 nt, Human
gggcagauugcaugagcccaggaguucgagac

SEQ ID NO: 464206 - RNA, 22 nt, Human
gggcagauugccugagcucagg

SEQ ID NO: 464207 - RNA, 22 nt, Human
gggcagauugcuugaacccagg

SEQ ID NO: 464208 - RNA, 32 nt, Human
gggcagauuuauucuaaccugcccucaaaucu

SEQ ID NO: 464209 - RNA, 32 nt, Human
gggcagcaaacaguaacuaccaaaaccaauga

SEQ ID NO: 464210 - RNA, 32 nt, Human
gggcagcaaaccugcuguuuaacaucagggug

SEQ ID NO: 464211 - RNA, 32 nt, Human
gggcagcaacuggcccuccugucccucacccc

SEQ ID NO: 464212 - RNA, 32 nt, Human
gggcagcaagaugccauuucugcaucucccag

SEQ ID NO: 464213 - RNA, 32 nt, Human
gggcagcaagggagcagcaaggccucaaaccc

SEQ ID NO: 464214 - RNA, 32 nt, Human
gggcagcacacagcagcucauggcagagccgc

SEQ ID NO: 464215 - RNA, 32 nt, Human
gggcagcacacugggagccauuuacuuuaugc

SEQ ID NO: 464216 - RNA, 24 nt, Human
gggcagcacaggaggguccugcug

SEQ ID NO: 464217 - RNA, 32 nt, Human
gggcagcacauacuuccagugccagggccaca

SEQ ID NO: 464218 - RNA, 32 nt, Human
gggcagcaccacuucgcuuuaaagacucugaa

SEQ ID NO: 464219 - RNA, 25 nt, Human
gggcagcacccgcgggauucugcug

SEQ ID NO: 464220 - RNA, 20 nt, Human
gggcagcacccuuccugcug

SEQ ID NO: 464221 - RNA, 32 nt, Human
gggcagcacgcagcaggcgccgagcgccgggc

SEQ ID NO: 464222 - RNA, 32 nt, Human
gggcagcacugagggacccugccccgccccuc

SEQ ID NO: 464223 - RNA, 32 nt, Human
gggcagcagaacugugcgugacaugucuucgu

SEQ ID NO: 464224 - RNA, 32 nt, Human
gggcagcagagaaaggaaguccucucccugga

SEQ ID NO: 464225 - RNA, 24 nt, Human
gggcagcagagcaaaacucugucu

SEQ ID NO: 464226 - RNA, 24 nt, Human
gggcagcagagcaagacucugucu

SEQ ID NO: 464227 - RNA, 24 nt, Human
gggcagcagagcgagacucugucu

SEQ ID NO: 464228 - RNA, 24 nt, Human
gggcagcagagugagacccugucu

SEQ ID NO: 464229 - RNA, 20 nt, Human
gggcagcagcaggaggccug

SEQ ID NO: 464230 - RNA, 32 nt, Human
gggcagcagccccugggcaggcaucggagcuu

SEQ ID NO: 464231 - RNA, 32 nt, Human
gggcagcagcgaacuaggccaggccugacugg

SEQ ID NO: 464232 - RNA, 27 nt, Human
gggcagcagcuccagcagcgccagcag

SEQ ID NO: 464233 - RNA, 32 nt, Human
gggcagcagcugcugccacagccuccagcggc

SEQ ID NO: 464234 - RNA, 32 nt, Human
gggcagcagcuggucuggccccugaaagccuu

SEQ ID NO: 464235 - RNA, 32 nt, Human
gggcagcaggaaaauaauacaaaacuuaaguu

SEQ ID NO: 464236 - RNA, 32 nt, Human
gggcagcaggcccaggccccacccucgaagcc

SEQ ID NO: 464237 - RNA, 32 nt, Human
gggcagcagguguuccaugcugcuagguggcg

SEQ ID NO: 464238 - RNA, 32 nt, Human
gggcagcauagcgagaccccaucucuauauaa

SEQ ID NO: 464239 - RNA, 32 nt, Human
gggcagcauccagcuggugaccugagagggca

SEQ ID NO: 464240 - RNA, 32 nt, Human
gggcagcaugcugcuuuccuccugugcccacu

SEQ ID NO: 464241 - RNA, 32 nt, Human
gggcagcauggcgaaaucccaucucuacaaaa

SEQ ID NO: 464242 - RNA, 32 nt, Human
gggcagcauggugaaacccuguaucuacaaaa

SEQ ID NO: 464243 - RNA, 32 nt, Human
gggcagcaugguucacuccagcaugggggcuc

SEQ ID NO: 464244 - RNA, 22 nt, Human
gggcagccaaccugccccagag

SEQ ID NO: 464245 - RNA, 18 nt, Human
gggcagccaagcccaggc

SEQ ID NO: 464246 - RNA, 25 nt, Human
gggcagccagcaacaaagccagcag

SEQ ID NO: 464247 - RNA, 32 nt, Human
gggcagccagcggucuucccugccugguguuu

SEQ ID NO: 464248 - RNA, 32 nt, Human
gggcagccaugcacucccccugggugucgcuc

SEQ ID NO: 464249 - RNA, 32 nt, Human
gggcagccauuuucucccgggagaggcuggag

SEQ ID NO: 464250 - RNA, 32 nt, Human
gggcagcccagccucugucccucuuugccugu

SEQ ID NO: 464251 - RNA, 17 nt, Human
gggcagcccagcuccag

SEQ ID NO: 464252 - RNA, 21 nt, Human
gggcagcccaggcuccugcug

SEQ ID NO: 464253 - RNA, 17 nt, Human
gggcagcccaggggggu

SEQ ID NO: 464254 - RNA, 32 nt, Human
gggcagccccucuccguccucagggcugugcc

SEQ ID NO: 464255 - RNA, 32 nt, Human
gggcagccccuggggagggaggagaggaccca

SEQ ID NO: 464256 - RNA, 32 nt, Human
gggcagcccucuccaccuuuugguacuuucua

SEQ ID NO: 464257 - RNA, 32 nt, Human
gggcagcccuggaagcucggaggagaggccac

SEQ ID NO: 464258 - RNA, 32 nt, Human
gggcagcccuggaggaacaaggggcuggcugu

SEQ ID NO: 464259 - RNA, 32 nt, Human
gggcagcccuggaggagccacugugggcucca

SEQ ID NO: 464260 - RNA, 32 nt, Human
gggcagcccuucucuucugcuguuuaauucca

SEQ ID NO: 464261 - RNA, 18 nt, Human
gggcagccgcgcccgccg

SEQ ID NO: 464262 - RNA, 32 nt, Human
gggcagccggagggcagggcucagggagcagg

SEQ ID NO: 464263 - RNA, 32 nt, Human
gggcagccgggagacugggcucugccuaggcu

SEQ ID NO: 464264 - RNA, 17 nt, Human
gggcagccggggggcag

SEQ ID NO: 464265 - RNA, 32 nt, Human
gggcagccuagagguguugggaacccuggccu

SEQ ID NO: 464266 - RNA, 32 nt, Human
gggcagccucggcagucugggcuccgggcccc

SEQ ID NO: 464267 - RNA, 32 nt, Human
gggcagccucugucugugugguuaauguucug

SEQ ID NO: 464268 - RNA, 32 nt, Human
gggcagccugcaggaguccauuuuacacaggu

SEQ ID NO: 464269 - RNA, 21 nt, Human
gggcagccugcagggcagcug

SEQ ID NO: 464270 - RNA, 32 nt, Human
gggcagccugcucuccuccuggggcccuguuc

SEQ ID NO: 464271 - RNA, 32 nt, Human
gggcagccuggaccggcugcugcugcacggga

SEQ ID NO: 464272 - RNA, 32 nt, Human
gggcagccugggaagagccaggaagcugggag

SEQ ID NO: 464273 - RNA, 32 nt, Human
gggcagcgagggccuaccaccaugaucacugg

SEQ ID NO: 464274 - RNA, 20 nt, Human
gggcagcgcagggcgcagag

SEQ ID NO: 464275 - RNA, 19 nt, Human
gggcagcggaacccagaga

SEQ ID NO: 464276 - RNA, 32 nt, Human
gggcagcggaggaggaaauggcagguccuaau

SEQ ID NO: 464277 - RNA, 32 nt, Human
gggcagcggcgaggaggaggaagaggaggcgg

SEQ ID NO: 464278 - RNA, 24 nt, Human
gggcagcggcggcagcggaggcag

SEQ ID NO: 464279 - RNA, 32 nt, Human
gggcagcggcuucccccucuagccccuccccu

SEQ ID NO: 464280 - RNA, 32 nt, Human
gggcagcggggagccucacaagaggacuacag

SEQ ID NO: 464281 - RNA, 19 nt, Human
gggcagcguaugggggcag

SEQ ID NO: 464282 - RNA, 32 nt, Human
gggcagcgugccugugccaacccuuccaggga

SEQ ID NO: 464283 - RNA, 20 nt, Human
gggcagcgugcugaguggga

SEQ ID NO: 464284 - RNA, 32 nt, Human
gggcagcguggugggggauaaauaaauaaaag

SEQ ID NO: 464285 - RNA, 32 nt, Human
gggcagcuaacaagggcugagccccagguaca

SEQ ID NO: 464286 - RNA, 32 nt, Human
gggcagcuacauguugagaaccacagcguccu

SEQ ID NO: 464287 - RNA, 18 nt, Human
gggcagcucaaggcuccu

SEQ ID NO: 464288 - RNA, 32 nt, Human
gggcagcucagaccucaucggacaucagguaa

SEQ ID NO: 464289 - RNA, 32 nt, Human
gggcagcucaugggauggucaggagucccacg

SEQ ID NO: 464290 - RNA, 32 nt, Human
gggcagcuccauccucuugaucuucuaaaugc

SEQ ID NO: 464291 - RNA, 32 nt, Human
gggcagcucccaggauauccugccuuccaacu

SEQ ID NO: 464292 - RNA, 32 nt, Human
gggcagcucccaggcccuugggcaggcugggg

SEQ ID NO: 464293 - RNA, 32 nt, Human
gggcagcuccucaccaugauccugcaccaguu

SEQ ID NO: 464294 - RNA, 24 nt, Human
gggcagcuccuuccccagccagga

SEQ ID NO: 464295 - RNA, 32 nt, Human
gggcagcucgaggcacgacuccagccucuucg

SEQ ID NO: 464296 - RNA, 32 nt, Human
gggcagcucuccccucacucuccuccaccugc

SEQ ID NO: 464297 - RNA, 21 nt, Human
gggcagcucugagcucgcgga

SEQ ID NO: 464298 - RNA, 32 nt, Human
gggcagcucugccccuguggcuuuguagggua

SEQ ID NO: 464299 - RNA, 32 nt, Human
gggcagcucugccuccuccucccaugaggugg

SEQ ID NO: 464300 - RNA, 32 nt, Human
gggcagcucuggaaggguugggggcuccccug

SEQ ID NO: 464301 - RNA, 32 nt, Human
gggcagcugaaaagcuggcgcagcccaaggag

SEQ ID NO: 464302 - RNA, 32 nt, Human
gggcagcugaacugagcguaugugccacgccg

SEQ ID NO: 464303 - RNA, 22 nt, Human
gggcagcugcaggacugagccu

SEQ ID NO: 464304 - RNA, 20 nt, Human
gggcagcugcaggagcgcug

SEQ ID NO: 464305 - RNA, 17 nt, Human
gggcagcugcccuggca

SEQ ID NO: 464306 - RNA, 32 nt, Human
gggcagcugccuggccaugcugucccugcacu

SEQ ID NO: 464307 - RNA, 32 nt, Human
gggcagcugcuugugggagagcugaggucuag

SEQ ID NO: 464308 - RNA, 21 nt, Human
gggcagcuggccugccacgga

SEQ ID NO: 464309 - RNA, 32 nt, Human
gggcagcuggcgugguggcucacaccuguaau

SEQ ID NO: 464310 - RNA, 23 nt, Human
gggcagcuggcugacagcuggga

SEQ ID NO: 464311 - RNA, 32 nt, Human
gggcagcugggagacaggcucauggcucaugg

SEQ ID NO: 464312 - RNA, 18 nt, Human
gggcagcugggccccaga

SEQ ID NO: 464313 - RNA, 32 nt, Human
gggcagcugggcugaggacuggaacauucugu

SEQ ID NO: 464314 - RNA, 19 nt, Human
gggcagcuggggccacaag

SEQ ID NO: 464315 - RNA, 32 nt, Human
gggcagcugugggcacagcuucaggacacuua

SEQ ID NO: 464316 - RNA, 32 nt, Human
gggcagcuucacaagccaucucuuucauuucu

SEQ ID NO: 464317 - RNA, 32 nt, Human
gggcagcuucaggggaggacaccccacuggcc

SEQ ID NO: 464318 - RNA, 32 nt, Human
gggcagcuucuggaaguggcugagacuggaag

SEQ ID NO: 464319 - RNA, 32 nt, Human
gggcagcuugggcccagacuccuccgcugugu

SEQ ID NO: 464320 - RNA, 22 nt, Human
gggcagcuuuaaucagguuggg

SEQ ID NO: 464321 - RNA, 32 nt, Human
gggcaggaaccgcggaauuccugcucuucguu

SEQ ID NO: 464322 - RNA, 32 nt, Human
gggcaggaagcccacggcccacagggguguag

SEQ ID NO: 464323 - RNA, 32 nt, Human
gggcaggaagggacaggagcggagcaggacac

SEQ ID NO: 464324 - RNA, 32 nt, Human
gggcaggacaggcucuggagggaaaagccaga

SEQ ID NO: 464325 - RNA, 32 nt, Human
gggcaggacagguccucccugcagagagagac

SEQ ID NO: 464326 - RNA, 21 nt, Human
gggcaggacauuggcugggag

SEQ ID NO: 464327 - RNA, 18 nt, Human
gggcaggaccaggacaga

SEQ ID NO: 464328 - RNA, 16 nt, Human
gggcaggaccuagcug

SEQ ID NO: 464329 - RNA, 18 nt, Human
gggcaggaccugcaggga

SEQ ID NO: 464330 - RNA, 24 nt, Human
gggcaggaccugucagcugggagg

SEQ ID NO: 464331 - RNA, 32 nt, Human
gggcaggacugaagauuucacuacuuagcaua

SEQ ID NO: 464332 - RNA, 20 nt, Human
gggcaggagaagcccgggag

SEQ ID NO: 464333 - RNA, 32 nt, Human
gggcaggagacagacacguaacaggaacucgg

SEQ ID NO: 464334 - RNA, 21 nt, Human
gggcaggagagagggccgccc

SEQ ID NO: 464335 - RNA, 32 nt, Human
gggcaggagagcuuugggggaaaggaaaaggc

SEQ ID NO: 464336 - RNA, 32 nt, Human
gggcaggagauuguuucuucauucuucugaca

SEQ ID NO: 464337 - RNA, 32 nt, Human
gggcaggagcuugcacgaaaucacacagccaa

SEQ ID NO: 464338 - RNA, 22 nt, Human
gggcaggaggaaaggugggagg

SEQ ID NO: 464339 - RNA, 32 nt, Human
gggcaggaggagagaggaaaagggagggcgag

SEQ ID NO: 464340 - RNA, 20 nt, Human
gggcaggaggaggggugugg

SEQ ID NO: 464341 - RNA, 21 nt, Human
gggcaggaggcagcugagagg

SEQ ID NO: 464342 - RNA, 32 nt, Human
gggcaggaggcaggagauggcaauggaagcga

SEQ ID NO: 464343 - RNA, 22 nt, Human
gggcaggaggcggcgggcugcg

SEQ ID NO: 464344 - RNA, 32 nt, Human
gggcaggaggcuggggaugggggugggauaug

SEQ ID NO: 464345 - RNA, 32 nt, Human
gggcaggaggggcagggcgggccagguggagu

SEQ ID NO: 464346 - RNA, 32 nt, Human
gggcaggagggggcuggggcagcauccacugu

SEQ ID NO: 464347 - RNA, 26 nt, Human
gggcaggaggugcacggauccugcug

SEQ ID NO: 464348 - RNA, 32 nt, Human
gggcaggagguggacaucuuugggggacauua

SEQ ID NO: 464349 - RNA, 32 nt, Human
gggcaggagguggcagcggcagcagcuguguu

SEQ ID NO: 464350 - RNA, 32 nt, Human
gggcaggaguagcugagcucacaaggcagcaa

SEQ ID NO: 464351 - RNA, 20 nt, Human
gggcaggaucuagcagggag

SEQ ID NO: 464352 - RNA, 32 nt, Human
gggcaggaugcagagaaugacaaggcugaaag

SEQ ID NO: 464353 - RNA, 32 nt, Human
gggcaggaugcagugagccagccccagggcca

SEQ ID NO: 464354 - RNA, 31 nt, Human
gggcaggcaaagugcagauguaggagcugcu

SEQ ID NO: 464355 - RNA, 32 nt, Human
gggcaggcaagccagucuucugucuuccuuug

SEQ ID NO: 464356 - RNA, 32 nt, Human
gggcaggcaagcucguggagguggugguugaa

SEQ ID NO: 464357 - RNA, 32 nt, Human
gggcaggcagaagaagugguauacagagaauu

SEQ ID NO: 464358 - RNA, 32 nt, Human
gggcaggcagaagggagaaccagcucaagaca

SEQ ID NO: 464359 - RNA, 32 nt, Human
gggcaggcagaggcacuuuguacuugcuccaa

SEQ ID NO: 464360 - RNA, 25 nt, Human
gggcaggcagcagcagugcuaguag

SEQ ID NO: 464361 - RNA, 22 nt, Human
gggcaggcagcagccgggcagg

SEQ ID NO: 464362 - RNA, 32 nt, Human
gggcaggcagcaggcucaggcccacaccuugu

SEQ ID NO: 464363 - RNA, 32 nt, Human
gggcaggcaggagguggaguugcagcuguugg

SEQ ID NO: 464364 - RNA, 32 nt, Human
gggcaggcaggcaauggguggaaaucagggga

SEQ ID NO: 464365 - RNA, 16 nt, Human
gggcaggcaggggcag

SEQ ID NO: 464366 - RNA, 32 nt, Human
gggcaggcaucggagcuuccagccuggggaga

SEQ ID NO: 464367 - RNA, 32 nt, Human
gggcaggccagagagagagggcagauggacuc

SEQ ID NO: 464368 - RNA, 32 nt, Human
gggcaggccagcagggcagacaccaggaaaag

SEQ ID NO: 464369 - RNA, 32 nt, Human
gggcaggcccacccuccucuuugcgcccuuuc

SEQ ID NO: 464370 - RNA, 32 nt, Human
gggcaggccccuccucuguccaccgagacucu

SEQ ID NO: 464371 - RNA, 22 nt, Human
gggcaggccccucucugcaucu

SEQ ID NO: 464372 - RNA, 20 nt, Human
gggcaggccgcagagcaagg

SEQ ID NO: 464373 - RNA, 32 nt, Human
gggcaggccgggaguguacugugugcagcuga

SEQ ID NO: 464374 - RNA, 31 nt, Human
gggcaggccgggucucccaucccgaggccag

SEQ ID NO: 464375 - RNA, 32 nt, Human
gggcaggccugaggcugggaucccgugcugcu

SEQ ID NO: 464376 - RNA, 32 nt, Human
gggcaggccuuguucugaacuguuucgcuucu

SEQ ID NO: 464377 - RNA, 32 nt, Human
gggcaggcgaggggcucagggcucucgaauug

SEQ ID NO: 464378 - RNA, 32 nt, Human
gggcaggcucacugcccgcuucuuuuccuucu

SEQ ID NO: 464379 - RNA, 32 nt, Human
gggcaggcucagacaggcccagcuccaccaag

SEQ ID NO: 464380 - RNA, 20 nt, Human
gggcaggcuccaggcucacc

SEQ ID NO: 464381 - RNA, 32 nt, Human
gggcaggcuccuggauggacaccagcuacacu

SEQ ID NO: 464382 - RNA, 32 nt, Human
gggcaggcuggcugcuggcucuaccagguucu

SEQ ID NO: 464383 - RNA, 21 nt, Human
gggcaggcuucuccugcaccu

SEQ ID NO: 464384 - RNA, 32 nt, Human
gggcagggaagagagcgcccggcucaguacug

SEQ ID NO: 464385 - RNA, 32 nt, Human
gggcagggacgguccccacccccagggacaca

SEQ ID NO: 464386 - RNA, 32 nt, Human
gggcagggacguugccgggcagaggaagcugg

SEQ ID NO: 464387 - RNA, 32 nt, Human
gggcagggacuggcgcccugugccugaguggg

SEQ ID NO: 464388 - RNA, 32 nt, Human
gggcagggagagaggaccagggucagggggaa

SEQ ID NO: 464389 - RNA, 18 nt, Human
gggcagggagaugucaug

SEQ ID NO: 464390 - RNA, 32 nt, Human
gggcagggagccucagaugggaagaagucaga

SEQ ID NO: 464391 - RNA, 32 nt, Human
gggcagggagcugaaggacuccaccgcugccc

SEQ ID NO: 464392 - RNA, 32 nt, Human
gggcagggaggcaccauucaggaaccuggacc

SEQ ID NO: 464393 - RNA, 32 nt, Human
gggcagggagggagcaugaaguacgaggaaaa

SEQ ID NO: 464394 - RNA, 32 nt, Human
gggcagggagggcuggcauuucccccagaaga

SEQ ID NO: 464395 - RNA, 20 nt, Human
gggcagggaggggcagggug

SEQ ID NO: 464396 - RNA, 17 nt, Human
gggcagggagggggcgg

SEQ ID NO: 464397 - RNA, 32 nt, Human
gggcagggaggugaggacuucaucucaacauc

SEQ ID NO: 464398 - RNA, 32 nt, Human
gggcagggagucgaggaaggcccaggguucgg

SEQ ID NO: 464399 - RNA, 28 nt, Human
gggcagggcaggacugccucauccucug

SEQ ID NO: 464400 - RNA, 32 nt, Human
gggcagggcaugaguuagggagacugaagagu

SEQ ID NO: 464401 - RNA, 32 nt, Human
gggcagggccagacugcaccuuuauuagaguc

SEQ ID NO: 464402 - RNA, 32 nt, Human
gggcagggccagcuuccaucccuucuccagcc

SEQ ID NO: 464403 - RNA, 21 nt, Human
gggcagggccccggcgcugga

SEQ ID NO: 464404 - RNA, 32 nt, Human
gggcagggccccugacccucccggccuggcuu

SEQ ID NO: 464405 - RNA, 16 nt, Human
gggcagggccuggaca

SEQ ID NO: 464406 - RNA, 32 nt, Human
gggcagggccuggagcuucccacuaaaaacau

SEQ ID NO: 464407 - RNA, 22 nt, Human
gggcagggcuagcaacaucgua

SEQ ID NO: 464408 - RNA, 32 nt, Human
gggcagggcucagggagcaggaggcugcaucc

SEQ ID NO: 464409 - RNA, 32 nt, Human
gggcagggcugaggccucucauuccagaggaa

SEQ ID NO: 464410 - RNA, 32 nt, Human
gggcagggcugcagugggguccaggugguguu

SEQ ID NO: 464411 - RNA, 32 nt, Human
gggcagggcugccuccagccugcacgcuggcu

SEQ ID NO: 464412 - RNA, 32 nt, Human
gggcagggcugccuccucaccucucuucggcc

SEQ ID NO: 464413 - RNA, 32 nt, Human
gggcagggcuguaguuggugacuggguguuca

SEQ ID NO: 464414 - RNA, 32 nt, Human
gggcaggggaaagagaaagaagaugagagauu

SEQ ID NO: 464415 - RNA, 32 nt, Human
gggcaggggaaagagaaagaaggugagagauu

SEQ ID NO: 464416 - RNA, 32 nt, Human
gggcaggggaagcucucacucuguugccauua

SEQ ID NO: 464417 - RNA, 32 nt, Human
gggcaggggacagcagagcagagaggcccagg

SEQ ID NO: 464418 - RNA, 32 nt, Human
gggcaggggagagacucucuccccaccaccca

SEQ ID NO: 464419 - RNA, 32 nt, Human
gggcaggggagagacucucuccccaccacccg

SEQ ID NO: 464420 - RNA, 32 nt, Human
gggcaggggcaguggcuggauggugccuacug

SEQ ID NO: 464421 - RNA, 32 nt, Human
gggcaggggcgguggaggacucaggaacugcc

SEQ ID NO: 464422 - RNA, 32 nt, Human
gggcaggggcuccaggugaggagccagcaggc

SEQ ID NO: 464423 - RNA, 20 nt, Human
gggcaggggcugaaaggggc

SEQ ID NO: 464424 - RNA, 32 nt, Human
gggcaggggcugcagagggagguggaaaugaa

SEQ ID NO: 464425 - RNA, 32 nt, Human
gggcaggggcuggggcugagaacugcagcccu

SEQ ID NO: 464426 - RNA, 32 nt, Human
gggcagggggcagagagcagagaggagcggca

SEQ ID NO: 464427 - RNA, 32 nt, Human
gggcagggggccugagcgggacaggccuggcc

SEQ ID NO: 464428 - RNA, 32 nt, Human
gggcaggggguguggcaggagcucccagcacu

SEQ ID NO: 464429 - RNA, 32 nt, Human
gggcagggguagaggcucguagauggaacugg

SEQ ID NO: 464430 - RNA, 32 nt, Human
gggcaggggucaggagaacaggagaacagggg

SEQ ID NO: 464431 - RNA, 23 nt, Human
gggcaggggucccugcugggagg

SEQ ID NO: 464432 - RNA, 32 nt, Human
gggcaggggugagagagcaagggggcaggggu

SEQ ID NO: 464433 - RNA, 32 nt, Human
gggcaggggugagagagcaggagagcaggggu

SEQ ID NO: 464434 - RNA, 32 nt, Human
gggcaggggugaggagagcaagagggcagggg

SEQ ID NO: 464435 - RNA, 32 nt, Human
gggcaggggugaggagggagcaggagggcagg

SEQ ID NO: 464436 - RNA, 32 nt, Human
gggcaggggugagggggagcagaagagggaug

SEQ ID NO: 464437 - RNA, 32 nt, Human
gggcaggggugagggggagcaggagggcaggg

SEQ ID NO: 464438 - RNA, 32 nt, Human
gggcaggggugguggagagauggaagggcauc

SEQ ID NO: 464439 - RNA, 21 nt, Human
gggcaggguccuggccagcag

SEQ ID NO: 464440 - RNA, 32 nt, Human
gggcagggucucaaacaguccugacucacagg

SEQ ID NO: 464441 - RNA, 32 nt, Human
gggcagggucuggcgggcucucaggccagggg

SEQ ID NO: 464442 - RNA, 32 nt, Human
gggcagggugcagaggaaaacaugccgcaugg

SEQ ID NO: 464443 - RNA, 32 nt, Human
gggcaggguggggcaggaugcagugagccagc

SEQ ID NO: 464444 - RNA, 17 nt, Human
gggcagggugggggcag

SEQ ID NO: 464445 - RNA, 32 nt, Human
gggcagggugugggaacagagcuggggucaga

SEQ ID NO: 464446 - RNA, 32 nt, Human
gggcagguagcagucccuggccucucccccug

SEQ ID NO: 464447 - RNA, 32 nt, Human
gggcaggucuucuccuccucuccaucccuauu

SEQ ID NO: 464448 - RNA, 32 nt, Human
gggcaggugaguggcagcugugcuccagcucc

SEQ ID NO: 464449 - RNA, 32 nt, Human
gggcaggugcaaguucauaggucuccaagacc

SEQ ID NO: 464450 - RNA, 32 nt, Human
gggcaggugccuguaaucccagcacuuuggga

SEQ ID NO: 464451 - RNA, 32 nt, Human
gggcagguggaggagcugggccucccacaggg

SEQ ID NO: 464452 - RNA, 20 nt, Human
gggcagguggcguaacccag

SEQ ID NO: 464453 - RNA, 32 nt, Human
gggcagguggggcaauccagagcugugggggc

SEQ ID NO: 464454 - RNA, 32 nt, Human
gggcaggugggggaauggaggcugcaggacug

SEQ ID NO: 464455 - RNA, 32 nt, Human
gggcagguggguaggagagggaaagccagagu

SEQ ID NO: 464456 - RNA, 23 nt, Human
gggcaggugguccuagacagcag

SEQ ID NO: 464457 - RNA, 16 nt, Human
gggcagguguggggug

SEQ ID NO: 464458 - RNA, 21 nt, Human
gggcagguuagaagacagcag

SEQ ID NO: 464459 - RNA, 32 nt, Human
gggcagguugagaagccaggggccaagaugga

SEQ ID NO: 464460 - RNA, 21 nt, Human
gggcagguugugaggccacag

SEQ ID NO: 464461 - RNA, 32 nt, Human
gggcagguuucugcuucuucuguuuugcccca

SEQ ID NO: 464462 - RNA, 32 nt, Human
gggcagguuuuaaacucuugaccucauguucc

SEQ ID NO: 464463 - RNA, 32 nt, Human
gggcagguuuuccaggcuggagucgguuccac

SEQ ID NO: 464464 - RNA, 32 nt, Human
gggcaguaagacgacccccagccccgggcccc

SEQ ID NO: 464465 - RNA, 32 nt, Human
gggcaguaagugggguggagcccagugagacu

SEQ ID NO: 464466 - RNA, 32 nt, Human
gggcaguagcagcagaggccaguggacucuga

SEQ ID NO: 464467 - RNA, 32 nt, Human
gggcaguaggggaaauggaguugcuucaaccu

SEQ ID NO: 464468 - RNA, 32 nt, Human
gggcagucaccacccagcccuuccuugggcgu

SEQ ID NO: 464469 - RNA, 32 nt, Human
gggcagucagacagcagccacagggagagggu

SEQ ID NO: 464470 - RNA, 17 nt, Human
gggcagucagggagcag

SEQ ID NO: 464471 - RNA, 32 nt, Human
gggcagucguaggagacucugaaaaagcaaau

SEQ ID NO: 464472 - RNA, 32 nt, Human
gggcagucuuccucccccuccccgaccaaacc

SEQ ID NO: 464473 - RNA, 32 nt, Human
gggcagugaacagaccacuagccccggcuggg

SEQ ID NO: 464474 - RNA, 32 nt, Human
gggcagugaagguagguuucagguuugguuuu

SEQ ID NO: 464475 - RNA, 21 nt, Human
gggcagugaccagucuguauc

SEQ ID NO: 464476 - RNA, 32 nt, Human
gggcagugacuucagaccccaaaggagucaga

SEQ ID NO: 464477 - RNA, 32 nt, Human
gggcagugagccaggcuagccacagaggguuc

SEQ ID NO: 464478 - RNA, 32 nt, Human
gggcagugaggaagggaaauauggggcuguag

SEQ ID NO: 464479 - RNA, 32 nt, Human
gggcagugagucuggccaaaauguaaacccca

SEQ ID NO: 464480 - RNA, 19 nt, Human
gggcagugcaggggaccug

SEQ ID NO: 464481 - RNA, 32 nt, Human
gggcagugccugauaagcuucaaagcugcuuu

SEQ ID NO: 464482 - RNA, 31 nt, Human
gggcagugcguggaaaggccggggaggugca

SEQ ID NO: 464483 - RNA, 32 nt, Human
gggcagugcugguaggguuucaaggugcuauu

SEQ ID NO: 464484 - RNA, 32 nt, Human
gggcaguggaaugcugauggaggcagacgcug

SEQ ID NO: 464485 - RNA, 32 nt, Human
gggcaguggacccuugacaaaauuuaauuacc

SEQ ID NO: 464486 - RNA, 32 nt, Human
gggcaguggagaggggacuuggauaggagcuu

SEQ ID NO: 464487 - RNA, 32 nt, Human
gggcaguggaggggcccgaggagccagguugc

SEQ ID NO: 464488 - RNA, 32 nt, Human
gggcaguggcugacacagaccacccacuccac

SEQ ID NO: 464489 - RNA, 22 nt, Human
gggcaguggcugacagcuggga

SEQ ID NO: 464490 - RNA, 29 nt, Human
gggcaguggcugcucguguccucugccac

SEQ ID NO: 464491 - RNA, 32 nt, Human
gggcagugggcucugagcuaggaggagguggc

SEQ ID NO: 464492 - RNA, 32 nt, Human
gggcagugggggaaggaaggggagaggugguu

SEQ ID NO: 464493 - RNA, 32 nt, Human
gggcaguggggugagaagguccuggcuccccu

SEQ ID NO: 464494 - RNA, 31 nt, Human
gggcaguggguggagggcugccaggaaacau

SEQ ID NO: 464495 - RNA, 32 nt, Human
gggcagugguucaugccuuaaucccagcacuu

SEQ ID NO: 464496 - RNA, 32 nt, Human
gggcagugugggcucauggcacugggauggua

SEQ ID NO: 464497 - RNA, 32 nt, Human
gggcaguuaccugcaugccuaaaggaguaggc

SEQ ID NO: 464498 - RNA, 32 nt, Human
gggcaguuacuggagacuguaucugcagcaga

SEQ ID NO: 464499 - RNA, 32 nt, Human
gggcaguucauuccaaauccagcacugcuguu

SEQ ID NO: 464500 - RNA, 32 nt, Human
gggcaguuccugaccagcaccccaccaagucc

SEQ ID NO: 464501 - RNA, 22 nt, Human
gggcaguugcgugacccugcug

SEQ ID NO: 464502 - RNA, 32 nt, Human
gggcaguuguuggagccccacccugggcugcc

SEQ ID NO: 464503 - RNA, 32 nt, Human
gggcauaaaggagcacucaauugcagagauuu

SEQ ID NO: 464504 - RNA, 32 nt, Human
gggcauaagggaugaaaacuuggccgagacua

SEQ ID NO: 464505 - RNA, 32 nt, Human
gggcauaauuuaugggcucagaaagggaagaa

SEQ ID NO: 464506 - RNA, 32 nt, Human
gggcauacaagaaacugcacgucuuuaaagug

SEQ ID NO: 464507 - RNA, 32 nt, Human
gggcauacacagaacgaacggggcagagaggu

SEQ ID NO: 464508 - RNA, 32 nt, Human
gggcauacagaagaaggcaggaguugauuuuu

SEQ ID NO: 464509 - RNA, 32 nt, Human
gggcauacagcauccgauuuaaucuggaucca

SEQ ID NO: 464510 - RNA, 32 nt, Human
gggcauacauguuagccaaaucuacacucagc

SEQ ID NO: 464511 - RNA, 18 nt, Human
gggcauaccacuucucca

SEQ ID NO: 464512 - RNA, 32 nt, Human
gggcauagaguagagaauagcuucauauguuu

SEQ ID NO: 464513 - RNA, 32 nt, Human
gggcauagagugaguggaugugaugggcugug

SEQ ID NO: 464514 - RNA, 20 nt, Human
gggcauagcagauggggcag

SEQ ID NO: 464515 - RNA, 32 nt, Human
gggcauagcuccaugucuucugacauuccugg

SEQ ID NO: 464516 - RNA, 24 nt, Human
gggcauaggagggagggccgcagc

SEQ ID NO: 464517 - RNA, 23 nt, Human
gggcauagugguggucaccugua

SEQ ID NO: 464518 - RNA, 22 nt, Human
gggcauaguuucacaaaagcuu

SEQ ID NO: 464519 - RNA, 18 nt, Human
gggcauauaagcuauggg

SEQ ID NO: 464520 - RNA, 32 nt, Human
gggcauauagugagacaguggcagggaaccca

SEQ ID NO: 464521 - RNA, 32 nt, Human
gggcauaugccccagccccuguaccaccccug

SEQ ID NO: 464522 - RNA, 32 nt, Human
gggcaucacccaggugaaugguguccagguga

SEQ ID NO: 464523 - RNA, 32 nt, Human
gggcaucagagaauggcauggaagagacaguc

SEQ ID NO: 464524 - RNA, 19 nt, Human
gggcaucagcuccagguca

SEQ ID NO: 464525 - RNA, 32 nt, Human
gggcaucagcuuucccuggcucagggaucuuc

SEQ ID NO: 464526 - RNA, 32 nt, Human
gggcaucaugagguagagaugggggcucgcau

SEQ ID NO: 464527 - RNA, 32 nt, Human
gggcaucaugaucuuugccuuccuugaaaaua

SEQ ID NO: 464528 - RNA, 32 nt, Human
gggcaucaugcuguaugggguggacagccgga

SEQ ID NO: 464529 - RNA, 20 nt, Human
gggcauccacgggcgccgag

SEQ ID NO: 464530 - RNA, 23 nt, Human
gggcauccagacgggauccagug

SEQ ID NO: 464531 - RNA, 23 nt, Human
gggcauccaggcagguccagcag

SEQ ID NO: 464532 - RNA, 32 nt, Human
gggcauccaguggcagcuccccaaaccaggcc

SEQ ID NO: 464533 - RNA, 32 nt, Human
gggcaucccggaagcugggaaaugggacuguu

SEQ ID NO: 464534 - RNA, 32 nt, Human
gggcaucccuagugaaggggcaaaccugagau

SEQ ID NO: 464535 - RNA, 19 nt, Human
gggcaucccugcaaaaggg

SEQ ID NO: 464536 - RNA, 32 nt, Human
gggcauccgggccugguagggacggggcgggu

SEQ ID NO: 464537 - RNA, 32 nt, Human
gggcauccguggugccuucuagcuuagaacca

SEQ ID NO: 464538 - RNA, 32 nt, Human
gggcauccugaacaaauacauggagauccaug

SEQ ID NO: 464539 - RNA, 32 nt, Human
gggcauccuggaccagcucuccacugaggagc

SEQ ID NO: 464540 - RNA, 32 nt, Human
gggcauccugggcccgggaagggaggccccug

SEQ ID NO: 464541 - RNA, 32 nt, Human
gggcauccuuguccuuugucuggcagacagcc

SEQ ID NO: 464542 - RNA, 32 nt, Human
gggcaucgaggggugcuuagccccagggcacu

SEQ ID NO: 464543 - RNA, 32 nt, Human
gggcaucgaugcugccccgggcuaccuggcug

SEQ ID NO: 464544 - RNA, 32 nt, Human
gggcaucgcugaggcccugagcaucccaggag

SEQ ID NO: 464545 - RNA, 16 nt, Human
gggcaucggggggcag

SEQ ID NO: 464546 - RNA, 21 nt, Human
gggcaucggucagcggggcag

SEQ ID NO: 464547 - RNA, 32 nt, Human
gggcaucguagugagacuccaucucugucuuu

SEQ ID NO: 464548 - RNA, 32 nt, Human
gggcaucuacccaagaagggagcacagggcaa

SEQ ID NO: 464549 - RNA, 19 nt, Human
gggcaucucaccacgacuu

SEQ ID NO: 464550 - RNA, 32 nt, Human
gggcaucucauccagggauucucaaaccaugu

SEQ ID NO: 464551 - RNA, 32 nt, Human
gggcaucucgacaaaaaggaauugaaagcccu

SEQ ID NO: 464552 - RNA, 32 nt, Human
gggcaucugaaaaaccuagaacaaguuuaacu

SEQ ID NO: 464553 - RNA, 32 nt, Human
gggcaucugggaggcucuggcugccuucugca

SEQ ID NO: 464554 - RNA, 20 nt, Human
gggcaucuggggaagggcag

SEQ ID NO: 464555 - RNA, 32 nt, Human
gggcaucuggugaucuuaggccugguuauuag

SEQ ID NO: 464556 - RNA, 32 nt, Human
gggcaucuguaauccuagcugcucgggaggcu

SEQ ID NO: 464557 - RNA, 32 nt, Human
gggcaucuguagucccagcuacucaggaggcu

SEQ ID NO: 464558 - RNA, 32 nt, Human
gggcaucugucugucugugggcuucagcacuu

SEQ ID NO: 464559 - RNA, 32 nt, Human
gggcaucugugauaccagcuacuugggaggcu

SEQ ID NO: 464560 - RNA, 32 nt, Human
gggcaucuuccagguggggaaacagucuuaga

SEQ ID NO: 464561 - RNA, 32 nt, Human
gggcaucuugccugcggggaccugugugugcc

SEQ ID NO: 464562 - RNA, 23 nt, Human
gggcaugaaaacaaagaaaugcc

SEQ ID NO: 464563 - RNA, 21 nt, Human
gggcaugaaaacaagaggucu

SEQ ID NO: 464564 - RNA, 32 nt, Human
gggcaugaaaguuguuuagauugucuucccag

SEQ ID NO: 464565 - RNA, 23 nt, Human
gggcaugaagacugagcaaagcu

SEQ ID NO: 464566 - RNA, 32 nt, Human
gggcaugaaggccucggaggcaacugugccug

SEQ ID NO: 464567 - RNA, 23 nt, Human
gggcaugacggcucaugccugua

SEQ ID NO: 464568 - RNA, 32 nt, Human
gggcaugagaccgagggugaggcuggaggguc

SEQ ID NO: 464569 - RNA, 32 nt, Human
gggcaugagaggcagagugcacaguggucaag

SEQ ID NO: 464570 - RNA, 32 nt, Human
gggcaugagccaccgcacccagcuugcauuga

SEQ ID NO: 464571 - RNA, 32 nt, Human
gggcaugagccacugcacccggcccugagaau

SEQ ID NO: 464572 - RNA, 32 nt, Human
gggcaugagccccugcgccugaccuucaacag

SEQ ID NO: 464573 - RNA, 32 nt, Human
gggcaugauaacacaucccuguagucccagcu

SEQ ID NO: 464574 - RNA, 23 nt, Human
gggcaugauggcucaugccugua

SEQ ID NO: 464575 - RNA, 23 nt, Human
gggcaugauggugguggccugua

SEQ ID NO: 464576 - RNA, 20 nt, Human
gggcaugcacuggggggcug

SEQ ID NO: 464577 - RNA, 32 nt, Human
gggcaugcagauuaguagaacuuucaaguaaa

SEQ ID NO: 464578 - RNA, 32 nt, Human
gggcaugccaggugccaaggagccaaacagau

SEQ ID NO: 464579 - RNA, 17 nt, Human
gggcaugccaugucuga

SEQ ID NO: 464580 - RNA, 32 nt, Human
gggcaugccuguaaucccagaauuuugggagg

SEQ ID NO: 464581 - RNA, 32 nt, Human
gggcaugccuguagucccagcuauucuggagg

SEQ ID NO: 464582 - RNA, 32 nt, Human
gggcaugcgugcaccauuccagcauccggcaa

SEQ ID NO: 464583 - RNA, 32 nt, Human
gggcauggaaccuggacacccucagcucuccu

SEQ ID NO: 464584 - RNA, 32 nt, Human
gggcauggaccagccuucagauggcagaagug

SEQ ID NO: 464585 - RNA, 32 nt, Human
gggcauggacuucaccuccugguccucucuuc

SEQ ID NO: 464586 - RNA, 32 nt, Human
gggcauggagaaaggugacccugaucccaaac

SEQ ID NO: 464587 - RNA, 32 nt, Human
gggcauggagccaccgggaccccaggaggaga

SEQ ID NO: 464588 - RNA, 32 nt, Human
gggcauggagcuucacuccuugcuggccaggg

SEQ ID NO: 464589 - RNA, 22 nt, Human
gggcauggcagggccaggccuc

SEQ ID NO: 464590 - RNA, 23 nt, Human
gggcauggccugcacaaaggucu

SEQ ID NO: 464591 - RNA, 21 nt, Human
gggcauggccugggucgcacc

SEQ ID NO: 464592 - RNA, 23 nt, Human
gggcaugggaaggauuuaacacc

SEQ ID NO: 464593 - RNA, 32 nt, Human
gggcaugggagagaggcaaguggaaaaugauu

SEQ ID NO: 464594 - RNA, 22 nt, Human
gggcaugggaggaaggaggcac

SEQ ID NO: 464595 - RNA, 32 nt, Human
gggcaugggauaggacaggagaggaggugaug

SEQ ID NO: 464596 - RNA, 32 nt, Human
gggcaugggauggugaccucagcuggaacaug

SEQ ID NO: 464597 - RNA, 32 nt, Human
gggcaugggcaggccagcuggccgagcuccug

SEQ ID NO: 464598 - RNA, 22 nt, Human
gggcauggggcgcagccgcgcc

SEQ ID NO: 464599 - RNA, 25 nt, Human
gggcauggguggauuuagccaagga

SEQ ID NO: 464600 - RNA, 32 nt, Human
gggcaugguagcaggugucuguuaucccaguu

SEQ ID NO: 464601 - RNA, 23 nt, Human
gggcauggugacacaugccugua

SEQ ID NO: 464602 - RNA, 23 nt, Human
gggcauggugaugcaugccugua

SEQ ID NO: 464603 - RNA, 32 nt, Human
gggcauggugcaugccuguaaucccagccacu

SEQ ID NO: 464604 - RNA, 32 nt, Human
gggcauggugcaugccuguaaucccagcugcu

SEQ ID NO: 464605 - RNA, 32 nt, Human
ggggaaagugcaguaccgucaucuucaagccu

SEQ ID NO: 464606 - RNA, 32 nt, Human
ggggaaaguguauccauauacacgcacaggug

SEQ ID NO: 464607 - RNA, 32 nt, Human
ggggaaauaaagugccuuacugacuguagcca

SEQ ID NO: 464608 - RNA, 32 nt, Human
ggggaaauauauucugauuccuaacaaccaac

SEQ ID NO: 464609 - RNA, 32 nt, Human
ggggaaaugcaggacugagaggcaacguggcu

SEQ ID NO: 464610 - RNA, 32 nt, Human
ggggaaauggccacugcagauggaguuuuaga

SEQ ID NO: 464611 - RNA, 32 nt, Human
ggggaaauggguaugagagacugaggcuugag

SEQ ID NO: 464612 - RNA, 32 nt, Human
ggggaaaugugugugucaguucugucagcugc

SEQ ID NO: 464613 - RNA, 32 nt, Human
ggggaacaaaggaaggagcaucagcagggucu

SEQ ID NO: 464614 - RNA, 31 nt, Human
ggggaacaaguguccuucagaacccagagaa

SEQ ID NO: 464615 - RNA, 21 nt, Human
ggggaacagagaagagacagg

SEQ ID NO: 464616 - RNA, 32 nt, Human
ggggaacagagauucagccaaagucaagaaac

SEQ ID NO: 464617 - RNA, 21 nt, Human
ggggaacagaugaauauuuca

SEQ ID NO: 464618 - RNA, 24 nt, Human
ggggaacagaugggacaauaaaga

SEQ ID NO: 464619 - RNA, 32 nt, Human
ggggaacagauguggccacaguccuuccugac

SEQ ID NO: 464620 - RNA, 32 nt, Human
ggggaacaggaaagucuggggagccacaggag

SEQ ID NO: 464621 - RNA, 32 nt, Human
ggggaacaggaugcccagcccagggggcaagg

SEQ ID NO: 464622 - RNA, 32 nt, Human
ggggaacaggcagaggggcgguaaggaagggc

SEQ ID NO: 464623 - RNA, 32 nt, Human
ggggaacaggcagugaggaaggagacaggggu

SEQ ID NO: 464624 - RNA, 32 nt, Human
ggggaacagggcggagcugagcuuaaaaucgg

SEQ ID NO: 464625 - RNA, 32 nt, Human
ggggaacauggcaagaccccaucucuacaaaa

SEQ ID NO: 464626 - RNA, 22 nt, Human
ggggaaccacauugauauucua

SEQ ID NO: 464627 - RNA, 28 nt, Human
ggggaacccaagccaagcgccugccuuu

SEQ ID NO: 464628 - RNA, 28 nt, Human
ggggaacccaaguguggcagcugccucu

SEQ ID NO: 464629 - RNA, 32 nt, Human
ggggaacccacugccggagcaguccuaucaca

SEQ ID NO: 464630 - RNA, 32 nt, Human
ggggaacccacuguaugccccucuccagcauu

SEQ ID NO: 464631 - RNA, 28 nt, Human
ggggaacccaggcaucacaccugccucu

SEQ ID NO: 464632 - RNA, 28 nt, Human
ggggaacccaggcugugcgccugccccu

SEQ ID NO: 464633 - RNA, 28 nt, Human
ggggaacccaggugcaccgccugccucu

SEQ ID NO: 464634 - RNA, 28 nt, Human
ggggaacccgaacucgcggccugccucu

SEQ ID NO: 464635 - RNA, 28 nt, Human
ggggaacccgaauguggcggcugccucu

SEQ ID NO: 464636 - RNA, 28 nt, Human
ggggaacccggacucagcuccugccucu

SEQ ID NO: 464637 - RNA, 32 nt, Human
ggggaaccuaggcagggcuggcuuucuuagcg

SEQ ID NO: 464638 - RNA, 18 nt, Human
ggggaacgcaauauucca

SEQ ID NO: 464639 - RNA, 28 nt, Human
ggggaacuaagugcugacuaguuuguuu

SEQ ID NO: 464640 - RNA, 32 nt, Human
ggggaacuaggagagcaggaguagaagugaga

SEQ ID NO: 464641 - RNA, 32 nt, Human
ggggaacuaucuuccuugauguuaacauuuca

SEQ ID NO: 464642 - RNA, 32 nt, Human
ggggaacucgcagccuugcagcgcggguggga

SEQ ID NO: 464643 - RNA, 32 nt, Human
ggggaacugcucacugacagcuucucuguaac

SEQ ID NO: 464644 - RNA, 32 nt, Human
ggggaacuugcagcuuaaagccagccaccccc

SEQ ID NO: 464645 - RNA, 32 nt, Human
ggggaacuuguagccagaaugcccuguucaug

SEQ ID NO: 464646 - RNA, 32 nt, Human
ggggaagaaagaacaagaaagucagaccugag

SEQ ID NO: 464647 - RNA, 32 nt, Human
ggggaagaaaugggcccagccccacauggccu

SEQ ID NO: 464648 - RNA, 32 nt, Human
ggggaagaaggaggagaagaugaagaagcacc

SEQ ID NO: 464649 - RNA, 21 nt, Human
ggggaagaaucaaagagcaga

SEQ ID NO: 464650 - RNA, 32 nt, Human
ggggaagaaugcaggagggguaggauuucuuu

SEQ ID NO: 464651 - RNA, 23 nt, Human
ggggaagaauugaaagagagaga

SEQ ID NO: 464652 - RNA, 17 nt, Human
ggggaagacagccggcc

SEQ ID NO: 464653 - RNA, 15 nt, Human
ggggaagacaggaau

SEQ ID NO: 464654 - RNA, 32 nt, Human
ggggaagacauugucucucaaaggggccagac

SEQ ID NO: 464655 - RNA, 32 nt, Human
ggggaagaccuagaacccuuuccccagcacuu

SEQ ID NO: 464656 - RNA, 22 nt, Human
ggggaagacugagagagacaga

SEQ ID NO: 464657 - RNA, 32 nt, Human
ggggaagagaggaggggagaggagaagggaaa

SEQ ID NO: 464658 - RNA, 32 nt, Human
ggggaagagaggcacagacacagauaggagaa

SEQ ID NO: 464659 - RNA, 32 nt, Human
ggggaagagaggcagagagggaaagaggcaga

SEQ ID NO: 464660 - RNA, 32 nt, Human
ggggaagagaggcaggcucucaguccccgcuu

SEQ ID NO: 464661 - RNA, 32 nt, Human
ggggaagagagggaagagaaagcacagagcag

SEQ ID NO: 464662 - RNA, 32 nt, Human
ggggaagagcagcuccaggagucaggcaaccu

SEQ ID NO: 464663 - RNA, 32 nt, Human
ggggaagagcucgccugcuccugagggaagca

SEQ ID NO: 464664 - RNA, 32 nt, Human
ggggaagaggaacccuuguucucugcaaggga

SEQ ID NO: 464665 - RNA, 32 nt, Human
ggggaagaggacacgcagaggagcagcuggcu

SEQ ID NO: 464666 - RNA, 32 nt, Human
ggggaagaggagaagaggguaagggggcuuca

SEQ ID NO: 464667 - RNA, 32 nt, Human
ggggaagaggaggaggagguuguugaugacac

SEQ ID NO: 464668 - RNA, 32 nt, Human
ggggaagagggacuggcucucagucccugccu

SEQ ID NO: 464669 - RNA, 32 nt, Human
ggggaagaggggcuggcucucaguccccgacu

SEQ ID NO: 464670 - RNA, 32 nt, Human
ggggaagaggggcuggcucucaguccccgccu

SEQ ID NO: 464671 - RNA, 32 nt, Human
ggggaagaggggcuggcucucaguccccgucu

SEQ ID NO: 464672 - RNA, 32 nt, Human
ggggaagaggggcuggcucucagucccugccu

SEQ ID NO: 464673 - RNA, 32 nt, Human
ggggaagaggggcugguucucaguccccgccu

SEQ ID NO: 464674 - RNA, 32 nt, Human
ggggaagagguucuggcucucaguccccgccu

SEQ ID NO: 464675 - RNA, 32 nt, Human
ggggaagaguagacacugcugaaggaaagaac

SEQ ID NO: 464676 - RNA, 32 nt, Human
ggggaagaguccaaggaagggagggagcagcc

SEQ ID NO: 464677 - RNA, 22 nt, Human
ggggaagauagagaaaagcaga

SEQ ID NO: 464678 - RNA, 32 nt, Human
ggggaagauggacccggcgcccucgcugggcu

SEQ ID NO: 464679 - RNA, 32 nt, Human
ggggaagauggcggcguccucccuggaacaga

SEQ ID NO: 464680 - RNA, 32 nt, Human
ggggaagcaaaaggcugccucggguguuuuaa

SEQ ID NO: 464681 - RNA, 32 nt, Human
ggggaagcaaaugaauucucagaggaaguggu

SEQ ID NO: 464682 - RNA, 18 nt, Human
ggggaagcagcagcggcc

SEQ ID NO: 464683 - RNA, 32 nt, Human
ggggaagcauggggauccgggagaagcaccca

SEQ ID NO: 464684 - RNA, 32 nt, Human
ggggaagccaccucaccucccuagagccucug

SEQ ID NO: 464685 - RNA, 32 nt, Human
ggggaagccccaggaaacgcacaugcccacac

SEQ ID NO: 464686 - RNA, 32 nt, Human
ggggaagccgcccugcgguucaucucacagcg

SEQ ID NO: 464687 - RNA, 32 nt, Human
ggggaagccggucacauggacacaccugugca

SEQ ID NO: 464688 - RNA, 32 nt, Human
ggggaagccugagguagucaacccaggagcca

SEQ ID NO: 464689 - RNA, 18 nt, Human
ggggaagcgagcccgccg

SEQ ID NO: 464690 - RNA, 32 nt, Human
ggggaagcgugugagagagugagaccgacaga

SEQ ID NO: 464691 - RNA, 32 nt, Human
ggggaagcugagagacagaggaggaacucaga

SEQ ID NO: 464692 - RNA, 32 nt, Human
ggggaagcuucaaaauauaucugugacucugu

SEQ ID NO: 464693 - RNA, 32 nt, Human
ggggaaggaacacuguaggggauagcugucca

SEQ ID NO: 464694 - RNA, 22 nt, Human
ggggaaggaacggcgaggccgg

SEQ ID NO: 464695 - RNA, 32 nt, Human
ggggaaggaagggcaugaggaauggccccggc

SEQ ID NO: 464696 - RNA, 32 nt, Human
ggggaaggacaguguggugugacuauuggcuu

SEQ ID NO: 464697 - RNA, 20 nt, Human
ggggaaggagaagagacuga

SEQ ID NO: 464698 - RNA, 32 nt, Human
ggggaaggagagaagggcagcucaggguggau

SEQ ID NO: 464699 - RNA, 32 nt, Human
ggggaaggagcacggggcugaucaagccaucc

SEQ ID NO: 464700 - RNA, 32 nt, Human
ggggaaggagccaagauggccgaauaggaaca

SEQ ID NO: 464701 - RNA, 32 nt, Human
ggggaaggagcucauccaggaggacugggauc

SEQ ID NO: 464702 - RNA, 32 nt, Human
ggggaaggaggaggagcuuaaaagaggcuacu

SEQ ID NO: 464703 - RNA, 32 nt, Human
ggggaaggaggcggugguggaggaggcaaagg

SEQ ID NO: 464704 - RNA, 32 nt, Human
ggggaaggauuuaugaauacaccaccaccaga

SEQ ID NO: 464705 - RNA, 32 nt, Human
ggggaaggcagcgccucucuagcuacucaagg

SEQ ID NO: 464706 - RNA, 32 nt, Human
ggggaaggccguugcgcagccuggaggaagcg

SEQ ID NO: 464707 - RNA, 32 nt, Human
ggggaaggcggggcuggugacaaggcagggca

SEQ ID NO: 464708 - RNA, 32 nt, Human
ggggaagggaaagaaagacagaggagagagag

SEQ ID NO: 464709 - RNA, 32 nt, Human
ggggaagggaaagacuggggagggagagugaa

SEQ ID NO: 464710 - RNA, 32 nt, Human
ggggaagggaaagguaugagggaaagagaguc

SEQ ID NO: 464711 - RNA, 18 nt, Human
ggggaagggaagaggcag

SEQ ID NO: 464712 - RNA, 32 nt, Human
ggggaagggaagggagaggcaagcuggcugug

SEQ ID NO: 464713 - RNA, 32 nt, Human
ggggaagggaggagggagagggaggacaggga

SEQ ID NO: 464714 - RNA, 32 nt, Human
ggggaagggcacacccccugcccaugcauggu

SEQ ID NO: 464715 - RNA, 32 nt, Human
ggggaagggcagggguguggagagggggugcc

SEQ ID NO: 464716 - RNA, 32 nt, Human
ggggaagggcgagcagcgggaggcacgggcuc

SEQ ID NO: 464717 - RNA, 32 nt, Human
ggggaaggggaaagagggaggaaggggagggg

SEQ ID NO: 464718 - RNA, 32 nt, Human
ggggaaggggaggaaagaggaaaacaaaggga

SEQ ID NO: 464719 - RNA, 32 nt, Human
ggggaaggggcagagccaacuccagaggcgga

SEQ ID NO: 464720 - RNA, 32 nt, Human
ggggaaggggcagugucugacagagaguggga

SEQ ID NO: 464721 - RNA, 32 nt, Human
ggggaaggggcugggagccaggguacuccaau

SEQ ID NO: 464722 - RNA, 32 nt, Human
ggggaaggggugacugaacugggaguccaggg

SEQ ID NO: 464723 - RNA, 32 nt, Human
ggggaagggucaggaugagaggcugcagccuc

SEQ ID NO: 464724 - RNA, 32 nt, Human
ggggaagggucugaaucccacccuuggcauug

SEQ ID NO: 464725 - RNA, 32 nt, Human
ggggaagggugaguuuacaggugaggaguggc

SEQ ID NO: 464726 - RNA, 32 nt, Human
ggggaaggugugagucgugaacggcccggguc

SEQ ID NO: 464727 - RNA, 32 nt, Human
ggggaaguaccacaaacauagagcagagacuu

SEQ ID NO: 464728 - RNA, 32 nt, Human
ggggaaguaguaaaccaaaaagacagggaaaa

SEQ ID NO: 464729 - RNA, 32 nt, Human
ggggaaguauggugaauaaacugacaugcaug

SEQ ID NO: 464730 - RNA, 32 nt, Human
ggggaaguccagggaggcucauggacaguggc

SEQ ID NO: 464731 - RNA, 32 nt, Human
ggggaagucuguucuuugguauggaauuuuuc

SEQ ID NO: 464732 - RNA, 32 nt, Human
ggggaagugcguguguugggccagguaggaua

SEQ ID NO: 464733 - RNA, 32 nt, Human
ggggaagugcugggaagggaaggguguggucc

SEQ ID NO: 464734 - RNA, 32 nt, Human
ggggaaguggccucugucagggccagggcuca

SEQ ID NO: 464735 - RNA, 32 nt, Human
ggggaaguucugccuuucugaucaaucuuuug

SEQ ID NO: 464736 - RNA, 32 nt, Human
ggggaauagaagggagaaagagaauaucaugg

SEQ ID NO: 464737 - RNA, 32 nt, Human
ggggaauagacccauuccuuccccugucucag

SEQ ID NO: 464738 - RNA, 32 nt, Human
ggggaauaggaguuuggauagccuucuaauua

SEQ ID NO: 464739 - RNA, 32 nt, Human
ggggaauagggaggggaggagaggagaggaga

SEQ ID NO: 464740 - RNA, 32 nt, Human
ggggaaucaguggaugaagacgucccuccucc

SEQ ID NO: 464741 - RNA, 32 nt, Human
ggggaauccuucucagagguuugaaaggagac

SEQ ID NO: 464742 - RNA, 32 nt, Human
ggggaaugaccaggcagccacagggaggacau

SEQ ID NO: 464743 - RNA, 32 nt, Human
ggggaaugaggugauaagcaaggaggguguaa

SEQ ID NO: 464744 - RNA, 32 nt, Human
ggggaaugcaacgugaggccaacugaacaauu

SEQ ID NO: 464745 - RNA, 32 nt, Human
ggggaaugcacuggcccuagaccucaacucua

SEQ ID NO: 464746 - RNA, 32 nt, Human
ggggaauggagugcucauuugcagaggcuaau

SEQ ID NO: 464747 - RNA, 32 nt, Human
ggggaauggcccaggcgggcugcgguuccucc

SEQ ID NO: 464748 - RNA, 32 nt, Human
ggggaaugggaugaauccccaucugugccucg

SEQ ID NO: 464749 - RNA, 32 nt, Human
ggggaaugggauggggacagcauuugauuuac

SEQ ID NO: 464750 - RNA, 32 nt, Human
ggggaaugucuggcuuuuccucagcuuauuga

SEQ ID NO: 464751 - RNA, 32 nt, Human
ggggaaugugccugcugaaucuguaccugagc

SEQ ID NO: 464752 - RNA, 32 nt, Human
ggggaauguggggaucagggagguggagggac

SEQ ID NO: 464753 - RNA, 22 nt, Human
ggggaauuaacuggacauuuca

SEQ ID NO: 464754 - RNA, 32 nt, Human
ggggaauuauaaggauaccauuuguaagaaag

SEQ ID NO: 464755 - RNA, 32 nt, Human
ggggaauugcugcucuuuaccaaagaaugguu

SEQ ID NO: 464756 - RNA, 32 nt, Human
ggggacaaaaagucuauuuuuccuucacuuuu

SEQ ID NO: 464757 - RNA, 32 nt, Human
ggggacaaaaggaaaccucugacuugcuaaug

SEQ ID NO: 464758 - RNA, 32 nt, Human
ggggacaacgccuguggcuggguccggaggug

SEQ ID NO: 464759 - RNA, 32 nt, Human
ggggacaaguuguguuucuguuuuccgccacg

SEQ ID NO: 464760 - RNA, 32 nt, Human
ggggacaaugucccaccuuggagcucuccuug

SEQ ID NO: 464761 - RNA, 32 nt, Human
ggggacacaaauucuguugccugguggaaaga

SEQ ID NO: 464762 - RNA, 32 nt, Human
ggggacacaaccugcuggagugcaauggcacg

SEQ ID NO: 464763 - RNA, 18 nt, Human
ggggacacacagcuucca

SEQ ID NO: 464764 - RNA, 32 nt, Human
ggggacacagcccaaccauaucagaggccuug

SEQ ID NO: 464765 - RNA, 32 nt, Human
ggggacacaggagaaaccaggccaggcccauc

SEQ ID NO: 464766 - RNA, 32 nt, Human
ggggacacaggggcuguguccuggccaaggcc

SEQ ID NO: 464767 - RNA, 19 nt, Human
ggggacacaguggcuucca

SEQ ID NO: 464768 - RNA, 19 nt, Human
ggggacacaugggugucca

SEQ ID NO: 464769 - RNA, 32 nt, Human
ggggacaccaacacccaaggccagacccaaau

SEQ ID NO: 464770 - RNA, 18 nt, Human
ggggacaccggcacucca

SEQ ID NO: 464771 - RNA, 32 nt, Human
ggggacaccucaggagcuuuacucauggcaga

SEQ ID NO: 464772 - RNA, 19 nt, Human
ggggacaccuguacauucu

SEQ ID NO: 464773 - RNA, 32 nt, Human
ggggacaccuuucuuuugccacccugaauugc

SEQ ID NO: 464774 - RNA, 32 nt, Human
ggggacacgagacagagggaguucuccguaau

SEQ ID NO: 464775 - RNA, 23 nt, Human
ggggacacgggcagcucagguca

SEQ ID NO: 464776 - RNA, 20 nt, Human
ggggacacuggcugcauucc

SEQ ID NO: 464777 - RNA, 20 nt, Human
ggggacacuuaacaaaucca

SEQ ID NO: 464778 - RNA, 18 nt, Human
ggggacacuuggggucca

SEQ ID NO: 464779 - RNA, 20 nt, Human
ggggacacuuucagcuucua

SEQ ID NO: 464780 - RNA, 32 nt, Human
ggggacagaagcugcaggggagagggaagcag

SEQ ID NO: 464781 - RNA, 32 nt, Human
ggggacagaagggguccucucguccuccccuc

SEQ ID NO: 464782 - RNA, 32 nt, Human
ggggacagagagagucugagcucuguuaacag

SEQ ID NO: 464783 - RNA, 32 nt, Human
ggggacagagagauucacgcacccucaagagu

SEQ ID NO: 464784 - RNA, 32 nt, Human
ggggacagaggaaggccuccugagggaggggc

SEQ ID NO: 464785 - RNA, 18 nt, Human
ggggacagaggccagcug

SEQ ID NO: 464786 - RNA, 32 nt, Human
ggggacagagggcaggacgcccaggcuggggg

SEQ ID NO: 464787 - RNA, 32 nt, Human
ggggacagagguggccgggacgugagcuguga

SEQ ID NO: 464788 - RNA, 32 nt, Human
ggggacagaguguccuuccucuguccucucau

SEQ ID NO: 464789 - RNA, 22 nt, Human
ggggacagauuaugaaauuuca

SEQ ID NO: 464790 - RNA, 19 nt, Human
ggggacagcgaaccgaggg

SEQ ID NO: 464791 - RNA, 32 nt, Human
ggggacagcuccagcagcucaggcuccagccc

SEQ ID NO: 464792 - RNA, 18 nt, Human
ggggacagcuccaggccg

SEQ ID NO: 464793 - RNA, 32 nt, Human
ggggacagcuggacggcugccucccaggggca

SEQ ID NO: 464794 - RNA, 32 nt, Human
ggggacaggagacggcccugcugcggacggag

SEQ ID NO: 464795 - RNA, 32 nt, Human
ggggacaggagugggagcagggagauaggaga

SEQ ID NO: 464796 - RNA, 32 nt, Human
ggggacaggcagcggggcaguggugaucagga

SEQ ID NO: 464797 - RNA, 23 nt, Human
ggggacaggcagggaaaaggggu

SEQ ID NO: 464798 - RNA, 32 nt, Human
ggggacagggaguggggcaggcagugguuggu

SEQ ID NO: 464799 - RNA, 32 nt, Human
ggggacagggcaggcccggaccagugccucac

SEQ ID NO: 464800 - RNA, 32 nt, Human
ggggacaggggcaggaggaagggguaggauua

SEQ ID NO: 464801 - RNA, 32 nt, Human
ggggacagggguuucucuuucuggccuaagga

SEQ ID NO: 464802 - RNA, 18 nt, Human
ggggacaggugacagugg

SEQ ID NO: 464803 - RNA, 32 nt, Human
ggggacaguaagguuuggaggaagggggaucg

SEQ ID NO: 464804 - RNA, 22 nt, Human
ggggacagugagucuccagguc

SEQ ID NO: 464805 - RNA, 32 nt, Human
ggggacaguggagccucugagcagaggacucc

SEQ ID NO: 464806 - RNA, 23 nt, Human
ggggacauacaggcccacaggga

SEQ ID NO: 464807 - RNA, 21 nt, Human
ggggacauagugacaauuucu

SEQ ID NO: 464808 - RNA, 32 nt, Human
ggggacaucaggguagcugaaggaaauccaca

SEQ ID NO: 464809 - RNA, 32 nt, Human
ggggacaucggaaaggagggaccccgccaccc

SEQ ID NO: 464810 - RNA, 21 nt, Human
ggggacaugagguucaguucu

SEQ ID NO: 464811 - RNA, 23 nt, Human
ggggacaugaguaaagcaugucu

SEQ ID NO: 464812 - RNA, 18 nt, Human
ggggacaugaguuuucca

SEQ ID NO: 464813 - RNA, 24 nt, Human
ggggacaugaguuuuccagcuuuu

SEQ ID NO: 464814 - RNA, 32 nt, Human
ggggacaugccagcuacacuggccuuggcgcc

SEQ ID NO: 464815 - RNA, 32 nt, Human
ggggacaugggcgauuccaaaagcaccgagga

SEQ ID NO: 464816 - RNA, 18 nt, Human
ggggacauuaauagucca

SEQ ID NO: 464817 - RNA, 21 nt, Human
ggggacauuauauauaugcca

SEQ ID NO: 464818 - RNA, 21 nt, Human
ggggacauugcccccauuuca

SEQ ID NO: 464819 - RNA, 32 nt, Human
ggggacauuggaaaggagggaccccgccaccc

SEQ ID NO: 464820 - RNA, 32 nt, Human
ggggaccaacagcuggccgaggcucagggaua

SEQ ID NO: 464821 - RNA, 32 nt, Human
ggggaccaauaugccaggcaugggcuuuuauc

SEQ ID NO: 464822 - RNA, 18 nt, Human
ggggaccacgggccacug

SEQ ID NO: 464823 - RNA, 32 nt, Human
ggggaccacucuuccucuguccuuccucucuc

SEQ ID NO: 464824 - RNA, 19 nt, Human
ggggaccagaacugugugg

SEQ ID NO: 464825 - RNA, 32 nt, Human
ggggaccagcagcugcuuccacccagaacaag

SEQ ID NO: 464826 - RNA, 32 nt, Human
ggggaccagcccacagcacaccaagguggccc

SEQ ID NO: 464827 - RNA, 32 nt, Human
ggggaccagcccaggccgcuguuuccacaaaa

SEQ ID NO: 464828 - RNA, 32 nt, Human
ggggaccaggagaaagucaggaucccuaagag

SEQ ID NO: 464829 - RNA, 32 nt, Human
ggggaccaggagacuuuaaaggaguuuggggu

SEQ ID NO: 464830 - RNA, 32 nt, Human
ggggaccaggcaccugguugaagggacuggga

SEQ ID NO: 464831 - RNA, 32 nt, Human
ggggaccaggcagccacugugcaucagauagg

SEQ ID NO: 464832 - RNA, 32 nt, Human
ggggaccagucauuuauuuuccauuuuguugc

SEQ ID NO: 464833 - RNA, 32 nt, Human
ggggaccauggccugcccucagucugcuaggu

SEQ ID NO: 464834 - RNA, 32 nt, Human
ggggaccaugggacuccuccagccuggcucuu

SEQ ID NO: 464835 - RNA, 32 nt, Human
ggggaccaugggguggcagggaagggacaggc

SEQ ID NO: 464836 - RNA, 32 nt, Human
ggggacccaaagauucuagugagucaacaucc

SEQ ID NO: 464837 - RNA, 32 nt, Human
ggggacccacacccuggcugggcagaggugcu

SEQ ID NO: 464838 - RNA, 24 nt, Human
ggggacccagacauccugucccca

SEQ ID NO: 464839 - RNA, 32 nt, Human
ggggacccagauuuucuuuucuuaugccauug

SEQ ID NO: 464840 - RNA, 17 nt, Human
ggggacccagccagggg

SEQ ID NO: 464841 - RNA, 32 nt, Human
ggggacccaggacaccuggccacggggaggcg

SEQ ID NO: 464842 - RNA, 19 nt, Human
ggggacccaggacccucca

SEQ ID NO: 464843 - RNA, 20 nt, Human
ggggacccauggucugugga

SEQ ID NO: 464844 - RNA, 32 nt, Human
ggggaccccacacacauguggcuaccauacuc

SEQ ID NO: 464845 - RNA, 19 nt, Human
ggggaccccucugucucca

SEQ ID NO: 464846 - RNA, 18 nt, Human
ggggaccccugcccccca

SEQ ID NO: 464847 - RNA, 32 nt, Human
ggggaccccuggaaagugggggcugugccucc

SEQ ID NO: 464848 - RNA, 32 nt, Human
ggggacccgagccugcagccgagcuccgcugc

SEQ ID NO: 464849 - RNA, 21 nt, Human
ggggacccggggaggggccgc

SEQ ID NO: 464850 - RNA, 32 nt, Human
ggggacccuacccccaccucagguugggcuuc

SEQ ID NO: 464851 - RNA, 32 nt, Human
ggggacccuccagaagcccagccggcuucccc

SEQ ID NO: 464852 - RNA, 23 nt, Human
ggggacccucccacccaccgcca

SEQ ID NO: 464853 - RNA, 32 nt, Human
ggggacccugaagaaagggggccagcagcagg

SEQ ID NO: 464854 - RNA, 32 nt, Human
ggggacccugcacccuccgggaagccauggag

SEQ ID NO: 464855 - RNA, 32 nt, Human
ggggacccugcucggucagugguccuggugau

SEQ ID NO: 464856 - RNA, 32 nt, Human
ggggaccgcuuucugcaauuggccucgacacu

SEQ ID NO: 464857 - RNA, 19 nt, Human
ggggaccggagcggcccgg

SEQ ID NO: 464858 - RNA, 32 nt, Human
ggggaccggggagggggcgggggccgggccgg

SEQ ID NO: 464859 - RNA, 32 nt, Human
ggggaccugaguuugggugggguggcaguugg

SEQ ID NO: 464860 - RNA, 32 nt, Human
ggggaccugcagcacugcagaaaugccucugc

SEQ ID NO: 464861 - RNA, 32 nt, Human
ggggaccugcagccacaacuucucugguccuc

SEQ ID NO: 464862 - RNA, 32 nt, Human
ggggaccugcagcccgccaugccugagccucc

SEQ ID NO: 464863 - RNA, 32 nt, Human
ggggaccugcccacgcugucuccuggaggccu

SEQ ID NO: 464864 - RNA, 32 nt, Human
ggggaccugccugcuccuuuggcuugggcucu

SEQ ID NO: 464865 - RNA, 32 nt, Human
ggggaccugcuauucuucgaggcaguggaccc

SEQ ID NO: 464866 - RNA, 32 nt, Human
ggggaccuggggacucgggugcugggagugug

SEQ ID NO: 464867 - RNA, 32 nt, Human
ggggaccuucuuccagaugccuucccaguugu

SEQ ID NO: 464868 - RNA, 32 nt, Human
ggggaccuugauagagaacuuuauaaacuucu

SEQ ID NO: 464869 - RNA, 32 nt, Human
ggggacgaagugagaacagagacccagaagga

SEQ ID NO: 464870 - RNA, 32 nt, Human
ggggacgacccugagcucgagcuccagggcgg

SEQ ID NO: 464871 - RNA, 32 nt, Human
ggggacgacucagaguuggggucucacugugu

SEQ ID NO: 464872 - RNA, 32 nt, Human
ggggacgaggggcaagaagcggccuccgaggg

SEQ ID NO: 464873 - RNA, 32 nt, Human
ggggacgcgcgggucuggaggagguagcgcgg

SEQ ID NO: 464874 - RNA, 32 nt, Human
ggggacgcgggauggaacacaccccacacagc

SEQ ID NO: 464875 - RNA, 21 nt, Human
ggggacgcucagggcuuucca

SEQ ID NO: 464876 - RNA, 32 nt, Human
ggggacgcuggcacugguggggagcuguuggg

SEQ ID NO: 464877 - RNA, 19 nt, Human
ggggacggaaggaggcgac

SEQ ID NO: 464878 - RNA, 32 nt, Human
ggggacggaggagggaaugagugaagaggagc

SEQ ID NO: 464879 - RNA, 32 nt, Human
ggggacggcagcaguagcgggagcagcagcgu

SEQ ID NO: 464880 - RNA, 32 nt, Human
ggggacggccacucccuggcugagggcccucc

SEQ ID NO: 464881 - RNA, 24 nt, Human
ggggacggcgcggagcgggugcgg

SEQ ID NO: 464882 - RNA, 20 nt, Human
ggggacgggaugaggagcgg

SEQ ID NO: 464883 - RNA, 32 nt, Human
ggggacgggccaggcugggccaggucgggggc

SEQ ID NO: 464884 - RNA, 32 nt, Human
ggggacgggcguccgcugucuccuggguuccc

SEQ ID NO: 464885 - RNA, 19 nt, Human
ggggacggggcggggaccg

SEQ ID NO: 464886 - RNA, 32 nt, Human
ggggacggggucaggacugagacagcuccaca

SEQ ID NO: 464887 - RNA, 32 nt, Human
ggggacggguguuccuucugggugggggccug

SEQ ID NO: 464888 - RNA, 23 nt, Human
ggggacgguguauggaggggagg

SEQ ID NO: 464889 - RNA, 32 nt, Human
ggggacuaagcuggggacagggcaggcccgga

SEQ ID NO: 464890 - RNA, 18 nt, Human
ggggacucaaacauucca

SEQ ID NO: 464891 - RNA, 32 nt, Human
ggggacucaaagccaaaacugcccaaagagga

SEQ ID NO: 464892 - RNA, 32 nt, Human
ggggacucaacagcagagcucugagcagcagc

SEQ ID NO: 464893 - RNA, 22 nt, Human
ggggacucagaggaagugucca

SEQ ID NO: 464894 - RNA, 32 nt, Human
ggggacucagcgggccagagagcgcggcgggc

SEQ ID NO: 464895 - RNA, 32 nt, Human
ggggacuccagcccgcgcucuuccgcaccccu

SEQ ID NO: 464896 - RNA, 32 nt, Human
ggggacuccagccugggcggggugauaaugaa

SEQ ID NO: 464897 - RNA, 32 nt, Human
ggggacuccagggguggcugggagacugggca

SEQ ID NO: 464898 - RNA, 32 nt, Human
ggggacuccaguaccuggagaugugauuccau

SEQ ID NO: 464899 - RNA, 32 nt, Human
ggggacuccauggcuuccgaguugcugacuga

SEQ ID NO: 464900 - RNA, 32 nt, Human
ggggacucugcaccaggaucuccagggcccac

SEQ ID NO: 464901 - RNA, 32 nt, Human
ggggacucuucuucaaagagcuugccaaugaa

SEQ ID NO: 464902 - RNA, 32 nt, Human
ggggacucuuuccaccaucagggcuggaagga

SEQ ID NO: 464903 - RNA, 32 nt, Human
ggggacugacucuggcaucucugccgaggcug

SEQ ID NO: 464904 - RNA, 32 nt, Human
ggggacugagagcccagcucugaaaagugcau

SEQ ID NO: 464905 - RNA, 32 nt, Human
ggggacugagccaccagccugacacccagaag

SEQ ID NO: 464906 - RNA, 32 nt, Human
ggggacugagcuggggagggaggcaggugggu

SEQ ID NO: 464907 - RNA, 32 nt, Human
ggggacugaggcccuggcggaucacgggugcc

SEQ ID NO: 464908 - RNA, 32 nt, Human
ggggacugaguuguuugggucaccucugcagg

SEQ ID NO: 464909 - RNA, 32 nt, Human
ggggacugauaagugcuuuaagcaauguccau

SEQ ID NO: 464910 - RNA, 32 nt, Human
ggggacugaucaggaagauauauuccugcaua

SEQ ID NO: 464911 - RNA, 32 nt, Human
ggggacugauggguucaggugggagcugcugg

SEQ ID NO: 464912 - RNA, 32 nt, Human
ggggacugcaccuuagaagccugcucugcauc

SEQ ID NO: 464913 - RNA, 32 nt, Human
ggggacugccuggccuuccagaugcgaacugg

SEQ ID NO: 464914 - RNA, 32 nt, Human
ggggacugcgguggacaccagaggaagcuguu

SEQ ID NO: 464915 - RNA, 30 nt, Human
ggggacugcucaauacagauacgguggacg

SEQ ID NO: 464916 - RNA, 32 nt, Human
ggggacugcucacggauaaggucuccccaacu

SEQ ID NO: 464917 - RNA, 32 nt, Human
ggggacugcugcugccuggccacugcucccua

SEQ ID NO: 464918 - RNA, 32 nt, Human
ggggacuggaaugaccuccugaccacucccuc

SEQ ID NO: 464919 - RNA, 21 nt, Human
ggggacuggcaaaacauucca

SEQ ID NO: 464920 - RNA, 29 nt, Human
ggggacuggcugcugugaucuucuaaggg

SEQ ID NO: 464921 - RNA, 32 nt, Human
ggggacugggagaagcagaagccggugccggu

SEQ ID NO: 464922 - RNA, 20 nt, Human
ggggacugggagcaguucca

SEQ ID NO: 464923 - RNA, 32 nt, Human
ggggacugggcugagaggguggacgaguucag

SEQ ID NO: 464924 - RNA, 32 nt, Human
ggggacuggggugcaggugaaggaggcucuca

SEQ ID NO: 464925 - RNA, 32 nt, Human
ggggacuguccaccccuccuuccagggcccag

SEQ ID NO: 464926 - RNA, 32 nt, Human
ggggacuguccuggguggagggcaggugaaca

SEQ ID NO: 464927 - RNA, 32 nt, Human
ggggacuguggacccauaauuucagccccagc

SEQ ID NO: 464928 - RNA, 32 nt, Human
ggggacuguggaccccacccugcugcacggag

SEQ ID NO: 464929 - RNA, 32 nt, Human
ggggacuguggccugggcugaucuugagccuu

SEQ ID NO: 464930 - RNA, 32 nt, Human
ggggacuuacuacccaaauucaucacauuagu

SEQ ID NO: 464931 - RNA, 32 nt, Human
ggggacuuccuaagcucugacagucuaauauu

SEQ ID NO: 464932 - RNA, 32 nt, Human
ggggacuugaaccucuucuaacuuugaacaag

SEQ ID NO: 464933 - RNA, 32 nt, Human
ggggacuuggccgcuucccuacccacagggcc

SEQ ID NO: 464934 - RNA, 32 nt, Human
ggggacuuucucaugugccugaugugguggag

SEQ ID NO: 464935 - RNA, 32 nt, Human
ggggagaaaaguuggccucccaaaauuucugu

SEQ ID NO: 464936 - RNA, 32 nt, Human
ggggagaaacagaagcccagagagggaaaggg

SEQ ID NO: 464937 - RNA, 32 nt, Human
ggggagaaacccugaacuccagccaggucuua

SEQ ID NO: 464938 - RNA, 22 nt, Human
ggggagaaacuugauucuggga

SEQ ID NO: 464939 - RNA, 19 nt, Human
ggggagaaaucucaguaga

SEQ ID NO: 464940 - RNA, 32 nt, Human
ggggagaacauacaaacucugccuucggucau

SEQ ID NO: 464941 - RNA, 32 nt, Human
ggggagaacauacgguccagagccugagaucg

SEQ ID NO: 464942 - RNA, 22 nt, Human
ggggagaacgucuccagacaga

SEQ ID NO: 464943 - RNA, 17 nt, Human
ggggagaagaacagcaa

SEQ ID NO: 464944 - RNA, 32 nt, Human
ggggagaagcaaggguugggcccagugucccc

SEQ ID NO: 464945 - RNA, 32 nt, Human
ggggagaaggaggaggagcagcaggccuccgg

SEQ ID NO: 464946 - RNA, 32 nt, Human
ggggagaaggauuguagaugggccagugacuc

SEQ ID NO: 464947 - RNA, 19 nt, Human
ggggagaagggaauggagg

SEQ ID NO: 464948 - RNA, 20 nt, Human
ggggagaagggagacacaga

SEQ ID NO: 464949 - RNA, 32 nt, Human
ggggagaagggccauaugucacuaauagaaag

SEQ ID NO: 464950 - RNA, 32 nt, Human
ggggagaagugcuggguaacuggcugggggcg

SEQ ID NO: 464951 - RNA, 32 nt, Human
ggggagaaguucaaggaauuucugcucggcca

SEQ ID NO: 464952 - RNA, 19 nt, Human
ggggagaauaagaggcaga

SEQ ID NO: 464953 - RNA, 32 nt, Human
ggggagaaucuccugucaccaccagaaaagca

SEQ ID NO: 464954 - RNA, 32 nt, Human
ggggagaaucugguggaugcuggaccuugcug

SEQ ID NO: 464955 - RNA, 25 nt, Human
ggggagaauggacaaggacuuagga

SEQ ID NO: 464956 - RNA, 20 nt, Human
ggggagacagccaucucaaa

SEQ ID NO: 464957 - RNA, 32 nt, Human
ggggagacagguggagaugaggugaagaucac

SEQ ID NO: 464958 - RNA, 32 nt, Human
ggggagaccaaaggggaugaguagggaggggu

SEQ ID NO: 464959 - RNA, 32 nt, Human
ggggagaccauggcucagaggaaggguggagc

SEQ ID NO: 464960 - RNA, 32 nt, Human
ggggagacgggccggaggagcagugggggccg

SEQ ID NO: 464961 - RNA, 32 nt, Human
ggggagacuaagggcuacaggccagcguggau

SEQ ID NO: 464962 - RNA, 32 nt, Human
ggggagacucacucuccaucucaggaaauucu

SEQ ID NO: 464963 - RNA, 32 nt, Human
ggggagacugaggaagggcagagccagaagca

SEQ ID NO: 464964 - RNA, 32 nt, Human
ggggagacuguggcugaaaacugugucuuccu

SEQ ID NO: 464965 - RNA, 32 nt, Human
ggggagacuugugagcggccaucuugguccug

SEQ ID NO: 464966 - RNA, 32 nt, Human
ggggagagaagaaaggagggggcaagggagaa

SEQ ID NO: 464967 - RNA, 19 nt, Human
ggggagagaagaagaugcu

SEQ ID NO: 464968 - RNA, 32 nt, Human
ggggagagaagagggaacgagcaagggaagga

SEQ ID NO: 464969 - RNA, 32 nt, Human
ggggagagaagggagagggugggccugcugug

SEQ ID NO: 464970 - RNA, 32 nt, Human
ggggagagacagagaagugggcaggggcaccc

SEQ ID NO: 464971 - RNA, 32 nt, Human
ggggagagaccagcucuccagccuggcaggaa

SEQ ID NO: 464972 - RNA, 32 nt, Human
ggggagagacuuuuucuuguauaugcuuauau

SEQ ID NO: 464973 - RNA, 32 nt, Human
ggggagagagggacucuuucugcucccucaga

SEQ ID NO: 464974 - RNA, 32 nt, Human
ggggagagagugagggguugggggaucggcag

SEQ ID NO: 464975 - RNA, 32 nt, Human
ggggagagcagcuuccagccugggucagaagg

SEQ ID NO: 464976 - RNA, 32 nt, Human
ggggagagccacccacaggccauguccagccc

SEQ ID NO: 464977 - RNA, 32 nt, Human
ggggagagcccgaaggagaggcauccugacag

SEQ ID NO: 464978 - RNA, 32 nt, Human
ggggagagcuugacacuucgccucccugaugg

SEQ ID NO: 464979 - RNA, 32 nt, Human
ggggagagcuuugugcuugucauuccagagug

SEQ ID NO: 464980 - RNA, 32 nt, Human
ggggagaggaacagcccucuguucccaagucc

SEQ ID NO: 464981 - RNA, 32 nt, Human
ggggagaggaagaggagucggaagggaggcgg

SEQ ID NO: 464982 - RNA, 32 nt, Human
ggggagaggaagagugguagggggagggagag

SEQ ID NO: 464983 - RNA, 32 nt, Human
ggggagaggagaagggaaauggaggugagggg

SEQ ID NO: 464984 - RNA, 32 nt, Human
ggggagaggagaggagaaauguggacagaggg

SEQ ID NO: 464985 - RNA, 32 nt, Human
ggggagaggaggggaaggggaggcagaggagg

SEQ ID NO: 464986 - RNA, 32 nt, Human
ggggagaggagugccaggcacacagacucagg

SEQ ID NO: 464987 - RNA, 32 nt, Human
ggggagaggcauucagccgcugcuuuugaugc

SEQ ID NO: 464988 - RNA, 32 nt, Human
ggggagaggcuucuuucguuuccucgucaaac

SEQ ID NO: 464989 - RNA, 32 nt, Human
ggggagagggaagguagcuggggagaaacaca

SEQ ID NO: 464990 - RNA, 32 nt, Human
ggggagagggcuggggcaggggagagggaaag

SEQ ID NO: 464991 - RNA, 21 nt, Human
ggggagaggggacccggcgag

SEQ ID NO: 464992 - RNA, 32 nt, Human
ggggagaggggauaggaggagggaaacacuag

SEQ ID NO: 464993 - RNA, 32 nt, Human
ggggagagucccuuccuaccugacugaccucc

SEQ ID NO: 464994 - RNA, 32 nt, Human
ggggagaguucauggagagagcauguguucuc

SEQ ID NO: 464995 - RNA, 32 nt, Human
ggggagaucucagggccucuguugggaggaau

SEQ ID NO: 464996 - RNA, 32 nt, Human
ggggagaucugccugcucacccggggccaccg

SEQ ID NO: 464997 - RNA, 32 nt, Human
ggggagaucuuagcugaagaugacugacagug

SEQ ID NO: 464998 - RNA, 31 nt, Human
ggggagauggcggcgcgauggagcagcgaaa

SEQ ID NO: 464999 - RNA, 32 nt, Human
ggggagauuagacaugcacagaaggccgacca

SEQ ID NO: 465000 - RNA, 32 nt, Human
ggggagauugcucuacuuccccaaaucacugu

SEQ ID NO: 465001 - RNA, 32 nt, Human
ggggagauuggacuagaggaguccugagagga

SEQ ID NO: 465002 - RNA, 32 nt, Human
ggggagcaacagcaaacaggugcuaauuuguu

SEQ ID NO: 465003 - RNA, 32 nt, Human
ggggagcaacccauggcucacaggucacuaag

SEQ ID NO: 465004 - RNA, 32 nt, Human
ggggagcacacagcugaccucgcugggcccug

SEQ ID NO: 465005 - RNA, 32 nt, Human
ggggagcaccacgcgcugcaguucaccgaccu

SEQ ID NO: 465006 - RNA, 32 nt, Human
ggggagcacccaggcggaucugcaagcaccuc

SEQ ID NO: 465007 - RNA, 32 nt, Human
ggggagcagacaggcccagcaggcagggugcc

SEQ ID NO: 465008 - RNA, 21 nt, Human
ggggagcagacucgggggcca

SEQ ID NO: 465009 - RNA, 32 nt, Human
ggggagcagagaauccccacucauauccucuc

SEQ ID NO: 465010 - RNA, 32 nt, Human
ggggagcagagacuuaacccccaacucagagg

SEQ ID NO: 465011 - RNA, 32 nt, Human
ggggagcagaugagggcccugcccccgcccca

SEQ ID NO: 465012 - RNA, 32 nt, Human
ggggagcagccucuacccucagcauccuggcc

SEQ ID NO: 465013 - RNA, 32 nt, Human
ggggagcagcugcuccauugugccucgaggcc

SEQ ID NO: 465014 - RNA, 32 nt, Human
ggggagcagcugggcacggugccccucccuau

SEQ ID NO: 465015 - RNA, 32 nt, Human
ggggagcagcuuuuggggcucagaggccaguc

SEQ ID NO: 465016 - RNA, 32 nt, Human
ggggagcaggagccccaggaacagggguguug

SEQ ID NO: 465017 - RNA, 32 nt, Human
ggggagcaggcagagaggggcgguugaaggaa

SEQ ID NO: 465018 - RNA, 32 nt, Human
ggggagcaggcaggugacaaccaguguccuac

SEQ ID NO: 465019 - RNA, 32 nt, Human
ggggagcaggccacagaacgcagggugaaacc

SEQ ID NO: 465020 - RNA, 32 nt, Human
ggggagcagggccuggaaaccugcauuuuagu

SEQ ID NO: 465021 - RNA, 32 nt, Human
ggggagcaggggagggaaagaaaccaggcauc

SEQ ID NO: 465022 - RNA, 32 nt, Human
ggggagcagggugggcaggaauacuguuaucu

SEQ ID NO: 465023 - RNA, 32 nt, Human
ggggagcaggguggggaagaggggaccauucc

SEQ ID NO: 465024 - RNA, 32 nt, Human
ggggagcaggguggggaagaggggagcauucc

SEQ ID NO: 465025 - RNA, 32 nt, Human
ggggagcagguguggggaaagcaccuuccacc

SEQ ID NO: 465026 - RNA, 20 nt, Human
ggggagcaguccuccaguuc

SEQ ID NO: 465027 - RNA, 22 nt, Human
ggggagccaaagcagcauauua

SEQ ID NO: 465028 - RNA, 32 nt, Human
ggggagccaaaucucagguaccgagaccuucc

SEQ ID NO: 465029 - RNA, 32 nt, Human
ggggagccagagaagagguuggaaaccuuuuc

SEQ ID NO: 465030 - RNA, 32 nt, Human
ggggagccagcuucuccuaaaccacguggauc

SEQ ID NO: 465031 - RNA, 32 nt, Human
ggggagcccagccccuggcccugccucccgcg

SEQ ID NO: 465032 - RNA, 32 nt, Human
ggggagcccugaggcuuuucuucuccugcccc

SEQ ID NO: 465033 - RNA, 32 nt, Human
ggggagcccugagggcugccucucugccaguc

SEQ ID NO: 465034 - RNA, 32 nt, Human
ggggagcccuggaagcagggcuuuuccggaug

SEQ ID NO: 465035 - RNA, 32 nt, Human
ggggagccucgggggcagaggugauagaugug

SEQ ID NO: 465036 - RNA, 32 nt, Human
ggggagccugcaggaggguggccaacagugga

SEQ ID NO: 465037 - RNA, 32 nt, Human
ggggagcgcgggacaggaggcuucggggaaga

SEQ ID NO: 465038 - RNA, 32 nt, Human
ggggagcgggcggcgggcgggagccaggcccg

SEQ ID NO: 465039 - RNA, 32 nt, Human
ggggagcggggaggggcacugagaugggcagg

SEQ ID NO: 465040 - RNA, 32 nt, Human
ggggagcggggaggggcagaggaguuccccgg

SEQ ID NO: 465041 - RNA, 32 nt, Human
ggggagcggggccgggaguggagcagccgccg

SEQ ID NO: 465042 - RNA, 32 nt, Human
ggggagcgguugggccugagccccagggacaa

SEQ ID NO: 465043 - RNA, 32 nt, Human
ggggagcgugagcgaugcccagcugcacccgg

SEQ ID NO: 465044 - RNA, 32 nt, Human
ggggagcguggaggcagggccuccaggugcug

SEQ ID NO: 465045 - RNA, 21 nt, Human
ggggagcuagaagagaccaga

SEQ ID NO: 465046 - RNA, 32 nt, Human
ggggagcucaggcaaaagagguuuccaggaug

SEQ ID NO: 465047 - RNA, 32 nt, Human
ggggagcucaggggccgcaggagccgggccgg

SEQ ID NO: 465048 - RNA, 32 nt, Human
ggggagcuccaggagagaggggagcccagcug

SEQ ID NO: 465049 - RNA, 32 nt, Human
ggggagcucccaagcugccaagccccugccuc

SEQ ID NO: 465050 - RNA, 32 nt, Human
ggggagcucugagacgccuccugucccacgcu

SEQ ID NO: 465051 - RNA, 20 nt, Human
ggggagcugagacccagaag

SEQ ID NO: 465052 - RNA, 32 nt, Human
ggggagcugcacccaccucccuuccagggauu

SEQ ID NO: 465053 - RNA, 32 nt, Human
ggggagcugccuggcugccucaguuugcagau

SEQ ID NO: 465054 - RNA, 21 nt, Human
ggggagcugcugcagcuccug

SEQ ID NO: 465055 - RNA, 32 nt, Human
ggggagcugcuggccauggcugcuuuguaguu

SEQ ID NO: 465056 - RNA, 32 nt, Human
ggggagcugcuggccgcuuagcguuguuugau

SEQ ID NO: 465057 - RNA, 32 nt, Human
ggggagcuggaccaggagguggaggcucaggg

SEQ ID NO: 465058 - RNA, 32 nt, Human
ggggagcuggcagaggagagagacgucucagc

SEQ ID NO: 465059 - RNA, 32 nt, Human
ggggagcugggggcagagggcggugccaagug

SEQ ID NO: 465060 - RNA, 32 nt, Human
ggggagcugucaccacgaauguucccaaacuu

SEQ ID NO: 465061 - RNA, 32 nt, Human
ggggagcuguugcagcagcccaagccgcagga

SEQ ID NO: 465062 - RNA, 32 nt, Human
ggggagcuuguccuggagggcacauuccgcgu

SEQ ID NO: 465063 - RNA, 32 nt, Human
ggggaggaaagccacgagcacugagcgccucc

SEQ ID NO: 465064 - RNA, 32 nt, Human
ggggaggaaaggcuguucugugucugaaccca

SEQ ID NO: 465065 - RNA, 19 nt, Human
ggggaggaaagugcauccc

SEQ ID NO: 465066 - RNA, 31 nt, Human
ggggaggaagagagagacuguggagcucugg

SEQ ID NO: 465067 - RNA, 32 nt, Human
ggggaggaaggaaggaaggaagggcggcgugg

SEQ ID NO: 465068 - RNA, 32 nt, Human
ggggaggaaggcagggaggaaaagcggucuuc

SEQ ID NO: 465069 - RNA, 32 nt, Human
ggggaggacaaggggguggguaaggggcucaa

SEQ ID NO: 465070 - RNA, 32 nt, Human
ggggaggacagcuugucugcugcuccaaauca

SEQ ID NO: 465071 - RNA, 32 nt, Human
ggggaggacaguucuuuuggagguuggagggg

SEQ ID NO: 465072 - RNA, 32 nt, Human
ggggaggacgcugguggcucccaccuggauuu

SEQ ID NO: 465073 - RNA, 24 nt, Human
ggggaggacguuggggacccuggg

SEQ ID NO: 465074 - RNA, 32 nt, Human
ggggaggacucugccuguguccuguguucccc

SEQ ID NO: 465075 - RNA, 32 nt, Human
ggggaggacuucacucagcagcaaagagaaga

SEQ ID NO: 465076 - RNA, 31 nt, Human
ggggaggagaagagagaagaaacuggagcag

SEQ ID NO: 465077 - RNA, 32 nt, Human
ggggaggagaaguggggaaagguggagcagag

SEQ ID NO: 465078 - RNA, 32 nt, Human
ggggaggagagggaaccccaggcgcgagcggg

SEQ ID NO: 465079 - RNA, 32 nt, Human
ggggaggagauggggaaguggagccacccugc

SEQ ID NO: 465080 - RNA, 32 nt, Human
ggggaggagcaguccgaggggaacguggguug

SEQ ID NO: 465081 - RNA, 26 nt, Human
ggggaggagcaguuaauggauucugg

SEQ ID NO: 465082 - RNA, 32 nt, Human
ggggaggagcaucugcccuccuccuucucagg

SEQ ID NO: 465083 - RNA, 32 nt, Human
ggggaggagccagcucucaggacuguggcugg

SEQ ID NO: 465084 - RNA, 32 nt, Human
ggggaggagcccaaaccacugcccacagacuc

SEQ ID NO: 465085 - RNA, 32 nt, Human
ggggaggagccgggcucugccugcgcccgggg

SEQ ID NO: 465086 - RNA, 32 nt, Human
ggggaggaggaaggggacagagggagcaggua

SEQ ID NO: 465087 - RNA, 32 nt, Human
ggggaggaggagagaauggaauggcuggacuu

SEQ ID NO: 465088 - RNA, 32 nt, Human
ggggaggaggagagucccuucucggaaggccu

SEQ ID NO: 465089 - RNA, 32 nt, Human
ggggaggaggaggaggaggagaggagcaguca

SEQ ID NO: 465090 - RNA, 32 nt, Human
ggggaggaggaggaggaggaggaggucgugga

SEQ ID NO: 465091 - RNA, 32 nt, Human
ggggaggaggaggaggaggaguucguggauga

SEQ ID NO: 465092 - RNA, 32 nt, Human
ggggaggaggaggcagguggucuaagugcuga

SEQ ID NO: 465093 - RNA, 32 nt, Human
ggggaggaggcaggagggcgcauggggcgccc

SEQ ID NO: 465094 - RNA, 32 nt, Human
ggggaggagggaggggcgccagcaccugauga

SEQ ID NO: 465095 - RNA, 20 nt, Human
ggggaggagggccucucaug

SEQ ID NO: 465096 - RNA, 32 nt, Human
ggggaggaggggaagaaggaaagggaagaguc

SEQ ID NO: 465097 - RNA, 32 nt, Human
ggggaggaggggcaaggccccagcaagccucu

SEQ ID NO: 465098 - RNA, 32 nt, Human
ggggaggaggggcaggugcugcaggcuccccc

SEQ ID NO: 465099 - RNA, 32 nt, Human
ggggaggaggggcagugcagguggacggggag

SEQ ID NO: 465100 - RNA, 32 nt, Human
ggggaggaggggcggcgggcugcuccugucac

SEQ ID NO: 465101 - RNA, 32 nt, Human
ggggaggaggggcggggaagcgcuuccaggga

SEQ ID NO: 465102 - RNA, 32 nt, Human
ggggaggagggggaggaggagcgggaggaggg

SEQ ID NO: 465103 - RNA, 32 nt, Human
ggggaggagggggaucagcuucugcuauuacc

SEQ ID NO: 465104 - RNA, 32 nt, Human
ggggaggaggucagaggagaugggggcuggcu

SEQ ID NO: 465105 - RNA, 32 nt, Human
ggggaggagguccuuccucuccgccacugccc

SEQ ID NO: 465106 - RNA, 32 nt, Human
ggggaggaggugguggccguggguuccugaug

SEQ ID NO: 465107 - RNA, 32 nt, Human
ggggaggaguguuaugaaagaagaugagucug

SEQ ID NO: 465108 - RNA, 32 nt, Human
ggggaggaguuggagagcacaguugccccguu

SEQ ID NO: 465109 - RNA, 32 nt, Human
ggggaggauacuuggguugauuuauccauuau

SEQ ID NO: 465110 - RNA, 32 nt, Human
ggggaggaucacuggagcccaggaguuugagg

SEQ ID NO: 465111 - RNA, 32 nt, Human
ggggaggauggaggcaggagcuggucugggga

SEQ ID NO: 465112 - RNA, 32 nt, Human
ggggaggcaaaaagccuugggcacuacccucc

SEQ ID NO: 465113 - RNA, 32 nt, Human
ggggaggcaaaggauauaauauauucaucuuu

SEQ ID NO: 465114 - RNA, 32 nt, Human
ggggaggcacucuccucuggaccuaaccugaa

SEQ ID NO: 465115 - RNA, 32 nt, Human
ggggaggcagagccaggaagcuaagccagggc

SEQ ID NO: 465116 - RNA, 32 nt, Human
ggggaggcagccaagagagccgugcagauggc

SEQ ID NO: 465117 - RNA, 32 nt, Human
ggggaggcagccggcacccacaagugccacug

SEQ ID NO: 465118 - RNA, 32 nt, Human
ggggaggcaggaagaaaggaaggaaggaaaga

SEQ ID NO: 465119 - RNA, 32 nt, Human
ggggaggcaggcaggugggugagcagcagaug

SEQ ID NO: 465120 - RNA, 32 nt, Human
ggggaggcaggcggaggccaugggcagcgagg

SEQ ID NO: 465121 - RNA, 32 nt, Human
ggggaggcaggcggaucaugaugucaggagau

SEQ ID NO: 465122 - RNA, 32 nt, Human
ggggaggcaggcggggcugacagcucaggagu

SEQ ID NO: 465123 - RNA, 32 nt, Human
ggggaggcagggccacaggaaaugaguggggu

SEQ ID NO: 465124 - RNA, 32 nt, Human
ggggaggccacagcagggcugagggaacucug

SEQ ID NO: 465125 - RNA, 32 nt, Human
ggggaggccagcccagugcgggcacagcacaa

SEQ ID NO: 465126 - RNA, 32 nt, Human
ggggaggccaggguagaggcugacggcgcaag

SEQ ID NO: 465127 - RNA, 32 nt, Human
ggggaggccauucccaugagacugccugucac

SEQ ID NO: 465128 - RNA, 32 nt, Human
ggggaggcccagaagcagggaugccaucuguu

SEQ ID NO: 465129 - RNA, 32 nt, Human
ggggaggcccucaccuuccagagaggacagac

SEQ ID NO: 465130 - RNA, 32 nt, Human
ggggaggccgugccaggcagggccgguucgug

SEQ ID NO: 465131 - RNA, 32 nt, Human
ggggaggccugggaacagagcccccacccucu

SEQ ID NO: 465132 - RNA, 32 nt, Human
ggggaggcugaggcaggagaauugcuuugaac

SEQ ID NO: 465133 - RNA, 32 nt, Human
ggggaggcuuucucaauaacauggcccuuugc

SEQ ID NO: 465134 - RNA, 32 nt, Human
ggggagggaacccagaggcuggggaugagacu

SEQ ID NO: 465135 - RNA, 32 nt, Human
ggggagggaagaggaggagaggggaggggacc

SEQ ID NO: 465136 - RNA, 24 nt, Human
ggggagggacaagggauucuggga

SEQ ID NO: 465137 - RNA, 24 nt, Human
ggggagggaccagcaaaucugaga

SEQ ID NO: 465138 - RNA, 19 nt, Human
ggggagggacguccuguga

SEQ ID NO: 465139 - RNA, 22 nt, Human
ggggagggacuggccccuggga

SEQ ID NO: 465140 - RNA, 32 nt, Human
ggggagggagaaaaggugggggaaagagagaa

SEQ ID NO: 465141 - RNA, 32 nt, Human
ggggagggagagagagggagggagagggagug

SEQ ID NO: 465142 - RNA, 20 nt, Human
ggggagggagcacucuggga

SEQ ID NO: 465143 - RNA, 32 nt, Human
ggggagggagcagcugggcaaggaaguggcuu

SEQ ID NO: 465144 - RNA, 32 nt, Human
ggggagggaggaagaaggaagagaggcagaag

SEQ ID NO: 465145 - RNA, 32 nt, Human
ggggagggaggcaauaagcaaagaaauaaaug

SEQ ID NO: 465146 - RNA, 32 nt, Human
ggggagggaggcaggugggugguaagagggaa

SEQ ID NO: 465147 - RNA, 32 nt, Human
ggggagggaggcagugguggcuggagggugcg

SEQ ID NO: 465148 - RNA, 32 nt, Human
ggggagggaggcaucuagggagaggggucccc

SEQ ID NO: 465149 - RNA, 32 nt, Human
ggggagggaggcggggguggacagggaggcag

SEQ ID NO: 465150 - RNA, 32 nt, Human
ggggagggaggcgggguuggggccacgugagc

SEQ ID NO: 465151 - RNA, 23 nt, Human
ggggagggaggcgucccggcgga

SEQ ID NO: 465152 - RNA, 32 nt, Human
ggggagggagggagggaguuggcaguuucaaa

SEQ ID NO: 465153 - RNA, 32 nt, Human
ggggagggagguggagggagggaaggguuucu

SEQ ID NO: 465154 - RNA, 32 nt, Human
ggggagggagguucaccugaggaggacugugg

SEQ ID NO: 465155 - RNA, 32 nt, Human
ggggagggaucgagaacggugugggagagcua

SEQ ID NO: 465156 - RNA, 32 nt, Human
ggggagggaugggguuauagcuguuuuguuua

SEQ ID NO: 465157 - RNA, 32 nt, Human
ggggagggcaaggugcugccccagggaaaagg

SEQ ID NO: 465158 - RNA, 32 nt, Human
ggggagggcaccggagccuugccaccauccca

SEQ ID NO: 465159 - RNA, 32 nt, Human
ggggagggcagaguucaaggacugccuucaag

SEQ ID NO: 465160 - RNA, 19 nt, Human
ggggagggcaugauccugg

SEQ ID NO: 465161 - RNA, 24 nt, Human
ggggagggccucugacugcuggga

SEQ ID NO: 465162 - RNA, 32 nt, Human
ggggagggccuggcaaggggaggcaggagggu

SEQ ID NO: 465163 - RNA, 32 nt, Human
ggggagggcgaagaggaggaggaaggggagga

SEQ ID NO: 465164 - RNA, 32 nt, Human
ggggagggcgacggagcgggugaccuuccgga

SEQ ID NO: 465165 - RNA, 32 nt, Human
ggggagggcggcaggccagggcgaaggccaag

SEQ ID NO: 465166 - RNA, 32 nt, Human
ggggagggcugaggucagggaggucugaagcu

SEQ ID NO: 465167 - RNA, 32 nt, Human
ggggagggcuugguggggagggggacuuacaa

SEQ ID NO: 465168 - RNA, 21 nt, Human
ggggaggggaagagacuggaa

SEQ ID NO: 465169 - RNA, 32 nt, Human
ggggaggggaaggagcggcacaugggguugag

SEQ ID NO: 465170 - RNA, 21 nt, Human
ggggaggggaagucccuggga

SEQ ID NO: 465171 - RNA, 32 nt, Human
ggggaggggagcagcagagggaggccaaggcc

SEQ ID NO: 465172 - RNA, 32 nt, Human
ggggaggggagggcacguucuugacacauggg

SEQ ID NO: 465173 - RNA, 32 nt, Human
ggggaggggccagugagcucugggcucagcca

SEQ ID NO: 465174 - RNA, 32 nt, Human
ggggaggggcccagagcaaagggcaucaggga

SEQ ID NO: 465175 - RNA, 32 nt, Human
ggggaggggcuaaagagcaggaaacaagcuug

SEQ ID NO: 465176 - RNA, 32 nt, Human
ggggaggggcugagagggugggggcuggaacc

SEQ ID NO: 465177 - RNA, 32 nt, Human
ggggaggggcugcagacagcagggggagagga

SEQ ID NO: 465178 - RNA, 22 nt, Human
ggggagggggaaaagagagaga

SEQ ID NO: 465179 - RNA, 32 nt, Human
ggggagggggagggaugaccagcucucaggga

SEQ ID NO: 465180 - RNA, 32 nt, Human
ggggagggggagggguccuccgggaggagcuc

SEQ ID NO: 465181 - RNA, 32 nt, Human
ggggagggggcaccgccucccacccacugagg

SEQ ID NO: 465182 - RNA, 32 nt, Human
ggggagggggcagaggcccucgggggcccgug

SEQ ID NO: 465183 - RNA, 32 nt, Human
ggggagggggcaguuagauuccccagcuuccu

SEQ ID NO: 465184 - RNA, 32 nt, Human
ggggagggggccaaggacacagcacugggcug

SEQ ID NO: 465185 - RNA, 23 nt, Human
ggggagggggccagacucuggga

SEQ ID NO: 465186 - RNA, 18 nt, Human
ggggagggggguggugaa

SEQ ID NO: 465187 - RNA, 32 nt, Human
ggggagggggucuguggaagauucaggagaaa

SEQ ID NO: 465188 - RNA, 32 nt, Human
ggggaggguagacugggaguccugaccacgca

SEQ ID NO: 465189 - RNA, 32 nt, Human
ggggaggguaggcaggauuggggaagagagcc

SEQ ID NO: 465190 - RNA, 16 nt, Human
ggggaggguaggggga

SEQ ID NO: 465191 - RNA, 32 nt, Human
ggggagggugcucaagcaggggugggggaggg

SEQ ID NO: 465192 - RNA, 32 nt, Human
ggggaggguggcaggugaccuucugggaaaug

SEQ ID NO: 465193 - RNA, 32 nt, Human
ggggaggguggggaugggaggggagagacaga

SEQ ID NO: 465194 - RNA, 32 nt, Human
ggggagguacauuccugcaucuucucaccccc

SEQ ID NO: 465195 - RNA, 32 nt, Human
ggggaggucugagugguggucuuugggauaac

SEQ ID NO: 465196 - RNA, 22 nt, Human
ggggaggugagagcuucuggga

SEQ ID NO: 465197 - RNA, 32 nt, Human
ggggaggugcccagguggguggaccaguacuc

SEQ ID NO: 465198 - RNA, 32 nt, Human
ggggagguggccaggccaguggccaggcccug

SEQ ID NO: 465199 - RNA, 32 nt, Human
ggggagguguggagggagaggcgcggugggaa

SEQ ID NO: 465200 - RNA, 32 nt, Human
ggggagguguggguucccugggccaagaccag

SEQ ID NO: 465201 - RNA, 32 nt, Human
ggggaguacagaagguaugggcagaagcugua

SEQ ID NO: 465202 - RNA, 32 nt, Human
ggggaguacauggcagaagugggcauauuuca

SEQ ID NO: 465203 - RNA, 32 nt, Human
ggggaguagauaugagagggagccgcuccugg

SEQ ID NO: 465204 - RNA, 32 nt, Human
ggggaguaggaaagaagaggaugguugcuuaa

SEQ ID NO: 465205 - RNA, 32 nt, Human
ggggagucgggcguggggcgggcagggagugg

SEQ ID NO: 465206 - RNA, 32 nt, Human
ggggagucucugugccugggaauuaggacccc

SEQ ID NO: 465207 - RNA, 32 nt, Human
ggggagucugguuuuucucuucauccugucuc

SEQ ID NO: 465208 - RNA, 32 nt, Human
ggggagugaaggcagagccuggugcagaugga

SEQ ID NO: 465209 - RNA, 32 nt, Human
ggggagugaagugccuuaagaaacaaagcccu

SEQ ID NO: 465210 - RNA, 32 nt, Human
ggggagugagaguucagggaggcccuucccac

SEQ ID NO: 465211 - RNA, 32 nt, Human
ggggagugaguccagagagggacuuaaggggc

SEQ ID NO: 465212 - RNA, 32 nt, Human
ggggaguggaaagaggaaggggugaaggagcu

SEQ ID NO: 465213 - RNA, 21 nt, Human
ggggagugggaaacucugggg

SEQ ID NO: 465214 - RNA, 32 nt, Human
ggggagugggaauucagccacauucagaauuc

SEQ ID NO: 465215 - RNA, 32 nt, Human
ggggagugggccagggcagcagccgggcugaa

SEQ ID NO: 465216 - RNA, 32 nt, Human
ggggaguggggugggagucaggggaauagaug

SEQ ID NO: 465217 - RNA, 31 nt, Human
ggggaguggguggcaggugggggugggcugc

SEQ ID NO: 465218 - RNA, 32 nt, Human
ggggagugguggguuuauagggggaggaggag

SEQ ID NO: 465219 - RNA, 32 nt, Human
ggggagugucuagccaugacgagaagauuccc

SEQ ID NO: 465220 - RNA, 32 nt, Human
ggggaguguucuguuccggcauauccuggccg

SEQ ID NO: 465221 - RNA, 32 nt, Human
ggggaguguugggcaugugaucacgccuggcu

SEQ ID NO: 465222 - RNA, 32 nt, Human
ggggaguugggguucucauaccagcagauuuc

SEQ ID NO: 465223 - RNA, 32 nt, Human
ggggaguugugcaggcuggggugacccuuccc

SEQ ID NO: 465224 - RNA, 32 nt, Human
ggggauaacccuuccuucgauaccaaacacua

SEQ ID NO: 465225 - RNA, 32 nt, Human
ggggauaagacggaagaaguuggcucauauca

SEQ ID NO: 465226 - RNA, 32 nt, Human
ggggauaaggggaugugcagcaucugugugga

SEQ ID NO: 465227 - RNA, 32 nt, Human
ggggauacagagaagcuccccgucucugcauc

SEQ ID NO: 465228 - RNA, 20 nt, Human
ggggauacaguggauaucua

SEQ ID NO: 465229 - RNA, 32 nt, Human
ggggauacuguacaucuuuaucccacugugac

SEQ ID NO: 465230 - RNA, 32 nt, Human
ggggauacuuccugcagggcccuuggaaaguu

SEQ ID NO: 465231 - RNA, 32 nt, Human
ggggauacuuugggucugggcuggcaggggcu

SEQ ID NO: 465232 - RNA, 32 nt, Human
ggggauagaaaaucgggagucugcccucauua

SEQ ID NO: 465233 - RNA, 32 nt, Human
ggggauagaaaauggaauaaagauagaaggga

SEQ ID NO: 465234 - RNA, 24 nt, Human
ggggauagaacuugagcaauuucu

SEQ ID NO: 465235 - RNA, 32 nt, Human
ggggauagaagucugguggagguggagugggc

SEQ ID NO: 465236 - RNA, 32 nt, Human
ggggauagaguccugaggaauguggucacagc

SEQ ID NO: 465237 - RNA, 32 nt, Human
ggggauaggaggugggggagucgagagcugga

SEQ ID NO: 465238 - RNA, 32 nt, Human
ggggauaggcaaagggaccaguaucagguuau

SEQ ID NO: 465239 - RNA, 15 nt, Human
ggggauagggcccuc

SEQ ID NO: 465240 - RNA, 18 nt, Human
ggggaucacagcguuuca

SEQ ID NO: 465241 - RNA, 20 nt, Human
ggggaucacuugagcccagg

SEQ ID NO: 465242 - RNA, 32 nt, Human
ggggaucacuugagcccaggagucuaggacca

SEQ ID NO: 465243 - RNA, 32 nt, Human
ggggaucacuugagcccaggaguuggaggcca

SEQ ID NO: 465244 - RNA, 32 nt, Human
ggggaucagacauaccuguccgggcaucaacc

SEQ ID NO: 465245 - RNA, 25 nt, Human
ggggaucagaguuuguuuuugcgga

SEQ ID NO: 465246 - RNA, 32 nt, Human
ggggaucagcuggcugggaggauuagugagca

SEQ ID NO: 465247 - RNA, 32 nt, Human
ggggaucaggaaccacacaauccccaggguuc

SEQ ID NO: 465248 - RNA, 32 nt, Human
ggggauccaagaaugucuugucauacaagccg

SEQ ID NO: 465249 - RNA, 32 nt, Human
ggggauccaccaggucaucuagcucuggcccu

SEQ ID NO: 465250 - RNA, 32 nt, Human
ggggauccaggauuuguaauuucuugaucuaa

SEQ ID NO: 465251 - RNA, 32 nt, Human
ggggaucccaggcuacuagugcaaagggagug

SEQ ID NO: 465252 - RNA, 32 nt, Human
ggggaucccccagcugaaggaggcuggcagga

SEQ ID NO: 465253 - RNA, 32 nt, Human
ggggaucccuccauccgcaaagccaggguccu

SEQ ID NO: 465254 - RNA, 32 nt, Human
ggggauccucaccgaccauggccacagcugcc

SEQ ID NO: 465255 - RNA, 32 nt, Human
ggggauccuguggcccacagagcugccccagc

SEQ ID NO: 465256 - RNA, 32 nt, Human
ggggauccuugcaggccuccagcuggggcuga

SEQ ID NO: 465257 - RNA, 32 nt, Human
ggggaucgagggcuggcggggagaagcagaca

SEQ ID NO: 465258 - RNA, 32 nt, Human
ggggaucgcuugaaccugggaggcagagguug

SEQ ID NO: 465259 - RNA, 20 nt, Human
ggggaucgcuugagcccagg

SEQ ID NO: 465260 - RNA, 32 nt, Human
ggggaucgcuugagcccaggaguuggaggcug

SEQ ID NO: 465261 - RNA, 32 nt, Human
ggggaucgcuugagcccaggaguuugaggcug

SEQ ID NO: 465262 - RNA, 32 nt, Human
ggggaucgugccgcugcauccagccugagcaa

SEQ ID NO: 465263 - RNA, 32 nt, Human
ggggaucuauaaucuuguaacagggucuaucu

SEQ ID NO: 465264 - RNA, 32 nt, Human
ggggaucugcauuucuaacaggcuccugcccc

SEQ ID NO: 465265 - RNA, 32 nt, Human
ggggaucugggagcugagcacuugucuauacu

SEQ ID NO: 465266 - RNA, 32 nt, Human
ggggaucugggcaccccaggaaccgccauugc

SEQ ID NO: 465267 - RNA, 22 nt, Human
ggggaucugggguagagggagg

SEQ ID NO: 465268 - RNA, 32 nt, Human
ggggaucuuuucuugaaaaccuacagugcuaa

SEQ ID NO: 465269 - RNA, 32 nt, Human
ggggaugaaaggaagagaggggccaauugggc

SEQ ID NO: 465270 - RNA, 29 nt, Human
ggggaugacccaugggcuucuggagcugg

SEQ ID NO: 465271 - RNA, 32 nt, Human
ggggaugagccaggcuggggacaguggggcug

SEQ ID NO: 465272 - RNA, 32 nt, Human
ggggaugaggggcaaguggaggggacggcuca

SEQ ID NO: 465273 - RNA, 32 nt, Human
ggggaugaggugggagaaagcaaccacaacgu

SEQ ID NO: 465274 - RNA, 32 nt, Human
ggggaugagugcagggcagaggugagggaacc

SEQ ID NO: 465275 - RNA, 32 nt, Human
ggggaugauuguaggucaagagacugaagcaa

SEQ ID NO: 465276 - RNA, 17 nt, Human
ggggaugcaguuuggca

SEQ ID NO: 465277 - RNA, 32 nt, Human
ggggaugcaugggaaagccaggagggcccuga

SEQ ID NO: 465278 - RNA, 32 nt, Human
ggggaugccaagaauuuuuagaauuuuugaga

SEQ ID NO: 465279 - RNA, 32 nt, Human
ggggaugccauucaaucagagccugggccugg

SEQ ID NO: 465280 - RNA, 32 nt, Human
ggggaugcccauuugucccaagcuuauccugu

SEQ ID NO: 465281 - RNA, 32 nt, Human
ggggaugccccagggacuguggcccacagaga

SEQ ID NO: 465282 - RNA, 22 nt, Human
ggggaugccgggcuccaggccg

SEQ ID NO: 465283 - RNA, 32 nt, Human
ggggaugccuaugucugugcuucauuggcguc

SEQ ID NO: 465284 - RNA, 19 nt, Human
ggggaugcguuuccagguc

SEQ ID NO: 465285 - RNA, 22 nt, Human
ggggaugcucaggggccugcag

SEQ ID NO: 465286 - RNA, 32 nt, Human
ggggaugcucugguagccugaauacagaacug

SEQ ID NO: 465287 - RNA, 32 nt, Human
ggggaugcuucuuagagcaucuuccacaucaa

SEQ ID NO: 465288 - RNA, 21 nt, Human
ggggauggacucugucaggga

SEQ ID NO: 465289 - RNA, 32 nt, Human
ggggauggagcaguagaaggaaucacuguuuc

SEQ ID NO: 465290 - RNA, 32 nt, Human
ggggauggagucucacuuuguugcccaggcug

SEQ ID NO: 465291 - RNA, 32 nt, Human
ggggauggagucucccucuguugcccaggcug

SEQ ID NO: 465292 - RNA, 32 nt, Human
ggggauggagugagcccauggugaccucggga

SEQ ID NO: 465293 - RNA, 22 nt, Human
ggggauggcagaaacucaggga

SEQ ID NO: 465294 - RNA, 22 nt, Human
ggggauggcagacagucaagga

SEQ ID NO: 465295 - RNA, 32 nt, Human
ggggauggcagaggaggugaggagggaggaag

SEQ ID NO: 465296 - RNA, 21 nt, Human
ggggauggccagcgucaggga

SEQ ID NO: 465297 - RNA, 32 nt, Human
ggggauggcccggagcccccaaggguggcagg

SEQ ID NO: 465298 - RNA, 32 nt, Human
ggggauggcuugagcccaggagguugagguca

SEQ ID NO: 465299 - RNA, 32 nt, Human
ggggaugggaggggacagggauucacgaucca

SEQ ID NO: 465300 - RNA, 32 nt, Human
ggggaugggcagggugcucucuggacccccac

SEQ ID NO: 465301 - RNA, 32 nt, Human
ggggauggggaggguagaaaugaaucagacau

SEQ ID NO: 465302 - RNA, 32 nt, Human
ggggauggggcagaggucuggaucugggaucg

SEQ ID NO: 465303 - RNA, 29 nt, Human
ggggauggggccgccgcucccgcugcugc

SEQ ID NO: 465304 - RNA, 32 nt, Human
ggggauggggcugugggggcggggcggcaugg

SEQ ID NO: 465305 - RNA, 24 nt, Human
ggggaugggggacuaugacagaga

SEQ ID NO: 465306 - RNA, 31 nt, Human
ggggaugggguggaaucugaggggugagccu

SEQ ID NO: 465307 - RNA, 32 nt, Human
ggggauggggugugugcccacugugcucauca

SEQ ID NO: 465308 - RNA, 32 nt, Human
ggggaugggguuucaccauguuggccaggcug

SEQ ID NO: 465309 - RNA, 32 nt, Human
ggggaugggguuucaucauguuggccaggcug

SEQ ID NO: 465310 - RNA, 32 nt, Human
ggggaugggguuuuaccauguuggccaggcug

SEQ ID NO: 465311 - RNA, 23 nt, Human
ggggaugguaaugauacagugga

SEQ ID NO: 465312 - RNA, 32 nt, Human
ggggaugguccacugucacuguuucucugcug

SEQ ID NO: 465313 - RNA, 23 nt, Human
ggggaugguggcggugguggugg

SEQ ID NO: 465314 - RNA, 23 nt, Human
ggggauggugggagugaaggggg

SEQ ID NO: 465315 - RNA, 32 nt, Human
ggggauggugucucacucugucacucaggcug

SEQ ID NO: 465316 - RNA, 32 nt, Human
ggggauguccacacagauuuagguacuuacgu

SEQ ID NO: 465317 - RNA, 32 nt, Human
ggggaugugagcaaaauucgggcuuguguucu

SEQ ID NO: 465318 - RNA, 32 nt, Human
ggggauguggccaggggugcuccugugcucac

SEQ ID NO: 465319 - RNA, 32 nt, Human
ggggaugugggagggagcagacaggaggaauc

SEQ ID NO: 465320 - RNA, 32 nt, Human
ggggaugugggauggcagcagccagguaugua

SEQ ID NO: 465321 - RNA, 32 nt, Human
ggggauguggggaccaggagaaagucaggauc

SEQ ID NO: 465322 - RNA, 24 nt, Human
ggggaugugggggagggcgguuuu

SEQ ID NO: 465323 - RNA, 32 nt, Human
ggggauguggucucauuagguugcccaagcug

SEQ ID NO: 465324 - RNA, 32 nt, Human
ggggauguguguguuuuuaucugagcagcucc

SEQ ID NO: 465325 - RNA, 32 nt, Human
ggggauuaacacuuuugcugagggagaaaaag

SEQ ID NO: 465326 - RNA, 32 nt, Human
ggggauuaccauuguuccuggaguacuccuac

SEQ ID NO: 465327 - RNA, 32 nt, Human
ggggauuagagugauuaugggagcagcuaaag

SEQ ID NO: 465328 - RNA, 25 nt, Human
ggggauuagggguggggcaguuuuu

SEQ ID NO: 465329 - RNA, 32 nt, Human
ggggauucuacgggggcaguagcucaacaagg

SEQ ID NO: 465330 - RNA, 32 nt, Human
ggggauucugcacuuuagccagccugggucgg

SEQ ID NO: 465331 - RNA, 32 nt, Human
ggggauugaagcaggcggaucacuugagccca

SEQ ID NO: 465332 - RNA, 32 nt, Human
ggggauugaauagauuucaccuggacaugggg

SEQ ID NO: 465333 - RNA, 32 nt, Human
ggggauugagcagcccaggagaagagagaugg

SEQ ID NO: 465334 - RNA, 32 nt, Human
ggggauugagucuugcugcucugcccagcccu

SEQ ID NO: 465335 - RNA, 32 nt, Human
ggggauuggagguggguguuagugguuagaag

SEQ ID NO: 465336 - RNA, 32 nt, Human
ggggauuucagcugugugcaggcacagaugca

SEQ ID NO: 465337 - RNA, 32 nt, Human
ggggauuucuguguccugacaccaccucccca

SEQ ID NO: 465338 - RNA, 32 nt, Human
ggggauuucuucuuggcucccugcuuucccca

SEQ ID NO: 465339 - RNA, 32 nt, Human
ggggauuugcacacaaaugcagcagagucugg

SEQ ID NO: 465340 - RNA, 32 nt, Human
ggggauuuuaucuguucaaugugcaaccugau

SEQ ID NO: 465341 - RNA, 32 nt, Human
ggggauuuuugaccaggaugugagugaccaga

SEQ ID NO: 465342 - RNA, 32 nt, Human
ggggcaaaaccauacggaugcgcugcugucug

SEQ ID NO: 465343 - RNA, 32 nt, Human
ggggcaaaccauugaugguuuucaaguauaug

SEQ ID NO: 465344 - RNA, 18 nt, Human
ggggcaaagaccugaaca

SEQ ID NO: 465345 - RNA, 19 nt, Human
ggggcaaagaggggugcag

SEQ ID NO: 465346 - RNA, 24 nt, Human
ggggcaaaggggugggcgauuucu

SEQ ID NO: 465347 - RNA, 32 nt, Human
ggggcaaaugugcccugaguccuugggguggu

SEQ ID NO: 465348 - RNA, 32 nt, Human
ggggcaacauauggagacuccgucucuacaga

SEQ ID NO: 465349 - RNA, 32 nt, Human
ggggcaacaugaugaaaucccaucucuaaaaa

SEQ ID NO: 465350 - RNA, 32 nt, Human
ggggcaacauggcaaaacccugucucuacuaa

SEQ ID NO: 465351 - RNA, 21 nt, Human
ggggcaaccccgugagcguca

SEQ ID NO: 465352 - RNA, 32 nt, Human
ggggcaaccuaaauucagagagcacccuggcu

SEQ ID NO: 465353 - RNA, 32 nt, Human
ggggcaacgaggguggaggucccacugagccu

SEQ ID NO: 465354 - RNA, 32 nt, Human
ggggcaacucaggauuuuaaguuccauaaagu

SEQ ID NO: 465355 - RNA, 32 nt, Human
ggggcaacugguuggagggaaggugaaguuca

SEQ ID NO: 465356 - RNA, 32 nt, Human
ggggcaagaauguacauuuucuuuuuagaaaa

SEQ ID NO: 465357 - RNA, 18 nt, Human
ggggcaagagcaacaacg

SEQ ID NO: 465358 - RNA, 19 nt, Human
ggggcaagagcauguacaa

SEQ ID NO: 465359 - RNA, 32 nt, Human
ggggcaagaggaagaaugugggggugaagagg

SEQ ID NO: 465360 - RNA, 19 nt, Human
ggggcaagaugcaguacaa

SEQ ID NO: 465361 - RNA, 32 nt, Human
ggggcaagcagaaccucuggccuccuaucagg

SEQ ID NO: 465362 - RNA, 18 nt, Human
ggggcaagcagcacaccg

SEQ ID NO: 465363 - RNA, 31 nt, Human
ggggcaagccucucugcaccugcguguccag

SEQ ID NO: 465364 - RNA, 32 nt, Human
ggggcaaggaagaggaguuggccaacaggcag

SEQ ID NO: 465365 - RNA, 32 nt, Human
ggggcaaggagaaaggagaggugacugcugau

SEQ ID NO: 465366 - RNA, 32 nt, Human
ggggcaaggcccugagaaggagaacaucgugu

SEQ ID NO: 465367 - RNA, 32 nt, Human
ggggcaaggcuccgagggcagcauucaguagc

SEQ ID NO: 465368 - RNA, 32 nt, Human
ggggcaagggccgugggcucugcccgcaccug

SEQ ID NO: 465369 - RNA, 32 nt, Human
ggggcaagguaacccugaagguggaguaggaa

SEQ ID NO: 465370 - RNA, 32 nt, Human
ggggcaaggucugagggcccaccgaugagaga

SEQ ID NO: 465371 - RNA, 32 nt, Human
ggggcaagucagcgccucuaaguggcuuagcg

SEQ ID NO: 465372 - RNA, 17 nt, Human
ggggcaaguccagguca

SEQ ID NO: 465373 - RNA, 31 nt, Human
ggggcaagugagagccggacgggcacugggc

SEQ ID NO: 465374 - RNA, 32 nt, Human
ggggcaagugaguuaggggcccaggggcaauu

SEQ ID NO: 465375 - RNA, 20 nt, Human
ggggcaaguggaggggacgg

SEQ ID NO: 465376 - RNA, 32 nt, Human
ggggcaaguggaggggacggcucagacgcaca

SEQ ID NO: 465377 - RNA, 32 nt, Human
ggggcaauauaaggagaccccaucucuacaaa

SEQ ID NO: 465378 - RNA, 18 nt, Human
ggggcaaugcaccuuugc

SEQ ID NO: 465379 - RNA, 32 nt, Human
ggggcaauggccaauucuaaucucaagucauu

SEQ ID NO: 465380 - RNA, 32 nt, Human
ggggcaauugauaaaggaaggacucuagugac

SEQ ID NO: 465381 - RNA, 32 nt, Human
ggggcacaauagcucugaagcugcagugaccc

SEQ ID NO: 465382 - RNA, 20 nt, Human
ggggcacacgccccaaggga

SEQ ID NO: 465383 - RNA, 32 nt, Human
ggggcacacgcugggccaaggugcaggcggcc

SEQ ID NO: 465384 - RNA, 32 nt, Human
ggggcacacguauccugaggggcuugggccau

SEQ ID NO: 465385 - RNA, 32 nt, Human
ggggcacacuccuaaauugcuggaugacugaa

SEQ ID NO: 465386 - RNA, 32 nt, Human
ggggcacagaagaagaaaaagaacuggggugc

SEQ ID NO: 465387 - RNA, 23 nt, Human
ggggcacagcaacuuccgggccu

SEQ ID NO: 465388 - RNA, 32 nt, Human
ggggcacagcacagaccccagagccaggaacc

SEQ ID NO: 465389 - RNA, 32 nt, Human
ggggcacagcacagaccccagaggcaggaacc

SEQ ID NO: 465390 - RNA, 32 nt, Human
ggggcacagccugucacugcucugccuaagag

SEQ ID NO: 465391 - RNA, 32 nt, Human
ggggcacagggagggacagcgggaggugucgc

SEQ ID NO: 465392 - RNA, 32 nt, Human
ggggcacagggaggggcagcgagcaggugggg

SEQ ID NO: 465393 - RNA, 32 nt, Human
ggggcacagugaagugcugaagggcuucucag

SEQ ID NO: 465394 - RNA, 32 nt, Human
ggggcacagugaauguguguauguaugaaggc

SEQ ID NO: 465395 - RNA, 32 nt, Human
ggggcacauagaagcccucacacacacaugcc

SEQ ID NO: 465396 - RNA, 32 nt, Human
ggggcacaucccucagcaggacagcaacaguc

SEQ ID NO: 465397 - RNA, 21 nt, Human
ggggcacauggagugggacag

SEQ ID NO: 465398 - RNA, 21 nt, Human
ggggcaccaagaaccugcuca

SEQ ID NO: 465399 - RNA, 32 nt, Human
ggggcaccaagggagagaggggcccaggggua

SEQ ID NO: 465400 - RNA, 32 nt, Human
ggggcaccacuacuccagcccagaaggaaagg

SEQ ID NO: 465401 - RNA, 32 nt, Human
ggggcaccagaggcaguaaccaugcccgcaua

SEQ ID NO: 465402 - RNA, 22 nt, Human
ggggcaccccaaagagggggca

SEQ ID NO: 465403 - RNA, 32 nt, Human
ggggcacccuccucucagcaccaaaauggccc

SEQ ID NO: 465404 - RNA, 32 nt, Human
ggggcacccucgggccauccagcccaguguuu

SEQ ID NO: 465405 - RNA, 32 nt, Human
ggggcacccugugagguggccccugagaggug

SEQ ID NO: 465406 - RNA, 32 nt, Human
ggggcaccugggaggucaaaggucuccaccac

SEQ ID NO: 465407 - RNA, 22 nt, Human
ggggcacgaacaggucugguga

SEQ ID NO: 465408 - RNA, 25 nt, Human
ggggcacgaagugggcccuggguga

SEQ ID NO: 465409 - RNA, 21 nt, Human
ggggcacgaggcaucaguugg

SEQ ID NO: 465410 - RNA, 22 nt, Human
ggggcacgagggccugggcugg

SEQ ID NO: 465411 - RNA, 32 nt, Human
ggggcacgaguggcugcggagugugggugguu

SEQ ID NO: 465412 - RNA, 20 nt, Human
ggggcacgcucggggccugc

SEQ ID NO: 465413 - RNA, 26 nt, Human
ggggcacggagggcagucccgggugg

SEQ ID NO: 465414 - RNA, 32 nt, Human
ggggcacgggagaaggguggggaccguugcug

SEQ ID NO: 465415 - RNA, 22 nt, Human
ggggcacggggcgcggggccgg

SEQ ID NO: 465416 - RNA, 24 nt, Human
ggggcacgguggcucaugccugua

SEQ ID NO: 465417 - RNA, 32 nt, Human
ggggcacguggacugguucugcuguuuuuggc

SEQ ID NO: 465418 - RNA, 32 nt, Human
ggggcacuccugggcagcuuuugcucagugga

SEQ ID NO: 465419 - RNA, 32 nt, Human
ggggcacuggcccuguggagcugcaguaagag

SEQ ID NO: 465420 - RNA, 32 nt, Human
ggggcacuggcucauuccaagacuguucuugu

SEQ ID NO: 465421 - RNA, 32 nt, Human
ggggcacuggcugccuggcugccuccuggagu

SEQ ID NO: 465422 - RNA, 32 nt, Human
ggggcacuguacccuucuagccccaucagggg

SEQ ID NO: 465423 - RNA, 32 nt, Human
ggggcacugucuccucuucccuccucuuggga

SEQ ID NO: 465424 - RNA, 32 nt, Human
ggggcacuuccucuucucuuuucuagucaggg

SEQ ID NO: 465425 - RNA, 32 nt, Human
ggggcacuuggcuaugcugauucgcgugaagg

SEQ ID NO: 465426 - RNA, 32 nt, Human
ggggcagaaagagggcgagagagcuccccgag

SEQ ID NO: 465427 - RNA, 32 nt, Human
ggggcagaacaaggcuggugcuuccuucuagu

SEQ ID NO: 465428 - RNA, 32 nt, Human
ggggcagaaccaauuggaaggaagaaagggac

SEQ ID NO: 465429 - RNA, 32 nt, Human
ggggcagaaccagcacaucuggagccacacag

SEQ ID NO: 465430 - RNA, 32 nt, Human
ggggcagaagugagagaaugagccaacccaug

SEQ ID NO: 465431 - RNA, 32 nt, Human
ggggcagacaccucuggacugacaaugguauc

SEQ ID NO: 465432 - RNA, 22 nt, Human
ggggcagacgcgauucagguga

SEQ ID NO: 465433 - RNA, 32 nt, Human
ggggcagagaaaggaagggaacuggagcuggc

SEQ ID NO: 465434 - RNA, 32 nt, Human
ggggcagagagaauacugacagcagaggucuu

SEQ ID NO: 465435 - RNA, 32 nt, Human
ggggcagagagggagagccgguccuagcuccu

SEQ ID NO: 465436 - RNA, 20 nt, Human
ggggcagagccaggaggcag

SEQ ID NO: 465437 - RNA, 32 nt, Human
ggggcagagccccagccagggcagcugcuucc

SEQ ID NO: 465438 - RNA, 32 nt, Human
ggggcagaggagcggaguugaggcagaagcca

SEQ ID NO: 465439 - RNA, 19 nt, Human
ggggcagaggcaggggcgg

SEQ ID NO: 465440 - RNA, 32 nt, Human
ggggcagaggcucauagcaccucagacucuca

SEQ ID NO: 465441 - RNA, 32 nt, Human
ggggcagagggagggagccaaggucacuccaa

SEQ ID NO: 465442 - RNA, 32 nt, Human
ggggcagcaaacaguaacuaccaaaaccaaug

SEQ ID NO: 465443 - RNA, 32 nt, Human
ggggcagcacagguucugggauugugaggcug

SEQ ID NO: 465444 - RNA, 19 nt, Human
ggggcagcacugccugcug

SEQ ID NO: 465445 - RNA, 19 nt, Human
ggggcagcagaacaaugca

SEQ ID NO: 465446 - RNA, 19 nt, Human
ggggcagcagcagccuccu

SEQ ID NO: 465447 - RNA, 32 nt, Human
ggggcagcagccuggccugugccauggugggu

SEQ ID NO: 465448 - RNA, 24 nt, Human
ggggcagcagcugcuucggaucca

SEQ ID NO: 465449 - RNA, 32 nt, Human
ggggcagcaggcccaaaccccaacaggguauu

SEQ ID NO: 465450 - RNA, 18 nt, Human
ggggcagcaguacugcug

SEQ ID NO: 465451 - RNA, 32 nt, Human
ggggcagcauacgggguugcaagugaagccgc

SEQ ID NO: 465452 - RNA, 20 nt, Human
ggggcagcaugacccaagca

SEQ ID NO: 465453 - RNA, 32 nt, Human
ggggcagccacuggcuccgcgggcacaggccu

SEQ ID NO: 465454 - RNA, 32 nt, Human
ggggcagccagcccuggcuggagagcgggacg

SEQ ID NO: 465455 - RNA, 32 nt, Human
ggggcagcccagggcaguguugcugcauauug

SEQ ID NO: 465456 - RNA, 32 nt, Human
ggggcagcccucccccuuuccuucucucccug

SEQ ID NO: 465457 - RNA, 32 nt, Human
ggggcagccgcugacagcaugcagagcaaguu

SEQ ID NO: 465458 - RNA, 32 nt, Human
ggggcagccuaggaggcccacccucuuuggag

SEQ ID NO: 465459 - RNA, 32 nt, Human
ggggcagccuccagucugcucucagcuugugc

SEQ ID NO: 465460 - RNA, 18 nt, Human
ggggcagccucugccuca

SEQ ID NO: 465461 - RNA, 32 nt, Human
ggggcagccucuggcuuggacagggucuguuu

SEQ ID NO: 465462 - RNA, 32 nt, Human
ggggcagcgcagaccucugcggcccgggcggg

SEQ ID NO: 465463 - RNA, 32 nt, Human
ggggcagcgcagggcagacggcggcaggagaa

SEQ ID NO: 465464 - RNA, 23 nt, Human
ggggcagcgcccaccugccggug

SEQ ID NO: 465465 - RNA, 32 nt, Human
ggggcagcgcuaugggcucucgugcggacggc

SEQ ID NO: 465466 - RNA, 32 nt, Human
ggggcagcggcgccgcagccugggcuggcgga

SEQ ID NO: 465467 - RNA, 32 nt, Human
ggggcagcuccuggggagcaucagggaagagg

SEQ ID NO: 465468 - RNA, 32 nt, Human
ggggcagcucgggagagccggagcgguagcgg

SEQ ID NO: 465469 - RNA, 32 nt, Human
ggggcagcucgggagagcgggagcgguggcgg

SEQ ID NO: 465470 - RNA, 32 nt, Human
ggggcagcucuaggcuggggcuugcgcugggc

SEQ ID NO: 465471 - RNA, 32 nt, Human
ggggcagcucucuucucuccccaggacccagg

SEQ ID NO: 465472 - RNA, 32 nt, Human
ggggcagcugccgcgguggucgccucuggcag

SEQ ID NO: 465473 - RNA, 32 nt, Human
ggggcagcugcugcacuggcccagggagggcc

SEQ ID NO: 465474 - RNA, 32 nt, Human
ggggcagcuggugugacacaaggagcugcggg

SEQ ID NO: 465475 - RNA, 20 nt, Human
ggggcagcuugggcuggaga

SEQ ID NO: 465476 - RNA, 32 nt, Human
ggggcaggaacagcaggccuggccagcccaaa

SEQ ID NO: 465477 - RNA, 32 nt, Human
ggggcaggaaccuggggaggggcccagagcaa

SEQ ID NO: 465478 - RNA, 32 nt, Human
ggggcaggaagaggagcagaaaagaagggcug

SEQ ID NO: 465479 - RNA, 32 nt, Human
ggggcaggaaggcagaaggucuugguggcccu

SEQ ID NO: 465480 - RNA, 20 nt, Human
ggggcaggaagggaggcggc

SEQ ID NO: 465481 - RNA, 32 nt, Human
ggggcaggacagcagaggaugugcugggauua

SEQ ID NO: 465482 - RNA, 32 nt, Human
ggggcaggagaaugggguguucccugcugucc

SEQ ID NO: 465483 - RNA, 16 nt, Human
ggggcaggagcccccu

SEQ ID NO: 465484 - RNA, 32 nt, Human
ggggcaggaggaagauugcaggggcgggaaga

SEQ ID NO: 465485 - RNA, 32 nt, Human
ggggcaggaggagagaggaaaagggagggcga

SEQ ID NO: 465486 - RNA, 20 nt, Human
ggggcaggaggcagaggcag

SEQ ID NO: 465487 - RNA, 24 nt, Human
ggggcaggaggcagggcggggagg

SEQ ID NO: 465488 - RNA, 32 nt, Human
ggggcaggaggccagugguggggacgcagagg

SEQ ID NO: 465489 - RNA, 20 nt, Human
ggggcaggaggugagggcag

SEQ ID NO: 465490 - RNA, 32 nt, Human
ggggcaggaguuagcacacacgcagcacagca

SEQ ID NO: 465491 - RNA, 32 nt, Human
ggggcaggaugccugccaggguguucuggggg

SEQ ID NO: 465492 - RNA, 32 nt, Human
ggggcaggcccaggcgcggccgccgaaucacg

SEQ ID NO: 465493 - RNA, 32 nt, Human
ggggcaggcugcagaggacucaugacaggcua

SEQ ID NO: 465494 - RNA, 32 nt, Human
ggggcagggaaaggucagcauaggagagaaag

SEQ ID NO: 465495 - RNA, 32 nt, Human
ggggcagggacccccggaagccccagcaaucc

SEQ ID NO: 465496 - RNA, 32 nt, Human
ggggcagggagccagguacagagcagauuugg

SEQ ID NO: 465497 - RNA, 32 nt, Human
ggggcagggagcugaaggacuccaccgcugcc

SEQ ID NO: 465498 - RNA, 32 nt, Human
ggggcagggaggaucacuggaguacaggaguu

SEQ ID NO: 465499 - RNA, 32 nt, Human
ggggcagggaggcgcagccacacuccugcucu

SEQ ID NO: 465500 - RNA, 32 nt, Human
ggggcagggagguggggguugggggaguagug

SEQ ID NO: 465501 - RNA, 18 nt, Human
ggggcagggagucgagga

SEQ ID NO: 465502 - RNA, 20 nt, Human
ggggcagggcagaagcagga

SEQ ID NO: 465503 - RNA, 32 nt, Human
ggggcagggcagcagagggagggacccugaag

SEQ ID NO: 465504 - RNA, 32 nt, Human
ggggcagggcaggccucuuggagcaccuccuc

SEQ ID NO: 465505 - RNA, 32 nt, Human
ggggcagggccugaggcaagaggugggaggag

SEQ ID NO: 465506 - RNA, 32 nt, Human
ggggcagggccugggccucauggcuuuugcuu

SEQ ID NO: 465507 - RNA, 19 nt, Human
ggggcaggggcaggggcag

SEQ ID NO: 465508 - RNA, 32 nt, Human
ggggcaggggcaguggcagugugcaaagaauu

SEQ ID NO: 465509 - RNA, 32 nt, Human
ggggcagggugaaggcuucagcucacuguugu

SEQ ID NO: 465510 - RNA, 32 nt, Human
ggggcagggugugaggacuggcugcucuggga

SEQ ID NO: 465511 - RNA, 32 nt, Human
ggggcaggguuagaggguugugaggggaagag

SEQ ID NO: 465512 - RNA, 32 nt, Human
ggggcaggucuccagcugaaucugugccuaca

SEQ ID NO: 465513 - RNA, 32 nt, Human
ggggcaggucuccagcugaaucugugccuacg

SEQ ID NO: 465514 - RNA, 32 nt, Human
ggggcaggucucucaaccaggcauauuuuuaa

SEQ ID NO: 465515 - RNA, 22 nt, Human
ggggcaggugcagagguggcag

SEQ ID NO: 465516 - RNA, 20 nt, Human
ggggcagguggagggagcag

SEQ ID NO: 465517 - RNA, 32 nt, Human
ggggcaggugggggaauggaggcugcaggacu

SEQ ID NO: 465518 - RNA, 32 nt, Human
ggggcaggugugaaguugcugagggcagaggg

SEQ ID NO: 465519 - RNA, 32 nt, Human
ggggcagguguuuucugugacaguuggaaaua

SEQ ID NO: 465520 - RNA, 32 nt, Human
ggggcagguuagacgcuggggagccaguuggc

SEQ ID NO: 465521 - RNA, 32 nt, Human
ggggcagguugcuaagucaggugcagagguuc

SEQ ID NO: 465522 - RNA, 32 nt, Human
ggggcagguuuuuaaaaauuagcuaggcauca

SEQ ID NO: 465523 - RNA, 32 nt, Human
ggggcaguaacaugaauggagcugucaucucc

SEQ ID NO: 465524 - RNA, 32 nt, Human
ggggcagucaaauuagcaccuacuggcucuga

SEQ ID NO: 465525 - RNA, 32 nt, Human
ggggcagucaccgagugaccaccaagaggaag

SEQ ID NO: 465526 - RNA, 23 nt, Human
ggggcagugaaguguuuagguga

SEQ ID NO: 465527 - RNA, 19 nt, Human
ggggcaguggggccugcag

SEQ ID NO: 465528 - RNA, 32 nt, Human
ggggcagugguugugucuggggccaaguuucu

SEQ ID NO: 465529 - RNA, 32 nt, Human
ggggcaguuaacccuucucuugcugcggcaga

SEQ ID NO: 465530 - RNA, 32 nt, Human
ggggcaguuccucuuuccuucccaagcaccga

SEQ ID NO: 465531 - RNA, 23 nt, Human
ggggcauaagaguuuccaggugg

SEQ ID NO: 465532 - RNA, 20 nt, Human
ggggcauagcaugggggcag

SEQ ID NO: 465533 - RNA, 32 nt, Human
ggggcaucacccaggugaaugguguccaggug

SEQ ID NO: 465534 - RNA, 22 nt, Human
ggggcaucagcagagggggcag

SEQ ID NO: 465535 - RNA, 20 nt, Human
ggggcaucaggaaagggcag

SEQ ID NO: 465536 - RNA, 20 nt, Human
ggggcaucccagagggggca

SEQ ID NO: 465537 - RNA, 32 nt, Human
ggggcaucucuccccugcuccagcgcaucucc

SEQ ID NO: 465538 - RNA, 32 nt, Human
ggggcaucugugugucccgucacacacugcag

SEQ ID NO: 465539 - RNA, 19 nt, Human
ggggcaugaaagagggcag

SEQ ID NO: 465540 - RNA, 22 nt, Human
ggggcaugaaagagggcaguga

SEQ ID NO: 465541 - RNA, 21 nt, Human
ggggcaugagacacacaggga

SEQ ID NO: 465542 - RNA, 32 nt, Human
ggggcaugagacacacagggaggcuggggcug

SEQ ID NO: 465543 - RNA, 21 nt, Human
ggggcaugagccccuggguga

SEQ ID NO: 465544 - RNA, 32 nt, Human
ggggcaugcaggugcccaccucccaggguagg

SEQ ID NO: 465545 - RNA, 30 nt, Human
ggggcaugcccaggcagagugacaggagag

SEQ ID NO: 465546 - RNA, 25 nt, Human
ggggcaugcccggccaucaggguga

SEQ ID NO: 465547 - RNA, 32 nt, Human
ggggcaugccuauaaucccaauacuuuaggag

SEQ ID NO: 465548 - RNA, 32 nt, Human
  misc_feature (23)..(23): n is a, c, g or u
  misc_feature (31)..(31): n is a, c, g or u
ggggcaugccuguaaucccagcnacucgccng

SEQ ID NO: 465549 - RNA, 32 nt, Human
ggggcaugccuguagucccaccuacuugggag

SEQ ID NO: 465550 - RNA, 32 nt, Human
ggggcaugccuguagucccacuuacuugggag

SEQ ID NO: 465551 - RNA, 32 nt, Human
ggggcaugccuguagucccagcuacucagaag

SEQ ID NO: 465552 - RNA, 23 nt, Human
ggggcauggaagugccagggugg

SEQ ID NO: 465553 - RNA, 32 nt, Human
ggggcaugggaaggugggcgggcaggggaggg

SEQ ID NO: 465554 - RNA, 23 nt, Human
ggggcauggguggcuccaggaga

SEQ ID NO: 465555 - RNA, 32 nt, Human
ggggcauguggacagcagggaccugcgcuacc

SEQ ID NO: 465556 - RNA, 32 nt, Human
ggggcaugugguuccagagaaagagaggauac

SEQ ID NO: 465557 - RNA, 32 nt, Human
ggggcauguugggagagggggagggaggggag

SEQ ID NO: 465558 - RNA, 32 nt, Human
ggggcauuucuagagcagugacccuggaaaac

SEQ ID NO: 465559 - RNA, 32 nt, Human
ggggcauuuucaaauucugccuaccacaggca

SEQ ID NO: 465560 - RNA, 32 nt, Human
ggggcauuuugugccugccuagcuauccagac

SEQ ID NO: 465561 - RNA, 32 nt, Human
ggggcauuuuguggguggagggccagagugug

SEQ ID NO: 465562 - RNA, 32 nt, Human
ggggccaaaagcuucuccugaucuaccgugga

SEQ ID NO: 465563 - RNA, 28 nt, Human
ggggccaaacauuuacaccuugcuucau

SEQ ID NO: 465564 - RNA, 22 nt, Human
ggggccaaaguuuuuauguggg

SEQ ID NO: 465565 - RNA, 32 nt, Human
ggggccaaccagcuacuggagcucuuugaccu

SEQ ID NO: 465566 - RNA, 32 nt, Human
ggggccaacgcuaguauggaggcugcaauaga

SEQ ID NO: 465567 - RNA, 32 nt, Human
ggggccaaggaugccaccccacccucagcugu

SEQ ID NO: 465568 - RNA, 32 nt, Human
ggggccaaggcaaaggggaagcauucacagac

SEQ ID NO: 465569 - RNA, 32 nt, Human
ggggccaaggcagaggaggaggacgacauccu

SEQ ID NO: 465570 - RNA, 32 nt, Human
ggggccaaggggauggacaggagaagucaugc

SEQ ID NO: 465571 - RNA, 32 nt, Human
ggggccaagucagugcuuccaaaggagggugc

SEQ ID NO: 465572 - RNA, 32 nt, Human
ggggccaaugggggccucagggggaggccccc

SEQ ID NO: 465573 - RNA, 32 nt, Human
ggggccacacggggcuucuaaguuagguugcc

SEQ ID NO: 465574 - RNA, 32 nt, Human
ggggccacagccacagccugcuggucucgaac

SEQ ID NO: 465575 - RNA, 32 nt, Human
ggggccacagccggcacaggcgcaggggcagu

SEQ ID NO: 465576 - RNA, 32 nt, Human
ggggccacagccggucucagcuuucuguguuc

SEQ ID NO: 465577 - RNA, 19 nt, Human
ggggccacagccugggugg

SEQ ID NO: 465578 - RNA, 22 nt, Human
ggggccacaguugcugcuucau

SEQ ID NO: 465579 - RNA, 23 nt, Human
ggggccacauucuuugccuucau

SEQ ID NO: 465580 - RNA, 19 nt, Human
ggggccaccagagcccccu

SEQ ID NO: 465581 - RNA, 32 nt, Human
ggggccacccuccagccuggggcaucugaugg

SEQ ID NO: 465582 - RNA, 22 nt, Human
ggggccacccuggagacuugga

SEQ ID NO: 465583 - RNA, 22 nt, Human
ggggccaccgcccaggccagcu

SEQ ID NO: 465584 - RNA, 32 nt, Human
ggggccaccgggcgggaguggggaaggguggg

SEQ ID NO: 465585 - RNA, 32 nt, Human
ggggccaccucacccucuuguuacagcagauc

SEQ ID NO: 465586 - RNA, 23 nt, Human
ggggccaccucacguucugcuuc

SEQ ID NO: 465587 - RNA, 24 nt, Human
ggggccaccuuugugcagcuucga

SEQ ID NO: 465588 - RNA, 21 nt, Human
ggggccacggguccagcccag

SEQ ID NO: 465589 - RNA, 22 nt, Human
ggggccacguggcagcgcccga

SEQ ID NO: 465590 - RNA, 32 nt, Human
ggggccacugauuuucaaagagaucugugauc

SEQ ID NO: 465591 - RNA, 32 nt, Human
ggggccacugcacugcagccugugugacaaag

SEQ ID NO: 465592 - RNA, 32 nt, Human
ggggccacugccuccagcugugucuagugcug

SEQ ID NO: 465593 - RNA, 32 nt, Human
ggggccacuguggccuaccugcugauuuucag

SEQ ID NO: 465594 - RNA, 24 nt, Human
ggggccacuuggaccaagcuccag

SEQ ID NO: 465595 - RNA, 18 nt, Human
ggggccagaacccaagag

SEQ ID NO: 465596 - RNA, 18 nt, Human
ggggccagaaccgaggag

SEQ ID NO: 465597 - RNA, 32 nt, Human
ggggccagaacuccagcccuggggagugggca

SEQ ID NO: 465598 - RNA, 32 nt, Human
ggggccagaaggacccuccccaacccuggaga

SEQ ID NO: 465599 - RNA, 32 nt, Human
ggggccagaccaccccauuguccauccuuguu

SEQ ID NO: 465600 - RNA, 32 nt, Human
ggggccagacuccagccuguuuccccagcccu

SEQ ID NO: 465601 - RNA, 32 nt, Human
ggggccagacuggcacaaggcacucgugccca

SEQ ID NO: 465602 - RNA, 22 nt, Human
ggggccagaggcaaggccggcu

SEQ ID NO: 465603 - RNA, 32 nt, Human
ggggccagaguguuggcuuuggauucaggagg

SEQ ID NO: 465604 - RNA, 32 nt, Human
ggggccagcacccacacugggucuccacagcg

SEQ ID NO: 465605 - RNA, 19 nt, Human
ggggccagcacccccgcug

SEQ ID NO: 465606 - RNA, 17 nt, Human
ggggccagcagccgccc

SEQ ID NO: 465607 - RNA, 32 nt, Human
ggggccagcagcugucauccuccugggaagcc

SEQ ID NO: 465608 - RNA, 32 nt, Human
ggggccagccugggaccagcagaguggaaaag

SEQ ID NO: 465609 - RNA, 32 nt, Human
ggggccagcgggcaccaggcuugggggcugag

SEQ ID NO: 465610 - RNA, 32 nt, Human
ggggccagcuacccuucuggccuuuuagcguc

SEQ ID NO: 465611 - RNA, 17 nt, Human
ggggccagcucagugga

SEQ ID NO: 465612 - RNA, 23 nt, Human
ggggccagcucaguggagcagcu

SEQ ID NO: 465613 - RNA, 32 nt, Human
ggggccagcucccuccuggggacccggagccg

SEQ ID NO: 465614 - RNA, 32 nt, Human
ggggccagcugcugccccagaguccugccccc

SEQ ID NO: 465615 - RNA, 32 nt, Human
ggggccagcugcugugugaguacagcaucuuc

SEQ ID NO: 465616 - RNA, 32 nt, Human
ggggccaggaagaggauccuucagcgaccugc

SEQ ID NO: 465617 - RNA, 32 nt, Human
ggggccaggaaggggaaguaggagagcuuugg

SEQ ID NO: 465618 - RNA, 32 nt, Human
ggggccaggaaggggacaggauugucugcugc

SEQ ID NO: 465619 - RNA, 22 nt, Human
ggggccaggacacagcucagcu

SEQ ID NO: 465620 - RNA, 21 nt, Human
ggggccaggacaggaccaguu

SEQ ID NO: 465621 - RNA, 31 nt, Human
ggggccaggacagugccucagagcugcuccg

SEQ ID NO: 465622 - RNA, 21 nt, Human
ggggccaggagcucucuugga

SEQ ID NO: 465623 - RNA, 32 nt, Human
ggggccaggagcugccccaaguccuuuccaca

SEQ ID NO: 465624 - RNA, 24 nt, Human
ggggccaggagggcaggaccgucu

SEQ ID NO: 465625 - RNA, 32 nt, Human
ggggccaggagggucagaguggugccaggugc

SEQ ID NO: 465626 - RNA, 32 nt, Human
ggggccaggcacugugcuaggcaccagcaggg

SEQ ID NO: 465627 - RNA, 32 nt, Human
ggggccaggcagcugagggccaggaaagaugu

SEQ ID NO: 465628 - RNA, 22 nt, Human
ggggccaggcagggaggccagu

SEQ ID NO: 465629 - RNA, 21 nt, Human
ggggccaggccacccugcggg

SEQ ID NO: 465630 - RNA, 25 nt, Human
ggggccaggccaggccaggccagcu

SEQ ID NO: 465631 - RNA, 32 nt, Human
ggggccaggccaggccagugccuucgccucuc

SEQ ID NO: 465632 - RNA, 23 nt, Human
ggggccaggcccggggccggcag

SEQ ID NO: 465633 - RNA, 32 nt, Human
ggggccaggccgcggcugcggcccaggcaacg

SEQ ID NO: 465634 - RNA, 32 nt, Human
ggggccaggccugcaucaggggcuaggcucug

SEQ ID NO: 465635 - RNA, 18 nt, Human
ggggccaggccugcucca

SEQ ID NO: 465636 - RNA, 23 nt, Human
ggggccaggccuucgaucaccca

SEQ ID NO: 465637 - RNA, 32 nt, Human
ggggccaggcuccacucccaaaugagacuggc

SEQ ID NO: 465638 - RNA, 23 nt, Human
ggggccaggcugccaaggcggcu

SEQ ID NO: 465639 - RNA, 32 nt, Human
ggggccaggcugggagcccacagccaccccac

SEQ ID NO: 465640 - RNA, 25 nt, Human
ggggccagggagcagcaagccagcu

SEQ ID NO: 465641 - RNA, 20 nt, Human
ggggccagggcacagccggc

SEQ ID NO: 465642 - RNA, 20 nt, Human
ggggccagggcaggaccagc

SEQ ID NO: 465643 - RNA, 32 nt, Human
ggggccagggcaggcaccagccccaggcggcc

SEQ ID NO: 465644 - RNA, 32 nt, Human
ggggccagggcccagacccaagaggagagggu

SEQ ID NO: 465645 - RNA, 20 nt, Human
ggggccagggcccaggccag

SEQ ID NO: 465646 - RNA, 20 nt, Human
ggggccagggcugagccggc

SEQ ID NO: 465647 - RNA, 32 nt, Human
ggggccagggcugcugccauccuggccuggug

SEQ ID NO: 465648 - RNA, 32 nt, Human
ggggccaggggaggggcgggcagguaggugca

SEQ ID NO: 465649 - RNA, 32 nt, Human
ggggccagggguagcugagcuuaaaggcccug

SEQ ID NO: 465650 - RNA, 22 nt, Human
ggggccagggguucugggcagc

SEQ ID NO: 465651 - RNA, 19 nt, Human
ggggccaggguggcucuuc

SEQ ID NO: 465652 - RNA, 32 nt, Human
ggggccaggugggaacaguguguccucugccc

SEQ ID NO: 465653 - RNA, 26 nt, Human
ggggccagugagggcugggcccacag

SEQ ID NO: 465654 - RNA, 32 nt, Human
ggggccaguggggccagcucagggaggaccug

SEQ ID NO: 465655 - RNA, 32 nt, Human
ggggccauauaguuugguuaugacaucaauau

SEQ ID NO: 465656 - RNA, 23 nt, Human
ggggccauauguucaccugcuuu

SEQ ID NO: 465657 - RNA, 32 nt, Human
ggggccaucugggcagagacuuguggaauccc

SEQ ID NO: 465658 - RNA, 19 nt, Human
ggggccaugcagcccuccu

SEQ ID NO: 465659 - RNA, 32 nt, Human
ggggccaugccuugguggggccugugucgggc

SEQ ID NO: 465660 - RNA, 32 nt, Human
ggggccauggugcacuguagguggcugcaaug

SEQ ID NO: 465661 - RNA, 32 nt, Human
ggggccaugguggagggcacuucagguccgug

SEQ ID NO: 465662 - RNA, 24 nt, Human
ggggccauguauacgcugccucgc

SEQ ID NO: 465663 - RNA, 32 nt, Human
ggggccauuagggagagcagagcgaggcagcu

SEQ ID NO: 465664 - RNA, 32 nt, Human
ggggccauucuuauucaguucuuucuguagcu

SEQ ID NO: 465665 - RNA, 32 nt, Human
ggggcccaacacgugguaggcacuccaucagu

SEQ ID NO: 465666 - RNA, 24 nt, Human
ggggcccaacccugcccacuucag

SEQ ID NO: 465667 - RNA, 32 nt, Human
ggggcccaagagucuggggaccagcuuggcuc

SEQ ID NO: 465668 - RNA, 32 nt, Human
ggggcccacagcccuggcugcaggcaucauga

SEQ ID NO: 465669 - RNA, 21 nt, Human
ggggcccaccaccgcgcccgg

SEQ ID NO: 465670 - RNA, 23 nt, Human
ggggcccacccugcccagcucag

SEQ ID NO: 465671 - RNA, 32 nt, Human
ggggcccacgucucccagaggucuccgagucg

SEQ ID NO: 465672 - RNA, 22 nt, Human
ggggcccagaacuucauaucag

SEQ ID NO: 465673 - RNA, 32 nt, Human
ggggcccagacuccugcggccucaccagggcu

SEQ ID NO: 465674 - RNA, 23 nt, Human
ggggcccagacugcaguggcuca

SEQ ID NO: 465675 - RNA, 24 nt, Human
ggggcccagagcaaagggcaucag

SEQ ID NO: 465676 - RNA, 24 nt, Human
ggggcccagagcccccugcuccag

SEQ ID NO: 465677 - RNA, 32 nt, Human
ggggcccagaguuugccuuuucugccaggcag

SEQ ID NO: 465678 - RNA, 32 nt, Human
ggggcccagcauggucauggcggauggcccga

SEQ ID NO: 465679 - RNA, 32 nt, Human
ggggcccagccccuucucuucucccccgccaa

SEQ ID NO: 465680 - RNA, 32 nt, Human
ggggcccagcucccaguuuacuugguuucccu

SEQ ID NO: 465681 - RNA, 32 nt, Human
ggggcccagcugguucugauucgguggccaga

SEQ ID NO: 465682 - RNA, 22 nt, Human
ggggcccaggaaggccugggca

SEQ ID NO: 465683 - RNA, 32 nt, Human
ggggcccaggaggcagguguaagggagugaaa

SEQ ID NO: 465684 - RNA, 32 nt, Human
ggggcccaggcagaaugcgagaacaccacgug

SEQ ID NO: 465685 - RNA, 32 nt, Human
ggggcccaggccaagguggggugcaggaggaa

SEQ ID NO: 465686 - RNA, 23 nt, Human
ggggcccaggccgcagggggccc

SEQ ID NO: 465687 - RNA, 32 nt, Human
ggggcccagggaggggcaggccgggcggccga

SEQ ID NO: 465688 - RNA, 32 nt, Human
ggggcccagggaggggcaggugugaaguugcu

SEQ ID NO: 465689 - RNA, 22 nt, Human
ggggcccaggggucaggcccag

SEQ ID NO: 465690 - RNA, 22 nt, Human
ggggcccagucagccgcuccag

SEQ ID NO: 465691 - RNA, 32 nt, Human
ggggcccauguggcccaucacacagaagauuc

SEQ ID NO: 465692 - RNA, 32 nt, Human
ggggcccauucagccucgucucuuuacagaag

SEQ ID NO: 465693 - RNA, 32 nt, Human
ggggccccacagaguccuugugcucaguguag

SEQ ID NO: 465694 - RNA, 32 nt, Human
ggggccccacugcaccugcuggcaggaaauaa

SEQ ID NO: 465695 - RNA, 32 nt, Human
ggggccccaggcagggcaggaggugguggaaa

SEQ ID NO: 465696 - RNA, 16 nt, Human
ggggccccccaagagg

SEQ ID NO: 465697 - RNA, 32 nt, Human
ggggcccccucaccuugucccuccucagccag

SEQ ID NO: 465698 - RNA, 32 nt, Human
ggggcccccuccuccaucccugacuggcugag

SEQ ID NO: 465699 - RNA, 32 nt, Human
ggggcccccugccagccccuucccaggcuggg

SEQ ID NO: 465700 - RNA, 23 nt, Human
ggggccccgaacgguggggccgg

SEQ ID NO: 465701 - RNA, 32 nt, Human
ggggccccgagucugcaugggucuccacaugc

SEQ ID NO: 465702 - RNA, 22 nt, Human
ggggccccucaccccaaggggu

SEQ ID NO: 465703 - RNA, 32 nt, Human
ggggccccugcggccucuggccccagacugaa

SEQ ID NO: 465704 - RNA, 32 nt, Human
ggggccccuuuguaaacaagcuucugccaggu

SEQ ID NO: 465705 - RNA, 32 nt, Human
ggggcccgaagcaucuucccuuccgcuuggcg

SEQ ID NO: 465706 - RNA, 19 nt, Human
ggggcccgaggcccgggcc

SEQ ID NO: 465707 - RNA, 18 nt, Human
ggggcccggaugggaggg

SEQ ID NO: 465708 - RNA, 18 nt, Human
ggggcccggccaagaagg

SEQ ID NO: 465709 - RNA, 32 nt, Human
ggggcccgggacuccucgcaaaugugggacac

SEQ ID NO: 465710 - RNA, 32 nt, Human
ggggcccgggcccagccgccgccaccgcugcc

SEQ ID NO: 465711 - RNA, 32 nt, Human
ggggcccggggucggggcuggggaaggggagc

SEQ ID NO: 465712 - RNA, 32 nt, Human
ggggcccgguccugccugucagcuccaggucc

SEQ ID NO: 465713 - RNA, 18 nt, Human
ggggcccguagggcccuc

SEQ ID NO: 465714 - RNA, 32 nt, Human
ggggcccgugagccacucuuagcggccggggc

SEQ ID NO: 465715 - RNA, 32 nt, Human
ggggcccucaggcugggcgcgcuggcgauccc

SEQ ID NO: 465716 - RNA, 32 nt, Human
ggggcccucaucugcuuucccgccacccuauc

SEQ ID NO: 465717 - RNA, 32 nt, Human
ggggcccuccacugcccagagaccugcagggc

SEQ ID NO: 465718 - RNA, 32 nt, Human
ggggcccuccuagcccagggcugccagcugag

SEQ ID NO: 465719 - RNA, 21 nt, Human
ggggcccuccugcucuccaca

SEQ ID NO: 465720 - RNA, 32 nt, Human
ggggcccucuuggaggcagcagugaguuggga

SEQ ID NO: 465721 - RNA, 32 nt, Human
ggggcccugagugcccagccauccuuguucgu

SEQ ID NO: 465722 - RNA, 32 nt, Human
ggggcccugcacaccauggcccccgggugggc

SEQ ID NO: 465723 - RNA, 18 nt, Human
ggggcccugcagcuccag

SEQ ID NO: 465724 - RNA, 32 nt, Human
ggggcccugcagcucucaugcugccccugccu

SEQ ID NO: 465725 - RNA, 32 nt, Human
ggggcccugccaacaccacuuccucagcagaa

SEQ ID NO: 465726 - RNA, 23 nt, Human
ggggcccugcuccaagccugcag

SEQ ID NO: 465727 - RNA, 32 nt, Human
ggggcccugcuggccugcuccuucucucgaaa

SEQ ID NO: 465728 - RNA, 32 nt, Human
ggggcccuggcuuuccagggagugcagcaagc

SEQ ID NO: 465729 - RNA, 32 nt, Human
ggggcccugggcugcaggagguugcggcggcc

SEQ ID NO: 465730 - RNA, 32 nt, Human
ggggcccuguggggucuggcccccaggagcaa

SEQ ID NO: 465731 - RNA, 32 nt, Human
ggggcccuguucugggggaccagcacugucag

SEQ ID NO: 465732 - RNA, 32 nt, Human
ggggcccuugguucccccucauuggaggcuga

SEQ ID NO: 465733 - RNA, 32 nt, Human
ggggcccuuguccugggccauggcccagaagg

SEQ ID NO: 465734 - RNA, 32 nt, Human
ggggcccuuugguggggccguuggacuucugg

SEQ ID NO: 465735 - RNA, 32 nt, Human
ggggccgaagccccaagcugggcacaaaguag

SEQ ID NO: 465736 - RNA, 32 nt, Human
ggggccgagacagguggaucaccugaggucag

SEQ ID NO: 465737 - RNA, 18 nt, Human
ggggccgagcagggggca

SEQ ID NO: 465738 - RNA, 32 nt, Human
ggggccgagccugggaaugggggugaguggag

SEQ ID NO: 465739 - RNA, 22 nt, Human
ggggccgagcguccgagccacu

SEQ ID NO: 465740 - RNA, 32 nt, Human
ggggccgaggagagagcggccgccacccggcc

SEQ ID NO: 465741 - RNA, 32 nt, Human
ggggccgaggcggguggaucaccugaggucag

SEQ ID NO: 465742 - RNA, 32 nt, Human
ggggccgagguggcagggggcuggcaugucaa

SEQ ID NO: 465743 - RNA, 20 nt, Human
ggggccgaguucagcuccgg

SEQ ID NO: 465744 - RNA, 21 nt, Human
ggggccgaguucagcuccgga

SEQ ID NO: 465745 - RNA, 20 nt, Human
ggggccgcagaggggacauu

SEQ ID NO: 465746 - RNA, 32 nt, Human
ggggccgcaggcggacguacucugugagcggc

SEQ ID NO: 465747 - RNA, 32 nt, Human
ggggccgcagggccaaggggugcuugcgccac

SEQ ID NO: 465748 - RNA, 32 nt, Human
ggggccgcaggggcuggccacugugggcucgg

SEQ ID NO: 465749 - RNA, 32 nt, Human
ggggccgccacccuccccuaugcugguagaug

SEQ ID NO: 465750 - RNA, 32 nt, Human
ggggccgccccaggguuccugcgcacugccug

SEQ ID NO: 465751 - RNA, 22 nt, Human
ggggccgccugugcagaugcca

SEQ ID NO: 465752 - RNA, 32 nt, Human
ggggccgcgcucucuucugggagggcagcggc

SEQ ID NO: 465753 - RNA, 32 nt, Human
ggggccgcgcugcuuagccacugggaccccac

SEQ ID NO: 465754 - RNA, 20 nt, Human
ggggccgcggccggaccggc

SEQ ID NO: 465755 - RNA, 32 nt, Human
ggggccgcugggagccgggugagacccccaca

SEQ ID NO: 465756 - RNA, 32 nt, Human
ggggccgcuugggggagggaagaggcagcccg

SEQ ID NO: 465757 - RNA, 32 nt, Human
ggggccggaacacaaccagucuuuuuguauuu

SEQ ID NO: 465758 - RNA, 21 nt, Human
ggggccggaaguggccugcgg

SEQ ID NO: 465759 - RNA, 20 nt, Human
ggggccggacgccaccuucc

SEQ ID NO: 465760 - RNA, 24 nt, Human
ggggccggagaagcagaaccagcu

SEQ ID NO: 465761 - RNA, 32 nt, Human
ggggccggaggcggggugugagugggugugug

SEQ ID NO: 465762 - RNA, 24 nt, Human
ggggccggcaagccagcgaagcuu

SEQ ID NO: 465763 - RNA, 32 nt, Human
ggggccggcaggggguuggggaagaagagggc

SEQ ID NO: 465764 - RNA, 23 nt, Human
ggggccggcccgcacgggcuuca

SEQ ID NO: 465765 - RNA, 19 nt, Human
ggggccggcgaggccgcag

SEQ ID NO: 465766 - RNA, 21 nt, Human
ggggccggcgcccagaguucc

SEQ ID NO: 465767 - RNA, 32 nt, Human
ggggccggcuucuccccucuugugaagcacaa

SEQ ID NO: 465768 - RNA, 32 nt, Human
ggggccgggaaagaggcacaaggaagaaagua

SEQ ID NO: 465769 - RNA, 32 nt, Human
ggggccgggagaccccagcaaaggguagcgag

SEQ ID NO: 465770 - RNA, 23 nt, Human
ggggccgggagcgaggggcagcu

SEQ ID NO: 465771 - RNA, 20 nt, Human
ggggccgggagcguccgcag

SEQ ID NO: 465772 - RNA, 32 nt, Human
ggggccgggaggcgugggggagccgggcccuc

SEQ ID NO: 465773 - RNA, 26 nt, Human
ggggccgggccagagacgggggccgg

SEQ ID NO: 465774 - RNA, 25 nt, Human
ggggccgggcccggggcccgggcuu

SEQ ID NO: 465775 - RNA, 20 nt, Human
ggggccgggccggagccggc

SEQ ID NO: 465776 - RNA, 22 nt, Human
ggggccgggccggggccgcgcu

SEQ ID NO: 465777 - RNA, 17 nt, Human
ggggccgggcgcccccu

SEQ ID NO: 465778 - RNA, 32 nt, Human
ggggccgggcgguguaaacagccccggaggcg

SEQ ID NO: 465779 - RNA, 19 nt, Human
ggggccgggcucucuccag

SEQ ID NO: 465780 - RNA, 32 nt, Human
ggggccggggaaguuugcgccgccgcgaccag

SEQ ID NO: 465781 - RNA, 25 nt, Human
ggggccggggagugaggggccggcu

SEQ ID NO: 465782 - RNA, 32 nt, Human
ggggccggggcaggccaggguuuguuugugga

SEQ ID NO: 465783 - RNA, 24 nt, Human
ggggccggggcauucagcucagcu

SEQ ID NO: 465784 - RNA, 32 nt, Human
ggggccggggccaagaccgcggaguucgcgga

SEQ ID NO: 465785 - RNA, 21 nt, Human
ggggccggggccggggccggc

SEQ ID NO: 465786 - RNA, 32 nt, Human
ggggccggggcugaggccgcggccgggucugc

SEQ ID NO: 465787 - RNA, 22 nt, Human
ggggccgggguccugcccggcu

SEQ ID NO: 465788 - RNA, 32 nt, Human
ggggccgguaacgagagcagucgcggcaccug

SEQ ID NO: 465789 - RNA, 22 nt, Human
ggggccgguggaagccgcgcag

SEQ ID NO: 465790 - RNA, 32 nt, Human
ggggccgucaucuccccucugccuccugcuuu

SEQ ID NO: 465791 - RNA, 32 nt, Human
ggggccgucuaauuuauuacugcccagcauuc

SEQ ID NO: 465792 - RNA, 22 nt, Human
ggggccguggccggggccagcu

SEQ ID NO: 465793 - RNA, 22 nt, Human
ggggccguggcugaagccggcu

SEQ ID NO: 465794 - RNA, 32 nt, Human
ggggccguguggccagcagcagcaucugccuu

SEQ ID NO: 465795 - RNA, 32 nt, Human
ggggccguugcguuuggcuuuguggagggccu

SEQ ID NO: 465796 - RNA, 32 nt, Human
ggggccuaaggagggucuccacacugcugcua

SEQ ID NO: 465797 - RNA, 32 nt, Human
ggggccuagauccacacacagaggaagagcag

SEQ ID NO: 465798 - RNA, 18 nt, Human
ggggccuagccugugugg

SEQ ID NO: 465799 - RNA, 32 nt, Human
ggggccuagcggagggcaucgaaggccuccgc

SEQ ID NO: 465800 - RNA, 32 nt, Human
ggggccuagugccacccuccucccuccaagcc

SEQ ID NO: 465801 - RNA, 32 nt, Human
ggggccucaauccagucuugauaacagcgagg

SEQ ID NO: 465802 - RNA, 32 nt, Human
ggggccucacauccaucuccuucccagcucuc

SEQ ID NO: 465803 - RNA, 32 nt, Human
ggggccucacccagaaggaacccggucccagg

SEQ ID NO: 465804 - RNA, 32 nt, Human
ggggccucaccccucuggagggccggaggcag

SEQ ID NO: 465805 - RNA, 21 nt, Human
ggggccucagcagaggaagca

SEQ ID NO: 465806 - RNA, 32 nt, Human
ggggccucagcagaggaagcacgggcagcagc

SEQ ID NO: 465807 - RNA, 32 nt, Human
ggggccucagcaggugcccaagcugcuacaac

SEQ ID NO: 465808 - RNA, 32 nt, Human
ggggccucagccccaggaggucccuucucugu

SEQ ID NO: 465809 - RNA, 32 nt, Human
ggggccucagcccuugggaggggacaccugag

SEQ ID NO: 465810 - RNA, 32 nt, Human
ggggccucaguucucgcccucuugccgucgcc

SEQ ID NO: 465811 - RNA, 32 nt, Human
ggggccucauacaacccuucaucugcacucaa

SEQ ID NO: 465812 - RNA, 32 nt, Human
ggggccucauggugaaauuugugcccuuguaa

SEQ ID NO: 465813 - RNA, 32 nt, Human
ggggccuccagccugggacugcugugaugggg

SEQ ID NO: 465814 - RNA, 16 nt, Human
ggggccuccaggugca

SEQ ID NO: 465815 - RNA, 28 nt, Human
ggggccuccagugcugccccuccucccu

SEQ ID NO: 465816 - RNA, 32 nt, Human
ggggccucccacccucaucuagcucuguucag

SEQ ID NO: 465817 - RNA, 20 nt, Human
ggggccuccccucccugcua

SEQ ID NO: 465818 - RNA, 18 nt, Human
ggggccuccugcgcccuc

SEQ ID NO: 465819 - RNA, 32 nt, Human
ggggccuccuguuccuccucuagcugggagua

SEQ ID NO: 465820 - RNA, 32 nt, Human
ggggccucuagggugauggaccagccccguua

SEQ ID NO: 465821 - RNA, 32 nt, Human
ggggccucucuagcuugcggccugugucuaug

SEQ ID NO: 465822 - RNA, 32 nt, Human
ggggccucucucccucucccuguccccacccc

SEQ ID NO: 465823 - RNA, 32 nt, Human
ggggccucucucugagaucggguccuccuccu

SEQ ID NO: 465824 - RNA, 32 nt, Human
ggggccucugagcugcucagcugggucuccug

SEQ ID NO: 465825 - RNA, 32 nt, Human
ggggccucuggcucgguguguggagaaaagag

SEQ ID NO: 465826 - RNA, 32 nt, Human
ggggccucuguccucacgguccugggccugcc

SEQ ID NO: 465827 - RNA, 32 nt, Human
ggggccucuucaaccaccggcaccccuugccc

SEQ ID NO: 465828 - RNA, 32 nt, Human
ggggccucuuccccgcaggcucuggcuggccg

SEQ ID NO: 465829 - RNA, 32 nt, Human
ggggccucuuucugugcuucucuuugucccca

SEQ ID NO: 465830 - RNA, 32 nt, Human
ggggccucuuugaaucagaagcccuuuguaua

SEQ ID NO: 465831 - RNA, 23 nt, Human
ggggccugagaauucacauuucc

SEQ ID NO: 465832 - RNA, 32 nt, Human
ggggccugaggagagaggggaaggguacagag

SEQ ID NO: 465833 - RNA, 32 nt, Human
ggggccugaggcacgagaaucgcuugaauucg

SEQ ID NO: 465834 - RNA, 24 nt, Human
ggggccugaggcggagaccggaga

SEQ ID NO: 465835 - RNA, 32 nt, Human
ggggccugcaacagcaaaucaccagcuuucuc

SEQ ID NO: 465836 - RNA, 32 nt, Human
ggggccugccaaggcaggaagcggaggacugu

SEQ ID NO: 465837 - RNA, 18 nt, Human
ggggccugccacacacuc

SEQ ID NO: 465838 - RNA, 32 nt, Human
ggggccugcuucuuaucugacacagcagcuau

SEQ ID NO: 465839 - RNA, 32 nt, Human
ggggccuggccaccccuuuccccacuccacga

SEQ ID NO: 465840 - RNA, 32 nt, Human
ggggccuggccacugggugccacccagccugu

SEQ ID NO: 465841 - RNA, 21 nt, Human
ggggccuggcggcaggggcgg

SEQ ID NO: 465842 - RNA, 32 nt, Human
ggggccuggcugaccccuccagcuucagccuc

SEQ ID NO: 465843 - RNA, 32 nt, Human
ggggccuggcuguggccuguuuuccuuugacc

SEQ ID NO: 465844 - RNA, 32 nt, Human
ggggccugggacauuccaucugagguccuucc

SEQ ID NO: 465845 - RNA, 32 nt, Human
ggggccugggagaugccaggaggaugagagcg

SEQ ID NO: 465846 - RNA, 32 nt, Human
ggggccugggcuguugugucuggagccugcag

SEQ ID NO: 465847 - RNA, 32 nt, Human
ggggccuggggccugggcuucgggcgcggcgu

SEQ ID NO: 465848 - RNA, 17 nt, Human
ggggccugggggccugc

SEQ ID NO: 465849 - RNA, 32 nt, Human
ggggccugggguuccuggacagaggaggacua

SEQ ID NO: 465850 - RNA, 21 nt, Human
ggggccuggucuccggguucu

SEQ ID NO: 465851 - RNA, 32 nt, Human
ggggccuguccacccucccaggccgacgucag

SEQ ID NO: 465852 - RNA, 32 nt, Human
ggggccugucugugccccuccugcccugcagg

SEQ ID NO: 465853 - RNA, 31 nt, Human
ggggccugugggagagaaaggcugugagaga

SEQ ID NO: 465854 - RNA, 32 nt, Human
ggggccuguucccagcacauuuuccuguaagc

SEQ ID NO: 465855 - RNA, 32 nt, Human
ggggccuuauucuguccuccaggcuggagugc

SEQ ID NO: 465856 - RNA, 32 nt, Human
ggggccuuccaagcacagccacggccaugggg

SEQ ID NO: 465857 - RNA, 32 nt, Human
ggggccuuccuaaccuuccaucauccucagcu

SEQ ID NO: 465858 - RNA, 32 nt, Human
ggggccuuccucucuucuccagccucucccuu

SEQ ID NO: 465859 - RNA, 32 nt, Human
ggggccuuccuugagaccuucccuuggggcug

SEQ ID NO: 465860 - RNA, 32 nt, Human
ggggccuucggcgagucuuuuuguuugguuuu

SEQ ID NO: 465861 - RNA, 32 nt, Human
ggggccuucggucucuccccagccucuuccuu

SEQ ID NO: 465862 - RNA, 32 nt, Human
ggggccuucgugggagcuggcagccacaagaa

SEQ ID NO: 465863 - RNA, 32 nt, Human
ggggccuugccacccuucccuguccacugcug

SEQ ID NO: 465864 - RNA, 32 nt, Human
ggggccuugcccucccccucccagcccagggu

SEQ ID NO: 465865 - RNA, 32 nt, Human
ggggccuuggagagacagaaacauggggguuu

SEQ ID NO: 465866 - RNA, 32 nt, Human
ggggccuuggaguugugacugccggggccgua

SEQ ID NO: 465867 - RNA, 21 nt, Human
ggggccuuguaccugcuucau

SEQ ID NO: 465868 - RNA, 32 nt, Human
ggggccuugugagcugcuucuaagaggcuaac

SEQ ID NO: 465869 - RNA, 32 nt, Human
ggggccuugugucugugccugccugucugaca

SEQ ID NO: 465870 - RNA, 32 nt, Human
ggggccuuucccucggacccauggccccaggc

SEQ ID NO: 465871 - RNA, 20 nt, Human
ggggcgaaaaggggggacag

SEQ ID NO: 465872 - RNA, 32 nt, Human
ggggcgaaggggucagcccugcccuucagcau

SEQ ID NO: 465873 - RNA, 32 nt, Human
ggggcgaaggugcuguaaacagguuugggcag

SEQ ID NO: 465874 - RNA, 32 nt, Human
ggggcgaaucucacggaccugaccucagaggu

SEQ ID NO: 465875 - RNA, 32 nt, Human
ggggcgacacagauuucugugaaugccagugc

SEQ ID NO: 465876 - RNA, 32 nt, Human
ggggcgacaucccggcggccgcgcugaggcca

SEQ ID NO: 465877 - RNA, 32 nt, Human
ggggcgacgacgagacggacagugauguccag

SEQ ID NO: 465878 - RNA, 18 nt, Human
ggggcgacgcgagggggc

SEQ ID NO: 465879 - RNA, 32 nt, Human
ggggcgagaguccuccgaguagucuggaaaau

SEQ ID NO: 465880 - RNA, 19 nt, Human
ggggcgagcggcggcgcgg

SEQ ID NO: 465881 - RNA, 32 nt, Human
ggggcgagcuccccucugucuggggcagggug

SEQ ID NO: 465882 - RNA, 32 nt, Human
ggggcgaggagguggaggaggaggaggaggag

SEQ ID NO: 465883 - RNA, 19 nt, Human
ggggcgaggcagaggacag

SEQ ID NO: 465884 - RNA, 32 nt, Human
ggggcgagggccaggucagguggcugcacugu

SEQ ID NO: 465885 - RNA, 32 nt, Human
ggggcgagggcugaggacucucuggcucuacc

SEQ ID NO: 465886 - RNA, 19 nt, Human
ggggcgaguuggcuauggc

SEQ ID NO: 465887 - RNA, 21 nt, Human
ggggcgauagaaggauggcag

SEQ ID NO: 465888 - RNA, 24 nt, Human
ggggcgaucgccagucacccauca

SEQ ID NO: 465889 - RNA, 32 nt, Human
ggggcgaugccaccccucauccuucacccagc

SEQ ID NO: 465890 - RNA, 32 nt, Human
ggggcgaugcuugugacccugcagcuccucaa

SEQ ID NO: 465891 - RNA, 32 nt, Human
ggggcgcagagggagcccggagcccggcgccc

SEQ ID NO: 465892 - RNA, 32 nt, Human
ggggcgcagcgcugaggucacccuggagguag

SEQ ID NO: 465893 - RNA, 32 nt, Human
ggggcgcaggagggagaaguugcuaagugcug

SEQ ID NO: 465894 - RNA, 21 nt, Human
ggggcgcaggggcgggugcgg

SEQ ID NO: 465895 - RNA, 32 nt, Human
ggggcgcaucccucgccacccgcggucgccca

SEQ ID NO: 465896 - RNA, 32 nt, Human
ggggcgccagccgcccaugccgccccggcgcc

SEQ ID NO: 465897 - RNA, 19 nt, Human
ggggcgccaguccgggcag

SEQ ID NO: 465898 - RNA, 21 nt, Human
ggggcgcccagcacugguuca

SEQ ID NO: 465899 - RNA, 32 nt, Human
ggggcgccccgacccguccccucugcccucca

SEQ ID NO: 465900 - RNA, 19 nt, Human
ggggcgccgagcgcugucg

SEQ ID NO: 465901 - RNA, 32 nt, Human
ggggcgccguccgcgagcggccuggacugucg

SEQ ID NO: 465902 - RNA, 32 nt, Human
ggggcgccugcagcucucccuggaguucgacu

SEQ ID NO: 465903 - RNA, 19 nt, Human
ggggcgcgaaggcggucgc

SEQ ID NO: 465904 - RNA, 32 nt, Human
ggggcgcgcuggggcuucgaccuggcugcacu

SEQ ID NO: 465905 - RNA, 32 nt, Human
ggggcgcggaggaggaggaucugggggaagag

SEQ ID NO: 465906 - RNA, 32 nt, Human
ggggcgcgggaacaugaggcuuggcuaggagc

SEQ ID NO: 465907 - RNA, 32 nt, Human
ggggcgcgggcggcccagcagagcuggccuga

SEQ ID NO: 465908 - RNA, 32 nt, Human
ggggcgcggggcggaggcugcgagggcgcgcg

SEQ ID NO: 465909 - RNA, 23 nt, Human
ggggcgcgggggccggaccauga

SEQ ID NO: 465910 - RNA, 32 nt, Human
ggggcgcguggaggaggaggaaaaggagggaa

SEQ ID NO: 465911 - RNA, 23 nt, Human
ggggcgcucagagaugggggcag

SEQ ID NO: 465912 - RNA, 32 nt, Human
ggggcgcucucccacacucacacuccuaggug

SEQ ID NO: 465913 - RNA, 32 nt, Human
ggggcgcugcggugccagccugaggcugggcu

SEQ ID NO: 465914 - RNA, 32 nt, Human
ggggcgcugggagcccguugggccgcgaacgc

SEQ ID NO: 465915 - RNA, 21 nt, Human
ggggcgcugggcaaggugcag

SEQ ID NO: 465916 - RNA, 32 nt, Human
ggggcgcugggcuggagagcagguucgggcag

SEQ ID NO: 465917 - RNA, 32 nt, Human
ggggcgcuggggcuggaggggcggggcgcgcg

SEQ ID NO: 465918 - RNA, 21 nt, Human
ggggcgcuguccugcguucag

SEQ ID NO: 465919 - RNA, 32 nt, Human
ggggcggaagaggaggaggaggaggaggaagg

SEQ ID NO: 465920 - RNA, 19 nt, Human
ggggcggaccgcggggcgg

SEQ ID NO: 465921 - RNA, 20 nt, Human
ggggcggacgcagagacaga

SEQ ID NO: 465922 - RNA, 19 nt, Human
ggggcggagaagggugcgg

SEQ ID NO: 465923 - RNA, 18 nt, Human
ggggcggagagagggggc

SEQ ID NO: 465924 - RNA, 31 nt, Human
ggggcggagagcgcgagaaggagggaggagg

SEQ ID NO: 465925 - RNA, 32 nt, Human
ggggcggaggcagcggcuguagcggggcugua

SEQ ID NO: 465926 - RNA, 19 nt, Human
ggggcggaggcggaggcag

SEQ ID NO: 465927 - RNA, 18 nt, Human
ggggcggaggcggggcgg

SEQ ID NO: 465928 - RNA, 32 nt, Human
ggggcggaggggaaggaagcccuggggagcag

SEQ ID NO: 465929 - RNA, 32 nt, Human
ggggcggagguugcaaugagccaaggucgcgc

SEQ ID NO: 465930 - RNA, 18 nt, Human
ggggcggaguugcccgcc

SEQ ID NO: 465931 - RNA, 32 nt, Human
ggggcggaguuucacucuuguugcccaggcug

SEQ ID NO: 465932 - RNA, 32 nt, Human
ggggcggaugcagccuaccuccugggcaguga

SEQ ID NO: 465933 - RNA, 32 nt, Human
ggggcggcaccccagcccugcccuugcuuccu

SEQ ID NO: 465934 - RNA, 32 nt, Human
ggggcggcagaggcaccagccgacccgucagu

SEQ ID NO: 465935 - RNA, 32 nt, Human
ggggcggcagcggugguagcagcugguaccuc

SEQ ID NO: 465936 - RNA, 32 nt, Human
ggggcggcagcugaggaagaaagacgcagugc

SEQ ID NO: 465937 - RNA, 32 nt, Human
ggggcggcaggcggcggcggcccggggcucga

SEQ ID NO: 465938 - RNA, 32 nt, Human
ggggcggccacuggucagaggcaggacagcag

SEQ ID NO: 465939 - RNA, 21 nt, Human
ggggcggccgccuccagguga

SEQ ID NO: 465940 - RNA, 19 nt, Human
ggggcggccgcggaggcgg

SEQ ID NO: 465941 - RNA, 32 nt, Human
ggggcggccggcggaggagcagcaggauccca

SEQ ID NO: 465942 - RNA, 32 nt, Human
ggggcggccuggcccgggaccugcugcugcuc

SEQ ID NO: 465943 - RNA, 32 nt, Human
ggggcggcgcgcaggagggaggagaacugggg

SEQ ID NO: 465944 - RNA, 22 nt, Human
ggggcggcggcgcgagcggcgg

SEQ ID NO: 465945 - RNA, 17 nt, Human
ggggcggcggcggggcg

SEQ ID NO: 465946 - RNA, 32 nt, Human
ggggcggcgggaggggcaggagacguuggccc

SEQ ID NO: 465947 - RNA, 32 nt, Human
ggggcggcuggcgcgcacuacacgcuugggaa

SEQ ID NO: 465948 - RNA, 32 nt, Human
ggggcggcuugcuguccagccugugugggggc

SEQ ID NO: 465949 - RNA, 32 nt, Human
ggggcgggacagggucucucuccgucucccag

SEQ ID NO: 465950 - RNA, 32 nt, Human
ggggcgggaccagacaguugcgcgcacagaag

SEQ ID NO: 465951 - RNA, 31 nt, Human
ggggcgggacuucuccgggucaaggccaggu

SEQ ID NO: 465952 - RNA, 32 nt, Human
ggggcgggagaaaguggccgcccggaggacgu

SEQ ID NO: 465953 - RNA, 32 nt, Human
ggggcgggagagacgguagagaagugagauga

SEQ ID NO: 465954 - RNA, 32 nt, Human
ggggcgggagagaggcaagggguggacggagc

SEQ ID NO: 465955 - RNA, 32 nt, Human
ggggcgggagcagcgcggagcccggcucggcc

SEQ ID NO: 465956 - RNA, 25 nt, Human
ggggcgggagcugaggcgggagcgg

SEQ ID NO: 465957 - RNA, 32 nt, Human
ggggcgggaggagcugcccgaggcucugggug

SEQ ID NO: 465958 - RNA, 21 nt, Human
ggggcgggaggcgcgcgcggg

SEQ ID NO: 465959 - RNA, 22 nt, Human
ggggcgggaggggacggggugg

SEQ ID NO: 465960 - RNA, 20 nt, Human
ggggcgggaugggggugugg

SEQ ID NO: 465961 - RNA, 32 nt, Human
ggggcgggcaggcagggguuagugaaaggaca

SEQ ID NO: 465962 - RNA, 32 nt, Human
ggggcgggcagggagaggcuggagccggugac

SEQ ID NO: 465963 - RNA, 22 nt, Human
ggggcgggcccggcgcgcgcgg

SEQ ID NO: 465964 - RNA, 32 nt, Human
ggggcgggccgccagccccagcaguuuacaga

SEQ ID NO: 465965 - RNA, 19 nt, Human
ggggcgggcgccgggcagg

SEQ ID NO: 465966 - RNA, 19 nt, Human
ggggcgggcgugggggcag

SEQ ID NO: 465967 - RNA, 32 nt, Human
ggggcggggaauggggcgcagugaggcuggga

SEQ ID NO: 465968 - RNA, 32 nt, Human
ggggcggggaggacggcgcccggggacagaga

SEQ ID NO: 465969 - RNA, 19 nt, Human
ggggcggggaugggggcag

SEQ ID NO: 465970 - RNA, 21 nt, Human
ggggcggggcaggcggcgcgg

SEQ ID NO: 465971 - RNA, 32 nt, Human
ggggcggggccagaacggcgccaaggccaacc

SEQ ID NO: 465972 - RNA, 32 nt, Human
ggggcggggcccggaagagcaggauggcggcg

SEQ ID NO: 465973 - RNA, 19 nt, Human
ggggcggggcccggagcgg

SEQ ID NO: 465974 - RNA, 32 nt, Human
ggggcggggcgcggggccagaggguggggcag

SEQ ID NO: 465975 - RNA, 22 nt, Human
ggggcggggcggcguggcgcgg

SEQ ID NO: 465976 - RNA, 19 nt, Human
ggggcggggcucggagcgg

SEQ ID NO: 465977 - RNA, 32 nt, Human
ggggcggggcugccugcggaaggggccgugcg

SEQ ID NO: 465978 - RNA, 19 nt, Human
ggggcgggggacggguggg

SEQ ID NO: 465979 - RNA, 32 nt, Human
ggggcgggggcacggccuggcauuucacgcau

SEQ ID NO: 465980 - RNA, 20 nt, Human
ggggcgggggcccggggcgg

SEQ ID NO: 465981 - RNA, 19 nt, Human
ggggcgggggccggcgcgg

SEQ ID NO: 465982 - RNA, 32 nt, Human
ggggcgggggcggggcggcagugagcucggcc

SEQ ID NO: 465983 - RNA, 20 nt, Human
ggggcggggggcuggugcgg

SEQ ID NO: 465984 - RNA, 32 nt, Human
ggggcggggucaaacacuguugcccaggcugg

SEQ ID NO: 465985 - RNA, 32 nt, Human
ggggcggggugaggacagagaggagucgaggg

SEQ ID NO: 465986 - RNA, 19 nt, Human
ggggcggggugcggagcgg

SEQ ID NO: 465987 - RNA, 32 nt, Human
ggggcgggguggaucacuugaggucagggguu

SEQ ID NO: 465988 - RNA, 32 nt, Human
ggggcgggguggggaaaggaugguucugaggu

SEQ ID NO: 465989 - RNA, 32 nt, Human
ggggcggguaggagccuggcucugccugagcu

SEQ ID NO: 465990 - RNA, 19 nt, Human
ggggcgggucugggugcgg

SEQ ID NO: 465991 - RNA, 32 nt, Human
ggggcgggugggaugcacagagcacagcgcgg

SEQ ID NO: 465992 - RNA, 19 nt, Human
ggggcgggugggggcgcgg

SEQ ID NO: 465993 - RNA, 23 nt, Human
ggggcgguacuuguucuugcgga

SEQ ID NO: 465994 - RNA, 32 nt, Human
ggggcggugaggugggggcagcggccccgcac

SEQ ID NO: 465995 - RNA, 32 nt, Human
ggggcggugaguguaaggaugcagugggagca

SEQ ID NO: 465996 - RNA, 20 nt, Human
ggggcggugcagagggggca

SEQ ID NO: 465997 - RNA, 18 nt, Human
ggggcgguggagggggca

SEQ ID NO: 465998 - RNA, 22 nt, Human
ggggcgguggcucacgccugua

SEQ ID NO: 465999 - RNA, 32 nt, Human
ggggcggugggugggaugguggagcagccugg

SEQ ID NO: 466000 - RNA, 32 nt, Human
ggggcgguguggcgcuagagccugggcgggcc

SEQ ID NO: 466001 - RNA, 32 nt, Human
ggggcgguguggcugcagccucagucccugcc

SEQ ID NO: 466002 - RNA, 23 nt, Human
ggggcgucacagucggcaggcag

SEQ ID NO: 466003 - RNA, 22 nt, Human
ggggcgucagaacgaaaggcag

SEQ ID NO: 466004 - RNA, 21 nt, Human
ggggcgucagcagaggggcag

SEQ ID NO: 466005 - RNA, 20 nt, Human
ggggcgucagcccugcaggg

SEQ ID NO: 466006 - RNA, 19 nt, Human
ggggcgucgagacaagaag

SEQ ID NO: 466007 - RNA, 20 nt, Human
ggggcgucgagaggcagcag

SEQ ID NO: 466008 - RNA, 32 nt, Human
ggggcgucuaaaaggccagcccaugcaucuug

SEQ ID NO: 466009 - RNA, 32 nt, Human
ggggcgucuagagacuggcugcgggagggaga

SEQ ID NO: 466010 - RNA, 32 nt, Human
ggggcgucuccaggacccagagcuguuccugc

SEQ ID NO: 466011 - RNA, 19 nt, Human
ggggcgucugccgggaggc

SEQ ID NO: 466012 - RNA, 32 nt, Human
ggggcgucugccugagcccgcuuuucuacaag

SEQ ID NO: 466013 - RNA, 32 nt, Human
ggggcgugccuggugagucugccugugguuca

SEQ ID NO: 466014 - RNA, 32 nt, Human
ggggcgugccuguagucccauguacuugggag

SEQ ID NO: 466015 - RNA, 20 nt, Human
ggggcgugcgcuagaggggg

SEQ ID NO: 466016 - RNA, 32 nt, Human
ggggcguggaggaggaggcgggcuggguugcg

SEQ ID NO: 466017 - RNA, 32 nt, Human
ggggcguggaguuuugucuuguauuuuggccu

SEQ ID NO: 466018 - RNA, 19 nt, Human
ggggcguggcagggcccuc

SEQ ID NO: 466019 - RNA, 32 nt, Human
ggggcguggccacuucacaugauggcgggccu

SEQ ID NO: 466020 - RNA, 32 nt, Human
ggggcguggcuggccuuucagguccaggccag

SEQ ID NO: 466021 - RNA, 32 nt, Human
ggggcguggcugggaacuggaaccuccugaag

SEQ ID NO: 466022 - RNA, 20 nt, Human
ggggcguggggcgggcgugg

SEQ ID NO: 466023 - RNA, 32 nt, Human
ggggcguggucugguccccauugcgggcccgg

SEQ ID NO: 466024 - RNA, 23 nt, Human
ggggcguguuaucgcgggggcag

SEQ ID NO: 466025 - RNA, 23 nt, Human
ggggcguuaccccaagggcccuc

SEQ ID NO: 466026 - RNA, 32 nt, Human
ggggcguugggagcgggagugcagagcguggu

SEQ ID NO: 466027 - RNA, 32 nt, Human
ggggcuaaagaggaggacgaagaaaagcagag

SEQ ID NO: 466028 - RNA, 20 nt, Human
ggggcuaagaaugggggcag

SEQ ID NO: 466029 - RNA, 32 nt, Human
ggggcuaauaccuguauccaaccaagggagua

SEQ ID NO: 466030 - RNA, 32 nt, Human
ggggcuacugugaccauggaggccagugccag

SEQ ID NO: 466031 - RNA, 32 nt, Human
ggggcuacuuccugugcugaaggaaguccucu

SEQ ID NO: 466032 - RNA, 19 nt, Human
ggggcuagaacuccaggag

SEQ ID NO: 466033 - RNA, 32 nt, Human
ggggcuagaagagcgagaaaauucaagaaaau

SEQ ID NO: 466034 - RNA, 32 nt, Human
ggggcuagcgggagccgagagcagggugcuga

SEQ ID NO: 466035 - RNA, 25 nt, Human
ggggcuagcuagcugucucugcgga

SEQ ID NO: 466036 - RNA, 23 nt, Human
ggggcuaggaguucuaagaacag

SEQ ID NO: 466037 - RNA, 22 nt, Human
ggggcuaggcugccgggccacu

SEQ ID NO: 466038 - RNA, 32 nt, Human
ggggcuaggcuggagcccagggagcggaaagc

SEQ ID NO: 466039 - RNA, 23 nt, Human
ggggcuagggcuggaagccaguu

SEQ ID NO: 466040 - RNA, 32 nt, Human
ggggcuagucaaucccagcugucucggaccag

SEQ ID NO: 466041 - RNA, 18 nt, Human
ggggcuauccgggucuga

SEQ ID NO: 466042 - RNA, 32 nt, Human
ggggcuaucgagaggagcucacugugggaugg

SEQ ID NO: 466043 - RNA, 24 nt, Human
ggggcuauucccugucucuguggg

SEQ ID NO: 466044 - RNA, 32 nt, Human
ggggcucaaaggacgucuggggugggaauggg

SEQ ID NO: 466045 - RNA, 32 nt, Human
ggggcucaagccuguauuccagcacuuuggga

SEQ ID NO: 466046 - RNA, 32 nt, Human
ggggcucaaggcgcaggaaggccgagcccggc

SEQ ID NO: 466047 - RNA, 32 nt, Human
ggggcucacaccugacauguauguccuccagg

SEQ ID NO: 466048 - RNA, 32 nt, Human
ggggcucacagggcagucccaggaguucugac

SEQ ID NO: 466049 - RNA, 32 nt, Human
ggggcucacaucuccccucugauucccccaug

SEQ ID NO: 466050 - RNA, 32 nt, Human
ggggcucacauucucaccuagcaacaacuggc

SEQ ID NO: 466051 - RNA, 32 nt, Human
ggggcucaccugguggauucacauuaaaccgg

SEQ ID NO: 466052 - RNA, 32 nt, Human
ggggcucacuacugcugugcccucaggcuggg

SEQ ID NO: 466053 - RNA, 32 nt, Human
ggggcucacugcuugcacugugcuuaggguag

SEQ ID NO: 466054 - RNA, 32 nt, Human
ggggcucagaggaggaggacaaagacggcggg

SEQ ID NO: 466055 - RNA, 32 nt, Human
ggggcucagauuggcacagaauucuuugugaa

SEQ ID NO: 466056 - RNA, 32 nt, Human
ggggcucagauuggcacagaauucuuuuguga

SEQ ID NO: 466057 - RNA, 32 nt, Human
ggggcucagauugggacagaauucuuuuguga

SEQ ID NO: 466058 - RNA, 18 nt, Human
ggggcucagcagccuccu

SEQ ID NO: 466059 - RNA, 32 nt, Human
ggggcucagcagugaccuggagugugcaaaua

SEQ ID NO: 466060 - RNA, 32 nt, Human
ggggcucaggagacagaagggacagugggccu

SEQ ID NO: 466061 - RNA, 32 nt, Human
ggggcucaggaggaggaaggaggacccgugcg

SEQ ID NO: 466062 - RNA, 22 nt, Human
ggggcucaggcacccgucccca

SEQ ID NO: 466063 - RNA, 16 nt, Human
ggggcucagggcccuu

SEQ ID NO: 466064 - RNA, 28 nt, Human
ggggcuccaagugccuuguucauccuuu

SEQ ID NO: 466065 - RNA, 19 nt, Human
ggggcuccagcaaaccccu

SEQ ID NO: 466066 - RNA, 32 nt, Human
ggggcuccagccugcaccugcaccaggcacag

SEQ ID NO: 466067 - RNA, 32 nt, Human
ggggcucccacaggcuggagugcaauggugug

SEQ ID NO: 466068 - RNA, 32 nt, Human
ggggcucccaggcugggugugccuuagccaca

SEQ ID NO: 466069 - RNA, 32 nt, Human
ggggcucccccacauccuuuccuugccuauga

SEQ ID NO: 466070 - RNA, 32 nt, Human
ggggcucccucccuccuucucuccuuccuucc

SEQ ID NO: 466071 - RNA, 32 nt, Human
ggggcuccgcccacccugcucccuuccggaca

SEQ ID NO: 466072 - RNA, 32 nt, Human
ggggcuccggcaggccgggguagugcucucac

SEQ ID NO: 466073 - RNA, 32 nt, Human
ggggcuccgggccagggugacaggaggcgugc

SEQ ID NO: 466074 - RNA, 32 nt, Human
ggggcuccugccuguagcaggugacagggcug

SEQ ID NO: 466075 - RNA, 32 nt, Human
ggggcuccuggaccaggcucaucagcaagcuu

SEQ ID NO: 466076 - RNA, 32 nt, Human
ggggcuccuggcccugaaugugguguuccugg

SEQ ID NO: 466077 - RNA, 32 nt, Human
ggggcuccugucucugccuccugggccuucag

SEQ ID NO: 466078 - RNA, 18 nt, Human
ggggcuccuucagccccc

SEQ ID NO: 466079 - RNA, 32 nt, Human
ggggcucgacccacccacccucccucucagac

SEQ ID NO: 466080 - RNA, 18 nt, Human
ggggcucggacgcccccu

SEQ ID NO: 466081 - RNA, 32 nt, Human
ggggcucggagggagaaaggcccagggcagug

SEQ ID NO: 466082 - RNA, 20 nt, Human
ggggcucggcgggggcgcgg

SEQ ID NO: 466083 - RNA, 32 nt, Human
ggggcucgggcaggagcacuccugggcucucc

SEQ ID NO: 466084 - RNA, 32 nt, Human
ggggcucuacuaccugcugcuauucaaggacc

SEQ ID NO: 466085 - RNA, 32 nt, Human
ggggcucuccacccccucuggccccagucgaa

SEQ ID NO: 466086 - RNA, 32 nt, Human
ggggcucugaucucccauccaucccacccucc

SEQ ID NO: 466087 - RNA, 32 nt, Human
ggggcucugccacucccagccugggaaugaag

SEQ ID NO: 466088 - RNA, 32 nt, Human
ggggcucugcucauuauaguugcccacggccu

SEQ ID NO: 466089 - RNA, 32 nt, Human
ggggcucugggagacuuugaagaccaguccug

SEQ ID NO: 466090 - RNA, 32 nt, Human
ggggcucuguccucagccugguggacagcagu

SEQ ID NO: 466091 - RNA, 32 nt, Human
ggggcucuucaccaauuuuuccagccucauuu

SEQ ID NO: 466092 - RNA, 32 nt, Human
ggggcucuucacuguggggcaugggagaggag

SEQ ID NO: 466093 - RNA, 32 nt, Human
ggggcucuuguccuguccuguguuccucgugg

SEQ ID NO: 466094 - RNA, 32 nt, Human
ggggcugaaagacacacagaagucuucaugga

SEQ ID NO: 466095 - RNA, 32 nt, Human
ggggcugaaaucauuuguucuccuucacauug

SEQ ID NO: 466096 - RNA, 20 nt, Human
ggggcugaagcgaagggggg

SEQ ID NO: 466097 - RNA, 21 nt, Human
ggggcugaaucacacauuucc

SEQ ID NO: 466098 - RNA, 19 nt, Human
ggggcugaaucagcuccag

SEQ ID NO: 466099 - RNA, 17 nt, Human
ggggcugacacacacuc

SEQ ID NO: 466100 - RNA, 32 nt, Human
ggggcugaccaccaccaccuggccucuccgag

SEQ ID NO: 466101 - RNA, 20 nt, Human
ggggcugagagagauggggg

SEQ ID NO: 466102 - RNA, 32 nt, Human
ggggcugagagugcugggguaguggguguggu

SEQ ID NO: 466103 - RNA, 32 nt, Human
ggggcugagcagcuaggaagcuaggaagugga

SEQ ID NO: 466104 - RNA, 21 nt, Human
ggggcugaggaggaggagcag

SEQ ID NO: 466105 - RNA, 32 nt, Human
ggggcugaggcagaggcagggauagcugggug

SEQ ID NO: 466106 - RNA, 32 nt, Human
ggggcugaggcaggcagccgggagagccaugg

SEQ ID NO: 466107 - RNA, 31 nt, Human
ggggcugaggcucuggggccugucucccugc

SEQ ID NO: 466108 - RNA, 32 nt, Human
ggggcugaggcugaggcacuggcgaggagagg

SEQ ID NO: 466109 - RNA, 27 nt, Human
ggggcugagggaauuguccucugugga

SEQ ID NO: 466110 - RNA, 32 nt, Human
ggggcugagggcccuguccccacccccgcccu

SEQ ID NO: 466111 - RNA, 32 nt, Human
ggggcugaggugggacuggaggauuucgaggg

SEQ ID NO: 466112 - RNA, 32 nt, Human
ggggcugagguggguggaucaccugagaccag

SEQ ID NO: 466113 - RNA, 30 nt, Human
ggggcugagguuuucuugcuccuguggaug

SEQ ID NO: 466114 - RNA, 32 nt, Human
ggggcugauacuuggaaagaaugugguaaagc

SEQ ID NO: 466115 - RNA, 32 nt, Human
ggggcugauuccagaugguuuuucugaaauuu

SEQ ID NO: 466116 - RNA, 28 nt, Human
ggggcugcaagugcuaccucgcgcuugu

SEQ ID NO: 466117 - RNA, 32 nt, Human
ggggcugcacacacucaggagcucugucacaa

SEQ ID NO: 466118 - RNA, 32 nt, Human
ggggcugcacaucugacggacuaaggugacuc

SEQ ID NO: 466119 - RNA, 32 nt, Human
ggggcugcaccugcgggccugggaagcauugc

SEQ ID NO: 466120 - RNA, 32 nt, Human
ggggcugcagagcuggagggugggcgugguac

SEQ ID NO: 466121 - RNA, 20 nt, Human
ggggcugcagcagggaggca

SEQ ID NO: 466122 - RNA, 16 nt, Human
ggggcugcagcccccu

SEQ ID NO: 466123 - RNA, 15 nt, Human
ggggcugcagcgcag

SEQ ID NO: 466124 - RNA, 22 nt, Human
ggggcugcagcggagggaacag

SEQ ID NO: 466125 - RNA, 32 nt, Human
ggggcugcaggcaccugccacuaccgcagagg

SEQ ID NO: 466126 - RNA, 32 nt, Human
ggggcugcagggaaggcagcuuucauuuguuu

SEQ ID NO: 466127 - RNA, 32 nt, Human
ggggcugcagggccacuggaaggaacauggag

SEQ ID NO: 466128 - RNA, 32 nt, Human
ggggcugcagugagccaagaucacgccacugc

SEQ ID NO: 466129 - RNA, 32 nt, Human
ggggcugcaguuggggcuccuccuggguugau

SEQ ID NO: 466130 - RNA, 22 nt, Human
ggggcugcauccaaggcuuugu

SEQ ID NO: 466131 - RNA, 17 nt, Human
ggggcugccaaaggggc

SEQ ID NO: 466132 - RNA, 32 nt, Human
ggggcugccaucagccucucacagaggcaucu

SEQ ID NO: 466133 - RNA, 32 nt, Human
ggggcugccaucccauuucuccugccucugga

SEQ ID NO: 466134 - RNA, 32 nt, Human
ggggcugccccagcugacuuggaggcccuggc

SEQ ID NO: 466135 - RNA, 32 nt, Human
ggggcugcccucuccacauuaucaguugacag

SEQ ID NO: 466136 - RNA, 32 nt, Human
ggggcugccgagccaccaugcuugccugaagc

SEQ ID NO: 466137 - RNA, 32 nt, Human
ggggcugccucugaccccuccuguggugguga

SEQ ID NO: 466138 - RNA, 32 nt, Human
ggggcugccugcaugccuccccugcaccuggg

SEQ ID NO: 466139 - RNA, 32 nt, Human
ggggcugccuguaaaugacacugugaauaaac

SEQ ID NO: 466140 - RNA, 32 nt, Human
ggggcugcgacuucugaagcacaagaggcaga

SEQ ID NO: 466141 - RNA, 32 nt, Human
ggggcugcggccagggcggagggaggaagacc

SEQ ID NO: 466142 - RNA, 32 nt, Human
ggggcugcggcucucccgcgugggccgcggcc

SEQ ID NO: 466143 - RNA, 21 nt, Human
ggggcugcguccaggccggcu

SEQ ID NO: 466144 - RNA, 23 nt, Human
ggggcugcguggggggcgggagg

SEQ ID NO: 466145 - RNA, 32 nt, Human
ggggcugcucaggccgccuagcugccccuuug

SEQ ID NO: 466146 - RNA, 32 nt, Human
ggggcugcuccuggugagaggacgugggcagg

SEQ ID NO: 466147 - RNA, 32 nt, Human
ggggcugcugcagcuucuggggccuccacaga

SEQ ID NO: 466148 - RNA, 21 nt, Human
ggggcugcugccuccaggugg

SEQ ID NO: 466149 - RNA, 21 nt, Human
ggggcugcugcgccgcuucga

SEQ ID NO: 466150 - RNA, 32 nt, Human
ggggcugcuggggccaaggagggaccuugacc

SEQ ID NO: 466151 - RNA, 32 nt, Human
ggggcugcuggugggaaaugggagccagggca

SEQ ID NO: 466152 - RNA, 32 nt, Human
ggggcugcuugcuuuugccucugcccaaccag

SEQ ID NO: 466153 - RNA, 32 nt, Human
ggggcuggaaccugggguuuugcuugggugug

SEQ ID NO: 466154 - RNA, 30 nt, Human
ggggcuggaagccacggguacgguuaaccu

SEQ ID NO: 466155 - RNA, 32 nt, Human
ggggcuggaauguccuguggccgcaucucuca

SEQ ID NO: 466156 - RNA, 21 nt, Human
ggggcuggacccgagccggcu

SEQ ID NO: 466157 - RNA, 32 nt, Human
ggggcuggacccucagguagaggaucaaugug

SEQ ID NO: 466158 - RNA, 24 nt, Human
ggggcuggaccgacauccugaaca

SEQ ID NO: 466159 - RNA, 32 nt, Human
ggggcuggacucagguuaguuugggggugggg

SEQ ID NO: 466160 - RNA, 20 nt, Human
ggggcuggagaaggggagaa

SEQ ID NO: 466161 - RNA, 32 nt, Human
ggggcuggagccaaagggagaggaagaggaaa

SEQ ID NO: 466162 - RNA, 25 nt, Human
ggggcuggagccuuccaaacaggcu

SEQ ID NO: 466163 - RNA, 32 nt, Human
ggggcuggaggaagauccggagggcaggggug

SEQ ID NO: 466164 - RNA, 32 nt, Human
ggggcuggaggcgguggcugcgguugcgggac

SEQ ID NO: 466165 - RNA, 18 nt, Human
ggggcuggaggggggcag

SEQ ID NO: 466166 - RNA, 23 nt, Human
ggggcuggcaggcagaggcccag

SEQ ID NO: 466167 - RNA, 20 nt, Human
ggggcuggcagggacccuag

SEQ ID NO: 466168 - RNA, 19 nt, Human
ggggcuggcagggccucca

SEQ ID NO: 466169 - RNA, 32 nt, Human
ggggcuggcagucccuggcugcagaccccgag

SEQ ID NO: 466170 - RNA, 32 nt, Human
ggggcuggccacuuccguacuuccgcuuuccg

SEQ ID NO: 466171 - RNA, 32 nt, Human
ggggcuggccagcugcucguccgcccuaggua

SEQ ID NO: 466172 - RNA, 21 nt, Human
ggggcuggccaguggggacag

SEQ ID NO: 466173 - RNA, 32 nt, Human
ggggcuggcccaggcuacggcggcugcagggc

SEQ ID NO: 466174 - RNA, 20 nt, Human
ggggcuggccccaagcccag

SEQ ID NO: 466175 - RNA, 20 nt, Human
ggggcuggcccgggguucca

SEQ ID NO: 466176 - RNA, 32 nt, Human
ggggcuggcgcugaagccggauccggauccgg

SEQ ID NO: 466177 - RNA, 21 nt, Human
ggggcuggcggagagucacag

SEQ ID NO: 466178 - RNA, 32 nt, Human
ggggcuggcuaguaggggaacauguaguagcc

SEQ ID NO: 466179 - RNA, 18 nt, Human
ggggcuggcuccaggcca

SEQ ID NO: 466180 - RNA, 32 nt, Human
ggggcuggcugguucggaggcucugcuauuuc

SEQ ID NO: 466181 - RNA, 22 nt, Human
ggggcugggaaagagggggcag

SEQ ID NO: 466182 - RNA, 32 nt, Human
ggggcugggaccccagucgaggggacacaacc

SEQ ID NO: 466183 - RNA, 32 nt, Human
ggggcugggaccccuucccaucccaaccuuga

SEQ ID NO: 466184 - RNA, 32 nt, Human
ggggcugggagggagaggggcuccggcuuucu

SEQ ID NO: 466185 - RNA, 32 nt, Human
ggggcugggagguggagggccccugauucgaa

SEQ ID NO: 466186 - RNA, 22 nt, Human
ggggcugggcagcagccuuccu

SEQ ID NO: 466187 - RNA, 19 nt, Human
ggggcugggcagcugccag

SEQ ID NO: 466188 - RNA, 32 nt, Human
ggggcugggcaggccagccgggcauccugacc

SEQ ID NO: 466189 - RNA, 32 nt, Human
ggggcugggcaggcccauugagggccaccgcc

SEQ ID NO: 466190 - RNA, 32 nt, Human
ggggcugggcagggaugccaggugggcccagc

SEQ ID NO: 466191 - RNA, 32 nt, Human
ggggcugggcaggggcagcugggcuggcuccc

SEQ ID NO: 466192 - RNA, 32 nt, Human
ggggcugggcaggggcgguggaggacucagga

SEQ ID NO: 466193 - RNA, 32 nt, Human
ggggcugggcauugugucugaccugugcaucu

SEQ ID NO: 466194 - RNA, 32 nt, Human
ggggcugggccauggagcuggcccagaggccc

SEQ ID NO: 466195 - RNA, 32 nt, Human
ggggcugggcccuggccuccuaacggggcugc

SEQ ID NO: 466196 - RNA, 32 nt, Human
ggggcugggcccugggaccugaaggagguaac

SEQ ID NO: 466197 - RNA, 32 nt, Human
ggggcugggccuuggccacagccucuuggaug

SEQ ID NO: 466198 - RNA, 32 nt, Human
ggggcugggcugagccagggaggaaggaccca

SEQ ID NO: 466199 - RNA, 32 nt, Human
ggggcuggggaaagggaugggagccaggaaag

SEQ ID NO: 466200 - RNA, 32 nt, Human
ggggcuggggacccucacaggugacagggaca

SEQ ID NO: 466201 - RNA, 32 nt, Human
ggggcuggggagaggaaggggcagagggaccg

SEQ ID NO: 466202 - RNA, 32 nt, Human
ggggcuggggagggggacagggagugaguguu

SEQ ID NO: 466203 - RNA, 32 nt, Human
ggggcuggggcaaugcaggcugggugaccgac

SEQ ID NO: 466204 - RNA, 32 nt, Human
ggggcuggggcauggcaggcugggugaccgac

SEQ ID NO: 466205 - RNA, 32 nt, Human
ggggcuggggcgucccucuccucucuccccag

SEQ ID NO: 466206 - RNA, 32 nt, Human
ggggcuggggcuggggccggaggcggggugug

SEQ ID NO: 466207 - RNA, 20 nt, Human
ggggcugggggucaguccag

SEQ ID NO: 466208 - RNA, 32 nt, Human
ggggcugggggugcuggauggacagugggcau

SEQ ID NO: 466209 - RNA, 32 nt, Human
ggggcugggggugggauugaaggaaacccucu

SEQ ID NO: 466210 - RNA, 32 nt, Human
ggggcuggggguuggagaauaaaagcaggaga

SEQ ID NO: 466211 - RNA, 32 nt, Human
ggggcuggggugagagaggaaagaccuacauu

SEQ ID NO: 466212 - RNA, 32 nt, Human
ggggcugggugggagaugggagggccaacugc

SEQ ID NO: 466213 - RNA, 20 nt, Human
ggggcugguccaugauguca

SEQ ID NO: 466214 - RNA, 32 nt, Human
ggggcugguggagauuugagguggguuuaagu

SEQ ID NO: 466215 - RNA, 32 nt, Human
ggggcuggugggguggaggaugcugaguggug

SEQ ID NO: 466216 - RNA, 32 nt, Human
ggggcuguaggcaccggacggaagcaggcggu

SEQ ID NO: 466217 - RNA, 32 nt, Human
ggggcuguaggcgccaaggccauguccgacuc

SEQ ID NO: 466218 - RNA, 24 nt, Human
ggggcugucccaggucucuguggg

SEQ ID NO: 466219 - RNA, 18 nt, Human
ggggcugugaaggucugg

SEQ ID NO: 466220 - RNA, 32 nt, Human
ggggcugugaccugggcagcucaagacuggug

SEQ ID NO: 466221 - RNA, 32 nt, Human
ggggcugugcuacaaucucugcagccuuuuca

SEQ ID NO: 466222 - RNA, 19 nt, Human
ggggcugugucucugacug

SEQ ID NO: 466223 - RNA, 32 nt, Human
ggggcugugugagacgcagggaaggaggcaca

SEQ ID NO: 466224 - RNA, 32 nt, Human
ggggcugugugccacagggugaagaguuugug

SEQ ID NO: 466225 - RNA, 32 nt, Human
ggggcuguguuggaggagaggaagaaagagag

SEQ ID NO: 466226 - RNA, 32 nt, Human
ggggcuguuaggugccuggaugacaaguggac

SEQ ID NO: 466227 - RNA, 32 nt, Human
ggggcuguuggcuagaccccuugucagacuug

SEQ ID NO: 466228 - RNA, 17 nt, Human
ggggcuguuuccagguc

SEQ ID NO: 466229 - RNA, 32 nt, Human
ggggcuguuugggcaucuguggaggguggugc

SEQ ID NO: 466230 - RNA, 32 nt, Human
ggggcuuagggaugagguccugguuuuucuug

SEQ ID NO: 466231 - RNA, 32 nt, Human
ggggcuuaucucugauacaugcuggagcccug

SEQ ID NO: 466232 - RNA, 32 nt, Human
ggggcuucaaaccacuuaggaccgacugcuga

SEQ ID NO: 466233 - RNA, 21 nt, Human
ggggcuucaagagaggggcag

SEQ ID NO: 466234 - RNA, 32 nt, Human
ggggcuucagccuccauucucacuuuccuucu

SEQ ID NO: 466235 - RNA, 32 nt, Human
ggggcuucaucauccugaaaagaaggagacag

SEQ ID NO: 466236 - RNA, 32 nt, Human
ggggcuucauucaccacauuggccagccuggu

SEQ ID NO: 466237 - RNA, 32 nt, Human
ggggcuuccaggggccccaggagaagcugggc

SEQ ID NO: 466238 - RNA, 15 nt, Human
ggggcuuccagguca

SEQ ID NO: 466239 - RNA, 32 nt, Human
ggggcuucccaugggagcugauggcuucgugc

SEQ ID NO: 466240 - RNA, 17 nt, Human
ggggcuuccugagcguc

SEQ ID NO: 466241 - RNA, 18 nt, Human
ggggcuuccuggcugcag

SEQ ID NO: 466242 - RNA, 32 nt, Human
ggggcuuccuguaccuccuuuugccuggcucu

SEQ ID NO: 466243 - RNA, 32 nt, Human
ggggcuuccuuucugcagcugagaugcacgca

SEQ ID NO: 466244 - RNA, 19 nt, Human
ggggcuucuagacaggaca

SEQ ID NO: 466245 - RNA, 32 nt, Human
ggggcuucuccaagccucacugcgccagccuc

SEQ ID NO: 466246 - RNA, 32 nt, Human
ggggcuucuccaggacugucuguggcucguug

SEQ ID NO: 466247 - RNA, 32 nt, Human
ggggcuucuccauccaggucccuggaguuccu

SEQ ID NO: 466248 - RNA, 32 nt, Human
ggggcuucuccauguuggucaggcuggucugg

SEQ ID NO: 466249 - RNA, 32 nt, Human
ggggcuucucccccucagcucucccucacacc

SEQ ID NO: 466250 - RNA, 32 nt, Human
ggggcuucuccccucgcugcugcacccuggcu

SEQ ID NO: 466251 - RNA, 19 nt, Human
ggggcuucuggaaggagca

SEQ ID NO: 466252 - RNA, 32 nt, Human
ggggcuucuggguggggagugggagagagacu

SEQ ID NO: 466253 - RNA, 32 nt, Human
ggggcuucugucuagcucugcagcuguggcug

SEQ ID NO: 466254 - RNA, 32 nt, Human
ggggcuucuuucuuuucgaauguggcuaccgu

SEQ ID NO: 466255 - RNA, 32 nt, Human
ggggcuugagggguggggaauggggagggaag

SEQ ID NO: 466256 - RNA, 32 nt, Human
ggggcuugaguccagcccugggggucccggac

SEQ ID NO: 466257 - RNA, 21 nt, Human
ggggcuugcccuuggauuuca

SEQ ID NO: 466258 - RNA, 32 nt, Human
ggggcuugcgcuucugucgggucugugccgcu

SEQ ID NO: 466259 - RNA, 32 nt, Human
ggggcuuggaaaggaagguauuuuggaaucac

SEQ ID NO: 466260 - RNA, 32 nt, Human
ggggcuuggacagaagcugcccuccgaccccc

SEQ ID NO: 466261 - RNA, 32 nt, Human
ggggcuuggaggugggcggcuggacucaaucc

SEQ ID NO: 466262 - RNA, 32 nt, Human
ggggcuuggcccuggcccuggcccagaucuua

SEQ ID NO: 466263 - RNA, 32 nt, Human
ggggcuuggcugcugcuguugcugcucuguau

SEQ ID NO: 466264 - RNA, 32 nt, Human
ggggcuuggggaggggagggggcgccuuguuc

SEQ ID NO: 466265 - RNA, 32 nt, Human
ggggcuuggggcugucugggcuacagaaguga

SEQ ID NO: 466266 - RNA, 32 nt, Human
ggggcuugucauucugaucucagcagucuucu

SEQ ID NO: 466267 - RNA, 32 nt, Human
ggggcuuguggaggcagcaggugaagaggcag

SEQ ID NO: 466268 - RNA, 31 nt, Human
ggggcuugugguacuuaacacuuguagccau

SEQ ID NO: 466269 - RNA, 22 nt, Human
ggggcuuguguguucucugcgg

SEQ ID NO: 466270 - RNA, 32 nt, Human
ggggcuuguuugcugacuugcugcugcacgug

SEQ ID NO: 466271 - RNA, 32 nt, Human
ggggcuuucaacccucucccccaccacccagc

SEQ ID NO: 466272 - RNA, 32 nt, Human
ggggcuuugcugcuuuugccugcagcauccgc

SEQ ID NO: 466273 - RNA, 19 nt, Human
ggggcuuuuccaagcccag

SEQ ID NO: 466274 - RNA, 32 nt, Human
ggggcuuuugaggacccagcugcgucaggagu

SEQ ID NO: 466275 - RNA, 32 nt, Human
gggggaaaacugugccccaggaugucuggccc

SEQ ID NO: 466276 - RNA, 32 nt, Human
gggggaaaaggaggugggagugcagaugaaac

SEQ ID NO: 466277 - RNA, 32 nt, Human
gggggaaaaguagaucacuuaucuuagcaaac

SEQ ID NO: 466278 - RNA, 32 nt, Human
gggggaaacauacauuuauucaugccagucug

SEQ ID NO: 466279 - RNA, 32 nt, Human
gggggaaagaaaagggaagaagaaaggaaaag

SEQ ID NO: 466280 - RNA, 32 nt, Human
gggggaaagagaggguuaaucuuaucauaugu

SEQ ID NO: 466281 - RNA, 32 nt, Human
gggggaaagagcaaaccaucuuucuuccaggc

SEQ ID NO: 466282 - RNA, 32 nt, Human
gggggaaaggacucuguccccuuggggcucau

SEQ ID NO: 466283 - RNA, 32 nt, Human
gggggaaagugaauuacagugacaucagagca

SEQ ID NO: 466284 - RNA, 32 nt, Human
gggggaacacaugacaugauuugugaauauca

SEQ ID NO: 466285 - RNA, 32 nt, Human
gggggaacagcuuucgcccuggagcggugcgc

SEQ ID NO: 466286 - RNA, 32 nt, Human
gggggaacucggcggagcuuccuggcggcauc

SEQ ID NO: 466287 - RNA, 32 nt, Human
gggggaacuucugccuuccugguuuccuugac

SEQ ID NO: 466288 - RNA, 32 nt, Human
gggggaagaaggaggagaagaugaagaagcac

SEQ ID NO: 466289 - RNA, 22 nt, Human
gggggaagagaauuacauuucc

SEQ ID NO: 466290 - RNA, 32 nt, Human
gggggaagaggaagaaaagucggauuacaaga

SEQ ID NO: 466291 - RNA, 32 nt, Human
gggggaagaggugaggcuaggggagugcugug

SEQ ID NO: 466292 - RNA, 32 nt, Human
gggggaagauggcggagcuggggaagaaguac

SEQ ID NO: 466293 - RNA, 22 nt, Human
gggggaagcaagucuggucucu

SEQ ID NO: 466294 - RNA, 18 nt, Human
gggggaagcagaggcgcc

SEQ ID NO: 466295 - RNA, 19 nt, Human
gggggaagcagggcgggcc

SEQ ID NO: 466296 - RNA, 23 nt, Human
gggggaagcagggggcaguuucu

SEQ ID NO: 466297 - RNA, 18 nt, Human
gggggaagccaggcggcc

SEQ ID NO: 466298 - RNA, 32 nt, Human
gggggaagccauagggcgcuuucacaggccug

SEQ ID NO: 466299 - RNA, 27 nt, Human
gggggaagcccgccugagcaguguuuu

SEQ ID NO: 466300 - RNA, 24 nt, Human
gggggaagcccggaggcagugcuc

SEQ ID NO: 466301 - RNA, 32 nt, Human
gggggaagccuuuauucuuuacuguugucccu

SEQ ID NO: 466302 - RNA, 32 nt, Human
gggggaagcugcugagagucccuaucacugcu

SEQ ID NO: 466303 - RNA, 32 nt, Human
gggggaaggagagaggcguggguaagggacau

SEQ ID NO: 466304 - RNA, 32 nt, Human
gggggaagggagccacccugggggagucugag

SEQ ID NO: 466305 - RNA, 32 nt, Human
gggggaagggcggggugagggaagaaagaccc

SEQ ID NO: 466306 - RNA, 32 nt, Human
gggggaaggggacaugggcaggaagcaccgag

SEQ ID NO: 466307 - RNA, 32 nt, Human
gggggaaggggcuggggagugggggugggaag

SEQ ID NO: 466308 - RNA, 32 nt, Human
gggggaagggucugagacucccuuuccuuuug

SEQ ID NO: 466309 - RNA, 32 nt, Human
gggggaagucaaccccuccugugcugccgguc

SEQ ID NO: 466310 - RNA, 20 nt, Human
gggggaaguuccgggugccu

SEQ ID NO: 466311 - RNA, 32 nt, Human
gggggaaucccuugagcccaggaguuggagag

SEQ ID NO: 466312 - RNA, 32 nt, Human
gggggaauuaggggauuagauuaagaguaggu

SEQ ID NO: 466313 - RNA, 32 nt, Human
gggggacaaggagccucuagacuuaagagaca

SEQ ID NO: 466314 - RNA, 32 nt, Human
gggggacacuccagggaacccaaaacucaaag

SEQ ID NO: 466315 - RNA, 32 nt, Human
gggggacacuggcuccugccaucuccucugcc

SEQ ID NO: 466316 - RNA, 32 nt, Human
gggggacacuggcugcauucccccgcccccag

SEQ ID NO: 466317 - RNA, 31 nt, Human
gggggacagacgcagcaccuucuuagcgauc

SEQ ID NO: 466318 - RNA, 32 nt, Human
gggggacagagcccugggaggccgggccgggc

SEQ ID NO: 466319 - RNA, 32 nt, Human
gggggacagcagcuccagggaugucuucucuu

SEQ ID NO: 466320 - RNA, 32 nt, Human
gggggacagcugaggaugggccuagcagauga

SEQ ID NO: 466321 - RNA, 22 nt, Human
gggggacagcuggacggugucu

SEQ ID NO: 466322 - RNA, 32 nt, Human
gggggacagggagugaguguuucauggggaca

SEQ ID NO: 466323 - RNA, 32 nt, Human
gggggacaggugugcacggggcggccaagggc

SEQ ID NO: 466324 - RNA, 32 nt, Human
gggggacaguggcggugggacugaccugcuga

SEQ ID NO: 466325 - RNA, 32 nt, Human
gggggaccaccagguugccuaaggagugguga

SEQ ID NO: 466326 - RNA, 32 nt, Human
gggggaccauggacuucaucagcauucagcag

SEQ ID NO: 466327 - RNA, 24 nt, Human
gggggacccacccaccgucuccca

SEQ ID NO: 466328 - RNA, 24 nt, Human
gggggacccagacaccugucccca

SEQ ID NO: 466329 - RNA, 22 nt, Human
gggggacccugggaggugcuuu

SEQ ID NO: 466330 - RNA, 32 nt, Human
gggggacccugggaggugcuuuacagaccgcu

SEQ ID NO: 466331 - RNA, 21 nt, Human
gggggaccguguccuccccca

SEQ ID NO: 466332 - RNA, 32 nt, Human
gggggaccuagcucugucuucccagccccuug

SEQ ID NO: 466333 - RNA, 32 nt, Human
gggggaccucauuccugggacuaugcuguaac

SEQ ID NO: 466334 - RNA, 32 nt, Human
gggggaccuccaccaggaccccggcccugcac

SEQ ID NO: 466335 - RNA, 32 nt, Human
gggggaccucuacaccucugcugugggcacgg

SEQ ID NO: 466336 - RNA, 18 nt, Human
gggggacgccgaccgcuc

SEQ ID NO: 466337 - RNA, 32 nt, Human
gggggacgggauggccuguugcuucuggacca

SEQ ID NO: 466338 - RNA, 32 nt, Human
gggggacggggcggggcuugaccugcgggugc

SEQ ID NO: 466339 - RNA, 32 nt, Human
gggggacucaauguggcccucucacucauccc

SEQ ID NO: 466340 - RNA, 32 nt, Human
gggggacuccgagacagggaagaccggggccc

SEQ ID NO: 466341 - RNA, 32 nt, Human
gggggacugcucacggauaaggucuccccaac

SEQ ID NO: 466342 - RNA, 21 nt, Human
gggggacugcuugagcucagg

SEQ ID NO: 466343 - RNA, 22 nt, Human
gggggagaacagaagggggacg

SEQ ID NO: 466344 - RNA, 24 nt, Human
gggggagaacagagaaggugugga

SEQ ID NO: 466345 - RNA, 32 nt, Human
gggggagaacagagaggagcugggcuauggga

SEQ ID NO: 466346 - RNA, 22 nt, Human
gggggagaacagaguggacgga

SEQ ID NO: 466347 - RNA, 32 nt, Human
gggggagaagacgaagacagggccgggucucu

SEQ ID NO: 466348 - RNA, 32 nt, Human
gggggagaaggugggugggcucagggagaacg

SEQ ID NO: 466349 - RNA, 32 nt, Human
gggggagaagugagaaguguuaugacauuagu

SEQ ID NO: 466350 - RNA, 32 nt, Human
gggggagaauuaagccaaagaaguauauuuau

SEQ ID NO: 466351 - RNA, 32 nt, Human
gggggagacacuacuccuacuuaucuugcuca

SEQ ID NO: 466352 - RNA, 32 nt, Human
gggggagacagacagauacauacacauacacc

SEQ ID NO: 466353 - RNA, 32 nt, Human
gggggagacccccauuuuccuccgccccucuc

SEQ ID NO: 466354 - RNA, 32 nt, Human
gggggagacgagcaaugcagcacucuaggaag

SEQ ID NO: 466355 - RNA, 32 nt, Human
gggggagacgaggaggaggaggacaugacuuu

SEQ ID NO: 466356 - RNA, 32 nt, Human
gggggagacucccuccaugguggaagcccuug

SEQ ID NO: 466357 - RNA, 31 nt, Human
gggggagagaagagagaaagaggcugacccu

SEQ ID NO: 466358 - RNA, 32 nt, Human
gggggagagaagcagagggagagagaagguga

SEQ ID NO: 466359 - RNA, 32 nt, Human
gggggagagaggggaaggaaauggaacaaguu

SEQ ID NO: 466360 - RNA, 32 nt, Human
gggggagagauggggcggggcuuggaaggagc

SEQ ID NO: 466361 - RNA, 32 nt, Human
gggggagagccuggcccuguccuuugcuaccc

SEQ ID NO: 466362 - RNA, 32 nt, Human
gggggagaggaggggaaagcuagaccugcaga

SEQ ID NO: 466363 - RNA, 32 nt, Human
gggggagaggauggcccagcaggccuggccca

SEQ ID NO: 466364 - RNA, 32 nt, Human
gggggagagggagggaaggaaggugcggcugc

SEQ ID NO: 466365 - RNA, 32 nt, Human
gggggagaggggcaaaugccuccgggacugac

SEQ ID NO: 466366 - RNA, 32 nt, Human
gggggagagguggauugcagcaguauccucaa

SEQ ID NO: 466367 - RNA, 26 nt, Human
gggggagaguacgucggcggugcucu

SEQ ID NO: 466368 - RNA, 32 nt, Human
gggggagauggaccaccccuggaacugucccc

SEQ ID NO: 466369 - RNA, 32 nt, Human
gggggagcagaggggucggaaagggaaaacaa

SEQ ID NO: 466370 - RNA, 32 nt, Human
gggggagcagguuggagaggggaccaaaggca

SEQ ID NO: 466371 - RNA, 32 nt, Human
gggggagccaggcuucggaaucacugagagag

SEQ ID NO: 466372 - RNA, 32 nt, Human
gggggagcccagggcggggagggcgcggccgg

SEQ ID NO: 466373 - RNA, 32 nt, Human
gggggagccccgaccaccccagccucucaucu

SEQ ID NO: 466374 - RNA, 32 nt, Human
gggggagcccuggcuuucaccaaaggagccca

SEQ ID NO: 466375 - RNA, 32 nt, Human
gggggagcugcugggccuaaagcccacuccug

SEQ ID NO: 466376 - RNA, 32 nt, Human
gggggagcuggcagaggagagagacgucucag

SEQ ID NO: 466377 - RNA, 32 nt, Human
gggggaggaagaggaagagaaaagaagaagaa

SEQ ID NO: 466378 - RNA, 32 nt, Human
gggggaggaagaggagguggagaaggaggggg

SEQ ID NO: 466379 - RNA, 21 nt, Human
gggggaggaagcagugacuuu

SEQ ID NO: 466380 - RNA, 32 nt, Human
gggggaggacgccgagcguugaggcaggggcc

SEQ ID NO: 466381 - RNA, 32 nt, Human
gggggaggacucugcugcuucuuaagcuccag

SEQ ID NO: 466382 - RNA, 32 nt, Human
gggggaggacugcccacccuuccagauccccg

SEQ ID NO: 466383 - RNA, 32 nt, Human
gggggaggagaagagagaagaaacuggagcag

SEQ ID NO: 466384 - RNA, 21 nt, Human
gggggaggagaagcagugccu

SEQ ID NO: 466385 - RNA, 32 nt, Human
gggggaggagacacuggcaggagaugugcugu

SEQ ID NO: 466386 - RNA, 32 nt, Human
gggggaggagauggggaaguggagccacccug

SEQ ID NO: 466387 - RNA, 32 nt, Human
gggggaggagccaagauggccgaauaggaaca

SEQ ID NO: 466388 - RNA, 32 nt, Human
gggggaggaggaagaagagaaggaagaggaga

SEQ ID NO: 466389 - RNA, 32 nt, Human
gggggaggaggaagaggggaaggaggaggaag

SEQ ID NO: 466390 - RNA, 32 nt, Human
gggggaggaggaggaggagaagguggagagga

SEQ ID NO: 466391 - RNA, 32 nt, Human
gggggaggaggaggaggaggaguucguggaug

SEQ ID NO: 466392 - RNA, 32 nt, Human
gggggaggagggagggaggaaaagaggaggag

SEQ ID NO: 466393 - RNA, 32 nt, Human
gggggaggagggccuggccucagucccgggug

SEQ ID NO: 466394 - RNA, 32 nt, Human
gggggaggaucacggggucaggagaucgagac

SEQ ID NO: 466395 - RNA, 32 nt, Human
gggggaggcagccacccugcucugccugccag

SEQ ID NO: 466396 - RNA, 32 nt, Human
gggggaggcagcugggaugggagccagcccca

SEQ ID NO: 466397 - RNA, 32 nt, Human
gggggaggcaggaggaugccugccuggacccu

SEQ ID NO: 466398 - RNA, 32 nt, Human
gggggaggcaggcgguggugacaggacagggu

SEQ ID NO: 466399 - RNA, 32 nt, Human
gggggaggcagggcacagggagaugcucaggg

SEQ ID NO: 466400 - RNA, 32 nt, Human
gggggaggcauucgcguuuccccaaaugagaa

SEQ ID NO: 466401 - RNA, 32 nt, Human
gggggaggccgaggcaggggcugggcagaggg

SEQ ID NO: 466402 - RNA, 21 nt, Human
gggggaggcgauaaagacaga

SEQ ID NO: 466403 - RNA, 32 nt, Human
gggggaggcgcugaagucggggcccgcccugu

SEQ ID NO: 466404 - RNA, 32 nt, Human
gggggaggcucccagcuacaccuugcuguccu

SEQ ID NO: 466405 - RNA, 20 nt, Human
gggggaggcucuggccccuc

SEQ ID NO: 466406 - RNA, 32 nt, Human
gggggaggcuggcugcugcccaccucucucgc

SEQ ID NO: 466407 - RNA, 32 nt, Human
gggggaggcugggagagguugggugcucuccu

SEQ ID NO: 466408 - RNA, 32 nt, Human
gggggagggaaagggagaggggaagggcaggg

SEQ ID NO: 466409 - RNA, 32 nt, Human
gggggagggaaagugggccaguggggaggggg

SEQ ID NO: 466410 - RNA, 32 nt, Human
gggggagggacugacuguacucauggcuaacu

SEQ ID NO: 466411 - RNA, 32 nt, Human
gggggagggagaggagauuccuggagaggaac

SEQ ID NO: 466412 - RNA, 32 nt, Human
gggggagggaggagguuccgucagcagcuggc

SEQ ID NO: 466413 - RNA, 32 nt, Human
gggggagggaggcagugguggcuggagggugc

SEQ ID NO: 466414 - RNA, 32 nt, Human
gggggagggagggagacgugaagccuauuuaa

SEQ ID NO: 466415 - RNA, 32 nt, Human
gggggagggagggcauuguggggaaggagagg

SEQ ID NO: 466416 - RNA, 32 nt, Human
gggggagggagguggagggagggaaggguuuc

SEQ ID NO: 466417 - RNA, 32 nt, Human
gggggagggaggugggccaccauguuuggacc

SEQ ID NO: 466418 - RNA, 32 nt, Human
gggggagggaguggcucggaaggggcccccac

SEQ ID NO: 466419 - RNA, 32 nt, Human
gggggagggaugaccagcucucagggacccag

SEQ ID NO: 466420 - RNA, 32 nt, Human
gggggagggcagcucugggcacgccgcaccca

SEQ ID NO: 466421 - RNA, 32 nt, Human
gggggagggcggucuucccacuuccucuccag

SEQ ID NO: 466422 - RNA, 32 nt, Human
gggggagggcugggacuguuucguuucugcuu

SEQ ID NO: 466423 - RNA, 32 nt, Human
gggggagggcuggggcaaaucgccaccugugc

SEQ ID NO: 466424 - RNA, 32 nt, Human
gggggagggcuggggcuuucucugccugguac

SEQ ID NO: 466425 - RNA, 32 nt, Human
gggggaggggaagaagaaggccucacuuuugc

SEQ ID NO: 466426 - RNA, 16 nt, Human
gggggaggggaggcga

SEQ ID NO: 466427 - RNA, 32 nt, Human
gggggagggggaggagaaggggcaguugugac

SEQ ID NO: 466428 - RNA, 32 nt, Human
gggggagggggagggggaguggcaguguguuc

SEQ ID NO: 466429 - RNA, 32 nt, Human
gggggagggggcucagccccuccaccccuccc

SEQ ID NO: 466430 - RNA, 32 nt, Human
gggggaggguaggaggugggaggcagauacuu

SEQ ID NO: 466431 - RNA, 32 nt, Human
gggggagggugcagaugagggagcgacccaga

SEQ ID NO: 466432 - RNA, 32 nt, Human
gggggagguagggaagaaugagcugaauuugu

SEQ ID NO: 466433 - RNA, 32 nt, Human
gggggaggugauguaguuacagcugacuaaua

SEQ ID NO: 466434 - RNA, 32 nt, Human
gggggaguccacccucuccuugaugcagcuug

SEQ ID NO: 466435 - RNA, 31 nt, Human
gggggaguccuggaaagauggggcggacuga

SEQ ID NO: 466436 - RNA, 32 nt, Human
gggggagucgugcgugucagauuuaggccagg

SEQ ID NO: 466437 - RNA, 32 nt, Human
gggggagucugaagcagaugcaaagaggcaag

SEQ ID NO: 466438 - RNA, 32 nt, Human
gggggaguggggagccaagaggucccauauuc

SEQ ID NO: 466439 - RNA, 32 nt, Human
gggggauaaggaaaggaagugggcguuugagg

SEQ ID NO: 466440 - RNA, 32 nt, Human
gggggauaaggguguuuaaccaccucccaacu

SEQ ID NO: 466441 - RNA, 32 nt, Human
gggggauaaggguguuuaaccaccucccagcu

SEQ ID NO: 466442 - RNA, 32 nt, Human
gggggauagcaccccuguccuccugaggcaga

SEQ ID NO: 466443 - RNA, 32 nt, Human
gggggauauauguaugugugugugcgugcaua

SEQ ID NO: 466444 - RNA, 32 nt, Human
gggggaucacaaggucaggagaucgagaccau

SEQ ID NO: 466445 - RNA, 32 nt, Human
gggggaucccuaauauccccagccccagccag

SEQ ID NO: 466446 - RNA, 32 nt, Human
gggggaucccuggccgcgcauccucuggaggc

SEQ ID NO: 466447 - RNA, 32 nt, Human
gggggaucgcgccuggcagaccccagaccgag

SEQ ID NO: 466448 - RNA, 31 nt, Human
gggggaucgcuggagcccaugccagguuacg

SEQ ID NO: 466449 - RNA, 21 nt, Human
gggggaucgcuugagcccagg

SEQ ID NO: 466450 - RNA, 32 nt, Human
gggggaucucccagaauauuugaaccugguua

SEQ ID NO: 466451 - RNA, 32 nt, Human
gggggaucugaggcugugucucugccuugucu

SEQ ID NO: 466452 - RNA, 32 nt, Human
gggggaucuguuguguacguggagagggauga

SEQ ID NO: 466453 - RNA, 32 nt, Human
gggggaucuuaguugcuuauuuguuuugacuc

SEQ ID NO: 466454 - RNA, 31 nt, Human
gggggaugaaaucucccuuccuaagucuuug

SEQ ID NO: 466455 - RNA, 32 nt, Human
gggggaugaggauauggcagggaagcuuucac

SEQ ID NO: 466456 - RNA, 32 nt, Human
gggggaugccccuggcaugggguggguggagg

SEQ ID NO: 466457 - RNA, 32 nt, Human
gggggauggaaagggagaaauggaagggaaaa

SEQ ID NO: 466458 - RNA, 32 nt, Human
gggggauggaguuucgcuguuguugcccaggc

SEQ ID NO: 466459 - RNA, 18 nt, Human
gggggauggccaaggggu

SEQ ID NO: 466460 - RNA, 32 nt, Human
gggggauggcuugggccuuuucucucaaccuu

SEQ ID NO: 466461 - RNA, 32 nt, Human
gggggaugggagaagagggaaggggccucaga

SEQ ID NO: 466462 - RNA, 32 nt, Human
gggggaugggccuugcccucuucucuuuuccc

SEQ ID NO: 466463 - RNA, 32 nt, Human
gggggauggggugggagaggguuaauugguau

SEQ ID NO: 466464 - RNA, 32 nt, Human
gggggauggguagaggaugacuggcacacuug

SEQ ID NO: 466465 - RNA, 32 nt, Human
gggggaugguaagagaaaagagagaaacacug

SEQ ID NO: 466466 - RNA, 32 nt, Human
gggggauguggagacugagcuguggagagugu

SEQ ID NO: 466467 - RNA, 32 nt, Human
gggggaugugugugugaggugugcacaccccc

SEQ ID NO: 466468 - RNA, 32 nt, Human
gggggauguuuccaauggugggcagccuggcc

SEQ ID NO: 466469 - RNA, 21 nt, Human
gggggauuacuucagcccagg

SEQ ID NO: 466470 - RNA, 32 nt, Human
gggggauucugagcagugccucuugucugagg

SEQ ID NO: 466471 - RNA, 21 nt, Human
gggggauugcuugaguccagg

SEQ ID NO: 466472 - RNA, 32 nt, Human
gggggauuggagguggguguuagugguuagaa

SEQ ID NO: 466473 - RNA, 32 nt, Human
gggggauuguagcagacgucugggcuuuuccc

SEQ ID NO: 466474 - RNA, 32 nt, Human
gggggauuuaccugaccagccaccccauagcc

SEQ ID NO: 466475 - RNA, 19 nt, Human
gggggcaaaacccagugga

SEQ ID NO: 466476 - RNA, 25 nt, Human
gggggcaaaaggcgccauugggcgg

SEQ ID NO: 466477 - RNA, 32 nt, Human
gggggcaaagccucaguuccacugccuuccuc

SEQ ID NO: 466478 - RNA, 32 nt, Human
gggggcaagagcccaggagacugugugguuug

SEQ ID NO: 466479 - RNA, 32 nt, Human
gggggcaauaaaccgagccacccgggcgucca

SEQ ID NO: 466480 - RNA, 19 nt, Human
gggggcacacuauauucca

SEQ ID NO: 466481 - RNA, 32 nt, Human
gggggcacacuauauuccaccacuuuggagac

SEQ ID NO: 466482 - RNA, 32 nt, Human
gggggcacagagagaacaacauuccucucugu

SEQ ID NO: 466483 - RNA, 32 nt, Human
gggggcacagcacagaccccagagccaggaac

SEQ ID NO: 466484 - RNA, 32 nt, Human
gggggcacagggaggggcagcgagcagguggg

SEQ ID NO: 466485 - RNA, 32 nt, Human
gggggcacagugguguguagugcugcugugua

SEQ ID NO: 466486 - RNA, 32 nt, Human
gggggcaccaugugugccuuugcccacguguc

SEQ ID NO: 466487 - RNA, 32 nt, Human
gggggcaccgcgaagguggaggcggggccgcg

SEQ ID NO: 466488 - RNA, 19 nt, Human
gggggcaccgcgcgggugc

SEQ ID NO: 466489 - RNA, 17 nt, Human
gggggcaccgcguucca

SEQ ID NO: 466490 - RNA, 32 nt, Human
gggggcaccugggggucagagaacaaaugacg

SEQ ID NO: 466491 - RNA, 19 nt, Human
gggggcacucggacaucua

SEQ ID NO: 466492 - RNA, 32 nt, Human
gggggcacugagccuccagacccugcuaacca

SEQ ID NO: 466493 - RNA, 20 nt, Human
gggggcacuggcucauucca

SEQ ID NO: 466494 - RNA, 32 nt, Human
gggggcacuggcugcuucuguauuuugggguu

SEQ ID NO: 466495 - RNA, 18 nt, Human
gggggcacuuuucaucca

SEQ ID NO: 466496 - RNA, 32 nt, Human
gggggcagagagaaggucugaguccggggcag

SEQ ID NO: 466497 - RNA, 32 nt, Human
gggggcagagggcuuucagcgcccccaggccu

SEQ ID NO: 466498 - RNA, 32 nt, Human
gggggcagaguccuaggaugaggcuugggcag

SEQ ID NO: 466499 - RNA, 22 nt, Human
gggggcagcaagccagcugcgg

SEQ ID NO: 466500 - RNA, 24 nt, Human
gggggcagcaaggaugcagucucc

SEQ ID NO: 466501 - RNA, 32 nt, Human
gggggcagcaggcaggccccagccucugaacu

SEQ ID NO: 466502 - RNA, 32 nt, Human
gggggcagccaagaagccggagcuggcagcau

SEQ ID NO: 466503 - RNA, 32 nt, Human
gggggcagccugcucuccuccuggggcccugu

SEQ ID NO: 466504 - RNA, 32 nt, Human
gggggcagcgagcuccagcccucggcgguggc

SEQ ID NO: 466505 - RNA, 32 nt, Human
gggggcagcggcgccgcagccugggcuggcgg

SEQ ID NO: 466506 - RNA, 23 nt, Human
gggggcagcgguggggagggagg

SEQ ID NO: 466507 - RNA, 31 nt, Human
gggggcagcugugccaaucuaccucacaggc

SEQ ID NO: 466508 - RNA, 31 nt, Human
gggggcaggaaacuaccucuggcuuaauucu

SEQ ID NO: 466509 - RNA, 32 nt, Human
gggggcaggaaccuggggaggggcccagagca

SEQ ID NO: 466510 - RNA, 23 nt, Human
gggggcaggaaggcagggguggg

SEQ ID NO: 466511 - RNA, 32 nt, Human
gggggcaggacugaaguauggaagagcaucau

SEQ ID NO: 466512 - RNA, 32 nt, Human
gggggcaggagaagcccgggagaggcccacug

SEQ ID NO: 466513 - RNA, 32 nt, Human
gggggcaggagaucccuucaagaggcugcacc

SEQ ID NO: 466514 - RNA, 32 nt, Human
gggggcaggaggagagaggaaaagggagggcg

SEQ ID NO: 466515 - RNA, 32 nt, Human
gggggcaggagguggacaucuuugggggacau

SEQ ID NO: 466516 - RNA, 32 nt, Human
gggggcaggauggcggaaaggaaggggcgugg

SEQ ID NO: 466517 - RNA, 32 nt, Human
gggggcaggcccacccuccucuuugcgcccuu

SEQ ID NO: 466518 - RNA, 32 nt, Human
gggggcagggaccauggcagagcgagaguucu

SEQ ID NO: 466519 - RNA, 32 nt, Human
gggggcagggagcaauccagcaggaaggccag

SEQ ID NO: 466520 - RNA, 32 nt, Human
gggggcagggagcaguguugggagagggcucc

SEQ ID NO: 466521 - RNA, 23 nt, Human
gggggcagggcagcagagggagg

SEQ ID NO: 466522 - RNA, 32 nt, Human
gggggcagggccagggcagggaggcuuccagc

SEQ ID NO: 466523 - RNA, 21 nt, Human
gggggcagggcccgggggcgg

SEQ ID NO: 466524 - RNA, 32 nt, Human
gggggcaggggcgggcgcgggagcagcccagg

SEQ ID NO: 466525 - RNA, 32 nt, Human
gggggcagggggcagagagcagagaggagcgg

SEQ ID NO: 466526 - RNA, 21 nt, Human
gggggcagggggugagggagg

SEQ ID NO: 466527 - RNA, 32 nt, Human
gggggcaggggugggaggaagacaaagaaauu

SEQ ID NO: 466528 - RNA, 32 nt, Human
gggggcaggguuccgcucugucaucugucacc

SEQ ID NO: 466529 - RNA, 32 nt, Human
gggggcaggugugggagcacagcuggaacaau

SEQ ID NO: 466530 - RNA, 32 nt, Human
gggggcagugagagagagcuggaaaggggcaa

SEQ ID NO: 466531 - RNA, 20 nt, Human
gggggcaguuccucagguca

SEQ ID NO: 466532 - RNA, 32 nt, Human
gggggcauccugcaggggcucccaccagagcc

SEQ ID NO: 466533 - RNA, 32 nt, Human
gggggcaugagacacacagggaggcuggggcu

SEQ ID NO: 466534 - RNA, 32 nt, Human
gggggcaugcuggccucugagcgaucaggcga

SEQ ID NO: 466535 - RNA, 32 nt, Human
gggggcauggaggccaggucucaguccgcgcu

SEQ ID NO: 466536 - RNA, 19 nt, Human
gggggcauugugacaccca

SEQ ID NO: 466537 - RNA, 32 nt, Human
gggggcauuugguggagguaccccaaacucga

SEQ ID NO: 466538 - RNA, 32 nt, Human
gggggccaacaggguaccagagccaagacccu

SEQ ID NO: 466539 - RNA, 23 nt, Human
gggggccaaggaugccccguccc

SEQ ID NO: 466540 - RNA, 32 nt, Human
gggggccaaggcaggagaauugcuugagccug

SEQ ID NO: 466541 - RNA, 32 nt, Human
gggggccacaggccucuagcugugcugcucaa

SEQ ID NO: 466542 - RNA, 32 nt, Human
gggggccacgcaagugugggugugugagugug

SEQ ID NO: 466543 - RNA, 23 nt, Human
gggggccacgccugcacaucucc

SEQ ID NO: 466544 - RNA, 18 nt, Human
gggggccacgcgggccgg

SEQ ID NO: 466545 - RNA, 32 nt, Human
gggggccacugaaaccaggccuaggagggaga

SEQ ID NO: 466546 - RNA, 32 nt, Human
gggggccacuguagugagcguggagaaauuug

SEQ ID NO: 466547 - RNA, 32 nt, Human
gggggccagaggagcuucucuccucugggcgc

SEQ ID NO: 466548 - RNA, 31 nt, Human
gggggccagaguagcugauguaggaguacug

SEQ ID NO: 466549 - RNA, 32 nt, Human
gggggccagaguagcugauguaggaguacugg

SEQ ID NO: 466550 - RNA, 32 nt, Human
gggggccagaucugccugcuguuuccaugggu

SEQ ID NO: 466551 - RNA, 32 nt, Human
gggggccagcagcagguaggugccaucaggga

SEQ ID NO: 466552 - RNA, 32 nt, Human
gggggccagcaggauggaggaaagcauggaag

SEQ ID NO: 466553 - RNA, 24 nt, Human
gggggccagcccuggauagguuuu

SEQ ID NO: 466554 - RNA, 26 nt, Human
gggggccagcgggagcagggccugca

SEQ ID NO: 466555 - RNA, 20 nt, Human
gggggccaggaaccagcucc

SEQ ID NO: 466556 - RNA, 24 nt, Human
gggggccaggcccugcacgucucu

SEQ ID NO: 466557 - RNA, 32 nt, Human
gggggccagggacaguggaggaagggcccaug

SEQ ID NO: 466558 - RNA, 32 nt, Human
gggggccagggccugggcuuuacucaauugca

SEQ ID NO: 466559 - RNA, 32 nt, Human
gggggccaguccugcacccaccucuaccccuc

SEQ ID NO: 466560 - RNA, 32 nt, Human
gggggccaguggggccagcucagggaggaccu

SEQ ID NO: 466561 - RNA, 32 nt, Human
gggggccaucaguaaaauuaagaggaauuuuu

SEQ ID NO: 466562 - RNA, 32 nt, Human
gggggccauggagcugcuaaagcugaaccgga

SEQ ID NO: 466563 - RNA, 32 nt, Human
gggggcccagcaaucuucccaccccagacguc

SEQ ID NO: 466564 - RNA, 32 nt, Human
gggggcccagcccaaaguucuugucaccuccu

SEQ ID NO: 466565 - RNA, 32 nt, Human
gggggcccagccgguaucccaggucucccuuc

SEQ ID NO: 466566 - RNA, 22 nt, Human
gggggcccauguccacaucucc

SEQ ID NO: 466567 - RNA, 32 nt, Human
gggggccccaauggagcauggaagaugacccc

SEQ ID NO: 466568 - RNA, 32 nt, Human
gggggccccaggagguagagauucugggaaug

SEQ ID NO: 466569 - RNA, 32 nt, Human
gggggcccccuucucugguucagcccccacgc

SEQ ID NO: 466570 - RNA, 20 nt, Human
gggggccccgggagguugaa

SEQ ID NO: 466571 - RNA, 17 nt, Human
gggggccccucagguca

SEQ ID NO: 466572 - RNA, 32 nt, Human
gggggccccucuccccacuccuggggcagcuc

SEQ ID NO: 466573 - RNA, 32 nt, Human
gggggccccugccggagccucagacacacugg

SEQ ID NO: 466574 - RNA, 32 nt, Human
gggggccccuuguggaccucacccagccagag

SEQ ID NO: 466575 - RNA, 32 nt, Human
gggggcccggucgccaggcaaaaagcccucca

SEQ ID NO: 466576 - RNA, 32 nt, Human
gggggcccugcaggagucugugcugggcucuc

SEQ ID NO: 466577 - RNA, 32 nt, Human
gggggcccugcucgccccucgccagggggacu

SEQ ID NO: 466578 - RNA, 32 nt, Human
gggggcccugcucuucuggcccgucucccgga

SEQ ID NO: 466579 - RNA, 32 nt, Human
gggggccgaccccugcgggcucagggcucuuu

SEQ ID NO: 466580 - RNA, 21 nt, Human
gggggccgagcggcgggccgg

SEQ ID NO: 466581 - RNA, 22 nt, Human
gggggccgagcucgcgcgccgc

SEQ ID NO: 466582 - RNA, 24 nt, Human
gggggccgcagucgagguccgcag

SEQ ID NO: 466583 - RNA, 18 nt, Human
gggggccgccccgggccg

SEQ ID NO: 466584 - RNA, 32 nt, Human
gggggccgcccggucgucaccugcacucaucu

SEQ ID NO: 466585 - RNA, 22 nt, Human
gggggccgccgcggcccugcag

SEQ ID NO: 466586 - RNA, 32 nt, Human
gggggccgcggagcgcuggggagcagcggccg

SEQ ID NO: 466587 - RNA, 32 nt, Human
gggggccgcgggagcccccacccggggagaug

SEQ ID NO: 466588 - RNA, 32 nt, Human
gggggccgcucccagccagccacugggaccag

SEQ ID NO: 466589 - RNA, 32 nt, Human
gggggccggaaccuggccccggggagggcgcg

SEQ ID NO: 466590 - RNA, 19 nt, Human
gggggccggacagccugca

SEQ ID NO: 466591 - RNA, 32 nt, Human
gggggccggcagcuggagcccaaagcaggcgg

SEQ ID NO: 466592 - RNA, 18 nt, Human
gggggccggcgggggcgg

SEQ ID NO: 466593 - RNA, 21 nt, Human
gggggccgggccguccuccag

SEQ ID NO: 466594 - RNA, 23 nt, Human
gggggccgggcggugcgcugcag

SEQ ID NO: 466595 - RNA, 32 nt, Human
gggggccggggcaggagaaucgcuugaaccug

SEQ ID NO: 466596 - RNA, 25 nt, Human
gggggccggggcccggcgcaucucc

SEQ ID NO: 466597 - RNA, 21 nt, Human
gggggccggguucaccagcag

SEQ ID NO: 466598 - RNA, 23 nt, Human
gggggccggguuugggcccucag

SEQ ID NO: 466599 - RNA, 32 nt, Human
gggggccgugcacaccccaaacccugagcuuc

SEQ ID NO: 466600 - RNA, 22 nt, Human
gggggccguggggggccuggag

SEQ ID NO: 466601 - RNA, 32 nt, Human
gggggccuaaagcgacagucucaggggccauc

SEQ ID NO: 466602 - RNA, 32 nt, Human
gggggccucaacccucuccuggagcgccugug

SEQ ID NO: 466603 - RNA, 32 nt, Human
gggggccucacugcagccgccgcugcuguugg

SEQ ID NO: 466604 - RNA, 32 nt, Human
gggggccucacugccuuguuggucuccaccuu

SEQ ID NO: 466605 - RNA, 32 nt, Human
gggggccucagccugcccugaagucccgccag

SEQ ID NO: 466606 - RNA, 32 nt, Human
gggggccuccccugcuaucccuccucccaucc

SEQ ID NO: 466607 - RNA, 26 nt, Human
gggggccucgggagggugaaaggagg

SEQ ID NO: 466608 - RNA, 32 nt, Human
gggggccucuccucacucagagggugaugggg

SEQ ID NO: 466609 - RNA, 32 nt, Human
gggggccucuucuuccuccccugggccguccc

SEQ ID NO: 466610 - RNA, 32 nt, Human
gggggccugaccucccccuccuucccagcugc

SEQ ID NO: 466611 - RNA, 32 nt, Human
gggggccugcgaaguggaggggagacgggcag

SEQ ID NO: 466612 - RNA, 32 nt, Human
gggggccuggacugcacggcccggcagcaggu

SEQ ID NO: 466613 - RNA, 32 nt, Human
gggggccuggaggagggcaggagccgcgggag

SEQ ID NO: 466614 - RNA, 32 nt, Human
gggggccuggcaggcggcccacgggcagcugg

SEQ ID NO: 466615 - RNA, 32 nt, Human
gggggccuggcgggggcauccggcggagcugg

SEQ ID NO: 466616 - RNA, 32 nt, Human
gggggccugggcugccccugacaccccuucug

SEQ ID NO: 466617 - RNA, 32 nt, Human
gggggccuggucaguggaggccuaggccauca

SEQ ID NO: 466618 - RNA, 17 nt, Human
gggggccuguaauccca

SEQ ID NO: 466619 - RNA, 32 nt, Human
gggggccuguaaucccagcuacucaggaggcu

SEQ ID NO: 466620 - RNA, 32 nt, Human
gggggccuguaauccuagcuacuuggggugcu

SEQ ID NO: 466621 - RNA, 20 nt, Human
gggggcgaacgcagcacaga

SEQ ID NO: 466622 - RNA, 21 nt, Human
gggggcgacguggcgggucgg

SEQ ID NO: 466623 - RNA, 32 nt, Human
gggggcgagagggaagugggcgggagccgcga

SEQ ID NO: 466624 - RNA, 32 nt, Human
gggggcgagcggacaggaagaugaagggagca

SEQ ID NO: 466625 - RNA, 18 nt, Human
gggggcgagcgggcccgg

SEQ ID NO: 466626 - RNA, 32 nt, Human
gggggcgcaggcggagagcgcagggcggggag

SEQ ID NO: 466627 - RNA, 32 nt, Human
gggggcgccaaggagccagggggaaaaccaag

SEQ ID NO: 466628 - RNA, 32 nt, Human
gggggcgccauggacgaggccgugggcgaccu

SEQ ID NO: 466629 - RNA, 21 nt, Human
gggggcgccgagccgaggccg

SEQ ID NO: 466630 - RNA, 32 nt, Human
gggggcgccgcgccccucacaccaacgcguag

SEQ ID NO: 466631 - RNA, 19 nt, Human
gggggcgccggggggccgg

SEQ ID NO: 466632 - RNA, 20 nt, Human
gggggcgcgaggcgggggcg

SEQ ID NO: 466633 - RNA, 24 nt, Human
gggggcgcgcugagacggcgggug

SEQ ID NO: 466634 - RNA, 32 nt, Human
gggggcgcgcugccuucugccuggaaguguug

SEQ ID NO: 466635 - RNA, 21 nt, Human
gggggcgcuggcgggccgcgg

SEQ ID NO: 466636 - RNA, 21 nt, Human
gggggcgcugggcaggggcgg

SEQ ID NO: 466637 - RNA, 18 nt, Human
gggggcgcuuccugugga

SEQ ID NO: 466638 - RNA, 19 nt, Human
gggggcggaagcgggagcg

SEQ ID NO: 466639 - RNA, 23 nt, Human
gggggcggaagggcggcgggcgg

SEQ ID NO: 466640 - RNA, 21 nt, Human
gggggcggagccagcgggcgg

SEQ ID NO: 466641 - RNA, 24 nt, Human
gggggcggaggcggcgggccacgg

SEQ ID NO: 466642 - RNA, 32 nt, Human
gggggcggaggcgggagugagaggagaaggga

SEQ ID NO: 466643 - RNA, 23 nt, Human
gggggcggcaggagcagaagcgg

SEQ ID NO: 466644 - RNA, 23 nt, Human
gggggcggccccgggugggcgcg

SEQ ID NO: 466645 - RNA, 32 nt, Human
gggggcggccgagagcgaggaggacuuccugc

SEQ ID NO: 466646 - RNA, 21 nt, Human
gggggcggccggaggaugcgg

SEQ ID NO: 466647 - RNA, 24 nt, Human
gggggcggccggcggcgaaggggg

SEQ ID NO: 466648 - RNA, 21 nt, Human
gggggcggccggcgggggcgg

SEQ ID NO: 466649 - RNA, 20 nt, Human
gggggcggcgcagcgggcgg

SEQ ID NO: 466650 - RNA, 22 nt, Human
gggggcggcgcgaacggcgcgg

SEQ ID NO: 466651 - RNA, 23 nt, Human
gggggcggcgcgcaggagggagg

SEQ ID NO: 466652 - RNA, 21 nt, Human
gggggcggcgcggcggcgcgg

SEQ ID NO: 466653 - RNA, 17 nt, Human
gggggcggcggcugcgg

SEQ ID NO: 466654 - RNA, 21 nt, Human
gggggcggcggcugcgggcgc

SEQ ID NO: 466655 - RNA, 32 nt, Human
gggggcggcgggggcgggccagcuggacgggc

SEQ ID NO: 466656 - RNA, 20 nt, Human
gggggcggcugcagcugcug

SEQ ID NO: 466657 - RNA, 19 nt, Human
gggggcgggaaggaggggc

SEQ ID NO: 466658 - RNA, 32 nt, Human
gggggcgggacagggucucucuccgucuccca

SEQ ID NO: 466659 - RNA, 24 nt, Human
gggggcgggacggggcgggggcgg

SEQ ID NO: 466660 - RNA, 32 nt, Human
gggggcgggacugggcugggccugcggugagc

SEQ ID NO: 466661 - RNA, 24 nt, Human
gggggcgggagcagcgcggggcgg

SEQ ID NO: 466662 - RNA, 19 nt, Human
gggggcgggagcggaggug

SEQ ID NO: 466663 - RNA, 21 nt, Human
gggggcgggcaggcggacggg

SEQ ID NO: 466664 - RNA, 17 nt, Human
gggggcgggcaggugca

SEQ ID NO: 466665 - RNA, 22 nt, Human
gggggcgggccgagcggggcgg

SEQ ID NO: 466666 - RNA, 21 nt, Human
gggggcgggccgagggcgcgg

SEQ ID NO: 466667 - RNA, 21 nt, Human
gggggcgggcgcggggcgcgg

SEQ ID NO: 466668 - RNA, 32 nt, Human
gggggcgggcuggagggagggggcgggcgcug

SEQ ID NO: 466669 - RNA, 32 nt, Human
gggggcgggcugggagggcugucggugggcca

SEQ ID NO: 466670 - RNA, 23 nt, Human
gggggcggggaccggcaaggcgg

SEQ ID NO: 466671 - RNA, 24 nt, Human
gggggcggggcacgcaagugacgg

SEQ ID NO: 466672 - RNA, 24 nt, Human
gggggcggggcgagggcggagcgg

SEQ ID NO: 466673 - RNA, 32 nt, Human
gggggcggggcgaucgggucucagccccugcc

SEQ ID NO: 466674 - RNA, 20 nt, Human
gggggcggggcgcggcgcgc

SEQ ID NO: 466675 - RNA, 21 nt, Human
gggggcgggggccgagcgcgg

SEQ ID NO: 466676 - RNA, 21 nt, Human
gggggcgggggcggcaggagc

SEQ ID NO: 466677 - RNA, 21 nt, Human
gggggcggggggaagaugcgg

SEQ ID NO: 466678 - RNA, 23 nt, Human
gggggcggggggaggcggggcgg

SEQ ID NO: 466679 - RNA, 20 nt, Human
gggggcggggggagggcgcg

SEQ ID NO: 466680 - RNA, 32 nt, Human
gggggcgggguggaucacuugaggucaggggu

SEQ ID NO: 466681 - RNA, 32 nt, Human
gggggcgggucugagugguaccccggaggaga

SEQ ID NO: 466682 - RNA, 19 nt, Human
gggggcggguugggggugc

SEQ ID NO: 466683 - RNA, 20 nt, Human
gggggcgguaggauauuuua

SEQ ID NO: 466684 - RNA, 21 nt, Human
gggggcggucggaaggcgcgg

SEQ ID NO: 466685 - RNA, 19 nt, Human
gggggcggugaucagguca

SEQ ID NO: 466686 - RNA, 32 nt, Human
gggggcgguggaggccgugcagggaggcggga

SEQ ID NO: 466687 - RNA, 32 nt, Human
gggggcgguggagguggcggcggcagcggcaa

SEQ ID NO: 466688 - RNA, 23 nt, Human
gggggcgguggcucacaccugua

SEQ ID NO: 466689 - RNA, 32 nt, Human
gggggcguacggagguggcagcugugggagga

SEQ ID NO: 466690 - RNA, 32 nt, Human
gggggcguggugagucgcggucuguucucacg

SEQ ID NO: 466691 - RNA, 19 nt, Human
gggggcguguuccauucca

SEQ ID NO: 466692 - RNA, 32 nt, Human
gggggcuaaagaggaaggaggggaggaggucg

SEQ ID NO: 466693 - RNA, 23 nt, Human
gggggcuaaaguguauauauucc

SEQ ID NO: 466694 - RNA, 32 nt, Human
gggggcuaaggaugcaaccucugacguucugc

SEQ ID NO: 466695 - RNA, 32 nt, Human
gggggcuacaucugguaacgcccucagaagcc

SEQ ID NO: 466696 - RNA, 32 nt, Human
gggggcuagcugguggaggagguaagaguagc

SEQ ID NO: 466697 - RNA, 32 nt, Human
gggggcucagaucuuggcuucggguugagaug

SEQ ID NO: 466698 - RNA, 32 nt, Human
gggggcucagugccauggaagcuacuccaagu

SEQ ID NO: 466699 - RNA, 32 nt, Human
gggggcucccuauguugcccaggcuggucuca

SEQ ID NO: 466700 - RNA, 32 nt, Human
gggggcucccuggcgcaugccugcuccugucc

SEQ ID NO: 466701 - RNA, 32 nt, Human
gggggcuccgacuccagcucugggcaagaucc

SEQ ID NO: 466702 - RNA, 22 nt, Human
gggggcuccggcggcggcgcgg

SEQ ID NO: 466703 - RNA, 32 nt, Human
gggggcucggcggccaccgcugccucaaggga

SEQ ID NO: 466704 - RNA, 32 nt, Human
gggggcucucauccuccucggauucugaagag

SEQ ID NO: 466705 - RNA, 32 nt, Human
gggggcucucgauguagcaccaugacaggcau

SEQ ID NO: 466706 - RNA, 32 nt, Human
gggggcucugcagcugcccagcucuuccagcu

SEQ ID NO: 466707 - RNA, 32 nt, Human
gggggcucugcuccucuucauuugcugguagc

SEQ ID NO: 466708 - RNA, 32 nt, Human
gggggcucuggaaggaugggccagcuugcagg

SEQ ID NO: 466709 - RNA, 32 nt, Human
gggggcucuggaccaggaagauguucugacag

SEQ ID NO: 466710 - RNA, 18 nt, Human
gggggcucugggccccuu

SEQ ID NO: 466711 - RNA, 32 nt, Human
gggggcucuuccgccagcaccggaggaagaaa

SEQ ID NO: 466712 - RNA, 17 nt, Human
gggggcucuuccugcug

SEQ ID NO: 466713 - RNA, 32 nt, Human
gggggcugaaaccuuuugccaucagcgaacag

SEQ ID NO: 466714 - RNA, 32 nt, Human
gggggcugaauuccagcucacacacaccucaa

SEQ ID NO: 466715 - RNA, 22 nt, Human
gggggcugaccccagcuuccag

SEQ ID NO: 466716 - RNA, 32 nt, Human
gggggcugagcuccagcacugggcaggcacag

SEQ ID NO: 466717 - RNA, 32 nt, Human
gggggcugaggcaggagaaucgcuugaaccug

SEQ ID NO: 466718 - RNA, 32 nt, Human
gggggcugaggcaggagaauugcuugaaccug

SEQ ID NO: 466719 - RNA, 32 nt, Human
gggggcugaggcaggaggaucaguugaacgug

SEQ ID NO: 466720 - RNA, 32 nt, Human
gggggcugaggcaggaggaucgcuugaaccca

SEQ ID NO: 466721 - RNA, 32 nt, Human
gggggcugaggcaggaggaucgcuugaaccug

SEQ ID NO: 466722 - RNA, 32 nt, Human
gggggcugaggcaggcagaucgcuugagcuca

SEQ ID NO: 466723 - RNA, 32 nt, Human
gggggcugaggcaugagaaucacuugaaccug

SEQ ID NO: 466724 - RNA, 32 nt, Human
gggggcugaggcgggaggauugcuugagccug

SEQ ID NO: 466725 - RNA, 32 nt, Human
gggggcugagguaaaagaauugcuugaacccg

SEQ ID NO: 466726 - RNA, 32 nt, Human
gggggcugcaccugccugccuuugccuaaggc

SEQ ID NO: 466727 - RNA, 32 nt, Human
gggggcugcauucuuguugguagcauguacuc

SEQ ID NO: 466728 - RNA, 32 nt, Human
gggggcugcccagcuggacagauggcuuccug

SEQ ID NO: 466729 - RNA, 21 nt, Human
gggggcugcccccggggccug

SEQ ID NO: 466730 - RNA, 32 nt, Human
gggggcugccugcacgcuccccuagccuacuc

SEQ ID NO: 466731 - RNA, 32 nt, Human
gggggcugcggaaugcgcgaggagaacaaggg

SEQ ID NO: 466732 - RNA, 19 nt, Human
gggggcugcguccaggccg

SEQ ID NO: 466733 - RNA, 24 nt, Human
gggggcugcugaacccagcaccag

SEQ ID NO: 466734 - RNA, 21 nt, Human
gggggcugcuucccgccccag

SEQ ID NO: 466735 - RNA, 22 nt, Human
gggggcuggcacaauagcccag

SEQ ID NO: 466736 - RNA, 24 nt, Human
gggggcuggcagagccacacccca

SEQ ID NO: 466737 - RNA, 18 nt, Human
gggggcuggcagcugcgg

SEQ ID NO: 466738 - RNA, 19 nt, Human
gggggcuggcagggcucca

SEQ ID NO: 466739 - RNA, 22 nt, Human
gggggcuggcaucccagcucca

SEQ ID NO: 466740 - RNA, 24 nt, Human
gggggcuggcccagggcccugcag

SEQ ID NO: 466741 - RNA, 19 nt, Human
gggggcuggcgggggccgg

SEQ ID NO: 466742 - RNA, 24 nt, Human
gggggcuggcucugagagccccag

SEQ ID NO: 466743 - RNA, 32 nt, Human
gggggcuggcucugcuggccgucacgagcacu

SEQ ID NO: 466744 - RNA, 32 nt, Human
gggggcugggaaggacccccacccucaauuuu

SEQ ID NO: 466745 - RNA, 32 nt, Human
gggggcugggagaggaaauuagaggggaggcg

SEQ ID NO: 466746 - RNA, 32 nt, Human
gggggcugggcagaggguggaggagguccugc

SEQ ID NO: 466747 - RNA, 19 nt, Human
gggggcugggcggaggcgg

SEQ ID NO: 466748 - RNA, 32 nt, Human
gggggcugggcuggagugagagagaggcaggu

SEQ ID NO: 466749 - RNA, 32 nt, Human
gggggcugggcuggggguuagggcugggacug

SEQ ID NO: 466750 - RNA, 32 nt, Human
gggggcuggggacugcagccccacucccgccc

SEQ ID NO: 466751 - RNA, 18 nt, Human
gggggcugggggcagcag

SEQ ID NO: 466752 - RNA, 22 nt, Human
gggggcugggucggcagcccag

SEQ ID NO: 466753 - RNA, 32 nt, Human
gggggcuggucuucagcucuggcgccuucauc

SEQ ID NO: 466754 - RNA, 32 nt, Human
gggggcugguggccgucuccacucccuaggca

SEQ ID NO: 466755 - RNA, 32 nt, Human
gggggcuguaggaggaggcagggauuccaggg

SEQ ID NO: 466756 - RNA, 21 nt, Human
gggggcuguccagagcugcag

SEQ ID NO: 466757 - RNA, 32 nt, Human
gggggcugugccaaccuguucuuagaguguag

SEQ ID NO: 466758 - RNA, 24 nt, Human
gggggcugugcuagggaccugcag

SEQ ID NO: 466759 - RNA, 18 nt, Human
gggggcuguggccgucag

SEQ ID NO: 466760 - RNA, 32 nt, Human
gggggcuuccaccauucccagaacugaucaaa

SEQ ID NO: 466761 - RNA, 32 nt, Human
gggggcuuccuggucugugcuuuacuuggcuu

SEQ ID NO: 466762 - RNA, 32 nt, Human
gggggcuucugaacuuggacuccugggaacau

SEQ ID NO: 466763 - RNA, 27 nt, Human
gggggcuucugagggaugcucaucuuu

SEQ ID NO: 466764 - RNA, 32 nt, Human
gggggcuucugaugccugguccaaggcucuua

SEQ ID NO: 466765 - RNA, 32 nt, Human
gggggcuugcccacugccugccuccccuccgc

SEQ ID NO: 466766 - RNA, 32 nt, Human
gggggcuuggagaagggcggagcccaccagcc

SEQ ID NO: 466767 - RNA, 16 nt, Human
gggggcuugggucuga

SEQ ID NO: 466768 - RNA, 32 nt, Human
gggggcuuugcaccuggagggaagcccaccug

SEQ ID NO: 466769 - RNA, 32 nt, Human
gggggcuuugggcauggaggaggcagaagagg

SEQ ID NO: 466770 - RNA, 32 nt, Human
gggggcuuugucuuggcugagccacaucucuc

SEQ ID NO: 466771 - RNA, 21 nt, Human
ggggggagggguggugcugcu

SEQ ID NO: 466772 - RNA, 21 nt, Human
ggggggagucucacagugccu

SEQ ID NO: 466773 - RNA, 22 nt, Human
ggggggaucacuugagcccagg

SEQ ID NO: 466774 - RNA, 20 nt, Human
ggggggcgagcggacaggaa

SEQ ID NO: 466775 - RNA, 22 nt, Human
ggggggugaucaccugagguca

SEQ ID NO: 466776 - RNA, 24 nt, Human
ggggggugggugggaucggugggg

SEQ ID NO: 466777 - RNA, 32 nt, Human
ggggguaaaaugcagaggugguugccugaagg

SEQ ID NO: 466778 - RNA, 32 nt, Human
ggggguaacagucugcaucaucaucacaaccu

SEQ ID NO: 466779 - RNA, 32 nt, Human
ggggguaaggccaagacuggguagauuuuaaa

SEQ ID NO: 466780 - RNA, 32 nt, Human
ggggguaccacagccagaccuaggggccuggg

SEQ ID NO: 466781 - RNA, 32 nt, Human
ggggguacucagaaagaggagccgcagaguuc

SEQ ID NO: 466782 - RNA, 32 nt, Human
ggggguacugaucuuuggaaaugucaguccug

SEQ ID NO: 466783 - RNA, 32 nt, Human
ggggguagaaggcagugagagcgugaggggga

SEQ ID NO: 466784 - RNA, 21 nt, Human
ggggguagagaugaggggagg

SEQ ID NO: 466785 - RNA, 23 nt, Human
ggggguaggagggacagagcuuu

SEQ ID NO: 466786 - RNA, 32 nt, Human
ggggguaggccugcugauucagaggguccucu

SEQ ID NO: 466787 - RNA, 32 nt, Human
ggggguaggcugggaccgucauuucuucugac

SEQ ID NO: 466788 - RNA, 25 nt, Human
ggggguagggggcggcaaagggagg

SEQ ID NO: 466789 - RNA, 32 nt, Human
ggggguagggggugacgcugaagaggaagagu

SEQ ID NO: 466790 - RNA, 21 nt, Human
ggggguagguuuggagggagg

SEQ ID NO: 466791 - RNA, 32 nt, Human
ggggguaugaggaggaggagggggaggagcaa

SEQ ID NO: 466792 - RNA, 32 nt, Human
gggggucaagacguccccugaggacccaggcc

SEQ ID NO: 466793 - RNA, 32 nt, Human
gggggucaagacuggaaacacacagaaaauag

SEQ ID NO: 466794 - RNA, 22 nt, Human
gggggucaagggauccacacuc

SEQ ID NO: 466795 - RNA, 32 nt, Human
gggggucacagccacagaguggaguuuuauug

SEQ ID NO: 466796 - RNA, 32 nt, Human
gggggucagacuccugaggcucucccuucccu

SEQ ID NO: 466797 - RNA, 32 nt, Human
gggggucagcuggucucaaaacuggccacugc

SEQ ID NO: 466798 - RNA, 32 nt, Human
gggggucaggcagaggccagccugcacuggag

SEQ ID NO: 466799 - RNA, 21 nt, Human
gggggucagggacgcagcucc

SEQ ID NO: 466800 - RNA, 32 nt, Human
gggggucagggugguuuugagagagcagggua

SEQ ID NO: 466801 - RNA, 18 nt, Human
ggggguccaggaggccgg

SEQ ID NO: 466802 - RNA, 32 nt, Human
ggggguccaggggacauccuggaaggcugggc

SEQ ID NO: 466803 - RNA, 32 nt, Human
ggggguccauguccaagagacccugacaagga

SEQ ID NO: 466804 - RNA, 32 nt, Human
ggggguccauuauaaaaccacccauuaggucu

SEQ ID NO: 466805 - RNA, 32 nt, Human
gggggucccacuguguuggccaaacuaguccc

SEQ ID NO: 466806 - RNA, 32 nt, Human
ggggguccccuucacauggccucaggcuuccc

SEQ ID NO: 466807 - RNA, 32 nt, Human
gggggucccugccuuagccccacacaaggcuu

SEQ ID NO: 466808 - RNA, 23 nt, Human
ggggguccgucccgagaagggag

SEQ ID NO: 466809 - RNA, 32 nt, Human
ggggguccucauucccuucuguaugacaggua

SEQ ID NO: 466810 - RNA, 32 nt, Human
ggggguccuccaggaccucagcugcacccauu

SEQ ID NO: 466811 - RNA, 32 nt, Human
ggggguccugacucacacuuacugcaaaggcu

SEQ ID NO: 466812 - RNA, 32 nt, Human
ggggguccugcucuucgucgugggcuucaucg

SEQ ID NO: 466813 - RNA, 32 nt, Human
ggggguccugguaugucucaccaggaaauucu

SEQ ID NO: 466814 - RNA, 32 nt, Human
ggggguccuguauccuggaguauuaugucucc

SEQ ID NO: 466815 - RNA, 32 nt, Human
gggggucucagggagcuucuccccagcgcugc

SEQ ID NO: 466816 - RNA, 32 nt, Human
gggggucuccagccagagacguugggugagac

SEQ ID NO: 466817 - RNA, 32 nt, Human
gggggucucccguuuccugugccugcaccagc

SEQ ID NO: 466818 - RNA, 18 nt, Human
gggggucucgcggggcgg

SEQ ID NO: 466819 - RNA, 32 nt, Human
gggggucugccauucccucccccaggccuucc

SEQ ID NO: 466820 - RNA, 32 nt, Human
gggggucugccugggccccuccugguguguca

SEQ ID NO: 466821 - RNA, 32 nt, Human
gggggucuggggcaucccuggagcucagaagc

SEQ ID NO: 466822 - RNA, 32 nt, Human
gggggucuguggauuucuaguuuaugauaaau

SEQ ID NO: 466823 - RNA, 32 nt, Human
gggggugagauaagcggccaugugaucccacc

SEQ ID NO: 466824 - RNA, 32 nt, Human
gggggugaggcagaggaucacuugagcccagg

SEQ ID NO: 466825 - RNA, 19 nt, Human
gggggugaucaccagggga

SEQ ID NO: 466826 - RNA, 21 nt, Human
gggggugaugaaaaggggagg

SEQ ID NO: 466827 - RNA, 20 nt, Human
gggggugauuggaagggagg

SEQ ID NO: 466828 - RNA, 32 nt, Human
gggggugauuugcaaugaaauuuugggaccca

SEQ ID NO: 466829 - RNA, 18 nt, Human
gggggugcaagaggguua

SEQ ID NO: 466830 - RNA, 32 nt, Human
gggggugcaaguguccaccaaaccagauaggc

SEQ ID NO: 466831 - RNA, 17 nt, Human
gggggugcagaagggca

SEQ ID NO: 466832 - RNA, 32 nt, Human
gggggugcagagacagaggcugaggugcaggg

SEQ ID NO: 466833 - RNA, 17 nt, Human
gggggugcagagcguua

SEQ ID NO: 466834 - RNA, 20 nt, Human
gggggugcagcccaggguca

SEQ ID NO: 466835 - RNA, 20 nt, Human
gggggugcagccggugggca

SEQ ID NO: 466836 - RNA, 17 nt, Human
gggggugcagcgcuuca

SEQ ID NO: 466837 - RNA, 17 nt, Human
gggggugcaggcgggca

SEQ ID NO: 466838 - RNA, 17 nt, Human
gggggugcaggugggca

SEQ ID NO: 466839 - RNA, 32 nt, Human
gggggugcagguguggaggcagcagcuguccu

SEQ ID NO: 466840 - RNA, 20 nt, Human
gggggugcagucugaggcca

SEQ ID NO: 466841 - RNA, 32 nt, Human
gggggugcagugguguguagugcugcugugua

SEQ ID NO: 466842 - RNA, 32 nt, Human
gggggugcaugggaaacugcaccccacaaccc

SEQ ID NO: 466843 - RNA, 18 nt, Human
gggggugcauuugagguc

SEQ ID NO: 466844 - RNA, 32 nt, Human
gggggugccacagccuuuugggauggggguga

SEQ ID NO: 466845 - RNA, 19 nt, Human
gggggugccaggaagggca

SEQ ID NO: 466846 - RNA, 20 nt, Human
gggggugccaggaccaguca

SEQ ID NO: 466847 - RNA, 32 nt, Human
gggggugccggcgcauucuaccagucucaggg

SEQ ID NO: 466848 - RNA, 21 nt, Human
gggggugccuagccaggugca

SEQ ID NO: 466849 - RNA, 19 nt, Human
gggggugccucucaaguua

SEQ ID NO: 466850 - RNA, 32 nt, Human
gggggugccucucggaggagccuguguccacc

SEQ ID NO: 466851 - RNA, 32 nt, Human
gggggugccugggaagagguuuaucuguccug

SEQ ID NO: 466852 - RNA, 20 nt, Human
gggggugccugugccaggca

SEQ ID NO: 466853 - RNA, 32 nt, Human
gggggugcgaggggcucaguggggcuucucuu

SEQ ID NO: 466854 - RNA, 18 nt, Human
gggggugcgcccaaguca

SEQ ID NO: 466855 - RNA, 25 nt, Human
gggggugcgcgccgggagccugcag

SEQ ID NO: 466856 - RNA, 32 nt, Human
gggggugcggagagacaggcggaggggcgggg

SEQ ID NO: 466857 - RNA, 20 nt, Human
gggggugcggccaccagguc

SEQ ID NO: 466858 - RNA, 20 nt, Human
gggggugcggcgucugguca

SEQ ID NO: 466859 - RNA, 19 nt, Human
gggggugcggggcaguuca

SEQ ID NO: 466860 - RNA, 32 nt, Human
gggggugcuaucaggguaacacugccugcagc

SEQ ID NO: 466861 - RNA, 32 nt, Human
gggggugcucagcagcagcccagauuuagggg

SEQ ID NO: 466862 - RNA, 17 nt, Human
gggggugcucuguaggu

SEQ ID NO: 466863 - RNA, 32 nt, Human
gggggugcugcuggcccuccugcaggccuucu

SEQ ID NO: 466864 - RNA, 18 nt, Human
gggggugcugugcaggca

SEQ ID NO: 466865 - RNA, 32 nt, Human
gggggugcuuugcagggcaguggugcagccgc

SEQ ID NO: 466866 - RNA, 32 nt, Human
ggggguggaaggagugccuggcccuggggagg

SEQ ID NO: 466867 - RNA, 32 nt, Human
ggggguggacaacauucaacacugcagaaugg

SEQ ID NO: 466868 - RNA, 32 nt, Human
ggggguggagccaaugccaggccagaagccuu

SEQ ID NO: 466869 - RNA, 32 nt, Human
ggggguggaggguggaggagggagcaggaaca

SEQ ID NO: 466870 - RNA, 20 nt, Human
ggggguggagguugcaguga

SEQ ID NO: 466871 - RNA, 32 nt, Human
ggggguggagugaagcucagggcuugcagcca

SEQ ID NO: 466872 - RNA, 32 nt, Human
ggggguggauccacuuggggaggcaggcaacc

SEQ ID NO: 466873 - RNA, 32 nt, Human
ggggguggaugcugaguccaggaggugaugag

SEQ ID NO: 466874 - RNA, 24 nt, Human
ggggguggcagagggaaaaggagg

SEQ ID NO: 466875 - RNA, 20 nt, Human
ggggguggcaguggagggag

SEQ ID NO: 466876 - RNA, 32 nt, Human
  misc_feature (24)..(24): n is a, c, g or u
ggggguggccacuccugggccccnagaaagcc

SEQ ID NO: 466877 - RNA, 20 nt, Human
ggggguggcccaagggaagg

SEQ ID NO: 466878 - RNA, 24 nt, Human
ggggguggcggcacgguccgggag

SEQ ID NO: 466879 - RNA, 19 nt, Human
ggggguggcgggauggagg

SEQ ID NO: 466880 - RNA, 19 nt, Human
ggggguggcgguggaggga

SEQ ID NO: 466881 - RNA, 32 nt, Human
ggggguggcuccaccagucgccuggccucuuc

SEQ ID NO: 466882 - RNA, 24 nt, Human
ggggguggcugggaggggaaggga

SEQ ID NO: 466883 - RNA, 23 nt, Human
gggggugggaaaaucgaagggag

SEQ ID NO: 466884 - RNA, 32 nt, Human
gggggugggaaagaagagggacguggggagaa

SEQ ID NO: 466885 - RNA, 32 nt, Human
gggggugggaaugggguggggucacuaaggag

SEQ ID NO: 466886 - RNA, 32 nt, Human
gggggugggagcagggucacaaaagugagugu

SEQ ID NO: 466887 - RNA, 32 nt, Human
gggggugggaggagagagcggcagagaagcuc

SEQ ID NO: 466888 - RNA, 32 nt, Human
gggggugggaggaugcgggcgggccgguagcc

SEQ ID NO: 466889 - RNA, 32 nt, Human
gggggugggaggauuugagggagcucacugcc

SEQ ID NO: 466890 - RNA, 32 nt, Human
gggggugggagggagaaugggcacagccagag

SEQ ID NO: 466891 - RNA, 23 nt, Human
gggggugggagggguguagggag

SEQ ID NO: 466892 - RNA, 32 nt, Human
gggggugggcagcccuuggagcacacaguggu

SEQ ID NO: 466893 - RNA, 32 nt, Human
gggggugggcaggcuuggaggggacgcuggga

SEQ ID NO: 466894 - RNA, 21 nt, Human
gggggugggcauuucagguca

SEQ ID NO: 466895 - RNA, 32 nt, Human
gggggugggcuuuggucuuagcacuuuccuuc

SEQ ID NO: 466896 - RNA, 32 nt, Human
ggggguggggacacuuguuuauaaaugcagaa

SEQ ID NO: 466897 - RNA, 32 nt, Human
ggggguggggagaaagaaaaaguguauuacuu

SEQ ID NO: 466898 - RNA, 32 nt, Human
ggggguggggagcuucuguucuggugaaggga

SEQ ID NO: 466899 - RNA, 32 nt, Human
ggggguggggcagaggcggagucugaggagcu

SEQ ID NO: 466900 - RNA, 32 nt, Human
gggggugggggaggagguugagggaacagggg

SEQ ID NO: 466901 - RNA, 32 nt, Human
gggggugggggcagccaaguccagccacucuu

SEQ ID NO: 466902 - RNA, 21 nt, Human
gggggugggguuugauaggga

SEQ ID NO: 466903 - RNA, 32 nt, Human
gggggugggugagagagacaggcagcucggau

SEQ ID NO: 466904 - RNA, 32 nt, Human
gggggugggugaggaauggggugaggguaucu

SEQ ID NO: 466905 - RNA, 18 nt, Human
ggggguggguggggugaa

SEQ ID NO: 466906 - RNA, 22 nt, Human
gggggugguacaggguagggag

SEQ ID NO: 466907 - RNA, 20 nt, Human
gggggugguauggaagggag

SEQ ID NO: 466908 - RNA, 32 nt, Human
gggggugguaugggugggggaggggaauugcc

SEQ ID NO: 466909 - RNA, 32 nt, Human
ggggguggucuggagugcgcugcagccuucug

SEQ ID NO: 466910 - RNA, 32 nt, Human
gggggugguggagagcgggggcggggauucag

SEQ ID NO: 466911 - RNA, 23 nt, Human
gggggugguggaugaacaaagag

SEQ ID NO: 466912 - RNA, 32 nt, Human
gggggugguggcagauaccugccuuggccugc

SEQ ID NO: 466913 - RNA, 32 nt, Human
gggggugguggcaucuggacaaaugccaccac

SEQ ID NO: 466914 - RNA, 22 nt, Human
gggggugguggcauuggggcag

SEQ ID NO: 466915 - RNA, 21 nt, Human
ggggguggugggagaaggagg

SEQ ID NO: 466916 - RNA, 21 nt, Human
ggggguggugggcagggaugg

SEQ ID NO: 466917 - RNA, 32 nt, Human
ggggguggugggcugguggcccaggagaaguc

SEQ ID NO: 466918 - RNA, 21 nt, Human
ggggguggugggguacaggga

SEQ ID NO: 466919 - RNA, 20 nt, Human
gggggugguggugaagagag

SEQ ID NO: 466920 - RNA, 32 nt, Human
gggggugguuucaggaguuccuuguggagagg

SEQ ID NO: 466921 - RNA, 17 nt, Human
ggggguguaccugguca

SEQ ID NO: 466922 - RNA, 32 nt, Human
ggggguguaggcaguagggaaaugagugaggc

SEQ ID NO: 466923 - RNA, 18 nt, Human
ggggguguaucacaguca

SEQ ID NO: 466924 - RNA, 31 nt, Human
ggggguguaugggguagauggguggagaggg

SEQ ID NO: 466925 - RNA, 32 nt, Human
ggggguguccccucagcggaggccaagggagg

SEQ ID NO: 466926 - RNA, 32 nt, Human
gggggugucuuaacaugacgcauuucagcaau

SEQ ID NO: 466927 - RNA, 17 nt, Human
gggggugugcacaauca

SEQ ID NO: 466928 - RNA, 32 nt, Human
gggggugugcaggccagggacuggccaggcag

SEQ ID NO: 466929 - RNA, 32 nt, Human
gggggugugcugacauguuugcucuugguuga

SEQ ID NO: 466930 - RNA, 32 nt, Human
gggggugugggauggaggagggucugcagcca

SEQ ID NO: 466931 - RNA, 19 nt, Human
gggggugugggcccaggca

SEQ ID NO: 466932 - RNA, 32 nt, Human
ggggguguguuucugagcuuggcaucaaggcu

SEQ ID NO: 466933 - RNA, 32 nt, Human
ggggguguuagagcaaaaacaggcuucagaaa

SEQ ID NO: 466934 - RNA, 17 nt, Human
ggggguguucaaggcca

SEQ ID NO: 466935 - RNA, 32 nt, Human
ggggguguugggguccgcagggggagggaggg

SEQ ID NO: 466936 - RNA, 32 nt, Human
ggggguguuugcugagugagugagugaaacac

SEQ ID NO: 466937 - RNA, 32 nt, Human
ggggguuaagucaggaugggguagguccccuc

SEQ ID NO: 466938 - RNA, 32 nt, Human
ggggguuacagcuguucugaaggucugguugg

SEQ ID NO: 466939 - RNA, 32 nt, Human
ggggguuaccaaaggccuagugcuuggccucg

SEQ ID NO: 466940 - RNA, 32 nt, Human
ggggguucaaugagcagcuucaacagaaaacu

SEQ ID NO: 466941 - RNA, 32 nt, Human
ggggguucagaaccagccuggccaaaaauuac

SEQ ID NO: 466942 - RNA, 32 nt, Human
ggggguucaggaagcgggucucaggccgcugg

SEQ ID NO: 466943 - RNA, 32 nt, Human
ggggguuccaggaauccaaauccagcauggcu

SEQ ID NO: 466944 - RNA, 32 nt, Human
ggggguucccagagcccuguacccucgacccg

SEQ ID NO: 466945 - RNA, 32 nt, Human
ggggguucccagagcccuguagcccucgaccc

SEQ ID NO: 466946 - RNA, 32 nt, Human
ggggguuccggguggaggcuugcagcugcuuc

SEQ ID NO: 466947 - RNA, 32 nt, Human
ggggguucuacaacauugaaguuggacuagug

SEQ ID NO: 466948 - RNA, 32 nt, Human
ggggguucucucucggguccgcacucaacugg

SEQ ID NO: 466949 - RNA, 32 nt, Human
ggggguucuucgcucaaccucuucuucccuag

SEQ ID NO: 466950 - RNA, 32 nt, Human
ggggguuggagaagaaccauuagaaagggaaa

SEQ ID NO: 466951 - RNA, 32 nt, Human
ggggguuggagaagggugaggggcuuccccca

SEQ ID NO: 466952 - RNA, 32 nt, Human
ggggguuggccugggagccuccuccgcuuccc

SEQ ID NO: 466953 - RNA, 32 nt, Human
ggggguugggagaaagguggcggugcuuucgg

SEQ ID NO: 466954 - RNA, 32 nt, Human
ggggguugggcuguaggcagggacagucacag

SEQ ID NO: 466955 - RNA, 32 nt, Human
ggggguuggggagcaggccagauggagguggu

SEQ ID NO: 466956 - RNA, 32 nt, Human
ggggguugggggcugugucucuccaucccuua

SEQ ID NO: 466957 - RNA, 32 nt, Human
ggggguuggggugggagccuggagauagcgcu

SEQ ID NO: 466958 - RNA, 32 nt, Human
ggggguuggguaagggaauggucaagacugag

SEQ ID NO: 466959 - RNA, 29 nt, Human
ggggguugucugugugucugugaauauuu

SEQ ID NO: 466960 - RNA, 32 nt, Human
ggggguugugggagagaggcagcugggagaca

SEQ ID NO: 466961 - RNA, 32 nt, Human
ggggguugugggcuggcggggcugugggaagg

SEQ ID NO: 466962 - RNA, 32 nt, Human
ggggguuuaagcucugccccuuccccaugaac

SEQ ID NO: 466963 - RNA, 31 nt, Human
ggggguuuggcaaucucacuaaccaccauua

SEQ ID NO: 466964 - RNA, 32 nt, Human
ggggguuuuccauauugcccaggcuggucccg

SEQ ID NO: 466965 - RNA, 32 nt, Human
ggggguuuuguuguguaaauauucuauuuuau

SEQ ID NO: 466966 - RNA, 32 nt, Human
gggguaaaaccagcuuaagguucagcgagcag

SEQ ID NO: 466967 - RNA, 32 nt, Human
gggguaaaacuagaggacacuggugagcagcu

SEQ ID NO: 466968 - RNA, 32 nt, Human
gggguaaagacaccuggaucagacuccaaggg

SEQ ID NO: 466969 - RNA, 32 nt, Human
gggguaaaggaaagcaggaaggggaauuuuua

SEQ ID NO: 466970 - RNA, 32 nt, Human
gggguaaagggggccuggaguugcuugacacg

SEQ ID NO: 466971 - RNA, 21 nt, Human
gggguaacccagcaagggcca

SEQ ID NO: 466972 - RNA, 32 nt, Human
gggguaacuggaagccaugaaggaaggacuua

SEQ ID NO: 466973 - RNA, 32 nt, Human
gggguaagaaaagcuggucuggaguugcugaa

SEQ ID NO: 466974 - RNA, 32 nt, Human
gggguaagacuacuuaaccucuguguuccucu

SEQ ID NO: 466975 - RNA, 32 nt, Human
gggguaagcuaaaucauaguuucugacaauaa

SEQ ID NO: 466976 - RNA, 32 nt, Human
gggguaaggaaaugugcugaagacagagcuau

SEQ ID NO: 466977 - RNA, 32 nt, Human
gggguaaggggcaguggugugaagggaccaaa

SEQ ID NO: 466978 - RNA, 32 nt, Human
gggguaagggggaccagagaggcgggcuggug

SEQ ID NO: 466979 - RNA, 32 nt, Human
gggguaaugagcuccagccccuaagcaaccgg

SEQ ID NO: 466980 - RNA, 32 nt, Human
gggguacaaaggaaaggacagaggugugggag

SEQ ID NO: 466981 - RNA, 32 nt, Human
gggguacaacagcagccaaauucuuccccacc

SEQ ID NO: 466982 - RNA, 32 nt, Human
gggguacaccauugacuucauuuguacuuagu

SEQ ID NO: 466983 - RNA, 32 nt, Human
gggguacagagggagggcuggagaacuuagcu

SEQ ID NO: 466984 - RNA, 32 nt, Human
gggguacagauggggcaggggcacuugugaga

SEQ ID NO: 466985 - RNA, 32 nt, Human
gggguacaguagcuggcuauucacaggcauca

SEQ ID NO: 466986 - RNA, 32 nt, Human
gggguacccuggggauucaucuguuuucuuca

SEQ ID NO: 466987 - RNA, 22 nt, Human
gggguacgagagcugcuggugg

SEQ ID NO: 466988 - RNA, 32 nt, Human
gggguacuacacucaccaccugggugacggga

SEQ ID NO: 466989 - RNA, 32 nt, Human
gggguacucugccucucugcucccugggggcc

SEQ ID NO: 466990 - RNA, 32 nt, Human
gggguacuggcagaggauggcagagcuggcug

SEQ ID NO: 466991 - RNA, 17 nt, Human
gggguacuuccagguca

SEQ ID NO: 466992 - RNA, 18 nt, Human
gggguagacguuccaccu

SEQ ID NO: 466993 - RNA, 32 nt, Human
gggguagaggcuucuuagauucucccagcauc

SEQ ID NO: 466994 - RNA, 32 nt, Human
gggguagagggagccaggagcacuggguucuc

SEQ ID NO: 466995 - RNA, 32 nt, Human
gggguagaggggaauccaggaggccggggaca

SEQ ID NO: 466996 - RNA, 32 nt, Human
gggguagaggggcuggcucucaguccccgccu

SEQ ID NO: 466997 - RNA, 32 nt, Human
gggguagagugggucagcaggagggagcuggu

SEQ ID NO: 466998 - RNA, 32 nt, Human
gggguagaguucuguguguggcauuuuaggcc

SEQ ID NO: 466999 - RNA, 32 nt, Human
gggguagaugcugggggcugcggccacgguca

SEQ ID NO: 467000 - RNA, 32 nt, Human
gggguagauggguggagagggaggggauaaga

SEQ ID NO: 467001 - RNA, 32 nt, Human
gggguagcacggaagggucucccaggcggcgu

SEQ ID NO: 467002 - RNA, 32 nt, Human
gggguagcagaaaguccugggcuaggagagug

SEQ ID NO: 467003 - RNA, 22 nt, Human
gggguagcagagggaagggagg

SEQ ID NO: 467004 - RNA, 32 nt, Human
gggguagcagggacccaggcacugugaccauc

SEQ ID NO: 467005 - RNA, 32 nt, Human
gggguagcaguggaggcugggguuaaccgccg

SEQ ID NO: 467006 - RNA, 32 nt, Human
gggguagccagcuugggcuguccccuugagac

SEQ ID NO: 467007 - RNA, 32 nt, Human
gggguagccauugugcagucauggcccggggg

SEQ ID NO: 467008 - RNA, 32 nt, Human
gggguagcccugcucagugagagcagugaaag

SEQ ID NO: 467009 - RNA, 20 nt, Human
gggguagcgggggagggggg

SEQ ID NO: 467010 - RNA, 32 nt, Human
gggguagcucacucccccuccugcugcuaugc

SEQ ID NO: 467011 - RNA, 22 nt, Human
gggguagcuguauuccagguca

SEQ ID NO: 467012 - RNA, 30 nt, Human
gggguaggaagcccgagggcugcagucacc

SEQ ID NO: 467013 - RNA, 32 nt, Human
gggguaggaaugguuguuggggcagagccagu

SEQ ID NO: 467014 - RNA, 32 nt, Human
gggguaggagggacagagagacagggagaguc

SEQ ID NO: 467015 - RNA, 32 nt, Human
gggguagggaucugcauuucuucauaucaacc

SEQ ID NO: 467016 - RNA, 32 nt, Human
gggguagggcugacuagaagggccaguccugc

SEQ ID NO: 467017 - RNA, 32 nt, Human
gggguagggcuggaggaucgcuccuguggaaa

SEQ ID NO: 467018 - RNA, 32 nt, Human
gggguaggggaggggcgucuggagaggacccc

SEQ ID NO: 467019 - RNA, 32 nt, Human
gggguaggggcagagucaggggcuggccagag

SEQ ID NO: 467020 - RNA, 32 nt, Human
gggguagggugagggaggacaggccaguaggg

SEQ ID NO: 467021 - RNA, 21 nt, Human
gggguagugcgaggccgggca

SEQ ID NO: 467022 - RNA, 32 nt, Human
gggguagugggauggugggguaccagccacug

SEQ ID NO: 467023 - RNA, 32 nt, Human
gggguaguuuucuaucugucaugggcucuagc

SEQ ID NO: 467024 - RNA, 32 nt, Human
gggguauagcccauaggugguggagagaaaag

SEQ ID NO: 467025 - RNA, 32 nt, Human
gggguauccccaccaacuuucccuucaaaaua

SEQ ID NO: 467026 - RNA, 32 nt, Human
gggguaucguccucaaaacaggacagccaagu

SEQ ID NO: 467027 - RNA, 32 nt, Human
gggguaucuccaccucuccaacacaagcucaa

SEQ ID NO: 467028 - RNA, 32 nt, Human
gggguaucugacccagucuucuuuucagcugg

SEQ ID NO: 467029 - RNA, 32 nt, Human
gggguaugaaccugugucuccuuuguaucccu

SEQ ID NO: 467030 - RNA, 32 nt, Human
gggguauguugggggauuggaagcacuugaac

SEQ ID NO: 467031 - RNA, 32 nt, Human
ggggucaacuguacccagccuagagccaagaa

SEQ ID NO: 467032 - RNA, 32 nt, Human
ggggucaagacccagugcuacuugggccagcg

SEQ ID NO: 467033 - RNA, 19 nt, Human
ggggucaaggaacauuuca

SEQ ID NO: 467034 - RNA, 16 nt, Human
ggggucaagggcccuc

SEQ ID NO: 467035 - RNA, 32 nt, Human
ggggucacaauggggaaauggaagugguacau

SEQ ID NO: 467036 - RNA, 21 nt, Human
ggggucacaccuguaauccca

SEQ ID NO: 467037 - RNA, 32 nt, Human
ggggucacaccuguaaucccagcacuuuggga

SEQ ID NO: 467038 - RNA, 32 nt, Human
ggggucacagccgcuucuucagcauggaccaa

SEQ ID NO: 467039 - RNA, 32 nt, Human
ggggucacauaaccacacuguugacuaccuca

SEQ ID NO: 467040 - RNA, 23 nt, Human
ggggucacgcggccccucgugcu

SEQ ID NO: 467041 - RNA, 32 nt, Human
ggggucacuaaggagagagggucaggagccag

SEQ ID NO: 467042 - RNA, 32 nt, Human
ggggucacuccagcccgggccucccagaacac

SEQ ID NO: 467043 - RNA, 32 nt, Human
ggggucacugcugaggccgugaggggaaucug

SEQ ID NO: 467044 - RNA, 32 nt, Human
ggggucacuguaccauggcaaaggcugaggug

SEQ ID NO: 467045 - RNA, 32 nt, Human
ggggucacuucuacuucacacacacaggauuc

SEQ ID NO: 467046 - RNA, 32 nt, Human
ggggucagaaccccugagcuucagcccccaca

SEQ ID NO: 467047 - RNA, 32 nt, Human
ggggucagacacaggcccugccccugcccuca

SEQ ID NO: 467048 - RNA, 32 nt, Human
ggggucagacuggccaucagcaccugagcgug

SEQ ID NO: 467049 - RNA, 32 nt, Human
ggggucagagaaggggaagcaacggcucucac

SEQ ID NO: 467050 - RNA, 32 nt, Human
ggggucagagggcaaagggcgacgccccgucg

SEQ ID NO: 467051 - RNA, 32 nt, Human
ggggucagcagcaggagaagcguguugaacac

SEQ ID NO: 467052 - RNA, 32 nt, Human
ggggucagccuggggcaaagcaggacuggggg

SEQ ID NO: 467053 - RNA, 24 nt, Human
ggggucaggaagaggcgaacagcu

SEQ ID NO: 467054 - RNA, 19 nt, Human
ggggucaggaggcacugcu

SEQ ID NO: 467055 - RNA, 32 nt, Human
ggggucaggagguggcucgggugugggcugga

SEQ ID NO: 467056 - RNA, 23 nt, Human
ggggucaggaguucaagaccagc

SEQ ID NO: 467057 - RNA, 23 nt, Human
ggggucaggaguucgagaccagc

SEQ ID NO: 467058 - RNA, 32 nt, Human
ggggucaggaguuugagaccagccuggccaac

SEQ ID NO: 467059 - RNA, 32 nt, Human
ggggucaggauuucgagaccagccuggccaac

SEQ ID NO: 467060 - RNA, 24 nt, Human
ggggucaggcagacuuggauucua

SEQ ID NO: 467061 - RNA, 20 nt, Human
ggggucaggcagaggccagc

SEQ ID NO: 467062 - RNA, 32 nt, Human
ggggucaggcauucgaguuuuugucuuucuuc

SEQ ID NO: 467063 - RNA, 21 nt, Human
ggggucaggccugccugcgga

SEQ ID NO: 467064 - RNA, 32 nt, Human
ggggucagggacgcagcuccacccucaccacu

SEQ ID NO: 467065 - RNA, 26 nt, Human
ggggucaggggagacgaggccaagcu

SEQ ID NO: 467066 - RNA, 26 nt, Human
ggggucaggguggcauuagcccagcu

SEQ ID NO: 467067 - RNA, 21 nt, Human
ggggucagguggacucuggga

SEQ ID NO: 467068 - RNA, 21 nt, Human
ggggucaggugucgaaccagc

SEQ ID NO: 467069 - RNA, 23 nt, Human
ggggucagguuauuuuuguaggg

SEQ ID NO: 467070 - RNA, 21 nt, Human
ggggucagguucccugccggg

SEQ ID NO: 467071 - RNA, 31 nt, Human
ggggucagguugugggccaugccaggccugu

SEQ ID NO: 467072 - RNA, 31 nt, Human
ggggucagugagagaaaugggaaugguagcu

SEQ ID NO: 467073 - RNA, 23 nt, Human
ggggucagugcagcagaggacag

SEQ ID NO: 467074 - RNA, 21 nt, Human
ggggucagugguucucucggg

SEQ ID NO: 467075 - RNA, 32 nt, Human
ggggucaguuauggaacaggacuugcccauua

SEQ ID NO: 467076 - RNA, 32 nt, Human
ggggucaguugggugcccaguuggccuuggaa

SEQ ID NO: 467077 - RNA, 32 nt, Human
ggggucauagauguuuccuugccuuguugaug

SEQ ID NO: 467078 - RNA, 32 nt, Human
ggggucaucaaauuauuaaucugaaaauagca

SEQ ID NO: 467079 - RNA, 32 nt, Human
ggggucaucaaauuguuaaucugaaaauagca

SEQ ID NO: 467080 - RNA, 32 nt, Human
ggggucauggcgguuguggcagcuggggaggu

SEQ ID NO: 467081 - RNA, 32 nt, Human
ggggucaugucuuccccaagguguggggagcu

SEQ ID NO: 467082 - RNA, 20 nt, Human
ggggucauuauggcauuuua

SEQ ID NO: 467083 - RNA, 32 nt, Human
gggguccacaggccccuccaccuuccagcuaa

SEQ ID NO: 467084 - RNA, 32 nt, Human
gggguccaccuucugcuccagccagaggaggg

SEQ ID NO: 467085 - RNA, 31 nt, Human
gggguccagagaggcaggcuggggaggcaag

SEQ ID NO: 467086 - RNA, 32 nt, Human
gggguccagagaggcaggcuggggaggcaagg

SEQ ID NO: 467087 - RNA, 19 nt, Human
gggguccagcacaggcugu

SEQ ID NO: 467088 - RNA, 32 nt, Human
gggguccagcaggguggcuggugacaggccug

SEQ ID NO: 467089 - RNA, 32 nt, Human
gggguccagccuugccuguuuccgaagccccc

SEQ ID NO: 467090 - RNA, 32 nt, Human
gggguccaggagacccagaaugaaggugucag

SEQ ID NO: 467091 - RNA, 32 nt, Human
gggguccaugggaccccucuccccagugccca

SEQ ID NO: 467092 - RNA, 17 nt, Human
ggggucccagggcccuu

SEQ ID NO: 467093 - RNA, 32 nt, Human
gggguccccgcuggaauccuguguuccucgcc

SEQ ID NO: 467094 - RNA, 32 nt, Human
gggguccccuccacucccaucugcuucccuuu

SEQ ID NO: 467095 - RNA, 17 nt, Human
gggguccccuccaggag

SEQ ID NO: 467096 - RNA, 32 nt, Human
gggguccccugccuccugccugucgcugccgu

SEQ ID NO: 467097 - RNA, 32 nt, Human
gggguccccugucuccccuuccagcccugacc

SEQ ID NO: 467098 - RNA, 32 nt, Human
gggguccccuuauccucccuugcuggcugugu

SEQ ID NO: 467099 - RNA, 32 nt, Human
ggggucccgcuuuccucagccuggaugugcca

SEQ ID NO: 467100 - RNA, 32 nt, Human
ggggucccggcaccuggcgugaguuucaugua

SEQ ID NO: 467101 - RNA, 21 nt, Human
ggggucccgggaggcgggugc

SEQ ID NO: 467102 - RNA, 32 nt, Human
ggggucccuagcagcccucccugcugcuggug

SEQ ID NO: 467103 - RNA, 32 nt, Human
ggggucccuauguguacccccuugucuccagc

SEQ ID NO: 467104 - RNA, 32 nt, Human
ggggucccuccagggaggagcguggagcggca

SEQ ID NO: 467105 - RNA, 32 nt, Human
ggggucccuccccucuccuguaccccuuggac

SEQ ID NO: 467106 - RNA, 32 nt, Human
ggggucccuccuuccuccuuccaagucugugc

SEQ ID NO: 467107 - RNA, 32 nt, Human
ggggucccugcacgagcccucugggaggcaug

SEQ ID NO: 467108 - RNA, 32 nt, Human
ggggucccugcagggcugaagccuaagcuacu

SEQ ID NO: 467109 - RNA, 32 nt, Human
gggguccggaggcagagacggccaugaacagc

SEQ ID NO: 467110 - RNA, 21 nt, Human
gggguccgggcccggguucca

SEQ ID NO: 467111 - RNA, 32 nt, Human
gggguccgguggauaccaggaggcagcagugc

SEQ ID NO: 467112 - RNA, 28 nt, Human
gggguccucaaggcugccuccuuccuuu

SEQ ID NO: 467113 - RNA, 32 nt, Human
gggguccucacugcagcuggccucuggcagcg

SEQ ID NO: 467114 - RNA, 32 nt, Human
gggguccucagcugccucgggacuggcuccgc

SEQ ID NO: 467115 - RNA, 32 nt, Human
gggguccuccaggaccucagcugcacccauuu

SEQ ID NO: 467116 - RNA, 27 nt, Human
gggguccuccaggaguucuggacagcu

SEQ ID NO: 467117 - RNA, 32 nt, Human
gggguccucgaggcggagcgagcugugguugg

SEQ ID NO: 467118 - RNA, 18 nt, Human
gggguccucucguccucc

SEQ ID NO: 467119 - RNA, 22 nt, Human
gggguccugaaaggcggggccg

SEQ ID NO: 467120 - RNA, 32 nt, Human
gggguccuggcacagacccaggcccaggggau

SEQ ID NO: 467121 - RNA, 32 nt, Human
gggguccuguccuccacuccaggucauuccuu

SEQ ID NO: 467122 - RNA, 32 nt, Human
gggguccuuguccugcucaggcaucccugccc

SEQ ID NO: 467123 - RNA, 32 nt, Human
gggguccuugugcugcucaggcaucccugccc

SEQ ID NO: 467124 - RNA, 32 nt, Human
ggggucgaggugggcagaucaccugaggucag

SEQ ID NO: 467125 - RNA, 32 nt, Human
ggggucgcacgcacgcccgccucggcggcugg

SEQ ID NO: 467126 - RNA, 32 nt, Human
ggggucgccacugcacccagccugugucuucc

SEQ ID NO: 467127 - RNA, 32 nt, Human
ggggucgccucccaggugucccagcaagcccg

SEQ ID NO: 467128 - RNA, 32 nt, Human
ggggucgccuugaccucugccucagccaguag

SEQ ID NO: 467129 - RNA, 24 nt, Human
ggggucgcguugcauuguguucau

SEQ ID NO: 467130 - RNA, 32 nt, Human
ggggucgcuccugcugugucuuccgcuccagc

SEQ ID NO: 467131 - RNA, 32 nt, Human
ggggucggaguccgagucgcugugcugggaga

SEQ ID NO: 467132 - RNA, 19 nt, Human
ggggucggcgggggcgcgg

SEQ ID NO: 467133 - RNA, 32 nt, Human
ggggucggggcuggggaaggggagccccaggg

SEQ ID NO: 467134 - RNA, 32 nt, Human
ggggucgggggaggagaaagggagacagcaga

SEQ ID NO: 467135 - RNA, 32 nt, Human
ggggucggggucgcggccagggccaagccgca

SEQ ID NO: 467136 - RNA, 19 nt, Human
ggggucgggucaucugcgg

SEQ ID NO: 467137 - RNA, 24 nt, Human
ggggucgggucuguccuuuguugg

SEQ ID NO: 467138 - RNA, 32 nt, Human
ggggucgggugaggcagaggucagaaacagaa

SEQ ID NO: 467139 - RNA, 32 nt, Human
ggggucguaagccugguuugcuucuauuacuu

SEQ ID NO: 467140 - RNA, 32 nt, Human
ggggucgucaaaccacagggguguuuagaaau

SEQ ID NO: 467141 - RNA, 32 nt, Human
ggggucuaaucuccuagaagguaggggcuuuu

SEQ ID NO: 467142 - RNA, 32 nt, Human
ggggucuaggcagcaguggauggugcagggga

SEQ ID NO: 467143 - RNA, 32 nt, Human
ggggucucaccauguuacccaggcuggucuca

SEQ ID NO: 467144 - RNA, 32 nt, Human
ggggucucaccauguugcccaggcuggucuca

SEQ ID NO: 467145 - RNA, 32 nt, Human
ggggucucaccugugaacgucucaccugugcc

SEQ ID NO: 467146 - RNA, 32 nt, Human
ggggucucagggaccuguguccuuccgccucc

SEQ ID NO: 467147 - RNA, 32 nt, Human
ggggucuccagaguugcugaaacccuuacucc

SEQ ID NO: 467148 - RNA, 32 nt, Human
ggggucuccagccagagacguugggugagaca

SEQ ID NO: 467149 - RNA, 32 nt, Human
ggggucuccagccuggcugcugcugggcccug

SEQ ID NO: 467150 - RNA, 32 nt, Human
ggggucuccauccuggaccaggaccuggacua

SEQ ID NO: 467151 - RNA, 32 nt, Human
ggggucucccuaugcugcccaggcuggucucg

SEQ ID NO: 467152 - RNA, 32 nt, Human
ggggucucccuauguugcccaggcuggccuca

SEQ ID NO: 467153 - RNA, 32 nt, Human
ggggucucccucugucacccaggcuggagugc

SEQ ID NO: 467154 - RNA, 32 nt, Human
ggggucucccuguguuacccaggcuggucuca

SEQ ID NO: 467155 - RNA, 32 nt, Human
ggggucuccugccucuccuggugucgccggug

SEQ ID NO: 467156 - RNA, 32 nt, Human
ggggucucgcugaacuccuggccuccagugau

SEQ ID NO: 467157 - RNA, 32 nt, Human
ggggucucguuugcccagggagggcuuggcuc

SEQ ID NO: 467158 - RNA, 32 nt, Human
ggggucucuacgccagcucaucagugccuccu

SEQ ID NO: 467159 - RNA, 32 nt, Human
ggggucucuauauguuucccaggcuggucuug

SEQ ID NO: 467160 - RNA, 32 nt, Human
ggggucucuccauguuggucaggcuggucuca

SEQ ID NO: 467161 - RNA, 32 nt, Human
ggggucucugcuggguguuagauuuguggagu

SEQ ID NO: 467162 - RNA, 32 nt, Human
ggggucucuggaggcagacagggugggcuggg

SEQ ID NO: 467163 - RNA, 32 nt, Human
ggggucucuggguggagagcugacccaggaag

SEQ ID NO: 467164 - RNA, 32 nt, Human
ggggucucuguugggaaugccugcugagacgg

SEQ ID NO: 467165 - RNA, 32 nt, Human
ggggucugaccccucccuccucccucuggagg

SEQ ID NO: 467166 - RNA, 32 nt, Human
ggggucugagucuauguucaaagacugugaac

SEQ ID NO: 467167 - RNA, 32 nt, Human
ggggucugauuugcugagacaccagcuucacc

SEQ ID NO: 467168 - RNA, 32 nt, Human
ggggucugcccagagaagccuggacccagggg

SEQ ID NO: 467169 - RNA, 31 nt, Human
ggggucugccucuuucacgcgccugucuccc

SEQ ID NO: 467170 - RNA, 32 nt, Human
ggggucugcuccuguggcggugcaguggcaaa

SEQ ID NO: 467171 - RNA, 32 nt, Human
ggggucugcuugagggcacuaaccucaacaga

SEQ ID NO: 467172 - RNA, 32 nt, Human
ggggucuggaggcauaagucuagaugcccaga

SEQ ID NO: 467173 - RNA, 32 nt, Human
ggggucuggcagcguggggagagggaccaacc

SEQ ID NO: 467174 - RNA, 32 nt, Human
gguaaccugcucacuccagaacuccagcuccc

SEQ ID NO: 467175 - RNA, 32 nt, Human
gguaaccuggaacuuccaccugggcucugcgc

SEQ ID NO: 467176 - RNA, 20 nt, Human
gguaacgggugcaggcugga

SEQ ID NO: 467177 - RNA, 19 nt, Human
gguaacuaggauccuaggg

SEQ ID NO: 467178 - RNA, 32 nt, Human
gguaacucaagaggacagaggcuggugaggag

SEQ ID NO: 467179 - RNA, 26 nt, Human
gguaacucacucugcagcccuugaac

SEQ ID NO: 467180 - RNA, 32 nt, Human
gguaacucauuuucucauuauuuucuagcugg

SEQ ID NO: 467181 - RNA, 32 nt, Human
gguaacucccacagaagugaccuuuuccuucg

SEQ ID NO: 467182 - RNA, 32 nt, Human
gguaacucucuuccuucuuuuucucccuaccc

SEQ ID NO: 467183 - RNA, 32 nt, Human
gguaacugaaguaaggagagcagugaauguca

SEQ ID NO: 467184 - RNA, 32 nt, Human
gguaacugagguaaaauguuccagcucagaag

SEQ ID NO: 467185 - RNA, 32 nt, Human
gguaacugcccaugcccgaggauuuuccagcc

SEQ ID NO: 467186 - RNA, 32 nt, Human
gguaacuggaaccucuccugagggggaauccu

SEQ ID NO: 467187 - RNA, 32 nt, Human
gguaacugggacuugcccaacuuuaaaaacau

SEQ ID NO: 467188 - RNA, 32 nt, Human
gguaacuguggaaugagcucuguuagggacag

SEQ ID NO: 467189 - RNA, 32 nt, Human
gguaacuuauuuuccagcacaugaagccacca

SEQ ID NO: 467190 - RNA, 32 nt, Human
gguaacuucucccuucuccugaccuacuuccu

SEQ ID NO: 467191 - RNA, 32 nt, Human
gguaacuucuuggcuuucuuuuguaccacaac

SEQ ID NO: 467192 - RNA, 32 nt, Human
gguaacuugcaggaauauucuauuggaaaaga

SEQ ID NO: 467193 - RNA, 32 nt, Human
gguaagaaaagggauggagagagaugggauga

SEQ ID NO: 467194 - RNA, 32 nt, Human
gguaagaaaguguggaaaguauaaaauaaauu

SEQ ID NO: 467195 - RNA, 32 nt, Human
gguaagaauguucagggggcugcccaggaggg

SEQ ID NO: 467196 - RNA, 31 nt, Human
gguaagacaccaaccuuuacauucuucccug

SEQ ID NO: 467197 - RNA, 32 nt, Human
gguaagagaaaugcuagauucuguacuucuau

SEQ ID NO: 467198 - RNA, 32 nt, Human
gguaagaggaagggaaaugcagccucaguaag

SEQ ID NO: 467199 - RNA, 32 nt, Human
gguaagagggcccauauucauucuuugccaug

SEQ ID NO: 467200 - RNA, 32 nt, Human
gguaagaggggugcuggaggacauggacagcg

SEQ ID NO: 467201 - RNA, 32 nt, Human
gguaagauugccacgugccugcugguacugug

SEQ ID NO: 467202 - RNA, 32 nt, Human
gguaagauuggaaacacaugaggcagagggaa

SEQ ID NO: 467203 - RNA, 32 nt, Human
gguaagccgagaucaccuccagccuggacacu

SEQ ID NO: 467204 - RNA, 32 nt, Human
gguaagcuccauccuuucucauggccucagcc

SEQ ID NO: 467205 - RNA, 32 nt, Human
gguaagcugcagcucugcucaacugcgucuuc

SEQ ID NO: 467206 - RNA, 32 nt, Human
gguaagcuuugcucaccucccucucucuugcu

SEQ ID NO: 467207 - RNA, 32 nt, Human
gguaaggaagagagagugggaggcagagugug

SEQ ID NO: 467208 - RNA, 30 nt, Human
gguaaggacucaagagaggugaaucauggg

SEQ ID NO: 467209 - RNA, 32 nt, Human
gguaaggagacugaauaucucaaucaguauuu

SEQ ID NO: 467210 - RNA, 32 nt, Human
gguaaggauuccaggaaugaagcugccauuuc

SEQ ID NO: 467211 - RNA, 32 nt, Human
gguaaggcccggugccuggaagaccucccagc

SEQ ID NO: 467212 - RNA, 22 nt, Human
gguaaggcgggcaccccgcgag

SEQ ID NO: 467213 - RNA, 22 nt, Human
gguaagggacgagucuucugga

SEQ ID NO: 467214 - RNA, 32 nt, Human
gguaagggcagccugcagcaccaugccaaggg

SEQ ID NO: 467215 - RNA, 32 nt, Human
gguaagggccaaaucacucuccuccauagcag

SEQ ID NO: 467216 - RNA, 32 nt, Human
gguaagggugaggccugcuggguggggagugg

SEQ ID NO: 467217 - RNA, 32 nt, Human
gguaagguauccacccucgaugcaauccaccu

SEQ ID NO: 467218 - RNA, 32 nt, Human
gguaaguagaggcacaugcagacucuggccac

SEQ ID NO: 467219 - RNA, 32 nt, Human
gguaaguauuaucuucagauuuccagagcucu

SEQ ID NO: 467220 - RNA, 32 nt, Human
gguaaguuuuagucaaaagaauucuuucuuga

SEQ ID NO: 467221 - RNA, 32 nt, Human
gguaauaaaauauauuaaaauaguuuaauuuu

SEQ ID NO: 467222 - RNA, 32 nt, Human
gguaauaaacacucuuuucaguuggaaauaaa

SEQ ID NO: 467223 - RNA, 32 nt, Human
gguaauacuacugauauuugcuuuucuauaua

SEQ ID NO: 467224 - RNA, 32 nt, Human
gguaauagcuucuauaaaaucugccauaguug

SEQ ID NO: 467225 - RNA, 21 nt, Human
gguaauaguacacccgaucau

SEQ ID NO: 467226 - RNA, 32 nt, Human
gguaaucaacuacuggcuccuccagcagcuca

SEQ ID NO: 467227 - RNA, 32 nt, Human
gguaaucaaucugcaucccauuuuggaugaga

SEQ ID NO: 467228 - RNA, 32 nt, Human
gguaaucacauacuuguucacaucuacaccgu

SEQ ID NO: 467229 - RNA, 32 nt, Human
gguaaucaucugcauuuggcuacugcaaagcu

SEQ ID NO: 467230 - RNA, 32 nt, Human
gguaauccaagggccugugacucuuuugguaa

SEQ ID NO: 467231 - RNA, 32 nt, Human
gguaaucgugcagaacagcaugugggcucugg

SEQ ID NO: 467232 - RNA, 32 nt, Human
gguaaucuaccaaucuaccaucgagcuuaggg

SEQ ID NO: 467233 - RNA, 32 nt, Human
gguaaucuggucaguaagauugagacuuaguu

SEQ ID NO: 467234 - RNA, 32 nt, Human
gguaaugagcuuguuucuugucuauuuugucu

SEQ ID NO: 467235 - RNA, 32 nt, Human
gguaaugaggugcagagguguggggaagaccu

SEQ ID NO: 467236 - RNA, 32 nt, Human
gguaaugauaaauauuucccuuaaauaauuga

SEQ ID NO: 467237 - RNA, 32 nt, Human
gguaaugaucaaagaugccugaaguguugggg

SEQ ID NO: 467238 - RNA, 32 nt, Human
gguaaugauucaaggaaacauaaucacacacg

SEQ ID NO: 467239 - RNA, 32 nt, Human
gguaaugccuaauguggucugccugugaaucu

SEQ ID NO: 467240 - RNA, 32 nt, Human
gguaaugcucuguggcuguccucuagcuagug

SEQ ID NO: 467241 - RNA, 32 nt, Human
gguaaugcuuugguauuuucuuggggaagacc

SEQ ID NO: 467242 - RNA, 29 nt, Human
gguaauggaguuuccuaaagugugcucug

SEQ ID NO: 467243 - RNA, 32 nt, Human
gguaauggauaugaaagagaaaaugcuuucuc

SEQ ID NO: 467244 - RNA, 32 nt, Human
gguaauguaaaaucauuucauuuaucauucau

SEQ ID NO: 467245 - RNA, 32 nt, Human
gguaaugucuuucccuaauacaggguugcgcu

SEQ ID NO: 467246 - RNA, 32 nt, Human
gguaaugugaggacgaagcgggcacggagcca

SEQ ID NO: 467247 - RNA, 31 nt, Human
gguaauuaguuucagacccugcacugaggcc

SEQ ID NO: 467248 - RNA, 32 nt, Human
gguaauucaguauuuauuauguuauuagagaa

SEQ ID NO: 467249 - RNA, 32 nt, Human
gguaauucaguuauuugcacaaguucagugag

SEQ ID NO: 467250 - RNA, 32 nt, Human
gguaauuccuccagagcuguuugcuggcuuca

SEQ ID NO: 467251 - RNA, 32 nt, Human
gguaauucuaacccacacauugucauucccaa

SEQ ID NO: 467252 - RNA, 32 nt, Human
gguaauucuucaccucuuuucucagcucccug

SEQ ID NO: 467253 - RNA, 32 nt, Human
gguaauuggggaggggagagaggugggggcaa

SEQ ID NO: 467254 - RNA, 32 nt, Human
gguaauuucauggcuguuacugcccagucaua

SEQ ID NO: 467255 - RNA, 32 nt, Human
gguaauuucccugaugucuguauaaaaucaag

SEQ ID NO: 467256 - RNA, 32 nt, Human
gguacaaaauuccaucucagccacuuucgagg

SEQ ID NO: 467257 - RNA, 32 nt, Human
gguacaaagcccagaggaagugguagagcagc

SEQ ID NO: 467258 - RNA, 32 nt, Human
gguacaacacaaaucuucaucaacagaagaau

SEQ ID NO: 467259 - RNA, 32 nt, Human
gguacaacaggguaggaccauccaggcagaac

SEQ ID NO: 467260 - RNA, 32 nt, Human
gguacaacuuuaggccacaggaaagguuauuu

SEQ ID NO: 467261 - RNA, 32 nt, Human
gguacaagauguggagguggaagacagugaua

SEQ ID NO: 467262 - RNA, 32 nt, Human
gguacaaggaagcacaacgccccaauccgcuu

SEQ ID NO: 467263 - RNA, 24 nt, Human
gguacaagugauucuccugccuca

SEQ ID NO: 467264 - RNA, 32 nt, Human
gguacaagugcagcaacaggaagaugucuuuu

SEQ ID NO: 467265 - RNA, 32 nt, Human
gguacaaguggcaaccugcuuccauggccgug

SEQ ID NO: 467266 - RNA, 32 nt, Human
gguacaauuccuuuauuccaaggccugcuaga

SEQ ID NO: 467267 - RNA, 32 nt, Human
gguacacacaaaguucuccugucucaccaucu

SEQ ID NO: 467268 - RNA, 32 nt, Human
gguacacacagcucaggagacacugcuuguuc

SEQ ID NO: 467269 - RNA, 24 nt, Human
gguacacaccagacauugaccaua

SEQ ID NO: 467270 - RNA, 24 nt, Human
gguacacaccagauaucgaccaua

SEQ ID NO: 467271 - RNA, 21 nt, Human
gguacacauacacagcuuccu

SEQ ID NO: 467272 - RNA, 32 nt, Human
gguacacauccucagaaugcaggaagugccug

SEQ ID NO: 467273 - RNA, 32 nt, Human
gguacacauggggcugggagggcaaagauggg

SEQ ID NO: 467274 - RNA, 32 nt, Human
gguacaccacuacacuccagccugggcaacag

SEQ ID NO: 467275 - RNA, 32 nt, Human
gguacaccauugacuucauuuguacuuaguua

SEQ ID NO: 467276 - RNA, 32 nt, Human
gguacaccccuaacagagccagugccaacaaa

SEQ ID NO: 467277 - RNA, 32 nt, Human
gguacaccuacaggcuggaguguaaaauggac

SEQ ID NO: 467278 - RNA, 32 nt, Human
gguacacgccuguaaucccagcuacucaggag

SEQ ID NO: 467279 - RNA, 32 nt, Human
gguacacgcuuucuccccagacggcacccacu

SEQ ID NO: 467280 - RNA, 32 nt, Human
gguacacgggcccagaggacuggggugacuca

SEQ ID NO: 467281 - RNA, 32 nt, Human
gguacacuagcacaccucugguuauacaugca

SEQ ID NO: 467282 - RNA, 32 nt, Human
gguacagaaacagauaccuagacuaugcaaca

SEQ ID NO: 467283 - RNA, 31 nt, Human
gguacagaaagaagagaaaagacugaacuga

SEQ ID NO: 467284 - RNA, 23 nt, Human
gguacagaaagccauuugaguga

SEQ ID NO: 467285 - RNA, 32 nt, Human
gguacagaaggugaguuaaagcugguggaaaa

SEQ ID NO: 467286 - RNA, 32 nt, Human
gguacagagggagggcuggagaacuuagcugg

SEQ ID NO: 467287 - RNA, 32 nt, Human
gguacagaugggcauaggugcagugagugcag

SEQ ID NO: 467288 - RNA, 21 nt, Human
gguacagauguuccugccuua

SEQ ID NO: 467289 - RNA, 20 nt, Human
gguacagauugccuacuuga

SEQ ID NO: 467290 - RNA, 32 nt, Human
gguacagcagucaggggucaggugucaggccc

SEQ ID NO: 467291 - RNA, 32 nt, Human
gguacagcuugaaaagcacuuuuuacuacaua

SEQ ID NO: 467292 - RNA, 32 nt, Human
gguacaggaaggcaaaguugacuggggcccac

SEQ ID NO: 467293 - RNA, 32 nt, Human
gguacaggaguccacaggaggccagguuuugg

SEQ ID NO: 467294 - RNA, 32 nt, Human
gguacaggcaccugccaccacacccagcuaau

SEQ ID NO: 467295 - RNA, 32 nt, Human
gguacaggugggcauaggugcagugagugcag

SEQ ID NO: 467296 - RNA, 32 nt, Human
gguacagguggguucccucaucuggaguuccc

SEQ ID NO: 467297 - RNA, 32 nt, Human
gguacagguuccccauucuagcacugaguauu

SEQ ID NO: 467298 - RNA, 23 nt, Human
gguacaguaagucuuugaccaca

SEQ ID NO: 467299 - RNA, 32 nt, Human
gguacagucucagcucacagcaaccacucucu

SEQ ID NO: 467300 - RNA, 32 nt, Human
gguacagugagaaguucucccucccagggcca

SEQ ID NO: 467301 - RNA, 32 nt, Human
gguacagugaugggaauuuggaagcaccccug

SEQ ID NO: 467302 - RNA, 22 nt, Human
gguacaguggcucaugccugua

SEQ ID NO: 467303 - RNA, 22 nt, Human
gguacagugguucaugccugua

SEQ ID NO: 467304 - RNA, 32 nt, Human
gguacagugugcacugcuugggugaugagugc

SEQ ID NO: 467305 - RNA, 32 nt, Human
gguacaguguucagcauggggguggggugguc

SEQ ID NO: 467306 - RNA, 32 nt, Human
gguacaguuaaguuuuuggugccucggaggua

SEQ ID NO: 467307 - RNA, 20 nt, Human
gguacaugccuauaguccca

SEQ ID NO: 467308 - RNA, 20 nt, Human
gguacaugccuguaauccca

SEQ ID NO: 467309 - RNA, 32 nt, Human
gguacaugccuguaaucccagcuacacuggag

SEQ ID NO: 467310 - RNA, 32 nt, Human
gguacaugccuguaaucccagcuacucaggag

SEQ ID NO: 467311 - RNA, 32 nt, Human
gguacaugccuguaaucccagcuacuugggag

SEQ ID NO: 467312 - RNA, 32 nt, Human
gguacaugccuguagucccagauacucgggag

SEQ ID NO: 467313 - RNA, 32 nt, Human
gguacauguuuaccuauguaacaaaccugcac

SEQ ID NO: 467314 - RNA, 32 nt, Human
gguacauuuauugcuuuaaucugcacucauug

SEQ ID NO: 467315 - RNA, 32 nt, Human
gguacauuuuaaaauccugauuuuggagacuu

SEQ ID NO: 467316 - RNA, 32 nt, Human
gguaccaaaacaggaagccucacuaggaauga

SEQ ID NO: 467317 - RNA, 32 nt, Human
gguaccaagagacuccuugagagaccaggcaa

SEQ ID NO: 467318 - RNA, 20 nt, Human
gguaccaaggacacaggcac

SEQ ID NO: 467319 - RNA, 32 nt, Human
gguaccacaccagggccucagccuggccccuc

SEQ ID NO: 467320 - RNA, 23 nt, Human
gguaccacagauggcugaucaca

SEQ ID NO: 467321 - RNA, 32 nt, Human
gguaccacaggaagccgccuagugcagagagg

SEQ ID NO: 467322 - RNA, 32 nt, Human
gguaccacccccagggcaggauggggacagga

SEQ ID NO: 467323 - RNA, 32 nt, Human
gguaccacugcacuccagccugggugacagag

SEQ ID NO: 467324 - RNA, 32 nt, Human
gguaccagccauacugaaugcuuacucugagc

SEQ ID NO: 467325 - RNA, 32 nt, Human
gguaccagccugagacuggagccagguuccuc

SEQ ID NO: 467326 - RNA, 21 nt, Human
gguaccagcguccuggcccac

SEQ ID NO: 467327 - RNA, 32 nt, Human
gguaccagcugggauguuggcagcagccgcuc

SEQ ID NO: 467328 - RNA, 32 nt, Human
gguaccaucaaaacggaaggcgagcaugaccc

SEQ ID NO: 467329 - RNA, 32 nt, Human
gguaccaucuuauuuuccccuuauacagauaa

SEQ ID NO: 467330 - RNA, 32 nt, Human
gguaccaucuuguauacacauauauacccaca

SEQ ID NO: 467331 - RNA, 32 nt, Human
gguaccaugccaucaguugcuggugggcccag

SEQ ID NO: 467332 - RNA, 26 nt, Human
gguaccauggugucugucauucaggg

SEQ ID NO: 467333 - RNA, 32 nt, Human
gguacccacacuugcccuuucucccucucucc

SEQ ID NO: 467334 - RNA, 32 nt, Human
gguacccaggcagagucaggagagguggucuu

SEQ ID NO: 467335 - RNA, 19 nt, Human
gguacccaggcccacucca

SEQ ID NO: 467336 - RNA, 32 nt, Human
gguacccaugagcagaggguagugggagagug

SEQ ID NO: 467337 - RNA, 32 nt, Human
gguaccccaagucccugcggccuccagcagug

SEQ ID NO: 467338 - RNA, 17 nt, Human
gguacccccagcacuuu

SEQ ID NO: 467339 - RNA, 32 nt, Human
gguacccccaggcuggggaaaaugacagcgcu

SEQ ID NO: 467340 - RNA, 32 nt, Human
gguaccccggccccucuggcccuucccucaag

SEQ ID NO: 467341 - RNA, 32 nt, Human
gguaccccucuggcccucagagcaccaauauc

SEQ ID NO: 467342 - RNA, 19 nt, Human
gguaccccuggcgcagcga

SEQ ID NO: 467343 - RNA, 32 nt, Human
gguaccccuucauguggcuguuguucaucugu

SEQ ID NO: 467344 - RNA, 32 nt, Human
gguacccucgagcacaccagacuugcagaaaa

SEQ ID NO: 467345 - RNA, 32 nt, Human
gguacccugcagcugucuccucagccacccug

SEQ ID NO: 467346 - RNA, 32 nt, Human
gguacccuguggcauggagaagccucagggaa

SEQ ID NO: 467347 - RNA, 32 nt, Human
gguacccuucccugucugcucucccaugccau

SEQ ID NO: 467348 - RNA, 32 nt, Human
gguaccgccagccuccgguaccacaguacccg

SEQ ID NO: 467349 - RNA, 32 nt, Human
gguaccgccugcugcccccgccuggcgucagu

SEQ ID NO: 467350 - RNA, 32 nt, Human
gguaccgcgccgguggcacuaggaccacuccu

SEQ ID NO: 467351 - RNA, 32 nt, Human
gguaccggaccuguacaugagcucagagcuac

SEQ ID NO: 467352 - RNA, 24 nt, Human
gguaccggcaggccgcggcgggag

SEQ ID NO: 467353 - RNA, 22 nt, Human
gguaccggcgaaacgggaucac

SEQ ID NO: 467354 - RNA, 32 nt, Human
gguaccggcgccggcgcagcugugacugucgc

SEQ ID NO: 467355 - RNA, 32 nt, Human
gguaccggugcgcccagggcagccaggagccc

SEQ ID NO: 467356 - RNA, 32 nt, Human
gguaccuaauuagacaguucuccaaacacaga

SEQ ID NO: 467357 - RNA, 32 nt, Human
gguaccuagagaccagcucccuucucuggggu

SEQ ID NO: 467358 - RNA, 31 nt, Human
gguaccuaggucuucuuuaauuucucuuggu

SEQ ID NO: 467359 - RNA, 32 nt, Human
gguaccuauaaucccagcuacuugggaggcug

SEQ ID NO: 467360 - RNA, 32 nt, Human
gguaccuaucaguuuguaucccuccccuccuu

SEQ ID NO: 467361 - RNA, 32 nt, Human
gguaccucauuuuggggagaaccuuaaaccca

SEQ ID NO: 467362 - RNA, 32 nt, Human
gguaccucccucucccucuccuggggcauuug

SEQ ID NO: 467363 - RNA, 32 nt, Human
gguaccucugcacugcagccugggcaacagaa

SEQ ID NO: 467364 - RNA, 32 nt, Human
gguaccucugcuucuugcuuugcccaccucca

SEQ ID NO: 467365 - RNA, 32 nt, Human
gguaccugcauccuuguuuuuguuuaguggau

SEQ ID NO: 467366 - RNA, 32 nt, Human
gguaccuggauggagaccugagcuggagaagg

SEQ ID NO: 467367 - RNA, 32 nt, Human
gguaccuguaaucccagcuacuagggaggcug

SEQ ID NO: 467368 - RNA, 32 nt, Human
gguaccuguaaucccagcuacucgggaggcug

SEQ ID NO: 467369 - RNA, 32 nt, Human
gguaccuguaaucccagcuacucgggagguga

SEQ ID NO: 467370 - RNA, 32 nt, Human
gguaccuguaaucccagcuacuugggaggcug

SEQ ID NO: 467371 - RNA, 32 nt, Human
gguaccuguagucccagcuacuagggaggcug

SEQ ID NO: 467372 - RNA, 32 nt, Human
gguaccuguagucccagcuacuccggaggcug

SEQ ID NO: 467373 - RNA, 32 nt, Human
gguaccugucacugcaaaugcuuugucucugg

SEQ ID NO: 467374 - RNA, 32 nt, Human
gguaccuguggagccacagcugccucagccca

SEQ ID NO: 467375 - RNA, 32 nt, Human
gguaccuugcaaguuugcacagaaaguggagc

SEQ ID NO: 467376 - RNA, 32 nt, Human
gguaccuugccaggaacaucggaaguagggca

SEQ ID NO: 467377 - RNA, 32 nt, Human
gguacgaagauacaauacuguuauucauuuau

SEQ ID NO: 467378 - RNA, 32 nt, Human
gguacgaauguccugcaucgccuuccucuuca

SEQ ID NO: 467379 - RNA, 32 nt, Human
gguacgacggggaacagcaggagcagggcgag

SEQ ID NO: 467380 - RNA, 21 nt, Human
gguacgcagacuccacacuca

SEQ ID NO: 467381 - RNA, 32 nt, Human
gguacgcauuccagggcugaauacuauugcuu

SEQ ID NO: 467382 - RNA, 32 nt, Human
gguacgcccacugcaaggccucccucccaccg

SEQ ID NO: 467383 - RNA, 32 nt, Human
gguacgcucacuguacagccaaugccuccaua

SEQ ID NO: 467384 - RNA, 32 nt, Human
gguacgcuguagaccagaccgcgacaggccag

SEQ ID NO: 467385 - RNA, 32 nt, Human
gguacggggcuguuggugacucugccuacagc

SEQ ID NO: 467386 - RNA, 21 nt, Human
gguacgggucuuccugccuca

SEQ ID NO: 467387 - RNA, 22 nt, Human
gguacgguggcucacgccugua

SEQ ID NO: 467388 - RNA, 32 nt, Human
gguacgucucccaggaguggccggacaguacc

SEQ ID NO: 467389 - RNA, 32 nt, Human
gguacgugcagcacuacggccugggcagugcc

SEQ ID NO: 467390 - RNA, 32 nt, Human
gguacgugccuguaggccuagcuacuuaggag

SEQ ID NO: 467391 - RNA, 32 nt, Human
gguacgugccuguagucccagcuacuucgggg

SEQ ID NO: 467392 - RNA, 32 nt, Human
gguacuaauuacugcccagccuggggagauca

SEQ ID NO: 467393 - RNA, 32 nt, Human
gguacuagaggaccacuggcucuggaccgucg

SEQ ID NO: 467394 - RNA, 32 nt, Human
gguacuauguagagaagacagcugaggaugcc

SEQ ID NO: 467395 - RNA, 32 nt, Human
gguacucagauguccagccgcacucucuacau

SEQ ID NO: 467396 - RNA, 20 nt, Human
gguacucagcuccaucucca

SEQ ID NO: 467397 - RNA, 24 nt, Human
gguacucagcuggcccacuccaca

SEQ ID NO: 467398 - RNA, 32 nt, Human
gguacucaucuuccuucaagacugagcaguca

SEQ ID NO: 467399 - RNA, 32 nt, Human
gguacuccagcuuugagguccuaggaaaaagg

SEQ ID NO: 467400 - RNA, 32 nt, Human
gguacuccuugaucuuuaugaaugaccgguua

SEQ ID NO: 467401 - RNA, 32 nt, Human
gguacuccuuguaguaagcuguuuucugcuca

SEQ ID NO: 467402 - RNA, 32 nt, Human
gguacucgagcagugggcgcccaggguccgag

SEQ ID NO: 467403 - RNA, 32 nt, Human
gguacucuccuguuccagccuugugaaggaac

SEQ ID NO: 467404 - RNA, 32 nt, Human
gguacucugacugcaacaucuuucaccccauu

SEQ ID NO: 467405 - RNA, 32 nt, Human
gguacucugagacaaaacacagugauggggcg

SEQ ID NO: 467406 - RNA, 32 nt, Human
gguacucugccucucugcucccugggggccaa

SEQ ID NO: 467407 - RNA, 31 nt, Human
gguacucugggaccuguuuccuggaggcccu

SEQ ID NO: 467408 - RNA, 32 nt, Human
gguacucuucagggaugagucauguggcagug

SEQ ID NO: 467409 - RNA, 32 nt, Human
gguacugaucagcgcccccacccaggacauac

SEQ ID NO: 467410 - RNA, 32 nt, Human
gguacugcaacugcuuuccucuugcccagaaa

SEQ ID NO: 467411 - RNA, 32 nt, Human
gguacugcagaacagagccugcagugagacac

SEQ ID NO: 467412 - RNA, 22 nt, Human
gguacugcauaagccgaccaca

SEQ ID NO: 467413 - RNA, 32 nt, Human
gguacugcauuucccguuucuaccuccacugc

SEQ ID NO: 467414 - RNA, 32 nt, Human
gguacugccacauuuucucuagagcagcuggc

SEQ ID NO: 467415 - RNA, 32 nt, Human
gguacuggacugggagucaggagaccuggauu

SEQ ID NO: 467416 - RNA, 32 nt, Human
gguacuggagaagcagcagggcaacuucaagg

SEQ ID NO: 467417 - RNA, 32 nt, Human
gguacuggaggguggguaccuucaggcugugg

SEQ ID NO: 467418 - RNA, 32 nt, Human
gguacuggccacggccaugcugggcagcucua

SEQ ID NO: 467419 - RNA, 32 nt, Human
gguacuggccugggugacagagcaggacauga

SEQ ID NO: 467420 - RNA, 32 nt, Human
gguacuggggacacaggaaggacgaggcagag

SEQ ID NO: 467421 - RNA, 32 nt, Human
gguacugguggaaaaacugagauacggaaacc

SEQ ID NO: 467422 - RNA, 17 nt, Human
gguacuguaacauucca

SEQ ID NO: 467423 - RNA, 32 nt, Human
gguacugucugggccugggaggcgagagcagu

SEQ ID NO: 467424 - RNA, 32 nt, Human
gguacugugaggaagagcaggcaccagcagca

SEQ ID NO: 467425 - RNA, 32 nt, Human
gguacugugguuucugugcucucuccuuccug

SEQ ID NO: 467426 - RNA, 32 nt, Human
gguacuguuguucacaugauuuauuuaccaua

SEQ ID NO: 467427 - RNA, 21 nt, Human
gguacuguuuauuugcuccuu

SEQ ID NO: 467428 - RNA, 18 nt, Human
gguacuguuucugccuca

SEQ ID NO: 467429 - RNA, 32 nt, Human
gguacuuaggaagaagucuaggaugugaauua

SEQ ID NO: 467430 - RNA, 32 nt, Human
gguacuucagauuuucuuuuugucuuguguca

SEQ ID NO: 467431 - RNA, 24 nt, Human
gguacuucuggggaccuccuggca

SEQ ID NO: 467432 - RNA, 21 nt, Human
gguacuugaccggaagaagac

SEQ ID NO: 467433 - RNA, 32 nt, Human
gguacuugauucuaaaccugugccagucuaua

SEQ ID NO: 467434 - RNA, 32 nt, Human
gguacuuggcacccuguuggguauuggguaca

SEQ ID NO: 467435 - RNA, 32 nt, Human
gguacuugucauggagcuggcacugcggcgcu

SEQ ID NO: 467436 - RNA, 32 nt, Human
gguacuuguccacccugccuccucuguucuga

SEQ ID NO: 467437 - RNA, 32 nt, Human
gguacuuguggacacagcucuucuccaggcug

SEQ ID NO: 467438 - RNA, 32 nt, Human
gguagaaaccaucuacccucuaccaccuugca

SEQ ID NO: 467439 - RNA, 32 nt, Human
gguagaaagaggagugaugggggagggggauu

SEQ ID NO: 467440 - RNA, 32 nt, Human
gguagaaaguagggcauaaucagaauauagag

SEQ ID NO: 467441 - RNA, 32 nt, Human
gguagaaauguucaagcuuaugcacaggcuug

SEQ ID NO: 467442 - RNA, 32 nt, Human
gguagaacaacaaaagcacuuuuccaucuugu

SEQ ID NO: 467443 - RNA, 32 nt, Human
gguagaacacauaggauugcaaaaccaauuag

SEQ ID NO: 467444 - RNA, 32 nt, Human
gguagaacaggugucguacacugugaaauguu

SEQ ID NO: 467445 - RNA, 19 nt, Human
gguagaaccaguauuuuug

SEQ ID NO: 467446 - RNA, 32 nt, Human
gguagaaccaguauuuuuguuguuuauuuaua

SEQ ID NO: 467447 - RNA, 32 nt, Human
gguagaaccaugagcuuuguugauguugauca

SEQ ID NO: 467448 - RNA, 32 nt, Human
gguagaaccccuggauacauuauuugcccucu

SEQ ID NO: 467449 - RNA, 32 nt, Human
gguagaagccacccuucccugccuccagcugu

SEQ ID NO: 467450 - RNA, 32 nt, Human
gguagaagcuggcuaaccuccacuuccacauu

SEQ ID NO: 467451 - RNA, 32 nt, Human
gguagaaggagagaaggggaguggaggaagca

SEQ ID NO: 467452 - RNA, 32 nt, Human
gguagaaggagagagaaaggggagagaaagga

SEQ ID NO: 467453 - RNA, 22 nt, Human
gguagaaggggaggacacuggu

SEQ ID NO: 467454 - RNA, 32 nt, Human
gguagaagguuaagaagagaaaaugcuaaaua

SEQ ID NO: 467455 - RNA, 32 nt, Human
gguagaaguauuagcuugcauuugaugaccuu

SEQ ID NO: 467456 - RNA, 32 nt, Human
gguagaauauaaaagcucauuaaucauccugg

SEQ ID NO: 467457 - RNA, 32 nt, Human
gguagaauggacaagugacacuguggacaaug

SEQ ID NO: 467458 - RNA, 19 nt, Human
gguagaauugugguucccu

SEQ ID NO: 467459 - RNA, 32 nt, Human
gguagacaaacaacagcugcaguugagaacug

SEQ ID NO: 467460 - RNA, 32 nt, Human
gguagacacuuaggugaugauagccaaaacau

SEQ ID NO: 467461 - RNA, 32 nt, Human
gguagacagcgcaaucuguggagcuuuuacuc

SEQ ID NO: 467462 - RNA, 32 nt, Human
gguagacagguggggaaaaggcccgugaguca

SEQ ID NO: 467463 - RNA, 32 nt, Human
gguagaccagauggucugggaaaguucugugc

SEQ ID NO: 467464 - RNA, 32 nt, Human
gguagacccaacucaucaggcagcggguaggg

SEQ ID NO: 467465 - RNA, 32 nt, Human
gguagacgcugguaggguaagggagcuaagua

SEQ ID NO: 467466 - RNA, 32 nt, Human
gguagacggggcuguuuggugccugaaggaug

SEQ ID NO: 467467 - RNA, 32 nt, Human
gguagacuuggagcuguccuccagagggguca

SEQ ID NO: 467468 - RNA, 32 nt, Human
gguagagaccgagccucugucacugcaggcac

SEQ ID NO: 467469 - RNA, 32 nt, Human
gguagagcacgcgcagcugggccaggccuacg

SEQ ID NO: 467470 - RNA, 32 nt, Human
gguagagccgugccucuugggcaggcucccau

SEQ ID NO: 467471 - RNA, 19 nt, Human
gguagagccucuacuuucc

SEQ ID NO: 467472 - RNA, 17 nt, Human
gguagagcggcaggacu

SEQ ID NO: 467473 - RNA, 19 nt, Human
gguagagcggccacuucug

SEQ ID NO: 467474 - RNA, 32 nt, Human
gguagaggagagaauugggggaguugcagggg

SEQ ID NO: 467475 - RNA, 32 nt, Human
gguagaggaggaaacuccucuccacaaaucca

SEQ ID NO: 467476 - RNA, 31 nt, Human
gguagaggaugacuggcacacuuguauagua

SEQ ID NO: 467477 - RNA, 32 nt, Human
gguagaggaugagaggaugaagagagguuaug

SEQ ID NO: 467478 - RNA, 32 nt, Human
gguagagggcuggccccuccucucaucuuccc

SEQ ID NO: 467479 - RNA, 21 nt, Human
gguagaggggcccaggauucc

SEQ ID NO: 467480 - RNA, 19 nt, Human
gguagaggggguauuucug

SEQ ID NO: 467481 - RNA, 31 nt, Human
gguagaggucacuucuucccagcccugccuc

SEQ ID NO: 467482 - RNA, 21 nt, Human
gguagaggugggaggacugau

SEQ ID NO: 467483 - RNA, 18 nt, Human
gguagagguugcagugag

SEQ ID NO: 467484 - RNA, 32 nt, Human
gguagagugugaacaucaugaaauugccaaug

SEQ ID NO: 467485 - RNA, 32 nt, Human
gguagaguuacuugacauguaucauguaauaa

SEQ ID NO: 467486 - RNA, 20 nt, Human
gguagaguugagcauuuuug

SEQ ID NO: 467487 - RNA, 32 nt, Human
gguagaguugauugaggcccuagaucaggacc

SEQ ID NO: 467488 - RNA, 32 nt, Human
gguagauacaggauaagauagauacaggguaa

SEQ ID NO: 467489 - RNA, 32 nt, Human
gguagauaggggcacugugcuuaaacaaaaug

SEQ ID NO: 467490 - RNA, 32 nt, Human
gguagauaguaaaaucacuggcuuuuuccagc

SEQ ID NO: 467491 - RNA, 32 nt, Human
gguagauaguacauacuugccauuucuauacu

SEQ ID NO: 467492 - RNA, 32 nt, Human
gguagaucacaaggucaggaaaucgagaccau

SEQ ID NO: 467493 - RNA, 32 nt, Human
gguagaucacaaggucaggaaauugagaccau

SEQ ID NO: 467494 - RNA, 32 nt, Human
gguagaucacugcauccgguuccuccucuuuc

SEQ ID NO: 467495 - RNA, 32 nt, Human
gguagaucacuugaggucaggagaccagccgg

SEQ ID NO: 467496 - RNA, 32 nt, Human
gguagaucacuugaugccaggaguuccagacc

SEQ ID NO: 467497 - RNA, 32 nt, Human
gguagaugaggccuucccauggcuacagugug

SEQ ID NO: 467498 - RNA, 32 nt, Human
gguagaugccuguaauuccagcuacucaggag

SEQ ID NO: 467499 - RNA, 32 nt, Human
gguagaugcuuagcuggcaguaugaguugugu

SEQ ID NO: 467500 - RNA, 22 nt, Human
gguagauggaaggaucccugga

SEQ ID NO: 467501 - RNA, 32 nt, Human
gguagauggugugugugaaacagugaagucuc

SEQ ID NO: 467502 - RNA, 32 nt, Human
gguagauucaaagcuccacccaccucauccca

SEQ ID NO: 467503 - RNA, 32 nt, Human
gguagauuccaggguguggaaguggcuuugug

SEQ ID NO: 467504 - RNA, 32 nt, Human
gguagauuugcugaaauggagaaacaaagaca

SEQ ID NO: 467505 - RNA, 32 nt, Human
gguagcaccacugcacuucagccuggacaaca

SEQ ID NO: 467506 - RNA, 32 nt, Human
gguagcagaaaauccuauugauuucaucucac

SEQ ID NO: 467507 - RNA, 32 nt, Human
gguagcagacuccucagaguccucuugacaca

SEQ ID NO: 467508 - RNA, 32 nt, Human
gguagcagaggacuagguguuaggacagacuc

SEQ ID NO: 467509 - RNA, 32 nt, Human
gguagcagauuggggaaaaugaagcagcccac

SEQ ID NO: 467510 - RNA, 20 nt, Human
gguagcagcaggcucaggca

SEQ ID NO: 467511 - RNA, 32 nt, Human
gguagcagcuccaaagcauuggaugcuggaua

SEQ ID NO: 467512 - RNA, 32 nt, Human
gguagcagcucucuucugucagcugaauguua

SEQ ID NO: 467513 - RNA, 32 nt, Human
gguagcaggaggcuggaagaaaggacagaagu

SEQ ID NO: 467514 - RNA, 23 nt, Human
gguagcagggcugucugguuuua

SEQ ID NO: 467515 - RNA, 32 nt, Human
gguagcaguaacucucugaagcauuuugaggu

SEQ ID NO: 467516 - RNA, 32 nt, Human
gguagcagugccuguguguuggagcucaguua

SEQ ID NO: 467517 - RNA, 32 nt, Human
gguagcaugauggcuguagcuguuucaugggc

SEQ ID NO: 467518 - RNA, 32 nt, Human
gguagcauggauggagagaggauucugaauaa

SEQ ID NO: 467519 - RNA, 32 nt, Human
gguagcauggcagaggcuggagaggauuaaca

SEQ ID NO: 467520 - RNA, 22 nt, Human
gguagccaacacgcugugcuca

SEQ ID NO: 467521 - RNA, 32 nt, Human
gguagccacauuuugaauccucuaccacaagu

SEQ ID NO: 467522 - RNA, 32 nt, Human
gguagccacuucagaggaagcucggcggcugu

SEQ ID NO: 467523 - RNA, 32 nt, Human
gguagccaggugggugaaggggagcgaggacg

SEQ ID NO: 467524 - RNA, 32 nt, Human
gguagccaugauuuaucccagccuggggcucc

SEQ ID NO: 467525 - RNA, 32 nt, Human
gguagcccagcacugugaagacccagcaggaa

SEQ ID NO: 467526 - RNA, 32 nt, Human
gguagccgagacuggagccuaaggcuggaucu

SEQ ID NO: 467527 - RNA, 32 nt, Human
gguagccgggcaguggaggucccggaugaggc

SEQ ID NO: 467528 - RNA, 32 nt, Human
gguagccuacuuccuuacccccgaauauuggu

SEQ ID NO: 467529 - RNA, 32 nt, Human
gguagccucccacugcaucccauccugaauau

SEQ ID NO: 467530 - RNA, 32 nt, Human
gguagccugaagugggagauugcuugagucca

SEQ ID NO: 467531 - RNA, 32 nt, Human
gguagccugcugcuucucacagacaccucaca

SEQ ID NO: 467532 - RNA, 32 nt, Human
gguagccugguagcaccaaaucccaauuaaug

SEQ ID NO: 467533 - RNA, 32 nt, Human
gguagccuuugucccuucaugccuuucaauuc

SEQ ID NO: 467534 - RNA, 32 nt, Human
gguagcgacccccucccccaaccccucucccu

SEQ ID NO: 467535 - RNA, 32 nt, Human
gguagcgcugggaguguagaaguggccugccc

SEQ ID NO: 467536 - RNA, 21 nt, Human
gguagcggcaaaacucaggca

SEQ ID NO: 467537 - RNA, 32 nt, Human
gguagcuaggguauaguggcuggugaggcugc

SEQ ID NO: 467538 - RNA, 32 nt, Human
gguagcuauggaugggacaggaagcugccaac

SEQ ID NO: 467539 - RNA, 23 nt, Human
gguagcucacaccuauaauccca

SEQ ID NO: 467540 - RNA, 23 nt, Human
gguagcucacaccuguaauccca

SEQ ID NO: 467541 - RNA, 23 nt, Human
gguagcucacgccuguaauccca

SEQ ID NO: 467542 - RNA, 23 nt, Human
gguagcucaugccuauaauccca

SEQ ID NO: 467543 - RNA, 23 nt, Human
gguagcucaugccuguaauccca

SEQ ID NO: 467544 - RNA, 23 nt, Human
gguagcucaugcuuguaauccca

SEQ ID NO: 467545 - RNA, 21 nt, Human
gguagcuccacaguguuucau

SEQ ID NO: 467546 - RNA, 32 nt, Human
gguagcuccaccccaacucccuucugcugggu

SEQ ID NO: 467547 - RNA, 32 nt, Human
gguagcuccagcgauggugcugcccaggccuc

SEQ ID NO: 467548 - RNA, 32 nt, Human
gguagcucccaccaggacagagcugccaacug

SEQ ID NO: 467549 - RNA, 32 nt, Human
gguagcucucucccucggcuuccagaguccac

SEQ ID NO: 467550 - RNA, 32 nt, Human
gguagcucugggauuugccuuccuucaugucc

SEQ ID NO: 467551 - RNA, 32 nt, Human
gguagcucuugugucuguggacucugcucagc

SEQ ID NO: 467552 - RNA, 32 nt, Human
gguagcugagcugagaggacauauggcccacg

SEQ ID NO: 467553 - RNA, 32 nt, Human
gguagcugcacugggcaugggguggugguggg

SEQ ID NO: 467554 - RNA, 32 nt, Human
gguagcugcaggcucagaagagacugagcuug

SEQ ID NO: 467555 - RNA, 32 nt, Human
gguagcugcuuugcugaagaccucacacgaug

SEQ ID NO: 467556 - RNA, 32 nt, Human
gguagcuggccucuguggggauuguaagugcc

SEQ ID NO: 467557 - RNA, 21 nt, Human
gguagcugggagcucugguca

SEQ ID NO: 467558 - RNA, 32 nt, Human
gguagcugggauuacaggcacccaccaccacg

SEQ ID NO: 467559 - RNA, 32 nt, Human
gguagcugggauuacaggcacgcgcugccaca

SEQ ID NO: 467560 - RNA, 32 nt, Human
gguagcugggauuacaggcaugugccacaacg

SEQ ID NO: 467561 - RNA, 32 nt, Human
gguagcugggauuacaggcaugugccaccaca

SEQ ID NO: 467562 - RNA, 32 nt, Human
gguagcugggauuacaggcaugugccaccacg

SEQ ID NO: 467563 - RNA, 32 nt, Human
gguagcugggauuacaggcucccgccaccacg

SEQ ID NO: 467564 - RNA, 32 nt, Human
gguagcugggauuacaggugcccaccaacaug

SEQ ID NO: 467565 - RNA, 32 nt, Human
gguagcugggauuacaggugugagccacugca

SEQ ID NO: 467566 - RNA, 32 nt, Human
gguagcugggcugggacgcugggacaggaccc

SEQ ID NO: 467567 - RNA, 21 nt, Human
gguagcuggggcucccaagaa

SEQ ID NO: 467568 - RNA, 32 nt, Human
gguagcugugguguugaaacacuggacuugga

SEQ ID NO: 467569 - RNA, 32 nt, Human
gguagcugugugcagucacugcagcuugccag

SEQ ID NO: 467570 - RNA, 22 nt, Human
gguagcuuccuuuuagucuuca

SEQ ID NO: 467571 - RNA, 32 nt, Human
gguagcuucuuuccucuucguccugaugcugc

SEQ ID NO: 467572 - RNA, 32 nt, Human
gguagcuugaagcacaccacuguccauuuauu

SEQ ID NO: 467573 - RNA, 32 nt, Human
gguagcuugcaggagcaucugaugaaugaucc

SEQ ID NO: 467574 - RNA, 22 nt, Human
gguagcuuuacguguggcuaca

SEQ ID NO: 467575 - RNA, 32 nt, Human
gguagcuuugggcacugcagcucuggacuuuu

SEQ ID NO: 467576 - RNA, 19 nt, Human
gguaggaaaagagcaggau

SEQ ID NO: 467577 - RNA, 32 nt, Human
gguaggaaaggaugauauuacaagggucaaaa

SEQ ID NO: 467578 - RNA, 32 nt, Human
gguaggaagugauugcaaacaggcuggauuug

SEQ ID NO: 467579 - RNA, 32 nt, Human
gguaggaagugggggccaggagagcagcgggc

SEQ ID NO: 467580 - RNA, 32 nt, Human
gguaggaauuguuacuuguuacugcagcagca

SEQ ID NO: 467581 - RNA, 32 nt, Human
gguaggaccaggcuucccggcuaggcacgccu

SEQ ID NO: 467582 - RNA, 20 nt, Human
gguaggaccauccgcuucca

SEQ ID NO: 467583 - RNA, 32 nt, Human
gguaggacucacuggagagaaacccuaugagu

SEQ ID NO: 467584 - RNA, 32 nt, Human
gguaggagauaaggagaaagaacagauacggu

SEQ ID NO: 467585 - RNA, 32 nt, Human
gguaggagcugcuggaacaggagaggcuucag

SEQ ID NO: 467586 - RNA, 32 nt, Human
gguaggagcuggagaugaagagacugcuagaa

SEQ ID NO: 467587 - RNA, 32 nt, Human
gguaggaggagaagaaacacagggaaagagac

SEQ ID NO: 467588 - RNA, 32 nt, Human
gguaggaggagagaaggcuggggagggcuggg

SEQ ID NO: 467589 - RNA, 32 nt, Human
gguaggaucccuccccuuccgucuucuccacu

SEQ ID NO: 467590 - RNA, 32 nt, Human
gguaggauuguuggcaggccagccugcaguga

SEQ ID NO: 467591 - RNA, 21 nt, Human
gguaggcaaagcagucugaga

SEQ ID NO: 467592 - RNA, 32 nt, Human
gguaggcaagaggaauagaaaagggaagaaug

SEQ ID NO: 467593 - RNA, 32 nt, Human
gguaggcaccuguaaucccagcuacucgggag

SEQ ID NO: 467594 - RNA, 32 nt, Human
gguaggcaccuuucugagcuuauucuauuccc

SEQ ID NO: 467595 - RNA, 32 nt, Human
gguaggcagagggcaggcaggagaaaagaaau

SEQ ID NO: 467596 - RNA, 32 nt, Human
gguaggcagcagcaggcugaagggaucauggu

SEQ ID NO: 467597 - RNA, 32 nt, Human
gguaggcaggagccccgcccucccaggcacag

SEQ ID NO: 467598 - RNA, 32 nt, Human
gguaggccccuggcaaguaggugagaagcuuu

SEQ ID NO: 467599 - RNA, 19 nt, Human
gguaggcgcaugguuuccu

SEQ ID NO: 467600 - RNA, 32 nt, Human
gguaggcgccuguaaucucagcuacuugaaag

SEQ ID NO: 467601 - RNA, 32 nt, Human
gguaggcucagggaguucaguggggacagguc

SEQ ID NO: 467602 - RNA, 21 nt, Human
gguagggaaauggaacugagg

SEQ ID NO: 467603 - RNA, 32 nt, Human
gguagggaagggggaggggcagaggaggggaa

SEQ ID NO: 467604 - RNA, 32 nt, Human
gguagggacacguguccaugcaccacagacac

SEQ ID NO: 467605 - RNA, 32 nt, Human
gguagggacccccuuuccccagagacccucua

SEQ ID NO: 467606 - RNA, 32 nt, Human
gguagggagaaauauucucuccacuuuggggg

SEQ ID NO: 467607 - RNA, 32 nt, Human
gguagggagaggaggggcagaggcugugaaca

SEQ ID NO: 467608 - RNA, 32 nt, Human
gguagggagaggguauaacaggaagagcuuug

SEQ ID NO: 467609 - RNA, 32 nt, Human
gguagggagaucaagaccauccuggcuaacac

SEQ ID NO: 467610 - RNA, 32 nt, Human
gguagggaggcaggagccaugucaguucugaa

SEQ ID NO: 467611 - RNA, 32 nt, Human
gguagggaggggcuuagaggucaucaacucca

SEQ ID NO: 467612 - RNA, 32 nt, Human
gguagggcagcaucuguuaugggcccugagaa

SEQ ID NO: 467613 - RNA, 32 nt, Human
gguagggcagggcccuggagacgacauggugu

SEQ ID NO: 467614 - RNA, 20 nt, Human
gguagggccuggagcugcug

SEQ ID NO: 467615 - RNA, 32 nt, Human
gguagggcucacagacugugugaaguccugug

SEQ ID NO: 467616 - RNA, 32 nt, Human
gguagggcugagcuugcaagaggaucaacaug

SEQ ID NO: 467617 - RNA, 32 nt, Human
gguaggggaagaggaggggcaggagggagagu

SEQ ID NO: 467618 - RNA, 21 nt, Human
gguaggggacucacuuucuca

SEQ ID NO: 467619 - RNA, 32 nt, Human
gguaggggagcauucugccuaacagaaauuag

SEQ ID NO: 467620 - RNA, 32 nt, Human
gguaggggaucugcuucccacugugacugggc

SEQ ID NO: 467621 - RNA, 32 nt, Human
gguaggggcaagggaagagagcugaggagagg

SEQ ID NO: 467622 - RNA, 32 nt, Human
gguaggggcagcuucuggagccuugggacaga

SEQ ID NO: 467623 - RNA, 32 nt, Human
gguagggggugggcugggggaggcgggugagg

SEQ ID NO: 467624 - RNA, 32 nt, Human
gguaggggugggcugaagaacuaccuguuggg

SEQ ID NO: 467625 - RNA, 31 nt, Human
gguagggucaucaucucuacauuccuuagga

SEQ ID NO: 467626 - RNA, 32 nt, Human
gguagguaacaucuuacauucuguuuucuucc

SEQ ID NO: 467627 - RNA, 32 nt, Human
gguagguagguuuuaaaaauacuaguuaaaau

SEQ ID NO: 467628 - RNA, 32 nt, Human
gguaggucaagaagugccaccugcugaagagu

SEQ ID NO: 467629 - RNA, 32 nt, Human
gguagguccuuuucuccuccggccuaguaggg

SEQ ID NO: 467630 - RNA, 23 nt, Human
gguaggucugaacaacugccgca

SEQ ID NO: 467631 - RNA, 32 nt, Human
gguaggucugcagcuagccuacucccuuugga

SEQ ID NO: 467632 - RNA, 23 nt, Human
gguaggucuguggcccuuagaca

SEQ ID NO: 467633 - RNA, 32 nt, Human
gguaggugagggaagcgcggaggcggggcgcg

SEQ ID NO: 467634 - RNA, 32 nt, Human
gguaggugccuguaaucccagcuacuugggag

SEQ ID NO: 467635 - RNA, 22 nt, Human
gguaggugcgaggcgguuaccc

SEQ ID NO: 467636 - RNA, 32 nt, Human
gguaggugcggcagggauggggccagugcuca

SEQ ID NO: 467637 - RNA, 32 nt, Human
gguaggugcucaauaaauguuggucauuguua

SEQ ID NO: 467638 - RNA, 32 nt, Human
gguaggugcuccauuacaauccaggaaagucu

SEQ ID NO: 467639 - RNA, 32 nt, Human
gguagguggaucaccugaggucgggaguucga

SEQ ID NO: 467640 - RNA, 32 nt, Human
gguaggugggguggcuugaggucugggagggu

SEQ ID NO: 467641 - RNA, 32 nt, Human
gguaggugugcaucacauugggcuuguucuca

SEQ ID NO: 467642 - RNA, 32 nt, Human
gguagguugucaaaccaaacagagccaccgug

SEQ ID NO: 467643 - RNA, 32 nt, Human
gguaguagcugugucuguguccccucgugaaa

SEQ ID NO: 467644 - RNA, 32 nt, Human
gguaguaggacugcgcggcuccaggcugaggg

SEQ ID NO: 467645 - RNA, 32 nt, Human
gguaguaggagagcaaaaaguaugaaugggau

SEQ ID NO: 467646 - RNA, 32 nt, Human
gguaguauaagaaugaggaaaaagagguaaua

SEQ ID NO: 467647 - RNA, 32 nt, Human
gguagucaaggaaagaagcaaagggaauaccu

SEQ ID NO: 467648 - RNA, 25 nt, Human
gguagucacauggaaagcucuuuua

SEQ ID NO: 467649 - RNA, 22 nt, Human
gguagucacgccuguaauccca

SEQ ID NO: 467650 - RNA, 32 nt, Human
gguagucagaggagggaggaggaauaagggga

SEQ ID NO: 467651 - RNA, 32 nt, Human
gguagucagagugagcuacauccugccccgcc

SEQ ID NO: 467652 - RNA, 32 nt, Human
gguagucaggggcucaggagcagaucccgagg

SEQ ID NO: 467653 - RNA, 32 nt, Human
gguagucaugaaaaucaaaugaugcaaaauau

SEQ ID NO: 467654 - RNA, 32 nt, Human
gguaguccaugucugauuguaauuguuucuuu

SEQ ID NO: 467655 - RNA, 32 nt, Human
gguagucccugcucuuggcuucaccaaaucuc

SEQ ID NO: 467656 - RNA, 32 nt, Human
gguagucuagagagggucgucuggccugcuug

SEQ ID NO: 467657 - RNA, 32 nt, Human
gguagucugccccuuccuuccucucucuuuuu

SEQ ID NO: 467658 - RNA, 21 nt, Human
gguagugacugagauuuggug

SEQ ID NO: 467659 - RNA, 32 nt, Human
gguagugagacaaaauugaugauccauuaagu

SEQ ID NO: 467660 - RNA, 32 nt, Human
gguagugagcuuccacuucugcccugacugca

SEQ ID NO: 467661 - RNA, 32 nt, Human
gguagugaguagaguccucaggcacagugggc

SEQ ID NO: 467662 - RNA, 32 nt, Human
gguagugaguagcugguacuacaggugugugc

SEQ ID NO: 467663 - RNA, 32 nt, Human
gguagugcaaauucaacuucaaauauggugua

SEQ ID NO: 467664 - RNA, 32 nt, Human
gguagugccugggggcuguggcgguccucccc

SEQ ID NO: 467665 - RNA, 32 nt, Human
gguagugcggugccuuucccccagaucaugcu

SEQ ID NO: 467666 - RNA, 23 nt, Human
gguaguggaaccagacagcaggu

SEQ ID NO: 467667 - RNA, 24 nt, Human
gguaguggaacgcagacccuggug

SEQ ID NO: 467668 - RNA, 32 nt, Human
gguaguggaugggguuucuguuguaucuugug

SEQ ID NO: 467669 - RNA, 32 nt, Human
gguaguggcaugcgccuguaaucccagcuacu

SEQ ID NO: 467670 - RNA, 32 nt, Human
gguaguggcauugugcuguauccugccugggc

SEQ ID NO: 467671 - RNA, 22 nt, Human
gguaguggcgguggaccaggug

SEQ ID NO: 467672 - RNA, 32 nt, Human
gguagugggagagaggaaaggagggaaggcaa

SEQ ID NO: 467673 - RNA, 32 nt, Human
gguagugggaggagaacggucagaaucaaagu

SEQ ID NO: 467674 - RNA, 32 nt, Human
gguagugggaggugggagggaagggcuuuggg

SEQ ID NO: 467675 - RNA, 23 nt, Human
gguaguggguugcugguaguuaa

SEQ ID NO: 467676 - RNA, 32 nt, Human
gguaguggugaaggaccgauaucagaaaaaug

SEQ ID NO: 467677 - RNA, 22 nt, Human
gguaguggugguagaccuggug

SEQ ID NO: 467678 - RNA, 32 nt, Human
gguaguggugugugccuauaaucccagcuacu

SEQ ID NO: 467679 - RNA, 32 nt, Human
gguagugucaguucaacuuucagaagugccac

SEQ ID NO: 467680 - RNA, 32 nt, Human
gguagugugacugaggaggaaaccccacccuu

SEQ ID NO: 467681 - RNA, 32 nt, Human
gguaguuaacacaucaaauauuucuugcugcu

SEQ ID NO: 467682 - RNA, 32 nt, Human
gguaguuauuccugccuguguugcccaccugu

SEQ ID NO: 467683 - RNA, 32 nt, Human
gguaguuauuuugcaccagcagugccuuucuc

SEQ ID NO: 467684 - RNA, 32 nt, Human
gguaguucaagaaaugaagagcuguugauggg

SEQ ID NO: 467685 - RNA, 32 nt, Human
gguaguuccacucuugaguaugguaguccccu

SEQ ID NO: 467686 - RNA, 32 nt, Human
gguaguucuugccucuggggugaguggcuuuc

SEQ ID NO: 467687 - RNA, 32 nt, Human
gguaguugagggugacuuuuccugcugccugg

SEQ ID NO: 467688 - RNA, 32 nt, Human
gguaguuggcagaaauacagucuuccacaaag

SEQ ID NO: 467689 - RNA, 32 nt, Human
gguaguuucuacaguugggcagcugguuaggu

SEQ ID NO: 467690 - RNA, 32 nt, Human
gguaguuucugugguuggcugggaaaucgagu

SEQ ID NO: 467691 - RNA, 32 nt, Human
gguaguuugaccuccguuggugcaaugccaga

SEQ ID NO: 467692 - RNA, 32 nt, Human
gguaguuugacuuccucucuuuuuauuuggag

SEQ ID NO: 467693 - RNA, 32 nt, Human
gguaguuuggagaaggagguguugagucaguu

SEQ ID NO: 467694 - RNA, 32 nt, Human
gguaguuuuuauuuucuuccuucuacuucucu

SEQ ID NO: 467695 - RNA, 32 nt, Human
gguauaaaccucaauuuuuguaacccuauuuu

SEQ ID NO: 467696 - RNA, 32 nt, Human
gguauaaaggcuaaaagggaaaaaggauaugu

SEQ ID NO: 467697 - RNA, 32 nt, Human
gguauaacaugccacggcgguccuccaggcag

SEQ ID NO: 467698 - RNA, 32 nt, Human
gguauaagcagcuguacucaaauguucuuaaa

SEQ ID NO: 467699 - RNA, 32 nt, Human
gguauaauacaacagagcacuuuuugaggcaa

SEQ ID NO: 467700 - RNA, 32 nt, Human
gguauacacagcagaaaggguacuguccacuu

SEQ ID NO: 467701 - RNA, 32 nt, Human
gguauacaggguggaguagggagaagcugccc

SEQ ID NO: 467702 - RNA, 32 nt, Human
gguauacaucuuccccuaaugccuaucugacc

SEQ ID NO: 467703 - RNA, 32 nt, Human
gguauaccuaguccagcacugccaucaauaac

SEQ ID NO: 467704 - RNA, 32 nt, Human
gguauaccucagacuucacugugcucacaauc

SEQ ID NO: 467705 - RNA, 32 nt, Human
gguauaccugggaggauccagcaguaaucccc

SEQ ID NO: 467706 - RNA, 32 nt, Human
gguauacuguaacccagguucugccugucgug

SEQ ID NO: 467707 - RNA, 32 nt, Human
gguauagaacugcuuuucucauagguaaaagg

SEQ ID NO: 467708 - RNA, 32 nt, Human
gguauagaagagguuuccugaagaaacagacc

SEQ ID NO: 467709 - RNA, 32 nt, Human
gguauagggaaaaggcuccaggcaggagaccu

SEQ ID NO: 467710 - RNA, 32 nt, Human
gguauagggaaagguuugaggcgggaauaguc

SEQ ID NO: 467711 - RNA, 32 nt, Human
gguauaguauuuugguuuugguuccagauugu

SEQ ID NO: 467712 - RNA, 32 nt, Human
gguauagucucuaggaguuuuauuaauaguaa

SEQ ID NO: 467713 - RNA, 32 nt, Human
gguauauaaacugacauacaucagcuugaaac

SEQ ID NO: 467714 - RNA, 32 nt, Human
gguauauaaagaacccaguuccagcagggaga

SEQ ID NO: 467715 - RNA, 32 nt, Human
gguauauaaaguguuuuucaaagcggaaagau

SEQ ID NO: 467716 - RNA, 32 nt, Human
gguauaugccuguagucccagcuacucaggag

SEQ ID NO: 467717 - RNA, 32 nt, Human
gguauauguguacacacauacacaggguggau

SEQ ID NO: 467718 - RNA, 32 nt, Human
gguauauucuaggaguaagugcaggaauucag

SEQ ID NO: 467719 - RNA, 32 nt, Human
gguaucaaaaggugagaaagacgucauccacc

SEQ ID NO: 467720 - RNA, 32 nt, Human
gguaucaaaaggugagaaagacgucauccgcc

SEQ ID NO: 467721 - RNA, 32 nt, Human
gguaucacaauaaaauccuuccauuuuacuca

SEQ ID NO: 467722 - RNA, 32 nt, Human
gguaucacacuauaccagccauuugagccagc

SEQ ID NO: 467723 - RNA, 19 nt, Human
gguaucaccaucucuugaa

SEQ ID NO: 467724 - RNA, 32 nt, Human
gguaucagaaagcaagcucacauugcucucca

SEQ ID NO: 467725 - RNA, 32 nt, Human
gguaucagaacagcuucccucacuguguacag

SEQ ID NO: 467726 - RNA, 32 nt, Human
gguaucagaaccggcugcagacugcacccucg

SEQ ID NO: 467727 - RNA, 32 nt, Human
gguaucagcaacuguccucaucagucuccaua

SEQ ID NO: 467728 - RNA, 22 nt, Human
gguaucagcacucuggccugca

SEQ ID NO: 467729 - RNA, 32 nt, Human
gguaucagcuuugugcuggcuuugugaaauga

SEQ ID NO: 467730 - RNA, 32 nt, Human
gguaucaguucugcugacacuuuggcccgaaa

SEQ ID NO: 467731 - RNA, 32 nt, Human
gguaucaguuuucuuuauuuucuugaauaaaa

SEQ ID NO: 467732 - RNA, 32 nt, Human
gguaucaucucacuuuucuaauuuacaggcug

SEQ ID NO: 467733 - RNA, 32 nt, Human
gguaucaucuuccucuguccuuacuguccacg

SEQ ID NO: 467734 - RNA, 32 nt, Human
gguauccaaucacaguggccacaaauucuaga

SEQ ID NO: 467735 - RNA, 32 nt, Human
gguauccacugcacgugcgccgcccgggcuuc

SEQ ID NO: 467736 - RNA, 32 nt, Human
gguauccagcagaggggagaagaaagagagau

SEQ ID NO: 467737 - RNA, 32 nt, Human
gguauccauucugccaauucccacccauucag

SEQ ID NO: 467738 - RNA, 24 nt, Human
gguaucccagaagcauuuaccaca

SEQ ID NO: 467739 - RNA, 32 nt, Human
gguaucccaucccgaucugccucccagaacug

SEQ ID NO: 467740 - RNA, 32 nt, Human
gguauccccucccaggguccaccaagggcucc

SEQ ID NO: 467741 - RNA, 19 nt, Human
gguaucccuccacccaagu

SEQ ID NO: 467742 - RNA, 32 nt, Human
gguaucccuucugagaucaucucccccaagaa

SEQ ID NO: 467743 - RNA, 32 nt, Human
gguauccggaaggggaaaugaguuaccuuaag

SEQ ID NO: 467744 - RNA, 32 nt, Human
gguauccugcugagauuuugauuugcauuucc

SEQ ID NO: 467745 - RNA, 32 nt, Human
gguauccuggggccacccucccugccuccaaa

SEQ ID NO: 467746 - RNA, 32 nt, Human
gguauccuuuuucacacaccuuaaacuccaaa

SEQ ID NO: 467747 - RNA, 32 nt, Human
gguaucgcguugcucaggggcuuuucaacccu

SEQ ID NO: 467748 - RNA, 32 nt, Human
gguaucuauuaccaagcugcccuucagagagg

SEQ ID NO: 467749 - RNA, 32 nt, Human
gguaucucagguccuuucuaagugucccuuuc

SEQ ID NO: 467750 - RNA, 32 nt, Human
gguaucucaguuuggacaugaagagaagaccg

SEQ ID NO: 467751 - RNA, 32 nt, Human
gguaucucauuggaauuauagcuuaaauaucc

SEQ ID NO: 467752 - RNA, 32 nt, Human
gguaucucauugugguuuugauuugcauuucu

SEQ ID NO: 467753 - RNA, 32 nt, Human
gguaucuccuccuccugccucuucuauuguuc

SEQ ID NO: 467754 - RNA, 32 nt, Human
gguaucuccuugugguuuugauuuacauuucc

SEQ ID NO: 467755 - RNA, 32 nt, Human
gguaucucuguguuaagauuaguguuauuauu

SEQ ID NO: 467756 - RNA, 32 nt, Human
gguaucugacagcugugguggcugagggccgu

SEQ ID NO: 467757 - RNA, 32 nt, Human
gguaucugagucugccauaauucugagaagaa

SEQ ID NO: 467758 - RNA, 32 nt, Human
gguaucugggaggcagaguuugccgugagcug

SEQ ID NO: 467759 - RNA, 32 nt, Human
gguaucuucauacuguauuuuguaucaaaaca

SEQ ID NO: 467760 - RNA, 18 nt, Human
gguaucuugagaguuuug

SEQ ID NO: 467761 - RNA, 32 nt, Human
gguaucuugagcuugguucugggcucuuuccu

SEQ ID NO: 467762 - RNA, 32 nt, Human
gguaucuugggaucaagacugcaguuugggaa

SEQ ID NO: 467763 - RNA, 32 nt, Human
gguaucuugguugugcucuggggugggggugg

SEQ ID NO: 467764 - RNA, 32 nt, Human
gguaucuugugaguuugcaagcaaugggauga

SEQ ID NO: 467765 - RNA, 32 nt, Human
gguaucuuuucaauuaauguaucuguaaaagu

SEQ ID NO: 467766 - RNA, 19 nt, Human
gguaugaaaaaggcuccag

SEQ ID NO: 467767 - RNA, 32 nt, Human
gguaugaaaucaccaucagauccaucagcgcu

SEQ ID NO: 467768 - RNA, 32 nt, Human
gguaugaaccaccacaaccugccaggaauuuu

SEQ ID NO: 467769 - RNA, 32 nt, Human
gguaugaaccacugcaccuggcccuggauugc

SEQ ID NO: 467770 - RNA, 32 nt, Human
gguaugaagcagagcucgggaacucacagaaa

SEQ ID NO: 467771 - RNA, 32 nt, Human
gguaugaauaccaggaaacagauaacucagaa

SEQ ID NO: 467772 - RNA, 32 nt, Human
gguaugacacggccugaaccucuggcuucaga

SEQ ID NO: 467773 - RNA, 32 nt, Human
gguaugacugccucuccaacccugugggcugu

SEQ ID NO: 467774 - RNA, 32 nt, Human
gguaugagcagaggaagagaucccagauagua

SEQ ID NO: 467775 - RNA, 32 nt, Human
gguaugagcaggaggaacaaaggaaaggggag

SEQ ID NO: 467776 - RNA, 32 nt, Human
gguaugagccaccacacccagcccaacucauu

SEQ ID NO: 467777 - RNA, 32 nt, Human
gguaugagccuucugcagagcuagugcagacu

SEQ ID NO: 467778 - RNA, 32 nt, Human
gguaugagucucauccagucugugcugaucug

SEQ ID NO: 467779 - RNA, 32 nt, Human
gguaugaguggaaagaggaugggcgaggaggc

SEQ ID NO: 467780 - RNA, 32 nt, Human
gguaugaguuggggcucaguagaguuggggau

SEQ ID NO: 467781 - RNA, 32 nt, Human
gguaugaucaugagcucacugcagccuugaca

SEQ ID NO: 467782 - RNA, 32 nt, Human
gguaugcaccuguaaucccagcuacucgggag

SEQ ID NO: 467783 - RNA, 32 nt, Human
gguaugcagccgcgguaaagcagggccccucc

SEQ ID NO: 467784 - RNA, 32 nt, Human
gguaugcagccgcgguaaagcagggcuccucc

SEQ ID NO: 467785 - RNA, 32 nt, Human
gguaugcaggcccacgggcaccccagacacug

SEQ ID NO: 467786 - RNA, 32 nt, Human
gguaugccucaccaauuugcccgucuuuaaua

SEQ ID NO: 467787 - RNA, 28 nt, Human
gguaugcuggggguggaggauuuggugg

SEQ ID NO: 467788 - RNA, 32 nt, Human
gguaugcuguccucacugggccuguccacagu

SEQ ID NO: 467789 - RNA, 32 nt, Human
gguauggaauugcacauccaucucauaggaau

SEQ ID NO: 467790 - RNA, 32 nt, Human
gguauggagcagagcucgggaacucacagaaa

SEQ ID NO: 467791 - RNA, 32 nt, Human
gguauggagcagagcucgggaacucacauaaa

SEQ ID NO: 467792 - RNA, 32 nt, Human
gguauggagccugaauuuaaaugcaggucugc

SEQ ID NO: 467793 - RNA, 32 nt, Human
gguauggaggcaggauugcagaggcauuuuca

SEQ ID NO: 467794 - RNA, 32 nt, Human
gguauggagguucacugguaaucccagcacuu

SEQ ID NO: 467795 - RNA, 32 nt, Human
gguaugggaaguggcauguucuaacuccuaga

SEQ ID NO: 467796 - RNA, 32 nt, Human
gguaugggcagcccaagguugcaugggaaaac

SEQ ID NO: 467797 - RNA, 32 nt, Human
gguaugggcagguugcuugaggcuccagacau

SEQ ID NO: 467798 - RNA, 32 nt, Human
gguauggggugggggaggggccuggaccguug

SEQ ID NO: 467799 - RNA, 25 nt, Human
gguauggguucagagcaaugccuag

SEQ ID NO: 467800 - RNA, 22 nt, Human
gguaugguggcacauaccugug

SEQ ID NO: 467801 - RNA, 22 nt, Human
gguaugguggcucaagccugua

SEQ ID NO: 467802 - RNA, 22 nt, Human
gguaugguggcucaugccugua

SEQ ID NO: 467803 - RNA, 32 nt, Human
gguaugguggucaccuuugcuccagucaacgu

SEQ ID NO: 467804 - RNA, 22 nt, Human
gguaugguggugcauaccugua

SEQ ID NO: 467805 - RNA, 32 nt, Human
gguaugguuuggcuguuucuccacccaaaucu

SEQ ID NO: 467806 - RNA, 32 nt, Human
gguaugguuuucccugucccuuguacacauuc

SEQ ID NO: 467807 - RNA, 32 nt, Human
gguauguaaugcacguuccugccugcagggag

SEQ ID NO: 467808 - RNA, 23 nt, Human
gguauguacuuauaaagacauuu

SEQ ID NO: 467809 - RNA, 32 nt, Human
gguaugucacagacaccagagcagugucuuug

SEQ ID NO: 467810 - RNA, 32 nt, Human
gguaugucuaacuguaugucaaccccagaggc

SEQ ID NO: 467811 - RNA, 32 nt, Human
gguaugucucaugaauguucacacagaaggag

SEQ ID NO: 467812 - RNA, 32 nt, Human
gguaugucucugcugccugccucuuuccucug

SEQ ID NO: 467813 - RNA, 32 nt, Human
gguaugugacucugaugccccagcacaguuac

SEQ ID NO: 467814 - RNA, 32 nt, Human
gguaugugcacucccauguucacugcaguauu

SEQ ID NO: 467815 - RNA, 32 nt, Human
gguaugugccagcugguuuagcauucaauaug

SEQ ID NO: 467816 - RNA, 32 nt, Human
gguaugugcccaccccucucccauuauccuuu

SEQ ID NO: 467817 - RNA, 32 nt, Human
gguaugugccuguaaucccagcuacuugggag

SEQ ID NO: 467818 - RNA, 32 nt, Human
gguaugugccuguagucccagguacucaggag

SEQ ID NO: 467819 - RNA, 32 nt, Human
gguaugugccuguagucucagcuacucaggag

SEQ ID NO: 467820 - RNA, 32 nt, Human
gguaugugggaagcccaucucaguuccuguga

SEQ ID NO: 467821 - RNA, 32 nt, Human
gguaugugggaggcugggcugcuuagugucuu

SEQ ID NO: 467822 - RNA, 19 nt, Human
gguauguguagaggcccag

SEQ ID NO: 467823 - RNA, 32 nt, Human
gguaugugugagaaccaggggccagagcuggg

SEQ ID NO: 467824 - RNA, 32 nt, Human
gguaugugugugaccaucagcaguggugugca

SEQ ID NO: 467825 - RNA, 32 nt, Human
gguaugugugugugagugugcauguaugcaca

SEQ ID NO: 467826 - RNA, 32 nt, Human
gguauguguuucugcugccuuauucaauccac

SEQ ID NO: 467827 - RNA, 32 nt, Human
gguauguuugucucccagucugggcaaaggag

SEQ ID NO: 467828 - RNA, 32 nt, Human
gguauuaaaggccaacugcaaagaucacccug

SEQ ID NO: 467829 - RNA, 18 nt, Human
gguauuacauacccagug

SEQ ID NO: 467830 - RNA, 32 nt, Human
gguauuagacaucccugaaacucaguuaaccg

SEQ ID NO: 467831 - RNA, 23 nt, Human
gguauuaggcaaaucuuacuaua

SEQ ID NO: 467832 - RNA, 25 nt, Human
gguauuauuaaguauccugacuaca

SEQ ID NO: 467833 - RNA, 32 nt, Human
gguauuauuuccaauauuauuugguuuauuau

SEQ ID NO: 467834 - RNA, 32 nt, Human
gguauucaaccagcaaguuguuuucuuucaga

SEQ ID NO: 467835 - RNA, 23 nt, Human
gguauucagaucaucugcuucuu

SEQ ID NO: 467836 - RNA, 32 nt, Human
gguauucaguaauacaaugaaaagcaaaauug

SEQ ID NO: 467837 - RNA, 32 nt, Human
gguauucaucuucuucuucaucaagcucugau

SEQ ID NO: 467838 - RNA, 32 nt, Human
gguauucccugcucuuacuccaaaaagaugga

SEQ ID NO: 467839 - RNA, 32 nt, Human
gguauuccucaagcccagcauccaucugguga

SEQ ID NO: 467840 - RNA, 32 nt, Human
gguauuccucaccuuucuugccuuuaccagac

SEQ ID NO: 467841 - RNA, 32 nt, Human
gguauuccuccuggauggaaaggcuguuggca

SEQ ID NO: 467842 - RNA, 32 nt, Human
gguauuccuggguccugucuguccccaaccgu

SEQ ID NO: 467843 - RNA, 32 nt, Human
gguauucuacaugugacuggcuuucuugcccu

SEQ ID NO: 467844 - RNA, 32 nt, Human
gguauucuauaucuuaaccagcugagggagcu

SEQ ID NO: 467845 - RNA, 32 nt, Human
gguauucucaacagcaaaggggugaaaaaucu

SEQ ID NO: 467846 - RNA, 32 nt, Human
gguauucuucaugcaggagaccccaggcccug

SEQ ID NO: 467847 - RNA, 23 nt, Human
gguauucuuuaaaguucugguca

SEQ ID NO: 467848 - RNA, 32 nt, Human
gguauugaaucuuuuaaaaucuggucacaaau

SEQ ID NO: 467849 - RNA, 32 nt, Human
gguauugagaagagagaaagaagauagugaga

SEQ ID NO: 467850 - RNA, 32 nt, Human
gguauugagcacguauuuugcaaaagcuacuu

SEQ ID NO: 467851 - RNA, 32 nt, Human
gguauugagugugagguugaggugggacauuu

SEQ ID NO: 467852 - RNA, 32 nt, Human
gguauugaguucaucuucaacuucucccaaca

SEQ ID NO: 467853 - RNA, 32 nt, Human
gguauugcauagccuugcuuucuugaacuaaa

SEQ ID NO: 467854 - RNA, 32 nt, Human
gguauugcuccccugaguguauaugagugcug

SEQ ID NO: 467855 - RNA, 32 nt, Human
gguauugcugagacaugaugcagagaguuaag

SEQ ID NO: 467856 - RNA, 32 nt, Human
gguauuggggaaggcaggaaagggaaaaggag

SEQ ID NO: 467857 - RNA, 32 nt, Human
gguauuggggguggggucuuggagaggugauu

SEQ ID NO: 467858 - RNA, 32 nt, Human
gguauugguuuguggagaaggaagcauucuuu

SEQ ID NO: 467859 - RNA, 32 nt, Human
gguauugugaccacugaauucacuccagucaa

SEQ ID NO: 467860 - RNA, 32 nt, Human
gguauugugauugggcagaacucccccuccag

SEQ ID NO: 467861 - RNA, 32 nt, Human
gguauuguucagaccucagcuccugggggccg

SEQ ID NO: 467862 - RNA, 32 nt, Human
gguauuguuucuuaaguaaauauugggacaau

SEQ ID NO: 467863 - RNA, 32 nt, Human
gguauuuaaagccacacaaggauaaugagcac

SEQ ID NO: 467864 - RNA, 32 nt, Human
gguauuuaaguaguugggcauggugguguggu

SEQ ID NO: 467865 - RNA, 32 nt, Human
gguauuuaauuuccaaccacacuucuuauuuu

SEQ ID NO: 467866 - RNA, 32 nt, Human
gguauuuacuuaggugauagcagccugaaucu

SEQ ID NO: 467867 - RNA, 32 nt, Human
gguauuuaucugccaaaacaaggacaaaucuu

SEQ ID NO: 467868 - RNA, 32 nt, Human
gguauuucagauccgcucuggcccagugggca

SEQ ID NO: 467869 - RNA, 32 nt, Human
gguauuucauuucuccuguccccuccccuccc

SEQ ID NO: 467870 - RNA, 32 nt, Human
gguauuuccuucagaaaagacuuuucuacuuu

SEQ ID NO: 467871 - RNA, 32 nt, Human
gguauuucgggcccuccucuucaggaaucuuc

SEQ ID NO: 467872 - RNA, 32 nt, Human
gguauuucuguguuguucuugaucuuaaaguc

SEQ ID NO: 467873 - RNA, 32 nt, Human
gguauuucuucauagcagugugagaauggauu

SEQ ID NO: 467874 - RNA, 32 nt, Human
gguauuugcuccaggccaggcagcaggcugug

SEQ ID NO: 467875 - RNA, 32 nt, Human
gguauuuggaggucaggcagcagcauaaaucu

SEQ ID NO: 467876 - RNA, 32 nt, Human
gguauuugugcaaaagagaugaagacuucuca

SEQ ID NO: 467877 - RNA, 32 nt, Human
gguauuuucccuuggauauuaacuugcauauc

SEQ ID NO: 467878 - RNA, 32 nt, Human
gguauuuucuguggcccugggagcugucuguc

SEQ ID NO: 467879 - RNA, 32 nt, Human
gguauuuuucaaugcuaagucuugccuuuuau

SEQ ID NO: 467880 - RNA, 32 nt, Human
ggucaaaaacauaaaaucccugccuucuugag

SEQ ID NO: 467881 - RNA, 32 nt, Human
ggucaaaaagagaauaauuuggccuauaaugu

SEQ ID NO: 467882 - RNA, 32 nt, Human
ggucaaaagcaauaccagaaguaaagggaaau

SEQ ID NO: 467883 - RNA, 32 nt, Human
ggucaaaagcagcugccugaaugaguuguugu

SEQ ID NO: 467884 - RNA, 32 nt, Human
ggucaaaauggaauauugggggcuguuguaaa

SEQ ID NO: 467885 - RNA, 32 nt, Human
ggucaaacguuccuaauggugccugaaccuac

SEQ ID NO: 467886 - RNA, 32 nt, Human
ggucaaagaaggaggaggaggguggggagcug

SEQ ID NO: 467887 - RNA, 32 nt, Human
ggucaaaggaagggaaagcaugucaggggcug

SEQ ID NO: 467888 - RNA, 32 nt, Human
ggucaaaggagagucaacauaugugauuguuc

SEQ ID NO: 467889 - RNA, 32 nt, Human
ggucaaauccccaauguaucaacucagcuuua

SEQ ID NO: 467890 - RNA, 32 nt, Human
ggucaaaucucuccaccucuagucagaguaua

SEQ ID NO: 467891 - RNA, 32 nt, Human
ggucaaaugcagaguccugggcccuacaucaa

SEQ ID NO: 467892 - RNA, 32 nt, Human
ggucaaauugaauauaacccaauaaaggcuuc

SEQ ID NO: 467893 - RNA, 22 nt, Human
ggucaacaaguccuugacuccu

SEQ ID NO: 467894 - RNA, 32 nt, Human
ggucaacacuagcugccagcaggauggagacc

SEQ ID NO: 467895 - RNA, 32 nt, Human
ggucaacacugcacuccagccugggcgacaga

SEQ ID NO: 467896 - RNA, 24 nt, Human
ggucaacagagugagacucugucu

SEQ ID NO: 467897 - RNA, 32 nt, Human
ggucaacagccaucuuuucagcaguugccaac

SEQ ID NO: 467898 - RNA, 32 nt, Human
ggucaacagggacugaguggggcagaggccca

SEQ ID NO: 467899 - RNA, 32 nt, Human
ggucaacauagugaaaccccgucucuaauaaa

SEQ ID NO: 467900 - RNA, 32 nt, Human
ggucaacaugaugaaacccugucuacuaaaaa

SEQ ID NO: 467901 - RNA, 32 nt, Human
ggucaacauggcaaaagcccaucucuacuaaa

SEQ ID NO: 467902 - RNA, 32 nt, Human
ggucaacauggcgaaaccccaucucuacuaaa

SEQ ID NO: 467903 - RNA, 32 nt, Human
ggucaacauggcgaaaccccaucucuacugaa

SEQ ID NO: 467904 - RNA, 32 nt, Human
ggucaacaugguaaaaccccauuucugcuaaa

SEQ ID NO: 467905 - RNA, 32 nt, Human
ggucaacauggugaaacccagccucuacuaaa

SEQ ID NO: 467906 - RNA, 32 nt, Human
ggucaacauggugaaaccccaucuccacuaaa

SEQ ID NO: 467907 - RNA, 32 nt, Human
ggucaacauggugaaaccccaucucuacuaaa

SEQ ID NO: 467908 - RNA, 32 nt, Human
ggucaacauggugaaacccccuaucuacuaaa

SEQ ID NO: 467909 - RNA, 32 nt, Human
ggucaacauggugaaaccccgucuccacuaaa

SEQ ID NO: 467910 - RNA, 32 nt, Human
ggucaacauggugaaaccccgucucuacuaaa

SEQ ID NO: 467911 - RNA, 32 nt, Human
ggucaacauggugaaaccccuucucuacuaaa

SEQ ID NO: 467912 - RNA, 32 nt, Human
ggucaacauggugaaacccugucccuacuaaa

SEQ ID NO: 467913 - RNA, 32 nt, Human
ggucaacauggugaaacccugucucuacuaaa

SEQ ID NO: 467914 - RNA, 32 nt, Human
ggucaacauggugaaacccugucucuaguaaa

SEQ ID NO: 467915 - RNA, 32 nt, Human
ggucaacauggugaaacccugucucuccuaaa

SEQ ID NO: 467916 - RNA, 32 nt, Human
ggucaacauggugaaacccugucucugcuaaa

SEQ ID NO: 467917 - RNA, 32 nt, Human
ggucaacauggugaaaccuugucucuacuaaa

SEQ ID NO: 467918 - RNA, 32 nt, Human
ggucaacauggugaaacucugucucuacucaa

SEQ ID NO: 467919 - RNA, 32 nt, Human
ggucaacauggugaaacugugucucuacuaaa

SEQ ID NO: 467920 - RNA, 32 nt, Human
ggucaacauggugaaaucuugucucuaguaaa

SEQ ID NO: 467921 - RNA, 32 nt, Human
ggucaacaugguguaaccccaucucuacuaaa

SEQ ID NO: 467922 - RNA, 32 nt, Human
ggucaacccuguaauuccagcacuuugggagg

SEQ ID NO: 467923 - RNA, 32 nt, Human
ggucaacguggugaaaccccaucucuacuaaa

SEQ ID NO: 467924 - RNA, 32 nt, Human
ggucaacucccaggccucagaugcaggggccc

SEQ ID NO: 467925 - RNA, 24 nt, Human
ggucaacuccuuuguuuuccgccu

SEQ ID NO: 467926 - RNA, 32 nt, Human
ggucaacugaauuccccacuuccuggguaaga

SEQ ID NO: 467927 - RNA, 32 nt, Human
ggucaacugcggccucacagcugggccugucc

SEQ ID NO: 467928 - RNA, 32 nt, Human
ggucaagaaagcuggaguagagagggacugaa

SEQ ID NO: 467929 - RNA, 32 nt, Human
ggucaagaagugacgcaucucuggccugugag

SEQ ID NO: 467930 - RNA, 32 nt, Human
ggucaagacagaaaugucgcaugcuuggccga

SEQ ID NO: 467931 - RNA, 32 nt, Human
ggucaagaccagccuggccaacguggugaaac

SEQ ID NO: 467932 - RNA, 32 nt, Human
ggucaagagaucaagaccauccuggccaacau

SEQ ID NO: 467933 - RNA, 32 nt, Human
ggucaagagaucaagaccauucuggccaacau

SEQ ID NO: 467934 - RNA, 32 nt, Human
ggucaagagaucaagacuauccuggccaacau

SEQ ID NO: 467935 - RNA, 32 nt, Human
ggucaagauauucagugagaccagcuuaaaug

SEQ ID NO: 467936 - RNA, 32 nt, Human
ggucaagauggugaaaccccaucucuacuaaa

SEQ ID NO: 467937 - RNA, 32 nt, Human
ggucaagauggugaaacuccgucuguacuaaa

SEQ ID NO: 467938 - RNA, 32 nt, Human
ggucaagauucacacagccacccuuggagcug

SEQ ID NO: 467939 - RNA, 23 nt, Human
ggucaagcaauucuccugccuca

SEQ ID NO: 467940 - RNA, 32 nt, Human
ggucaagcaauucuccugccucagcuucccga

SEQ ID NO: 467941 - RNA, 32 nt, Human
ggucaagcagcagaaaggacagcuggauccau

SEQ ID NO: 467942 - RNA, 32 nt, Human
ggucaagcaguggcagacgcaaggcuuucugu

SEQ ID NO: 467943 - RNA, 23 nt, Human
ggucaagcaguugcuuggcggga

SEQ ID NO: 467944 - RNA, 32 nt, Human
ggucaagccagggcagucacagcugcuugggg

SEQ ID NO: 467945 - RNA, 32 nt, Human
ggucaagccggugggcugggcccgugggccgc

SEQ ID NO: 467946 - RNA, 32 nt, Human
ggucaagcgaagugccuggcauaccaugaugg

SEQ ID NO: 467947 - RNA, 32 nt, Human
ggucaagcugagacacagaggagucagggccu

SEQ ID NO: 467948 - RNA, 19 nt, Human
ggucaagcugucagacauc

SEQ ID NO: 467949 - RNA, 32 nt, Human
ggucaaggaacaggaagcugaccuggauggaa

SEQ ID NO: 467950 - RNA, 32 nt, Human
ggucaaggaacugagagaagaggcuuaagaaa

SEQ ID NO: 467951 - RNA, 32 nt, Human
ggucaaggcagaggaggagaggaggaaaggau

SEQ ID NO: 467952 - RNA, 19 nt, Human
ggucaaggcuuccccugag

SEQ ID NO: 467953 - RNA, 20 nt, Human
ggucaagggauccacacuca

SEQ ID NO: 467954 - RNA, 17 nt, Human
ggucaaggggcagcagg

SEQ ID NO: 467955 - RNA, 32 nt, Human
ggucaaggggugcagccaggagggcaggggga

SEQ ID NO: 467956 - RNA, 21 nt, Human
ggucaagguauccuccugaga

SEQ ID NO: 467957 - RNA, 32 nt, Human
ggucaaggugggcagaucaugaggucaggagu

SEQ ID NO: 467958 - RNA, 32 nt, Human
ggucaagucaugccuccaagaagggcuugacc

SEQ ID NO: 467959 - RNA, 21 nt, Human
ggucaaguccagguucaggga

SEQ ID NO: 467960 - RNA, 32 nt, Human
ggucaagucuguuugccuuagauuuugauguc

SEQ ID NO: 467961 - RNA, 32 nt, Human
ggucaagugagucugggaaacacuaugucugu

SEQ ID NO: 467962 - RNA, 32 nt, Human
ggucaagugauccucucaccucagccucccaa

SEQ ID NO: 467963 - RNA, 32 nt, Human
ggucaaguucucuccaccucucuaucuauguc

SEQ ID NO: 467964 - RNA, 32 nt, Human
ggucaaguucucucccgcucaggguagggcug

SEQ ID NO: 467965 - RNA, 25 nt, Human
ggucaaguuguuucuuauuugugag

SEQ ID NO: 467966 - RNA, 19 nt, Human
ggucaaguuugcccuuaga

SEQ ID NO: 467967 - RNA, 32 nt, Human
ggucaauaccagccugggcaacauaguaagac

SEQ ID NO: 467968 - RNA, 20 nt, Human
ggucaauaggcuuauauuua

SEQ ID NO: 467969 - RNA, 32 nt, Human
ggucaauauggugaaaccccaucucuacuaaa

SEQ ID NO: 467970 - RNA, 32 nt, Human
ggucaaucuauuucccccacccucucuccucc

SEQ ID NO: 467971 - RNA, 22 nt, Human
ggucaaucuccugaccuuguga

SEQ ID NO: 467972 - RNA, 32 nt, Human
ggucaaugagaaagaauggaagaugguaaaca

SEQ ID NO: 467973 - RNA, 21 nt, Human
ggucacaaacuccugaccuca

SEQ ID NO: 467974 - RNA, 32 nt, Human
ggucacaaagcgaggcccaaaggggcgcucuc

SEQ ID NO: 467975 - RNA, 32 nt, Human
ggucacaaggcuccgugcucaggcugggauuc

SEQ ID NO: 467976 - RNA, 32 nt, Human
ggucacaaguacagugucuucaaucuucauaa

SEQ ID NO: 467977 - RNA, 32 nt, Human
ggucacaagugacuggccaucccugggcugcu

SEQ ID NO: 467978 - RNA, 32 nt, Human
ggucacacagcaguagagcugggcuggggcag

SEQ ID NO: 467979 - RNA, 32 nt, Human
ggucacaccacugcacuccagccugggcaaua

SEQ ID NO: 467980 - RNA, 32 nt, Human
ggucacaccacugcacuccagccugggcuaca

SEQ ID NO: 467981 - RNA, 32 nt, Human
ggucacaccacuguauuccagccugggugaca

SEQ ID NO: 467982 - RNA, 32 nt, Human
ggucacaccauugcacuccaaccugggcgaca

SEQ ID NO: 467983 - RNA, 20 nt, Human
ggucacaccccugugugaua

SEQ ID NO: 467984 - RNA, 32 nt, Human
ggucacaccgcugcacuccagccugggcaaca

SEQ ID NO: 467985 - RNA, 32 nt, Human
ggucacaccuguaaucccagcacguugggagg

SEQ ID NO: 467986 - RNA, 32 nt, Human
ggucacaccuguaaucccagcacuuugggagg

SEQ ID NO: 467987 - RNA, 32 nt, Human
ggucacacugcagcucccagugccccaguguc

SEQ ID NO: 467988 - RNA, 21 nt, Human
ggucacagaaugccuuuuaaa

SEQ ID NO: 467989 - RNA, 32 nt, Human
ggucacagacagcuccagcaagagcaguuguu

SEQ ID NO: 467990 - RNA, 32 nt, Human
ggucacagagaggaauggcaagcccuggaaac

SEQ ID NO: 467991 - RNA, 31 nt, Human
ggucacagagcacagaauaccugggcgggug

SEQ ID NO: 467992 - RNA, 32 nt, Human
ggucacagagcaucauuuuaucacuucuggaa

SEQ ID NO: 467993 - RNA, 32 nt, Human
ggucacagaucuucccccgaccaugcugggaa

SEQ ID NO: 467994 - RNA, 20 nt, Human
ggucacagauguuuaccuca

SEQ ID NO: 467995 - RNA, 25 nt, Human
ggucacagcacaauguccacaucca

SEQ ID NO: 467996 - RNA, 23 nt, Human
ggucacagcagacaccugauaca

SEQ ID NO: 467997 - RNA, 32 nt, Human
ggucacagccucagggggccaggcugggggaa

SEQ ID NO: 467998 - RNA, 20 nt, Human
ggucacagccuccucugucu

SEQ ID NO: 467999 - RNA, 23 nt, Human
ggucacagccucgcucuccgcuu

SEQ ID NO: 468000 - RNA, 32 nt, Human
ggucacagcuacuaggaaugaggugauuucug

SEQ ID NO: 468001 - RNA, 32 nt, Human
ggucacagcuacucagaaggcugaggugggag

SEQ ID NO: 468002 - RNA, 32 nt, Human
ggucacagcuacuuggaaggcugagaugugaa

SEQ ID NO: 468003 - RNA, 32 nt, Human
ggucacagcucucauggcugcagcuagcguga

SEQ ID NO: 468004 - RNA, 32 nt, Human
ggucacaggaucagaaggcaagggauaggcag

SEQ ID NO: 468005 - RNA, 32 nt, Human
ggucacagggagggcucagaggagccugacuc

SEQ ID NO: 468006 - RNA, 32 nt, Human
ggucacagguucugggcucucaacugauauuu

SEQ ID NO: 468007 - RNA, 32 nt, Human
ggucacauccauggaaucagagcaagauuucc

SEQ ID NO: 468008 - RNA, 32 nt, Human
ggucacaucuguaaucucagcucuuuggaagg

SEQ ID NO: 468009 - RNA, 32 nt, Human
ggucacaugcccacugcagcccuccagccucu

SEQ ID NO: 468010 - RNA, 32 nt, Human
ggucacauggugccuagggaugcagggcugga

SEQ ID NO: 468011 - RNA, 32 nt, Human
ggucacauucucgagaacugugcucagccccc

SEQ ID NO: 468012 - RNA, 32 nt, Human
ggucacauuugcaggcugcgggcaguggcacc

SEQ ID NO: 468013 - RNA, 19 nt, Human
ggucacauuugcuuucaaa

SEQ ID NO: 468014 - RNA, 32 nt, Human
ggucacauuugcuuucaaaaagcuauuguccu

SEQ ID NO: 468015 - RNA, 32 nt, Human
ggucaccaaaaaugaaauaauaguuuaaaaca

SEQ ID NO: 468016 - RNA, 32 nt, Human
ggucaccaaacaggaaguggacauucuaaggg

SEQ ID NO: 468017 - RNA, 32 nt, Human
ggucaccaaaggcccuaugcaggcuucaaaau

SEQ ID NO: 468018 - RNA, 32 nt, Human
ggucaccaagaugcagcaggaaaucacuuuuc

SEQ ID NO: 468019 - RNA, 32 nt, Human
ggucaccacccccaccaugucccaggugaugu

SEQ ID NO: 468020 - RNA, 24 nt, Human
ggucaccagaaucgcccgaucaca

SEQ ID NO: 468021 - RNA, 32 nt, Human
ggucaccagacggggcuggagugugagggucc

SEQ ID NO: 468022 - RNA, 21 nt, Human
ggucaccagagccugaccaua

SEQ ID NO: 468023 - RNA, 32 nt, Human
ggucaccagagggaagagaacauggcauuaaa

SEQ ID NO: 468024 - RNA, 32 nt, Human
ggucaccagcagacacacugggcauggacccc

SEQ ID NO: 468025 - RNA, 32 nt, Human
ggucaccauggugggagcggaagacaauuuca

SEQ ID NO: 468026 - RNA, 22 nt, Human
ggucacccacagccuguguaua

SEQ ID NO: 468027 - RNA, 24 nt, Human
ggucacccagacgucacugugaua

SEQ ID NO: 468028 - RNA, 26 nt, Human
ggucacccccagguccccagggcucc

SEQ ID NO: 468029 - RNA, 32 nt, Human
ggucacccccuucccaucuacacgucccuccc

SEQ ID NO: 468030 - RNA, 20 nt, Human
ggucacccguugccagcucu

SEQ ID NO: 468031 - RNA, 32 nt, Human
ggucacccuccugguucugcccugucccauuc

SEQ ID NO: 468032 - RNA, 32 nt, Human
ggucacccugcucccucgugggucgccuucgc

SEQ ID NO: 468033 - RNA, 19 nt, Human
ggucacccuucaacgcucc

SEQ ID NO: 468034 - RNA, 19 nt, Human
ggucaccgcccaggguucc

SEQ ID NO: 468035 - RNA, 22 nt, Human
ggucaccgcggacaccugccgc

SEQ ID NO: 468036 - RNA, 24 nt, Human
ggucaccggaaucgcccgaucaca

SEQ ID NO: 468037 - RNA, 24 nt, Human
ggucaccggaaucgcccggucaca

SEQ ID NO: 468038 - RNA, 32 nt, Human
ggucaccuaagcugguccucacaggggccuuu

SEQ ID NO: 468039 - RNA, 32 nt, Human
ggucaccuaccacaaauugauggcuagagcaa

SEQ ID NO: 468040 - RNA, 23 nt, Human
ggucaccuaggggacugccucug

SEQ ID NO: 468041 - RNA, 32 nt, Human
ggucaccucaaagguaugcuaugccguguggc

SEQ ID NO: 468042 - RNA, 21 nt, Human
ggucaccucaggaagaggcag

SEQ ID NO: 468043 - RNA, 32 nt, Human
ggucaccuccccucgggcucugggcaacuguc

SEQ ID NO: 468044 - RNA, 23 nt, Human
ggucaccuccuugcgcuucuccu

SEQ ID NO: 468045 - RNA, 32 nt, Human
ggucaccucuggugcgcagcaagugcaaagcc

SEQ ID NO: 468046 - RNA, 32 nt, Human
ggucaccugcagcaguacguggccaccuauca

SEQ ID NO: 468047 - RNA, 32 nt, Human
ggucaccuggacucugcucccaggaagcugug

SEQ ID NO: 468048 - RNA, 32 nt, Human
ggucaccugggacuucagggaggcucagcuug

SEQ ID NO: 468049 - RNA, 32 nt, Human
ggucaccugggugucacacggcaaggcuacag

SEQ ID NO: 468050 - RNA, 32 nt, Human
ggucaccuguaacccaagcuacuugggagucu

SEQ ID NO: 468051 - RNA, 32 nt, Human
ggucaccuguagucccagcuacucgggaggcu

SEQ ID NO: 468052 - RNA, 32 nt, Human
ggucaccuguagucccagcugcucgggagggu

SEQ ID NO: 468053 - RNA, 32 nt, Human
ggucaccuguaguccuagcuacucaggaggcu

SEQ ID NO: 468054 - RNA, 18 nt, Human
ggucaccuuuguccuguu

SEQ ID NO: 468055 - RNA, 32 nt, Human
ggucaccuuuugucucuuccuuccuaggcucu

SEQ ID NO: 468056 - RNA, 21 nt, Human
ggucacgaacuccugaccuca

SEQ ID NO: 468057 - RNA, 32 nt, Human
ggucacgacuucccuccugccugcagccuggg

SEQ ID NO: 468058 - RNA, 32 nt, Human
ggucacgagguuccccucccaccucugucaca

SEQ ID NO: 468059 - RNA, 21 nt, Human
ggucacgagucauuucugccu

SEQ ID NO: 468060 - RNA, 32 nt, Human
ggucacgcaccaguuugggccugagauaaaac

SEQ ID NO: 468061 - RNA, 32 nt, Human
ggucacgccugccuccacaucucuguuucuuc

SEQ ID NO: 468062 - RNA, 32 nt, Human
ggucacgccuguaaucccagcacuuugggagg

SEQ ID NO: 468063 - RNA, 20 nt, Human
ggucacggcggccgcgcuca

SEQ ID NO: 468064 - RNA, 32 nt, Human
ggucacggugacccaugcugcccagccuggag

SEQ ID NO: 468065 - RNA, 23 nt, Human
ggucacgguggcucacgccugua

SEQ ID NO: 468066 - RNA, 32 nt, Human
ggucacgucacugcacucuagccugggcaaca

SEQ ID NO: 468067 - RNA, 32 nt, Human
ggucacgucuuucuccuucuccuuccuccuuc

SEQ ID NO: 468068 - RNA, 32 nt, Human
ggucacgugacacggagggggccgaauucugc

SEQ ID NO: 468069 - RNA, 23 nt, Human
ggucacgugggcagcuucugccu

SEQ ID NO: 468070 - RNA, 32 nt, Human
ggucacuaauuaucucaaaauauuucauacua

SEQ ID NO: 468071 - RNA, 32 nt, Human
ggucacuacagccugauugguccuccagguca

SEQ ID NO: 468072 - RNA, 32 nt, Human
ggucacuacaggaugguggagcagggggcauc

SEQ ID NO: 468073 - RNA, 32 nt, Human
ggucacuacagucucagauuccugggcuuaag

SEQ ID NO: 468074 - RNA, 32 nt, Human
ggucacuacugagagcugccuccuggaagcuu

SEQ ID NO: 468075 - RNA, 32 nt, Human
ggucacuagggaggguacaggccugugugcca

SEQ ID NO: 468076 - RNA, 32 nt, Human
ggucacuagucuauagaagaugacacagaaau

SEQ ID NO: 468077 - RNA, 32 nt, Human
ggucacuauuucuuccucugcuuggugaauug

SEQ ID NO: 468078 - RNA, 31 nt, Human
ggucacucaauaaaugugcuggaguaacaca

SEQ ID NO: 468079 - RNA, 32 nt, Human
ggucacucaccacuccccuggucuccaucugg

SEQ ID NO: 468080 - RNA, 32 nt, Human
ggucacucagcuuggaugcuauggaacaggga

SEQ ID NO: 468081 - RNA, 24 nt, Human
ggucacuccaccauccccacccca

SEQ ID NO: 468082 - RNA, 20 nt, Human
ggucacucccccacaccugc

SEQ ID NO: 468083 - RNA, 24 nt, Human
ggucacucuccccaaaauauuaua

SEQ ID NO: 468084 - RNA, 32 nt, Human
ggucacucucccuggcacaccuuccaggcugg

SEQ ID NO: 468085 - RNA, 32 nt, Human
ggucacucugugggucauuugcagccauuuuu

SEQ ID NO: 468086 - RNA, 32 nt, Human
ggucacugagaggcugccagagggccauuuuc

SEQ ID NO: 468087 - RNA, 19 nt, Human
ggucacugauucacaccca

SEQ ID NO: 468088 - RNA, 32 nt, Human
ggucacugcaaccuccaccucccggguucaag

SEQ ID NO: 468089 - RNA, 22 nt, Human
ggucacugcaaccuccgccucc

SEQ ID NO: 468090 - RNA, 23 nt, Human
ggucacugcaaccucugccuccu

SEQ ID NO: 468091 - RNA, 32 nt, Human
ggucacugcaaccucugccuccuggguucaaa

SEQ ID NO: 468092 - RNA, 32 nt, Human
ggucacugcaaccucugccuccuggguucaag

SEQ ID NO: 468093 - RNA, 32 nt, Human
ggucacugcacgcaccuggccuccauggacga

SEQ ID NO: 468094 - RNA, 32 nt, Human
ggucacugcacuaccacccaccucuggaagac

SEQ ID NO: 468095 - RNA, 32 nt, Human
ggucacugcacuccagccuggcuacagaguga

SEQ ID NO: 468096 - RNA, 32 nt, Human
ggucacugcagcccugaccuccugggcucaag

SEQ ID NO: 468097 - RNA, 20 nt, Human
ggucacugccccuccugcca

SEQ ID NO: 468098 - RNA, 32 nt, Human
ggucacugccuaacucauucucuguuaucagu

SEQ ID NO: 468099 - RNA, 32 nt, Human
ggucacugcggccuugauuucccaggcucaag

SEQ ID NO: 468100 - RNA, 32 nt, Human
ggucacugcucucccagcccugccugggccua

SEQ ID NO: 468101 - RNA, 32 nt, Human
ggucacugcugggccugcuaggagcccacacg

SEQ ID NO: 468102 - RNA, 22 nt, Human
ggucacuggagucuccucccca

SEQ ID NO: 468103 - RNA, 32 nt, Human
ggucacuggcaggacauccgcgucuguggccc

SEQ ID NO: 468104 - RNA, 32 nt, Human
ggucacuggcauuccagaagacagcgugccgg

SEQ ID NO: 468105 - RNA, 32 nt, Human
ggucacugggccuggccacuucugucccucug

SEQ ID NO: 468106 - RNA, 32 nt, Human
ggucacuuaaaaugugcaguaauagcacugcc

SEQ ID NO: 468107 - RNA, 32 nt, Human
ggucacuucaugcugauuagaaugacaucucu

SEQ ID NO: 468108 - RNA, 18 nt, Human
ggucacuucgcacaccca

SEQ ID NO: 468109 - RNA, 32 nt, Human
ggucacuuucugacuccagccuugccagccug

SEQ ID NO: 468110 - RNA, 32 nt, Human
ggucacuuuucuuuccugccuucugcugugag

SEQ ID NO: 468111 - RNA, 32 nt, Human
ggucagaaaauauuaagcaaguagaagugugg

SEQ ID NO: 468112 - RNA, 32 nt, Human
ggucagaagacaugccuggagggaugucuggc

SEQ ID NO: 468113 - RNA, 32 nt, Human
ggucagaagaucaagaccauccuggccaacau

SEQ ID NO: 468114 - RNA, 32 nt, Human
ggucagaaguaccaggugccccaugaagugcu

SEQ ID NO: 468115 - RNA, 32 nt, Human
ggucagaaguucaagacuagccuggucaacau

SEQ ID NO: 468116 - RNA, 32 nt, Human
ggucagaaguuugaaaccagccuggacuacau

SEQ ID NO: 468117 - RNA, 32 nt, Human
ggucagaaugauuuguuuuauucauugacuuu

SEQ ID NO: 468118 - RNA, 32 nt, Human
ggucagacucugaagccgaguugcugugggcg

SEQ ID NO: 468119 - RNA, 32 nt, Human
ggucagacuggaggugggggcagcagcuccca

SEQ ID NO: 468120 - RNA, 32 nt, Human
ggucagacuugaccauucaccuccaguaccug

SEQ ID NO: 468121 - RNA, 32 nt, Human
ggucagagaacacgaggcuugccaccaucuug

SEQ ID NO: 468122 - RNA, 32 nt, Human
ggucagagaagaggaaaagagacucagagaaa

SEQ ID NO: 468123 - RNA, 32 nt, Human
ggucagagacacccaguggcccaggugggcgu

SEQ ID NO: 468124 - RNA, 32 nt, Human
ggucagagagaagggagaggccuccuucugag

SEQ ID NO: 468125 - RNA, 32 nt, Human
ggucagagaggaagaaacaaaggcagcugugg

SEQ ID NO: 468126 - RNA, 32 nt, Human
ggucagagagguuucuguggacugcagaugag

SEQ ID NO: 468127 - RNA, 32 nt, Human
ggucagagaguaaauggagcagaggaacaggu

SEQ ID NO: 468128 - RNA, 32 nt, Human
ggucagagcaagcaucuuccugacagcauuuu

SEQ ID NO: 468129 - RNA, 32 nt, Human
ggucagagcccaugggcgguucugggacaugg

SEQ ID NO: 468130 - RNA, 32 nt, Human
ggucagagcgaagugacagucaguaucgugua

SEQ ID NO: 468131 - RNA, 32 nt, Human
ggucagagcugcugcugaagcucucuuaacug

SEQ ID NO: 468132 - RNA, 25 nt, Human
ggucagaggagaugggggccggcuu

SEQ ID NO: 468133 - RNA, 32 nt, Human
ggucagaggauuucuuuauggcuaucuguuuu

SEQ ID NO: 468134 - RNA, 32 nt, Human
ggucagaggcagcuuccagccugggggcuggu

SEQ ID NO: 468135 - RNA, 32 nt, Human
ggucagagguccagccucuauacccgugcccc

SEQ ID NO: 468136 - RNA, 19 nt, Human
ggucagagguggagcaggu

SEQ ID NO: 468137 - RNA, 32 nt, Human
ggucagauaagcagcuacagcugcaguuuggu

SEQ ID NO: 468138 - RNA, 32 nt, Human
ggucagauaguggccagcaggccagguacuga

SEQ ID NO: 468139 - RNA, 19 nt, Human
ggucagauucggcggcagg

SEQ ID NO: 468140 - RNA, 32 nt, Human
ggucagauuugaaaagaacagaaggacugaag

SEQ ID NO: 468141 - RNA, 21 nt, Human
ggucagcaaaggggugggguu

SEQ ID NO: 468142 - RNA, 32 nt, Human
ggucagcaaauggugccagcucuggcucauga

SEQ ID NO: 468143 - RNA, 32 nt, Human
ggucagcaacucccgaagauugcccagcaagu

SEQ ID NO: 468144 - RNA, 26 nt, Human
ggucagcaaggagagggggugggguu

SEQ ID NO: 468145 - RNA, 32 nt, Human
ggucagcacaaaccgauucuguuccucuuuaa

SEQ ID NO: 468146 - RNA, 32 nt, Human
ggucagcacggaagcuccaccuucugggugga

SEQ ID NO: 468147 - RNA, 32 nt, Human
ggucagcagcagagagagcaacgggaaggaca

SEQ ID NO: 468148 - RNA, 32 nt, Human
ggucagcagggcggagcggcuuuuccaggaga

SEQ ID NO: 468149 - RNA, 32 nt, Human
ggucagcaggugccgaacccacggccaggcuu

SEQ ID NO: 468150 - RNA, 32 nt, Human
ggucagcagugcccccagccccacccaagagg

SEQ ID NO: 468151 - RNA, 32 nt, Human
ggucagcaucuccagccaccuggcuuugcugg

SEQ ID NO: 468152 - RNA, 31 nt, Human
ggucagcaucuuuucugucaucaggaagucu

SEQ ID NO: 468153 - RNA, 32 nt, Human
ggucagcaucuuuucugucaucaggaagucuc

SEQ ID NO: 468154 - RNA, 32 nt, Human
ggucagcauggugaaacgccaucccuacuaag

SEQ ID NO: 468155 - RNA, 32 nt, Human
ggucagccacugcagccuccugagauauuuuu

SEQ ID NO: 468156 - RNA, 32 nt, Human
ggucagccagagcucuggaaugcacugcuugc

SEQ ID NO: 468157 - RNA, 19 nt, Human
ggucagccauucacaccca

SEQ ID NO: 468158 - RNA, 23 nt, Human
ggucagcccacucccagggcccc

SEQ ID NO: 468159 - RNA, 32 nt, Human
ggucagcccaggaauuggcagaggaaguaggu

SEQ ID NO: 468160 - RNA, 32 nt, Human
ggucagcccaugcaccugcccugggugaggaa

SEQ ID NO: 468161 - RNA, 23 nt, Human
ggucagccccagugaucugcuuc

SEQ ID NO: 468162 - RNA, 32 nt, Human
ggucagcccuaguggcugccugcacacuguag

SEQ ID NO: 468163 - RNA, 19 nt, Human
ggucagcccuccauaucca

SEQ ID NO: 468164 - RNA, 20 nt, Human
ggucagcccuucucuucccu

SEQ ID NO: 468165 - RNA, 32 nt, Human
ggucagccucacugccugcuuauugccucuuu

SEQ ID NO: 468166 - RNA, 16 nt, Human
ggucagccucccagca

SEQ ID NO: 468167 - RNA, 32 nt, Human
ggucagccuccccuccaccacuuccuucccug

SEQ ID NO: 468168 - RNA, 23 nt, Human
ggucagccucucucacacaagga

SEQ ID NO: 468169 - RNA, 20 nt, Human
ggucagccucuucacaccca

SEQ ID NO: 468170 - RNA, 32 nt, Human
ggucagccuggcuccugagacgcccaggcccg

SEQ ID NO: 468171 - RNA, 32 nt, Human
ggucagccuguccccaaggagaucuugugucu

SEQ ID NO: 468172 - RNA, 20 nt, Human
ggucagccuucccuguucuc

SEQ ID NO: 468173 - RNA, 32 nt, Human
ggucagcgugagccccuagccucacaccggcu

SEQ ID NO: 468174 - RNA, 32 nt, Human
ggucagcgugagccccuugccucacaccggcc

SEQ ID NO: 468175 - RNA, 32 nt, Human
ggucagcgugagccccuugccucaccccggcc

SEQ ID NO: 468176 - RNA, 32 nt, Human
ggucagcucccaggucggucgugcugggccag

SEQ ID NO: 468177 - RNA, 32 nt, Human
ggucagcucuucuguggauugcauggcgugug

SEQ ID NO: 468178 - RNA, 32 nt, Human
ggucagcucuuucugccaccuccgccuucgcg

SEQ ID NO: 468179 - RNA, 32 nt, Human
ggucagcugcccacagcccucuugccugaccc

SEQ ID NO: 468180 - RNA, 18 nt, Human
ggucagcugccuuuccug

SEQ ID NO: 468181 - RNA, 32 nt, Human
ggucagcugucugcuuuccuugcucagcacgg

SEQ ID NO: 468182 - RNA, 20 nt, Human
ggucagcuucuuuuaccuca

SEQ ID NO: 468183 - RNA, 32 nt, Human
ggucaggaaacagcuggaauccacacucaccu

SEQ ID NO: 468184 - RNA, 32 nt, Human
ggucaggacacuuggucuccuucucuuugguc

SEQ ID NO: 468185 - RNA, 32 nt, Human
ggucaggagagggagcaagaggaguuuuuagu

SEQ ID NO: 468186 - RNA, 32 nt, Human
ggucaggagaggggcagaacagccgcuccugu

SEQ ID NO: 468187 - RNA, 32 nt, Human
ggucaggagaucaagaccacccuggcuaacac

SEQ ID NO: 468188 - RNA, 32 nt, Human
ggucaggagaucaagaccauccuggccaacau

SEQ ID NO: 468189 - RNA, 32 nt, Human
ggucaggagaucaagaccauccuggcuaacaa

SEQ ID NO: 468190 - RNA, 32 nt, Human
ggucaggagaucaagaccauccuggcuaacac

SEQ ID NO: 468191 - RNA, 32 nt, Human
ggucaggagaucaagaccauccuggcuaacau

SEQ ID NO: 468192 - RNA, 32 nt, Human
ggucaggagaucaagaccauccuggcuaaugc

SEQ ID NO: 468193 - RNA, 32 nt, Human
ggucaggagaucaagaccauccuggcuauggu

SEQ ID NO: 468194 - RNA, 32 nt, Human
ggucaggagaucaagaccaucuuggcuaacac

SEQ ID NO: 468195 - RNA, 32 nt, Human
ggucaggagaucaagaccauucuggccaacau

SEQ ID NO: 468196 - RNA, 32 nt, Human
ggucaggagaucaagacuauccuggcuaacac

SEQ ID NO: 468197 - RNA, 32 nt, Human
ggucaggagaucgagaccguccuggccgacau

SEQ ID NO: 468198 - RNA, 32 nt, Human
ggucaggagcuguagagauggagcucaagcac

SEQ ID NO: 468199 - RNA, 32 nt, Human
ggucaggaggcaauuugccugccuuguacaaa

SEQ ID NO: 468200 - RNA, 31 nt, Human
ggucaggaguuccagaccagcccagccaaca

SEQ ID NO: 468201 - RNA, 32 nt, Human
ggucaggaguucgagaccauccuggccaacau

SEQ ID NO: 468202 - RNA, 32 nt, Human
ggucaggaguucgagagcauccuggccaacgu

SEQ ID NO: 468203 - RNA, 32 nt, Human
ggucaggaguucgggaccauccuggccaacau

SEQ ID NO: 468204 - RNA, 32 nt, Human
ggucaggaguuugagaccagccuggacaacau

SEQ ID NO: 468205 - RNA, 32 nt, Human
ggucaggaguuugagaucagccuggacaacag

SEQ ID NO: 468206 - RNA, 32 nt, Human
ggucaggaugagaauuccaaacacacugccag

SEQ ID NO: 468207 - RNA, 32 nt, Human
ggucaggauguaagugagagaccuugggacca

SEQ ID NO: 468208 - RNA, 32 nt, Human
ggucaggauugaaagagaaauauuucaacacc

SEQ ID NO: 468209 - RNA, 32 nt, Human
ggucaggcagggugcaguaucaugcccugugc

SEQ ID NO: 468210 - RNA, 32 nt, Human
ggucaggcauuauuauuacuaaccuuauuguu

SEQ ID NO: 468211 - RNA, 24 nt, Human
ggucaggccaaggcagguggauca

SEQ ID NO: 468212 - RNA, 21 nt, Human
ggucaggccaaggcccgggga

SEQ ID NO: 468213 - RNA, 32 nt, Human
ggucaggccauucuguugcccaccucgugcug

SEQ ID NO: 468214 - RNA, 21 nt, Human
ggucaggcccccacagcaggu

SEQ ID NO: 468215 - RNA, 32 nt, Human
ggucaggcgccugggaaggggccuuugguggc

SEQ ID NO: 468216 - RNA, 32 nt, Human
ggucaggcuagucuugaacuccugggcccaag

SEQ ID NO: 468217 - RNA, 24 nt, Human
ggucaggcucugauaccugcuuuu

SEQ ID NO: 468218 - RNA, 32 nt, Human
ggucaggcucuuaccuccaccuccagggcaca

SEQ ID NO: 468219 - RNA, 18 nt, Human
ggucaggcuguccacacc

SEQ ID NO: 468220 - RNA, 32 nt, Human
ggucagggaagguuugggaggaugcugaggcc

SEQ ID NO: 468221 - RNA, 22 nt, Human
ggucagggaccaccagcauggu

SEQ ID NO: 468222 - RNA, 21 nt, Human
ggucagggagacgcccccagg

SEQ ID NO: 468223 - RNA, 23 nt, Human
ggucagggagggaugcucaggga

SEQ ID NO: 468224 - RNA, 23 nt, Human
ggucagggccaggacaccugaga

SEQ ID NO: 468225 - RNA, 32 nt, Human
ggucagggcucaauaaggauuugcugaaugaa

SEQ ID NO: 468226 - RNA, 23 nt, Human
ggucagggcugggacccccagga

SEQ ID NO: 468227 - RNA, 32 nt, Human
ggucaggggagaaggaaaagaggucaacauga

SEQ ID NO: 468228 - RNA, 20 nt, Human
ggucaggggcuucccuaaga

SEQ ID NO: 468229 - RNA, 32 nt, Human
ggucaggggugaggggaccaggaagagaaagu

SEQ ID NO: 468230 - RNA, 32 nt, Human
ggucaggguggagguccugggugggcuaaggc

SEQ ID NO: 468231 - RNA, 20 nt, Human
ggucaggguguccauuccua

SEQ ID NO: 468232 - RNA, 32 nt, Human
ggucaggugagcugucuaggagagggacagag

SEQ ID NO: 468233 - RNA, 32 nt, Human
ggucagguguuuccguaccacagcaggagcag

SEQ ID NO: 468234 - RNA, 19 nt, Human
ggucagguugacaggaggu

SEQ ID NO: 468235 - RNA, 32 nt, Human
ggucaguacugcaggcugccucaccuugguga

SEQ ID NO: 468236 - RNA, 25 nt, Human
ggucaguaguuucauguuuuaggga

SEQ ID NO: 468237 - RNA, 32 nt, Human
ggucagucagcagcuuacaugaucucauugac

SEQ ID NO: 468238 - RNA, 32 nt, Human
ggucagucucagauggaagcugggccugggug

SEQ ID NO: 468239 - RNA, 32 nt, Human
ggucagucuccgugcaggaugugagcagcguc

SEQ ID NO: 468240 - RNA, 21 nt, Human
ggucagucuucaccacagaga

SEQ ID NO: 468241 - RNA, 32 nt, Human
ggucagugacgacgcauuuccucccaguacag

SEQ ID NO: 468242 - RNA, 32 nt, Human
ggucagugacggccuggacgggccaaggagac

SEQ ID NO: 468243 - RNA, 32 nt, Human
ggucagugacucgccugugauguggcccacaa

SEQ ID NO: 468244 - RNA, 32 nt, Human
ggucaguggagaugggugaggagcagcacaga

SEQ ID NO: 468245 - RNA, 32 nt, Human
ggucagugggcagcaacuuaagacugaccucg

SEQ ID NO: 468246 - RNA, 31 nt, Human
ggucagugggggagcuugcuucugagccccc

SEQ ID NO: 468247 - RNA, 19 nt, Human
ggucagugggucagaagga

SEQ ID NO: 468248 - RNA, 32 nt, Human
ggucaguggguggcagggggcuggcaaugagc

SEQ ID NO: 468249 - RNA, 18 nt, Human
ggucagugguccacaucc

SEQ ID NO: 468250 - RNA, 32 nt, Human
ggucagugucccacccuucacuucccgagggc

SEQ ID NO: 468251 - RNA, 32 nt, Human
ggucagugugcaaagaaaagaacugcuugcau

SEQ ID NO: 468252 - RNA, 23 nt, Human
ggucaguguggcgggcucagggg

SEQ ID NO: 468253 - RNA, 16 nt, Human
ggucaguucaggggga

SEQ ID NO: 468254 - RNA, 32 nt, Human
ggucaguucccagaggagaguggggugggucu

SEQ ID NO: 468255 - RNA, 32 nt, Human
ggucaguuuccaagccuuuccagauggacuuc

SEQ ID NO: 468256 - RNA, 32 nt, Human
ggucaguuuucugugcaaacaaaccuguuuag

SEQ ID NO: 468257 - RNA, 32 nt, Human
ggucaguuuugugguuucugcuuucuugccua

SEQ ID NO: 468258 - RNA, 23 nt, Human
ggucauaaauguguucauaccca

SEQ ID NO: 468259 - RNA, 22 nt, Human
ggucauaacagugccuguuucu

SEQ ID NO: 468260 - RNA, 19 nt, Human
ggucauaaguuucuaccca

SEQ ID NO: 468261 - RNA, 32 nt, Human
ggucauaaucaugccacuguacuccagccugg

SEQ ID NO: 468262 - RNA, 23 nt, Human
ggucauaccaacucuggauccuc

SEQ ID NO: 468263 - RNA, 32 nt, Human
ggucauaccacagccuucaucugcgcccuggg

SEQ ID NO: 468264 - RNA, 32 nt, Human
ggucauaccaccgcacuccagccugagcaaca

SEQ ID NO: 468265 - RNA, 32 nt, Human
ggucauaccagugcacuccaggcgggugacag

SEQ ID NO: 468266 - RNA, 20 nt, Human
ggucauagacaauuccucca

SEQ ID NO: 468267 - RNA, 19 nt, Human
ggucauagacccauuuuca

SEQ ID NO: 468268 - RNA, 21 nt, Human
ggucauagagucagggaucua

SEQ ID NO: 468269 - RNA, 18 nt, Human
ggucauagaguccucuca

SEQ ID NO: 468270 - RNA, 32 nt, Human
ggucauagaucugguucuggaggacagaaguu

SEQ ID NO: 468271 - RNA, 18 nt, Human
ggucauagcacccacuca

SEQ ID NO: 468272 - RNA, 18 nt, Human
ggucauagccgugaucca

SEQ ID NO: 468273 - RNA, 32 nt, Human
ggucauagccucuuugcuauucuauuggagua

SEQ ID NO: 468274 - RNA, 20 nt, Human
ggucauaggagucaugucca

SEQ ID NO: 468275 - RNA, 20 nt, Human
ggucauaggauaucuacacc

SEQ ID NO: 468276 - RNA, 21 nt, Human
ggucauaggcucuagucaccu

SEQ ID NO: 468277 - RNA, 19 nt, Human
ggucauaggggccugccca

SEQ ID NO: 468278 - RNA, 23 nt, Human
ggucauaugacggacugcauuca

SEQ ID NO: 468279 - RNA, 32 nt, Human
ggucauaugagguccuaaugaaguacuacagu

SEQ ID NO: 468280 - RNA, 32 nt, Human
ggucauaugcggggguaugauccugcuuaauu

SEQ ID NO: 468281 - RNA, 19 nt, Human
ggucaucaaacacauacaa

SEQ ID NO: 468282 - RNA, 32 nt, Human
ggucaucaaacacucuuuucuccucaucaguc

SEQ ID NO: 468283 - RNA, 32 nt, Human
ggucaucaacuugcaauaccucacagagccag

SEQ ID NO: 468284 - RNA, 32 nt, Human
ggucaucaauaugaccaagcucauauccuuac

SEQ ID NO: 468285 - RNA, 18 nt, Human
ggucaucacucuacaccc

SEQ ID NO: 468286 - RNA, 32 nt, Human
ggucaucacugccaugguccggagcggcccug

SEQ ID NO: 468287 - RNA, 32 nt, Human
ggucaucagaugcuuauugcacccucaccaug

SEQ ID NO: 468288 - RNA, 32 nt, Human
ggucaucagcaguggagaacugugggagcugg

SEQ ID NO: 468289 - RNA, 32 nt, Human
ggucaucagcaugucccagucacugcagcaac

SEQ ID NO: 468290 - RNA, 32 nt, Human
ggucaucagcccagggcuucagucuuccuuua

SEQ ID NO: 468291 - RNA, 32 nt, Human
ggucaucaucccuacccacacacagauggcca

SEQ ID NO: 468292 - RNA, 17 nt, Human
ggucauccagagcagua

SEQ ID NO: 468293 - RNA, 32 nt, Human
ggucauccagcaccagaaugcgcaccucacac

SEQ ID NO: 468294 - RNA, 18 nt, Human
ggucaucccucuugcccu

SEQ ID NO: 468295 - RNA, 19 nt, Human
ggucauccgcgccgcacuc

SEQ ID NO: 468296 - RNA, 32 nt, Human
ggucauccucuccuauacuagggccuauugac

SEQ ID NO: 468297 - RNA, 32 nt, Human
ggucaucguccucagucccugccugcaacuag

SEQ ID NO: 468298 - RNA, 32 nt, Human
ggucaucuccugggcucuuccugcugcugcuc

SEQ ID NO: 468299 - RNA, 32 nt, Human
ggucaucucuccuuaaggaaucauggaccauu

SEQ ID NO: 468300 - RNA, 32 nt, Human
ggucaucucuguucuuaucagggcacuaaucc

SEQ ID NO: 468301 - RNA, 19 nt, Human
ggucaucugaacacaucca

SEQ ID NO: 468302 - RNA, 32 nt, Human
ggucaucugcagaggacagagagaugguaagc

SEQ ID NO: 468303 - RNA, 32 nt, Human
ggucaucugcagcucuggcccagucauagaua

SEQ ID NO: 468304 - RNA, 32 nt, Human
ggucaucugcuccagccuguccucucgucagc

SEQ ID NO: 468305 - RNA, 32 nt, Human
ggucaucugcuuguuuggugacuuagauauac

SEQ ID NO: 468306 - RNA, 16 nt, Human
ggucaugaacuauggg

SEQ ID NO: 468307 - RNA, 32 nt, Human
ggucaugaaggagaagggcaagagauccucug

SEQ ID NO: 468308 - RNA, 32 nt, Human
ggucaugacauacugaagcuccagccaggggg

SEQ ID NO: 468309 - RNA, 32 nt, Human
ggucaugaccauggugugggugcagugacugc

SEQ ID NO: 468310 - RNA, 32 nt, Human
ggucaugaggcuggggcccaggagacacgguc

SEQ ID NO: 468311 - RNA, 32 nt, Human
ggucaugauagggagagcaggcagcugggucc

SEQ ID NO: 468312 - RNA, 20 nt, Human
ggucaugauggugcacaccu

SEQ ID NO: 468313 - RNA, 18 nt, Human
ggucaugauuuccacauc

SEQ ID NO: 468314 - RNA, 32 nt, Human
ggucaugccacugcacuccagccuggccuggg

SEQ ID NO: 468315 - RNA, 32 nt, Human
ggucaugccacugcacuccagccugggagaca

SEQ ID NO: 468316 - RNA, 32 nt, Human
ggucaugccacugcacuccagccugggcaaca

SEQ ID NO: 468317 - RNA, 32 nt, Human
ggucaugccacugcacuccagccugggugaca

SEQ ID NO: 468318 - RNA, 32 nt, Human
ggucaugccacugcacucuagccugggugaca

SEQ ID NO: 468319 - RNA, 32 nt, Human
ggucaugccacugcacugcagccugggcgaca

SEQ ID NO: 468320 - RNA, 32 nt, Human
ggucaugccauuguacuccagccugggcaaca

SEQ ID NO: 468321 - RNA, 32 nt, Human
ggucaugccuguaaucccagcauuuuggaagg

SEQ ID NO: 468322 - RNA, 18 nt, Human
ggucaugcuaccuaccca

SEQ ID NO: 468323 - RNA, 20 nt, Human
ggucauggaauucucaucca

SEQ ID NO: 468324 - RNA, 19 nt, Human
ggucauggaccuuacaucc

SEQ ID NO: 468325 - RNA, 21 nt, Human
ggucauggacguggucagcca

SEQ ID NO: 468326 - RNA, 24 nt, Human
ggucauggacugggucguggcuca

SEQ ID NO: 468327 - RNA, 29 nt, Human
ggucauggauccugaacaaagugucaagg

SEQ ID NO: 468328 - RNA, 18 nt, Human
ggucauggcaaaacccca

SEQ ID NO: 468329 - RNA, 32 nt, Human
ggucauggcacacaccugugcccagacgccaa

SEQ ID NO: 468330 - RNA, 19 nt, Human
ggucauggcagccacaccu

SEQ ID NO: 468331 - RNA, 32 nt, Human
ggucauggccuaccucuucaccaucaucaaca

SEQ ID NO: 468332 - RNA, 32 nt, Human
ggucauggcugcagagagccaugaucaugcca

SEQ ID NO: 468333 - RNA, 32 nt, Human
ggucauggcuuaugccuguaaucccagcaugc

SEQ ID NO: 468334 - RNA, 22 nt, Human
ggucaugggccaugccauaccc

SEQ ID NO: 468335 - RNA, 32 nt, Human
ggucaugggggaagaauguaggguuguggcac

SEQ ID NO: 468336 - RNA, 32 nt, Human
ggucauggucagcccuguagcagacaccucgg

SEQ ID NO: 468337 - RNA, 21 nt, Human
ggucaugguggcacgcgccua

SEQ ID NO: 468338 - RNA, 23 nt, Human
ggucaugguggcucacgccugua

SEQ ID NO: 468339 - RNA, 21 nt, Human
ggucaugguggcucaugccua

SEQ ID NO: 468340 - RNA, 23 nt, Human
ggucaugguggcucaugccugua

SEQ ID NO: 468341 - RNA, 18 nt, Human
ggucauggugucaccccc

SEQ ID NO: 468342 - RNA, 32 nt, Human
ggucaugguucauuucgaguuccaaugcuauu

SEQ ID NO: 468343 - RNA, 18 nt, Human
ggucaugguucuacuuca

SEQ ID NO: 468344 - RNA, 32 nt, Human
ggucaugucuguaaucccagcaauuuggaggc

SEQ ID NO: 468345 - RNA, 32 nt, Human
ggucaugugggucuugcugggcucuguggagc

SEQ ID NO: 468346 - RNA, 32 nt, Human
ggucauguguucaccaucacugaggcacugug

SEQ ID NO: 468347 - RNA, 32 nt, Human
ggucauguugccagccauguugcccaggcugg

SEQ ID NO: 468348 - RNA, 32 nt, Human
ggucauguuguugccacccugugugacuuuug

SEQ ID NO: 468349 - RNA, 32 nt, Human
ggucauguuuaccucuccauuugggagccugc

SEQ ID NO: 468350 - RNA, 32 nt, Human
ggucauguuuuuauuuggcaagauugugguuu

SEQ ID NO: 468351 - RNA, 32 nt, Human
ggucauuaaauacuauuugucuccuuuucugg

SEQ ID NO: 468352 - RNA, 32 nt, Human
ggucauuaagaaggaaggaaugugaggaagaa

SEQ ID NO: 468353 - RNA, 20 nt, Human
ggucauuaaggccacaucca

SEQ ID NO: 468354 - RNA, 32 nt, Human
ggucauuauuuaugcuuugagaguuucaauau

SEQ ID NO: 468355 - RNA, 32 nt, Human
ggucauuccugccucuuggcaccagguugggg

SEQ ID NO: 468356 - RNA, 24 nt, Human
ggucauucuguggauuccgcaccu

SEQ ID NO: 468357 - RNA, 32 nt, Human
ggucauucuuccagccuccaugucaccacgug

SEQ ID NO: 468358 - RNA, 32 nt, Human
ggucauugcacucaagccugggcaauaagaag

SEQ ID NO: 468359 - RNA, 32 nt, Human
ggucauuggcugcucuacucuguccccuaccu

SEQ ID NO: 468360 - RNA, 32 nt, Human
ggucauugggcugagggugagcucagggcagg

SEQ ID NO: 468361 - RNA, 32 nt, Human
ggucauugucuccccuccagcucuacucacag

SEQ ID NO: 468362 - RNA, 20 nt, Human
ggucauugugcccauaucca

SEQ ID NO: 468363 - RNA, 32 nt, Human
ggucauugugguugccuuuccuuuccucaugu

SEQ ID NO: 468364 - RNA, 32 nt, Human
ggucauuuaaagggacuugaggaagcuaccca

SEQ ID NO: 468365 - RNA, 32 nt, Human
ggucauuuauuaauuuucacuaauccauauau

SEQ ID NO: 468366 - RNA, 32 nt, Human
ggucauuucauucauuuaucacacaugggcac

SEQ ID NO: 468367 - RNA, 32 nt, Human
ggucauuucgucgcugggaagggacggcccuc

SEQ ID NO: 468368 - RNA, 32 nt, Human
ggucauuucuguccuucaaguuuggccaacua

SEQ ID NO: 468369 - RNA, 27 nt, Human
ggucauuugccagguuuccugacucca

SEQ ID NO: 468370 - RNA, 32 nt, Human
ggucauuugccuccuccgcccugcuucccggu

SEQ ID NO: 468371 - RNA, 32 nt, Human
ggucauuuucccucucagcccugagagaagca

SEQ ID NO: 468372 - RNA, 32 nt, Human
ggucauuuucuccuucuuucucccucuugagu

SEQ ID NO: 468373 - RNA, 32 nt, Human
gguccaaaccauccuggguagaugcugccaga

SEQ ID NO: 468374 - RNA, 32 nt, Human
gguccaaaggccagcggugaccagccugucac

SEQ ID NO: 468375 - RNA, 32 nt, Human
gguccaaaugcccuagucacauggcagaccca

SEQ ID NO: 468376 - RNA, 32 nt, Human
gguccaacacagauucugccugguccaacaca

SEQ ID NO: 468377 - RNA, 32 nt, Human
gguccaacagaacacauggccuagaggcaaug

SEQ ID NO: 468378 - RNA, 32 nt, Human
gguccaaccccuucauccccagcugcuccuag

SEQ ID NO: 468379 - RNA, 32 nt, Human
gguccaagagggcugggucccacaccaugcug

SEQ ID NO: 468380 - RNA, 24 nt, Human
gguccaagcaauuauugugccuca

SEQ ID NO: 468381 - RNA, 22 nt, Human
gguccaagcgauucucuugccu

SEQ ID NO: 468382 - RNA, 24 nt, Human
gguccaagcgauucucuugccuca

SEQ ID NO: 468383 - RNA, 32 nt, Human
gguccaaggaagcccucuguugcaaccagaua

SEQ ID NO: 468384 - RNA, 24 nt, Human
gguccaagugauucuccugccuca

SEQ ID NO: 468385 - RNA, 24 nt, Human
gguccaagugauucuccugcuuca

SEQ ID NO: 468386 - RNA, 32 nt, Human
gguccaauggcugguugugugagagggcuugg

SEQ ID NO: 468387 - RNA, 21 nt, Human
gguccacacuccccgcccugg

SEQ ID NO: 468388 - RNA, 32 nt, Human
gguccacagaaaucuacagcuguaauggaacc

SEQ ID NO: 468389 - RNA, 32 nt, Human
gguccacagcacaaugaggcuuuucacaggca

SEQ ID NO: 468390 - RNA, 22 nt, Human
gguccacaggaaccagcucccu

SEQ ID NO: 468391 - RNA, 32 nt, Human
gguccacaggcagcaacacucccuccuuccug

SEQ ID NO: 468392 - RNA, 32 nt, Human
gguccacauaguggggaaguagccaggaaaug

SEQ ID NO: 468393 - RNA, 18 nt, Human
gguccacaugcagcuucc

SEQ ID NO: 468394 - RNA, 32 nt, Human
gguccacauggcaaaaccccaucuguaccaaa

SEQ ID NO: 468395 - RNA, 19 nt, Human
gguccacauugcuuucaag

SEQ ID NO: 468396 - RNA, 17 nt, Human
gguccaccacaugcucc

SEQ ID NO: 468397 - RNA, 32 nt, Human
gguccaccagucucccccuuugguucccuucc

SEQ ID NO: 468398 - RNA, 32 nt, Human
gguccacccagggauggggagauguuugcucu

SEQ ID NO: 468399 - RNA, 19 nt, Human
gguccacccucaccauccg

SEQ ID NO: 468400 - RNA, 32 nt, Human
gguccacccugugaaucuuaucagcccaggcu

SEQ ID NO: 468401 - RNA, 32 nt, Human
gguccaccugagcacuggacggugcucccagg

SEQ ID NO: 468402 - RNA, 32 nt, Human
gguccaccuucucuggcucacagaggaggccc

SEQ ID NO: 468403 - RNA, 32 nt, Human
gguccacggaagcacagcagggcccaaacuca

SEQ ID NO: 468404 - RNA, 32 nt, Human
gguccacgucuccaaaagacucuuccacuugu

SEQ ID NO: 468405 - RNA, 32 nt, Human
gguccacguuucuccccggcuccucugggcua

SEQ ID NO: 468406 - RNA, 32 nt, Human
gguccacugcaaccuccacuucccggguucaa

SEQ ID NO: 468407 - RNA, 32 nt, Human
gguccacugcccggggagcagcucccuuccca

SEQ ID NO: 468408 - RNA, 32 nt, Human
gguccacuggcagagggacacacgaucggggc

SEQ ID NO: 468409 - RNA, 32 nt, Human
gguccacuggcggguaaaggggaccaggacgg

SEQ ID NO: 468410 - RNA, 24 nt, Human
gguccacuucaugugccuuucaga

SEQ ID NO: 468411 - RNA, 18 nt, Human
gguccacuucucuucacu

SEQ ID NO: 468412 - RNA, 32 nt, Human
gguccagaaagacucagccacuggagucugug

SEQ ID NO: 468413 - RNA, 19 nt, Human
gguccagaggccuuucaga

SEQ ID NO: 468414 - RNA, 32 nt, Human
gguccagaguuucuuucugaagugcucuuuga

SEQ ID NO: 468415 - RNA, 32 nt, Human
gguccagaugaauccugcagggccaaggucug

SEQ ID NO: 468416 - RNA, 32 nt, Human
gguccagauugaaaaguguccucuggcugagu

SEQ ID NO: 468417 - RNA, 32 nt, Human
gguccagcauguagguugugugguguugcuuu

SEQ ID NO: 468418 - RNA, 32 nt, Human
gguccagccacagccuugcaugaagcuggcac

SEQ ID NO: 468419 - RNA, 32 nt, Human
gguccagccagacccugggcccucucuccuca

SEQ ID NO: 468420 - RNA, 32 nt, Human
gguccagcccacaagcugcaucagggucucug

SEQ ID NO: 468421 - RNA, 32 nt, Human
gguccagccguggagaaacauccgggacccuc

SEQ ID NO: 468422 - RNA, 32 nt, Human
gguccagccguuccgcccagcauacaagcuua

SEQ ID NO: 468423 - RNA, 32 nt, Human
gguccagccguuccgcccggcauacaagcuua

SEQ ID NO: 468424 - RNA, 32 nt, Human
gguccagcuagcagcucuccauuccugagugg

SEQ ID NO: 468425 - RNA, 32 nt, Human
gguccagcuagugccgcucagcccuagacccu

SEQ ID NO: 468426 - RNA, 32 nt, Human
gguccagcucuccccaaaaauuggguuuuuag

SEQ ID NO: 468427 - RNA, 32 nt, Human
gguccagcugggccuccugccuccgggcaggc

SEQ ID NO: 468428 - RNA, 32 nt, Human
gguccagcuuggccuuuucuucccagggacuc

SEQ ID NO: 468429 - RNA, 32 nt, Human
gguccaggaagaaaaugucacacuugccugug

SEQ ID NO: 468430 - RNA, 32 nt, Human
gguccaggacagugaccaucugggucugugua

SEQ ID NO: 468431 - RNA, 32 nt, Human
gguccaggacaguucacgccgggugcggagga

SEQ ID NO: 468432 - RNA, 32 nt, Human
gguccaggacccguggaggagcccacagcuac

SEQ ID NO: 468433 - RNA, 32 nt, Human
gguccaggagagacugggcugaagggagcuag

SEQ ID NO: 468434 - RNA, 32 nt, Human
gguccaggaggccaaggagcuggggagcugug

SEQ ID NO: 468435 - RNA, 26 nt, Human
gguccaggagguggaggcugcaguga

SEQ ID NO: 468436 - RNA, 32 nt, Human
gguccaggagguggaggcugcagugagcuaug

SEQ ID NO: 468437 - RNA, 32 nt, Human
gguccaggcaccacucagcucuggcucuuccu

SEQ ID NO: 468438 - RNA, 22 nt, Human
gguccaggcagccaggcucccu

SEQ ID NO: 468439 - RNA, 32 nt, Human
gguccaggcaggcggggaugugcggugaccac

SEQ ID NO: 468440 - RNA, 32 nt, Human
gguccaggcggcaacauguccaugcuuuuagu

SEQ ID NO: 468441 - RNA, 32 nt, Human
gguccaggcugcagccugggugacagagcaag

SEQ ID NO: 468442 - RNA, 32 nt, Human
gguccaggcuguacccgcugcucucagcuggg

SEQ ID NO: 468443 - RNA, 21 nt, Human
gguccaggcuguccagcuccc

SEQ ID NO: 468444 - RNA, 24 nt, Human
gguccaggcuugccucaaguucca

SEQ ID NO: 468445 - RNA, 32 nt, Human
gguccagggaaguuaguccucuggccucaauu

SEQ ID NO: 468446 - RNA, 32 nt, Human
gguccagggaugggcucugaugagaggguaaa

SEQ ID NO: 468447 - RNA, 32 nt, Human
gguccagggccugggaaauuucuacuuauccu

SEQ ID NO: 468448 - RNA, 32 nt, Human
gguccaggggaggccuuccagggacgaagaag

SEQ ID NO: 468449 - RNA, 24 nt, Human
gguccaggugccucaccaccugcu

SEQ ID NO: 468450 - RNA, 32 nt, Human
gguccagugauacccacuagaucuuccaagga

SEQ ID NO: 468451 - RNA, 23 nt, Human
gguccaguggcacccagcucccu

SEQ ID NO: 468452 - RNA, 32 nt, Human
gguccaguuuauucuaacaucuugcugacuuc

SEQ ID NO: 468453 - RNA, 32 nt, Human
gguccauagagugugcagagaauccaguaaag

SEQ ID NO: 468454 - RNA, 25 nt, Human
gguccauauaacccugacucuccug

SEQ ID NO: 468455 - RNA, 32 nt, Human
gguccauccuacaggcacugguguggggcaca

SEQ ID NO: 468456 - RNA, 21 nt, Human
gguccaucuccagcagcuggu

SEQ ID NO: 468457 - RNA, 22 nt, Human
gguccaucuguaagagcuccuu

SEQ ID NO: 468458 - RNA, 18 nt, Human
gguccaugaccacaucca

SEQ ID NO: 468459 - RNA, 32 nt, Human
gguccaugaugauguuguggcugagcuuagaa

SEQ ID NO: 468460 - RNA, 20 nt, Human
gguccauggagccuuucaaa

SEQ ID NO: 468461 - RNA, 32 nt, Human
gguccauggccauccagcaccuguaaggccgg

SEQ ID NO: 468462 - RNA, 32 nt, Human
gguccauggcuuccccagcccagggaggguau

SEQ ID NO: 468463 - RNA, 32 nt, Human
gguccaugucccagaccccucuauucugcucc

SEQ ID NO: 468464 - RNA, 32 nt, Human
gguccaugugcgcagugaguggcgcuauuccu

SEQ ID NO: 468465 - RNA, 18 nt, Human
gguccauucagagcaccu

SEQ ID NO: 468466 - RNA, 32 nt, Human
gguccauucagaugaauagauggaauuuggaa

SEQ ID NO: 468467 - RNA, 17 nt, Human
gguccauuccagauccc

SEQ ID NO: 468468 - RNA, 32 nt, Human
gguccauugcccacauucucugucuccuucuc

SEQ ID NO: 468469 - RNA, 19 nt, Human
gguccauuguggcgccccu

SEQ ID NO: 468470 - RNA, 21 nt, Human
gguccauuugaaugcaucccu

SEQ ID NO: 468471 - RNA, 21 nt, Human
gguccauuuguuuuucuuccu

SEQ ID NO: 468472 - RNA, 32 nt, Human
gguccauuuuggcuucuuuccacacccacagu

SEQ ID NO: 468473 - RNA, 32 nt, Human
ggucccaagagucgcgcuuggugagagaaauc

SEQ ID NO: 468474 - RNA, 30 nt, Human
ggucccaagccugcugugcuccuguggcag

SEQ ID NO: 468475 - RNA, 20 nt, Human
ggucccaaggccccagccaa

SEQ ID NO: 468476 - RNA, 32 nt, Human
ggucccaauaccagcaccucuaguuagaguua

SEQ ID NO: 468477 - RNA, 32 nt, Human
ggucccacacaaaagcagaccugcgagaucuc

SEQ ID NO: 468478 - RNA, 32 nt, Human
ggucccacagccgacagugcccagagcaugca

SEQ ID NO: 468479 - RNA, 32 nt, Human
ggucccacaguccucaggccccucucuggcug

SEQ ID NO: 468480 - RNA, 32 nt, Human
ggucccaccgcacuccagccugggcaacagag

SEQ ID NO: 468481 - RNA, 32 nt, Human
ggucccacucacugcacugggguccuuggggu

SEQ ID NO: 468482 - RNA, 32 nt, Human
ggucccacucugucuuugccuauggggauucg

SEQ ID NO: 468483 - RNA, 32 nt, Human
ggucccacugccuguccagccuggcucccuuc

SEQ ID NO: 468484 - RNA, 32 nt, Human
ggucccacuggcaggcgggcaagaggggaguc

SEQ ID NO: 468485 - RNA, 32 nt, Human
ggucccagaaggaggggacagaggagcugaga

SEQ ID NO: 468486 - RNA, 32 nt, Human
ggucccagagggccagaaacaccugacuuacc

SEQ ID NO: 468487 - RNA, 17 nt, Human
ggucccagcaucuuccc

SEQ ID NO: 468488 - RNA, 32 nt, Human
ggucccagccccuuuuccccagucccagacaa

SEQ ID NO: 468489 - RNA, 32 nt, Human
ggucccagccgcucgggaggcugaggcaggag

SEQ ID NO: 468490 - RNA, 32 nt, Human
ggucccagccucccagucccugcucugaaagc

SEQ ID NO: 468491 - RNA, 24 nt, Human
ggucccagcgauucuccugccuca

SEQ ID NO: 468492 - RNA, 32 nt, Human
ggucccagcuacuagggaggcugagccaggaa

SEQ ID NO: 468493 - RNA, 32 nt, Human
ggucccagcuacucaacaggcugagguuggga

SEQ ID NO: 468494 - RNA, 32 nt, Human
ggucccagcuacucaagagacggaggugggag

SEQ ID NO: 468495 - RNA, 32 nt, Human
ggucccagcuacucaagaggcugaggugagag

SEQ ID NO: 468496 - RNA, 32 nt, Human
ggucccagcuacucaagagguggaggcaggaa

SEQ ID NO: 468497 - RNA, 32 nt, Human
ggucccagcuacucagagggcugaggugggag

SEQ ID NO: 468498 - RNA, 32 nt, Human
ggucccagcuacucaggagacugaggugggag

SEQ ID NO: 468499 - RNA, 32 nt, Human
ggucccagcuacucaggaggcugaggcagaag

SEQ ID NO: 468500 - RNA, 32 nt, Human
ggucccagcuacucaggaggcugaggcuggag

SEQ ID NO: 468501 - RNA, 32 nt, Human
ggucccagcuacucaggaggcugagguggaag

SEQ ID NO: 468502 - RNA, 32 nt, Human
ggucccagcuacucaggaggcugaggugggaa

SEQ ID NO: 468503 - RNA, 32 nt, Human
ggucccagcuacucaggaggcugaggugggag

SEQ ID NO: 468504 - RNA, 32 nt, Human
ggucccagcuacucaggaggcugagguuggag

SEQ ID NO: 468505 - RNA, 32 nt, Human
ggucccagcuacuccagaggcugaggugggaa

SEQ ID NO: 468506 - RNA, 32 nt, Human
ggucccagcuacucgagaggcuaaggcaggaa

SEQ ID NO: 468507 - RNA, 32 nt, Human
ggucccagcuacucgggacgcugaggugggag

SEQ ID NO: 468508 - RNA, 32 nt, Human
ggucccagcuacucgggagacucaugcaggag

SEQ ID NO: 468509 - RNA, 32 nt, Human
ggucccagcuacucgggaggcugaggcacaag

SEQ ID NO: 468510 - RNA, 32 nt, Human
ggucccagcuacucgggaggcugaggcaggag

SEQ ID NO: 468511 - RNA, 32 nt, Human
ggucccagcuacucgggaggcugagggggaag

SEQ ID NO: 468512 - RNA, 32 nt, Human
ggucccagcuacucgggaggcugaggugggag

SEQ ID NO: 468513 - RNA, 32 nt, Human
ggucccagcuacucgggaggcuguggugggag

SEQ ID NO: 468514 - RNA, 32 nt, Human
ggucccagcuacucgggaggcuuagacaugag

SEQ ID NO: 468515 - RNA, 32 nt, Human
ggucccagcuacucuggaagcugaggugagag

SEQ ID NO: 468516 - RNA, 32 nt, Human
ggucccagcuacucuggaggcuaaggugggag

SEQ ID NO: 468517 - RNA, 32 nt, Human
ggucccagcuacucuggaggcugaggcggaac

SEQ ID NO: 468518 - RNA, 32 nt, Human
ggucccagcuacucuggaggcugaggugggaa

SEQ ID NO: 468519 - RNA, 32 nt, Human
ggucccagcuacugaggaggcugaggugggag

SEQ ID NO: 468520 - RNA, 32 nt, Human
ggucccagcuacuggggaggcugaagcaggaa

SEQ ID NO: 468521 - RNA, 32 nt, Human
ggucccagcuacuggggaggcugaggcaggac

SEQ ID NO: 468522 - RNA, 32 nt, Human
ggucccagcuacuggggaggcugaggugggag

SEQ ID NO: 468523 - RNA, 18 nt, Human
ggucccagcuacuugaga

SEQ ID NO: 468524 - RNA, 32 nt, Human
ggucccagcuacuugagaggcugagccaggag

SEQ ID NO: 468525 - RNA, 32 nt, Human
ggucccagcuacuugagaggcugaggugggag

SEQ ID NO: 468526 - RNA, 32 nt, Human
ggucccagcuacuuggaaggcuaagguaggag

SEQ ID NO: 468527 - RNA, 32 nt, Human
ggucccagcuacuugggaagcugagguaggag

SEQ ID NO: 468528 - RNA, 32 nt, Human
ggucccagcuacuugggaggcuaagguagaag

SEQ ID NO: 468529 - RNA, 32 nt, Human
ggucccagcuacuugggaggcugaagcaggag

SEQ ID NO: 468530 - RNA, 32 nt, Human
ggucccagcuacuugggaggcugaggcgggag

SEQ ID NO: 468531 - RNA, 32 nt, Human
ggucccagcuacuugggaggcugaggugggag

SEQ ID NO: 468532 - RNA, 32 nt, Human
ggucccagcuacuuugggagguugaggcagga

SEQ ID NO: 468533 - RNA, 32 nt, Human
ggucccagcuccaggcuggagccagugaaggg

SEQ ID NO: 468534 - RNA, 32 nt, Human
ggucccagcucucagagugcaaggguucuccc

SEQ ID NO: 468535 - RNA, 32 nt, Human
ggucccagcugcucgggaggcugagcaggagg

SEQ ID NO: 468536 - RNA, 32 nt, Human
ggucccagcugcucgggaggcugaggcaggag

SEQ ID NO: 468537 - RNA, 32 nt, Human
ggucccagcugcucgggagguugaugcaggag

SEQ ID NO: 468538 - RNA, 32 nt, Human
ggucccagcuuaguuaagucacccaugcaccu

SEQ ID NO: 468539 - RNA, 32 nt, Human
ggucccaggaacucaggcuucaggugagaagg

SEQ ID NO: 468540 - RNA, 32 nt, Human
ggucccaggagggucuggaggaaaacuggcua

SEQ ID NO: 468541 - RNA, 23 nt, Human
ggucccaggccgcggccuggcug

SEQ ID NO: 468542 - RNA, 32 nt, Human
ggucccaggcucuggucaucagaaggacuggu

SEQ ID NO: 468543 - RNA, 32 nt, Human
ggucccaggcuggauugccguggcacaaucuc

SEQ ID NO: 468544 - RNA, 32 nt, Human
ggucccaggcuggucucaaacuccugagcuca

SEQ ID NO: 468545 - RNA, 32 nt, Human
ggucccagggugagacaggugagaagagggau

SEQ ID NO: 468546 - RNA, 32 nt, Human
ggucccagguacuugggggacugaggcgggag

SEQ ID NO: 468547 - RNA, 32 nt, Human
ggucccaggugcagcggaugcagaggagagag

SEQ ID NO: 468548 - RNA, 32 nt, Human
ggucccagguguggagcagagcucgggaacuc

SEQ ID NO: 468549 - RNA, 32 nt, Human
ggucccagucugugucuccaucaggcuuaagc

SEQ ID NO: 468550 - RNA, 32 nt, Human
ggucccaguucuguguagcuugcccugcccca

SEQ ID NO: 468551 - RNA, 32 nt, Human
ggucccaucccaccccugccuccuccagaccg

SEQ ID NO: 468552 - RNA, 32 nt, Human
ggucccaucugaugccgaggcugaaggagucu

SEQ ID NO: 468553 - RNA, 32 nt, Human
ggucccaucugggggugaugggagacagugac

SEQ ID NO: 468554 - RNA, 32 nt, Human
ggucccaucuuaccuggugaccaccaucauug

SEQ ID NO: 468555 - RNA, 19 nt, Human
ggucccaugaccagcuccc

SEQ ID NO: 468556 - RNA, 32 nt, Human
ggucccaugggccaccuccugcaugucuccgc

SEQ ID NO: 468557 - RNA, 19 nt, Human
ggucccauuuucagugccc

SEQ ID NO: 468558 - RNA, 32 nt, Human
gguccccaaagaacuaaagagucagcuccaca

SEQ ID NO: 468559 - RNA, 22 nt, Human
gguccccaagggcaguauucag

SEQ ID NO: 468560 - RNA, 20 nt, Human
gguccccacacagagucugg

SEQ ID NO: 468561 - RNA, 32 nt, Human
gguccccacaugcacacagaacucugacacag

SEQ ID NO: 468562 - RNA, 32 nt, Human
gguccccacucagaccagcaccagugucugcc

SEQ ID NO: 468563 - RNA, 32 nt, Human
gguccccacuccuguaccgggggugggguggg

SEQ ID NO: 468564 - RNA, 32 nt, Human
gguccccacuggcaccucucucucuuuggguu

SEQ ID NO: 468565 - RNA, 32 nt, Human
gguccccagaagcagggaccucaggcaggagu

SEQ ID NO: 468566 - RNA, 32 nt, Human
gguccccagagucauucugcucugccucuuug

SEQ ID NO: 468567 - RNA, 32 nt, Human
gguccccagauggggagacugaggccguggcu

SEQ ID NO: 468568 - RNA, 32 nt, Human
gguccccagcagugccugguucugagcaaacu

SEQ ID NO: 468569 - RNA, 32 nt, Human
gguccccagcccucgucgcagccccggccgcc

SEQ ID NO: 468570 - RNA, 18 nt, Human
gguccccagcugguccag

SEQ ID NO: 468571 - RNA, 32 nt, Human
gguccccaggcccacgggcacagggagaggga

SEQ ID NO: 468572 - RNA, 18 nt, Human
gguccccagggcaggcuc

SEQ ID NO: 468573 - RNA, 32 nt, Human
gguccccagugcugcacucccacccugggcuc

SEQ ID NO: 468574 - RNA, 32 nt, Human
gguccccauggacuuagggggaccaggcaaga

SEQ ID NO: 468575 - RNA, 32 nt, Human
gguccccauguccagccuugugcagugaguuc

SEQ ID NO: 468576 - RNA, 23 nt, Human
ggucccccacaccgguucccuga

SEQ ID NO: 468577 - RNA, 17 nt, Human
ggucccccagcccucca

SEQ ID NO: 468578 - RNA, 32 nt, Human
ggucccccagcgugcaccaccuggcccggcac

SEQ ID NO: 468579 - RNA, 32 nt, Human
ggucccccagggugggcucagcuccagggaga

SEQ ID NO: 468580 - RNA, 32 nt, Human
ggucccccgagcucugugaccuuaugcuccac

SEQ ID NO: 468581 - RNA, 32 nt, Human
ggucccccuccccacuaagugccucuuugcau

SEQ ID NO: 468582 - RNA, 32 nt, Human
ggucccccugguuguuguagcagcuuaacugu

SEQ ID NO: 468583 - RNA, 17 nt, Human
ggucccccuuccugcca

SEQ ID NO: 468584 - RNA, 32 nt, Human
gguccccgaagaucucaggaauuuuuguaggg

SEQ ID NO: 468585 - RNA, 32 nt, Human
gguccccgaaguccuugcucccgcuccugcgg

SEQ ID NO: 468586 - RNA, 32 nt, Human
gguccccgacuggccagggccacucagcugcc

SEQ ID NO: 468587 - RNA, 32 nt, Human
gguccccgagcaagccugggaacucaggaaaa

SEQ ID NO: 468588 - RNA, 18 nt, Human
gguccccgcgccugccuu

SEQ ID NO: 468589 - RNA, 32 nt, Human
gguccccgcgcggcgcaucccagccugggcgg

SEQ ID NO: 468590 - RNA, 32 nt, Human
gguccccgcuggcugcuuucuuccugccccug

SEQ ID NO: 468591 - RNA, 32 nt, Human
gguccccggaaaaauuccaaccagacugcgcc

SEQ ID NO: 468592 - RNA, 32 nt, Human
gguccccggcuuccugcucccuucgccuacgc

SEQ ID NO: 468593 - RNA, 32 nt, Human
gguccccgggaggcuagagaucauggaaggga

SEQ ID NO: 468594 - RNA, 32 nt, Human
gguccccgggcgaacagaggcugcgguggacu

SEQ ID NO: 468595 - RNA, 32 nt, Human
gguccccgguccucccgggcaggauggaggcu

SEQ ID NO: 468596 - RNA, 32 nt, Human
gguccccgguugcuggucagguccccauggcu

SEQ ID NO: 468597 - RNA, 32 nt, Human
gguccccuaccuuaagucucccccucuuuuau

SEQ ID NO: 468598 - RNA, 32 nt, Human
gguccccucaaaagguagacaaaacagcagcu

SEQ ID NO: 468599 - RNA, 32 nt, Human
gguccccuccauggcccugaauccuccucugc

SEQ ID NO: 468600 - RNA, 32 nt, Human
gguccccuccccucucagcauuuccuuguccc

SEQ ID NO: 468601 - RNA, 20 nt, Human
gguccccucccugcuggacc

SEQ ID NO: 468602 - RNA, 20 nt, Human
gguccccuccucugccauca

SEQ ID NO: 468603 - RNA, 32 nt, Human
gguccccucuuuucccuucagucuucuucacu

SEQ ID NO: 468604 - RNA, 32 nt, Human
gguccccugaagugcugggauuacagguguga

SEQ ID NO: 468605 - RNA, 32 nt, Human
gguccccugcaaccucccaucaaaggaugacc

SEQ ID NO: 468606 - RNA, 32 nt, Human
gguccccuguucuccccgcucaggugcggcgc

SEQ ID NO: 468607 - RNA, 32 nt, Human
gguccccuucacauggccucaggcuucccaca

SEQ ID NO: 468608 - RNA, 32 nt, Human
gguccccuucucaaagaacuucagaggaaaag

SEQ ID NO: 468609 - RNA, 32 nt, Human
gguccccuugcuucuguuuucuaccucuccag

SEQ ID NO: 468610 - RNA, 32 nt, Human
ggucccgaaggacacugccacagggacgccuu

SEQ ID NO: 468611 - RNA, 32 nt, Human
ggucccgcagaggcggggugggaguggggcuc

SEQ ID NO: 468612 - RNA, 24 nt, Human
ggucccgcagggaugaggcugcca

SEQ ID NO: 468613 - RNA, 32 nt, Human
ggucccgccacugcacuccagccugggugaca

SEQ ID NO: 468614 - RNA, 32 nt, Human
ggucccgccagccccucacacucccagcaaaa

SEQ ID NO: 468615 - RNA, 19 nt, Human
ggucccgccucccuugacg

SEQ ID NO: 468616 - RNA, 32 nt, Human
ggucccgcgagugcccuauaaggacugccagg

SEQ ID NO: 468617 - RNA, 21 nt, Human
ggucccgcggcccgcaccugc

SEQ ID NO: 468618 - RNA, 32 nt, Human
ggucccgcggggugcccccgcccacacgcuau

SEQ ID NO: 468619 - RNA, 32 nt, Human
ggucccgcuccugguggcccacuguggcugcc

SEQ ID NO: 468620 - RNA, 32 nt, Human
ggucccgcuggcuguccccuugucggccugac

SEQ ID NO: 468621 - RNA, 21 nt, Human
ggucccggaaccaccgcgcug

SEQ ID NO: 468622 - RNA, 32 nt, Human
ggucccggaagugacgucucccagaggggccg

SEQ ID NO: 468623 - RNA, 32 nt, Human
ggucccggagaauguugugagggguuuauuuu

SEQ ID NO: 468624 - RNA, 32 nt, Human
ggucccggaguaacuucucuccaggcugaagg

SEQ ID NO: 468625 - RNA, 32 nt, Human
ggucccggcccuggcccagccagcccagcccu

SEQ ID NO: 468626 - RNA, 32 nt, Human
ggucccggcugcucgggaggcugaggcagggg

SEQ ID NO: 468627 - RNA, 32 nt, Human
ggucccgucugccugcuccucaggaccacuca

SEQ ID NO: 468628 - RNA, 31 nt, Human
ggucccuaccucucugcugugucuucauguc

SEQ ID NO: 468629 - RNA, 32 nt, Human
ggucccucacagccacaccacagcccuuuggg

SEQ ID NO: 468630 - RNA, 32 nt, Human
ggucccucagccccuucucccccgucagcccu

SEQ ID NO: 468631 - RNA, 32 nt, Human
ggucccucaggguugaugcguggagaaggacu

SEQ ID NO: 468632 - RNA, 24 nt, Human
ggucccuccccagguccccugaga

SEQ ID NO: 468633 - RNA, 32 nt, Human
ggucccucccuauacuccucaggcuccugggu

SEQ ID NO: 468634 - RNA, 32 nt, Human
ggucccuccgcccucugucaugcggccuuaug

SEQ ID NO: 468635 - RNA, 32 nt, Human
ggucccuccugcaccugcugccuggauccccg

SEQ ID NO: 468636 - RNA, 32 nt, Human
ggucccuccugguccccugccucuacugccgg

SEQ ID NO: 468637 - RNA, 21 nt, Human
ggucccuccuucacagccgcu

SEQ ID NO: 468638 - RNA, 32 nt, Human
ggucccuccuucuauuuugugaaaggguagca

SEQ ID NO: 468639 - RNA, 32 nt, Human
ggucccuccuugaggcaaacagccugggcuuc

SEQ ID NO: 468640 - RNA, 32 nt, Human
ggucccucuagccuguggacaccagcuggggg

SEQ ID NO: 468641 - RNA, 32 nt, Human
ggucccucuccucggaagaacugcccagccac

SEQ ID NO: 468642 - RNA, 32 nt, Human
ggucccucucuccuccucuuccucucucugga

SEQ ID NO: 468643 - RNA, 32 nt, Human
ggucccucuguccaucugggccuuuguaugag

SEQ ID NO: 468644 - RNA, 32 nt, Human
ggucccucugucccaagaagcugguggugcca

SEQ ID NO: 468645 - RNA, 32 nt, Human
ggucccucugucucccuggggccuuggguucu

SEQ ID NO: 468646 - RNA, 32 nt, Human
ggucccugaccuucugagaggggccugccuca

SEQ ID NO: 468647 - RNA, 32 nt, Human
ggucccugcagaggggcuccaggcuggugaga

SEQ ID NO: 468648 - RNA, 32 nt, Human
ggucccugccagauccacccagaagaaaggga

SEQ ID NO: 468649 - RNA, 32 nt, Human
ggucccugccuccccuuccuucacuggcugau

SEQ ID NO: 468650 - RNA, 21 nt, Human
ggucccugcgucuccugccca

SEQ ID NO: 468651 - RNA, 32 nt, Human
ggucccugcucacugugcuagcuuucuagcug

SEQ ID NO: 468652 - RNA, 29 nt, Human
ggucccuggcugcuguggccuccccugac

SEQ ID NO: 468653 - RNA, 32 nt, Human
ggucccugucccagcugcuccuggggaguaga

SEQ ID NO: 468654 - RNA, 32 nt, Human
ggucccugugccaggccucaauacugccaggg

SEQ ID NO: 468655 - RNA, 32 nt, Human
ggucccugugccagggcacagggggucaggca

SEQ ID NO: 468656 - RNA, 32 nt, Human
ggucccuguggucccagcuacucuggaggcug

SEQ ID NO: 468657 - RNA, 32 nt, Human
ggucccuuacuagagagguugagugaauuugc

SEQ ID NO: 468658 - RNA, 32 nt, Human
ggucccuuucuacugugguguuggagcaggac

SEQ ID NO: 468659 - RNA, 32 nt, Human
ggucccuuucugucugucuccuugcucugccc

SEQ ID NO: 468660 - RNA, 32 nt, Human
ggucccuuuuugaggcaguagcagguaaggaa

SEQ ID NO: 468661 - RNA, 20 nt, Human
gguccgaaaccaagcucccu

SEQ ID NO: 468662 - RNA, 32 nt, Human
gguccgacacaggcuggacugaucuggagagc

SEQ ID NO: 468663 - RNA, 32 nt, Human
gguccgagaggucaggggucagcuggagaggg

SEQ ID NO: 468664 - RNA, 17 nt, Human
gguccgaggcgaggaag

SEQ ID NO: 468665 - RNA, 32 nt, Human
gguccgcagaucaguccuccugggaauuuagu

SEQ ID NO: 468666 - RNA, 32 nt, Human
gguccgcaggccaguccucccaggaacugaaa

SEQ ID NO: 468667 - RNA, 32 nt, Human
gguccgccaauugcucguuugcacugagagag

SEQ ID NO: 468668 - RNA, 21 nt, Human
gguccgccccccagggccacc

SEQ ID NO: 468669 - RNA, 32 nt, Human
gguccgcgggcgcgucaggagaacuaugccau

SEQ ID NO: 468670 - RNA, 32 nt, Human
gguccgcuacccacgugggggcucagcgugca

SEQ ID NO: 468671 - RNA, 32 nt, Human
gguccgcugccucuucggccauggaagcugcc

SEQ ID NO: 468672 - RNA, 32 nt, Human
gguccggagagggcgcggcgcggagcgcagcc

SEQ ID NO: 468673 - RNA, 32 nt, Human
gguccggccugccugccugccugccugccucu

SEQ ID NO: 468674 - RNA, 21 nt, Human
gguccggcggcagcgcuuccu

SEQ ID NO: 468675 - RNA, 32 nt, Human
gguccggcucagacugaauaagaagagauaaa

SEQ ID NO: 468676 - RNA, 32 nt, Human
gguccggcuccuggaggacagcgggaugggag

SEQ ID NO: 468677 - RNA, 32 nt, Human
gguccggcugggguagcggagcccccagugcg

SEQ ID NO: 468678 - RNA, 23 nt, Human
gguccgggagaagcggcgggguc

SEQ ID NO: 468679 - RNA, 32 nt, Human
gguccgggccuggaguucagugggugcagccu

SEQ ID NO: 468680 - RNA, 21 nt, Human
gguccggguauuccacgccca

SEQ ID NO: 468681 - RNA, 32 nt, Human
gguccgggucaguuguucaugguguaagcuuu

SEQ ID NO: 468682 - RNA, 21 nt, Human
gguccggguggggggcggguu

SEQ ID NO: 468683 - RNA, 32 nt, Human
gguccggugccaauaaauccuuguggaaucug

SEQ ID NO: 468684 - RNA, 32 nt, Human
gguccguccaccacagcagccccagguggagg

SEQ ID NO: 468685 - RNA, 32 nt, Human
gguccgucccccucagacgucucccccaacgc

SEQ ID NO: 468686 - RNA, 32 nt, Human
gguccgugaaggacggccucaggccuuggcau

SEQ ID NO: 468687 - RNA, 32 nt, Human
gguccgugcccaggcccuuggcugcaggcaac

SEQ ID NO: 468688 - RNA, 32 nt, Human
gguccgugcucugccagugggguucacaacaa

SEQ ID NO: 468689 - RNA, 32 nt, Human
gguccgugugggcuuccaccucagacaguugc

SEQ ID NO: 468690 - RNA, 32 nt, Human
gguccguguguaguaaggugcgcagccucggc

SEQ ID NO: 468691 - RNA, 25 nt, Human
gguccguguucucacagugcugcca

SEQ ID NO: 468692 - RNA, 32 nt, Human
gguccuaaaggccuuugauccuuugaagaaga

SEQ ID NO: 468693 - RNA, 32 nt, Human
gguccuaauuuguguucugagaucccaguuua

SEQ ID NO: 468694 - RNA, 32 nt, Human
gguccuacucucuuucugugccuguuacccac

SEQ ID NO: 468695 - RNA, 18 nt, Human
gguccuagaaguucaguu

SEQ ID NO: 468696 - RNA, 32 nt, Human
gguccuagaggaagcauuggggugggggaggg

SEQ ID NO: 468697 - RNA, 32 nt, Human
gguccuagagguuccucagugcagcuggacuc

SEQ ID NO: 468698 - RNA, 32 nt, Human
gguccuagcuacucaggaggcugaggcaggag

SEQ ID NO: 468699 - RNA, 32 nt, Human
gguccuagcuacucgggagacugaaguggaag

SEQ ID NO: 468700 - RNA, 32 nt, Human
gguccuagcuacucgggaggcugaggcaggag

SEQ ID NO: 468701 - RNA, 32 nt, Human
gguccuagcuccucgggaggcugaggcaggag

SEQ ID NO: 468702 - RNA, 32 nt, Human
gguccuagggguagcagagggaagggaggauu

SEQ ID NO: 468703 - RNA, 19 nt, Human
gguccuagggucacaccca

SEQ ID NO: 468704 - RNA, 32 nt, Human
gguccuaguuacucggaagacugaggcaggag

SEQ ID NO: 468705 - RNA, 32 nt, Human
gguccuaucagaugcugggccuccucagccau

SEQ ID NO: 468706 - RNA, 18 nt, Human
gguccuaucugacuccug

SEQ ID NO: 468707 - RNA, 32 nt, Human
gguccucaagacugugggagacccuggcugcu

SEQ ID NO: 468708 - RNA, 21 nt, Human
gguccucacacccagcucccu

SEQ ID NO: 468709 - RNA, 32 nt, Human
gguccucacacccuuccucagccccaucaucu

SEQ ID NO: 468710 - RNA, 32 nt, Human
gguccucacuucugucuccugucuucagagca

SEQ ID NO: 468711 - RNA, 32 nt, Human
gguccucagagaaaaugcccauuuucucggag

SEQ ID NO: 468712 - RNA, 32 nt, Human
gguccucagccaucugccccucgagagccaag

SEQ ID NO: 468713 - RNA, 32 nt, Human
gguccucagcccagggugagcugcagucaggc

SEQ ID NO: 468714 - RNA, 23 nt, Human
gguccucauacacagagcucccu

SEQ ID NO: 468715 - RNA, 32 nt, Human
gguccucauagagccugugguggcuacuuuug

SEQ ID NO: 468716 - RNA, 32 nt, Human
gguccucaugccuguaucccagcacuuuggga

SEQ ID NO: 468717 - RNA, 32 nt, Human
gguccucauggaagaagagcaagauuuaccag

SEQ ID NO: 468718 - RNA, 22 nt, Human
gguccucauucacaguauccga

SEQ ID NO: 468719 - RNA, 32 nt, Human
gguccucauucauguuguaaauuuuuggagca

SEQ ID NO: 468720 - RNA, 32 nt, Human
gguccuccacagccacaagcauggacccacug

SEQ ID NO: 468721 - RNA, 32 nt, Human
gguccuccagugcccagguaggagguuucacu

SEQ ID NO: 468722 - RNA, 32 nt, Human
gguccucccugccuaaggcccaagucaacuuu

SEQ ID NO: 468723 - RNA, 32 nt, Human
gguccuccuaucucccuggcucacuggcaggu

SEQ ID NO: 468724 - RNA, 32 nt, Human
gguccuccucaccucuaucuuucuuucucucu

SEQ ID NO: 468725 - RNA, 22 nt, Human
gguccuccucccagcuaccccu

SEQ ID NO: 468726 - RNA, 32 nt, Human
gguccuccugcagaaguggccccugugguccu

SEQ ID NO: 468727 - RNA, 32 nt, Human
gguccuccugcaggagcccaacccuggcaucg

SEQ ID NO: 468728 - RNA, 32 nt, Human
gguccuccugccacagucaagcuuucagauga

SEQ ID NO: 468729 - RNA, 32 nt, Human
gguccuccugccucagcuuccaaaggcacagg

SEQ ID NO: 468730 - RNA, 32 nt, Human
gguccuccuggggccuuccugccuuugaacug

SEQ ID NO: 468731 - RNA, 32 nt, Human
gguccucgcugauguccuccagccgccuggcu

SEQ ID NO: 468732 - RNA, 32 nt, Human
gguccucgcuucaugcucacacaggcuauggg

SEQ ID NO: 468733 - RNA, 32 nt, Human
gguccucgggcgcgcaccgcucucuuacacuc

SEQ ID NO: 468734 - RNA, 25 nt, Human
gguccucgguuuccucauuugugaa

SEQ ID NO: 468735 - RNA, 32 nt, Human
gguccucgugcugaccgcgcucugccucagcg

SEQ ID NO: 468736 - RNA, 32 nt, Human
gguccucuaggccugggcugggcuccaggcca

SEQ ID NO: 468737 - RNA, 32 nt, Human
gguccucucacugcagccucccaacaggcugg

SEQ ID NO: 468738 - RNA, 32 nt, Human
gguccucucccaggagcagccccuggaugccc

SEQ ID NO: 468739 - RNA, 32 nt, Human
gguccucucgguccucuccauccugugcuucu

SEQ ID NO: 468740 - RNA, 32 nt, Human
gguccucugcguuguagugcuaccucaaucuc

SEQ ID NO: 468741 - RNA, 32 nt, Human
gguccucuggauggcaggugaguaaaggugac

SEQ ID NO: 468742 - RNA, 20 nt, Human
gguccucuggcccugcucuc

SEQ ID NO: 468743 - RNA, 32 nt, Human
gguccucugggagucggaagagcugucugggu

SEQ ID NO: 468744 - RNA, 32 nt, Human
gguccucuucuuucuagcuucugacaagucug

SEQ ID NO: 468745 - RNA, 21 nt, Human
gguccugaauccagagacaaa

SEQ ID NO: 468746 - RNA, 32 nt, Human
gguccugaccuucccuuccucccaaguuagca

SEQ ID NO: 468747 - RNA, 32 nt, Human
gguccugacucugccaggucucuuaucccuag

SEQ ID NO: 468748 - RNA, 32 nt, Human
gguccugagaacaugugcccaagguggucggg

SEQ ID NO: 468749 - RNA, 32 nt, Human
gguccugagagggagaggagagcaagagaauc

SEQ ID NO: 468750 - RNA, 18 nt, Human
gguccugagcacugauca

SEQ ID NO: 468751 - RNA, 32 nt, Human
gguccugagcugggucccacccuccgagccau

SEQ ID NO: 468752 - RNA, 32 nt, Human
gguccugaggcucaucugccuucuccugguca

SEQ ID NO: 468753 - RNA, 32 nt, Human
gguccugagucaggagguugaggcugcaguga

SEQ ID NO: 468754 - RNA, 32 nt, Human
gguccugaguccuguguguggggccuauauca

SEQ ID NO: 468755 - RNA, 32 nt, Human
gguccugauacuuguuucuuuucacguuuucc

SEQ ID NO: 468756 - RNA, 24 nt, Human
gguccugaucuccugaccuuguga

SEQ ID NO: 468757 - RNA, 32 nt, Human
gguccugauggccauuaugggaauagaggcug

SEQ ID NO: 468758 - RNA, 21 nt, Human
gguccugcacagauucccagg

SEQ ID NO: 468759 - RNA, 32 nt, Human
gguccugcacuucuccccagaggugggcccuc

SEQ ID NO: 468760 - RNA, 32 nt, Human
gguccugcaguaggaugggagggaagguuaaa

SEQ ID NO: 468761 - RNA, 32 nt, Human
gguccugccacauccuucucaaggugguagac

SEQ ID NO: 468762 - RNA, 32 nt, Human
gguccugccagaccuccuuccugaccucugag

SEQ ID NO: 468763 - RNA, 32 nt, Human
gguccugccagcugccucccugaucccucccc

SEQ ID NO: 468764 - RNA, 32 nt, Human
gguccugccagcugccugaggaaguccugaaa

SEQ ID NO: 468765 - RNA, 32 nt, Human
gguccugcccugcuguucuuugcuggagauga

SEQ ID NO: 468766 - RNA, 22 nt, Human
gguccugccgccuccgcaucug

SEQ ID NO: 468767 - RNA, 32 nt, Human
gguccugccggcucccccuccugcucccaagg

SEQ ID NO: 468768 - RNA, 20 nt, Human
gguccugccucuuuaccaca

SEQ ID NO: 468769 - RNA, 32 nt, Human
gguccugcugaccugcacuguccaggccucac

SEQ ID NO: 468770 - RNA, 32 nt, Human
gguccugcugcucgggaaggccugagggaagc

SEQ ID NO: 468771 - RNA, 32 nt, Human
gguccugcugcuucaucucucccccagccugc

SEQ ID NO: 468772 - RNA, 32 nt, Human
gguccugcuggugaccggccuggaccuuggcc

SEQ ID NO: 468773 - RNA, 32 nt, Human
gguccugcuguagugccuucugcgccaggccc

SEQ ID NO: 468774 - RNA, 32 nt, Human
gguccugcugugccaucucccugugcgccuga

SEQ ID NO: 468775 - RNA, 32 nt, Human
gguccugcuucaccuuccccugaccugaguag

SEQ ID NO: 468776 - RNA, 32 nt, Human
gguccugcuuugcccucuuugauauuccuggu

SEQ ID NO: 468777 - RNA, 32 nt, Human
gguccuggacucacugcugcaggauggggaau

SEQ ID NO: 468778 - RNA, 32 nt, Human
gguccuggagccacguccagcacagaguggac

SEQ ID NO: 468779 - RNA, 32 nt, Human
gguccuggagccugucucuucuuucuggaggu

SEQ ID NO: 468780 - RNA, 20 nt, Human
gguccuggcauucuaccauc

SEQ ID NO: 468781 - RNA, 32 nt, Human
gguccuggcccaggccuguccaaagagaagcc

SEQ ID NO: 468782 - RNA, 32 nt, Human
gguccuggcuaacacggugaaaccccggcucu

SEQ ID NO: 468783 - RNA, 32 nt, Human
gguccuggcucugccacuggcuugcuuuugga

SEQ ID NO: 468784 - RNA, 32 nt, Human
gguccuggcugcacucuugaacugggcgaaug

SEQ ID NO: 468785 - RNA, 32 nt, Human
gguccuggcugcagggaaacaagcugggcuuu

SEQ ID NO: 468786 - RNA, 18 nt, Human
gguccuggcuggcuuugu

SEQ ID NO: 468787 - RNA, 32 nt, Human
gguccugggagaaaauagagacccauccccaa

SEQ ID NO: 468788 - RNA, 32 nt, Human
gguccugggagguggucgcccugcagugcaag

SEQ ID NO: 468789 - RNA, 32 nt, Human
gguccugggcaaagcuggcaaauucacuuccu

SEQ ID NO: 468790 - RNA, 32 nt, Human
gguccugggcagguugcaagacuggucuuaga

SEQ ID NO: 468791 - RNA, 19 nt, Human
gguccugggcccccacugc

SEQ ID NO: 468792 - RNA, 32 nt, Human
gguccugggccgcacugcuccgccggggucug

SEQ ID NO: 468793 - RNA, 32 nt, Human
gguccugggcuggggccacaucccugauggca

SEQ ID NO: 468794 - RNA, 32 nt, Human
gguccugggcuguggguaggggcuagggccgg

SEQ ID NO: 468795 - RNA, 32 nt, Human
gguccuggguagaguccuagccccagagcccc

SEQ ID NO: 468796 - RNA, 32 nt, Human
gguccugguggagaaagaaaggcuaggaccau

SEQ ID NO: 468797 - RNA, 32 nt, Human
gguccugguugcacuccgugcuuugcacaaag

SEQ ID NO: 468798 - RNA, 32 nt, Human
gguccugguuucaacauggaagugagauagcu

SEQ ID NO: 468799 - RNA, 32 nt, Human
gguccugguuucccuaugacauggaagcaaga

SEQ ID NO: 468800 - RNA, 20 nt, Human
gguccugucaccgccaccgc

SEQ ID NO: 468801 - RNA, 19 nt, Human
gguccuguccuugcuauca

SEQ ID NO: 468802 - RNA, 32 nt, Human
gguccugucuccaagccugguugcucuuacgc

SEQ ID NO: 468803 - RNA, 32 nt, Human
gguccugucuguccuucugaaguguguccauc

SEQ ID NO: 468804 - RNA, 32 nt, Human
gguccugugagggcgagcggaggcggagaaag

SEQ ID NO: 468805 - RNA, 32 nt, Human
gguccugugcaccgcuuuggggcacagucuga

SEQ ID NO: 468806 - RNA, 32 nt, Human
gguccugugcccuuuacuugcuggugaggugu

SEQ ID NO: 468807 - RNA, 32 nt, Human
gguccuguuaacccuccaccuccucucuugga

SEQ ID NO: 468808 - RNA, 31 nt, Human
gguccuguuagagaggagaaagacuguaaug

SEQ ID NO: 468809 - RNA, 32 nt, Human
gguccuguuccucaucacccuacuucccugag

SEQ ID NO: 468810 - RNA, 20 nt, Human
gguccuguuguuuauuauca

SEQ ID NO: 468811 - RNA, 32 nt, Human
gguccuuccagccugaggggcuucggagcuga

SEQ ID NO: 468812 - RNA, 32 nt, Human
gguccuuccccaguuccuaucucccacccgcc

SEQ ID NO: 468813 - RNA, 22 nt, Human
gguccuucguuacgcagccccc

SEQ ID NO: 468814 - RNA, 32 nt, Human
gguccuucuaccucagccucuggagcaacugg

SEQ ID NO: 468815 - RNA, 32 nt, Human
gguccuucuggugggaagggaggcgggaggug

SEQ ID NO: 468816 - RNA, 32 nt, Human
gguccuugaacuguguaucuauuucauagggc

SEQ ID NO: 468817 - RNA, 32 nt, Human
gguccuugaacuguguaucuauuucauagggu

SEQ ID NO: 468818 - RNA, 32 nt, Human
gguccuugaggagagcgccucccguccgaggc

SEQ ID NO: 468819 - RNA, 32 nt, Human
gguccuugagguggagggaagauggcugaugu

SEQ ID NO: 468820 - RNA, 32 nt, Human
gguccuuggagugcugcagcuuugggaaagcc

SEQ ID NO: 468821 - RNA, 18 nt, Human
gguccuuggaguggcgug

SEQ ID NO: 468822 - RNA, 24 nt, Human
gguccuuggcgccguccacaucca

SEQ ID NO: 468823 - RNA, 32 nt, Human
gguccuuguuucugcccugccagcugcagccu

SEQ ID NO: 468824 - RNA, 32 nt, Human
gguccuuucaucuggcuccguuucuggugcuu

SEQ ID NO: 468825 - RNA, 33 nt, Human
gguccuuuucuugcuccaguuuucaugguaaca

SEQ ID NO: 468826 - RNA, 32 nt, Human
gguccuuuugucccaucucucucgcugagaug

SEQ ID NO: 468827 - RNA, 32 nt, Human
ggucgaacucuggcucucaggaauaugaccga

SEQ ID NO: 468828 - RNA, 32 nt, Human
ggucgaagcucacaccaccucugcagacucau

SEQ ID NO: 468829 - RNA, 24 nt, Human
ggucgacagagugagacuccaucu

SEQ ID NO: 468830 - RNA, 32 nt, Human
ggucgacaugggaccucugccccacaucuuac

SEQ ID NO: 468831 - RNA, 32 nt, Human
ggucgacugagccauuggaaacccagcucacg

SEQ ID NO: 468832 - RNA, 32 nt, Human
ggucgacuugccaaaggguuuaggcuucauug

SEQ ID NO: 468833 - RNA, 32 nt, Human
ggucgagaaccgggugcugggccgggcgcggg

SEQ ID NO: 468834 - RNA, 32 nt, Human
ggucgaggcccaggaggaaggggaggguucac

SEQ ID NO: 468835 - RNA, 32 nt, Human
ggucgaggcugcagugagccaagauggcgcca

SEQ ID NO: 468836 - RNA, 32 nt, Human
ggucgaggcuggcucuggaagcagcaccaugg

SEQ ID NO: 468837 - RNA, 32 nt, Human
ggucgaguagaugcggggcagccggagcuguu

SEQ ID NO: 468838 - RNA, 32 nt, Human
ggucgaguaggugauagaagacaagggggaga

SEQ ID NO: 468839 - RNA, 32 nt, Human
ggucgaucuucccacguguuaggguuuauuuu

SEQ ID NO: 468840 - RNA, 32 nt, Human
ggucgcaccacugcacuccagccugggugaca

SEQ ID NO: 468841 - RNA, 32 nt, Human
ggucgcaccacugcacuccagucuggguaaca

SEQ ID NO: 468842 - RNA, 32 nt, Human
ggucgcaccacugcacugcagccugggugaca

SEQ ID NO: 468843 - RNA, 32 nt, Human
ggucgcaccgcuacacuccagccugggugaca

SEQ ID NO: 468844 - RNA, 32 nt, Human
ggucgcaccguuguacuccagccuggugauag

SEQ ID NO: 468845 - RNA, 32 nt, Human
ggucgcacggagcuuuucuuggguaaggcagu

SEQ ID NO: 468846 - RNA, 32 nt, Human
ggucgcagagcacagaucuuuaaagaagcgag

SEQ ID NO: 468847 - RNA, 32 nt, Human
ggucgcagagcagaggagacccaggcaguguc

SEQ ID NO: 468848 - RNA, 32 nt, Human
ggucgcagaggcaggaggcgugcguggcagga

SEQ ID NO: 468849 - RNA, 24 nt, Human
ggucgcagcaaauggcuucagccu

SEQ ID NO: 468850 - RNA, 32 nt, Human
ggucgcagcaaauggcuucagccugggacgcc

SEQ ID NO: 468851 - RNA, 32 nt, Human
ggucgcagcugcucgggaggcugaggcaggag

SEQ ID NO: 468852 - RNA, 32 nt, Human
ggucgcauucucucccgccugagacuucuuuu

SEQ ID NO: 468853 - RNA, 18 nt, Human
ggucgccacggccauccc

SEQ ID NO: 468854 - RNA, 32 nt, Human
ggucgccacugcacccagccugugucuuccag

SEQ ID NO: 468855 - RNA, 22 nt, Human
ggucgccagagcccugccccca

SEQ ID NO: 468856 - RNA, 32 nt, Human
ggucgccaugaucaccccaacucuagaggccg

SEQ ID NO: 468857 - RNA, 32 nt, Human
ggucgccccgagagaagagccaggguccuuca

SEQ ID NO: 468858 - RNA, 32 nt, Human
ggucgcccuccccaccaugaagaagacccgga

SEQ ID NO: 468859 - RNA, 32 nt, Human
ggucgcccugguuccuggcagcuccuggugcc

SEQ ID NO: 468860 - RNA, 32 nt, Human
ggucgccgccguugcugcuccugcugccgcag

SEQ ID NO: 468861 - RNA, 32 nt, Human
ggucgccucccaggugucccagcaagcccgug

SEQ ID NO: 468862 - RNA, 32 nt, Human
ggucgccucugccccacugccagccugagugg

SEQ ID NO: 468863 - RNA, 32 nt, Human
ggucgccucuuaggugacgcugggaagugccu

SEQ ID NO: 468864 - RNA, 32 nt, Human
ggucgccuggggaccccagaagggacaggcug

SEQ ID NO: 468865 - RNA, 32 nt, Human
ggucgccuguagucccagcuacucgggaggcu

SEQ ID NO: 468866 - RNA, 32 nt, Human
ggucgccugugaucgcagcuacucgggaggug

SEQ ID NO: 468867 - RNA, 28 nt, Human
ggucgccuguggagcucagccccgagcu

SEQ ID NO: 468868 - RNA, 28 nt, Human
ggucgccuguggagcucagcccugagcu

SEQ ID NO: 468869 - RNA, 32 nt, Human
ggucgcgccacugcacuccagccugggagaaa

SEQ ID NO: 468870 - RNA, 32 nt, Human
ggucgcgccacugcacuccagccugggcagca

SEQ ID NO: 468871 - RNA, 32 nt, Human
ggucgcgccacugcacuccagccugggcgaca

SEQ ID NO: 468872 - RNA, 32 nt, Human
ggucgcgccacugcacuucagccugggugaca

SEQ ID NO: 468873 - RNA, 32 nt, Human
ggucgcgccacugcgcuccagccuggacaaca

SEQ ID NO: 468874 - RNA, 32 nt, Human
ggucgcgccauugcacuccagccugggcaaca

SEQ ID NO: 468875 - RNA, 32 nt, Human
ggucgcgccauugcacuccagccugggcgaca

SEQ ID NO: 468876 - RNA, 32 nt, Human
ggucgcgcucacugcgacggcaggcuuugagu

SEQ ID NO: 468877 - RNA, 32 nt, Human
ggucgcggaagaggaggcugagagggucaaaa

SEQ ID NO: 468878 - RNA, 32 nt, Human
ggucgcggaggaggcagggggaaggugcccau

SEQ ID NO: 468879 - RNA, 25 nt, Human
ggucgcggcgccccgcgcuuccgcu

SEQ ID NO: 468880 - RNA, 22 nt, Human
ggucgcggcuugggcuccgcuu

SEQ ID NO: 468881 - RNA, 32 nt, Human
ggucgcgggaggugacgcgcggcgaggauggc

SEQ ID NO: 468882 - RNA, 32 nt, Human
ggucgcguagcccaggguggaggcagaacgau

SEQ ID NO: 468883 - RNA, 24 nt, Human
ggucgcgucgggagcccugcgcug

SEQ ID NO: 468884 - RNA, 32 nt, Human
ggucgcguugcauuguguucaugaccauguag

SEQ ID NO: 468885 - RNA, 32 nt, Human
ggucgcucagggagguggaguguccacuguuc

SEQ ID NO: 468886 - RNA, 32 nt, Human
ggucgcuccauugcacuccagccugggcaaca

SEQ ID NO: 468887 - RNA, 19 nt, Human
ggucgcucccguuccgcgc

SEQ ID NO: 468888 - RNA, 32 nt, Human
ggucgcuccugguucugccagcuccccugaga

SEQ ID NO: 468889 - RNA, 32 nt, Human
ggucgcucucuccuccccgccaccccacgcac

SEQ ID NO: 468890 - RNA, 32 nt, Human
ggucgcucuugggaggcacaggcaugggugug

SEQ ID NO: 468891 - RNA, 32 nt, Human
ggucgcugaggguuuggggaggcuuuucugag

SEQ ID NO: 468892 - RNA, 32 nt, Human
ggucgcugcagccucaaccuccugggcucaag

SEQ ID NO: 468893 - RNA, 20 nt, Human
ggucgcugcccuucacuccu

SEQ ID NO: 468894 - RNA, 21 nt, Human
ggucgcugccuguaccgcucc

SEQ ID NO: 468895 - RNA, 32 nt, Human
ggucgcugcguuuccucugccugcgccgggca

SEQ ID NO: 468896 - RNA, 32 nt, Human
ggucgcuggaaccagggcugccuuccagcacu

SEQ ID NO: 468897 - RNA, 32 nt, Human
ggucgcugggagacagaagguuuugugcccug

SEQ ID NO: 468898 - RNA, 32 nt, Human
ggucgcugggccugcuuguguccuccagccca

SEQ ID NO: 468899 - RNA, 32 nt, Human
ggucgcuguaaccuccgucuccuggguucaag

SEQ ID NO: 468900 - RNA, 22 nt, Human
ggucgcuguggaucugcgccca

SEQ ID NO: 468901 - RNA, 32 nt, Human
ggucgcuucuguagcuccgagggcagguugcg

SEQ ID NO: 468902 - RNA, 32 nt, Human
ggucggaaauggcagagguggaggagacacug

SEQ ID NO: 468903 - RNA, 32 nt, Human
ggucggagggccuugggcaagaucgccuccuc

SEQ ID NO: 468904 - RNA, 32 nt, Human
ggucggaguuaccugaucacaucgagagagug

SEQ ID NO: 468905 - RNA, 32 nt, Human
ggucggaucugagauaucucccagggagguuc

SEQ ID NO: 468906 - RNA, 32 nt, Human
ggucggaugggacuuccggccucaccccugaa

SEQ ID NO: 468907 - RNA, 32 nt, Human
ggucggauucugccaguuucugcucugcagcc

SEQ ID NO: 468908 - RNA, 32 nt, Human
ggucggcacaagauacagaucacaaagaccuu

SEQ ID NO: 468909 - RNA, 32 nt, Human
ggucggcagcaugggucgggagucacgccacu

SEQ ID NO: 468910 - RNA, 32 nt, Human
ggucggcauaggugcccacagagcagacugaa

SEQ ID NO: 468911 - RNA, 32 nt, Human
ggucggcccucgcccccucccccaggcccagc

SEQ ID NO: 468912 - RNA, 32 nt, Human
ggucggccuggagucccugcagccacucaugc

SEQ ID NO: 468913 - RNA, 32 nt, Human
ggucggcgcggguggagggggcgugaggccgc

SEQ ID NO: 468914 - RNA, 24 nt, Human
ggucggcgguuuccagccaaugga

SEQ ID NO: 468915 - RNA, 32 nt, Human
ggucggcugcagugccagcauccugccccucc

SEQ ID NO: 468916 - RNA, 26 nt, Human
ggucggcuuagcccugcuuuccgccu

SEQ ID NO: 468917 - RNA, 32 nt, Human
ggucggcuuggcugggagagauggauggcggg

SEQ ID NO: 468918 - RNA, 32 nt, Human
ggucgggaugccgaugccggcuuggaguuaga

SEQ ID NO: 468919 - RNA, 32 nt, Human
ggucgggauugaggcuguugaccugggcagua

SEQ ID NO: 468920 - RNA, 24 nt, Human
ggucgggcagcugggcucgggcgg

SEQ ID NO: 468921 - RNA, 32 nt, Human
ggucgggcagucaagccaggugaccccaugag

SEQ ID NO: 468922 - RNA, 32 nt, Human
ggucgggccugacugcagcgcagguccuaaaa

SEQ ID NO: 468923 - RNA, 32 nt, Human
ggucgggccugggccguuaucuccccacaacc

SEQ ID NO: 468924 - RNA, 32 nt, Human
ggucgggcugguggccugguggcccugagcgg

SEQ ID NO: 468925 - RNA, 32 nt, Human
ggucgggcuuccaggcuggauggagugcccug

SEQ ID NO: 468926 - RNA, 32 nt, Human
ggucggggcgagcagagggugcgaaggugcgg

SEQ ID NO: 468927 - RNA, 32 nt, Human
ggucggggcucaauggcuacguggaggcggga

SEQ ID NO: 468928 - RNA, 32 nt, Human
ggucgggggaauggcugaggagauggagucgu

SEQ ID NO: 468929 - RNA, 32 nt, Human
ggucgggguccaguagcugccccagaaacaag

SEQ ID NO: 468930 - RNA, 32 nt, Human
ggucggucaacacacacucacgcacuugcaca

SEQ ID NO: 468931 - RNA, 32 nt, Human
ggucggucacccagacagcucuguggaggcag

SEQ ID NO: 468932 - RNA, 32 nt, Human
ggucggugcaccacugcgugaccuccaggcag

SEQ ID NO: 468933 - RNA, 32 nt, Human
ggucggugcgaguggucggcugggcagagugc

SEQ ID NO: 468934 - RNA, 32 nt, Human
ggucgguggcggaggcugaggagaaggaggag

SEQ ID NO: 468935 - RNA, 32 nt, Human
ggucgguucuggagcgggugacccagauggcc

SEQ ID NO: 468936 - RNA, 23 nt, Human
ggucguagacgugucuguaccca

SEQ ID NO: 468937 - RNA, 32 nt, Human
ggucguagugcuguuucugguauucucaucgc

SEQ ID NO: 468938 - RNA, 32 nt, Human
ggucgucacagaaaggucucucuguuccucac

SEQ ID NO: 468939 - RNA, 32 nt, Human
ggucgucaccugcacucaucuuggguuuuccu

SEQ ID NO: 468940 - RNA, 22 nt, Human
ggucgucacgccuguaauccca

SEQ ID NO: 468941 - RNA, 32 nt, Human
ggucgucaggagguggagguugcagugagcca

SEQ ID NO: 468942 - RNA, 32 nt, Human
ggucguccucacugcuacacuccugacagcac

SEQ ID NO: 468943 - RNA, 32 nt, Human
ggucgucugaagaggagggccaggagucccca

SEQ ID NO: 468944 - RNA, 32 nt, Human
ggucgugaggggacagugacucccuuccaacc

SEQ ID NO: 468945 - RNA, 21 nt, Human
ggucgugauccuccugccuca

SEQ ID NO: 468946 - RNA, 32 nt, Human
ggucgugccacugcacuccagccugggcaaca

SEQ ID NO: 468947 - RNA, 32 nt, Human
ggucgugccacugcacuccagccugggcagca

SEQ ID NO: 468948 - RNA, 32 nt, Human
ggucgugccacugcacuccagccugggcgaca

SEQ ID NO: 468949 - RNA, 24 nt, Human
ggucgugccacugcacuucagccu

SEQ ID NO: 468950 - RNA, 32 nt, Human
ggucgugccacugcacuucagccugggugaca

SEQ ID NO: 468951 - RNA, 32 nt, Human
ggucgugccacugcaugccagccugggcaaca

SEQ ID NO: 468952 - RNA, 32 nt, Human
ggucgugccacugcgcuccagccugggugaca

SEQ ID NO: 468953 - RNA, 32 nt, Human
ggucgugccauugcacuccagccugggugaca

SEQ ID NO: 468954 - RNA, 32 nt, Human
ggucgugccugacgugcaccuuccucgggcac

SEQ ID NO: 468955 - RNA, 32 nt, Human
ggucgugcuacugcacucccgccugggugaca

SEQ ID NO: 468956 - RNA, 21 nt, Human
ggucguggaagaaacaaccca

SEQ ID NO: 468957 - RNA, 19 nt, Human
ggucguggaccauccccca

SEQ ID NO: 468958 - RNA, 18 nt, Human
ggucguggaccccggcca

SEQ ID NO: 468959 - RNA, 19 nt, Human
ggucguggagcuccgcacc

SEQ ID NO: 468960 - RNA, 32 nt, Human
ggucguggauggauggaaggcacacagcccgu

SEQ ID NO: 468961 - RNA, 21 nt, Human
ggucguggccauucacuccca

SEQ ID NO: 468962 - RNA, 32 nt, Human
ggucgugggaaagaagguggaagagcgagcuu

SEQ ID NO: 468963 - RNA, 32 nt, Human
ggucgugggucugagagucacuggagcuacca

SEQ ID NO: 468964 - RNA, 32 nt, Human
ggucgugguagucuuggaagaggucgaggggg

SEQ ID NO: 468965 - RNA, 23 nt, Human
ggucgugguggcucaugccugua

SEQ ID NO: 468966 - RNA, 23 nt, Human
ggucgugucuccuccugacccca

SEQ ID NO: 468967 - RNA, 32 nt, Human
ggucguugcacuccagccugucgcugugcaga

SEQ ID NO: 468968 - RNA, 19 nt, Human
ggucuaaauccagcucccu

SEQ ID NO: 468969 - RNA, 32 nt, Human
ggucuaacagggagcccggcugccucaccugg

SEQ ID NO: 468970 - RNA, 32 nt, Human
ggucuaacaucuaacaaauaguggcuuuagaa

SEQ ID NO: 468971 - RNA, 32 nt, Human
ggucuaacgagaagguugagcaccuucccguu

SEQ ID NO: 468972 - RNA, 32 nt, Human
ggucuaagagagaguccucagcagagucuucu

SEQ ID NO: 468973 - RNA, 32 nt, Human
ggucuaaguauaaaggcacuaccccagagaag

SEQ ID NO: 468974 - RNA, 32 nt, Human
ggucuaaguuuugggucauccaauugucaucc

SEQ ID NO: 468975 - RNA, 32 nt, Human
ggucuaauucucucacccaggugcaaaugacc

SEQ ID NO: 468976 - RNA, 32 nt, Human
ggucuaauuuccucucuguuuuuaacuauucu

SEQ ID NO: 468977 - RNA, 32 nt, Human
ggucuacacccacuuucugguagccucucugc

SEQ ID NO: 468978 - RNA, 32 nt, Human
ggucuacagcagacaaauagugaaccagagag

SEQ ID NO: 468979 - RNA, 32 nt, Human
ggucuacaggcacgcaccaccacacccagcua

SEQ ID NO: 468980 - RNA, 32 nt, Human
ggucuacaggugcauaccaccaugccuggcua

SEQ ID NO: 468981 - RNA, 32 nt, Human
ggucuacauggugaaaccccaucucaacuaaa

SEQ ID NO: 468982 - RNA, 32 nt, Human
ggucuacauuuuagggaagagcagguacaugg

SEQ ID NO: 468983 - RNA, 23 nt, Human
ggucuaccagcguggcggcuggu

SEQ ID NO: 468984 - RNA, 32 nt, Human
ggucuaccuagagguuucacauggcaccacuu

SEQ ID NO: 468985 - RNA, 32 nt, Human
ggucuaccugacagaugaguuugcuaaaggaa

SEQ ID NO: 468986 - RNA, 32 nt, Human
ggucuacuccauuccuccuggcccaccugggg

SEQ ID NO: 468987 - RNA, 32 nt, Human
ggucuacugugggaacaguuaucccuaaccac

SEQ ID NO: 468988 - RNA, 32 nt, Human
ggucuacuuggcucacccuccaccugcauccc

SEQ ID NO: 468989 - RNA, 32 nt, Human
ggucuacuuuccaauugguugucuggccauau

SEQ ID NO: 468990 - RNA, 20 nt, Human
ggucuacuuugacuuucaaa

SEQ ID NO: 468991 - RNA, 32 nt, Human
ggucuagacccucccuuuccugucacuuagcu

SEQ ID NO: 468992 - RNA, 32 nt, Human
ggucuagagaggaggagggcggggcuggagga

SEQ ID NO: 468993 - RNA, 32 nt, Human
ggucuagagccauaucugaaauauugcuaagc

SEQ ID NO: 468994 - RNA, 32 nt, Human
ggucuagaggaaugaguguccaggcagaguuc

SEQ ID NO: 468995 - RNA, 21 nt, Human
ggucuagaggggucuggggca

SEQ ID NO: 468996 - RNA, 32 nt, Human
ggucuagaucacauucucgauccagaggaagg

SEQ ID NO: 468997 - RNA, 24 nt, Human
ggucuagaucuccugaccuuguga

SEQ ID NO: 468998 - RNA, 32 nt, Human
ggucuagcaaacauaaugcuaguccuagauua

SEQ ID NO: 468999 - RNA, 32 nt, Human
ggucuagccaggggagguugugugugugggag

SEQ ID NO: 469000 - RNA, 32 nt, Human
ggucuagcuaguucuuguaaaagugaugccuc

SEQ ID NO: 469001 - RNA, 32 nt, Human
ggucuagcuaucucuuuuacuguaccauuuua

SEQ ID NO: 469002 - RNA, 32 nt, Human
ggucuaggacacaccuucccugagacucauga

SEQ ID NO: 469003 - RNA, 32 nt, Human
ggucuaggcagcaguggauggugcaggggaaa

SEQ ID NO: 469004 - RNA, 32 nt, Human
ggucuaggcagggcagccgguucuccaccucc

SEQ ID NO: 469005 - RNA, 22 nt, Human
ggucuaggcuaaccuuugguca

SEQ ID NO: 469006 - RNA, 32 nt, Human
ggucuagggcaggaguccagcggagaagggaa

SEQ ID NO: 469007 - RNA, 32 nt, Human
ggucuaggugugaguccuuccucagauaugug

SEQ ID NO: 469008 - RNA, 31 nt, Human
ggucuauaaagaaaaucugcucuuuaaccac

SEQ ID NO: 469009 - RNA, 32 nt, Human
ggucuauaaagaaaaucugcucuuuaaccacu

SEQ ID NO: 469010 - RNA, 25 nt, Human
ggucuauaugcugggugcugagaca

SEQ ID NO: 469011 - RNA, 32 nt, Human
ggucuauaugcugggugcugagacacugaucc

SEQ ID NO: 469012 - RNA, 31 nt, Human
ggucuaucagaauccuaacucacuuagacca

SEQ ID NO: 469013 - RNA, 32 nt, Human
ggucuaucucagaggaaggaacaggaaacaaa

SEQ ID NO: 469014 - RNA, 32 nt, Human
ggucuaugccaaggaacagcuguuugcugaag

SEQ ID NO: 469015 - RNA, 32 nt, Human
ggucuauucauagggucccaaaccacuuuggc

SEQ ID NO: 469016 - RNA, 24 nt, Human
ggucucaaacaccugaccuuguga

SEQ ID NO: 469017 - RNA, 24 nt, Human
ggucucaaacuccuaaccuuguga

SEQ ID NO: 469018 - RNA, 24 nt, Human
ggucucaaacuccugacccuguga

SEQ ID NO: 469019 - RNA, 24 nt, Human
ggucucaaacuccugaccuaguga

SEQ ID NO: 469020 - RNA, 32 nt, Human
ggucucaaacuccugaccucaggugcccaccu

SEQ ID NO: 469021 - RNA, 24 nt, Human
ggucucaaacuccugaccucauga

SEQ ID NO: 469022 - RNA, 22 nt, Human
ggucucaaacuccugaccucgu

SEQ ID NO: 469023 - RNA, 24 nt, Human
ggucucaaacuccugaccucguga

SEQ ID NO: 469024 - RNA, 24 nt, Human
ggucucaaacuccugaccucuuga

SEQ ID NO: 469025 - RNA, 20 nt, Human
ggucucaaacuccugaccuu

SEQ ID NO: 469026 - RNA, 24 nt, Human
ggucucaaacuccugaccuuguga

SEQ ID NO: 469027 - RNA, 24 nt, Human
ggucucaaacuccugaccuugugg

SEQ ID NO: 469028 - RNA, 24 nt, Human
ggucucaaacucuugaccucguga

SEQ ID NO: 469029 - RNA, 24 nt, Human
ggucucaaacuucugaccucguga

SEQ ID NO: 469030 - RNA, 32 nt, Human
ggucucaaagauaacugcauccuucauuccag

SEQ ID NO: 469031 - RNA, 20 nt, Human
ggucucaagauggaacugug

SEQ ID NO: 469032 - RNA, 25 nt, Human
ggucucaagugauucuacugccuca

SEQ ID NO: 469033 - RNA, 24 nt, Human
ggucucaauccccugaccucguga

SEQ ID NO: 469034 - RNA, 22 nt, Human
ggucucaauccuggccucuuga

SEQ ID NO: 469035 - RNA, 24 nt, Human
ggucucaaucucccggccucguga

SEQ ID NO: 469036 - RNA, 24 nt, Human
ggucucaaucuccuaaccuugaga

SEQ ID NO: 469037 - RNA, 19 nt, Human
ggucucaaucuccugaccu

SEQ ID NO: 469038 - RNA, 24 nt, Human
ggucucaaucuccugaccucauga

SEQ ID NO: 469039 - RNA, 24 nt, Human
ggucucaaucuccugaccucguga

SEQ ID NO: 469040 - RNA, 24 nt, Human
ggucucaaucuccugaccuuguga

SEQ ID NO: 469041 - RNA, 24 nt, Human
ggucucaaucuccugacuucaugg

SEQ ID NO: 469042 - RNA, 22 nt, Human
ggucucaaucucgaccucguga

SEQ ID NO: 469043 - RNA, 24 nt, Human
ggucucaaucucuugaccuccuga

SEQ ID NO: 469044 - RNA, 22 nt, Human
ggucucaaucucuugaccucgu

SEQ ID NO: 469045 - RNA, 24 nt, Human
ggucucaaucucuugaccucuuga

SEQ ID NO: 469046 - RNA, 24 nt, Human
ggucucaaucucuugaccuuguga

SEQ ID NO: 469047 - RNA, 32 nt, Human
ggucucaaugggucucauuugagucucgcggg

SEQ ID NO: 469048 - RNA, 32 nt, Human
ggucucaccaacaagugaggauauagccuuau

SEQ ID NO: 469049 - RNA, 32 nt, Human
ggucucacccccacuuccuuccagucauacac

SEQ ID NO: 469050 - RNA, 32 nt, Human
ggucucaccugucaguuguuugcugaguuuau

SEQ ID NO: 469051 - RNA, 32 nt, Human
ggucucaccugucgcuggagugcaguggugug

SEQ ID NO: 469052 - RNA, 21 nt, Human
ggucucaccuuccgcgcaagg

SEQ ID NO: 469053 - RNA, 32 nt, Human
ggucucacgccugugaucccagcacuuuggga

SEQ ID NO: 469054 - RNA, 22 nt, Human
ggucucacguuuguugccauua

SEQ ID NO: 469055 - RNA, 32 nt, Human
ggucucacuauauugcccagacuggucucgaa

SEQ ID NO: 469056 - RNA, 21 nt, Human
ggucucacucaggcaccagcc

SEQ ID NO: 469057 - RNA, 24 nt, Human
ggucucacugcaaccucuaccucc

SEQ ID NO: 469058 - RNA, 32 nt, Human
ggucucacugcaaccucuaccucccagguuca

SEQ ID NO: 469059 - RNA, 32 nt, Human
ggucucacuggaccaucaggacugcugccgcc

SEQ ID NO: 469060 - RNA, 32 nt, Human
ggucucacuggacugaauuccugccaccuccc

SEQ ID NO: 469061 - RNA, 32 nt, Human
ggucucagagaacucccccaccugugguuuua

SEQ ID NO: 469062 - RNA, 32 nt, Human
ggucucagcauucugucauacucaacagcuau

SEQ ID NO: 469063 - RNA, 23 nt, Human
ggucucagcauuucaucugugaa

SEQ ID NO: 469064 - RNA, 32 nt, Human
ggucucagccaagacaugugauaaucacugua

SEQ ID NO: 469065 - RNA, 32 nt, Human
ggucucagccuccucccgaccccuuccugcgc

SEQ ID NO: 469066 - RNA, 32 nt, Human
ggucucagccugggcccaggucgaggaaggcc

SEQ ID NO: 469067 - RNA, 32 nt, Human
ggucucagccuggggguggcagggguggggca

SEQ ID NO: 469068 - RNA, 32 nt, Human
ggucucagcuacucaggaggcugagaugagag

SEQ ID NO: 469069 - RNA, 32 nt, Human
ggucucagcuacucaggaggcugaggugggag

SEQ ID NO: 469070 - RNA, 32 nt, Human
ggucucagcuacucagggggcugaggcuggac

SEQ ID NO: 469071 - RNA, 32 nt, Human
ggucucagcuacucggcauucugaggugggag

SEQ ID NO: 469072 - RNA, 32 nt, Human
ggucucagcuacucgggaggcugaggugggag

SEQ ID NO: 469073 - RNA, 32 nt, Human
ggucucagcuacuugggaggcugaggcaggag

SEQ ID NO: 469074 - RNA, 32 nt, Human
ggucucagcuacuugggaggcugaggugggag

SEQ ID NO: 469075 - RNA, 32 nt, Human
ggucucagcuacuugggaggcuggggugggag

SEQ ID NO: 469076 - RNA, 23 nt, Human
ggucucaggccaauuacugugga

SEQ ID NO: 469077 - RNA, 32 nt, Human
ggucucaggccuguguggggagcuggugccuc

SEQ ID NO: 469078 - RNA, 32 nt, Human
ggucucagggagccaguucaaggucuggcugu

SEQ ID NO: 469079 - RNA, 32 nt, Human
ggucucaggggcuggggcucuaccuccccugg

SEQ ID NO: 469080 - RNA, 32 nt, Human
ggucucagucccggcuccaucugugcccucgc

SEQ ID NO: 469081 - RNA, 24 nt, Human
ggucucagucuccagacccuguga

SEQ ID NO: 469082 - RNA, 32 nt, Human
ggucucaguggaggggacaaaggcaagcaaaa

SEQ ID NO: 469083 - RNA, 21 nt, Human
ggucucaguguccucaucugu

SEQ ID NO: 469084 - RNA, 23 nt, Human
ggucucauaauuccauuugugga

SEQ ID NO: 469085 - RNA, 32 nt, Human
ggucucauauuggauucuuucugucauccuau

SEQ ID NO: 469086 - RNA, 32 nt, Human
ggucucauccgccugcacagcugaguccagug

SEQ ID NO: 469087 - RNA, 32 nt, Human
ggucucaucugaauauuguggucucaucuaaa

SEQ ID NO: 469088 - RNA, 32 nt, Human
ggucucaugguucagacagagggagguggacg

SEQ ID NO: 469089 - RNA, 22 nt, Human
ggucucauucauggcuugggga

SEQ ID NO: 469090 - RNA, 32 nt, Human
ggucuccaaaagugcugggauuacaggcauga

SEQ ID NO: 469091 - RNA, 24 nt, Human
ggucuccaacuccugacuucauga

SEQ ID NO: 469092 - RNA, 32 nt, Human
ggucuccaagccccaaaugaguccuugugaac

SEQ ID NO: 469093 - RNA, 31 nt, Human
ggucuccaagugucaacucccagugaaagaa

SEQ ID NO: 469094 - RNA, 32 nt, Human
ggucuccacaucuuccuucucugaaguccagg

SEQ ID NO: 469095 - RNA, 19 nt, Human
ggucuccagaaccccuuug

SEQ ID NO: 469096 - RNA, 19 nt, Human
ggucuccagaagcccugca

SEQ ID NO: 469097 - RNA, 19 nt, Human
ggucuccagagcgcuugca

SEQ ID NO: 469098 - RNA, 32 nt, Human
ggucuccagagggagacaugacaguaauugua

SEQ ID NO: 469099 - RNA, 32 nt, Human
ggucuccagcaggaguggaggcuggucugggc

SEQ ID NO: 469100 - RNA, 32 nt, Human
ggucuccagccucaucgaauucuugaagcaga

SEQ ID NO: 469101 - RNA, 32 nt, Human
ggucuccagcugcaguggguggccgccaauug

SEQ ID NO: 469102 - RNA, 32 nt, Human
ggucuccagcuuauagaugacagaucauggga

SEQ ID NO: 469103 - RNA, 32 nt, Human
ggucuccagcuucucugcuucucagcugccau

SEQ ID NO: 469104 - RNA, 32 nt, Human
ggucuccagggccuggcagaccccagagucag

SEQ ID NO: 469105 - RNA, 23 nt, Human
ggucuccagggggucccugugca

SEQ ID NO: 469106 - RNA, 32 nt, Human
ggucuccaggugguccagaggauagcauugcg

SEQ ID NO: 469107 - RNA, 32 nt, Human
ggucuccauauguugcccaggcuggucucgaa

SEQ ID NO: 469108 - RNA, 24 nt, Human
ggucuccaucuccugaccucauga

SEQ ID NO: 469109 - RNA, 24 nt, Human
ggucuccaucuccugaccuccuga

SEQ ID NO: 469110 - RNA, 24 nt, Human
ggucuccaucuccugaccucguga

SEQ ID NO: 469111 - RNA, 24 nt, Human
ggucuccaucuccugaccuuguga

SEQ ID NO: 469112 - RNA, 24 nt, Human
ggucuccaucucuugaccucguga

SEQ ID NO: 469113 - RNA, 21 nt, Human
ggucuccaucuucuuucacuc

SEQ ID NO: 469114 - RNA, 32 nt, Human
ggucuccaucuucuuucacuccuguggcccug

SEQ ID NO: 469115 - RNA, 32 nt, Human
ggucuccaucuucuuugacuccuguggcccuc

SEQ ID NO: 469116 - RNA, 32 nt, Human
ggucucccaaaaugcugggauuacagggguga

SEQ ID NO: 469117 - RNA, 32 nt, Human
ggucucccaaagcgcugggauuacaggcguga

SEQ ID NO: 469118 - RNA, 32 nt, Human
ggucucccaaagugaugggauuacaggcguga

SEQ ID NO: 469119 - RNA, 32 nt, Human
ggucucccaaagugcugggauuacagacauga

SEQ ID NO: 469120 - RNA, 32 nt, Human
ggucucccaaagugcugggauuacagauguga

SEQ ID NO: 469121 - RNA, 32 nt, Human
ggucucccaaagugcugggauuacaggaguga

SEQ ID NO: 469122 - RNA, 32 nt, Human
ggucucccaaagugcugggauuacaggcauga

SEQ ID NO: 469123 - RNA, 32 nt, Human
ggucucccaaagugcugggauuacaggcguga

SEQ ID NO: 469124 - RNA, 32 nt, Human
ggucucccaaagugcugggauuacaggcuuga

SEQ ID NO: 469125 - RNA, 32 nt, Human
ggucucccaaagugcugggauuacagggauaa

SEQ ID NO: 469126 - RNA, 32 nt, Human
ggucucccaaagugcugggauuacagguguga

SEQ ID NO: 469127 - RNA, 32 nt, Human
ggucucccaaagugcugggauuacccacaucc

SEQ ID NO: 469128 - RNA, 32 nt, Human
ggucucccaaagugcugggauuacgguguuag

SEQ ID NO: 469129 - RNA, 32 nt, Human
ggucucccaaagugcugggauuauaggcauga

SEQ ID NO: 469130 - RNA, 32 nt, Human
ggucucccaaaguguugggauuacaggcauga

SEQ ID NO: 469131 - RNA, 32 nt, Human
ggucucccaacgugcugggauuacaggcauga

SEQ ID NO: 469132 - RNA, 28 nt, Human
ggucucccaagugcacucauccagguca

SEQ ID NO: 469133 - RNA, 32 nt, Human
ggucucccagaguguuaggauuacaggcguga

SEQ ID NO: 469134 - RNA, 32 nt, Human
ggucuccccaccccaccugugcuggugugugu

SEQ ID NO: 469135 - RNA, 32 nt, Human
ggucuccccagccuuaguuuagguugguguau

SEQ ID NO: 469136 - RNA, 32 nt, Human
ggucuccccaguuccuccucucagaacuccca

SEQ ID NO: 469137 - RNA, 32 nt, Human
ggucuccccaugugccugcaccaggagacaga

SEQ ID NO: 469138 - RNA, 32 nt, Human
ggucucccccacccccaggagguuuuaugauu

SEQ ID NO: 469139 - RNA, 32 nt, Human
ggucucccccucccagcuucuuaccucggcuu

SEQ ID NO: 469140 - RNA, 24 nt, Human
ggucuccccugacgcccacaccca

SEQ ID NO: 469141 - RNA, 32 nt, Human
ggucucccgaagugcugggauuacagguguga

SEQ ID NO: 469142 - RNA, 32 nt, Human
ggucucccgaguggcugggauuauaggcgugc

SEQ ID NO: 469143 - RNA, 21 nt, Human
ggucucccguaggaaacugug

SEQ ID NO: 469144 - RNA, 32 nt, Human
ggucucccgugaggcuggagucagccgugggu

SEQ ID NO: 469145 - RNA, 32 nt, Human
ggucucccuacaaaugaagacuuaucagggcc

SEQ ID NO: 469146 - RNA, 32 nt, Human
ggucucccuauguugcccaggcuggucuagaa

SEQ ID NO: 469147 - RNA, 32 nt, Human
ggucucccuauguugcccaggcuggucuugaa

SEQ ID NO: 469148 - RNA, 32 nt, Human
ggucucccugggggcuccccaguggcucugcc

SEQ ID NO: 469149 - RNA, 32 nt, Human
ggucucccuguguuacccaggcuggucucaaa

SEQ ID NO: 469150 - RNA, 32 nt, Human
ggucucccuuugacuucauguguucucccugu

SEQ ID NO: 469151 - RNA, 32 nt, Human
ggucuccgagaugucacgauggcuguggccau

SEQ ID NO: 469152 - RNA, 32 nt, Human
ggucuccgcacuuggaaagguuucaagacuug

SEQ ID NO: 469153 - RNA, 19 nt, Human
ggucuccgccggcgcccgc

SEQ ID NO: 469154 - RNA, 32 nt, Human
ggucuccgggguccgcuuuggccagaggcgcg

SEQ ID NO: 469155 - RNA, 24 nt, Human
ggucuccgucuccugaccucguga

SEQ ID NO: 469156 - RNA, 32 nt, Human
ggucuccuaaaguacugggauuacaggcguga

SEQ ID NO: 469157 - RNA, 32 nt, Human
ggucuccucccuccucccccuucaccaaugcc

SEQ ID NO: 469158 - RNA, 32 nt, Human
ggucuccucgugccuccucccagaucacccuu

SEQ ID NO: 469159 - RNA, 22 nt, Human
ggucuccugaacugagcugugu

SEQ ID NO: 469160 - RNA, 32 nt, Human
ggucuccugaguagcugggacuacaggugcau

SEQ ID NO: 469161 - RNA, 32 nt, Human
ggucuccugauccguccgaggcugcuucccag

SEQ ID NO: 469162 - RNA, 22 nt, Human
ggucuccugcacugagcugugu

SEQ ID NO: 469163 - RNA, 32 nt, Human
ggucuccugcagcccucugcuccucccggccg

SEQ ID NO: 469164 - RNA, 32 nt, Human
ggucuccugcagggcccugccucccaagcccc

SEQ ID NO: 469165 - RNA, 19 nt, Human
ggucuccuguccuccugca

SEQ ID NO: 469166 - RNA, 22 nt, Human
ggucuccugugcuuggugugug

SEQ ID NO: 469167 - RNA, 32 nt, Human
ggucuccuugcccugugaacgcuccauuugug

SEQ ID NO: 469168 - RNA, 32 nt, Human
ggucuccuugggacguucaucuccuguacucc

SEQ ID NO: 469169 - RNA, 23 nt, Human
ggucucgaaccccgaucucguga

SEQ ID NO: 469170 - RNA, 24 nt, Human
ggucucgaacgccugaccucauga

SEQ ID NO: 469171 - RNA, 23 nt, Human
ggucucgaacgccugaccucgug

SEQ ID NO: 469172 - RNA, 24 nt, Human
ggucucgaacuacugaccucguga

SEQ ID NO: 469173 - RNA, 19 nt, Human
ggucucgaacuccugaccu

SEQ ID NO: 469174 - RNA, 24 nt, Human
ggucucgaacuccugaccucauga

SEQ ID NO: 469175 - RNA, 24 nt, Human
ggucucgaacuccugaccucggga

SEQ ID NO: 469176 - RNA, 24 nt, Human
ggucucgaacuccugaccucguga

SEQ ID NO: 469177 - RNA, 24 nt, Human
ggucucgaacuccugaccugguga

SEQ ID NO: 469178 - RNA, 20 nt, Human
ggucucgaacuccugaccuu

SEQ ID NO: 469179 - RNA, 24 nt, Human
ggucucgaacuccugaccuuguga

SEQ ID NO: 469180 - RNA, 24 nt, Human
ggucucgaacuccugaucucauga

SEQ ID NO: 469181 - RNA, 24 nt, Human
ggucucgaacuccuggccucguga

SEQ ID NO: 469182 - RNA, 32 nt, Human
ggucucgaacuccuggcuucaagggauccucc

SEQ ID NO: 469183 - RNA, 23 nt, Human
ggucucgaacucugaccuuguga

SEQ ID NO: 469184 - RNA, 24 nt, Human
ggucucgaacucuugaccuuguga

SEQ ID NO: 469185 - RNA, 22 nt, Human
ggucucgaauuccugaccucug

SEQ ID NO: 469186 - RNA, 23 nt, Human
ggucucgacccuggaccuccuga

SEQ ID NO: 469187 - RNA, 32 nt, Human
ggucucgacuccuguuuuguucugcgguuccc

SEQ ID NO: 469188 - RNA, 25 nt, Human
ggucucgagucuccugaccucguga

SEQ ID NO: 469189 - RNA, 24 nt, Human
ggucucgauauccugaccuuguga

SEQ ID NO: 469190 - RNA, 23 nt, Human
ggucucgauaucugaucucguga

SEQ ID NO: 469191 - RNA, 22 nt, Human
ggucucgaucucaaccucguga

SEQ ID NO: 469192 - RNA, 24 nt, Human
ggucucgaucuccuaaccugguga

SEQ ID NO: 469193 - RNA, 24 nt, Human
ggucucgaucuccucaccucguga

SEQ ID NO: 469194 - RNA, 19 nt, Human
ggucucgaucuccugaccu

SEQ ID NO: 469195 - RNA, 24 nt, Human
ggucucgaucuccugaccucauga

SEQ ID NO: 469196 - RNA, 24 nt, Human
ggucucgaucuccugaccucguga

SEQ ID NO: 469197 - RNA, 24 nt, Human
ggucucgaucuccugaccugguga

SEQ ID NO: 469198 - RNA, 22 nt, Human
ggucucgaucuccugaccuugu

SEQ ID NO: 469199 - RNA, 24 nt, Human
ggucucgaucuccugaccuuguga

SEQ ID NO: 469200 - RNA, 24 nt, Human
ggucucgaucuccugacgucguga

SEQ ID NO: 469201 - RNA, 24 nt, Human
ggucucgaucuccugacuucauga

SEQ ID NO: 469202 - RNA, 22 nt, Human
ggucucgaucuccugacuucgu

SEQ ID NO: 469203 - RNA, 24 nt, Human
ggucucgaucuccugcccucguga

SEQ ID NO: 469204 - RNA, 23 nt, Human
ggucucgaucuccugcccuggug

SEQ ID NO: 469205 - RNA, 24 nt, Human
ggucucgaucuccugcccugguga

SEQ ID NO: 469206 - RNA, 24 nt, Human
ggucucgaucucuuaaccuuguga

SEQ ID NO: 469207 - RNA, 24 nt, Human
ggucucgaucucuugaccucauga

SEQ ID NO: 469208 - RNA, 24 nt, Human
ggucucgaucucuugaccucguga

SEQ ID NO: 469209 - RNA, 24 nt, Human
ggucucgaucucuugaccugguga

SEQ ID NO: 469210 - RNA, 24 nt, Human
ggucucgaucucuugacgucguga

SEQ ID NO: 469211 - RNA, 24 nt, Human
ggucucgaucucuugaucucauga

SEQ ID NO: 469212 - RNA, 21 nt, Human
ggucucgaucugaccucauga

SEQ ID NO: 469213 - RNA, 24 nt, Human
ggucucgaucuucugaccucguga

SEQ ID NO: 469214 - RNA, 24 nt, Human
ggucucgaugaucugaccucguga

SEQ ID NO: 469215 - RNA, 24 nt, Human
ggucucgauuuccugaccuaguga

SEQ ID NO: 469216 - RNA, 24 nt, Human
ggucucgauuuccugaccucguga

SEQ ID NO: 469217 - RNA, 24 nt, Human
ggucucgauuuccugaccuuguga

SEQ ID NO: 469218 - RNA, 32 nt, Human
ggucucgcagccucugucucuuccgcucucug

SEQ ID NO: 469219 - RNA, 32 nt, Human
ggucucgcccaccaaagccagaaagugcaagc

SEQ ID NO: 469220 - RNA, 24 nt, Human
ggucucgcccuccugaccuuguga

SEQ ID NO: 469221 - RNA, 24 nt, Human
ggucucgcucuccugaccucguga

SEQ ID NO: 469222 - RNA, 24 nt, Human
ggucucggacccuugaccuuguga

SEQ ID NO: 469223 - RNA, 32 nt, Human
ggucucggacuccugaccucaggugucugccc

SEQ ID NO: 469224 - RNA, 22 nt, Human
ggucucggcaguggcuguaagg

SEQ ID NO: 469225 - RNA, 32 nt, Human
ggucucgggacaucuccagacccuaccaacug

SEQ ID NO: 469226 - RNA, 32 nt, Human
ggucucgggccagccccuccucuccccgccuu

SEQ ID NO: 469227 - RNA, 21 nt, Human
ggucucggguauccuuucaaa

SEQ ID NO: 469228 - RNA, 32 nt, Human
ggucucggguccagggaguggagggggcugcc

SEQ ID NO: 469229 - RNA, 23 nt, Human
ggucucggucccuccgcgcaagg

SEQ ID NO: 469230 - RNA, 32 nt, Human
ggucucgugaugcucccucccucuccggagug

SEQ ID NO: 469231 - RNA, 18 nt, Human
ggucucguggcuggggga

SEQ ID NO: 469232 - RNA, 32 nt, Human
ggucucuacuaaaaauacaaaaauuaacuggg

SEQ ID NO: 469233 - RNA, 32 nt, Human
ggucucuacuaaaaauacaaaaauuagccagg

SEQ ID NO: 469234 - RNA, 32 nt, Human
ggucucuacuaaaaauacaaaaauuagcgggg

SEQ ID NO: 469235 - RNA, 32 nt, Human
ggucucuacuaaaaauucaaaaauuaccuagg

SEQ ID NO: 469236 - RNA, 32 nt, Human
ggucucuaggaugccagaggcagcgcacacaa

SEQ ID NO: 469237 - RNA, 32 nt, Human
ggucucuaguaguucuggcccaccucuuuccc

SEQ ID NO: 469238 - RNA, 32 nt, Human
ggucucuauacauuauaccaucugcugaaguu

SEQ ID NO: 469239 - RNA, 24 nt, Human
ggucucuaucuccugaccucguga

SEQ ID NO: 469240 - RNA, 32 nt, Human
ggucucuaugagcaaggaauacaagacaaaac

SEQ ID NO: 469241 - RNA, 32 nt, Human
ggucucucaaagugcugggauuacaggcauaa

SEQ ID NO: 469242 - RNA, 28 nt, Human
ggucucucaagugcuuaugcuuuucuuc

SEQ ID NO: 469243 - RNA, 32 nt, Human
ggucucucaccucucugaccucagcuuccuca

SEQ ID NO: 469244 - RNA, 32 nt, Human
ggucucucauuacccagcuaauacucagcagg

SEQ ID NO: 469245 - RNA, 32 nt, Human
ggucucuccagccucuggucccugggagcaag

SEQ ID NO: 469246 - RNA, 32 nt, Human
ggucucucccuucauuugucucuggugggaca

SEQ ID NO: 469247 - RNA, 32 nt, Human
ggucucuccgggucacgaucuuccaaaguucg

SEQ ID NO: 469248 - RNA, 32 nt, Human
ggucucuccucccugcugaagucccucuccug

SEQ ID NO: 469249 - RNA, 32 nt, Human
ggucucuccugcugcuuuccugguauagcacc

SEQ ID NO: 469250 - RNA, 32 nt, Human
ggucucucucacucugcccccuccucacgcag

SEQ ID NO: 469251 - RNA, 32 nt, Human
ggucucucuccaggacugccaggcugcuggag

SEQ ID NO: 469252 - RNA, 32 nt, Human
ggucucucugagaagcaggaaucucccuguau

SEQ ID NO: 469253 - RNA, 20 nt, Human
ggucucucugucaccaggcu

SEQ ID NO: 469254 - RNA, 32 nt, Human
ggucucucuguggugaccauucacagcauaac

SEQ ID NO: 469255 - RNA, 32 nt, Human
ggucucugcagcaacagaggcaauuuagcaug

SEQ ID NO: 469256 - RNA, 21 nt, Human
ggucucugcauguaguuguca

SEQ ID NO: 469257 - RNA, 32 nt, Human
ggucucugccuucuccccuuacccucccgccu

SEQ ID NO: 469258 - RNA, 19 nt, Human
ggucucugcuagaguuguu

SEQ ID NO: 469259 - RNA, 32 nt, Human
ggucucugcucugcuacccaaggaacuggugg

SEQ ID NO: 469260 - RNA, 21 nt, Human
ggucucugcugugcguugucc

SEQ ID NO: 469261 - RNA, 32 nt, Human
ggucucuggagacaucuucagcaggugggugc

SEQ ID NO: 469262 - RNA, 32 nt, Human
ggucucugggaacccucagaauacggcucagu

SEQ ID NO: 469263 - RNA, 32 nt, Human
ggucucugggagaggaaggaagagggagggag

SEQ ID NO: 469264 - RNA, 32 nt, Human
ggucucugggcuccuguuucugcucuuuuccu

SEQ ID NO: 469265 - RNA, 32 nt, Human
ggucucugggcugaggcggcgacagcuccucu

SEQ ID NO: 469266 - RNA, 32 nt, Human
ggucucuguaacuguggggugagggaaggcag

SEQ ID NO: 469267 - RNA, 32 nt, Human
ggucucugucuccgucccuccuccuuugcugc

SEQ ID NO: 469268 - RNA, 32 nt, Human
ggucucuguucacauggcucaacuggaaaccu

SEQ ID NO: 469269 - RNA, 32 nt, Human
ggucucuuaccuuuuccaagcuacucagaccu

SEQ ID NO: 469270 - RNA, 32 nt, Human
ggucucuuacuaacuccauuacacucucucuc

SEQ ID NO: 469271 - RNA, 32 nt, Human
ggucucuucagccucagaugguucacuccugg

SEQ ID NO: 469272 - RNA, 32 nt, Human
ggucucuucaugcucuccccaucccaguuuuu

SEQ ID NO: 469273 - RNA, 32 nt, Human
ggucucuucccaaccagaccccacccaggcac

SEQ ID NO: 469274 - RNA, 32 nt, Human
ggucucuuccucuccaggccuugccguccccc

SEQ ID NO: 469275 - RNA, 32 nt, Human
ggucucuucuauucucccuuggguuuuauggg

SEQ ID NO: 469276 - RNA, 32 nt, Human
ggucucuucuucuuucugguuguuuuuguucu

SEQ ID NO: 469277 - RNA, 32 nt, Human
ggucucuugccaguacaauccccaggcguuuu

SEQ ID NO: 469278 - RNA, 23 nt, Human
ggucucuuugcuuucugguggug

SEQ ID NO: 469279 - RNA, 32 nt, Human
ggucucuuuuccucaggcauuccagaggugaa

SEQ ID NO: 469280 - RNA, 32 nt, Human
ggucucuuuuugcuuugguugccuguguguuc

SEQ ID NO: 469281 - RNA, 23 nt, Human
ggucugaaagggguguuugggca

SEQ ID NO: 469282 - RNA, 32 nt, Human
ggucugaaaguaggaggugggggaagaggcaa

SEQ ID NO: 469283 - RNA, 32 nt, Human
ggucugaacguggugucucacucugaaaagca

SEQ ID NO: 469284 - RNA, 32 nt, Human
ggucugaacucacuccaaaagauaauaacugc

SEQ ID NO: 469285 - RNA, 32 nt, Human
ggucugaacugcggccccagagccuuuggccu

SEQ ID NO: 469286 - RNA, 32 nt, Human
ggucugaacuguggguggauggguggauugcc

SEQ ID NO: 469287 - RNA, 32 nt, Human
ggucugaaggccaggagcccugugcucuugac

SEQ ID NO: 469288 - RNA, 32 nt, Human
ggucugaaggcuggcuucugaagaaucccuga

SEQ ID NO: 469289 - RNA, 32 nt, Human
ggucugaaguagaauuuucacuuuauguuaga

SEQ ID NO: 469290 - RNA, 32 nt, Human
ggucugaauguggacccucucuccccgaccuc

SEQ ID NO: 469291 - RNA, 32 nt, Human
ggucugacaccugggcuggagugcaguggugc

SEQ ID NO: 469292 - RNA, 32 nt, Human
ggucugacucacccacaauccaucagccugcu

SEQ ID NO: 469293 - RNA, 32 nt, Human
ggucugacugcacugucuccaucuuaugcaaa

SEQ ID NO: 469294 - RNA, 32 nt, Human
ggucugacuguguuacccaggcuggucuucaa

SEQ ID NO: 469295 - RNA, 16 nt, Human
ggucugacuugagguc

SEQ ID NO: 469296 - RNA, 32 nt, Human
ggucugagaacagcggagcgcggaaaccgcgg

SEQ ID NO: 469297 - RNA, 32 nt, Human
ggucugagaacugucagccuuuugccauucaa

SEQ ID NO: 469298 - RNA, 32 nt, Human
ggucugagacaaagggcccuguuucucagcau

SEQ ID NO: 469299 - RNA, 24 nt, Human
ggucugagacucucuuuccuuuug

SEQ ID NO: 469300 - RNA, 32 nt, Human
ggucugagagagaacuccugaccucgugaucc

SEQ ID NO: 469301 - RNA, 32 nt, Human
ggucugagcagagacauugauuugguuucauu

SEQ ID NO: 469302 - RNA, 18 nt, Human
ggucugagcccgcaccca

SEQ ID NO: 469303 - RNA, 20 nt, Human
ggucugagccugcugggccc

SEQ ID NO: 469304 - RNA, 21 nt, Human
ggucugagccuugccuggggc

SEQ ID NO: 469305 - RNA, 32 nt, Human
ggucugagcucccugcccugagaggucggugc

SEQ ID NO: 469306 - RNA, 32 nt, Human
ggucugagcucuccagccuguggcaucuacuc

SEQ ID NO: 469307 - RNA, 32 nt, Human
ggucugagcucuuggguggaagggacccuccu

SEQ ID NO: 469308 - RNA, 32 nt, Human
ggucugaggcccaaauccuuccucacuaaggg

SEQ ID NO: 469309 - RNA, 32 nt, Human
ggucugaggcccauccucccacucucacuguc

SEQ ID NO: 469310 - RNA, 32 nt, Human
ggucugaggccugggagagucucuacugucua

SEQ ID NO: 469311 - RNA, 32 nt, Human
ggucugaggucccagcccuguugccaagugac

SEQ ID NO: 469312 - RNA, 23 nt, Human
ggucugaggucuugcuugggcca

SEQ ID NO: 469313 - RNA, 32 nt, Human
ggucugaggucuugcuugggccagucaccucc

SEQ ID NO: 469314 - RNA, 32 nt, Human
ggucugaggugaugguaacuuggacucggaug

SEQ ID NO: 469315 - RNA, 32 nt, Human
ggucugagguucuugccugccuucccucccau

SEQ ID NO: 469316 - RNA, 32 nt, Human
ggucugagucaggccuucugguuauauugugc

SEQ ID NO: 469317 - RNA, 32 nt, Human
ggucugaguucagggguguggagggagcagac

SEQ ID NO: 469318 - RNA, 32 nt, Human
ggucugaucuggggauaccauguccaagcccc

SEQ ID NO: 469319 - RNA, 20 nt, Human
ggucugaugucucgcaccua

SEQ ID NO: 469320 - RNA, 32 nt, Human
ggucugauguguaagcagccucuccccaucua

SEQ ID NO: 469321 - RNA, 32 nt, Human
ggucugauguguagcagccucuccccaucuac

SEQ ID NO: 469322 - RNA, 32 nt, Human
ggucugauuuucucuuuggauucuuccaaaau

SEQ ID NO: 469323 - RNA, 21 nt, Human
ggucugauuuugcccuggggc

SEQ ID NO: 469324 - RNA, 32 nt, Human
ggucugcaagucagaggauggccagugucugu

SEQ ID NO: 469325 - RNA, 20 nt, Human
ggucugcacagggagucaag

SEQ ID NO: 469326 - RNA, 32 nt, Human
ggucugcacuccccugcggccugcugcuggau

SEQ ID NO: 469327 - RNA, 32 nt, Human
ggucugcagagugcccucccaccagcgaugga

SEQ ID NO: 469328 - RNA, 32 nt, Human
ggucugcagcagccccugguccugagcaggcg

SEQ ID NO: 469329 - RNA, 18 nt, Human
ggucugcagcuauuucaa

SEQ ID NO: 469330 - RNA, 24 nt, Human
ggucugcaggacugaccccaagga

SEQ ID NO: 469331 - RNA, 20 nt, Human
ggucugcagguccgcgccca

SEQ ID NO: 469332 - RNA, 18 nt, Human
ggucugcaguguuuuaaa

SEQ ID NO: 469333 - RNA, 22 nt, Human
ggucugcauagcagacuuuuaa

SEQ ID NO: 469334 - RNA, 20 nt, Human
ggucugcaucacugccauca

SEQ ID NO: 469335 - RNA, 21 nt, Human
ggucugcaucauccuuuucaa

SEQ ID NO: 469336 - RNA, 22 nt, Human
ggucugcaucauccuuuucaaa

SEQ ID NO: 469337 - RNA, 22 nt, Human
ggucugcauugccgggcccccu

SEQ ID NO: 469338 - RNA, 23 nt, Human
ggucugcauugcguccauuucaa

SEQ ID NO: 469339 - RNA, 32 nt, Human
ggucugcauuuuggagaguccacaccacggac

SEQ ID NO: 469340 - RNA, 32 nt, Human
ggucugccaggcucugcccugcccagugacca

SEQ ID NO: 469341 - RNA, 32 nt, Human
ggucugccaggggccaacgggcaggcaucgcc

SEQ ID NO: 469342 - RNA, 32 nt, Human
ggucugcccaggccugccucccuucccuaggc

SEQ ID NO: 469343 - RNA, 21 nt, Human
ggucugcccauagagcagcgg

SEQ ID NO: 469344 - RNA, 18 nt, Human
ggucugccccuccgcagc

SEQ ID NO: 469345 - RNA, 18 nt, Human
ggucugccccuuuucaaa

SEQ ID NO: 469346 - RNA, 32 nt, Human
ggucugcccucugcauccucuggagccagccg

SEQ ID NO: 469347 - RNA, 31 nt, Human
ggucugcccugagcugugccugugugcucca

SEQ ID NO: 469348 - RNA, 32 nt, Human
ggucugccugcaggaaguucacguucuaguau

SEQ ID NO: 469349 - RNA, 32 nt, Human
ggucugccugccucccugugcaguccagcccu

SEQ ID NO: 469350 - RNA, 32 nt, Human
ggucugcggaaggugggaggaggcagacaccc

SEQ ID NO: 469351 - RNA, 20 nt, Human
ggucugcgucuucugccauu

SEQ ID NO: 469352 - RNA, 32 nt, Human
ggucugcuagcacccucagccugggagcuacu

SEQ ID NO: 469353 - RNA, 32 nt, Human
ggucugcuccccacaucucuccuaauuccacu

SEQ ID NO: 469354 - RNA, 32 nt, Human
ggucugcucccuggacagagaggaaggaggug

SEQ ID NO: 469355 - RNA, 32 nt, Human
ggucugcugccagggauugaggagacugaaga

SEQ ID NO: 469356 - RNA, 32 nt, Human
ggucugcugccuggcccacaugucccuuuugu

SEQ ID NO: 469357 - RNA, 21 nt, Human
ggucugcugcuccacgagcug

SEQ ID NO: 469358 - RNA, 32 nt, Human
ggucugcuggcuguggaggguggguugcacgg

SEQ ID NO: 469359 - RNA, 32 nt, Human
ggucugcuggguggcagaaaugguuccuuccg

SEQ ID NO: 469360 - RNA, 32 nt, Human
ggucugcuucaaggaggucgaccuucuaaugu

SEQ ID NO: 469361 - RNA, 20 nt, Human
ggucugcuugagcaacuggu

SEQ ID NO: 469362 - RNA, 32 nt, Human
ggucuggaaaguuggcuugucucauaauaccc

SEQ ID NO: 469363 - RNA, 24 nt, Human
ggucuggaacuccugacccuguga

SEQ ID NO: 469364 - RNA, 24 nt, Human
ggucuggaacuccugaccucguga

SEQ ID NO: 469365 - RNA, 32 nt, Human
ggucuggaagcagagccggcggagggagcgcc

SEQ ID NO: 469366 - RNA, 23 nt, Human
ggucuggaagcugcagggcucuc

SEQ ID NO: 469367 - RNA, 32 nt, Human
ggucuggagagggaagcgaggcgcuguuagag

SEQ ID NO: 469368 - RNA, 32 nt, Human
ggucuggaggaaaacuggcuaucagaaccucc

SEQ ID NO: 469369 - RNA, 32 nt, Human
ggucuggaggcagaggaaugggcauagcugag

SEQ ID NO: 469370 - RNA, 32 nt, Human
ggucuggaggcugaggaccaggcagacaaaca

SEQ ID NO: 469371 - RNA, 32 nt, Human
ggucuggaggcugcaggccugagcaggugggc

SEQ ID NO: 469372 - RNA, 32 nt, Human
ggucuggaggggccauggggcaguccugggug

SEQ ID NO: 469373 - RNA, 32 nt, Human
ggucuggaggggccucaggggugcccagcccg

SEQ ID NO: 469374 - RNA, 32 nt, Human
ggucuggagguaugggcagcugugggggccgg

SEQ ID NO: 469375 - RNA, 32 nt, Human
ggucuggauacuugcuaugauuuucacuuuuu

SEQ ID NO: 469376 - RNA, 32 nt, Human
ggucuggauccaguugagcagcacagcagaua

SEQ ID NO: 469377 - RNA, 24 nt, Human
ggucuggaucuccugaccucguga

SEQ ID NO: 469378 - RNA, 24 nt, Human
ggucuggaucuccugaccuuguga

SEQ ID NO: 469379 - RNA, 32 nt, Human
ggucuggaugcugccacccucuucugacccug

SEQ ID NO: 469380 - RNA, 20 nt, Human
ggucuggauuuuuauaccua

SEQ ID NO: 469381 - RNA, 25 nt, Human
ggucuggcaaagucaggcucaggga

SEQ ID NO: 469382 - RNA, 21 nt, Human
ggucuggcagagccucugaga

SEQ ID NO: 469383 - RNA, 32 nt, Human
ggucuggcagcccucccgggaugggcccacau

SEQ ID NO: 469384 - RNA, 32 nt, Human
ggucuggccagaggaacagaccagcuuuugca

SEQ ID NO: 469385 - RNA, 32 nt, Human
ggucuggcccccucccuguccaggccccgcag

SEQ ID NO: 469386 - RNA, 32 nt, Human
ggucuggccguuggcccuggcuaaugucucuc

SEQ ID NO: 469387 - RNA, 32 nt, Human
ggucuggccucuccccagagcugucuggacag

SEQ ID NO: 469388 - RNA, 18 nt, Human
ggucuggcuccuuucaga

SEQ ID NO: 469389 - RNA, 19 nt, Human
ggucuggcuuuuuuacuua

SEQ ID NO: 469390 - RNA, 32 nt, Human
ggucugggaccuggcuccacaccaguuaccug

SEQ ID NO: 469391 - RNA, 32 nt, Human
ggucugggagaaagauggaaacuagggagaug

SEQ ID NO: 469392 - RNA, 32 nt, Human
ggucugggagagagagcagagggcggcagggc

SEQ ID NO: 469393 - RNA, 23 nt, Human
ggucugggagcuguucuggggca

SEQ ID NO: 469394 - RNA, 32 nt, Human
ggucugggaguccucaguguccacuuguccca

SEQ ID NO: 469395 - RNA, 22 nt, Human
ggucugggauccucagggcucc

SEQ ID NO: 469396 - RNA, 32 nt, Human
ggucugggauucuaagugaccugcucuguguu

SEQ ID NO: 469397 - RNA, 21 nt, Human
ggucugggauuucugcuuuca

SEQ ID NO: 469398 - RNA, 32 nt, Human
ggucugggcacauggugguggacaguggcuau

SEQ ID NO: 469399 - RNA, 32 nt, Human
ggucugggcaggacucagcuccccagaguccu

SEQ ID NO: 469400 - RNA, 32 nt, Human
ggucugggccagacugccuugcuuucuggugc

SEQ ID NO: 469401 - RNA, 24 nt, Human
ggucugggcccagcggggcucccu

SEQ ID NO: 469402 - RNA, 32 nt, Human
ggucugggcccagguuugagggagaaguuugc

SEQ ID NO: 469403 - RNA, 22 nt, Human
ggucugggcccuguggcccucu

SEQ ID NO: 469404 - RNA, 18 nt, Human
ggucugggccucggcccc

SEQ ID NO: 469405 - RNA, 32 nt, Human
ggucugggcuccugccucaccgcugguucagc

SEQ ID NO: 469406 - RNA, 20 nt, Human
ggucugggcuuuaggccccu

SEQ ID NO: 469407 - RNA, 21 nt, Human
ggucuggggaguuuccucuca

SEQ ID NO: 469408 - RNA, 20 nt, Human
ggucuggggcaggccagcag

SEQ ID NO: 469409 - RNA, 32 nt, Human
ggucuggggcaggccagcagggcagacaccag

SEQ ID NO: 469410 - RNA, 32 nt, Human
ggucuggggcagguggggcuggggaagggagc

SEQ ID NO: 469411 - RNA, 31 nt, Human
ggucugggggagauaagauggguggugaaga

SEQ ID NO: 469412 - RNA, 32 nt, Human
ggucugggggcagagguggcaugcagggcuuu

SEQ ID NO: 469413 - RNA, 32 nt, Human
ggucuggggucccaccccugccccacuuuacc

SEQ ID NO: 469414 - RNA, 32 nt, Human
ggucuggggucugggacuaggcuaucuggaca

SEQ ID NO: 469415 - RNA, 32 nt, Human
ggucuggguagcccaacuccucccucuccuug

SEQ ID NO: 469416 - RNA, 18 nt, Human
ggucuggguccaugccua

SEQ ID NO: 469417 - RNA, 32 nt, Human
ggucugggugccccuuuuccuccccugggaag

SEQ ID NO: 469418 - RNA, 19 nt, Human
ggucugggugggggcuccc

SEQ ID NO: 469419 - RNA, 24 nt, Human
ggucuggguuuccaaaacuacccu

SEQ ID NO: 469420 - RNA, 32 nt, Human
ggucugguagcagccugucacuccagacuguc

SEQ ID NO: 469421 - RNA, 32 nt, Human
ggucuggucugcagcagugugugguggcaugc

SEQ ID NO: 469422 - RNA, 18 nt, Human
ggucugguggaugaggug

SEQ ID NO: 469423 - RNA, 23 nt, Human
ggucugguucaccaauggggaca

SEQ ID NO: 469424 - RNA, 17 nt, Human
ggucugguucaggggga

SEQ ID NO: 469425 - RNA, 32 nt, Human
ggucugguugaugaucuagcacuuucaccaag

SEQ ID NO: 469426 - RNA, 32 nt, Human
ggucugguuggggcaggcaggagcaguguggu

SEQ ID NO: 469427 - RNA, 32 nt, Human
ggucugguuucuucccuucccagagggucuua

SEQ ID NO: 469428 - RNA, 24 nt, Human
ggucugguuugcagagcuugaaca

SEQ ID NO: 469429 - RNA, 32 nt, Human
ggucugguuugugucuguguucauguuuguuu

SEQ ID NO: 469430 - RNA, 32 nt, Human
ggucuguacaaaggaaugaaguucugaaaaug

SEQ ID NO: 469431 - RNA, 32 nt, Human
ggucuguacugauucaauuugauguggugaaa

SEQ ID NO: 469432 - RNA, 32 nt, Human
ggucuguauaagcuuugagagcaacgucacug

SEQ ID NO: 469433 - RNA, 32 nt, Human
ggucugucacccaggcuggagugcaguggugc

SEQ ID NO: 469434 - RNA, 18 nt, Human
ggucugucacucacguca

SEQ ID NO: 469435 - RNA, 32 nt, Human
ggucuguccuucaaggccuccuccgauagugc

SEQ ID NO: 469436 - RNA, 32 nt, Human
ggucuguccuuccugggauuccuagccgaggc

SEQ ID NO: 469437 - RNA, 32 nt, Human
ggucugucgccaggcuggagugcaguggcgcg

SEQ ID NO: 469438 - RNA, 32 nt, Human
ggucugucgcccaggcuggagugcaguagcac

SEQ ID NO: 469439 - RNA, 32 nt, Human
ggucugucuccucugaacuugcaccugggccu

SEQ ID NO: 469440 - RNA, 18 nt, Human
ggucugucucuugcuuca

SEQ ID NO: 469441 - RNA, 32 nt, Human
ggucugucugcaggaacucucccgucugugag

SEQ ID NO: 469442 - RNA, 32 nt, Human
ggucugucuggauguggagaagcucuguguga

SEQ ID NO: 469443 - RNA, 18 nt, Human
ggucugucuguacaguua

SEQ ID NO: 469444 - RNA, 20 nt, Human
ggucugucuuccuuaucauc

SEQ ID NO: 469445 - RNA, 25 nt, Human
ggucugugaauagaguuuacaucca

SEQ ID NO: 469446 - RNA, 21 nt, Human
ggucugugagaacagcucccu

SEQ ID NO: 469447 - RNA, 30 nt, Human
ggucugugccucuccagaaucuugucuuac

SEQ ID NO: 469448 - RNA, 19 nt, Human
ggucugugcuccuuuuaaa

SEQ ID NO: 469449 - RNA, 32 nt, Human
ggucugugcugaggccuuaucauucauucuua

SEQ ID NO: 469450 - RNA, 32 nt, Human
ggucuguggcagcaagcacauuauuuccauuc

SEQ ID NO: 469451 - RNA, 32 nt, Human
ggucugugggcaggggacagggcguggguggg

SEQ ID NO: 469452 - RNA, 31 nt, Human
ggucuguggguggugauggaggagggacuca

SEQ ID NO: 469453 - RNA, 29 nt, Human
ggucugugucugugugugccuguaagugu

SEQ ID NO: 469454 - RNA, 32 nt, Human
ggucugugugggcugaaggcuuggugaccagg

SEQ ID NO: 469455 - RNA, 32 nt, Human
ggucuguuacccaggcuggagugcaguggcau

SEQ ID NO: 469456 - RNA, 32 nt, Human
ggucuguucagauuuuucuacuucuucauuau

SEQ ID NO: 469457 - RNA, 32 nt, Human
ggucuguucccccagccccuugggcucaccug

SEQ ID NO: 469458 - RNA, 21 nt, Human
ggucuguuccuuuuacuacca

SEQ ID NO: 469459 - RNA, 32 nt, Human
ggucuguucucccacuugauugaccucaccag

SEQ ID NO: 469460 - RNA, 32 nt, Human
ggucuguugcccaggcuggaaugcaguggugu

SEQ ID NO: 469461 - RNA, 32 nt, Human
ggucuguugcccaggcuggagugcaguggugu

SEQ ID NO: 469462 - RNA, 32 nt, Human
ggucuguugcccagguuggagugcaguggcgg

SEQ ID NO: 469463 - RNA, 32 nt, Human
ggucuguugccuaggcgggagugcaguggcau

SEQ ID NO: 469464 - RNA, 32 nt, Human
ggucuguuucagaaaccaacagugauggcauu

SEQ ID NO: 469465 - RNA, 32 nt, Human
ggucuguuucagacugugucucuggucauaag

SEQ ID NO: 469466 - RNA, 17 nt, Human
ggucuguuuccccauca

SEQ ID NO: 469467 - RNA, 27 nt, Human
ggucuguuucuggagaaguucugguca

SEQ ID NO: 469468 - RNA, 32 nt, Human
ggucuguuugucuuuucuaccucuuucucuug

SEQ ID NO: 469469 - RNA, 18 nt, Human
ggucuguuuuuagaauua

SEQ ID NO: 469470 - RNA, 18 nt, Human
ggucuguuuuuauguuca

SEQ ID NO: 469471 - RNA, 32 nt, Human
ggucuuaagacauggaaaucuccauccaauga

SEQ ID NO: 469472 - RNA, 32 nt, Human
ggucuuaagaugacuuuaguaauuuaacuguu

SEQ ID NO: 469473 - RNA, 32 nt, Human
ggucuuaccauuugccccagcuggucucaaac

SEQ ID NO: 469474 - RNA, 17 nt, Human
ggucuuacuugggucca

SEQ ID NO: 469475 - RNA, 32 nt, Human
ggucuuagagagaaggggagacuagagacgga

SEQ ID NO: 469476 - RNA, 32 nt, Human
ggucuuagcuguucuugcauaggcucuuaagc

SEQ ID NO: 469477 - RNA, 32 nt, Human
ggucuuagcuguucuugcaugggcucuuaagc

SEQ ID NO: 469478 - RNA, 32 nt, Human
ggucuuagggcagaggguugaguuuggauucc

SEQ ID NO: 469479 - RNA, 32 nt, Human
ggucuuaugagcugcuauugaacacggcagag

SEQ ID NO: 469480 - RNA, 32 nt, Human
ggucuucacagaaauauauuucagaaagacgu

SEQ ID NO: 469481 - RNA, 32 nt, Human
ggucuucacagaaauauauuucagaaagaggu

SEQ ID NO: 469482 - RNA, 32 nt, Human
ggucuucacagaaauauauuucagaaaggggu

SEQ ID NO: 469483 - RNA, 32 nt, Human
ggucuucacgcaggcugguugguaacgugcug

SEQ ID NO: 469484 - RNA, 28 nt, Human
ggucuucagaguugucuuuauaugugaa

SEQ ID NO: 469485 - RNA, 24 nt, Human
ggucuucaggagcugguccaagga

SEQ ID NO: 469486 - RNA, 18 nt, Human
ggucuucauccugcugcc

SEQ ID NO: 469487 - RNA, 32 nt, Human
ggucuucaugauaaaucuugcugcugcucacu

SEQ ID NO: 469488 - RNA, 32 nt, Human
ggucuucaugcaauuuuccaccucgcaguagu

SEQ ID NO: 469489 - RNA, 32 nt, Human
ggucuucaugcugcugugggugauauuacugg

SEQ ID NO: 469490 - RNA, 32 nt, Human
ggucuuccaaagugcugggauuacagguguga

SEQ ID NO: 469491 - RNA, 32 nt, Human
ggucuuccauuuuaaagacagaggccaagauc

SEQ ID NO: 469492 - RNA, 19 nt, Human
ggucuucccugcugagcca

SEQ ID NO: 469493 - RNA, 32 nt, Human
ggucuuccuccaccccucugggaaucaccauu

SEQ ID NO: 469494 - RNA, 32 nt, Human
ggucuuccuccaggaugccugcaugggacccc

SEQ ID NO: 469495 - RNA, 18 nt, Human
ggucuuccugcugcugcc

SEQ ID NO: 469496 - RNA, 18 nt, Human
ggucuuccuucagugccu

SEQ ID NO: 469497 - RNA, 32 nt, Human
ggucuucgggugcuucccagcacaagcugccc

SEQ ID NO: 469498 - RNA, 32 nt, Human
ggucuucuacacuaagacaccaugaaggagua

SEQ ID NO: 469499 - RNA, 32 nt, Human
ggucuucuacagacuuccccaguaaucccuca

SEQ ID NO: 469500 - RNA, 32 nt, Human
ggucuucuaccgacuucaugguauuuaggaaa

SEQ ID NO: 469501 - RNA, 21 nt, Human
ggucuucuauagcuuuuuuca

SEQ ID NO: 469502 - RNA, 32 nt, Human
ggucuucucccaggcuggaucugggcgaagug

SEQ ID NO: 469503 - RNA, 32 nt, Human
ggucuucucucugcaaccacuuccccuaugcc

SEQ ID NO: 469504 - RNA, 32 nt, Human
ggucuucugaguagcugggacuacaggcaugc

SEQ ID NO: 469505 - RNA, 24 nt, Human
ggucuucugccagggucccuaaga

SEQ ID NO: 469506 - RNA, 18 nt, Human
ggucuucuggcuuucaaa

SEQ ID NO: 469507 - RNA, 32 nt, Human
ggucuucuucagccuguuuccccagccacagg

SEQ ID NO: 469508 - RNA, 32 nt, Human
ggucuucuuuaccuuccagcugcucacagaac

SEQ ID NO: 469509 - RNA, 32 nt, Human
ggucuucuuuccagagacauuuucggagccga

SEQ ID NO: 469510 - RNA, 24 nt, Human
ggucuugaaccccugaccucauga

SEQ ID NO: 469511 - RNA, 24 nt, Human
ggucuugaacgccugaccuuguga

SEQ ID NO: 469512 - RNA, 24 nt, Human
ggucuugaacucccgaccuuguga

SEQ ID NO: 469513 - RNA, 24 nt, Human
ggucuugaacuccugaccucauga

SEQ ID NO: 469514 - RNA, 24 nt, Human
ggucuugaacuccugaccuccuga

SEQ ID NO: 469515 - RNA, 24 nt, Human
ggucuugaacuccugaccucguga

SEQ ID NO: 469516 - RNA, 24 nt, Human
ggucuugaacuccugaccugguga

SEQ ID NO: 469517 - RNA, 24 nt, Human
ggucuugaacuccugaccuuguga

SEQ ID NO: 469518 - RNA, 24 nt, Human
ggucuugaacuccugaccuugugg

SEQ ID NO: 469519 - RNA, 32 nt, Human
ggucuugaacuccugaccuugugguccacccg

SEQ ID NO: 469520 - RNA, 32 nt, Human
ggucuugaacuccuggcuucgggugauccgcu

SEQ ID NO: 469521 - RNA, 24 nt, Human
ggucuugaacucuugaccucauga

SEQ ID NO: 469522 - RNA, 24 nt, Human
ggucuugaacucuugaccucguga

SEQ ID NO: 469523 - RNA, 21 nt, Human
ggucuugaacugaccucauga

SEQ ID NO: 469524 - RNA, 32 nt, Human
ggucuugaagacagguccaccuucaaaaucua

SEQ ID NO: 469525 - RNA, 32 nt, Human
ggucuugacuccugaccucaugaccugcccac

SEQ ID NO: 469526 - RNA, 32 nt, Human
ggucuugagaugggcaacagagcuguaagauc

SEQ ID NO: 469527 - RNA, 24 nt, Human
ggucuugauauccugaccucguga

SEQ ID NO: 469528 - RNA, 24 nt, Human
ggucuugaucucccgaccucguga

SEQ ID NO: 469529 - RNA, 24 nt, Human
ggucuugaucuccuaaccucuuga

SEQ ID NO: 469530 - RNA, 24 nt, Human
ggucuugaucuccugaccucauga

SEQ ID NO: 469531 - RNA, 24 nt, Human
ggucuugaucuccugaccucguga

SEQ ID NO: 469532 - RNA, 24 nt, Human
ggucuugaucuccugaccuuguga

SEQ ID NO: 469533 - RNA, 24 nt, Human
ggucuugaucuccugagcucguga

SEQ ID NO: 469534 - RNA, 24 nt, Human
ggucuugaucucuugaccucauga

SEQ ID NO: 469535 - RNA, 24 nt, Human
ggucuugaucucuugaccucguga

SEQ ID NO: 469536 - RNA, 32 nt, Human
ggucuugcagugagcagagaucgcgccaccgc

SEQ ID NO: 469537 - RNA, 23 nt, Human
ggucuugccaacuccaucuucaa

SEQ ID NO: 469538 - RNA, 32 nt, Human
ggucuugccuccaggaugaaaaugagaaggag

SEQ ID NO: 469539 - RNA, 32 nt, Human
ggucuugcuguguuacccaggcuggucucaca

SEQ ID NO: 469540 - RNA, 25 nt, Human
ggucuuggaacuccugaccucguga

SEQ ID NO: 469541 - RNA, 32 nt, Human
ggucuuggaagacagaggggagcugcuuuaga

SEQ ID NO: 469542 - RNA, 32 nt, Human
ggucuuggaccaguagaggacacggaggguuc

SEQ ID NO: 469543 - RNA, 24 nt, Human
ggucuuggacuccugaccucguga

SEQ ID NO: 469544 - RNA, 24 nt, Human
ggucuuggacuccugacgucguga

SEQ ID NO: 469545 - RNA, 32 nt, Human
ggucuuggagcugggagagggacagcagcagc

SEQ ID NO: 469546 - RNA, 32 nt, Human
ggucuuggcuagacugccuagauucccacagc

SEQ ID NO: 469547 - RNA, 32 nt, Human
ggucuuggcuggguugaagguuccaagcugcu

SEQ ID NO: 469548 - RNA, 18 nt, Human
ggucuuggggcagcgggg

SEQ ID NO: 469549 - RNA, 32 nt, Human
ggucuugggggcacuauagccacuaaacgagg

SEQ ID NO: 469550 - RNA, 32 nt, Human
ggucuuggguuagagccaaaauggauuugagg

SEQ ID NO: 469551 - RNA, 24 nt, Human
ggucuuguacuccugaccuuguga

SEQ ID NO: 469552 - RNA, 32 nt, Human
ggucuugucuccaggaugaaaaugggaaggag

SEQ ID NO: 469553 - RNA, 32 nt, Human
ggucuugucuucccagccgcagucuaggaaug

SEQ ID NO: 469554 - RNA, 32 nt, Human
ggucuugugguuguguguguucuguccccauc

SEQ ID NO: 469555 - RNA, 32 nt, Human
ggucuugugucacccaggcuggagugcaaugg

SEQ ID NO: 469556 - RNA, 32 nt, Human
ggucuugugucacccaggcuggcgugcagggc

SEQ ID NO: 469557 - RNA, 32 nt, Human
ggucuuguguugcuucuggucucuccaggcuu

SEQ ID NO: 469558 - RNA, 22 nt, Human
ggucuuguuucuuugcuuucua

SEQ ID NO: 469559 - RNA, 32 nt, Human
ggucuuuacuuuuuauggauguuuucaaggaa

SEQ ID NO: 469560 - RNA, 32 nt, Human
ggucuuuagagcucagcuuucugaggcccuga

SEQ ID NO: 469561 - RNA, 32 nt, Human
ggucuuuaguaaaguaaaacaauuucccaauc

SEQ ID NO: 469562 - RNA, 32 nt, Human
ggucuuuaucgucuaugaugggagaaaaggag

SEQ ID NO: 469563 - RNA, 24 nt, Human
ggucuuuaucuccugaccucauga

SEQ ID NO: 469564 - RNA, 24 nt, Human
ggucuuuaucuccugcccuuguga

SEQ ID NO: 469565 - RNA, 32 nt, Human
ggucuuucacccaggcuggagugcagugcugu

SEQ ID NO: 469566 - RNA, 32 nt, Human
ggucuuucacccaggcuggagugcuguggcac

SEQ ID NO: 469567 - RNA, 32 nt, Human
ggucuuucauuucuauuuuuccccuccuuucc

SEQ ID NO: 469568 - RNA, 32 nt, Human
ggucuuucauuucuuguucgcuuacuuucgug

SEQ ID NO: 469569 - RNA, 32 nt, Human
ggucuuuccuggggcaagaggcugcugagaag

SEQ ID NO: 469570 - RNA, 32 nt, Human
ggucuuucucugacccugucccccucucacgu

SEQ ID NO: 469571 - RNA, 32 nt, Human
ggucuuugaaauucucuacucucugaacacag

SEQ ID NO: 469572 - RNA, 32 nt, Human
ggucuuugcagauguccugggugcagggccuu

SEQ ID NO: 469573 - RNA, 32 nt, Human
ggucuuuggaagcugcucuacaaugccuguuc

SEQ ID NO: 469574 - RNA, 32 nt, Human
ggucuuuggggagggggugccgaggcuacgca

SEQ ID NO: 469575 - RNA, 32 nt, Human
ggucuuuguccuggcagugccucugccaguca

SEQ ID NO: 469576 - RNA, 32 nt, Human
ggucuuuguggacugaagguagacaccagcca

SEQ ID NO: 469577 - RNA, 32 nt, Human
ggucuuuucccaaggcucuuccagaccugcag

SEQ ID NO: 469578 - RNA, 32 nt, Human
ggucuuuucuuugacagucuguacaccuuuau

SEQ ID NO: 469579 - RNA, 32 nt, Human
ggucuuuugcaaauauuuuccucccaggcugu

SEQ ID NO: 469580 - RNA, 32 nt, Human
ggucuuuugugauuuccucugaugcaggagag

SEQ ID NO: 469581 - RNA, 32 nt, Human
ggucuuuuuccucugcggucauguuggcuuuc

SEQ ID NO: 469582 - RNA, 32 nt, Human
ggucuuuuucugcuugaaaucugaucacaccc

SEQ ID NO: 469583 - RNA, 21 nt, Human
ggugaaaacccaucucuacua

SEQ ID NO: 469584 - RNA, 32 nt, Human
ggugaaaacuccaggcucuaaguggacaacca

SEQ ID NO: 469585 - RNA, 32 nt, Human
ggugaaaagcucagcuagguccuggcucuggu

SEQ ID NO: 469586 - RNA, 32 nt, Human
ggugaaaauggcugagaacuugcuggacggac

SEQ ID NO: 469587 - RNA, 21 nt, Human
ggugaaacaccgucucuacua

SEQ ID NO: 469588 - RNA, 32 nt, Human
ggugaaacagggcuugucccuccaacugcagg

SEQ ID NO: 469589 - RNA, 32 nt, Human
ggugaaacauggugaaaccccgucucuacuaa

SEQ ID NO: 469590 - RNA, 32 nt, Human
ggugaaacauuucaacaucacaucacucacca

SEQ ID NO: 469591 - RNA, 32 nt, Human
ggugaaaccaacacccccagcucagacucugc

SEQ ID NO: 469592 - RNA, 32 nt, Human
ggugaaaccaggaggcagagaguuucaaaauc

SEQ ID NO: 469593 - RNA, 21 nt, Human
ggugaaacccaaucucuacua

SEQ ID NO: 469594 - RNA, 21 nt, Human
ggugaaacccagccucuacua

SEQ ID NO: 469595 - RNA, 32 nt, Human
ggugaaacccaggaggagaguguggaguccag

SEQ ID NO: 469596 - RNA, 21 nt, Human
ggugaaacccagucucuacua

SEQ ID NO: 469597 - RNA, 19 nt, Human
ggugaaaccccaccucuac

SEQ ID NO: 469598 - RNA, 21 nt, Human
ggugaaaccccaccucuacua

SEQ ID NO: 469599 - RNA, 21 nt, Human
ggugaaaccccaucuccacua

SEQ ID NO: 469600 - RNA, 19 nt, Human
ggugaaaccccaucucuac

SEQ ID NO: 469601 - RNA, 20 nt, Human
ggugaaaccccaucucuacu

SEQ ID NO: 469602 - RNA, 21 nt, Human
ggugaaaccccaucucuacua

SEQ ID NO: 469603 - RNA, 21 nt, Human
ggugaaaccccaucucuacug

SEQ ID NO: 469604 - RNA, 21 nt, Human
ggugaaaccccaucucuauua

SEQ ID NO: 469605 - RNA, 20 nt, Human
ggugaaaccccaucucucua

SEQ ID NO: 469606 - RNA, 21 nt, Human
ggugaaaccccaucucugcua

SEQ ID NO: 469607 - RNA, 21 nt, Human
ggugaaaccccaucucuucua

SEQ ID NO: 469608 - RNA, 21 nt, Human
ggugaaaccccaucuguacua

SEQ ID NO: 469609 - RNA, 21 nt, Human
ggugaaaccccaucuucacua

SEQ ID NO: 469610 - RNA, 21 nt, Human
ggugaaaccccaugucuacua

SEQ ID NO: 469611 - RNA, 21 nt, Human
ggugaaaccccauuuccacua

SEQ ID NO: 469612 - RNA, 21 nt, Human
ggugaaaccccauuucuacua

SEQ ID NO: 469613 - RNA, 22 nt, Human
ggugaaacccccaucucuacua

SEQ ID NO: 469614 - RNA, 21 nt, Human
ggugaaacccccucucuacua

SEQ ID NO: 469615 - RNA, 21 nt, Human
ggugaaaccccgacucuacua

SEQ ID NO: 469616 - RNA, 21 nt, Human
ggugaaaccccgccucuacua

SEQ ID NO: 469617 - RNA, 21 nt, Human
ggugaaaccccggcucuacua

SEQ ID NO: 469618 - RNA, 21 nt, Human
ggugaaaccccgucccuacua

SEQ ID NO: 469619 - RNA, 21 nt, Human
ggugaaaccccgucuccacua

SEQ ID NO: 469620 - RNA, 19 nt, Human
ggugaaaccccgucucuac

SEQ ID NO: 469621 - RNA, 21 nt, Human
ggugaaaccccgucucuacua

SEQ ID NO: 469622 - RNA, 21 nt, Human
ggugaaaccccuucucuacua

SEQ ID NO: 469623 - RNA, 21 nt, Human
ggugaaacccgaucccuacua

SEQ ID NO: 469624 - RNA, 21 nt, Human
ggugaaacccggucucuacua

SEQ ID NO: 469625 - RNA, 20 nt, Human
ggugaaacccgucucuacua

SEQ ID NO: 469626 - RNA, 21 nt, Human
ggugaaacccuaucucuacua

SEQ ID NO: 469627 - RNA, 32 nt, Human
ggugaaacccugaaauacaaaaauuagucagg

SEQ ID NO: 469628 - RNA, 21 nt, Human
ggugaaacccuguaucuacua

SEQ ID NO: 469629 - RNA, 19 nt, Human
ggugaaacccugucuccac

SEQ ID NO: 469630 - RNA, 21 nt, Human
ggugaaacccugucucuacua

SEQ ID NO: 469631 - RNA, 21 nt, Human
ggugaaacccuguuuccacua

SEQ ID NO: 469632 - RNA, 21 nt, Human
ggugaaaccucaucucuacua

SEQ ID NO: 469633 - RNA, 21 nt, Human
ggugaaaccucgucucuacua

SEQ ID NO: 469634 - RNA, 20 nt, Human
ggugaaaccugucucuacua

SEQ ID NO: 469635 - RNA, 21 nt, Human
ggugaaacgcugucucuacua

SEQ ID NO: 469636 - RNA, 21 nt, Human
ggugaaacuccaucucuacua

SEQ ID NO: 469637 - RNA, 21 nt, Human
ggugaaacuccgucucuacua

SEQ ID NO: 469638 - RNA, 32 nt, Human
ggugaaacugcaggagcucagcauagacccag

SEQ ID NO: 469639 - RNA, 26 nt, Human
ggugaaagaaagggacccaccugcua

SEQ ID NO: 469640 - RNA, 32 nt, Human
ggugaaagauccagagagugggggugaggggu

SEQ ID NO: 469641 - RNA, 31 nt, Human
ggugaaagcugacucuagcacuuguacuuuu

SEQ ID NO: 469642 - RNA, 32 nt, Human
ggugaaaggaagaaggaaguggcugaguuauu

SEQ ID NO: 469643 - RNA, 32 nt, Human
ggugaaaggaagcaccaccagcauggccccug

SEQ ID NO: 469644 - RNA, 32 nt, Human
ggugaaaggagggagaggaucagcaaaaagca

SEQ ID NO: 469645 - RNA, 31 nt, Human
ggugaaaggcacuucugacaugcugguggca

SEQ ID NO: 469646 - RNA, 32 nt, Human
ggugaaaggcuucucaugcaguuagccuugcu

SEQ ID NO: 469647 - RNA, 32 nt, Human
ggugaaagggaugaacugccuuuugcuggaag

SEQ ID NO: 469648 - RNA, 32 nt, Human
ggugaaagggugauggauuucacugugaauau

SEQ ID NO: 469649 - RNA, 32 nt, Human
ggugaaagucuccaaggaaagaggugucucgg

SEQ ID NO: 469650 - RNA, 32 nt, Human
ggugaaaguuauaaccuccugccugggagaaa

SEQ ID NO: 469651 - RNA, 32 nt, Human
ggugaaaugccagagaccuagacgggguggaa

SEQ ID NO: 469652 - RNA, 32 nt, Human
ggugaacaaagaucauuacaaacaaaaacugu

SEQ ID NO: 469653 - RNA, 32 nt, Human
ggugaacaccugcagcugaggcuuggaaacgu

SEQ ID NO: 469654 - RNA, 32 nt, Human
ggugaacaccugcugcucaugguacccaguga

SEQ ID NO: 469655 - RNA, 32 nt, Human
ggugaacaccuguaaucccagcuacuuggaag

SEQ ID NO: 469656 - RNA, 32 nt, Human
ggugaacagaaaccacaaguguccagcccucg

SEQ ID NO: 469657 - RNA, 32 nt, Human
ggugaacagugaacauauuuacauuugauuua

SEQ ID NO: 469658 - RNA, 32 nt, Human
ggugaacccacugccagcugugcccagaagac

SEQ ID NO: 469659 - RNA, 32 nt, Human
ggugaacccgggaggaagagcuugcagugagc

SEQ ID NO: 469660 - RNA, 32 nt, Human
ggugaaccuaaggaugaaagcaaaggagggcc

SEQ ID NO: 469661 - RNA, 32 nt, Human
ggugaaccugagcucucccaggagacaacuua

SEQ ID NO: 469662 - RNA, 32 nt, Human
ggugaaccugggaggcggagcuugcagugagc

SEQ ID NO: 469663 - RNA, 32 nt, Human
ggugaaccugggagguggagcuugcagugagc

SEQ ID NO: 469664 - RNA, 32 nt, Human
ggugaacgggcagaggaaguauggcgggccac

SEQ ID NO: 469665 - RNA, 32 nt, Human
ggugaagaacaagcacaagauuaaggaguaag

SEQ ID NO: 469666 - RNA, 32 nt, Human
ggugaagaacuccaaagggaccuaacgcagca

SEQ ID NO: 469667 - RNA, 32 nt, Human
ggugaagaagaggaguuugaugaagaagauga

SEQ ID NO: 469668 - RNA, 32 nt, Human
ggugaagaauuuugcaggugggagauuuggau

SEQ ID NO: 469669 - RNA, 32 nt, Human
ggugaagacagggccagcaggagacaccaugg

SEQ ID NO: 469670 - RNA, 32 nt, Human
ggugaagaccacgccacaccacccuccagcuc

SEQ ID NO: 469671 - RNA, 32 nt, Human
ggugaagacccccauccccauguccuuccagc

SEQ ID NO: 469672 - RNA, 32 nt, Human
ggugaagagcacuacagugacugugaauauau

SEQ ID NO: 469673 - RNA, 32 nt, Human
ggugaagaggaggguucuagaggcagagagcc

SEQ ID NO: 469674 - RNA, 32 nt, Human
ggugaagaggcuagguuguuuaaggagguggg

SEQ ID NO: 469675 - RNA, 16 nt, Human
ggugaagaggcuccag

SEQ ID NO: 469676 - RNA, 32 nt, Human
ggugaagcaguccaggcccggcuggucaccag

SEQ ID NO: 469677 - RNA, 32 nt, Human
ggugaagcagucccucaccccuagucagccca

SEQ ID NO: 469678 - RNA, 32 nt, Human
ggugaagccacuguggaaacagccuggcaguc

SEQ ID NO: 469679 - RNA, 32 nt, Human
ggugaagccagccacgguuuuccccagggcca

SEQ ID NO: 469680 - RNA, 32 nt, Human
ggugaagccagggagggagacaggagggcagg

SEQ ID NO: 469681 - RNA, 32 nt, Human
ggugaagccagggcaccccucuccccacuuaa

SEQ ID NO: 469682 - RNA, 32 nt, Human
ggugaagccauagaaaaguuacccgagggaaa

SEQ ID NO: 469683 - RNA, 32 nt, Human
ggugaagccugccuggccuguggugcuuucca

SEQ ID NO: 469684 - RNA, 32 nt, Human
ggugaagcuagaggaaccagaccucaucagcc

SEQ ID NO: 469685 - RNA, 32 nt, Human
ggugaagcucucuauuguccugaccccacggu

SEQ ID NO: 469686 - RNA, 32 nt, Human
ggugaagcucuuccuucaagaguuucuagauc

SEQ ID NO: 469687 - RNA, 32 nt, Human
ggugaagcugggcucccaguagugcaggaggu

SEQ ID NO: 469688 - RNA, 32 nt, Human
ggugaaggaccugccgagucagcuggcugaga

SEQ ID NO: 469689 - RNA, 32 nt, Human
ggugaaggagaaagaggcuggcuaggaccagg

SEQ ID NO: 469690 - RNA, 32 nt, Human
ggugaaggagagaaguagcaggaccagagggg

SEQ ID NO: 469691 - RNA, 32 nt, Human
ggugaaggauacucccuucuuucauacagaag

SEQ ID NO: 469692 - RNA, 32 nt, Human
ggugaaggcccagagaccagcagaacggcauc

SEQ ID NO: 469693 - RNA, 32 nt, Human
ggugaagggaacaaagcuggaggcucuggagc

SEQ ID NO: 469694 - RNA, 32 nt, Human
ggugaagggacagagagaggagaggaggaaga

SEQ ID NO: 469695 - RNA, 32 nt, Human
ggugaagggacugaucaagaucauucagcaau

SEQ ID NO: 469696 - RNA, 32 nt, Human
ggugaaggggaugggguaagaggcagaaaccc

SEQ ID NO: 469697 - RNA, 32 nt, Human
ggugaaggggcagaacaggcagguucccucga

SEQ ID NO: 469698 - RNA, 32 nt, Human
ggugaagguacuuuguucuggaagauguuguc

SEQ ID NO: 469699 - RNA, 32 nt, Human
ggugaaggucuuuccugauucuuccaagcuuu

SEQ ID NO: 469700 - RNA, 32 nt, Human
ggugaaggugucugcagcacacacagugagaa

SEQ ID NO: 469701 - RNA, 32 nt, Human
ggugaaguaaaggggcaaggagaagacggccu

SEQ ID NO: 469702 - RNA, 32 nt, Human
ggugaagucuagauggggaggagaagugaggc

SEQ ID NO: 469703 - RNA, 32 nt, Human
ggugaagugcccagcgcuggagugcagcgugc

SEQ ID NO: 469704 - RNA, 32 nt, Human
ggugaaguggggcugaaaaugcugacccucua

SEQ ID NO: 469705 - RNA, 32 nt, Human
ggugaaguucacuguauugcuauauuuuugua

SEQ ID NO: 469706 - RNA, 32 nt, Human
ggugaauaaccuuugagaccccuuaacagaaa

SEQ ID NO: 469707 - RNA, 32 nt, Human
ggugaaucaucccggcagacaccaagagccgc

SEQ ID NO: 469708 - RNA, 32 nt, Human
ggugaauccauuucacgaggaggagcucaguc

SEQ ID NO: 469709 - RNA, 32 nt, Human
ggugaaucccuuaaggucaggaguucaagacc

SEQ ID NO: 469710 - RNA, 32 nt, Human
ggugaaugcugcagcugccgggagacucacgc

SEQ ID NO: 469711 - RNA, 32 nt, Human
ggugaaugcuggccugugaugaauggcuggcc

SEQ ID NO: 469712 - RNA, 32 nt, Human
ggugaauggaagacacuuaccuaacaaguacu

SEQ ID NO: 469713 - RNA, 32 nt, Human
ggugaaugggcaaaagcuggaagcauuccccu

SEQ ID NO: 469714 - RNA, 32 nt, Human
ggugaaugggcagagggauuuggggauuacuu

SEQ ID NO: 469715 - RNA, 32 nt, Human
ggugaaugugcugccagugaaagcucagagcu

SEQ ID NO: 469716 - RNA, 30 nt, Human
ggugaauguggagaauuucuuuagccaaag

SEQ ID NO: 469717 - RNA, 32 nt, Human
ggugaaugugucuugcggcagcugcagcaagu

SEQ ID NO: 469718 - RNA, 32 nt, Human
ggugaauguuuaaugcucaugaaaauuggggg

SEQ ID NO: 469719 - RNA, 32 nt, Human
ggugaauuaaugcacauccuuaucucauugcu

SEQ ID NO: 469720 - RNA, 32 nt, Human
ggugaauucccugccccucccccaccacugag

SEQ ID NO: 469721 - RNA, 32 nt, Human
ggugaauugaguagaggguucauuccaauucc

SEQ ID NO: 469722 - RNA, 32 nt, Human
ggugaauuucuccccaggauaugguuuaugcu

SEQ ID NO: 469723 - RNA, 32 nt, Human
gguguguuugcguagccuuagggaaggaaggc

SEQ ID NO: 469724 - RNA, 32 nt, Human
gguguuacagaacauggagggaaccaggaaaa

SEQ ID NO: 469725 - RNA, 32 nt, Human
gguguuaccagggaacugggcgggauguuuga

SEQ ID NO: 469726 - RNA, 32 nt, Human
gguguuaccaucccagcucccgggagcccuua

SEQ ID NO: 469727 - RNA, 32 nt, Human
gguguuacgggaaguccaaccccagcauuaug

SEQ ID NO: 469728 - RNA, 32 nt, Human
gguguuacugauuuuuaaaccucuuugaccau

SEQ ID NO: 469729 - RNA, 32 nt, Human
gguguuaggaagaggaagagggugguagagga

SEQ ID NO: 469730 - RNA, 32 nt, Human
gguguuaguucugcagaggagucuuccugcuu

SEQ ID NO: 469731 - RNA, 26 nt, Human
gguguuaucaucgaggaacuuucuca

SEQ ID NO: 469732 - RNA, 32 nt, Human
gguguuaugaggaagaauaaaggggauaaaag

SEQ ID NO: 469733 - RNA, 24 nt, Human
gguguuauguaaacaccuggcaca

SEQ ID NO: 469734 - RNA, 31 nt, Human
gguguucacagcugccauauaaaguucuacu

SEQ ID NO: 469735 - RNA, 32 nt, Human
gguguucaccuuucacucaugagcaaugugcc

SEQ ID NO: 469736 - RNA, 19 nt, Human
gguguucacguccacaccu

SEQ ID NO: 469737 - RNA, 32 nt, Human
gguguucagggcccuggacacagacacagagc

SEQ ID NO: 469738 - RNA, 18 nt, Human
gguguucccaccacccua

SEQ ID NO: 469739 - RNA, 32 nt, Human
gguguucccgggaggagagggcggagggcgga

SEQ ID NO: 469740 - RNA, 32 nt, Human
gguguuccucgcgucccuguccuugaaggacc

SEQ ID NO: 469741 - RNA, 32 nt, Human
gguguuccugcagggacccuccgucuccugua

SEQ ID NO: 469742 - RNA, 32 nt, Human
gguguucgagguggagguuaggcgggugaagu

SEQ ID NO: 469743 - RNA, 32 nt, Human
gguguucgccugagcugggcucagggaggucc

SEQ ID NO: 469744 - RNA, 23 nt, Human
gguguucuaaggaauagcugcau

SEQ ID NO: 469745 - RNA, 32 nt, Human
gguguucuaauccaauugcaugauguaguaag

SEQ ID NO: 469746 - RNA, 21 nt, Human
gguguucucagcaugaagcuc

SEQ ID NO: 469747 - RNA, 32 nt, Human
gguguucucagugaccuaccucccaggcuccu

SEQ ID NO: 469748 - RNA, 32 nt, Human
gguguucucagugguugcugaaggcagguaga

SEQ ID NO: 469749 - RNA, 23 nt, Human
gguguucuccuggaagcuccuua

SEQ ID NO: 469750 - RNA, 32 nt, Human
gguguucugccuucccauucucuuagcccguc

SEQ ID NO: 469751 - RNA, 32 nt, Human
gguguucuguguuuguuggaggggcagauagu

SEQ ID NO: 469752 - RNA, 31 nt, Human
gguguugaacaaugcaacuuuuuauuuaaaa

SEQ ID NO: 469753 - RNA, 32 nt, Human
gguguugaagauaaauaagcuuaaacaaauaa

SEQ ID NO: 469754 - RNA, 32 nt, Human
gguguugacagaaaguauguucaaacaucuuc

SEQ ID NO: 469755 - RNA, 32 nt, Human
gguguugagagcaaguggccucuagucagagu

SEQ ID NO: 469756 - RNA, 32 nt, Human
gguguugaggaucuugagaaaauaaaucaagg

SEQ ID NO: 469757 - RNA, 32 nt, Human
gguguugcagugaaccaagaucacaccacugc

SEQ ID NO: 469758 - RNA, 32 nt, Human
gguguugccagguguggcuggggaagggucug

SEQ ID NO: 469759 - RNA, 32 nt, Human
gguguugccauuuuggaaauaaaaguccccua

SEQ ID NO: 469760 - RNA, 32 nt, Human
gguguugccugccuccccugugcuugugccuu

SEQ ID NO: 469761 - RNA, 32 nt, Human
gguguugcgcggggcugggauuagggccgggg

SEQ ID NO: 469762 - RNA, 32 nt, Human
gguguuggaaaaagacaaaaagaaccuggucc

SEQ ID NO: 469763 - RNA, 20 nt, Human
gguguuggaagggcagcggg

SEQ ID NO: 469764 - RNA, 32 nt, Human
gguguuggacaagcuucugagacgucaugagg

SEQ ID NO: 469765 - RNA, 18 nt, Human
gguguuggagcgccggag

SEQ ID NO: 469766 - RNA, 23 nt, Human
gguguuggcaaagucuucuuuga

SEQ ID NO: 469767 - RNA, 18 nt, Human
gguguuggcagccggggg

SEQ ID NO: 469768 - RNA, 19 nt, Human
gguguuggcagccugggag

SEQ ID NO: 469769 - RNA, 32 nt, Human
gguguuggccacucuugaugugaggcgugucg

SEQ ID NO: 469770 - RNA, 32 nt, Human
gguguuggccaggaagguaaagaaaugguguc

SEQ ID NO: 469771 - RNA, 21 nt, Human
gguguuggcgggggcggaggg

SEQ ID NO: 469772 - RNA, 18 nt, Human
gguguuggcgugugggag

SEQ ID NO: 469773 - RNA, 32 nt, Human
gguguuggcucuagacuggucucaucuccauu

SEQ ID NO: 469774 - RNA, 32 nt, Human
gguguuggcucugagaggaggagguggucuua

SEQ ID NO: 469775 - RNA, 20 nt, Human
gguguugggaaagcgcggag

SEQ ID NO: 469776 - RNA, 32 nt, Human
gguguugggaaggaaaggggagagggagauuc

SEQ ID NO: 469777 - RNA, 32 nt, Human
gguguugggaaggccugcgucucaggucacag

SEQ ID NO: 469778 - RNA, 18 nt, Human
gguguugggacagcagga

SEQ ID NO: 469779 - RNA, 32 nt, Human
gguguugggauuacagaugugagccaccacac

SEQ ID NO: 469780 - RNA, 32 nt, Human
gguguugggauuacaggcgugagccaccgugc

SEQ ID NO: 469781 - RNA, 32 nt, Human
gguguugggauuacaggcgugagccacugcac

SEQ ID NO: 469782 - RNA, 32 nt, Human
gguguugggauugcaggugugagccacugcgc

SEQ ID NO: 469783 - RNA, 32 nt, Human
gguguuggggagaaaauggagaguaaaucaga

SEQ ID NO: 469784 - RNA, 20 nt, Human
gguguugggggagacaggag

SEQ ID NO: 469785 - RNA, 19 nt, Human
gguguugggggcaguggga

SEQ ID NO: 469786 - RNA, 32 nt, Human
gguguugggguccgcagggggagggaggggag

SEQ ID NO: 469787 - RNA, 18 nt, Human
gguguugguccucaggag

SEQ ID NO: 469788 - RNA, 19 nt, Human
gguguuggugcauggagag

SEQ ID NO: 469789 - RNA, 19 nt, Human
gguguuggugucggcaggg

SEQ ID NO: 469790 - RNA, 18 nt, Human
gguguugguguggacggg

SEQ ID NO: 469791 - RNA, 32 nt, Human
gguguugguuggagcagaacuggugaggaugu

SEQ ID NO: 469792 - RNA, 29 nt, Human
gguguugguuuguguguggacaagaggug

SEQ ID NO: 469793 - RNA, 20 nt, Human
gguguugucuuucugccauc

SEQ ID NO: 469794 - RNA, 32 nt, Human
gguguugugcugugucuggcugugggauaaau

SEQ ID NO: 469795 - RNA, 32 nt, Human
gguguuguggggauggugauggagagggaugg

SEQ ID NO: 469796 - RNA, 32 nt, Human
gguguuguuucugcgcccucuuuuggcuaauu

SEQ ID NO: 469797 - RNA, 18 nt, Human
gguguuuaaagggcccuc

SEQ ID NO: 469798 - RNA, 32 nt, Human
gguguuuagucuuccuguugcauuucaugggc

SEQ ID NO: 469799 - RNA, 32 nt, Human
gguguuuauacugauuugauugugcuggcaaa

SEQ ID NO: 469800 - RNA, 32 nt, Human
gguguuuauaucuccuuuguauucugucuuca

SEQ ID NO: 469801 - RNA, 32 nt, Human
gguguuucaccaacuucggccuauggcucugu

SEQ ID NO: 469802 - RNA, 32 nt, Human
gguguuuccauucacuuucaaaauuacacagu

SEQ ID NO: 469803 - RNA, 32 nt, Human
gguguuuccccaugucauccaggcuggucugg

SEQ ID NO: 469804 - RNA, 32 nt, Human
gguguuucccuuacacaagugccuucacaggu

SEQ ID NO: 469805 - RNA, 32 nt, Human
gguguuuccucucugcuggcucguagccggaa

SEQ ID NO: 469806 - RNA, 32 nt, Human
gguguuuccuggaggcuggaaaugcuauuccu

SEQ ID NO: 469807 - RNA, 32 nt, Human
gguguuuccugggcacugcuuccagugaggcu

SEQ ID NO: 469808 - RNA, 32 nt, Human
gguguuucuccccucuauucuuugucucaggu

SEQ ID NO: 469809 - RNA, 20 nt, Human
gguguuucuguggucaggua

SEQ ID NO: 469810 - RNA, 32 nt, Human
gguguuucuuggggguguugggagggcaggag

SEQ ID NO: 469811 - RNA, 32 nt, Human
gguguuugaggacuacaguucaucucaggguu

SEQ ID NO: 469812 - RNA, 31 nt, Human
gguguuugauuaaaguaucuguugaauuuuu

SEQ ID NO: 469813 - RNA, 22 nt, Human
gguguuugcacacacaagugca

SEQ ID NO: 469814 - RNA, 32 nt, Human
gguguuugcaggagguugcaguacucgcuggg

SEQ ID NO: 469815 - RNA, 32 nt, Human
gguguuuggagauucuguuuuacucugccuag

SEQ ID NO: 469816 - RNA, 32 nt, Human
gguguuuggcgaggacugcucucugcuuccaa

SEQ ID NO: 469817 - RNA, 32 nt, Human
gguguuuggggagcuggagucccaggccgugg

SEQ ID NO: 469818 - RNA, 24 nt, Human
gguguuuguggacugguucaggga

SEQ ID NO: 469819 - RNA, 32 nt, Human
gguguuuuaaagcaguguugcauuuuaaucag

SEQ ID NO: 469820 - RNA, 32 nt, Human
gguguuuuaagcuugagugaaaggagggugag

SEQ ID NO: 469821 - RNA, 32 nt, Human
gguguuuuagggaccguccuucuccccuaccc

SEQ ID NO: 469822 - RNA, 32 nt, Human
gguguuuuaguaagaauccugggucccauaac

SEQ ID NO: 469823 - RNA, 32 nt, Human
gguguuuucccaaggcucccuucccaagcuca

SEQ ID NO: 469824 - RNA, 32 nt, Human
gguguuuuugggggagcccuguuuuccauagu

SEQ ID NO: 469825 - RNA, 20 nt, Human
gguuaaaaauucuccugccu

SEQ ID NO: 469826 - RNA, 22 nt, Human
gguuaaaaauucuccugccuca

SEQ ID NO: 469827 - RNA, 32 nt, Human
gguuaaacuucugcacuuucuuaguuaccaca

SEQ ID NO: 469828 - RNA, 32 nt, Human
gguuaaagaagcugcauguuaagugccauuac

SEQ ID NO: 469829 - RNA, 32 nt, Human
gguuaaagaggugaggugacgggaaauacaca

SEQ ID NO: 469830 - RNA, 32 nt, Human
gguuaaagagguggagaaagagaaaagaaaug

SEQ ID NO: 469831 - RNA, 32 nt, Human
gguuaaagcuuaaaaagugaaaaagaaacagg

SEQ ID NO: 469832 - RNA, 32 nt, Human
gguuaaagugcucuccuguguaggacccuucc

SEQ ID NO: 469833 - RNA, 32 nt, Human
gguuaaaguucaauaaauacuuuguugaauuu

SEQ ID NO: 469834 - RNA, 24 nt, Human
gguuaaauaacuuaccugugguua

SEQ ID NO: 469835 - RNA, 32 nt, Human
gguuaacacggugaaaccccgacucuacuaaa

SEQ ID NO: 469836 - RNA, 32 nt, Human
gguuaacacggugaaacccugucucuacaaaa

SEQ ID NO: 469837 - RNA, 32 nt, Human
gguuaacauggugaaacaccaucucuaguaaa

SEQ ID NO: 469838 - RNA, 32 nt, Human
gguuaacauggugaaacccugucuguacuaaa

SEQ ID NO: 469839 - RNA, 32 nt, Human
gguuaaccagaacucaccgacacagcaggaga

SEQ ID NO: 469840 - RNA, 32 nt, Human
gguuaacccacugguuucaaccaguucaggaa

SEQ ID NO: 469841 - RNA, 32 nt, Human
gguuaacccuugugugaaaugaaggaacuguc

SEQ ID NO: 469842 - RNA, 32 nt, Human
gguuaacgcugacagaauggaggcucaggcug

SEQ ID NO: 469843 - RNA, 32 nt, Human
gguuaacuuugcaacuggacugucuuuuacuu

SEQ ID NO: 469844 - RNA, 32 nt, Human
gguuaacuuugcuuaauuccucaggcuuugcg

SEQ ID NO: 469845 - RNA, 32 nt, Human
gguuaagaagagaagacagccagaggcucaca

SEQ ID NO: 469846 - RNA, 32 nt, Human
gguuaagagacacaguugggcgaacucucaaa

SEQ ID NO: 469847 - RNA, 31 nt, Human
gguuaagcaauguccagugcuaggauuauuu

SEQ ID NO: 469848 - RNA, 32 nt, Human
gguuaagcuguguacagaugauggagaguuug

SEQ ID NO: 469849 - RNA, 32 nt, Human
gguuaaggccuuccagcaucagucacauguaa

SEQ ID NO: 469850 - RNA, 32 nt, Human
gguuaaggcuggucuaaacuuauuuucacuuu

SEQ ID NO: 469851 - RNA, 32 nt, Human
gguuaagggaaagcgugggugugaguaggagu

SEQ ID NO: 469852 - RNA, 32 nt, Human
gguuaagggaggaguuccugcccaccaggaac

SEQ ID NO: 469853 - RNA, 32 nt, Human
gguuaagguauccagccuuuaucauauaagca

SEQ ID NO: 469854 - RNA, 32 nt, Human
gguuaagguaugauuauaagagagcuuauugu

SEQ ID NO: 469855 - RNA, 32 nt, Human
gguuaagguuggcucuggccaggauuccaggc

SEQ ID NO: 469856 - RNA, 24 nt, Human
gguuaaguaaccaaccuaagguca

SEQ ID NO: 469857 - RNA, 24 nt, Human
gguuaaguaacuugugcaagauca

SEQ ID NO: 469858 - RNA, 23 nt, Human
gguuaaguauauucccaagguca

SEQ ID NO: 469859 - RNA, 32 nt, Human
gguuaagucuaagaaggugggggugagcaggg

SEQ ID NO: 469860 - RNA, 21 nt, Human
gguuaaguuuccuuucacuca

SEQ ID NO: 469861 - RNA, 32 nt, Human
gguuaaguuuuuguuucuccuggcuuggaacu

SEQ ID NO: 469862 - RNA, 32 nt, Human
gguuaaucacuaccauccuguaacuaguuaua

SEQ ID NO: 469863 - RNA, 32 nt, Human
gguuaaucuucucuugagaauggcagucaaga

SEQ ID NO: 469864 - RNA, 30 nt, Human
gguuaaugaaggagaagcagcgucugagca

SEQ ID NO: 469865 - RNA, 32 nt, Human
gguuaaugcagauggcaagugcaccaaggaga

SEQ ID NO: 469866 - RNA, 32 nt, Human
gguuaauggaaaggaaaaauguugaacagaua

SEQ ID NO: 469867 - RNA, 32 nt, Human
gguuaauguguggcauauggaagggacuccca

SEQ ID NO: 469868 - RNA, 32 nt, Human
gguuaauuuugcucagaguauccagaguuagc

SEQ ID NO: 469869 - RNA, 32 nt, Human
gguuacaauuagaacuccugaccccagauuca

SEQ ID NO: 469870 - RNA, 32 nt, Human
gguuacaccuguaaucccagcacuuugggagg

SEQ ID NO: 469871 - RNA, 20 nt, Human
gguuacagagccaucacggu

SEQ ID NO: 469872 - RNA, 31 nt, Human
gguuacagagcuagucccaccaaagcuacuc

SEQ ID NO: 469873 - RNA, 32 nt, Human
gguuacagauggccaaugaucucuccaacuau

SEQ ID NO: 469874 - RNA, 32 nt, Human
gguuacagccugacaccugugcguugcaucgg

SEQ ID NO: 469875 - RNA, 25 nt, Human
gguuacaggcaugcaccaccaugcc

SEQ ID NO: 469876 - RNA, 25 nt, Human
gguuacaggcauuugccaccgggcc

SEQ ID NO: 469877 - RNA, 25 nt, Human
gguuacaggcgugcaccaccaugcc

SEQ ID NO: 469878 - RNA, 23 nt, Human
gguuacagggcaaaagggcagcu

SEQ ID NO: 469879 - RNA, 25 nt, Human
gguuacaggugugugccaccacgcc

SEQ ID NO: 469880 - RNA, 21 nt, Human
gguuacaguggccacuaggcu

SEQ ID NO: 469881 - RNA, 32 nt, Human
gguuacaucauuuuucuugcugucuugggcau

SEQ ID NO: 469882 - RNA, 32 nt, Human
gguuacaugguguaaauauuagugcaguuaag

SEQ ID NO: 469883 - RNA, 32 nt, Human
gguuaccaacuggccagcaggcugugucccug

SEQ ID NO: 469884 - RNA, 32 nt, Human
gguuaccaagcaggguucccccuucccuuuuc

SEQ ID NO: 469885 - RNA, 32 nt, Human
gguuaccacacuggucucucuuccuaggcuau

SEQ ID NO: 469886 - RNA, 32 nt, Human
gguuaccaccuugcucaacaccugugcccgga

SEQ ID NO: 469887 - RNA, 32 nt, Human
gguuaccacucaccuggggauucagcaacagg

SEQ ID NO: 469888 - RNA, 21 nt, Human
gguuaccauguaucacaccua

SEQ ID NO: 469889 - RNA, 32 nt, Human
gguuacccagcacauaguaguacuggauucca

SEQ ID NO: 469890 - RNA, 32 nt, Human
gguuacccggcccggcccuuccucgcuucccu

SEQ ID NO: 469891 - RNA, 32 nt, Human
gguuacccuucagauaaagaagggaagaagcc

SEQ ID NO: 469892 - RNA, 23 nt, Human
gguuaccugugccauucauggcc

SEQ ID NO: 469893 - RNA, 32 nt, Human
gguuaccuuagcaaccuuccaccauccaggaa

SEQ ID NO: 469894 - RNA, 32 nt, Human
gguuaccuugauaaagcuguuauucaugaaau

SEQ ID NO: 469895 - RNA, 31 nt, Human
gguuaccuuucugccugcccugugucguaaa

SEQ ID NO: 469896 - RNA, 20 nt, Human
gguuacggaacuccucaagg

SEQ ID NO: 469897 - RNA, 21 nt, Human
gguuacggcuggcuccuggcc

SEQ ID NO: 469898 - RNA, 32 nt, Human
gguuacuagaauuauguuacugugucuuauug

SEQ ID NO: 469899 - RNA, 32 nt, Human
gguuacucaaagcugauucaaagccgauuaaa

SEQ ID NO: 469900 - RNA, 32 nt, Human
gguuacucauccugggcucagguaagagggcc

SEQ ID NO: 469901 - RNA, 32 nt, Human
gguuacugaggggcucaggaaggggccccucg

SEQ ID NO: 469902 - RNA, 32 nt, Human
gguuacugauuuuccucuacccucuuaguuuu

SEQ ID NO: 469903 - RNA, 32 nt, Human
gguuacugccaagcaggauuuagucuggauuu

SEQ ID NO: 469904 - RNA, 32 nt, Human
gguuacugugaaucccagaggagucucucccu

SEQ ID NO: 469905 - RNA, 32 nt, Human
gguuacuguggacuugauagauuugagguacc

SEQ ID NO: 469906 - RNA, 32 nt, Human
gguuacuuaagaggcagagaagcccuaggcaa

SEQ ID NO: 469907 - RNA, 32 nt, Human
gguuacuucuuucuucugccucgacucacaug

SEQ ID NO: 469908 - RNA, 32 nt, Human
gguuagaacagcugccugaggcuccucccuga

SEQ ID NO: 469909 - RNA, 32 nt, Human
gguuagaagggaaggaaggaaagaucaaggaa

SEQ ID NO: 469910 - RNA, 32 nt, Human
gguuagaauggcccucauauugccugccuaaa

SEQ ID NO: 469911 - RNA, 32 nt, Human
gguuagacugggucggggccaggggagaagca

SEQ ID NO: 469912 - RNA, 32 nt, Human
gguuagagagguggagaaagagaaaagaaaug

SEQ ID NO: 469913 - RNA, 32 nt, Human
gguuagagagguggagaaagagaaaggaaaug

SEQ ID NO: 469914 - RNA, 32 nt, Human
gguuagagcuaacauuuuuggugaggaaagca

SEQ ID NO: 469915 - RNA, 32 nt, Human
gguuagagcugaaaggggacagcuggagucaa

SEQ ID NO: 469916 - RNA, 32 nt, Human
gguuagagcuuggcccugccacugaguggccu

SEQ ID NO: 469917 - RNA, 32 nt, Human
gguuagauaaugaaugauaagcaggaaggaug

SEQ ID NO: 469918 - RNA, 32 nt, Human
gguuagauggcugcuacucugaguacccccuc

SEQ ID NO: 469919 - RNA, 32 nt, Human
gguuagauugguucccuguggugaccuagaga

SEQ ID NO: 469920 - RNA, 32 nt, Human
gguuagcaaauaagggcauuggaccugagaac

SEQ ID NO: 469921 - RNA, 32 nt, Human
gguuagcagacugguguguguggaucugcagu

SEQ ID NO: 469922 - RNA, 32 nt, Human
gguuagcauuaccuuaaucuuuguugcucaag

SEQ ID NO: 469923 - RNA, 32 nt, Human
gguuagccccuucaguccauuauccuccaaua

SEQ ID NO: 469924 - RNA, 32 nt, Human
gguuagccuccuggcgcugcaaggcugccugc

SEQ ID NO: 469925 - RNA, 32 nt, Human
gguuagccugaagaaaauugccucagccucca

SEQ ID NO: 469926 - RNA, 32 nt, Human
gguuagccugcuuaggggaagggcuaggggua

SEQ ID NO: 469927 - RNA, 32 nt, Human
gguuagcucugcccucuccucuccucucuacg

SEQ ID NO: 469928 - RNA, 32 nt, Human
gguuagcugccucugcuuccagcuuuguauaa

SEQ ID NO: 469929 - RNA, 32 nt, Human
gguuagcugccucugcuuccagcuuuguguaa

SEQ ID NO: 469930 - RNA, 32 nt, Human
gguuaggaagaaagaggagacaaggacagaca

SEQ ID NO: 469931 - RNA, 32 nt, Human
gguuaggacuguccggcaguugccugcuuuug

SEQ ID NO: 469932 - RNA, 32 nt, Human
gguuaggacuucagaaaccagagcacaagccc

SEQ ID NO: 469933 - RNA, 32 nt, Human
gguuaggagaagggguuucuugaucaugucau

SEQ ID NO: 469934 - RNA, 32 nt, Human
gguuaggaggagagaggacgaaguacagaaca

SEQ ID NO: 469935 - RNA, 32 nt, Human
gguuaggagggacagaguguuccaggaggagg

SEQ ID NO: 469936 - RNA, 32 nt, Human
gguuaggcauguuaagcuugagaugucuguua

SEQ ID NO: 469937 - RNA, 32 nt, Human
gguuagggaauuuggggugagguuccucagga

SEQ ID NO: 469938 - RNA, 32 nt, Human
gguuagggacugucacccucagcacugugaac

SEQ ID NO: 469939 - RNA, 19 nt, Human
gguuagggcaggguagcuc

SEQ ID NO: 469940 - RNA, 32 nt, Human
gguuaggggagaaaaguuggccucccaaaauu

SEQ ID NO: 469941 - RNA, 32 nt, Human
gguuaggggagaggugacccugagggacagcc

SEQ ID NO: 469942 - RNA, 32 nt, Human
gguuaggggagcaccuguuucagacugggcau

SEQ ID NO: 469943 - RNA, 17 nt, Human
gguuagguggcgcgagg

SEQ ID NO: 469944 - RNA, 32 nt, Human
gguuagguggggugaaugugguacaggaaugu

SEQ ID NO: 469945 - RNA, 32 nt, Human
gguuagguuaugagacuggcagagguaggagu

SEQ ID NO: 469946 - RNA, 32 nt, Human
gguuaguaagagaagggggagauggccagccu

SEQ ID NO: 469947 - RNA, 32 nt, Human
gguuaguacugguccccuucugggcaacaugg

SEQ ID NO: 469948 - RNA, 32 nt, Human
gguuagucagcaaaauaaaaucaaccuaauga

SEQ ID NO: 469949 - RNA, 32 nt, Human
gguuaguccucagacuaaugauagugucugcu

SEQ ID NO: 469950 - RNA, 32 nt, Human
gguuagucuuacagaagaaauguggauuugau

SEQ ID NO: 469951 - RNA, 32 nt, Human
gguuagugacucugcaggacuucacagagaga

SEQ ID NO: 469952 - RNA, 32 nt, Human
gguuagugcucgagugaaaaccucuuucagcu

SEQ ID NO: 469953 - RNA, 32 nt, Human
gguuagugguucagaaagguaaccucaagaag

SEQ ID NO: 469954 - RNA, 32 nt, Human
gguuauaaaacagcucaaucggggaguacaac

SEQ ID NO: 469955 - RNA, 25 nt, Human
gguuauaaaauuauacaccauggcc

SEQ ID NO: 469956 - RNA, 32 nt, Human
gguuauaaagguuuggauuggagagggcucac

SEQ ID NO: 469957 - RNA, 19 nt, Human
gguuauaaagucauaucca

SEQ ID NO: 469958 - RNA, 18 nt, Human
gguuauaacuggauccua

SEQ ID NO: 469959 - RNA, 32 nt, Human
gguuauagaauuucaggguuaggguuuaaaga

SEQ ID NO: 469960 - RNA, 21 nt, Human
gguuauagacagucguuccca

SEQ ID NO: 469961 - RNA, 23 nt, Human
gguuauagagaugacuguagcuu

SEQ ID NO: 469962 - RNA, 21 nt, Human
gguuauagauuaucuaauuca

SEQ ID NO: 469963 - RNA, 21 nt, Human
gguuauagcuggucccagguc

SEQ ID NO: 469964 - RNA, 21 nt, Human
gguuauagcuucccauaugcc

SEQ ID NO: 469965 - RNA, 22 nt, Human
gguuauagcuucccauaugcca

SEQ ID NO: 469966 - RNA, 23 nt, Human
gguuauagcuuuccaucacagcu

SEQ ID NO: 469967 - RNA, 19 nt, Human
gguuauagggguacacuua

SEQ ID NO: 469968 - RNA, 32 nt, Human
gguuauagucagcucauuuccauuccacuauu

SEQ ID NO: 469969 - RNA, 21 nt, Human
gguuauaguugcuaauucuaa

SEQ ID NO: 469970 - RNA, 32 nt, Human
gguuauauacaaaguggcaaugcugagauuca

SEQ ID NO: 469971 - RNA, 32 nt, Human
gguuauauggcagccaagaaacaccuggagau

SEQ ID NO: 469972 - RNA, 22 nt, Human
gguuaucacaccaucgcuggcc

SEQ ID NO: 469973 - RNA, 26 nt, Human
gguuaucagcaccagccgccauggcc

SEQ ID NO: 469974 - RNA, 32 nt, Human
gguuaucaguugcuggcugugccugagcagcu

SEQ ID NO: 469975 - RNA, 32 nt, Human
gguuauccagucaacagaacucuaucccaaag

SEQ ID NO: 469976 - RNA, 32 nt, Human
gguuauccccuuggacugugugcagcacgaug

SEQ ID NO: 469977 - RNA, 32 nt, Human
gguuauccuggagaaaauggacucaggagcua

SEQ ID NO: 469978 - RNA, 32 nt, Human
gguuauccuguuugaagaaaaaggacaaauaa

SEQ ID NO: 469979 - RNA, 32 nt, Human
gguuaucgggauaccugggaggauggggugga

SEQ ID NO: 469980 - RNA, 32 nt, Human
gguuaucugaaggggagauuaucaauggcaaa

SEQ ID NO: 469981 - RNA, 32 nt, Human
gguuaucugcaagugaggugugucacaaugag

SEQ ID NO: 469982 - RNA, 32 nt, Human
gguuaucuguaucuggagguuccacuguugcu

SEQ ID NO: 469983 - RNA, 32 nt, Human
gguuaucuguuagaacagucucuguacacaau

SEQ ID NO: 469984 - RNA, 32 nt, Human
gguuaucuucuuuuucucccugauauuuuaau

SEQ ID NO: 469985 - RNA, 23 nt, Human
gguuaugaaucauuaccauggcu

SEQ ID NO: 469986 - RNA, 20 nt, Human
gguuaugauauccauacuca

SEQ ID NO: 469987 - RNA, 32 nt, Human
gguuaugaugaaacaccacauuuuagcaaaac

SEQ ID NO: 469988 - RNA, 32 nt, Human
gguuaugcacacuaaauuaaaugugacauaaa

SEQ ID NO: 469989 - RNA, 29 nt, Human
gguuaugcagcgcgugaacaugaucaugg

SEQ ID NO: 469990 - RNA, 24 nt, Human
gguuaugccuggccccacccagca

SEQ ID NO: 469991 - RNA, 22 nt, Human
gguuaugcucuuuucuuucuca

SEQ ID NO: 469992 - RNA, 18 nt, Human
gguuauggacagcagcca

SEQ ID NO: 469993 - RNA, 21 nt, Human
gguuauggacauucaugccca

SEQ ID NO: 469994 - RNA, 29 nt, Human
gguuauggacggcaccauggaggacuccg

SEQ ID NO: 469995 - RNA, 22 nt, Human
gguuauggacuauacacaccua

SEQ ID NO: 469996 - RNA, 22 nt, Human
gguuaugggggugccagaggca

SEQ ID NO: 469997 - RNA, 32 nt, Human
gguuauguauuuuugugggauccugcaguaaa

SEQ ID NO: 469998 - RNA, 32 nt, Human
gguuaugucaagcaucuggcacagcugaaggc

SEQ ID NO: 469999 - RNA, 32 nt, Human
gguuaugugugccaggcuggcuggcaggaacu

SEQ ID NO: 470000 - RNA, 32 nt, Human
gguuauguuagaauuuacacugaggagaaaau

SEQ ID NO: 470001 - RNA, 19 nt, Human
gguuauguuucugcuacca

SEQ ID NO: 470002 - RNA, 32 nt, Human
gguuauuagaaauaacauaaauggcugguaug

SEQ ID NO: 470003 - RNA, 32 nt, Human
gguuauuagugggaagagaguaauagguugcu

SEQ ID NO: 470004 - RNA, 32 nt, Human
gguuauucagaaccuaaaaguauuauucaaac

SEQ ID NO: 470005 - RNA, 32 nt, Human
gguuauucguuucuaaacuuggauggaauuag

SEQ ID NO: 470006 - RNA, 32 nt, Human
gguuauugauguggcccuggcugccggcacgg

SEQ ID NO: 470007 - RNA, 32 nt, Human
gguuauuggagccugagcuugaccucaaacgg

SEQ ID NO: 470008 - RNA, 32 nt, Human
gguuauuguguguuauauuacuuuccagggac

SEQ ID NO: 470009 - RNA, 32 nt, Human
gguuauuuccucagcuauuuccaccaaauccu

SEQ ID NO: 470010 - RNA, 32 nt, Human
gguuauuuccucagcuguuuccaccaaauccu

SEQ ID NO: 470011 - RNA, 32 nt, Human
gguuauuuuauuuauuguaagcauuuugacau

SEQ ID NO: 470012 - RNA, 32 nt, Human
gguucaaaacucaggcaaagggcgcagaggug

SEQ ID NO: 470013 - RNA, 22 nt, Human
gguucaaacaauuccugccuca

SEQ ID NO: 470014 - RNA, 24 nt, Human
gguucaaacaauucucaugccuca

SEQ ID NO: 470015 - RNA, 24 nt, Human
gguucaaacaauucuccugccuca

SEQ ID NO: 470016 - RNA, 24 nt, Human
gguucaaacaauuuuccugccuca

SEQ ID NO: 470017 - RNA, 24 nt, Human
gguucaaaccauucuccugccuca

SEQ ID NO: 470018 - RNA, 24 nt, Human
gguucaaacgauucuccuaccuca

SEQ ID NO: 470019 - RNA, 24 nt, Human
gguucaaacgauucuccugcccca

SEQ ID NO: 470020 - RNA, 22 nt, Human
gguucaaacgauucuccugccu

SEQ ID NO: 470021 - RNA, 24 nt, Human
gguucaaacgauucuccugccuca

SEQ ID NO: 470022 - RNA, 22 nt, Human
gguucaaacgauucucuugccu

SEQ ID NO: 470023 - RNA, 24 nt, Human
gguucaaacgauucucuugccuca

SEQ ID NO: 470024 - RNA, 24 nt, Human
gguucaaacgauuguccugccuca

SEQ ID NO: 470025 - RNA, 21 nt, Human
gguucaaauaacuuuuccacu

SEQ ID NO: 470026 - RNA, 24 nt, Human
gguucaaaugauacuccugccuca

SEQ ID NO: 470027 - RNA, 24 nt, Human
gguucaaaugauucuccugccuca

SEQ ID NO: 470028 - RNA, 25 nt, Human
gguucaaauguuguucucuucuuua

SEQ ID NO: 470029 - RNA, 24 nt, Human
gguucaaccgauucuccugccuca

SEQ ID NO: 470030 - RNA, 21 nt, Human
gguucaagaacugcugccuua

SEQ ID NO: 470031 - RNA, 24 nt, Human
gguucaagagacucuccugccuca

SEQ ID NO: 470032 - RNA, 24 nt, Human
gguucaagagauccuccugccuca

SEQ ID NO: 470033 - RNA, 24 nt, Human
gguucaagagauuccccugccuca

SEQ ID NO: 470034 - RNA, 22 nt, Human
gguucaagagauucuccugccu

SEQ ID NO: 470035 - RNA, 24 nt, Human
gguucaagagauucuccugccuca

SEQ ID NO: 470036 - RNA, 22 nt, Human
gguucaagagauucuccugucu

SEQ ID NO: 470037 - RNA, 24 nt, Human
gguucaagagauucuccugucuca

SEQ ID NO: 470038 - RNA, 21 nt, Human
gguucaagagauucugccuca

SEQ ID NO: 470039 - RNA, 22 nt, Human
gguucaagagauucuucugccu

SEQ ID NO: 470040 - RNA, 24 nt, Human
gguucaagagauucuucugccuca

SEQ ID NO: 470041 - RNA, 24 nt, Human
gguucaagagauucuucugucuca

SEQ ID NO: 470042 - RNA, 24 nt, Human
gguucaagagauucuugugccuca

SEQ ID NO: 470043 - RNA, 22 nt, Human
gguucaagagauuuuccugccu

SEQ ID NO: 470044 - RNA, 24 nt, Human
gguucaagagauuuuccugccuca

SEQ ID NO: 470045 - RNA, 24 nt, Human
gguucaagauauucuccugccuca

SEQ ID NO: 470046 - RNA, 22 nt, Human
gguucaagauuguuccugcuuu

SEQ ID NO: 470047 - RNA, 24 nt, Human
gguucaagcaaaucuccugccuca

SEQ ID NO: 470048 - RNA, 21 nt, Human
gguucaagcaacccugccuca

SEQ ID NO: 470049 - RNA, 24 nt, Human
gguucaagcaagucuccugccuca

SEQ ID NO: 470050 - RNA, 24 nt, Human
gguucaagcaauccucccaccuca

SEQ ID NO: 470051 - RNA, 24 nt, Human
gguucaagcaauccucccacuuca

SEQ ID NO: 470052 - RNA, 24 nt, Human
gguucaagcaauccuccugccuca

SEQ ID NO: 470053 - RNA, 24 nt, Human
gguucaagcaauccuccugccuua

SEQ ID NO: 470054 - RNA, 32 nt, Human
gguucaagcaauuaacugccucagcuucccua

SEQ ID NO: 470055 - RNA, 22 nt, Human
gguucaagcaauuauccugccu

SEQ ID NO: 470056 - RNA, 24 nt, Human
gguucaagcaauuauccugccuca

SEQ ID NO: 470057 - RNA, 23 nt, Human
gguucaagcaauuaucugccuca

SEQ ID NO: 470058 - RNA, 23 nt, Human
gguucaagcaauuauuugccuca

SEQ ID NO: 470059 - RNA, 22 nt, Human
gguucaagcaauuccccugccu

SEQ ID NO: 470060 - RNA, 23 nt, Human
gguucaagcaauucccugccuca

SEQ ID NO: 470061 - RNA, 24 nt, Human
gguucaagcaauucucaugccuca

SEQ ID NO: 470062 - RNA, 24 nt, Human
gguucaagcaauucuccagccuca

SEQ ID NO: 470063 - RNA, 24 nt, Human
gguucaagcaauucuccuaccuca

SEQ ID NO: 470064 - RNA, 24 nt, Human
gguucaagcaauucuccugcauca

SEQ ID NO: 470065 - RNA, 21 nt, Human
gguucaagcaauucuccugcc

SEQ ID NO: 470066 - RNA, 24 nt, Human
gguucaagcaauucuccugcccca

SEQ ID NO: 470067 - RNA, 24 nt, Human
gguucaagcaauucuccugccgca

SEQ ID NO: 470068 - RNA, 22 nt, Human
gguucaagcaauucuccugccu

SEQ ID NO: 470069 - RNA, 23 nt, Human
gguucaagcaauucuccugccuc

SEQ ID NO: 470070 - RNA, 24 nt, Human
gguucaagcaauucuccugccuca

SEQ ID NO: 470071 - RNA, 23 nt, Human
gguucaagcaauucuccugccuu

SEQ ID NO: 470072 - RNA, 24 nt, Human
gguucaagcaauucuccugccuua

SEQ ID NO: 470073 - RNA, 24 nt, Human
gguucaagcaauucuccugcuuca

SEQ ID NO: 470074 - RNA, 22 nt, Human
gguucaagcaauucuccugucu

SEQ ID NO: 470075 - RNA, 24 nt, Human
gguucaagcaauucuccugucuca

SEQ ID NO: 470076 - RNA, 24 nt, Human
gguucaagcaauucuccugucuua

SEQ ID NO: 470077 - RNA, 22 nt, Human
gguucaagcaauucuccuguuu

SEQ ID NO: 470078 - RNA, 24 nt, Human
gguucaagcaauucuccuguuuca

SEQ ID NO: 470079 - RNA, 24 nt, Human
gguucaagcaauucuccuuccuca

SEQ ID NO: 470080 - RNA, 24 nt, Human
gguucaagcaauucuccuucuuca

SEQ ID NO: 470081 - RNA, 25 nt, Human
gguucaagcaauucucguugucuca

SEQ ID NO: 470082 - RNA, 23 nt, Human
gguucaagcaauucucugccuca

SEQ ID NO: 470083 - RNA, 23 nt, Human
gguucaagcaauucucugucuca

SEQ ID NO: 470084 - RNA, 22 nt, Human
gguucaagcaauucucuugccu

SEQ ID NO: 470085 - RNA, 24 nt, Human
gguucaagcaauucucuugccuca

SEQ ID NO: 470086 - RNA, 21 nt, Human
gguucaagcaauucugcccca

SEQ ID NO: 470087 - RNA, 24 nt, Human
gguucaagcaauucuucugacuca

SEQ ID NO: 470088 - RNA, 22 nt, Human
gguucaagcaauucuucugccu

SEQ ID NO: 470089 - RNA, 24 nt, Human
gguucaagcaauucuucugccuca

SEQ ID NO: 470090 - RNA, 22 nt, Human
gguucaagcaauuguccugccu

SEQ ID NO: 470091 - RNA, 24 nt, Human
gguucaagcaauuguccugccuca

SEQ ID NO: 470092 - RNA, 23 nt, Human
gguucaagcaauugucugccuca

SEQ ID NO: 470093 - RNA, 23 nt, Human
gguucaagcaauuuccugccuca

SEQ ID NO: 470094 - RNA, 22 nt, Human
gguucaagcaauuuuccugcuu

SEQ ID NO: 470095 - RNA, 24 nt, Human
gguucaagcaauuuuccugcuuca

SEQ ID NO: 470096 - RNA, 24 nt, Human
gguucaagcaauuuucgugccuca

SEQ ID NO: 470097 - RNA, 24 nt, Human
gguucaagcacuucucguaccuca

SEQ ID NO: 470098 - RNA, 23 nt, Human
gguucaagcagucuuccugccuu

SEQ ID NO: 470099 - RNA, 24 nt, Human
gguucaagcaguucucccgccuca

SEQ ID NO: 470100 - RNA, 22 nt, Human
gguucaagcaguucuccugccu

SEQ ID NO: 470101 - RNA, 24 nt, Human
gguucaagcaguucuccugccuca

SEQ ID NO: 470102 - RNA, 22 nt, Human
gguucaagcaguucuccugucu

SEQ ID NO: 470103 - RNA, 24 nt, Human
gguucaagcaguucuccugucuca

SEQ ID NO: 470104 - RNA, 23 nt, Human
gguucaagcaguucucugccuca

SEQ ID NO: 470105 - RNA, 24 nt, Human
gguucaagcaguucucuugccuca

SEQ ID NO: 470106 - RNA, 21 nt, Human
gguucaagcaguucugccuca

SEQ ID NO: 470107 - RNA, 21 nt, Human
gguucaagcaguucuuccuca

SEQ ID NO: 470108 - RNA, 23 nt, Human
gguucaagcaguuuccugcuuca

SEQ ID NO: 470109 - RNA, 22 nt, Human
gguucaagcauuucuccugccu

SEQ ID NO: 470110 - RNA, 24 nt, Human
gguucaagcauuucuccugccuca

SEQ ID NO: 470111 - RNA, 24 nt, Human
gguucaagcauuucuccugucuca

SEQ ID NO: 470112 - RNA, 25 nt, Human
gguucaagccaucccuccugccuca

SEQ ID NO: 470113 - RNA, 24 nt, Human
gguucaagccauucucaugccuca

SEQ ID NO: 470114 - RNA, 24 nt, Human
gguucaagccauucuccucccuca

SEQ ID NO: 470115 - RNA, 22 nt, Human
gguucaagccauucuccugccu

SEQ ID NO: 470116 - RNA, 24 nt, Human
gguucaagccauucuccugccuca

SEQ ID NO: 470117 - RNA, 24 nt, Human
gguucaagccauucuccugucuca

SEQ ID NO: 470118 - RNA, 21 nt, Human
gguucaagccauucugccuca

SEQ ID NO: 470119 - RNA, 24 nt, Human
gguucaagccauucuucugccuca

SEQ ID NO: 470120 - RNA, 24 nt, Human
gguucaagcgaaccuccugccuca

SEQ ID NO: 470121 - RNA, 24 nt, Human
gguucaagcgaaucuccugccuca

SEQ ID NO: 470122 - RNA, 22 nt, Human
gguucaagcgacucuccugccu

SEQ ID NO: 470123 - RNA, 24 nt, Human
gguucaagcgacucuccugccuca

SEQ ID NO: 470124 - RNA, 22 nt, Human
gguucaagcgagucuccugccu

SEQ ID NO: 470125 - RNA, 24 nt, Human
gguucaagcgagucuccugccuca

SEQ ID NO: 470126 - RNA, 24 nt, Human
gguucaagcgauccucccacuuca

SEQ ID NO: 470127 - RNA, 24 nt, Human
gguucaagcgauccuccugccuca

SEQ ID NO: 470128 - RNA, 21 nt, Human
gguucaagcgauccugccuca

SEQ ID NO: 470129 - RNA, 24 nt, Human
gguucaagcgaugcuccugccuca

SEQ ID NO: 470130 - RNA, 24 nt, Human
gguucaagcgauuauccugccuca

SEQ ID NO: 470131 - RNA, 24 nt, Human
gguucaagcgauucaccugccuca

SEQ ID NO: 470132 - RNA, 22 nt, Human
gguucaagcgauuccccugccu

SEQ ID NO: 470133 - RNA, 24 nt, Human
gguucaagcgauuccccugccuca

SEQ ID NO: 470134 - RNA, 24 nt, Human
gguucaagcgauuccucugccuca

SEQ ID NO: 470135 - RNA, 22 nt, Human
gguucaagcgauucucaugccu

SEQ ID NO: 470136 - RNA, 23 nt, Human
gguucaagcgauucucaugccuc

SEQ ID NO: 470137 - RNA, 24 nt, Human
gguucaagcgauucucaugccuca

SEQ ID NO: 470138 - RNA, 24 nt, Human
gguucaagcgauucucaugccuua

SEQ ID NO: 470139 - RNA, 24 nt, Human
gguucaagcgauucucaugucuca

SEQ ID NO: 470140 - RNA, 24 nt, Human
gguucaagcgauucuccagccuca

SEQ ID NO: 470141 - RNA, 24 nt, Human
gguucaagcgauucuccagccuua

SEQ ID NO: 470142 - RNA, 22 nt, Human
gguucaagcgauucucccgccu

SEQ ID NO: 470143 - RNA, 24 nt, Human
gguucaagcgauucucccgccuca

SEQ ID NO: 470144 - RNA, 24 nt, Human
gguucaagcgauucuccuaccuca

SEQ ID NO: 470145 - RNA, 22 nt, Human
gguucaagcgauucuccugacu

SEQ ID NO: 470146 - RNA, 24 nt, Human
gguucaagcgauucuccugacuca

SEQ ID NO: 470147 - RNA, 20 nt, Human
gguucaagcgauucuccugc

SEQ ID NO: 470148 - RNA, 24 nt, Human
gguucaagcgauucuccugcauca

SEQ ID NO: 470149 - RNA, 22 nt, Human
gguucaagcgauucuccugccu

SEQ ID NO: 470150 - RNA, 23 nt, Human
gguucaagcgauucuccugccuc

SEQ ID NO: 470151 - RNA, 24 nt, Human
gguucaagcgauucuccugccuca

SEQ ID NO: 470152 - RNA, 24 nt, Human
gguucaagcgauucuccugccuua

SEQ ID NO: 470153 - RNA, 22 nt, Human
gguucaagcgauucuccugcuu

SEQ ID NO: 470154 - RNA, 24 nt, Human
gguucaagcgauucuccugcuuca

SEQ ID NO: 470155 - RNA, 23 nt, Human
gguucaagcgauucuccugcuuu

SEQ ID NO: 470156 - RNA, 20 nt, Human
gguucaagcgauucuccugu

SEQ ID NO: 470157 - RNA, 24 nt, Human
gguucaagcgauucuccugucuca

SEQ ID NO: 470158 - RNA, 24 nt, Human
gguucaagcgauucuccuguguca

SEQ ID NO: 470159 - RNA, 22 nt, Human
gguucaagcgauucucgugccu

SEQ ID NO: 470160 - RNA, 24 nt, Human
gguucaagcgauucucgugccuca

SEQ ID NO: 470161 - RNA, 22 nt, Human
gguucaagcgauucucguggcu

SEQ ID NO: 470162 - RNA, 21 nt, Human
gguucaagcgauucucucacu

SEQ ID NO: 470163 - RNA, 22 nt, Human
gguucaagcgauucucuugccu

SEQ ID NO: 470164 - RNA, 23 nt, Human
gguucaagcgauucucuugccuc

SEQ ID NO: 470165 - RNA, 24 nt, Human
gguucaagcgauucucuugccuca

SEQ ID NO: 470166 - RNA, 21 nt, Human
gguucaagcgauucugccucg

SEQ ID NO: 470167 - RNA, 24 nt, Human
gguucaagcgauucugcugccuca

SEQ ID NO: 470168 - RNA, 22 nt, Human
gguucaagcgauucuuaugccu

SEQ ID NO: 470169 - RNA, 24 nt, Human
gguucaagcgauucuuaugccuca

SEQ ID NO: 470170 - RNA, 22 nt, Human
gguucaagcgauucuucugccu

SEQ ID NO: 470171 - RNA, 23 nt, Human
gguucaagcgauucuucugccuc

SEQ ID NO: 470172 - RNA, 24 nt, Human
gguucaagcgauucuucugccuca

SEQ ID NO: 470173 - RNA, 24 nt, Human
gguucaagcgauucuucugcuuca

SEQ ID NO: 470174 - RNA, 23 nt, Human
gguucaagcgauucuugugccuc

SEQ ID NO: 470175 - RNA, 24 nt, Human
gguucaagcgauucuugugccuca

SEQ ID NO: 470176 - RNA, 22 nt, Human
gguucaagcgauugucccgccu

SEQ ID NO: 470177 - RNA, 22 nt, Human
gguucaagcgauuguccugccu

SEQ ID NO: 470178 - RNA, 24 nt, Human
gguucaagcgauuguccugccuca

SEQ ID NO: 470179 - RNA, 22 nt, Human
gguucaagcgauuuuccugccu

SEQ ID NO: 470180 - RNA, 24 nt, Human
gguucaagcgauuuuccugccuca

SEQ ID NO: 470181 - RNA, 24 nt, Human
gguucaagcgauuuuccugcuuca

SEQ ID NO: 470182 - RNA, 24 nt, Human
gguucaagcgcuucuccagccuca

SEQ ID NO: 470183 - RNA, 24 nt, Human
gguucaagcgcuucuccugccuca

SEQ ID NO: 470184 - RNA, 24 nt, Human
gguucaagcgguucuacugccuca

SEQ ID NO: 470185 - RNA, 18 nt, Human
gguucaagcuauucuacu

SEQ ID NO: 470186 - RNA, 24 nt, Human
gguucaagcuauucuacugccuca

SEQ ID NO: 470187 - RNA, 24 nt, Human
gguucaagcuauucucaugccuca

SEQ ID NO: 470188 - RNA, 22 nt, Human
gguucaagcuauucuccugccu

SEQ ID NO: 470189 - RNA, 24 nt, Human
gguucaagcuauucuccugccuca

SEQ ID NO: 470190 - RNA, 32 nt, Human
gguucaagcuccgugggccacacugcugcugu

SEQ ID NO: 470191 - RNA, 32 nt, Human
gguucaagcugaaaauguuacacaggaagaca

SEQ ID NO: 470192 - RNA, 21 nt, Human
gguucaaggauucuccugccu

SEQ ID NO: 470193 - RNA, 23 nt, Human
gguucaaggauucuccugccuca

SEQ ID NO: 470194 - RNA, 32 nt, Human
gguucaaggcacagucauucucuggcuuucau

SEQ ID NO: 470195 - RNA, 22 nt, Human
gguucaagggauucuccugccu

SEQ ID NO: 470196 - RNA, 24 nt, Human
gguucaagggauucuccugccuca

SEQ ID NO: 470197 - RNA, 24 nt, Human
gguucaagggauucuccugucuua

SEQ ID NO: 470198 - RNA, 24 nt, Human
gguucaagggauucucgugccuca

SEQ ID NO: 470199 - RNA, 21 nt, Human
gguucaagggauucugccuca

SEQ ID NO: 470200 - RNA, 22 nt, Human
gguucaaguaauucuccugccu

SEQ ID NO: 470201 - RNA, 24 nt, Human
gguucaaguaauucuccugccuca

SEQ ID NO: 470202 - RNA, 24 nt, Human
gguucaaguaauucugcugucuca

SEQ ID NO: 470203 - RNA, 22 nt, Human
gguucaaguaguucuccugccu

SEQ ID NO: 470204 - RNA, 24 nt, Human
gguucaaguaguucuccugccuca

SEQ ID NO: 470205 - RNA, 21 nt, Human
gguucaagucugcuuuccaca

SEQ ID NO: 470206 - RNA, 24 nt, Human
gguucaagugacccucccaccuca

SEQ ID NO: 470207 - RNA, 24 nt, Human
gguucaagugacucuugugccuca

SEQ ID NO: 470208 - RNA, 24 nt, Human
gguucaagugagucucaugccuca

SEQ ID NO: 470209 - RNA, 24 nt, Human
gguucaagugagucuccugccuca

SEQ ID NO: 470210 - RNA, 24 nt, Human
gguucaagugagucucgugccuca

SEQ ID NO: 470211 - RNA, 24 nt, Human
gguucaagugauccucccaccuca

SEQ ID NO: 470212 - RNA, 22 nt, Human
gguucaagugauccuccugccu

SEQ ID NO: 470213 - RNA, 24 nt, Human
gguucaagugauccuccugccuca

SEQ ID NO: 470214 - RNA, 24 nt, Human
gguucaagugauccucucaccuca

SEQ ID NO: 470215 - RNA, 24 nt, Human
gguucaagugauccucuugucuca

SEQ ID NO: 470216 - RNA, 24 nt, Human
gguucaagugaucguccugccuca

SEQ ID NO: 470217 - RNA, 24 nt, Human
gguucaagugaucguccugccuua

SEQ ID NO: 470218 - RNA, 24 nt, Human
gguucaagugaugcuccugccuca

SEQ ID NO: 470219 - RNA, 24 nt, Human
gguucaagugauucaccugccuca

SEQ ID NO: 470220 - RNA, 24 nt, Human
gguucaagugauuccccuaccuca

SEQ ID NO: 470221 - RNA, 23 nt, Human
gguucaagugauucccugccuca

SEQ ID NO: 470222 - RNA, 22 nt, Human
gguucaagugauucucaucuca

SEQ ID NO: 470223 - RNA, 32 nt, Human
gguucaagugauucucaucucagccucccaag

SEQ ID NO: 470224 - RNA, 22 nt, Human
gguucaagugauucucaugccu

SEQ ID NO: 470225 - RNA, 24 nt, Human
gguucaagugauucucaugccuca

SEQ ID NO: 470226 - RNA, 24 nt, Human
gguucaagugauucuccagccuca

SEQ ID NO: 470227 - RNA, 20 nt, Human
gguucaagugauucucccac

SEQ ID NO: 470228 - RNA, 22 nt, Human
gguucaagugauucucccaccu

SEQ ID NO: 470229 - RNA, 24 nt, Human
gguucaagugauucucccaccuca

SEQ ID NO: 470230 - RNA, 23 nt, Human
gguucaagugauucuccuaccuc

SEQ ID NO: 470231 - RNA, 32 nt, Human
gguucaagugauucuccuaucucagccuccug

SEQ ID NO: 470232 - RNA, 22 nt, Human
gguucaagugauucuccucccu

SEQ ID NO: 470233 - RNA, 24 nt, Human
gguucaagugauucuccucccuca

SEQ ID NO: 470234 - RNA, 32 nt, Human
gguucaagugauucuccucccucagccuccca

SEQ ID NO: 470235 - RNA, 21 nt, Human
gguucaagugauucuccugcc

SEQ ID NO: 470236 - RNA, 24 nt, Human
gguucaagugauucuccugcccca

SEQ ID NO: 470237 - RNA, 22 nt, Human
gguucaagugauucuccugccu

SEQ ID NO: 470238 - RNA, 23 nt, Human
gguucaagugauucuccugccuc

SEQ ID NO: 470239 - RNA, 24 nt, Human
gguucaagugauucuccugccuca

SEQ ID NO: 470240 - RNA, 24 nt, Human
gguucaagugauucuccugccuua

SEQ ID NO: 470241 - RNA, 22 nt, Human
gguucaagugauucuccugcuu

SEQ ID NO: 470242 - RNA, 24 nt, Human
gguucaagugauucuccugcuuca

SEQ ID NO: 470243 - RNA, 23 nt, Human
gguucaagugauucuccugcuuu

SEQ ID NO: 470244 - RNA, 24 nt, Human
gguucaagugauucuccugcuuua

SEQ ID NO: 470245 - RNA, 22 nt, Human
gguucaagugauucuccugucu

SEQ ID NO: 470246 - RNA, 24 nt, Human
gguucaagugauucuccugucuca

SEQ ID NO: 470247 - RNA, 24 nt, Human
gguucaagugauucucguaccuca

SEQ ID NO: 470248 - RNA, 24 nt, Human
gguucaagugauucucgugccuca

SEQ ID NO: 470249 - RNA, 24 nt, Human
gguucaagugauucucgugcuuca

SEQ ID NO: 470250 - RNA, 24 nt, Human
gguucaagugauucucuggccuca

SEQ ID NO: 470251 - RNA, 22 nt, Human
gguucaagugauucucuugccu

SEQ ID NO: 470252 - RNA, 24 nt, Human
gguucaagugauucucuugccuca

SEQ ID NO: 470253 - RNA, 24 nt, Human
gguucaagugauucucuugucuca

SEQ ID NO: 470254 - RNA, 24 nt, Human
gguucaagugauucuuaugccuca

SEQ ID NO: 470255 - RNA, 24 nt, Human
gguucaagugauucuuccaccuca

SEQ ID NO: 470256 - RNA, 22 nt, Human
gguucaagugauucuucugccu

SEQ ID NO: 470257 - RNA, 24 nt, Human
gguucaagugauucuucugccuca

SEQ ID NO: 470258 - RNA, 24 nt, Human
gguucaagugauucuucugcuuca

SEQ ID NO: 470259 - RNA, 25 nt, Human
gguucaagugauucuucuugccuca

SEQ ID NO: 470260 - RNA, 24 nt, Human
gguucaagugauucuugugccuca

SEQ ID NO: 470261 - RNA, 24 nt, Human
gguucaagugauuuuccugccuca

SEQ ID NO: 470262 - RNA, 23 nt, Human
gguucaagugcuucuccagccuc

SEQ ID NO: 470263 - RNA, 22 nt, Human
gguucaagugcuucuccugccu

SEQ ID NO: 470264 - RNA, 24 nt, Human
gguucaagugcuucuccugccuca

SEQ ID NO: 470265 - RNA, 24 nt, Human
gguucaagugguucuccugcccca

SEQ ID NO: 470266 - RNA, 24 nt, Human
gguucaagugguucuccugccuca

SEQ ID NO: 470267 - RNA, 22 nt, Human
gguucaagugguucuccuuccu

SEQ ID NO: 470268 - RNA, 24 nt, Human
gguucaagugguucuccuuccuca

SEQ ID NO: 470269 - RNA, 24 nt, Human
gguucaauagauucuccagccuca

SEQ ID NO: 470270 - RNA, 24 nt, Human
gguucaaucaauucuccuaccuca

SEQ ID NO: 470271 - RNA, 24 nt, Human
gguucaaucgauucuccugccuca

SEQ ID NO: 470272 - RNA, 22 nt, Human
gguucaaucgguuuuccugccu

SEQ ID NO: 470273 - RNA, 24 nt, Human
gguucaaucgguuuuccugccuca

SEQ ID NO: 470274 - RNA, 22 nt, Human
gguucaauugauucuccugccu

SEQ ID NO: 470275 - RNA, 24 nt, Human
gguucaauugauucuccugccuca

SEQ ID NO: 470276 - RNA, 24 nt, Human
gguucacaccauucuccggccuca

SEQ ID NO: 470277 - RNA, 24 nt, Human
gguucacaccauucuccuaccuca

SEQ ID NO: 470278 - RNA, 22 nt, Human
gguucacaccauucuccugccu

SEQ ID NO: 470279 - RNA, 24 nt, Human
gguucacaccauucuccugccuca

SEQ ID NO: 470280 - RNA, 24 nt, Human
gguucacaccauucucuugccuca

SEQ ID NO: 470281 - RNA, 32 nt, Human
gguucacaccuguaauccaagcacuuugggag

SEQ ID NO: 470282 - RNA, 32 nt, Human
gguucacaccuguaaucccaacacuuugggag

SEQ ID NO: 470283 - RNA, 32 nt, Human
gguucacaccuguaaucccagcacuuugggag

SEQ ID NO: 470284 - RNA, 32 nt, Human
gguucacaccuguaauccccgcacuuuggaag

SEQ ID NO: 470285 - RNA, 32 nt, Human
gguucacaccuguaaucccggcacuuugggag

SEQ ID NO: 470286 - RNA, 32 nt, Human
gguucacaccuguaaucccggcauuuugggag

SEQ ID NO: 470287 - RNA, 32 nt, Human
gguucacaccuguaauccuagaacuuugggag

SEQ ID NO: 470288 - RNA, 32 nt, Human
gguucacaccuguaauccuagcaguuugggag

SEQ ID NO: 470289 - RNA, 32 nt, Human
gguucacaccuguaauugcagcacuuugggag

SEQ ID NO: 470290 - RNA, 32 nt, Human
gguucacacguguguucacagagcuacggcca

SEQ ID NO: 470291 - RNA, 32 nt, Human
gguucacagaggcagagugggcagggacaagg

SEQ ID NO: 470292 - RNA, 24 nt, Human
gguucacaucauucuccugccuca

SEQ ID NO: 470293 - RNA, 24 nt, Human
gguucacaugauucuccugccuca

SEQ ID NO: 470294 - RNA, 32 nt, Human
gguucacauuuguaaucccagcacuuuggaag

SEQ ID NO: 470295 - RNA, 24 nt, Human
gguucaccccauucuccuguuuca

SEQ ID NO: 470296 - RNA, 32 nt, Human
gguucacccugucuuugggauguggcccuuga

SEQ ID NO: 470297 - RNA, 32 nt, Human
gguucaccugaacacagaguguauuuucuuau

SEQ ID NO: 470298 - RNA, 24 nt, Human
gguucacgccacucucccgccuca

SEQ ID NO: 470299 - RNA, 23 nt, Human
gguucacgccauccuccugccuc

SEQ ID NO: 470300 - RNA, 24 nt, Human
gguucacgccauccuccugccuca

SEQ ID NO: 470301 - RNA, 24 nt, Human
gguucacgccauuccccugccuca

SEQ ID NO: 470302 - RNA, 24 nt, Human
gguucacgccauucuccugcccca

SEQ ID NO: 470303 - RNA, 22 nt, Human
gguucacgccauucuccugccu

SEQ ID NO: 470304 - RNA, 24 nt, Human
gguucacgccauucuccugccuca

SEQ ID NO: 470305 - RNA, 24 nt, Human
gguucacgccauucuccuggcuca

SEQ ID NO: 470306 - RNA, 24 nt, Human
gguucacgccauucucuugccuca

SEQ ID NO: 470307 - RNA, 24 nt, Human
gguucacgccauuguccugccuca

SEQ ID NO: 470308 - RNA, 24 nt, Human
gguucacgcccuucuccugccuca

SEQ ID NO: 470309 - RNA, 24 nt, Human
gguucacgccguucuccugccuca

SEQ ID NO: 470310 - RNA, 32 nt, Human
gguucacgccuggaaucccagcacuugaggcc

SEQ ID NO: 470311 - RNA, 32 nt, Human
gguucacgccuggaaucccagcauuuugggag

SEQ ID NO: 470312 - RNA, 20 nt, Human
gguucacgccuguaauccca

SEQ ID NO: 470313 - RNA, 32 nt, Human
gguucacgccuguaaucccaauacuuugggag

SEQ ID NO: 470314 - RNA, 32 nt, Human
gguucacgccuguaaucccagcacuuugggag

SEQ ID NO: 470315 - RNA, 32 nt, Human
gguucacgccuguaaucccagcacuuugggau

SEQ ID NO: 470316 - RNA, 32 nt, Human
gguucacgccuguaaucccagcacuuuggggg

SEQ ID NO: 470317 - RNA, 32 nt, Human
gguucacgccuguaaugccagcacuuugggag

SEQ ID NO: 470318 - RNA, 32 nt, Human
gguucacgccuguaauuccagcacuuugagag

SEQ ID NO: 470319 - RNA, 32 nt, Human
gguucacgccuguauucccagcauuuugggag

SEQ ID NO: 470320 - RNA, 32 nt, Human
gguucacgcuuguaaucccaucacuuugggag

SEQ ID NO: 470321 - RNA, 24 nt, Human
gguucacgucauucuccugccuca

SEQ ID NO: 470322 - RNA, 24 nt, Human
gguucacgugauucucaugccuca

SEQ ID NO: 470323 - RNA, 24 nt, Human
gguucacuacaaccuccgccuccu

SEQ ID NO: 470324 - RNA, 32 nt, Human
gguucacuacaaccuccgccuccuggguccaa

SEQ ID NO: 470325 - RNA, 32 nt, Human
gguucacuaucuguuugcuggaagauauacaa

SEQ ID NO: 470326 - RNA, 32 nt, Human
gguucacucauucaacacauacauucaaaaca

SEQ ID NO: 470327 - RNA, 32 nt, Human
gguucacuccaucauauacagcucucugcucc

SEQ ID NO: 470328 - RNA, 32 nt, Human
gguucacugcaacauucaccucccagguucau

SEQ ID NO: 470329 - RNA, 23 nt, Human
gguucacugcaaccuccaccucc

SEQ ID NO: 470330 - RNA, 32 nt, Human
gguucacugcaaccuccaccuccaggguucag

SEQ ID NO: 470331 - RNA, 32 nt, Human
gguucacugcaaccuccaccucccagguucaa

SEQ ID NO: 470332 - RNA, 32 nt, Human
gguucacugcaaccuccaccucccgaguucaa

SEQ ID NO: 470333 - RNA, 32 nt, Human
gguucacugcaaccuccaccucucagauucaa

SEQ ID NO: 470334 - RNA, 32 nt, Human
gguucacugcaaccuccaccucuuggguucaa

SEQ ID NO: 470335 - RNA, 32 nt, Human
gguucacugcaaccuccgcauccgggguucaa

SEQ ID NO: 470336 - RNA, 32 nt, Human
gguucacugcaaccuccgccuccagguucaag

SEQ ID NO: 470337 - RNA, 32 nt, Human
gguucacugcaaccuccgccucccgguucagg

SEQ ID NO: 470338 - RNA, 32 nt, Human
gguucacugcaaccuccgccuccuggauucaa

SEQ ID NO: 470339 - RNA, 32 nt, Human
gguucacugcaaccuccgccucuuggguucaa

SEQ ID NO: 470340 - RNA, 32 nt, Human
gguucacugcaaccucugccacccauguucaa

SEQ ID NO: 470341 - RNA, 23 nt, Human
gguucacugcaaccucugccucc

SEQ ID NO: 470342 - RNA, 32 nt, Human
gguucacugcaaccucugccuccagguucaag

SEQ ID NO: 470343 - RNA, 32 nt, Human
gguucacugcaaccucugccucccaggaucaa

SEQ ID NO: 470344 - RNA, 32 nt, Human
gguucacugcaaccucugccucccagguucaa

SEQ ID NO: 470345 - RNA, 32 nt, Human
gguucacugcaaccucugccucccggguucaa

SEQ ID NO: 470346 - RNA, 24 nt, Human
gguucacugcaaccucugccuccu

SEQ ID NO: 470347 - RNA, 32 nt, Human
gguucacugcaaccucugccuccugggcucaa

SEQ ID NO: 470348 - RNA, 32 nt, Human
gguucacugcaaccucugccuccuggguucaa

SEQ ID NO: 470349 - RNA, 32 nt, Human
gguucacugcaaccucugccucucagguucaa

SEQ ID NO: 470350 - RNA, 32 nt, Human
gguucacugcaaccuuggccuccuagguucaa

SEQ ID NO: 470351 - RNA, 32 nt, Human
gguucacugcaagcuccaccucccggguucac

SEQ ID NO: 470352 - RNA, 32 nt, Human
gguucacugcaaucucgacuuccaguuucagg

SEQ ID NO: 470353 - RNA, 32 nt, Human
gguucacugcacccucugccucccagguucaa

SEQ ID NO: 470354 - RNA, 32 nt, Human
gguucacugcagacuccaccucuccaggcuca

SEQ ID NO: 470355 - RNA, 32 nt, Human
gguucacugcagccucgaccucccaggcucaa

SEQ ID NO: 470356 - RNA, 32 nt, Human
gguucacugcagccucugccuucugggcucac

SEQ ID NO: 470357 - RNA, 32 nt, Human
gguucacugcagccuugaccuccagggcucaa

SEQ ID NO: 470358 - RNA, 32 nt, Human
gguucacugcagcuccugucacaagcugggau

SEQ ID NO: 470359 - RNA, 32 nt, Human
gguucacugcagucuugaccucccaggcuuag

SEQ ID NO: 470360 - RNA, 32 nt, Human
gguucacugcuuugguggaaauugguggaaau

SEQ ID NO: 470361 - RNA, 32 nt, Human
gguucacugguaaucccagcacuuugggaggc

SEQ ID NO: 470362 - RNA, 32 nt, Human
gguucacuuacauauaucauuuaacaucagug

SEQ ID NO: 470363 - RNA, 32 nt, Human
gguucacuucaaccccuaccuccugggcucaa

SEQ ID NO: 470364 - RNA, 32 nt, Human
gguucacuucaaccucaaccucccaggcucaa

SEQ ID NO: 470365 - RNA, 32 nt, Human
gguucagaaaacaucaaaacacugcagcaguu

SEQ ID NO: 470366 - RNA, 32 nt, Human
gguucagaaagccaguacagagggagucgcca

SEQ ID NO: 470367 - RNA, 32 nt, Human
gguucagaccaguaggaaccaggcugggucag

SEQ ID NO: 470368 - RNA, 32 nt, Human
gguucagacucugcaucgaagccugacugaag

SEQ ID NO: 470369 - RNA, 32 nt, Human
gguucagagaaaagagcgacaaggaaaaguua

SEQ ID NO: 470370 - RNA, 32 nt, Human
gguucagagaacaccccacggggcuguuuguc

SEQ ID NO: 470371 - RNA, 32 nt, Human
gguucagagcaucagaugaagacuucauuggg

SEQ ID NO: 470372 - RNA, 32 nt, Human
gguucagagcaugggugcucugagggacaaag

SEQ ID NO: 470373 - RNA, 32 nt, Human
gguucagagccacucuggaggcugggcuggca

SEQ ID NO: 470374 - RNA, 32 nt, Human
gguucagagguugguagcacuuggggagagua

SEQ ID NO: 470375 - RNA, 32 nt, Human
gguucagaguagcugggacuacaggcccacac

SEQ ID NO: 470376 - RNA, 32 nt, Human
gguucagaguuauacaacuaaucccaggugau

SEQ ID NO: 470377 - RNA, 24 nt, Human
gguucagaugauuccccugccuca

SEQ ID NO: 470378 - RNA, 24 nt, Human
gguucagaugauucuucugcuuca

SEQ ID NO: 470379 - RNA, 18 nt, Human
gguucagauucacaccua

SEQ ID NO: 470380 - RNA, 32 nt, Human
gguucagccagggccucccaggaagagugcug

SEQ ID NO: 470381 - RNA, 21 nt, Human
gguucagcccacccaccccca

SEQ ID NO: 470382 - RNA, 32 nt, Human
gguucagccccggggaggagguuccacaggac

SEQ ID NO: 470383 - RNA, 32 nt, Human
gguucaggaaccugcugguucugauacauaaa

SEQ ID NO: 470384 - RNA, 21 nt, Human
gguucaggaagauggccauga

SEQ ID NO: 470385 - RNA, 32 nt, Human
gguucaggagggagaagagcaaagccgcuucc

SEQ ID NO: 470386 - RNA, 24 nt, Human
gguucaggcaauucucccaccuca

SEQ ID NO: 470387 - RNA, 24 nt, Human
gguucaggcaauucuccugccuca

SEQ ID NO: 470388 - RNA, 24 nt, Human
gguucaggcaauucuugugucuca

SEQ ID NO: 470389 - RNA, 24 nt, Human
gguucaggccauucuccugccuca

SEQ ID NO: 470390 - RNA, 32 nt, Human
gguucaggccuguaauuccagcacuuugggag

SEQ ID NO: 470391 - RNA, 22 nt, Human
gguucaggcgauucccgugccu

SEQ ID NO: 470392 - RNA, 22 nt, Human
gguucaggcgauucuccugccu

SEQ ID NO: 470393 - RNA, 24 nt, Human
gguucaggcgauucuccugccuca

SEQ ID NO: 470394 - RNA, 24 nt, Human
gguucaggcgauucuuccgucuca

SEQ ID NO: 470395 - RNA, 24 nt, Human
gguucaggcuauucuccugccuca

SEQ ID NO: 470396 - RNA, 23 nt, Human
gguucaggcuauucuccugcuca

SEQ ID NO: 470397 - RNA, 32 nt, Human
gguucaggcuugcuuugaaccugagcucuuag

SEQ ID NO: 470398 - RNA, 32 nt, Human
gguucagggaaggaggggaaaagggaggugca

SEQ ID NO: 470399 - RNA, 32 nt, Human
gguucagggacccugagggugcauuuacaucc

SEQ ID NO: 470400 - RNA, 22 nt, Human
gguucagggagugagggccuga

SEQ ID NO: 470401 - RNA, 32 nt, Human
gguucagggcagcaaugcugaguucaagaaaa

SEQ ID NO: 470402 - RNA, 22 nt, Human
gguucaggggacucagcccuga

SEQ ID NO: 470403 - RNA, 32 nt, Human
gguucaggggguacaugugcagguuuguuaca

SEQ ID NO: 470404 - RNA, 22 nt, Human
gguucagggguguuucugucuc

SEQ ID NO: 470405 - RNA, 32 nt, Human
gguucaggucacuucggacaccugccauggac

SEQ ID NO: 470406 - RNA, 32 nt, Human
gguucaggugaaguuuucccagcuggaacaau

SEQ ID NO: 470407 - RNA, 21 nt, Human
gguucaggugagaguggcuca

SEQ ID NO: 470408 - RNA, 24 nt, Human
gguucaggugauccucccgccuca

SEQ ID NO: 470409 - RNA, 24 nt, Human
gguucaggugauccuccugccuca

SEQ ID NO: 470410 - RNA, 24 nt, Human
gguucaggugauuauuuugccuca

SEQ ID NO: 470411 - RNA, 23 nt, Human
gguucaggugauucuccauccuc

SEQ ID NO: 470412 - RNA, 22 nt, Human
gguucaggugauucuccucccu

SEQ ID NO: 470413 - RNA, 24 nt, Human
gguucaggugauucuccugacuua

SEQ ID NO: 470414 - RNA, 22 nt, Human
gguucaggugauucuccugccu

SEQ ID NO: 470415 - RNA, 24 nt, Human
gguucaggugauucuccugccuca

SEQ ID NO: 470416 - RNA, 24 nt, Human
gguucaggugauucuccuguccca

SEQ ID NO: 470417 - RNA, 32 nt, Human
gguucaggugauucuccugucccagccuuccg

SEQ ID NO: 470418 - RNA, 24 nt, Human
gguucaggugauucucuugccuca

SEQ ID NO: 470419 - RNA, 24 nt, Human
gguucaggugauucuucuggcuua

SEQ ID NO: 470420 - RNA, 22 nt, Human
gguucagucagccuuccacuga

SEQ ID NO: 470421 - RNA, 32 nt, Human
gguucagucccucccaacucccuccuuguguc

SEQ ID NO: 470422 - RNA, 32 nt, Human
gguucagucuaucacagcucccauggaguuag

SEQ ID NO: 470423 - RNA, 32 nt, Human
gguucaguucucucagccccagguucaaccug

SEQ ID NO: 470424 - RNA, 32 nt, Human
gguucaguuucuucugcgccucaggcugcugg

SEQ ID NO: 470425 - RNA, 32 nt, Human
gguucauaaucagcugucugaccacguuccua

SEQ ID NO: 470426 - RNA, 32 nt, Human
gguucauaggguggagaaggaggaguuaucuc

SEQ ID NO: 470427 - RNA, 32 nt, Human
gguucauaucuguaauccuaacacuuugacag

SEQ ID NO: 470428 - RNA, 32 nt, Human
gguucaucagaagaaagaaaggacaaaaugac

SEQ ID NO: 470429 - RNA, 21 nt, Human
gguucauccucuucugcuuca

SEQ ID NO: 470430 - RNA, 32 nt, Human
gguucaugaggccaccucuuugcucaauccau

SEQ ID NO: 470431 - RNA, 19 nt, Human
gguucaugccaccauggcc

SEQ ID NO: 470432 - RNA, 32 nt, Human
gguucaugccaguaaucccagcacuuucggag

SEQ ID NO: 470433 - RNA, 24 nt, Human
gguucaugccauucuccugcccca

SEQ ID NO: 470434 - RNA, 22 nt, Human
gguucaugccauucuccugccu

SEQ ID NO: 470435 - RNA, 24 nt, Human
gguucaugccauucuccugccuca

SEQ ID NO: 470436 - RNA, 32 nt, Human
gguucaugccauucuccugccucggccuucca

SEQ ID NO: 470437 - RNA, 24 nt, Human
gguucaugccauucuccugcuuca

SEQ ID NO: 470438 - RNA, 24 nt, Human
gguucaugccauuuuccugccuca

SEQ ID NO: 470439 - RNA, 20 nt, Human
gguucaugccuauaauccca

SEQ ID NO: 470440 - RNA, 32 nt, Human
gguucaugccuauaaucccaacacuuuaggag

SEQ ID NO: 470441 - RNA, 32 nt, Human
gguucaugccuauaaucccagcacuuugggag

SEQ ID NO: 470442 - RNA, 32 nt, Human
gguucaugccuauaaucccagcgcuuugggag

SEQ ID NO: 470443 - RNA, 32 nt, Human
gguucaugccuauaaucccagugcuuuacaag

SEQ ID NO: 470444 - RNA, 32 nt, Human
gguucaugccuaucaucccagcacuuugggag

SEQ ID NO: 470445 - RNA, 32 nt, Human
gguucaugccuggaaucccagcacuuugggag

SEQ ID NO: 470446 - RNA, 32 nt, Human
gguucaugccuggaauccuagcacuuugggag

SEQ ID NO: 470447 - RNA, 32 nt, Human
gguucaugccuguaauaccagcguuuugggag

SEQ ID NO: 470448 - RNA, 32 nt, Human
gguucaugccuguaauccagcacuuugggagg

SEQ ID NO: 470449 - RNA, 20 nt, Human
gguucaugccuguaauccca

SEQ ID NO: 470450 - RNA, 32 nt, Human
gguucaugccuguaaucccaaugcuuugggag

SEQ ID NO: 470451 - RNA, 32 nt, Human
gguucaugccuguaaucccagcacuaugggag

SEQ ID NO: 470452 - RNA, 32 nt, Human
gguucaugccuguaaucccagcacuucacuuu

SEQ ID NO: 470453 - RNA, 32 nt, Human
gguucaugccuguaaucccagcacuugggagg

SEQ ID NO: 470454 - RNA, 32 nt, Human
gguucaugccuguaaucccagcacuuuggaag

SEQ ID NO: 470455 - RNA, 32 nt, Human
gguucaugccuguaaucccagcacuuugggag

SEQ ID NO: 470456 - RNA, 32 nt, Human
gguucaugccuguaaucccaguacuuuggaaa

SEQ ID NO: 470457 - RNA, 32 nt, Human
gguucaugccuguaaucccaguacuuugggag

SEQ ID NO: 470458 - RNA, 32 nt, Human
gguucaugccuuaaucccagcacuuugggagg

SEQ ID NO: 470459 - RNA, 22 nt, Human
gguucaugcgauucuccugccu

SEQ ID NO: 470460 - RNA, 24 nt, Human
gguucaugcgauucuccugccuca

SEQ ID NO: 470461 - RNA, 32 nt, Human
gguucaugcuguaaucccaucacuuugggagg

SEQ ID NO: 470462 - RNA, 24 nt, Human
gguucauggcauucuccugccuca

SEQ ID NO: 470463 - RNA, 32 nt, Human
gguucaugggaggcggaggugacuggcuggcu

SEQ ID NO: 470464 - RNA, 24 nt, Human
gguucaugucauucuccugccuca

SEQ ID NO: 470465 - RNA, 32 nt, Human
gguucaugucccaaugaaaacgcucaccucag

SEQ ID NO: 470466 - RNA, 32 nt, Human
gguucaugucuguaaucccagcacuuugugag

SEQ ID NO: 470467 - RNA, 24 nt, Human
gguucaugugauucuccugccuca

SEQ ID NO: 470468 - RNA, 32 nt, Human
gguucauguggacuauggcacucuguagguaa

SEQ ID NO: 470469 - RNA, 19 nt, Human
gguucauguuuaagugggg

SEQ ID NO: 470470 - RNA, 32 nt, Human
gguucauucucaggcugggguggacucagaug

SEQ ID NO: 470471 - RNA, 32 nt, Human
gguucauugcaaccuccgccucccgaguucaa

SEQ ID NO: 470472 - RNA, 32 nt, Human
gguucauugcaaccuccgccuccugcguucgg

SEQ ID NO: 470473 - RNA, 32 nt, Human
gguucauuguagccuccgccucagccucugga

SEQ ID NO: 470474 - RNA, 32 nt, Human
gguucauuuucaucuucuguuuuccaaaugaa

SEQ ID NO: 470475 - RNA, 22 nt, Human
gguuccaaccaggacuuggcuc

SEQ ID NO: 470476 - RNA, 24 nt, Human
gguuccaacgauucuccugccuca

SEQ ID NO: 470477 - RNA, 25 nt, Human
gguuccacagcauacaguuucugca

SEQ ID NO: 470478 - RNA, 23 nt, Human
gguuccacaggccccugaccgca

SEQ ID NO: 470479 - RNA, 22 nt, Human
gguuccacagucccaccagagu

SEQ ID NO: 470480 - RNA, 32 nt, Human
gguuccaccgugugucagaggcugcaaguuua

SEQ ID NO: 470481 - RNA, 32 nt, Human
gguuccacucagcucaccugugcucacucccu

SEQ ID NO: 470482 - RNA, 24 nt, Human
gguuccagaaguggcgccugcucu

SEQ ID NO: 470483 - RNA, 32 nt, Human
gguuccagagagaagcuagaagucccccuuga

SEQ ID NO: 470484 - RNA, 22 nt, Human
gguuccagcaauucuccugccu

SEQ ID NO: 470485 - RNA, 24 nt, Human
gguuccagcaauucuccugccuca

SEQ ID NO: 470486 - RNA, 24 nt, Human
gguuccagcaauucuucugccuca

SEQ ID NO: 470487 - RNA, 32 nt, Human
gguuccagcacuccgugagccauguccagucc

SEQ ID NO: 470488 - RNA, 32 nt, Human
gguuccagcacucugugagccauguccagucc

SEQ ID NO: 470489 - RNA, 32 nt, Human
gguuccagcagccuguuccacacccccacacc

SEQ ID NO: 470490 - RNA, 32 nt, Human
gguuccagccaucagcagacuuccugcucauc

SEQ ID NO: 470491 - RNA, 22 nt, Human
gguuccagcgauucuccugccu

SEQ ID NO: 470492 - RNA, 24 nt, Human
gguuccagcgauucuccugccuca

SEQ ID NO: 470493 - RNA, 32 nt, Human
gguuccagcuacucaagaggcugaggcaggag

SEQ ID NO: 470494 - RNA, 32 nt, Human
gguuccagcuacucaggaggcugaggugggag

SEQ ID NO: 470495 - RNA, 32 nt, Human
gguuccagcuacuugggaggcucaggcaggag

SEQ ID NO: 470496 - RNA, 24 nt, Human
gguuccagcuauuguccugccuca

SEQ ID NO: 470497 - RNA, 32 nt, Human
gguuccagcugcucgggagguugagggagaag

SEQ ID NO: 470498 - RNA, 32 nt, Human
gguuccaggaacagcccuucccccaccacugg

SEQ ID NO: 470499 - RNA, 32 nt, Human
gguuccaggaaugagcucaccuaacagauagc

SEQ ID NO: 470500 - RNA, 21 nt, Human
gguuccaggauccuccacuga

SEQ ID NO: 470501 - RNA, 32 nt, Human
gguuccaggccugggggucgcuuccagcugcc

SEQ ID NO: 470502 - RNA, 32 nt, Human
gguuccagggacugguggagguggauggcagg

SEQ ID NO: 470503 - RNA, 25 nt, Human
gguuccagggagacaagcagcaugu

SEQ ID NO: 470504 - RNA, 32 nt, Human
gguuccagguagacacuagaauccaaaucaac

SEQ ID NO: 470505 - RNA, 23 nt, Human
gguuccagugauucuccugccuc

SEQ ID NO: 470506 - RNA, 24 nt, Human
gguuccagugauucuccugccuca

SEQ ID NO: 470507 - RNA, 32 nt, Human
gguuccaguggguucuggagggagggugggcu

SEQ ID NO: 470508 - RNA, 32 nt, Human
gguuccauacucgucccuccccuccuggcucu

SEQ ID NO: 470509 - RNA, 20 nt, Human
gguuccauccaccaccuugc

SEQ ID NO: 470510 - RNA, 32 nt, Human
gguuccaugcagcccccgaccucccgggcuca

SEQ ID NO: 470511 - RNA, 32 nt, Human
gguuccauggaagaaaaaggccaaggaguuug

SEQ ID NO: 470512 - RNA, 21 nt, Human
gguuccauuccuucugccacc

SEQ ID NO: 470513 - RNA, 20 nt, Human
gguucccaacgucuccugcc

SEQ ID NO: 470514 - RNA, 32 nt, Human
gguucccaagccccaagacccgccucagaacu

SEQ ID NO: 470515 - RNA, 32 nt, Human
gguucccacacucgugcauacacacacaucca

SEQ ID NO: 470516 - RNA, 32 nt, Human
gguucccacaugcauuuaugcacagaagaaaa

SEQ ID NO: 470517 - RNA, 32 nt, Human
gguucccacucagcuucugccggucggcagcc

SEQ ID NO: 470518 - RNA, 32 nt, Human
gguucccacugaggcccuuugcaggauggaac

SEQ ID NO: 470519 - RNA, 32 nt, Human
gguucccacugauccuucugggccacguugug

SEQ ID NO: 470520 - RNA, 31 nt, Human
gguucccagaacagaccuaggaggcggccuc

SEQ ID NO: 470521 - RNA, 32 nt, Human
gguucccagcuccagcccuagucagcuuaacu

SEQ ID NO: 470522 - RNA, 32 nt, Human
gguucccaggagggagaaagagaagacaagag

SEQ ID NO: 470523 - RNA, 32 nt, Human
gguucccaggcaggaaccgcucggccuggcug

SEQ ID NO: 470524 - RNA, 32 nt, Human
gguucccaucaacccccauuucccuagggucc

SEQ ID NO: 470525 - RNA, 21 nt, Human
gguucccauggcccaugccca

SEQ ID NO: 470526 - RNA, 20 nt, Human
gguuccccaccggccuacug

SEQ ID NO: 470527 - RNA, 22 nt, Human
gguuccccagaguccugccccu

SEQ ID NO: 470528 - RNA, 32 nt, Human
gguuccccagggaagcagagccugugugcggg

SEQ ID NO: 470529 - RNA, 32 nt, Human
gguuccccaucaugggcaaggaagggaauucc

SEQ ID NO: 470530 - RNA, 19 nt, Human
gguuccccaucggccucca

SEQ ID NO: 470531 - RNA, 32 nt, Human
gguucccccaggaguauaaacacaaggagcca

SEQ ID NO: 470532 - RNA, 18 nt, Human
gguuccccccaugccucu

SEQ ID NO: 470533 - RNA, 32 nt, Human
gguucccccucagcccgugagcagccaugucc

SEQ ID NO: 470534 - RNA, 32 nt, Human
gguucccccuuucugccagcaguucugguucu

SEQ ID NO: 470535 - RNA, 32 nt, Human
gguuccccgcaaaaucaggcuugagugcagug

SEQ ID NO: 470536 - RNA, 23 nt, Human
gguuccccggaagcuuucccuga

SEQ ID NO: 470537 - RNA, 18 nt, Human
gguuccccucccaccucu

SEQ ID NO: 470538 - RNA, 18 nt, Human
gguuccccuucccuccuc

SEQ ID NO: 470539 - RNA, 18 nt, Human
gguuccccuuccucccuc

SEQ ID NO: 470540 - RNA, 32 nt, Human
gguucccgacuucuuugcuuugggagaauuug

SEQ ID NO: 470541 - RNA, 24 nt, Human
gguucccgccauucuucugccuca

SEQ ID NO: 470542 - RNA, 32 nt, Human
gguucccgcccgugccucucccuccacaccuc

SEQ ID NO: 470543 - RNA, 23 nt, Human
gguucccgcucaccgccgccgcc

SEQ ID NO: 470544 - RNA, 32 nt, Human
gguucccggaagggacacuaggaggacgagcg

SEQ ID NO: 470545 - RNA, 32 nt, Human
gguucccgggacugcagguccaggcaggguag

SEQ ID NO: 470546 - RNA, 32 nt, Human
gguucccgugucugagccuggaagaggcucgg

SEQ ID NO: 470547 - RNA, 32 nt, Human
gguucccuccacccagguccccaucacgccau

SEQ ID NO: 470548 - RNA, 32 nt, Human
gguucccugagcuauaugcacacucacaccuc

SEQ ID NO: 470549 - RNA, 32 nt, Human
gguucccugagcugugggauucugcacuggug

SEQ ID NO: 470550 - RNA, 32 nt, Human
gguucccugcaacccccgcccuccagcccacc

SEQ ID NO: 470551 - RNA, 32 nt, Human
gguucccugcagccucaugccuggccccuuga

SEQ ID NO: 470552 - RNA, 32 nt, Human
gguucccugcagccuugcucugcauaggcucu

SEQ ID NO: 470553 - RNA, 18 nt, Human
gguucccugggccaggua

SEQ ID NO: 470554 - RNA, 23 nt, Human
gguucccuggucucuugcacuga

SEQ ID NO: 470555 - RNA, 32 nt, Human
gguucccuuccacgcugugaagcuuuguucuu

SEQ ID NO: 470556 - RNA, 32 nt, Human
gguucccuuucuucccuacccuugccacuccc

SEQ ID NO: 470557 - RNA, 32 nt, Human
gguuccgcagaugcagagguugagguggcugc

SEQ ID NO: 470558 - RNA, 19 nt, Human
gguuccgccuguaauccca

SEQ ID NO: 470559 - RNA, 21 nt, Human
gguuccgccuguaaucccagc

SEQ ID NO: 470560 - RNA, 32 nt, Human
gguuccgccuguaaucccagcacuuugggagg

SEQ ID NO: 470561 - RNA, 32 nt, Human
gguuccggcgaggccugagcugugcugucguc

SEQ ID NO: 470562 - RNA, 22 nt, Human
gguuccggcuccgccacccuca

SEQ ID NO: 470563 - RNA, 32 nt, Human
gguuccggguaggagcuaggugacccucggcu

SEQ ID NO: 470564 - RNA, 32 nt, Human
gguuccggguggaggcuugcagcugcuuccag

SEQ ID NO: 470565 - RNA, 32 nt, Human
gguuccggugauguguuuagggaucuucucug

SEQ ID NO: 470566 - RNA, 24 nt, Human
gguuccggugauucucaugccuca

SEQ ID NO: 470567 - RNA, 32 nt, Human
gguuccgugccagagucgggggccacacgagg

SEQ ID NO: 470568 - RNA, 32 nt, Human
gguuccguggcugcaaggaagggaaacagucu

SEQ ID NO: 470569 - RNA, 32 nt, Human
gguuccuagaggcagagguugaagauggaaga

SEQ ID NO: 470570 - RNA, 32 nt, Human
gguuccuaucaccucuuguccucaguuucggu

SEQ ID NO: 470571 - RNA, 32 nt, Human
gguuccucagugugggacaugcagcaugugga

SEQ ID NO: 470572 - RNA, 32 nt, Human
gguuccucauggcuguuaucugucuuuaugau

SEQ ID NO: 470573 - RNA, 32 nt, Human
gguuccucccaggagcucuggagguacaggau

SEQ ID NO: 470574 - RNA, 21 nt, Human
gguuccuccccucaccccaua

SEQ ID NO: 470575 - RNA, 31 nt, Human
gguuccucccucucuggccugugccgccuca

SEQ ID NO: 470576 - RNA, 32 nt, Human
gguuccucuccucaccccacaugccugaaaag

SEQ ID NO: 470577 - RNA, 32 nt, Human
gguuccucuccuccuuccugaugucugccauu

SEQ ID NO: 470578 - RNA, 32 nt, Human
gguuccucucuccucucccccucucuccuccc

SEQ ID NO: 470579 - RNA, 32 nt, Human
gguuccucugcucaccgcccaucaggguucuc

SEQ ID NO: 470580 - RNA, 32 nt, Human
gguuccucuggcccucuccaggguguuuucca

SEQ ID NO: 470581 - RNA, 21 nt, Human
gguuccugaaucuuccugcca

SEQ ID NO: 470582 - RNA, 32 nt, Human
gguuccugacggccaggcagggaugcuaaggu

SEQ ID NO: 470583 - RNA, 25 nt, Human
gguuccugaggggugauuugggaca

SEQ ID NO: 470584 - RNA, 32 nt, Human
gguuccugcaccuggaauccaguguguccaag

SEQ ID NO: 470585 - RNA, 32 nt, Human
gguuccugcagcagccacugcccugcccaauc

SEQ ID NO: 470586 - RNA, 32 nt, Human
gguuccugccuccuuuuuccguucugguuuuu

SEQ ID NO: 470587 - RNA, 29 nt, Human
gguuccuggcugcugccaugucucagaug

SEQ ID NO: 470588 - RNA, 32 nt, Human
gguuccugggaugagccauacccuggaacugg

SEQ ID NO: 470589 - RNA, 32 nt, Human
gguuccuggggcugcagccagccugggacuuu

SEQ ID NO: 470590 - RNA, 32 nt, Human
gguuccuguaugguggaagcugggugagccaa

SEQ ID NO: 470591 - RNA, 32 nt, Human
gguuccuguguguuuggcccgggcacaauccc

SEQ ID NO: 470592 - RNA, 32 nt, Human
gguuccuuaucugucacaccugugccuccuca

SEQ ID NO: 470593 - RNA, 32 nt, Human
gguuccuucaauuggcauuuuccccagaauug

SEQ ID NO: 470594 - RNA, 32 nt, Human
gguuccuucccagcacucccagccugggauaa

SEQ ID NO: 470595 - RNA, 32 nt, Human
gguuccuuccuuggagccauaguuacccugcc

SEQ ID NO: 470596 - RNA, 32 nt, Human
gguuccuucucccuuuccuguccccauguuuc

SEQ ID NO: 470597 - RNA, 23 nt, Human
gguuccuugaguucuccugucuc

SEQ ID NO: 470598 - RNA, 32 nt, Human
gguuccuugccugaaaaaugaaagaggcgcug

SEQ ID NO: 470599 - RNA, 32 nt, Human
gguuccuuguauugcauuucuuugcacauauu

SEQ ID NO: 470600 - RNA, 19 nt, Human
gguuccuuucagugucaua

SEQ ID NO: 470601 - RNA, 32 nt, Human
gguuccuuuccaggaagggaggcaggagcacc

SEQ ID NO: 470602 - RNA, 32 nt, Human
gguuccuuuggcuccugcugagguccccuuuc

SEQ ID NO: 470603 - RNA, 32 nt, Human
gguucgaaaccagccaggccaacuuggcaaaa

SEQ ID NO: 470604 - RNA, 32 nt, Human
gguucgagacccaaacccccaaaauccaaaac

SEQ ID NO: 470605 - RNA, 24 nt, Human
gguucgagcaauucuccugccuca

SEQ ID NO: 470606 - RNA, 23 nt, Human
gguucgagcgauucuccugccuc

SEQ ID NO: 470607 - RNA, 24 nt, Human
gguucgagcgauucuccugccuca

SEQ ID NO: 470608 - RNA, 32 nt, Human
gguucgaggaauaggcauuggaggugguuucu

SEQ ID NO: 470609 - RNA, 20 nt, Human
gguucgaggccucuugccuu

SEQ ID NO: 470610 - RNA, 32 nt, Human
gguucgagggacuuaguggaguucucaucccu

SEQ ID NO: 470611 - RNA, 20 nt, Human
gguucgaucauaguaucaua

SEQ ID NO: 470612 - RNA, 32 nt, Human
gguucgauuccccuguuggcauaugauuauuu

SEQ ID NO: 470613 - RNA, 22 nt, Human
gguucgcaagaagcauacacug

SEQ ID NO: 470614 - RNA, 24 nt, Human
gguucgcaccauucuccugccuca

SEQ ID NO: 470615 - RNA, 32 nt, Human
gguucgcagaagcagcagugaagagaagcuac

SEQ ID NO: 470616 - RNA, 32 nt, Human
gguucgcgcucucgccgccucugagggaauug

SEQ ID NO: 470617 - RNA, 22 nt, Human
gguucgcggguucuccgccuca

SEQ ID NO: 470618 - RNA, 22 nt, Human
gguucggaaucacccgaucaca

SEQ ID NO: 470619 - RNA, 24 nt, Human
gguucgggcaauucuccugccuua

SEQ ID NO: 470620 - RNA, 24 nt, Human
gguucgggcaguucuccugccuca

SEQ ID NO: 470621 - RNA, 22 nt, Human
gguucgggcgagucuccugccu

SEQ ID NO: 470622 - RNA, 24 nt, Human
gguucgggcgagucuccugccuca

SEQ ID NO: 470623 - RNA, 32 nt, Human
gguucgggcucgcgagucuccgucugggguag

SEQ ID NO: 470624 - RNA, 23 nt, Human
gguucgggcuucaccgccuggcc

SEQ ID NO: 470625 - RNA, 24 nt, Human
gguucgggugauucuccugccuca

SEQ ID NO: 470626 - RNA, 23 nt, Human
gguucgggugguucuccugccuc

SEQ ID NO: 470627 - RNA, 32 nt, Human
gguucggguguuucaccaugccagcacagcgc

SEQ ID NO: 470628 - RNA, 23 nt, Human
gguucggugauucuccugccuca

SEQ ID NO: 470629 - RNA, 32 nt, Human
gguucgguuucugcaucuucuggaucaauuca

SEQ ID NO: 470630 - RNA, 32 nt, Human
gguucgucgccgcggcgcugcggcucgccucc

SEQ ID NO: 470631 - RNA, 32 nt, Human
gguucgugcccugcugcggccagccugacuag

SEQ ID NO: 470632 - RNA, 32 nt, Human
gguucgugccuguaaucccagcucuuugggag

SEQ ID NO: 470633 - RNA, 32 nt, Human
gguucgugggcuguggaggcgacggagcaggg

SEQ ID NO: 470634 - RNA, 32 nt, Human
gguucguggucucccugacuucagaagugaag

SEQ ID NO: 470635 - RNA, 32 nt, Human
gguucgugguuaucccauuguggaaauucauc

SEQ ID NO: 470636 - RNA, 19 nt, Human
gguucguuguccacaucca

SEQ ID NO: 470637 - RNA, 32 nt, Human
gguucuaaaaucccaaaccccaaacagccugg

SEQ ID NO: 470638 - RNA, 31 nt, Human
gguucuaaagugucccgcggaguacagauaa

SEQ ID NO: 470639 - RNA, 32 nt, Human
gguucuaccacuggcauaugacuugggcaagu

SEQ ID NO: 470640 - RNA, 32 nt, Human
gguucuagaacugcccaccucuuccauuucag

SEQ ID NO: 470641 - RNA, 32 nt, Human
gguucuagacuucuucccugagguucucagaa

SEQ ID NO: 470642 - RNA, 19 nt, Human
gguucuagcauuccauaua

SEQ ID NO: 470643 - RNA, 24 nt, Human
gguucuagcgagucuccucccuca

SEQ ID NO: 470644 - RNA, 32 nt, Human
gguucuagcuggcaaggcccacaucucagagc

SEQ ID NO: 470645 - RNA, 32 nt, Human
gguucuagggcugggagcugggauuugaacca

SEQ ID NO: 470646 - RNA, 32 nt, Human
gguucuaguucucauacagaacuccagaauuu

SEQ ID NO: 470647 - RNA, 32 nt, Human
gguucucaaugguaacgagcuccauacugcug

SEQ ID NO: 470648 - RNA, 32 nt, Human
gguucucacauccagucuuugcacuucagcug

SEQ ID NO: 470649 - RNA, 24 nt, Human
gguucucaccauucuccugccuca

SEQ ID NO: 470650 - RNA, 19 nt, Human
gguucucagagccugccuc

SEQ ID NO: 470651 - RNA, 32 nt, Human
gguucucagcuuuccuuaagcgacccagcagc

SEQ ID NO: 470652 - RNA, 32 nt, Human
gguucucaggcagggccccugcuguguccgug

SEQ ID NO: 470653 - RNA, 32 nt, Human
gguucucaggggacagggagagcaagagguca

SEQ ID NO: 470654 - RNA, 32 nt, Human
gguucucaucauuucuccucuggauucaucug

SEQ ID NO: 470655 - RNA, 32 nt, Human
gguucucauuucucagcucuuucccuuaucac

SEQ ID NO: 470656 - RNA, 32 nt, Human
gguucuccaugccuauaaucccggcuacucgg

SEQ ID NO: 470657 - RNA, 32 nt, Human
gguucucccagcacgcagauggagaucugaga

SEQ ID NO: 470658 - RNA, 32 nt, Human
gguucucccaggagcucagggccugucagacc

SEQ ID NO: 470659 - RNA, 32 nt, Human
gguucuccugccuggaaucaagugaugcgugu

SEQ ID NO: 470660 - RNA, 32 nt, Human
gguucucgcucucucuuugccugcugccaugu

SEQ ID NO: 470661 - RNA, 32 nt, Human
gguucucgucugcagacccucuggaccugguc

SEQ ID NO: 470662 - RNA, 32 nt, Human
gguucucguucucccagcuccagccuuucuag

SEQ ID NO: 470663 - RNA, 32 nt, Human
gguucucuauuugagucuguguuuucaauaaa

SEQ ID NO: 470664 - RNA, 32 nt, Human
gguucucucagccccaccucagcaggucucca

SEQ ID NO: 470665 - RNA, 32 nt, Human
gguucucugaacuacauacccccagcugugaa

SEQ ID NO: 470666 - RNA, 32 nt, Human
gguucucugcagccacacaaucagcccggcuc

SEQ ID NO: 470667 - RNA, 32 nt, Human
gguucucugcagcccaggacugugcaugugug

SEQ ID NO: 470668 - RNA, 32 nt, Human
gguucucugcucccucccagcuccugaaccug

SEQ ID NO: 470669 - RNA, 32 nt, Human
gguucucugcuugugaaguggcucgagcucuu

SEQ ID NO: 470670 - RNA, 16 nt, Human
gguucucuggguccag

SEQ ID NO: 470671 - RNA, 32 nt, Human
gguucucugucugggguuggcucucuuaaccc

SEQ ID NO: 470672 - RNA, 32 nt, Human
gguucucuguuccccucagccccuggugcauu

SEQ ID NO: 470673 - RNA, 32 nt, Human
gguucucuucauuccuugggccagcuucucag

SEQ ID NO: 470674 - RNA, 32 nt, Human
gguucucuuccucuggucccuucuggggacuc

SEQ ID NO: 470675 - RNA, 32 nt, Human
gguucucuugagcaagucuguuccuucuggaa

SEQ ID NO: 470676 - RNA, 32 nt, Human
gguucucuuuagcuucugguucuugaaagaaa

SEQ ID NO: 470677 - RNA, 32 nt, Human
gguucugaaccuagauguuggccaagggagca

SEQ ID NO: 470678 - RNA, 32 nt, Human
gguucugaacuaaguguaaucaucucaccaaa

SEQ ID NO: 470679 - RNA, 32 nt, Human
gguucugaagaaaauggaugugcaaaggcuug

SEQ ID NO: 470680 - RNA, 32 nt, Human
gguucugaaguucuucaguacauugcuguagg

SEQ ID NO: 470681 - RNA, 32 nt, Human
gguucugacuccagaucccuggcuccucagcc

SEQ ID NO: 470682 - RNA, 32 nt, Human
gguucugagaugcagugagggaagaaaggauc

SEQ ID NO: 470683 - RNA, 32 nt, Human
gguucugaggggacaggcugaccuggaggacc

SEQ ID NO: 470684 - RNA, 32 nt, Human
gguucugaguucugagauauucacaagucccc

SEQ ID NO: 470685 - RNA, 32 nt, Human
gguucugaguuugagaagggaucuucuaaagg

SEQ ID NO: 470686 - RNA, 32 nt, Human
gguucugaucuugccuucauguggaccuucau

SEQ ID NO: 470687 - RNA, 23 nt, Human
gguucugcaaccaguucauaugu

SEQ ID NO: 470688 - RNA, 32 nt, Human
gguucugcaaggggugacucauugcauagagg

SEQ ID NO: 470689 - RNA, 32 nt, Human
gguucugcaauaucucugaggugcaaagaaug

SEQ ID NO: 470690 - RNA, 32 nt, Human
gguucugcagcagaaaggggagaggacacagg

SEQ ID NO: 470691 - RNA, 24 nt, Human
gguucugcagcgucuccugcucca

SEQ ID NO: 470692 - RNA, 32 nt, Human
gguucugcagggccuuccuccuccagguuggg

SEQ ID NO: 470693 - RNA, 32 nt, Human
gguucugcaugaccuagccacugcuggggguu

SEQ ID NO: 470694 - RNA, 24 nt, Human
gguucugcauuaaccccugccuca

SEQ ID NO: 470695 - RNA, 32 nt, Human
gguucugcauuagauuugaugacucuuuuucu

SEQ ID NO: 470696 - RNA, 32 nt, Human
gguucugccaccaccaggaggauuucaagaaa

SEQ ID NO: 470697 - RNA, 32 nt, Human
gguucugccuguaauugagccucucugaugau

SEQ ID NO: 470698 - RNA, 32 nt, Human
gguucugcggauaaaggaggaauaagacagag

SEQ ID NO: 470699 - RNA, 32 nt, Human
gguucugcucuuccucccuauguugaucagug

SEQ ID NO: 470700 - RNA, 32 nt, Human
gguucugcucuucuugccucuggagagcccca

SEQ ID NO: 470701 - RNA, 32 nt, Human
gguucugcugacccucagucuccuggacccua

SEQ ID NO: 470702 - RNA, 32 nt, Human
gguucugcuguuugcucugauccuguugauau

SEQ ID NO: 470703 - RNA, 32 nt, Human
gguucuggagguuggagguuccgcucagugac

SEQ ID NO: 470704 - RNA, 32 nt, Human
gguucuggauuaucuggguggguccuuaggga

SEQ ID NO: 470705 - RNA, 32 nt, Human
gguucuggcaccaccugagcccacugggcauc

SEQ ID NO: 470706 - RNA, 32 nt, Human
gguucuggccuccagaccaggguaagggcagg

SEQ ID NO: 470707 - RNA, 32 nt, Human
gguucugggaggcgagggcucaggaacagccc

SEQ ID NO: 470708 - RNA, 32 nt, Human
gguucugggaggugagggcucaggaacagccc

SEQ ID NO: 470709 - RNA, 32 nt, Human
gguucugggccuuccuguggagcugagcugcc

SEQ ID NO: 470710 - RNA, 33 nt, Human
gguucugggguuuaccuguucggccuccugccu

SEQ ID NO: 470711 - RNA, 32 nt, Human
gguucugggucagcuucuuuuaccucaauuuu

SEQ ID NO: 470712 - RNA, 32 nt, Human
gguucuggguccuggagugcaggccugucaac

SEQ ID NO: 470713 - RNA, 32 nt, Human
gguucugguucuuggcugauguucuguaucuu

SEQ ID NO: 470714 - RNA, 32 nt, Human
gguucugucacaugaccuauccuaaccgaggc

SEQ ID NO: 470715 - RNA, 32 nt, Human
gguucuguccagagcaguucaggcuggggcug

SEQ ID NO: 470716 - RNA, 32 nt, Human
gguucuguccccgaggccggagugcaauggcg

SEQ ID NO: 470717 - RNA, 32 nt, Human
gguucugucugugucaaugucccagcgggaac

SEQ ID NO: 470718 - RNA, 22 nt, Human
gguucugugagcccaucgggga

SEQ ID NO: 470719 - RNA, 21 nt, Human
gguucugugcaucaccacagu

SEQ ID NO: 470720 - RNA, 21 nt, Human
gguucuguguuugcugcggug

SEQ ID NO: 470721 - RNA, 32 nt, Human
gguucuguuccagauaaacagaguaacugacc

SEQ ID NO: 470722 - RNA, 32 nt, Human
gguucuguuucccaggcuggagugcaguggug

SEQ ID NO: 470723 - RNA, 21 nt, Human
gguucuguuugucucuuuuca

SEQ ID NO: 470724 - RNA, 24 nt, Human
gguucuuaagggauucuccguuuu

SEQ ID NO: 470725 - RNA, 32 nt, Human
gguucuuaaugauugaccacaagcagaucuuu

SEQ ID NO: 470726 - RNA, 32 nt, Human
gguucuuacccccuuuuccuucucugaagugu

SEQ ID NO: 470727 - RNA, 32 nt, Human
gguucuuagcuugucugugaucucugcugggg

SEQ ID NO: 470728 - RNA, 32 nt, Human
gguucuuaguuugccuggaauuguucuguacc

SEQ ID NO: 470729 - RNA, 32 nt, Human
gguucuuauccaaauacccaaccugugaagau

SEQ ID NO: 470730 - RNA, 32 nt, Human
gguucuuccagccucaggucccagcugucuca

SEQ ID NO: 470731 - RNA, 32 nt, Human
gguucuuccaggugauggugugcagccaccgc

SEQ ID NO: 470732 - RNA, 32 nt, Human
gguucuucccuccugcccucaauuguuuuucu

SEQ ID NO: 470733 - RNA, 32 nt, Human
gguucuuccugacugcuuucuccaacuguuca

SEQ ID NO: 470734 - RNA, 32 nt, Human
gguucuucuacacugcugggaucucuguuuua

SEQ ID NO: 470735 - RNA, 32 nt, Human
gguucuucuaucuccccucuauacuuccucug

SEQ ID NO: 470736 - RNA, 32 nt, Human
gguucuucucucaugguagcucuccaacagca

SEQ ID NO: 470737 - RNA, 32 nt, Human
gguucuucugugacaugugccucccagcagug

SEQ ID NO: 470738 - RNA, 32 nt, Human
gguucuugaccugguggauguggcugcagucc

SEQ ID NO: 470739 - RNA, 32 nt, Human
gguucuugagcagagauugggaggacuuuacu

SEQ ID NO: 470740 - RNA, 32 nt, Human
gguucuugagccagccaggcccugccaguggg

SEQ ID NO: 470741 - RNA, 32 nt, Human
gguucuugaugucauguacuuccuguguacuc

SEQ ID NO: 470742 - RNA, 22 nt, Human
gguucuugauucuccuguguca

SEQ ID NO: 470743 - RNA, 18 nt, Human
gguucuugcccugagcca

SEQ ID NO: 470744 - RNA, 32 nt, Human
gguucuugcuauauugccccaggcuggucucg

SEQ ID NO: 470745 - RNA, 32 nt, Human
gguucuugcucucccaggcuggagugcagugg

SEQ ID NO: 470746 - RNA, 32 nt, Human
gguucuuggaaagauaaggaccagaacaagcu

SEQ ID NO: 470747 - RNA, 32 nt, Human
gguucuuggaagagguggaguuuggagaggcu

SEQ ID NO: 470748 - RNA, 32 nt, Human
gguucuuggccaggcuguaggugguggcucac

SEQ ID NO: 470749 - RNA, 32 nt, Human
gguucuugggagagaggggaagagucgggacu

SEQ ID NO: 470750 - RNA, 32 nt, Human
gguucuugggaggaagggagaaaagaagcaga

SEQ ID NO: 470751 - RNA, 32 nt, Human
gguucuuggguagccuuuggggugaggggacu

SEQ ID NO: 470752 - RNA, 31 nt, Human
gguucuugucuccauagccuguugaguguuc

SEQ ID NO: 470753 - RNA, 32 nt, Human
gguucuuugcugcauucugccucucuaggacc

SEQ ID NO: 470754 - RNA, 32 nt, Human
gguucuuugguuacugcacuguaguuucaaau

SEQ ID NO: 470755 - RNA, 32 nt, Human
gguucuuuuccuucuccuccgccagaggccac

SEQ ID NO: 470756 - RNA, 32 nt, Human
gguucuuuugggguaauguacacaccuaacug

SEQ ID NO: 470757 - RNA, 32 nt, Human
gguucuuuuuaagaguucagcugcgagauauc

SEQ ID NO: 470758 - RNA, 32 nt, Human
gguucuuuuuauuuuaaccaguuauuuuuauu

SEQ ID NO: 470759 - RNA, 32 nt, Human
gguugaaaagaaugugaacacuguagaaguua

SEQ ID NO: 470760 - RNA, 32 nt, Human
gguugaaagaagcgcagggaagagacugggug

SEQ ID NO: 470761 - RNA, 32 nt, Human
gguugaacccaggaggcggagguugcagugag

SEQ ID NO: 470762 - RNA, 32 nt, Human
gguugaacuggagucuugagugcgcugcgguc

SEQ ID NO: 470763 - RNA, 32 nt, Human
gguugaagaaagaggaucuggcugaaagaccc

SEQ ID NO: 470764 - RNA, 32 nt, Human
gguugaagaaguggccagaaaaagaaaaguau

SEQ ID NO: 470765 - RNA, 24 nt, Human
gguugaagagguucuccugccuca

SEQ ID NO: 470766 - RNA, 32 nt, Human
gguugaagcaauucuucugccucagccuccgg

SEQ ID NO: 470767 - RNA, 32 nt, Human
gguugaagcccaccuucucuuuucacauagga

SEQ ID NO: 470768 - RNA, 22 nt, Human
gguugaagcgauucuccugccu

SEQ ID NO: 470769 - RNA, 24 nt, Human
gguugaagcgauucuccugccuca

SEQ ID NO: 470770 - RNA, 32 nt, Human
gguugaagcugcagugaguugugaucaugcca

SEQ ID NO: 470771 - RNA, 20 nt, Human
gguugaagggccacaaggug

SEQ ID NO: 470772 - RNA, 24 nt, Human
gguugaagugauacuccugccuca

SEQ ID NO: 470773 - RNA, 24 nt, Human
gguugaagugauucuccugccuca

SEQ ID NO: 470774 - RNA, 24 nt, Human
gguugaagugauucucgugccuca

SEQ ID NO: 470775 - RNA, 32 nt, Human
gguugaagugauucucgugucucagucuuccg

SEQ ID NO: 470776 - RNA, 24 nt, Human
gguugaagugauucucuugccuca

SEQ ID NO: 470777 - RNA, 32 nt, Human
gguugaauacuugccuaaggcgguaagaaauc

SEQ ID NO: 470778 - RNA, 32 nt, Human
gguugaaucucuuccugagggcagagcucuua

SEQ ID NO: 470779 - RNA, 32 nt, Human
gguugaaucuggagaagaaaagggagauuuga

SEQ ID NO: 470780 - RNA, 32 nt, Human
gguugaaugccacagauucccuuuuaaacuua

SEQ ID NO: 470781 - RNA, 24 nt, Human
gguugacagagcaagacuccgucu

SEQ ID NO: 470782 - RNA, 24 nt, Human
gguugacagagugagaccccgucu

SEQ ID NO: 470783 - RNA, 24 nt, Human
gguugacagagugagacuccgucu

SEQ ID NO: 470784 - RNA, 32 nt, Human
gguugacagcuaggcuggaggcucaugguuuc

SEQ ID NO: 470785 - RNA, 32 nt, Human
gguugacaucuucauuucugggcuacuacuau

SEQ ID NO: 470786 - RNA, 32 nt, Human
gguugacaugauacacuauggccuuagaaaag

SEQ ID NO: 470787 - RNA, 32 nt, Human
gguugaccagaacucaccgacacagcaggaga

SEQ ID NO: 470788 - RNA, 32 nt, Human
gguugacccagaggauccugauaaugugcaau

SEQ ID NO: 470789 - RNA, 32 nt, Human
gguugacccugacacacaagcagaaagugagg

SEQ ID NO: 470790 - RNA, 32 nt, Human
gguugacccugcacucguccaacuugggccaa

SEQ ID NO: 470791 - RNA, 32 nt, Human
gguugaccuaggcugaauauccacuuuguuuu

SEQ ID NO: 470792 - RNA, 32 nt, Human
gguugacucaacuacuggaaagcccaguaaug

SEQ ID NO: 470793 - RNA, 18 nt, Human
gguugacucucucuggga

SEQ ID NO: 470794 - RNA, 32 nt, Human
gguugagaacaacagucaaacccucuucuucc

SEQ ID NO: 470795 - RNA, 32 nt, Human
gguugagaaggagagaaaaagguggcaggaau

SEQ ID NO: 470796 - RNA, 32 nt, Human
gguugagacagggccuuucucuucauuacuuc

SEQ ID NO: 470797 - RNA, 32 nt, Human
gguugagaccagcagagacugcugugaguuuc

SEQ ID NO: 470798 - RNA, 32 nt, Human
gguugagacgcacucccacccugggugcugca

SEQ ID NO: 470799 - RNA, 32 nt, Human
gguugagaggagaaaagggaagaaaagucggg

SEQ ID NO: 470800 - RNA, 32 nt, Human
gguugagauccaguguggccaugccagcuagu

SEQ ID NO: 470801 - RNA, 19 nt, Human
gguugagcacuucaggaua

SEQ ID NO: 470802 - RNA, 32 nt, Human
gguugagcccaggagguuguggcugcagugag

SEQ ID NO: 470803 - RNA, 32 nt, Human
gguugagcccaggaguucgaagcugcagggac

SEQ ID NO: 470804 - RNA, 32 nt, Human
gguugagccucuacuuucuucuugccaccuuu

SEQ ID NO: 470805 - RNA, 32 nt, Human
gguugagcuuaggagguugaggcugcagugag

SEQ ID NO: 470806 - RNA, 32 nt, Human
gguugaggaaacaaacaugacccuaaaucuug

SEQ ID NO: 470807 - RNA, 32 nt, Human
gguugaggaggagccaguuuuagguucgaaga

SEQ ID NO: 470808 - RNA, 32 nt, Human
gguugaggagggggaggagaccccugagaccc

SEQ ID NO: 470809 - RNA, 18 nt, Human
gguugaggcacagccugu

SEQ ID NO: 470810 - RNA, 32 nt, Human
gguugaggccaggaguuugaggcugcagugag

SEQ ID NO: 470811 - RNA, 32 nt, Human
gguugaggcugcagagaguggugaucaugccu

SEQ ID NO: 470812 - RNA, 32 nt, Human
gguugaggcugugggggcagcagaucaggagc

SEQ ID NO: 470813 - RNA, 32 nt, Human
gguugagggaggcaguaauaugaagugacugc

SEQ ID NO: 470814 - RNA, 32 nt, Human
gguugagguggguggaucaugaggucaggagu

SEQ ID NO: 470815 - RNA, 32 nt, Human
gguugagguuucaaaccucccuuuccaaaugc

SEQ ID NO: 470816 - RNA, 32 nt, Human
gguugaguaggcuccagcuaggaaggggccag

SEQ ID NO: 470817 - RNA, 32 nt, Human
gguugauaggacugcuuggguccuccacuguc

SEQ ID NO: 470818 - RNA, 32 nt, Human
gguugauauuuuuauaguggcguguaaucucc

SEQ ID NO: 470819 - RNA, 32 nt, Human
gguugaucucagacugcugugcuagcaaucag

SEQ ID NO: 470820 - RNA, 16 nt, Human
gguugaucucaggaua

SEQ ID NO: 470821 - RNA, 32 nt, Human
gguugaugauaccaccaccaccugccuaccca

SEQ ID NO: 470822 - RNA, 32 nt, Human
gguugauggcgaguggugcugaagggacagcu

SEQ ID NO: 470823 - RNA, 32 nt, Human
gguugauuacacaaugccuuguacaugauaua

SEQ ID NO: 470824 - RNA, 32 nt, Human
gguugauuacuccuuagagagcuccccacugc

SEQ ID NO: 470825 - RNA, 18 nt, Human
gguugauuucuuucuuca

SEQ ID NO: 470826 - RNA, 32 nt, Human
gguugauuucuuucuucagcuuucugacaugu

SEQ ID NO: 470827 - RNA, 32 nt, Human
gguugauuuuugucccucugcgcuugcucccc

SEQ ID NO: 470828 - RNA, 32 nt, Human
gguugcaaaguuagccgagaucacgccaucac

SEQ ID NO: 470829 - RNA, 32 nt, Human
gguugcaacacuguacuccagccugggcaaca

SEQ ID NO: 470830 - RNA, 21 nt, Human
gguugcaaccucucuuccucu

SEQ ID NO: 470831 - RNA, 32 nt, Human
gguugcaaccucucuuccucugggacuuuugc

SEQ ID NO: 470832 - RNA, 32 nt, Human
gguugcaaugaagcggagguugcagugagccg

SEQ ID NO: 470833 - RNA, 23 nt, Human
gguugcaaugccucacuuugccu

SEQ ID NO: 470834 - RNA, 32 nt, Human
gguugcaauguuuugcucccagaagagaauca

SEQ ID NO: 470835 - RNA, 32 nt, Human
gguugcacacuggccucuguggaggucaggga

SEQ ID NO: 470836 - RNA, 32 nt, Human
gguugcaccacuacacuguagccugggugaca

SEQ ID NO: 470837 - RNA, 32 nt, Human
gguugcaccacugcucuccaggcuugagugac

SEQ ID NO: 470838 - RNA, 32 nt, Human
gguugcaccacuguacuccagccugggcgaua

SEQ ID NO: 470839 - RNA, 32 nt, Human
gguugcaccauuguacuccagccugggcaaca

SEQ ID NO: 470840 - RNA, 32 nt, Human
gguugcacccuuaagaguauucagagagcauc

SEQ ID NO: 470841 - RNA, 32 nt, Human
gguugcacuauggccucaucuguggcucugaa

SEQ ID NO: 470842 - RNA, 20 nt, Human
gguugcacucuuccuauagc

SEQ ID NO: 470843 - RNA, 32 nt, Human
gguugcacugaauuugggggagcugcauggua

SEQ ID NO: 470844 - RNA, 32 nt, Human
gguugcacuucagcuucaucuccuuggcaggg

SEQ ID NO: 470845 - RNA, 22 nt, Human
gguugcagaaaugggaagagcu

SEQ ID NO: 470846 - RNA, 32 nt, Human
gguugcagaacuucaugaaagcuuuacuaaua

SEQ ID NO: 470847 - RNA, 32 nt, Human
gguugcagagcaggccaggcagacaguggggg

SEQ ID NO: 470848 - RNA, 32 nt, Human
gguugcagaggcuggccgcugccuggaagugu

SEQ ID NO: 470849 - RNA, 32 nt, Human
gguugcagauacaauagaagaaaaauuugucc

SEQ ID NO: 470850 - RNA, 32 nt, Human
gguugcagccaugucgagacugacgcugagga

SEQ ID NO: 470851 - RNA, 32 nt, Human
gguugcagccugaccaaaagugagaugggaag

SEQ ID NO: 470852 - RNA, 24 nt, Human
gguugcagccugcacaccauagcc

SEQ ID NO: 470853 - RNA, 22 nt, Human
gguugcaggcuuucccaugguc

SEQ ID NO: 470854 - RNA, 32 nt, Human
gguugcagggaggcggagguugcagugagccg

SEQ ID NO: 470855 - RNA, 25 nt, Human
gguugcaggugugcaccaccgcgcc

SEQ ID NO: 470856 - RNA, 32 nt, Human
gguugcagguucaaggcaaacaggcuucuagc

SEQ ID NO: 470857 - RNA, 22 nt, Human
gguugcaguaccagccacagcc

SEQ ID NO: 470858 - RNA, 21 nt, Human
gguugcaguacucgcugggcu

SEQ ID NO: 470859 - RNA, 24 nt, Human
gguugcagucucggccucguggcc

SEQ ID NO: 470860 - RNA, 32 nt, Human
gguugcagugaacuuagaucaugccacugcac

SEQ ID NO: 470861 - RNA, 32 nt, Human
gguugcagugagccaagauugcagugagccaa

SEQ ID NO: 470862 - RNA, 32 nt, Human
gguugcagugagccacugcacuccagccugau

SEQ ID NO: 470863 - RNA, 32 nt, Human
gguugcagugagccgggauugcagugagccac

SEQ ID NO: 470864 - RNA, 32 nt, Human
gguugcagugagcugagguugcggugagcuga

SEQ ID NO: 470865 - RNA, 32 nt, Human
gguugcaguuaagccgagaucaugcuacugca

SEQ ID NO: 470866 - RNA, 32 nt, Human
gguugcauagagaagaguaagaauguagacca

SEQ ID NO: 470867 - RNA, 32 nt, Human
gguugcaugccuguaaucccagcauuuuggga

SEQ ID NO: 470868 - RNA, 32 nt, Human
gguugcauuuuugagcauggggugcaggagcc

SEQ ID NO: 470869 - RNA, 32 nt, Human
gguugccaacccacaaucucauugaucagcag

SEQ ID NO: 470870 - RNA, 32 nt, Human
gguugccaacuacaucugucccuucccaucaa

SEQ ID NO: 470871 - RNA, 32 nt, Human
gguugccacucaccuggagauucagcaacagg

SEQ ID NO: 470872 - RNA, 32 nt, Human
gguugccagaaguggaaaugggaguuaacuau

SEQ ID NO: 470873 - RNA, 32 nt, Human
gguugccaugaagacccgguccgggagcaguc

SEQ ID NO: 470874 - RNA, 32 nt, Human
gguugccaugguaccgagggacucauuccugg

SEQ ID NO: 470875 - RNA, 32 nt, Human
gguugcccccuucaccuucuugcaaccucuuc

SEQ ID NO: 470876 - RNA, 32 nt, Human
gguugcccgaaggaugacgguggagacagauu

SEQ ID NO: 470877 - RNA, 32 nt, Human
gguugcccuguauacaugauccagucugugac

SEQ ID NO: 470878 - RNA, 19 nt, Human
gguugccgcccccucggga

SEQ ID NO: 470879 - RNA, 22 nt, Human
gguugccgccgccgccgccgcc

SEQ ID NO: 470880 - RNA, 24 nt, Human
gguugccgugagcugagauugcgu

SEQ ID NO: 470881 - RNA, 32 nt, Human
gguugccucuccccugcucacuccagucacau

SEQ ID NO: 470882 - RNA, 32 nt, Human
gguugccucuuccucuucccucacuuacuugu

SEQ ID NO: 470883 - RNA, 32 nt, Human
gguugccugccugggccccauguggaaggcag

SEQ ID NO: 470884 - RNA, 32 nt, Human
gguugccugcggcguccacuuccuuggccgcc

SEQ ID NO: 470885 - RNA, 32 nt, Human
gguugccuggccugggcugcgcccagcagcuu

SEQ ID NO: 470886 - RNA, 32 nt, Human
gguugccuggcuaccugcucaugagggacuug

SEQ ID NO: 470887 - RNA, 32 nt, Human
gguugccuuagucaucuuccuacagcaccauc

SEQ ID NO: 470888 - RNA, 32 nt, Human
gguugccuucuaacggcaggugggcauaaggc

SEQ ID NO: 470889 - RNA, 32 nt, Human
gguugccuugaaaucacugugguccaaaugua

SEQ ID NO: 470890 - RNA, 32 nt, Human
gguugcgaggggcgguguugaagaaugugugg

SEQ ID NO: 470891 - RNA, 32 nt, Human
gguugcgcaaagugcugaacuggcugaaguuc

SEQ ID NO: 470892 - RNA, 32 nt, Human
gguugcgccacuacacuccagccugggugaca

SEQ ID NO: 470893 - RNA, 32 nt, Human
gguugcgccacugcacuccagccugggcaaca

SEQ ID NO: 470894 - RNA, 32 nt, Human
gguugcgccacugcacucuagccugggcuaca

SEQ ID NO: 470895 - RNA, 32 nt, Human
gguugcgccacuguacuccagccugggugagg

SEQ ID NO: 470896 - RNA, 32 nt, Human
gguugcgcuacugcacuccagccuggacaaca

SEQ ID NO: 470897 - RNA, 24 nt, Human
gguugcggagccgacaucacggcc

SEQ ID NO: 470898 - RNA, 20 nt, Human
gguugcggcuguaccauggc

SEQ ID NO: 470899 - RNA, 32 nt, Human
gguugcgggaggcuggacucuggugacuguaa

SEQ ID NO: 470900 - RNA, 32 nt, Human
gguugcgggggagaggggagaauggaguagag

SEQ ID NO: 470901 - RNA, 23 nt, Human
gguugcgguggcucaugccugua

SEQ ID NO: 470902 - RNA, 22 nt, Human
gguugcuacgcgcaccauggcu

SEQ ID NO: 470903 - RNA, 23 nt, Human
gguugcuagcugccgccgcugcu

SEQ ID NO: 470904 - RNA, 32 nt, Human
gguugcuauguccuuuugacauggcccaucau

SEQ ID NO: 470905 - RNA, 21 nt, Human
gguugcuccucaggcacccug

SEQ ID NO: 470906 - RNA, 32 nt, Human
gguugcucucaaacuccugaccucaggugauc

SEQ ID NO: 470907 - RNA, 32 nt, Human
gguugcugaccagcaaucagccauguuuggag

SEQ ID NO: 470908 - RNA, 31 nt, Human
gguugcugacuucuuuauuucagagcucugg

SEQ ID NO: 470909 - RNA, 32 nt, Human
gguugcugagaguugaggggaaaggagggaug

SEQ ID NO: 470910 - RNA, 32 nt, Human
gguugcugcugaaggaggaggcagcagcgagg

SEQ ID NO: 470911 - RNA, 19 nt, Human
gguugcugcuuuugcuaca

SEQ ID NO: 470912 - RNA, 32 nt, Human
gguugcuggagcucaccagucuugagggaggu

SEQ ID NO: 470913 - RNA, 20 nt, Human
gguugcugggguuacaggug

SEQ ID NO: 470914 - RNA, 31 nt, Human
gguugcuuaaggcgaggaguuggagaccagc

SEQ ID NO: 470915 - RNA, 18 nt, Human
gguugcuuauuucccuca

SEQ ID NO: 470916 - RNA, 18 nt, Human
gguugcuuauuugucuca

SEQ ID NO: 470917 - RNA, 22 nt, Human
gguugcuucugcuauucgcuua

SEQ ID NO: 470918 - RNA, 32 nt, Human
gguugcuucuggaagggcccggauggggccug

SEQ ID NO: 470919 - RNA, 32 nt, Human
gguugcuuggagaagggacauggggcugaauc

SEQ ID NO: 470920 - RNA, 32 nt, Human
gguugcuugugucugugacugcagcuauggcc

SEQ ID NO: 470921 - RNA, 31 nt, Human
gguugcuuuagcucaggaguuggagacaagc

SEQ ID NO: 470922 - RNA, 32 nt, Human
gguugcuuucagauaaagaugacaugggaagg

SEQ ID NO: 470923 - RNA, 32 nt, Human
gguugcuuugagagaggcauggggaaggggau

SEQ ID NO: 470924 - RNA, 22 nt, Human
gguugcuuuugaguuuuacuca

SEQ ID NO: 470925 - RNA, 18 nt, Human
gguugcuuuuucuuccuc

SEQ ID NO: 470926 - RNA, 32 nt, Human
gguugcuuuuucuuccuccugggcaacuauuu

SEQ ID NO: 470927 - RNA, 32 nt, Human
gguuggaacagggagagcagcagccaugucag

SEQ ID NO: 470928 - RNA, 32 nt, Human
gguuggaagaaauaucccaaaacccauugucu

SEQ ID NO: 470929 - RNA, 32 nt, Human
gguuggaagagaguaaccaguuuccagagagc

SEQ ID NO: 470930 - RNA, 32 nt, Human
gguuggaagcagggagcuggaccgcagugucc

SEQ ID NO: 470931 - RNA, 16 nt, Human
gguuggaaucaggaua

SEQ ID NO: 470932 - RNA, 32 nt, Human
gguuggaccccuccccaagaggccaacccagu

SEQ ID NO: 470933 - RNA, 32 nt, Human
gguuggaccgggaggcaguggcuuggagaggc

SEQ ID NO: 470934 - RNA, 32 nt, Human
gguuggacucaaacuccugaccuugugauuug

SEQ ID NO: 470935 - RNA, 32 nt, Human
gguuggagaggagccauuuacagauuuuaagc

SEQ ID NO: 470936 - RNA, 32 nt, Human
gguuggaggaaaccccucccuauucaugucca

SEQ ID NO: 470937 - RNA, 32 nt, Human
gguuggaggagagagguggagacuguggcuca

SEQ ID NO: 470938 - RNA, 32 nt, Human
gguuggaggagggagaagugggaaguagcuug

SEQ ID NO: 470939 - RNA, 32 nt, Human
gguuggaggccugaggccucuuggaacucuug

SEQ ID NO: 470940 - RNA, 32 nt, Human
gguuggagggccggaagaggaaagaaaccaga

SEQ ID NO: 470941 - RNA, 32 nt, Human
gguuggaggucuggacagggagcccagucccg

SEQ ID NO: 470942 - RNA, 22 nt, Human
gguuggaggucuuaucugugga

SEQ ID NO: 470943 - RNA, 32 nt, Human
gguuggagugcaguggcccaucagggcucacu

SEQ ID NO: 470944 - RNA, 32 nt, Human
gguuggaguuccagggcugggcccugguggag

SEQ ID NO: 470945 - RNA, 32 nt, Human
gguuggaucuuccugcuacccucuuggauucu

SEQ ID NO: 470946 - RNA, 32 nt, Human
gguuggcaccuugacugcagccccaugagaca

SEQ ID NO: 470947 - RNA, 32 nt, Human
gguuggcagagaacacucacacacggggaagc

SEQ ID NO: 470948 - RNA, 32 nt, Human
gguuggcagagggagaaauaagccagccacgg

SEQ ID NO: 470949 - RNA, 32 nt, Human
gguuggcagaugagugaggaaaaagggguguc

SEQ ID NO: 470950 - RNA, 32 nt, Human
gguuggcagcagcggcgcuuggaggaaaggaa

SEQ ID NO: 470951 - RNA, 24 nt, Human
gguuggcagccacccaccccagag

SEQ ID NO: 470952 - RNA, 19 nt, Human
gguuggcaggggcugcagg

SEQ ID NO: 470953 - RNA, 32 nt, Human
gguuggcagggggaggguaggagcagcuggag

SEQ ID NO: 470954 - RNA, 32 nt, Human
gguuggcagggugggcguuuggggcccucaug

SEQ ID NO: 470955 - RNA, 32 nt, Human
gguuggcagggugugcuggggccuggaggagg

SEQ ID NO: 470956 - RNA, 32 nt, Human
gguuggcaucaucugauggcauguccaagugu

SEQ ID NO: 470957 - RNA, 32 nt, Human
gguuggcauggagucagcacaggaagccggga

SEQ ID NO: 470958 - RNA, 22 nt, Human
gguuggcauucuucuuaaugua

SEQ ID NO: 470959 - RNA, 32 nt, Human
gguuggccagggauggaguaaaccccacuucc

SEQ ID NO: 470960 - RNA, 32 nt, Human
gguuggccagucuguaccuggacuucgaauaa

SEQ ID NO: 470961 - RNA, 28 nt, Human
gguuggccaugacagcuagcccuccccu

SEQ ID NO: 470962 - RNA, 32 nt, Human
gguuggcccagccugcgagcgcgauccugacu

SEQ ID NO: 470963 - RNA, 32 nt, Human
gguuggccuuucuuauuuauauagagaacacu

SEQ ID NO: 470964 - RNA, 32 nt, Human
gguuggcgccuguaaucccagcuacucgggag

SEQ ID NO: 470965 - RNA, 32 nt, Human
gguuggcgucgccuugaaaucccaggccguga

SEQ ID NO: 470966 - RNA, 32 nt, Human
gguuggcuccagcaaaggagguugaacaucac

SEQ ID NO: 470967 - RNA, 32 nt, Human
gguuggcucugagcuccuuccaaaagaugaau

SEQ ID NO: 470968 - RNA, 32 nt, Human
gguuggcucugccuuugcugucuuuaccugaa

SEQ ID NO: 470969 - RNA, 21 nt, Human
gguuggcugaggccaccagcc

SEQ ID NO: 470970 - RNA, 32 nt, Human
gguuggcugggaguucaagaccagccuggcca

SEQ ID NO: 470971 - RNA, 32 nt, Human
gguuggcuucaaugcuaaggaagcccacaaua

SEQ ID NO: 470972 - RNA, 32 nt, Human
gguuggcuuuaacccaggaggcagagguugca

SEQ ID NO: 470973 - RNA, 32 nt, Human
gguugggaaauggaucaaggagagggaagcgu

SEQ ID NO: 470974 - RNA, 32 nt, Human
gguugggaaggcaccugcucccacagaagggg

SEQ ID NO: 470975 - RNA, 32 nt, Human
gguugggaauauucucugaugcucugacucac

SEQ ID NO: 470976 - RNA, 32 nt, Human
gguugggaauauucugugaugcucugacuccc

SEQ ID NO: 470977 - RNA, 32 nt, Human
gguugggacguguaagcgccugggagagccua

SEQ ID NO: 470978 - RNA, 30 nt, Human
gguugggacuugugaucagaaaaacugaag

SEQ ID NO: 470979 - RNA, 32 nt, Human
gguugggagaggggcugggcauggacaggagg

SEQ ID NO: 470980 - RNA, 32 nt, Human
gguugggagaugucucccaacugcugauuaau

SEQ ID NO: 470981 - RNA, 32 nt, Human
gguugggagcugagggaaggcugagaauccuc

SEQ ID NO: 470982 - RNA, 32 nt, Human
gguugggaggcuaacgagucuaccucccucuu

SEQ ID NO: 470983 - RNA, 32 nt, Human
gguugggaugggauaggacuagcaccauuuua

SEQ ID NO: 470984 - RNA, 32 nt, Human
gguugggauuugggggcugagcugucuggggu

SEQ ID NO: 470985 - RNA, 32 nt, Human
gguugggcaggcaggagccaggagaguagcua

SEQ ID NO: 470986 - RNA, 32 nt, Human
gguugggcuccuugguaccaugugggaagcgc

SEQ ID NO: 470987 - RNA, 32 nt, Human
gguugggcucuuccuccuccagcucaggagcc

SEQ ID NO: 470988 - RNA, 32 nt, Human
gguuggggacaguggggugcgugggagugggg

SEQ ID NO: 470989 - RNA, 32 nt, Human
gguuggggagagacagagaagugggcaggggc

SEQ ID NO: 470990 - RNA, 32 nt, Human
gguuggggaggaaguucuccagccccuugugc

SEQ ID NO: 470991 - RNA, 32 nt, Human
gguuggggaggcacagagcagagguucagguc

SEQ ID NO: 470992 - RNA, 22 nt, Human
gguuggggaugggggguaccuu

SEQ ID NO: 470993 - RNA, 32 nt, Human
gguuggggcaaaagaagggaaacccauccagu

SEQ ID NO: 470994 - RNA, 32 nt, Human
gguuggggcaggcaggagcagugugguaguac

SEQ ID NO: 470995 - RNA, 32 nt, Human
gguugggggaggcagagguggcacuggaggcc

SEQ ID NO: 470996 - RNA, 32 nt, Human
gguugggggaggcagcgggugauggcucugaa

SEQ ID NO: 470997 - RNA, 32 nt, Human
gguugggggaggcgggugcaggaccgaggccu

SEQ ID NO: 470998 - RNA, 32 nt, Human
gguugggggaugaggucagggggucuugggug

SEQ ID NO: 470999 - RNA, 32 nt, Human
gguugggggauggagcagggaauaagacauug

SEQ ID NO: 471000 - RNA, 32 nt, Human
gguugggggcagaggcccaucuggccugaacu

SEQ ID NO: 471001 - RNA, 32 nt, Human
gguugggggugggggagagggagagagcgaac

SEQ ID NO: 471002 - RNA, 32 nt, Human
gguugggguccugcaagaaggccuccucagcc

SEQ ID NO: 471003 - RNA, 32 nt, Human
gguugggucacauuugaaaaacaggccaguau

SEQ ID NO: 471004 - RNA, 32 nt, Human
gguugggucccugaggccuuccucggagcauu

SEQ ID NO: 471005 - RNA, 32 nt, Human
gguugggugcugcuguugugguccuucccaga

SEQ ID NO: 471006 - RNA, 32 nt, Human
gguugggugggaggaggaagaaagggaagaau

SEQ ID NO: 471007 - RNA, 32 nt, Human
gguugggugguggaggguggguccccuucccc

SEQ ID NO: 471008 - RNA, 32 nt, Human
gguugguaauucaggauucauuuggaaagugg

SEQ ID NO: 471009 - RNA, 32 nt, Human
gguugguacauggauaccuguucuuuaaaagg

SEQ ID NO: 471010 - RNA, 32 nt, Human
gguugguccacagcacuccauucuggguggca

SEQ ID NO: 471011 - RNA, 32 nt, Human
gguuggucucaaacuccugagcucaagcaauc

SEQ ID NO: 471012 - RNA, 32 nt, Human
gguuggucucaaacuccugagcucaagcaguc

SEQ ID NO: 471013 - RNA, 32 nt, Human
gguuggucucaaacuccuggacucaagugauc

SEQ ID NO: 471014 - RNA, 32 nt, Human
gguuggucucaaacuccuggguucaagcaguc

SEQ ID NO: 471015 - RNA, 19 nt, Human
gguuggucuccagauucuc

SEQ ID NO: 471016 - RNA, 32 nt, Human
gguuggucucgaacuccugaccucaggugauu

SEQ ID NO: 471017 - RNA, 32 nt, Human
gguuggucucgaacuccugaccuugugaugcu

SEQ ID NO: 471018 - RNA, 32 nt, Human
gguuggucucgaacuccugaucucaugaucca

SEQ ID NO: 471019 - RNA, 32 nt, Human
gguuggucucgaacuccugggcucaagcaguc

SEQ ID NO: 471020 - RNA, 32 nt, Human
gguuggucuguggagugccugaagugaccagc

SEQ ID NO: 471021 - RNA, 32 nt, Human
gguuggucuugaacuccugaccucaggugauc

SEQ ID NO: 471022 - RNA, 32 nt, Human
gguuggucuugcugucucagguggcagaggug

SEQ ID NO: 471023 - RNA, 18 nt, Human
gguuggugagugcuggug

SEQ ID NO: 471024 - RNA, 32 nt, Human
gguuggugauggagccacaacagcagcgagca

SEQ ID NO: 471025 - RNA, 32 nt, Human
gguuggugcaugugccuguaaucccagcuacu

SEQ ID NO: 471026 - RNA, 21 nt, Human
gguuggugccaccaccaggcu

SEQ ID NO: 471027 - RNA, 32 nt, Human
gguuggugccuuucccccuccuuccuccccac

SEQ ID NO: 471028 - RNA, 32 nt, Human
gguuggugcucacugacuacuacauguugauu

SEQ ID NO: 471029 - RNA, 32 nt, Human
gguugguguacuuggcuuaaguacuucaugcu

SEQ ID NO: 471030 - RNA, 32 nt, Human
gguugguguccagguuuguggcacuguuccaa

SEQ ID NO: 471031 - RNA, 32 nt, Human
gguugguguggaagagguggggcagauuaaag

SEQ ID NO: 471032 - RNA, 32 nt, Human
gguugguuaggcaaucauucuagggcagaaag

SEQ ID NO: 471033 - RNA, 32 nt, Human
gguugguugaguagcugguguuugcauccugg

SEQ ID NO: 471034 - RNA, 32 nt, Human
gguugguuggcugauugguggaaaguagggug

SEQ ID NO: 471035 - RNA, 32 nt, Human
gguugguugggggaggaaguggggaggagugu

SEQ ID NO: 471036 - RNA, 32 nt, Human
gguuguaaacaaacaguacacaugucauuuug

SEQ ID NO: 471037 - RNA, 32 nt, Human
gguuguaaagaugucuuggccucccagacagu

SEQ ID NO: 471038 - RNA, 32 nt, Human
gguuguaccacugcacuccagccuggcugaca

SEQ ID NO: 471039 - RNA, 32 nt, Human
gguuguacugaagacacgagaccugagacuug

SEQ ID NO: 471040 - RNA, 32 nt, Human
gguuguagacacacccuccccuaacaaaaaca

SEQ ID NO: 471041 - RNA, 25 nt, Human
gguuguagauguugcucuacauuca

SEQ ID NO: 471042 - RNA, 20 nt, Human
gguuguagcccacuucgccu

SEQ ID NO: 471043 - RNA, 32 nt, Human
gguuguauacuucuugaccaugugggacuaau

SEQ ID NO: 471044 - RNA, 32 nt, Human
gguuguauagaacacugaagcaucugauuuca

SEQ ID NO: 471045 - RNA, 31 nt, Human
gguuguauggguugcucugagggaccuugga

SEQ ID NO: 471046 - RNA, 24 nt, Human
gguugucacucaacaaaagugcuu

SEQ ID NO: 471047 - RNA, 32 nt, Human
gguugucacuuaaguuuggagugcaguggcau

SEQ ID NO: 471048 - RNA, 32 nt, Human
gguugucauggacuggcugccuuacaaaagcu

SEQ ID NO: 471049 - RNA, 21 nt, Human
gguugucauguuaaagugcuu

SEQ ID NO: 471050 - RNA, 32 nt, Human
gguuguccaacauuuucuaauacgcauucuac

SEQ ID NO: 471051 - RNA, 32 nt, Human
gguuguccacggucacaucugccccagugccu

SEQ ID NO: 471052 - RNA, 32 nt, Human
gguugucccucccagggaugcagccagacccg

SEQ ID NO: 471053 - RNA, 32 nt, Human
gguuguccuccaccccgcuggaaauccuguuc

SEQ ID NO: 471054 - RNA, 32 nt, Human
gguugucgccgggcgggccaggagcagcgcgg

SEQ ID NO: 471055 - RNA, 32 nt, Human
gguugucugcaggagagcaagccaggaggaca

SEQ ID NO: 471056 - RNA, 32 nt, Human
gguugucugccuccccucagauuuccugauag

SEQ ID NO: 471057 - RNA, 32 nt, Human
gguugucugcuaaaccugcuccuccaaagcca

SEQ ID NO: 471058 - RNA, 32 nt, Human
gguugucugcuaaaccugcuuuuccaaagccg

SEQ ID NO: 471059 - RNA, 32 nt, Human
gguugucugcuuagccacaugccuguauaguu

SEQ ID NO: 471060 - RNA, 32 nt, Human
gguugucugggguggguggaguggcgacagga

SEQ ID NO: 471061 - RNA, 32 nt, Human
gguugucuucauacccggcuucaugccagggu

SEQ ID NO: 471062 - RNA, 32 nt, Human
gguugucuuuaaagauauaaaaauuaggaugc

SEQ ID NO: 471063 - RNA, 32 nt, Human
gguugucuuuggucaggcaugugcccugagca

SEQ ID NO: 471064 - RNA, 32 nt, Human
gguugugaaguuaaugggaguacagagagcgu

SEQ ID NO: 471065 - RNA, 21 nt, Human
gguugugagacgccgcgcuca

SEQ ID NO: 471066 - RNA, 32 nt, Human
gguugugccacugcacuccagccugggcaaaa

SEQ ID NO: 471067 - RNA, 32 nt, Human
gguugugccacugcacuccagccuggguaaga

SEQ ID NO: 471068 - RNA, 32 nt, Human
gguugugccacugcacuccagccugggugaca

SEQ ID NO: 471069 - RNA, 32 nt, Human
gguugugccacugcacugcagccugggcuaca

SEQ ID NO: 471070 - RNA, 32 nt, Human
gguugugccuguaaucccagcuacuugggagg

SEQ ID NO: 471071 - RNA, 32 nt, Human
gguugugcgucugaagccuacaagaaaguuug

SEQ ID NO: 471072 - RNA, 32 nt, Human
gguugugcguggcuccugaccugcugcuaaga

SEQ ID NO: 471073 - RNA, 32 nt, Human
gguugugcuuugacuaacugaucuguucuuuc

SEQ ID NO: 471074 - RNA, 19 nt, Human
gguuguggccuccacccca

SEQ ID NO: 471075 - RNA, 32 nt, Human
gguuguggccuguaaucccagcuacucgggag

SEQ ID NO: 471076 - RNA, 24 nt, Human
gguugugggaaggguggguggcuu

SEQ ID NO: 471077 - RNA, 22 nt, Human
gguugugggagggccugggcca

SEQ ID NO: 471078 - RNA, 32 nt, Human
gguuguggggcaucuggagcagggugccugua

SEQ ID NO: 471079 - RNA, 32 nt, Human
gguuguggggugagaggaugugaguggccggg

SEQ ID NO: 471080 - RNA, 32 nt, Human
gguugugggugcgggugcacacaaaugagugg

SEQ ID NO: 471081 - RNA, 32 nt, Human
gguuguggugcagcugagugaggaccugcugu

SEQ ID NO: 471082 - RNA, 32 nt, Human
gguuguggugugcaccuguaguccuaguuacu

SEQ ID NO: 471083 - RNA, 32 nt, Human
gguuguguaaccaccagugcagucaaggcaua

SEQ ID NO: 471084 - RNA, 32 nt, Human
gguugugucauugcacuccagccuggggaaca

SEQ ID NO: 471085 - RNA, 32 nt, Human
gguugugugcagauggcccuucaaucucgaaa

SEQ ID NO: 471086 - RNA, 32 nt, Human
gguugugugggugggcuguugggagugaggau

SEQ ID NO: 471087 - RNA, 32 nt, Human
gguuguuacugccucuucccuaggugaagagg

SEQ ID NO: 471088 - RNA, 32 nt, Human
gguuguucuuuguccuaagugagcucuguuca

SEQ ID NO: 471089 - RNA, 22 nt, Human
gguuguugaaucucuccucuug

SEQ ID NO: 471090 - RNA, 32 nt, Human
gguuguugcccaggcuggagugcaguggcgcc

SEQ ID NO: 471091 - RNA, 32 nt, Human
gguuguugcuucuccccucgccacgcccuucu

SEQ ID NO: 471092 - RNA, 32 nt, Human
gguuguuggccagacaagucccagaaacugcc

SEQ ID NO: 471093 - RNA, 32 nt, Human
gguuguuuccaguuuggggcuguuauaaauaa

SEQ ID NO: 471094 - RNA, 18 nt, Human
gguuguuucuuaaauuua

SEQ ID NO: 471095 - RNA, 32 nt, Human
gguuguuugacaccuucuuuccacuuucaccu

SEQ ID NO: 471096 - RNA, 20 nt, Human
gguuguuuuuacuuuauuua

SEQ ID NO: 471097 - RNA, 32 nt, Human
gguuuaaaaagaaucacagcuucggaacuuuu

SEQ ID NO: 471098 - RNA, 32 nt, Human
gguuuaaaaccagcaccgaggcccaguggggg

SEQ ID NO: 471099 - RNA, 32 nt, Human
gguuuaaaaggccgagagaagcuguauucugg

SEQ ID NO: 471100 - RNA, 32 nt, Human
gguuuaaaguacaguuucucuaaagaucagac

SEQ ID NO: 471101 - RNA, 32 nt, Human
gguuuaaaucuguuuuacauccuugagauucu

SEQ ID NO: 471102 - RNA, 32 nt, Human
gguuuaacaagcccgucaggugauucugauuu

SEQ ID NO: 471103 - RNA, 32 nt, Human
gguuuaacugauuuugugcuggaauucaaagg

SEQ ID NO: 471104 - RNA, 24 nt, Human
gguuuaagcaaugcuucugccuca

SEQ ID NO: 471105 - RNA, 24 nt, Human
gguuuaagcaauucuccugccuca

SEQ ID NO: 471106 - RNA, 22 nt, Human
gguuuaagcaauucuccugcuu

SEQ ID NO: 471107 - RNA, 24 nt, Human
gguuuaagcaauucuccugcuuca

SEQ ID NO: 471108 - RNA, 24 nt, Human
gguuuaagcaguucuccugccuca

SEQ ID NO: 471109 - RNA, 24 nt, Human
gguuuaagccauucuucugccuca

SEQ ID NO: 471110 - RNA, 22 nt, Human
gguuuaagcgauucucaugccu

SEQ ID NO: 471111 - RNA, 24 nt, Human
gguuuaagcgauucucaugccuca

SEQ ID NO: 471112 - RNA, 24 nt, Human
gguuuaagcgauucuccugccuca

SEQ ID NO: 471113 - RNA, 22 nt, Human
gguuuaagcgauucucuugccu

SEQ ID NO: 471114 - RNA, 24 nt, Human
gguuuaagcgauucucuugccuca

SEQ ID NO: 471115 - RNA, 22 nt, Human
gguuuaagcgauucuucugccu

SEQ ID NO: 471116 - RNA, 24 nt, Human
gguuuaagcgauucuucugccuca

SEQ ID NO: 471117 - RNA, 22 nt, Human
gguuuaagcuauucuccugccu

SEQ ID NO: 471118 - RNA, 24 nt, Human
gguuuaagcuauucuccugccuca

SEQ ID NO: 471119 - RNA, 32 nt, Human
gguuuaaggaugacauuucugaccauuugugu

SEQ ID NO: 471120 - RNA, 24 nt, Human
gguuuaagggauucuccugccuca

SEQ ID NO: 471121 - RNA, 32 nt, Human
gguuuaagucuguggaaaaggaagcacgggag

SEQ ID NO: 471122 - RNA, 27 nt, Human
gguuuaagugauucuucuucugccuca

SEQ ID NO: 471123 - RNA, 24 nt, Human
gguuuaagugguugugcugcuuca

SEQ ID NO: 471124 - RNA, 32 nt, Human
gguuuacaccacugcacuccagucuggaugac

SEQ ID NO: 471125 - RNA, 32 nt, Human
gguuuacaccuguaaucccagcacuuugggag

SEQ ID NO: 471126 - RNA, 32 nt, Human
gguuuacagaacaccuguccugccugugccag

SEQ ID NO: 471127 - RNA, 32 nt, Human
gguuuacaggcacccaccaccaugcccagcua

SEQ ID NO: 471128 - RNA, 32 nt, Human
gguuuacagguaugcaccaccacgcccagcua

SEQ ID NO: 471129 - RNA, 32 nt, Human
gguuuacauccagcaggaguuggcccugagcu

SEQ ID NO: 471130 - RNA, 32 nt, Human
gguuuacaugcugcugggccugagcagcagga

SEQ ID NO: 471131 - RNA, 21 nt, Human
gguuuacgccacaaaagugcu

SEQ ID NO: 471132 - RNA, 32 nt, Human
gguuuacgccuauaaucccagcauuuugggac

SEQ ID NO: 471133 - RNA, 23 nt, Human
gguuuacucaccacaucugugga

SEQ ID NO: 471134 - RNA, 32 nt, Human
gguuuacuccuugaguuuuccugcugcgaugc

SEQ ID NO: 471135 - RNA, 32 nt, Human
gguuuacucugguuauaaaaacaguacaauaa

SEQ ID NO: 471136 - RNA, 32 nt, Human
gguuuacugagugcccacuaugugccaagcac

SEQ ID NO: 471137 - RNA, 32 nt, Human
gguuuacugcaaccuccaccuccuaggcucaa

SEQ ID NO: 471138 - RNA, 32 nt, Human
gguuuacugcugucauuguccaugccuacaga

SEQ ID NO: 471139 - RNA, 32 nt, Human
gguuuacugcugucauuguccaugccuauaga

SEQ ID NO: 471140 - RNA, 32 nt, Human
gguuuagacucuuguacauuucucccauaacu

SEQ ID NO: 471141 - RNA, 32 nt, Human
gguuuagagagggaugaagaggugagaguaag

SEQ ID NO: 471142 - RNA, 32 nt, Human
gguuuagauaaauacuuauacuuugcaaaguc

SEQ ID NO: 471143 - RNA, 32 nt, Human
gguuuagcaagagguuuauuguuaucaaaugc

SEQ ID NO: 471144 - RNA, 32 nt, Human
gguuuagcuuuugcuuucgaaguggccagcug

SEQ ID NO: 471145 - RNA, 32 nt, Human
gguuuaggaagagaugugguucaggugcuaaa

SEQ ID NO: 471146 - RNA, 32 nt, Human
gguuuaggcauuuggaaaaucugguucacauc

SEQ ID NO: 471147 - RNA, 24 nt, Human
gguuuaggccauucuccugcccca

SEQ ID NO: 471148 - RNA, 32 nt, Human
gguuuaggucuaauuucacucaguaguuuuua

SEQ ID NO: 471149 - RNA, 22 nt, Human
gguuuagguguuagccuucuua

SEQ ID NO: 471150 - RNA, 32 nt, Human
gguuuaguaaagcuuuuaucuuuagaaaaaug

SEQ ID NO: 471151 - RNA, 32 nt, Human
gguuuagugcugcugcuuucacugcugcaccc

SEQ ID NO: 471152 - RNA, 32 nt, Human
gguuuagugucccacggaaagagaccagaccu

SEQ ID NO: 471153 - RNA, 32 nt, Human
gguuuaguuaaaugucuuacucuacugugccu

SEQ ID NO: 471154 - RNA, 32 nt, Human
gguuuauagucaucugucgcauugccucgagu

SEQ ID NO: 471155 - RNA, 32 nt, Human
gguuuauauagcagggaagaaauguaacuaca

SEQ ID NO: 471156 - RNA, 32 nt, Human
gguuuauaucugugugaccuuaggcaagucac

SEQ ID NO: 471157 - RNA, 32 nt, Human
gguuuaucaagcaaagcuuuucuucauuugaa

SEQ ID NO: 471158 - RNA, 32 nt, Human
gguuuaucaguauuucuauuauaaaccucuau

SEQ ID NO: 471159 - RNA, 32 nt, Human
gguuuauccugacaguaaccucuccccagguc

SEQ ID NO: 471160 - RNA, 32 nt, Human
gguuuaucugcuggccuugcaucagccaauuc

SEQ ID NO: 471161 - RNA, 24 nt, Human
gguuuaugccauucuccugucuca

SEQ ID NO: 471162 - RNA, 32 nt, Human
gguuuaugccuguaaucccagcacugugggag

SEQ ID NO: 471163 - RNA, 32 nt, Human
gguuuauggcagcacuuccaucaaaagacacc

SEQ ID NO: 471164 - RNA, 32 nt, Human
gguuuaugggaugcaggauaauggagcaugcu

SEQ ID NO: 471165 - RNA, 32 nt, Human
gguuuauguguaugugauguugguguguguaa

SEQ ID NO: 471166 - RNA, 22 nt, Human
gguuuauuccucauucugugga

SEQ ID NO: 471167 - RNA, 22 nt, Human
gguuuauucuuaccaccuugcu

SEQ ID NO: 471168 - RNA, 32 nt, Human
gguuuauuuucugggaggucucuccuuugugu

SEQ ID NO: 471169 - RNA, 25 nt, Human
gguuucaaacacuucuccugccuca

SEQ ID NO: 471170 - RNA, 31 nt, Human
gguuucaaacagugggauaggagggacacuu

SEQ ID NO: 471171 - RNA, 32 nt, Human
gguuucaacauguuggccaggcuggucaugaa

SEQ ID NO: 471172 - RNA, 32 nt, Human
gguuucaacauguuggccaggcuggucuugaa

SEQ ID NO: 471173 - RNA, 21 nt, Human
gguuucaaccuccuggccuca

SEQ ID NO: 471174 - RNA, 23 nt, Human
gguuucaagcaauucuccugccu

SEQ ID NO: 471175 - RNA, 25 nt, Human
gguuucaagcaauucuccugccuca

SEQ ID NO: 471176 - RNA, 32 nt, Human
gguuucaagccaaaugugaauuuauuuggguu

SEQ ID NO: 471177 - RNA, 32 nt, Human
gguuucaagcccuuagggaugcagccugucua

SEQ ID NO: 471178 - RNA, 24 nt, Human
gguuucaagugauucuccugccuc

SEQ ID NO: 471179 - RNA, 25 nt, Human
gguuucaagugauucuccugccuca

SEQ ID NO: 471180 - RNA, 32 nt, Human
gguuucaauguucuuggaccucagggccuucg

SEQ ID NO: 471181 - RNA, 32 nt, Human
gguuucacaauguugaccaggcuggucucgaa

SEQ ID NO: 471182 - RNA, 32 nt, Human
gguuucacaauguuggccaggcuggucucaaa

SEQ ID NO: 471183 - RNA, 32 nt, Human
gguuucacagaauuuuaaaauagaguuaaagg

SEQ ID NO: 471184 - RNA, 19 nt, Human
gguuucaccaucuugguca

SEQ ID NO: 471185 - RNA, 19 nt, Human
gguuucaccaugcugguca

SEQ ID NO: 471186 - RNA, 32 nt, Human
gguuucaccauggcuaggcuggucucaaacuc

SEQ ID NO: 471187 - RNA, 32 nt, Human
gguuucaccauguaggccaggauggucucgaa

SEQ ID NO: 471188 - RNA, 32 nt, Human
gguuucaccauguugcccagacuggucuugaa

SEQ ID NO: 471189 - RNA, 19 nt, Human
gguuucaccauguuggcca

SEQ ID NO: 471190 - RNA, 19 nt, Human
gguuucaccauguugguca

SEQ ID NO: 471191 - RNA, 19 nt, Human
gguuucaccguguugguca

SEQ ID NO: 471192 - RNA, 32 nt, Human
gguuucacgauguuggccaggcuggucuuaau

SEQ ID NO: 471193 - RNA, 32 nt, Human
gguuucacuguguaggccaggcuggucucgaa

SEQ ID NO: 471194 - RNA, 32 nt, Human
gguuucacuguguuggccaggcuggucgugaa

SEQ ID NO: 471195 - RNA, 32 nt, Human
gguuucacuguguuggccaggcuggucucgaa

SEQ ID NO: 471196 - RNA, 32 nt, Human
gguuucacuguguuggccaggcuggucuugaa

SEQ ID NO: 471197 - RNA, 21 nt, Human
gguuucacuucuccuggcuca

SEQ ID NO: 471198 - RNA, 32 nt, Human
gguuucagaagaagcauggcucugccaacacc

SEQ ID NO: 471199 - RNA, 32 nt, Human
gguuucagcaagaaagucugugaugugaccag

SEQ ID NO: 471200 - RNA, 32 nt, Human
gguuucagcauauggucaacaaaagaacauuu

SEQ ID NO: 471201 - RNA, 32 nt, Human
gguuucagcgcugaggaggccugaguuccguc

SEQ ID NO: 471202 - RNA, 32 nt, Human
gguuucagcuggccccagcccagaagugaccc

SEQ ID NO: 471203 - RNA, 32 nt, Human
gguuucagucaucuccccauuugguccccugg

SEQ ID NO: 471204 - RNA, 23 nt, Human
gguuucagugauuuuucugccuc

SEQ ID NO: 471205 - RNA, 23 nt, Human
gguuucaguguacuaguuuugaa

SEQ ID NO: 471206 - RNA, 32 nt, Human
gguuucaguuacucucagucagucauggucca

SEQ ID NO: 471207 - RNA, 24 nt, Human
gguuucaguuuccuuauuucugag

SEQ ID NO: 471208 - RNA, 32 nt, Human
gguuucauauccagcaacuuugcuaaaauuca

SEQ ID NO: 471209 - RNA, 32 nt, Human
gguuucaucacggugaaacccccucucugcua

SEQ ID NO: 471210 - RNA, 32 nt, Human
gguuucaucacguugaccaggcuggucucgaa

SEQ ID NO: 471211 - RNA, 23 nt, Human
gguuucaucacuaacaaaagugc

SEQ ID NO: 471212 - RNA, 32 nt, Human
gguuucaucaugguggccaggauggucuaucu

SEQ ID NO: 471213 - RNA, 32 nt, Human
gguuucaucauguugcccaggcuggucucaaa

SEQ ID NO: 471214 - RNA, 32 nt, Human
gguuucaucauguuggccaggauggucucuua

SEQ ID NO: 471215 - RNA, 32 nt, Human
gguuucaucauguuggccaggauggucuugau

SEQ ID NO: 471216 - RNA, 32 nt, Human
gguuucaucauguuggccaggcuggucucaaa

SEQ ID NO: 471217 - RNA, 32 nt, Human
gguuucaucauguuggccaggcuggucucgaa

SEQ ID NO: 471218 - RNA, 32 nt, Human
gguuucaucauguuggccaggcuggucucgag

SEQ ID NO: 471219 - RNA, 32 nt, Human
gguuucaucauguuggccaggcuggucuugaa

SEQ ID NO: 471220 - RNA, 32 nt, Human
gguuucaucauguuggccuggcuggucucaaa

SEQ ID NO: 471221 - RNA, 32 nt, Human
gguuucaucauguuguccaggcuggucuugaa

SEQ ID NO: 471222 - RNA, 32 nt, Human
gguuucaucccugaaacagggccucacuuccu

SEQ ID NO: 471223 - RNA, 23 nt, Human
gguuucaucuaucaaaugucucc

SEQ ID NO: 471224 - RNA, 32 nt, Human
gguuucauuauguuggccaggcuggucuccaa

SEQ ID NO: 471225 - RNA, 32 nt, Human
gguuucauuauguuggccaggcuggucucgaa

SEQ ID NO: 471226 - RNA, 32 nt, Human
gguuucauuccagcauggcacauguauacaua

SEQ ID NO: 471227 - RNA, 32 nt, Human
gguuucauuuugaugcuaugugcuugccuuua

SEQ ID NO: 471228 - RNA, 32 nt, Human
gguuuccacaggaagcagauggagcuccuuuc

SEQ ID NO: 471229 - RNA, 32 nt, Human
gguuuccacaguugcugcuccuuuggggcaac

SEQ ID NO: 471230 - RNA, 32 nt, Human
gguuuccacucucgccaaagagagaagacgcc

SEQ ID NO: 471231 - RNA, 32 nt, Human
gguuuccacugaggacauucagccugggaagg

SEQ ID NO: 471232 - RNA, 31 nt, Human
gguuuccagagagagucaugcuggaggagaa

SEQ ID NO: 471233 - RNA, 32 nt, Human
gguuuccaggccaccguucuccugccuacauc

SEQ ID NO: 471234 - RNA, 32 nt, Human
gguuuccagguggacgggcagagccagugaac

SEQ ID NO: 471235 - RNA, 32 nt, Human
gguuuccagguuuucucccaggugacgcuguu

SEQ ID NO: 471236 - RNA, 32 nt, Human
gguuucccaaaguguugggauuacaggcauga

SEQ ID NO: 471237 - RNA, 32 nt, Human
gguuucccaagcucugggaccuugcucccagc

SEQ ID NO: 471238 - RNA, 21 nt, Human
gguuucccagcagcucaggca

SEQ ID NO: 471239 - RNA, 32 nt, Human
gguuucccaggaggaggaggccccugaagggg

SEQ ID NO: 471240 - RNA, 32 nt, Human
gguuucccauuugucuggccagucucuaugug

SEQ ID NO: 471241 - RNA, 32 nt, Human
gguuucccauuugucuggccagucucugugug

SEQ ID NO: 471242 - RNA, 32 nt, Human
gguuuccccaagugcugggauuacagguguga

SEQ ID NO: 471243 - RNA, 32 nt, Human
gguuuccccugaaccagcccuggaccuuucug

SEQ ID NO: 471244 - RNA, 32 nt, Human
gguuuccccuuuugcuuagcucucauucauuc

SEQ ID NO: 471245 - RNA, 32 nt, Human
gguuucccucaccucggucuucccaagaugga

SEQ ID NO: 471246 - RNA, 32 nt, Human
gguuucccuccaggucugguagggacugggcu

SEQ ID NO: 471247 - RNA, 21 nt, Human
gguuucccugucugucugugu

SEQ ID NO: 471248 - RNA, 32 nt, Human
gguuucccuucaugggaaaagccauuauauuu

SEQ ID NO: 471249 - RNA, 32 nt, Human
gguuuccgaggcccucuccagccaaggaaaag

SEQ ID NO: 471250 - RNA, 22 nt, Human
gguuuccggucagugguguggu

SEQ ID NO: 471251 - RNA, 32 nt, Human
gguuuccgucggcacugguggagggggugcgc

SEQ ID NO: 471252 - RNA, 32 nt, Human
gguuuccucaaccaccuuuccucagcuuucuu

SEQ ID NO: 471253 - RNA, 32 nt, Human
gguuuccucuuuccuuucccucuugucagguc

SEQ ID NO: 471254 - RNA, 32 nt, Human
gguuuccugaagugggaggaguguugaguaag

SEQ ID NO: 471255 - RNA, 32 nt, Human
gguuuccugcaagcccugacauuccuuggcuu

SEQ ID NO: 471256 - RNA, 32 nt, Human
gguuuccuggcuaguuuguguggugugguugg

SEQ ID NO: 471257 - RNA, 32 nt, Human
gguuuccuggggacccaggcuugcaaagugac

SEQ ID NO: 471258 - RNA, 24 nt, Human
gguuucgaacuccugaccucguga

SEQ ID NO: 471259 - RNA, 32 nt, Human
gguuucgagcugucucaaaauauugcccaaua

SEQ ID NO: 471260 - RNA, 24 nt, Human
gguuucgaucuccucaccucgcga

SEQ ID NO: 471261 - RNA, 24 nt, Human
gguuucgaucuccugaccuuguga

SEQ ID NO: 471262 - RNA, 32 nt, Human
gguuucgccauguuacccagacuggucuugaa

SEQ ID NO: 471263 - RNA, 32 nt, Human
gguuucgucauguugcccaggcuggucuccaa

SEQ ID NO: 471264 - RNA, 32 nt, Human
gguuucgucauguuggccaggcuggucuccaa

SEQ ID NO: 471265 - RNA, 32 nt, Human
gguuucgucauguuggccaggcuggucucgaa

SEQ ID NO: 471266 - RNA, 32 nt, Human
gguuucguuguauuuacaccauguguggaggc

SEQ ID NO: 471267 - RNA, 32 nt, Human
gguuucuagcacuaccggucacggccaugucg

SEQ ID NO: 471268 - RNA, 23 nt, Human
gguuucuagcggugccugaggca

SEQ ID NO: 471269 - RNA, 32 nt, Human
gguuucuaguguuucaguuacuauguuguauu

SEQ ID NO: 471270 - RNA, 32 nt, Human
gguuucuaucuuucuuccaccagacuccaagc

SEQ ID NO: 471271 - RNA, 32 nt, Human
gguuucucacagaauggauucccagcggaacu

SEQ ID NO: 471272 - RNA, 32 nt, Human
gguuucuccauguauugcccaggcuggucucg

SEQ ID NO: 471273 - RNA, 19 nt, Human
gguuucuccauguugguca

SEQ ID NO: 471274 - RNA, 32 nt, Human
gguuucucgauguuggccaggcuggucucaaa

SEQ ID NO: 471275 - RNA, 32 nt, Human
gguuucucuaauuuccuccacucccaguucga

SEQ ID NO: 471276 - RNA, 32 nt, Human
gguuucucucgaccucgcagagcuccugacaa

SEQ ID NO: 471277 - RNA, 32 nt, Human
gguuucucugauccuccuccacucccgcugcu

SEQ ID NO: 471278 - RNA, 32 nt, Human
gguuucucugcagaagcucucuuuuugccucc

SEQ ID NO: 471279 - RNA, 32 nt, Human
gguuucucuguucauauccaauucuggugcuu

SEQ ID NO: 471280 - RNA, 22 nt, Human
gguuucucuguugaggaugcgu

SEQ ID NO: 471281 - RNA, 32 nt, Human
gguuucugauaccuagcuccccaagcugacug

SEQ ID NO: 471282 - RNA, 32 nt, Human
gguuucugauuagucucuccaaaggaggcaau

SEQ ID NO: 471283 - RNA, 32 nt, Human
gguuucugcaauauuuuucuuauguccacccu

SEQ ID NO: 471284 - RNA, 32 nt, Human
gguuucugccuaccacuuccuccccuaccacc

SEQ ID NO: 471285 - RNA, 32 nt, Human
gguuucuggccaaacacauucaagcucacauu

SEQ ID NO: 471286 - RNA, 32 nt, Human
gguuucuggggaggcagagaggcagggacuuu

SEQ ID NO: 471287 - RNA, 32 nt, Human
gguuucuggggccucaggguucugggaaagca

SEQ ID NO: 471288 - RNA, 32 nt, Human
gguuucuguccuugguucuguccuccuuagca

SEQ ID NO: 471289 - RNA, 32 nt, Human
gguuucuguucagcucuuuucaguuaacagau

SEQ ID NO: 471290 - RNA, 32 nt, Human
gguuucuuagauagcauuguggccaaauagcu

SEQ ID NO: 471291 - RNA, 32 nt, Human
gguuucuuccagagucaucuaccugaguccug

SEQ ID NO: 471292 - RNA, 32 nt, Human
gguuucuucccuuccuccugcacaaucgcuuc

SEQ ID NO: 471293 - RNA, 32 nt, Human
gguuucuuccucacguggcuuuuucuuccaug

SEQ ID NO: 471294 - RNA, 32 nt, Human
gguuucuucuuagaucacuccucugccaaaga

SEQ ID NO: 471295 - RNA, 32 nt, Human
gguuucuugggagucgggcagggaccugcagg

SEQ ID NO: 471296 - RNA, 32 nt, Human
gguuucuuggggucccagggaugaggaaucgc

SEQ ID NO: 471297 - RNA, 32 nt, Human
gguuucuugguauugcgcguuucucuuccuug

SEQ ID NO: 471298 - RNA, 32 nt, Human
gguuucuuguugcacugugauacacaugaagc

SEQ ID NO: 471299 - RNA, 19 nt, Human
gguuucuuuucuucacuca

SEQ ID NO: 471300 - RNA, 32 nt, Human
gguuucuuuuuauuuguguaaaggagguuaag

SEQ ID NO: 471301 - RNA, 32 nt, Human
gguuugaaagccucuggaaaacucaggauucu

SEQ ID NO: 471302 - RNA, 32 nt, Human
gguuugaagacugcuucauucugccucuagua

SEQ ID NO: 471303 - RNA, 32 nt, Human
gguuugaagggcagucuucucuggcuuguuuu

SEQ ID NO: 471304 - RNA, 19 nt, Human
gguuugacagagaaaagac

SEQ ID NO: 471305 - RNA, 32 nt, Human
gguuugagacgucaaucaccacugagaaagaa

SEQ ID NO: 471306 - RNA, 32 nt, Human
gguuugagagagcagccaggagagcuuagggu

SEQ ID NO: 471307 - RNA, 32 nt, Human
gguuugagagcaucauggggcagacagauggu

SEQ ID NO: 471308 - RNA, 32 nt, Human
gguuugagcugcugaagagggagcccuugcau

SEQ ID NO: 471309 - RNA, 24 nt, Human
gguuugaggaauuguccugccuca

SEQ ID NO: 471310 - RNA, 32 nt, Human
gguuugaggagaaagggccuacucauuugcaa

SEQ ID NO: 471311 - RNA, 32 nt, Human
gguuugaggccccacagcaacagaaguccagg

SEQ ID NO: 471312 - RNA, 32 nt, Human
gguuugaggcgggaauagucagcucugaucac

SEQ ID NO: 471313 - RNA, 32 nt, Human
gguuugaggucauagaucugguucuggaggac

SEQ ID NO: 471314 - RNA, 32 nt, Human
gguuugagucaaggcagggaaaacuuggguuu

SEQ ID NO: 471315 - RNA, 24 nt, Human
gguuugagugauucucaugccuca

SEQ ID NO: 471316 - RNA, 32 nt, Human
gguuugaguguucuucaucagcugaccuuaaa

SEQ ID NO: 471317 - RNA, 32 nt, Human
gguuugauaccacauuuaacauugacauuuaa

SEQ ID NO: 471318 - RNA, 32 nt, Human
gguuugaucccuggcaggucccucgagcagua

SEQ ID NO: 471319 - RNA, 32 nt, Human
gguuugaucuguggaugaaaugaaucaugauu

SEQ ID NO: 471320 - RNA, 32 nt, Human
gguuugcaaaggacugggaguuccugaggaag

SEQ ID NO: 471321 - RNA, 32 nt, Human
gguuugcaauccaagcaggaagaaggaaaaga

SEQ ID NO: 471322 - RNA, 31 nt, Human
gguuugcacagcuagaggccgcgcagcagca

SEQ ID NO: 471323 - RNA, 24 nt, Human
gguuugcaccauucuccugccuca

SEQ ID NO: 471324 - RNA, 32 nt, Human
gguuugcacugagaaauuagcauucaggccuu

SEQ ID NO: 471325 - RNA, 32 nt, Human
gguuugcagcaaguccagacaggaagcaauga

SEQ ID NO: 471326 - RNA, 32 nt, Human
gguuugcagcuccuugccagagcccagauucc

SEQ ID NO: 471327 - RNA, 23 nt, Human
gguuugcaggcgcuuuccucuug

SEQ ID NO: 471328 - RNA, 23 nt, Human
gguuugcagguugcugugccuga

SEQ ID NO: 471329 - RNA, 32 nt, Human
gguuugcaguugagaggggagggcaggagggg

SEQ ID NO: 471330 - RNA, 31 nt, Human
gguuugcaguuucacuccugaaaucagugua

SEQ ID NO: 471331 - RNA, 32 nt, Human
gguuugcaguuucacuccugaaaucaguguag

SEQ ID NO: 471332 - RNA, 32 nt, Human
gguuugcaguuuucacucaaguuuugcaugaa

SEQ ID NO: 471333 - RNA, 26 nt, Human
gguuugcauccaucaccaucacggcc

SEQ ID NO: 471334 - RNA, 32 nt, Human
gguuugccaccugagcccagggaucaggcagg

SEQ ID NO: 471335 - RNA, 32 nt, Human
gguuugccaucagggcccuguggcugggucug

SEQ ID NO: 471336 - RNA, 32 nt, Human
gguuugcccuccuaugaguggagggagggccu

SEQ ID NO: 471337 - RNA, 32 nt, Human
gguuugcgccuguaaucccagccacucgagaa

SEQ ID NO: 471338 - RNA, 21 nt, Human
gguuugcgucaucaucaggcc

SEQ ID NO: 471339 - RNA, 32 nt, Human
gguuugcucacagauggaggagaaggagcucu

SEQ ID NO: 471340 - RNA, 32 nt, Human
gguuugcucaguugagugucagcuguguaugu

SEQ ID NO: 471341 - RNA, 32 nt, Human
gguuugcuccuuggauuccccuucccacucca

SEQ ID NO: 471342 - RNA, 32 nt, Human
gguuugcucuucagucaucuagccacuaaaug

SEQ ID NO: 471343 - RNA, 32 nt, Human
gguuugcugauggggacuuggaugccgugcug

SEQ ID NO: 471344 - RNA, 32 nt, Human
gguuugcuuaaaggagcuuggcugguuugggc

SEQ ID NO: 471345 - RNA, 32 nt, Human
gguuugcuuuccauaucugaucuuuaauccac

SEQ ID NO: 471346 - RNA, 32 nt, Human
gguuugcuuucuuuaccauaagcaaucccuug

SEQ ID NO: 471347 - RNA, 20 nt, Human
gguuugcuuucuuuuaguua

SEQ ID NO: 471348 - RNA, 32 nt, Human
gguuugcuuuggcucacucgcuuuuuacaaac

SEQ ID NO: 471349 - RNA, 18 nt, Human
gguuugcuuuuaucauua

SEQ ID NO: 471350 - RNA, 32 nt, Human
gguuugcuuuuuguuuugggggagaggauuua

SEQ ID NO: 471351 - RNA, 32 nt, Human
gguuuggaccugggucacuagagcagagccuc

SEQ ID NO: 471352 - RNA, 32 nt, Human
gguuuggagagcuguaucuguugggccuuggg

SEQ ID NO: 471353 - RNA, 32 nt, Human
gguuuggaggcaaggcggaggggccagggugg

SEQ ID NO: 471354 - RNA, 32 nt, Human
gguuuggaggggauugggggauagugggacag

SEQ ID NO: 471355 - RNA, 32 nt, Human
gguuuggagugacaaugguagguuucuucucu

SEQ ID NO: 471356 - RNA, 32 nt, Human
gguuuggauuuucaagagaugauugggcuucu

SEQ ID NO: 471357 - RNA, 32 nt, Human
gguuuggcaaaggcagaacaaauaucccauau

SEQ ID NO: 471358 - RNA, 32 nt, Human
gguuuggcagugccccucagagcccaggccug

SEQ ID NO: 471359 - RNA, 18 nt, Human
gguuuggccaguuucuaa

SEQ ID NO: 471360 - RNA, 24 nt, Human
gguuuggcccaaguuucuaaggga

SEQ ID NO: 471361 - RNA, 22 nt, Human
gguuuggcccccagggcuccua

SEQ ID NO: 471362 - RNA, 21 nt, Human
gguuuggccucaggagaguca

SEQ ID NO: 471363 - RNA, 32 nt, Human
gguuuggccuccauccucaucucucuugggcc

SEQ ID NO: 471364 - RNA, 32 nt, Human
gguuuggcuacggaggcugggugcagcuccaa

SEQ ID NO: 471365 - RNA, 32 nt, Human
gguuuggcuccucuguguguguccguaucuug

SEQ ID NO: 471366 - RNA, 32 nt, Human
gguuuggcuuccuucucacauuucuuuagcuu

SEQ ID NO: 471367 - RNA, 22 nt, Human
gguuugggaagguccuggggca

SEQ ID NO: 471368 - RNA, 32 nt, Human
gguuugggagagaggagcaugcgcgagagagu

SEQ ID NO: 471369 - RNA, 32 nt, Human
gguuugggagagaguagggaagccacagcugc

SEQ ID NO: 471370 - RNA, 32 nt, Human
gguuugggagagauagugagggccugucaaag

SEQ ID NO: 471371 - RNA, 32 nt, Human
gguuugggaggcaaaaaucuaugaaggguuuu

SEQ ID NO: 471372 - RNA, 32 nt, Human
gguuugggcauuuaagaauggcaaacacucgg

SEQ ID NO: 471373 - RNA, 32 nt, Human
gguuuggggaaaggaaggcuggcuuggcgaga

SEQ ID NO: 471374 - RNA, 32 nt, Human
gguuuggggaaaggggaagcaggggcauaguc

SEQ ID NO: 471375 - RNA, 32 nt, Human
gguuuggggaagccucucagaggaggaggagc

SEQ ID NO: 471376 - RNA, 25 nt, Human
gguuuggggaaguguuucuaggaga

SEQ ID NO: 471377 - RNA, 32 nt, Human
gguuuggggcgaauguccugaggcagagaugg

SEQ ID NO: 471378 - RNA, 32 nt, Human
gguuuggggcuuccacauauccuguucucaag

SEQ ID NO: 471379 - RNA, 32 nt, Human
gguuugggggagaagaaguagggguggcccga

SEQ ID NO: 471380 - RNA, 21 nt, Human
gguuugggggaugccugggac

SEQ ID NO: 471381 - RNA, 32 nt, Human
gguuuggggguugaggccccuugagaagcuca

SEQ ID NO: 471382 - RNA, 32 nt, Human
gguuugggugggggcuguggcccugcccuugg

SEQ ID NO: 471383 - RNA, 32 nt, Human
gguuugggugugagauuucagagccccaggua

SEQ ID NO: 471384 - RNA, 32 nt, Human
gguuuggguuaguggcugcuggcguuuuggcc

SEQ ID NO: 471385 - RNA, 32 nt, Human
gguuugguaugggacaugcacacacacucaca

SEQ ID NO: 471386 - RNA, 32 nt, Human
gguuuggucaucugacuaaguucuagccaaag

SEQ ID NO: 471387 - RNA, 32 nt, Human
gguuuggugcaguuuccagggugcaguacagc

SEQ ID NO: 471388 - RNA, 23 nt, Human
gguuugguggugguggcggugua

SEQ ID NO: 471389 - RNA, 32 nt, Human
gguuugguguugagucucucuccugcugccua

SEQ ID NO: 471390 - RNA, 32 nt, Human
gguuugguuccugaccuaggcuugggaagaca

SEQ ID NO: 471391 - RNA, 24 nt, Human
gguuugguuuccagaccugaggca

SEQ ID NO: 471392 - RNA, 32 nt, Human
gguuugguuuugucuaggcagccucuggccag

SEQ ID NO: 471393 - RNA, 19 nt, Human
gguuugguuuuuauuauua

SEQ ID NO: 471394 - RNA, 32 nt, Human
gguuuguagccaucuggccagucgcugggugc

SEQ ID NO: 471395 - RNA, 22 nt, Human
gguuuguauguucucucuguca

SEQ ID NO: 471396 - RNA, 17 nt, Human
gguuugucugcccauua

SEQ ID NO: 471397 - RNA, 32 nt, Human
gguuugucugucccugacuucugccucugaga

SEQ ID NO: 471398 - RNA, 18 nt, Human
gguuugucuguguccuca

SEQ ID NO: 471399 - RNA, 32 nt, Human
gguuugucuuccaggacaagucauucuacaac

SEQ ID NO: 471400 - RNA, 18 nt, Human
gguuugucuuccccacca

SEQ ID NO: 471401 - RNA, 32 nt, Human
gguuugucuucugugugccuguguccucaucu

SEQ ID NO: 471402 - RNA, 17 nt, Human
gguuugugcaggggggc

SEQ ID NO: 471403 - RNA, 32 nt, Human
gguuugugcugagcuggcugcagccgcucuca

SEQ ID NO: 471404 - RNA, 29 nt, Human
gguuuguggcugugugugugacugugagu

SEQ ID NO: 471405 - RNA, 32 nt, Human
gguuugugggaccugggcugaugucugaugaa

SEQ ID NO: 471406 - RNA, 32 nt, Human
gguuuguguggaccccgaguuccaccagguga

SEQ ID NO: 471407 - RNA, 32 nt, Human
gguuuguguguguauauagugucugugugugu

SEQ ID NO: 471408 - RNA, 32 nt, Human
gguuuguguugacuuaacauugaguucaagcc

SEQ ID NO: 471409 - RNA, 24 nt, Human
gguuuguguuugccuugccuggug

SEQ ID NO: 471410 - RNA, 19 nt, Human
gguuuguuaguugccauua

SEQ ID NO: 471411 - RNA, 18 nt, Human
gguuuguugacuaccauu

SEQ ID NO: 471412 - RNA, 32 nt, Human
gguuuguugagguggaggaacagaagugaaau

SEQ ID NO: 471413 - RNA, 32 nt, Human
gguuuguuguuuguuuggauuacuugaaaacc

SEQ ID NO: 471414 - RNA, 32 nt, Human
gguuuguuucucaagcgcuauccacagaaccu

SEQ ID NO: 471415 - RNA, 32 nt, Human
gguuuguuucuggggagcucuuaauuucuauu

SEQ ID NO: 471416 - RNA, 32 nt, Human
gguuuguuuggaugguggagggagacagggcc

SEQ ID NO: 471417 - RNA, 20 nt, Human
gguuuguuuucuuucauuua

SEQ ID NO: 471418 - RNA, 22 nt, Human
gguuuguuuuugguuauuauca

SEQ ID NO: 471419 - RNA, 18 nt, Human
gguuuguuuuuucauuca

SEQ ID NO: 471420 - RNA, 32 nt, Human
gguuuuaaaaaccaaaccaauaaaauuuuuau

SEQ ID NO: 471421 - RNA, 30 nt, Human
gguuuuaacuugcaauacggaaaagacauu

SEQ ID NO: 471422 - RNA, 32 nt, Human
gguuuuaagaccucugcuuucucacuuugaag

SEQ ID NO: 471423 - RNA, 32 nt, Human
gguuuuaagucauucauuuccaaaucauuuuu

SEQ ID NO: 471424 - RNA, 32 nt, Human
gguuuuacaauagugauguuauccugaggagc

SEQ ID NO: 471425 - RNA, 32 nt, Human
gguuuuacacagagaaauacaaaauaaagauc

SEQ ID NO: 471426 - RNA, 32 nt, Human
gguuuuaccacugcacgaccaucuggcucucc

SEQ ID NO: 471427 - RNA, 32 nt, Human
gguuuuaccauguuggccagagugguuuugaa

SEQ ID NO: 471428 - RNA, 32 nt, Human
gguuuuacuaugcuguccagacuggucuuaaa

SEQ ID NO: 471429 - RNA, 32 nt, Human
gguuuuacugguuuuaaaaauugaugcauugg

SEQ ID NO: 471430 - RNA, 32 nt, Human
gguuuuacugguuuuaauaguacucuggaagg

SEQ ID NO: 471431 - RNA, 32 nt, Human
gguuuuagagguuucaaaucugugaacuuugg

SEQ ID NO: 471432 - RNA, 32 nt, Human
gguuuuagagugagagaaugaagggggugagg

SEQ ID NO: 471433 - RNA, 32 nt, Human
gguuuuagcccaaacucugcuucuaugguagg

SEQ ID NO: 471434 - RNA, 32 nt, Human
gguuuuaggcggggcuuaucuggcauccacca

SEQ ID NO: 471435 - RNA, 32 nt, Human
gguuuuaguagagacaggguuucuccauguug

SEQ ID NO: 471436 - RNA, 32 nt, Human
gguuuuaguagagacuuggccucccagaaccc

SEQ ID NO: 471437 - RNA, 32 nt, Human
gguuuuagugcagcuucugccguuaacuaggu

SEQ ID NO: 471438 - RNA, 24 nt, Human
gguuuuaguguguguaugugugaa

SEQ ID NO: 471439 - RNA, 32 nt, Human
gguuuuauggcuaaaacauuucuccagauuaa

SEQ ID NO: 471440 - RNA, 32 nt, Human
gguuuuauucaggguuuucacuguggacagaa

SEQ ID NO: 471441 - RNA, 32 nt, Human
gguuuuauugaaugucuauuugaguaucauuu

SEQ ID NO: 471442 - RNA, 32 nt, Human
gguuuuauuucagggcccuuuucaagaugccc

SEQ ID NO: 471443 - RNA, 22 nt, Human
gguuuuauuuugguucuuucca

SEQ ID NO: 471444 - RNA, 32 nt, Human
gguuuucaaagcaguuaucuugggaaacuguu

SEQ ID NO: 471445 - RNA, 24 nt, Human
gguuuucaagcaauucuccugccu

SEQ ID NO: 471446 - RNA, 26 nt, Human
gguuuucaagcaauucuccugccuca

SEQ ID NO: 471447 - RNA, 32 nt, Human
gguuuucaagccuucaaguugaaugagucuua

SEQ ID NO: 471448 - RNA, 32 nt, Human
gguuuucacugucucugucucaucuaguaccu

SEQ ID NO: 471449 - RNA, 32 nt, Human
gguuuucaucuauuuccuggcuuauaacuccc

SEQ ID NO: 471450 - RNA, 32 nt, Human
gguuuucauuguuccccgccuccugcgacucg

SEQ ID NO: 471451 - RNA, 32 nt, Human
gguuuuccaaagagcugggauuacaggcauga

SEQ ID NO: 471452 - RNA, 32 nt, Human
gguuuuccaauacacaagugcuagaaaauaca

SEQ ID NO: 471453 - RNA, 32 nt, Human
gguuuuccacgcuagggcggggcacagauugg

SEQ ID NO: 471454 - RNA, 32 nt, Human
gguuuuccauucuuaacugucuccuuauaccu

SEQ ID NO: 471455 - RNA, 18 nt, Human
gguuuucccacugcugcc

SEQ ID NO: 471456 - RNA, 19 nt, Human
gguuuucccuacugcugcc

SEQ ID NO: 471457 - RNA, 32 nt, Human
gguuuucccuacugcugccugaucccucggcu

SEQ ID NO: 471458 - RNA, 32 nt, Human
gguuuuccuagcuccauaccacacaccuaaac

SEQ ID NO: 471459 - RNA, 32 nt, Human
gguuuuccucaaggaacauuuuugagcuagaa

SEQ ID NO: 471460 - RNA, 22 nt, Human
gguuuuccugcccagccugcca

SEQ ID NO: 471461 - RNA, 28 nt, Human
gguuuuccugggacagcuggagcugugu

SEQ ID NO: 471462 - RNA, 32 nt, Human
gguuuuccuuaugaacaaaccuuacaggguaa

SEQ ID NO: 471463 - RNA, 19 nt, Human
gguuuuccuuuuucacuca

SEQ ID NO: 471464 - RNA, 32 nt, Human
gguuuucuagaaaguuguuacauaucauggcu

SEQ ID NO: 471465 - RNA, 25 nt, Human
gguuuucucaaagccacacagcaag

SEQ ID NO: 471466 - RNA, 32 nt, Human
gguuuucucccagaagagggucugccuugaga

SEQ ID NO: 471467 - RNA, 32 nt, Human
gguuuucuccuugguccugcaguaggauggga

SEQ ID NO: 471468 - RNA, 32 nt, Human
gguuuucucuucguuccagauaccaaauaaau

SEQ ID NO: 471469 - RNA, 32 nt, Human
gguuuucugaaacuccagcuucaugugacccu

SEQ ID NO: 471470 - RNA, 32 nt, Human
gguuuucuggugucuuuugaaaaauccaaaga

SEQ ID NO: 471471 - RNA, 32 nt, Human
gguuuucuguaacugaagccagugccacuucc

SEQ ID NO: 471472 - RNA, 32 nt, Human
gguuuucuucacugccaggaguagugagcugu

SEQ ID NO: 471473 - RNA, 32 nt, Human
gguuuucuucccaucacuggagcaccaggcac

SEQ ID NO: 471474 - RNA, 32 nt, Human
gguuuucuucuuucuccuuuaagcacuuacau

SEQ ID NO: 471475 - RNA, 32 nt, Human
gguuuucuugaccugccugccugcucuugaga

SEQ ID NO: 471476 - RNA, 32 nt, Human
gguuuucuugguaaaucuaaaaagcaaaaaua

SEQ ID NO: 471477 - RNA, 32 nt, Human
gguuuucuuguggggagguuacagaggcugac

SEQ ID NO: 471478 - RNA, 22 nt, Human
gguuuucuuuacaaccauggcc

SEQ ID NO: 471479 - RNA, 32 nt, Human
gguuuugaaaucucagcuauaaaagacaucca

SEQ ID NO: 471480 - RNA, 32 nt, Human
gguuuugaagcagcauugaaacuuuuguagca

SEQ ID NO: 471481 - RNA, 32 nt, Human
gguuuugacucuuccagcacccauggaugugc

SEQ ID NO: 471482 - RNA, 32 nt, Human
gguuuugacuuuuucuguugaaugaacaacug

SEQ ID NO: 471483 - RNA, 32 nt, Human
gguuuugagccccuccucugcagggaaugcuu

SEQ ID NO: 471484 - RNA, 32 nt, Human
gguuuugaugcuugggggaucauagaguauuu

SEQ ID NO: 471485 - RNA, 32 nt, Human
gguuuugauucugccacgagccagcuguguga

SEQ ID NO: 471486 - RNA, 32 nt, Human
gguuuugcaggucacuguuccacccaccuggg

SEQ ID NO: 471487 - RNA, 32 nt, Human
gguuuugccaagaaugacacuguaaauauaac

SEQ ID NO: 471488 - RNA, 32 nt, Human
gguuuugccaagaaugacacuguaaauguaac

SEQ ID NO: 471489 - RNA, 32 nt, Human
gguuuugccacauugcccaggauggccuugaa

SEQ ID NO: 471490 - RNA, 32 nt, Human
gguuuugcgauguugcccaggcuggucucaaa

SEQ ID NO: 471491 - RNA, 32 nt, Human
gguuuugcugccaugcauccugggcgaacuac

SEQ ID NO: 471492 - RNA, 32 nt, Human
gguuuugcuuguauuuuccuccagagauuuug

SEQ ID NO: 471493 - RNA, 32 nt, Human
gguuuuggaacucaaggccucugacaaugcca

SEQ ID NO: 471494 - RNA, 32 nt, Human
gguuuuggaauuacaggugugagccaccaugc

SEQ ID NO: 471495 - RNA, 19 nt, Human
gguuuuggaggaagaagac

SEQ ID NO: 471496 - RNA, 32 nt, Human
gguuuuggccacuacaacugcagaguugaaua

SEQ ID NO: 471497 - RNA, 32 nt, Human
gguuuugggggcaccuuccagaagguacaggu

SEQ ID NO: 471498 - RNA, 32 nt, Human
gguuuugggguccugggcuggggccacauccc

SEQ ID NO: 471499 - RNA, 32 nt, Human
gguuuugggguuuuuuguagugccuuuuguuu

SEQ ID NO: 471500 - RNA, 32 nt, Human
gguuuuggguuggaguucuuguuuuccucugu

SEQ ID NO: 471501 - RNA, 32 nt, Human
gguuuuggugacucugugcccuugcucucuaa

SEQ ID NO: 471502 - RNA, 31 nt, Human
gguuuuggugagagauaauauugauugaagg

SEQ ID NO: 471503 - RNA, 29 nt, Human
gguuuugugcagugugugccugggaggcg

SEQ ID NO: 471504 - RNA, 32 nt, Human
gguuuuguggggaucacugagaugaggcacgg

SEQ ID NO: 471505 - RNA, 32 nt, Human
gguuuuguguuagucuuccugcagcugagcuu

SEQ ID NO: 471506 - RNA, 22 nt, Human
gguuuuguucauauuuucucca

SEQ ID NO: 471507 - RNA, 32 nt, Human
gguuuuguuccuuuuuguggcugcaaaguuuu

SEQ ID NO: 471508 - RNA, 23 nt, Human
gguuuuguucugaguuauuucua

SEQ ID NO: 471509 - RNA, 32 nt, Human
gguuuuguucuggccuucuguacugaucugug

SEQ ID NO: 471510 - RNA, 32 nt, Human
gguuuuguuguuguuguuuuucaaacuaagaa

SEQ ID NO: 471511 - RNA, 32 nt, Human
gguuuuguuuacccuacuccccaaaucccuga

SEQ ID NO: 471512 - RNA, 32 nt, Human
gguuuuguuucugccucaaagcauuuugaagu

SEQ ID NO: 471513 - RNA, 26 nt, Human
gguuuuguuuuguuuucauuuuucca

SEQ ID NO: 471514 - RNA, 32 nt, Human
gguuuuguuuuuaauacuacuuuuuaaaagga

SEQ ID NO: 471515 - RNA, 23 nt, Human
gguuuuguuuuuaucuuguuuuc

SEQ ID NO: 471516 - RNA, 22 nt, Human
gguuuuguuuuuguuuuugcca

SEQ ID NO: 471517 - RNA, 32 nt, Human
gguuuuuaagaaaacaaaguguucuuuuuauu

SEQ ID NO: 471518 - RNA, 32 nt, Human
gguuuuuaaugucuuguggaaauuugcagagg

SEQ ID NO: 471519 - RNA, 32 nt, Human
gguuuuuaauuuaaaauaggagggccccagau

SEQ ID NO: 471520 - RNA, 32 nt, Human
gguuuuuacuauugaacccuuguacuuugccu

SEQ ID NO: 471521 - RNA, 32 nt, Human
gguuuuuaguuuuaucuacucuucuauugaag

SEQ ID NO: 471522 - RNA, 21 nt, Human
gguuuuuaguuuuuaccauca

SEQ ID NO: 471523 - RNA, 32 nt, Human
gguuuuuauaaauuucucaauuuggggacaag

SEQ ID NO: 471524 - RNA, 32 nt, Human
gguuuuuaucacuuguaaagacaugcagaugg

SEQ ID NO: 471525 - RNA, 32 nt, Human
gguuuuuauuucauuuuggcucugucauuuuc

SEQ ID NO: 471526 - RNA, 32 nt, Human
gguuuuucaagcaaauucugauaccaaccucu

SEQ ID NO: 471527 - RNA, 32 nt, Human
gguuuuuccacuucauuuugugacuuugugug

SEQ ID NO: 471528 - RNA, 32 nt, Human
gguuuuucuauggaaaguucugauacagcugg

SEQ ID NO: 471529 - RNA, 32 nt, Human
gguuuuucucccuuucugugcuugccaauagu

SEQ ID NO: 471530 - RNA, 32 nt, Human
gguuuuucucuagcuuuuugccagaacaaagg

SEQ ID NO: 471531 - RNA, 32 nt, Human
gguuuuucucucaugguagcucuccaacagca

SEQ ID NO: 471532 - RNA, 32 nt, Human
gguuuuucugaacuuuugccucugcggaauca

SEQ ID NO: 471533 - RNA, 32 nt, Human
gguuuuucugcagcuauuuucuagcauuugcc

SEQ ID NO: 471534 - RNA, 32 nt, Human
gguuuuucuuucucccugauggacagacccaa

SEQ ID NO: 471535 - RNA, 32 nt, Human
gguuuuucuuuuauuuucuaagaagguugaag

SEQ ID NO: 471536 - RNA, 32 nt, Human
gguuuuucuuuuccuuuuuaauuuuucuucuu

SEQ ID NO: 471537 - RNA, 32 nt, Human
gguuuuugacccuggaugucagaguugaucua

SEQ ID NO: 471538 - RNA, 32 nt, Human
gguuuuuggcuguuucucaucaucucauggaa

SEQ ID NO: 471539 - RNA, 32 nt, Human
  misc_feature (2)..(4): n is a, c, g or u
gnnncacgccuguaaucccagcacuuugggag

SEQ ID NO: 471540 - RNA, 32 nt, Human
  misc_feature (2)..(2): n is a, c, g or u
  misc_feature (5)..(5): n is a, c, g or u
gnuanuacuaugugcaggaacccuuggucaca

SEQ ID NO: 471541 - RNA, 32 nt, Human
guaaaaacaacaacaacaaaacaccucuguca

SEQ ID NO: 471542 - RNA, 32 nt, Human
guaaaaacaagaaaccauccacucuguauauu

SEQ ID NO: 471543 - RNA, 32 nt, Human
guaaaaacaaguuugaaaugcauuuuggggua

SEQ ID NO: 471544 - RNA, 32 nt, Human
guaaaaacuaccaagagaacacgaggaaggca

SEQ ID NO: 471545 - RNA, 32 nt, Human
guaaaaagcagagcaaaugcauggacaguggg

SEQ ID NO: 471546 - RNA, 32 nt, Human
guaaaaagcagcuuuggaaacugugaaugauc

SEQ ID NO: 471547 - RNA, 32 nt, Human
guaaaaagcaggaacuccuacuuuuucuuuau

SEQ ID NO: 471548 - RNA, 21 nt, Human
guaaaaaguaaugaauccuga

SEQ ID NO: 471549 - RNA, 32 nt, Human
guaaaaaguacacuuuaaaauauuuuaaucag

SEQ ID NO: 471550 - RNA, 25 nt, Human
guaaaaaguauuuuuucaaguugua

SEQ ID NO: 471551 - RNA, 32 nt, Human
guaaaaagugccacccacggaggcaggacaca

SEQ ID NO: 471552 - RNA, 32 nt, Human
guaaaaauacaaaaauuagcugggcacggugg

SEQ ID NO: 471553 - RNA, 32 nt, Human
guaaaaauacaaaaauuagcugggcguggcgg

SEQ ID NO: 471554 - RNA, 32 nt, Human
guaaaaaucucucauuuguguggagucauuuc

SEQ ID NO: 471555 - RNA, 32 nt, Human
guaaaaaugagaacauguuaguauuuaucuau

SEQ ID NO: 471556 - RNA, 32 nt, Human
guaaaaauguguuugcuugagaaaagcaaaaa

SEQ ID NO: 471557 - RNA, 32 nt, Human
guaaaaauucccccaagagccgcauaugaauc

SEQ ID NO: 471558 - RNA, 32 nt, Human
guaaaaauuuggacccuuaucaugcauacccc

SEQ ID NO: 471559 - RNA, 32 nt, Human
guaaaacacaaaccccgcucuccauaaugaga

SEQ ID NO: 471560 - RNA, 32 nt, Human
guaaaacacuguaguuacaagaucucauuuaa

SEQ ID NO: 471561 - RNA, 32 nt, Human
guaaaacagaagccacacuguauuccagauga

SEQ ID NO: 471562 - RNA, 32 nt, Human
guaaaacagaucuuuuauguaagaaaaauaca

SEQ ID NO: 471563 - RNA, 32 nt, Human
guaaaacagcugggagcagugggagcuguggc

SEQ ID NO: 471564 - RNA, 32 nt, Human
guaaaacauucugcuuucuuagucuuaccuag

SEQ ID NO: 471565 - RNA, 32 nt, Human
guaaaacauugaguccccucccugccuugguu

SEQ ID NO: 471566 - RNA, 32 nt, Human
guaaaacauuugguacaguaugugacacauag

SEQ ID NO: 471567 - RNA, 32 nt, Human
guaaaacccaagacauuaaaucugccaucuca

SEQ ID NO: 471568 - RNA, 32 nt, Human
guaaaacccaggaggcagagcuugcagugagc

SEQ ID NO: 471569 - RNA, 32 nt, Human
guaaaacggggacagucccugccccucccuac

SEQ ID NO: 471570 - RNA, 32 nt, Human
guaaaacuaaggcuucagccauaauauggagg

SEQ ID NO: 471571 - RNA, 32 nt, Human
guaaaacucuaucauccagaacagagaucuua

SEQ ID NO: 471572 - RNA, 32 nt, Human
guaaaacucucaucucauuuuacauugauauu

SEQ ID NO: 471573 - RNA, 32 nt, Human
guaaaacucugcaacucuaggaauucuaagau

SEQ ID NO: 471574 - RNA, 32 nt, Human
guaaaacugcaacacugugacuucuuaaauga

SEQ ID NO: 471575 - RNA, 32 nt, Human
guaaaacugguaaaggaaguaucagaacgguu

SEQ ID NO: 471576 - RNA, 32 nt, Human
guaaaagaaaggcauuggggacaaaugaaaga

SEQ ID NO: 471577 - RNA, 32 nt, Human
guaaaagaagcagcuacaucaugcuuuuagug

SEQ ID NO: 471578 - RNA, 32 nt, Human
guaaaagaagguguauuuguguggacaagaug

SEQ ID NO: 471579 - RNA, 32 nt, Human
guaaaagacccaaccccagcagaaagacaccg

SEQ ID NO: 471580 - RNA, 32 nt, Human
guaaaagacggcuaguuggccuccucauuuua

SEQ ID NO: 471581 - RNA, 32 nt, Human
guaaaagaugacgcuugauaucuccggagcau

SEQ ID NO: 471582 - RNA, 32 nt, Human
guaaaagcaaaaagcuuuuacaaaacacagcc

SEQ ID NO: 471583 - RNA, 32 nt, Human
guaaaagcaaaggagguggggagcaggagaga

SEQ ID NO: 471584 - RNA, 32 nt, Human
guaaaagcauuuucauucucuuagaaauucaa

SEQ ID NO: 471585 - RNA, 32 nt, Human
guaaaagcauuuuccacagauuguuaucaccu

SEQ ID NO: 471586 - RNA, 32 nt, Human
guaaaagcccccgagaccucccagaagccaag

SEQ ID NO: 471587 - RNA, 32 nt, Human
guaaaagcccuccugaguucaugggcuguacc

SEQ ID NO: 471588 - RNA, 32 nt, Human
guaaaagcccucuuuucuguuuucagguuuuu

SEQ ID NO: 471589 - RNA, 25 nt, Human
guaaaagcuaugguaaccacuaccc

SEQ ID NO: 471590 - RNA, 32 nt, Human
guaaaagggagagagggagggaggaaggaagg

SEQ ID NO: 471591 - RNA, 32 nt, Human
guaaaagggcauucaucauugugccucauauc

SEQ ID NO: 471592 - RNA, 32 nt, Human
guaaaaggggcagcaggguagagcaggugaug

SEQ ID NO: 471593 - RNA, 32 nt, Human
guaaaagguacccuugccuuacuccaucuuau

SEQ ID NO: 471594 - RNA, 32 nt, Human
guaaaaggugaagccaagaacagcauuacuga

SEQ ID NO: 471595 - RNA, 31 nt, Human
guaaaaguacccauuguuucacuuccuggag

SEQ ID NO: 471596 - RNA, 32 nt, Human
guaaaagugccuggcagcuuggcugccgugga

SEQ ID NO: 471597 - RNA, 32 nt, Human
guaaaagugggguaaagauggguuuuuaauga

SEQ ID NO: 471598 - RNA, 32 nt, Human
guaaaaguuacugccuaugcuuuuuaccuuag

SEQ ID NO: 471599 - RNA, 32 nt, Human
guaaaaguucacaauaugguucaaauguaaca

SEQ ID NO: 471600 - RNA, 32 nt, Human
guaaaauaagguaagaaguaaauauguaaaag

SEQ ID NO: 471601 - RNA, 32 nt, Human
guaaaauaaugaagguagaaauuauaacacua

SEQ ID NO: 471602 - RNA, 32 nt, Human
guaaaauaggaccacuucucuucaucuacacu

SEQ ID NO: 471603 - RNA, 32 nt, Human
guaaaauagggcagugcccagcuggggaggua

SEQ ID NO: 471604 - RNA, 32 nt, Human
guaaaauaugaaaacuuaacucugcugugugu

SEQ ID NO: 471605 - RNA, 32 nt, Human
guaaaauauguaugaagaaaagguguacaaaa

SEQ ID NO: 471606 - RNA, 32 nt, Human
guaaaaucaacugauuguacauguguggguuc

SEQ ID NO: 471607 - RNA, 32 nt, Human
guaaaaucacuuuugaaaacaguuuggcaguu

SEQ ID NO: 471608 - RNA, 32 nt, Human
guaaaaucccagaggaauccaaagcccucucu

SEQ ID NO: 471609 - RNA, 32 nt, Human
guaaaaucucaccuccuaucuuuccuuucucu

SEQ ID NO: 471610 - RNA, 32 nt, Human
guaaaaucucuacucuuccugagaguuuugag

SEQ ID NO: 471611 - RNA, 32 nt, Human
guaaaaucucuucugucacacacagaugaacu

SEQ ID NO: 471612 - RNA, 32 nt, Human
guaaaaucuuucucaacccugcuuuucaucau

SEQ ID NO: 471613 - RNA, 32 nt, Human
guaaaaugaacugcaguggguucuccaaacua

SEQ ID NO: 471614 - RNA, 32 nt, Human
guaaaaugaagcagucuuaagagugacuaaua

SEQ ID NO: 471615 - RNA, 31 nt, Human
guaaaaugacuucuguuuucucaaaggccau

SEQ ID NO: 471616 - RNA, 32 nt, Human
guaaaaugccagaagcaggugaagagcaacca

SEQ ID NO: 471617 - RNA, 32 nt, Human
guaaaauggaccaaucagcaggaugugggugg

SEQ ID NO: 471618 - RNA, 32 nt, Human
guaaaauggaccagucagcaggaugugggcgg

SEQ ID NO: 471619 - RNA, 32 nt, Human
guaaaauggagaccaauugcacuaggcaagug

SEQ ID NO: 471620 - RNA, 32 nt, Human
guaaaaugggagaagguucgugggaggggccu

SEQ ID NO: 471621 - RNA, 32 nt, Human
guaaaaugggccaaucagcaggaugugggugg

SEQ ID NO: 471622 - RNA, 32 nt, Human
guaaaaugguaguuggcucuugugcucaauuu

SEQ ID NO: 471623 - RNA, 32 nt, Human
guaaaaugugcacaccugacuugcaauguugu

SEQ ID NO: 471624 - RNA, 32 nt, Human
guaaaauguuacuguccaauguuggauuauug

SEQ ID NO: 471625 - RNA, 32 nt, Human
guaaaauuagccacugcguggcuuuguguaua

SEQ ID NO: 471626 - RNA, 32 nt, Human
guaaaauuauuuuucaagcaaauguuuaaaau

SEQ ID NO: 471627 - RNA, 23 nt, Human
guaaaauucaaacugguacugua

SEQ ID NO: 471628 - RNA, 32 nt, Human
guaaaauucaauauuuuuauauucccagaaau

SEQ ID NO: 471629 - RNA, 32 nt, Human
guaaaauucccuagcucucugcacugagcuga

SEQ ID NO: 471630 - RNA, 32 nt, Human
guaaaauuugccacacacccagccugaaguuc

SEQ ID NO: 471631 - RNA, 32 nt, Human
guaaaauuuuccuguccacugugaaucaaagc

SEQ ID NO: 471632 - RNA, 32 nt, Human
guaaacaaaaggaguuugugaccaacuauguu

SEQ ID NO: 471633 - RNA, 32 nt, Human
guaaacaaccugcucagggcucuggugaacaa

SEQ ID NO: 471634 - RNA, 32 nt, Human
guaaacacaugagccauucggcaccaaacaca

SEQ ID NO: 471635 - RNA, 32 nt, Human
guaaacaccagccuguugcuguacuuuucugc

SEQ ID NO: 471636 - RNA, 32 nt, Human
guaaacacuuggaaaugguggugcuuuaaaaa

SEQ ID NO: 471637 - RNA, 32 nt, Human
guaaacagacaggcucuggcagugcagaucug

SEQ ID NO: 471638 - RNA, 32 nt, Human
guaaacagagacaguuugauuuccugucuauu

SEQ ID NO: 471639 - RNA, 32 nt, Human
guaaacaggaaggaaggaggccaucuguucaa

SEQ ID NO: 471640 - RNA, 32 nt, Human
guaaacaggcucaucucugaguucucaggacc

SEQ ID NO: 471641 - RNA, 32 nt, Human
guaaacaguucauccaugaucucacuuaacca

SEQ ID NO: 471642 - RNA, 32 nt, Human
guaaacaguucugcacucuuguacaaaagaaa

SEQ ID NO: 471643 - RNA, 32 nt, Human
guaaacaguuugaaaagacaaaugggccugcc

SEQ ID NO: 471644 - RNA, 32 nt, Human
guaaacaguuuuuguuucugauaguaauggac

SEQ ID NO: 471645 - RNA, 32 nt, Human
guaaacauacagauuccuaauucuaugacagu

SEQ ID NO: 471646 - RNA, 32 nt, Human
guaaacaugaauguucaggaacuacugaugua

SEQ ID NO: 471647 - RNA, 32 nt, Human
guaaacauuuugcucaauaucauuguauuuug

SEQ ID NO: 471648 - RNA, 32 nt, Human
guaaaccaggagacacagaagacguaccagau

SEQ ID NO: 471649 - RNA, 32 nt, Human
guaaacccacugggcaccacagaggcagaagg

SEQ ID NO: 471650 - RNA, 32 nt, Human
guaaacccagcacuuugggagacugaggaggg

SEQ ID NO: 471651 - RNA, 32 nt, Human
guaaaccccaacaacaucaagcacauuugucu

SEQ ID NO: 471652 - RNA, 32 nt, Human
guaaaccccaagaguaucugagacaaguguca

SEQ ID NO: 471653 - RNA, 32 nt, Human
guaaacccuucuuuggcuuuccuugcccauug

SEQ ID NO: 471654 - RNA, 32 nt, Human
guaaaccugcagccguuuugcacacccugguc

SEQ ID NO: 471655 - RNA, 32 nt, Human
guaaaccugggauguagagccgcauuccccca

SEQ ID NO: 471656 - RNA, 32 nt, Human
guaaacgccccagucccacccugcugcugcuc

SEQ ID NO: 471657 - RNA, 32 nt, Human
guaaacgccucagucucacccugcugcugcuc

SEQ ID NO: 471658 - RNA, 32 nt, Human
guaaacgcucacugccauucugcgaucauuau

SEQ ID NO: 471659 - RNA, 32 nt, Human
guaaacggaauggugccauuguacuucaugua

SEQ ID NO: 471660 - RNA, 32 nt, Human
guaaacgggggagggggcaaaagaccaugcua

SEQ ID NO: 471661 - RNA, 32 nt, Human
guaaacggguacagcucauucuuucugagaag

SEQ ID NO: 471662 - RNA, 32 nt, Human
guaaacguucgguggauccucugucuuuguaa

SEQ ID NO: 471663 - RNA, 32 nt, Human
guaaacguuugucguguacaagcucagagcuu

SEQ ID NO: 471664 - RNA, 32 nt, Human
guaaacuaaagaaagauaaaguauacuaaaaa

SEQ ID NO: 471665 - RNA, 32 nt, Human
guaaacuaagggugucaagccccauucccucu

SEQ ID NO: 471666 - RNA, 32 nt, Human
guaaacuacugcaacccucacauccucaaagg

SEQ ID NO: 471667 - RNA, 32 nt, Human
guaaacuaguucaaccauuguggaagucagug

SEQ ID NO: 471668 - RNA, 32 nt, Human
guaaacuaucucugccuucaaggagcuugcag

SEQ ID NO: 471669 - RNA, 32 nt, Human
guaaacucaaauaucaauauuuuaaauguccg

SEQ ID NO: 471670 - RNA, 32 nt, Human
guaaacucaauuugccucccuaccucacacaa

SEQ ID NO: 471671 - RNA, 32 nt, Human
guaaacucagcagauagagccaggcugcaucu

SEQ ID NO: 471672 - RNA, 32 nt, Human
guaaacuccucagccagcacccuggggugugg

SEQ ID NO: 471673 - RNA, 32 nt, Human
guaaacugaaaccuaagacacacgaagaaauu

SEQ ID NO: 471674 - RNA, 32 nt, Human
guaaacugagguaaugagagggggacacugau

SEQ ID NO: 471675 - RNA, 32 nt, Human
guaaacugccaagaaaggaaguucacuaauau

SEQ ID NO: 471676 - RNA, 30 nt, Human
guaaacugccuguccaugcucuuuguuuuu

SEQ ID NO: 471677 - RNA, 32 nt, Human
guaaacugguaaaaacagccauuuaaggcuuc

SEQ ID NO: 471678 - RNA, 32 nt, Human
guaaacuguggaccuugaaguuagcagcgugg

SEQ ID NO: 471679 - RNA, 32 nt, Human
guaaacuucucccagccuccgcccugcccuca

SEQ ID NO: 471680 - RNA, 32 nt, Human
guaaacuugugucaugggggcuuguuguacag

SEQ ID NO: 471681 - RNA, 32 nt, Human
guaaagaaaagagguuuaauugacucacaguu

SEQ ID NO: 471682 - RNA, 32 nt, Human
guaaagaaaagagguuuaauuggcucauggcu

SEQ ID NO: 471683 - RNA, 32 nt, Human
guaaagaaaauguaaaaauguaacuauagcau

SEQ ID NO: 471684 - RNA, 32 nt, Human
guaaagaaaauguaaaauugcugcuagucaaa

SEQ ID NO: 471685 - RNA, 32 nt, Human
guaaagaaaauuacuucugguauuuaggcugu

SEQ ID NO: 471686 - RNA, 32 nt, Human
guaaagaacacugccuuguuccccaucaguaa

SEQ ID NO: 471687 - RNA, 32 nt, Human
guaaagaacccaagguugagugcaacuggggu

SEQ ID NO: 471688 - RNA, 32 nt, Human
guaaagaagaaauguaguuuacauuuguauuu

SEQ ID NO: 471689 - RNA, 32 nt, Human
guaaagaagggaagcuuuguuugaaaauugua

SEQ ID NO: 471690 - RNA, 32 nt, Human
guaaagacaguucagagagaccuguugauuug

SEQ ID NO: 471691 - RNA, 32 nt, Human
guaaagacauuuccaugugcagcgaggaaaag

SEQ ID NO: 471692 - RNA, 32 nt, Human
guaaagacccuccaccaccccuauaaguuuga

SEQ ID NO: 471693 - RNA, 32 nt, Human
guaaagacgggggauuucaccauguuggccag

SEQ ID NO: 471694 - RNA, 32 nt, Human
guaaagacgggguuucgccuuguugcccaggg

SEQ ID NO: 471695 - RNA, 32 nt, Human
guaaagacugggaugguuguguggaaaacuuu

SEQ ID NO: 471696 - RNA, 32 nt, Human
guaaagagaacagcagguccuggacuaaagca

SEQ ID NO: 471697 - RNA, 32 nt, Human
guaaagagagagagccagcccagcccuguuuc

SEQ ID NO: 471698 - RNA, 32 nt, Human
guaaagaggggcuggaaauacgcugguugcug

SEQ ID NO: 471699 - RNA, 32 nt, Human
guaaagaucccaauguucuaccucucccuguc

SEQ ID NO: 471700 - RNA, 32 nt, Human
guaaagaucugaaauaaaaagaugcaucuuua

SEQ ID NO: 471701 - RNA, 16 nt, Human
guaaagauggcggaaa

SEQ ID NO: 471702 - RNA, 32 nt, Human
guaaagauguuggccuugaagcagaaaauuca

SEQ ID NO: 471703 - RNA, 32 nt, Human
guaaagcaagcaaccucugcuuacuugcccaa

SEQ ID NO: 471704 - RNA, 32 nt, Human
guaaagcacuauauucuuguuuguuaguccuu

SEQ ID NO: 471705 - RNA, 32 nt, Human
guaaagcagaucuguggauggggagccuacgg

SEQ ID NO: 471706 - RNA, 32 nt, Human
guaaagcagccugucgcuugccgggcagcugg

SEQ ID NO: 471707 - RNA, 32 nt, Human
guaaagcaggaaauggugugggagaugugaga

SEQ ID NO: 471708 - RNA, 32 nt, Human
guaaagccaagaggguuuagagagggauuugc

SEQ ID NO: 471709 - RNA, 32 nt, Human
guaaagccccucucccuucguucgaccaaccc

SEQ ID NO: 471710 - RNA, 32 nt, Human
guaaagcccuugauaccacgugcauugcaaag

SEQ ID NO: 471711 - RNA, 32 nt, Human
guaaagcgcuccagagccacauggacggagcu

SEQ ID NO: 471712 - RNA, 32 nt, Human
guaaagcuaccugaggcagugcgcuggaggau

SEQ ID NO: 471713 - RNA, 32 nt, Human
guaaagcucuacuuuccuacugcagccuucag

SEQ ID NO: 471714 - RNA, 32 nt, Human
guaaagcugcuugugaauuuucugagacggau

SEQ ID NO: 471715 - RNA, 32 nt, Human
guaaagcuggcuuucuggagucugccaggucc

SEQ ID NO: 471716 - RNA, 32 nt, Human
guaaagcuguugggggaagaagaguuuuugga

SEQ ID NO: 471717 - RNA, 32 nt, Human
guaaaggaaaugauugaggagugaggaaggca

SEQ ID NO: 471718 - RNA, 32 nt, Human
guaaaggaguggggcugcugcagccauucaga

SEQ ID NO: 471719 - RNA, 32 nt, Human
guaaaggaguuggggaaggaagagggcgagau

SEQ ID NO: 471720 - RNA, 31 nt, Human
guaaaggcaaugucuauuucagggauuguaa

SEQ ID NO: 471721 - RNA, 32 nt, Human
guaaaggccauggccaugcagaaaaucuuugc

SEQ ID NO: 471722 - RNA, 32 nt, Human
guaaaggcccccagucccugagacgggccagu

SEQ ID NO: 471723 - RNA, 32 nt, Human
guaaaggccugggagcuagacccuccccaagc

SEQ ID NO: 471724 - RNA, 32 nt, Human
guaaaggcuacacacacauauggagcacccca

SEQ ID NO: 471725 - RNA, 32 nt, Human
guaaagggagagaaguuggugcucaacgugag

SEQ ID NO: 471726 - RNA, 32 nt, Human
guaaagggaucagggcuucaguuauucuauau

SEQ ID NO: 471727 - RNA, 32 nt, Human
guaaagggaucauuucugugccaagcugcaca

SEQ ID NO: 471728 - RNA, 32 nt, Human
guaaaggggaacagaagccaagcaucagcuuc

SEQ ID NO: 471729 - RNA, 32 nt, Human
guaaagguguucaaauaaagggcuguuucuac

SEQ ID NO: 471730 - RNA, 32 nt, Human
guaaaguaaaacauaacagguuauggcaaagc

SEQ ID NO: 471731 - RNA, 32 nt, Human
guaaaguauuuauugcuacaucauaguugaua

SEQ ID NO: 471732 - RNA, 32 nt, Human
guaaaguauuugacuuacuaguucucaauaaa

SEQ ID NO: 471733 - RNA, 32 nt, Human
guaaagucuccucuggaaaugccaauccaucc

SEQ ID NO: 471734 - RNA, 32 nt, Human
guaaagucucuccugaaaauguuggcauagua

SEQ ID NO: 471735 - RNA, 32 nt, Human
guaaaguguuaaggaauagggacagcugguca

SEQ ID NO: 471736 - RNA, 32 nt, Human
guaaaguucucuuccuuuuguugccuaccucu

SEQ ID NO: 471737 - RNA, 32 nt, Human
guaaaguuugcaaaaguuugguguuuugauuu

SEQ ID NO: 471738 - RNA, 32 nt, Human
guaaauaaacacacacauuaaggagagauuaa

SEQ ID NO: 471739 - RNA, 32 nt, Human
guaaauaauaaccaaccaaccaaccaaccaaa

SEQ ID NO: 471740 - RNA, 19 nt, Human
guaaauaauguacauuuaa

SEQ ID NO: 471741 - RNA, 32 nt, Human
guaaauacacuucaaaaugccuaugauccggu

SEQ ID NO: 471742 - RNA, 32 nt, Human
guaaauacaguacacauuuuauuucuuggauu

SEQ ID NO: 471743 - RNA, 32 nt, Human
guaaauacaugugcauaaggcacagaagcaca

SEQ ID NO: 471744 - RNA, 32 nt, Human
guaaauaccuugaggcaggagugagguuuuua

SEQ ID NO: 471745 - RNA, 32 nt, Human
guaaauacuaacgacaugaaaaugcaaguguc

SEQ ID NO: 471746 - RNA, 32 nt, Human
guaaauagcuauugcacuccagccuuggcaac

SEQ ID NO: 471747 - RNA, 32 nt, Human
guaaauaggcucaucuaccucuaccucugggg

SEQ ID NO: 471748 - RNA, 32 nt, Human
guaaauaggcuguggccagugccuggucauca

SEQ ID NO: 471749 - RNA, 32 nt, Human
guaaauaguauuugagaguucuaaauuuuguc

SEQ ID NO: 471750 - RNA, 32 nt, Human
guaaauaucaauauaauguaccaaugaaauaa

SEQ ID NO: 471751 - RNA, 32 nt, Human
guaaauaugagggaagacacagcaaauggcca

SEQ ID NO: 471752 - RNA, 32 nt, Human
guaaauaugcaaaucagcuuuauagguuuauu

SEQ ID NO: 471753 - RNA, 32 nt, Human
guaaauaugcugcaguuaauugugcuaaguua

SEQ ID NO: 471754 - RNA, 32 nt, Human
guaaauauuccaguggauacaagcuuggacuc

SEQ ID NO: 471755 - RNA, 32 nt, Human
guaaauauuguuuuaaaaugcaucagccuaug

SEQ ID NO: 471756 - RNA, 32 nt, Human
guaaauauuuggacuaacuuuuagaaaaguuu

SEQ ID NO: 471757 - RNA, 32 nt, Human
guaaaucagaugggaccucugaccucagugcg

SEQ ID NO: 471758 - RNA, 32 nt, Human
guaaaucaugacucaguacagugcaaguuuuu

SEQ ID NO: 471759 - RNA, 32 nt, Human
guaaauccaccuuugagaauuuaggcgaagga

SEQ ID NO: 471760 - RNA, 32 nt, Human
guaaauccccacacugcagcccugccacuugc

SEQ ID NO: 471761 - RNA, 32 nt, Human
guaaauccuuucuaccucuggcugaaggagug

SEQ ID NO: 471762 - RNA, 32 nt, Human
guaaaucgaccuuuaagaauuccuggggugga

SEQ ID NO: 471763 - RNA, 32 nt, Human
guaaaucgccuggagcaagcuguuguaaauuu

SEQ ID NO: 471764 - RNA, 32 nt, Human
guaaaucuaaguaaacauguauuacucaaagu

SEQ ID NO: 471765 - RNA, 32 nt, Human
guaaaucuaguuuuugacacagugcaugaacu

SEQ ID NO: 471766 - RNA, 30 nt, Human
guaaaucuccaauaaaguuaucgucuguuc

SEQ ID NO: 471767 - RNA, 32 nt, Human
guaaaucuggaauaauggaaggaaaacauaga

SEQ ID NO: 471768 - RNA, 32 nt, Human
guaaaucugucugguccugggcuuuucuuggu

SEQ ID NO: 471769 - RNA, 32 nt, Human
guaaaucuguggugagagaagcuuccuuucug

SEQ ID NO: 471770 - RNA, 32 nt, Human
guaaaucuuccacuuaaccacugaaaauuauu

SEQ ID NO: 471771 - RNA, 24 nt, Human
guaaaucuuucaacacacuuccac

SEQ ID NO: 471772 - RNA, 32 nt, Human
guaaaugaagaaagaggaagauuccaggaccu

SEQ ID NO: 471773 - RNA, 22 nt, Human
guaaaugaagcccaggaaaaca

SEQ ID NO: 471774 - RNA, 32 nt, Human
guaaaugaccuuguauauaaauauugccauau

SEQ ID NO: 471775 - RNA, 32 nt, Human
guaaaugacgccgcucgauuccaggcuccaag

SEQ ID NO: 471776 - RNA, 32 nt, Human
guaaaugacucuccucugagcuguaauaaaua

SEQ ID NO: 471777 - RNA, 32 nt, Human
guaaaugagcugauggaagagcuguuugaaac

SEQ ID NO: 471778 - RNA, 32 nt, Human
guaaaugagguaacugaggcucagggaggcac

SEQ ID NO: 471779 - RNA, 32 nt, Human
guaaaugaucacuucgaucauguuuccaugca

SEQ ID NO: 471780 - RNA, 32 nt, Human
guaaaugauguguugguuuacaggguauauuu

SEQ ID NO: 471781 - RNA, 32 nt, Human
guaaaugcaaacauguaucuauauugagagau

SEQ ID NO: 471782 - RNA, 32 nt, Human
guaaaugcauuuucacccauucugugguucau

SEQ ID NO: 471783 - RNA, 32 nt, Human
guaaaugccggagguggagcugggcagcugug

SEQ ID NO: 471784 - RNA, 32 nt, Human
guaaaugccucaauacguucugggagaaaacu

SEQ ID NO: 471785 - RNA, 32 nt, Human
guaaaugggaaagaagugagcaacuuaagauu

SEQ ID NO: 471786 - RNA, 29 nt, Human
guaaauggggucuugcuguguugcccaga

SEQ ID NO: 471787 - RNA, 32 nt, Human
guaaaugguaguugaaaggagcaggggcccug

SEQ ID NO: 471788 - RNA, 32 nt, Human
guaaauggugccucuaggcaaaggaggcuugu

SEQ ID NO: 471789 - RNA, 32 nt, Human
guaaauguagguagcagugcaggggugaucuc

SEQ ID NO: 471790 - RNA, 32 nt, Human
guaaauguauccugaagguggggaggaauguu

SEQ ID NO: 471791 - RNA, 32 nt, Human
guaaaugucccaagcagccucuugccagcagu

SEQ ID NO: 471792 - RNA, 32 nt, Human
guaaaugugauggagagggaacaacuguguac

SEQ ID NO: 471793 - RNA, 32 nt, Human
guaaauguggagccuuuaagaacugagcgcaa

SEQ ID NO: 471794 - RNA, 32 nt, Human
guaaauguguacauauuaaaggaagcacucug

SEQ ID NO: 471795 - RNA, 32 nt, Human
guaaauuacugccccucacugggucucugucu

SEQ ID NO: 471796 - RNA, 32 nt, Human
guaaauuaguaaaguaauaauuuggcuucaga

SEQ ID NO: 471797 - RNA, 32 nt, Human
guaaauuauaaaggaggcuacucugguaaggg

SEQ ID NO: 471798 - RNA, 32 nt, Human
guaaauuauauacuguugucuuucuaauaaaa

SEQ ID NO: 471799 - RNA, 32 nt, Human
guaaauuaucuuucuaaugcucugugaggcca

SEQ ID NO: 471800 - RNA, 32 nt, Human
guaaauucauuaguugguauuuauuuaaaagc

SEQ ID NO: 471801 - RNA, 32 nt, Human
guaaauugacccuagccagagaauagaucagu

SEQ ID NO: 471802 - RNA, 32 nt, Human
guaaauugagaugucuggaaguccaggaugac

SEQ ID NO: 471803 - RNA, 32 nt, Human
guaaauuuauaaauauauucaggaguuggaau

SEQ ID NO: 471804 - RNA, 32 nt, Human
guaaauuugaagaugggaccgucuaguugcaa

SEQ ID NO: 471805 - RNA, 32 nt, Human
guaacaaacagcuuugaacugagagcaauuuc

SEQ ID NO: 471806 - RNA, 32 nt, Human
guaacaaacccccaugacacaccuuuauguau

SEQ ID NO: 471807 - RNA, 32 nt, Human
guaacaaaguaaucacuuugucuaucacuaag

SEQ ID NO: 471808 - RNA, 32 nt, Human
guaacaacuaugauuaacuuguuuacuuuuuc

SEQ ID NO: 471809 - RNA, 32 nt, Human
guaacaacucacaugagcucguguuuggcuca

SEQ ID NO: 471810 - RNA, 32 nt, Human
guaacaagaugggguugaccauaugugaaccc

SEQ ID NO: 471811 - RNA, 32 nt, Human
guaacaagcuguuccuuguuucugauacauaa

SEQ ID NO: 471812 - RNA, 32 nt, Human
guaacaaggaaagaaggauggaagagaaggca

SEQ ID NO: 471813 - RNA, 32 nt, Human
guaacaagggugugugcacacuugagaagcca

SEQ ID NO: 471814 - RNA, 32 nt, Human
guaacaauuccuggcauacagugggcagccaa

SEQ ID NO: 471815 - RNA, 32 nt, Human
guaacaauuuugcuucucagcuuccacucuaa

SEQ ID NO: 471816 - RNA, 32 nt, Human
guaacacaaucagaaaucccaugugcccauaa

SEQ ID NO: 471817 - RNA, 32 nt, Human
guaacacacaguuugggauacguaucuguuga

SEQ ID NO: 471818 - RNA, 32 nt, Human
guaacacagccaagacccaguuuacagugucu

SEQ ID NO: 471819 - RNA, 32 nt, Human
guaacaccacugcacuccaaccugggcaacag

SEQ ID NO: 471820 - RNA, 32 nt, Human
guaacaccagcuggccuuguccaagggacaga

SEQ ID NO: 471821 - RNA, 32 nt, Human
guaacacuacucauauccaccucggcagaaau

SEQ ID NO: 471822 - RNA, 32 nt, Human
guaacacucauuuuaacgcuacuuuaguggca

SEQ ID NO: 471823 - RNA, 32 nt, Human
guaacacucugacuucuaagguccagacauaa

SEQ ID NO: 471824 - RNA, 32 nt, Human
guaacacugagccagccacuacccagagagca

SEQ ID NO: 471825 - RNA, 32 nt, Human
guaacacugaucugcuagugcuguaauauugu

SEQ ID NO: 471826 - RNA, 32 nt, Human
guaacacugcauguucauauccugaauuacaa

SEQ ID NO: 471827 - RNA, 32 nt, Human
guaacacuggugccuguaucccugucuucuuu

SEQ ID NO: 471828 - RNA, 32 nt, Human
guaacacugugauuuaucuuucaagagucucu

SEQ ID NO: 471829 - RNA, 32 nt, Human
guaacagaacagacccaggacagggaaaagca

SEQ ID NO: 471830 - RNA, 32 nt, Human
guaacagaagagaagacuguggagccagcuac

SEQ ID NO: 471831 - RNA, 32 nt, Human
guaacagauggaggaauugaauccaagagaug

SEQ ID NO: 471832 - RNA, 32 nt, Human
guaacagcagaaaaggaaagaaacaaagaaca

SEQ ID NO: 471833 - RNA, 32 nt, Human
guaacagcuagcacuaucaugaguuacuaccu

SEQ ID NO: 471834 - RNA, 32 nt, Human
guaacagcuuuauauuugugaagugagaacau

SEQ ID NO: 471835 - RNA, 32 nt, Human
guaacaggaauagucagcauuucacauaaauu

SEQ ID NO: 471836 - RNA, 23 nt, Human
guaacaggacguggauucugccu

SEQ ID NO: 471837 - RNA, 32 nt, Human
guaacaggcccaggcauaguggcugaacaacu

SEQ ID NO: 471838 - RNA, 32 nt, Human
guaacagggagggagacaccuagauuagcagc

SEQ ID NO: 471839 - RNA, 32 nt, Human
guaacaguccacacaagaugguauaggccuga

SEQ ID NO: 471840 - RNA, 32 nt, Human
guaacagucucugcgcuuuccuuuguaauuuc

SEQ ID NO: 471841 - RNA, 32 nt, Human
guaacaguuccuuuccaccagauuuaauauuu

SEQ ID NO: 471842 - RNA, 32 nt, Human
guaacauaacuaguggcucucaguuaaaaugu

SEQ ID NO: 471843 - RNA, 32 nt, Human
guaacaucacuagcgaccggugaccucuuuuu

SEQ ID NO: 471844 - RNA, 31 nt, Human
guaacaugcacacuuuggccugugucaguuu

SEQ ID NO: 471845 - RNA, 32 nt, Human
guaacaugcagagcacuuacacaaagcucccu

SEQ ID NO: 471846 - RNA, 32 nt, Human
guaacaugggaagacgugaagaagaaauaauc

SEQ ID NO: 471847 - RNA, 32 nt, Human
guaacauggguuaccuuugcaccagcuucagu

SEQ ID NO: 471848 - RNA, 32 nt, Human
guaacaugguauuggcuuaucguuuuuaucuc

SEQ ID NO: 471849 - RNA, 32 nt, Human
guaacauguaaaaggcaggacgcacauaaagg

SEQ ID NO: 471850 - RNA, 32 nt, Human
guaacauguaggaaguaggaaguaaauuauag

SEQ ID NO: 471851 - RNA, 32 nt, Human
guaacauuacucugcuucagaaauguuuugua

SEQ ID NO: 471852 - RNA, 32 nt, Human
guaacauugucaggacuuccugaaggauuaga

SEQ ID NO: 471853 - RNA, 32 nt, Human
guaacauuguuuugaaaaauagaguuaacaca

SEQ ID NO: 471854 - RNA, 32 nt, Human
guaacauuucaaacuauugaaaaggaugcuuu

SEQ ID NO: 471855 - RNA, 32 nt, Human
guaacauuuucuaguuuuuguuucugguuaaa

SEQ ID NO: 471856 - RNA, 32 nt, Human
guaaccaacaccugguccagaccucaugggua

SEQ ID NO: 471857 - RNA, 32 nt, Human
guaaccaacagcuuugucugaacuugaaguca

SEQ ID NO: 471858 - RNA, 32 nt, Human
guaaccacagcccuaaauccaugauaaagcua

SEQ ID NO: 471859 - RNA, 32 nt, Human
guaaccacugcugcuacuguuuuuauuuguuu

SEQ ID NO: 471860 - RNA, 32 nt, Human
guaaccacuugucgccuuagggccagauuccc

SEQ ID NO: 471861 - RNA, 32 nt, Human
guaaccagagacagcugauuauagcuuucugc

SEQ ID NO: 471862 - RNA, 32 nt, Human
guaaccagguccuaagggugcagcccucauga

SEQ ID NO: 471863 - RNA, 32 nt, Human
guaaccaguauuacaggagggacuuucagagc

SEQ ID NO: 471864 - RNA, 32 nt, Human
guaaccaucacagcugcugcuauggucugaau

SEQ ID NO: 471865 - RNA, 32 nt, Human
guaaccauuaacacagcacccuuucaagccau

SEQ ID NO: 471866 - RNA, 32 nt, Human
guaaccauuguuuggauuuggaaguacucugc

SEQ ID NO: 471867 - RNA, 32 nt, Human
guaacccagcacuuugggaagccgaggcgggc

SEQ ID NO: 471868 - RNA, 32 nt, Human
guaacccagcuacucaggaggcugaggcacaa

SEQ ID NO: 471869 - RNA, 32 nt, Human
guaacccagcuauucaagaggcugaggcauga

SEQ ID NO: 471870 - RNA, 24 nt, Human
guaacccaggcuggaaugcaaugg

SEQ ID NO: 471871 - RNA, 32 nt, Human
guaaccccaccacugcccacauuccugaagug

SEQ ID NO: 471872 - RNA, 32 nt, Human
guaaccccagcacuucgggaggcugagguggg

SEQ ID NO: 471873 - RNA, 32 nt, Human
guaaccccagcacuuugggaggcugagacagg

SEQ ID NO: 471874 - RNA, 32 nt, Human
guaaccccagcacuuugggaggcugagauggg

SEQ ID NO: 471875 - RNA, 32 nt, Human
guaaccccagcacuuugggaggcugagguggg

SEQ ID NO: 471876 - RNA, 32 nt, Human
guaaccccuguucugucuucauugacaggauu

SEQ ID NO: 471877 - RNA, 32 nt, Human
guaacccuaaagcagaggggcaugaugaaggg

SEQ ID NO: 471878 - RNA, 32 nt, Human
guaacccuagaacuugggaggcugaggugggc

SEQ ID NO: 471879 - RNA, 32 nt, Human
guaacccugccuuguucugucauccagggcuc

SEQ ID NO: 471880 - RNA, 32 nt, Human
guaacccugugggucacagagcugaugugaga

SEQ ID NO: 471881 - RNA, 32 nt, Human
guaacccuugcagcagucacaggcaggugcca

SEQ ID NO: 471882 - RNA, 32 nt, Human
guaacccuuucuguauugagugcaguguuuuu

SEQ ID NO: 471883 - RNA, 32 nt, Human
guaaccgaggcggcaaggaggccagguagucc

SEQ ID NO: 471884 - RNA, 32 nt, Human
guaaccgcuccugggagcaguggggaaccguc

SEQ ID NO: 471885 - RNA, 32 nt, Human
guaaccgcuccugggagcaguggggaacuguc

SEQ ID NO: 471886 - RNA, 32 nt, Human
guaaccuagguggggucacugccccuccuggg

SEQ ID NO: 471887 - RNA, 24 nt, Human
guaaccucaaacucaugggcucaa

SEQ ID NO: 471888 - RNA, 24 nt, Human
guaaccucaaacucuggggcucaa

SEQ ID NO: 471889 - RNA, 32 nt, Human
guaaccucaagugaugcucccaccucagccuc

SEQ ID NO: 471890 - RNA, 32 nt, Human
guaaccucaguuaacuuuaacaacaagcauuc

SEQ ID NO: 471891 - RNA, 24 nt, Human
guaaccuccgacuccuggguucaa

SEQ ID NO: 471892 - RNA, 24 nt, Human
guaaccuccgccuccuggguucaa

SEQ ID NO: 471893 - RNA, 32 nt, Human
guaaccucugcagacuuaagugucccugucug

SEQ ID NO: 471894 - RNA, 32 nt, Human
guaaccucuugagaccucucccugaccaggga

SEQ ID NO: 471895 - RNA, 32 nt, Human
guaaccugacacucucaggagacauuaagaua

SEQ ID NO: 471896 - RNA, 32 nt, Human
guaaccugaucguggagagugaggcugugaga

SEQ ID NO: 471897 - RNA, 32 nt, Human
guaaccugcugcccccuccacccccaacccag

SEQ ID NO: 471898 - RNA, 32 nt, Human
guaaccuguuuacuuugugcuaacagugccgg

SEQ ID NO: 471899 - RNA, 32 nt, Human
guaaccuuauauuuacaauaaaugaagauuac

SEQ ID NO: 471900 - RNA, 32 nt, Human
guaaccuuccacuaccuaucccaaaccuauaa

SEQ ID NO: 471901 - RNA, 32 nt, Human
guaaccuuccugcccauggcuuccagaggacg

SEQ ID NO: 471902 - RNA, 24 nt, Human
guaaccuugaacuccugggcucaa

SEQ ID NO: 471903 - RNA, 32 nt, Human
guaaccuugcaucucauugcucuggcugaguu

SEQ ID NO: 471904 - RNA, 32 nt, Human
guaaccuuuaaaugaaacuugccuaaaaucuu

SEQ ID NO: 471905 - RNA, 32 nt, Human
guaaccuuucaucaugaucauaggcaguugaa

SEQ ID NO: 471906 - RNA, 32 nt, Human
guaaccuuugaggacguguccauggacuucuc

SEQ ID NO: 471907 - RNA, 32 nt, Human
guaacgagaagagauccucagcagaacacuca

SEQ ID NO: 471908 - RNA, 32 nt, Human
guaacgcagacaucagcuuuacacuucacagg

SEQ ID NO: 471909 - RNA, 32 nt, Human
guaacgcagugcgggguuagggauuccccggg

SEQ ID NO: 471910 - RNA, 32 nt, Human
guaacgccaccuggaugccccauccaccgcau

SEQ ID NO: 471911 - RNA, 32 nt, Human
guaacggagccaccuccaacucuaacaauaaa

SEQ ID NO: 471912 - RNA, 32 nt, Human
guaacggagcgguuuggguggcggagccugcg

SEQ ID NO: 471913 - RNA, 32 nt, Human
guaacgugaaguauuucucauugaaaugcuuu

SEQ ID NO: 471914 - RNA, 32 nt, Human
guaacgugccgggcacacacuaaacucaguua

SEQ ID NO: 471915 - RNA, 32 nt, Human
guaacgugcugccagcacagggcugggugaua

SEQ ID NO: 471916 - RNA, 32 nt, Human
guaacguguuuucugugucugccgcuuccagc

SEQ ID NO: 471917 - RNA, 32 nt, Human
guaacuaacuugcuuuuuaauuuuacaggcuu

SEQ ID NO: 471918 - RNA, 32 nt, Human
guaacuaagaucuauguuuggguuuguaaaau

SEQ ID NO: 471919 - RNA, 32 nt, Human
guaacuaagccauaugugaucacguuauugga

SEQ ID NO: 471920 - RNA, 32 nt, Human
guaacuacagcuuggaaacuaugcaaaugguc

SEQ ID NO: 471921 - RNA, 32 nt, Human
guaacuagaaguuguacgaaguagaaggcugu

SEQ ID NO: 471922 - RNA, 32 nt, Human
guaacuaguggggcuuaaugaaggucauaagu

SEQ ID NO: 471923 - RNA, 32 nt, Human
guaacuaguggugcuauuaugugcccagcacg

SEQ ID NO: 471924 - RNA, 32 nt, Human
guaacuaguuaaaaaugaaaaauucaguuccu

SEQ ID NO: 471925 - RNA, 32 nt, Human
guaacucacagcccugcugucuucagaguaua

SEQ ID NO: 471926 - RNA, 22 nt, Human
guaacucacgccuguaauccca

SEQ ID NO: 471927 - RNA, 32 nt, Human
guaacucagauucauuucaaaaggacagugaa

SEQ ID NO: 471928 - RNA, 32 nt, Human
guaacucaggaaauauuuggcacauucuauca

SEQ ID NO: 471929 - RNA, 32 nt, Human
guaacucaguauuacugaaaagguacccacau

SEQ ID NO: 471930 - RNA, 32 nt, Human
guaacucaugcuuucaaaauaucaggaagcaa

SEQ ID NO: 471931 - RNA, 32 nt, Human
guaacuccagccugggcaacagagugagaccc

SEQ ID NO: 471932 - RNA, 32 nt, Human
guaacuccgccccuuucucucccucucaguaa

SEQ ID NO: 471933 - RNA, 32 nt, Human
guaacuccugaaaaacaucgagcuagaaaaag

SEQ ID NO: 471934 - RNA, 32 nt, Human
guaacuccugaaaaauaucgagcuagaaaaag

SEQ ID NO: 471935 - RNA, 32 nt, Human
guaacuccuuugugcuaccaacuuacugcucu

SEQ ID NO: 471936 - RNA, 32 nt, Human
guaacucuaauugagcccgaaaccagaauaaa

SEQ ID NO: 471937 - RNA, 32 nt, Human
guaacucuacccacuguggguuuccuccuugc

SEQ ID NO: 471938 - RNA, 32 nt, Human
guaacucugcugucugaaugccuccuuucucc

SEQ ID NO: 471939 - RNA, 32 nt, Human
guaacucuguuuccugaggugagggcaugaaa

SEQ ID NO: 471940 - RNA, 32 nt, Human
guaacucuucaaaggccaguuuccccucacgc

SEQ ID NO: 471941 - RNA, 32 nt, Human
guaacugagcacucaagguggggaucauugag

SEQ ID NO: 471942 - RNA, 32 nt, Human
guaacugagcaggggcuacaaagaggucuccu

SEQ ID NO: 471943 - RNA, 32 nt, Human
guaacugaggccagcaaucugagugcagcaaa

SEQ ID NO: 471944 - RNA, 32 nt, Human
guaacugaucuccugccccacuaaccuuaacg

SEQ ID NO: 471945 - RNA, 32 nt, Human
guaacugcaaccugcagaaucaaauuuagggu

SEQ ID NO: 471946 - RNA, 32 nt, Human
guaacugcauuuuucaccuuaaaaguuaaaug

SEQ ID NO: 471947 - RNA, 32 nt, Human
guaacugccuggucagugcccagagacaagug

SEQ ID NO: 471948 - RNA, 32 nt, Human
guaacugcgguuucagccaacacucuucaugg

SEQ ID NO: 471949 - RNA, 32 nt, Human
guaacugcugugcacugcuguaaacuuguuag

SEQ ID NO: 471950 - RNA, 32 nt, Human
guaacugcuuucuguuccaaauucaguuucau

SEQ ID NO: 471951 - RNA, 22 nt, Human
guaacuggaacaggccugggca

SEQ ID NO: 471952 - RNA, 32 nt, Human
guaacuggaaucuuuugccucucccagccacc

SEQ ID NO: 471953 - RNA, 32 nt, Human
guaacuggaauugcaggucagagcagagcaug

SEQ ID NO: 471954 - RNA, 32 nt, Human
guaacuggagcuuggaugaggaugagacaagc

SEQ ID NO: 471955 - RNA, 32 nt, Human
guaacuggcugcagagaaaucuaccgagcaag

SEQ ID NO: 471956 - RNA, 32 nt, Human
guaacugggagagaggcugugccugaaacuag

SEQ ID NO: 471957 - RNA, 32 nt, Human
guaacugggauuacaagugacugccacuaugc

SEQ ID NO: 471958 - RNA, 32 nt, Human
guaacugggauuacaggcaugcgccaccauac

SEQ ID NO: 471959 - RNA, 32 nt, Human
guaacugggauuacaggcaugcgccaccaugc

SEQ ID NO: 471960 - RNA, 32 nt, Human
guaacugggauuacaggcaugcgccacuaagg

SEQ ID NO: 471961 - RNA, 32 nt, Human
guaacugggauuacaggcaugugccaucacgc

SEQ ID NO: 471962 - RNA, 32 nt, Human
guaacugggauuacaggcaugugucaccaugc

SEQ ID NO: 471963 - RNA, 32 nt, Human
guaacugggauuacaggcgggcgccaccacgc

SEQ ID NO: 471964 - RNA, 32 nt, Human
guaacugggauuacaggcuugugccaccgcac

SEQ ID NO: 471965 - RNA, 32 nt, Human
guaacugggauuacaggugugugccaccacac

SEQ ID NO: 471966 - RNA, 32 nt, Human
guaacugggauuacagucgugugccaccacgc

SEQ ID NO: 471967 - RNA, 32 nt, Human
guaacugggauuauaggcaugcaccaccacgc

SEQ ID NO: 471968 - RNA, 32 nt, Human
guaacuggggaaacugaguauguucuguagac

SEQ ID NO: 471969 - RNA, 32 nt, Human
guaacugguuccuaauaaaaagaauuauaaaa

SEQ ID NO: 471970 - RNA, 32 nt, Human
guaacugucaguguacacgucuggaccccguu

SEQ ID NO: 471971 - RNA, 32 nt, Human
guaacuguccgagaugggaugccugagcucuu

SEQ ID NO: 471972 - RNA, 32 nt, Human
guaacugucugacgcuuuugccugugugucca

SEQ ID NO: 471973 - RNA, 32 nt, Human
guaacuuaaccagcacauuucuccuguuuaca

SEQ ID NO: 471974 - RNA, 32 nt, Human
guaacuuaggggccagaaucuccaugcacuuu

SEQ ID NO: 471975 - RNA, 32 nt, Human
guaacuucacauauggaaaaguuaaagacuca

SEQ ID NO: 471976 - RNA, 24 nt, Human
guaacuucgaccaccugggcucaa

SEQ ID NO: 471977 - RNA, 31 nt, Human
guaacuucugucuuugggccugggucugucc

SEQ ID NO: 471978 - RNA, 32 nt, Human
guaacuugagaugucugugguugugggggugu

SEQ ID NO: 471979 - RNA, 32 nt, Human
guaacuugccucugagccugggcugaucugag

SEQ ID NO: 471980 - RNA, 32 nt, Human
guaacuugcuacccucuugagcagcucuucug

SEQ ID NO: 471981 - RNA, 32 nt, Human
guaacuuucacucauucaaaggcagguuauaa

SEQ ID NO: 471982 - RNA, 32 nt, Human
guaacuuucucuaugaacucuguuuucuuucu

SEQ ID NO: 471983 - RNA, 22 nt, Human
guaacuuucuucaucccuugaa

SEQ ID NO: 471984 - RNA, 32 nt, Human
guaacuuuuaaucccuauguuugucucacuuu

SEQ ID NO: 471985 - RNA, 32 nt, Human
guaacuuuuacguuguugugggagauuuacug

SEQ ID NO: 471986 - RNA, 32 nt, Human
guaacuuuucuaaggauugaauaaauugagcu

SEQ ID NO: 471987 - RNA, 32 nt, Human
guaagaaaagaaugcuggcaggaaaguggcca

SEQ ID NO: 471988 - RNA, 32 nt, Human
guaagaaacagagcuggagaugagcucaggcc

SEQ ID NO: 471989 - RNA, 32 nt, Human
guaagaaacaucuggguauuuggaaacaagug

SEQ ID NO: 471990 - RNA, 32 nt, Human
guaagaaaccaaucaagauaaaggacagugaa

SEQ ID NO: 471991 - RNA, 32 nt, Human
guaagaaagaugaugugcaugucuguaucaug

SEQ ID NO: 471992 - RNA, 32 nt, Human
guaagaaaguagaagaaaguaaacuguaauaa

SEQ ID NO: 471993 - RNA, 32 nt, Human
guaagaaaugguaucaagcucuccaguucugu

SEQ ID NO: 471994 - RNA, 32 nt, Human
guaagaacaguuucagcaucaacuaacgaaca

SEQ ID NO: 471995 - RNA, 32 nt, Human
guaagaaccccacccugcuugcagagaaccuu

SEQ ID NO: 471996 - RNA, 32 nt, Human
guaagaacgcccugcgcgucagccuggaacgg

SEQ ID NO: 471997 - RNA, 32 nt, Human
guaagaacucagaacauaauaccugagugccu

SEQ ID NO: 471998 - RNA, 32 nt, Human
guaagaagaacugcuuucuuauagcacaaaac

SEQ ID NO: 471999 - RNA, 32 nt, Human
guaagaaguaccucuaggccugggaggcauug

SEQ ID NO: 472000 - RNA, 32 nt, Human
guaagaaguuuagagggggaagaaaagaauga

SEQ ID NO: 472001 - RNA, 22 nt, Human
guaagaaugagaagaaggaaca

SEQ ID NO: 472002 - RNA, 32 nt, Human
guaagacaccaaccuuuacauucuucccugag

SEQ ID NO: 472003 - RNA, 32 nt, Human
guaagacaugacuuuuuccuccuugccuucca

SEQ ID NO: 472004 - RNA, 32 nt, Human
guaagacaugccuuugcucuuccuucacauuc

SEQ ID NO: 472005 - RNA, 32 nt, Human
guaagaccaggagguugguaagagugacuaac

SEQ ID NO: 472006 - RNA, 32 nt, Human
guaagacccuugcuguuuggaggguggucuug

SEQ ID NO: 472007 - RNA, 28 nt, Human
guaagaccuugggcugccucuucugucu

SEQ ID NO: 472008 - RNA, 32 nt, Human
guaagacguugcagaggucuaggaaggcuggu

SEQ ID NO: 472009 - RNA, 32 nt, Human
guaagacuccucuauguugccugcuguccagg

SEQ ID NO: 472010 - RNA, 23 nt, Human
guaagacucuacaccauauugua

SEQ ID NO: 472011 - RNA, 32 nt, Human
guaagacuugaccuuuaucuggaacacuccuu

SEQ ID NO: 472012 - RNA, 32 nt, Human
guaagagagcccuggaggauaaggacuuuggc

SEQ ID NO: 472013 - RNA, 32 nt, Human
guaagagagcgcuacucuggggccaguaccaa

SEQ ID NO: 472014 - RNA, 32 nt, Human
guaagagcaaaaaguguaauuccacaucaugu

SEQ ID NO: 472015 - RNA, 32 nt, Human
guaagagcacugcacugacgguuuggagaccu

SEQ ID NO: 472016 - RNA, 32 nt, Human
guaagagcugacucaucgcuucccaggaagac

SEQ ID NO: 472017 - RNA, 32 nt, Human
guaagagcuuccagaggucacccaacaucaca

SEQ ID NO: 472018 - RNA, 32 nt, Human
guaagagcuuuguuucuuuauggaacuccccu

SEQ ID NO: 472019 - RNA, 32 nt, Human
guaagagggaaaggaaaagagguaucaaguaa

SEQ ID NO: 472020 - RNA, 32 nt, Human
guaagagggagagagaagaagaggaagaagag

SEQ ID NO: 472021 - RNA, 32 nt, Human
guaagagguacuguaagcgccuccaggugcug

SEQ ID NO: 472022 - RNA, 32 nt, Human
guaagagugagggagggaaggaaggaacuaca

SEQ ID NO: 472023 - RNA, 32 nt, Human
guaagaguggucucuucuuauugaacaaccuc

SEQ ID NO: 472024 - RNA, 32 nt, Human
guaagauacuccugacaucuugcuuuagcaca

SEQ ID NO: 472025 - RNA, 32 nt, Human
guaagauacucugccaaguuuccucuguagag

SEQ ID NO: 472026 - RNA, 32 nt, Human
guaagauauaaauaacaacacuuuccuuaaaa

SEQ ID NO: 472027 - RNA, 32 nt, Human
guaagauauauguacuaaacauauguguugcu

SEQ ID NO: 472028 - RNA, 31 nt, Human
guaagaugagcuagagaaaauaaccuggucu

SEQ ID NO: 472029 - RNA, 32 nt, Human
guaagaugcaucaaaugugaugcagcucuugu

SEQ ID NO: 472030 - RNA, 32 nt, Human
guaagaugcccuuuuaaauauaaggaucagug

SEQ ID NO: 472031 - RNA, 32 nt, Human
guaagauggauuucacccccaggccaaugcag

SEQ ID NO: 472032 - RNA, 32 nt, Human
guaagauguguauauguauagcuauguagcgc

SEQ ID NO: 472033 - RNA, 32 nt, Human
guaagaugugugacccugcaaggaauaacaaa

SEQ ID NO: 472034 - RNA, 32 nt, Human
guaagauuccccaaggagggaaaaguggagcu

SEQ ID NO: 472035 - RNA, 32 nt, Human
guaagcaaauuuaugaaucuuuguacaccaua

SEQ ID NO: 472036 - RNA, 32 nt, Human
guaagcaacagcuccuucaugggcugagaagg

SEQ ID NO: 472037 - RNA, 32 nt, Human
guaagcaagucuuccugaagcaagcagagucc

SEQ ID NO: 472038 - RNA, 32 nt, Human
guaagcaauaaauauggagugucaguagucuc

SEQ ID NO: 472039 - RNA, 32 nt, Human
guaagcacacaggguauccacauguuacccug

SEQ ID NO: 472040 - RNA, 32 nt, Human
guaagcaccagcugccucuuugcugcuuuguu

SEQ ID NO: 472041 - RNA, 32 nt, Human
guaagcacguugcccaagguugcacagcaaga

SEQ ID NO: 472042 - RNA, 32 nt, Human
guaagcagacguccauuaccacccucacccac

SEQ ID NO: 472043 - RNA, 32 nt, Human
guaagcagccacugcaagcucugaaucaguuu

SEQ ID NO: 472044 - RNA, 32 nt, Human
guaagcagugaagauuuuagcauggucuguau

SEQ ID NO: 472045 - RNA, 32 nt, Human
guaagcauaugggaauuucugagcuauaacau

SEQ ID NO: 472046 - RNA, 32 nt, Human
guaagcaucuggagaaaauucaguuaaaagaa

SEQ ID NO: 472047 - RNA, 32 nt, Human
guaagccaagcagcuuugcuucugccucuguu

SEQ ID NO: 472048 - RNA, 32 nt, Human
guaagccaagcugcucagaaguacgaggcacu

SEQ ID NO: 472049 - RNA, 32 nt, Human
guaagccacagugcccagcccgaauuggauau

SEQ ID NO: 472050 - RNA, 18 nt, Human
guaagccaggcauggagg

SEQ ID NO: 472051 - RNA, 32 nt, Human
guaagcccacacaagcucuucuuaucucuacu

SEQ ID NO: 472052 - RNA, 32 nt, Human
guaagcccaguucuucucuguauagaaaggaa

SEQ ID NO: 472053 - RNA, 32 nt, Human
guaagccuaggucacaacaucuguaaacuagg

SEQ ID NO: 472054 - RNA, 32 nt, Human
guaagccuuagcagcaaacauucuuccuaaaa

SEQ ID NO: 472055 - RNA, 22 nt, Human
guaagccuucaaagaaaaaaca

SEQ ID NO: 472056 - RNA, 32 nt, Human
guaagccuugaagaaguaugugagagggccac

SEQ ID NO: 472057 - RNA, 32 nt, Human
guaagcgccagagccacuaguggacgccaggu

SEQ ID NO: 472058 - RNA, 32 nt, Human
guaagcggagcaagugccaagcagaacagacc

SEQ ID NO: 472059 - RNA, 32 nt, Human
guaagcggcucaagcccaggagggagcagagg

SEQ ID NO: 472060 - RNA, 32 nt, Human
guaagcuagucuuccccucugcuuucucgaaa

SEQ ID NO: 472061 - RNA, 32 nt, Human
guaagcuauuaaugcuaacucuugcaugucaa

SEQ ID NO: 472062 - RNA, 32 nt, Human
guaagcucccuucugucauuuucauugauuua

SEQ ID NO: 472063 - RNA, 32 nt, Human
guaagcugaaaccucaaugaauaacaagaaaa

SEQ ID NO: 472064 - RNA, 32 nt, Human
guaagcugcaucacuucugcuuucuuccuacu

SEQ ID NO: 472065 - RNA, 32 nt, Human
guaagcuggaccugcaaccugccugagccccg

SEQ ID NO: 472066 - RNA, 32 nt, Human
guaagcuggaugaccuguggugcugaccuuuu

SEQ ID NO: 472067 - RNA, 32 nt, Human
guaagcugguuuacagauguuuuccacugagc

SEQ ID NO: 472068 - RNA, 32 nt, Human
guaagcuucagucuuauuuauagugugggaau

SEQ ID NO: 472069 - RNA, 32 nt, Human
guaagcuuccccagcccugccugagcagccuu

SEQ ID NO: 472070 - RNA, 31 nt, Human
guaagcuugcucucuggccuccucuuaaaaa

SEQ ID NO: 472071 - RNA, 32 nt, Human
guaaggaaaugcaguguguugcaguggccuuu

SEQ ID NO: 472072 - RNA, 32 nt, Human
guaaggacaacaaaggccauucagugcccucc

SEQ ID NO: 472073 - RNA, 32 nt, Human
guaaggacaggcacccucccacagugucaggg

SEQ ID NO: 472074 - RNA, 32 nt, Human
guaaggacauagagaaauuggaacccuuguuc

SEQ ID NO: 472075 - RNA, 32 nt, Human
guaaggaccuucuccccacaaugggucccuag

SEQ ID NO: 472076 - RNA, 32 nt, Human
guaaggacuuggacuccucuguccagcuuuua

SEQ ID NO: 472077 - RNA, 32 nt, Human
guaaggagagguagcuacacagcaucuguuac

SEQ ID NO: 472078 - RNA, 32 nt, Human
guaaggagcaaaguuacaggccaguuuuuacu

SEQ ID NO: 472079 - RNA, 32 nt, Human
guaaggagccaguuccagaccuggguuugugc

SEQ ID NO: 472080 - RNA, 32 nt, Human
guaaggagcccucagcccacacccagcagaga

SEQ ID NO: 472081 - RNA, 32 nt, Human
guaaggagugaugauuuaaaguauuuacucag

SEQ ID NO: 472082 - RNA, 32 nt, Human
guaaggauggagaggagggagagccagaaaaa

SEQ ID NO: 472083 - RNA, 32 nt, Human
guaaggauuuuucaucugaaguacaauaaugc

SEQ ID NO: 472084 - RNA, 32 nt, Human
guaaggcacagagagguugaauaacuugccug

SEQ ID NO: 472085 - RNA, 32 nt, Human
guaaggcaguauaugauugugccaaaccuaca

SEQ ID NO: 472086 - RNA, 32 nt, Human
guaaggcauuggagaaggacaauguaaaagac

SEQ ID NO: 472087 - RNA, 32 nt, Human
guaaggcauuggugauguuugcauuuacccuc

SEQ ID NO: 472088 - RNA, 32 nt, Human
guaaggcccaaguuauugagcagcagcuuccu

SEQ ID NO: 472089 - RNA, 32 nt, Human
guaaggccuuuaguaaugaauguaaugagaga

SEQ ID NO: 472090 - RNA, 32 nt, Human
guaaggcucagggcugcugggcucugauguca

SEQ ID NO: 472091 - RNA, 32 nt, Human
guaaggcugaccucccugugugaccugcccac

SEQ ID NO: 472092 - RNA, 32 nt, Human
guaaggcuggcagaaggacagaagagaaaaga

SEQ ID NO: 472093 - RNA, 32 nt, Human
guaaggcugggcccugggcacaagugccagaa

SEQ ID NO: 472094 - RNA, 32 nt, Human
guaaggcuuaauaaguaguucauugacccugu

SEQ ID NO: 472095 - RNA, 32 nt, Human
guaagggacagcugagauugagugucaguauu

SEQ ID NO: 472096 - RNA, 32 nt, Human
guaagggagagggagggagccgggagccguag

SEQ ID NO: 472097 - RNA, 32 nt, Human
guaagggagggagggguagggacagaagcuag

SEQ ID NO: 472098 - RNA, 32 nt, Human
guaagggagggcaggggugagggggagcagaa

SEQ ID NO: 472099 - RNA, 32 nt, Human
guaagggagggcaggggugagggggagcagga

SEQ ID NO: 472100 - RNA, 32 nt, Human
guaagggauucugcaagggacagggggccuga

SEQ ID NO: 472101 - RNA, 32 nt, Human
guaagggcuuuguuuuccuaauagcugacuuu

SEQ ID NO: 472102 - RNA, 32 nt, Human
guaaggggacagcuccaggccggggcugucuc

SEQ ID NO: 472103 - RNA, 32 nt, Human
guaaggggagaaaggacccugcccucccuguu

SEQ ID NO: 472104 - RNA, 32 nt, Human
guaaggggcuagugugauagggagaggggugg

SEQ ID NO: 472105 - RNA, 32 nt, Human
guaagggggcuccauuuuccucccucucuuua

SEQ ID NO: 472106 - RNA, 32 nt, Human
guaagggggcuucacucucuagaucagccugc

SEQ ID NO: 472107 - RNA, 32 nt, Human
guaaggggguccagagaccaaaaguuuuagag

SEQ ID NO: 472108 - RNA, 32 nt, Human
guaaggggucagccccuccuucuggcccgaga

SEQ ID NO: 472109 - RNA, 32 nt, Human
guaagggucaguuuuugcuauuuggaagcuua

SEQ ID NO: 472110 - RNA, 32 nt, Human
guaagguagauggcagaggcagagacauggaa

SEQ ID NO: 472111 - RNA, 32 nt, Human
guaaggucaaauacuauaguuuucagcauaug

SEQ ID NO: 472112 - RNA, 32 nt, Human
guaaggucauuagcggucaacaugguucccaa

SEQ ID NO: 472113 - RNA, 32 nt, Human
guaagguccuggaaguucagcaaaguuucgug

SEQ ID NO: 472114 - RNA, 32 nt, Human
guaagguggccauaccagcacaugcugcacua

SEQ ID NO: 472115 - RNA, 24 nt, Human
guaagguggcucacaccuauaauc

SEQ ID NO: 472116 - RNA, 31 nt, Human
guaagguggcuggaaagaaccuugaggagag

SEQ ID NO: 472117 - RNA, 32 nt, Human
guaagguguauucauagggaugguggcucaac

SEQ ID NO: 472118 - RNA, 32 nt, Human
guaagguucccaagccagccccaacacccuuc

SEQ ID NO: 472119 - RNA, 32 nt, Human
guaaguaaaagcuaaaugaggggccaggugca

SEQ ID NO: 472120 - RNA, 32 nt, Human
guaaguaaacagucagaagauuagcaugaaag

SEQ ID NO: 472121 - RNA, 32 nt, Human
guaaguaaaguguuaugguaggguucuucaga

SEQ ID NO: 472122 - RNA, 32 nt, Human
guaaguacaaaggauauucuguuucuaucugc

SEQ ID NO: 472123 - RNA, 32 nt, Human
guaaguaggcuggauaaauggugcuuaaaugg

SEQ ID NO: 472124 - RNA, 32 nt, Human
guaaguaucuggaggaagaaaacaggugaaag

SEQ ID NO: 472125 - RNA, 32 nt, Human
guaaguauuucuaugucaaaggcacagccuug

SEQ ID NO: 472126 - RNA, 32 nt, Human
guaagucacugcagaccgaccucccugcaguu

SEQ ID NO: 472127 - RNA, 32 nt, Human
guaagucacuugucuaaggucacauagcuagc

SEQ ID NO: 472128 - RNA, 32 nt, Human
guaaguccacuuacaaaaaccccgcucugucu

SEQ ID NO: 472129 - RNA, 32 nt, Human
guaagucccuguggccauggugcauuggccuu

SEQ ID NO: 472130 - RNA, 32 nt, Human
guaaguccuguaugguaggaaguggguguggc

SEQ ID NO: 472131 - RNA, 32 nt, Human
guaagucuccucuucccagcauguucaacagg

SEQ ID NO: 472132 - RNA, 32 nt, Human
guaagucucucuuccuccuucucaccccuggc

SEQ ID NO: 472133 - RNA, 31 nt, Human
guaagugaacaaugcauuacuucuaccuuag

SEQ ID NO: 472134 - RNA, 32 nt, Human
guaagugacucaucuuccuguuguuccaauuc

SEQ ID NO: 472135 - RNA, 32 nt, Human
guaagugagguugccccacacagccgucuccc

SEQ ID NO: 472136 - RNA, 32 nt, Human
guaagugauuuuuccaguucaaagucaagaca

SEQ ID NO: 472137 - RNA, 32 nt, Human
guaagugcucagaaaaaugugcaggucaauaa

SEQ ID NO: 472138 - RNA, 32 nt, Human
guaagugcuuucuuucuuuuuaagcuacuucu

SEQ ID NO: 472139 - RNA, 32 nt, Human
guaaguggaagagcuugcccuuugucuucccc

SEQ ID NO: 472140 - RNA, 32 nt, Human
guaaguggagcauuuggaaggaaaggaauaua

SEQ ID NO: 472141 - RNA, 31 nt, Human
guaaguggcacaaucucggcucacugcaacc

SEQ ID NO: 472142 - RNA, 32 nt, Human
guaaguggccauacugcuacugccucauguag

SEQ ID NO: 472143 - RNA, 32 nt, Human
guaagugggaaagccuuuugauguggcauggc

SEQ ID NO: 472144 - RNA, 32 nt, Human
guaagugggauuaugaugaguaacuggagggg

SEQ ID NO: 472145 - RNA, 32 nt, Human
guaaguggguaagucuguauguguguaucaua

SEQ ID NO: 472146 - RNA, 32 nt, Human
guaaguggucccuuagggcugaaggacuucag

SEQ ID NO: 472147 - RNA, 32 nt, Human
guaaguggucuugaaggauucauuuagucacc

SEQ ID NO: 472148 - RNA, 32 nt, Human
guaaguguaagguccacauccuuggggaagua

SEQ ID NO: 472149 - RNA, 32 nt, Human
guaagugugcaggagugaauguauguggcagg

SEQ ID NO: 472150 - RNA, 32 nt, Human
guaaguguuguauguaccguugauguugauaa

SEQ ID NO: 472151 - RNA, 32 nt, Human
guaaguguuuucuccauugccucuugccaggg

SEQ ID NO: 472152 - RNA, 32 nt, Human
guaaguuagaucccucccuuuggggagccuau

SEQ ID NO: 472153 - RNA, 32 nt, Human
guaaguucauucuuguaccaacuaauccagug

SEQ ID NO: 472154 - RNA, 32 nt, Human
guaaguucauuugaguagcagaccuaacaaau

SEQ ID NO: 472155 - RNA, 32 nt, Human
guaaguucucacuucaaagcuauggaauggau

SEQ ID NO: 472156 - RNA, 32 nt, Human
guaaguucucagcugcuggccugcacucauca

SEQ ID NO: 472157 - RNA, 32 nt, Human
guaaguugagauguuguguggcaaugggauuu

SEQ ID NO: 472158 - RNA, 32 nt, Human
guaaguugcaggaagccagaggaggcaauaca

SEQ ID NO: 472159 - RNA, 32 nt, Human
guaaguugcccucccucuccuggccuuacaag

SEQ ID NO: 472160 - RNA, 32 nt, Human
guaaguuggugacuugcaucuguggccuugaa

SEQ ID NO: 472161 - RNA, 32 nt, Human
guaaguuuauacuugaggacugaagugugacu

SEQ ID NO: 472162 - RNA, 32 nt, Human
guaauaaacuuuuaucaguuauuuagaaaaag

SEQ ID NO: 472163 - RNA, 29 nt, Human
guaauaaauaugugaggccuuucguuuuu

SEQ ID NO: 472164 - RNA, 32 nt, Human
guaauaaggagaggguugggggugggcagggc

SEQ ID NO: 472165 - RNA, 18 nt, Human
guaauaagggggcuccag

SEQ ID NO: 472166 - RNA, 32 nt, Human
guaauaaguuuagcauaagucuugccugccaa

SEQ ID NO: 472167 - RNA, 32 nt, Human
guaauaauacaaaaauuagcugggcguggugg

SEQ ID NO: 472168 - RNA, 32 nt, Human
guaauaauugcaucaagcuuagaugagaaauu

SEQ ID NO: 472169 - RNA, 32 nt, Human
guaauacaagggccagccuggccaacauggug

SEQ ID NO: 472170 - RNA, 32 nt, Human
guaauacacucugauccccucagucugaaucu

SEQ ID NO: 472171 - RNA, 32 nt, Human
guaauaccagcacuuugggaaguggagguggg

SEQ ID NO: 472172 - RNA, 32 nt, Human
guaauacguacauguuuauggcaauuuaacau

SEQ ID NO: 472173 - RNA, 32 nt, Human
guaauagauggaaggucagccccggcuuaacc

SEQ ID NO: 472174 - RNA, 32 nt, Human
guaauaggguaguucuggagagaugguaugca

SEQ ID NO: 472175 - RNA, 32 nt, Human
guaauaguaaaucguucuccuuacaaucaagu

SEQ ID NO: 472176 - RNA, 32 nt, Human
guaauagugauacauggauauacuuccuuuua

SEQ ID NO: 472177 - RNA, 31 nt, Human
guaauauaaggaccuguucuggacacagcac

SEQ ID NO: 472178 - RNA, 32 nt, Human
guaauauaauuugccauuuuuauuagaaauuu

SEQ ID NO: 472179 - RNA, 32 nt, Human
guaauauaggcaauauaaugaaacaccgaguu

SEQ ID NO: 472180 - RNA, 32 nt, Human
guaauaucacuaugcauuucuacacauuuuau

SEQ ID NO: 472181 - RNA, 32 nt, Human
guaauaucagaacaggaaggaggaauggcuug

SEQ ID NO: 472182 - RNA, 32 nt, Human
guaauaucaguuacaguggcaguauugacaau

SEQ ID NO: 472183 - RNA, 32 nt, Human
guaauauggagacugagcugcaugguaguugg

SEQ ID NO: 472184 - RNA, 32 nt, Human
guaauauuacacaaacacauauucacuguggu

SEQ ID NO: 472185 - RNA, 32 nt, Human
guaauauucauauuggaaaaauuuccuacaag

SEQ ID NO: 472186 - RNA, 32 nt, Human
guaauauuuccacaggacuggaaagggcgaga

SEQ ID NO: 472187 - RNA, 32 nt, Human
guaauauuuccuccuuuuccaagaccaaggcc

SEQ ID NO: 472188 - RNA, 32 nt, Human
guaauauuugugaauggaaugccuugcaauau

SEQ ID NO: 472189 - RNA, 32 nt, Human
guaauauuuuuccuacuacauuggaguuuagc

SEQ ID NO: 472190 - RNA, 32 nt, Human
guaaucaaacauguuuuccaauacuugauaac

SEQ ID NO: 472191 - RNA, 32 nt, Human
guaaucaaagagaugugucugagaucuaauag

SEQ ID NO: 472192 - RNA, 32 nt, Human
guaaucaacuccugcucuacuucauauucauc

SEQ ID NO: 472193 - RNA, 32 nt, Human
guaaucacaccacugcacuccagcuuggggga

SEQ ID NO: 472194 - RNA, 19 nt, Human
guaaucacagcuacuuggg

SEQ ID NO: 472195 - RNA, 32 nt, Human
guaaucaccuacuggauucaagcaauucuccu

SEQ ID NO: 472196 - RNA, 32 nt, Human
guaaucacugcacuccaaccuggcaacagagu

SEQ ID NO: 472197 - RNA, 32 nt, Human
guaaucacugcacuuugggaagcugagguggg

SEQ ID NO: 472198 - RNA, 32 nt, Human
guaaucagcuacucgggaggcugaggcagggg

SEQ ID NO: 472199 - RNA, 32 nt, Human
guaaucaguauuaagaguguguuuuaccauuc

SEQ ID NO: 472200 - RNA, 32 nt, Human
guaaucagugcauccacaccucccaggaucca

SEQ ID NO: 472201 - RNA, 32 nt, Human
guaaucagugcauuugaaaauucaagccagca

SEQ ID NO: 472202 - RNA, 32 nt, Human
guaaucaucugaagaaauuggucccaagacau

SEQ ID NO: 472203 - RNA, 32 nt, Human
guaaucaugacagcugucuguuguuuuaugaa

SEQ ID NO: 472204 - RNA, 32 nt, Human
guaaucauggacccuucuccuggggcauuugu

SEQ ID NO: 472205 - RNA, 31 nt, Human
guaaucauggcggcggggguggcagcguggc

SEQ ID NO: 472206 - RNA, 32 nt, Human
guaaucauuucaaccaaaugaauuucaagcaa

SEQ ID NO: 472207 - RNA, 32 nt, Human
guaaucauuuuuaggccgggugcaguggcuca

SEQ ID NO: 472208 - RNA, 32 nt, Human
guaauccaacacuuugagaggcugaggcgggc

SEQ ID NO: 472209 - RNA, 32 nt, Human
guaauccaacuacccaggaggcugaggcauga

SEQ ID NO: 472210 - RNA, 32 nt, Human
guaauccacauccuccaucuugaguuacuccu

SEQ ID NO: 472211 - RNA, 32 nt, Human
guaauccagcacuuugggaggccgaggugggc

SEQ ID NO: 472212 - RNA, 32 nt, Human
guaauccagcuacucaggaggcugaggcagga

SEQ ID NO: 472213 - RNA, 32 nt, Human
guaauccagcuacucgggaggcugaggcagga

SEQ ID NO: 472214 - RNA, 32 nt, Human
guaauccagcuacuugggaggcugaggcagga

SEQ ID NO: 472215 - RNA, 32 nt, Human
guaauccagguaugugggaggcugagacacga

SEQ ID NO: 472216 - RNA, 32 nt, Human
guaauccauccaccuccaccucccaaggugcu

SEQ ID NO: 472217 - RNA, 32 nt, Human
guaaucccaaagugcugggauuacaggcguga

SEQ ID NO: 472218 - RNA, 32 nt, Human
guaaucccaaagugcugggauuacagguguga

SEQ ID NO: 472219 - RNA, 32 nt, Human
guaaucccaacacuuugagaggcugagguggg

SEQ ID NO: 472220 - RNA, 32 nt, Human
guaaucccaacacuuugggaggccgagguggg

SEQ ID NO: 472221 - RNA, 19 nt, Human
guaaucccaacuacuuggg

SEQ ID NO: 472222 - RNA, 32 nt, Human
guaaucccaagcagcugggauuacaggcacac

SEQ ID NO: 472223 - RNA, 19 nt, Human
guaaucccaccuacuuggg

SEQ ID NO: 472224 - RNA, 32 nt, Human
guaaucccacuacugcauuccagccugggugg

SEQ ID NO: 472225 - RNA, 32 nt, Human
guaaucccagaacaauggcuauucauguggga

SEQ ID NO: 472226 - RNA, 19 nt, Human
guaaucccagauacuuggg

SEQ ID NO: 472227 - RNA, 32 nt, Human
guaaucccagcaauuuggaggcugagguggga

SEQ ID NO: 472228 - RNA, 32 nt, Human
guaaucccagcacauugggaagaucacuugag

SEQ ID NO: 472229 - RNA, 32 nt, Human
guaaucccagcaccuugggaggcugagguggg

SEQ ID NO: 472230 - RNA, 32 nt, Human
guaaucccagcacuaugggaggcugaggugag

SEQ ID NO: 472231 - RNA, 32 nt, Human
guaaucccagcacuaugggaggcugagguggg

SEQ ID NO: 472232 - RNA, 32 nt, Human
guaaucccagcacucuggaaggcugagguggg

SEQ ID NO: 472233 - RNA, 32 nt, Human
guaaucccagcacucugggaggcugagacagg

SEQ ID NO: 472234 - RNA, 32 nt, Human
guaaucccagcacucugggaggcugagguggg

SEQ ID NO: 472235 - RNA, 32 nt, Human
guaaucccagcacugugagaggcugaggcggg

SEQ ID NO: 472236 - RNA, 32 nt, Human
guaaucccagcacugugggaagcugaggcggg

SEQ ID NO: 472237 - RNA, 32 nt, Human
guaaucccagcacugugggaggcugagguggu

SEQ ID NO: 472238 - RNA, 32 nt, Human
guaaucccagcacuuagggaggucaacguagg

SEQ ID NO: 472239 - RNA, 32 nt, Human
guaaucccagcacuucgggaggucaagguagg

SEQ ID NO: 472240 - RNA, 32 nt, Human
guaaucccagcacuuggagaggcugagguugc

SEQ ID NO: 472241 - RNA, 32 nt, Human
guaaucccagcacuuggggaagccgagucagg

SEQ ID NO: 472242 - RNA, 32 nt, Human
guaaucccagcacuuggggaagcugagguggg

SEQ ID NO: 472243 - RNA, 32 nt, Human
guaaucccagcacuuggggaggccaaagcggu

SEQ ID NO: 472244 - RNA, 32 nt, Human
guaaucccagcacuuggggaggccaaggaggg

SEQ ID NO: 472245 - RNA, 32 nt, Human
guaaucccagcacuuggggaggcugagauggg

SEQ ID NO: 472246 - RNA, 32 nt, Human
guaaucccagcacuuggggaggcugaggcagg

SEQ ID NO: 472247 - RNA, 32 nt, Human
guaaucccagcacuuugagagacugagacagg

SEQ ID NO: 472248 - RNA, 32 nt, Human
guaaucccagcacuuugagaggccaagacagg

SEQ ID NO: 472249 - RNA, 32 nt, Human
guaaucccagcacuuugagaggccaaggaggg

SEQ ID NO: 472250 - RNA, 32 nt, Human
guaaucccagcacuuugagaugcugaggcagg

SEQ ID NO: 472251 - RNA, 32 nt, Human
guaaucccagcacuuugcgauaccaaggcggg

SEQ ID NO: 472252 - RNA, 32 nt, Human
guaaucccagcacuuuggaaggccaagguaga

SEQ ID NO: 472253 - RNA, 32 nt, Human
guaaucccagcacuuugggaagccaagaugag

SEQ ID NO: 472254 - RNA, 32 nt, Human
guaaucccagcacuuugggaagcugaagcagg

SEQ ID NO: 472255 - RNA, 32 nt, Human
guaaucccagcacuuugggaagcugagauggg

SEQ ID NO: 472256 - RNA, 32 nt, Human
guaaucccagcacuuugggaagcugaggcagg

SEQ ID NO: 472257 - RNA, 32 nt, Human
guaaucccagcacuuugggaagcugagguggg

SEQ ID NO: 472258 - RNA, 32 nt, Human
guaaucccagcacuuugggaagucaaggcagg

SEQ ID NO: 472259 - RNA, 32 nt, Human
guaaucccagcacuuugggagaccgaggcagg

SEQ ID NO: 472260 - RNA, 32 nt, Human
guaaucccagcacuuugggagacugagauggg

SEQ ID NO: 472261 - RNA, 32 nt, Human
guaaucccagcacuuugggagacugaggaggg

SEQ ID NO: 472262 - RNA, 32 nt, Human
guaaucccagcacuuugggagacugaggcggg

SEQ ID NO: 472263 - RNA, 32 nt, Human
guaaucccagcacuuugggaggccaacacagg

SEQ ID NO: 472264 - RNA, 32 nt, Human
guaaucccagcacuuugggaggccaagacagg

SEQ ID NO: 472265 - RNA, 32 nt, Human
guaaucccagcacuuugggaggccaagaccaa

SEQ ID NO: 472266 - RNA, 32 nt, Human
guaaucccagcacuuugggaggccaaggaagg

SEQ ID NO: 472267 - RNA, 32 nt, Human
guaaucccagcacuuugggaggccaagggagg

SEQ ID NO: 472268 - RNA, 32 nt, Human
guaaucccagcacuuugggaggccaagguugg

SEQ ID NO: 472269 - RNA, 32 nt, Human
guaaucccagcacuuugggaggccaaugcagg

SEQ ID NO: 472270 - RNA, 32 nt, Human
guauguauguuacuaaguuaaacuuagaaaca

SEQ ID NO: 472271 - RNA, 32 nt, Human
guauguauuucaauaagaacuaaaugcaguaa

SEQ ID NO: 472272 - RNA, 32 nt, Human
guauguauuugcuugugaaauuaaagucaccu

SEQ ID NO: 472273 - RNA, 32 nt, Human
guaugucaccuguagauuuccacacgccaagc

SEQ ID NO: 472274 - RNA, 32 nt, Human
guaugucaugcuguuuaugugugacuaccggg

SEQ ID NO: 472275 - RNA, 32 nt, Human
guauguccagaagaaagagaaagaccaucaau

SEQ ID NO: 472276 - RNA, 32 nt, Human
guauguccauuauaggacacugugggccauaa

SEQ ID NO: 472277 - RNA, 32 nt, Human
guauguccugcugccgaugccuucauuaaaau

SEQ ID NO: 472278 - RNA, 32 nt, Human
guaugucucugaguaggacuuggaccuuuccu

SEQ ID NO: 472279 - RNA, 32 nt, Human
guaugucucugcugccugccucuuuccucuga

SEQ ID NO: 472280 - RNA, 32 nt, Human
guaugucugauacuagaaacuaauuugcuuau

SEQ ID NO: 472281 - RNA, 32 nt, Human
guaugucugguucucaauuccaacaguuuaau

SEQ ID NO: 472282 - RNA, 32 nt, Human
guaugucuuuauuagcagugugagaauggacu

SEQ ID NO: 472283 - RNA, 32 nt, Human
guaugugagauguuuugacacaggcaugcaau

SEQ ID NO: 472284 - RNA, 32 nt, Human
guaugugaugcuguaggcuuggcuccaaacca

SEQ ID NO: 472285 - RNA, 32 nt, Human
guaugugauugugugagugugggcaggugagu

SEQ ID NO: 472286 - RNA, 32 nt, Human
guaugugcacacaaaaguauucaagagacagu

SEQ ID NO: 472287 - RNA, 32 nt, Human
guaugugcagagauugaaaaauaaccuugaga

SEQ ID NO: 472288 - RNA, 32 nt, Human
guaugugcaguauuuaagaaaaugacauucua

SEQ ID NO: 472289 - RNA, 32 nt, Human
guaugugccaggcacuaugcuaagcacuuuac

SEQ ID NO: 472290 - RNA, 32 nt, Human
guaugugccaggcuugccugggcugggcagcc

SEQ ID NO: 472291 - RNA, 32 nt, Human
guaugugcccugucaccugccauuccagaacu

SEQ ID NO: 472292 - RNA, 32 nt, Human
guaugugcccuucuucacacagacacuaacga

SEQ ID NO: 472293 - RNA, 32 nt, Human
guaugugccuguaaucccagcuacuugggagg

SEQ ID NO: 472294 - RNA, 32 nt, Human
guaugugccuguagucucagcuacucaggagg

SEQ ID NO: 472295 - RNA, 32 nt, Human
guaugugcuagguaggaguggagggagauaug

SEQ ID NO: 472296 - RNA, 32 nt, Human
guaugugcuaucucuaauacgcuacuucgaua

SEQ ID NO: 472297 - RNA, 32 nt, Human
guauguggacucccagcuaagcagaaaacuau

SEQ ID NO: 472298 - RNA, 32 nt, Human
guauguggauagcgugaaagaagcuugugauc

SEQ ID NO: 472299 - RNA, 32 nt, Human
guaugugggaccccagaccaucccagccaccc

SEQ ID NO: 472300 - RNA, 32 nt, Human
guaugugggagguggauaggucggugaugugu

SEQ ID NO: 472301 - RNA, 32 nt, Human
guauguguauauguuucauguacaagcaagca

SEQ ID NO: 472302 - RNA, 32 nt, Human
guaugugugugacaggaaaaucuguagagaag

SEQ ID NO: 472303 - RNA, 32 nt, Human
guauguguuugcuuuugcuugcacugaaaauu

SEQ ID NO: 472304 - RNA, 32 nt, Human
guauguguuuuuaaacccuuucuaaauaugca

SEQ ID NO: 472305 - RNA, 32 nt, Human
guauguuaaagccacagagauagagcugagga

SEQ ID NO: 472306 - RNA, 32 nt, Human
guauguuauacagacauauacacauacauaca

SEQ ID NO: 472307 - RNA, 32 nt, Human
guauguuauauaagagaaugacauacuguggc

SEQ ID NO: 472308 - RNA, 29 nt, Human
guauguuauuaaagauacaaaauguuggg

SEQ ID NO: 472309 - RNA, 32 nt, Human
guauguucaguuaacaaauuauuuguaaugua

SEQ ID NO: 472310 - RNA, 32 nt, Human
guauguucucagaacauuuuucacaaugugua

SEQ ID NO: 472311 - RNA, 32 nt, Human
guauguucuggggacgugucugcuugcccaug

SEQ ID NO: 472312 - RNA, 32 nt, Human
guauguugagccacuguugucaugccagccag

SEQ ID NO: 472313 - RNA, 32 nt, Human
guauguuuaagcucaggcuggaaaaggaucac

SEQ ID NO: 472314 - RNA, 32 nt, Human
guauguuugcuccuuguccauccaccaguccc

SEQ ID NO: 472315 - RNA, 32 nt, Human
guauguuuggaaagaauuuuuguauuuauucc

SEQ ID NO: 472316 - RNA, 32 nt, Human
guauguuuucucuccaggugcagccagaucuc

SEQ ID NO: 472317 - RNA, 32 nt, Human
guauguuuuguuguuuuguuuuggaaacugga

SEQ ID NO: 472318 - RNA, 32 nt, Human
guauuaaccccagagcacugaagagacuugug

SEQ ID NO: 472319 - RNA, 32 nt, Human
guauuaagcaagaauuaggagaauggcugucc

SEQ ID NO: 472320 - RNA, 32 nt, Human
guauuaagugagaguuccuguucugcauccuc

SEQ ID NO: 472321 - RNA, 32 nt, Human
guauuaaucuuucucucaguguuuuauaggag

SEQ ID NO: 472322 - RNA, 32 nt, Human
guauuaauguacagaguggccccucaccuggg

SEQ ID NO: 472323 - RNA, 32 nt, Human
guauuaaugucaguacuaccagcacuuugcca

SEQ ID NO: 472324 - RNA, 32 nt, Human
guauuacaggcgugagccaccaugcccagccu

SEQ ID NO: 472325 - RNA, 32 nt, Human
guauuacccacugggaaacagugguaacccac

SEQ ID NO: 472326 - RNA, 32 nt, Human
guauuacccuugcuuuuucaaaugauaaaagg

SEQ ID NO: 472327 - RNA, 32 nt, Human
guauuacccuugcuuuuucaaaugauaaaaua

SEQ ID NO: 472328 - RNA, 32 nt, Human
guauuacugagucuuggagucaucucugagag

SEQ ID NO: 472329 - RNA, 32 nt, Human
guauuacugcagcugcccaaagaugcuuuauu

SEQ ID NO: 472330 - RNA, 32 nt, Human
guauuacuguggugaaacaaaauaucuuuaaa

SEQ ID NO: 472331 - RNA, 32 nt, Human
guauuagagguccacaaagaacuauuuggagc

SEQ ID NO: 472332 - RNA, 32 nt, Human
guauuagauauggcagaaaaaccauuuccacu

SEQ ID NO: 472333 - RNA, 32 nt, Human
guauuagccagccucgccucccugccccacgu

SEQ ID NO: 472334 - RNA, 32 nt, Human
guauuaggaaguggggcuuggggaggugauua

SEQ ID NO: 472335 - RNA, 32 nt, Human
guauuaggauaguuccagcaguaaugccucaa

SEQ ID NO: 472336 - RNA, 32 nt, Human
guauuagucauuuagagguauaguuacuauua

SEQ ID NO: 472337 - RNA, 32 nt, Human
guauuaguuaugaguuugguugcaguguucuu

SEQ ID NO: 472338 - RNA, 32 nt, Human
guauuaguuccuguaacucaaaccagaauuuu

SEQ ID NO: 472339 - RNA, 32 nt, Human
guauuauaaguauuguuacacaggguuaugca

SEQ ID NO: 472340 - RNA, 32 nt, Human
guauuaucucaaggaauguacaaacuuuaguu

SEQ ID NO: 472341 - RNA, 32 nt, Human
guauuaucucacuaaugugcuaugucagccag

SEQ ID NO: 472342 - RNA, 32 nt, Human
guauuaucuccacuuucaaucucccuccaagc

SEQ ID NO: 472343 - RNA, 32 nt, Human
guauuaucuguaaauuccagacauuguaggaa

SEQ ID NO: 472344 - RNA, 32 nt, Human
guauuaugaauccauuccuuugaauuucauuu

SEQ ID NO: 472345 - RNA, 32 nt, Human
guauuaugacaugugacaggugaacucuggga

SEQ ID NO: 472346 - RNA, 32 nt, Human
guauuaugagggcuggauaauuucaugcccac

SEQ ID NO: 472347 - RNA, 32 nt, Human
guauuauggagcugcuuccucucuccaggcuc

SEQ ID NO: 472348 - RNA, 32 nt, Human
guauuaugggcgugaaccaccaugcccagccg

SEQ ID NO: 472349 - RNA, 32 nt, Human
guauuauugaaggugccagggaugggaaaggu

SEQ ID NO: 472350 - RNA, 32 nt, Human
guauucacagcugcuuggauggcugaggcagg

SEQ ID NO: 472351 - RNA, 32 nt, Human
guauucaccaugggguaccccaugcaagcaca

SEQ ID NO: 472352 - RNA, 32 nt, Human
guauucacugucacuuuuucucauguucuaau

SEQ ID NO: 472353 - RNA, 32 nt, Human
guauucagcaccuguugcaguaugaaugacac

SEQ ID NO: 472354 - RNA, 32 nt, Human
guauucaguaaacaggcugccucuccagggag

SEQ ID NO: 472355 - RNA, 32 nt, Human
guauucagugaugucauucuuuauuuauuuuu

SEQ ID NO: 472356 - RNA, 32 nt, Human
guauucagugccuggcgcggugcuagaugcug

SEQ ID NO: 472357 - RNA, 31 nt, Human
guauucaugcuuugguugcauuuaaauugcu

SEQ ID NO: 472358 - RNA, 32 nt, Human
guauuccaaagcccaauuaugugaugguuuuc

SEQ ID NO: 472359 - RNA, 24 nt, Human
guauuccacaauaguacuuacucu

SEQ ID NO: 472360 - RNA, 32 nt, Human
guauuccacacagcauugccucugaccaaggc

SEQ ID NO: 472361 - RNA, 32 nt, Human
guauuccagcacuuugggaggccgaggcgggu

SEQ ID NO: 472362 - RNA, 32 nt, Human
guauuccagcacuuugggaggccgaggugggc

SEQ ID NO: 472363 - RNA, 32 nt, Human
guauuccagggagccuuucuuggcccucaguu

SEQ ID NO: 472364 - RNA, 32 nt, Human
guauuccaggugcucaggaggcugaggcagga

SEQ ID NO: 472365 - RNA, 32 nt, Human
guauuccauauguacaugugaaaugauguuuu

SEQ ID NO: 472366 - RNA, 32 nt, Human
guauuccaucaucuuccuuuuucauuccaguc

SEQ ID NO: 472367 - RNA, 32 nt, Human
guauuccaugagcugcucaucacaguucuuuc

SEQ ID NO: 472368 - RNA, 32 nt, Human
guauuccaugagcugcucauuacaguucuuuc

SEQ ID NO: 472369 - RNA, 32 nt, Human
guauucccaacacuuuuggaggcugagguugg

SEQ ID NO: 472370 - RNA, 32 nt, Human
guauucccagcuacucagaggcugaggcagga

SEQ ID NO: 472371 - RNA, 32 nt, Human
guauucccagcugcuugggaggcugaggcagg

SEQ ID NO: 472372 - RNA, 18 nt, Human
guauucccuuuugcugcc

SEQ ID NO: 472373 - RNA, 32 nt, Human
guauuccugacaggagcccugaugucuuaaau

SEQ ID NO: 472374 - RNA, 32 nt, Human
guauuccugcauucaaaugucagccguuugua

SEQ ID NO: 472375 - RNA, 32 nt, Human
guauuccugccacucugcuccgccucagccuu

SEQ ID NO: 472376 - RNA, 32 nt, Human
guauuccugccugggccuccuggcacaagaga

SEQ ID NO: 472377 - RNA, 32 nt, Human
guauuccugcugucuguguuguccagagagcg

SEQ ID NO: 472378 - RNA, 32 nt, Human
guauuccuggugcugaauaaaggguguugcug

SEQ ID NO: 472379 - RNA, 32 nt, Human
guauuccuuggcccaguuauguucuugaauug

SEQ ID NO: 472380 - RNA, 32 nt, Human
guauuccuuuuugagaaggcaccugaagaaga

SEQ ID NO: 472381 - RNA, 32 nt, Human
guauucgguacuggacaaaaagacuggacugc

SEQ ID NO: 472382 - RNA, 32 nt, Human
guauucuaacuuuaaaagacaagugcaacaaa

SEQ ID NO: 472383 - RNA, 32 nt, Human
guauucuaccucacacuccagcgugggcuuuu

SEQ ID NO: 472384 - RNA, 32 nt, Human
guauucuagacagauccucaguuggguuuucu

SEQ ID NO: 472385 - RNA, 32 nt, Human
guauucuagacagauccucgguuggguuuucu

SEQ ID NO: 472386 - RNA, 32 nt, Human
guauucucaccacauuucguuuagucuacuca

SEQ ID NO: 472387 - RNA, 32 nt, Human
guauucucaguuuacagaccacugaccagagg

SEQ ID NO: 472388 - RNA, 32 nt, Human
guauucucauuucucacaccagccuuccaccc

SEQ ID NO: 472389 - RNA, 32 nt, Human
guauucucauuuguuuggcugcauaaucaagc

SEQ ID NO: 472390 - RNA, 32 nt, Human
guauucugccuguguucuccuccagucccacc

SEQ ID NO: 472391 - RNA, 32 nt, Human
guauucugcuuccacaugugccaguugccugg

SEQ ID NO: 472392 - RNA, 32 nt, Human
guauucuguaccauagcgcugcucuuaugcca

SEQ ID NO: 472393 - RNA, 21 nt, Human
guauucuguauagcuuacucu

SEQ ID NO: 472394 - RNA, 32 nt, Human
guauucuguguagugggaugagcagagaacaa

SEQ ID NO: 472395 - RNA, 32 nt, Human
guauucuguucuaauuucugcuucacugugag

SEQ ID NO: 472396 - RNA, 32 nt, Human
guauucuuagcacugaguauaaggcugcuacu

SEQ ID NO: 472397 - RNA, 32 nt, Human
guauucuucucuuccuuuuaucaguaggugcc

SEQ ID NO: 472398 - RNA, 32 nt, Human
guauucuugugggggcucucaaaggaaacaag

SEQ ID NO: 472399 - RNA, 32 nt, Human
guauucuuuagauccuaguauuuggaaaacaa

SEQ ID NO: 472400 - RNA, 32 nt, Human
guauugaaaggcaguuuuaccaggccucaagc

SEQ ID NO: 472401 - RNA, 32 nt, Human
guauugaacuccuggccucaagcaauccuccc

SEQ ID NO: 472402 - RNA, 32 nt, Human
guauugaaggcugcucucugaagcucccugcc

SEQ ID NO: 472403 - RNA, 32 nt, Human
guauugaauauauguaaggaaguauuggaaac

SEQ ID NO: 472404 - RNA, 32 nt, Human
guauugacugccuucacugccuggugauccuc

SEQ ID NO: 472405 - RNA, 32 nt, Human
guauugagacugaggagaaugauagagaguga

SEQ ID NO: 472406 - RNA, 32 nt, Human
guauugagggagauuguguccauaccaagcca

SEQ ID NO: 472407 - RNA, 32 nt, Human
guauugaggugcaggcuucuuccccuuuguuc

SEQ ID NO: 472408 - RNA, 32 nt, Human
guauugagucuuccuuucaaggaccauaaggu

SEQ ID NO: 472409 - RNA, 32 nt, Human
guauugagugugagguugaggugggacauuug

SEQ ID NO: 472410 - RNA, 32 nt, Human
guauugaucugagccagcaucccccaagacuu

SEQ ID NO: 472411 - RNA, 32 nt, Human
guauugauuacauuguggacuuugaaugugag

SEQ ID NO: 472412 - RNA, 32 nt, Human
guauugauuaggaaaagagacagaguaauuug

SEQ ID NO: 472413 - RNA, 32 nt, Human
guauugcaaaggccgcuuauggucuguuuggg

SEQ ID NO: 472414 - RNA, 32 nt, Human
guauugcaccagacaaacaccagacgucaagg

SEQ ID NO: 472415 - RNA, 32 nt, Human
guauugcaugaagauggcuggcagcugagucc

SEQ ID NO: 472416 - RNA, 32 nt, Human
guauugccaaggucaaggccaacuggaagcau

SEQ ID NO: 472417 - RNA, 32 nt, Human
guauugccaucuccuguaaauucaaaggcaca

SEQ ID NO: 472418 - RNA, 32 nt, Human
guauugcccaggcuggagugcaguggcgcgau

SEQ ID NO: 472419 - RNA, 32 nt, Human
guauugcccaggcuggagugugguggcacaau

SEQ ID NO: 472420 - RNA, 32 nt, Human
guauugcccugaggcuuauauucugccucagu

SEQ ID NO: 472421 - RNA, 32 nt, Human
guauugcucacugcagccccucugccccuauc

SEQ ID NO: 472422 - RNA, 32 nt, Human
guauugcucauuuccuucucuacccaaccuga

SEQ ID NO: 472423 - RNA, 32 nt, Human
guauugcuuuuaacauucuacuuugccaguuu

SEQ ID NO: 472424 - RNA, 32 nt, Human
guauuggaggucuuuaggaggagagaagcgug

SEQ ID NO: 472425 - RNA, 32 nt, Human
guauuggcaccugccuccucuucggccacccc

SEQ ID NO: 472426 - RNA, 32 nt, Human
guauuggcucuuuuaucaucagaauaggaaaa

SEQ ID NO: 472427 - RNA, 32 nt, Human
guauugggagguuucugggaagggcagaggau

SEQ ID NO: 472428 - RNA, 32 nt, Human
guauugggggacugugcuagcuuuacccccgc

SEQ ID NO: 472429 - RNA, 32 nt, Human
guauuggggucugaccccaaacaccuuccagc

SEQ ID NO: 472430 - RNA, 32 nt, Human
guauugggguggagguugcagugagcagagau

SEQ ID NO: 472431 - RNA, 32 nt, Human
guauugggguggagguugcagugagcggagau

SEQ ID NO: 472432 - RNA, 32 nt, Human
guauugguagagcugaggaagaguuagggccu

SEQ ID NO: 472433 - RNA, 32 nt, Human
guauuguaaauguguguuccuccuagguugga

SEQ ID NO: 472434 - RNA, 32 nt, Human
guauuguaaauucccuuuaguuuguuacagua

SEQ ID NO: 472435 - RNA, 32 nt, Human
guauuguaacagcaacuugucaaaccuaagca

SEQ ID NO: 472436 - RNA, 32 nt, Human
guauugucagugugugcuagcugugugucugu

SEQ ID NO: 472437 - RNA, 32 nt, Human
guauuguccugccucugccuuuucugucucag

SEQ ID NO: 472438 - RNA, 32 nt, Human
guauugugacauaaugcugggcccaacaccug

SEQ ID NO: 472439 - RNA, 32 nt, Human
guauugugaccgcggagccacaggggacccca

SEQ ID NO: 472440 - RNA, 32 nt, Human
guauuguggcaucagauaaugccaccaaagga

SEQ ID NO: 472441 - RNA, 32 nt, Human
guauuguggggaggggaguuccaagugugccc

SEQ ID NO: 472442 - RNA, 32 nt, Human
guauuguggugugguuucauuucucagagaag

SEQ ID NO: 472443 - RNA, 32 nt, Human
guauuguucagaccucagcuccugggggccgg

SEQ ID NO: 472444 - RNA, 32 nt, Human
guauuguucagugggauuuggaaaagaugccu

SEQ ID NO: 472445 - RNA, 32 nt, Human
guauuguuugugcuaagcauuguguuagauuu

SEQ ID NO: 472446 - RNA, 32 nt, Human
guauuuaaacuaaggcauuaagagauauuaga

SEQ ID NO: 472447 - RNA, 32 nt, Human
guauuuaaaguuaggaagaucugggagauagg

SEQ ID NO: 472448 - RNA, 32 nt, Human
guauuuaacucauaugaucucccuucagcaac

SEQ ID NO: 472449 - RNA, 32 nt, Human
guauuuaagcucaggccuagcagaugcaaagu

SEQ ID NO: 472450 - RNA, 32 nt, Human
guauuuacauuagaagucugauucacaggucg

SEQ ID NO: 472451 - RNA, 32 nt, Human
guauuuaccaggggagugggaaaaagaguuga

SEQ ID NO: 472452 - RNA, 32 nt, Human
guauuuacuguacauagacuucaaugauuuua

SEQ ID NO: 472453 - RNA, 32 nt, Human
guauuuagaaauuucuguucaaaauuucaggc

SEQ ID NO: 472454 - RNA, 32 nt, Human
guauuuauacagcugcuucugccacacgcacc

SEQ ID NO: 472455 - RNA, 32 nt, Human
guauuuauccaaugccaacuguaugcuaggua

SEQ ID NO: 472456 - RNA, 32 nt, Human
guauuuauccaaugccuguacucucauuguau

SEQ ID NO: 472457 - RNA, 32 nt, Human
guauuuauccacccaaaccccagacugagaua

SEQ ID NO: 472458 - RNA, 32 nt, Human
guauuuaugaaucaggguuaggcuccauauuu

SEQ ID NO: 472459 - RNA, 32 nt, Human
guauuuaugcaaggaaggauauacugagcuga

SEQ ID NO: 472460 - RNA, 32 nt, Human
guauuuauggcagaaggaccuaaauaaacugu

SEQ ID NO: 472461 - RNA, 32 nt, Human
guauuuauuuaaucucccaaaacaacugagaa

SEQ ID NO: 472462 - RNA, 32 nt, Human
guauuuauuuucccuguguuugucucuagugu

SEQ ID NO: 472463 - RNA, 32 nt, Human
guauuuauuuugcuuugagaagaggcuccucu

SEQ ID NO: 472464 - RNA, 32 nt, Human
guauuucagaaggagaaggcuggagaaggaca

SEQ ID NO: 472465 - RNA, 32 nt, Human
guauuucagauccgcucuggcccagugggcag

SEQ ID NO: 472466 - RNA, 32 nt, Human
guauuucaucccuagagcaggucagccuccuu

SEQ ID NO: 472467 - RNA, 23 nt, Human
guauuucaucucaagcuugcucu

SEQ ID NO: 472468 - RNA, 32 nt, Human
guauuucaugaaauuaaaacagugaugcuaaa

SEQ ID NO: 472469 - RNA, 32 nt, Human
guauuuccaguuuuggaaaguuuucaauacau

SEQ ID NO: 472470 - RNA, 32 nt, Human
guauuucccaagaaaguauccuuuguaaaaac

SEQ ID NO: 472471 - RNA, 32 nt, Human
guauuucccaggcuggagugcagaggcacgau

SEQ ID NO: 472472 - RNA, 32 nt, Human
guauuuccgcagcaaccaacuggcaugaagaa

SEQ ID NO: 472473 - RNA, 32 nt, Human
guauuuccuaacaacagagagauucucuuaug

SEQ ID NO: 472474 - RNA, 32 nt, Human
guauuuccuaauuuauguaucuuggucagcuu

SEQ ID NO: 472475 - RNA, 32 nt, Human
guauuuccucuucccauugucaggcccugugg

SEQ ID NO: 472476 - RNA, 32 nt, Human
guauuuccuggcaucccucccccugagacacc

SEQ ID NO: 472477 - RNA, 32 nt, Human
guauuuccuucuucaacaaagaagaaaugccc

SEQ ID NO: 472478 - RNA, 32 nt, Human
guauuucuauagcaccucucuauuggguuuau

SEQ ID NO: 472479 - RNA, 32 nt, Human
guauuucucccauuucucccucuccuucccug

SEQ ID NO: 472480 - RNA, 32 nt, Human
guauuucucccuucccacucugccucaaguga

SEQ ID NO: 472481 - RNA, 32 nt, Human
guauuucugauucucccucucuucgaauuauc

SEQ ID NO: 472482 - RNA, 32 nt, Human
guauuucugcucaugaaagaguuucacuauuu

SEQ ID NO: 472483 - RNA, 32 nt, Human
guauuucuuaccauuuuaucuuccucaugcca

SEQ ID NO: 472484 - RNA, 32 nt, Human
guauuugaaauggcaaaggaugugcuucaucc

SEQ ID NO: 472485 - RNA, 32 nt, Human
guauuugaaccaggcauccuggcuccagagcc

SEQ ID NO: 472486 - RNA, 32 nt, Human
guauuugaagaagaaugaugcauuuugacaag

SEQ ID NO: 472487 - RNA, 31 nt, Human
guauuugacaggagguaaacagcagacaaaa

SEQ ID NO: 472488 - RNA, 32 nt, Human
guauuugauaggguauugaguguauuuugugu

SEQ ID NO: 472489 - RNA, 32 nt, Human
guauuugauugaugucucaugccuuccuaaaa

SEQ ID NO: 472490 - RNA, 32 nt, Human
guauuugcaaacugagcuuguuggagggaagg

SEQ ID NO: 472491 - RNA, 32 nt, Human
guauuugcaauuuuucuuugucaguguggcuu

SEQ ID NO: 472492 - RNA, 32 nt, Human
guauuugcccacugaauaauguaugucuauga

SEQ ID NO: 472493 - RNA, 32 nt, Human
guauuugcucuaccaucucucccuagagcacu

SEQ ID NO: 472494 - RNA, 32 nt, Human
guauuugcuugucccaauacaagaaugccaaa

SEQ ID NO: 472495 - RNA, 32 nt, Human
guauuuggaagaugauuuaaauucagcaacgc

SEQ ID NO: 472496 - RNA, 32 nt, Human
guauuuggaagauuuaaaaaccuagcauccug

SEQ ID NO: 472497 - RNA, 32 nt, Human
guauuuggagguggugccaccgccucuuccug

SEQ ID NO: 472498 - RNA, 32 nt, Human
guauuuggcaguguucaucacaggcuagagag

SEQ ID NO: 472499 - RNA, 32 nt, Human
guauuugggaaguggaaaagagcccucaguug

SEQ ID NO: 472500 - RNA, 32 nt, Human
guauuuggguucaagcuuugaagguucuggga

SEQ ID NO: 472501 - RNA, 23 nt, Human
guauuugguaaaaguguaaagua

SEQ ID NO: 472502 - RNA, 32 nt, Human
guauuugucuuuuuacuacauguaggaacucu

SEQ ID NO: 472503 - RNA, 32 nt, Human
guauuuuaaaguaugugucucuaaaggaagaa

SEQ ID NO: 472504 - RNA, 22 nt, Human
guauuuuaaguaaagcuucucu

SEQ ID NO: 472505 - RNA, 32 nt, Human
guauuuuauauacucaguuuuauaaggugaua

SEQ ID NO: 472506 - RNA, 29 nt, Human
guauuuuaucugugugugcucaggaggug

SEQ ID NO: 472507 - RNA, 32 nt, Human
guauuuucaccaagccuuuucauaaucaaguu

SEQ ID NO: 472508 - RNA, 31 nt, Human
guauuuucaucaaguagcguuggagacauac

SEQ ID NO: 472509 - RNA, 32 nt, Human
guauuuucauuucucucaagcucuuucaauaa

SEQ ID NO: 472510 - RNA, 32 nt, Human
guauuuuccaaaagaagagcaagggcccggcu

SEQ ID NO: 472511 - RNA, 32 nt, Human
guauuuuccacuuauuauuacuguauaacaua

SEQ ID NO: 472512 - RNA, 32 nt, Human
guauuuuccucaugcccuggagauaauggagc

SEQ ID NO: 472513 - RNA, 32 nt, Human
guauuuuccuuaggaauucaguggaacuuauc

SEQ ID NO: 472514 - RNA, 32 nt, Human
guauuuuccuucuuuguuucccccucuuucuu

SEQ ID NO: 472515 - RNA, 32 nt, Human
guauuuucggacuuugacauuugacauuuggu

SEQ ID NO: 472516 - RNA, 32 nt, Human
guauuuucugccauuuuucagggucuaagauu

SEQ ID NO: 472517 - RNA, 32 nt, Human
guauuuucuuggggaagaccuucaccuuugca

SEQ ID NO: 472518 - RNA, 32 nt, Human
guauuuugaaguuugacugcuugaaaaagauu

SEQ ID NO: 472519 - RNA, 32 nt, Human
guauuuugauucauccaaggguuuccaaacuu

SEQ ID NO: 472520 - RNA, 32 nt, Human
guauuuugcauuggaaaaaggaagcacugugu

SEQ ID NO: 472521 - RNA, 32 nt, Human
guauuuugcccaggcaacaguacuucaaacag

SEQ ID NO: 472522 - RNA, 32 nt, Human
guauuuuggcagcccuuuccccuagacaucua

SEQ ID NO: 472523 - RNA, 32 nt, Human
guauuuugguagaguauauacauaccucacug

SEQ ID NO: 472524 - RNA, 32 nt, Human
guauuuuggugucaauaaauaucuuguaccuc

SEQ ID NO: 472525 - RNA, 32 nt, Human
guauuuugugcaaugaagcccugcucccagcc

SEQ ID NO: 472526 - RNA, 32 nt, Human
guauuuuguuucacauuugaacagucauucuu

SEQ ID NO: 472527 - RNA, 32 nt, Human
guauuuuuaaagggauuagggauucuuaguau

SEQ ID NO: 472528 - RNA, 32 nt, Human
guauuuuuaagaauugaguuguuccugcuguu

SEQ ID NO: 472529 - RNA, 32 nt, Human
guauuuuuccagaauucuuuuguccuaugcag

SEQ ID NO: 472530 - RNA, 32 nt, Human
guauuuuuccagauucuuuguagccuuugaaa

SEQ ID NO: 472531 - RNA, 32 nt, Human
guauuuuuccagcuuacauuaacccuguugau

SEQ ID NO: 472532 - RNA, 32 nt, Human
guauuuuucuccccauuuuccagggagaaauc

SEQ ID NO: 472533 - RNA, 32 nt, Human
guauuuuucuggaaagaaaacuuucuuuaccc

SEQ ID NO: 472534 - RNA, 32 nt, Human
guauuuuucuuguacauuacuuccaguaaaua

SEQ ID NO: 472535 - RNA, 32 nt, Human
guauuuuucuuuuucuauaauaccuuuaacug

SEQ ID NO: 472536 - RNA, 32 nt, Human
guauuuuugccggcuggugaauucaaacaacc

SEQ ID NO: 472537 - RNA, 32 nt, Human
guauuuuuguaugaaaagugggagacuucuga

SEQ ID NO: 472538 - RNA, 32 nt, Human
gucaaaaaucaggcuggagugcaguggcauga

SEQ ID NO: 472539 - RNA, 32 nt, Human
gucaaaaauggagugacaccccagacucaguc

SEQ ID NO: 472540 - RNA, 31 nt, Human
gucaaaacauacucagaacauuuaaaaaugu

SEQ ID NO: 472541 - RNA, 22 nt, Human
gucaaaagaacaggaauucgga

SEQ ID NO: 472542 - RNA, 32 nt, Human
gucaaaagcaugagaagagcaaacagaaacag

SEQ ID NO: 472543 - RNA, 22 nt, Human
gucaaaaggcaggugcuagaca

SEQ ID NO: 472544 - RNA, 32 nt, Human
gucaaaauacaaaugcauagauaguaaaugau

SEQ ID NO: 472545 - RNA, 32 nt, Human
gucaaaauagaaaugcauagauaguaaaugau

SEQ ID NO: 472546 - RNA, 32 nt, Human
gucaaaauagccacuuuuauccuuaacauugu

SEQ ID NO: 472547 - RNA, 32 nt, Human
gucaaaauaucuuuggccauuuugcuaagaaa

SEQ ID NO: 472548 - RNA, 21 nt, Human
gucaaacaaaacccaauuuaa

SEQ ID NO: 472549 - RNA, 32 nt, Human
gucaaacaaugagguuguagggggagguaggg

SEQ ID NO: 472550 - RNA, 32 nt, Human
gucaaacacacaaaaauacugccuuguacugg

SEQ ID NO: 472551 - RNA, 32 nt, Human
gucaaacaccugcaccuugagauauccuacaa

SEQ ID NO: 472552 - RNA, 23 nt, Human
gucaaacauuccaaguacucuuu

SEQ ID NO: 472553 - RNA, 32 nt, Human
gucaaaccaacucccucucagaagaaccugau

SEQ ID NO: 472554 - RNA, 32 nt, Human
gucaaaccaagccaggccuggugggcuggacg

SEQ ID NO: 472555 - RNA, 32 nt, Human
gucaaaccacugcaauccagccugggcaacga

SEQ ID NO: 472556 - RNA, 32 nt, Human
gucaaacccugccuuuccuuuacuuuuacuuu

SEQ ID NO: 472557 - RNA, 32 nt, Human
gucaaaccuucccagggacauuccuaacaucu

SEQ ID NO: 472558 - RNA, 32 nt, Human
gucaaacgucauaccuuguguaccaucguaga

SEQ ID NO: 472559 - RNA, 22 nt, Human
gucaaacuacaucacuuguauc

SEQ ID NO: 472560 - RNA, 32 nt, Human
gucaaacucacagcagcacuguccucucaguu

SEQ ID NO: 472561 - RNA, 32 nt, Human
gucaaacucuccccaucucuacugccucaccc

SEQ ID NO: 472562 - RNA, 32 nt, Human
gucaaacucuuauuucagagcuucaugaauuu

SEQ ID NO: 472563 - RNA, 24 nt, Human
gucaaacugcaaacauuuugcauc

SEQ ID NO: 472564 - RNA, 32 nt, Human
gucaaacugucacaguaucugcuccauagguu

SEQ ID NO: 472565 - RNA, 32 nt, Human
gucaaagaagacugcaaagccuaugaugauaa

SEQ ID NO: 472566 - RNA, 32 nt, Human
gucaaagaaggaggaggaggguggggagcugg

SEQ ID NO: 472567 - RNA, 32 nt, Human
gucaaagaagucaaaggggcugccuggaggag

SEQ ID NO: 472568 - RNA, 32 nt, Human
gucaaagacagaaugguggaguguagccucca

SEQ ID NO: 472569 - RNA, 32 nt, Human
gucaaagaccuccuggccaaguccugcccucu

SEQ ID NO: 472570 - RNA, 32 nt, Human
gucaaagcaaaacaaaaacaauaaccaugauu

SEQ ID NO: 472571 - RNA, 32 nt, Human
gucaaagcaacaguccacacuuuguccaaugg

SEQ ID NO: 472572 - RNA, 32 nt, Human
gucaaagcaauccugccucaggcccccuagua

SEQ ID NO: 472573 - RNA, 19 nt, Human
gucaaagcaggcccugagg

SEQ ID NO: 472574 - RNA, 32 nt, Human
gucaaagccugcaggcgaaggacaggacagca

SEQ ID NO: 472575 - RNA, 32 nt, Human
gucaaagcguggcauugagauaauuggacuga

SEQ ID NO: 472576 - RNA, 32 nt, Human
gucaaagcuuucuagugacggucaguccuacu

SEQ ID NO: 472577 - RNA, 32 nt, Human
gucaaaggcaggcagggacugugaaauguuau

SEQ ID NO: 472578 - RNA, 18 nt, Human
gucaaaggcuccaagcga

SEQ ID NO: 472579 - RNA, 32 nt, Human
gucaaagguaauccaaucucacccucaucuug

SEQ ID NO: 472580 - RNA, 32 nt, Human
gucaaaggugugcagcuuccaaauggcauccc

SEQ ID NO: 472581 - RNA, 32 nt, Human
gucaaagguuaaggggcagcagcuggucuggc

SEQ ID NO: 472582 - RNA, 32 nt, Human
gucaaaguggacggauaccugaggucaggagc

SEQ ID NO: 472583 - RNA, 32 nt, Human
gucaaauaaaaauuuguuuuucagagauuuac

SEQ ID NO: 472584 - RNA, 32 nt, Human
gucaaauauauagugauaauguuaacauguuu

SEQ ID NO: 472585 - RNA, 32 nt, Human
gucaaauaucaggucacagcaugcagaagaac

SEQ ID NO: 472586 - RNA, 32 nt, Human
gucaaauauuacugccuugguagcauuuauuu

SEQ ID NO: 472587 - RNA, 23 nt, Human
gucaaaucauaguauccuaagca

SEQ ID NO: 472588 - RNA, 32 nt, Human
gucaaauccuacucuucaacuaccaucucugg

SEQ ID NO: 472589 - RNA, 21 nt, Human
gucaaauccucuuuccuuccc

SEQ ID NO: 472590 - RNA, 32 nt, Human
gucaaaugaacaaaccaguguucuaagagugu

SEQ ID NO: 472591 - RNA, 23 nt, Human
gucaaaugacuguguccuggaca

SEQ ID NO: 472592 - RNA, 32 nt, Human
gucaaaugagaguaaucaugcccacccucauu

SEQ ID NO: 472593 - RNA, 32 nt, Human
gucaaaugcccaggcagauagggguggguacc

SEQ ID NO: 472594 - RNA, 32 nt, Human
gucaaauguaaacccuggaaccugagucccaa

SEQ ID NO: 472595 - RNA, 32 nt, Human
gucaaauuacguauuuuuaugaccacguaaug

SEQ ID NO: 472596 - RNA, 32 nt, Human
gucaaauucggacuuguaggcgaucagggcug

SEQ ID NO: 472597 - RNA, 32 nt, Human
gucaaauucugacacuuuaaguggugagggag

SEQ ID NO: 472598 - RNA, 32 nt, Human
gucaaauuucaaaucacccaguguugaagaau

SEQ ID NO: 472599 - RNA, 21 nt, Human
gucaacaaaagccagcucuag

SEQ ID NO: 472600 - RNA, 32 nt, Human
gucaacaaagaaugguuaaaugcuaaggaagc

SEQ ID NO: 472601 - RNA, 21 nt, Human
gucaacaaagcaagacccuuu

SEQ ID NO: 472602 - RNA, 20 nt, Human
gucaacaaauucaggcucuu

SEQ ID NO: 472603 - RNA, 23 nt, Human
gucaacaacagaauaaagcucug

SEQ ID NO: 472604 - RNA, 22 nt, Human
gucaacaacaggagaagcucua

SEQ ID NO: 472605 - RNA, 32 nt, Human
gucaacaaccagccuguucugcuacuggugaa

SEQ ID NO: 472606 - RNA, 32 nt, Human
gucaacaaguauuuuaacucucaguccaacau

SEQ ID NO: 472607 - RNA, 19 nt, Human
gucaacaauaaaacacuga

SEQ ID NO: 472608 - RNA, 32 nt, Human
gucaacaaucccagaccugccaagccccauuu

SEQ ID NO: 472609 - RNA, 19 nt, Human
gucaacaaucucaacucug

SEQ ID NO: 472610 - RNA, 19 nt, Human
gucaacaauuaaaaaacug

SEQ ID NO: 472611 - RNA, 32 nt, Human
gucaacaauucagguguaucuauauucagaca

SEQ ID NO: 472612 - RNA, 32 nt, Human
gucaacacagaauuuauacagcagcuggugcu

SEQ ID NO: 472613 - RNA, 32 nt, Human
gucaacaccagaaagccuccucuggagaaucu

SEQ ID NO: 472614 - RNA, 32 nt, Human
gucaacaccauggacugaacacuugcugggcu

SEQ ID NO: 472615 - RNA, 32 nt, Human
gucaacacugcacuccagccugggcgacagag

SEQ ID NO: 472616 - RNA, 20 nt, Human
gucaacagagugagacucug

SEQ ID NO: 472617 - RNA, 19 nt, Human
gucaacagcugaacucuga

SEQ ID NO: 472618 - RNA, 23 nt, Human
gucaacaguaugaaggauucuga

SEQ ID NO: 472619 - RNA, 32 nt, Human
gucaacaguaugaaggauucugaccccugugc

SEQ ID NO: 472620 - RNA, 20 nt, Human
gucaacagugaaaccuuuga

SEQ ID NO: 472621 - RNA, 20 nt, Human
gucaacaguggaaaaucuga

SEQ ID NO: 472622 - RNA, 19 nt, Human
gucaacauagaagcuuuag

SEQ ID NO: 472623 - RNA, 32 nt, Human
gucaacauguagagucugcuucccucauuauu

SEQ ID NO: 472624 - RNA, 32 nt, Human
gucaacauguuucugauguggcauuuuuguuu

SEQ ID NO: 472625 - RNA, 23 nt, Human
gucaaccaggccagagugcagug

SEQ ID NO: 472626 - RNA, 32 nt, Human
gucaacccaggagccaagaaaagagaacuacg

SEQ ID NO: 472627 - RNA, 32 nt, Human
gucaacccccuucaaccuccucaccucucuaa

SEQ ID NO: 472628 - RNA, 32 nt, Human
gucaacccucugaggauggaaggcagugucuu

SEQ ID NO: 472629 - RNA, 23 nt, Human
gucaacccugcacugggagcuua

SEQ ID NO: 472630 - RNA, 32 nt, Human
gucaacccuguaauuccagcacuuugggaggg

SEQ ID NO: 472631 - RNA, 32 nt, Human
gucaaccgcaguaggaggugggggcgaagaga

SEQ ID NO: 472632 - RNA, 32 nt, Human
gucaaccugucugaaccuuaguauccuuuccu

SEQ ID NO: 472633 - RNA, 32 nt, Human
gucaaccuuucugagccacagcuucccgcugg

SEQ ID NO: 472634 - RNA, 32 nt, Human
gucaaccuuuucugcacaucuaguuuccuacc

SEQ ID NO: 472635 - RNA, 25 nt, Human
gucaacgcagacuggagugcagugg

SEQ ID NO: 472636 - RNA, 32 nt, Human
gucaacgggcgggugcuggagcuguuccgggc

SEQ ID NO: 472637 - RNA, 32 nt, Human
gucaacgggcuggggacacaaaauacucagag

SEQ ID NO: 472638 - RNA, 32 nt, Human
gucaacgguaugauuaacugccuuuguucugc

SEQ ID NO: 472639 - RNA, 32 nt, Human
gucaacgugagcuggugcuucgugugcuccaa

SEQ ID NO: 472640 - RNA, 23 nt, Human
gucaacuccaaggaauacugaga

SEQ ID NO: 472641 - RNA, 32 nt, Human
gucaacucugcuuaauuaagcacuuugaugau

SEQ ID NO: 472642 - RNA, 32 nt, Human
gucaacugaauuccccacuuccuggguaagaa

SEQ ID NO: 472643 - RNA, 24 nt, Human
gucaacugacaucuaugcuacaua

SEQ ID NO: 472644 - RNA, 32 nt, Human
gucaacugacuuccugcguggcugucggacug

SEQ ID NO: 472645 - RNA, 32 nt, Human
gucaacugagacugagacugggagcagaguug

SEQ ID NO: 472646 - RNA, 32 nt, Human
gucaacuggagacuaucugagaacaaaaggac

SEQ ID NO: 472647 - RNA, 32 nt, Human
gucaacuucacuucucacucuuauggucucaa

SEQ ID NO: 472648 - RNA, 32 nt, Human
gucaacuucuaucaacuucaggccaggcccgu

SEQ ID NO: 472649 - RNA, 32 nt, Human
gucaacuucucccaccugaccacaaaggacua

SEQ ID NO: 472650 - RNA, 32 nt, Human
gucaacuugucauauacaccuccagggaccaa

SEQ ID NO: 472651 - RNA, 32 nt, Human
gucaacuuugauccuuugucucccaggaaggu

SEQ ID NO: 472652 - RNA, 32 nt, Human
gucaacuuuucucuuggcuaacucuugaagcu

SEQ ID NO: 472653 - RNA, 32 nt, Human
gucaagaaaacgauucuagcucuggcucuguc

SEQ ID NO: 472654 - RNA, 32 nt, Human
gucaagaaaugagaugguucacuugacuacug

SEQ ID NO: 472655 - RNA, 32 nt, Human
gucaagaaggaaucugcucagagcagauucug

SEQ ID NO: 472656 - RNA, 32 nt, Human
gucaagaaucacccuuuccaaauccucugggu

SEQ ID NO: 472657 - RNA, 32 nt, Human
gucaagacagaugacaccagcacuuuaaacuc

SEQ ID NO: 472658 - RNA, 32 nt, Human
gucaagacagcuaggucucuguccuaaccucc

SEQ ID NO: 472659 - RNA, 32 nt, Human
gucaagaccaagggccuccuggaaacaccagc

SEQ ID NO: 472660 - RNA, 32 nt, Human
gucaagaccagccagggcaacaugaugagacc

SEQ ID NO: 472661 - RNA, 32 nt, Human
gucaagaccagccuggccaacguggugaaaca

SEQ ID NO: 472662 - RNA, 32 nt, Human
gucaagaccagccugggcaacacggugaaacc

SEQ ID NO: 472663 - RNA, 32 nt, Human
gucaagaccagccuugcagccaggugcagugg

SEQ ID NO: 472664 - RNA, 32 nt, Human
gucaagaccauccuggcuaacauggugaaacc

SEQ ID NO: 472665 - RNA, 32 nt, Human
gucaagaccccuggcccugcugagcgugaaac

SEQ ID NO: 472666 - RNA, 32 nt, Human
gucaagacucucagaagaaccuggaguaauug

SEQ ID NO: 472667 - RNA, 18 nt, Human
gucaagagaagacucuaa

SEQ ID NO: 472668 - RNA, 32 nt, Human
gucaagagacgcagagggccccugccaggguu

SEQ ID NO: 472669 - RNA, 32 nt, Human
gucaagagagaagaggaggagaagggaggggg

SEQ ID NO: 472670 - RNA, 32 nt, Human
gucaagagaggaagagagggaggagggguagg

SEQ ID NO: 472671 - RNA, 32 nt, Human
gucaagagccaagacacagguaaugcacgaca

SEQ ID NO: 472672 - RNA, 20 nt, Human
gucaagagcccuguguucca

SEQ ID NO: 472673 - RNA, 32 nt, Human
gucaagaggaagguccccauacacauguaccu

SEQ ID NO: 472674 - RNA, 31 nt, Human
gucaagaggcacuucuuuauuaauuaccaaa

SEQ ID NO: 472675 - RNA, 32 nt, Human
gucaagagggggcaagucacaugggcagagau

SEQ ID NO: 472676 - RNA, 32 nt, Human
gucaagaggugggagaggaaagggguagaugg

SEQ ID NO: 472677 - RNA, 32 nt, Human
gucaagagugagagaagagaagaaaauuagua

SEQ ID NO: 472678 - RNA, 32 nt, Human
gucaagaguuucagacuagccuugccaacaug

SEQ ID NO: 472679 - RNA, 20 nt, Human
gucaagauagccaagcaguu

SEQ ID NO: 472680 - RNA, 32 nt, Human
gucaagauaggauaugccucacccucagcuac

SEQ ID NO: 472681 - RNA, 32 nt, Human
gucaagaucagacuggccaacagaaugaaacc

SEQ ID NO: 472682 - RNA, 32 nt, Human
gucaagaucagccugaccaacaugaugaaacc

SEQ ID NO: 472683 - RNA, 32 nt, Human
gucaagaucagcucuggcuaguucucacaggu

SEQ ID NO: 472684 - RNA, 32 nt, Human
gucaagauugcagugagcuaugaucaugccac

SEQ ID NO: 472685 - RNA, 32 nt, Human
gucaagcagagcugggugggcugagaccagca

SEQ ID NO: 472686 - RNA, 32 nt, Human
gucaagcagaggaggaaggcagggguaccacc

SEQ ID NO: 472687 - RNA, 32 nt, Human
gucaagcauucauuauucugaagaggaggaga

SEQ ID NO: 472688 - RNA, 17 nt, Human
gucaagccaggugugga

SEQ ID NO: 472689 - RNA, 32 nt, Human
gucaagcccccuuugauugaguucaucaugag

SEQ ID NO: 472690 - RNA, 20 nt, Human
gucaagccccuggccugagg

SEQ ID NO: 472691 - RNA, 32 nt, Human
gucaagccggggagggcgaaaagggaaccugg

SEQ ID NO: 472692 - RNA, 32 nt, Human
gucaagccugaagauaguggcucugcuguuuu

SEQ ID NO: 472693 - RNA, 32 nt, Human
gucaagccuguaaucccaacacuuugggagac

SEQ ID NO: 472694 - RNA, 32 nt, Human
gucaagcgcaggcucuucagaaaccuagaaac

SEQ ID NO: 472695 - RNA, 32 nt, Human
gucaagcgccggcguucucugccaucacccuu

SEQ ID NO: 472696 - RNA, 32 nt, Human
gucaagcgguucugcucuggccccagaagauc

SEQ ID NO: 472697 - RNA, 32 nt, Human
gucaagcuacuuccugagcuucucucagauuu

SEQ ID NO: 472698 - RNA, 32 nt, Human
gucaagcucagugagcauucucagcacauugc

SEQ ID NO: 472699 - RNA, 32 nt, Human
gucaagcuggugucauugacuaccacauccac

SEQ ID NO: 472700 - RNA, 32 nt, Human
gucaagcuguuucuucaggcagccucucaaau

SEQ ID NO: 472701 - RNA, 32 nt, Human
gucaagcuugccucuucuugaggagcaccaac

SEQ ID NO: 472702 - RNA, 32 nt, Human
gucaaggaagaaaggaaggaaggaaggcgaga

SEQ ID NO: 472703 - RNA, 32 nt, Human
gucaaggagaggguguggacuggaggaaaucu

SEQ ID NO: 472704 - RNA, 32 nt, Human
gucaaggagcucagaggagggcccugaggucu

SEQ ID NO: 472705 - RNA, 32 nt, Human
gucaaggaggccagaaaacaagccagaauuuu

SEQ ID NO: 472706 - RNA, 18 nt, Human
gucaaggaggccccugag

SEQ ID NO: 472707 - RNA, 32 nt, Human
gucaaggccaacaccccagggagacccauuuc

SEQ ID NO: 472708 - RNA, 32 nt, Human
gucaaggccacccccaccccagaacagaaccg

SEQ ID NO: 472709 - RNA, 32 nt, Human
gucaaggccacccugggcuugaagggaccggc

SEQ ID NO: 472710 - RNA, 32 nt, Human
gucaaggccagcaagguggaguggaugccuca

SEQ ID NO: 472711 - RNA, 32 nt, Human
gucaaggccccauucuccucuggaaagccuuc

SEQ ID NO: 472712 - RNA, 32 nt, Human
gucaaggccgaacuccagccugguggcuuugc

SEQ ID NO: 472713 - RNA, 32 nt, Human
gucaaggccugcucccuguaggguccaaccag

SEQ ID NO: 472714 - RNA, 32 nt, Human
gucaaggcguagggcuggagggcaggggcggg

SEQ ID NO: 472715 - RNA, 32 nt, Human
gucaaggcucagagguaacaagacagaaaauu

SEQ ID NO: 472716 - RNA, 32 nt, Human
gucaaggcugcagugagccaugaucaugccac

SEQ ID NO: 472717 - RNA, 32 nt, Human
gucaaggcugggcccugcaguggggcgggccg

SEQ ID NO: 472718 - RNA, 32 nt, Human
gucaagggaagcuuccugugaaccaaaguucu

SEQ ID NO: 472719 - RNA, 31 nt, Human
gucaagggaauugcuuuccagaugcuaagaa

SEQ ID NO: 472720 - RNA, 32 nt, Human
gucaaggggcuuccaacuccagccucucaugg

SEQ ID NO: 472721 - RNA, 32 nt, Human
gucaagggggaccagagguugaccacugugga

SEQ ID NO: 472722 - RNA, 32 nt, Human
gucaagguaacagaacaaaagggaauccugau

SEQ ID NO: 472723 - RNA, 32 nt, Human
gucaaggucagccuggagcuggguggcggccu

SEQ ID NO: 472724 - RNA, 32 nt, Human
gucaaggugaagcacauacggcagaccucuua

SEQ ID NO: 472725 - RNA, 32 nt, Human
gucaaggugaagccccacgacaaggaugccaa

SEQ ID NO: 472726 - RNA, 32 nt, Human
gucaagguugcauccuuuugagcccaggaccu

SEQ ID NO: 472727 - RNA, 32 nt, Human
gucaaguaaaaauuuguuuuucagagauuuac

SEQ ID NO: 472728 - RNA, 18 nt, Human
gucaaguaaguuuaggga

SEQ ID NO: 472729 - RNA, 32 nt, Human
gucaaguagaggcaaugcaaagauucacauag

SEQ ID NO: 472730 - RNA, 32 nt, Human
gucaaguagccagaaacagguguucuggcuuu

SEQ ID NO: 472731 - RNA, 32 nt, Human
gucaaguaguaagucgaaccauccuaagucag

SEQ ID NO: 472732 - RNA, 22 nt, Human
gucaagucagagcaccuggaca

SEQ ID NO: 472733 - RNA, 32 nt, Human
gucaagucagaggaggaagcugagggccccga

SEQ ID NO: 472734 - RNA, 32 nt, Human
gucaagucuuacaugagugaagagacacgcag

SEQ ID NO: 472735 - RNA, 32 nt, Human
gucaagugaaacccccuuuuccagucauaaaa

SEQ ID NO: 472736 - RNA, 32 nt, Human
gucaagugauucugccuguaaucccagaauuu

SEQ ID NO: 472737 - RNA, 32 nt, Human
gucaaguggcugggggccaggaugccuggguu

SEQ ID NO: 472738 - RNA, 31 nt, Human
gucaaguggcuucucccugcccuaaggaggg

SEQ ID NO: 472739 - RNA, 32 nt, Human
gucaagugugcccagugcuuucucucagaacu

SEQ ID NO: 472740 - RNA, 32 nt, Human
gucaaguuccaaaagcagaggcggccuuggcg

SEQ ID NO: 472741 - RNA, 32 nt, Human
gucaaguucuguuuucuuuuuacccucugaga

SEQ ID NO: 472742 - RNA, 32 nt, Human
gucaaguuucuguucuguuuccuuccuuucua

SEQ ID NO: 472743 - RNA, 20 nt, Human
gucaauaauuaucgcuuuaa

SEQ ID NO: 472744 - RNA, 32 nt, Human
gucaauaccaaguugaaaaccaucugggagag

SEQ ID NO: 472745 - RNA, 32 nt, Human
gucaauaccagccugggcaacauaguaagacc

SEQ ID NO: 472746 - RNA, 32 nt, Human
gucaauaccaugcuuuccuguaauauuugugg

SEQ ID NO: 472747 - RNA, 18 nt, Human
gucaauaguuauaaccua

SEQ ID NO: 472748 - RNA, 20 nt, Human
gucaauauacaaaacuuuaa

SEQ ID NO: 472749 - RNA, 32 nt, Human
gucaauaucacaguauuacaggugcuauuuuu

SEQ ID NO: 472750 - RNA, 32 nt, Human
gucaauauguuuauuuccucugucuacagcag

SEQ ID NO: 472751 - RNA, 32 nt, Human
gucaaucaguaggcaguagaggagccagcaua

SEQ ID NO: 472752 - RNA, 32 nt, Human
gucaauccaaguguccaucaaugguagacugg

SEQ ID NO: 472753 - RNA, 32 nt, Human
gucaaucccaguugcuuuuccccagauuuggu

SEQ ID NO: 472754 - RNA, 32 nt, Human
gucaauccugguguuucucuguaucuucucac

SEQ ID NO: 472755 - RNA, 22 nt, Human
gucaaucgauucugaacucuga

SEQ ID NO: 472756 - RNA, 32 nt, Human
gucaaugaacagcaucaaagggaggcugaaga

SEQ ID NO: 472757 - RNA, 32 nt, Human
gucaaugaagugaugaaagcuuagagccagua

SEQ ID NO: 472758 - RNA, 32 nt, Human
gucaaugagcaucuccuuccuugccaaagcau

SEQ ID NO: 472759 - RNA, 32 nt, Human
gucaaugaggggcacccagugcuucuagggca

SEQ ID NO: 472760 - RNA, 32 nt, Human
gucaaugcaacaaaacacucuucuguccuuuu

SEQ ID NO: 472761 - RNA, 32 nt, Human
gucaaugcccacucuugccacacugcuaauau

SEQ ID NO: 472762 - RNA, 32 nt, Human
gucaaugcucacugaaagucugucuuagcugc

SEQ ID NO: 472763 - RNA, 32 nt, Human
gucaauggaagaaaccaccaagguccaaagcg

SEQ ID NO: 472764 - RNA, 32 nt, Human
gucaauggaaguuggcugcacuugauguuugu

SEQ ID NO: 472765 - RNA, 32 nt, Human
gucaauggcugugucucaccagccuggagaug

SEQ ID NO: 472766 - RNA, 32 nt, Human
gucaaugggacgacaguggcaagagggguugg

SEQ ID NO: 472767 - RNA, 32 nt, Human
gucaauggggaaaggacacagaaacaggaacu

SEQ ID NO: 472768 - RNA, 32 nt, Human
gucaauggucaccaagguccugaagccuuccu

SEQ ID NO: 472769 - RNA, 32 nt, Human
gucaauggucugcucuguagcagucucagagc

SEQ ID NO: 472770 - RNA, 32 nt, Human
gucaaugugggcagccucauggugccugucuu

SEQ ID NO: 472771 - RNA, 32 nt, Human
gucaaugugggcugcugagcacugcuuggaua

SEQ ID NO: 472772 - RNA, 32 nt, Human
gucaaugugugugacauguguguccuuucagu

SEQ ID NO: 472773 - RNA, 32 nt, Human
gucaauucaguuugagaaagugcuauuaacuu

SEQ ID NO: 472774 - RNA, 31 nt, Human
gucaauuccaagaaauaucuguugaauauuu

SEQ ID NO: 472775 - RNA, 32 nt, Human
gucaauugccauuauuuguauugaaguaucag

SEQ ID NO: 472776 - RNA, 32 nt, Human
gucaauugccuagucaggcuuaugcaaugcag

SEQ ID NO: 472777 - RNA, 32 nt, Human
gucaauuuagaacaguuacuaggauaaacucc

SEQ ID NO: 472778 - RNA, 31 nt, Human
gucaauuugcacuucuuuauaauccucuggu

SEQ ID NO: 472779 - RNA, 32 nt, Human
gucaauuugccucugugugccucaguggagac

SEQ ID NO: 472780 - RNA, 32 nt, Human
gucaauuuguucccucaccaacauggaugccu

SEQ ID NO: 472781 - RNA, 32 nt, Human
gucaauuuucuccaaaacaaaccccaccgggc

SEQ ID NO: 472782 - RNA, 32 nt, Human
gucacaaaagacugagcaauugagaaaacaaa

SEQ ID NO: 472783 - RNA, 32 nt, Human
gucacaaacaugucagacaaaagugaauuaaa

SEQ ID NO: 472784 - RNA, 32 nt, Human
gucacaaagcuuugagcaacaggagaaccacu

SEQ ID NO: 472785 - RNA, 32 nt, Human
gucacaaaggccaucagggcuuguccgggagc

SEQ ID NO: 472786 - RNA, 32 nt, Human
gucacaacacaaauaccccucuugaaagagau

SEQ ID NO: 472787 - RNA, 32 nt, Human
gucacaacucacugcagccuggaccuccuagc

SEQ ID NO: 472788 - RNA, 32 nt, Human
gucacaagagggaaggacuuggagaggagaau

SEQ ID NO: 472789 - RNA, 32 nt, Human
gucacaaggagagcaggcugaguuuggagcag

SEQ ID NO: 472790 - RNA, 32 nt, Human
gucacaagguuuaaggugacccaaugauucag

SEQ ID NO: 472791 - RNA, 32 nt, Human
gucacaaucugaagaaucaaacuuccauccug

SEQ ID NO: 472792 - RNA, 32 nt, Human
gucacaaugaacagccaugcugcaggugacgg

SEQ ID NO: 472793 - RNA, 32 nt, Human
gucacaaugagaaccucgggguuugagguggc

SEQ ID NO: 472794 - RNA, 32 nt, Human
gucacacacagcaacgaauacagacuuuauaa

SEQ ID NO: 472795 - RNA, 32 nt, Human
gucacacagauggugggacagaaacgaucucu

SEQ ID NO: 472796 - RNA, 32 nt, Human
gucacacagcacaucaguggcuacaugugagc

SEQ ID NO: 472797 - RNA, 20 nt, Human
gucacacagcuaauggcaga

SEQ ID NO: 472798 - RNA, 24 nt, Human
gucacacagcuaguuagcggcaga

SEQ ID NO: 472799 - RNA, 32 nt, Human
gucacacagcuauuauggagguuaaguucauu

SEQ ID NO: 472800 - RNA, 23 nt, Human
gucacacagcucagauccccaga

SEQ ID NO: 472801 - RNA, 23 nt, Human
gucacacagcugcugggucaguc

SEQ ID NO: 472802 - RNA, 32 nt, Human
gucacacagcuggcuggggcaggauuggguuu

SEQ ID NO: 472803 - RNA, 32 nt, Human
gucacacaggaaguuggcagcucugcuccauc

SEQ ID NO: 472804 - RNA, 32 nt, Human
gucacacaggcaggggugaaacaugggcucug

SEQ ID NO: 472805 - RNA, 32 nt, Human
gucacacaggcugcucagagggcugcugaaca

SEQ ID NO: 472806 - RNA, 24 nt, Human
gucacacaggcuggagggcagugg

SEQ ID NO: 472807 - RNA, 32 nt, Human
gucacacaggcuggagugcaguacaauuacgg

SEQ ID NO: 472808 - RNA, 24 nt, Human
gucacacaggcuggagugcagugg

SEQ ID NO: 472809 - RNA, 32 nt, Human
gucacacaguaucccacacacacuggugccca

SEQ ID NO: 472810 - RNA, 32 nt, Human
gucacacaguuggccaccaccaucucuagaug

SEQ ID NO: 472811 - RNA, 32 nt, Human
gucacacaucaauuuuucuccugacuuuugcu

SEQ ID NO: 472812 - RNA, 32 nt, Human
gucacacauccugguuguauaaccaggagguc

SEQ ID NO: 472813 - RNA, 32 nt, Human
gucacacaugucuagccuccaggcgcugugcu

SEQ ID NO: 472814 - RNA, 32 nt, Human
gucacacaugugccuguuagguugugaaaguu

SEQ ID NO: 472815 - RNA, 32 nt, Human
gucacacauucagaacugucucuggcagucga

SEQ ID NO: 472816 - RNA, 32 nt, Human
gucacaccacugcacuccagccugggcaauag

SEQ ID NO: 472817 - RNA, 32 nt, Human
gucacaccacugcacuccagccugggcuacag

SEQ ID NO: 472818 - RNA, 32 nt, Human
gucacaccacuguauuccagccugggugacag

SEQ ID NO: 472819 - RNA, 32 nt, Human
gucacaccagguggccagcauuucugugaagg

SEQ ID NO: 472820 - RNA, 32 nt, Human
gucacaccauugcacuccaaccugggcgacag

SEQ ID NO: 472821 - RNA, 32 nt, Human
gucacaccccugcacuccagccugggugacag

SEQ ID NO: 472822 - RNA, 32 nt, Human
gucacaccgcugcacuccagccugggcaacaa

SEQ ID NO: 472823 - RNA, 32 nt, Human
gucacaccguuuuaggacucugugccacuuug

SEQ ID NO: 472824 - RNA, 32 nt, Human
gucacaccuauaaucccagcacuuugggaggc

SEQ ID NO: 472825 - RNA, 32 nt, Human
gucacaccuguaaucccagcacguugggaggc

SEQ ID NO: 472826 - RNA, 32 nt, Human
gucacaccuguaaucccagcacuuugggagga

SEQ ID NO: 472827 - RNA, 32 nt, Human
gucacacgcuggugccgggggugcuuuggggg

SEQ ID NO: 472828 - RNA, 32 nt, Human
gucacacgggcauccauuggaaaagagaagca

SEQ ID NO: 472829 - RNA, 32 nt, Human
gucacacgguacaauguccuacccacaacucc

SEQ ID NO: 472830 - RNA, 32 nt, Human
gucacacuauuaccacugcccaaccaaccuau

SEQ ID NO: 472831 - RNA, 32 nt, Human
gucacacucccagaccccugaggggcccacgg

SEQ ID NO: 472832 - RNA, 32 nt, Human
gucacacucccagaccccugggggcccacggu

SEQ ID NO: 472833 - RNA, 32 nt, Human
gucacacucccagcaccuaguaugcucaguaa

SEQ ID NO: 472834 - RNA, 32 nt, Human
gucacacucccaggaugaugaagaggggaucu

SEQ ID NO: 472835 - RNA, 32 nt, Human
gucacacucuccaggcuggagugcaguggcac

SEQ ID NO: 472836 - RNA, 32 nt, Human
gucacacugaccuucagcauugcccacagucc

SEQ ID NO: 472837 - RNA, 32 nt, Human
gucacacuggaggcuucauuuacuccagacuc

SEQ ID NO: 472838 - RNA, 32 nt, Human
gucacacuggauccuuggccuccaggguccau

SEQ ID NO: 472839 - RNA, 32 nt, Human
gucacacuggugcugagugaccgggggcugcu

SEQ ID NO: 472840 - RNA, 25 nt, Human
gucacacuguggaauacaagacagu

SEQ ID NO: 472841 - RNA, 32 nt, Human
gucacacuucaaggaggcagcucucuagacag

SEQ ID NO: 472842 - RNA, 32 nt, Human
gucacagaaaaaugaaacugugacugguuuuc

SEQ ID NO: 472843 - RNA, 21 nt, Human
gucacagaacauaaaugcaua

SEQ ID NO: 472844 - RNA, 23 nt, Human
gucacagaauuuugagacccauu

SEQ ID NO: 472845 - RNA, 24 nt, Human
gucacagaauuuugagacccauua

SEQ ID NO: 472846 - RNA, 32 nt, Human
gucacagacacacagagcccagccguggcagg

SEQ ID NO: 472847 - RNA, 32 nt, Human
gucacagacugugugggggccacccaggggcu

SEQ ID NO: 472848 - RNA, 32 nt, Human
gucacagaggagccugcugagcuccagacugc

SEQ ID NO: 472849 - RNA, 32 nt, Human
gucacagagguagaauugagcacucacagaug

SEQ ID NO: 472850 - RNA, 32 nt, Human
gucacagaguuccacuuuuuccacucuuauua

SEQ ID NO: 472851 - RNA, 32 nt, Human
gucacagauagucucugccacuccccugccuc

SEQ ID NO: 472852 - RNA, 32 nt, Human
gucacagaucccuaccugccuggcuaagaccc

SEQ ID NO: 472853 - RNA, 24 nt, Human
gucacagaugaaacuuaaaugaua

SEQ ID NO: 472854 - RNA, 32 nt, Human
gucacagaugcugggaaguauggcccgaaaga

SEQ ID NO: 472855 - RNA, 32 nt, Human
gucacagauggcagucacugaccugcugugau

SEQ ID NO: 472856 - RNA, 32 nt, Human
gucacagaugugagccagggcacugcucagcu

SEQ ID NO: 472857 - RNA, 32 nt, Human
gucacagauuccauugaaaggagcagauucua

SEQ ID NO: 472858 - RNA, 32 nt, Human
gucacagcagugagcuagagccugaccccuga

SEQ ID NO: 472859 - RNA, 32 nt, Human
gucacagcaguggugaaagacugcucggucau

SEQ ID NO: 472860 - RNA, 32 nt, Human
gucacagccccucagucucuucuccuuccccu

SEQ ID NO: 472861 - RNA, 22 nt, Human
gucacagcggcccuuucugaug

SEQ ID NO: 472862 - RNA, 32 nt, Human
gucacagcuacuugggagacugagguuggagg

SEQ ID NO: 472863 - RNA, 32 nt, Human
gucacagcuauggauguggaagagauaggaaa

SEQ ID NO: 472864 - RNA, 32 nt, Human
gucacagcucacugcagccucgaccucccggg

SEQ ID NO: 472865 - RNA, 32 nt, Human
gucacagcucacuguagccucgaccuuccagg

SEQ ID NO: 472866 - RNA, 32 nt, Human
gucacagcugcccagugggauucuccaggggg

SEQ ID NO: 472867 - RNA, 32 nt, Human
gucacaggaacccagagcaccaagugagauga

SEQ ID NO: 472868 - RNA, 32 nt, Human
gucacaggaccuucccuaagagcccgcaggga

SEQ ID NO: 472869 - RNA, 32 nt, Human
gucacaggagagugugagucagcucugugugu

SEQ ID NO: 472870 - RNA, 32 nt, Human
gucacaggagauuauaugcaccaaugacaaau

SEQ ID NO: 472871 - RNA, 32 nt, Human
gucacaggagggugugagucagcucugggugg

SEQ ID NO: 472872 - RNA, 32 nt, Human
gucacaggagggugugagucagcucuguccau

SEQ ID NO: 472873 - RNA, 32 nt, Human
gucacaggagggugugagucagcucugucucu

SEQ ID NO: 472874 - RNA, 32 nt, Human
gucacaggagggugugagucagcucugucuga

SEQ ID NO: 472875 - RNA, 32 nt, Human
gucacaggagggugugagucagcucugucugu

SEQ ID NO: 472876 - RNA, 32 nt, Human
gucacaggagggugugagucagcucugugugg

SEQ ID NO: 472877 - RNA, 32 nt, Human
gucacaggagggugugugucagcucuguccgu

SEQ ID NO: 472878 - RNA, 32 nt, Human
gucacaggagggugugugucagcucugucugu

SEQ ID NO: 472879 - RNA, 32 nt, Human
gucacaggcagugaggaugagagggggugaug

SEQ ID NO: 472880 - RNA, 32 nt, Human
gucacaggcccaggaaggcggcaggcagagaa

SEQ ID NO: 472881 - RNA, 32 nt, Human
gucacaggcgggugugagucagcucugucucu

SEQ ID NO: 472882 - RNA, 32 nt, Human
gucacaggcugcauagacugcaggaaagcgaa

SEQ ID NO: 472883 - RNA, 32 nt, Human
gucacaggcugcauagauugcaggaaagcgaa

SEQ ID NO: 472884 - RNA, 32 nt, Human
gucacaggcuguuggacgcagccuggguggca

SEQ ID NO: 472885 - RNA, 32 nt, Human
gucacagguagaaaaaccuauuuaguuaauuc

SEQ ID NO: 472886 - RNA, 32 nt, Human
gucacaguaagccuugcagcuugagcugaaag

SEQ ID NO: 472887 - RNA, 19 nt, Human
gucacaguauaaaauucua

SEQ ID NO: 472888 - RNA, 32 nt, Human
gucacagugagcugugauugcaccacuuguaa

SEQ ID NO: 472889 - RNA, 32 nt, Human
gucacagugccuuagaaguggcagaggugagg

SEQ ID NO: 472890 - RNA, 32 nt, Human
gucacaguggguggcaggugacuuuccggagg

SEQ ID NO: 472891 - RNA, 32 nt, Human
gucacagugucuuccgggacagcuggggacag

SEQ ID NO: 472892 - RNA, 32 nt, Human
gucacagugugccugaggaaggcugcuaggga

SEQ ID NO: 472893 - RNA, 32 nt, Human
gucacagugugucuggacagccuggacauugg

SEQ ID NO: 472894 - RNA, 20 nt, Human
gucacaguucaaaauucuaa

SEQ ID NO: 472895 - RNA, 32 nt, Human
gucacaguucccucgacucuuucaaagcuuca

SEQ ID NO: 472896 - RNA, 32 nt, Human
gucacaguuuggaagcagucuauuccaucaac

SEQ ID NO: 472897 - RNA, 32 nt, Human
gucacauauacaaaagcaagacuuccagguag

SEQ ID NO: 472898 - RNA, 32 nt, Human
gucacaucaucuacaccaacagugguauccua

SEQ ID NO: 472899 - RNA, 32 nt, Human
gucacauccuaaaaguccaggagggggccagg

SEQ ID NO: 472900 - RNA, 32 nt, Human
gucacaucuguaaucucagcucuuuggaaggc

SEQ ID NO: 472901 - RNA, 32 nt, Human
gucacaugacugcauccugccugccagggcug

SEQ ID NO: 472902 - RNA, 32 nt, Human
gucacaugcccacagcagccucggugacgaga

SEQ ID NO: 472903 - RNA, 32 nt, Human
gucacaugcccacugcagcccuccagccucug

SEQ ID NO: 472904 - RNA, 32 nt, Human
gucacauggccacacccagcagaaagaacucu

SEQ ID NO: 472905 - RNA, 32 nt, Human
gucacauguaagaaggaagaaaagagauaggg

SEQ ID NO: 472906 - RNA, 32 nt, Human
gucacauguucacuugcuuuuccuuccaucug

SEQ ID NO: 472907 - RNA, 32 nt, Human
gucacauucaaggucaccagguacaguuguac

SEQ ID NO: 472908 - RNA, 32 nt, Human
gucacauuccagauuugaagcuguguuuuugu

SEQ ID NO: 472909 - RNA, 32 nt, Human
gucacauucucagagaguuggagggauuaugc

SEQ ID NO: 472910 - RNA, 32 nt, Human
gucacauugaugaugaugagugcaguggggug

SEQ ID NO: 472911 - RNA, 32 nt, Human
gucacauugguuugucucccuuguacauucuu

SEQ ID NO: 472912 - RNA, 32 nt, Human
gucaccaaaagcuuucugaaaaugccuuucug

SEQ ID NO: 472913 - RNA, 32 nt, Human
gucaccaacauggcugggccugggacaggcuc

SEQ ID NO: 472914 - RNA, 18 nt, Human
gucaccaagaaacucuga

SEQ ID NO: 472915 - RNA, 23 nt, Human
gucaccaagcuggacugcagugg

SEQ ID NO: 472916 - RNA, 32 nt, Human
gucaccaaggcugggcgggacagagcagucaa

SEQ ID NO: 472917 - RNA, 32 nt, Human
gucaccacacccuugcuuggaugaggaaggaa

SEQ ID NO: 472918 - RNA, 32 nt, Human
gucaccacacuccagccugggugacagagcaa

SEQ ID NO: 472919 - RNA, 32 nt, Human
gucaccacaguggcuggagaugagcccacacg

SEQ ID NO: 472920 - RNA, 32 nt, Human
gucaccaccaauaucuuauuucaaccucacag

SEQ ID NO: 472921 - RNA, 32 nt, Human
gucaccacuccccucccuauauacccccaccc

SEQ ID NO: 472922 - RNA, 32 nt, Human
gucaccacugacugggcaaggcuucuugggca

SEQ ID NO: 472923 - RNA, 32 nt, Human
gucaccacugcaacccagggucccagcuggcu

SEQ ID NO: 472924 - RNA, 32 nt, Human
gucaccacugcccuccagccugggugacagag

SEQ ID NO: 472925 - RNA, 23 nt, Human
gucaccagacuggagugcagugg

SEQ ID NO: 472926 - RNA, 32 nt, Human
gucaccagacuggagugcaguggcgccaucuc

SEQ ID NO: 472927 - RNA, 32 nt, Human
gucaccagagagcuuucagcugagggagaguu

SEQ ID NO: 472928 - RNA, 21 nt, Human
gucaccagcaguagaaccaua

SEQ ID NO: 472929 - RNA, 32 nt, Human
gucaccagccacggcaauggaucccguccacc

SEQ ID NO: 472930 - RNA, 32 nt, Human
gucaccagccacuccaggggcagggaccauuu

SEQ ID NO: 472931 - RNA, 32 nt, Human
gucaccagccuucuguacacugccuuugguuu

SEQ ID NO: 472932 - RNA, 32 nt, Human
gucaccaggaaggacaagggugcucuguuguu

SEQ ID NO: 472933 - RNA, 32 nt, Human
gucaccaggagaauggacccuuccuccaccuc

SEQ ID NO: 472934 - RNA, 32 nt, Human
gucaccaggagaauggacgcuuccuccaccuc

SEQ ID NO: 472935 - RNA, 32 nt, Human
gucaccaggagcccaccaccucccucuaggau

SEQ ID NO: 472936 - RNA, 32 nt, Human
gucaccaggaggggcccaggagcugggugacg

SEQ ID NO: 472937 - RNA, 32 nt, Human
gucaccaggaggguaugcauagggagggcaag

SEQ ID NO: 472938 - RNA, 23 nt, Human
gucaccaggauggagugcagugg

SEQ ID NO: 472939 - RNA, 32 nt, Human
gucaccaggauggcagagagccagggcagaga

SEQ ID NO: 472940 - RNA, 32 nt, Human
gucaccaggcagugaagacaggauguggccca

SEQ ID NO: 472941 - RNA, 32 nt, Human
gucaccaggccacugugcagugggcgcagagc

SEQ ID NO: 472942 - RNA, 23 nt, Human
gucaccaggccggagugcagugg

SEQ ID NO: 472943 - RNA, 32 nt, Human
gucaccaggccggagugcaguggugucaucuc

SEQ ID NO: 472944 - RNA, 32 nt, Human
gucaccaggccugaaacucccuuuccaggacu

SEQ ID NO: 472945 - RNA, 23 nt, Human
gucaccaggcuagagugcagugg

SEQ ID NO: 472946 - RNA, 23 nt, Human
gucaccaggcuggaaugcagugg

SEQ ID NO: 472947 - RNA, 23 nt, Human
gucaccaggcuggagggcagugg

SEQ ID NO: 472948 - RNA, 32 nt, Human
gucaccaggcuggagggcaguggcgccaucuc

SEQ ID NO: 472949 - RNA, 32 nt, Human
gucaccaggcuggagggcaguggugcgaucuc

SEQ ID NO: 472950 - RNA, 22 nt, Human
gucaccaggcuggaguacagug

SEQ ID NO: 472951 - RNA, 23 nt, Human
gucaccaggcuggagugcagcgg

SEQ ID NO: 472952 - RNA, 32 nt, Human
gucaccaggcuggagugcagcggcgcaaucuc

SEQ ID NO: 472953 - RNA, 21 nt, Human
gucaccaggcuggagugcagu

SEQ ID NO: 472954 - RNA, 22 nt, Human
gucaccaggcuggagugcagug

SEQ ID NO: 472955 - RNA, 32 nt, Human
gucaccaggcuggagugcagugccgcaaucuc

SEQ ID NO: 472956 - RNA, 23 nt, Human
gucaccaggcuggagugcagugg

SEQ ID NO: 472957 - RNA, 32 nt, Human
gucaccaggcuggagugcaguggaggcaucuc

SEQ ID NO: 472958 - RNA, 32 nt, Human
gucaccaggcuggagugcaguggcgcaauugu

SEQ ID NO: 472959 - RNA, 32 nt, Human
gucaccaggcuggagugcaguggcgcgaucuc

SEQ ID NO: 472960 - RNA, 32 nt, Human
gucaccaggcuggagugcaguggcgcgauuuc

SEQ ID NO: 472961 - RNA, 32 nt, Human
gucaccaggcuggagugcaguggugcaaucuc

SEQ ID NO: 472962 - RNA, 32 nt, Human
gucaccaggcuggagugcaguggugcgaucgc

SEQ ID NO: 472963 - RNA, 32 nt, Human
gucaccaggcuggagugcaguggugugaucuc

SEQ ID NO: 472964 - RNA, 32 nt, Human
gucaccaggcuguauuacaguggugcaaucau

SEQ ID NO: 472965 - RNA, 32 nt, Human
gucaccaggcuugagugcaguggugugaucuu

SEQ ID NO: 472966 - RNA, 32 nt, Human
gucaccauccacccucguaacaacagucuccc

SEQ ID NO: 472967 - RNA, 32 nt, Human
gucaccauccaccuucccuucuacaaggacuc

SEQ ID NO: 472968 - RNA, 32 nt, Human
gucaccauccucauccccaucuucauggaacc

SEQ ID NO: 472969 - RNA, 32 nt, Human
gucaccaucuggaagccagcugggccacagca

SEQ ID NO: 472970 - RNA, 32 nt, Human
gucaccaugaugccuuugaucgaugcugcucc

SEQ ID NO: 472971 - RNA, 32 nt, Human
gucaccaugccuggcuaauuuuguauuuuuag

SEQ ID NO: 472972 - RNA, 32 nt, Human
gucaccaugccuggcuaauuuuuguauuuuua

SEQ ID NO: 472973 - RNA, 18 nt, Human
gucaccaugcugcugguc

SEQ ID NO: 472974 - RNA, 32 nt, Human
gucaccaugguggcgagcacagcaaccccagg

SEQ ID NO: 472975 - RNA, 32 nt, Human
gucaccauggugggauucuuucagaaugagac

SEQ ID NO: 472976 - RNA, 32 nt, Human
gucaccauuuaucauggacgguugucaugagu

SEQ ID NO: 472977 - RNA, 32 nt, Human
gucacccaaagucaugaucaauucaggagacu

SEQ ID NO: 472978 - RNA, 22 nt, Human
gucacccaagcuggagugcagu

SEQ ID NO: 472979 - RNA, 23 nt, Human
gucacccaagcuggagugcagug

SEQ ID NO: 472980 - RNA, 24 nt, Human
gucacccaagcuggagugcagugg

SEQ ID NO: 472981 - RNA, 23 nt, Human
gucacccaaggcggagugcagug

SEQ ID NO: 472982 - RNA, 32 nt, Human
gucacccaaggcggagugcagugacgacauca

SEQ ID NO: 472983 - RNA, 24 nt, Human
gucacccaaguuggagugcagugg

SEQ ID NO: 472984 - RNA, 24 nt, Human
gucacccacgcuggaaugcagugg

SEQ ID NO: 472985 - RNA, 24 nt, Human
gucacccacgcuggagugcaaugg

SEQ ID NO: 472986 - RNA, 23 nt, Human
gucacccacgcuggagugcugug

SEQ ID NO: 472987 - RNA, 32 nt, Human
gucacccacucugccagggccuggcugaccca

SEQ ID NO: 472988 - RNA, 32 nt, Human
gucacccagaacuucuccccaggaugagacca

SEQ ID NO: 472989 - RNA, 22 nt, Human
gucacccagacuagaggucagu

SEQ ID NO: 472990 - RNA, 22 nt, Human
gucacccagacuagagugcagu

SEQ ID NO: 472991 - RNA, 24 nt, Human
gucacccagacuagagugcagugg

SEQ ID NO: 472992 - RNA, 22 nt, Human
gucacccagacuggaacacagu

SEQ ID NO: 472993 - RNA, 22 nt, Human
gucacccagacuggaaugcagu

SEQ ID NO: 472994 - RNA, 24 nt, Human
gucacccagacuggaaugcaguga

SEQ ID NO: 472995 - RNA, 21 nt, Human
gucacccagacuggagugcag

SEQ ID NO: 472996 - RNA, 23 nt, Human
gucacccagacuggagugcaggg

SEQ ID NO: 472997 - RNA, 22 nt, Human
gucacccagacuggagugcagu

SEQ ID NO: 472998 - RNA, 23 nt, Human
gucacccagacuggagugcagug

SEQ ID NO: 472999 - RNA, 24 nt, Human
gucacccagacuggagugcagugg

SEQ ID NO: 473000 - RNA, 23 nt, Human
gucacccagacuggagugcgaug

SEQ ID NO: 473001 - RNA, 24 nt, Human
gucacccagacuggagugcgaugg

SEQ ID NO: 473002 - RNA, 32 nt, Human
gucacccagagcccgaugaggggugccagcag

SEQ ID NO: 473003 - RNA, 32 nt, Human
gucacccagagccggaugagggaugccagcag

SEQ ID NO: 473004 - RNA, 32 nt, Human
gucacccagcagaggcuucuccccauagcacg

SEQ ID NO: 473005 - RNA, 18 nt, Human
gucacccagccaccagcc

SEQ ID NO: 473006 - RNA, 32 nt, Human
gucacccagccaucccgucucugugcuggaug

SEQ ID NO: 473007 - RNA, 24 nt, Human
gucacccagccuggaauguagugg

SEQ ID NO: 473008 - RNA, 23 nt, Human
gucacccaggacacagccacucg

SEQ ID NO: 473009 - RNA, 23 nt, Human
gucacccaggauggagugcagug

SEQ ID NO: 473010 - RNA, 24 nt, Human
gucacccaggcaggagugcagugg

SEQ ID NO: 473011 - RNA, 32 nt, Human
gucacccaggcaggagugcaguggcacaguca

SEQ ID NO: 473012 - RNA, 32 nt, Human
gucacccaggcaggagugcaguggcguuaucu

SEQ ID NO: 473013 - RNA, 32 nt, Human
gucacccaggccaaguucaauggugcaaucug

SEQ ID NO: 473014 - RNA, 22 nt, Human
gucacccaggccggagugcagu

SEQ ID NO: 473015 - RNA, 23 nt, Human
gucacccaggccggagugcagug

SEQ ID NO: 473016 - RNA, 24 nt, Human
gucacccaggccggagugcagugg

SEQ ID NO: 473017 - RNA, 22 nt, Human
gucacccaggcuagaaugcagu

SEQ ID NO: 473018 - RNA, 24 nt, Human
gucacccaggcuagaaugcagugg

SEQ ID NO: 473019 - RNA, 22 nt, Human
gucacccaggcuagaggguggu

SEQ ID NO: 473020 - RNA, 22 nt, Human
gucacccaggcuagaguacagu

SEQ ID NO: 473021 - RNA, 24 nt, Human
gucacccaggcuagaguacagugg

SEQ ID NO: 473022 - RNA, 23 nt, Human
gucacccaggcuagagugcaaug

SEQ ID NO: 473023 - RNA, 24 nt, Human
gucacccaggcuagagugcaaugg

SEQ ID NO: 473024 - RNA, 22 nt, Human
gucacccaggcuagagugcagu

SEQ ID NO: 473025 - RNA, 24 nt, Human
gucacccaggcuagagugcaguag

SEQ ID NO: 473026 - RNA, 23 nt, Human
gucacccaggcuagagugcagug

SEQ ID NO: 473027 - RNA, 24 nt, Human
gucacccaggcuagagugcagugg

SEQ ID NO: 473028 - RNA, 22 nt, Human
gucacccaggcugaacugcagu

SEQ ID NO: 473029 - RNA, 24 nt, Human
gucacccaggcugaacugcagugg

SEQ ID NO: 473030 - RNA, 22 nt, Human
gucacccaggcugaagugcagu

SEQ ID NO: 473031 - RNA, 23 nt, Human
gucacccaggcugaagugcagug

SEQ ID NO: 473032 - RNA, 24 nt, Human
gucacccaggcugaagugcagugg

SEQ ID NO: 473033 - RNA, 32 nt, Human
gucacccaggcugaagugcaguggagcaaucu

SEQ ID NO: 473034 - RNA, 18 nt, Human
gucacccaggcugcagug

SEQ ID NO: 473035 - RNA, 24 nt, Human
gucacccaggcugcagugcaaugg

SEQ ID NO: 473036 - RNA, 22 nt, Human
gucacccaggcugcaguguagu

SEQ ID NO: 473037 - RNA, 24 nt, Human
gucacccaggcugcaguguagugg

SEQ ID NO: 473038 - RNA, 20 nt, Human
gucacccaggcugcaguuca

SEQ ID NO: 473039 - RNA, 24 nt, Human
gucacccaggcugcaguucacugg

SEQ ID NO: 473040 - RNA, 32 nt, Human
gucacccaggcugcuggaguacaguggcacaa

SEQ ID NO: 473041 - RNA, 22 nt, Human
gucacccaggcuggaauccagu

SEQ ID NO: 473042 - RNA, 24 nt, Human
gucacccaggcuggaauccagugg

SEQ ID NO: 473043 - RNA, 22 nt, Human
gucacccaggcuggaaugcagu

SEQ ID NO: 473044 - RNA, 23 nt, Human
gucacccaggcuggaaugcagug

SEQ ID NO: 473045 - RNA, 24 nt, Human
gucacccaggcuggaaugcagugg

SEQ ID NO: 473046 - RNA, 23 nt, Human
gucacccaggcuggacugcaaug

SEQ ID NO: 473047 - RNA, 24 nt, Human
gucacccaggcuggacugcaauga

SEQ ID NO: 473048 - RNA, 22 nt, Human
gucacccaggcuggacugcagu

SEQ ID NO: 473049 - RNA, 24 nt, Human
gucacccaggcuggacugcagugg

SEQ ID NO: 473050 - RNA, 22 nt, Human
gucacccaggcuggagagcagu

SEQ ID NO: 473051 - RNA, 24 nt, Human
gucacccaggcuggagagcagugg

SEQ ID NO: 473052 - RNA, 18 nt, Human
gucacccaggcuggagca

SEQ ID NO: 473053 - RNA, 24 nt, Human
gucacccaggcuggagcacacugg

SEQ ID NO: 473054 - RNA, 22 nt, Human
gucacccaggcuggagcgcagu

SEQ ID NO: 473055 - RNA, 23 nt, Human
gucacccaggcuggagcgcagug

SEQ ID NO: 473056 - RNA, 24 nt, Human
gucacccaggcuggagcgcagugg

SEQ ID NO: 473057 - RNA, 24 nt, Human
gucacccaggcuggaguacaauag

SEQ ID NO: 473058 - RNA, 23 nt, Human
gucacccaggcuggaguacaaug

SEQ ID NO: 473059 - RNA, 24 nt, Human
gucacccaggcuggaguacaauga

SEQ ID NO: 473060 - RNA, 24 nt, Human
gucacccaggcuggaguacacugg

SEQ ID NO: 473061 - RNA, 22 nt, Human
gucacccaggcuggaguacagu

SEQ ID NO: 473062 - RNA, 23 nt, Human
gucacccaggcuggaguacagug

SEQ ID NO: 473063 - RNA, 24 nt, Human
gucacccaggcuggaguacaguga

SEQ ID NO: 473064 - RNA, 24 nt, Human
gucacccaggcuggaguacagugg

SEQ ID NO: 473065 - RNA, 23 nt, Human
gucacccaggcuggaguaccggu

SEQ ID NO: 473066 - RNA, 24 nt, Human
gucacccaggcuggaguaccggug

SEQ ID NO: 473067 - RNA, 22 nt, Human
gucacccaggcuggaguauagu

SEQ ID NO: 473068 - RNA, 24 nt, Human
gucacccaggcuggaguauagugg

SEQ ID NO: 473069 - RNA, 18 nt, Human
gucacccaggcuggaguc

SEQ ID NO: 473070 - RNA, 22 nt, Human
gucacccaggcuggaguccaau

SEQ ID NO: 473071 - RNA, 24 nt, Human
gucacccaggcuggaguccaaugg

SEQ ID NO: 473072 - RNA, 22 nt, Human
gucacccaggcuggaguccagu

SEQ ID NO: 473073 - RNA, 24 nt, Human
gucacccaggcuggaguccagugg

SEQ ID NO: 473074 - RNA, 22 nt, Human
gucacccaggcuggagucuagu

SEQ ID NO: 473075 - RNA, 23 nt, Human
gucacccaggcuggagucuagug

SEQ ID NO: 473076 - RNA, 20 nt, Human
gucacccaggcuggagugag

SEQ ID NO: 473077 - RNA, 24 nt, Human
gucacccaggcuggagugaggugg

SEQ ID NO: 473078 - RNA, 19 nt, Human
gucacccaggcuggagugc

SEQ ID NO: 473079 - RNA, 20 nt, Human
gucacccaggcuggagugca

SEQ ID NO: 473080 - RNA, 22 nt, Human
gucacccaggcuggagugcaau

SEQ ID NO: 473081 - RNA, 23 nt, Human
gucacccaggcuggagugcaaug

SEQ ID NO: 473082 - RNA, 24 nt, Human
gucacccaggcuggagugcaauga

SEQ ID NO: 473083 - RNA, 24 nt, Human
gucacccaggcuggagugcaaugg

SEQ ID NO: 473084 - RNA, 24 nt, Human
gucacccaggcuggagugcacugg

SEQ ID NO: 473085 - RNA, 21 nt, Human
gucacccaggcuggagugcag

SEQ ID NO: 473086 - RNA, 22 nt, Human
gucacccaggcuggagugcagu

SEQ ID NO: 473087 - RNA, 24 nt, Human
gucacccaggcuggagugcaguag

SEQ ID NO: 473088 - RNA, 23 nt, Human
gucacccaggcuggagugcagug

SEQ ID NO: 473089 - RNA, 24 nt, Human
gucacccaggcuggagugcagugg

SEQ ID NO: 473090 - RNA, 22 nt, Human
gucacccaggcuggagugcaug

SEQ ID NO: 473091 - RNA, 24 nt, Human
gucacccaggcuggagugccauag

SEQ ID NO: 473092 - RNA, 24 nt, Human
gucacccaggcuggagugccaugg

SEQ ID NO: 473093 - RNA, 23 nt, Human
gucacccaggcuggagugccgug

SEQ ID NO: 473094 - RNA, 24 nt, Human
gucacccaggcuggagugccgugg

SEQ ID NO: 473095 - RNA, 23 nt, Human
gucacccaggcuggagugcgaug

SEQ ID NO: 473096 - RNA, 24 nt, Human
gucacccaggcuggagugcgaugg

SEQ ID NO: 473097 - RNA, 22 nt, Human
gucacccaggcuggagugcggu

SEQ ID NO: 473098 - RNA, 23 nt, Human
gucacccaggcuggagugcggug

SEQ ID NO: 473099 - RNA, 24 nt, Human
gucacccaggcuggagugcggugg

SEQ ID NO: 473100 - RNA, 24 nt, Human
gucacccaggcuggagugcuaugg

SEQ ID NO: 473101 - RNA, 24 nt, Human
gucacccaggcuggagugcugugg

SEQ ID NO: 473102 - RNA, 22 nt, Human
gucacccaggcuggaguguagu

SEQ ID NO: 473103 - RNA, 24 nt, Human
gucacccaggcuggaguguagugg

SEQ ID NO: 473104 - RNA, 32 nt, Human
gucacccaggcuggaguguaguggcgcaaucu

SEQ ID NO: 473105 - RNA, 19 nt, Human
gucacccaggcuggaguua

SEQ ID NO: 473106 - RNA, 24 nt, Human
gucacccaggcuggaguuauagug

SEQ ID NO: 473107 - RNA, 22 nt, Human
gucacccaggcuggaguucagu

SEQ ID NO: 473108 - RNA, 24 nt, Human
gucacccaggcuggaguucagugg

SEQ ID NO: 473109 - RNA, 24 nt, Human
gucacccaggcuggcgugcaaugg

SEQ ID NO: 473110 - RNA, 23 nt, Human
gucacccaggcugggaauugcag

SEQ ID NO: 473111 - RNA, 26 nt, Human
gucacccaggcugggaauugcagugg

SEQ ID NO: 473112 - RNA, 22 nt, Human
gucacccaggcugggaugcagu

SEQ ID NO: 473113 - RNA, 24 nt, Human
gucacccaggcugggaugcagugg

SEQ ID NO: 473114 - RNA, 21 nt, Human
gucacccaggcugggguacgg

SEQ ID NO: 473115 - RNA, 24 nt, Human
gucacccaggcugggguacggugg

SEQ ID NO: 473116 - RNA, 22 nt, Human
gucacccaggcuggggugcagu

SEQ ID NO: 473117 - RNA, 24 nt, Human
gucacccaggcuggggugcagugg

SEQ ID NO: 473118 - RNA, 22 nt, Human
gucacccaggcuguagugcagu

SEQ ID NO: 473119 - RNA, 24 nt, Human
gucacccaggcuguagugcagugg

SEQ ID NO: 473120 - RNA, 24 nt, Human
gucacccaggcuguaguggagugg

SEQ ID NO: 473121 - RNA, 24 nt, Human
gucacccaggcuugagugcagugg

SEQ ID NO: 473122 - RNA, 20 nt, Human
gucacccaggggucuccguc

SEQ ID NO: 473123 - RNA, 32 nt, Human
gucacccaggguggugugcaguggagcuauca

SEQ ID NO: 473124 - RNA, 32 nt, Human
gucacccagguggcuggaguacaguggccuga

SEQ ID NO: 473125 - RNA, 24 nt, Human
gucacccagguuagaguguagugg

SEQ ID NO: 473126 - RNA, 24 nt, Human
gucacccagguucgaguucagugg

SEQ ID NO: 473127 - RNA, 24 nt, Human
gucacccagguuggagugcagugg

SEQ ID NO: 473128 - RNA, 24 nt, Human
gucacccagucuggagugcagugg

SEQ ID NO: 473129 - RNA, 32 nt, Human
gucacccaguugcacacugggcauuuucuugg

SEQ ID NO: 473130 - RNA, 24 nt, Human
gucacccaguuuggagugcagugg

SEQ ID NO: 473131 - RNA, 32 nt, Human
gucacccaucauucuugcguguuguaugcuuu

SEQ ID NO: 473132 - RNA, 22 nt, Human
gucacccauccuagagugcagu

SEQ ID NO: 473133 - RNA, 32 nt, Human
gucacccauugaucggcccacucugaaccccc

SEQ ID NO: 473134 - RNA, 32 nt, Human
gucaccccaauguucuggaggcugcgguucug

SEQ ID NO: 473135 - RNA, 32 nt, Human
gucaccccacgcugccccaucuugccugcugu

SEQ ID NO: 473136 - RNA, 32 nt, Human
gucaccccacuuuaacuuucuaccaggacccc

SEQ ID NO: 473137 - RNA, 22 nt, Human
gucaccccagcuggagugcagu

SEQ ID NO: 473138 - RNA, 23 nt, Human
gucaccccagcuggagugcagug

SEQ ID NO: 473139 - RNA, 24 nt, Human
gucaccccagcuggagugcagugg

SEQ ID NO: 473140 - RNA, 32 nt, Human
gucacccccaacaacaagcccugcugaaggug

SEQ ID NO: 473141 - RNA, 32 nt, Human
gucaccccgcuuuccaugacccuccuugccug

SEQ ID NO: 473142 - RNA, 15 nt, Human
gucaccccuaccacu

SEQ ID NO: 473143 - RNA, 32 nt, Human
gucaccccucauuuuccucuggggaccccagg

SEQ ID NO: 473144 - RNA, 32 nt, Human
gucaccccucuguccagccagcuccugcacaa

SEQ ID NO: 473145 - RNA, 32 nt, Human
gucaccccugcacuccugccuucccgugggca

SEQ ID NO: 473146 - RNA, 24 nt, Human
gucacccgagcuggagugcagugg

SEQ ID NO: 473147 - RNA, 32 nt, Human
gucacccggaaccugggaggggagggaacacu

SEQ ID NO: 473148 - RNA, 32 nt, Human
gucacccggaagcagaguuuaaugugacuaaa

SEQ ID NO: 473149 - RNA, 23 nt, Human
gucacccgggcuggagugcagug

SEQ ID NO: 473150 - RNA, 24 nt, Human
gucacccgggcuggagugcagugg

SEQ ID NO: 473151 - RNA, 21 nt, Human
gucacccgggcuggaguguaa

SEQ ID NO: 473152 - RNA, 31 nt, Human
gucacccucaauaaauacuguuaauuggaga

SEQ ID NO: 473153 - RNA, 32 nt, Human
gucacccucccggaauggggcuuccuuucucg

SEQ ID NO: 473154 - RNA, 19 nt, Human
gucacccuccugagccuca

SEQ ID NO: 473155 - RNA, 32 nt, Human
gucacccuccuuggacuuauucaguaacucau

SEQ ID NO: 473156 - RNA, 32 nt, Human
gucacccucguucugucugccaccugaaggga

SEQ ID NO: 473157 - RNA, 32 nt, Human
gucacccucuucccucuccuuucauaccaguc

SEQ ID NO: 473158 - RNA, 32 nt, Human
gucacccugaccgguccaauugccugucacuc

SEQ ID NO: 473159 - RNA, 32 nt, Human
gucacccugcaaccgugccacguggaggagcu

SEQ ID NO: 473160 - RNA, 32 nt, Human
gucacccugcagcuccuuuacaguucaaucca

SEQ ID NO: 473161 - RNA, 32 nt, Human
gucacccugccuuccuccuugcuggcccagcu

SEQ ID NO: 473162 - RNA, 22 nt, Human
gucacccuggcuggagugcagu

SEQ ID NO: 473163 - RNA, 23 nt, Human
gucacccugggccuggggucacc

SEQ ID NO: 473164 - RNA, 32 nt, Human
gucacccuuccaccauuguccuagcuacuugg

SEQ ID NO: 473165 - RNA, 23 nt, Human
gucaccgaggcuggagugcaaug

SEQ ID NO: 473166 - RNA, 24 nt, Human
gucaccgaggcuggagugcaauga

SEQ ID NO: 473167 - RNA, 24 nt, Human
gucaccgaggcuggagugcagugg

SEQ ID NO: 473168 - RNA, 32 nt, Human
gucaccgccccaugcagggcucccaggggaag

SEQ ID NO: 473169 - RNA, 32 nt, Human
gucaccgcgccuggccaauguuguuguuguuu

SEQ ID NO: 473170 - RNA, 32 nt, Human
gucaccgcgggggccgaugguggagaauccga

SEQ ID NO: 473171 - RNA, 20 nt, Human
gucaccgcuuucuauggcgu

SEQ ID NO: 473172 - RNA, 32 nt, Human
gucaccgggaaggccaaguccuuugcugugag

SEQ ID NO: 473173 - RNA, 32 nt, Human
gucaccgguaacaauggcaaugccaguggaac

SEQ ID NO: 473174 - RNA, 32 nt, Human
gucaccguccgugcucagaggauccagaacgg

SEQ ID NO: 473175 - RNA, 32 nt, Human
gucaccuaaacucuggaucucagucaccuuuu

SEQ ID NO: 473176 - RNA, 23 nt, Human
gucaccuaagcuggaguacagug

SEQ ID NO: 473177 - RNA, 32 nt, Human
gucaccuaaggaaaugcauuugaugagugcug

SEQ ID NO: 473178 - RNA, 16 nt, Human
gucaccuacugugaua

SEQ ID NO: 473179 - RNA, 32 nt, Human
gucaccuagacuagacuggagugcaauggccu

SEQ ID NO: 473180 - RNA, 24 nt, Human
gucaccuagacuggagugcaaugg

SEQ ID NO: 473181 - RNA, 23 nt, Human
gucaccuaggcuagagggcagug

SEQ ID NO: 473182 - RNA, 24 nt, Human
gucaccuaggcugcagugcagugg

SEQ ID NO: 473183 - RNA, 24 nt, Human
gucaccuaggcuggaaugcagugg

SEQ ID NO: 473184 - RNA, 23 nt, Human
gucaccuaggcuggagugcagug

SEQ ID NO: 473185 - RNA, 24 nt, Human
gucaccuaggcuggagugcagugg

SEQ ID NO: 473186 - RNA, 25 nt, Human
gucaccuaggcuggaguugcagugg

SEQ ID NO: 473187 - RNA, 24 nt, Human
gucaccuaggcuggauugcaaugg

SEQ ID NO: 473188 - RNA, 24 nt, Human
gucaccuagguuggagugcagugg

SEQ ID NO: 473189 - RNA, 32 nt, Human
gucaccuagugagcagggacagagccaggagu

SEQ ID NO: 473190 - RNA, 32 nt, Human
gucaccuaucuaguccauaugucugcaggaau

SEQ ID NO: 473191 - RNA, 32 nt, Human
gucaccuaucucagcaauaaagguucugaccc

SEQ ID NO: 473192 - RNA, 32 nt, Human
gucaccuaugacaagagcagugaaggugaggu

SEQ ID NO: 473193 - RNA, 32 nt, Human
gucaccucaguggaccagccugggggaaggag

SEQ ID NO: 473194 - RNA, 32 nt, Human
gucaccucauugguccaugaaggagcagccag

SEQ ID NO: 473195 - RNA, 32 nt, Human
gucaccucauuuugcauuacugucuuccgugg

SEQ ID NO: 473196 - RNA, 32 nt, Human
gucaccuccaccucucuccaugacccggcucu

SEQ ID NO: 473197 - RNA, 32 nt, Human
gucaccucccaccucuugccaccugcugcugc

SEQ ID NO: 473198 - RNA, 32 nt, Human
gucaccuccccuccaccagagugcuccauggc

SEQ ID NO: 473199 - RNA, 32 nt, Human
gucaccuccucucagguucaagugauucuccu

SEQ ID NO: 473200 - RNA, 31 nt, Human
gucaccucgcacuucauuacauuccuguacu

SEQ ID NO: 473201 - RNA, 32 nt, Human
gucaccucuaacuacuuucauuucccucaaua

SEQ ID NO: 473202 - RNA, 32 nt, Human
gucaccucucacucuucugucuuugcaaaccg

SEQ ID NO: 473203 - RNA, 32 nt, Human
gucaccucugugguggcccugucguccgccuc

SEQ ID NO: 473204 - RNA, 32 nt, Human
gucaccucuuugcccagcuucuccccugcccu

SEQ ID NO: 473205 - RNA, 32 nt, Human
gucaccugacccuucucauuucauaggcaucu

SEQ ID NO: 473206 - RNA, 32 nt, Human
gucaccugagccugguaggcugaggcugcagu

SEQ ID NO: 473207 - RNA, 32 nt, Human
gucaccugagucuaacagcaguuugacuuugu

SEQ ID NO: 473208 - RNA, 32 nt, Human
gucaccugcacucccagccaaguggugaugua

SEQ ID NO: 473209 - RNA, 32 nt, Human
gucaccugccauuccagaacuggaccacagaa

SEQ ID NO: 473210 - RNA, 32 nt, Human
gucaccugcccuggccccuccucugggcagcc

SEQ ID NO: 473211 - RNA, 31 nt, Human
gucaccugccucuuucccuuguucccggaug

SEQ ID NO: 473212 - RNA, 32 nt, Human
gucaccuggaaagaacagagauuacccuuuca

SEQ ID NO: 473213 - RNA, 32 nt, Human
gucaccuggagaugggggccagguugugcaga

SEQ ID NO: 473214 - RNA, 32 nt, Human
gucaccugggagguggggcaaggaugguguuu

SEQ ID NO: 473215 - RNA, 32 nt, Human
gucaccugggagguggggcagggaugguguuu

SEQ ID NO: 473216 - RNA, 24 nt, Human
gucaccugggcuggaguccagugg

SEQ ID NO: 473217 - RNA, 32 nt, Human
gucaccugggcugugaugugaagacaccugca

SEQ ID NO: 473218 - RNA, 32 nt, Human
gucaccugguugcacuauggccucaucugugg

SEQ ID NO: 473219 - RNA, 32 nt, Human
gucaccuguaaucccagcuacuugggaggcug

SEQ ID NO: 473220 - RNA, 32 nt, Human
gucaccuguaccaaacauuugaaaucaacuac

SEQ ID NO: 473221 - RNA, 32 nt, Human
gucaccuguagucccagcuacucgggaggcug

SEQ ID NO: 473222 - RNA, 32 nt, Human
gucaccuguagucccagcuacuugggaggaug

SEQ ID NO: 473223 - RNA, 32 nt, Human
gucaccuguagucccagcugcucgggagggug

SEQ ID NO: 473224 - RNA, 32 nt, Human
gucaccuguggcagaggugugcagaggcagag

SEQ ID NO: 473225 - RNA, 32 nt, Human
gucaccuugcacaaggaggacagugguauggc

SEQ ID NO: 473226 - RNA, 32 nt, Human
gucaccuugucuucuuugccuucagggagcug

SEQ ID NO: 473227 - RNA, 32 nt, Human
gucaccuuuacuccaguucccaacaaguuccu

SEQ ID NO: 473228 - RNA, 32 nt, Human
gucaccuuugcuccaguucccaacaaguuauu

SEQ ID NO: 473229 - RNA, 32 nt, Human
gucaccuuuguuccaguucccaacaaguuccu

SEQ ID NO: 473230 - RNA, 32 nt, Human
gucacgaacccccgccuugguuuuugaacacg

SEQ ID NO: 473231 - RNA, 32 nt, Human
gucacgaagcucaugguagacugaggccacua

SEQ ID NO: 473232 - RNA, 32 nt, Human
gucacgagagcacggcccugcgcuccccacaa

SEQ ID NO: 473233 - RNA, 32 nt, Human
gucacgauuuuucugccacuucaccuuaggga

SEQ ID NO: 473234 - RNA, 24 nt, Human
gucacgcaggcuagagugcagugg

SEQ ID NO: 473235 - RNA, 32 nt, Human
gucacgcaggguuccagguauuucuggggcuc

SEQ ID NO: 473236 - RNA, 32 nt, Human
gucacgcaguugaggucagggaaggaguaacu

SEQ ID NO: 473237 - RNA, 32 nt, Human
gucacgcauaucuggcagauggugcaggaaga

SEQ ID NO: 473238 - RNA, 32 nt, Human
gucacgccacugcacuccagccugggugacag

SEQ ID NO: 473239 - RNA, 32 nt, Human
gucacgccacugcauucuauccugggcaacag

SEQ ID NO: 473240 - RNA, 32 nt, Human
gucacgccaggccaggccaggccaggugggga

SEQ ID NO: 473241 - RNA, 32 nt, Human
gucacgccuguaaucccagcacuuuggcaggc

SEQ ID NO: 473242 - RNA, 32 nt, Human
gucacgccuguaaucccagcacuuugggaggc

SEQ ID NO: 473243 - RNA, 32 nt, Human
gucacgccuguaaucccagcacuuugggaggu

SEQ ID NO: 473244 - RNA, 32 nt, Human
gucacgccuguaaucccaguacuuugggaggc

SEQ ID NO: 473245 - RNA, 23 nt, Human
gucacgccuugugccuuccgccu

SEQ ID NO: 473246 - RNA, 32 nt, Human
gucacgcgccuguaaucccagcuacuuggggg

SEQ ID NO: 473247 - RNA, 32 nt, Human
gucacgcucgguaccaggcgcagaucauggca

SEQ ID NO: 473248 - RNA, 32 nt, Human
gucacggacaggagguaggauccugccgcucg

SEQ ID NO: 473249 - RNA, 32 nt, Human
gucacggagauccaaggggcugcaggagacuc

SEQ ID NO: 473250 - RNA, 32 nt, Human
gucacggcucacugcagccucaaacuccuagg

SEQ ID NO: 473251 - RNA, 32 nt, Human
gucacggcucacugcauccucaaccuccuggg

SEQ ID NO: 473252 - RNA, 32 nt, Human
gucacggcugcuucccaccagcaaagaccacg

SEQ ID NO: 473253 - RNA, 32 nt, Human
gucacgggagggugugagucagcucuguccac

SEQ ID NO: 473254 - RNA, 32 nt, Human
gucacgggagggugugagucagcucugucugu

SEQ ID NO: 473255 - RNA, 32 nt, Human
gucacgggagggugugugucagcucuguccgu

SEQ ID NO: 473256 - RNA, 32 nt, Human
gucacgggagggugugugucagcucugucugu

SEQ ID NO: 473257 - RNA, 32 nt, Human
gucacggggcgcgcacgccggggaagacuaca

SEQ ID NO: 473258 - RNA, 32 nt, Human
gucacgguggaccauucccuacuugcuuuuuc

SEQ ID NO: 473259 - RNA, 32 nt, Human
gucacgguuagaagaagcuaauauuugaaaca

SEQ ID NO: 473260 - RNA, 32 nt, Human
gucacguaccgccugcuugcucaaaucaauga

SEQ ID NO: 473261 - RNA, 32 nt, Human
gucacguacuccccagcacuguugagggauug

SEQ ID NO: 473262 - RNA, 32 nt, Human
gucacgucacugcacucuagccugggcaacag

SEQ ID NO: 473263 - RNA, 32 nt, Human
gucacgucuuucuccuucuccuuccuccuucu

SEQ ID NO: 473264 - RNA, 32 nt, Human
gucacgugggcugacccagagccggggcggaa

SEQ ID NO: 473265 - RNA, 32 nt, Human
gucacguuuggucaccauggaagcuuuuauug

SEQ ID NO: 473266 - RNA, 20 nt, Human
gucacuaaacaaaucccaga

SEQ ID NO: 473267 - RNA, 32 nt, Human
gucacuaaagcaaaguguggauuugaguuacu

SEQ ID NO: 473268 - RNA, 32 nt, Human
gucacuaaggagagagggucaggagccagagu

SEQ ID NO: 473269 - RNA, 32 nt, Human
gucacuacacuccaggcugggugacagauuaa

SEQ ID NO: 473270 - RNA, 32 nt, Human
gucacuaccuggaggacagcugccuggacagu

SEQ ID NO: 473271 - RNA, 23 nt, Human
gucacuacuacuuaaaacucuga

SEQ ID NO: 473272 - RNA, 32 nt, Human
gucacuacugcaauccaucuguggccgauuuu

SEQ ID NO: 473273 - RNA, 32 nt, Human
gucacuagaaaugggccagcugggucaaugug

SEQ ID NO: 473274 - RNA, 32 nt, Human
gucacuagagauacccugagguucaugucauc

SEQ ID NO: 473275 - RNA, 32 nt, Human
gucacuagcagaaggaaugaaagggaauuuau

SEQ ID NO: 473276 - RNA, 32 nt, Human
gucacuagccugugaucccagcacuuugggag

SEQ ID NO: 473277 - RNA, 21 nt, Human
gucacuagcuuaucuugaaca

SEQ ID NO: 473278 - RNA, 32 nt, Human
gucacuaggggguuccaugagaggugugugac

SEQ ID NO: 473279 - RNA, 32 nt, Human
gucacuaucuguggcugggugaacggcugugu

SEQ ID NO: 473280 - RNA, 32 nt, Human
gucacucaagaggacuucagcucugcuguugg

SEQ ID NO: 473281 - RNA, 24 nt, Human
gucacucaaucuggaaugcagugg

SEQ ID NO: 473282 - RNA, 32 nt, Human
gucacucacaaaaggcuggaugugcuuucauc

SEQ ID NO: 473283 - RNA, 32 nt, Human
gucacucacaggcgaagacacaaccugaaguc

SEQ ID NO: 473284 - RNA, 32 nt, Human
gucacucacucacccugacccugggcaaguua

SEQ ID NO: 473285 - RNA, 32 nt, Human
gucacucacugugucugaucugucucacucac

SEQ ID NO: 473286 - RNA, 32 nt, Human
gucacucaggaucaccaaagaaacagucauca

SEQ ID NO: 473287 - RNA, 24 nt, Human
gucacucaggcuagagugcagugg

SEQ ID NO: 473288 - RNA, 24 nt, Human
gucacucaggcugcagugcagugg

SEQ ID NO: 473289 - RNA, 24 nt, Human
gucacucaggcuggaaugcagugg

SEQ ID NO: 473290 - RNA, 24 nt, Human
gucacucaggcuggaguacagugg

SEQ ID NO: 473291 - RNA, 23 nt, Human
gucacucaggcuggagugcaaug

SEQ ID NO: 473292 - RNA, 24 nt, Human
gucacucaggcuggagugcaauga

SEQ ID NO: 473293 - RNA, 23 nt, Human
gucacucaggcuggagugcagug

SEQ ID NO: 473294 - RNA, 24 nt, Human
gucacucaggcuggagugcagugg

SEQ ID NO: 473295 - RNA, 24 nt, Human
gucacucaggcuggagugcggugg

SEQ ID NO: 473296 - RNA, 32 nt, Human
gucacucagugaucacggguaaagagaacugu

SEQ ID NO: 473297 - RNA, 32 nt, Human
gucacucauggaggccuaggggaacagcgaga

SEQ ID NO: 473298 - RNA, 32 nt, Human
gucacuccaaaccuugaaacugucagggucag

SEQ ID NO: 473299 - RNA, 32 nt, Human
gucacuccagccugggcaacagagugagacuc

SEQ ID NO: 473300 - RNA, 32 nt, Human
gucacuccagugguucccuccuuguccaaguc

SEQ ID NO: 473301 - RNA, 21 nt, Human
gucacucccugaacacaggga

SEQ ID NO: 473302 - RNA, 32 nt, Human
gucacuccucccaccccaccuaccucacaggg

SEQ ID NO: 473303 - RNA, 22 nt, Human
gucacuccucuuucccuuggua

SEQ ID NO: 473304 - RNA, 23 nt, Human
gucacucgcugugagauggggag

SEQ ID NO: 473305 - RNA, 32 nt, Human
gucacucuaaauggacaccacaugaaccucug

SEQ ID NO: 473306 - RNA, 19 nt, Human
gucacucuccacccagcca

SEQ ID NO: 473307 - RNA, 32 nt, Human
gucacucuccacccuucccuucugccugccca

SEQ ID NO: 473308 - RNA, 32 nt, Human
gucacucucccaugcccgccuuugaagcugag

SEQ ID NO: 473309 - RNA, 32 nt, Human
gucacucucccucugcuacugcugcugaucug

SEQ ID NO: 473310 - RNA, 32 nt, Human
gucacucucuucacauuuuucuucuauuccuc

SEQ ID NO: 473311 - RNA, 32 nt, Human
gucacucucuugcccaggcuggagugcagugg

SEQ ID NO: 473312 - RNA, 32 nt, Human
gucacucugaucaugguaacagcaucccuauu

SEQ ID NO: 473313 - RNA, 32 nt, Human
gucacucuguugcccaggcuggagugcagugg

SEQ ID NO: 473314 - RNA, 32 nt, Human
gucacucuuaccucccugucugcuuacucacc

SEQ ID NO: 473315 - RNA, 19 nt, Human
gucacucuuagaauucuaa

SEQ ID NO: 473316 - RNA, 32 nt, Human
gucacucuuccaccccuuuucucccucucccc

SEQ ID NO: 473317 - RNA, 32 nt, Human
gucacucuugaugggcaccuggauaacucagg

SEQ ID NO: 473318 - RNA, 32 nt, Human
gucacucuugcagucuuugaggcaggauaagu

SEQ ID NO: 473319 - RNA, 32 nt, Human
gucacugaaaaauauaaaaauuagcugagcau

SEQ ID NO: 473320 - RNA, 32 nt, Human
gucacugaaagccugagacuccuggcuucuuu

SEQ ID NO: 473321 - RNA, 32 nt, Human
gucacugaacuccggccugggugacagaagga

SEQ ID NO: 473322 - RNA, 32 nt, Human
gucacugaagacugugauuacaugcaccugcc

SEQ ID NO: 473323 - RNA, 32 nt, Human
gucacugacagcccuguguugugcucaggacu

SEQ ID NO: 473324 - RNA, 24 nt, Human
gucacugaccucauuuccuugaug

SEQ ID NO: 473325 - RNA, 32 nt, Human
gucacugacucagaugcagggucugcucaccc

SEQ ID NO: 473326 - RNA, 32 nt, Human
gucacugacuucaugacagucuggcccuccag

SEQ ID NO: 473327 - RNA, 24 nt, Human
gucacugaggcuggagugcagugg

SEQ ID NO: 473328 - RNA, 32 nt, Human
gucacugaggguugacugacuggagagcucaa

SEQ ID NO: 473329 - RNA, 32 nt, Human
gucacugauugcauuccagccugggugacaga

SEQ ID NO: 473330 - RNA, 32 nt, Human
gucacugcaaccucugccuccuggguucaaac

SEQ ID NO: 473331 - RNA, 32 nt, Human
gucacugcaaccucugccuccuggguucaaga

SEQ ID NO: 473332 - RNA, 32 nt, Human
gucacugcaaccucugccuccuggguucaagc

SEQ ID NO: 473333 - RNA, 32 nt, Human
gucacugcacuccaaccugggugacagagcga

SEQ ID NO: 473334 - RNA, 32 nt, Human
gucacugcacuccagccugggugacagaguga

SEQ ID NO: 473335 - RNA, 32 nt, Human
gucacugcacuccagccugggugacagugagu

SEQ ID NO: 473336 - RNA, 32 nt, Human
gucacugcacuccagcuugggugacagagacc

SEQ ID NO: 473337 - RNA, 32 nt, Human
gucacugcacuccggccugggugacagagcca

SEQ ID NO: 473338 - RNA, 32 nt, Human
gucacugcacugcagccugggugacagaaugu

SEQ ID NO: 473339 - RNA, 32 nt, Human
gucacugcauuccagccugggugacagagcga

SEQ ID NO: 473340 - RNA, 32 nt, Human
gucacugccaacaacaacgagguuccuauaau

SEQ ID NO: 473341 - RNA, 32 nt, Human
gucacugccagccugccgggccugccuucccu

SEQ ID NO: 473342 - RNA, 32 nt, Human
gucacugccaggaacgugcugaggaauggagu

SEQ ID NO: 473343 - RNA, 32 nt, Human
gucacugccccagagaauauacacacccuguc

SEQ ID NO: 473344 - RNA, 32 nt, Human
gucacugccccaggaacuagaagagagcgagg

SEQ ID NO: 473345 - RNA, 32 nt, Human
gucacugcccucucccugccugggggcuaugu

SEQ ID NO: 473346 - RNA, 32 nt, Human
gucacugccgacaucccucccccagcagaaug

SEQ ID NO: 473347 - RNA, 32 nt, Human
gucacugccuguuccccacugccuguguucgc

SEQ ID NO: 473348 - RNA, 32 nt, Human
gucacugcuacugccacggucagcauucccgc

SEQ ID NO: 473349 - RNA, 32 nt, Human
gucacugcucacuguagccuugacucuggagc

SEQ ID NO: 473350 - RNA, 26 nt, Human
gucacugcuggggaagggaugggguc

SEQ ID NO: 473351 - RNA, 32 nt, Human
gucacugcugucaaacagaagguaaacagucu

SEQ ID NO: 473352 - RNA, 32 nt, Human
gucacugcuuugucugugcugguaguuuguga

SEQ ID NO: 473353 - RNA, 32 nt, Human
gucacuggaaccucccugggccugucucagau

SEQ ID NO: 473354 - RNA, 32 nt, Human
gucacuggagaaaggggcugugcuggggccag

SEQ ID NO: 473355 - RNA, 32 nt, Human
gucacuggauaucuugagcucuguauugaaga

SEQ ID NO: 473356 - RNA, 32 nt, Human
gucacuggccuggaacucagccuugauucacu

SEQ ID NO: 473357 - RNA, 32 nt, Human
gucacuggcgagcccacccacacucaccagaa

SEQ ID NO: 473358 - RNA, 32 nt, Human
gucacugggauuauagacaugaaccaccucau

SEQ ID NO: 473359 - RNA, 32 nt, Human
gucacuggguaguggccguggcuccugacgau

SEQ ID NO: 473360 - RNA, 32 nt, Human
gucacugguccuuucucagccucucucgugcu

SEQ ID NO: 473361 - RNA, 32 nt, Human
gucacuggucucaaagaaucuacggaauucag

SEQ ID NO: 473362 - RNA, 32 nt, Human
gucacugguguuccucacccaccagcuguaac

SEQ ID NO: 473363 - RNA, 32 nt, Human
gucacuguacuccagccugggugacagaguga

SEQ ID NO: 473364 - RNA, 32 nt, Human
gucacugucaaucugcuauauuuuucacuauc

SEQ ID NO: 473365 - RNA, 32 nt, Human
gucacugucauaagaauaaacguguacugggg

SEQ ID NO: 473366 - RNA, 32 nt, Human
gucacugucauccucaccacagccagggguga

SEQ ID NO: 473367 - RNA, 32 nt, Human
gucacugucuccccugaacccccacacagugg

SEQ ID NO: 473368 - RNA, 31 nt, Human
gucacugucugcccugggccucaguuucccu

SEQ ID NO: 473369 - RNA, 32 nt, Human
gucacugugcccucauuggcccccagcaauca

SEQ ID NO: 473370 - RNA, 32 nt, Human
gucacugugcugcucugcagaguuacuucagg

SEQ ID NO: 473371 - RNA, 32 nt, Human
gucacuguggccaaacagugcccagcuuaagc

SEQ ID NO: 473372 - RNA, 32 nt, Human
gucacuguggugaugcagagauaauacggcug

SEQ ID NO: 473373 - RNA, 32 nt, Human
gucacugugguucagugagcacauggguggac

SEQ ID NO: 473374 - RNA, 31 nt, Human
gucacuuaagcgucucuuacagcagagagac

SEQ ID NO: 473375 - RNA, 20 nt, Human
gucacuuagggcaucuccug

SEQ ID NO: 473376 - RNA, 32 nt, Human
gucacuucaaaacuccagcuugcccaauaagg

SEQ ID NO: 473377 - RNA, 32 nt, Human
gucacuucacacuuggcaugcacugugaaagc

SEQ ID NO: 473378 - RNA, 32 nt, Human
gucacuucagacaggagccacagggagccugu

SEQ ID NO: 473379 - RNA, 18 nt, Human
gucacuucagggcuccuu

SEQ ID NO: 473380 - RNA, 32 nt, Human
gucacuuccaagcuagaaggaggaaucagaua

SEQ ID NO: 473381 - RNA, 32 nt, Human
gucacuucccugcucacaaucuuccaaugacu

SEQ ID NO: 473382 - RNA, 32 nt, Human
gucacuuccuucagcaucucacuucuucuucu

SEQ ID NO: 473383 - RNA, 32 nt, Human
gucacuucuccuccuccuuucuccagccagcc

SEQ ID NO: 473384 - RNA, 32 nt, Human
gucacuucuccucuguagaucucagucucccu

SEQ ID NO: 473385 - RNA, 32 nt, Human
gucacuugaacccaggaggcagagguugcagu

SEQ ID NO: 473386 - RNA, 32 nt, Human
gucacuugaacccgggaggcggaggcugcagu

SEQ ID NO: 473387 - RNA, 21 nt, Human
gucacuugaauagaagauggu

SEQ ID NO: 473388 - RNA, 32 nt, Human
gucacuugcagcuccauuuccaucacguggua

SEQ ID NO: 473389 - RNA, 32 nt, Human
gucacuugcccaggugcgguggcucacaccug

SEQ ID NO: 473390 - RNA, 22 nt, Human
gucacuugcugcuuuuucugcg

SEQ ID NO: 473391 - RNA, 32 nt, Human
gucacuuggaccacugucaguauuccaugccg

SEQ ID NO: 473392 - RNA, 32 nt, Human
gucacuugggcauuagaaugaaguuuuccuga

SEQ ID NO: 473393 - RNA, 32 nt, Human
gucacuuguugacugucucuguggaccagagu

SEQ ID NO: 473394 - RNA, 32 nt, Human
gucacuuugucacccaggcuggagugcaaugg

SEQ ID NO: 473395 - RNA, 32 nt, Human
gucacuuugucacucgaugucauuccaaaguu

SEQ ID NO: 473396 - RNA, 32 nt, Human
gucacuuugucccccaggcuggagugcagugg

SEQ ID NO: 473397 - RNA, 32 nt, Human
gucacuuuugaacucuucuccccaccaaaccc

SEQ ID NO: 473398 - RNA, 32 nt, Human
gucagaaacagaucugcuucauggacaucccc

SEQ ID NO: 473399 - RNA, 32 nt, Human
gucagaaaggaacuuuuacacaguuugccuuc

SEQ ID NO: 473400 - RNA, 32 nt, Human
gucagaaaguaguuuguaauugauauuaaaag

SEQ ID NO: 473401 - RNA, 32 nt, Human
gucagaaaguccuaaucauuucaguccugugc

SEQ ID NO: 473402 - RNA, 32 nt, Human
gucagaaaugcaggaagcuauaugagauucca

SEQ ID NO: 473403 - RNA, 32 nt, Human
gucagaaauucugcccuuugccuccaccacau

SEQ ID NO: 473404 - RNA, 19 nt, Human
gucagaacagguucuccaa

SEQ ID NO: 473405 - RNA, 32 nt, Human
gucagaacauucgaaucucugccccucacuug

SEQ ID NO: 473406 - RNA, 32 nt, Human
gucagaaccaguccugcccugugaauuacugc

SEQ ID NO: 473407 - RNA, 32 nt, Human
gucagaaccaguccugcccugugauuacugcu

SEQ ID NO: 473408 - RNA, 32 nt, Human
gucagaaccucaccccuuuucacuugucucuc

SEQ ID NO: 473409 - RNA, 32 nt, Human
gucagaacucacaccuugucagucaucaaaga

SEQ ID NO: 473410 - RNA, 32 nt, Human
gucagaacucacugcagccucuacaucccugg

SEQ ID NO: 473411 - RNA, 32 nt, Human
gucagaacugaggagggaaguggucagguuua

SEQ ID NO: 473412 - RNA, 32 nt, Human
gucagaacugaguucuugcugagguuugcauu

SEQ ID NO: 473413 - RNA, 32 nt, Human
gucagaagacuccagaagcagccacuuaguag

SEQ ID NO: 473414 - RNA, 32 nt, Human
gucagaaggaagaggcccagcagaagggacuc

SEQ ID NO: 473415 - RNA, 32 nt, Human
gucagaaggcggcacuucuggccaggucucug

SEQ ID NO: 473416 - RNA, 32 nt, Human
gucagaagucauaccuugcaugccaucguagc

SEQ ID NO: 473417 - RNA, 32 nt, Human
gucagaagugugaagggugccuguucugaauc

SEQ ID NO: 473418 - RNA, 32 nt, Human
gucagaaguuugucaggcagagauguuuaugg

SEQ ID NO: 473419 - RNA, 32 nt, Human
gucagaaugcaagcccugccucagcuucuccc

SEQ ID NO: 473420 - RNA, 32 nt, Human
gucagacaacacaagaaaagccaguagaaauu

SEQ ID NO: 473421 - RNA, 32 nt, Human
gucagacacagcaccucaggccgcugcucaga

SEQ ID NO: 473422 - RNA, 32 nt, Human
gucagacacuccucaaauauuguggacagggg

SEQ ID NO: 473423 - RNA, 20 nt, Human
gucagacaguggaugggcuc

SEQ ID NO: 473424 - RNA, 32 nt, Human
gucagacauggaaaugguggggagacaaaaau

SEQ ID NO: 473425 - RNA, 32 nt, Human
gucagacauggaaaugguggggagacagaaau

SEQ ID NO: 473426 - RNA, 21 nt, Human
gucagacccaggaggaggcau

SEQ ID NO: 473427 - RNA, 32 nt, Human
gucagacccaggaggaggcauugccagcucuc

SEQ ID NO: 473428 - RNA, 32 nt, Human
gucagacccaggcugguuugagcucagguucg

SEQ ID NO: 473429 - RNA, 32 nt, Human
gucagacccuccaggcuucggggaaauguggg

SEQ ID NO: 473430 - RNA, 32 nt, Human
gucagaccuuggacaguagucuugacuuccug

SEQ ID NO: 473431 - RNA, 32 nt, Human
gucagacguggaaaugguggggagacaaaaau

SEQ ID NO: 473432 - RNA, 32 nt, Human
gucagacucagccugugaacagacgcuaaccu

SEQ ID NO: 473433 - RNA, 32 nt, Human
gucagacuccaucccuccucugccgccaccgc

SEQ ID NO: 473434 - RNA, 32 nt, Human
gucagacugcccuggguggagggagacgccgg

SEQ ID NO: 473435 - RNA, 32 nt, Human
gucagacuuauuuuuaccuguacaccaucuuc

SEQ ID NO: 473436 - RNA, 32 nt, Human
gucagacuucuggucuugcuucuccacgugga

SEQ ID NO: 473437 - RNA, 32 nt, Human
gucagacuuugcugcauuuuacacaugugcug

SEQ ID NO: 473438 - RNA, 32 nt, Human
gucagagaaugccacagacaccaggguaagua

SEQ ID NO: 473439 - RNA, 32 nt, Human
gucagagagcacugcaauaugugcuucauggg

SEQ ID NO: 473440 - RNA, 32 nt, Human
gucagagaggagaguggagagugaaucuaggg

SEQ ID NO: 473441 - RNA, 32 nt, Human
gucagagcaaagcauuucaugaugacuguaac

SEQ ID NO: 473442 - RNA, 31 nt, Human
gucagagcaauguccaacugucaggcucuca

SEQ ID NO: 473443 - RNA, 32 nt, Human
gucagagcagcuuuaccacagcuucaggccac

SEQ ID NO: 473444 - RNA, 32 nt, Human
gucagagcaguggaggggagacaucgcccaug

SEQ ID NO: 473445 - RNA, 32 nt, Human
gucagagcauuuuaacuagccacucagaugag

SEQ ID NO: 473446 - RNA, 32 nt, Human
gucagagccaacagguuggggagagacagaga

SEQ ID NO: 473447 - RNA, 32 nt, Human
gucagagccacugggcaucgcuugggugagau

SEQ ID NO: 473448 - RNA, 32 nt, Human
gucagagcccucuggguuuguggagcacacag

SEQ ID NO: 473449 - RNA, 32 nt, Human
gucagagccugaugccgccucggucucugggu

SEQ ID NO: 473450 - RNA, 32 nt, Human
gucagagccuuccuccccaucuggaauucaca

SEQ ID NO: 473451 - RNA, 32 nt, Human
gucagagcucacuguaaccucaaaauccuggg

SEQ ID NO: 473452 - RNA, 32 nt, Human
gucagagcuguuggccucgccugggcccaggc

SEQ ID NO: 473453 - RNA, 32 nt, Human
gucagagcuuuagagccugcaaggagcucccg

SEQ ID NO: 473454 - RNA, 32 nt, Human
gucagaggaagagacuucuucuguucucugga

SEQ ID NO: 473455 - RNA, 32 nt, Human
gucagaggaguccagauuuucccaccugaccu

SEQ ID NO: 473456 - RNA, 32 nt, Human
gucagaggaugcaucuucuucuagucuuggag

SEQ ID NO: 473457 - RNA, 32 nt, Human
gucagaggcaggagugggggaucagggaaggu

SEQ ID NO: 473458 - RNA, 32 nt, Human
gucagaggcccuggacagaagcuccagauagg

SEQ ID NO: 473459 - RNA, 32 nt, Human
gucagaggccggggcuagaggcagauggaagg

SEQ ID NO: 473460 - RNA, 32 nt, Human
gucagaggccuggcccuucuuuacagauguag

SEQ ID NO: 473461 - RNA, 32 nt, Human
gucagaggcgacaugagugccgcggggcugcu

SEQ ID NO: 473462 - RNA, 32 nt, Human
gucagaggcugcaggaagcgcuugccucuccc

SEQ ID NO: 473463 - RNA, 21 nt, Human
gucagaggcuggagugcaaug

SEQ ID NO: 473464 - RNA, 22 nt, Human
gucagaggcuggagugcaaugg

SEQ ID NO: 473465 - RNA, 32 nt, Human
gucagagggccagauuuggcccuuggucuaua

SEQ ID NO: 473466 - RNA, 32 nt, Human
gucagagggcggggcuggugaggguuuguccu

SEQ ID NO: 473467 - RNA, 32 nt, Human
gucagaggguccuguucccaucagcgauuccc

SEQ ID NO: 473468 - RNA, 32 nt, Human
gucagagguggcugugccagaggugcggcuuc

SEQ ID NO: 473469 - RNA, 32 nt, Human
gucagaguaaagcugcuccacccccagauugc

SEQ ID NO: 473470 - RNA, 32 nt, Human
gucagagugauacgcaguuuuaaagggaggaa

SEQ ID NO: 473471 - RNA, 32 nt, Human
gucagagugggagguugucaacagaagagucc

SEQ ID NO: 473472 - RNA, 32 nt, Human
gucagaguguguagagugaaguugcugugccc

SEQ ID NO: 473473 - RNA, 32 nt, Human
gucagaguguugaacccugccucccaguuaaa

SEQ ID NO: 473474 - RNA, 32 nt, Human
gucagaguugggucagggccacugugaguggg

SEQ ID NO: 473475 - RNA, 32 nt, Human
gucagaguuuucuaccaacuggcaucugugau

SEQ ID NO: 473476 - RNA, 32 nt, Human
gucagauaaagaaaaaggugaaggaggucaga

SEQ ID NO: 473477 - RNA, 32 nt, Human
gucagauagauuuuucucccagcauguucuac

SEQ ID NO: 473478 - RNA, 21 nt, Human
gucagauaguuagaauuguaa

SEQ ID NO: 473479 - RNA, 32 nt, Human
gucagaucccagguucuaugaccaaauaagua

SEQ ID NO: 473480 - RNA, 32 nt, Human
gucagaugaaguucacaucucuaaaggguaaa

SEQ ID NO: 473481 - RNA, 32 nt, Human
gucagaugccuguagucccagcuacuugugag

SEQ ID NO: 473482 - RNA, 32 nt, Human
gucagauggaagcucuguggccuuuccuaacu

SEQ ID NO: 473483 - RNA, 32 nt, Human
gucagauggagugccggucugcagaggacugc

SEQ ID NO: 473484 - RNA, 32 nt, Human
gucagaugguggggugggcccucuccaggggg

SEQ ID NO: 473485 - RNA, 32 nt, Human
gucagauguagaggagagagagcgagagaaca

SEQ ID NO: 473486 - RNA, 32 nt, Human
gucagauguggaggcccagggaauagacccuc

SEQ ID NO: 473487 - RNA, 20 nt, Human
gucagauuaaaacaagaugg

SEQ ID NO: 473488 - RNA, 32 nt, Human
gucagcaaccgcacucaucagaccaugcacua

SEQ ID NO: 473489 - RNA, 22 nt, Human
gucagcaaccucagaacucuga

SEQ ID NO: 473490 - RNA, 32 nt, Human
gucagcaacguggcuggggaggccgugcggac

SEQ ID NO: 473491 - RNA, 32 nt, Human
gucagcaagagaaacucuacggcuaugggaga

SEQ ID NO: 473492 - RNA, 32 nt, Human
gucagcaagcuggagacccaggagagcugaug

SEQ ID NO: 473493 - RNA, 20 nt, Human
gucagcaaggaagacccuga

SEQ ID NO: 473494 - RNA, 19 nt, Human
gucagcaagguggcucuga

SEQ ID NO: 473495 - RNA, 17 nt, Human
gucagcaauaccucuga

SEQ ID NO: 473496 - RNA, 19 nt, Human
gucagcaaugaagacuuug

SEQ ID NO: 473497 - RNA, 20 nt, Human
gucagcaauucugauucuga

SEQ ID NO: 473498 - RNA, 20 nt, Human
gucagcaauuuucuuucuga

SEQ ID NO: 473499 - RNA, 32 nt, Human
gucagcacaaaggaggcuuuuucugugcuuug

SEQ ID NO: 473500 - RNA, 32 nt, Human
gucagcacaccuaggguaugggcagugcuuag

SEQ ID NO: 473501 - RNA, 31 nt, Human
gucagcacacucaagcuggcuugggacgagg

SEQ ID NO: 473502 - RNA, 32 nt, Human
gucagcacagcagaggaggcccaggcaauauc

SEQ ID NO: 473503 - RNA, 32 nt, Human
gucagcacagcagaggaggcccaggcagugcc

SEQ ID NO: 473504 - RNA, 32 nt, Human
gucagcacaggcuggccagagagauguucuug

SEQ ID NO: 473505 - RNA, 32 nt, Human
gucagcaccaaguaacaccacacacacgcagc

SEQ ID NO: 473506 - RNA, 32 nt, Human
gucagcaccagccucagcaacugugcagagac

SEQ ID NO: 473507 - RNA, 20 nt, Human
gucagcaccugaaggagagg

SEQ ID NO: 473508 - RNA, 32 nt, Human
gucagcaccuggaaguggagugcaggcugcag

SEQ ID NO: 473509 - RNA, 32 nt, Human
gucagcaccuuugaaguuaagggaaggacagg

SEQ ID NO: 473510 - RNA, 32 nt, Human
gucagcacggaagcuccaccuucuggguggag

SEQ ID NO: 473511 - RNA, 32 nt, Human
gucagcacucacugaaccucacuuuacaggga

SEQ ID NO: 473512 - RNA, 32 nt, Human
gucagcagagagacccugaacucugcuaaggg

SEQ ID NO: 473513 - RNA, 32 nt, Human
gucagcagagcugaaagagaaaguagaaggau

SEQ ID NO: 473514 - RNA, 32 nt, Human
gucagcagaugaagaugcaauggcugccucag

SEQ ID NO: 473515 - RNA, 32 nt, Human
gucagcagauggugacaacgugcaucugguuc

SEQ ID NO: 473516 - RNA, 32 nt, Human
gucagcagccucccugaagaccaaaauuagaa

SEQ ID NO: 473517 - RNA, 32 nt, Human
gucagcagcuacuugguagucacuguggcaug

SEQ ID NO: 473518 - RNA, 32 nt, Human
gucagcagcugccugcuuuucugugauguaug

SEQ ID NO: 473519 - RNA, 19 nt, Human
gucagcaggaggaacucua

SEQ ID NO: 473520 - RNA, 32 nt, Human
gucagcaggauggaccuggagaugucagggcu

SEQ ID NO: 473521 - RNA, 32 nt, Human
gucagcaggcacugugcccaggaagagccugc

SEQ ID NO: 473522 - RNA, 32 nt, Human
gucagcagggccugagccaggcucguccccug

SEQ ID NO: 473523 - RNA, 32 nt, Human
gucagcaggugaugagcugggagcagcuccuu

SEQ ID NO: 473524 - RNA, 32 nt, Human
gucagcaguaagguuucaagguacaguuaugg

SEQ ID NO: 473525 - RNA, 32 nt, Human
gucagcagugcugcagacacaggacagaacgu

SEQ ID NO: 473526 - RNA, 21 nt, Human
gucagcaguuaacaguuuuga

SEQ ID NO: 473527 - RNA, 22 nt, Human
gucagcaguuuuguaaacucug

SEQ ID NO: 473528 - RNA, 20 nt, Human
gucagcauaaaaaauuuuaa

SEQ ID NO: 473529 - RNA, 23 nt, Human
gucagcauacuuuggcggaccuu

SEQ ID NO: 473530 - RNA, 32 nt, Human
gucagcauaggagagaaaguucaugaaucugg

SEQ ID NO: 473531 - RNA, 32 nt, Human
gucagcauauacaagcucuuaauauucuguuu

SEQ ID NO: 473532 - RNA, 32 nt, Human
gucagcaucucaagggcacugugguauggaaa

SEQ ID NO: 473533 - RNA, 21 nt, Human
gucagcaucugagaacuuuaa

SEQ ID NO: 473534 - RNA, 32 nt, Human
gucagcaucuggaaggugcccguguccuaugc

SEQ ID NO: 473535 - RNA, 32 nt, Human
gucagccacaccugucagcccaagcagaguga

SEQ ID NO: 473536 - RNA, 32 nt, Human
gucagccacagcucucuuccagcacuguccuc

SEQ ID NO: 473537 - RNA, 32 nt, Human
gucagccacccaggcccaacauguugugaguu

SEQ ID NO: 473538 - RNA, 32 nt, Human
gucagccaccgcacccagccuggaguggccuu

SEQ ID NO: 473539 - RNA, 32 nt, Human
gucagccagagcuggggaaacccagaacugac

SEQ ID NO: 473540 - RNA, 32 nt, Human
gucagccagauagucuggaucuauggugugac

SEQ ID NO: 473541 - RNA, 32 nt, Human
gucagccagcagcuccaugagaggcucuacca

SEQ ID NO: 473542 - RNA, 18 nt, Human
gucagccaggacccugug

SEQ ID NO: 473543 - RNA, 32 nt, Human
gucagccaggcugcccuuaucagcuguccccu

SEQ ID NO: 473544 - RNA, 23 nt, Human
gucagccaggcuggagugcagug

SEQ ID NO: 473545 - RNA, 32 nt, Human
gucagccauugcacccagcccagauugucuua

SEQ ID NO: 473546 - RNA, 32 nt, Human
gucagcccaaaaucugauaaucaugucuaacc

SEQ ID NO: 473547 - RNA, 32 nt, Human
gucagcccaaagcagaggcucggccaugaacu

SEQ ID NO: 473548 - RNA, 32 nt, Human
gucagcccaccaggagcccugccuucgucucc

SEQ ID NO: 473549 - RNA, 24 nt, Human
gucagcccagucuggaugcacagg

SEQ ID NO: 473550 - RNA, 32 nt, Human
gucagcccagucuggaugcacaggaggaugcu

SEQ ID NO: 473551 - RNA, 32 nt, Human
gucagcccaugcaccugcccugggugaggaag

SEQ ID NO: 473552 - RNA, 32 nt, Human
gucagcccauggugauuuagcuccuugcuguu

SEQ ID NO: 473553 - RNA, 32 nt, Human
gucagcccauuggcucccaucugaaccacuuu

SEQ ID NO: 473554 - RNA, 32 nt, Human
gucagccccaggagaguccugagaugauuuug

SEQ ID NO: 473555 - RNA, 24 nt, Human
gucagccccucggugcuggccucu

SEQ ID NO: 473556 - RNA, 32 nt, Human
gucagcccggaggaggaggaggaggaggagga

SEQ ID NO: 473557 - RNA, 32 nt, Human
gucagcccuacccugaccaugaccugagguug

SEQ ID NO: 473558 - RNA, 32 nt, Human
gucagcccuccucauuccuaaauaacuugccu

SEQ ID NO: 473559 - RNA, 32 nt, Human
gucagcccugcuccccacagggccaggcuggc

SEQ ID NO: 473560 - RNA, 32 nt, Human
gucagccgccacugcugcaguaacccuucuag

SEQ ID NO: 473561 - RNA, 32 nt, Human
gucagccgcgggccgcugggaacuccacucgg

SEQ ID NO: 473562 - RNA, 32 nt, Human
gucagccuaggaggaggaagggcucccggaag

SEQ ID NO: 473563 - RNA, 32 nt, Human
gucagccuaggaggaggaagggcuuccggaag

SEQ ID NO: 473564 - RNA, 32 nt, Human
gucagccucaaaggcauggcuuucucucuggc

SEQ ID NO: 473565 - RNA, 32 nt, Human
gucagccucagggggaguucaaggucaucugg

SEQ ID NO: 473566 - RNA, 32 nt, Human
gucagccuccaccugcuuuuccuggguccugu

SEQ ID NO: 473567 - RNA, 32 nt, Human
gucagccuccacugcuguacguccuuggcuac

SEQ ID NO: 473568 - RNA, 32 nt, Human
gucagccucccucucuggaauuuaguuucacc

SEQ ID NO: 473569 - RNA, 32 nt, Human
gucagccucugcagcugccucaguuuccccag

SEQ ID NO: 473570 - RNA, 32 nt, Human
gucagccucuucuccccaugcuucuaggaacu

SEQ ID NO: 473571 - RNA, 32 nt, Human
gucagccugacuggugguuacacagggcuaua

SEQ ID NO: 473572 - RNA, 32 nt, Human
gucagccugagacucucagagcacgacggcca

SEQ ID NO: 473573 - RNA, 32 nt, Human
gucagccugccugaggcuucucuccuggggca

SEQ ID NO: 473574 - RNA, 32 nt, Human
gucagccugccuggcguccccuugccucagca

SEQ ID NO: 473575 - RNA, 32 nt, Human
gucagccuggcucucgggaaauucagccauga

SEQ ID NO: 473576 - RNA, 32 nt, Human
gucagccuggguggcugggcccggcuuagggc

SEQ ID NO: 473577 - RNA, 32 nt, Human
gucagccugugcaaaggccccguggccagggg

SEQ ID NO: 473578 - RNA, 32 nt, Human
gucagccuucaauccccuuuccuuccucuuuu

SEQ ID NO: 473579 - RNA, 32 nt, Human
gucagccuuccacugaauacacgauugagucu

SEQ ID NO: 473580 - RNA, 32 nt, Human
gucagccuucccuguucuccagccuagguggu

SEQ ID NO: 473581 - RNA, 32 nt, Human
gucagccuucccuuugauccucaggcccuacc

SEQ ID NO: 473582 - RNA, 32 nt, Human
gucagccuucucucccccauaaggacuggcug

SEQ ID NO: 473583 - RNA, 24 nt, Human
gucagcgagccgugagaugcgugg

SEQ ID NO: 473584 - RNA, 32 nt, Human
gucagcgagggaagguugaggaggagccagag

SEQ ID NO: 473585 - RNA, 32 nt, Human
gucagcgccgcucggacgccgccggcaccaug

SEQ ID NO: 473586 - RNA, 32 nt, Human
gucagcggaaggcaggugcggagauaaaggag

SEQ ID NO: 473587 - RNA, 32 nt, Human
gucagcggagucguggcugagcagaacacgcc

SEQ ID NO: 473588 - RNA, 32 nt, Human
gucagcgggcaccagccgcuuccugugcccau

SEQ ID NO: 473589 - RNA, 32 nt, Human
gucagcggggugggcucagaccugcagacucc

SEQ ID NO: 473590 - RNA, 32 nt, Human
gucagcgugcagaaaccagcugucugcugaug

SEQ ID NO: 473591 - RNA, 32 nt, Human
gucagcguguggugucgccugcaugggucgua

SEQ ID NO: 473592 - RNA, 32 nt, Human
gucagcuaacuucagccugugcugcugggccc

SEQ ID NO: 473593 - RNA, 23 nt, Human
gucagcuagauugaaaacucuga

SEQ ID NO: 473594 - RNA, 24 nt, Human
gucagcuaggcugaaguguagugg

SEQ ID NO: 473595 - RNA, 32 nt, Human
gucagcuaggggcugguguggaagaggagcuc

SEQ ID NO: 473596 - RNA, 32 nt, Human
gucagcuagucauuccugucauauucccagua

SEQ ID NO: 473597 - RNA, 32 nt, Human
gucagcucacugcaaccuccaccuccuggauu

SEQ ID NO: 473598 - RNA, 32 nt, Human
gucagcucagccuccaaaggagccagccucuc

SEQ ID NO: 473599 - RNA, 18 nt, Human
gucagcucagggcccugu

SEQ ID NO: 473600 - RNA, 32 nt, Human
gucagcucauucuugccuuacuccaaugaugg

SEQ ID NO: 473601 - RNA, 32 nt, Human
gucagcucauuuccauuccacuauuucccaua

SEQ ID NO: 473602 - RNA, 32 nt, Human
gucagcuccccuacacacaccccacaccuuca

SEQ ID NO: 473603 - RNA, 18 nt, Human
gucagcuccuccugcaag

SEQ ID NO: 473604 - RNA, 32 nt, Human
gucagcuccuggcucccugccucucucccacu

SEQ ID NO: 473605 - RNA, 20 nt, Human
gucagcuccugugcauucuc

SEQ ID NO: 473606 - RNA, 32 nt, Human
gucagcucuaauuguucaccacagaacucaua

SEQ ID NO: 473607 - RNA, 32 nt, Human
gucagcucuggccucugcuucuacacauggac

SEQ ID NO: 473608 - RNA, 32 nt, Human
gucagcucuguaauuauaguaucacuuagaca

SEQ ID NO: 473609 - RNA, 32 nt, Human
gucagcucugugcugagccuccuggccuggcc

SEQ ID NO: 473610 - RNA, 32 nt, Human
gucagcugagaagagugaggcagcgccuccgg

SEQ ID NO: 473611 - RNA, 19 nt, Human
gucagcugagagcauccuc

SEQ ID NO: 473612 - RNA, 21 nt, Human
gucagcugaggggccugcaca

SEQ ID NO: 473613 - RNA, 32 nt, Human
gucagcugcagcaauggaauacgugcuggaag

SEQ ID NO: 473614 - RNA, 32 nt, Human
gucagcugcccgccugcgccuccugagccaga

SEQ ID NO: 473615 - RNA, 32 nt, Human
gucagcugcgggcucccaggccuaggcgccca

SEQ ID NO: 473616 - RNA, 32 nt, Human
gucagcugcguggacuaugacauccuauuugc

SEQ ID NO: 473617 - RNA, 20 nt, Human
gucagcuggaugaugccaca

SEQ ID NO: 473618 - RNA, 32 nt, Human
gucagcuggccaaacaacuaaagcccacuugc

SEQ ID NO: 473619 - RNA, 32 nt, Human
gucagcuggucuucagcuugacccuagaauug

SEQ ID NO: 473620 - RNA, 25 nt, Human
gucagcuguaaguaggagcuacaca

SEQ ID NO: 473621 - RNA, 32 nt, Human
gucagcugucacccaggaccuaggcagggaug

SEQ ID NO: 473622 - RNA, 32 nt, Human
gucagcugucuuucagaagaccugguggggca

SEQ ID NO: 473623 - RNA, 32 nt, Human
gucagcuguguaugucccuugaugucacccug

SEQ ID NO: 473624 - RNA, 32 nt, Human
gucagcuuaaccauuuccuaugugccaagcug

SEQ ID NO: 473625 - RNA, 32 nt, Human
gucagcuucagcuuucuccaucgaaaucccau

SEQ ID NO: 473626 - RNA, 32 nt, Human
gucagcuucauugcuuacuacugugaaauaag

SEQ ID NO: 473627 - RNA, 32 nt, Human
gucagcuuccuugagccugggccacuccuccc

SEQ ID NO: 473628 - RNA, 18 nt, Human
gucagcuuggcucgggga

SEQ ID NO: 473629 - RNA, 32 nt, Human
gucagcuugugccgcauccccaaccaauccac

SEQ ID NO: 473630 - RNA, 32 nt, Human
gucagcuuucagggcucugaaacccuauuccc

SEQ ID NO: 473631 - RNA, 32 nt, Human
gucagcuuucuuuccugagucuuccuuaccua

SEQ ID NO: 473632 - RNA, 32 nt, Human
gucagcuuugcaccaggagacagaggcagcug

SEQ ID NO: 473633 - RNA, 32 nt, Human
gucagcuuuugcuacaauuccaugccuguccc

SEQ ID NO: 473634 - RNA, 32 nt, Human
gucaggaaaccagcucguggacaggggcuuug

SEQ ID NO: 473635 - RNA, 32 nt, Human
gucaggaaagaguagacuguuaagaagaccga

SEQ ID NO: 473636 - RNA, 32 nt, Human
gucaggaaauuccaaguugguuaucacaacuc

SEQ ID NO: 473637 - RNA, 32 nt, Human
gucaggaaggugcaguuuuucuucucaaucua

SEQ ID NO: 473638 - RNA, 31 nt, Human
gucaggaauguaggaacugguauccauucug

SEQ ID NO: 473639 - RNA, 32 nt, Human
gucaggacaagaggaagcaagggaugcagcua

SEQ ID NO: 473640 - RNA, 22 nt, Human
gucaggacaauuaggauuguaa

SEQ ID NO: 473641 - RNA, 18 nt, Human
gucaggaccagccugguc

SEQ ID NO: 473642 - RNA, 31 nt, Human
gucaggacccaacucacuugguguaacagau

SEQ ID NO: 473643 - RNA, 32 nt, Human
gucaggaccucuggcccuacuaggcuguagac

SEQ ID NO: 473644 - RNA, 32 nt, Human
gucaggaccuugccuugaaagccgggcggcgc

SEQ ID NO: 473645 - RNA, 32 nt, Human
gucaggacugcagcuccagccucuucaggccc

SEQ ID NO: 473646 - RNA, 32 nt, Human
gucaggagaauggugugaucaccugucacaga

SEQ ID NO: 473647 - RNA, 32 nt, Human
gucaggagaccucuguauggcuuuucaauuuu

SEQ ID NO: 473648 - RNA, 32 nt, Human
gucaggagaccugggucccucucccagcuugu

SEQ ID NO: 473649 - RNA, 32 nt, Human
gucaggagagaaggccugauaggagccuucag

SEQ ID NO: 473650 - RNA, 32 nt, Human
gucaggagagaggugcagggaggaaggccuug

SEQ ID NO: 473651 - RNA, 32 nt, Human
gucaggagagcccucugcugcuuuccaacaca

SEQ ID NO: 473652 - RNA, 32 nt, Human
gucaggagagccuucugggcaguggcucuaac

SEQ ID NO: 473653 - RNA, 32 nt, Human
gucaggagcccaggccagugagauggggccug

SEQ ID NO: 473654 - RNA, 21 nt, Human
gucaggaggaagucacaggga

SEQ ID NO: 473655 - RNA, 32 nt, Human
gucaggaggcuggaguggagggaaggcagggg

SEQ ID NO: 473656 - RNA, 32 nt, Human
gucaggagguggagguugcagugagccaagau

SEQ ID NO: 473657 - RNA, 32 nt, Human
gucaggagguugaggcugcagugagcuaugac

SEQ ID NO: 473658 - RNA, 32 nt, Human
gucaggaguaggcugaggcagccuucuggugc

SEQ ID NO: 473659 - RNA, 32 nt, Human
gucaggagucacugagaaggaggcagauggag

SEQ ID NO: 473660 - RNA, 32 nt, Human
gucaggaguucaagacaagaccagccuggcca

SEQ ID NO: 473661 - RNA, 32 nt, Human
gucaggaguucaagaucaggaccaacauggug

SEQ ID NO: 473662 - RNA, 32 nt, Human
gucaggaguucacgcaaaucagggggcccgug

SEQ ID NO: 473663 - RNA, 32 nt, Human
gucaggaguucgagaccaaccuagccaacaug

SEQ ID NO: 473664 - RNA, 32 nt, Human
gucaggaguucgagaccagccuagccaacaug

SEQ ID NO: 473665 - RNA, 32 nt, Human
gucaggaguuugagaccagccuagccaacaug

SEQ ID NO: 473666 - RNA, 32 nt, Human
gucaggaguuugagaccagugugcaaaacaua

SEQ ID NO: 473667 - RNA, 32 nt, Human
gucaggauacagauuuccaaggccaacuguug

SEQ ID NO: 473668 - RNA, 32 nt, Human
gucaggaucaaaacacauuuagugugacuuag

SEQ ID NO: 473669 - RNA, 31 nt, Human
gucaggauggcagaggagcaggaguucaccc

SEQ ID NO: 473670 - RNA, 32 nt, Human
gucaggauguucuccaacuccugacuucauga

SEQ ID NO: 473671 - RNA, 32 nt, Human
gucaggauucaaaaccagccuggccaacauag

SEQ ID NO: 473672 - RNA, 32 nt, Human
gucaggauugugccuccagucagaaggaccau

SEQ ID NO: 473673 - RNA, 32 nt, Human
gucaggcaaaacuaaugaacguggaguuaaug

SEQ ID NO: 473674 - RNA, 32 nt, Human
gucaggcaaauuuaacaaaccugcacaugugc

SEQ ID NO: 473675 - RNA, 32 nt, Human
gucaggcaauaugcccuugagcaggucacccc

SEQ ID NO: 473676 - RNA, 32 nt, Human
gucaggcacaaggguuuggauuuugugcaagc

SEQ ID NO: 473677 - RNA, 32 nt, Human
gucaggcaccagcauggagaccucaugacaaa

SEQ ID NO: 473678 - RNA, 32 nt, Human
gucaggcacugagcuccuacacaggucacugu

SEQ ID NO: 473679 - RNA, 32 nt, Human
gucaggcagaggcugaaaaugcccggcugcag

SEQ ID NO: 473680 - RNA, 32 nt, Human
gucaggcagggagcccuucuccccacagagcu

SEQ ID NO: 473681 - RNA, 31 nt, Human
gucaggcaguuuccaucuucucacaaucuuc

SEQ ID NO: 473682 - RNA, 32 nt, Human
gucaggcauuccucacucccaccaggcagaag

SEQ ID NO: 473683 - RNA, 32 nt, Human
gucaggccaaaauccuuggagccacccucaac

SEQ ID NO: 473684 - RNA, 32 nt, Human
gucaggccacacacuuuagucuuccgucuuuu

SEQ ID NO: 473685 - RNA, 32 nt, Human
gucaggccaccagggggcgccagagaaccaca

SEQ ID NO: 473686 - RNA, 32 nt, Human
gucaggccacuggccaguggggaccagccucu

SEQ ID NO: 473687 - RNA, 32 nt, Human
gucaggccaggccaccaccacuggggagcggg

SEQ ID NO: 473688 - RNA, 20 nt, Human
gucaggccaggccgggucca

SEQ ID NO: 473689 - RNA, 32 nt, Human
gucaggcccagaagggcucuggggaggggaag

SEQ ID NO: 473690 - RNA, 32 nt, Human
gucaggcccaggcugagugagaugagcugcag

SEQ ID NO: 473691 - RNA, 32 nt, Human
gucaggcccauccugguugucaccaugaggac

SEQ ID NO: 473692 - RNA, 18 nt, Human
gucaggccccagaggagc

SEQ ID NO: 473693 - RNA, 32 nt, Human
gucaggccuaaagagccccacagggaaaggga

SEQ ID NO: 473694 - RNA, 32 nt, Human
gucaggccucacgguggccucuccaggaugag

SEQ ID NO: 473695 - RNA, 32 nt, Human
gucaggccucugggucaggccucugccaccuc

SEQ ID NO: 473696 - RNA, 32 nt, Human
gucaggccuggaccuccugggcaggaaagggu

SEQ ID NO: 473697 - RNA, 32 nt, Human
gucaggccuggcccagguccuuauacuccccu

SEQ ID NO: 473698 - RNA, 32 nt, Human
gucaggcgggggcgcuccugcccaggccacgg

SEQ ID NO: 473699 - RNA, 32 nt, Human
gucaggcggguguucaccacugccuuuucuuc

SEQ ID NO: 473700 - RNA, 32 nt, Human
gucaggcuacugucugugauucuuuuguuugu

SEQ ID NO: 473701 - RNA, 32 nt, Human
gucaggcuagucuugaacuccugggcccaagc

SEQ ID NO: 473702 - RNA, 22 nt, Human
gucaggcucagguuccauggga

SEQ ID NO: 473703 - RNA, 32 nt, Human
gucaggcucagguuucccugcuguuggcuuuc

SEQ ID NO: 473704 - RNA, 32 nt, Human
gucaggcucuuaccuccaccuccagggcacag

SEQ ID NO: 473705 - RNA, 32 nt, Human
gucaggcuggucucaaacugaccucaggugau

SEQ ID NO: 473706 - RNA, 32 nt, Human
gucaggcuuagaagauggagaaagcacuggaa

SEQ ID NO: 473707 - RNA, 32 nt, Human
gucaggcuuccuggugagccucagggagugca

SEQ ID NO: 473708 - RNA, 19 nt, Human
gucaggcuuggcucuggga

SEQ ID NO: 473709 - RNA, 32 nt, Human
gucaggcuuguccugggccaggaggagcugag

SEQ ID NO: 473710 - RNA, 32 nt, Human
gucagggaaaagcagaagcgucugccacagau

SEQ ID NO: 473711 - RNA, 32 nt, Human
gucagggaaauguuaaaaacugcaagagaaag

SEQ ID NO: 473712 - RNA, 32 nt, Human
gucagggaagaaagacuucucaaggaggugcc

SEQ ID NO: 473713 - RNA, 32 nt, Human
gucagggaagaccacagaagccuagcacagcu

SEQ ID NO: 473714 - RNA, 32 nt, Human
gucagggaagcacagugaagcuugcuuaaagg

SEQ ID NO: 473715 - RNA, 32 nt, Human
gucagggaauuucauaucuuugcucaaaaucu

SEQ ID NO: 473716 - RNA, 32 nt, Human
gucagggacuggucacagggagggcucagagg

SEQ ID NO: 473717 - RNA, 32 nt, Human
gucagggagaggaggcggcgagagaggacugc

SEQ ID NO: 473718 - RNA, 32 nt, Human
gucagggagauggagucaguggggcauugcag

SEQ ID NO: 473719 - RNA, 32 nt, Human
gucagggagggaaaggaggagggagagagaug

SEQ ID NO: 473720 - RNA, 32 nt, Human
gucagggagggcagaggguggcagcgagggca

SEQ ID NO: 473721 - RNA, 32 nt, Human
gucagggaggugggaaggugggugggccugaa

SEQ ID NO: 473722 - RNA, 32 nt, Human
gucagggcacacucugcuccaccagcuucuug

SEQ ID NO: 473723 - RNA, 32 nt, Human
gucagggcagugccaugcugaccugcugaccg

SEQ ID NO: 473724 - RNA, 32 nt, Human
gucagggccacauugggcucacagaccucagc

SEQ ID NO: 473725 - RNA, 32 nt, Human
gucagggccaggaaguagaggcugggaacucu

SEQ ID NO: 473726 - RNA, 20 nt, Human
gucagggccagggccagaga

SEQ ID NO: 473727 - RNA, 32 nt, Human
gucagggcccagagaguggguggagaagcucu

SEQ ID NO: 473728 - RNA, 31 nt, Human
gucagggccuaggaugggccugugucaccag

SEQ ID NO: 473729 - RNA, 32 nt, Human
gucagggccucgggggcccagcuauguacaac

SEQ ID NO: 473730 - RNA, 32 nt, Human
gucagggcuaggaggcaggggcugcaggcuca

SEQ ID NO: 473731 - RNA, 32 nt, Human
gucagggcucccgcuucauauuuccuuuucuu

SEQ ID NO: 473732 - RNA, 32 nt, Human
gucagggcugaggaggagaagcaggggcagga

SEQ ID NO: 473733 - RNA, 32 nt, Human
gucagggcuucuggguucccuuaacuuugugc

SEQ ID NO: 473734 - RNA, 32 nt, Human
gucaggggacucaggcuuaugaggagguauug

SEQ ID NO: 473735 - RNA, 32 nt, Human
gucaggggagagaggggaggaaagccaaggga

SEQ ID NO: 473736 - RNA, 32 nt, Human
gucaggggcuggugccugggagcugaugaagc

SEQ ID NO: 473737 - RNA, 32 nt, Human
gucagggguccaccuucucuggcucacagagg

SEQ ID NO: 473738 - RNA, 32 nt, Human
gucagggguuguuucuaccugcuuugucuaaa

SEQ ID NO: 473739 - RNA, 32 nt, Human
gucaggguccaagaggaauggguguucugugg

SEQ ID NO: 473740 - RNA, 32 nt, Human
gucagggugagaggcugcucuggagaacaaug

SEQ ID NO: 473741 - RNA, 32 nt, Human
gucagggugagugggagcccaggaaggagcga

SEQ ID NO: 473742 - RNA, 32 nt, Human
gucagggugaugaucuucugaagcucuuggau

SEQ ID NO: 473743 - RNA, 32 nt, Human
gucagggugggaggaaaacuguugaaguauua

SEQ ID NO: 473744 - RNA, 32 nt, Human
gucagggugguguggcgguugcagcggccccu

SEQ ID NO: 473745 - RNA, 32 nt, Human
gucaggguugcagaaucagccggacuuuccug

SEQ ID NO: 473746 - RNA, 32 nt, Human
gucaggguuucaggaguccagccccaggaggc

SEQ ID NO: 473747 - RNA, 32 nt, Human
gucagguaaggguuuccacucugcacauugua

SEQ ID NO: 473748 - RNA, 32 nt, Human
gucagguacaagguuuguagcuugccaauaug

SEQ ID NO: 473749 - RNA, 19 nt, Human
gucagguagggcacagggg

SEQ ID NO: 473750 - RNA, 32 nt, Human
gucagguagggugagagaggcccugaagauag

SEQ ID NO: 473751 - RNA, 32 nt, Human
gucagguaggguggggccggugggagaggccc

SEQ ID NO: 473752 - RNA, 32 nt, Human
gucagguauaccaaagcauuccucugacugcu

SEQ ID NO: 473753 - RNA, 32 nt, Human
gucaggucagcugccuugauuucccucuccca

SEQ ID NO: 473754 - RNA, 32 nt, Human
gucaggucauguuugaaaccaugcuuggcugg

SEQ ID NO: 473755 - RNA, 32 nt, Human
gucaggugcugaagggacauugggagaaguga

SEQ ID NO: 473756 - RNA, 32 nt, Human
gucaggugcugcaaauuggaaagaagacuugu

SEQ ID NO: 473757 - RNA, 32 nt, Human
gucagguggggaggggacaccaagggcccauu

SEQ ID NO: 473758 - RNA, 32 nt, Human
gucaggugucgcgugguccugaucuaggaaga

SEQ ID NO: 473759 - RNA, 31 nt, Human
gucagguguuuccguaccacagcaggagcag

SEQ ID NO: 473760 - RNA, 32 nt, Human
gucagguucaugguuacgaagcugcugacccc

SEQ ID NO: 473761 - RNA, 32 nt, Human
gucagguuguaauacaggccaagcagacgggc

SEQ ID NO: 473762 - RNA, 32 nt, Human
gucaguaacacaaaugauguauucagugaaua

SEQ ID NO: 473763 - RNA, 32 nt, Human
gucaguaacacauguguaagagccgcggaggg

SEQ ID NO: 473764 - RNA, 32 nt, Human
gucaguaaccaccaacaccaugccucugguuc

SEQ ID NO: 473765 - RNA, 21 nt, Human
gucaguaagugguguguucaa

SEQ ID NO: 473766 - RNA, 32 nt, Human
gucaguaauuuccaaugggcgggaggcauuaa

SEQ ID NO: 473767 - RNA, 32 nt, Human
gucaguacauccuucagcgagugccuuacucu

SEQ ID NO: 473768 - RNA, 32 nt, Human
gucaguaccagcccuuguccucugccugugga

SEQ ID NO: 473769 - RNA, 32 nt, Human
gucaguacccuuaccagccacugguaaccauu

SEQ ID NO: 473770 - RNA, 32 nt, Human
gucaguacugcacugcaagaauggcagauuuu

SEQ ID NO: 473771 - RNA, 32 nt, Human
gucaguacuguacaucugcacacugguguuaa

SEQ ID NO: 473772 - RNA, 32 nt, Human
gucaguacuguuggacccauagguagccucau

SEQ ID NO: 473773 - RNA, 32 nt, Human
gucaguagcugcuuucugagcuacucaacaag

SEQ ID NO: 473774 - RNA, 32 nt, Human
gucaguaggaugaccuccacccuccuuggaca

SEQ ID NO: 473775 - RNA, 32 nt, Human
gucagucacaaaccaaacgaagguucuacuua

SEQ ID NO: 473776 - RNA, 32 nt, Human
gucagucaccaugugugggcucagggaccccc

SEQ ID NO: 473777 - RNA, 32 nt, Human
gucagucaggcagggagggaguggcuguguug

SEQ ID NO: 473778 - RNA, 32 nt, Human
gucaguccaggcccugaauggcuggucuccag

SEQ ID NO: 473779 - RNA, 32 nt, Human
gucaguccauacagcaagacaccuggcacuug

SEQ ID NO: 473780 - RNA, 32 nt, Human
gucagucccaggugaggccaaggcuuucuggc

SEQ ID NO: 473781 - RNA, 32 nt, Human
gucaguccccauccuccuccccucagccccca

SEQ ID NO: 473782 - RNA, 32 nt, Human
gucagucccuguucuugagccucuuuucuccu

SEQ ID NO: 473783 - RNA, 32 nt, Human
gucaguccuaggcuggaugggaggguggcccc

SEQ ID NO: 473784 - RNA, 32 nt, Human
gucaguccucaccaaguuuuccagaucauucc

SEQ ID NO: 473785 - RNA, 32 nt, Human
gucaguccugaggaaaaauauuggggacucca

SEQ ID NO: 473786 - RNA, 32 nt, Human
gucaguccuggacuugugcaggccuguuuugu

SEQ ID NO: 473787 - RNA, 32 nt, Human
gucaguccuguguauaccuagauauuagucag

SEQ ID NO: 473788 - RNA, 32 nt, Human
gucagucgggugccgagauuugggagagacgc

SEQ ID NO: 473789 - RNA, 19 nt, Human
gucagucucacuucugcug

SEQ ID NO: 473790 - RNA, 32 nt, Human
gucagucucuacugggacauguuaggcccuug

SEQ ID NO: 473791 - RNA, 32 nt, Human
gucagucucuuccugcacccaaaggcagaaca

SEQ ID NO: 473792 - RNA, 32 nt, Human
gucagucucuuuucacacauugcaucaguuuc

SEQ ID NO: 473793 - RNA, 32 nt, Human
gucagucugcagaauggucgcacuggagguuc

SEQ ID NO: 473794 - RNA, 32 nt, Human
gucagucuggccugagggguggauggcuggcc

SEQ ID NO: 473795 - RNA, 32 nt, Human
gucagucugucucuuuuucagcucaauuguau

SEQ ID NO: 473796 - RNA, 32 nt, Human
gucagucuuaauucccaugccaaaggacaaac

SEQ ID NO: 473797 - RNA, 32 nt, Human
gucagucuuccacguguaaacaacagugugug

SEQ ID NO: 473798 - RNA, 20 nt, Human
gucagugaaaauauguacaa

SEQ ID NO: 473799 - RNA, 20 nt, Human
gucagugaagaggggcucag

SEQ ID NO: 473800 - RNA, 23 nt, Human
gucagugacucaaauaucucuuu

SEQ ID NO: 473801 - RNA, 32 nt, Human
gucagugacuccugccccuuggucuucagugu

SEQ ID NO: 473802 - RNA, 32 nt, Human
gucagugacugagaaagggugggugggacuag

SEQ ID NO: 473803 - RNA, 32 nt, Human
gucagugacugucagacaucuuccugcuuauu

SEQ ID NO: 473804 - RNA, 32 nt, Human
gucagugacuuucuccaauucucccuccuuuu

SEQ ID NO: 473805 - RNA, 20 nt, Human
gucagugagaggaaugucca

SEQ ID NO: 473806 - RNA, 32 nt, Human
gucagugagccccuuccuuggccaugaagcuc

SEQ ID NO: 473807 - RNA, 32 nt, Human
gucagugaggaagaauugggccaugcuaacgu

SEQ ID NO: 473808 - RNA, 21 nt, Human
gucagugaggaugaggcucag

SEQ ID NO: 473809 - RNA, 32 nt, Human
gucagugagggugggguggaggacuccuaaag

SEQ ID NO: 473810 - RNA, 24 nt, Human
gucagugagguggggaaaggaagu

SEQ ID NO: 473811 - RNA, 32 nt, Human
gucagugcaauaacaaaccuuccuuuuuaaga

SEQ ID NO: 473812 - RNA, 32 nt, Human
gucagugcagcgguuacucugggagguggagg

SEQ ID NO: 473813 - RNA, 32 nt, Human
gucagugcccaacuguuauagguuguuggaua

SEQ ID NO: 473814 - RNA, 32 nt, Human
gucagugccgggcucacacugcagucuauccc

SEQ ID NO: 473815 - RNA, 32 nt, Human
gucagugccugagauacaccuacaagagcgcc

SEQ ID NO: 473816 - RNA, 32 nt, Human
gucagugccugccucgauaccucucucugcag

SEQ ID NO: 473817 - RNA, 32 nt, Human
gucagugcgguggaggaagugcgaagccaugu

SEQ ID NO: 473818 - RNA, 32 nt, Human
gucagugcucucagcuggcagugcaaugcuug

SEQ ID NO: 473819 - RNA, 21 nt, Human
gucaguggaaaagggguucaa

SEQ ID NO: 473820 - RNA, 32 nt, Human
gucaguggaagagaguagagcucaaaacugga

SEQ ID NO: 473821 - RNA, 32 nt, Human
gucaguggagccagcacccucugcugcuucag

SEQ ID NO: 473822 - RNA, 26 nt, Human
gucaguggaguguucgggaugcaggg

SEQ ID NO: 473823 - RNA, 32 nt, Human
gucaguggcaaagcugcaucugaagggcggcc

SEQ ID NO: 473824 - RNA, 21 nt, Human
gucaguggccaaggcuacaca

SEQ ID NO: 473825 - RNA, 32 nt, Human
gucaguggccuuuccuccuucugggugcccag

SEQ ID NO: 473826 - RNA, 32 nt, Human
gucaguggcggcuguccccuccccagcccagc

SEQ ID NO: 473827 - RNA, 20 nt, Human
gucagugggaaagagcucaa

SEQ ID NO: 473828 - RNA, 32 nt, Human
gucaguggggcucucugaguccuggcccaaag

SEQ ID NO: 473829 - RNA, 32 nt, Human
gucagugggggucagccaggagcccagggagu

SEQ ID NO: 473830 - RNA, 32 nt, Human
gucagugggugagguguuccgccugggccggc

SEQ ID NO: 473831 - RNA, 32 nt, Human
gucagugguggcaccaggauggaagggcaagg

SEQ ID NO: 473832 - RNA, 32 nt, Human
gucagugguguaacuuggaggaagaugcuuag

SEQ ID NO: 473833 - RNA, 32 nt, Human
gucagugguuccaccuucacaggccacuuuga

SEQ ID NO: 473834 - RNA, 32 nt, Human
gucaguguaaucuccaagguccuggccuuucc

SEQ ID NO: 473835 - RNA, 32 nt, Human
gucaguguagcagcguagcagagaagcagaga

SEQ ID NO: 473836 - RNA, 32 nt, Human
gucaguguccccaucaugguggcuaugaagcu

SEQ ID NO: 473837 - RNA, 32 nt, Human
gucagugucuccugcccugacuccacaucauu

SEQ ID NO: 473838 - RNA, 32 nt, Human
gucagugucuugcucauucuucaugacacucc

SEQ ID NO: 473839 - RNA, 32 nt, Human
gucagugugagaagaagauuguuucugagcuu

SEQ ID NO: 473840 - RNA, 19 nt, Human
gucagugugauaccagcag

SEQ ID NO: 473841 - RNA, 32 nt, Human
gucagugugcaggggacucaggggcuuggccc

SEQ ID NO: 473842 - RNA, 32 nt, Human
gucaguguuuuguucuauccaggcuuucagau

SEQ ID NO: 473843 - RNA, 32 nt, Human
gucaguuauagaggaggcucaggaggaucugg

SEQ ID NO: 473844 - RNA, 32 nt, Human
gucaguuaucaugucccugaaagggacauucu

SEQ ID NO: 473845 - RNA, 32 nt, Human
gucaguuauguuauggaccaaaagccaaaucu

SEQ ID NO: 473846 - RNA, 31 nt, Human
gucaguuauucauguuuucauuuaaaguuuu

SEQ ID NO: 473847 - RNA, 32 nt, Human
gucaguucaagaccagccuggccaaacauggu

SEQ ID NO: 473848 - RNA, 32 nt, Human
gucaguucaagaccagccuggccaacauggug

SEQ ID NO: 473849 - RNA, 32 nt, Human
gucaguucagggcauuuuagggcugucuugcu

SEQ ID NO: 473850 - RNA, 32 nt, Human
gucaguucaguaggagaguucacacuggcccc

SEQ ID NO: 473851 - RNA, 32 nt, Human
gucaguucauguccaaagcacuuuaggaggcu

SEQ ID NO: 473852 - RNA, 32 nt, Human
gucaguucccagagguccugggacaggggaga

SEQ ID NO: 473853 - RNA, 32 nt, Human
gucaguucccucaucagcaccagaggcucagc

SEQ ID NO: 473854 - RNA, 32 nt, Human
gucaguuccugccuuuucucaucagcagaaca

SEQ ID NO: 473855 - RNA, 32 nt, Human
gucaguuccuggcgaagccucucuucuagguu

SEQ ID NO: 473856 - RNA, 32 nt, Human
gucaguucugaaggagggugaggcgguggggg

SEQ ID NO: 473857 - RNA, 32 nt, Human
gucaguugacucugauauucauucccaaauga

SEQ ID NO: 473858 - RNA, 32 nt, Human
gucaguugauuuucaacaauggugcuaaaaca

SEQ ID NO: 473859 - RNA, 32 nt, Human
gucaguugccuggcuccuggggccagaguuuc

SEQ ID NO: 473860 - RNA, 32 nt, Human
gucaguugcuuacuuauuuugcucuggaugag

SEQ ID NO: 473861 - RNA, 32 nt, Human
gucaguugggcaacagugaaaauuuucuuuua

SEQ ID NO: 473862 - RNA, 32 nt, Human
gucaguugugcaucaaggcuacucgggggaua

SEQ ID NO: 473863 - RNA, 23 nt, Human
gucaguuguuguuccuguacucg

SEQ ID NO: 473864 - RNA, 32 nt, Human
gucaguuuagagaccuuucuguguuaaugccu

SEQ ID NO: 473865 - RNA, 32 nt, Human
gucaguuuagaggcaguggccugggaacuggc

SEQ ID NO: 473866 - RNA, 24 nt, Human
gucaguuuaggcugggcgcagugg

SEQ ID NO: 473867 - RNA, 32 nt, Human
gucaguuuaguuaaguagaugcaguccccgca

SEQ ID NO: 473868 - RNA, 32 nt, Human
gucaguuucuauaauggcaucuuacauggcau

SEQ ID NO: 473869 - RNA, 32 nt, Human
gucaguuugagaccagccugggcaacauggug

SEQ ID NO: 473870 - RNA, 32 nt, Human
gucaguuugggauucucuucagaaagauggca

SEQ ID NO: 473871 - RNA, 32 nt, Human
gucaguuuucccucaaugcccaaggcucagca

SEQ ID NO: 473872 - RNA, 32 nt, Human
gucauaaaccuacaccaaugcccagcaaucac

SEQ ID NO: 473873 - RNA, 32 nt, Human
gucauaaagaggaggagaaacagggugaguca

SEQ ID NO: 473874 - RNA, 32 nt, Human
gucauaaaguccuccuugagcccagggaccau

SEQ ID NO: 473875 - RNA, 21 nt, Human
gucauaaauuauuuccccggu

SEQ ID NO: 473876 - RNA, 32 nt, Human
gucauaaccaacauaugaacagacagauuuau

SEQ ID NO: 473877 - RNA, 32 nt, Human
gucauaacuucuguuacuccuuuggcccauag

SEQ ID NO: 473878 - RNA, 32 nt, Human
gucauacaacacagcuaaccauuaugccaauc

SEQ ID NO: 473879 - RNA, 18 nt, Human
gucauacaguaaacucug

SEQ ID NO: 473880 - RNA, 32 nt, Human
gucauaccagugcacuccaggcgggugacaga

SEQ ID NO: 473881 - RNA, 32 nt, Human
gucauaccauuucaccuaucauaguacucaaa

SEQ ID NO: 473882 - RNA, 32 nt, Human
gucauaccuaggacagguaugaccucugccca

SEQ ID NO: 473883 - RNA, 32 nt, Human
gucauaccucacugcggccucaaacuccuggg

SEQ ID NO: 473884 - RNA, 32 nt, Human
gucauaccuccuucuauuaggaauggcauaua

SEQ ID NO: 473885 - RNA, 32 nt, Human
gucauacuguuuucuuugccuugaaggggaac

SEQ ID NO: 473886 - RNA, 32 nt, Human
gucauagaauggggacauuagacugaaaacug

SEQ ID NO: 473887 - RNA, 32 nt, Human
gucauagacuuuucuuuuuaaccuucugcaaa

SEQ ID NO: 473888 - RNA, 19 nt, Human
gucauagaugaagcucuga

SEQ ID NO: 473889 - RNA, 32 nt, Human
gucauagcucacugcagccucgaacuccuggg

SEQ ID NO: 473890 - RNA, 32 nt, Human
gucauagcuguagaggggcagaugugguuuga

SEQ ID NO: 473891 - RNA, 32 nt, Human
gucauaguggccaccagugagucacaucuaug

SEQ ID NO: 473892 - RNA, 32 nt, Human
gucauaguucacugcagccuugaacucuuugg

SEQ ID NO: 473893 - RNA, 32 nt, Human
gucauaucaggccacaggaagcggggcaggga

SEQ ID NO: 473894 - RNA, 32 nt, Human
gucauaucugcugccucuguccagagcgccag

SEQ ID NO: 473895 - RNA, 32 nt, Human
gucauaugacaaaggcauucacugcagcauua

SEQ ID NO: 473896 - RNA, 32 nt, Human
gucauauguuaaaaauaaagagauguagaaau

SEQ ID NO: 473897 - RNA, 32 nt, Human
gucauauugaacaccagucucuuagaaaguua

SEQ ID NO: 473898 - RNA, 23 nt, Human
gucauauugacacugguauuuua

SEQ ID NO: 473899 - RNA, 32 nt, Human
gucauauuuguaacguggagagaacacggagc

SEQ ID NO: 473900 - RNA, 23 nt, Human
gucaucaaacagagcuucuuccu

SEQ ID NO: 473901 - RNA, 32 nt, Human
gucaucaaacuggccauguccuggccccgucu

SEQ ID NO: 473902 - RNA, 32 nt, Human
gucaucacagaggcagguacacgacaccacgg

SEQ ID NO: 473903 - RNA, 32 nt, Human
gucaucacccucuacaccauguuugucaccug

SEQ ID NO: 473904 - RNA, 20 nt, Human
gucaucacuuaaaauauuga

SEQ ID NO: 473905 - RNA, 32 nt, Human
gucaucagaagaggaaaaaugaagguaauguu

SEQ ID NO: 473906 - RNA, 32 nt, Human
gucaucagaagagggaggaggagcccaggcgu

SEQ ID NO: 473907 - RNA, 32 nt, Human
gucaucagagagguggcaguggagguuuguua

SEQ ID NO: 473908 - RNA, 32 nt, Human
gucaucagaucuucuccugaaaaugggagaca

SEQ ID NO: 473909 - RNA, 32 nt, Human
gucaucaggagaggagaaugaggaugaggccc

SEQ ID NO: 473910 - RNA, 23 nt, Human
gucaucaggcuggagugcagugg

SEQ ID NO: 473911 - RNA, 32 nt, Human
gucaucaggcuggagugcaguggcgcaauuuc

SEQ ID NO: 473912 - RNA, 32 nt, Human
gucaucaggcuggagugcaguggcucacugca

SEQ ID NO: 473913 - RNA, 32 nt, Human
gucaucagguccuagacgugggagaaggagcc

SEQ ID NO: 473914 - RNA, 32 nt, Human
gucaucagugugucaaaagcacaaagaucccc

SEQ ID NO: 473915 - RNA, 23 nt, Human
gucaucauacauguacauuucca

SEQ ID NO: 473916 - RNA, 32 nt, Human
gucaucaucauuguuguggugcugcuaauggg

SEQ ID NO: 473917 - RNA, 32 nt, Human
gucaucaucugucagcaguaccacacugucuu

SEQ ID NO: 473918 - RNA, 32 nt, Human
gucaucaugccacugcacuuccagccugggug

SEQ ID NO: 473919 - RNA, 32 nt, Human
gucaucauucaccauuuauccaggauggccgc

SEQ ID NO: 473920 - RNA, 32 nt, Human
gucaucauucagaacauacagccucgaagggc

SEQ ID NO: 473921 - RNA, 24 nt, Human
gucauccaaacuggagugcagugg

SEQ ID NO: 473922 - RNA, 22 nt, Human
gucauccaagcuggagugcagu

SEQ ID NO: 473923 - RNA, 23 nt, Human
gucauccaagcuggagugcagug

SEQ ID NO: 473924 - RNA, 24 nt, Human
gucauccaagcuggagugcagugg

SEQ ID NO: 473925 - RNA, 32 nt, Human
gucauccaaguggcauuccuaguaaguugggu

SEQ ID NO: 473926 - RNA, 32 nt, Human
gucauccaaucagccaccaaauggcauuaccu

SEQ ID NO: 473927 - RNA, 32 nt, Human
gucauccacugagccuucaucucccaugaacu

SEQ ID NO: 473928 - RNA, 20 nt, Human
gucauccagcagccuccccu

SEQ ID NO: 473929 - RNA, 32 nt, Human
gucauccaggaaaaucggaaagaagcacagua

SEQ ID NO: 473930 - RNA, 24 nt, Human
gucauccaggcuagagugcagugg

SEQ ID NO: 473931 - RNA, 23 nt, Human
gucauccaggcuggagugcagug

SEQ ID NO: 473932 - RNA, 24 nt, Human
gucauccaggcuggagugcagugg

SEQ ID NO: 473933 - RNA, 32 nt, Human
gucaucccaaagugcugagauuacaguuggcg

SEQ ID NO: 473934 - RNA, 32 nt, Human
gucaucccagcacuuugggaagcugaggcgag

SEQ ID NO: 473935 - RNA, 32 nt, Human
gucaucccagcacuuugggaggcugaggcagg

SEQ ID NO: 473936 - RNA, 32 nt, Human
gucaucccagcauuugggaggcugaggcaggc

SEQ ID NO: 473937 - RNA, 17 nt, Human
gucauccccuucuuuga

SEQ ID NO: 473938 - RNA, 32 nt, Human
gucaucccugauuccuccuucuucuuaacccu

SEQ ID NO: 473939 - RNA, 32 nt, Human
gucauccucacagcugcagggccaggugcaug

SEQ ID NO: 473940 - RNA, 32 nt, Human
gucauccucaccaagcucauuacaucugccag

SEQ ID NO: 473941 - RNA, 32 nt, Human
gucauccucccuugccccaggccagguagcaa

SEQ ID NO: 473942 - RNA, 32 nt, Human
gucauccucucaccucacccaccuccgaauga

SEQ ID NO: 473943 - RNA, 32 nt, Human
gucauccugauacuucccugaggucucuuuuc

SEQ ID NO: 473944 - RNA, 32 nt, Human
gucauccugcccagcccugccuccuggccaug

SEQ ID NO: 473945 - RNA, 32 nt, Human
gucauccuggagcacagcucuucccacgcucc

SEQ ID NO: 473946 - RNA, 32 nt, Human
gucauccugucuccuguaccuccugggaaagg

SEQ ID NO: 473947 - RNA, 32 nt, Human
gucauccuuauuauuaaaaugcagccuccaaa

SEQ ID NO: 473948 - RNA, 32 nt, Human
gucaucgaugccugugccgccccaggcaauaa

SEQ ID NO: 473949 - RNA, 32 nt, Human
gucaucggaaguggugccuucagcacagaaga

SEQ ID NO: 473950 - RNA, 32 nt, Human
gucaucgggaaaggcaaagaaacugaaggcag

SEQ ID NO: 473951 - RNA, 32 nt, Human
gucaucgggccagaaggcgugcuggcaggcaa

SEQ ID NO: 473952 - RNA, 32 nt, Human
gucaucguaggugauuugaaggucuugauuug

SEQ ID NO: 473953 - RNA, 17 nt, Human
gucaucguccugcugcc

SEQ ID NO: 473954 - RNA, 32 nt, Human
gucaucguggucgccaucaugagcucgggcau

SEQ ID NO: 473955 - RNA, 32 nt, Human
gucaucguuggagcuuccuaagacucccagag

SEQ ID NO: 473956 - RNA, 32 nt, Human
gucaucuaaaaacuuucuguuuucuggggucu

SEQ ID NO: 473957 - RNA, 32 nt, Human
gucaucuagucgaguccucucauuaguaaagg

SEQ ID NO: 473958 - RNA, 32 nt, Human
gucaucucagaacucuauguccagccauggaa

SEQ ID NO: 473959 - RNA, 32 nt, Human
gucaucucagucuggaacucagucccacuucu

SEQ ID NO: 473960 - RNA, 27 nt, Human
gucaucucauauugaucagguauuuua

SEQ ID NO: 473961 - RNA, 32 nt, Human
gucaucucauccauuuccuccaugucuuugua

SEQ ID NO: 473962 - RNA, 32 nt, Human
gucaucucaugacaacagaagggagguggccg

SEQ ID NO: 473963 - RNA, 32 nt, Human
gucaucuccagaauuauuggggucacauaugu

SEQ ID NO: 473964 - RNA, 32 nt, Human
gucaucuccgggguggccacaggcuagauccc

SEQ ID NO: 473965 - RNA, 32 nt, Human
gucaucuccugggggcccucucuggagccacc

SEQ ID NO: 473966 - RNA, 32 nt, Human
gucaucucugaccuuguuucagcaaaguaaac

SEQ ID NO: 473967 - RNA, 32 nt, Human
gucaucugcagccucugccuccagcccggcag

SEQ ID NO: 473968 - RNA, 32 nt, Human
gucaucugcccagucacccaggaaucagagaa

SEQ ID NO: 473969 - RNA, 31 nt, Human
gucaucugccucugagggaccguccucaccg

SEQ ID NO: 473970 - RNA, 32 nt, Human
gucaucugcugaccacaccccagauccgcccu

SEQ ID NO: 473971 - RNA, 32 nt, Human
gucaucugcuguggccccaucuggccgcuagc

SEQ ID NO: 473972 - RNA, 32 nt, Human
gucaucuggcggaggucucugggagcccagaa

SEQ ID NO: 473973 - RNA, 32 nt, Human
gucaucugggccaccagcuccacuggcccccg

SEQ ID NO: 473974 - RNA, 32 nt, Human
gucaucuggugaugaagagaaaagguuaaucu

SEQ ID NO: 473975 - RNA, 32 nt, Human
gucaucuguaccucugccuccuuuccccuccc

SEQ ID NO: 473976 - RNA, 24 nt, Human
gucaucugugaauaaaguauuuua

SEQ ID NO: 473977 - RNA, 22 nt, Human
gucaucugugguuugguuuuua

SEQ ID NO: 473978 - RNA, 20 nt, Human
gucaucuguguuuguguuuu

SEQ ID NO: 473979 - RNA, 32 nt, Human
gucaucuuagggcaggagccacuguggcaucu

SEQ ID NO: 473980 - RNA, 32 nt, Human
gucaucuucacucguguauuaagucauucacu

SEQ ID NO: 473981 - RNA, 32 nt, Human
gucaucuucucccuugacaugcccaucagauu

SEQ ID NO: 473982 - RNA, 32 nt, Human
gucaucuucucucugcugcuguagcugccaug

SEQ ID NO: 473983 - RNA, 32 nt, Human
gucaucuuucugcagaaaaccauuagaccauc

SEQ ID NO: 473984 - RNA, 32 nt, Human
gucaugaaaaauaugaacauuuccuguggaaa

SEQ ID NO: 473985 - RNA, 28 nt, Human
gucaugaacagccacagcuacaauggca

SEQ ID NO: 473986 - RNA, 32 nt, Human
gucaugaagccgcgcagcagccauggcuuuua

SEQ ID NO: 473987 - RNA, 32 nt, Human
gucaugaaugaggaggugugugagcagggaac

SEQ ID NO: 473988 - RNA, 32 nt, Human
gucaugacacugcccuccagccuggacaacag

SEQ ID NO: 473989 - RNA, 32 nt, Human
gucaugaccagaaaacaagcccugccagccuc

SEQ ID NO: 473990 - RNA, 32 nt, Human
gucaugacuccaagagcagagcagggaagagc

SEQ ID NO: 473991 - RNA, 32 nt, Human
gucaugagaaaggauuaucacaccuguagcaa

SEQ ID NO: 473992 - RNA, 32 nt, Human
gucaugagcuuuguuaauuuucaauguuuucc

SEQ ID NO: 473993 - RNA, 32 nt, Human
gucaugaggaaggguucuuuuaacacucggca

SEQ ID NO: 473994 - RNA, 32 nt, Human
gucaugaggagaccucaccaccagucggucaa

SEQ ID NO: 473995 - RNA, 32 nt, Human
gucaugaggguggagaucaugaaugggguuag

SEQ ID NO: 473996 - RNA, 32 nt, Human
gucaugaugcuuggccuggcaggaugacucaa

SEQ ID NO: 473997 - RNA, 32 nt, Human
gucaugcaacacauaaugacguucuaguuagu

SEQ ID NO: 473998 - RNA, 32 nt, Human
gucaugcaaucaauaggguccuaacaacugag

SEQ ID NO: 473999 - RNA, 32 nt, Human
gucaugcaauuaagggcagaucugggccagug

SEQ ID NO: 474000 - RNA, 24 nt, Human
gucaugcagacuggagugcagugg

SEQ ID NO: 474001 - RNA, 32 nt, Human
gucaugcagaguauuucuaaaguaauugguua

SEQ ID NO: 474002 - RNA, 32 nt, Human
gucaugcagcucauacuguccacccuuguauu

SEQ ID NO: 474003 - RNA, 18 nt, Human
gucaugcaggaacucuaa

SEQ ID NO: 474004 - RNA, 24 nt, Human
gucaugcaggcuggagugcggugg

SEQ ID NO: 474005 - RNA, 19 nt, Human
gucaugcaugagauccaua

SEQ ID NO: 474006 - RNA, 23 nt, Human
gucaugccaaagagcuccugaga

SEQ ID NO: 474007 - RNA, 32 nt, Human
gucaugccaaccuagacaccucaugcuucugu

SEQ ID NO: 474008 - RNA, 32 nt, Human
gucaugccacugcacuccagccuggccugggc

SEQ ID NO: 474009 - RNA, 32 nt, Human
gucaugccacugcacuccagccugggagacag

SEQ ID NO: 474010 - RNA, 32 nt, Human
gucaugccacugcacuccagccugggcaacag

SEQ ID NO: 474011 - RNA, 32 nt, Human
gucaugccacugcacuccagccugggugacag

SEQ ID NO: 474012 - RNA, 32 nt, Human
gucaugccacugcacucuagccugggugacag

SEQ ID NO: 474013 - RNA, 32 nt, Human
gucaugccacugcacugcagccugggcgacag

SEQ ID NO: 474014 - RNA, 32 nt, Human
gucaugccauuguacuccagccugggcaacaa

SEQ ID NO: 474015 - RNA, 32 nt, Human
gucaugcccagcuuggagugccacauggccgc

SEQ ID NO: 474016 - RNA, 32 nt, Human
gucaugcccagcuuggagugccacguggccgc

SEQ ID NO: 474017 - RNA, 32 nt, Human
gucaugccugcaaucccagcacuuugggaggc

SEQ ID NO: 474018 - RNA, 32 nt, Human
gucaugccuguaaucccagcauuuuggaaggc

SEQ ID NO: 474019 - RNA, 32 nt, Human
gucaugcgccugucaucccagcuacuugagag

SEQ ID NO: 474020 - RNA, 32 nt, Human
gucaugcgucacugcagccuccaccucccggg

SEQ ID NO: 474021 - RNA, 32 nt, Human
gucaugcgugccacgcucuccucuacgcgccg

SEQ ID NO: 474022 - RNA, 32 nt, Human
gucaugcucagcacgcuacagauguguuguuu

SEQ ID NO: 474023 - RNA, 32 nt, Human
gucaugcucagccugugccaccauugcucugu

SEQ ID NO: 474024 - RNA, 32 nt, Human
gucaugcugaagauaaguucuguuauaucaua

SEQ ID NO: 474025 - RNA, 18 nt, Human
gucauggaaaggugccaa

SEQ ID NO: 474026 - RNA, 32 nt, Human
gucauggaccuuacauccucacugcagucacc

SEQ ID NO: 474027 - RNA, 28 nt, Human
gucauggagacauccucaaaaggucugc

SEQ ID NO: 474028 - RNA, 28 nt, Human
gucauggagauggaaaaggaguucgagc

SEQ ID NO: 474029 - RNA, 32 nt, Human
gucauggauaugucuaucaaaaucucaauaaa

SEQ ID NO: 474030 - RNA, 32 nt, Human
gucauggaugccugugccaccccaggcaauaa

SEQ ID NO: 474031 - RNA, 32 nt, Human
gucauggcaaauucaggugauauauggguaug

SEQ ID NO: 474032 - RNA, 32 nt, Human
gucauggcagugaugaaaaccuaacagggugg

SEQ ID NO: 474033 - RNA, 32 nt, Human
gucauggcaugcgccuguagucucagcuaccu

SEQ ID NO: 474034 - RNA, 32 nt, Human
gucauggccacauagcccccagccaggagaga

SEQ ID NO: 474035 - RNA, 32 nt, Human
gucauggcccgggggaaacuugccaaccuucg

SEQ ID NO: 474036 - RNA, 28 nt, Human
gucauggcguacuccacagugcagagag

SEQ ID NO: 474037 - RNA, 32 nt, Human
gucauggcgugccaggguggugacaguugaac

SEQ ID NO: 474038 - RNA, 32 nt, Human
gucauggcucacugcagccucaaccugcuggg

SEQ ID NO: 474039 - RNA, 32 nt, Human
gucauggcucacugcagcuuaagcucacugcc

SEQ ID NO: 474040 - RNA, 32 nt, Human
gucauggcucugcuguugcuuccagaaccaaa

SEQ ID NO: 474041 - RNA, 28 nt, Human
gucaugggaacccgcaccuguuuucccg

SEQ ID NO: 474042 - RNA, 32 nt, Human
gucaugggaggcagagcugggggagcgaggcu

SEQ ID NO: 474043 - RNA, 19 nt, Human
gucaugggcguccagcuca

SEQ ID NO: 474044 - RNA, 32 nt, Human
gucauggggccagcccuagcugcuggagggac

SEQ ID NO: 474045 - RNA, 31 nt, Human
gucauggggcugucuccccugacaggcacaa

SEQ ID NO: 474046 - RNA, 20 nt, Human
gucauggguguccccaccca

SEQ ID NO: 474047 - RNA, 32 nt, Human
gucauggucaugauuauaaacaucagccccuu

SEQ ID NO: 474048 - RNA, 32 nt, Human
gucauggucucgucccauuccacaccauuugu

SEQ ID NO: 474049 - RNA, 32 nt, Human
gucauggugauaauuggaaacuccuuucaggu

SEQ ID NO: 474050 - RNA, 31 nt, Human
gucaugguuucuguuuggccuguguucauau

SEQ ID NO: 474051 - RNA, 32 nt, Human
gucauguaccgccugcuugcucaaaucaauca

SEQ ID NO: 474052 - RNA, 32 nt, Human
gucauguaccgccuguuugcucaaaucaauca

SEQ ID NO: 474053 - RNA, 32 nt, Human
gucauguaucugcagugccuggcacaucacug

SEQ ID NO: 474054 - RNA, 32 nt, Human
gucaugucaaggggguagcagauuccauucgu

SEQ ID NO: 474055 - RNA, 28 nt, Human
gucauguccacucaagacgagaggcaga

SEQ ID NO: 474056 - RNA, 32 nt, Human
gucauguccuucaggaucucugcccucaaaau

SEQ ID NO: 474057 - RNA, 32 nt, Human
gucaugucuguaaucccagcaauuuggaggcu

SEQ ID NO: 474058 - RNA, 32 nt, Human
gucaugugacagaaacuuuuccuuuguccauc

SEQ ID NO: 474059 - RNA, 32 nt, Human
gucaugugaccacacccuccucccucugcccc

SEQ ID NO: 474060 - RNA, 32 nt, Human
gucaugugacgaggaagaggugaucugaccca

SEQ ID NO: 474061 - RNA, 32 nt, Human
gucaugugagacaaccuuuuauugggacauca

SEQ ID NO: 474062 - RNA, 32 nt, Human
gucaugugaggacgugcuuccugcuucauaga

SEQ ID NO: 474063 - RNA, 32 nt, Human
gucaugugagugggugggauggggacauuuga

SEQ ID NO: 474064 - RNA, 32 nt, Human
gucaugugccacagaagcucagccugggcuuc

SEQ ID NO: 474065 - RNA, 32 nt, Human
gucaugugcugaguuaaaacucagggauucug

SEQ ID NO: 474066 - RNA, 32 nt, Human
gucaugugggugacucuucuucauuugaccaa

SEQ ID NO: 474067 - RNA, 32 nt, Human
gucaugugguucacccuucaccccagauacaa

SEQ ID NO: 474068 - RNA, 26 nt, Human
gucauguucaguugcauuccuuggug

SEQ ID NO: 474069 - RNA, 32 nt, Human
gucauguuccucuccauugucaggcaccccug

SEQ ID NO: 474070 - RNA, 24 nt, Human
gucauguugcccaggcuggucuca

SEQ ID NO: 474071 - RNA, 32 nt, Human
gucauguugcccaggcuggucucaggagucac

SEQ ID NO: 474072 - RNA, 32 nt, Human
gucauguuuacaguccucagugccccacaccg

SEQ ID NO: 474073 - RNA, 32 nt, Human
gucauguuucaaaucaaggcugaaauuuucaa

SEQ ID NO: 474074 - RNA, 32 nt, Human
gucauuaaauacuauuugucuccuuuucuggu

SEQ ID NO: 474075 - RNA, 32 nt, Human
gucauuacacaauuucaucauugugcuaucau

SEQ ID NO: 474076 - RNA, 32 nt, Human
gucauuaccuuuccuguccuccuguuauauga

SEQ ID NO: 474077 - RNA, 32 nt, Human
gucauuacugauuuuaaagguucuguuuucag

SEQ ID NO: 474078 - RNA, 32 nt, Human
gucauuacuguccuuuuccccuacagaauuuu

SEQ ID NO: 474079 - RNA, 32 nt, Human
gucauuagaaaggacauuucugccauuguuca

SEQ ID NO: 474080 - RNA, 32 nt, Human
gucauuaggagagagauuuaagaccgaaggag

SEQ ID NO: 474081 - RNA, 32 nt, Human
gucauuagggcugagggcucggcuguaggggc

SEQ ID NO: 474082 - RNA, 32 nt, Human
gucauuaucaguugaaccuccaugccacacau

SEQ ID NO: 474083 - RNA, 32 nt, Human
gucauucaagggacagcacaaccucauccaag

SEQ ID NO: 474084 - RNA, 32 nt, Human
gucauucagccugggagaccacggugacauuc

SEQ ID NO: 474085 - RNA, 32 nt, Human
gucauucagcggcuggccagaggaugagacuc

SEQ ID NO: 474086 - RNA, 32 nt, Human
gucauucaggacaacauggauggaauuggagg

SEQ ID NO: 474087 - RNA, 22 nt, Human
gucauucaggcaagagugcagu

SEQ ID NO: 474088 - RNA, 24 nt, Human
gucauucaggcuggagugcagugg

SEQ ID NO: 474089 - RNA, 32 nt, Human
gucauucauauguauauguuguugugcuuguc

SEQ ID NO: 474090 - RNA, 32 nt, Human
gucauucaugcugcuguccccuggugaaguga

SEQ ID NO: 474091 - RNA, 32 nt, Human
gucauuccagcaucccugccucuugucacaaa

SEQ ID NO: 474092 - RNA, 32 nt, Human
gucauuccaggagacaaaaagaaacaaauccu

SEQ ID NO: 474093 - RNA, 32 nt, Human
gucauuccaucuuuuggaaggcagucuuucua

SEQ ID NO: 474094 - RNA, 32 nt, Human
gucauuccauggcugcuguuuucuccucugua

SEQ ID NO: 474095 - RNA, 32 nt, Human
gucauucccagaggaaauguucucuucacggu

SEQ ID NO: 474096 - RNA, 32 nt, Human
gucauucccaucuuguuuucagaagagaaggu

SEQ ID NO: 474097 - RNA, 32 nt, Human
gucauuccuaaccuaaccuuagagucccuccc

SEQ ID NO: 474098 - RNA, 32 nt, Human
gucauuccucaauuacugccugcagcaauucc

SEQ ID NO: 474099 - RNA, 32 nt, Human
gucauucgcucauguaagaguuuuuaagagag

SEQ ID NO: 474100 - RNA, 23 nt, Human
gucauucgggcugggcgcagcgg

SEQ ID NO: 474101 - RNA, 32 nt, Human
gucauucuacaaccugcacagagcuccggagc

SEQ ID NO: 474102 - RNA, 32 nt, Human
gucauucuagcaccugugggugacuuccucau

SEQ ID NO: 474103 - RNA, 32 nt, Human
gucauucucauugaauuauaaaagccagcagg

SEQ ID NO: 474104 - RNA, 25 nt, Human
gucauucuccaucucuuuguuuuag

SEQ ID NO: 474105 - RNA, 32 nt, Human
gucauucuccugccucagccucuugcgagcug

SEQ ID NO: 474106 - RNA, 32 nt, Human
gucauucucugccugcauccagccccuugccc

SEQ ID NO: 474107 - RNA, 32 nt, Human
gucauucugaaacugucccuccagagguucuu

SEQ ID NO: 474108 - RNA, 32 nt, Human
gucauucugacuccugggcuuacccuacaccc

SEQ ID NO: 474109 - RNA, 32 nt, Human
gucauucugccuggcggccaggccuccagcuu

SEQ ID NO: 474110 - RNA, 32 nt, Human
gucauucugggaacauguuguaagcacugacu

SEQ ID NO: 474111 - RNA, 32 nt, Human
gucauucugggaggccuuggggcccucagccc

SEQ ID NO: 474112 - RNA, 32 nt, Human
gucauucugucuguccggaucuucugaaggcc

SEQ ID NO: 474113 - RNA, 32 nt, Human
gucauucuuaguaaccugcucuguccuuaguc

SEQ ID NO: 474114 - RNA, 32 nt, Human
gucauucuucaaucagauaguggaaauagaac

SEQ ID NO: 474115 - RNA, 32 nt, Human
gucauucuucucuuacagaggggcaguagagu

SEQ ID NO: 474116 - RNA, 32 nt, Human
gucauucuuuggaagucucccuucccaucucc

SEQ ID NO: 474117 - RNA, 32 nt, Human
gucauugaaggguguucacccaucccacccaa

SEQ ID NO: 474118 - RNA, 32 nt, Human
gucauugaagugaggaagagugaguugggccu

SEQ ID NO: 474119 - RNA, 32 nt, Human
gucauugaagugcuagaagugaaggaaaaagg

SEQ ID NO: 474120 - RNA, 32 nt, Human
gucauugauacuugccaacuaccaccuaccuc

SEQ ID NO: 474121 - RNA, 32 nt, Human
gucauugauuugugcugggacugcuauacuug

SEQ ID NO: 474122 - RNA, 32 nt, Human
gucauugcgccacugcaaaccagccugggcaa

SEQ ID NO: 474123 - RNA, 32 nt, Human
gucauuggcucugggaagcggcagcagaggca

SEQ ID NO: 474124 - RNA, 32 nt, Human
gucauuggugcugaaguugaggaacccugccc

SEQ ID NO: 474125 - RNA, 32 nt, Human
gucauugguggaggucugaaugugaggcuggg

SEQ ID NO: 474126 - RNA, 32 nt, Human
gucauuguagccucaaccucccaggcuccaag

SEQ ID NO: 474127 - RNA, 32 nt, Human
gucauuguauuuuuaacaccagaaagaaccuu

SEQ ID NO: 474128 - RNA, 32 nt, Human
gucauugucaaaggaaaucuguggcccugaga

SEQ ID NO: 474129 - RNA, 32 nt, Human
gucauugugguuuauuggaaccuauuuucacc

SEQ ID NO: 474130 - RNA, 32 nt, Human
gucauuguuacccauagacuguaaaccagagc

SEQ ID NO: 474131 - RNA, 32 nt, Human
gucauuguucauucagccuccuuuguacccca

SEQ ID NO: 474132 - RNA, 32 nt, Human
gucauuuacucugcugcaaccucucuuucucc

SEQ ID NO: 474133 - RNA, 32 nt, Human
gucauuuaucucugugacuucgggcuagaugu

SEQ ID NO: 474134 - RNA, 32 nt, Human
gucauuucaaaccauuguggucuucaagcaac

SEQ ID NO: 474135 - RNA, 32 nt, Human
gucauuucagcccuaacuucuguguggaucac

SEQ ID NO: 474136 - RNA, 32 nt, Human
gucauuucaguauuuuugcuggauaaauccau

SEQ ID NO: 474137 - RNA, 32 nt, Human
gucauuucguacaccacagcucagucagccca

SEQ ID NO: 474138 - RNA, 32 nt, Human
gucauuucuaacucuuaaaaccaacucaguuc

SEQ ID NO: 474139 - RNA, 21 nt, Human
gucauuucucaaccugaggug

SEQ ID NO: 474140 - RNA, 32 nt, Human
gucauuucucagaacugaccguagucacugua

SEQ ID NO: 474141 - RNA, 32 nt, Human
gucauuucugacaacaugaaugaaccuggagg

SEQ ID NO: 474142 - RNA, 32 nt, Human
gucauuucuggucugugcaccaaaggaugcau

SEQ ID NO: 474143 - RNA, 32 nt, Human
gucauuucuuuaggucuugccuucccaaguag

SEQ ID NO: 474144 - RNA, 32 nt, Human
gucauuugaccacguccauuguuuccaucuuu

SEQ ID NO: 474145 - RNA, 32 nt, Human
gucauuugcuauuccccucugauauucaaccc

SEQ ID NO: 474146 - RNA, 32 nt, Human
gucauuuggacacuuggggaaaagugaggcca

SEQ ID NO: 474147 - RNA, 32 nt, Human
gucauuuguaagacaucucaugucauauaaaa

SEQ ID NO: 474148 - RNA, 32 nt, Human
gucauuugugaucccuggcucuugugauaugc

SEQ ID NO: 474149 - RNA, 32 nt, Human
gucauuuucaaaggggcaacagugauaccauc

SEQ ID NO: 474150 - RNA, 32 nt, Human
gucauuuuccugaaguccugguacauaacaag

SEQ ID NO: 474151 - RNA, 18 nt, Human
guccaaaaauaaagacca

SEQ ID NO: 474152 - RNA, 17 nt, Human
guccaaaaauauuucca

SEQ ID NO: 474153 - RNA, 32 nt, Human
guccaaaacauuccuuucagccuuuuuauuuc

SEQ ID NO: 474154 - RNA, 32 nt, Human
guccaaaacucagaagguacagaagggaagua

SEQ ID NO: 474155 - RNA, 32 nt, Human
guccaaaacuccugccucucggccgcuucagc

SEQ ID NO: 474156 - RNA, 32 nt, Human
guccaaaacuccugccuuuuggcagcuucgac

SEQ ID NO: 474157 - RNA, 24 nt, Human
guccaaaagccauuccagaugcca

SEQ ID NO: 474158 - RNA, 32 nt, Human
guccaaaagccucuucccucccuuuccuuuuc

SEQ ID NO: 474159 - RNA, 32 nt, Human
guccaaacacuccucuuccuccaggucauuug

SEQ ID NO: 474160 - RNA, 32 nt, Human
guccaaacccaaaagaaacugacaugcccucc

SEQ ID NO: 474161 - RNA, 32 nt, Human
guccaaaccccaggaagagagcucuaaagaug

SEQ ID NO: 474162 - RNA, 32 nt, Human
guccaaacccuugugccucccaguucuuccaa

SEQ ID NO: 474163 - RNA, 32 nt, Human
guccaaacugcuugccaccucuacucgccacc

SEQ ID NO: 474164 - RNA, 32 nt, Human
guccaaagaguccucagaaccugccuggagaa

SEQ ID NO: 474165 - RNA, 32 nt, Human
guccaaagccagccugggcaacauggugaaac

SEQ ID NO: 474166 - RNA, 32 nt, Human
guccaaagcgagcaagagaaucccaggacaga

SEQ ID NO: 474167 - RNA, 32 nt, Human
guccaaagcuccugccuuucggccacuucagc

SEQ ID NO: 474168 - RNA, 32 nt, Human
guccaaagcuccugccuuucggccacuucggc

SEQ ID NO: 474169 - RNA, 32 nt, Human
guccaaaggacagugugucacugugaacugga

SEQ ID NO: 474170 - RNA, 32 nt, Human
guccaaagucccaggcccagugcaguccuugc

SEQ ID NO: 474171 - RNA, 32 nt, Human
guccaaauaccggcucgacuccuggguacgcu

SEQ ID NO: 474172 - RNA, 22 nt, Human
guccaaauuugaacuccuuccu

SEQ ID NO: 474173 - RNA, 32 nt, Human
guccaacaagccccacagccccucaaagacuu

SEQ ID NO: 474174 - RNA, 32 nt, Human
guccaacacaucucccuuuuccaugcuguggu

SEQ ID NO: 474175 - RNA, 22 nt, Human
guccaacagacaccaccuguca

SEQ ID NO: 474176 - RNA, 32 nt, Human
guccaacagggccagcuucccuugggggcccu

SEQ ID NO: 474177 - RNA, 32 nt, Human
guccaacauggugaaacccccaucucuacuaa

SEQ ID NO: 474178 - RNA, 20 nt, Human
guccaacauucccagcuccc

SEQ ID NO: 474179 - RNA, 17 nt, Human
guccaaccacaaaagaa

SEQ ID NO: 474180 - RNA, 32 nt, Human
guccaaccucagcuucccagccagcagcucag

SEQ ID NO: 474181 - RNA, 32 nt, Human
guccaaccucuggugcugaaucagccaagaga

SEQ ID NO: 474182 - RNA, 32 nt, Human
guccaaccugcacucgcguaggacaagaagac

SEQ ID NO: 474183 - RNA, 32 nt, Human
guccaacgucaacuuccuauccuugccugaca

SEQ ID NO: 474184 - RNA, 32 nt, Human
guccaacgucaacuuccuguccuugccugaca

SEQ ID NO: 474185 - RNA, 32 nt, Human
guccaacguggugaaaccccgucuguacuaaa

SEQ ID NO: 474186 - RNA, 32 nt, Human
guccaacucuuuucaucccucuccugggucug

SEQ ID NO: 474187 - RNA, 32 nt, Human
guccaacuucguuguccuuuguucuguaaccu

SEQ ID NO: 474188 - RNA, 32 nt, Human
guccaacuuuggcccaggcuuguccaugcacu

SEQ ID NO: 474189 - RNA, 18 nt, Human
guccaagaacaaaugcca

SEQ ID NO: 474190 - RNA, 32 nt, Human
guccaagaccagccuggccaacauggugaaac

SEQ ID NO: 474191 - RNA, 32 nt, Human
guccaagaccagccuggccaacauggugaaau

SEQ ID NO: 474192 - RNA, 24 nt, Human
guccaagaccuuuuguugauuuca

SEQ ID NO: 474193 - RNA, 32 nt, Human
guccaagaguaaaccccaccugccacagggcc

SEQ ID NO: 474194 - RNA, 32 nt, Human
guccaagaugugcuugaaaauacucauuaggu

SEQ ID NO: 474195 - RNA, 32 nt, Human
guccaagcaaaauggagcuggggaagauaacc

SEQ ID NO: 474196 - RNA, 32 nt, Human
guccaagcacaucugggcggggaggccgugga

SEQ ID NO: 474197 - RNA, 32 nt, Human
guccaagcacaucuugucaacaugcauugcca

SEQ ID NO: 474198 - RNA, 19 nt, Human
guccaagccaucuccuuca

SEQ ID NO: 474199 - RNA, 32 nt, Human
guccaagcccaucagccccaaacuccugucuc

SEQ ID NO: 474200 - RNA, 18 nt, Human
guccaagccgugcugcug

SEQ ID NO: 474201 - RNA, 32 nt, Human
guccaagcucaaagcuggagugcaauggcgca

SEQ ID NO: 474202 - RNA, 32 nt, Human
guccaagcuggucucaaacuccuggguucaag

SEQ ID NO: 474203 - RNA, 32 nt, Human
guccaaggaagagaggguggccucgacaucaa

SEQ ID NO: 474204 - RNA, 32 nt, Human
guccaaggaggaacuguacugcccccguguca

SEQ ID NO: 474205 - RNA, 32 nt, Human
guccaaggcaauggucagccacugcagccucc

SEQ ID NO: 474206 - RNA, 21 nt, Human
guccaaggccgggcgcagugg

SEQ ID NO: 474207 - RNA, 32 nt, Human
guccaaggccuccccuuccccuuugcuggugg

SEQ ID NO: 474208 - RNA, 32 nt, Human
guccaaggcuggccacuuuucucuccaaggug

SEQ ID NO: 474209 - RNA, 32 nt, Human
guccaagggagaagccccagacccccuucucu

SEQ ID NO: 474210 - RNA, 20 nt, Human
guccaaggggcagauggcca

SEQ ID NO: 474211 - RNA, 32 nt, Human
guccaagggucuauguggugggcaguuugagc

SEQ ID NO: 474212 - RNA, 32 nt, Human
guccaagguaauggcacacauauucaugcaca

SEQ ID NO: 474213 - RNA, 32 nt, Human
guccaagguagaccagagcaaauggaacagga

SEQ ID NO: 474214 - RNA, 32 nt, Human
guccaagguggcuucccacugaagggacacag

SEQ ID NO: 474215 - RNA, 21 nt, Human
guccaaggugggcugaugcca

SEQ ID NO: 474216 - RNA, 32 nt, Human
guccaagucgcgaucaaggacucucucacaca

SEQ ID NO: 474217 - RNA, 32 nt, Human
guccaaguucaccgucaccaucaagccacugg

SEQ ID NO: 474218 - RNA, 32 nt, Human
guccaauagcuggugggaaucaaaacaaggaa

SEQ ID NO: 474219 - RNA, 32 nt, Human
guccaaucacagucuucuagcacaauuuuucc

SEQ ID NO: 474220 - RNA, 32 nt, Human
guccaauggcugguugugugagagggcuuggc

SEQ ID NO: 474221 - RNA, 32 nt, Human
guccaaugucaacuuccuguccuugccugaca

SEQ ID NO: 474222 - RNA, 32 nt, Human
guccaauucccugagcuuugcucacucagcua

SEQ ID NO: 474223 - RNA, 32 nt, Human
guccaauuuacaggcuggagcagcagcugcau

SEQ ID NO: 474224 - RNA, 32 nt, Human
guccacaaagugcugggauuacaggugugagc

SEQ ID NO: 474225 - RNA, 21 nt, Human
guccacaaauacaagaugcca

SEQ ID NO: 474226 - RNA, 32 nt, Human
guccacaaauuccaucagccugccucagcaga

SEQ ID NO: 474227 - RNA, 18 nt, Human
guccacaaccaagaggaa

SEQ ID NO: 474228 - RNA, 22 nt, Human
guccacaagcccucagaugcca

SEQ ID NO: 474229 - RNA, 32 nt, Human
guccacacacccuucaggaagggggagcacug

SEQ ID NO: 474230 - RNA, 32 nt, Human
guccacaccagccugggcaacacagcaagaca

SEQ ID NO: 474231 - RNA, 32 nt, Human
guccacacccgccucagaguccggagucuguc

SEQ ID NO: 474232 - RNA, 19 nt, Human
guccacacccuggaucccc

SEQ ID NO: 474233 - RNA, 32 nt, Human
guccacacucguaaccguuacacucaccugga

SEQ ID NO: 474234 - RNA, 22 nt, Human
guccacacucgucuccucucug

SEQ ID NO: 474235 - RNA, 32 nt, Human
guccacagaagccacaggggcagggggagcag

SEQ ID NO: 474236 - RNA, 32 nt, Human
guccacagagccugggcugggcccgguggagg

SEQ ID NO: 474237 - RNA, 32 nt, Human
guccacagagcuaugaccuuggcaucauccca

SEQ ID NO: 474238 - RNA, 32 nt, Human
guccacagaguauaaauaaccaauuccucauu

SEQ ID NO: 474239 - RNA, 32 nt, Human
guccacagaguccaagacugggugcucuugca

SEQ ID NO: 474240 - RNA, 32 nt, Human
guccacagaguccuggagcgucucccucucag

SEQ ID NO: 474241 - RNA, 22 nt, Human
guccacagauuauuagauggca

SEQ ID NO: 474242 - RNA, 32 nt, Human
guccacagcacuccauucuggguggcagagug

SEQ ID NO: 474243 - RNA, 32 nt, Human
guccacagccuccuggugcugaaaaccuacgu

SEQ ID NO: 474244 - RNA, 32 nt, Human
guccacagcuccugccuuucggccacuucggc

SEQ ID NO: 474245 - RNA, 32 nt, Human
guccacaggcacaacuguuccuuggggccccu

SEQ ID NO: 474246 - RNA, 32 nt, Human
guccacaggcuccccaucuucuccuuacugca

SEQ ID NO: 474247 - RNA, 32 nt, Human
guccacagggcagcagcaccugcuugagacca

SEQ ID NO: 474248 - RNA, 32 nt, Human
guccacaguucagcauccggaaacccaggucc

SEQ ID NO: 474249 - RNA, 32 nt, Human
guccacauaauuguuguacaaaccagagcuuu

SEQ ID NO: 474250 - RNA, 32 nt, Human
guccacaucaagauagcugggcccagugugga

SEQ ID NO: 474251 - RNA, 32 nt, Human
guccacaucugccuccucuccuccucagcugc

SEQ ID NO: 474252 - RNA, 32 nt, Human
guccacaugaggacagggaagcucgggaaggg

SEQ ID NO: 474253 - RNA, 32 nt, Human
guccacauugccuguuucuuguguacaugggg

SEQ ID NO: 474254 - RNA, 24 nt, Human
guccacauuuggggccuauccuua

SEQ ID NO: 474255 - RNA, 24 nt, Human
guccacauuuucugccccaccuua

SEQ ID NO: 474256 - RNA, 32 nt, Human
guccaccaccagccagaagagcagggauggug

SEQ ID NO: 474257 - RNA, 32 nt, Human
guccaccacuuggcuagaguucagagacagga

SEQ ID NO: 474258 - RNA, 32 nt, Human
guccaccagcgucuuggcuuggugggagggcu

SEQ ID NO: 474259 - RNA, 32 nt, Human
guccaccagcuauucuccuggcgccggaacug

SEQ ID NO: 474260 - RNA, 32 nt, Human
guccaccaggagaccgagauugcugaugagug

SEQ ID NO: 474261 - RNA, 32 nt, Human
guccaccagggagggagacacacaagccuuuu

SEQ ID NO: 474262 - RNA, 32 nt, Human
guccaccaugaucuucaucacagucuuugaua

SEQ ID NO: 474263 - RNA, 32 nt, Human
guccaccaugccacccaugcuguggcugcugc

SEQ ID NO: 474264 - RNA, 32 nt, Human
guccaccauguuuacaggugggagacuugaga

SEQ ID NO: 474265 - RNA, 20 nt, Human
guccacccaccuuggccuca

SEQ ID NO: 474266 - RNA, 32 nt, Human
guccaccccguccuucauguucuaucacugcu

SEQ ID NO: 474267 - RNA, 32 nt, Human
guccaccccugaacuccugagcgacagaagcc

SEQ ID NO: 474268 - RNA, 32 nt, Human
guccaccccugccuccccuucacuggggacug

SEQ ID NO: 474269 - RNA, 32 nt, Human
guccaccccugccugccuuguuugauuuggcu

SEQ ID NO: 474270 - RNA, 32 nt, Human
guccaccccuucucucugggcuuguugagaag

SEQ ID NO: 474271 - RNA, 32 nt, Human
guccacccugcagccgcugccuccugggcccc

SEQ ID NO: 474272 - RNA, 20 nt, Human
guccacccugccccagggug

SEQ ID NO: 474273 - RNA, 32 nt, Human
guccacccuucccagcucagcucaguaccuca

SEQ ID NO: 474274 - RNA, 32 nt, Human
guccaccgagacucuggacuugcucagguccc

SEQ ID NO: 474275 - RNA, 32 nt, Human
guccaccgugggaggcagaggccugggcugca

SEQ ID NO: 474276 - RNA, 32 nt, Human
guccaccuccacuccccucugacccucaggcu

SEQ ID NO: 474277 - RNA, 32 nt, Human
guccaccucuacugggcccucaugcuugccuu

SEQ ID NO: 474278 - RNA, 32 nt, Human
guccaccugacgcaaaugcccaguccuuccag

SEQ ID NO: 474279 - RNA, 19 nt, Human
guccaccugcguggccuug

SEQ ID NO: 474280 - RNA, 32 nt, Human
guccaccugggcaaaguggccagguggaugaa

SEQ ID NO: 474281 - RNA, 32 nt, Human
guccaccugggcucagcucacacccaagacau

SEQ ID NO: 474282 - RNA, 32 nt, Human
guccaccuggugcuggggcuguggugcuaggg

SEQ ID NO: 474283 - RNA, 32 nt, Human
guccaccuucuccaagucuggcagcuauuuug

SEQ ID NO: 474284 - RNA, 32 nt, Human
guccaccuuuguccagugcuagauucaccuca

SEQ ID NO: 474285 - RNA, 32 nt, Human
guccacgaacugcccacguccucuccaggaag

SEQ ID NO: 474286 - RNA, 32 nt, Human
guccacgaggcagggauucucaucucuggugc

SEQ ID NO: 474287 - RNA, 32 nt, Human
guccacgcagccgccggccggccagcacccag

SEQ ID NO: 474288 - RNA, 22 nt, Human
guccacgcaucucagcacuucc

SEQ ID NO: 474289 - RNA, 32 nt, Human
guccacgccccgaggccugggcucaggccgaa

SEQ ID NO: 474290 - RNA, 21 nt, Human
guccacgcgccggaacucgga

SEQ ID NO: 474291 - RNA, 32 nt, Human
guccacggaagccucggggagguggagcugcu

SEQ ID NO: 474292 - RNA, 16 nt, Human
guccacggccugaggc

SEQ ID NO: 474293 - RNA, 32 nt, Human
guccacguccuaaagacaccucuccuuuacaa

SEQ ID NO: 474294 - RNA, 23 nt, Human
guccacgugacaguccccacagc

SEQ ID NO: 474295 - RNA, 32 nt, Human
guccacgugcgccuugcggucucuccauuuau

SEQ ID NO: 474296 - RNA, 32 nt, Human
guccacguucacugccccaccacaggcccagc

SEQ ID NO: 474297 - RNA, 32 nt, Human
guccacuccagccugagcaacagagcgagacc

SEQ ID NO: 474298 - RNA, 32 nt, Human
guccacucggggguggagugagacugacugca

SEQ ID NO: 474299 - RNA, 32 nt, Human
guccacugcaaccuccacauccuggguucaag

SEQ ID NO: 474300 - RNA, 32 nt, Human
guccacugcaaccucugcccucccggguuuaa

SEQ ID NO: 474301 - RNA, 32 nt, Human
guccacugcagucgcuuaagacaguguaacga

SEQ ID NO: 474302 - RNA, 22 nt, Human
guccacugcccuguguggccuu

SEQ ID NO: 474303 - RNA, 32 nt, Human
guccacugggagaggcagcuugguggaggccu

SEQ ID NO: 474304 - RNA, 32 nt, Human
guccacugggaggcugggaaaacgugacuccc

SEQ ID NO: 474305 - RNA, 32 nt, Human
guccacuggggcaacagacacugccacaauuu

SEQ ID NO: 474306 - RNA, 32 nt, Human
guccacugguucuucuuggucucagugucaau

SEQ ID NO: 474307 - RNA, 27 nt, Human
guccacugugggaggccgacgcaggag

SEQ ID NO: 474308 - RNA, 32 nt, Human
guccacugugggccuagcacagugcaggaacc

SEQ ID NO: 474309 - RNA, 32 nt, Human
guccacuuccuuggccgcccuugcuacacugg

SEQ ID NO: 474310 - RNA, 32 nt, Human
guccacuucucagcgaggauggcacuucaggg

SEQ ID NO: 474311 - RNA, 32 nt, Human
guccacuucuccccucacuuuccccucaccca

SEQ ID NO: 474312 - RNA, 32 nt, Human
guccacuucugccucugccacuacugcugcca

SEQ ID NO: 474313 - RNA, 32 nt, Human
guccacuuucucaaacacaaaccucacuaugc

SEQ ID NO: 474314 - RNA, 32 nt, Human
guccagaaacgaaccccagcuggcuggccucu

SEQ ID NO: 474315 - RNA, 32 nt, Human
guccagaaaguggcaguugcagugaguggaga

SEQ ID NO: 474316 - RNA, 21 nt, Human
guccagaaaugggaaagggaa

SEQ ID NO: 474317 - RNA, 32 nt, Human
guccagaacuagugggaguggaggcaggcccu

SEQ ID NO: 474318 - RNA, 32 nt, Human
guccagaagaauaccuggcaguagaagaaaug

SEQ ID NO: 474319 - RNA, 32 nt, Human
guccagaagacucuccucugacuguuaccuuu

SEQ ID NO: 474320 - RNA, 20 nt, Human
guccagaagauaguaggauc

SEQ ID NO: 474321 - RNA, 32 nt, Human
guccagaaggagacaggcagagcugcuccccu

SEQ ID NO: 474322 - RNA, 22 nt, Human
guccagaaggcaguagggaucc

SEQ ID NO: 474323 - RNA, 32 nt, Human
guccagaagugaggaggaagagaagcuggugc

SEQ ID NO: 474324 - RNA, 32 nt, Human
guccagaaucccaaaccagcugagaugaaaug

SEQ ID NO: 474325 - RNA, 32 nt, Human
guccagaaucuacagaccugccaggaaagaaa

SEQ ID NO: 474326 - RNA, 17 nt, Human
guccagacaggaagcag

SEQ ID NO: 474327 - RNA, 32 nt, Human
guccagaccagccugggcaacacagcgggacc

SEQ ID NO: 474328 - RNA, 32 nt, Human
guccagacuggucucaaacuccugggcucaag

SEQ ID NO: 474329 - RNA, 32 nt, Human
guccagacuggucuuaaacuccugggcucaag

SEQ ID NO: 474330 - RNA, 32 nt, Human
guccagagagaagggagugggugggcaggggu

SEQ ID NO: 474331 - RNA, 32 nt, Human
guccagagagccaagcacggcagaggacugca

SEQ ID NO: 474332 - RNA, 32 nt, Human
guccagagaggcaggaggauggagcucggaag

SEQ ID NO: 474333 - RNA, 32 nt, Human
guccagagaucuauucauauagucugaggaag

SEQ ID NO: 474334 - RNA, 32 nt, Human
guccagagcagcagagauuugcagcccucgcc

SEQ ID NO: 474335 - RNA, 32 nt, Human
guccagagccacugccuuugcuccagccgcug

SEQ ID NO: 474336 - RNA, 32 nt, Human
guccagaggaaggaggccagcaggaccuggug

SEQ ID NO: 474337 - RNA, 32 nt, Human
guccagaggaagggggaguaucugugggcaac

SEQ ID NO: 474338 - RNA, 32 nt, Human
guccagaggaaggucuuuuuaccaucagcauu

SEQ ID NO: 474339 - RNA, 32 nt, Human
guccagagggacagucaguuuuaggguugccu

SEQ ID NO: 474340 - RNA, 32 nt, Human
guccagagggcucccugcaggccagggguccc

SEQ ID NO: 474341 - RNA, 32 nt, Human
guccagaucugccuccagccccucgaaaccag

SEQ ID NO: 474342 - RNA, 19 nt, Human
guccagauguccccaucca

SEQ ID NO: 474343 - RNA, 32 nt, Human
guccagauucaccacccucaaccuucuguggg

SEQ ID NO: 474344 - RNA, 32 nt, Human
guccagauuucucaucaacuggcaauacaaag

SEQ ID NO: 474345 - RNA, 32 nt, Human
guccagcaaccugcacuccagccugggugaca

SEQ ID NO: 474346 - RNA, 32 nt, Human
guccagcaccuacagaccuagagccagggcug

SEQ ID NO: 474347 - RNA, 32 nt, Human
guccagcaccugcuguuagcccagugguuccu

SEQ ID NO: 474348 - RNA, 32 nt, Human
guccagcacuagcuccacggccccagacaccu

SEQ ID NO: 474349 - RNA, 32 nt, Human
guccagcagaagcagaugcaccugacaaaaau

SEQ ID NO: 474350 - RNA, 32 nt, Human
guccagcagagggaguggaggaagggccacug

SEQ ID NO: 474351 - RNA, 32 nt, Human
guccagcagcagaggggacagggggcaggugu

SEQ ID NO: 474352 - RNA, 32 nt, Human
guccagcagcagggguggaggcuggggccaca

SEQ ID NO: 474353 - RNA, 32 nt, Human
guccagcagggugggaaggagggaguuugggc

SEQ ID NO: 474354 - RNA, 32 nt, Human
guccagcauggguuucagcacagcagacggcg

SEQ ID NO: 474355 - RNA, 32 nt, Human
guccagcauguauuguuccaaauaugacuccc

SEQ ID NO: 474356 - RNA, 32 nt, Human
guccagccaagaccauucaucucuccagcacu

SEQ ID NO: 474357 - RNA, 32 nt, Human
guccagccacagccccagcccaggcagcccac

SEQ ID NO: 474358 - RNA, 21 nt, Human
guccagccaccaucacccgga

SEQ ID NO: 474359 - RNA, 22 nt, Human
guccagccacccccacggaggg

SEQ ID NO: 474360 - RNA, 32 nt, Human
guccagccagaagccaggucucaggcuagaau

SEQ ID NO: 474361 - RNA, 32 nt, Human
guccagccagauguuccacagaccuccggagc

SEQ ID NO: 474362 - RNA, 28 nt, Human
guccagccaggggcugccuccauguccu

SEQ ID NO: 474363 - RNA, 32 nt, Human
guccagccaguaaauacacagaauagcagaag

SEQ ID NO: 474364 - RNA, 32 nt, Human
guccagcccagccauggugcaugacucuucca

SEQ ID NO: 474365 - RNA, 32 nt, Human
guccagcccagccuugugccugcaguggaggu

SEQ ID NO: 474366 - RNA, 32 nt, Human
guccagccccaccuccagcccaucagaaacau

SEQ ID NO: 474367 - RNA, 32 nt, Human
guccagccccaggcacaucuugcuccagacuc

SEQ ID NO: 474368 - RNA, 32 nt, Human
guccagccccuccagacaccaccacucagaaa

SEQ ID NO: 474369 - RNA, 32 nt, Human
guccagcccuagcgucgacuccacacuagagg

SEQ ID NO: 474370 - RNA, 32 nt, Human
guccagcccugccucucugcggauucccugcc

SEQ ID NO: 474371 - RNA, 32 nt, Human
guccagcccuggagccagccagugcauuuauu

SEQ ID NO: 474372 - RNA, 32 nt, Human
guccagccuagucucaaacuccuggguucaag

SEQ ID NO: 474373 - RNA, 32 nt, Human
guccagccucacucucccucccuggugcugua

SEQ ID NO: 474374 - RNA, 17 nt, Human
guccagccucucucuga

SEQ ID NO: 474375 - RNA, 32 nt, Human
guccagccucugccgagagccugcugcgugca

SEQ ID NO: 474376 - RNA, 32 nt, Human
guccagccuguucacacugcaccucagguauc

SEQ ID NO: 474377 - RNA, 32 nt, Human
guccagcgcgaaccacacgucguccacgggca

SEQ ID NO: 474378 - RNA, 32 nt, Human
guccagcgugugaacccaggggagaccuugcu

SEQ ID NO: 474379 - RNA, 32 nt, Human
guccagcuaccugacucuuuugcaauaacaac

SEQ ID NO: 474380 - RNA, 32 nt, Human
guccagcuacuuccagaaacacucaguguccc

SEQ ID NO: 474381 - RNA, 32 nt, Human
guccagcuccgagaacugggguccgccagccg

SEQ ID NO: 474382 - RNA, 32 nt, Human
guccagcuccgucggcacuaccacccugcucc

SEQ ID NO: 474383 - RNA, 32 nt, Human
guccagcucguuuccagcaccaugucggugcg

SEQ ID NO: 474384 - RNA, 32 nt, Human
guccagcucuaugacccugacuauaugaaggu

SEQ ID NO: 474385 - RNA, 23 nt, Human
guccagcucucucucccccaccc

SEQ ID NO: 474386 - RNA, 18 nt, Human
guccagcucuggagcccc

SEQ ID NO: 474387 - RNA, 32 nt, Human
guccagcugcaacccagagauaguggaaacug

SEQ ID NO: 474388 - RNA, 32 nt, Human
guccagcugcacucuccucuccugggacccag

SEQ ID NO: 474389 - RNA, 32 nt, Human
guccagcugccccugccgucucccaggcccuc

SEQ ID NO: 474390 - RNA, 32 nt, Human
guccagcugcugccucccaacccaugcccgcu

SEQ ID NO: 474391 - RNA, 32 nt, Human
guccagcuggaacggcagcccaguccagccuu

SEQ ID NO: 474392 - RNA, 32 nt, Human
guccagcugggccuccugccuccgggcaggca

SEQ ID NO: 474393 - RNA, 32 nt, Human
guccagcugggggaugccugccuggauaucga

SEQ ID NO: 474394 - RNA, 32 nt, Human
guccagcuucugucugugucacuaaucuuucc

SEQ ID NO: 474395 - RNA, 32 nt, Human
guccaggaagauuggcuguggccaggugcugg

SEQ ID NO: 474396 - RNA, 32 nt, Human
guccaggaaugagacucuuuuaagaaacacau

SEQ ID NO: 474397 - RNA, 32 nt, Human
guccaggaauuagagguugcagugagguauga

SEQ ID NO: 474398 - RNA, 32 nt, Human
guccaggagaagcaggcgccagggauccagug

SEQ ID NO: 474399 - RNA, 32 nt, Human
guccaggagaaggugcugcucuccuugcuuuc

SEQ ID NO: 474400 - RNA, 32 nt, Human
guccaggagagggagcgccccuggcugccccu

SEQ ID NO: 474401 - RNA, 32 nt, Human
guccaggagauggagagaggugagcacuauga

SEQ ID NO: 474402 - RNA, 32 nt, Human
guccaggaggcggaggcugcagugagcuguga

SEQ ID NO: 474403 - RNA, 32 nt, Human
guccaggaggucgaggcugcagugagccaaga

SEQ ID NO: 474404 - RNA, 32 nt, Human
guccaggagguggaggcugcagugagcuauga

SEQ ID NO: 474405 - RNA, 32 nt, Human
guccaggagguugaggcugcagugagcuguga

SEQ ID NO: 474406 - RNA, 32 nt, Human
guccaggaguucaaggcugcagugaguuguga

SEQ ID NO: 474407 - RNA, 32 nt, Human
guccaggaguucaagguggcagugagcuauuc

SEQ ID NO: 474408 - RNA, 32 nt, Human
guccaggaguuggaggcuacagugagccauga

SEQ ID NO: 474409 - RNA, 32 nt, Human
guccaggaguuuaagaccagccuggacaacau

SEQ ID NO: 474410 - RNA, 32 nt, Human
guccaggaguuugagaccagccuggacaacau

SEQ ID NO: 474411 - RNA, 32 nt, Human
guccaggaucaaggagucgcucagugcaggac

SEQ ID NO: 474412 - RNA, 21 nt, Human
guccaggauggagugcagugg

SEQ ID NO: 474413 - RNA, 32 nt, Human
guccaggauuccucuuuucucugccauaaaug

SEQ ID NO: 474414 - RNA, 32 nt, Human
guccaggcaccagcucagcuccacacuagccu

SEQ ID NO: 474415 - RNA, 21 nt, Human
guccaggcaggagugcagugg

SEQ ID NO: 474416 - RNA, 23 nt, Human
guccaggcaggagugcaguggug

SEQ ID NO: 474417 - RNA, 32 nt, Human
guccaggcaggcggggaugugcggugaccacc

SEQ ID NO: 474418 - RNA, 32 nt, Human
guccaggcagugagccaagauugugccaccac

SEQ ID NO: 474419 - RNA, 20 nt, Human
guccaggcauaguaccuucc

SEQ ID NO: 474420 - RNA, 21 nt, Human
guccaggcaugggucccuucc

SEQ ID NO: 474421 - RNA, 32 nt, Human
guccaggcauguuggacucugagcucauuugg

SEQ ID NO: 474422 - RNA, 32 nt, Human
guccaggccacaugggcacaugcuauuauaau

SEQ ID NO: 474423 - RNA, 32 nt, Human
guccaggccaggucuucauccugcugccaagu

SEQ ID NO: 474424 - RNA, 30 nt, Human
guccaggcccucuccauggaccuguaugug

SEQ ID NO: 474425 - RNA, 32 nt, Human
guccaggcccuguggcaggacacacaugguga

SEQ ID NO: 474426 - RNA, 23 nt, Human
guccaggccugugaggugcagag

SEQ ID NO: 474427 - RNA, 32 nt, Human
guccaggccuucucccccacacccucaggccg

SEQ ID NO: 474428 - RNA, 32 nt, Human
guccaggccuucuuuacuuucuccccuguauu

SEQ ID NO: 474429 - RNA, 32 nt, Human
guccaggcuaagaggugggauuugagcugaga

SEQ ID NO: 474430 - RNA, 32 nt, Human
guccaggcuacagagggugacuccagguucca

SEQ ID NO: 474431 - RNA, 21 nt, Human
guccaggcuagagugcagugg

SEQ ID NO: 474432 - RNA, 24 nt, Human
guccaggcuagagugcaguggugu

SEQ ID NO: 474433 - RNA, 32 nt, Human
guccaggcuagauucaaacuccugggcucaag

SEQ ID NO: 474434 - RNA, 32 nt, Human
guccaggcuagucucgaauuccugggcucaag

SEQ ID NO: 474435 - RNA, 32 nt, Human
guccaggcucaauccuaggcccuggccugauu

SEQ ID NO: 474436 - RNA, 20 nt, Human
guccaggcuggagggcagug

SEQ ID NO: 474437 - RNA, 19 nt, Human
guccaggcuggagugcaau

SEQ ID NO: 474438 - RNA, 21 nt, Human
guccaggcuggagugcaauag

SEQ ID NO: 474439 - RNA, 20 nt, Human
guccaggcuggagugcaaug

SEQ ID NO: 474440 - RNA, 21 nt, Human
guccaggcuggagugcaaugg

SEQ ID NO: 474441 - RNA, 24 nt, Human
guccaggcuggagugcaauggugu

SEQ ID NO: 474442 - RNA, 18 nt, Human
guccaggcuggagugcag

SEQ ID NO: 474443 - RNA, 19 nt, Human
guccaggcuggagugcagu

SEQ ID NO: 474444 - RNA, 21 nt, Human
guccaggcuggagugcaguag

SEQ ID NO: 474445 - RNA, 20 nt, Human
guccaggcuggagugcagug

SEQ ID NO: 474446 - RNA, 23 nt, Human
guccaggcuggagugcagugcug

SEQ ID NO: 474447 - RNA, 32 nt, Human
guccaggcuggagugcagugcugcaaucuugg

SEQ ID NO: 474448 - RNA, 21 nt, Human
guccaggcuggagugcagugg

SEQ ID NO: 474449 - RNA, 24 nt, Human
guccaggcuggagugcaguggcgu

SEQ ID NO: 474450 - RNA, 23 nt, Human
guccaggcuggagugcaguggug

SEQ ID NO: 474451 - RNA, 24 nt, Human
guccaggcuggagugcaguggugu

SEQ ID NO: 474452 - RNA, 20 nt, Human
guccaggcuggaguucagug

SEQ ID NO: 474453 - RNA, 21 nt, Human
guccaggcuggaguucagugg

SEQ ID NO: 474454 - RNA, 32 nt, Human
guccaggcuggauucaaacuccugggcucaag

SEQ ID NO: 474455 - RNA, 32 nt, Human
guccaggcuggccucuguggcugcccucuggg

SEQ ID NO: 474456 - RNA, 32 nt, Human
guccaggcuggucacgaacuccugggcucaag

SEQ ID NO: 474457 - RNA, 32 nt, Human
guccaggcuggucucagaauucuggugaguga

SEQ ID NO: 474458 - RNA, 32 nt, Human
guccaggcuguguuuggcuuucagggaggccc

SEQ ID NO: 474459 - RNA, 32 nt, Human
guccagggaaagagccaggaauggcagugucu

SEQ ID NO: 474460 - RNA, 18 nt, Human
guccagggacagcucccu

SEQ ID NO: 474461 - RNA, 32 nt, Human
guccagggaggcaggcaguuaacugagaauug

SEQ ID NO: 474462 - RNA, 32 nt, Human
guccagggaggguggaggcccaggagaccaaa

SEQ ID NO: 474463 - RNA, 32 nt, Human
guccagggcaaggacguggccagugggagcug

SEQ ID NO: 474464 - RNA, 32 nt, Human
guccagggccagccugcaguacagaggcugga

SEQ ID NO: 474465 - RNA, 19 nt, Human
guccagggccugggcuccc

SEQ ID NO: 474466 - RNA, 32 nt, Human
guccagggcucccacaggucucagacugacag

SEQ ID NO: 474467 - RNA, 32 nt, Human
guccagggcucccggagagggagucagucuuc

SEQ ID NO: 474468 - RNA, 32 nt, Human
guccagggcucucuaggagucugcaccugcag

SEQ ID NO: 474469 - RNA, 32 nt, Human
guccagggcugcuuccuguccuggaggggcca

SEQ ID NO: 474470 - RNA, 32 nt, Human
guccagggcugugacagaccaggccuuccccu

SEQ ID NO: 474471 - RNA, 32 nt, Human
guccagggcuucagauauuuugcacgaauuuu

SEQ ID NO: 474472 - RNA, 32 nt, Human
guccagggucaccaagcagcagagcucugggg

SEQ ID NO: 474473 - RNA, 32 nt, Human
guccaggguccaggguccagagaagggagugg

SEQ ID NO: 474474 - RNA, 32 nt, Human
guccaggguucugcagggccuuccuccuccag

SEQ ID NO: 474475 - RNA, 32 nt, Human
guccagguaaaaaugugaagaccaugguuuug

SEQ ID NO: 474476 - RNA, 32 nt, Human
guccaggucagaaaguggcccaggaagggggc

SEQ ID NO: 474477 - RNA, 32 nt, Human
guccaggucgaguuccagagauuacucagaac

SEQ ID NO: 474478 - RNA, 32 nt, Human
guccaggugcccuguccagcugacugcaagga

SEQ ID NO: 474479 - RNA, 32 nt, Human
guccaguacaguagccaguggccacauaaacc

SEQ ID NO: 474480 - RNA, 32 nt, Human
guccagucaccaccugcagccucggcagggca

SEQ ID NO: 474481 - RNA, 32 nt, Human
guccagucccuccaaauccggcuacacucuac

SEQ ID NO: 474482 - RNA, 32 nt, Human
guccaguccucaggugagguuaaguccuucua

SEQ ID NO: 474483 - RNA, 32 nt, Human
guccaguccuucagaaggcaucaggaaggcaa

SEQ ID NO: 474484 - RNA, 32 nt, Human
guccagucucaagugaguucuuggccugggcc

SEQ ID NO: 474485 - RNA, 20 nt, Human
guccagucuggagugcaaug

SEQ ID NO: 474486 - RNA, 21 nt, Human
guccagucuggagugcaaugg

SEQ ID NO: 474487 - RNA, 32 nt, Human
guccagugacuuucaggaauugcccauuguuu

SEQ ID NO: 474488 - RNA, 32 nt, Human
guccagugaggugauugggagagguuauuuuc

SEQ ID NO: 474489 - RNA, 24 nt, Human
guccagugcccaucucuugcuugu

SEQ ID NO: 474490 - RNA, 32 nt, Human
guccagugcccuuuucagugcuaccggccucu

SEQ ID NO: 474491 - RNA, 32 nt, Human
guccagugcgggcucccgcugcugggggagag

SEQ ID NO: 474492 - RNA, 32 nt, Human
guccagugcuccaggcugggggccguggaucc

SEQ ID NO: 474493 - RNA, 32 nt, Human
guccagugcuugguccugcucuggucacuggg

SEQ ID NO: 474494 - RNA, 32 nt, Human
guccaguggaaugggggccaggagugcuggcu

SEQ ID NO: 474495 - RNA, 32 nt, Human
guccaguggccccucaccacacugacuuauuu

SEQ ID NO: 474496 - RNA, 24 nt, Human
guccaguggcucacaccuguaauc

SEQ ID NO: 474497 - RNA, 24 nt, Human
guccaguggcucacgccuguaauc

SEQ ID NO: 474498 - RNA, 32 nt, Human
guccagugggugugaggcugacuugccgacgg

SEQ ID NO: 474499 - RNA, 32 nt, Human
guccaguguguauccugcaucugccuuuccug

SEQ ID NO: 474500 - RNA, 32 nt, Human
guccaguguugucaugucaucaugcccccuca

SEQ ID NO: 474501 - RNA, 32 nt, Human
guccaguguuugagccaagguugccaccuguc

SEQ ID NO: 474502 - RNA, 32 nt, Human
guccaguugaggcagaggcaauaaccucccau

SEQ ID NO: 474503 - RNA, 32 nt, Human
guccaguuuacagcgucucugcccccuagcgu

SEQ ID NO: 474504 - RNA, 32 nt, Human
guccaguuucucuccccucugaccccuagaag

SEQ ID NO: 474505 - RNA, 32 nt, Human
guccaguuugucucccccguucaggccgccag

SEQ ID NO: 474506 - RNA, 32 nt, Human
guccauaaaggauuguaucaaguagaugggac

SEQ ID NO: 474507 - RNA, 32 nt, Human
guccauaaccaaagggagcacagucugcaccc

SEQ ID NO: 474508 - RNA, 32 nt, Human
guccauacacagaaacauaauaaacaaucuuc

SEQ ID NO: 474509 - RNA, 22 nt, Human
guccauaccccuuuuacuuccu

SEQ ID NO: 474510 - RNA, 32 nt, Human
guccauacuugagagaaaaacuuagaucugag

SEQ ID NO: 474511 - RNA, 32 nt, Human
guccauagcccagccagaugagcuugcagccu

SEQ ID NO: 474512 - RNA, 32 nt, Human
guccauagccucuguucguuuucacugcagga

SEQ ID NO: 474513 - RNA, 32 nt, Human
guccauaguauuauugcuaaucuuuugguuua

SEQ ID NO: 474514 - RNA, 32 nt, Human
guccauagucauuacucagucaaaacuugugu

SEQ ID NO: 474515 - RNA, 32 nt, Human
guccauaguggagggcccagagcccagugagg

SEQ ID NO: 474516 - RNA, 21 nt, Human
guccauaucaucagacucccu

SEQ ID NO: 474517 - RNA, 32 nt, Human
guccauauuugaaggcugccucaggccuggca

SEQ ID NO: 474518 - RNA, 32 nt, Human
guccaucaaaggagguugcugaccugaccgug

SEQ ID NO: 474519 - RNA, 32 nt, Human
guccaucaaggcagagcggcaagagccaggug

SEQ ID NO: 474520 - RNA, 21 nt, Human
guccaucacagugagcucccu

SEQ ID NO: 474521 - RNA, 32 nt, Human
guccaucaccagcaaccaauccaccaacagaa

SEQ ID NO: 474522 - RNA, 21 nt, Human
guccaucaguuaaaauuuuaa

SEQ ID NO: 474523 - RNA, 32 nt, Human
guccaucaugaagaacauggccacggagcugg

SEQ ID NO: 474524 - RNA, 32 nt, Human
guccauccacgggacccugaaacuccacuugg

SEQ ID NO: 474525 - RNA, 32 nt, Human
guccauccaucuaugcugcuuccacagagaaa

SEQ ID NO: 474526 - RNA, 32 nt, Human
guccaucccaaagcugcccugcagccuagccc

SEQ ID NO: 474527 - RNA, 32 nt, Human
guccaucccagagcauucaugaagucuucccg

SEQ ID NO: 474528 - RNA, 25 nt, Human
guccauccgugaccgcguggccuug

SEQ ID NO: 474529 - RNA, 22 nt, Human
guccauccucccuauggcccug

SEQ ID NO: 474530 - RNA, 32 nt, Human
guccauccucucaacagccccaugaagaaggg

SEQ ID NO: 474531 - RNA, 32 nt, Human
guccauccuuuccccaucccugccuccugccc

SEQ ID NO: 474532 - RNA, 32 nt, Human
guccaucggggaacuuacagccuagcaaggaa

SEQ ID NO: 474533 - RNA, 32 nt, Human
guccaucguggguaacagccuuggggagggug

SEQ ID NO: 474534 - RNA, 32 nt, Human
guccaucuccuccugcccgcagacacaggagu

SEQ ID NO: 474535 - RNA, 31 nt, Human
guccaucuccucucugagccucaguuuaccc

SEQ ID NO: 474536 - RNA, 32 nt, Human
guccaucugacuccugagccugugcuuuuccc

SEQ ID NO: 474537 - RNA, 32 nt, Human
guccaucugcaccaggcucugccuucacuccc

SEQ ID NO: 474538 - RNA, 32 nt, Human
guccaucugccaggaccccugcguccaaauuc

SEQ ID NO: 474539 - RNA, 32 nt, Human
guccaucuggggaccaugaggguugguguggg

SEQ ID NO: 474540 - RNA, 32 nt, Human
guccaucuguucccucuccucuccucauuccc

SEQ ID NO: 474541 - RNA, 32 nt, Human
guccaucuuuacccuucucugagcuaugcagc

SEQ ID NO: 474542 - RNA, 32 nt, Human
guccaucuuuggcaggcgcaaauguuuggcga

SEQ ID NO: 474543 - RNA, 32 nt, Human
guccaugaagggggugugagggggaggguauu

SEQ ID NO: 474544 - RNA, 32 nt, Human
guccaugagaacagccaugaaauaagucacua

SEQ ID NO: 474545 - RNA, 32 nt, Human
guccaugagagggcaggguaaugaggaggagu

SEQ ID NO: 474546 - RNA, 32 nt, Human
guccaugagggagagguugcugagaaguacau

SEQ ID NO: 474547 - RNA, 32 nt, Human
guccaugcaggggccacauccaaaaaggggag

SEQ ID NO: 474548 - RNA, 32 nt, Human
guccaugcauguuggagggaccaggccaucgu

SEQ ID NO: 474549 - RNA, 32 nt, Human
guccaugccagcaacacaaucacucaaagucc

SEQ ID NO: 474550 - RNA, 32 nt, Human
guccaugccaggacaccagcugacaauuucuu

SEQ ID NO: 474551 - RNA, 32 nt, Human
guccaugcccccugugcccacccuccccaggu

SEQ ID NO: 474552 - RNA, 32 nt, Human
guccaugcccucagggagucaggcugguggag

SEQ ID NO: 474553 - RNA, 22 nt, Human
guccaugcccuuugugauuuca

SEQ ID NO: 474554 - RNA, 29 nt, Human
guccaugcugccccucugccucguggccg

SEQ ID NO: 474555 - RNA, 32 nt, Human
guccaugcuggcugccuucaggaagcuaaagu

SEQ ID NO: 474556 - RNA, 32 nt, Human
guccauggagcugagcagcaggaggaggagcc

SEQ ID NO: 474557 - RNA, 32 nt, Human
guccauggagcugagggucggaggaaccuucc

SEQ ID NO: 474558 - RNA, 23 nt, Human
guccauggccacucaaccuguca

SEQ ID NO: 474559 - RNA, 32 nt, Human
guccauggucgcggcguccugaggcgggggac

SEQ ID NO: 474560 - RNA, 21 nt, Human
guccaugguuagaauuugauc

SEQ ID NO: 474561 - RNA, 20 nt, Human
guccauguacccuccuuccu

SEQ ID NO: 474562 - RNA, 32 nt, Human
guccauguacccuccuuccucacuacagucau

SEQ ID NO: 474563 - RNA, 32 nt, Human
guccaugucugugcuggcuggaagagggcuug

SEQ ID NO: 474564 - RNA, 32 nt, Human
guccauguuccaacugcuguacauccaaaagu

SEQ ID NO: 474565 - RNA, 32 nt, Human
guccauuaaaugucuuucuuuuguaaguugcc

SEQ ID NO: 474566 - RNA, 29 nt, Human
guccauuaugucugugugccuggaugucu

SEQ ID NO: 474567 - RNA, 32 nt, Human
guccauucacccucaccucucccugcauggag

SEQ ID NO: 474568 - RNA, 32 nt, Human
guccauuccauguaccagcuuaguuaugauac

SEQ ID NO: 474569 - RNA, 22 nt, Human
guccauuccccuuuucccuccu

SEQ ID NO: 474570 - RNA, 32 nt, Human
guccauuccccuuuucccuccugugcucuguc

SEQ ID NO: 474571 - RNA, 32 nt, Human
guccauuccucuuucaucuuaaucaaggacau

SEQ ID NO: 474572 - RNA, 32 nt, Human
guccauuccuuccaaagaagcuaaggcuaugc

SEQ ID NO: 474573 - RNA, 32 nt, Human
guccauucucacugcugggacacucaugaaaa

SEQ ID NO: 474574 - RNA, 32 nt, Human
guccauucucagcaugcugcuaauucaaacuc

SEQ ID NO: 474575 - RNA, 32 nt, Human
guccauucucauuccugcucugggccauuugu

SEQ ID NO: 474576 - RNA, 32 nt, Human
guccauucugcagcguuucucuuucccuugga

SEQ ID NO: 474577 - RNA, 32 nt, Human
guccauucugcccucgcugccuggugaggacc

SEQ ID NO: 474578 - RNA, 32 nt, Human
guccauucugcccucugaauggaucugagacg

SEQ ID NO: 474579 - RNA, 32 nt, Human
guccauugaugcuuugagauucugagcuauuu

SEQ ID NO: 474580 - RNA, 32 nt, Human
guccauuggcagcaccugccuccuggugucuc

SEQ ID NO: 474581 - RNA, 32 nt, Human
guccauuggcaugcuucugcugggugagcagg

SEQ ID NO: 474582 - RNA, 32 nt, Human
guccauuuaaguuagggggacaggaggcuaca

SEQ ID NO: 474583 - RNA, 32 nt, Human
guccauuuggcagggguggcugccucauuuag

SEQ ID NO: 474584 - RNA, 32 nt, Human
guccauuugggugacaaccagugacuugggaa

SEQ ID NO: 474585 - RNA, 32 nt, Human
guccauuuucccuccugggaccagagcugacu

SEQ ID NO: 474586 - RNA, 19 nt, Human
guccauuuucuagcugccu

SEQ ID NO: 474587 - RNA, 21 nt, Human
gucccaaaaccucauucccuu

SEQ ID NO: 474588 - RNA, 18 nt, Human
gucccaaaaggcacuguc

SEQ ID NO: 474589 - RNA, 20 nt, Human
gucccaaagaucaaguuguc

SEQ ID NO: 474590 - RNA, 32 nt, Human
gucccaaagugcuaggauuacaggcaugagcc

SEQ ID NO: 474591 - RNA, 32 nt, Human
gucccaaagugcugggauuauaggcgugagcc

SEQ ID NO: 474592 - RNA, 32 nt, Human
gucccaacagaggaggccagugaggcagagac

SEQ ID NO: 474593 - RNA, 32 nt, Human
gucccaaccuugaggcguggagcccagucuuu

SEQ ID NO: 474594 - RNA, 32 nt, Human
gucccaacuccuuuucccuauuuccuucuccu

SEQ ID NO: 474595 - RNA, 32 nt, Human
gucccaagaaauggaggaagaaaacaaagaau

SEQ ID NO: 474596 - RNA, 32 nt, Human
gucccaagaccuccugaaggaggagcuugcuc

SEQ ID NO: 474597 - RNA, 32 nt, Human
gucccaagauggcugcuguauccccaagaauc

SEQ ID NO: 474598 - RNA, 32 nt, Human
gucccaagcccaccccuccucccaccaucacc

SEQ ID NO: 474599 - RNA, 32 nt, Human
gucccaagcuuugccuacaucaccgccuuggu

SEQ ID NO: 474600 - RNA, 32 nt, Human
gucccaaggagaaggaagagcugaaauucauc

SEQ ID NO: 474601 - RNA, 32 nt, Human
gucccaaguagcuggaauuacagccaugcggc

SEQ ID NO: 474602 - RNA, 32 nt, Human
gucccaagucaauggaaagggaaagggugggg

SEQ ID NO: 474603 - RNA, 32 nt, Human
gucccaaugacuuuccuuuacccuccagcugu

SEQ ID NO: 474604 - RNA, 32 nt, Human
gucccaaugccacuugcuuccuuuccaagccg

SEQ ID NO: 474605 - RNA, 31 nt, Human
gucccaaugucagugaaacccagcugggggc

SEQ ID NO: 474606 - RNA, 32 nt, Human
gucccaauuccaaccugacucugguguagauc

SEQ ID NO: 474607 - RNA, 32 nt, Human
gucccaauuuucucccucccugugugucacua

SEQ ID NO: 474608 - RNA, 32 nt, Human
gucccacaagcagaguaggagaauacucuuuu

SEQ ID NO: 474609 - RNA, 32 nt, Human
gucccacacagccccagcuggggcaaacagcc

SEQ ID NO: 474610 - RNA, 32 nt, Human
gucccacacugaaauccccucuagucacccau

SEQ ID NO: 474611 - RNA, 32 nt, Human
gucccacacugugcagacccagucccacacug

SEQ ID NO: 474612 - RNA, 32 nt, Human
gucccacagaagacccagacggucuguguggc

SEQ ID NO: 474613 - RNA, 32 nt, Human
gucccacagauguguucacagggccagcacug

SEQ ID NO: 474614 - RNA, 32 nt, Human
gucccacagcaagggagagcaagaacgcacaa

SEQ ID NO: 474615 - RNA, 18 nt, Human
gucccacagcaucuccua

SEQ ID NO: 474616 - RNA, 32 nt, Human
gucccacagccaccaccucucuccucagccag

SEQ ID NO: 474617 - RNA, 32 nt, Human
gucccacaggcaggagggaucuggaccggcgg

SEQ ID NO: 474618 - RNA, 20 nt, Human
gucccacaggugccuaaggg

SEQ ID NO: 474619 - RNA, 22 nt, Human
gucccaccagccaacugcaacu

SEQ ID NO: 474620 - RNA, 32 nt, Human
gucccaccauuuucucaguuucucccucucuc

SEQ ID NO: 474621 - RNA, 32 nt, Human
gucccaccgcacuccagccugggcaacagagu

SEQ ID NO: 474622 - RNA, 32 nt, Human
gucccaccucacugccccgccucgccucucug

SEQ ID NO: 474623 - RNA, 32 nt, Human
gucccaccucagaguaaggacuacccaggggu

SEQ ID NO: 474624 - RNA, 32 nt, Human
gucccaccucccacuuuccaucauggccugaa

SEQ ID NO: 474625 - RNA, 32 nt, Human
gucccaccucucccccuccacuuccucuccuc

SEQ ID NO: 474626 - RNA, 32 nt, Human
gucccaccuggaggaggagguuggaggguuga

SEQ ID NO: 474627 - RNA, 32 nt, Human
gucccaccuggcucccccugcuggugucuagu

SEQ ID NO: 474628 - RNA, 32 nt, Human
gucccaccuuuguccccuggcugcugcccucc

SEQ ID NO: 474629 - RNA, 21 nt, Human
gucccacgcucccuggcgcgu

SEQ ID NO: 474630 - RNA, 20 nt, Human
gucccacgcucucagggggg

SEQ ID NO: 474631 - RNA, 32 nt, Human
gucccacggaggaggggcagagccaggaggca

SEQ ID NO: 474632 - RNA, 23 nt, Human
gucccacguggggcccacgggug

SEQ ID NO: 474633 - RNA, 32 nt, Human
gucccacguucucugcugacaucccccaauaa

SEQ ID NO: 474634 - RNA, 32 nt, Human
gucccacuccaucacccaggcuggaguccagu

SEQ ID NO: 474635 - RNA, 32 nt, Human
gucccacugcacuccagcccgggcaacagagu

SEQ ID NO: 474636 - RNA, 32 nt, Human
gucccacugcacuccagccugggcaacagagu

SEQ ID NO: 474637 - RNA, 27 nt, Human
gucccacuggccagccaucuuugcuca

SEQ ID NO: 474638 - RNA, 32 nt, Human
gucccacugucucucuccuucucuccaguuuu

SEQ ID NO: 474639 - RNA, 32 nt, Human
gucccacuguguucccagcuuccagagugaca

SEQ ID NO: 474640 - RNA, 32 nt, Human
gucccacuucagccucccaaauagcugggacu

SEQ ID NO: 474641 - RNA, 32 nt, Human
gucccacuuccaacguuggggauuacacuuca

SEQ ID NO: 474642 - RNA, 32 nt, Human
gucccacuuccccuuggcacauagaagaggca

SEQ ID NO: 474643 - RNA, 32 nt, Human
gucccacuugcaacuucuuucuguugagagaa

SEQ ID NO: 474644 - RNA, 32 nt, Human
gucccagaaagccggggguaggggccacccug

SEQ ID NO: 474645 - RNA, 32 nt, Human
gucccagaaauucccaggagggucagagaaga

SEQ ID NO: 474646 - RNA, 32 nt, Human
gucccagaagccucuggguugcagauugcuug

SEQ ID NO: 474647 - RNA, 32 nt, Human
gucccagaaggacuguggcuugugugugucca

SEQ ID NO: 474648 - RNA, 32 nt, Human
gucccagaaggaggggacagaggagcugagag

SEQ ID NO: 474649 - RNA, 32 nt, Human
gucccagaaggaugucaguaauugugacuagg

SEQ ID NO: 474650 - RNA, 32 nt, Human
gucccagaaguaaacccucacugugaaucaga

SEQ ID NO: 474651 - RNA, 32 nt, Human
gucccagacacauuucagcagcuuugagaaau

SEQ ID NO: 474652 - RNA, 32 nt, Human
gucccagaccaacugcuuccauggcccaaacg

SEQ ID NO: 474653 - RNA, 32 nt, Human
gucccagaccuagguacauggauauagggcuc

SEQ ID NO: 474654 - RNA, 32 nt, Human
gucccagagaaaagcaggcuguggaaaacugg

SEQ ID NO: 474655 - RNA, 20 nt, Human
gucccagagaaacugccaca

SEQ ID NO: 474656 - RNA, 32 nt, Human
gucccagagaacuacuucuaugugccagaccu

SEQ ID NO: 474657 - RNA, 32 nt, Human
gucccagagacaccugagccaccccacagaac

SEQ ID NO: 474658 - RNA, 32 nt, Human
gucccagagacauuuucccauggcaguccucc

SEQ ID NO: 474659 - RNA, 32 nt, Human
gucccagagugcugggauuacaguugugagcc

SEQ ID NO: 474660 - RNA, 32 nt, Human
gucccagauaaccuugaggccugggcacuggc

SEQ ID NO: 474661 - RNA, 22 nt, Human
gucccagaucaagccugccuca

SEQ ID NO: 474662 - RNA, 32 nt, Human
gucccagaucagugaggggagaagguugagcu

SEQ ID NO: 474663 - RNA, 32 nt, Human
gucccagcaacuugggaggcugaggcagaagu

SEQ ID NO: 474664 - RNA, 32 nt, Human
gucccagcacccuuggccugaguaaacuugga

SEQ ID NO: 474665 - RNA, 32 nt, Human
gucccagcagcaucugcccugugaaguuuguu

SEQ ID NO: 474666 - RNA, 32 nt, Human
gucccagcagccucccccuggccagggccauc

SEQ ID NO: 474667 - RNA, 32 nt, Human
gucccagcaggggcggcaggagagagaggcug

SEQ ID NO: 474668 - RNA, 32 nt, Human
gucccagcagguaugggcagguugcuugaggc

SEQ ID NO: 474669 - RNA, 32 nt, Human
gucccagccaacacccucuagguccuaaaagu

SEQ ID NO: 474670 - RNA, 32 nt, Human
gucccagccacugaagccagaggaucgauuga

SEQ ID NO: 474671 - RNA, 32 nt, Human
gucccagccagugaggaugacagugacaccca

SEQ ID NO: 474672 - RNA, 32 nt, Human
gucccagccaugguccgcccaaugcucuugcu

SEQ ID NO: 474673 - RNA, 32 nt, Human
gucccagcccacauagaugccccuugcugagg

SEQ ID NO: 474674 - RNA, 19 nt, Human
gucccagcccaccuacuca

SEQ ID NO: 474675 - RNA, 32 nt, Human
gucccagcccagugcugggacagggaaggaug

SEQ ID NO: 474676 - RNA, 32 nt, Human
gucccagccuccagaacugagcgaugaaauuc

SEQ ID NO: 474677 - RNA, 19 nt, Human
gucccagcggaugcugcca

SEQ ID NO: 474678 - RNA, 22 nt, Human
gucccagcgggugcgucugcag

SEQ ID NO: 474679 - RNA, 23 nt, Human
gucccagcuacucagaaggauga

SEQ ID NO: 474680 - RNA, 23 nt, Human
gucccagcuacucagaaggccga

SEQ ID NO: 474681 - RNA, 23 nt, Human
gucccagcuacucagaaggguga

SEQ ID NO: 474682 - RNA, 23 nt, Human
gucccagcuacucaggagacuga

SEQ ID NO: 474683 - RNA, 32 nt, Human
gucccagcuacucaggagacugaggcgggaga

SEQ ID NO: 474684 - RNA, 32 nt, Human
gucccagcuacucaggagacugaggcuagaag

SEQ ID NO: 474685 - RNA, 32 nt, Human
gucccagcuacucaggagacugaggugggagg

SEQ ID NO: 474686 - RNA, 23 nt, Human
gucccagcuacucaggaggccga

SEQ ID NO: 474687 - RNA, 26 nt, Human
gucccagcuacucaggaggcucagca

SEQ ID NO: 474688 - RNA, 32 nt, Human
gucccagcuacucaggaggcugggcaggagaa

SEQ ID NO: 474689 - RNA, 31 nt, Human
gucccagcuacucaggagguugaagugggag

SEQ ID NO: 474690 - RNA, 31 nt, Human
gucccagcuacucaggagguugaggcagaag

SEQ ID NO: 474691 - RNA, 31 nt, Human
gucccagcuacucaggagguugagguaggag

SEQ ID NO: 474692 - RNA, 31 nt, Human
gucccagcuacucaggagguugaggugggaa

SEQ ID NO: 474693 - RNA, 32 nt, Human
gucccagcuacucccagcuauucaggaggcug

SEQ ID NO: 474694 - RNA, 32 nt, Human
gucccagcuacucgcgagacugaggcaggaga

SEQ ID NO: 474695 - RNA, 32 nt, Human
gucccagcuacucgggagacucaugcaggagg

SEQ ID NO: 474696 - RNA, 23 nt, Human
gucccagcuacucgggagacuga

SEQ ID NO: 474697 - RNA, 32 nt, Human
gucccagcuacucgggagacugaggcaggaga

SEQ ID NO: 474698 - RNA, 32 nt, Human
gucccagcuacucgggagacugaggcaggagg

SEQ ID NO: 474699 - RNA, 23 nt, Human
gucccagcuacucgggaggccga

SEQ ID NO: 474700 - RNA, 31 nt, Human
gucccagcuacucgggagguugaggcaggag

SEQ ID NO: 474701 - RNA, 23 nt, Human
gucccagcuacucugaagacuga

SEQ ID NO: 474702 - RNA, 32 nt, Human
gucccagcuacuuagggaggcuaagauaggag

SEQ ID NO: 474703 - RNA, 32 nt, Human
gucccagcuacuugggagguugaggcuggaag

SEQ ID NO: 474704 - RNA, 32 nt, Human
gucccagcuccaggcuggagccagugaagggu

SEQ ID NO: 474705 - RNA, 31 nt, Human
gucccagcucccaaggagguugcagaaguac

SEQ ID NO: 474706 - RNA, 32 nt, Human
gucccagcucuggagcaagcuguagacggaca

SEQ ID NO: 474707 - RNA, 32 nt, Human
gucccagcugccugccugccucuuaggagucc

SEQ ID NO: 474708 - RNA, 32 nt, Human
gucccagcugcuggucacggagcggagaaagc

SEQ ID NO: 474709 - RNA, 32 nt, Human
gucccagcuggcuggguccucuucugccccca

SEQ ID NO: 474710 - RNA, 32 nt, Human
gucccagcugugcaucaccaaugucagcaguc

SEQ ID NO: 474711 - RNA, 21 nt, Human
gucccaggaaacagugcuuuc

SEQ ID NO: 474712 - RNA, 17 nt, Human
gucccaggaaagcuguu

SEQ ID NO: 474713 - RNA, 20 nt, Human
gucccaggaacucaggcuuc

SEQ ID NO: 474714 - RNA, 32 nt, Human
gucccaggaagagacaggccaggcuuaugggc

SEQ ID NO: 474715 - RNA, 17 nt, Human
gucccaggaagagcuuc

SEQ ID NO: 474716 - RNA, 18 nt, Human
gucccaggaagccgcuuc

SEQ ID NO: 474717 - RNA, 19 nt, Human
gucccaggaagcucauguc

SEQ ID NO: 474718 - RNA, 20 nt, Human
gucccaggaaguccagcucc

SEQ ID NO: 474719 - RNA, 32 nt, Human
gucccaggacccagggagaguguggggacagg

SEQ ID NO: 474720 - RNA, 20 nt, Human
gucccaggaccuugaguguc

SEQ ID NO: 474721 - RNA, 32 nt, Human
gucccaggacgugccucauacaugacuugagc

SEQ ID NO: 474722 - RNA, 16 nt, Human
gucccaggagcagcug

SEQ ID NO: 474723 - RNA, 17 nt, Human
gucccaggagcagcugu

SEQ ID NO: 474724 - RNA, 19 nt, Human
gucccaggaggcagcucuc

SEQ ID NO: 474725 - RNA, 17 nt, Human
gucccaggaggcagcug

SEQ ID NO: 474726 - RNA, 17 nt, Human
gucccaggaucaggcug

SEQ ID NO: 474727 - RNA, 17 nt, Human
gucccaggauggagcug

SEQ ID NO: 474728 - RNA, 32 nt, Human
gucccaggcacuaucuggagugcuuuacacau

SEQ ID NO: 474729 - RNA, 32 nt, Human
gucccaggcagugaugaugguggagaacagcc

SEQ ID NO: 474730 - RNA, 32 nt, Human
gucccaggcaucucucuagaguuuauuuacag

SEQ ID NO: 474731 - RNA, 17 nt, Human
gucccaggccagcuguc

SEQ ID NO: 474732 - RNA, 18 nt, Human
gucccaggcccaaugccu

SEQ ID NO: 474733 - RNA, 32 nt, Human
gucccaggcccugggggugagggggaggggac

SEQ ID NO: 474734 - RNA, 17 nt, Human
gucccaggccgcccucc

SEQ ID NO: 474735 - RNA, 32 nt, Human
gucccaggccugggacccagagccaagaaagc

SEQ ID NO: 474736 - RNA, 32 nt, Human
gucccaggccuggugcccagacuccuugcaug

SEQ ID NO: 474737 - RNA, 32 nt, Human
gucccaggcgccggcgccuggagcccaacugc

SEQ ID NO: 474738 - RNA, 22 nt, Human
gucccaggcuagagugcagugg

SEQ ID NO: 474739 - RNA, 22 nt, Human
gucccaggcuggagugcagugg

SEQ ID NO: 474740 - RNA, 32 nt, Human
gucccaggcuguggugccacccucucuggcau

SEQ ID NO: 474741 - RNA, 32 nt, Human
gucccagggcaggcgggacagcacagaggcag

SEQ ID NO: 474742 - RNA, 32 nt, Human
gucccagggccccuccuggggaugcucgccag

SEQ ID NO: 474743 - RNA, 32 nt, Human
gucccaggggccugaaaaggaaggaccaggcu

SEQ ID NO: 474744 - RNA, 32 nt, Human
gucccaggggucuuggcuguugccccacgaaa

SEQ ID NO: 474745 - RNA, 32 nt, Human
gucccagggucuuccugucacccaggcuggag

SEQ ID NO: 474746 - RNA, 32 nt, Human
gucccaggugcucaggaagcugaggugggagg

SEQ ID NO: 474747 - RNA, 32 nt, Human
gucccaggugugaaagagggucugugccuccg

SEQ ID NO: 474748 - RNA, 32 nt, Human
gucccaguauacucacuuaucucauccaugga

SEQ ID NO: 474749 - RNA, 32 nt, Human
gucccaguauuuuuagccccaaaggagaagug

SEQ ID NO: 474750 - RNA, 32 nt, Human
gucccagucaguccggaggcugcggcugcaga

SEQ ID NO: 474751 - RNA, 32 nt, Human
gucccagugcgaggccgggagcgaauggaaaa

SEQ ID NO: 474752 - RNA, 32 nt, Human
gucccagugcugcugcagcucugagcauuccc

SEQ ID NO: 474753 - RNA, 16 nt, Human
gucccaguggaagcug

SEQ ID NO: 474754 - RNA, 32 nt, Human
gucccaguggauugauguuguuuuuaauggau

SEQ ID NO: 474755 - RNA, 32 nt, Human
gucccauaaggguuggaaguuguguagcauuc

SEQ ID NO: 474756 - RNA, 32 nt, Human
gucccauagggaggucacaaagaaguccuuau

SEQ ID NO: 474757 - RNA, 32 nt, Human
gucccaucaauuccaaagauguuuccaguggu

SEQ ID NO: 474758 - RNA, 32 nt, Human
gucccaucaccugaaccuucagucucccccau

SEQ ID NO: 474759 - RNA, 18 nt, Human
gucccaucacucacugcc

SEQ ID NO: 474760 - RNA, 32 nt, Human
gucccaucauuucccagaaggcagcagacaga

SEQ ID NO: 474761 - RNA, 21 nt, Human
gucccauccacaccagcuccc

SEQ ID NO: 474762 - RNA, 22 nt, Human
gucccaucugccccagagcgcu

SEQ ID NO: 474763 - RNA, 32 nt, Human
gucccaugaaauauauguauacauuccccacu

SEQ ID NO: 474764 - RNA, 32 nt, Human
gucccaugggugggggacaggagcugcuuccc

SEQ ID NO: 474765 - RNA, 32 nt, Human
gucccaugucaugcagaggugacaggguaucc

SEQ ID NO: 474766 - RNA, 32 nt, Human
gucccaugugagccacggugccccaccuuuua

SEQ ID NO: 474767 - RNA, 32 nt, Human
gucccauuagagauguaucaccaccuugucac

SEQ ID NO: 474768 - RNA, 22 nt, Human
gucccauucaagccaccgagcu

SEQ ID NO: 474769 - RNA, 20 nt, Human
gucccauucuccacucacug

SEQ ID NO: 474770 - RNA, 32 nt, Human
gucccauuuuccgacuaggagacaucuuccga

SEQ ID NO: 474771 - RNA, 32 nt, Human
gucccauuuuccugagugcuuuugccagacuu

SEQ ID NO: 474772 - RNA, 32 nt, Human
guccccaaagagagccucgccacuggcuucag

SEQ ID NO: 474773 - RNA, 32 nt, Human
guccccaaagugucacagauauugaacccacu

SEQ ID NO: 474774 - RNA, 32 nt, Human
guccccaacgcugggcuugcuugggggcagcc

SEQ ID NO: 474775 - RNA, 32 nt, Human
guccccaagagauucagagaaaagaggucaau

SEQ ID NO: 474776 - RNA, 24 nt, Human
guccccaaggcuggagugcagugg

SEQ ID NO: 474777 - RNA, 31 nt, Human
guccccaauguguccauugaugccagagaau

SEQ ID NO: 474778 - RNA, 18 nt, Human
guccccacaccagccugu

SEQ ID NO: 474779 - RNA, 32 nt, Human
guccccacagccagccccagaugcuucugaca

SEQ ID NO: 474780 - RNA, 32 nt, Human
guccccaccaacaccaggaauuuagaccuuuu

SEQ ID NO: 474781 - RNA, 18 nt, Human
guccccaccaccccugcc

SEQ ID NO: 474782 - RNA, 19 nt, Human
guccccaccagggcucccu

SEQ ID NO: 474783 - RNA, 32 nt, Human
guccccaccagugcccagcccaggcaggguca

SEQ ID NO: 474784 - RNA, 20 nt, Human
guccccaccccccuccgccc

SEQ ID NO: 474785 - RNA, 32 nt, Human
guccccacccgcacgcucucuggaccacuaca

SEQ ID NO: 474786 - RNA, 32 nt, Human
guccccacccuaacccccaccucccggcccug

SEQ ID NO: 474787 - RNA, 32 nt, Human
guccccacccugccuccucccugcugcuuugc

SEQ ID NO: 474788 - RNA, 20 nt, Human
guccccacccuuccccgccc

SEQ ID NO: 474789 - RNA, 32 nt, Human
guccccacgguuccuuucugcuuuucugaaug

SEQ ID NO: 474790 - RNA, 32 nt, Human
guccccacuagccaggcucuuugagggcaggg

SEQ ID NO: 474791 - RNA, 32 nt, Human
guccccacugcacccccuccagaggcgacuuu

SEQ ID NO: 474792 - RNA, 32 nt, Human
guccccacuggcccugagcacgacagcccuuc

SEQ ID NO: 474793 - RNA, 32 nt, Human
guccccacuguggccuucuccuuuggcgcucc

SEQ ID NO: 474794 - RNA, 32 nt, Human
gucugaccccucucuccaccccugggcuaugc

SEQ ID NO: 474795 - RNA, 20 nt, Human
gucugacccgccuccuuccc

SEQ ID NO: 474796 - RNA, 32 nt, Human
gucugacccuagaggcagaugcugcacugcac

SEQ ID NO: 474797 - RNA, 32 nt, Human
gucugaccucaggccuuuuagccauauuucag

SEQ ID NO: 474798 - RNA, 32 nt, Human
gucugacucccgcucuuccugccugaaggugc

SEQ ID NO: 474799 - RNA, 32 nt, Human
gucugacucuaucacccaggcuggagugcagu

SEQ ID NO: 474800 - RNA, 32 nt, Human
gucugacucuggagcccagccugcugcuuccc

SEQ ID NO: 474801 - RNA, 32 nt, Human
gucugacucuuccucuuccuccugcucccugg

SEQ ID NO: 474802 - RNA, 32 nt, Human
gucugacugcaagcgcugaguccuuccagagg

SEQ ID NO: 474803 - RNA, 32 nt, Human
gucugacugcaccugcauccuuagcucagagc

SEQ ID NO: 474804 - RNA, 32 nt, Human
gucugacuggcacugccuuuuguuugcccuug

SEQ ID NO: 474805 - RNA, 32 nt, Human
gucugacuguugcccaggcuggaguguaaugg

SEQ ID NO: 474806 - RNA, 32 nt, Human
gucugacuucaaggaacucaguuuaauuuuga

SEQ ID NO: 474807 - RNA, 32 nt, Human
gucugacuucucucccccaccugcugugcccu

SEQ ID NO: 474808 - RNA, 32 nt, Human
gucugacuucugcaucuccuuccaggucagcu

SEQ ID NO: 474809 - RNA, 32 nt, Human
gucugacuugauaacuccagugccaguauagu

SEQ ID NO: 474810 - RNA, 32 nt, Human
gucugacuugcagccaacucucaaggcaaggc

SEQ ID NO: 474811 - RNA, 32 nt, Human
gucugagaagccccuucucuccuuccuuuauc

SEQ ID NO: 474812 - RNA, 32 nt, Human
gucugagacaggacccaggcacccucacggca

SEQ ID NO: 474813 - RNA, 32 nt, Human
gucugagacaguguugcuacugcugagggaac

SEQ ID NO: 474814 - RNA, 32 nt, Human
gucugagaccagccuggcuaacauggugaaac

SEQ ID NO: 474815 - RNA, 32 nt, Human
gucugagaccagccugggcaacauggugaaac

SEQ ID NO: 474816 - RNA, 32 nt, Human
gucugagacucacaggaaggaggagccgaccg

SEQ ID NO: 474817 - RNA, 32 nt, Human
gucugagagaucugaaauaaccuuucccagug

SEQ ID NO: 474818 - RNA, 32 nt, Human
gucugagagcuagccagaacugggguacagcc

SEQ ID NO: 474819 - RNA, 32 nt, Human
gucugagaggagaacuuccuggagccagugcc

SEQ ID NO: 474820 - RNA, 32 nt, Human
gucugagauacauucaccuaacauacaagauu

SEQ ID NO: 474821 - RNA, 32 nt, Human
gucugagaugguaggagcaguugugugaagau

SEQ ID NO: 474822 - RNA, 32 nt, Human
gucugagcacagaagacagugucuuggacgcc

SEQ ID NO: 474823 - RNA, 32 nt, Human
gucugagccaagcaggacccugucccagagca

SEQ ID NO: 474824 - RNA, 32 nt, Human
gucugagcccagccaccugaguuuuuaguacu

SEQ ID NO: 474825 - RNA, 32 nt, Human
gucugagcccaggauucgugcaacaccaggaa

SEQ ID NO: 474826 - RNA, 32 nt, Human
gucugagccccagcugaagggacugagccuca

SEQ ID NO: 474827 - RNA, 32 nt, Human
gucugagcuaaaaucuaggugauuguucauca

SEQ ID NO: 474828 - RNA, 18 nt, Human
gucugagcucgggcuccc

SEQ ID NO: 474829 - RNA, 21 nt, Human
gucugagcuguggaaaaggga

SEQ ID NO: 474830 - RNA, 32 nt, Human
gucugaggaggugacaucggagcugagaacug

SEQ ID NO: 474831 - RNA, 32 nt, Human
gucugaggcccagguugacccguggucauggu

SEQ ID NO: 474832 - RNA, 32 nt, Human
gucugagggaagggaggcaggcagcuuacuac

SEQ ID NO: 474833 - RNA, 32 nt, Human
gucugagggaugaccucuccuagccaccucug

SEQ ID NO: 474834 - RNA, 32 nt, Human
gucugagggauggacgagacgagcccacuagu

SEQ ID NO: 474835 - RNA, 32 nt, Human
gucugagggcuaucguuccagcagagaucaac

SEQ ID NO: 474836 - RNA, 32 nt, Human
gucugaggugacaccaucauuaaggauucgac

SEQ ID NO: 474837 - RNA, 32 nt, Human
gucugagguggagggagucauggcaggacagg

SEQ ID NO: 474838 - RNA, 32 nt, Human
gucugagguucuugccugccuucccucccauu

SEQ ID NO: 474839 - RNA, 32 nt, Human
gucugaguacaaguuccacuucaggauggcgc

SEQ ID NO: 474840 - RNA, 32 nt, Human
gucugagucagguuuguugagaacaagcccuc

SEQ ID NO: 474841 - RNA, 32 nt, Human
gucugaguccaaccucagcuucccagccagca

SEQ ID NO: 474842 - RNA, 32 nt, Human
gucugaguccagauuucuucucuccuuacuuc

SEQ ID NO: 474843 - RNA, 32 nt, Human
gucugagucugaguccugucucugccugcggc

SEQ ID NO: 474844 - RNA, 32 nt, Human
gucugagucugcagucccgagaucccagccau

SEQ ID NO: 474845 - RNA, 32 nt, Human
gucugagugaagauagcagggaugcuguguuc

SEQ ID NO: 474846 - RNA, 32 nt, Human
gucugagugcguguggggaccucagaacacug

SEQ ID NO: 474847 - RNA, 32 nt, Human
gucugaguggccuggcccaucuggcccaccug

SEQ ID NO: 474848 - RNA, 32 nt, Human
gucugaguuagaaccacuuguuuuggggaagu

SEQ ID NO: 474849 - RNA, 32 nt, Human
gucugaguucucucuuccuuccccugcauaga

SEQ ID NO: 474850 - RNA, 32 nt, Human
gucugaguuggcagcaaggacccccagcucuc

SEQ ID NO: 474851 - RNA, 27 nt, Human
gucugauaaguauugucagugugcaaa

SEQ ID NO: 474852 - RNA, 32 nt, Human
gucugauacuaauccaggcacacugcugcugu

SEQ ID NO: 474853 - RNA, 32 nt, Human
gucugauagauaacuaacaaaauaguuuuagu

SEQ ID NO: 474854 - RNA, 32 nt, Human
gucugauagauggggaacggcaucucugagga

SEQ ID NO: 474855 - RNA, 31 nt, Human
gucugauaguccuaggagguucuggaagaaa

SEQ ID NO: 474856 - RNA, 18 nt, Human
gucugaucccagagggug

SEQ ID NO: 474857 - RNA, 32 nt, Human
gucugauccucccuggcccacucaccaggguc

SEQ ID NO: 474858 - RNA, 32 nt, Human
gucugauccugguuuccaccuccagcccuggg

SEQ ID NO: 474859 - RNA, 32 nt, Human
gucugaucuaaauguggagaaacuguagucuc

SEQ ID NO: 474860 - RNA, 32 nt, Human
gucugaugaaggcagggguggugauucaugcu

SEQ ID NO: 474861 - RNA, 21 nt, Human
gucugaugacuuccucuuccc

SEQ ID NO: 474862 - RNA, 32 nt, Human
gucugauggagguuugcucuuguugcccaggc

SEQ ID NO: 474863 - RNA, 32 nt, Human
gucugauguguaagcagccucuccccaucuac

SEQ ID NO: 474864 - RNA, 32 nt, Human
gucugauguucuguuccauuguacaucgaaga

SEQ ID NO: 474865 - RNA, 32 nt, Human
gucugauuacaauggacuugacucccacgcuu

SEQ ID NO: 474866 - RNA, 32 nt, Human
gucugauucccaagcucugcuccucuccccag

SEQ ID NO: 474867 - RNA, 32 nt, Human
gucugauucgauccucccugauggcaauggag

SEQ ID NO: 474868 - RNA, 32 nt, Human
gucugauuggcacaucaagaguuaacucugcc

SEQ ID NO: 474869 - RNA, 32 nt, Human
gucugauugguugcaggaggggaccaaucaga

SEQ ID NO: 474870 - RNA, 32 nt, Human
gucugauuuaauaaaugguucauuuuaaaagu

SEQ ID NO: 474871 - RNA, 32 nt, Human
gucugcaaaaugaagauugaggaggugaagag

SEQ ID NO: 474872 - RNA, 32 nt, Human
gucugcaaaaugcagaggucaccagagccaag

SEQ ID NO: 474873 - RNA, 32 nt, Human
gucugcaaagguguaaucuuuggaagacuuca

SEQ ID NO: 474874 - RNA, 32 nt, Human
gucugcaaaguagagcuguuauguuuuucuug

SEQ ID NO: 474875 - RNA, 32 nt, Human
gucugcaaaguagagggccaucgcucaccaau

SEQ ID NO: 474876 - RNA, 32 nt, Human
gucugcaacuuccugaggccuguucugaaaua

SEQ ID NO: 474877 - RNA, 32 nt, Human
gucugcaagggcccagagugaaccguccuuuc

SEQ ID NO: 474878 - RNA, 32 nt, Human
gucugcaaugcuguuuauauuuugggugauga

SEQ ID NO: 474879 - RNA, 32 nt, Human
gucugcacaagccuggacaaguucuuccauau

SEQ ID NO: 474880 - RNA, 32 nt, Human
gucugcacaccguugagcacagcagcuuagac

SEQ ID NO: 474881 - RNA, 32 nt, Human
gucugcacaccucgcucugccugccauggcug

SEQ ID NO: 474882 - RNA, 32 nt, Human
gucugcacacuggccucugcagccagauuucu

SEQ ID NO: 474883 - RNA, 18 nt, Human
gucugcacaguuuccaaa

SEQ ID NO: 474884 - RNA, 32 nt, Human
gucugcacccacccuuccacccucagggccug

SEQ ID NO: 474885 - RNA, 32 nt, Human
gucugcacugacagccugaagggucuacaccc

SEQ ID NO: 474886 - RNA, 32 nt, Human
gucugcacugcaaccuccaccaggaccaggau

SEQ ID NO: 474887 - RNA, 32 nt, Human
gucugcacugcaacuucuguauccuuccuucc

SEQ ID NO: 474888 - RNA, 32 nt, Human
gucugcacuggagcugccuggugaccagaagu

SEQ ID NO: 474889 - RNA, 32 nt, Human
gucugcacuugggaacaaucauucucccccag

SEQ ID NO: 474890 - RNA, 30 nt, Human
gucugcagaaaucucauguuguguucuuuc

SEQ ID NO: 474891 - RNA, 19 nt, Human
gucugcagagugcucucua

SEQ ID NO: 474892 - RNA, 32 nt, Human
gucugcagaguguugggucuguagccagcaaa

SEQ ID NO: 474893 - RNA, 32 nt, Human
gucugcagcaagggcauuacugcccagguaag

SEQ ID NO: 474894 - RNA, 32 nt, Human
gucugcagcucccagcgagaucaaugaagaag

SEQ ID NO: 474895 - RNA, 32 nt, Human
gucugcagcugcugcccuucucccaggccccc

SEQ ID NO: 474896 - RNA, 32 nt, Human
gucugcaggaauuggcuuauuucuguaugcca

SEQ ID NO: 474897 - RNA, 32 nt, Human
gucugcaggagagcaagccaggaggacauggg

SEQ ID NO: 474898 - RNA, 20 nt, Human
gucugcaggcaccaggcugg

SEQ ID NO: 474899 - RNA, 32 nt, Human
gucugcaggccaggagagaugcugcccaggcc

SEQ ID NO: 474900 - RNA, 23 nt, Human
gucugcagggacagccaccggca

SEQ ID NO: 474901 - RNA, 32 nt, Human
gucugcagggccagaggccaggagggugccuc

SEQ ID NO: 474902 - RNA, 22 nt, Human
gucugcagggucccuccuuccu

SEQ ID NO: 474903 - RNA, 24 nt, Human
gucugcagguccagccggcuggca

SEQ ID NO: 474904 - RNA, 23 nt, Human
gucugcagguuccaugggugaca

SEQ ID NO: 474905 - RNA, 22 nt, Human
gucugcagguugcaaggcagca

SEQ ID NO: 474906 - RNA, 23 nt, Human
gucugcagucagagccacugaca

SEQ ID NO: 474907 - RNA, 32 nt, Human
gucugcaguccugugcucacagacaucugaaa

SEQ ID NO: 474908 - RNA, 32 nt, Human
gucugcagucgcugcaaccuacccucucucug

SEQ ID NO: 474909 - RNA, 23 nt, Human
gucugcauaaacuucaucuucaa

SEQ ID NO: 474910 - RNA, 32 nt, Human
gucugcauaaccugaaugaaagaaggaaauga

SEQ ID NO: 474911 - RNA, 18 nt, Human
gucugcauaacuuucgaa

SEQ ID NO: 474912 - RNA, 32 nt, Human
gucugcaucaaaggaacauuugcuucacuggg

SEQ ID NO: 474913 - RNA, 32 nt, Human
gucugcauccaccuccccagccuuugucaccg

SEQ ID NO: 474914 - RNA, 32 nt, Human
gucugcauccccuuuccaaggcugcuucccug

SEQ ID NO: 474915 - RNA, 32 nt, Human
gucugcaugaacuacugaaagcugcugagugu

SEQ ID NO: 474916 - RNA, 32 nt, Human
gucugcauggcagagagcgcccugccaugaga

SEQ ID NO: 474917 - RNA, 21 nt, Human
gucugcaugggaccauuucaa

SEQ ID NO: 474918 - RNA, 32 nt, Human
gucugcauuccaccacauauccacccuugaga

SEQ ID NO: 474919 - RNA, 18 nt, Human
gucugccaccaccaugcc

SEQ ID NO: 474920 - RNA, 17 nt, Human
gucugccaccauaccca

SEQ ID NO: 474921 - RNA, 32 nt, Human
gucugccacccaggcuggaguccaguggcgug

SEQ ID NO: 474922 - RNA, 32 nt, Human
gucugccacuaccacugugcugugcugugggg

SEQ ID NO: 474923 - RNA, 32 nt, Human
gucugccacuggcuuucaugcccuauuccagg

SEQ ID NO: 474924 - RNA, 32 nt, Human
gucugccacuugucaaagaaggugcugauccu

SEQ ID NO: 474925 - RNA, 22 nt, Human
gucugccacuuuccgggccaug

SEQ ID NO: 474926 - RNA, 32 nt, Human
gucugccagcagaggcaguagggcacagaggg

SEQ ID NO: 474927 - RNA, 23 nt, Human
gucugccaggauggagugcagug

SEQ ID NO: 474928 - RNA, 24 nt, Human
gucugccaggauggagugcagugg

SEQ ID NO: 474929 - RNA, 32 nt, Human
gucugccaggcugggagcuggagcuugcugag

SEQ ID NO: 474930 - RNA, 32 nt, Human
gucugccagggagccagaaggaagggccuugc

SEQ ID NO: 474931 - RNA, 32 nt, Human
gucugccaucagcuuaguuagccauugaugca

SEQ ID NO: 474932 - RNA, 32 nt, Human
gucugccaugcgcuucuuccucccaggcuacc

SEQ ID NO: 474933 - RNA, 22 nt, Human
gucugccaugcucugugcaaug

SEQ ID NO: 474934 - RNA, 32 nt, Human
gucugccauuuggagaaauuuaaaugcuauuu

SEQ ID NO: 474935 - RNA, 32 nt, Human
gucugcccaagugucuuaggaaccaaaagcaa

SEQ ID NO: 474936 - RNA, 32 nt, Human
gucugcccacaaagaauccagcuuugacauua

SEQ ID NO: 474937 - RNA, 32 nt, Human
gucugcccacuucccucccccugccgaggcug

SEQ ID NO: 474938 - RNA, 32 nt, Human
gucugccccacccucaaacccuguggggccug

SEQ ID NO: 474939 - RNA, 20 nt, Human
gucugccccacugggucugg

SEQ ID NO: 474940 - RNA, 32 nt, Human
gucugcccccauguuucagucaccucccucca

SEQ ID NO: 474941 - RNA, 18 nt, Human
gucugccccucaguuggu

SEQ ID NO: 474942 - RNA, 23 nt, Human
gucugccccucccguggcugcca

SEQ ID NO: 474943 - RNA, 32 nt, Human
gucugccccuuucacauaauuuuaaccugguu

SEQ ID NO: 474944 - RNA, 32 nt, Human
gucugcccgggcccgcccaucgggguccccaa

SEQ ID NO: 474945 - RNA, 32 nt, Human
gucugcccgugagccucagcagauauggcucc

SEQ ID NO: 474946 - RNA, 20 nt, Human
gucugcccuauccacagcug

SEQ ID NO: 474947 - RNA, 32 nt, Human
gucugcccucugcauccucuggagccagccga

SEQ ID NO: 474948 - RNA, 32 nt, Human
gucugcccugagcugugccugugugcuccagc

SEQ ID NO: 474949 - RNA, 32 nt, Human
gucugcccugcaggaugccgcagcugagccug

SEQ ID NO: 474950 - RNA, 32 nt, Human
gucugcccugcagggaguaccgaccuauccca

SEQ ID NO: 474951 - RNA, 32 nt, Human
gucugcccugggccucaguuucccucuuaacg

SEQ ID NO: 474952 - RNA, 32 nt, Human
gucugcccuucaggagcucgcagcuggugugc

SEQ ID NO: 474953 - RNA, 18 nt, Human
gucugccgggcacagugg

SEQ ID NO: 474954 - RNA, 32 nt, Human
gucugccgggggcccaggcugugcugucccug

SEQ ID NO: 474955 - RNA, 32 nt, Human
gucugccguccuggacuccaucaaggcccagc

SEQ ID NO: 474956 - RNA, 32 nt, Human
gucugccuaaacucagugucucuccuagaaaa

SEQ ID NO: 474957 - RNA, 23 nt, Human
gucugccuacuggguugacgcca

SEQ ID NO: 474958 - RNA, 23 nt, Human
gucugccuaggagcuggcuggca

SEQ ID NO: 474959 - RNA, 23 nt, Human
gucugccuaggucacugcugcca

SEQ ID NO: 474960 - RNA, 32 nt, Human
gucugccuagugagugagcaggagaacaucau

SEQ ID NO: 474961 - RNA, 32 nt, Human
gucugccuccaggacucugagccuucugccuc

SEQ ID NO: 474962 - RNA, 22 nt, Human
gucugccuccgcacggcuggca

SEQ ID NO: 474963 - RNA, 32 nt, Human
gucugccucuacugugucucacaucaccaugu

SEQ ID NO: 474964 - RNA, 32 nt, Human
gucugccucuccucaaaugcugugugcugcaa

SEQ ID NO: 474965 - RNA, 32 nt, Human
gucugccucugccucugccucacccugcuggc

SEQ ID NO: 474966 - RNA, 32 nt, Human
gucugccucuguggauccacagccuggcagag

SEQ ID NO: 474967 - RNA, 32 nt, Human
gucugccugcagcaguacuacugucaacauag

SEQ ID NO: 474968 - RNA, 24 nt, Human
gucugccugcccagccaugcucca

SEQ ID NO: 474969 - RNA, 32 nt, Human
gucugccugccugagccucccaaagugcuggg

SEQ ID NO: 474970 - RNA, 32 nt, Human
gucugccugccugggccacccuuccugccugg

SEQ ID NO: 474971 - RNA, 32 nt, Human
gucugccugccuggggcauuccaggcuucgac

SEQ ID NO: 474972 - RNA, 32 nt, Human
gucugccugccuguuucugucugggugucuga

SEQ ID NO: 474973 - RNA, 20 nt, Human
gucugccugcgagggcugcc

SEQ ID NO: 474974 - RNA, 32 nt, Human
gucugccugcgguccuuccuccggccagagug

SEQ ID NO: 474975 - RNA, 32 nt, Human
gucugccugcugcugugcgguagcuccagaac

SEQ ID NO: 474976 - RNA, 32 nt, Human
gucugccuguggucccagcuacucgggaggcu

SEQ ID NO: 474977 - RNA, 32 nt, Human
gucugccuguucuccccucgucgguggcuaag

SEQ ID NO: 474978 - RNA, 32 nt, Human
gucugccuuccagguugaagagguucuccugc

SEQ ID NO: 474979 - RNA, 32 nt, Human
gucugccuugugaagguggcaggggccagguc

SEQ ID NO: 474980 - RNA, 32 nt, Human
gucugccuuucaaccaugccccugucccuggg

SEQ ID NO: 474981 - RNA, 32 nt, Human
gucugccuuucuguuuggcuucaguccuuaaa

SEQ ID NO: 474982 - RNA, 32 nt, Human
gucugccuuugagggcuugggcagcagcggca

SEQ ID NO: 474983 - RNA, 23 nt, Human
gucugccuuugcugccacugcca

SEQ ID NO: 474984 - RNA, 32 nt, Human
gucugcggcacaaccucucuugccuggugucg

SEQ ID NO: 474985 - RNA, 32 nt, Human
gucugcggccucuccaguccaaagcugcuccu

SEQ ID NO: 474986 - RNA, 32 nt, Human
gucugcgggagaaagaggagaaucacccaagc

SEQ ID NO: 474987 - RNA, 32 nt, Human
gucugcgggagaaagaggagaaucgcccaagc

SEQ ID NO: 474988 - RNA, 32 nt, Human
gucugcgggaggcggguuauggcggcggcggc

SEQ ID NO: 474989 - RNA, 32 nt, Human
gucugcgggcugggaacucucguccucggucc

SEQ ID NO: 474990 - RNA, 32 nt, Human
gucugcggggacugaggcauggcagggaaacu

SEQ ID NO: 474991 - RNA, 32 nt, Human
gucugcguccaauacacgcgugugcuccucuc

SEQ ID NO: 474992 - RNA, 32 nt, Human
gucugcuaaccaauuccagucugguccaugaa

SEQ ID NO: 474993 - RNA, 32 nt, Human
gucugcuagagcagugccaucugggucuggau

SEQ ID NO: 474994 - RNA, 32 nt, Human
gucugcuagaggcagaggaagaagggugagga

SEQ ID NO: 474995 - RNA, 32 nt, Human
gucugcucaagccucaggaucuggagaugcag

SEQ ID NO: 474996 - RNA, 32 nt, Human
gucugcucccucuccacucucuucucaaaugg

SEQ ID NO: 474997 - RNA, 32 nt, Human
gucugcuccugccuccuccaggcaaugagcac

SEQ ID NO: 474998 - RNA, 32 nt, Human
gucugcuccuucagccuccuugcucuuguugg

SEQ ID NO: 474999 - RNA, 32 nt, Human
gucugcucuccuccuuuuugguuugguuuugg

SEQ ID NO: 475000 - RNA, 32 nt, Human
gucugcucuccucucucuuccaacacagccca

SEQ ID NO: 475001 - RNA, 32 nt, Human
gucugcucugcagguucuucauacagcugccu

SEQ ID NO: 475002 - RNA, 32 nt, Human
gucugcucuucacccagcaccacagaggcacc

SEQ ID NO: 475003 - RNA, 32 nt, Human
gucugcucuuucccuccccauccucuggcaga

SEQ ID NO: 475004 - RNA, 32 nt, Human
gucugcugagcggcgcugugaccugcggccug

SEQ ID NO: 475005 - RNA, 31 nt, Human
gucugcugaugucucccuuuagucacgaggg

SEQ ID NO: 475006 - RNA, 32 nt, Human
gucugcugcaggccuccucccugcugccccaa

SEQ ID NO: 475007 - RNA, 32 nt, Human
gucugcugcaguaaaacacagaaggcuuuaaa

SEQ ID NO: 475008 - RNA, 32 nt, Human
gucugcugcauacuugacuagccuggacucca

SEQ ID NO: 475009 - RNA, 32 nt, Human
gucugcugccucuccaguccaaagcugcgccu

SEQ ID NO: 475010 - RNA, 32 nt, Human
gucugcugccuugguaauucuugguguggccu

SEQ ID NO: 475011 - RNA, 19 nt, Human
gucugcugcugccugggga

SEQ ID NO: 475012 - RNA, 23 nt, Human
gucugcugcuuugcucuuucaaa

SEQ ID NO: 475013 - RNA, 32 nt, Human
gucugcuggaagaguuuaucagcuggauaaug

SEQ ID NO: 475014 - RNA, 23 nt, Human
gucugcugggcaggccucgggga

SEQ ID NO: 475015 - RNA, 32 nt, Human
gucugcugguggucugcuuaccacagaauccu

SEQ ID NO: 475016 - RNA, 32 nt, Human
gucugcugucagccccuccuggugcuggugcc

SEQ ID NO: 475017 - RNA, 32 nt, Human
gucugcugucuuuucucccacagagcucuuga

SEQ ID NO: 475018 - RNA, 32 nt, Human
gucugcugugaaaggccagcucucggcagccc

SEQ ID NO: 475019 - RNA, 32 nt, Human
gucugcugugcccugaccacaggcugcuucau

SEQ ID NO: 475020 - RNA, 32 nt, Human
gucugcuucauacuuuuuccuaggcuuggcac

SEQ ID NO: 475021 - RNA, 32 nt, Human
gucugcuuccaaguucuuccaacugggcauau

SEQ ID NO: 475022 - RNA, 32 nt, Human
gucugcuucccaacugcaucccccacccagcu

SEQ ID NO: 475023 - RNA, 31 nt, Human
gucugcuugaacucugggcuuggugcagagu

SEQ ID NO: 475024 - RNA, 32 nt, Human
gucugcuuucuuucuccuucuacuaugcugga

SEQ ID NO: 475025 - RNA, 32 nt, Human
gucugcuuugcaauagcaaagacuuggaacca

SEQ ID NO: 475026 - RNA, 32 nt, Human
gucugcuuugucagaggccagaauucugacuu

SEQ ID NO: 475027 - RNA, 32 nt, Human
gucuggaaaauagaagaguguguugggcaggu

SEQ ID NO: 475028 - RNA, 32 nt, Human
gucuggaaaugaaguacagagagcaaggcucc

SEQ ID NO: 475029 - RNA, 22 nt, Human
gucuggaacagcaagcucgaga

SEQ ID NO: 475030 - RNA, 32 nt, Human
gucuggaacuccugggcucaagcaauccuccc

SEQ ID NO: 475031 - RNA, 32 nt, Human
gucuggaagaagaggaggaagacucuggagcc

SEQ ID NO: 475032 - RNA, 17 nt, Human
gucuggaagacccaagg

SEQ ID NO: 475033 - RNA, 32 nt, Human
gucuggaagaugaccacugacuccuacucucc

SEQ ID NO: 475034 - RNA, 32 nt, Human
gucuggaagcauccugugcugugcacaccugc

SEQ ID NO: 475035 - RNA, 32 nt, Human
gucuggaaguggugggaggcagcuguggugca

SEQ ID NO: 475036 - RNA, 32 nt, Human
gucuggacugcggaggccggggcgguggcgug

SEQ ID NO: 475037 - RNA, 32 nt, Human
gucuggacuuugcuuccccuccaggagggacc

SEQ ID NO: 475038 - RNA, 32 nt, Human
gucuggagacguucccucugcccagguggggg

SEQ ID NO: 475039 - RNA, 24 nt, Human
gucuggagagccaugaagagggaa

SEQ ID NO: 475040 - RNA, 32 nt, Human
gucuggagaggauuuugugugaaaguaaaugg

SEQ ID NO: 475041 - RNA, 32 nt, Human
gucuggagagucucuucagaccuccaauaaaa

SEQ ID NO: 475042 - RNA, 32 nt, Human
gucuggagcaguggggcacaccccggaggagg

SEQ ID NO: 475043 - RNA, 32 nt, Human
gucuggagccugaauucauuuggaagaguuag

SEQ ID NO: 475044 - RNA, 32 nt, Human
gucuggagccuggcuacucugcauuugggauu

SEQ ID NO: 475045 - RNA, 32 nt, Human
gucuggagccugggagccuccugaagucccgg

SEQ ID NO: 475046 - RNA, 32 nt, Human
gucuggagcgaauuccagccugcagggcugau

SEQ ID NO: 475047 - RNA, 19 nt, Human
gucuggagcucacccaagg

SEQ ID NO: 475048 - RNA, 23 nt, Human
gucuggagcuggggaaagaggaa

SEQ ID NO: 475049 - RNA, 32 nt, Human
gucuggaggaggggacaugaggugagagguau

SEQ ID NO: 475050 - RNA, 32 nt, Human
gucuggaggcagcagggaugcugcugggaguc

SEQ ID NO: 475051 - RNA, 32 nt, Human
gucuggaguccgugagacugaaaggacccgug

SEQ ID NO: 475052 - RNA, 32 nt, Human
gucuggaguggaccuccagcaaacuccagcag

SEQ ID NO: 475053 - RNA, 32 nt, Human
gucuggagugggauaggagcagugagugacaa

SEQ ID NO: 475054 - RNA, 32 nt, Human
gucuggaguuccacgguguggugggccagagg

SEQ ID NO: 475055 - RNA, 32 nt, Human
gucuggaguuguuuccuucugguggguucaug

SEQ ID NO: 475056 - RNA, 19 nt, Human
gucuggauacaggcucccu

SEQ ID NO: 475057 - RNA, 32 nt, Human
gucuggauccugcgacagggaggcccuggacu

SEQ ID NO: 475058 - RNA, 32 nt, Human
gucuggaucuguggugagaugggggaaguggg

SEQ ID NO: 475059 - RNA, 32 nt, Human
gucuggauuucuaacaguccuugcuucggggc

SEQ ID NO: 475060 - RNA, 32 nt, Human
gucuggcaacuaugaaccuaauggugcccuaa

SEQ ID NO: 475061 - RNA, 32 nt, Human
gucuggcaagggacaggaagcugauagaaagu

SEQ ID NO: 475062 - RNA, 32 nt, Human
gucuggcacacaguaggugcucauuggcuccc

SEQ ID NO: 475063 - RNA, 32 nt, Human
gucuggcacauccuuaauccugugccccugcc

SEQ ID NO: 475064 - RNA, 32 nt, Human
gucuggcagagcugacaccaggauucaguggg

SEQ ID NO: 475065 - RNA, 32 nt, Human
gucuggcagagcuggugugagacgagacaauc

SEQ ID NO: 475066 - RNA, 32 nt, Human
gucuggcagccuggauauccucuccuaccggc

SEQ ID NO: 475067 - RNA, 32 nt, Human
gucuggcagcguggggagagggaccaaccgac

SEQ ID NO: 475068 - RNA, 27 nt, Human
gucuggcagggcugguguggggugcag

SEQ ID NO: 475069 - RNA, 32 nt, Human
gucuggcaggugggggaaugagaugagaaagu

SEQ ID NO: 475070 - RNA, 32 nt, Human
gucuggccaggguugacuugagcugagacacc

SEQ ID NO: 475071 - RNA, 32 nt, Human
gucuggcccaaucucugugucaucauugucau

SEQ ID NO: 475072 - RNA, 19 nt, Human
gucuggcccacauuuucaa

SEQ ID NO: 475073 - RNA, 19 nt, Human
gucuggcccaguucagaga

SEQ ID NO: 475074 - RNA, 32 nt, Human
gucuggccccacccuggagucuugccucacag

SEQ ID NO: 475075 - RNA, 32 nt, Human
gucuggcccuccugcugcagcuggauucucug

SEQ ID NO: 475076 - RNA, 32 nt, Human
gucuggccgggacuugggccuggguggcuuuu

SEQ ID NO: 475077 - RNA, 32 nt, Human
gucuggccuccagggaccuagagaaugggagg

SEQ ID NO: 475078 - RNA, 32 nt, Human
gucuggccucuacaacaaguuuugcauuguag

SEQ ID NO: 475079 - RNA, 32 nt, Human
gucuggccucuuucacucagcacaauucuuuu

SEQ ID NO: 475080 - RNA, 32 nt, Human
gucuggccugggaacacugcgccuuagacaac

SEQ ID NO: 475081 - RNA, 32 nt, Human
gucuggccuuggccuccagccuggagaagggc

SEQ ID NO: 475082 - RNA, 32 nt, Human
gucuggccuuggggcucuaaguugaccucucu

SEQ ID NO: 475083 - RNA, 32 nt, Human
gucuggcggggaacagggaccaagagacaaca

SEQ ID NO: 475084 - RNA, 20 nt, Human
gucuggcucagcagcccccu

SEQ ID NO: 475085 - RNA, 32 nt, Human
gucuggcucuacugaugauggauaggccccuu

SEQ ID NO: 475086 - RNA, 32 nt, Human
gucuggcucugucccccaccucuuggccagcc

SEQ ID NO: 475087 - RNA, 18 nt, Human
gucuggcugaacugcaga

SEQ ID NO: 475088 - RNA, 32 nt, Human
gucuggcugccugggaugcccccugcccccuc

SEQ ID NO: 475089 - RNA, 23 nt, Human
gucuggcugcuguggcauugugu

SEQ ID NO: 475090 - RNA, 21 nt, Human
gucuggcugucaacugacaaa

SEQ ID NO: 475091 - RNA, 32 nt, Human
gucuggcugucaccuucacaagccacagaaac

SEQ ID NO: 475092 - RNA, 32 nt, Human
gucuggcuucugcaggggaaauuucaaggcca

SEQ ID NO: 475093 - RNA, 32 nt, Human
gucuggcuugcccaggcuggagugcgguggcu

SEQ ID NO: 475094 - RNA, 21 nt, Human
gucuggcuugcugaguguaaa

SEQ ID NO: 475095 - RNA, 32 nt, Human
gucuggcuugggagaugcuuucagguugcagc

SEQ ID NO: 475096 - RNA, 32 nt, Human
gucugggaagauuuugaaaacaggacaaagaa

SEQ ID NO: 475097 - RNA, 32 nt, Human
gucugggaagcauauggaccagugggaaggau

SEQ ID NO: 475098 - RNA, 20 nt, Human
gucugggaagugaaguucua

SEQ ID NO: 475099 - RNA, 32 nt, Human
gucugggacagacugcuccugacagaaggaug

SEQ ID NO: 475100 - RNA, 32 nt, Human
gucugggacagugccaagagugggguguguga

SEQ ID NO: 475101 - RNA, 21 nt, Human
gucugggaccuccuucuuccc

SEQ ID NO: 475102 - RNA, 32 nt, Human
gucugggaccugccuccaccccauccagggau

SEQ ID NO: 475103 - RNA, 32 nt, Human
gucugggagaaggaggcuacagugagcugugc

SEQ ID NO: 475104 - RNA, 32 nt, Human
gucugggaggcggagguugcagugagcugaga

SEQ ID NO: 475105 - RNA, 32 nt, Human
gucugggagggcaugggagcagugagcaggcc

SEQ ID NO: 475106 - RNA, 32 nt, Human
gucugggagguggaggcugcagugagccguga

SEQ ID NO: 475107 - RNA, 32 nt, Human
gucugggagguugaggcugcagugagcuguga

SEQ ID NO: 475108 - RNA, 32 nt, Human
gucugggagugagcaccaugcccaucacccag

SEQ ID NO: 475109 - RNA, 23 nt, Human
gucugggagugggguggggaggc

SEQ ID NO: 475110 - RNA, 32 nt, Human
gucugggauaagagguuaaugaauaucucaua

SEQ ID NO: 475111 - RNA, 32 nt, Human
gucugggaucuguucuggaacggaagccaacc

SEQ ID NO: 475112 - RNA, 28 nt, Human
gucugggcaagugcucccucacucccuu

SEQ ID NO: 475113 - RNA, 32 nt, Human
gucugggcacacacgagcagguggcaucuugg

SEQ ID NO: 475114 - RNA, 32 nt, Human
gucugggcacuggaugcaugaauuccacuccu

SEQ ID NO: 475115 - RNA, 32 nt, Human
gucugggcaggccacuuuuggaaguaggcguu

SEQ ID NO: 475116 - RNA, 32 nt, Human
gucugggcagucccuccucuccccagugucca

SEQ ID NO: 475117 - RNA, 32 nt, Human
gucugggccaacccuuccaugggugaagacaa

SEQ ID NO: 475118 - RNA, 32 nt, Human
gucugggccaagcacgaagcccuuucccaccc

SEQ ID NO: 475119 - RNA, 32 nt, Human
gucugggcccacccuucacaacugccuuucaa

SEQ ID NO: 475120 - RNA, 32 nt, Human
gucugggcccagccaguguggcuccaggugcc

SEQ ID NO: 475121 - RNA, 22 nt, Human
gucugggcccuagcgacgcccc

SEQ ID NO: 475122 - RNA, 18 nt, Human
gucugggcccugcucccu

SEQ ID NO: 475123 - RNA, 32 nt, Human
gucugggccgcuccaguguuuuggggcacaga

SEQ ID NO: 475124 - RNA, 19 nt, Human
gucugggccuguggcuccc

SEQ ID NO: 475125 - RNA, 32 nt, Human
gucugggcucacugcaaccucugccucccggg

SEQ ID NO: 475126 - RNA, 32 nt, Human
gucugggcuccagccagagaacaaucuuuuau

SEQ ID NO: 475127 - RNA, 32 nt, Human
gucugggcuccaggaguggaggcuggucuggg

SEQ ID NO: 475128 - RNA, 32 nt, Human
gucugggcucucauuacccaaacaucugagau

SEQ ID NO: 475129 - RNA, 32 nt, Human
gucugggcugagccggagggaggcgggaggac

SEQ ID NO: 475130 - RNA, 32 nt, Human
gucugggcugcagggacauugcagugucccau

SEQ ID NO: 475131 - RNA, 32 nt, Human
gucugggcuggagcgcaguccccagcuagcgu

SEQ ID NO: 475132 - RNA, 32 nt, Human
gucugggcugggacggacaggagaggcugucg

SEQ ID NO: 475133 - RNA, 32 nt, Human
gucugggcuguaauguggcacuggugggcugg

SEQ ID NO: 475134 - RNA, 32 nt, Human
gucugggcuguuuuugaaaaaguuuccauuaa

SEQ ID NO: 475135 - RNA, 20 nt, Human
gucuggggaagagaacccca

SEQ ID NO: 475136 - RNA, 32 nt, Human
gucuggggagagaaaagguggccaggauccua

SEQ ID NO: 475137 - RNA, 32 nt, Human
gucuggggagagagcuacaccuccccaggccc

SEQ ID NO: 475138 - RNA, 32 nt, Human
gucuggggagaggccuggggaggcgugguaug

SEQ ID NO: 475139 - RNA, 32 nt, Human
gucuggggaggacauugaacaggcugggcuga

SEQ ID NO: 475140 - RNA, 32 nt, Human
gucuggggaggcacauuuaugcacuuuguauc

SEQ ID NO: 475141 - RNA, 32 nt, Human
gucuggggcaccagguggagaccauggcagcc

SEQ ID NO: 475142 - RNA, 32 nt, Human
gucuggggcacucugcagguucugccuuugag

SEQ ID NO: 475143 - RNA, 16 nt, Human
gucuggggcaggggga

SEQ ID NO: 475144 - RNA, 32 nt, Human
gucuggggcagguggggcuggggaagggagca

SEQ ID NO: 475145 - RNA, 21 nt, Human
gucuggggccaggggagccca

SEQ ID NO: 475146 - RNA, 32 nt, Human
gucuggggccugauucucaggaaugccagugg

SEQ ID NO: 475147 - RNA, 32 nt, Human
gucuggggcucaggcuggugugggaugcagcc

SEQ ID NO: 475148 - RNA, 32 nt, Human
gucuggggcuccagggcuggacaugcagacag

SEQ ID NO: 475149 - RNA, 32 nt, Human
gucugggggaggaggagagaaggaaggggugg

SEQ ID NO: 475150 - RNA, 32 nt, Human
gucugggggccagaccaccccauuguccaucc

SEQ ID NO: 475151 - RNA, 32 nt, Human
gucugggggccagcggcagcgggucagucugg

SEQ ID NO: 475152 - RNA, 32 nt, Human
gucugggggccuggaguuuguauuugauuugc

SEQ ID NO: 475153 - RNA, 32 nt, Human
gucugggggcuggagucuggugguggcaagga

SEQ ID NO: 475154 - RNA, 32 nt, Human
gucugggggcugggcagcuaagaaaauuucuu

SEQ ID NO: 475155 - RNA, 32 nt, Human
gucuggggguugggacuggacccccugauugc

SEQ ID NO: 475156 - RNA, 32 nt, Human
gucuggggucacccucuccagcaagagaaccc

SEQ ID NO: 475157 - RNA, 32 nt, Human
gucuggggucagcaggagugagagcacugacc

SEQ ID NO: 475158 - RNA, 32 nt, Human
gucuggggucuggcugcugccugcuucuugcu

SEQ ID NO: 475159 - RNA, 32 nt, Human
gucugggguuaguguuuuacaaggucauuaca

SEQ ID NO: 475160 - RNA, 22 nt, Human
gucugggguuccuuuccuuucc

SEQ ID NO: 475161 - RNA, 32 nt, Human
gucugggucacuuuggaaacaggaauccucuc

SEQ ID NO: 475162 - RNA, 20 nt, Human
gucuggguccauccugguca

SEQ ID NO: 475163 - RNA, 32 nt, Human
gucugggucugcugccgaaacacugcccccag

SEQ ID NO: 475164 - RNA, 23 nt, Human
gucugggugccccuuuuccuccc

SEQ ID NO: 475165 - RNA, 32 nt, Human
gucuggguggggcuggagucuccacccucuga

SEQ ID NO: 475166 - RNA, 32 nt, Human
gucuggguggguuaugggaugugggcaucccu

SEQ ID NO: 475167 - RNA, 32 nt, Human
gucuggguucacucccugucaugacguccgcc

SEQ ID NO: 475168 - RNA, 32 nt, Human
gucuggguuccagggcugcugucuccuggcua

SEQ ID NO: 475169 - RNA, 32 nt, Human
gucuggguuugaggacaggggagugggaaaac

SEQ ID NO: 475170 - RNA, 32 nt, Human
gucugguagaaaccauauuuugguuaacagca

SEQ ID NO: 475171 - RNA, 32 nt, Human
gucugguagccuugcuccagaagccuguuccu

SEQ ID NO: 475172 - RNA, 32 nt, Human
gucugguaggagagagugcugcagagccacgu

SEQ ID NO: 475173 - RNA, 32 nt, Human
gucugguaggggugcuaggaccagccucgccu

SEQ ID NO: 475174 - RNA, 32 nt, Human
gucugguaucaggaccaaagcauuuuauucgc

SEQ ID NO: 475175 - RNA, 20 nt, Human
gucuggucagagccacaggg

SEQ ID NO: 475176 - RNA, 32 nt, Human
gucuggucagcauauguguauguaugcguaug

SEQ ID NO: 475177 - RNA, 32 nt, Human
gucuggucaggcaaugcccugcggcucuggaa

SEQ ID NO: 475178 - RNA, 32 nt, Human
gucugguccuccugcguguccuccccuccacu

SEQ ID NO: 475179 - RNA, 32 nt, Human
gucugguccucugagccccagugagaguuucc

SEQ ID NO: 475180 - RNA, 32 nt, Human
gucugguccuucaucccucccgcuucaccaga

SEQ ID NO: 475181 - RNA, 20 nt, Human
gucugguccuuuuccuuccc

SEQ ID NO: 475182 - RNA, 32 nt, Human
gucuggucgcagagacaggaacguguaauccu

SEQ ID NO: 475183 - RNA, 32 nt, Human
gucuggucucaaacucccaaccucaggugaua

SEQ ID NO: 475184 - RNA, 32 nt, Human
gucuggucucaaacucccgaccucaggugauc

SEQ ID NO: 475185 - RNA, 32 nt, Human
gucuggucucagaaucacuuuucccaucugua

SEQ ID NO: 475186 - RNA, 32 nt, Human
gucuggucugagucugccccagggagaaagaa

SEQ ID NO: 475187 - RNA, 32 nt, Human
gucuggucugugcagaaguggggagugauggg

SEQ ID NO: 475188 - RNA, 32 nt, Human
gucuggucuuccucucuucugaaacucugcca

SEQ ID NO: 475189 - RNA, 32 nt, Human
gucuggugccaccgucccucugcagauacacu

SEQ ID NO: 475190 - RNA, 21 nt, Human
gucuggugggaggaaagggaa

SEQ ID NO: 475191 - RNA, 32 nt, Human
gucugguguguguggugggcacacauagaaca

SEQ ID NO: 475192 - RNA, 32 nt, Human
gucugguuaauacccaaaggcucucgacaugu

SEQ ID NO: 475193 - RNA, 32 nt, Human
gucugguuccugcugucugcagccagguaucu

SEQ ID NO: 475194 - RNA, 32 nt, Human
gucugguuccugugugacccugggcaguuccu

SEQ ID NO: 475195 - RNA, 32 nt, Human
gucugguugcaauguuuugcucccagaagaga

SEQ ID NO: 475196 - RNA, 32 nt, Human
gucugguugugccaggaaaacagauguuauau

SEQ ID NO: 475197 - RNA, 32 nt, Human
gucugguuuagaugagauucugguuuuuggac

SEQ ID NO: 475198 - RNA, 32 nt, Human
gucugguuugugucuguguucauguuuguuua

SEQ ID NO: 475199 - RNA, 32 nt, Human
gucugguuuucacgcccucuagccccuacccc

SEQ ID NO: 475200 - RNA, 32 nt, Human
gucuguaagcaaccacaagcccugccacuggg

SEQ ID NO: 475201 - RNA, 32 nt, Human
gucuguaagcugcagugucugugauucugugu

SEQ ID NO: 475202 - RNA, 32 nt, Human
gucuguaaguucuuaaagaaccagcuucuuag

SEQ ID NO: 475203 - RNA, 32 nt, Human
gucuguaauauacacacacauauacauuugaa

SEQ ID NO: 475204 - RNA, 32 nt, Human
gucuguacaggcugcuacagcaaaauaccaua

SEQ ID NO: 475205 - RNA, 22 nt, Human
gucuguacccccacuccauccc

SEQ ID NO: 475206 - RNA, 21 nt, Human
gucuguacuaaaaauacaaaa

SEQ ID NO: 475207 - RNA, 22 nt, Human
gucuguacuaaaaauacaaaau

SEQ ID NO: 475208 - RNA, 23 nt, Human
gucuguacucccuuuuccuuccc

SEQ ID NO: 475209 - RNA, 32 nt, Human
gucuguagccuggaggggcuugaguggauggg

SEQ ID NO: 475210 - RNA, 21 nt, Human
gucuguagcuauuuuccuccc

SEQ ID NO: 475211 - RNA, 18 nt, Human
gucuguagggccaagcag

SEQ ID NO: 475212 - RNA, 32 nt, Human
gucuguagggcugggacagggaaggaagucag

SEQ ID NO: 475213 - RNA, 32 nt, Human
gucuguaucauguguuuacgugccaucaugaa

SEQ ID NO: 475214 - RNA, 32 nt, Human
gucuguauccagacaucuaugugcuuggacaa

SEQ ID NO: 475215 - RNA, 23 nt, Human
gucuguauguagcagggcucccu

SEQ ID NO: 475216 - RNA, 21 nt, Human
gucuguauuaauccccauccc

SEQ ID NO: 475217 - RNA, 32 nt, Human
gucugucaagccuugaggacacccacgaaugg

SEQ ID NO: 475218 - RNA, 32 nt, Human
gucugucacccaggcuggaguacaguggcaug

SEQ ID NO: 475219 - RNA, 32 nt, Human
gucugucacccaggcuggagugaucucagcuc

SEQ ID NO: 475220 - RNA, 32 nt, Human
gucugucacccaggcuggagugcaguggcgug

SEQ ID NO: 475221 - RNA, 32 nt, Human
gucugucacccaggcuggagugcaguggugca

SEQ ID NO: 475222 - RNA, 32 nt, Human
gucugucacccagguuggagugcaguggcgug

SEQ ID NO: 475223 - RNA, 32 nt, Human
gucugucaccuccucgcugugugaucuugaga

SEQ ID NO: 475224 - RNA, 32 nt, Human
gucugucacuggcuuguuuguucccuaccaau

SEQ ID NO: 475225 - RNA, 32 nt, Human
gucugucaucucagucuggaguaaaugcagug

SEQ ID NO: 475226 - RNA, 32 nt, Human
gucuguccagaggcugacguagacagugaagg

SEQ ID NO: 475227 - RNA, 32 nt, Human
gucuguccauggcuccuuaucacauccgcaaa

SEQ ID NO: 475228 - RNA, 32 nt, Human
gucuguccccuucggaggagaugauguagagg

SEQ ID NO: 475229 - RNA, 32 nt, Human
gucugucccuccggccgguccccagcugcagu

SEQ ID NO: 475230 - RNA, 32 nt, Human
gucugucccugacuucugccucugagauuguc

SEQ ID NO: 475231 - RNA, 32 nt, Human
gucuguccuaaagggaagugggcgcuggauuu

SEQ ID NO: 475232 - RNA, 32 nt, Human
gucuguccuaaagggaagugggugcuggauuu

SEQ ID NO: 475233 - RNA, 32 nt, Human
gucuguccucaccggcuuagugaucacgaaug

SEQ ID NO: 475234 - RNA, 32 nt, Human
gucuguccugcucugcucccugcagggcuggu

SEQ ID NO: 475235 - RNA, 32 nt, Human
gucuguccuuguucuccuccagguggagcugc

SEQ ID NO: 475236 - RNA, 32 nt, Human
gucugucgcccaggcuggagugcaguagcacg

SEQ ID NO: 475237 - RNA, 21 nt, Human
gucugucuaauacaugccaga

SEQ ID NO: 475238 - RNA, 32 nt, Human
gucugucuccaccccauccccucuugucucug

SEQ ID NO: 475239 - RNA, 32 nt, Human
gucugucuccauccuucccucuccuuuucugu

SEQ ID NO: 475240 - RNA, 32 nt, Human
gucugucuccgucauggggagggucccugcuc

SEQ ID NO: 475241 - RNA, 32 nt, Human
gucugucucugucacccaggcuggagugcagu

SEQ ID NO: 475242 - RNA, 32 nt, Human
gucugucucuuuucuucucuucaaaaacuuug

SEQ ID NO: 475243 - RNA, 32 nt, Human
gucugucugcagcgaguugauaugagaguuua

SEQ ID NO: 475244 - RNA, 32 nt, Human
gucugucugggaggccuuaggcaaguuugauc

SEQ ID NO: 475245 - RNA, 32 nt, Human
gucugucugguccauagcugugguguaggggc

SEQ ID NO: 475246 - RNA, 32 nt, Human
gucugucugucauuuucccuuccuaccccaac

SEQ ID NO: 475247 - RNA, 32 nt, Human
gucugucugucccaaagaaguucugguaugaa

SEQ ID NO: 475248 - RNA, 32 nt, Human
gucugucuguccuuguccuuguggugauccug

SEQ ID NO: 475249 - RNA, 21 nt, Human
gucugucugucuguccuuccc

SEQ ID NO: 475250 - RNA, 32 nt, Human
gucugucugucuguccuuguccuuguggugau

SEQ ID NO: 475251 - RNA, 32 nt, Human
gucugucugucugucugucuaucuaucuaucu

SEQ ID NO: 475252 - RNA, 32 nt, Human
gucugucugucugucugucugucuaucuaucu

SEQ ID NO: 475253 - RNA, 32 nt, Human
gucugucugucugucugucugucugucuaucu

SEQ ID NO: 475254 - RNA, 32 nt, Human
gucugucugucugucugucugucugucugucu

SEQ ID NO: 475255 - RNA, 32 nt, Human
gucugugaaauuaggcacacaugugagcucag

SEQ ID NO: 475256 - RNA, 32 nt, Human
gucugugacaaccuggccagacauagggcuca

SEQ ID NO: 475257 - RNA, 32 nt, Human
gucugugacuguccacuucccuucccccagag

SEQ ID NO: 475258 - RNA, 28 nt, Human
gucugugacuuagcugcagacuaggaga

SEQ ID NO: 475259 - RNA, 32 nt, Human
gucugugagagcgcgggagugcauggcagcuc

SEQ ID NO: 475260 - RNA, 24 nt, Human
gucugugagagucaauucagggga

SEQ ID NO: 475261 - RNA, 32 nt, Human
gucugugaggaggcaggagcuggggaguggga

SEQ ID NO: 475262 - RNA, 32 nt, Human
gucugugaggggagagcagagagcagaaccug

SEQ ID NO: 475263 - RNA, 32 nt, Human
gucugugagggugggcuggcaggaggccuagg

SEQ ID NO: 475264 - RNA, 21 nt, Human
gucugugaguaaaacuggggg

SEQ ID NO: 475265 - RNA, 32 nt, Human
gucugugagugggaagagacuggaguguagau

SEQ ID NO: 475266 - RNA, 21 nt, Human
gucugugaguuuauuuggaga

SEQ ID NO: 475267 - RNA, 32 nt, Human
gucugugaguuucuuagguauuagcaaucuug

SEQ ID NO: 475268 - RNA, 32 nt, Human
gucugugauucugcugauggucuucagugccu

SEQ ID NO: 475269 - RNA, 32 nt, Human
gucugugcaaagugccugagugucugcuuuca

SEQ ID NO: 475270 - RNA, 32 nt, Human
gucugugcagagcugaggcccgggcgcuggcu

SEQ ID NO: 475271 - RNA, 32 nt, Human
gucugugcagccuuacacucugucuuuacaga

SEQ ID NO: 475272 - RNA, 32 nt, Human
gucugugcaguuggagagauuuaaaggauuuu

SEQ ID NO: 475273 - RNA, 23 nt, Human
gucugugcauccacugugccgug

SEQ ID NO: 475274 - RNA, 31 nt, Human
gucugugcauucaugcaucuaccucauuccg

SEQ ID NO: 475275 - RNA, 32 nt, Human
gucugugccacaucugacacuggaguagcgau

SEQ ID NO: 475276 - RNA, 32 nt, Human
gucugugccaugaccuucaugauaccagugag

SEQ ID NO: 475277 - RNA, 32 nt, Human
gucugugcgggaaucagcucugcaguuguguc

SEQ ID NO: 475278 - RNA, 20 nt, Human
gucugugcguccugcaccca

SEQ ID NO: 475279 - RNA, 32 nt, Human
gucugugcgugagacuccuucgauuguagcuc

SEQ ID NO: 475280 - RNA, 32 nt, Human
gucugugcguggaaagacuggcugucuuccuc

SEQ ID NO: 475281 - RNA, 32 nt, Human
gucugugcuacugaaaucuaacuuuuuacaaa

SEQ ID NO: 475282 - RNA, 32 nt, Human
gucugugcuguccagcauagcagccacaagcc

SEQ ID NO: 475283 - RNA, 32 nt, Human
gucugugcuuucuaagauaagagcuugauccc

SEQ ID NO: 475284 - RNA, 32 nt, Human
gucuguggaagacauggcccgguggggcccca

SEQ ID NO: 475285 - RNA, 32 nt, Human
gucuguggauggacaugaucagugcuaaggaa

SEQ ID NO: 475286 - RNA, 20 nt, Human
gucuguggcacagcaccaag

SEQ ID NO: 475287 - RNA, 23 nt, Human
gucuguggcucucauuccuuccc

SEQ ID NO: 475288 - RNA, 32 nt, Human
gucuguggcugcauauuuugcaaaaccagaaa

SEQ ID NO: 475289 - RNA, 32 nt, Human
gucugugggaagagagagccaccuagcauguc

SEQ ID NO: 475290 - RNA, 32 nt, Human
gucugugggaggaacccggugggaggugauuu

SEQ ID NO: 475291 - RNA, 32 nt, Human
gucugugggcaggccgauuacuggaagggccg

SEQ ID NO: 475292 - RNA, 32 nt, Human
gucuguggggaccuguugaaggacuggggcag

SEQ ID NO: 475293 - RNA, 32 nt, Human
gucuguggggguuucucugccagcagggggcu

SEQ ID NO: 475294 - RNA, 32 nt, Human
gucuguggggucauuacccucugccuccugga

SEQ ID NO: 475295 - RNA, 24 nt, Human
gucuguggggugggguggggaagc

SEQ ID NO: 475296 - RNA, 32 nt, Human
gucuguguaccucugaauucaugagagaugaa

SEQ ID NO: 475297 - RNA, 32 nt, Human
gucuguguaugugugugucugugcgucugugu

SEQ ID NO: 475298 - RNA, 32 nt, Human
gucugugucacuaaucuuuccugcuuucagcg

SEQ ID NO: 475299 - RNA, 32 nt, Human
gucugugucagcccagcucugccucgcagccc

SEQ ID NO: 475300 - RNA, 32 nt, Human
gucugugucugggaacuaccugcccagcuguu

SEQ ID NO: 475301 - RNA, 32 nt, Human
gucugugucugugugugccuguaagugugaaa

SEQ ID NO: 475302 - RNA, 32 nt, Human
gucugugucugugugugccugugagccagcau

SEQ ID NO: 475303 - RNA, 21 nt, Human
gucugugugccccuccugccc

SEQ ID NO: 475304 - RNA, 32 nt, Human
gucuguguggcacccugugagcucaggcaucc

SEQ ID NO: 475305 - RNA, 18 nt, Human
gucugugugucccggcga

SEQ ID NO: 475306 - RNA, 32 nt, Human
gucugugugugccugugugcgagucugaguca

SEQ ID NO: 475307 - RNA, 24 nt, Human
gucuguguguucccguccccuccc

SEQ ID NO: 475308 - RNA, 32 nt, Human
gucuguguucugacucuuuggaaaagagcuua

SEQ ID NO: 475309 - RNA, 32 nt, Human
gucuguguugcaccuaggacugccauggcgga

SEQ ID NO: 475310 - RNA, 32 nt, Human
gucuguguugcuacaagacugcagcuuuggau

SEQ ID NO: 475311 - RNA, 32 nt, Human
gucuguguuggcacagaugaguaacugccaug

SEQ ID NO: 475312 - RNA, 16 nt, Human
gucuguguuguggagg

SEQ ID NO: 475313 - RNA, 32 nt, Human
gucuguguuucacccauugucuguguuuaguc

SEQ ID NO: 475314 - RNA, 31 nt, Human
gucuguuacacaugugaaaccaaagccugcu

SEQ ID NO: 475315 - RNA, 32 nt, Human
gucuguuaccaugacaaccagccgcugcaguc

SEQ ID NO: 475316 - RNA, 32 nt, Human
gucuguuacccaggcuggagugcaguggcaug

SEQ ID NO: 475317 - RNA, 32 nt, Human
gucuguuacuccugacccacuuuguuucauga

SEQ ID NO: 475318 - RNA, 18 nt, Human
gucuguuagccuuucaga

SEQ ID NO: 475319 - RNA, 32 nt, Human
gucuguucagcuggagaacacauucaaaucag

SEQ ID NO: 475320 - RNA, 32 nt, Human
gucuguuccagccuacauccuuccuggguguu

SEQ ID NO: 475321 - RNA, 32 nt, Human
gucuguuccuguucuucucccagccucugccc

SEQ ID NO: 475322 - RNA, 32 nt, Human
gucuguuccuucuaggcacuguauuuaacuaa

SEQ ID NO: 475323 - RNA, 32 nt, Human
gucuguucuaagccacaaccccugucucaggu

SEQ ID NO: 475324 - RNA, 32 nt, Human
gucuguucuggaggguggagagagacaccagu

SEQ ID NO: 475325 - RNA, 32 nt, Human
gucuguugaauucauuuguccaauuguauaac

SEQ ID NO: 475326 - RNA, 32 nt, Human
gucuguugaguuggccuggccauguccaagag

SEQ ID NO: 475327 - RNA, 32 nt, Human
gucuguugaucugccuuuuguucucccaaaau

SEQ ID NO: 475328 - RNA, 32 nt, Human
gucuguugcccaggcuggaaugcaguggugug

SEQ ID NO: 475329 - RNA, 32 nt, Human
gucuguugcccaggcuggagugcaguggcgcg

SEQ ID NO: 475330 - RNA, 32 nt, Human
gucuguugcccaggcuggagugcaguggugug

SEQ ID NO: 475331 - RNA, 32 nt, Human
gucuguugcccagguuggagugcaguggcggg

SEQ ID NO: 475332 - RNA, 32 nt, Human
gucuguugccuaggcgggagugcaguggcauc

SEQ ID NO: 475333 - RNA, 32 nt, Human
gucuguugcucaccucugucccuccagaacuc

SEQ ID NO: 475334 - RNA, 32 nt, Human
gucuguuggucuccauggccacuguggaccgg

SEQ ID NO: 475335 - RNA, 32 nt, Human
gucuguugucaaaccuaaauaucuuuguuuga

SEQ ID NO: 475336 - RNA, 32 nt, Human
gucuguuuaacuucugcagugccuucacuaca

SEQ ID NO: 475337 - RNA, 32 nt, Human
gucuguuuacuacccagaacucuuugggucag

SEQ ID NO: 475338 - RNA, 32 nt, Human
gucuguuucccaggcuggaguguagugauaca

SEQ ID NO: 475339 - RNA, 32 nt, Human
gucuguuucucccacuguccuuggcucagcuc

SEQ ID NO: 475340 - RNA, 32 nt, Human
gucuguuucuccccuagacucugggccuggcc

SEQ ID NO: 475341 - RNA, 32 nt, Human
gucuguuucugcuuccuuacacauagauauaa

SEQ ID NO: 475342 - RNA, 32 nt, Human
gucuguuuucccaaccuccugugggccucaag

SEQ ID NO: 475343 - RNA, 32 nt, Human
gucuguuuucuuaccugcaaauggcagguacu

SEQ ID NO: 475344 - RNA, 32 nt, Human
gucuguuuucuucgcugucauuuccuuaguag

SEQ ID NO: 475345 - RNA, 32 nt, Human
gucuguuuuguuaaugcagcugugccacaaau

SEQ ID NO: 475346 - RNA, 32 nt, Human
gucuguuuuuaucuccccucucaggaccaguc

SEQ ID NO: 475347 - RNA, 32 nt, Human
gucuuaaaauaggauguaaguguuacaucuug

SEQ ID NO: 475348 - RNA, 32 nt, Human
gucuuaaacuccuggccucaagcaauccuucu

SEQ ID NO: 475349 - RNA, 32 nt, Human
gucuuaaaggcagcacgucuggaguuguucgu

SEQ ID NO: 475350 - RNA, 32 nt, Human
gucuuaaccuggaagguggggcugucuuaucc

SEQ ID NO: 475351 - RNA, 32 nt, Human
gucuuaagcuguucuugcacggacucuuaagc

SEQ ID NO: 475352 - RNA, 32 nt, Human
gucuuaagcuguucuugcauaggcucuuaagc

SEQ ID NO: 475353 - RNA, 32 nt, Human
gucuuaagcuguucuugcaugggcucuuaagc

SEQ ID NO: 475354 - RNA, 32 nt, Human
gucuuaaggaagaggaaguaggagagcacguu

SEQ ID NO: 475355 - RNA, 32 nt, Human
gucuuaaggacacgucuccaugauauuuuggu

SEQ ID NO: 475356 - RNA, 32 nt, Human
gucuuaagguuugaggcuaagcugcuaaccug

SEQ ID NO: 475357 - RNA, 32 nt, Human
gucuuaauauucaguucuggaucucuucuuau

SEQ ID NO: 475358 - RNA, 32 nt, Human
gucuuaaucuaucccuccagcuggcaguuacu

SEQ ID NO: 475359 - RNA, 32 nt, Human
gucuuaaucucuuccacugaugcauccuccaa

SEQ ID NO: 475360 - RNA, 32 nt, Human
gucuuaaugccacaccacuauuccagcgaauu

SEQ ID NO: 475361 - RNA, 32 nt, Human
gucuuaauucagcauuuucagguuuuauauug

SEQ ID NO: 475362 - RNA, 32 nt, Human
gucuuaauugcacuuauacccauguccugugg

SEQ ID NO: 475363 - RNA, 22 nt, Human
gucuuacagcugggugcagugg

SEQ ID NO: 475364 - RNA, 32 nt, Human
gucuuacaggaaagggcauccccaggcugccc

SEQ ID NO: 475365 - RNA, 32 nt, Human
gucuuacauuggcuuuuuaaauuuuccauuaa

SEQ ID NO: 475366 - RNA, 32 nt, Human
gucuuacccagcccagggauucuugaacuauc

SEQ ID NO: 475367 - RNA, 32 nt, Human
gucuuaccucccaacuggaagacagcucgaga

SEQ ID NO: 475368 - RNA, 32 nt, Human
gucuuaccuuucuccccuagugcucaugcccc

SEQ ID NO: 475369 - RNA, 22 nt, Human
gucuuacgucuuuuucccuccc

SEQ ID NO: 475370 - RNA, 32 nt, Human
gucuuacucaucugcgauuccaucaucagggu

SEQ ID NO: 475371 - RNA, 32 nt, Human
gucuuacuccagcccuuccuggguguuaacug

SEQ ID NO: 475372 - RNA, 32 nt, Human
gucuuacuuaauacagugugggcagaggccuu

SEQ ID NO: 475373 - RNA, 22 nt, Human
gucuuacuuccuaccccuuccc

SEQ ID NO: 475374 - RNA, 20 nt, Human
gucuuagaagaaaguggaau

SEQ ID NO: 475375 - RNA, 22 nt, Human
gucuuagacaggauaaggaagc

SEQ ID NO: 475376 - RNA, 20 nt, Human
gucuuagacauguuauuuua

SEQ ID NO: 475377 - RNA, 32 nt, Human
gucuuagagaccagcagagaaucugugagaga

SEQ ID NO: 475378 - RNA, 32 nt, Human
gucuuagaugcugcacauaguaccuggugcua

SEQ ID NO: 475379 - RNA, 32 nt, Human
gucuuagauuccaguagauggaauugcaaucc

SEQ ID NO: 475380 - RNA, 32 nt, Human
gucuuagcacccaggaaacagaacuuuaagau

SEQ ID NO: 475381 - RNA, 32 nt, Human
gucuuagcaguggagccaugccuggguuucag

SEQ ID NO: 475382 - RNA, 32 nt, Human
gucuuagcucacugcagccuccaccucccagg

SEQ ID NO: 475383 - RNA, 32 nt, Human
gucuuaggcaacacucagagcagaucucccuu

SEQ ID NO: 475384 - RNA, 28 nt, Human
gucuuaggcaggcaagagaauugaaaug

SEQ ID NO: 475385 - RNA, 32 nt, Human
gucuuaggcaggcaagagaauugaaaugaggg

SEQ ID NO: 475386 - RNA, 32 nt, Human
gucuuaggcgauuuguggggugcagugaauga

SEQ ID NO: 475387 - RNA, 32 nt, Human
gucuuagggaaaggaauggggaagcaacauuu

SEQ ID NO: 475388 - RNA, 21 nt, Human
gucuuaguaaaaauacaaaau

SEQ ID NO: 475389 - RNA, 32 nt, Human
gucuuaguggguggaugggcauggauagaaau

SEQ ID NO: 475390 - RNA, 32 nt, Human
gucuuaguuggcuacucgccauggacgaagcg

SEQ ID NO: 475391 - RNA, 32 nt, Human
gucuuaguuucugggaauuggauuuauuucuc

SEQ ID NO: 475392 - RNA, 23 nt, Human
gucuuauaaauggaguacaggga

SEQ ID NO: 475393 - RNA, 32 nt, Human
gucuuaucaaguuuucauucucugucaauaug

SEQ ID NO: 475394 - RNA, 32 nt, Human
gucuuauccaagauuucucuggcuccaggggc

SEQ ID NO: 475395 - RNA, 32 nt, Human
gucuuaucccuuauuuauggagcuagacugac

SEQ ID NO: 475396 - RNA, 32 nt, Human
gucuuaucuccccagggaaugcuccagcaacc

SEQ ID NO: 475397 - RNA, 32 nt, Human
gucuuaucugccaggaaagaccagccucacuc

SEQ ID NO: 475398 - RNA, 22 nt, Human
gucuuauugggugugaggaagc

SEQ ID NO: 475399 - RNA, 32 nt, Human
gucuuauugugaugagucucgacugucaaauc

SEQ ID NO: 475400 - RNA, 32 nt, Human
gucuuauugugaugagucucgacugucauauc

SEQ ID NO: 475401 - RNA, 32 nt, Human
gucuucaaagucuaugauucucaccuagagca

SEQ ID NO: 475402 - RNA, 32 nt, Human
gucuucaaauacuaaggaaggagaaugagggg

SEQ ID NO: 475403 - RNA, 32 nt, Human
gucuucaacagguuuccaggcauacaacuacu

SEQ ID NO: 475404 - RNA, 32 nt, Human
gucuucaaccagcugcugauucacgcggccuu

SEQ ID NO: 475405 - RNA, 32 nt, Human
gucuucaacucagcagagauggcccucuggga

SEQ ID NO: 475406 - RNA, 32 nt, Human
gucuucaacuccugaccucaagcaauuguccu

SEQ ID NO: 475407 - RNA, 32 nt, Human
gucuucaagggagauuacgggggaagaaggcu

SEQ ID NO: 475408 - RNA, 32 nt, Human
gucuucaaguuuucacuccagcuacacagaug

SEQ ID NO: 475409 - RNA, 32 nt, Human
gucuucaaugguuagcagaagggagaaaagaa

SEQ ID NO: 475410 - RNA, 32 nt, Human
gucuucaccagcugggcugggccagccuggcc

SEQ ID NO: 475411 - RNA, 32 nt, Human
gucuucaccagggacaucaacaaggcccugua

SEQ ID NO: 475412 - RNA, 32 nt, Human
gucuucacuccagccagcaucauggucuucgg

SEQ ID NO: 475413 - RNA, 20 nt, Human
gucuucacucucuccuuccc

SEQ ID NO: 475414 - RNA, 32 nt, Human
gucuucacugccuccuuuucccugucaugcuc

SEQ ID NO: 475415 - RNA, 21 nt, Human
gucuucacugcucuguguccu

SEQ ID NO: 475416 - RNA, 32 nt, Human
gucuucacuggcaguagggggagauggggaga

SEQ ID NO: 475417 - RNA, 32 nt, Human
gucuucacuuucugcauuauccccacauuuua

SEQ ID NO: 475418 - RNA, 32 nt, Human
gucuucagacuccucagagucccuuggugaga

SEQ ID NO: 475419 - RNA, 32 nt, Human
gucuucagaguuuccugggaccgcggugggug

SEQ ID NO: 475420 - RNA, 32 nt, Human
gucuucagcaucagcauguuggacacacugcu

SEQ ID NO: 475421 - RNA, 32 nt, Human
gucuucagcauucccucccaucaugcccgguc

SEQ ID NO: 475422 - RNA, 32 nt, Human
gucuucagcccagcuacuucccuauuuuugug

SEQ ID NO: 475423 - RNA, 32 nt, Human
gucuucagcugggcugggguuggggcugcugu

SEQ ID NO: 475424 - RNA, 32 nt, Human
gucuucaguguucuucaggguaguugggaucu

SEQ ID NO: 475425 - RNA, 20 nt, Human
gucuucauaugcccuuuaaa

SEQ ID NO: 475426 - RNA, 32 nt, Human
gucuucaucccuccaucaaccuuaaucacaua

SEQ ID NO: 475427 - RNA, 32 nt, Human
gucuucaucucaaccagcuaaugguaggucuu

SEQ ID NO: 475428 - RNA, 32 nt, Human
gucuucaucuuccuccucaagacagcuggugc

SEQ ID NO: 475429 - RNA, 32 nt, Human
gucuucaugaaaugcuaugucauuucaugucc

SEQ ID NO: 475430 - RNA, 32 nt, Human
gucuucaugaagcagauuugcacuggaaccau

SEQ ID NO: 475431 - RNA, 32 nt, Human
gucuucaugucccugagggucuugggcucugg

SEQ ID NO: 475432 - RNA, 32 nt, Human
gucuucauucuccacgcagccuggugauggca

SEQ ID NO: 475433 - RNA, 32 nt, Human
gucuuccaauuuaaccaaagauaaaggacuag

SEQ ID NO: 475434 - RNA, 32 nt, Human
gucuuccacaccacagaggcacaaagcugacu

SEQ ID NO: 475435 - RNA, 32 nt, Human
gucuuccacagccgccugaaagccacaaugag

SEQ ID NO: 475436 - RNA, 32 nt, Human
gucuuccacaguuccggagccuucagugaggg

SEQ ID NO: 475437 - RNA, 32 nt, Human
gucuuccacuauaucuguuuuccucuuaguuc

SEQ ID NO: 475438 - RNA, 30 nt, Human
gucuuccagcucuaaucagaaagcugcuug

SEQ ID NO: 475439 - RNA, 32 nt, Human
gucuuccagcugguggaucugggcccagcaaa

SEQ ID NO: 475440 - RNA, 32 nt, Human
gucuuccaggagacaggugauuguggcuugga

SEQ ID NO: 475441 - RNA, 24 nt, Human
gucuuccaggcuggagugcagugg

SEQ ID NO: 475442 - RNA, 32 nt, Human
gucuuccaggguggcuggagagcacagacgcg

SEQ ID NO: 475443 - RNA, 32 nt, Human
gucuuccaguggggcacggggguggggagcug

SEQ ID NO: 475444 - RNA, 31 nt, Human
gucuuccauuuccucccgccagucuccauug

SEQ ID NO: 475445 - RNA, 32 nt, Human
gucuuccauuuccucccgccagucuccauuga

SEQ ID NO: 475446 - RNA, 32 nt, Human
gucuucccaauccucugcuuuagacagcucgg

SEQ ID NO: 475447 - RNA, 32 nt, Human
gucuuccccaaaauugaucacuccgccuucuc

SEQ ID NO: 475448 - RNA, 32 nt, Human
gucuuccccuaaaggagaacauggggauaaca

SEQ ID NO: 475449 - RNA, 32 nt, Human
gucuucccugcaggacacaggcggcuuucugg

SEQ ID NO: 475450 - RNA, 32 nt, Human
gucuucccugcucuccgagguagagcugggua

SEQ ID NO: 475451 - RNA, 32 nt, Human
gucuucccuucucuccaagaggccucaguccc

SEQ ID NO: 475452 - RNA, 19 nt, Human
gucuuccgcccccagccca

SEQ ID NO: 475453 - RNA, 32 nt, Human
gucuuccuagccccgagacuuucaaguccaua

SEQ ID NO: 475454 - RNA, 32 nt, Human
gucuuccuaguuaaggcucuuuauaaagagcu

SEQ ID NO: 475455 - RNA, 21 nt, Human
gucuuccuaucucuuaguuuc

SEQ ID NO: 475456 - RNA, 32 nt, Human
gucuuccuccaagagaagguggaccuggcagu

SEQ ID NO: 475457 - RNA, 32 nt, Human
gucuuccuccacccgccucuuccuucccagcc

SEQ ID NO: 475458 - RNA, 32 nt, Human
gucuuccucccaggguucuuugggguaaagaa

SEQ ID NO: 475459 - RNA, 32 nt, Human
gucuuccucccucccucccuuccucuuacucu

SEQ ID NO: 475460 - RNA, 32 nt, Human
gucuuccucuacuggggucguucuggcuuuuu

SEQ ID NO: 475461 - RNA, 32 nt, Human
gucuuccucuuccucucucuuccagagcccag

SEQ ID NO: 475462 - RNA, 32 nt, Human
gucuuccugaacagccugaagcagaagguggu

SEQ ID NO: 475463 - RNA, 32 nt, Human
gucuuccugagacccaggcugguguggacaca

SEQ ID NO: 475464 - RNA, 32 nt, Human
gucuuccuggggauggggccugaagccucagg

SEQ ID NO: 475465 - RNA, 32 nt, Human
gucuuccugguccccaccuccuggggccgacg

SEQ ID NO: 475466 - RNA, 32 nt, Human
gucuuccugucacccaggcuggaguacagugg

SEQ ID NO: 475467 - RNA, 18 nt, Human
gucuuccuuuuguucuca

SEQ ID NO: 475468 - RNA, 32 nt, Human
gucuucgcaagugccaugaugcaugccuuaga

SEQ ID NO: 475469 - RNA, 32 nt, Human
gucuucgccacgcgcccuccccugggcucgcg

SEQ ID NO: 475470 - RNA, 32 nt, Human
gucuucggacaacagguaguucuaauuucuua

SEQ ID NO: 475471 - RNA, 32 nt, Human
gucuucgggaggcagaauugaagugaacauga

SEQ ID NO: 475472 - RNA, 32 nt, Human
gucuucgggccccagcccuggagcugcaggag

SEQ ID NO: 475473 - RNA, 32 nt, Human
gucuucggggagaaggcccuuggagccgggcu

SEQ ID NO: 475474 - RNA, 32 nt, Human
gucuucgguuucuuagcuucaggcuggacuuc

SEQ ID NO: 475475 - RNA, 32 nt, Human
gucuucguucuuccuccccucaguggcaguuu

SEQ ID NO: 475476 - RNA, 32 nt, Human
gucuucuaaacagguauuuauaccuuuuuaua

SEQ ID NO: 475477 - RNA, 32 nt, Human
gucuucuacgaaaagcucuccccaccuuccca

SEQ ID NO: 475478 - RNA, 32 nt, Human
gucuucuacgugagguuccuuggcguuguuua

SEQ ID NO: 475479 - RNA, 32 nt, Human
gucuucuagacauuuacuaucacugcaccuga

SEQ ID NO: 475480 - RNA, 32 nt, Human
gucuucucacgcccucuccucuggggccucgu

SEQ ID NO: 475481 - RNA, 32 nt, Human
gucuucucagccgggacgccagcgguucugau

SEQ ID NO: 475482 - RNA, 32 nt, Human
gucuucucaggccaugagcugcagugacuggu

SEQ ID NO: 475483 - RNA, 32 nt, Human
gucuucucagggagacucugaggcucuguuga

SEQ ID NO: 475484 - RNA, 32 nt, Human
gucuucucccccagggucuugcucugucaccc

SEQ ID NO: 475485 - RNA, 32 nt, Human
gucuucucccuaaaaaccaaaacaucucccug

SEQ ID NO: 475486 - RNA, 20 nt, Human
gucuucucccucugacccca

SEQ ID NO: 475487 - RNA, 32 nt, Human
gucuucucccugccaugucccuugccaggcuc

SEQ ID NO: 475488 - RNA, 32 nt, Human
gucuucucuaugcccaugacuuugggacccuc

SEQ ID NO: 475489 - RNA, 32 nt, Human
gucuucucuccacuccccagcauggaggaagg

SEQ ID NO: 475490 - RNA, 32 nt, Human
gucuucucucccuucacaaaaaucugagggcu

SEQ ID NO: 475491 - RNA, 32 nt, Human
gucuucucugaggcugggccaagccugaggga

SEQ ID NO: 475492 - RNA, 32 nt, Human
gucuucucugcagacaccagccugguguccuc

SEQ ID NO: 475493 - RNA, 32 nt, Human
gucuucucugcaggaccccuugauuuacauug

SEQ ID NO: 475494 - RNA, 32 nt, Human
gucuucucuggccucugccugcccacagaauc

SEQ ID NO: 475495 - RNA, 32 nt, Human
gucuucucuucacccuuccuggccuuauuucc

SEQ ID NO: 475496 - RNA, 32 nt, Human
gucuucugaaucuagaguaaguccucugucuu

SEQ ID NO: 475497 - RNA, 32 nt, Human
gucuucugagacaagcauuucugugagcugcc

SEQ ID NO: 475498 - RNA, 32 nt, Human
gucuucugaucccauucccuucuuccccaaaa

SEQ ID NO: 475499 - RNA, 32 nt, Human
gucuucugcccuucugcagccgucgacauuuu

SEQ ID NO: 475500 - RNA, 31 nt, Human
gucuucugccucucucucguuucuuccccca

SEQ ID NO: 475501 - RNA, 32 nt, Human
gucuucugcucaacucagguaccagcugacac

SEQ ID NO: 475502 - RNA, 32 nt, Human
gucuucugcuccaugcucuuccucgggucaaa

SEQ ID NO: 475503 - RNA, 19 nt, Human
gucuucugcugccuggaga

SEQ ID NO: 475504 - RNA, 32 nt, Human
gucuucugggugacagacaaaauagcuugucu

SEQ ID NO: 475505 - RNA, 31 nt, Human
gucuucuggguggacacguggagaaagagaa

SEQ ID NO: 475506 - RNA, 32 nt, Human
gucuucugugcguuuaguuuucuugcugagcg

SEQ ID NO: 475507 - RNA, 32 nt, Human
gucuucuguggccagggacacaggcuuggggc

SEQ ID NO: 475508 - RNA, 19 nt, Human
gucuucuguuuucauuuga

SEQ ID NO: 475509 - RNA, 32 nt, Human
gucuucuucaaaaaggagaaaagcugugguuu

SEQ ID NO: 475510 - RNA, 21 nt, Human
gucuucuucagaggucaggga

SEQ ID NO: 475511 - RNA, 32 nt, Human
gucuucuucagguccugagauuacacggugga

SEQ ID NO: 475512 - RNA, 32 nt, Human
gucuucuucccaagagaguuuuuaauuguaaa

SEQ ID NO: 475513 - RNA, 32 nt, Human
gucuucuucgaaagugaaaagugguaacagcu

SEQ ID NO: 475514 - RNA, 32 nt, Human
gucuucuucucauuuaaagcuguuuauacuca

SEQ ID NO: 475515 - RNA, 32 nt, Human
gucuucuucugcacgagacuuugaggcuguca

SEQ ID NO: 475516 - RNA, 32 nt, Human
gucuucuucuucuucuucuucuucuucuucuu

SEQ ID NO: 475517 - RNA, 32 nt, Human
gucuucuuuaauuucucuugguaauguuuugu

SEQ ID NO: 475518 - RNA, 32 nt, Human
gucuucuuucucucucugcccccaccaagugc

SEQ ID NO: 475519 - RNA, 32 nt, Human
gucuucuuucuuauccccuuggugggcugggu

SEQ ID NO: 475520 - RNA, 32 nt, Human
gucuucuuuuucucccaacuucgccacucagc

SEQ ID NO: 475521 - RNA, 22 nt, Human
gucuugaaaagugaaaaugguu

SEQ ID NO: 475522 - RNA, 32 nt, Human
gucuugaacuccugaguucaagcaguccuccu

SEQ ID NO: 475523 - RNA, 32 nt, Human
gucuugaacuccugaguucaagcgauccaccu

SEQ ID NO: 475524 - RNA, 32 nt, Human
gucuugaacuccuggacucaagcaaucccccc

SEQ ID NO: 475525 - RNA, 32 nt, Human
gucuugaacuccuggccucaagcaauccgccu

SEQ ID NO: 475526 - RNA, 32 nt, Human
gucuugaacuccuggccucaagcaauccuccu

SEQ ID NO: 475527 - RNA, 32 nt, Human
gucuugaacuccuggccucaagcaauccucuc

SEQ ID NO: 475528 - RNA, 32 nt, Human
gucuugaacuccuggccucaagcaauccuucc

SEQ ID NO: 475529 - RNA, 32 nt, Human
gucuugaacuccugggcccaagcaaucuuccc

SEQ ID NO: 475530 - RNA, 32 nt, Human
gucuugaacuccugggcucaagcaaucagccc

SEQ ID NO: 475531 - RNA, 32 nt, Human
gucuugaacuccugggcucaagcaauccuccc

SEQ ID NO: 475532 - RNA, 32 nt, Human
gucuugaacuccuggguucaagcagucuuccu

SEQ ID NO: 475533 - RNA, 32 nt, Human
gucuugaacuucucuucaagaacccgggcugc

SEQ ID NO: 475534 - RNA, 32 nt, Human
gucuugaagcuugacaggauguuuucauuacu

SEQ ID NO: 475535 - RNA, 19 nt, Human
gucuugaagucucuuccca

SEQ ID NO: 475536 - RNA, 23 nt, Human
gucuugaauuccugaccuccuga

SEQ ID NO: 475537 - RNA, 32 nt, Human
gucuugaauuccugggcucaagcaauucuucc

SEQ ID NO: 475538 - RNA, 32 nt, Human
gucuugacucacugcaauucugccuccugggu

SEQ ID NO: 475539 - RNA, 32 nt, Human
gucuugacuuccaguuugauacugugguuaaa

SEQ ID NO: 475540 - RNA, 32 nt, Human
gucuugagacaguaccaggcaucugggaugaa

SEQ ID NO: 475541 - RNA, 22 nt, Human
gucuugagaccagccugccagg

SEQ ID NO: 475542 - RNA, 32 nt, Human
gucuugagaccagccugggcaacaggcuauuu

SEQ ID NO: 475543 - RNA, 32 nt, Human
gucuugagcccaagccccaucuuccuccuuca

SEQ ID NO: 475544 - RNA, 32 nt, Human
gucuugagccugggguugacuggguuagagaa

SEQ ID NO: 475545 - RNA, 32 nt, Human
gucuugagggucacuaccaaagaauuacccuc

SEQ ID NO: 475546 - RNA, 32 nt, Human
gucuugagguccgaagcugggguggggguguc

SEQ ID NO: 475547 - RNA, 32 nt, Human
gucuugaucaaaucaaacuaagaagaccuuag

SEQ ID NO: 475548 - RNA, 23 nt, Human
gucuugaucuccugaccucauga

SEQ ID NO: 475549 - RNA, 23 nt, Human
gucuugaucuccugaccucguga

SEQ ID NO: 475550 - RNA, 31 nt, Human
gucuugaugauguacuaacauuuaaaaauuu

SEQ ID NO: 475551 - RNA, 32 nt, Human
gucuugaugcaggagagucuggaaaaggaaga

SEQ ID NO: 475552 - RNA, 32 nt, Human
gucuugaugccaucaaaggacauccccugccc

SEQ ID NO: 475553 - RNA, 31 nt, Human
gucuugaugcucucugggcuuuguugaggcg

SEQ ID NO: 475554 - RNA, 32 nt, Human
gucuugauuagaauguugaacaugacaaggcu

SEQ ID NO: 475555 - RNA, 32 nt, Human
gucuugauuugugcuauuauguucuguuaguu

SEQ ID NO: 475556 - RNA, 32 nt, Human
gucuugcagagcuagggugugugacugccucc

SEQ ID NO: 475557 - RNA, 32 nt, Human
gucuugcagagcuaggugugugacugccuccc

SEQ ID NO: 475558 - RNA, 24 nt, Human
gucuugcagaguauccuuuuuuga

SEQ ID NO: 475559 - RNA, 32 nt, Human
gucuugcagcuuuuauucccugugcaacaaaa

SEQ ID NO: 475560 - RNA, 32 nt, Human
gucuugcaggacuggagaagguggugguucua

SEQ ID NO: 475561 - RNA, 32 nt, Human
gucuugcaggccugggccucuaccuaaccccc

SEQ ID NO: 475562 - RNA, 32 nt, Human
gucuugccaaugcucccggccgaauaaagccc

SEQ ID NO: 475563 - RNA, 26 nt, Human
gucuugcccaggcuggagugcagugg

SEQ ID NO: 475564 - RNA, 32 nt, Human
gucuugcccaggcuggagugcaguggccugaa

SEQ ID NO: 475565 - RNA, 32 nt, Human
gucuugcccaggcuggaguucaggggcuauuc

SEQ ID NO: 475566 - RNA, 32 nt, Human
gucuugcccugaccccaagcacaaggucuuuc

SEQ ID NO: 475567 - RNA, 32 nt, Human
gucuugccucauucaugagcuggucagcguuu

SEQ ID NO: 475568 - RNA, 32 nt, Human
gucuugccuccaggaccugggaagggugaugc

SEQ ID NO: 475569 - RNA, 32 nt, Human
gucuugccucuugucauugucuguccccaccc

SEQ ID NO: 475570 - RNA, 32 nt, Human
gucuugccuucucagcgccacagggaaggcca

SEQ ID NO: 475571 - RNA, 32 nt, Human
gucuugcgccuguacucccagcacuuugggag

SEQ ID NO: 475572 - RNA, 32 nt, Human
gucuugcuaguuaaccucacgaggacuggggg

SEQ ID NO: 475573 - RNA, 32 nt, Human
gucuugcuccagcccaggcuggagugcagugg

SEQ ID NO: 475574 - RNA, 32 nt, Human
gucuugcucuaucacccaggcuggagugcagu

SEQ ID NO: 475575 - RNA, 32 nt, Human
gucuugcucugccuuagcacucccuucuccuu

SEQ ID NO: 475576 - RNA, 32 nt, Human
gucuugcucugcuccuuucauccucgucuccc

SEQ ID NO: 475577 - RNA, 25 nt, Human
gucuugcucugcuggagugcggugg

SEQ ID NO: 475578 - RNA, 32 nt, Human
gucuugcucugucacccagacuggaacacagu

SEQ ID NO: 475579 - RNA, 32 nt, Human
gucuugcucugucacccagacuggaguacaau

SEQ ID NO: 475580 - RNA, 32 nt, Human
gucuugcucugucacccagacuggagugcagu

SEQ ID NO: 475581 - RNA, 32 nt, Human
gucuugcucugucacccaggcuggggcgcaau

SEQ ID NO: 475582 - RNA, 32 nt, Human
gucuugcucugucacccagucuggagugcagu

SEQ ID NO: 475583 - RNA, 32 nt, Human
gucuugcucuguugcccacauuggagugcagu

SEQ ID NO: 475584 - RNA, 32 nt, Human
gucuugcucuucccuuucauauccaaugucaa

SEQ ID NO: 475585 - RNA, 32 nt, Human
gucuugcugcagagucugacacuggauucccc

SEQ ID NO: 475586 - RNA, 32 nt, Human
gucuugcugguguggauagaaaccaggcagga

SEQ ID NO: 475587 - RNA, 32 nt, Human
gucuugcugugugaugggaacaugcuuguaaa

SEQ ID NO: 475588 - RNA, 24 nt, Human
gucuugcuucaggaaggugaagug

SEQ ID NO: 475589 - RNA, 32 nt, Human
gucuugcuucuuucuccaggccuggcuccuua

SEQ ID NO: 475590 - RNA, 32 nt, Human
gucuuggaacugcuccugcuauccccacaccc

SEQ ID NO: 475591 - RNA, 32 nt, Human
gucuuggacuccugaccucaugcuccacccgc

SEQ ID NO: 475592 - RNA, 32 nt, Human
gucuuggacuccugaccucgugauccacccac

SEQ ID NO: 475593 - RNA, 32 nt, Human
gucuuggacuccugacgucgugauccacccgc

SEQ ID NO: 475594 - RNA, 32 nt, Human
gucuuggacuccuggccucaagcaauccuccc

SEQ ID NO: 475595 - RNA, 22 nt, Human
gucuuggagacaggcaggaggu

SEQ ID NO: 475596 - RNA, 32 nt, Human
gucuuggagacauuacuccugagagacugcag

SEQ ID NO: 475597 - RNA, 32 nt, Human
gucuuggagaggagguguggaguggagggguc

SEQ ID NO: 475598 - RNA, 32 nt, Human
gucuuggagaucuucuguucaaaguacagugc

SEQ ID NO: 475599 - RNA, 32 nt, Human
gucuuggagcagcuccaggucaucggugaugu

SEQ ID NO: 475600 - RNA, 32 nt, Human
gucuuggagcaucugccuugugccuggcacuc

SEQ ID NO: 475601 - RNA, 32 nt, Human
gucuuggaggcuggcuaccacauucaauuaac

SEQ ID NO: 475602 - RNA, 32 nt, Human
gucuuggauccaggcugggcacgguggcucac

SEQ ID NO: 475603 - RNA, 32 nt, Human
gucuuggauccuucagagccucagccacuagc

SEQ ID NO: 475604 - RNA, 32 nt, Human
gucuuggccaugucuaguaauugcuauguguu

SEQ ID NO: 475605 - RNA, 32 nt, Human
gucuuggcccaggaugggagagccgccugccc

SEQ ID NO: 475606 - RNA, 32 nt, Human
gucuuggccucagauggauggauguguuugga

SEQ ID NO: 475607 - RNA, 32 nt, Human
gucuuggcguaaggacacagcccaaguaacug

SEQ ID NO: 475608 - RNA, 32 nt, Human
gucuuggcguacccucuccacgugcccguccc

SEQ ID NO: 475609 - RNA, 32 nt, Human
gucuuggcuagacugccuagauucccacagca

SEQ ID NO: 475610 - RNA, 32 nt, Human
gucuuggcucaccucaaccucugccucccagg

SEQ ID NO: 475611 - RNA, 32 nt, Human
gucuuggcucacugcaaccuccaccucccagg

SEQ ID NO: 475612 - RNA, 32 nt, Human
gucuuggcucacugcaaccuccaccuccuggg

SEQ ID NO: 475613 - RNA, 32 nt, Human
gucuuggcucacugcaaccuccgccucccggg

SEQ ID NO: 475614 - RNA, 32 nt, Human
gucuuggcucacugcaaccucugccuccuugg

SEQ ID NO: 475615 - RNA, 32 nt, Human
gucuuggcucacugcaacuucugccucuuggg

SEQ ID NO: 475616 - RNA, 32 nt, Human
gucuuggcucacugcaagcuccgccucccggg

SEQ ID NO: 475617 - RNA, 32 nt, Human
gucuuggcucacugcaagcuccgucugccggg

SEQ ID NO: 475618 - RNA, 32 nt, Human
gucuuggcucacugcagccuccaccuccuggg

SEQ ID NO: 475619 - RNA, 32 nt, Human
gucuuggcucacugcagccucugccuccugag

SEQ ID NO: 475620 - RNA, 32 nt, Human
gucuuggcuccaccucuguccucucucuagcc

SEQ ID NO: 475621 - RNA, 32 nt, Human
gucuuggcugcugauggguggggugagcccca

SEQ ID NO: 475622 - RNA, 32 nt, Human
gucuuggcuuacugcaaccuccgccucccagg

SEQ ID NO: 475623 - RNA, 32 nt, Human
gucuuggcuuauugaagccucugccuccuggg

SEQ ID NO: 475624 - RNA, 32 nt, Human
gucuuggcuugugcuuucuccucuccccaucg

SEQ ID NO: 475625 - RNA, 32 nt, Human
gucuugggagaagggugaggaugggcauuuag

SEQ ID NO: 475626 - RNA, 32 nt, Human
gucuuggggaagaggugcaggagaagcugugu

SEQ ID NO: 475627 - RNA, 32 nt, Human
gucuuggggagagaggaggaggugacugcuua

SEQ ID NO: 475628 - RNA, 32 nt, Human
gucuugggggagaaaggaaugggagcccagac

SEQ ID NO: 475629 - RNA, 31 nt, Human
gucuuggggguggaaagggagggaugaauug

SEQ ID NO: 475630 - RNA, 32 nt, Human
gucuuggggguguaggggaucgcuugagccca

SEQ ID NO: 475631 - RNA, 31 nt, Human
gucuugggugagagagagggaccugcaggau

SEQ ID NO: 475632 - RNA, 32 nt, Human
gucuugggugagagagagggaccugcaggaug

SEQ ID NO: 475633 - RNA, 32 nt, Human
gucuugggugggagacggcaggucccucuguc

SEQ ID NO: 475634 - RNA, 32 nt, Human
gucuuggguuacugcaaccucugccccucggg

SEQ ID NO: 475635 - RNA, 32 nt, Human
gucuugguagccuuugccauuuugaauuuaga

SEQ ID NO: 475636 - RNA, 32 nt, Human
gucuugguaggaggagaagaaacacagggaaa

SEQ ID NO: 475637 - RNA, 32 nt, Human
gucuuggugagggccaggggacaggucggggc

SEQ ID NO: 475638 - RNA, 31 nt, Human
gucuuggugcacuucucacucuuccugccug

SEQ ID NO: 475639 - RNA, 32 nt, Human
gucuuggugccacccucuccacuccuacugcc

SEQ ID NO: 475640 - RNA, 32 nt, Human
gucuugguugacugagagucugggggagaggg

SEQ ID NO: 475641 - RNA, 32 nt, Human
gucuugguuuaccuguggugacaaccgggugu

SEQ ID NO: 475642 - RNA, 32 nt, Human
gucuugucagcucuggguguuuguucccugcc

SEQ ID NO: 475643 - RNA, 32 nt, Human
gucuugucucaaacuccugggcucaagcgauc

SEQ ID NO: 475644 - RNA, 32 nt, Human
gucuugucucaccaaccccagcccaucaucug

SEQ ID NO: 475645 - RNA, 32 nt, Human
gucuugucuccucuccucaggccccuggaccu

SEQ ID NO: 475646 - RNA, 32 nt, Human
gucuugucucucaagagcaucucggauccaga

SEQ ID NO: 475647 - RNA, 32 nt, Human
gucuugucuuauucccugaggcucccuugacu

SEQ ID NO: 475648 - RNA, 32 nt, Human
gucuuguggcaagcccagcuucaguuuauguu

SEQ ID NO: 475649 - RNA, 32 nt, Human
gucuuguggcuucagaaacagcuuaaaauaau

SEQ ID NO: 475650 - RNA, 22 nt, Human
gucuuguggguuuucuguuuga

SEQ ID NO: 475651 - RNA, 32 nt, Human
gucuuguggguuuucuguuugaaaaggaguca

SEQ ID NO: 475652 - RNA, 29 nt, Human
gucuugugucuguguggcuagauggccuc

SEQ ID NO: 475653 - RNA, 18 nt, Human
gucuugugugccuggcga

SEQ ID NO: 475654 - RNA, 32 nt, Human
gucuuguguucuauguggagucuguuacugug

SEQ ID NO: 475655 - RNA, 32 nt, Human
gucuuguuacagacaccuuccucuguguaagu

SEQ ID NO: 475656 - RNA, 22 nt, Human
gucuuguucuacccagauucag

SEQ ID NO: 475657 - RNA, 32 nt, Human
gucuuguucugucacccaggcuggagugcagu

SEQ ID NO: 475658 - RNA, 32 nt, Human
gucuuguucugucacccaggcuggggugcagu

SEQ ID NO: 475659 - RNA, 32 nt, Human
gucuuguugcccaggcuggagugcaauggcgu

SEQ ID NO: 475660 - RNA, 32 nt, Human
gucuuguuucccaggcuggagugcaauggcac

SEQ ID NO: 475661 - RNA, 32 nt, Human
gucuuguuugccaggcugaggcugaguugcau

SEQ ID NO: 475662 - RNA, 32 nt, Human
gucuuguuuguagccaauacaugguguauagc

SEQ ID NO: 475663 - RNA, 32 nt, Human
gucuuguuuuaggauaacuacuuuaaaauuuu

SEQ ID NO: 475664 - RNA, 32 nt, Human
gucuuguuuugcuuuccagagaucuugcucau

SEQ ID NO: 475665 - RNA, 32 nt, Human
gucuuguuuugucacccaggcuggagugcagu

SEQ ID NO: 475666 - RNA, 26 nt, Human
gucuuguuuuuuccugguuuguuuga

SEQ ID NO: 475667 - RNA, 32 nt, Human
gucuuuaaaggaugaauuagcauggucuuaaa

SEQ ID NO: 475668 - RNA, 32 nt, Human
gucuuuaagccucccuugccucagcaaggaga

SEQ ID NO: 475669 - RNA, 32 nt, Human
gucuuuaauacuucaugaucacuugaauuaaa

SEQ ID NO: 475670 - RNA, 20 nt, Human
gucuuuaaugugccuggaga

SEQ ID NO: 475671 - RNA, 32 nt, Human
gucuuuaauguucuuuuuggaguuaggaccuc

SEQ ID NO: 475672 - RNA, 32 nt, Human
gucuuuacaaugaaacauuuugcuuaauuuuu

SEQ ID NO: 475673 - RNA, 32 nt, Human
gucuuuacagcuuacauuuccauuccauuauu

SEQ ID NO: 475674 - RNA, 32 nt, Human
gucuuuaccuucuuagacauuuugucauacca

SEQ ID NO: 475675 - RNA, 21 nt, Human
gucuuuacuaaaaauacaaaa

SEQ ID NO: 475676 - RNA, 22 nt, Human
gucuuuacuaaaaauacaaaau

SEQ ID NO: 475677 - RNA, 32 nt, Human
gucuuuacugccccuucugccccuccacccac

SEQ ID NO: 475678 - RNA, 32 nt, Human
gucuuuacugcucagaaccucuacuucucauc

SEQ ID NO: 475679 - RNA, 32 nt, Human
gucuuuagagcucagcuuucugaggcccugag

SEQ ID NO: 475680 - RNA, 32 nt, Human
gucuuuagauggaaggaauccaggcaacauuc

SEQ ID NO: 475681 - RNA, 32 nt, Human
gucuuuaggauuugcagcuccaggaagcgaga

SEQ ID NO: 475682 - RNA, 32 nt, Human
gucuuuaguacaaaacugcucuagggacaccu

SEQ ID NO: 475683 - RNA, 32 nt, Human
gucuuuauucuguccuguuugacauuuuuauu

SEQ ID NO: 475684 - RNA, 32 nt, Human
gucuuuauuuacuuugcuucgugugugggcaa

SEQ ID NO: 475685 - RNA, 32 nt, Human
gucuuucaaauacaugacgccuuuaguaugcc

SEQ ID NO: 475686 - RNA, 32 nt, Human
gucuuucaaauacgagauaacugcaaaauauu

SEQ ID NO: 475687 - RNA, 32 nt, Human
gucuuucaauacaggcauaaaccuuccacucu

SEQ ID NO: 475688 - RNA, 32 nt, Human
gucuuucacaucggguugcacuguccaugaaa

SEQ ID NO: 475689 - RNA, 32 nt, Human
gucuuucacccaggcuggagugcagugcugug

SEQ ID NO: 475690 - RNA, 32 nt, Human
gucuuucacccaggcuggagugcuguggcacg

SEQ ID NO: 475691 - RNA, 32 nt, Human
gucuuucaccuguaaucccagcacuuugggag

SEQ ID NO: 475692 - RNA, 32 nt, Human
gucuuucacugauuucugaaucauguucuacu

SEQ ID NO: 475693 - RNA, 32 nt, Human
gucuuucacugauuucugaaucauguucuagu

SEQ ID NO: 475694 - RNA, 32 nt, Human
gucuuucaggauucaggaugacuuuucuuuua

SEQ ID NO: 475695 - RNA, 32 nt, Human
gucuuucaggcagugcaggucagccuggagcc

SEQ ID NO: 475696 - RNA, 22 nt, Human
gucuuucaguucguuuguuuga

SEQ ID NO: 475697 - RNA, 32 nt, Human
gucuuucauaggugaaaagcaccagagaauac

SEQ ID NO: 475698 - RNA, 32 nt, Human
gucuuucaucaucacaccacuccgcugccugg

SEQ ID NO: 475699 - RNA, 32 nt, Human
gucuuucauggggagagaaggagacugaauua

SEQ ID NO: 475700 - RNA, 32 nt, Human
gucuuucauuuugccugaguguauuuuacuau

SEQ ID NO: 475701 - RNA, 32 nt, Human
gucuuuccagccugguccaguccacacuuguu

SEQ ID NO: 475702 - RNA, 32 nt, Human
gucuuuccccucccaucuccucagaucggugg

SEQ ID NO: 475703 - RNA, 32 nt, Human
gucuuucccuggugaugguccccugcccuguc

SEQ ID NO: 475704 - RNA, 32 nt, Human
gucuuucccuggugauggucucucgcucuguc

SEQ ID NO: 475705 - RNA, 32 nt, Human
gucuuuccucuccgccucuccuccccagccgg

SEQ ID NO: 475706 - RNA, 32 nt, Human
gucuuuccuuauccucuccaugcugagcuuga

SEQ ID NO: 475707 - RNA, 32 nt, Human
gucuuuccuucuuuaagucugauaccauuaac

SEQ ID NO: 475708 - RNA, 32 nt, Human
gucuuucucaaagagaagucaagcagacuccc

SEQ ID NO: 475709 - RNA, 32 nt, Human
gucuuucucaaggucucugagguccagacagc

SEQ ID NO: 475710 - RNA, 32 nt, Human
gucuuucuccccugcagcuuccucugcuucug

SEQ ID NO: 475711 - RNA, 32 nt, Human
gucuuucuccccugggcuccugucucacacua

SEQ ID NO: 475712 - RNA, 32 nt, Human
gucuuucucuccccucacuuccaccccuucac

SEQ ID NO: 475713 - RNA, 32 nt, Human
gucuuucucugcacuccagccuaggcaacaga

SEQ ID NO: 475714 - RNA, 32 nt, Human
gucuuucucugucacccaggauggagugcagu

SEQ ID NO: 475715 - RNA, 32 nt, Human
gucuuucucugucacccaggcuggaaugcagu

SEQ ID NO: 475716 - RNA, 32 nt, Human
gucuuucucugucacccaggcuggagugcagu

SEQ ID NO: 475717 - RNA, 32 nt, Human
gucuuucugaccgggaaugagugcaaagcaca

SEQ ID NO: 475718 - RNA, 32 nt, Human
gucuuucuggccgucccgccucuagaugccgg

SEQ ID NO: 475719 - RNA, 32 nt, Human
gucuuucugguggacuccaaucccuuucucuu

SEQ ID NO: 475720 - RNA, 32 nt, Human
gucuuucuguuuagagggaaguguaacauauc

SEQ ID NO: 475721 - RNA, 32 nt, Human
gucuuucuuaaaacugacauuuguuguuaaug

SEQ ID NO: 475722 - RNA, 32 nt, Human
gucuuucuuauaaacuaacagagcagguauau

SEQ ID NO: 475723 - RNA, 32 nt, Human
gucuuucuuauauaacugcagaaagauaaaua

SEQ ID NO: 475724 - RNA, 32 nt, Human
gucuuucuucucagguguauuucuugguaccc

SEQ ID NO: 475725 - RNA, 32 nt, Human
gucuuucuucucccacccuccaccuuccaaaa

SEQ ID NO: 475726 - RNA, 32 nt, Human
gucuuucuuggccccugucucucuccauguug

SEQ ID NO: 475727 - RNA, 32 nt, Human
gucuuugaaacuuaagaaagcuuaaguuuuaa

SEQ ID NO: 475728 - RNA, 32 nt, Human
gucuuugaaagccagacgcuguggccugcugu

SEQ ID NO: 475729 - RNA, 32 nt, Human
gucuuugaaauacgacaucuaaaagaguggcc

SEQ ID NO: 475730 - RNA, 25 nt, Human
gucuuugaaucgugggaggggaggc

SEQ ID NO: 475731 - RNA, 32 nt, Human
gucuuugaauugccaguucuguaagugccauc

SEQ ID NO: 475732 - RNA, 32 nt, Human
gucuuugaccgacacagaaugccuggcauuug

SEQ ID NO: 475733 - RNA, 18 nt, Human
gucuuugagauuugauca

SEQ ID NO: 475734 - RNA, 32 nt, Human
gucuuugaggagcuccaggccagagcagaugc

SEQ ID NO: 475735 - RNA, 32 nt, Human
gucuuugaggaggcucacaaaauacuaaagcu

SEQ ID NO: 475736 - RNA, 20 nt, Human
gucuuugcacacacagugca

SEQ ID NO: 475737 - RNA, 32 nt, Human
gucuuugcacacacauauagguauauucugaa

SEQ ID NO: 475738 - RNA, 32 nt, Human
gucuuugcacaucccaacccgugaccuuccac

SEQ ID NO: 475739 - RNA, 32 nt, Human
gucuuugccacauuugacugaauugagcuguc

SEQ ID NO: 475740 - RNA, 32 nt, Human
gucuuugccugucccaacuacaaggacuguac

SEQ ID NO: 475741 - RNA, 31 nt, Human
gucuuugccuuugcugggccuucugugcagg

SEQ ID NO: 475742 - RNA, 32 nt, Human
gucuuugcggagcuggaguuccaggcuggacc

SEQ ID NO: 475743 - RNA, 32 nt, Human
gucuuugcuauacaaaaguguuuuccacuaau

SEQ ID NO: 475744 - RNA, 32 nt, Human
gucuuugcucccuccccucucuuagagacugu

SEQ ID NO: 475745 - RNA, 32 nt, Human
gucuuugcugcuguccccagaccuccugugac

SEQ ID NO: 475746 - RNA, 32 nt, Human
gucuuugcuggaaaguguauuugugcauaaau

SEQ ID NO: 475747 - RNA, 32 nt, Human
gucuuugcuguacucuugcugauggcugcuag

SEQ ID NO: 475748 - RNA, 32 nt, Human
gucuuuggaaagguuuggaaaugcagaaauaa

SEQ ID NO: 475749 - RNA, 32 nt, Human
gucuuuggaagagguagccccugaacgcagag

SEQ ID NO: 475750 - RNA, 32 nt, Human
gucuuuggaauagcaguaguuuuggaaauauu

SEQ ID NO: 475751 - RNA, 32 nt, Human
gucuuuggagcagccacggcccacaaucaccc

SEQ ID NO: 475752 - RNA, 27 nt, Human
gucuuuggagucggggauggaggaggu

SEQ ID NO: 475753 - RNA, 21 nt, Human
gucuuugggagguaagcaagu

SEQ ID NO: 475754 - RNA, 21 nt, Human
gucuuugggaucuggggaggc

SEQ ID NO: 475755 - RNA, 32 nt, Human
gucuuugggcagggaauuaaugacagaaugag

SEQ ID NO: 475756 - RNA, 32 nt, Human
gucuuugggccagccagucucuccccacugcu

SEQ ID NO: 475757 - RNA, 32 nt, Human
gucuuuggggagaggggagugcauuuagacuu

SEQ ID NO: 475758 - RNA, 32 nt, Human
gucuuugggggaggacagccaccaaaguuuaa

SEQ ID NO: 475759 - RNA, 32 nt, Human
gucuuugguagugcuucugcugcugccaccaa

SEQ ID NO: 475760 - RNA, 32 nt, Human
gucuuugguggcaccuuccuugcuggccucca

SEQ ID NO: 475761 - RNA, 23 nt, Human
gucuuugguggggauggggaggc

SEQ ID NO: 475762 - RNA, 23 nt, Human
gucuuugucaagugucugcucca

SEQ ID NO: 475763 - RNA, 32 nt, Human
gucuuugucccaccagggguugcaguggcuug

SEQ ID NO: 475764 - RNA, 32 nt, Human
gucuuugugaaaugaaauaacaugcuucauuu

SEQ ID NO: 475765 - RNA, 32 nt, Human
gucuuugugcguugcuuuuccaaggauaggaa

SEQ ID NO: 475766 - RNA, 32 nt, Human
gucuuuguggcuguuuaagucaccaacaauag

SEQ ID NO: 475767 - RNA, 32 nt, Human
gucuuugugggggaaggcccuggcuuuguauu

SEQ ID NO: 475768 - RNA, 32 nt, Human
gucuuugugguccggggcugagacccacgagg

SEQ ID NO: 475769 - RNA, 32 nt, Human
gucuuuguuacccaggcuggaguacaguggug

SEQ ID NO: 475770 - RNA, 32 nt, Human
gucuuuguuccuucuuauuuuggcauucgaua

SEQ ID NO: 475771 - RNA, 21 nt, Human
gucuuuguucggggcugucca

SEQ ID NO: 475772 - RNA, 32 nt, Human
gucuuuguugcucaggcuggaguacaguggca

SEQ ID NO: 475773 - RNA, 32 nt, Human
gucuuuuacaccauuuagugcccuugcuuuug

SEQ ID NO: 475774 - RNA, 32 nt, Human
gucuuuuagccuucaacuuuguauccaucaga

SEQ ID NO: 475775 - RNA, 32 nt, Human
gucuuuuagggagggugacugggaggugcccc

SEQ ID NO: 475776 - RNA, 32 nt, Human
gucuuuucauuuuguacauucuucccauucug

SEQ ID NO: 475777 - RNA, 18 nt, Human
gucuuuucccagcugcca

SEQ ID NO: 475778 - RNA, 32 nt, Human
gucuuuuccccaccaucuuuaaaucaaaguug

SEQ ID NO: 475779 - RNA, 28 nt, Human
gucuuuuccccugcugccucacucccca

SEQ ID NO: 475780 - RNA, 32 nt, Human
gucuuuuccuauucagaacuaugugcuuguca

SEQ ID NO: 475781 - RNA, 32 nt, Human
gucuuuuccuugugguuccuuucuccggcauc

SEQ ID NO: 475782 - RNA, 32 nt, Human
gucuuuucuagcaaagggauaaaacuuagaug

SEQ ID NO: 475783 - RNA, 32 nt, Human
gucuuuucuagcaacgucgacaggcuuuccaa

SEQ ID NO: 475784 - RNA, 32 nt, Human
gucuuuucuaucuccaugccuggcuuuuucua

SEQ ID NO: 475785 - RNA, 32 nt, Human
gucuuuucucauuccuuugacucugccggacu

SEQ ID NO: 475786 - RNA, 32 nt, Human
gucuuuucugugggauacacaggacagugcca

SEQ ID NO: 475787 - RNA, 32 nt, Human
gucuuuucuuccaugaguucugucugaacuga

SEQ ID NO: 475788 - RNA, 32 nt, Human
gucuuuucuuugccaucucugcuccaaccggg

SEQ ID NO: 475789 - RNA, 32 nt, Human
gucuuuugaagaaaaagauucuuuagaaaugu

SEQ ID NO: 475790 - RNA, 24 nt, Human
gucuuuugacauguggaaagugaa

SEQ ID NO: 475791 - RNA, 32 nt, Human
gucuuuugagauacagguuuauaacacugcuu

SEQ ID NO: 475792 - RNA, 32 nt, Human
gucuuuugcaaauauuuuccucccaggcugug

SEQ ID NO: 475793 - RNA, 32 nt, Human
gucuuuugcuccacuugcugguguuuuauaga

SEQ ID NO: 475794 - RNA, 32 nt, Human
gucuuuuggaaaugcagguuuaaggacaaauu

SEQ ID NO: 475795 - RNA, 21 nt, Human
gucuuuugggggugagggagc

SEQ ID NO: 475796 - RNA, 32 nt, Human
gucuuuuggucugaauuuguuuuccuuugguu

SEQ ID NO: 475797 - RNA, 32 nt, Human
gucuuuuguuucucccuucugugguuuaugag

SEQ ID NO: 475798 - RNA, 31 nt, Human
gucuuuuuccucuuggcauuuccuaauaaca

SEQ ID NO: 475799 - RNA, 32 nt, Human
gucuuuuucuaguuugugcucuucuguuccaa

SEQ ID NO: 475800 - RNA, 30 nt, Human
gucuuuuucugcuuucccuuagaguagcug

SEQ ID NO: 475801 - RNA, 32 nt, Human
gucuuuuugaagcacaguuacauucauguuau

SEQ ID NO: 475802 - RNA, 32 nt, Human
gucuuuuuguggcuucugguuuggaaagcaca

SEQ ID NO: 475803 - RNA, 20 nt, Human
gugaaaaaauaaauuucugu

SEQ ID NO: 475804 - RNA, 32 nt, Human
gugaaaaagaugaccccuuucugauuaggauc

SEQ ID NO: 475805 - RNA, 32 nt, Human
gugaaaaaggaaaugucaggagggauaagaca

SEQ ID NO: 475806 - RNA, 32 nt, Human
gugaaaaaggugccuuucuucugguuugccuu

SEQ ID NO: 475807 - RNA, 22 nt, Human
gugaaaaaucugaugacuuuaa

SEQ ID NO: 475808 - RNA, 31 nt, Human
gugaaaacacucaaggccuagggggaggaca

SEQ ID NO: 475809 - RNA, 32 nt, Human
gugaaaacacucuuaacuuucucuuuacccuu

SEQ ID NO: 475810 - RNA, 32 nt, Human
gugaaaaccacauuaccagcaugguaaagggu

SEQ ID NO: 475811 - RNA, 32 nt, Human
gugaaaacccuccaucauaaggaggaaguuau

SEQ ID NO: 475812 - RNA, 32 nt, Human
gugaaaacuaggagaacagagaugagauuuga

SEQ ID NO: 475813 - RNA, 32 nt, Human
gugaaaacugggaaugugaauguaauauaugu

SEQ ID NO: 475814 - RNA, 32 nt, Human
gugaaaagaaaauuucuagugucuauccauug

SEQ ID NO: 475815 - RNA, 32 nt, Human
gugaaaagaggagugacaggagggaaaggggg

SEQ ID NO: 475816 - RNA, 22 nt, Human
gugaaaagcugcgcuuuuugaa

SEQ ID NO: 475817 - RNA, 32 nt, Human
gugaaaaggagaggguaacagaaaaagaggaa

SEQ ID NO: 475818 - RNA, 32 nt, Human
gugaaaaggggaggggaugugguaagcagaaa

SEQ ID NO: 475819 - RNA, 32 nt, Human
gugaaaagggugccacuggcaccacugggugg

SEQ ID NO: 475820 - RNA, 20 nt, Human
gugaaaagucucccuuucca

SEQ ID NO: 475821 - RNA, 18 nt, Human
gugaaaaguuccuuuaaa

SEQ ID NO: 475822 - RNA, 22 nt, Human
gugaaaaguuguugaucuugaa

SEQ ID NO: 475823 - RNA, 32 nt, Human
gugaaaaguuugggagcacugcuuuauaauaa

SEQ ID NO: 475824 - RNA, 32 nt, Human
gugaaaauacuuuugggcugggcacgguggcu

SEQ ID NO: 475825 - RNA, 31 nt, Human
gugaaaaugaacacagggcgugauucucagu

SEQ ID NO: 475826 - RNA, 32 nt, Human
gugaaaaugaugucuaccugccuugcugauga

SEQ ID NO: 475827 - RNA, 32 nt, Human
gugaaaaugccacucuccugugccuaccaaua

SEQ ID NO: 475828 - RNA, 32 nt, Human
gugaaaauguucaucaauucccauugcaucac

SEQ ID NO: 475829 - RNA, 32 nt, Human
gugaaacacagcuguucuucuguucugcagac

SEQ ID NO: 475830 - RNA, 32 nt, Human
gugaaacagcaaaccccaaaucuucaaaguug

SEQ ID NO: 475831 - RNA, 32 nt, Human
gugaaacagcauauuacaaguuugaaaauuca

SEQ ID NO: 475832 - RNA, 32 nt, Human
gugaaacagggaagguuguuaaacagcaccgu

SEQ ID NO: 475833 - RNA, 32 nt, Human
gugaaacauccuugcaaacucuucccaccucc

SEQ ID NO: 475834 - RNA, 32 nt, Human
gugaaacaucuucagggcgggaaaggggccac

SEQ ID NO: 475835 - RNA, 32 nt, Human
gugaaacaucuucagggugggaaaggggccac

SEQ ID NO: 475836 - RNA, 32 nt, Human
gugaaacauggugaaaccccgucucuacuaaa

SEQ ID NO: 475837 - RNA, 32 nt, Human
gugaaaccagacaaagccgcgagcccagggau

SEQ ID NO: 475838 - RNA, 32 nt, Human
gugaaaccagagaugauuuggaagaugggggu

SEQ ID NO: 475839 - RNA, 32 nt, Human
gugaaacccaggaggagaguguggaguccaga

SEQ ID NO: 475840 - RNA, 20 nt, Human
gugaaaccccagcucuacua

SEQ ID NO: 475841 - RNA, 20 nt, Human
gugaaaccccaucucuacua

SEQ ID NO: 475842 - RNA, 20 nt, Human
gugaaaccccaugucuacua

SEQ ID NO: 475843 - RNA, 20 nt, Human
gugaaaccccgucuccacua

SEQ ID NO: 475844 - RNA, 20 nt, Human
gugaaaccccgucucuacua

SEQ ID NO: 475845 - RNA, 32 nt, Human
gugaaacccugccucuacuaaaaauacaaaaa

SEQ ID NO: 475846 - RNA, 32 nt, Human
gugaaacccugccucuacuaaauauacaaaaa

SEQ ID NO: 475847 - RNA, 20 nt, Human
gugaaacccugucuccacua

SEQ ID NO: 475848 - RNA, 20 nt, Human
gugaaacccugucucuacua

SEQ ID NO: 475849 - RNA, 20 nt, Human
gugaaaccucaucucuacua

SEQ ID NO: 475850 - RNA, 32 nt, Human
gugaaaccucucgcugcugcuagguuuacaaa

SEQ ID NO: 475851 - RNA, 32 nt, Human
gugaaacggggugcggggguggggacggcggu

SEQ ID NO: 475852 - RNA, 32 nt, Human
gugaaacuaagcaaccuggucggcuuuacugu

SEQ ID NO: 475853 - RNA, 32 nt, Human
gugaaacuauuaaaccuagaaauuguauucau

SEQ ID NO: 475854 - RNA, 32 nt, Human
gugaaacugaaggaggcuggaaguauucaccc

SEQ ID NO: 475855 - RNA, 32 nt, Human
gugaaacuggaaggcugccauggcuagcccag

SEQ ID NO: 475856 - RNA, 32 nt, Human
gugaaacuggcaguugacggcuccugggacua

SEQ ID NO: 475857 - RNA, 32 nt, Human
gugaaacugggcugaagugagguuugcagccu

SEQ ID NO: 475858 - RNA, 32 nt, Human
gugaaacuuguuucuaacaggauuucauguga

SEQ ID NO: 475859 - RNA, 23 nt, Human
gugaaagaaauguuucuugaaga

SEQ ID NO: 475860 - RNA, 32 nt, Human
gugaaagaagugaaaagaagcaaccacagcua

SEQ ID NO: 475861 - RNA, 32 nt, Human
gugaaagaagugagaauggggguagccaagug

SEQ ID NO: 475862 - RNA, 32 nt, Human
gugaaagacugaggcagcguggaugggaagua

SEQ ID NO: 475863 - RNA, 19 nt, Human
gugaaagagagcuagcugg

SEQ ID NO: 475864 - RNA, 32 nt, Human
gugaaagagagggaggggugcagcaacaugug

SEQ ID NO: 475865 - RNA, 32 nt, Human
gugaaagagcccccuccuccccucucuccugg

SEQ ID NO: 475866 - RNA, 32 nt, Human
gugaaagagucucaguucagugaacacaaaac

SEQ ID NO: 475867 - RNA, 32 nt, Human
gugaaagauaaauuguucuucagacagagugc

SEQ ID NO: 475868 - RNA, 32 nt, Human
gugaaagaugacguccuuagcccagcagcugc

SEQ ID NO: 475869 - RNA, 19 nt, Human
gugaaagcaaaauagcuug

SEQ ID NO: 475870 - RNA, 20 nt, Human
gugaaagcccaucucuacua

SEQ ID NO: 475871 - RNA, 32 nt, Human
gugaaagccugagucccaccagaaggaccuuc

SEQ ID NO: 475872 - RNA, 32 nt, Human
gugaaagcugugguagagugguuaacagauac

SEQ ID NO: 475873 - RNA, 32 nt, Human
gugaaaggaaggcagcuuguauugagccuuuu

SEQ ID NO: 475874 - RNA, 32 nt, Human
gugaaaggacuugccagguuuuguucagguuu

SEQ ID NO: 475875 - RNA, 32 nt, Human
gugaaaggagaugagaagauggguggagagga

SEQ ID NO: 475876 - RNA, 32 nt, Human
gugaaaggaggaaugaaagcaagugaaggaug

SEQ ID NO: 475877 - RNA, 24 nt, Human
gugaaaggaucacuugagcccagg

SEQ ID NO: 475878 - RNA, 23 nt, Human
gugaaaggauugcuugagccagg

SEQ ID NO: 475879 - RNA, 32 nt, Human
gugaaaggccacugcacuccagccugagugac

SEQ ID NO: 475880 - RNA, 32 nt, Human
gugaaaggccuggcggggaggaaagugaaacg

SEQ ID NO: 475881 - RNA, 32 nt, Human
gugaaaggcugaaggagguggagcuggggagg

SEQ ID NO: 475882 - RNA, 32 nt, Human
gugaaagggcaucauauacuucaaggaagacu

SEQ ID NO: 475883 - RNA, 32 nt, Human
gugaaagggccuacacuaaaacaacaaauuuu

SEQ ID NO: 475884 - RNA, 21 nt, Human
gugaaaggggacgagcagggg

SEQ ID NO: 475885 - RNA, 32 nt, Human
gugaaaggggcucuugauuagcuuaaaaucac

SEQ ID NO: 475886 - RNA, 21 nt, Human
gugaaaggggggaaccaguga

SEQ ID NO: 475887 - RNA, 22 nt, Human
gugaaaggggugacuuuuagga

SEQ ID NO: 475888 - RNA, 31 nt, Human
gugaaagggugauggauuucacugugaauau

SEQ ID NO: 475889 - RNA, 32 nt, Human
gugaaagggugauggauuucacugugaauaug

SEQ ID NO: 475890 - RNA, 32 nt, Human
gugaaaguagagucugggaaguagcugccuau

SEQ ID NO: 475891 - RNA, 32 nt, Human
gugaaagucgaugccuucuagucucagugaau

SEQ ID NO: 475892 - RNA, 32 nt, Human
gugaaagucuccuguaucauuucuugguauga

SEQ ID NO: 475893 - RNA, 32 nt, Human
gugaaaguucugauucucuuccuucccuguuu

SEQ ID NO: 475894 - RNA, 21 nt, Human
gugaaaguuggacaguugggg

SEQ ID NO: 475895 - RNA, 21 nt, Human
gugaaaguuggggcugaagua

SEQ ID NO: 475896 - RNA, 32 nt, Human
gugaaauaagaggcuguaguacauggcgagcu

SEQ ID NO: 475897 - RNA, 32 nt, Human
gugaaauacuaccagaacuguucucuaaaccc

SEQ ID NO: 475898 - RNA, 32 nt, Human
gugaaauauguuacagaacaugcacuugcccu

SEQ ID NO: 475899 - RNA, 32 nt, Human
gugaaaucagccccugcccaccaaaauaaucu

SEQ ID NO: 475900 - RNA, 32 nt, Human
gugaaaucuccaugguuccugcuuuguguucc

SEQ ID NO: 475901 - RNA, 32 nt, Human
gugaaaucugagaagaaauccuuggaucucuu

SEQ ID NO: 475902 - RNA, 32 nt, Human
gugaaaugacaugcaaaggccauaguugucaa

SEQ ID NO: 475903 - RNA, 32 nt, Human
gugaaaugacuuaccaaugucacauaacuagu

SEQ ID NO: 475904 - RNA, 32 nt, Human
gugaaaugagccagggcgaggagggaggguga

SEQ ID NO: 475905 - RNA, 32 nt, Human
gugaaaugcauccuuguaacaucauuguauuc

SEQ ID NO: 475906 - RNA, 32 nt, Human
gugaaaugccaaauuugaaaggccuguacugc

SEQ ID NO: 475907 - RNA, 32 nt, Human
gugaaauggaccugacagcccaaacugucaga

SEQ ID NO: 475908 - RNA, 32 nt, Human
gugaaauggagucucuuugugguucugauuug

SEQ ID NO: 475909 - RNA, 32 nt, Human
gugaaaugggcugaggcaggaaaugggaaaaa

SEQ ID NO: 475910 - RNA, 24 nt, Human
gugaaauguagacagggcaggcug

SEQ ID NO: 475911 - RNA, 32 nt, Human
gugaaauguaucuuucaacuguuuaguuaccc

SEQ ID NO: 475912 - RNA, 32 nt, Human
gugaaaugucacuccauugacccaccgaaaaa

SEQ ID NO: 475913 - RNA, 32 nt, Human
gugaaauguguguguauacaauaaacugaaaa

SEQ ID NO: 475914 - RNA, 32 nt, Human
gugaaauuaauauuaugcagaugaugaaaggg

SEQ ID NO: 475915 - RNA, 21 nt, Human
gugaaauucagaauuuuucuu

SEQ ID NO: 475916 - RNA, 32 nt, Human
gugaaauucugaguuguuggggcuaagccuga

SEQ ID NO: 475917 - RNA, 24 nt, Human
gugaaauuguaggccauuuucuua

SEQ ID NO: 475918 - RNA, 32 nt, Human
gugaaauuucaaaagugugaacuuuuuauucu

SEQ ID NO: 475919 - RNA, 21 nt, Human
gugaacaaaacuguguuuuga

SEQ ID NO: 475920 - RNA, 22 nt, Human
gugaacaaaaugacugauaucu

SEQ ID NO: 475921 - RNA, 32 nt, Human
gugaacaaagaucauuacaaacaaaaacugua

SEQ ID NO: 475922 - RNA, 32 nt, Human
gugaacaaagcacgacuauuuuguaaagggaa

SEQ ID NO: 475923 - RNA, 20 nt, Human
gugaacaaaguacggaaucu

SEQ ID NO: 475924 - RNA, 32 nt, Human
gugaacaaaucugucuuugacuuacgacccau

SEQ ID NO: 475925 - RNA, 32 nt, Human
gugaacaaggugucagcucugaagggaagguu

SEQ ID NO: 475926 - RNA, 21 nt, Human
gugaacacacgccacuuccca

SEQ ID NO: 475927 - RNA, 19 nt, Human
gugaacaccuguaauccca

SEQ ID NO: 475928 - RNA, 32 nt, Human
gugaacacgagugacagggcuccgggggaagu

SEQ ID NO: 475929 - RNA, 32 nt, Human
gugaacacugcaauauccccugggagacucuc

SEQ ID NO: 475930 - RNA, 26 nt, Human
gugaacagaauacuguuuucugggga

SEQ ID NO: 475931 - RNA, 23 nt, Human
gugaacagaauugcaaauagucu

SEQ ID NO: 475932 - RNA, 21 nt, Human
gugaacagauguuuucuagga

SEQ ID NO: 475933 - RNA, 32 nt, Human
gugaacagcagcaggaggagccgcuagagcag

SEQ ID NO: 475934 - RNA, 32 nt, Human
gugaacagcagcuacuacaguaguggaagccg

SEQ ID NO: 475935 - RNA, 32 nt, Human
gugaacaggcugggcugcuggagguggggcga

SEQ ID NO: 475936 - RNA, 32 nt, Human
gugaacagguucuccaggugauucugaucccu

SEQ ID NO: 475937 - RNA, 21 nt, Human
gugaacaguccuucuagggga

SEQ ID NO: 475938 - RNA, 32 nt, Human
gugaacagugugugugcgugcgugagaccaca

SEQ ID NO: 475939 - RNA, 20 nt, Human
gugaacaguuguguuugaag

SEQ ID NO: 475940 - RNA, 32 nt, Human
gugaacaucuguggcuguccucuccuuuucuu

SEQ ID NO: 475941 - RNA, 32 nt, Human
gugaacaugccaccguauucuucauuccuucu

SEQ ID NO: 475942 - RNA, 32 nt, Human
gugaacauguacauggucugcucucauuuauu

SEQ ID NO: 475943 - RNA, 32 nt, Human
gugaaccaacccagaaacagaaaaugaaaugc

SEQ ID NO: 475944 - RNA, 32 nt, Human
gugaaccaacccccaucucccuagcccacccc

SEQ ID NO: 475945 - RNA, 32 nt, Human
gugaaccaagaugucaguuuuguauuggggau

SEQ ID NO: 475946 - RNA, 32 nt, Human
gugaaccacugcacccagccaauggguguaau

SEQ ID NO: 475947 - RNA, 32 nt, Human
gugaaccacugcacccagccuaucuuuugcau

SEQ ID NO: 475948 - RNA, 32 nt, Human
gugaaccacugcacccagccugcugauccuuu

SEQ ID NO: 475949 - RNA, 23 nt, Human
gugaaccagcuucuagaugacau

SEQ ID NO: 475950 - RNA, 32 nt, Human
gugaaccagggaggggcagggcaaggcagggc

SEQ ID NO: 475951 - RNA, 32 nt, Human
gugaaccagggccuggagagccuggaccugca

SEQ ID NO: 475952 - RNA, 32 nt, Human
gugaaccaucugagaagcuuggaagaggaccc

SEQ ID NO: 475953 - RNA, 32 nt, Human
gugaaccaugaucacaccacugcacucuagcc

SEQ ID NO: 475954 - RNA, 32 nt, Human
gugaaccaugauugcacuccaaccugggcgac

SEQ ID NO: 475955 - RNA, 32 nt, Human
gugaaccauggacuuaaucaaccagcgguuuc

SEQ ID NO: 475956 - RNA, 32 nt, Human
gugaaccauggaggccgcaaggcccuucgccc

SEQ ID NO: 475957 - RNA, 32 nt, Human
gugaacccaggagacggagcuugcagugagcc

SEQ ID NO: 475958 - RNA, 32 nt, Human
gugaacccaggaggaggagcuugcagugagcc

SEQ ID NO: 475959 - RNA, 32 nt, Human
gugaacccaggaggcacagcuugcagugagcg

SEQ ID NO: 475960 - RNA, 32 nt, Human
gugaacccaggaggcagagcuugcagugagcc

SEQ ID NO: 475961 - RNA, 32 nt, Human
gugaacccaggaggcagagcuugcagugagcu

SEQ ID NO: 475962 - RNA, 32 nt, Human
gugaacccaggaggcagagguugcagugagcc

SEQ ID NO: 475963 - RNA, 32 nt, Human
gugaacccaggaggcggaccuuguagugagcc

SEQ ID NO: 475964 - RNA, 32 nt, Human
gugaacccaggaggcggagcuggcagugagcu

SEQ ID NO: 475965 - RNA, 32 nt, Human
gugaacccaggaggcggagcuugcagugagca

SEQ ID NO: 475966 - RNA, 32 nt, Human
gugaacccaggaggcggagcuugcagugagcc

SEQ ID NO: 475967 - RNA, 32 nt, Human
gugaacccaggaggcggagcuugcagugagcu

SEQ ID NO: 475968 - RNA, 32 nt, Human
gugaacccaggaggcggaggcugcagugagcu

SEQ ID NO: 475969 - RNA, 32 nt, Human
gugaacccaggaggcggagguugcagugagcc

SEQ ID NO: 475970 - RNA, 32 nt, Human
gugaacccaggaggcggcgguugcagugagcc

SEQ ID NO: 475971 - RNA, 32 nt, Human
gugaacccaggagguggagcuugcaaugagcc

SEQ ID NO: 475972 - RNA, 32 nt, Human
gugaacccaggagguggagcuugcagugagcc

SEQ ID NO: 475973 - RNA, 32 nt, Human
gugaacccagugagccgagaucgugccacugc

SEQ ID NO: 475974 - RNA, 32 nt, Human
gugaaccccaaagugucccccuuguggaacca

SEQ ID NO: 475975 - RNA, 32 nt, Human
gugaaccccuuuugguugcacacaugcucccc

SEQ ID NO: 475976 - RNA, 32 nt, Human
gugaacccgggacgcagggguugcagugagcg

SEQ ID NO: 475977 - RNA, 32 nt, Human
gugaacccgggagcggagguugcagugagcug

SEQ ID NO: 475978 - RNA, 32 nt, Human
gugaacccgggaggcagagguugcagugaacc

SEQ ID NO: 475979 - RNA, 32 nt, Human
gugaacccgggaggcagagguugcagugagcc

SEQ ID NO: 475980 - RNA, 32 nt, Human
gugaacccgggaggcgagcuugcagugagccg

SEQ ID NO: 475981 - RNA, 32 nt, Human
gugaacccgggaggcggagguugcagugagcc

SEQ ID NO: 475982 - RNA, 32 nt, Human
gugaacccgggcccgguggaggcugcagugag

SEQ ID NO: 475983 - RNA, 32 nt, Human
gugaacccugcagcgggccagcuaugguggga

SEQ ID NO: 475984 - RNA, 32 nt, Human
gugaacccuguaguguugcaggcccagcagac

SEQ ID NO: 475985 - RNA, 32 nt, Human
gugaaccgagaggugguuacuguaguguuugu

SEQ ID NO: 475986 - RNA, 32 nt, Human
gugaaccgcgcugcugcuccagccugacuucc

SEQ ID NO: 475987 - RNA, 32 nt, Human
gugaaccgcuggcugcuguugugccucaucuc

SEQ ID NO: 475988 - RNA, 32 nt, Human
gugaaccucaaagcuggacucuggguucucac

SEQ ID NO: 475989 - RNA, 32 nt, Human
gugaaccugcaaucccagugcuuugggaggcu

SEQ ID NO: 475990 - RNA, 32 nt, Human
gugaaccugcaggagcugcggggcagguguug

SEQ ID NO: 475991 - RNA, 32 nt, Human
gugaaccugcugcagacagaagcagaggaaag

SEQ ID NO: 475992 - RNA, 32 nt, Human
gugaaccugggaggcggagguugcagugagcu

SEQ ID NO: 475993 - RNA, 32 nt, Human
gugaaccuggggagccucgggggcagagguga

SEQ ID NO: 475994 - RNA, 32 nt, Human
gugaaccuguguucuccacauuuguccugacu

SEQ ID NO: 475995 - RNA, 32 nt, Human
gugaacuacaucucauuccuguuuccaacuag

SEQ ID NO: 475996 - RNA, 18 nt, Human
gugaacuacugcuguaaa

SEQ ID NO: 475997 - RNA, 32 nt, Human
gugaacuagagaaugcugagucuggaggagac

SEQ ID NO: 475998 - RNA, 23 nt, Human
gugaacucuagagcacaguaguu

SEQ ID NO: 475999 - RNA, 32 nt, Human
gugaacucuccccuccccaucuguguucuaac

SEQ ID NO: 476000 - RNA, 32 nt, Human
gugaacucucucacucagugaccucagucacc

SEQ ID NO: 476001 - RNA, 32 nt, Human
gugaacugaauugaauccauuguugggcuuaa

SEQ ID NO: 476002 - RNA, 32 nt, Human
gugaacugaguauuuuugucaaaagucacagg

SEQ ID NO: 476003 - RNA, 32 nt, Human
gugaacugaucaucuucucuauauucauuuca

SEQ ID NO: 476004 - RNA, 32 nt, Human
gugaacugcuuagguaggagugcacugcaguu

SEQ ID NO: 476005 - RNA, 32 nt, Human
gugaacuggcccauccugcggacaguuguggu

SEQ ID NO: 476006 - RNA, 32 nt, Human
gugaacugguuacuuucugucucugugcucua

SEQ ID NO: 476007 - RNA, 32 nt, Human
gugaacugguuguaccugaugaucugagaucc

SEQ ID NO: 476008 - RNA, 24 nt, Human
gugaacuuaguccuguuauagacg

SEQ ID NO: 476009 - RNA, 32 nt, Human
gugaacuugcaggugcacaaaauaagagggcc

SEQ ID NO: 476010 - RNA, 24 nt, Human
gugaacuuggguuugcaaguaucu

SEQ ID NO: 476011 - RNA, 32 nt, Human
gugaacuuggugggcccaggagggaacaggag

SEQ ID NO: 476012 - RNA, 32 nt, Human
gugaacuuguguaauaguauaauaggagauau

SEQ ID NO: 476013 - RNA, 32 nt, Human
gugaacuuuuccaguaaaugaagcaagcacug

SEQ ID NO: 476014 - RNA, 22 nt, Human
gugaagaaacaaggaggcacuu

SEQ ID NO: 476015 - RNA, 23 nt, Human
gugaagaaaccaucagcaggcug

SEQ ID NO: 476016 - RNA, 32 nt, Human
gugaagaaaguucccaauagugaggaguauca

SEQ ID NO: 476017 - RNA, 32 nt, Human
gugaagaagaaccagaugaggccaggcacggu

SEQ ID NO: 476018 - RNA, 32 nt, Human
gugaagaagacaagcucaacugccauucucug

SEQ ID NO: 476019 - RNA, 32 nt, Human
gugaagaagagaggaagcaggaucccacugag

SEQ ID NO: 476020 - RNA, 32 nt, Human
gugaagaagccacaccuuccagaggccaggca

SEQ ID NO: 476021 - RNA, 32 nt, Human
gugaagaagugaguauguuucaccuggacauu

SEQ ID NO: 476022 - RNA, 32 nt, Human
gugaagacagaggcagagauuggagugacgca

SEQ ID NO: 476023 - RNA, 32 nt, Human
gugaagaccaaucccuuccuuugguccuuugg

SEQ ID NO: 476024 - RNA, 32 nt, Human
gugaagaccaugguuuugagguuucuuaauaa

SEQ ID NO: 476025 - RNA, 32 nt, Human
gugaagacccuccagacucugggagaggcugg

SEQ ID NO: 476026 - RNA, 32 nt, Human
gugaagaccugacaguaauuuuugucuuaaga

SEQ ID NO: 476027 - RNA, 24 nt, Human
gugaagacgagaagaaggcaacug

SEQ ID NO: 476028 - RNA, 25 nt, Human
gugaagagaaaagaggaggacugau

SEQ ID NO: 476029 - RNA, 32 nt, Human
gugaagagacagaaggaggauggcaggaguua

SEQ ID NO: 476030 - RNA, 32 nt, Human
gugaagagcacaggcuguggggacaaccagac

SEQ ID NO: 476031 - RNA, 32 nt, Human
gugaagagcagugugcugucacacaccguuaa

SEQ ID NO: 476032 - RNA, 32 nt, Human
gugaagagccggcaggaaggggaccagucaca

SEQ ID NO: 476033 - RNA, 32 nt, Human
gugaagagcuaaaccacuggccugggcaccug

SEQ ID NO: 476034 - RNA, 32 nt, Human
gugaagaggagaacgauguccaggcaggggcc

SEQ ID NO: 476035 - RNA, 32 nt, Human
gugaagagggagaagggauggaggucacacug

SEQ ID NO: 476036 - RNA, 32 nt, Human
gugaagagggcggagagagggggcaggcucgg

SEQ ID NO: 476037 - RNA, 32 nt, Human
gugaagaggggccagaugacacccuaaagcag

SEQ ID NO: 476038 - RNA, 32 nt, Human
gugaagaguaguucuuguuuguuacaaccuuu

SEQ ID NO: 476039 - RNA, 32 nt, Human
gugaagagugggauugggagaggugggggugg

SEQ ID NO: 476040 - RNA, 32 nt, Human
gugaagaguuggacacaugaaugaacgcauga

SEQ ID NO: 476041 - RNA, 32 nt, Human
gugaagaucuacugcucccucucuccacacgg

SEQ ID NO: 476042 - RNA, 32 nt, Human
gugaagaugacaccccuccccaccaccucuca

SEQ ID NO: 476043 - RNA, 32 nt, Human
gugaagaugacccccaguaccaaaaaggucuu

SEQ ID NO: 476044 - RNA, 32 nt, Human
gugaagaugaggugaggaaggaagggguugcu

SEQ ID NO: 476045 - RNA, 32 nt, Human
gugaagaugaugucucgcugggagguccugga

SEQ ID NO: 476046 - RNA, 32 nt, Human
gugaagaugauugagaccugcgaugggaagcu

SEQ ID NO: 476047 - RNA, 32 nt, Human
gugaagaugcagaagggaaauggggagccuca

SEQ ID NO: 476048 - RNA, 32 nt, Human
gugaagauggccaagauccccguaucgcuggg

SEQ ID NO: 476049 - RNA, 32 nt, Human
gugaagauggcugauacccacccugggaugga

SEQ ID NO: 476050 - RNA, 32 nt, Human
gugaagaugguaggguggaaagacuuaauuuc

SEQ ID NO: 476051 - RNA, 32 nt, Human
gugaagcaaauacauucagcuuacugaucacu

SEQ ID NO: 476052 - RNA, 24 nt, Human
gugaagcaaguggagugguuggga

SEQ ID NO: 476053 - RNA, 32 nt, Human
gugaagcacaaauccuccuggcagaugggaag

SEQ ID NO: 476054 - RNA, 32 nt, Human
gugaagcacacagcucugcagccugggcucug

SEQ ID NO: 476055 - RNA, 32 nt, Human
gugaagcagcagcuaugagaaaagugguaaaa

SEQ ID NO: 476056 - RNA, 32 nt, Human
gugaagcagcagcuccagccccgggauaaaca

SEQ ID NO: 476057 - RNA, 32 nt, Human
gugaagcaggaaacauggugaugcugggugac

SEQ ID NO: 476058 - RNA, 32 nt, Human
gugaagccagaggcagcuccagccugggggac

SEQ ID NO: 476059 - RNA, 32 nt, Human
gugaagccagcagaggagugauagcugcuccc

SEQ ID NO: 476060 - RNA, 32 nt, Human
gugaagcccagccuggcgccugcccugccccc

SEQ ID NO: 476061 - RNA, 32 nt, Human
gugaagcccaggaggugguguuggcugcaggg

SEQ ID NO: 476062 - RNA, 32 nt, Human
gugaagcccuuggaucgagcagucuucuggau

SEQ ID NO: 476063 - RNA, 22 nt, Human
gugaagccgagucacaggaccc

SEQ ID NO: 476064 - RNA, 32 nt, Human
gugaagccgcggccaccggaagagucgcgguc

SEQ ID NO: 476065 - RNA, 32 nt, Human
gugaagccuggaguagggagagcgaguuuggg

SEQ ID NO: 476066 - RNA, 32 nt, Human
gugaagccugggaaugaguguuacugcagcau

SEQ ID NO: 476067 - RNA, 32 nt, Human
gugaagccuguauucaccuuuuucaguguauu

SEQ ID NO: 476068 - RNA, 32 nt, Human
gugaagcgggcagaucacuugaggucaggagu

SEQ ID NO: 476069 - RNA, 32 nt, Human
gugaagcucccacauguggaauggaagcccuu

SEQ ID NO: 476070 - RNA, 32 nt, Human
gugaagcugccugguguuaggucucugcaaga

SEQ ID NO: 476071 - RNA, 32 nt, Human
gugaagcugggagcuucgccagcaucugauuu

SEQ ID NO: 476072 - RNA, 32 nt, Human
gugaaggaaccgccuuucucuccgcgugucuc

SEQ ID NO: 476073 - RNA, 32 nt, Human
gugaaggaaggggccaaaaaugaacgagaucc

SEQ ID NO: 476074 - RNA, 19 nt, Human
gugaaggacauccaggcgg

SEQ ID NO: 476075 - RNA, 32 nt, Human
gugaaggagaggguggggagggaggcaucuag

SEQ ID NO: 476076 - RNA, 32 nt, Human
gugaaggaggaggcggggcugcacugugagcc

SEQ ID NO: 476077 - RNA, 32 nt, Human
gugaaggagggaaagugcagaggcuuucuggg

SEQ ID NO: 476078 - RNA, 32 nt, Human
gugaaggagggaaggagcaggagagcaggaag

SEQ ID NO: 476079 - RNA, 32 nt, Human
gugaaggauacucccuucuuucauacagaagc

SEQ ID NO: 476080 - RNA, 32 nt, Human
gugaaggauccagugagauuuuccagguuaac

SEQ ID NO: 476081 - RNA, 32 nt, Human
gugaaggaugguuuggaagaugaggacccggc

SEQ ID NO: 476082 - RNA, 32 nt, Human
gugaaggcacacugucccaccacaacugaacc

SEQ ID NO: 476083 - RNA, 32 nt, Human
gugaaggcagaacugcucacaccagcuccaga

SEQ ID NO: 476084 - RNA, 32 nt, Human
gugaaggcagagugagcagguaagagagggau

SEQ ID NO: 476085 - RNA, 32 nt, Human
gugaaggcagggggaaggugggguacuggagc

SEQ ID NO: 476086 - RNA, 32 nt, Human
gugaaggcauuagcuggguguuugugugggau

SEQ ID NO: 476087 - RNA, 21 nt, Human
gugaaggccugaggcaggcug

SEQ ID NO: 476088 - RNA, 32 nt, Human
gugaaggccugauggggaggaggacccggcau

SEQ ID NO: 476089 - RNA, 32 nt, Human
gugaaggcuaucuggggcaggcacaaauuggu

SEQ ID NO: 476090 - RNA, 32 nt, Human
gugaaggcugccuuaggucucuccagugccau

SEQ ID NO: 476091 - RNA, 32 nt, Human
gugaaggcugggugggguggguguggggacug

SEQ ID NO: 476092 - RNA, 32 nt, Human
gugaaggcuguaagacuguaacuuggaagaac

SEQ ID NO: 476093 - RNA, 32 nt, Human
gugaaggcuugaggggaugccucugccucucu

SEQ ID NO: 476094 - RNA, 32 nt, Human
gugaagggaacuccaguucuggggucagaaga

SEQ ID NO: 476095 - RNA, 32 nt, Human
gugaagggaagggaggaggaggaggacgccgg

SEQ ID NO: 476096 - RNA, 32 nt, Human
gugaagggaaguggggaguauuugaacacagu

SEQ ID NO: 476097 - RNA, 20 nt, Human
gugaagggacccgggcaggc

SEQ ID NO: 476098 - RNA, 32 nt, Human
gugaagggacccugccuuucagggcacuacgc

SEQ ID NO: 476099 - RNA, 32 nt, Human
gugaagggagagaaguggauuugggagacauu

SEQ ID NO: 476100 - RNA, 32 nt, Human
gugaagggagagugugaguguguaugugugug

SEQ ID NO: 476101 - RNA, 20 nt, Human
gugaagggagguaggugggg

SEQ ID NO: 476102 - RNA, 23 nt, Human
gugaagggagugccucucuggga

SEQ ID NO: 476103 - RNA, 32 nt, Human
gugaagggaguggcagaaucaaauugcuacau

SEQ ID NO: 476104 - RNA, 20 nt, Human
gugaagggaguggguagggg

SEQ ID NO: 476105 - RNA, 32 nt, Human
gugaagggcaaucagggcagacugccuggagg

SEQ ID NO: 476106 - RNA, 32 nt, Human
gugaagggcgcgaaugggcagagcagaacuuc

SEQ ID NO: 476107 - RNA, 32 nt, Human
gugaaggggaggcggugggcgucuuggagaac

SEQ ID NO: 476108 - RNA, 32 nt, Human
gugaagggggcagaggacugggaguuuucauc

SEQ ID NO: 476109 - RNA, 32 nt, Human
gugaaggggugaggauauucuaaacaaacaaa

SEQ ID NO: 476110 - RNA, 32 nt, Human
gugaagggugaggaguuccuucuguuaaggcc

SEQ ID NO: 476111 - RNA, 32 nt, Human
gugaagggugccuguucugaaucccagagccu

SEQ ID NO: 476112 - RNA, 32 nt, Human
gugaaggguuguguucuuuauggcagguucua

SEQ ID NO: 476113 - RNA, 32 nt, Human
gugaagguaaggucuugugagcacaacagcaa

SEQ ID NO: 476114 - RNA, 32 nt, Human
gugaagguagcaggugcuccuggcagaagaac

SEQ ID NO: 476115 - RNA, 32 nt, Human
gugaaggucaggccagggucucagccuccccu

SEQ ID NO: 476116 - RNA, 32 nt, Human
gugaaggucaggcucuucaaugcugaagaaug

SEQ ID NO: 476117 - RNA, 32 nt, Human
gugaaggucaugcgaugccuggaacaccccaa

SEQ ID NO: 476118 - RNA, 32 nt, Human
gugaaggucugcagcuucacuccuggagucag

SEQ ID NO: 476119 - RNA, 32 nt, Human
gugaaggugaagcacccagcccaagacucagc

SEQ ID NO: 476120 - RNA, 32 nt, Human
gugaaggugcaucuuucccugcccuccccugu

SEQ ID NO: 476121 - RNA, 32 nt, Human
gugaagguggaggccgaccaguagcugcagac

SEQ ID NO: 476122 - RNA, 32 nt, Human
gugaaggugggguuuggggagcuuggccgauu

SEQ ID NO: 476123 - RNA, 32 nt, Human
gugaagguggguggaguugaccagagaaaggg

SEQ ID NO: 476124 - RNA, 22 nt, Human
gugaagguucucgggacaggcu

SEQ ID NO: 476125 - RNA, 32 nt, Human
gugaaguagaggggugaggaaggguaaggggc

SEQ ID NO: 476126 - RNA, 32 nt, Human
gugaaguagccgccccucccaccccggcacga

SEQ ID NO: 476127 - RNA, 32 nt, Human
gugaaguagugucuuccaaaagcugauggaaa

SEQ ID NO: 476128 - RNA, 32 nt, Human
gugaagucaaacuguuauucagagauguuuaa

SEQ ID NO: 476129 - RNA, 32 nt, Human
gugaaguccaacuacgcugaacaucagagaac

SEQ ID NO: 476130 - RNA, 32 nt, Human
gugaaguccaacuggaaacagaaaaauaauua

SEQ ID NO: 476131 - RNA, 32 nt, Human
gugaaguccaacuggaaacagaaaaauauuua

SEQ ID NO: 476132 - RNA, 32 nt, Human
gugaagucucucucuuaaagucuuuugcaaac

SEQ ID NO: 476133 - RNA, 32 nt, Human
gugaagugaagaaaaauaagaaguauuacaac

SEQ ID NO: 476134 - RNA, 31 nt, Human
gugaagugacuuccagcuugcacaaggaaau

SEQ ID NO: 476135 - RNA, 32 nt, Human
gugaagugcaagagcuaggauuacaacugagu

SEQ ID NO: 476136 - RNA, 32 nt, Human
gugaagugcacgucuugggaaagggaugcaau

SEQ ID NO: 476137 - RNA, 32 nt, Human
gugaagugcccagcgcuggagugcagcgugcc

SEQ ID NO: 476138 - RNA, 32 nt, Human
gugaagugccuucuguuuuagcacuuuaaguu

SEQ ID NO: 476139 - RNA, 32 nt, Human
gugaagugcuggcaaccacuaagaauucaaac

SEQ ID NO: 476140 - RNA, 32 nt, Human
gugaagugcuucccauugcugcaggugaagaa

SEQ ID NO: 476141 - RNA, 32 nt, Human
gugaagugucaaccauccagaacacaaggaug

SEQ ID NO: 476142 - RNA, 32 nt, Human
gugaagugucugcugugccuuuacuuauuugg

SEQ ID NO: 476143 - RNA, 32 nt, Human
gugaagugugggcuaaauagggcugaggcuug

SEQ ID NO: 476144 - RNA, 32 nt, Human
gugaagugugggcucuuaggaagccugugggc

SEQ ID NO: 476145 - RNA, 32 nt, Human
gugaaguguucguggcaguagacucugaagcu

SEQ ID NO: 476146 - RNA, 32 nt, Human
gugaaguuaaauggcaaaaggccaggcgagca

SEQ ID NO: 476147 - RNA, 32 nt, Human
gugaaguuaacauugccaggacgauucuucua

SEQ ID NO: 476148 - RNA, 32 nt, Human
gugaaguucacugucaaccucuuauaguccau

SEQ ID NO: 476149 - RNA, 32 nt, Human
gugaaguuccaaucuaaugacaccugcuguga

SEQ ID NO: 476150 - RNA, 32 nt, Human
gugaaguuccucacacccugcuaccacccuaa

SEQ ID NO: 476151 - RNA, 32 nt, Human
gugaaguuguauguauguuugccugaggcugc

SEQ ID NO: 476152 - RNA, 32 nt, Human
gugaaguuguguauuuaaugcauuauagcaug

SEQ ID NO: 476153 - RNA, 32 nt, Human
gugaaguuugaaaacuuuucaaacuuuucuag

SEQ ID NO: 476154 - RNA, 32 nt, Human
gugaaguuuuuaauugguguucauccuauuuu

SEQ ID NO: 476155 - RNA, 32 nt, Human
gugaauaaaacauaaaugcacaaccuaacaca

SEQ ID NO: 476156 - RNA, 32 nt, Human
gugaauaaaucucauaucaaaugucaaacuuu

SEQ ID NO: 476157 - RNA, 32 nt, Human
gugaauaacugcacuccagccugggcaacaua

SEQ ID NO: 476158 - RNA, 32 nt, Human
gugaauaagccagugaccagauuucccccaga

SEQ ID NO: 476159 - RNA, 32 nt, Human
gugaauacauucuuugcuaguuggagugcuug

SEQ ID NO: 476160 - RNA, 32 nt, Human
gugaauacccagagguugggcagaucaguguc

SEQ ID NO: 476161 - RNA, 32 nt, Human
gugaauacucuccaccaagcccuugacccauu

SEQ ID NO: 476162 - RNA, 32 nt, Human
gugaauacugcaacacugucucaaagguuucu

SEQ ID NO: 476163 - RNA, 32 nt, Human
gugaauagccacugcacuccagccugggcaac

SEQ ID NO: 476164 - RNA, 32 nt, Human
gugaauagccacugcacuccaucuugggcaac

SEQ ID NO: 476165 - RNA, 32 nt, Human
gugaauagccacugcacucuagucuggggaac

SEQ ID NO: 476166 - RNA, 32 nt, Human
gugaauagccacugcacuucagccugggcaac

SEQ ID NO: 476167 - RNA, 32 nt, Human
gugaauagccacugcacuugagccucuuggga

SEQ ID NO: 476168 - RNA, 32 nt, Human
gugaauagugccacaauaaacauacacgugca

SEQ ID NO: 476169 - RNA, 32 nt, Human
gugaauaugccuguaauucaguguauuucagu

SEQ ID NO: 476170 - RNA, 32 nt, Human
gugaauauggggaccaggaaaaaugaggaugg

SEQ ID NO: 476171 - RNA, 32 nt, Human
gugaauauuaagguaguuauucacaaaaauug

SEQ ID NO: 476172 - RNA, 32 nt, Human
gugaauauugaaugguagcuugagucauucgu

SEQ ID NO: 476173 - RNA, 32 nt, Human
gugaaucaaagaaugagugggcaaguguugau

SEQ ID NO: 476174 - RNA, 22 nt, Human
gugaaucacaccuguaauccca

SEQ ID NO: 476175 - RNA, 32 nt, Human
gugaaucacugcaucugacuauggcaaggauc

SEQ ID NO: 476176 - RNA, 32 nt, Human
gugaaucagaccccauuccugccuucggggag

SEQ ID NO: 476177 - RNA, 32 nt, Human
gugaaucauugccuuuuucuuuaaaaagaugg

SEQ ID NO: 476178 - RNA, 32 nt, Human
gugaauccagugguggagguugcagugagcca

SEQ ID NO: 476179 - RNA, 32 nt, Human
gugaaucccacugugguauagauuccauaaua

SEQ ID NO: 476180 - RNA, 21 nt, Human
gugaaucccagacgaggcauu

SEQ ID NO: 476181 - RNA, 32 nt, Human
gugaaucccagaggagucucucccugugccca

SEQ ID NO: 476182 - RNA, 32 nt, Human
gugaauccuggcaagaaagcuugagucucaag

SEQ ID NO: 476183 - RNA, 23 nt, Human
gugaauccuggggcagggcacuu

SEQ ID NO: 476184 - RNA, 32 nt, Human
gugaauccugugagcuaauacagucuauacuu

SEQ ID NO: 476185 - RNA, 32 nt, Human
gugaauccuuguguuccauaugacuuuggaaa

SEQ ID NO: 476186 - RNA, 32 nt, Human
gugaaucgcuugaacccaggaggcagaguuug

SEQ ID NO: 476187 - RNA, 32 nt, Human
gugaaucuccaccugucuucuccagggagcuc

SEQ ID NO: 476188 - RNA, 21 nt, Human
gugaaucuccucacugucacu

SEQ ID NO: 476189 - RNA, 22 nt, Human
gugaaucuccucaugaauacuu

SEQ ID NO: 476190 - RNA, 32 nt, Human
gugaaucuccuuccuuucucucccugcuuugc

SEQ ID NO: 476191 - RNA, 32 nt, Human
gugaaucucuggggccaggaagacccugcugc

SEQ ID NO: 476192 - RNA, 32 nt, Human
gugaaucuuggaaacucaagccccagugcaaa

SEQ ID NO: 476193 - RNA, 32 nt, Human
gugaaugacucuguaaugaggccugagucuua

SEQ ID NO: 476194 - RNA, 32 nt, Human
gugaaugagaaaguauuugucucuccaacuug

SEQ ID NO: 476195 - RNA, 32 nt, Human
gugaaugauucugcacuuuguaaacagcacug

SEQ ID NO: 476196 - RNA, 32 nt, Human
gugaaugcacacaugcagaaaugcagagucaa

SEQ ID NO: 476197 - RNA, 32 nt, Human
gugaaugcagaagggaaugcaccccacauucc

SEQ ID NO: 476198 - RNA, 32 nt, Human
gugaaugcauuuuccccucuccuccucccugc

SEQ ID NO: 476199 - RNA, 20 nt, Human
gugaaugccaucuucuuccu

SEQ ID NO: 476200 - RNA, 32 nt, Human
gugaaugcuggccugugaugaauggcuggccu

SEQ ID NO: 476201 - RNA, 32 nt, Human
gugaauggauacagagcugaaugaguagguuc

SEQ ID NO: 476202 - RNA, 32 nt, Human
gugaauggauuaauggaacagaaaggaggugu

SEQ ID NO: 476203 - RNA, 32 nt, Human
gugaauggcaaauguugggauuugaacccagg

SEQ ID NO: 476204 - RNA, 32 nt, Human
gugaauggcauguucagcaggugcagaaaggg

SEQ ID NO: 476205 - RNA, 32 nt, Human
gugaauggccaggaucagauugugcccggccu

SEQ ID NO: 476206 - RNA, 32 nt, Human
gugaauggcuggaggugcagggccaggaggag

SEQ ID NO: 476207 - RNA, 32 nt, Human
gugaauggcuuuguauagaaccucuuugucua

SEQ ID NO: 476208 - RNA, 32 nt, Human
gugaaugggacggauucgaagugagcaaaggg

SEQ ID NO: 476209 - RNA, 32 nt, Human
gugaaugggagguggaggaggguugcagcucc

SEQ ID NO: 476210 - RNA, 32 nt, Human
gugaaugggauggaagccagagggucucuacc

SEQ ID NO: 476211 - RNA, 32 nt, Human
gugaaugggccacgugcccccacgcuggauac

SEQ ID NO: 476212 - RNA, 32 nt, Human
gugaaugggccuguggcccacccggggucacc

SEQ ID NO: 476213 - RNA, 32 nt, Human
gugaaugggccuguggcccaccuggggucacu

SEQ ID NO: 476214 - RNA, 32 nt, Human
gugaaugggcuucaaguggucacaaagagggu

SEQ ID NO: 476215 - RNA, 32 nt, Human
gugaaugguggugaccaggugggcagggcagg

SEQ ID NO: 476216 - RNA, 32 nt, Human
gugaauguacugggccuucuaaagcggcgcuu

SEQ ID NO: 476217 - RNA, 32 nt, Human
gugaaugucaagaguuagcuccuauagcaguu

SEQ ID NO: 476218 - RNA, 23 nt, Human
gugaaugugucuugcggcagcug

SEQ ID NO: 476219 - RNA, 32 nt, Human
gugaaugugugaaggucuugccugaauccauc

SEQ ID NO: 476220 - RNA, 32 nt, Human
gugaaugugugugaugucuucuaauuaauuuu

SEQ ID NO: 476221 - RNA, 32 nt, Human
gugaauuagcaaaccucagccuauguguuucu

SEQ ID NO: 476222 - RNA, 32 nt, Human
gugaauuauaccuuugugcaugccuaggaugu

SEQ ID NO: 476223 - RNA, 32 nt, Human
gugaauucaagaccagccuggccaacauggug

SEQ ID NO: 476224 - RNA, 32 nt, Human
gugaauucaucagcucugcaggcacagaccuu

SEQ ID NO: 476225 - RNA, 32 nt, Human
gugaauuccucuucaaagauuuuagccuguaa

SEQ ID NO: 476226 - RNA, 32 nt, Human
gugaauucucacucuuuguuucugcaaggucu

SEQ ID NO: 476227 - RNA, 32 nt, Human
gugaauucuuuagggcacuuuuguggccggau

SEQ ID NO: 476228 - RNA, 32 nt, Human
gugaauugaaguuucaaguuuuaaaguucauu

SEQ ID NO: 476229 - RNA, 32 nt, Human
gugaauugagugugagacuuaauaggaagacc

SEQ ID NO: 476230 - RNA, 32 nt, Human
gugaauugauccaucccaucucuucauuuuga

SEQ ID NO: 476231 - RNA, 32 nt, Human
gugaauugccacugcacuccagccuaagcaaa

SEQ ID NO: 476232 - RNA, 23 nt, Human
gugaauuguuagaugugcacuga

SEQ ID NO: 476233 - RNA, 32 nt, Human
gugaauuucaaaaauagacacuucuuaauugu

SEQ ID NO: 476234 - RNA, 32 nt, Human
gugaauuuccuuuaacaccgccugaaacaugc

SEQ ID NO: 476235 - RNA, 32 nt, Human
gugaauuucuacugcugaggaggcuugagcuu

SEQ ID NO: 476236 - RNA, 32 nt, Human
gugaauuucugucucaaaauguauaauauaga

SEQ ID NO: 476237 - RNA, 32 nt, Human
gugaauuuuugaaagaugaguaauuucuuugg

SEQ ID NO: 476238 - RNA, 21 nt, Human
gugacaaaagucuuuucuggg

SEQ ID NO: 476239 - RNA, 31 nt, Human
gugacaaacagcuagagcaucagagcccuuu

SEQ ID NO: 476240 - RNA, 32 nt, Human
gugacaaagaagcugaagaugggugguggaga

SEQ ID NO: 476241 - RNA, 32 nt, Human
gugacaaagucaaauaaacccccaaggacgac

SEQ ID NO: 476242 - RNA, 32 nt, Human
gugacaaauuuuuacuggugugaauugggaag

SEQ ID NO: 476243 - RNA, 32 nt, Human
gugacaacacucaucacacuucauuguaaauc

SEQ ID NO: 476244 - RNA, 32 nt, Human
gugacaacagugugugguguguuauuacagcu

SEQ ID NO: 476245 - RNA, 32 nt, Human
gugacaacccccagaaaugugaaaggagguuu

SEQ ID NO: 476246 - RNA, 32 nt, Human
gugacaaccuaugggaaaaggaaaggucgaga

SEQ ID NO: 476247 - RNA, 32 nt, Human
gugacaacugucuggauugccugcugcaaacg

SEQ ID NO: 476248 - RNA, 21 nt, Human
gugacaacugugagcauucca

SEQ ID NO: 476249 - RNA, 32 nt, Human
gugacaagaggaaggaaugggcccgugggaug

SEQ ID NO: 476250 - RNA, 32 nt, Human
gugacaagccuggguuucucccaggauaggug

SEQ ID NO: 476251 - RNA, 32 nt, Human
gugacaaggaagcagagaaagacgggaagagg

SEQ ID NO: 476252 - RNA, 23 nt, Human
gugacaaggcagaauucuuuaaa

SEQ ID NO: 476253 - RNA, 17 nt, Human
gugacaaggguccuggg

SEQ ID NO: 476254 - RNA, 32 nt, Human
gugacaagguaggggcuagguacuggacuacc

SEQ ID NO: 476255 - RNA, 21 nt, Human
gugacaagugaggcccuaccu

SEQ ID NO: 476256 - RNA, 32 nt, Human
gugacaagugccaguguuagugccaguuccag

SEQ ID NO: 476257 - RNA, 22 nt, Human
gugacaagugccuguaaucuca

SEQ ID NO: 476258 - RNA, 32 nt, Human
gugacaaguuaucuuggcugcugagaaagagu

SEQ ID NO: 476259 - RNA, 32 nt, Human
gugacaaugaccacugcagccuccaccuccua

SEQ ID NO: 476260 - RNA, 32 nt, Human
gugacaaugcaaaggaaagcaucuaacaguaa

SEQ ID NO: 476261 - RNA, 32 nt, Human
gugacaauuuccucuucuguuugacuauugua

SEQ ID NO: 476262 - RNA, 32 nt, Human
gugacacaaaccuauacuucauaugcugcuuu

SEQ ID NO: 476263 - RNA, 22 nt, Human
gugacacacaccuguaaucuca

SEQ ID NO: 476264 - RNA, 32 nt, Human
gugacacaccugcaggugucaggcauggcacu

SEQ ID NO: 476265 - RNA, 22 nt, Human
gugacacacgccuguaauccca

SEQ ID NO: 476266 - RNA, 32 nt, Human
gugacacagaaacacagcuccuccggauggug

SEQ ID NO: 476267 - RNA, 32 nt, Human
gugacacagaaaggaagaaacuagcgguguuc

SEQ ID NO: 476268 - RNA, 32 nt, Human
gugacacagacacacguuuggacugucuugua

SEQ ID NO: 476269 - RNA, 19 nt, Human
gugacacagcccugucauc

SEQ ID NO: 476270 - RNA, 32 nt, Human
gugacacaggacagccauaguauaguguguca

SEQ ID NO: 476271 - RNA, 32 nt, Human
gugacacagggugguuuggagcuggucacugu

SEQ ID NO: 476272 - RNA, 32 nt, Human
gugacacaugagacucacaguuggaguucucc

SEQ ID NO: 476273 - RNA, 22 nt, Human
gugacacaugccuguaguccca

SEQ ID NO: 476274 - RNA, 32 nt, Human
gugacacaugcucugcccucugaggcagucag

SEQ ID NO: 476275 - RNA, 32 nt, Human
gugacaccaccacugugucccagugucuggcc

SEQ ID NO: 476276 - RNA, 32 nt, Human
gugacacccugagaaucccaugacauuaucau

SEQ ID NO: 476277 - RNA, 32 nt, Human
gugacaccuucaccaauaacauagucauguau

SEQ ID NO: 476278 - RNA, 32 nt, Human
gugacaccuugaucuuggacugacacucauga

SEQ ID NO: 476279 - RNA, 32 nt, Human
gugacacgcaugcacacauggaguuccacaug

SEQ ID NO: 476280 - RNA, 32 nt, Human
gugacacgugucugacagagacgggagcucug

SEQ ID NO: 476281 - RNA, 32 nt, Human
gugacacuacagaaaaacacaaaaaggugaug

SEQ ID NO: 476282 - RNA, 32 nt, Human
gugacacucaggcuggaguggugguaagggac

SEQ ID NO: 476283 - RNA, 32 nt, Human
gugacacucaugcacagcagccauugcacgug

SEQ ID NO: 476284 - RNA, 32 nt, Human
gugacacucuccugccuggaaagaggacgaac

SEQ ID NO: 476285 - RNA, 32 nt, Human
gugacacugcacuccagccugggcaacagagc

SEQ ID NO: 476286 - RNA, 32 nt, Human
gugacacugcacuccagccugggcaacagagu

SEQ ID NO: 476287 - RNA, 32 nt, Human
gugacacugcacuccagccugggcgacagagu

SEQ ID NO: 476288 - RNA, 32 nt, Human
gugacacugcacuucagccuggcugacagagc

SEQ ID NO: 476289 - RNA, 32 nt, Human
gugacacugcccuccagccugggugacagagu

SEQ ID NO: 476290 - RNA, 32 nt, Human
gugacagaaaaccuguuaugcugcuuuguagu

SEQ ID NO: 476291 - RNA, 22 nt, Human
gugacagaaugagaccuugucu

SEQ ID NO: 476292 - RNA, 22 nt, Human
gugacagaaugagacuccaucu

SEQ ID NO: 476293 - RNA, 18 nt, Human
gugacagacacaugggua

SEQ ID NO: 476294 - RNA, 32 nt, Human
gugacagacccccauucggagcgcucucugca

SEQ ID NO: 476295 - RNA, 32 nt, Human
gugacagagaaacugagagagccacugguggu

SEQ ID NO: 476296 - RNA, 32 nt, Human
gugacagagaggaaggaggaggaaugagaggg

SEQ ID NO: 476297 - RNA, 32 nt, Human
gugacagagagggauauuggaggcuuuuuccc

SEQ ID NO: 476298 - RNA, 32 nt, Human
gugacagagauggguggaggggcuggggaaag

SEQ ID NO: 476299 - RNA, 22 nt, Human
gugacagagcaagacccugucu

SEQ ID NO: 476300 - RNA, 22 nt, Human
gugacagagcagacuccugucu

SEQ ID NO: 476301 - RNA, 32 nt, Human
gugacagagccucauggcuggggcaggcgggg

SEQ ID NO: 476302 - RNA, 24 nt, Human
gugacagagcgagaccaugucuca

SEQ ID NO: 476303 - RNA, 22 nt, Human
gugacagagcgagacccugucu

SEQ ID NO: 476304 - RNA, 22 nt, Human
gugacagagcgagacuccaucu

SEQ ID NO: 476305 - RNA, 22 nt, Human
gugacagagcgagacucugucu

SEQ ID NO: 476306 - RNA, 22 nt, Human
gugacagaguaagacucugucu

SEQ ID NO: 476307 - RNA, 32 nt, Human
gugacagaguaugguguuccuguagggaaaca

SEQ ID NO: 476308 - RNA, 22 nt, Human
gugacagagugagacccugucu

SEQ ID NO: 476309 - RNA, 22 nt, Human
gugacagagugagacuccaucu

SEQ ID NO: 476310 - RNA, 32 nt, Human
gugacagaguggggaaagauggggacugaggg

SEQ ID NO: 476311 - RNA, 19 nt, Human
gugacagaguugcuucuau

SEQ ID NO: 476312 - RNA, 32 nt, Human
gugacagaucacugcagccuccaacuccuggg

SEQ ID NO: 476313 - RNA, 27 nt, Human
gugacagcaagagaucuugucucagaa

SEQ ID NO: 476314 - RNA, 21 nt, Human
gugacagcacgcuccuuugaa

SEQ ID NO: 476315 - RNA, 32 nt, Human
gugacagcacuugcauggucacuugagcccac

SEQ ID NO: 476316 - RNA, 32 nt, Human
gugacagcagccgcccauccuaccuggaugga

SEQ ID NO: 476317 - RNA, 32 nt, Human
gugacagcauuuuuccccucugugcuggauac

SEQ ID NO: 476318 - RNA, 32 nt, Human
gugacagccuccagaaugucauggaagcagaa

SEQ ID NO: 476319 - RNA, 32 nt, Human
gugacagccuugccuguucugccuuguauguc

SEQ ID NO: 476320 - RNA, 32 nt, Human
gugacagcuucaaagccacugacucaugacac

SEQ ID NO: 476321 - RNA, 32 nt, Human
gugacagcuuccucuuagucaaggacacugcg

SEQ ID NO: 476322 - RNA, 32 nt, Human
gugacaggaagaaaggagggaagagcugaugu

SEQ ID NO: 476323 - RNA, 32 nt, Human
gugacaggaagaggagggagagggugacgaac

SEQ ID NO: 476324 - RNA, 18 nt, Human
gugacaggaagcccaagg

SEQ ID NO: 476325 - RNA, 32 nt, Human
gugacaggaaggccacguuccaaugucacagu

SEQ ID NO: 476326 - RNA, 32 nt, Human
gugacaggaauggggaaaaagagggauuucgc

SEQ ID NO: 476327 - RNA, 32 nt, Human
gugacaggaggcagcagaaguugcagagaaga

SEQ ID NO: 476328 - RNA, 18 nt, Human
gugacaggaucauacgua

SEQ ID NO: 476329 - RNA, 22 nt, Human
gugacaggcaccuauaauccca

SEQ ID NO: 476330 - RNA, 21 nt, Human
gugacaggcaggugcccugug

SEQ ID NO: 476331 - RNA, 16 nt, Human
gugacaggcaucaggu

SEQ ID NO: 476332 - RNA, 32 nt, Human
gugacaggccaaucagacagggcccagagcau

SEQ ID NO: 476333 - RNA, 32 nt, Human
gugacaggcccaggacgagguggccaggcggc

SEQ ID NO: 476334 - RNA, 17 nt, Human
gugacaggcccagggug

SEQ ID NO: 476335 - RNA, 32 nt, Human
gugacaggcccaguggaacagucacccuucug

SEQ ID NO: 476336 - RNA, 32 nt, Human
gugacaggccuggcuucaucaccccgcccacc

SEQ ID NO: 476337 - RNA, 15 nt, Human
gugacaggccuuagg

SEQ ID NO: 476338 - RNA, 19 nt, Human
gugacaggcgaauccuggg

SEQ ID NO: 476339 - RNA, 19 nt, Human
gugacaggcgcugccccug

SEQ ID NO: 476340 - RNA, 32 nt, Human
gugacaggcucuagguuugagcuagacuauuu

SEQ ID NO: 476341 - RNA, 15 nt, Human
gugacaggcuucagg

SEQ ID NO: 476342 - RNA, 19 nt, Human
gugacaggcuuugcggggu

SEQ ID NO: 476343 - RNA, 19 nt, Human
gugacaggcuuuuaaggua

SEQ ID NO: 476344 - RNA, 32 nt, Human
gugacaggggauccuggagcugugcuguggcu

SEQ ID NO: 476345 - RNA, 32 nt, Human
gugacagggucugcggcaccgcgccuggccag

SEQ ID NO: 476346 - RNA, 19 nt, Human
gugacaggguggauaggua

SEQ ID NO: 476347 - RNA, 32 nt, Human
gugacagguaacggggcccagccccggugucc

SEQ ID NO: 476348 - RNA, 32 nt, Human
gugacaggugauuuuauaugucagcuugacua

SEQ ID NO: 476349 - RNA, 22 nt, Human
gugacaggugccuguaauccca

SEQ ID NO: 476350 - RNA, 32 nt, Human
gugacaggugggaggauggcucugggugugug

SEQ ID NO: 476351 - RNA, 32 nt, Human
gugacaguaaagggcaggaagggaauacaaag

SEQ ID NO: 476352 - RNA, 32 nt, Human
gugacaguaggugagggcagaggaggagauca

SEQ ID NO: 476353 - RNA, 32 nt, Human
gugacaguccggaagcaauggaggcuucagug

SEQ ID NO: 476354 - RNA, 32 nt, Human
gugacagugaugacuaugcuggaucuuucgaa

SEQ ID NO: 476355 - RNA, 32 nt, Human
gugacagugcaucgaugcucccccgcguggcc

SEQ ID NO: 476356 - RNA, 32 nt, Human
gugacaguggcaggacggaugggcggguuuga

SEQ ID NO: 476357 - RNA, 32 nt, Human
gugacaguuaccggcuggagagccggaggugg

SEQ ID NO: 476358 - RNA, 32 nt, Human
gugacaguucacugcauauuuugagaccuuau

SEQ ID NO: 476359 - RNA, 32 nt, Human
gugacauaagcccucugggugguuaaccaggg

SEQ ID NO: 476360 - RNA, 32 nt, Human
gugacauagaccugcauauuugucagugccau

SEQ ID NO: 476361 - RNA, 32 nt, Human
gugacauaugaagaacaaagcaaucuaaacug

SEQ ID NO: 476362 - RNA, 32 nt, Human
gugacauauguaaucccagcacuuugggaggc

SEQ ID NO: 476363 - RNA, 20 nt, Human
gugacaucacccccagaucc

SEQ ID NO: 476364 - RNA, 32 nt, Human
gugacaucaucaucauggcaacaagagcugca

SEQ ID NO: 476365 - RNA, 21 nt, Human
gugacaucaugcaggaauucc

SEQ ID NO: 476366 - RNA, 32 nt, Human
gugacaucauggggcugaaagacuggacagaa

SEQ ID NO: 476367 - RNA, 19 nt, Human
gugacaucauuagcaagcc

SEQ ID NO: 476368 - RNA, 32 nt, Human
gugacauccucucccuccuuuccuuucucccu

SEQ ID NO: 476369 - RNA, 32 nt, Human
gugacauccuucagucccucacaucucugaca

SEQ ID NO: 476370 - RNA, 32 nt, Human
gugacauccuuccccuuccacccugcucccug

SEQ ID NO: 476371 - RNA, 20 nt, Human
gugacaucgucuuuaaaccc

SEQ ID NO: 476372 - RNA, 32 nt, Human
gugacaucuaccuagaaaucccuucccucuaa

SEQ ID NO: 476373 - RNA, 32 nt, Human
gugacaucugcauuuaauuuccagaaauuaaa

SEQ ID NO: 476374 - RNA, 21 nt, Human
gugacaucuuuucuucaagcc

SEQ ID NO: 476375 - RNA, 32 nt, Human
gugacaugaaugcacacaucacaaugaaauuu

SEQ ID NO: 476376 - RNA, 22 nt, Human
gugacaugcaccuguaauccca

SEQ ID NO: 476377 - RNA, 32 nt, Human
gugacaugcuuugccagcaccccuccccauca

SEQ ID NO: 476378 - RNA, 31 nt, Human
gugacauggacaaucuugggccuccauggag

SEQ ID NO: 476379 - RNA, 32 nt, Human
gugacauggggaaggcagaggcuggcaccaug

SEQ ID NO: 476380 - RNA, 32 nt, Human
gugacauggggaaggcagaggcuggcacgaug

SEQ ID NO: 476381 - RNA, 22 nt, Human
gugacaugugccuguaauccca

SEQ ID NO: 476382 - RNA, 32 nt, Human
gugacauuaggcagaaauggccagucaaacac

SEQ ID NO: 476383 - RNA, 32 nt, Human
gugacauucaguguuagaggugggccuaguag

SEQ ID NO: 476384 - RNA, 32 nt, Human
gugacauuccaggggucguuugcuuuucaggg

SEQ ID NO: 476385 - RNA, 32 nt, Human
gugacauuccucaaugaccucucccaaaccuc

SEQ ID NO: 476386 - RNA, 32 nt, Human
gugacauuccuucucccaucucuuccuugaca

SEQ ID NO: 476387 - RNA, 32 nt, Human
gugacauucucaaacuaaauguaaagugguug

SEQ ID NO: 476388 - RNA, 19 nt, Human
gugacauucucucucagca

SEQ ID NO: 476389 - RNA, 32 nt, Human
gugacauucugcagcuaguccacuacuccaag

SEQ ID NO: 476390 - RNA, 32 nt, Human
gugacauugcacaaucugccucugaagcugga

SEQ ID NO: 476391 - RNA, 32 nt, Human
gugacauuugcagagauauacacacacuuuuu

SEQ ID NO: 476392 - RNA, 32 nt, Human
gugaccaaaaccuugcuuggauuuuuaccuga

SEQ ID NO: 476393 - RNA, 32 nt, Human
gugaccaaagauggccagcuagagauucagca

SEQ ID NO: 476394 - RNA, 32 nt, Human
gugaccaaaucaacagcucuuuccaagaaaaa

SEQ ID NO: 476395 - RNA, 32 nt, Human
gugaccaacauagugaaaccccaucucuacug

SEQ ID NO: 476396 - RNA, 24 nt, Human
gugaccaaccaggcuccugugaua

SEQ ID NO: 476397 - RNA, 32 nt, Human
gugaccaagagaaaggcacugagcccuccgag

SEQ ID NO: 476398 - RNA, 32 nt, Human
gugaccacagagagcuauagcuaccagcuacc

SEQ ID NO: 476399 - RNA, 32 nt, Human
gugaccacaggcugguguguaggugguaaaac

SEQ ID NO: 476400 - RNA, 32 nt, Human
gugaccaccacacuccaggaggcagccccauc

SEQ ID NO: 476401 - RNA, 32 nt, Human
gugaccaccauggacugcccuuccccucugag

SEQ ID NO: 476402 - RNA, 32 nt, Human
gugaccaccccuccaauaucccagaaugaaua

SEQ ID NO: 476403 - RNA, 32 nt, Human
gugaccacgaagcagcugacugugcaucacgc

SEQ ID NO: 476404 - RNA, 32 nt, Human
gugaccacgccuuuugcuggggccugcuggag

SEQ ID NO: 476405 - RNA, 32 nt, Human
gugaccacuccugggagcggggguggucgggg

SEQ ID NO: 476406 - RNA, 24 nt, Human
gugaccagacagaaccuccacuca

SEQ ID NO: 476407 - RNA, 32 nt, Human
gugaccagagcugggaugagagaggggaaggg

SEQ ID NO: 476408 - RNA, 32 nt, Human
gugaccagagcuugccucugaaugccccuugu

SEQ ID NO: 476409 - RNA, 32 nt, Human
gugaccagagggcaaaggacccauucucagua

SEQ ID NO: 476410 - RNA, 32 nt, Human
gugaccagcacugucucaguuucacuuucaca

SEQ ID NO: 476411 - RNA, 32 nt, Human
gugaccagccauggucuggacugugaguuuac

SEQ ID NO: 476412 - RNA, 25 nt, Human
gugaccagcuaugcuucuugugaua

SEQ ID NO: 476413 - RNA, 24 nt, Human
gugaccagcuccugccaccacuca

SEQ ID NO: 476414 - RNA, 32 nt, Human
gugaccagcugaggaccucaggcugcagcgga

SEQ ID NO: 476415 - RNA, 32 nt, Human
gugaccagcuggcagacucgggaccaauacua

SEQ ID NO: 476416 - RNA, 32 nt, Human
gugaccaggagaacaaggagcuccuccagcaa

SEQ ID NO: 476417 - RNA, 32 nt, Human
gugaccaggccucacuacaggccugguuggau

SEQ ID NO: 476418 - RNA, 32 nt, Human
gugaccagggaccacguugcugccugugaaug

SEQ ID NO: 476419 - RNA, 32 nt, Human
gugaccagggaggccagccugggagguccaga

SEQ ID NO: 476420 - RNA, 32 nt, Human
gugaccaggggcaccggcugcccacagggaac

SEQ ID NO: 476421 - RNA, 21 nt, Human
gugaccagggugccccaucca

SEQ ID NO: 476422 - RNA, 32 nt, Human
gugaccagucccggaagagagcuggggaugag

SEQ ID NO: 476423 - RNA, 32 nt, Human
gugaccaguucuuuaauucuguaagugaacuc

SEQ ID NO: 476424 - RNA, 32 nt, Human
gugaccauacacaaccaucacagcggagguga

SEQ ID NO: 476425 - RNA, 32 nt, Human
gugaccauagaggcagagauuggagugaagug

SEQ ID NO: 476426 - RNA, 32 nt, Human
gugaccaucuagggcaguaccugcugggcuua

SEQ ID NO: 476427 - RNA, 32 nt, Human
gugaccauggccagcaggaagccacugaugag

SEQ ID NO: 476428 - RNA, 32 nt, Human
gugaccaugguguuguucuugaugacauugcu

SEQ ID NO: 476429 - RNA, 32 nt, Human
gugaccauguucauuauaaucucaaaggagaa

SEQ ID NO: 476430 - RNA, 32 nt, Human
gugaccauuuggaugucugggcccugccaagg

SEQ ID NO: 476431 - RNA, 32 nt, Human
gugacccaauccccuuccuccuggccuggacg

SEQ ID NO: 476432 - RNA, 22 nt, Human
gugacccacaccuguaauccca

SEQ ID NO: 476433 - RNA, 32 nt, Human
gugacccagacuugagaggucguuugggcuuu

SEQ ID NO: 476434 - RNA, 32 nt, Human
gugacccagcagaggugugacgggaggcuggg

SEQ ID NO: 476435 - RNA, 32 nt, Human
gugacccagccaugggcacuagcucaucuuuc

SEQ ID NO: 476436 - RNA, 32 nt, Human
gugacccagcccaggacgaaguuuacaaacac

SEQ ID NO: 476437 - RNA, 22 nt, Human
gugacccaggcuggaaugcaau

SEQ ID NO: 476438 - RNA, 23 nt, Human
gugacccaggcuggaaugcaaug

SEQ ID NO: 476439 - RNA, 22 nt, Human
gugacccaggcuggaguguagu

SEQ ID NO: 476440 - RNA, 32 nt, Human
gugacccaggguggggacaggggcuggcccag

SEQ ID NO: 476441 - RNA, 32 nt, Human
gugacccaucuauuuuuguuugggaagaggaa

SEQ ID NO: 476442 - RNA, 32 nt, Human
gugacccaugacccacagugcuggccuccugu

SEQ ID NO: 476443 - RNA, 32 nt, Human
gugacccaugcgcuagggucucugcugaggaa

SEQ ID NO: 476444 - RNA, 32 nt, Human
gugacccauugccucuguuggaagacagaggu

SEQ ID NO: 476445 - RNA, 32 nt, Human
gugaccccaaccuaugcucucggucuuuccug

SEQ ID NO: 476446 - RNA, 32 nt, Human
gugaccccaggccccaggaaagggagcgagga

SEQ ID NO: 476447 - RNA, 32 nt, Human
gugaccccagugcuuuucagacguuucuuagc

SEQ ID NO: 476448 - RNA, 32 nt, Human
gugaccccauccccauccccaggauucccacc

SEQ ID NO: 476449 - RNA, 32 nt, Human
gugacccccagagggauaccgauucaaaagau

SEQ ID NO: 476450 - RNA, 32 nt, Human
gugacccccagcuaucgccucuugccuucccc

SEQ ID NO: 476451 - RNA, 32 nt, Human
gugacccccaggaggaggauuccuggggcugg

SEQ ID NO: 476452 - RNA, 32 nt, Human
gugacccccuagugcuuccuggagcugaggcu

SEQ ID NO: 476453 - RNA, 32 nt, Human
gugaccccgggggcacacaggcuccacacugc

SEQ ID NO: 476454 - RNA, 32 nt, Human
gugacccgggcccugaccuucucccucuuccc

SEQ ID NO: 476455 - RNA, 32 nt, Human
gugacccuccaggauaaggucugugcgugaga

SEQ ID NO: 476456 - RNA, 32 nt, Human
gugacccugcagcuccucaaaccagccuguau

SEQ ID NO: 476457 - RNA, 32 nt, Human
gugacccugccuggccucccacacccccugca

SEQ ID NO: 476458 - RNA, 32 nt, Human
gugacccuggcuggcccuguuugucugugggu

SEQ ID NO: 476459 - RNA, 32 nt, Human
gugacccugggugugaggagacguggucugug

SEQ ID NO: 476460 - RNA, 32 nt, Human
gugacccuggucacuuggugcugguguagggg

SEQ ID NO: 476461 - RNA, 32 nt, Human
gugacccugguuucugagcuccagaaacucug

SEQ ID NO: 476462 - RNA, 21 nt, Human
gugacccugucagugcuuuca

SEQ ID NO: 476463 - RNA, 32 nt, Human
gugacccuucaaggaguucagaccugggggcu

SEQ ID NO: 476464 - RNA, 32 nt, Human
gugacccuuccuguaaccauaacugaaagauu

SEQ ID NO: 476465 - RNA, 32 nt, Human
gugaccgaaugagagacucuacaggggcaggu

SEQ ID NO: 476466 - RNA, 32 nt, Human
gugaccgaauugcuguaaccucaggaucaaac

SEQ ID NO: 476467 - RNA, 24 nt, Human
gugaccgacucaugcuucuggaua

SEQ ID NO: 476468 - RNA, 32 nt, Human
gugaccgagacuaagucuagcacacagcacuu

SEQ ID NO: 476469 - RNA, 32 nt, Human
gugaccgagcccagcggagccugagcaaggag

SEQ ID NO: 476470 - RNA, 24 nt, Human
gugaccgaucaugcugcugugaua

SEQ ID NO: 476471 - RNA, 32 nt, Human
gugaccgcaagcgauucacccaccucagccuc

SEQ ID NO: 476472 - RNA, 20 nt, Human
gugaccgcgccuguaauccc

SEQ ID NO: 476473 - RNA, 32 nt, Human
gugaccgcgcuccagacacagcucugcguccu

SEQ ID NO: 476474 - RNA, 32 nt, Human
gugaccggagagaaagaggagcccucccgcuc

SEQ ID NO: 476475 - RNA, 32 nt, Human
gugaccggaggagacaucggccucugcaggcu

SEQ ID NO: 476476 - RNA, 32 nt, Human
gugaccggcucuggaaguucccaugaauggac

SEQ ID NO: 476477 - RNA, 18 nt, Human
gugaccggcugugcggga

SEQ ID NO: 476478 - RNA, 32 nt, Human
gugaccgggaagggaagucagggucuggggcc

SEQ ID NO: 476479 - RNA, 32 nt, Human
gugaccggugccuguucuccccugaccgagcc

SEQ ID NO: 476480 - RNA, 32 nt, Human
gugaccgucccucucagaagcuuuucccugga

SEQ ID NO: 476481 - RNA, 32 nt, Human
gugaccgucucccuuuguacauacuugcacac

SEQ ID NO: 476482 - RNA, 32 nt, Human
gugaccgucuguccuucaggagaggacaccag

SEQ ID NO: 476483 - RNA, 32 nt, Human
gugaccguuggcccuccugccugguggcgcug

SEQ ID NO: 476484 - RNA, 32 nt, Human
gugaccuaccgcugcccucccuuucuaagaga

SEQ ID NO: 476485 - RNA, 30 nt, Human
gugaccuacuaaaaauauaaaaauuagcug

SEQ ID NO: 476486 - RNA, 32 nt, Human
gugaccuacuaaaaauauaaaaauuagcuggg

SEQ ID NO: 476487 - RNA, 32 nt, Human
gugaccuaggacaaguaccucacuucucugag

SEQ ID NO: 476488 - RNA, 32 nt, Human
gugaccuaugaccacaucacuguacgccagcc

SEQ ID NO: 476489 - RNA, 32 nt, Human
gugaccuaugccugcaauccagcacuuuggga

SEQ ID NO: 476490 - RNA, 32 nt, Human
gugaccucagccaaguugcuugacuauucuca

SEQ ID NO: 476491 - RNA, 32 nt, Human
gugaccucauacauccccugagccucacuaga

SEQ ID NO: 476492 - RNA, 32 nt, Human
gugaccuccaggcagcagucucugcuccagaa

SEQ ID NO: 476493 - RNA, 32 nt, Human
gugaccuccguccucuccccagccuggcacag

SEQ ID NO: 476494 - RNA, 32 nt, Human
gugaccucucucuccucagauuuccuucuugg

SEQ ID NO: 476495 - RNA, 24 nt, Human
gugaccucugauaaauuacugcua

SEQ ID NO: 476496 - RNA, 32 nt, Human
gugaccucugcaguacuccuuagccugcguuu

SEQ ID NO: 476497 - RNA, 32 nt, Human
gugaccucuggcucuuucacuuccuccccacc

SEQ ID NO: 476498 - RNA, 32 nt, Human
gugaccucuggguaguccuggcaugccaacau

SEQ ID NO: 476499 - RNA, 32 nt, Human
gugaccugauguaaacagugucuucuuaaaau

SEQ ID NO: 476500 - RNA, 32 nt, Human
gugaccugauguaaacagugucuucuuaaaug

SEQ ID NO: 476501 - RNA, 32 nt, Human
gugaccugccgaaguccacugccuuugcccca

SEQ ID NO: 476502 - RNA, 32 nt, Human
gugaccugcuccugggacuuugcuggcucacg

SEQ ID NO: 476503 - RNA, 32 nt, Human
gugaccuggaaaggguacuagauggaaacuug

SEQ ID NO: 476504 - RNA, 32 nt, Human
gugaccuggagagagaaagaaagaugaccccu

SEQ ID NO: 476505 - RNA, 32 nt, Human
gugaccuggaggacagugugugccaugucucc

SEQ ID NO: 476506 - RNA, 32 nt, Human
gugaccuggagggagacagggugacagcacca

SEQ ID NO: 476507 - RNA, 32 nt, Human
gugaccuggcccagaugagcucugccugcuug

SEQ ID NO: 476508 - RNA, 29 nt, Human
gugaccuggcugccuuccaccccuuguac

SEQ ID NO: 476509 - RNA, 32 nt, Human
gugaccuggcuggaguuaccuggugcacauag

SEQ ID NO: 476510 - RNA, 32 nt, Human
gugaccugggcugaguccugggagugggaaga

SEQ ID NO: 476511 - RNA, 32 nt, Human
gugaccuggguauccccugccuccugccaccc

SEQ ID NO: 476512 - RNA, 32 nt, Human
gugaccugggugaggaaggucauuuggguuuu

SEQ ID NO: 476513 - RNA, 32 nt, Human
gugaccugguccugaccaucuggggcacgagg

SEQ ID NO: 476514 - RNA, 32 nt, Human
gugaccugucacacucaccuggcuccagccuc

SEQ ID NO: 476515 - RNA, 32 nt, Human
gugaccuguccccagggcugcagcuguaucca

SEQ ID NO: 476516 - RNA, 32 nt, Human
gugaccugugguucugggcuggugagggcacc

SEQ ID NO: 476517 - RNA, 19 nt, Human
gugaccuguuuucccagca

SEQ ID NO: 476518 - RNA, 32 nt, Human
gugaccuuauugcugcucagacucuauguucc

SEQ ID NO: 476519 - RNA, 32 nt, Human
gugaccuuccucacuuucucuugucccagcuu

SEQ ID NO: 476520 - RNA, 32 nt, Human
gugaccuugagauccugauaccaccuucaagg

SEQ ID NO: 476521 - RNA, 32 nt, Human
gugaccuugccuccuucuccuugccaacuuug

SEQ ID NO: 476522 - RNA, 32 nt, Human
gugaccuuggaugcccccuccagggauccccc

SEQ ID NO: 476523 - RNA, 32 nt, Human
gugaccuuggcaugucuuggcagcagcuagau

SEQ ID NO: 476524 - RNA, 32 nt, Human
gugaccuuggcccaucuccacccuccaaccug

SEQ ID NO: 476525 - RNA, 32 nt, Human
gugaccuuggccccagcuccgcaagggaaucc

SEQ ID NO: 476526 - RNA, 18 nt, Human
gugaccuuggcucccagc

SEQ ID NO: 476527 - RNA, 32 nt, Human
gugaccuugucugccaagaucuuucuuuugaa

SEQ ID NO: 476528 - RNA, 32 nt, Human
gugacgaacugggugugaggcacacagccuaa

SEQ ID NO: 476529 - RNA, 32 nt, Human
gugacgacaacagggacaaggacuccgagaag

SEQ ID NO: 476530 - RNA, 32 nt, Human
gugacgaccccaaaugccaagacagcuacaaa

SEQ ID NO: 476531 - RNA, 32 nt, Human
gugacgagcgcuccucccuggaguucagcccu

SEQ ID NO: 476532 - RNA, 32 nt, Human
gugacgaggccuggccaggggugcaggagcag

SEQ ID NO: 476533 - RNA, 32 nt, Human
gugacgauggagcucuugaggacucugcacuu

SEQ ID NO: 476534 - RNA, 32 nt, Human
gugacgaugggaagacauggaaaacaaggaga

SEQ ID NO: 476535 - RNA, 32 nt, Human
gugacgauggguguugcuguuuuucuuguguu

SEQ ID NO: 476536 - RNA, 24 nt, Human
gugacgcacgugcccacaccccca

SEQ ID NO: 476537 - RNA, 32 nt, Human
gugacgcacugccucccuuucacuguuucgcc

SEQ ID NO: 476538 - RNA, 32 nt, Human
gugacgcccagccccggacacaguacuccaga

SEQ ID NO: 476539 - RNA, 32 nt, Human
gugacgcccgggcugcuuggucacaacucugu

SEQ ID NO: 476540 - RNA, 32 nt, Human
gugacgcccugagacccugcuuggccuagcua

SEQ ID NO: 476541 - RNA, 22 nt, Human
gugacgccugccuguaguccca

SEQ ID NO: 476542 - RNA, 25 nt, Human
gugacgcgcacacccugcaccacca

SEQ ID NO: 476543 - RNA, 32 nt, Human
gugacgcgcugacaguggaugcgaaugcguga

SEQ ID NO: 476544 - RNA, 32 nt, Human
gugacgcggcacugcgucuccagccuaccucc

SEQ ID NO: 476545 - RNA, 22 nt, Human
gugacgcguaccugugauccca

SEQ ID NO: 476546 - RNA, 32 nt, Human
gugacgcuaggacacccucugccugcauguca

SEQ ID NO: 476547 - RNA, 32 nt, Human
gugacgcuccagagaacuacccugaguggaga

SEQ ID NO: 476548 - RNA, 32 nt, Human
gugacgcugcugcaccacgugcuggaggaagc

SEQ ID NO: 476549 - RNA, 32 nt, Human
gugacgcugugcucugaucuugcuggaggcga

SEQ ID NO: 476550 - RNA, 21 nt, Human
gugacgcuugccuguauccca

SEQ ID NO: 476551 - RNA, 32 nt, Human
gugacggaguuucccucuuguugcccaggcug

SEQ ID NO: 476552 - RNA, 19 nt, Human
gugacggcacauucaaguc

SEQ ID NO: 476553 - RNA, 32 nt, Human
gugacggcacccgagcccugagggucccagcc

SEQ ID NO: 476554 - RNA, 32 nt, Human
gugacggcgacccugcagcccaaggagcgcuc

SEQ ID NO: 476555 - RNA, 32 nt, Human
gugacggcucacugcagccugcgccucccagc

SEQ ID NO: 476556 - RNA, 32 nt, Human
gugacgggagaggagguuggagguguagcgau

SEQ ID NO: 476557 - RNA, 22 nt, Human
gugacgggcaccuguaguccca

SEQ ID NO: 476558 - RNA, 32 nt, Human
gugacgggcagcuucgcagagugcaguacagc

SEQ ID NO: 476559 - RNA, 32 nt, Human
gugacgggcagcuucgcggagugcaguacagc

SEQ ID NO: 476560 - RNA, 22 nt, Human
gugacgggcgccuguaauccca

SEQ ID NO: 476561 - RNA, 32 nt, Human
gugacggggagggagacgggauaguguuucug

SEQ ID NO: 476562 - RNA, 32 nt, Human
gugacggggccagcuggacacacggugagauu

SEQ ID NO: 476563 - RNA, 32 nt, Human
gugacgggggagcacccccauccagacugcga

SEQ ID NO: 476564 - RNA, 32 nt, Human
gugacgggugcccagaacaugaucucaggaac

SEQ ID NO: 476565 - RNA, 22 nt, Human
gugacgggugccuguaauccca

SEQ ID NO: 476566 - RNA, 32 nt, Human
gugacggucuuuauucccaucuggcuucugca

SEQ ID NO: 476567 - RNA, 32 nt, Human
gugacggugaucucggggugggcaggacucca

SEQ ID NO: 476568 - RNA, 32 nt, Human
gugacggugcccaggauagauguaauauuucu

SEQ ID NO: 476569 - RNA, 32 nt, Human
gugacgucaugcccuucucaugugggcagcuu

SEQ ID NO: 476570 - RNA, 24 nt, Human
gugacguccuguuuccucugaaga

SEQ ID NO: 476571 - RNA, 32 nt, Human
gugacgugagccacggggaagccaccuagguc

SEQ ID NO: 476572 - RNA, 32 nt, Human
gugacgugcaccuguacucaggaggcugaggg

SEQ ID NO: 476573 - RNA, 32 nt, Human
gugacgugggcuccugaguuccucccacagaa

SEQ ID NO: 476574 - RNA, 32 nt, Human
gugacguggucaccaaggcagugagccccgcu

SEQ ID NO: 476575 - RNA, 32 nt, Human
gugacuaacacagugaaaccccgucucuaaua

SEQ ID NO: 476576 - RNA, 32 nt, Human
gugacuaaucuagacacuuccaugcaccuggg

SEQ ID NO: 476577 - RNA, 32 nt, Human
gugacuaaugaccacaccugccucucccgucg

SEQ ID NO: 476578 - RNA, 32 nt, Human
gugacuaccuccacucaugucccauuuuagcc

SEQ ID NO: 476579 - RNA, 32 nt, Human
gugacuacuugaccaacagaauacagcagaag

SEQ ID NO: 476580 - RNA, 32 nt, Human
gugacuagauuuccacuaaugugucuuaaucu

SEQ ID NO: 476581 - RNA, 32 nt, Human
gugacuagcuacugcacuccaaccugggcaac

SEQ ID NO: 476582 - RNA, 32 nt, Human
gugacuaggcagcagggggucaggaugcggcg

SEQ ID NO: 476583 - RNA, 32 nt, Human
gugacuagggcugggggagagguuaggaggag

SEQ ID NO: 476584 - RNA, 32 nt, Human
gugacuaugaaugacugccgggcaguaacuuc

SEQ ID NO: 476585 - RNA, 32 nt, Human
gugacuaugccuccucuucugcacagaaugcu

SEQ ID NO: 476586 - RNA, 32 nt, Human
gugacucaacaaagacaggacacaugggguac

SEQ ID NO: 476587 - RNA, 17 nt, Human
gugacucaaccaaggcc

SEQ ID NO: 476588 - RNA, 32 nt, Human
gugacucaacuccaggggcaagauggggagug

SEQ ID NO: 476589 - RNA, 32 nt, Human
gugacucaagccuguaucccagcacuuuggga

SEQ ID NO: 476590 - RNA, 32 nt, Human
gugacucaaggccugcuguuuaaucacagaua

SEQ ID NO: 476591 - RNA, 22 nt, Human
gugacucacaccuauaauccca

SEQ ID NO: 476592 - RNA, 19 nt, Human
gugacucacaccuguaauc

SEQ ID NO: 476593 - RNA, 20 nt, Human
gugacucacaccuguaaucc

SEQ ID NO: 476594 - RNA, 22 nt, Human
gugacucacaccuguaauccca

SEQ ID NO: 476595 - RNA, 22 nt, Human
gugacucacaccuguaauccua

SEQ ID NO: 476596 - RNA, 22 nt, Human
gugacucacaccuguaaucuca

SEQ ID NO: 476597 - RNA, 19 nt, Human
gugacucacacugauccca

SEQ ID NO: 476598 - RNA, 22 nt, Human
gugacucacacuuguaauccca

SEQ ID NO: 476599 - RNA, 22 nt, Human
gugacucacagccguaauccca

SEQ ID NO: 476600 - RNA, 32 nt, Human
gugacucacauaaaaucaggaacuugacacag

SEQ ID NO: 476601 - RNA, 19 nt, Human
gugacucacaucuguaauc

SEQ ID NO: 476602 - RNA, 20 nt, Human
gugacucacaucuguaaucc

SEQ ID NO: 476603 - RNA, 22 nt, Human
gugacucacaucuguaauccca

SEQ ID NO: 476604 - RNA, 22 nt, Human
gugacucacgccuauaauccca

SEQ ID NO: 476605 - RNA, 22 nt, Human
gugacucacgccuauaaucuca

SEQ ID NO: 476606 - RNA, 22 nt, Human
gugacucacgccuguaacccca

SEQ ID NO: 476607 - RNA, 19 nt, Human
gugacucacgccuguaauc

SEQ ID NO: 476608 - RNA, 22 nt, Human
gugacucacgccuguaauccca

SEQ ID NO: 476609 - RNA, 22 nt, Human
gugacucacgucuguaauccca

SEQ ID NO: 476610 - RNA, 32 nt, Human
gugacucacuuccaaagaguggaguauggaaa

SEQ ID NO: 476611 - RNA, 32 nt, Human
gugacucagaggacagggcuaggcaggagacc

SEQ ID NO: 476612 - RNA, 32 nt, Human
gugacucagaucaaagagagcaaauggcaaag

SEQ ID NO: 476613 - RNA, 32 nt, Human
gugacucaggcagaggaagggcuacacaggug

SEQ ID NO: 476614 - RNA, 22 nt, Human
gugacucaggccuguaauccca

SEQ ID NO: 476615 - RNA, 32 nt, Human
gugacucaguugaaacucaguguugcauacau

SEQ ID NO: 476616 - RNA, 22 nt, Human
gugacucauaccuguaauccca

SEQ ID NO: 476617 - RNA, 18 nt, Human
gugacucauccucuugaa

SEQ ID NO: 476618 - RNA, 32 nt, Human
gugacucauccugggaggaucugagcugguuc

SEQ ID NO: 476619 - RNA, 32 nt, Human
gugacucaucgaggagcuccagcuguugggac

SEQ ID NO: 476620 - RNA, 19 nt, Human
gugacucaugccuguaauc

SEQ ID NO: 476621 - RNA, 22 nt, Human
gugacucaugccuguaauccca

SEQ ID NO: 476622 - RNA, 22 nt, Human
gugacucaugccuguaauccua

SEQ ID NO: 476623 - RNA, 22 nt, Human
gugacucaugcuuguaauccca

SEQ ID NO: 476624 - RNA, 32 nt, Human
gugacucaugggaucaugagguccauggcugg

SEQ ID NO: 476625 - RNA, 32 nt, Human
gugacuccaggauauucaacacaggaaggagc

SEQ ID NO: 476626 - RNA, 24 nt, Human
gugacucccacaccuguaacccca

SEQ ID NO: 476627 - RNA, 32 nt, Human
gugacucccacugcacuccagcucggggaaca

SEQ ID NO: 476628 - RNA, 20 nt, Human
gugacucccagcccaagccc

SEQ ID NO: 476629 - RNA, 32 nt, Human
gugacuccccuugacagagugcccccaccccc

SEQ ID NO: 476630 - RNA, 32 nt, Human
gugacuccccuuucucuucucgucccuccucc

SEQ ID NO: 476631 - RNA, 32 nt, Human
gugacucccuuguguguaucugugccagccuc

SEQ ID NO: 476632 - RNA, 21 nt, Human
gugacuccgcagcuucugaca

SEQ ID NO: 476633 - RNA, 32 nt, Human
gugacuccugcugggagagguaaguugaagua

SEQ ID NO: 476634 - RNA, 18 nt, Human
gugacuccuguugucguc

SEQ ID NO: 476635 - RNA, 32 nt, Human
gugacuccuucaucccgcucagugccaugucc

SEQ ID NO: 476636 - RNA, 32 nt, Human
gugacuccuugaucuucuuccugcguggagag

SEQ ID NO: 476637 - RNA, 22 nt, Human
gugacucgcaccuguaauccca

SEQ ID NO: 476638 - RNA, 22 nt, Human
gugacucgggggaggaggcgac

SEQ ID NO: 476639 - RNA, 32 nt, Human
gugacucuaagcucagugcucucuccacuacc

SEQ ID NO: 476640 - RNA, 32 nt, Human
gugacucuccagagagcaacagugauggcucu

SEQ ID NO: 476641 - RNA, 32 nt, Human
gugacucucgccccgccagccccagcccugca

SEQ ID NO: 476642 - RNA, 32 nt, Human
gugacucugcagcuccuggccagcugauucag

SEQ ID NO: 476643 - RNA, 32 nt, Human
gugacucuggaccugagguugcgugagauccc

SEQ ID NO: 476644 - RNA, 31 nt, Human
gugacucugggcgcggagguuggcgacuggc

SEQ ID NO: 476645 - RNA, 32 nt, Human
gugacucugugguguggagcugacuuccagag

SEQ ID NO: 476646 - RNA, 32 nt, Human
gugacucuuagcaaccucauuucgacaguggu

SEQ ID NO: 476647 - RNA, 32 nt, Human
gugacucuuccuuagacagcuagaaagaugcu

SEQ ID NO: 476648 - RNA, 20 nt, Human
gugacucuucugcccuugag

SEQ ID NO: 476649 - RNA, 32 nt, Human
gugacucuucuguggagcuuuacccucugagu

SEQ ID NO: 476650 - RNA, 32 nt, Human
gugacugaaacggcaucugccucacagugcau

SEQ ID NO: 476651 - RNA, 32 nt, Human
gugacugaagaauuuucaaaccagcuuuacac

SEQ ID NO: 476652 - RNA, 32 nt, Human
gugacugaagugaaaaucaacgaggcccgaga

SEQ ID NO: 476653 - RNA, 32 nt, Human
gugacugacccgugacccagcaugcaaagaag

SEQ ID NO: 476654 - RNA, 32 nt, Human
gugacugagccccucuucggggccacgcagcu

SEQ ID NO: 476655 - RNA, 21 nt, Human
gugacugagccuguguccugu

SEQ ID NO: 476656 - RNA, 32 nt, Human
gugacugagcuacaagccuggcggcgggugug

SEQ ID NO: 476657 - RNA, 32 nt, Human
gugacugagcuacgagccuggcggcgggugug

SEQ ID NO: 476658 - RNA, 32 nt, Human
gugacugagcucuauucuguaccugccacucu

SEQ ID NO: 476659 - RNA, 32 nt, Human
gugacugagcuucccucccguguguucuccgu

SEQ ID NO: 476660 - RNA, 32 nt, Human
gugacugaggcccugcgagccugguggucuug

SEQ ID NO: 476661 - RNA, 32 nt, Human
gugacugagggggcagaggcaguggcucuuua

SEQ ID NO: 476662 - RNA, 32 nt, Human
gugacugaggugagcaagauaucccuuaaacu

SEQ ID NO: 476663 - RNA, 32 nt, Human
gugacugauccacgccagccucucugagccaa

SEQ ID NO: 476664 - RNA, 19 nt, Human
gugacugaugccuguaauc

SEQ ID NO: 476665 - RNA, 22 nt, Human
gugacugaugccuguaauccca

SEQ ID NO: 476666 - RNA, 32 nt, Human
gugacugcaaccacugccucccagguucaaga

SEQ ID NO: 476667 - RNA, 32 nt, Human
gugacugcacacaucugggcucuaaaugaauu

SEQ ID NO: 476668 - RNA, 32 nt, Human
gugacugcaccacugcacagucugggcgacag

SEQ ID NO: 476669 - RNA, 32 nt, Human
gugacugcaccacugcacuccacccugggcag

SEQ ID NO: 476670 - RNA, 32 nt, Human
gugacugcaccauggcacuggcaccagggcga

SEQ ID NO: 476671 - RNA, 32 nt, Human
gugacugcagagcagggauaccaaggcaggcc

SEQ ID NO: 476672 - RNA, 32 nt, Human
gugacugcagagccguccaaccccaguccugu

SEQ ID NO: 476673 - RNA, 32 nt, Human
gugacugcagccuguguaggaccauggggagu

SEQ ID NO: 476674 - RNA, 32 nt, Human
gugacugcaucuguucaaucugcuccagagac

SEQ ID NO: 476675 - RNA, 32 nt, Human
gugacugccaagcaggcaaccccugaugauuu

SEQ ID NO: 476676 - RNA, 21 nt, Human
gugacugccgaguguucugug

SEQ ID NO: 476677 - RNA, 32 nt, Human
gugacugcgccacugcacuccagucugggaca

SEQ ID NO: 476678 - RNA, 32 nt, Human
gugacugcucaggaguuugggggcuccaggac

SEQ ID NO: 476679 - RNA, 32 nt, Human
gugacugcugcaagcucugccuucaccaguag

SEQ ID NO: 476680 - RNA, 32 nt, Human
gugacugcuguugccaauaccucagacuccag

SEQ ID NO: 476681 - RNA, 21 nt, Human
gugacugcuucauugccaugg

SEQ ID NO: 476682 - RNA, 32 nt, Human
gugacuggagccacgaugcacggccaggcgcg

SEQ ID NO: 476683 - RNA, 32 nt, Human
gugacuggaguccugagcugugucugaagacu

SEQ ID NO: 476684 - RNA, 32 nt, Human
gugacuggaucccuagcuccagccucuuccug

SEQ ID NO: 476685 - RNA, 32 nt, Human
gugacuggaugauuccggcauuccugggucuu

SEQ ID NO: 476686 - RNA, 32 nt, Human
gugacuggcaggcaggugaggggcacagcacc

SEQ ID NO: 476687 - RNA, 21 nt, Human
gugacuggcaggcugcccucg

SEQ ID NO: 476688 - RNA, 18 nt, Human
gugacuggcccuguccug

SEQ ID NO: 476689 - RNA, 20 nt, Human
gugacuggcuggcugucuug

SEQ ID NO: 476690 - RNA, 22 nt, Human
gugacuggcuuuucguucugug

SEQ ID NO: 476691 - RNA, 32 nt, Human
gugacugggaggaccagcggaggauaaaagac

SEQ ID NO: 476692 - RNA, 32 nt, Human
gugacugggcgggcuucagccaugaagacccu

SEQ ID NO: 476693 - RNA, 32 nt, Human
gugacuggucugcugcugcaggcuucaucuaa

SEQ ID NO: 476694 - RNA, 32 nt, Human
gugacuggugccucgccgccuccucucggugc

SEQ ID NO: 476695 - RNA, 32 nt, Human
gugacuguaccugcucagggcuugccucuagc

SEQ ID NO: 476696 - RNA, 32 nt, Human
gugacugucagcacugggccucuuguccaucu

SEQ ID NO: 476697 - RNA, 32 nt, Human
gugacugucucugccacuucuuaccugcugaa

SEQ ID NO: 476698 - RNA, 32 nt, Human
gugacugugcguguaagcggcacuuuguugag

SEQ ID NO: 476699 - RNA, 19 nt, Human
gugacuguggaacugcugc

SEQ ID NO: 476700 - RNA, 32 nt, Human
gugacuguggacugacacccacugccucugug

SEQ ID NO: 476701 - RNA, 32 nt, Human
gugacugugucaaauguugcaguagaugggca

SEQ ID NO: 476702 - RNA, 32 nt, Human
gugacugugucauuucuccuacugccacagau

SEQ ID NO: 476703 - RNA, 32 nt, Human
gugacugugugugaugacucucuuuccauucu

SEQ ID NO: 476704 - RNA, 32 nt, Human
gugacuguuucuugcuuccugccucugacuuu

SEQ ID NO: 476705 - RNA, 21 nt, Human
gugacuuacacaguguccuug

SEQ ID NO: 476706 - RNA, 22 nt, Human
gugacuuacgccuguaaucuca

SEQ ID NO: 476707 - RNA, 32 nt, Human
gugacuuagauacugcuuuuugggagguuaag

SEQ ID NO: 476708 - RNA, 32 nt, Human
gugacuuaggcagaggagugcagaggaggguc

SEQ ID NO: 476709 - RNA, 32 nt, Human
gugacuuaugaagguuuuguuucuugaauuuu

SEQ ID NO: 476710 - RNA, 32 nt, Human
gugacuucauuucccuuccuucuguccuccuc

SEQ ID NO: 476711 - RNA, 32 nt, Human
gugacuuccccaggaguguggaggggguggug

SEQ ID NO: 476712 - RNA, 32 nt, Human
gugacuuccucgggggauucccaggacacagu

SEQ ID NO: 476713 - RNA, 32 nt, Human
gugacuucucauuuuccuguuuacacugggga

SEQ ID NO: 476714 - RNA, 32 nt, Human
gugacuucucuccuccccuuugcucacugucc

SEQ ID NO: 476715 - RNA, 32 nt, Human
gugacuucugacucuccuuccaccuccccacu

SEQ ID NO: 476716 - RNA, 32 nt, Human
gugacuucugaguaguuaucacugugucugcc

SEQ ID NO: 476717 - RNA, 32 nt, Human
gugacuucuguggugaggaggcuucaguguuc

SEQ ID NO: 476718 - RNA, 32 nt, Human
gugacuucuuuuucucuucauuagccagagau

SEQ ID NO: 476719 - RNA, 32 nt, Human
gugacuugagguguugggaugggugagggagc

SEQ ID NO: 476720 - RNA, 22 nt, Human
gugacuugcaccuguaauccca

SEQ ID NO: 476721 - RNA, 32 nt, Human
gugacuugcccagggcagagguuuuugaagug

SEQ ID NO: 476722 - RNA, 32 nt, Human
gugacuugcuucccaccuccuuucucuguccu

SEQ ID NO: 476723 - RNA, 32 nt, Human
gugacuugggaagcuuucagugcugcuguuug

SEQ ID NO: 476724 - RNA, 32 nt, Human
gugacuugggucucagugcuaggguauugagu

SEQ ID NO: 476725 - RNA, 32 nt, Human
gugacuuuauucuuuagcagugcucaagugua

SEQ ID NO: 476726 - RNA, 32 nt, Human
gugacuuucucagaggugacagagaugaugga

SEQ ID NO: 476727 - RNA, 32 nt, Human
gugacuuucugcagugaaugcaucacccuuua

SEQ ID NO: 476728 - RNA, 23 nt, Human
gugacuuugcucauucugucauc

SEQ ID NO: 476729 - RNA, 32 nt, Human
gugacuuugcuuguuuacuuucugccucagau

SEQ ID NO: 476730 - RNA, 32 nt, Human
gugacuuuggagccaugagaccccagauccug

SEQ ID NO: 476731 - RNA, 16 nt, Human
gugagaaaaccaccua

SEQ ID NO: 476732 - RNA, 32 nt, Human
gugagaaagaggaugagagggauggucagcug

SEQ ID NO: 476733 - RNA, 32 nt, Human
gugagaaaggaaaaggaagaagaaaagaaaca

SEQ ID NO: 476734 - RNA, 24 nt, Human
gugagaaagugaugcuaguugggg

SEQ ID NO: 476735 - RNA, 19 nt, Human
gugagaaauaaauuucugu

SEQ ID NO: 476736 - RNA, 32 nt, Human
gugagaaaugucccucuuugccuuggacuucu

SEQ ID NO: 476737 - RNA, 32 nt, Human
gugagaaauguucaugcacuuuggccaggguu

SEQ ID NO: 476738 - RNA, 32 nt, Human
gugagaaauuccucuuggguucuugaacagcc

SEQ ID NO: 476739 - RNA, 32 nt, Human
gugagaacaagaacugagggaaagcaccuucc

SEQ ID NO: 476740 - RNA, 32 nt, Human
gugagaacagcacccaugaagagaugcggaag

SEQ ID NO: 476741 - RNA, 32 nt, Human
gugagaacagguuuguguuucauaaaaugaau

SEQ ID NO: 476742 - RNA, 32 nt, Human
gugagaacaguaggggcaggaaaaugaucagg

SEQ ID NO: 476743 - RNA, 19 nt, Human
gugagaaccgaggguuaga

SEQ ID NO: 476744 - RNA, 32 nt, Human
gugagaacugauuucugcaucagaauaucucc

SEQ ID NO: 476745 - RNA, 32 nt, Human
gugagaagagguccuccagaccccagaauggu

SEQ ID NO: 476746 - RNA, 32 nt, Human
gugagaagauggagaacacagaggcagagaaa

SEQ ID NO: 476747 - RNA, 32 nt, Human
gugagaagauucacagccuaaaagagaaaauc

SEQ ID NO: 476748 - RNA, 32 nt, Human
gugagaagcaauauuugucauuucuaaaacug

SEQ ID NO: 476749 - RNA, 32 nt, Human
gugagaagcugccugacuucauggcaccuccu

SEQ ID NO: 476750 - RNA, 32 nt, Human
gugagaaggaagccaggacagcgcagucccca

SEQ ID NO: 476751 - RNA, 31 nt, Human
gugagaagugagagaucugaugguuuaaaag

SEQ ID NO: 476752 - RNA, 32 nt, Human
gugagaauccccuugacacucccaccaucuuc

SEQ ID NO: 476753 - RNA, 32 nt, Human
gugagaauccugcugaccccagucccaucccc

SEQ ID NO: 476754 - RNA, 32 nt, Human
gugagaaugagcagcugcaggagcacugcgcc

SEQ ID NO: 476755 - RNA, 32 nt, Human
gugagaauggacuaauacaaacaggaacuuac

SEQ ID NO: 476756 - RNA, 32 nt, Human
gugagaauuaguuccacuaucuuucuccaagu

SEQ ID NO: 476757 - RNA, 31 nt, Human
gugagacaaagggcccugucacuggaagcca

SEQ ID NO: 476758 - RNA, 32 nt, Human
gugagacaacacagcugagcagcccagccaga

SEQ ID NO: 476759 - RNA, 32 nt, Human
gugagacaacacaggagccuucuauaguaugu

SEQ ID NO: 476760 - RNA, 32 nt, Human
gugagacacagcaggacccuuccccaaauacu

SEQ ID NO: 476761 - RNA, 18 nt, Human
gugagacacaggauucua

SEQ ID NO: 476762 - RNA, 32 nt, Human
gugagacaccuacaaucaccagucucaaaugc

SEQ ID NO: 476763 - RNA, 32 nt, Human
gugagacacugcgcccagccucaucccuguga

SEQ ID NO: 476764 - RNA, 32 nt, Human
gugagacagaguuucacucuuguugcccaggc

SEQ ID NO: 476765 - RNA, 21 nt, Human
gugagacaggagaggcugagc

SEQ ID NO: 476766 - RNA, 32 nt, Human
gugagacaggcacugugcgggccagguauacc

SEQ ID NO: 476767 - RNA, 32 nt, Human
gugagacaggcaggaccggguggaggcgucuc

SEQ ID NO: 476768 - RNA, 32 nt, Human
gugagacaucuacagagacaaaauuaggaagg

SEQ ID NO: 476769 - RNA, 32 nt, Human
gugagacaucuuagggaaggagacaccacagu

SEQ ID NO: 476770 - RNA, 32 nt, Human
gugagacauggagccuaaggagaucauuuugg

SEQ ID NO: 476771 - RNA, 32 nt, Human
gugagaccaagaagucucucuuuccucucugu

SEQ ID NO: 476772 - RNA, 32 nt, Human
gugagaccagcccagccaacauggucccaggu

SEQ ID NO: 476773 - RNA, 32 nt, Human
gugagaccgggaaugcuugggcccccgccuuc

SEQ ID NO: 476774 - RNA, 32 nt, Human
gugagacggccgcggcggcggcgacagcgcgg

SEQ ID NO: 476775 - RNA, 32 nt, Human
gugagacucacagagcaaauagcccaaggaaa

SEQ ID NO: 476776 - RNA, 32 nt, Human
gugagacucagcucucaugcaggagaugggua

SEQ ID NO: 476777 - RNA, 32 nt, Human
gugagacuccacccuccccaccuggcucauuu

SEQ ID NO: 476778 - RNA, 32 nt, Human
gugagacuccagcacagacacaugguggaaga

SEQ ID NO: 476779 - RNA, 32 nt, Human
gugagacuccagcacagcuacaugguggaaga

SEQ ID NO: 476780 - RNA, 32 nt, Human
gugagacucggugucaucaccaauccaucgcc

SEQ ID NO: 476781 - RNA, 32 nt, Human
gugagacugaaguugcuuagaguacuucuuug

SEQ ID NO: 476782 - RNA, 32 nt, Human
gugagacuggcuuauggcaugaguuguggaca

SEQ ID NO: 476783 - RNA, 32 nt, Human
gugagacuugggcuggagugcccacguggcug

SEQ ID NO: 476784 - RNA, 32 nt, Human
gugagagaaagccacaaagucagugccuggag

SEQ ID NO: 476785 - RNA, 32 nt, Human
gugagagaaagcccgggcaggagagcacagag

SEQ ID NO: 476786 - RNA, 32 nt, Human
gugagagacugaagaagcagagccuguaucau

SEQ ID NO: 476787 - RNA, 32 nt, Human
gugagagagcaggagagcaggggugaggagag

SEQ ID NO: 476788 - RNA, 32 nt, Human
gugagagagcccaggccacaggacaugcugcc

SEQ ID NO: 476789 - RNA, 32 nt, Human
gugagagaggaguuggccuagagcaggccacu

SEQ ID NO: 476790 - RNA, 32 nt, Human
gugagagaggauccaggagagccugacugcgu

SEQ ID NO: 476791 - RNA, 32 nt, Human
gugagagauggcugugagagaagauuaaaaca

SEQ ID NO: 476792 - RNA, 32 nt, Human
gugagagcacacaauuauuagcaucauuucug

SEQ ID NO: 476793 - RNA, 32 nt, Human
gugagagcacuucaaaucacacagacagaauu

SEQ ID NO: 476794 - RNA, 32 nt, Human
gugagagcagaacccccauuccccagccucug

SEQ ID NO: 476795 - RNA, 29 nt, Human
gugagagcauugaauaaauaucuuaagcu

SEQ ID NO: 476796 - RNA, 32 nt, Human
gugagagcccaggggucuuugguugcaccucc

SEQ ID NO: 476797 - RNA, 32 nt, Human
gugagagccuaaaacccagcuugccugucuuu

SEQ ID NO: 476798 - RNA, 32 nt, Human
gugagagcggcuguuccaggcuaacagcugug

SEQ ID NO: 476799 - RNA, 32 nt, Human
gugagagcugggaugggcaggaaggggcucaa

SEQ ID NO: 476800 - RNA, 32 nt, Human
gugagaggaagcacaggggaagacugaaagca

SEQ ID NO: 476801 - RNA, 32 nt, Human
gugagaggagagaaggaaguggcuguuuggcu

SEQ ID NO: 476802 - RNA, 20 nt, Human
gugagaggagagggcugggg

SEQ ID NO: 476803 - RNA, 32 nt, Human
gugagaggagccaaggaggguggggauuagga

SEQ ID NO: 476804 - RNA, 32 nt, Human
gugagaggaggagaggccaggaagggagaggg

SEQ ID NO: 476805 - RNA, 22 nt, Human
gugagaggagguuccagcuggg

SEQ ID NO: 476806 - RNA, 24 nt, Human
gugagaggauagcuuaagcccagg

SEQ ID NO: 476807 - RNA, 23 nt, Human
gugagaggaucacuugagccagg

SEQ ID NO: 476808 - RNA, 24 nt, Human
gugagaggaucacuugagcccagg

SEQ ID NO: 476809 - RNA, 24 nt, Human
gugagaggaucacuugagcccugg

SEQ ID NO: 476810 - RNA, 24 nt, Human
gugagaggaucacuugagcucagg

SEQ ID NO: 476811 - RNA, 32 nt, Human
gugagaggaucucuagagcccaggaauucaag

SEQ ID NO: 476812 - RNA, 32 nt, Human
gugagaggaugagggggagggagccaacgccu

SEQ ID NO: 476813 - RNA, 32 nt, Human
gugagaggaugggaaggagcagccaggcgugg

SEQ ID NO: 476814 - RNA, 24 nt, Human
gugagaggauugcuugaggccagg

SEQ ID NO: 476815 - RNA, 32 nt, Human
gugagaggcacaguuggaucagcagacucagc

SEQ ID NO: 476816 - RNA, 32 nt, Human
gugagaggccagcaggaggcucagggaggacg

SEQ ID NO: 476817 - RNA, 31 nt, Human
gugagaggccucucuggaaguugucccgggu

SEQ ID NO: 476818 - RNA, 32 nt, Human
gugagaggcggugggcugacugggaaggagag

SEQ ID NO: 476819 - RNA, 20 nt, Human
gugagaggcuugcugccauc

SEQ ID NO: 476820 - RNA, 32 nt, Human
gugagagggacggcucacagggcuuggaccgg

SEQ ID NO: 476821 - RNA, 32 nt, Human
gugagaggggcagacucuguggucugagacac

SEQ ID NO: 476822 - RNA, 32 nt, Human
gugagaggggcgcgcagcagcagcuccucaac

SEQ ID NO: 476823 - RNA, 24 nt, Human
gugagagggucacuugagcccagg

SEQ ID NO: 476824 - RNA, 32 nt, Human
gugagagguagaguuaccaaagagcucaggga

SEQ ID NO: 476825 - RNA, 32 nt, Human
gugagaggucuggggaggaugaagagcagaaa

SEQ ID NO: 476826 - RNA, 22 nt, Human
gugagaggugacacuguugggg

SEQ ID NO: 476827 - RNA, 32 nt, Human
gugagaguaagccuuguguuagucagaacucu

SEQ ID NO: 476828 - RNA, 32 nt, Human
gugagagugaacacauugucucugcuguggca

SEQ ID NO: 476829 - RNA, 32 nt, Human
gugagagugagcuguaggugugcgggaccggu

SEQ ID NO: 476830 - RNA, 32 nt, Human
gugagagugcuagaaaggacguggaugaagca

SEQ ID NO: 476831 - RNA, 32 nt, Human
gugagagugcugcuguuccauuccuggggucc

SEQ ID NO: 476832 - RNA, 32 nt, Human
gugagaguuagcaaguguccggcuccagcaac

SEQ ID NO: 476833 - RNA, 32 nt, Human
gugagauaagucagaggugacuuuccugggga

SEQ ID NO: 476834 - RNA, 32 nt, Human
gugagauaaguuaacccggccugacagaauca

SEQ ID NO: 476835 - RNA, 32 nt, Human
gugagauacagcaacagccggauuaguuacag

SEQ ID NO: 476836 - RNA, 32 nt, Human
gugagauaucuauuuccuugccuccuucuuuc

SEQ ID NO: 476837 - RNA, 32 nt, Human
gugagaucacccagggaagcaguaaaauauca

SEQ ID NO: 476838 - RNA, 32 nt, Human
gugagaucauagcucacaccuguaaucccagc

SEQ ID NO: 476839 - RNA, 32 nt, Human
gugagauccaggagaaguaaggcccuggagug

SEQ ID NO: 476840 - RNA, 32 nt, Human
gugagaucuggaaaucaagaaaugggugucca

SEQ ID NO: 476841 - RNA, 32 nt, Human
gugagaugaauaggaggagucuucaggaggag

SEQ ID NO: 476842 - RNA, 32 nt, Human
gugagaugccaauuuggggucuugaggcugac

SEQ ID NO: 476843 - RNA, 32 nt, Human
gugagaugcucagugggcucaauccuccacua

SEQ ID NO: 476844 - RNA, 32 nt, Human
gugagaugcuggagaagagaggagaggagaga

SEQ ID NO: 476845 - RNA, 32 nt, Human
gugagauggcuucaguucaugagacgggaucu

SEQ ID NO: 476846 - RNA, 32 nt, Human
gugagauucagcucuaguuugcaccuugauuu

SEQ ID NO: 476847 - RNA, 32 nt, Human
gugagauuggaauuuagaguuguuaaauugaa

SEQ ID NO: 476848 - RNA, 32 nt, Human
gugagauuuuuacucaaacagaaacaaaacau

SEQ ID NO: 476849 - RNA, 32 nt, Human
gugagcaacugcacccagccuaguugaguaua

SEQ ID NO: 476850 - RNA, 32 nt, Human
gugagcaagcagauugccccagaggggccggu

SEQ ID NO: 476851 - RNA, 32 nt, Human
gugagcaccacugcacuaagccagugcggagc

SEQ ID NO: 476852 - RNA, 32 nt, Human
gugagcaccccuguucagucuuugacaauugc

SEQ ID NO: 476853 - RNA, 32 nt, Human
gugagcaccuguaaucccagcuacucuggagg

SEQ ID NO: 476854 - RNA, 32 nt, Human
gugagcacucaggaugacuguggagaaggagg

SEQ ID NO: 476855 - RNA, 32 nt, Human
gugagcacugguuaguacugguccccuucugg

SEQ ID NO: 476856 - RNA, 32 nt, Human
gugagcagaagggagagagggagggcgcaagg

SEQ ID NO: 476857 - RNA, 32 nt, Human
gugagcagacacaaaacgguggcagguuuggc

SEQ ID NO: 476858 - RNA, 32 nt, Human
gugagcagaggggagagcggccgccgccgcug

SEQ ID NO: 476859 - RNA, 32 nt, Human
gugagcagaguguucuguucuucacuuccagc

SEQ ID NO: 476860 - RNA, 32 nt, Human
gugagcagcagcccuggggucacagacaugga

SEQ ID NO: 476861 - RNA, 32 nt, Human
gugagcagccaagauauggcuagagagaucau

SEQ ID NO: 476862 - RNA, 32 nt, Human
gugagcagcggggcuccugccucccggccugg

SEQ ID NO: 476863 - RNA, 32 nt, Human
gugagcagcucgcugguacagcccucccuguu

SEQ ID NO: 476864 - RNA, 31 nt, Human
gugagcagcugaagggcuaggagggaagccg

SEQ ID NO: 476865 - RNA, 32 nt, Human
gugagcaggacagcuccuguccccagcgaaga

SEQ ID NO: 476866 - RNA, 23 nt, Human
gugagcaggacucaggcugugug

SEQ ID NO: 476867 - RNA, 32 nt, Human
gugagcaggacuguucuucccacugcaaucug

SEQ ID NO: 476868 - RNA, 32 nt, Human
gugagcaggagacagggagggcugaaggcugu

SEQ ID NO: 476869 - RNA, 32 nt, Human
gugagcaggaggucuucccacgcccugucauu

SEQ ID NO: 476870 - RNA, 32 nt, Human
gugagcaggaggugaugugccagguauggacc

SEQ ID NO: 476871 - RNA, 32 nt, Human
gugagcaggaguuugaacagaccuggccccag

SEQ ID NO: 476872 - RNA, 32 nt, Human
gugagcaggcaguguggguggggaggggcuac

SEQ ID NO: 476873 - RNA, 32 nt, Human
gugagcagggagaggcugggcacuguggaauu

SEQ ID NO: 476874 - RNA, 32 nt, Human
gugagcaggggagcaacugagcaggaagagga

SEQ ID NO: 476875 - RNA, 32 nt, Human
gugagcaggguaaggguacgugaggggucuga

SEQ ID NO: 476876 - RNA, 24 nt, Human
gugagcagguugcuugagcccagg

SEQ ID NO: 476877 - RNA, 32 nt, Human
gugagcauaaccuugugaaccagcacuagcuu

SEQ ID NO: 476878 - RNA, 32 nt, Human
gugagcaucaaaaggcgucagucaggccgcag

SEQ ID NO: 476879 - RNA, 32 nt, Human
gugagcaucuugccagccucaggcuugaggga

SEQ ID NO: 476880 - RNA, 32 nt, Human
gugagcaugcauggcaggaggcugucugagac

SEQ ID NO: 476881 - RNA, 21 nt, Human
gugagcauggagcaucuccua

SEQ ID NO: 476882 - RNA, 21 nt, Human
gugagccaaacacacuuccca

SEQ ID NO: 476883 - RNA, 32 nt, Human
gugagccaaauaaaccucuuuucuuucuaaaa

SEQ ID NO: 476884 - RNA, 32 nt, Human
gugagccaacaucacguuuuguuagcugugau

SEQ ID NO: 476885 - RNA, 32 nt, Human
gugagccaagauccagccugggcgacagagcc

SEQ ID NO: 476886 - RNA, 32 nt, Human
gugagccaagauugcacacugcacuccagccu

SEQ ID NO: 476887 - RNA, 28 nt, Human
gugagccaauuaaaccucuuuucucuau

SEQ ID NO: 476888 - RNA, 32 nt, Human
gugagccaauuaaaccucuuuucuuuauaaaa

SEQ ID NO: 476889 - RNA, 32 nt, Human
gugagccacacagcagucacacaacucagagu

SEQ ID NO: 476890 - RNA, 32 nt, Human
gugagccaccacacccagccuaauguaacugu

SEQ ID NO: 476891 - RNA, 32 nt, Human
gugagccaccacaccuagcuggaagaggagau

SEQ ID NO: 476892 - RNA, 32 nt, Human
gugagccaccacgccugggcccaugaaccaag

SEQ ID NO: 476893 - RNA, 32 nt, Human
gugagccaccacguccaacugccuuauuuugu

SEQ ID NO: 476894 - RNA, 32 nt, Human
gugagccaccaugccuggccccaugaauacac

SEQ ID NO: 476895 - RNA, 32 nt, Human
gugagccaccgcauccggccucauguucuuuu

SEQ ID NO: 476896 - RNA, 32 nt, Human
gugagccaccgcccccagccuggccuggcauu

SEQ ID NO: 476897 - RNA, 32 nt, Human
gugagccacgaucacaccacaguacuccagcc

SEQ ID NO: 476898 - RNA, 32 nt, Human
gugagccacggcacuccacccugggcaacaga

SEQ ID NO: 476899 - RNA, 32 nt, Human
gugagccacggcgcccagcccaggaagaguuu

SEQ ID NO: 476900 - RNA, 31 nt, Human
gugagccacucugcccggccugugcauauuu

SEQ ID NO: 476901 - RNA, 32 nt, Human
gugagccacugcacccacccaagacaagugau

SEQ ID NO: 476902 - RNA, 32 nt, Human
gugagccacugcacccacccacgccuggcuga

SEQ ID NO: 476903 - RNA, 32 nt, Human
gugagccacugcacccagcccucuuagccauu

SEQ ID NO: 476904 - RNA, 32 nt, Human
gugagccacugcacccagccgagugagaauuu

SEQ ID NO: 476905 - RNA, 32 nt, Human
gugagccacugcacccagccuagaaucuugua

SEQ ID NO: 476906 - RNA, 32 nt, Human
gugagccacugcacccagccuauucuaugcau

SEQ ID NO: 476907 - RNA, 32 nt, Human
gugagccacugcacccagccucauguugaccc

SEQ ID NO: 476908 - RNA, 32 nt, Human
gugagccacugcacccagccugggagaggggu

SEQ ID NO: 476909 - RNA, 32 nt, Human
gugagccacugcacccagccuguaaaauauuu

SEQ ID NO: 476910 - RNA, 32 nt, Human
gugagccacugcacccagccugugauguuucu

SEQ ID NO: 476911 - RNA, 32 nt, Human
gugagccacugcacccagcugagagugcuucu

SEQ ID NO: 476912 - RNA, 32 nt, Human
gugagccacugcacccggccgggaauuuauca

SEQ ID NO: 476913 - RNA, 32 nt, Human
gugagccacugcacccggccgugaccaacauu

SEQ ID NO: 476914 - RNA, 32 nt, Human
gugagccacugcacccggccuccaagccagca

SEQ ID NO: 476915 - RNA, 32 nt, Human
gugagccacugcaccgggccacagagaaagua

SEQ ID NO: 476916 - RNA, 32 nt, Human
gugagccacugcaccugaccuaagaggaagca

SEQ ID NO: 476917 - RNA, 32 nt, Human
gugagccacugcaccuggcagugaugucauuc

SEQ ID NO: 476918 - RNA, 32 nt, Human
gugagccacugcaccuggccucuguugcaguc

SEQ ID NO: 476919 - RNA, 32 nt, Human
gugagccacugcaccuggccuggagcucaguu

SEQ ID NO: 476920 - RNA, 32 nt, Human
gugagccacugcaccuggcucuaauaguugau

SEQ ID NO: 476921 - RNA, 32 nt, Human
gugagccacugcacguggccuaaaaguuuuaa

SEQ ID NO: 476922 - RNA, 32 nt, Human
gugagccacugcacuccagccugaugacagag

SEQ ID NO: 476923 - RNA, 32 nt, Human
gugagccacugcgcccagccuauacauguuau

SEQ ID NO: 476924 - RNA, 32 nt, Human
gugagccacugugcccagccuaauugcaguaa

SEQ ID NO: 476925 - RNA, 31 nt, Human
gugagccagagaguauuaugagggaggccga

SEQ ID NO: 476926 - RNA, 32 nt, Human
gugagccagaggcuugacagagcuguuacuua

SEQ ID NO: 476927 - RNA, 32 nt, Human
gugagccagccuggcccuguacagauguggaa

SEQ ID NO: 476928 - RNA, 32 nt, Human
gugagccagccuggccgcuccacccugcagaa

SEQ ID NO: 476929 - RNA, 32 nt, Human
gugagccaggcaggguagggauuagugucccc

SEQ ID NO: 476930 - RNA, 32 nt, Human
gugagccagggagguguggaagucaccugcug

SEQ ID NO: 476931 - RNA, 32 nt, Human
gugagccagguaaugagggacuggaaccaggg

SEQ ID NO: 476932 - RNA, 32 nt, Human
gugagccagguccugaggguugaagaggaguu

SEQ ID NO: 476933 - RNA, 32 nt, Human
gugagccaugacuguugcugcacuccagccug

SEQ ID NO: 476934 - RNA, 32 nt, Human
gugagccaugauauugccagccugggugacag

SEQ ID NO: 476935 - RNA, 32 nt, Human
gugagccaugaucaugccacugcacucugggc

SEQ ID NO: 476936 - RNA, 32 nt, Human
gugagccaugccaaugcacuccagucugggca

SEQ ID NO: 476937 - RNA, 32 nt, Human
gugagcccaagaggaagcaugaacaggacgcu

SEQ ID NO: 476938 - RNA, 32 nt, Human
gugagcccagcgugggcaccgggccgucucag

SEQ ID NO: 476939 - RNA, 32 nt, Human
gugagcccaggaauucaaggcugcagugaacu

SEQ ID NO: 476940 - RNA, 32 nt, Human
gugagcccaggaggcggagcuugcagugaguc

SEQ ID NO: 476941 - RNA, 32 nt, Human
gugagcccaggaguucaaggcugcaaugagcu

SEQ ID NO: 476942 - RNA, 32 nt, Human
gugagcccaggaguuugagaccagcuaaggca

SEQ ID NO: 476943 - RNA, 32 nt, Human
gugagcccaguuguuggugaauuuaaagcuua

SEQ ID NO: 476944 - RNA, 32 nt, Human
gugagccccgcuccggguccccgggcgggcuu

SEQ ID NO: 476945 - RNA, 32 nt, Human
gugagccccgggcuccugcucagccuugugcc

SEQ ID NO: 476946 - RNA, 32 nt, Human
gugagccccugccucccugaacauaggaaacc

SEQ ID NO: 476947 - RNA, 32 nt, Human
gugagcccggaaagggaaggagggggcgggga

SEQ ID NO: 476948 - RNA, 32 nt, Human
gugagcccugcaaaggugaugguggucccggc

SEQ ID NO: 476949 - RNA, 32 nt, Human
gugagcccugcaggagcacccugaggccuagg

SEQ ID NO: 476950 - RNA, 32 nt, Human
gugagcccugcucuauccgccuggcuggauuc

SEQ ID NO: 476951 - RNA, 32 nt, Human
gugagcccugcucuucucuccccagcccccuc

SEQ ID NO: 476952 - RNA, 32 nt, Human
gugagcccugggcaccuccugauguccugcga

SEQ ID NO: 476953 - RNA, 32 nt, Human
gugagccgagacugugcuccagccugggcgac

SEQ ID NO: 476954 - RNA, 32 nt, Human
gugagccgaggcauuccagccugggcaacaga

SEQ ID NO: 476955 - RNA, 32 nt, Human
gugagccgcaucuucuccaucuggcagggugg

SEQ ID NO: 476956 - RNA, 32 nt, Human
gugagccggacuccccaacuccggacgaucag

SEQ ID NO: 476957 - RNA, 32 nt, Human
gugagccggcucggccugacugcuccaacuuc

SEQ ID NO: 476958 - RNA, 32 nt, Human
gugagccgugaagggacccugccuuucagggc

SEQ ID NO: 476959 - RNA, 32 nt, Human
gugagccguuucuccccugggcucggaggcgg

SEQ ID NO: 476960 - RNA, 32 nt, Human
gugagccuccaggacuguccugcugugccucu

SEQ ID NO: 476961 - RNA, 32 nt, Human
gugagccugagcugcccaaggcgaugcccuuu

SEQ ID NO: 476962 - RNA, 32 nt, Human
gugagccugcaggcuuuggaaguggcccuguc

SEQ ID NO: 476963 - RNA, 32 nt, Human
gugagccuggacaacaacguggagccugcacc

SEQ ID NO: 476964 - RNA, 22 nt, Human
gugagccuggaggaggaccuga

SEQ ID NO: 476965 - RNA, 32 nt, Human
gugagccugggagccugacagggccaguguug

SEQ ID NO: 476966 - RNA, 32 nt, Human
gugagccugggaggucaaggcugcagugagcc

SEQ ID NO: 476967 - RNA, 32 nt, Human
gugagccugggaguucgaggcugcagugagca

SEQ ID NO: 476968 - RNA, 32 nt, Human
gugagccuggggaacuugcagcuuaaagccag

SEQ ID NO: 476969 - RNA, 32 nt, Human
gugagccuggggaaucagcaaaaggggaggag

SEQ ID NO: 476970 - RNA, 32 nt, Human
gugagccuguaaucccagcuacucagaaggcu

SEQ ID NO: 476971 - RNA, 32 nt, Human
gugagccuguagucccagcuacucgagaggcu

SEQ ID NO: 476972 - RNA, 32 nt, Human
gugagccuguaguccuagcuacucgggaggcu

SEQ ID NO: 476973 - RNA, 32 nt, Human
gugagccugucgucccagcuacucaggaggcu

SEQ ID NO: 476974 - RNA, 32 nt, Human
gugagccugugccuggcuggucuuucuugagg

SEQ ID NO: 476975 - RNA, 32 nt, Human
gugagcgcccucucucuccggcggagcggaga

SEQ ID NO: 476976 - RNA, 32 nt, Human
gugagcgcgagcuggggacucucucaaagaua

SEQ ID NO: 476977 - RNA, 32 nt, Human
gugagcgcugccucuauggggcacugagugac

SEQ ID NO: 476978 - RNA, 32 nt, Human
gugagcgcuuccaggcugguaccaggucucac

SEQ ID NO: 476979 - RNA, 32 nt, Human
gugagcgcuuccucccugugcacuguccuggc

SEQ ID NO: 476980 - RNA, 32 nt, Human
gugagcggagaggggcccugcuucccacacaa

SEQ ID NO: 476981 - RNA, 32 nt, Human
gugagcggagccaccaggaggccaugucgggu

SEQ ID NO: 476982 - RNA, 32 nt, Human
gugagcggcgcccgggcgccugggcaggcgcc

SEQ ID NO: 476983 - RNA, 32 nt, Human
gugagcgggggaggggcugggggaguaauaac

SEQ ID NO: 476984 - RNA, 32 nt, Human
gugagcgucuggccacauggagcugcuuucug

SEQ ID NO: 476985 - RNA, 32 nt, Human
gugagcguuuucucaagaccuuccucaagcau

SEQ ID NO: 476986 - RNA, 32 nt, Human
gugagcuacugugcccagccugcaauuauucu

SEQ ID NO: 476987 - RNA, 31 nt, Human
gugagcuagcacuucugcguuccuuuugauu

SEQ ID NO: 476988 - RNA, 32 nt, Human
gugagcuagggugggagaaagguggugcugaa

SEQ ID NO: 476989 - RNA, 32 nt, Human
gugagcuaugaauuacucucagucuccuuuuu

SEQ ID NO: 476990 - RNA, 32 nt, Human
gugagcucacuacaaucucuggcuucugguuc

SEQ ID NO: 476991 - RNA, 32 nt, Human
gugagcucacuggccucagugccagguaagga

SEQ ID NO: 476992 - RNA, 32 nt, Human
gugagcucaguggauugcaguggugugcuggu

SEQ ID NO: 476993 - RNA, 32 nt, Human
gugagcuccaccugccccaguucuccuggcuu

SEQ ID NO: 476994 - RNA, 32 nt, Human
gugagcucccugcccagcaccaccuccugcac

SEQ ID NO: 476995 - RNA, 32 nt, Human
gugagcuccugggaaugagauuaaaggaggca

SEQ ID NO: 476996 - RNA, 32 nt, Human
gugagcucgaaccugggcgcgagggaccggcc

SEQ ID NO: 476997 - RNA, 32 nt, Human
gugagcucgcugaguccagccucguggucuuc

SEQ ID NO: 476998 - RNA, 32 nt, Human
gugagcucuucugccaaggggguccuccuggc

SEQ ID NO: 476999 - RNA, 30 nt, Human
gugagcugaagccacaggcagcgaucccac

SEQ ID NO: 477000 - RNA, 32 nt, Human
gugagcugacaccuuucaaugcccccugguug

SEQ ID NO: 477001 - RNA, 32 nt, Human
gugagcugacugccuuggccucccagagugcu

SEQ ID NO: 477002 - RNA, 32 nt, Human
gugagcugagauugcacuccagccugggcgac

SEQ ID NO: 477003 - RNA, 32 nt, Human
gugagcugagcaaagcccugggcucacagcac

SEQ ID NO: 477004 - RNA, 32 nt, Human
gugagcugagcacgguagcucacaccuguaau

SEQ ID NO: 477005 - RNA, 32 nt, Human
gugagcugcacugcauuccagccugggugaca

SEQ ID NO: 477006 - RNA, 32 nt, Human
gugagcugcaggcugugcuccagauccaccga

SEQ ID NO: 477007 - RNA, 20 nt, Human
gugagcugccucugccccug

SEQ ID NO: 477008 - RNA, 32 nt, Human
gugagcugcuggcacagcaguucuggcccugg

SEQ ID NO: 477009 - RNA, 32 nt, Human
gugagcuggacgacacagccuaggcagaaaug

SEQ ID NO: 477010 - RNA, 32 nt, Human
gugagcuggagagagaaaaggugguaacugga

SEQ ID NO: 477011 - RNA, 31 nt, Human
gugagcuggcuggaaagagggggcggagugc

SEQ ID NO: 477012 - RNA, 32 nt, Human
gugagcugggagagggcaucccaggccgugcg

SEQ ID NO: 477013 - RNA, 32 nt, Human
gugagcugggcuucuguccuccucuguguccc

SEQ ID NO: 477014 - RNA, 32 nt, Human
gugagcugucuggccuuuuguccuugauccuu

SEQ ID NO: 477015 - RNA, 32 nt, Human
gugagcuuagaggaagaaagaaaacaauuuuu

SEQ ID NO: 477016 - RNA, 32 nt, Human
gugagcuuugcucugugcugggcauagagaau

SEQ ID NO: 477017 - RNA, 32 nt, Human
gugaggaaaauacagcaucccaccucacaggc

SEQ ID NO: 477018 - RNA, 32 nt, Human
gugaggaagaaggggaagaagauugucaaacu

SEQ ID NO: 477019 - RNA, 32 nt, Human
gugaggaagagggagaugaagugcagcgagaa

SEQ ID NO: 477020 - RNA, 32 nt, Human
gugaggaagagggagggauggacaagucugaa

SEQ ID NO: 477021 - RNA, 32 nt, Human
gugaggaagccagacuccagagacacggagaa

SEQ ID NO: 477022 - RNA, 32 nt, Human
gugaggaagccaucagaucugugcaccauuaa

SEQ ID NO: 477023 - RNA, 32 nt, Human
gugaggaaggcaggaagagagcaugagaggaa

SEQ ID NO: 477024 - RNA, 31 nt, Human
gugaggaaggguuuaaccucacuggaaggaa

SEQ ID NO: 477025 - RNA, 32 nt, Human
gugaggaccaggcacuauuuccuccgagguua

SEQ ID NO: 477026 - RNA, 32 nt, Human
gugaggaccuguaauccagcauucuuguuaaa

SEQ ID NO: 477027 - RNA, 32 nt, Human
gugaggacgaagcgggcacggagccagauggc

SEQ ID NO: 477028 - RNA, 32 nt, Human
gugaggacucacugagugcaccuccaucucca

SEQ ID NO: 477029 - RNA, 32 nt, Human
gugaggacucaggaaaaauaaauaaauaaaag

SEQ ID NO: 477030 - RNA, 32 nt, Human
gugaggacugcaccuuaaccugggcacuggga

SEQ ID NO: 477031 - RNA, 32 nt, Human
gugaggacuggucucccgggggugggggucug

SEQ ID NO: 477032 - RNA, 32 nt, Human
gugaggagagguggaggugcuuuggggacacu

SEQ ID NO: 477033 - RNA, 32 nt, Human
gugaggagagugagucaauguagaagaaguug

SEQ ID NO: 477034 - RNA, 32 nt, Human
gugaggagcagcacagagcagcagggaucauc

SEQ ID NO: 477035 - RNA, 32 nt, Human
gugaggagcagcagagucugauacuaggucua

SEQ ID NO: 477036 - RNA, 32 nt, Human
gugaggagcccagcagaggccacuccacaccc

SEQ ID NO: 477037 - RNA, 32 nt, Human
gugaggagccuggaacagggcucugaauuguc

SEQ ID NO: 477038 - RNA, 32 nt, Human
gugaggaggaagagaagcuggugcagccacac

SEQ ID NO: 477039 - RNA, 32 nt, Human
gugaggaggaagggaaggcgguucagagaugu

SEQ ID NO: 477040 - RNA, 32 nt, Human
gugaggaggagccacagcacauggggugccac

SEQ ID NO: 477041 - RNA, 32 nt, Human
gugaggaggaggaggaagaaaaugagaguggg

SEQ ID NO: 477042 - RNA, 32 nt, Human
gugaggaggaggaggaggagaaggaggaggag

SEQ ID NO: 477043 - RNA, 32 nt, Human
gugaggaggaggauuauaacuuaggccuagcc

SEQ ID NO: 477044 - RNA, 32 nt, Human
gugaggaggccugucugcaucuccuuccggcc

SEQ ID NO: 477045 - RNA, 32 nt, Human
gugaggagggagaacuuggaagggugcagccc

SEQ ID NO: 477046 - RNA, 32 nt, Human
gugaggaggggguugggaggggagaggacgcg

SEQ ID NO: 477047 - RNA, 32 nt, Human
gugaggagguaaagaaaggcagaccucuccgg

SEQ ID NO: 477048 - RNA, 32 nt, Human
gugaggauacauaacauuuucucuacaaugaa

SEQ ID NO: 477049 - RNA, 22 nt, Human
gugaggaucacuugagcccagg

SEQ ID NO: 477050 - RNA, 32 nt, Human
gugaggaugggacagagaagagcgaccacugg

SEQ ID NO: 477051 - RNA, 22 nt, Human
gugaggcaagagaagcuggaac

SEQ ID NO: 477052 - RNA, 32 nt, Human
gugaggcaagcccccuccuaugaggaugagca

SEQ ID NO: 477053 - RNA, 32 nt, Human
gugaggcaccugaggcagagaaaguaaagaaa

SEQ ID NO: 477054 - RNA, 24 nt, Human
gugaggcagaaaacuugacuugaa

SEQ ID NO: 477055 - RNA, 24 nt, Human
gugaggcagaagcauugcuugagc

SEQ ID NO: 477056 - RNA, 32 nt, Human
gugaggcagaagcauugcuugagcuugggaga

SEQ ID NO: 477057 - RNA, 23 nt, Human
gugaggcagaggaucacuugagc

SEQ ID NO: 477058 - RNA, 32 nt, Human
gugaggcagaggaucacuugagcccaggaguu

SEQ ID NO: 477059 - RNA, 32 nt, Human
gugaggcagagggagacguuaguccagcauuu

SEQ ID NO: 477060 - RNA, 32 nt, Human
gugaggcagcucuggaacgugaagagcuguuu

SEQ ID NO: 477061 - RNA, 32 nt, Human
gugaggcagcugcggaagaaaaguaggagacu

SEQ ID NO: 477062 - RNA, 27 nt, Human
gugaggcaggacuucccucgcuugaac

SEQ ID NO: 477063 - RNA, 24 nt, Human
gugaggcaggagaaucacuucaac

SEQ ID NO: 477064 - RNA, 24 nt, Human
gugaggcaggagaaucacuugaac

SEQ ID NO: 477065 - RNA, 24 nt, Human
gugaggcaggagaaucgcuugaac

SEQ ID NO: 477066 - RNA, 24 nt, Human
gugaggcaggagaaucuuucgagc

SEQ ID NO: 477067 - RNA, 24 nt, Human
gugaggcaggagaauggcaugaac

SEQ ID NO: 477068 - RNA, 24 nt, Human
gugaggcaggagaauggcuugagc

SEQ ID NO: 477069 - RNA, 24 nt, Human
gugaggcaggagauuugcuugaac

SEQ ID NO: 477070 - RNA, 32 nt, Human
gugaggcaggaucuguuucagcaaaggcccug

SEQ ID NO: 477071 - RNA, 24 nt, Human
gugaggcaggcgaaucucuugaac

SEQ ID NO: 477072 - RNA, 23 nt, Human
gugaggcaggcggaucacuugaa

SEQ ID NO: 477073 - RNA, 32 nt, Human
gugaggcagggggcauucacugccugggucag

SEQ ID NO: 477074 - RNA, 32 nt, Human
gugaggcagguggaucaccugaggucgggagc

SEQ ID NO: 477075 - RNA, 32 nt, Human
gugaggcauuggucccaagcugugcugaggac

SEQ ID NO: 477076 - RNA, 23 nt, Human
gugaggccaaagcacuguccugu

SEQ ID NO: 477077 - RNA, 32 nt, Human
gugaggccaccaggcugaagucagcucagacc

SEQ ID NO: 477078 - RNA, 32 nt, Human
gugaggccauuugaggccugagccugguccuc

SEQ ID NO: 477079 - RNA, 32 nt, Human
gugaggcccaccagcagaggaagaggagcuuc

SEQ ID NO: 477080 - RNA, 17 nt, Human
gugaggcccccaggcgg

SEQ ID NO: 477081 - RNA, 32 nt, Human
gugaggcccugcugaggacuccggacacugcc

SEQ ID NO: 477082 - RNA, 32 nt, Human
gugaggccgugccucuuugggggcuaaagguc

SEQ ID NO: 477083 - RNA, 22 nt, Human
gugaggccucugagggccucca

SEQ ID NO: 477084 - RNA, 32 nt, Human
gugaggccuucugcccuggccuuggggagaag

SEQ ID NO: 477085 - RNA, 32 nt, Human
gugaggcgcguguucgggcucuugccgucccc

SEQ ID NO: 477086 - RNA, 32 nt, Human
gugaggcgcuccugccauuuucucuccugcgg

SEQ ID NO: 477087 - RNA, 32 nt, Human
gugaggcggagcagagguuuaauggaggugug

SEQ ID NO: 477088 - RNA, 32 nt, Human
gugaggcggaggacaggcugggggaucccaaa

SEQ ID NO: 477089 - RNA, 32 nt, Human
gugaggcggcagcggcccuggcccccgcgccg

SEQ ID NO: 477090 - RNA, 24 nt, Human
gugaggcggcucacaccuguaauc

SEQ ID NO: 477091 - RNA, 32 nt, Human
gugaggcggcuggagcaaagucaaagucaugc

SEQ ID NO: 477092 - RNA, 32 nt, Human
gugaggcgggcaaaucaccugaggucagcagu

SEQ ID NO: 477093 - RNA, 32 nt, Human
gugaggcuaggggagugcugugcugauucucc

SEQ ID NO: 477094 - RNA, 32 nt, Human
gugaggcucugggaacaccuucuugccuuccu

SEQ ID NO: 477095 - RNA, 32 nt, Human
gugaggcugagaugagaaugcggauuaaaaug

SEQ ID NO: 477096 - RNA, 32 nt, Human
gugaggcugagggugccaagauuuccccaggg

SEQ ID NO: 477097 - RNA, 32 nt, Human
gugaggcugcuuguggcggauuccucaccaag

SEQ ID NO: 477098 - RNA, 32 nt, Human
gugaggcugggagcuucucuugggccugcugg

SEQ ID NO: 477099 - RNA, 19 nt, Human
gugaggcugggugcagugg

SEQ ID NO: 477100 - RNA, 23 nt, Human
gugaggcuucugcagaaccccca

SEQ ID NO: 477101 - RNA, 32 nt, Human
gugaggcuuugagaggccccaaagaugagcgc

SEQ ID NO: 477102 - RNA, 32 nt, Human
gugaggcuuuguuuuugccuuuauggagagua

SEQ ID NO: 477103 - RNA, 20 nt, Human
gugaggcuuuugugcuccca

SEQ ID NO: 477104 - RNA, 32 nt, Human
gugagggaacguuggcucugacugccuuugga

SEQ ID NO: 477105 - RNA, 32 nt, Human
gugagggaacuuucauauaccacugggaggaa

SEQ ID NO: 477106 - RNA, 32 nt, Human
gugagggaagacgccuuucuccuccaacccaa

SEQ ID NO: 477107 - RNA, 32 nt, Human
gugagggaagacuguaacacagcugaacuauu

SEQ ID NO: 477108 - RNA, 22 nt, Human
gugagggacagagcuagugggg

SEQ ID NO: 477109 - RNA, 32 nt, Human
gugagggagagggacgcagggagggaaaagcg

SEQ ID NO: 477110 - RNA, 32 nt, Human
gugagggagcagcacagacaaaagguggcaca

SEQ ID NO: 477111 - RNA, 32 nt, Human
gugagggaggagaauggacagaauacugacug

SEQ ID NO: 477112 - RNA, 32 nt, Human
gugagggagggaaggaaggaacuacaagagag

SEQ ID NO: 477113 - RNA, 32 nt, Human
gugagggagguggacggugccagcugaggcug

SEQ ID NO: 477114 - RNA, 32 nt, Human
gugagggaguuacuaagcugaaggcggaagau

SEQ ID NO: 477115 - RNA, 32 nt, Human
gugagggaucugccuccugagcaaagagcucu

SEQ ID NO: 477116 - RNA, 32 nt, Human
gugagggaugcagagccagggaaggcuggugg

SEQ ID NO: 477117 - RNA, 32 nt, Human
gugagggcaccccuccucugaagaucccugua

SEQ ID NO: 477118 - RNA, 32 nt, Human
gugagggcaucagccugcuggcucagaacacc

SEQ ID NO: 477119 - RNA, 32 nt, Human
gugagggccaagggggacccccagaaaaaggu

SEQ ID NO: 477120 - RNA, 16 nt, Human
gugagggcccaggugg

SEQ ID NO: 477121 - RNA, 32 nt, Human
gugagggccugugggauucuccggauauggcc

SEQ ID NO: 477122 - RNA, 32 nt, Human
gugagggcgaggaggaugacgagggcgaggag

SEQ ID NO: 477123 - RNA, 32 nt, Human
gugagggcgccugggagcugauggguuaagcc

SEQ ID NO: 477124 - RNA, 32 nt, Human
gugagggcgggcaaggggccccagccgcugca

SEQ ID NO: 477125 - RNA, 32 nt, Human
gugagggcugaaguagaguaagaaaaaucaca

SEQ ID NO: 477126 - RNA, 32 nt, Human
gugagggcuucgaucccuucucugauuugcug

SEQ ID NO: 477127 - RNA, 24 nt, Human
gugagggcuuugaaaggccuucca

SEQ ID NO: 477128 - RNA, 25 nt, Human
gugaggggaaucucaguagcuggga

SEQ ID NO: 477129 - RNA, 32 nt, Human
gugaggggagagaagggagagggugggccugc

SEQ ID NO: 477130 - RNA, 32 nt, Human
gugaggggagggcuguggggaacuccauucag

SEQ ID NO: 477131 - RNA, 32 nt, Human
gugaggggagggugaggagcuggagggagggg

SEQ ID NO: 477132 - RNA, 32 nt, Human
gugaggggaguccuaggcagagcugcugauug

SEQ ID NO: 477133 - RNA, 32 nt, Human
gugaggggcugagaggaauacuugaaacaaca

SEQ ID NO: 477134 - RNA, 32 nt, Human
gugaggggcugggcuggacaccagggcccgcc

SEQ ID NO: 477135 - RNA, 32 nt, Human
gugagggggcuugcuugguaugcuuaccuggg

SEQ ID NO: 477136 - RNA, 32 nt, Human
gugaggggugguggaaagaggggaggagggag

SEQ ID NO: 477137 - RNA, 32 nt, Human
gugaggggugugaggccccagccuggagccag

SEQ ID NO: 477138 - RNA, 32 nt, Human
gugagggucaaauaagcuaaaagcagcugaaa

SEQ ID NO: 477139 - RNA, 22 nt, Human
gugagggugcaagggucuuuca

SEQ ID NO: 477140 - RNA, 32 nt, Human
gugagggugggacccugugaaggucugaccac

SEQ ID NO: 477141 - RNA, 32 nt, Human
gugagggugggaggcagaaaagaggcacaggu

SEQ ID NO: 477142 - RNA, 22 nt, Human
gugagguagagcugugcauuaa

SEQ ID NO: 477143 - RNA, 24 nt, Human
gugagguagcucacaccuguaauc

SEQ ID NO: 477144 - RNA, 32 nt, Human
gugaggucaagagaucgagaccagccuggcca

SEQ ID NO: 477145 - RNA, 32 nt, Human
gugaggucaagaguucaagaccagccuggcca

SEQ ID NO: 477146 - RNA, 32 nt, Human
gugaggucacuguccaggucugggacucagcc

SEQ ID NO: 477147 - RNA, 32 nt, Human
gugaggucaggaguucgagaccagccugacca

SEQ ID NO: 477148 - RNA, 32 nt, Human
gugaggucaggaguuugagaccagccuggcca

SEQ ID NO: 477149 - RNA, 32 nt, Human
gugaggucgggaguucaagaccagccuggcca

SEQ ID NO: 477150 - RNA, 32 nt, Human
gugaggucugagauucccuuguuccuggggug

SEQ ID NO: 477151 - RNA, 32 nt, Human
gugaggugagcaugagcuugagcugagagaca

SEQ ID NO: 477152 - RNA, 32 nt, Human
gugaggugaggcucuguugcagugucguaggc

SEQ ID NO: 477153 - RNA, 17 nt, Human
gugaggugcccaggugg

SEQ ID NO: 477154 - RNA, 32 nt, Human
gugaggugccuguaaaguaguauuuuugauca

SEQ ID NO: 477155 - RNA, 32 nt, Human
gugaggugcugauguccuugccuugcuggaag

SEQ ID NO: 477156 - RNA, 32 nt, Human
gugagguggagugccuagaacucccguggugg

SEQ ID NO: 477157 - RNA, 32 nt, Human
gugagguggauaacuauaaugagaaucucuua

SEQ ID NO: 477158 - RNA, 32 nt, Human
gugagguggauagaucaccuggagucccucgu

SEQ ID NO: 477159 - RNA, 24 nt, Human
gugagguggcucacgccuauaauc

SEQ ID NO: 477160 - RNA, 24 nt, Human
gugagguggcucaugccuguaauc

SEQ ID NO: 477161 - RNA, 32 nt, Human
gugaggugggaggaucaccugaggucgaaagu

SEQ ID NO: 477162 - RNA, 32 nt, Human
gugaggugggaggucaggggucagccucuccg

SEQ ID NO: 477163 - RNA, 31 nt, Human
gugaggugggugggagaggaagaaaguuggg

SEQ ID NO: 477164 - RNA, 32 nt, Human
gugaggugguggaacaaaaggccagguagagg

SEQ ID NO: 477165 - RNA, 32 nt, Human
gugaggugguuuagcuuuugcuuucgaagugg

SEQ ID NO: 477166 - RNA, 32 nt, Human
gugagguguaugccacaccuggccuuaaagag

SEQ ID NO: 477167 - RNA, 32 nt, Human
gugagguguccagccugcaaagcuauuccagc

SEQ ID NO: 477168 - RNA, 32 nt, Human
gugaggugugggaguagccaccagccucccac

SEQ ID NO: 477169 - RNA, 32 nt, Human
gugagguuacagacacggcccuggugaugggc

SEQ ID NO: 477170 - RNA, 32 nt, Human
gugagguuccucacuuugcuucuccaacagcc

SEQ ID NO: 477171 - RNA, 32 nt, Human
gugagguucucagccgauguguuagagguuga

SEQ ID NO: 477172 - RNA, 32 nt, Human
gugagguugaccacucuguagguggacgagcc

SEQ ID NO: 477173 - RNA, 32 nt, Human
gugagguugcugccaacaguccuggccucccc

SEQ ID NO: 477174 - RNA, 32 nt, Human
gugagguuuccgagccucucccugcccauccu

SEQ ID NO: 477175 - RNA, 32 nt, Human
gugagguuugguggauccacgccccucucccc

SEQ ID NO: 477176 - RNA, 32 nt, Human
gugaguaaauaccucagauguccuccugcagc

SEQ ID NO: 477177 - RNA, 32 nt, Human
gugaguaacuugcccauuucuccacagagacc

SEQ ID NO: 477178 - RNA, 32 nt, Human
gugaguaaugugccccugaaaccaguggggug

SEQ ID NO: 477179 - RNA, 32 nt, Human
gugaguacauuguccuuccaaaccugauucau

SEQ ID NO: 477180 - RNA, 32 nt, Human
gugaguaccuguuugucuccaggccaaaccuu

SEQ ID NO: 477181 - RNA, 32 nt, Human
gugaguagaggggccugggggcuuccaaggcc

SEQ ID NO: 477182 - RNA, 32 nt, Human
gugaguagccuaugaaugaaauucuuuuauaa

SEQ ID NO: 477183 - RNA, 32 nt, Human
gugaguaggcuaaguuggggaggcucaaacca

SEQ ID NO: 477184 - RNA, 32 nt, Human
gugaguagugcuuuucauucuucucacuugcc

SEQ ID NO: 477185 - RNA, 32 nt, Human
gugaguauauuuuucuuccagcugaacuuuaa

SEQ ID NO: 477186 - RNA, 32 nt, Human
gugaguauuaaugucaguacuaccagcacuuu

SEQ ID NO: 477187 - RNA, 32 nt, Human
gugaguauuuggaccauugaagugggaguuau

SEQ ID NO: 477188 - RNA, 32 nt, Human
gugagucaaagcaggcccugaggucuccuguu

SEQ ID NO: 477189 - RNA, 32 nt, Human
gugagucaagaaccgcauaggucuccaguccc

SEQ ID NO: 477190 - RNA, 24 nt, Human
gugagucaagagaauugcuugaac

SEQ ID NO: 477191 - RNA, 32 nt, Human
gugagucaauuaaaccucuuuucuuuauaaau

SEQ ID NO: 477192 - RNA, 32 nt, Human
gugagucacagcccucuccgucugcucuagcc

SEQ ID NO: 477193 - RNA, 32 nt, Human
gugagucaccgugcccagccuggaugaggguc

SEQ ID NO: 477194 - RNA, 32 nt, Human
gugagucacugcacccaagccuccuuucucuu

SEQ ID NO: 477195 - RNA, 32 nt, Human
gugagucacugcacccagccgaguugcuuucu

SEQ ID NO: 477196 - RNA, 32 nt, Human
gugagucagcuggucaaguuguguguugagca

SEQ ID NO: 477197 - RNA, 32 nt, Human
gugagucagggcagggcagcugguaucgaggu

SEQ ID NO: 477198 - RNA, 32 nt, Human
gugagucaggggcagagcagggcggucugagc

SEQ ID NO: 477199 - RNA, 32 nt, Human
gugagucaguuaaaccucuuuucuuuauaaau

SEQ ID NO: 477200 - RNA, 32 nt, Human
gugaguccaagccagacuuuguggcugucccc

SEQ ID NO: 477201 - RNA, 32 nt, Human
gugaguccaggaguuugagaccagccugggca

SEQ ID NO: 477202 - RNA, 32 nt, Human
gugaguccaugggaacagccccacugcaaaca

SEQ ID NO: 477203 - RNA, 32 nt, Human
gugaguccauuaaaccucuuuuucucuauaaa

SEQ ID NO: 477204 - RNA, 32 nt, Human
gugagucccagaggaccucgugguccucaauu

SEQ ID NO: 477205 - RNA, 32 nt, Human
gugagucccgucgcauccccucccucuuccug

SEQ ID NO: 477206 - RNA, 32 nt, Human
gugagucccugagaugugcucuuguuguuugg

SEQ ID NO: 477207 - RNA, 31 nt, Human
gugaguccgggcaaggagguuaggaggcagc

SEQ ID NO: 477208 - RNA, 32 nt, Human
gugaguccgggcaaggagguuaggaggcagcu

SEQ ID NO: 477209 - RNA, 32 nt, Human
gugaguccucagagccuccaucugccaagaac

SEQ ID NO: 477210 - RNA, 32 nt, Human
gugaguccuggguggagaaagaagagaagcag

SEQ ID NO: 477211 - RNA, 32 nt, Human
gugagucuacagcaguaucucugccugguguc

SEQ ID NO: 477212 - RNA, 32 nt, Human
gugagucugaaauuccagggaaugccgugagg

SEQ ID NO: 477213 - RNA, 32 nt, Human
gugagucugcaggcccuggacccgcuggccag

SEQ ID NO: 477214 - RNA, 32 nt, Human
gugagucuggccaaaauguaaaccccacccuc

SEQ ID NO: 477215 - RNA, 32 nt, Human
gugagucugucaggagcuucagccuagcugau

SEQ ID NO: 477216 - RNA, 32 nt, Human
gugagucugucaugagagcuguccugaaugcc

SEQ ID NO: 477217 - RNA, 32 nt, Human
gugagucugucuuuaacacauuuccuuccaau

SEQ ID NO: 477218 - RNA, 32 nt, Human
gugagucuucacuaaaaucagugacucacuuc

SEQ ID NO: 477219 - RNA, 32 nt, Human
gugagugaaaccagcuagugugucaacaguga

SEQ ID NO: 477220 - RNA, 32 nt, Human
gugagugaagauggcagagaggacgugaccag

SEQ ID NO: 477221 - RNA, 32 nt, Human
gugagugaauuccuggauaaagcaagauuucc

SEQ ID NO: 477222 - RNA, 32 nt, Human
gugagugacagcagcccuggugccccagccug

SEQ ID NO: 477223 - RNA, 32 nt, Human
gugagugaccgcggccccgagccuggggcugg

SEQ ID NO: 477224 - RNA, 32 nt, Human
gugagugaccuguuuucccagcaacucacccu

SEQ ID NO: 477225 - RNA, 32 nt, Human
gugagugaggaggaggaggaggagaaggagga

SEQ ID NO: 477226 - RNA, 32 nt, Human
gugagugcacacacuaugcgaggagcaagcau

SEQ ID NO: 477227 - RNA, 29 nt, Human
gugagugcagcgugugugcgugugccugu

SEQ ID NO: 477228 - RNA, 32 nt, Human
gugagugccagugugagggagcagggguguug

SEQ ID NO: 477229 - RNA, 32 nt, Human
gugagugccuguaaucacagcuacuugggagg

SEQ ID NO: 477230 - RNA, 32 nt, Human
gugagugccuguaaucccagcuacucgggagg

SEQ ID NO: 477231 - RNA, 32 nt, Human
gugagugccuguaaucccagcuacuugggagg

SEQ ID NO: 477232 - RNA, 32 nt, Human
gugagugccuguaaucucaguuacucaggagg

SEQ ID NO: 477233 - RNA, 32 nt, Human
gugaguggaacaggagccgggcauucagagag

SEQ ID NO: 477234 - RNA, 32 nt, Human
gugaguggagaggaggaggaggaugaagaagg

SEQ ID NO: 477235 - RNA, 24 nt, Human
gugaguggauugcuugaguccggg

SEQ ID NO: 477236 - RNA, 20 nt, Human
gugagugggagcugagccca

SEQ ID NO: 477237 - RNA, 32 nt, Human
gugagugggaggcggcggcgcugguggcugca

SEQ ID NO: 477238 - RNA, 32 nt, Human
gugagugggcagguuuggaggagcagccaggg

SEQ ID NO: 477239 - RNA, 32 nt, Human
gugaguggggcgagguugagggcuuauucagu

SEQ ID NO: 477240 - RNA, 32 nt, Human
gugagugguagcgauguggcccagugagacgg

SEQ ID NO: 477241 - RNA, 32 nt, Human
gugagugguccccuccuccaucagccuggaca

SEQ ID NO: 477242 - RNA, 32 nt, Human
gugaguggugagugguguucuacuggaagaac

SEQ ID NO: 477243 - RNA, 31 nt, Human
gugagugugaagauggugguuagcaguuucg

SEQ ID NO: 477244 - RNA, 32 nt, Human
gugagugugacggggguugggguggggcggga

SEQ ID NO: 477245 - RNA, 32 nt, Human
gugagugugaugggccaccggggcaagaggga

SEQ ID NO: 477246 - RNA, 32 nt, Human
gugaguguggcaguccccacagcuccacaaug

SEQ ID NO: 477247 - RNA, 32 nt, Human
gugaguguguauccuaggaaaggcgagcugga

SEQ ID NO: 477248 - RNA, 32 nt, Human
gugagugugugugagagagaauuggugaguuu

SEQ ID NO: 477249 - RNA, 32 nt, Human
gugaguguuggaugucugcaugugugugugcc

SEQ ID NO: 477250 - RNA, 32 nt, Human
gugaguuacuccugcauucuuuccagggaccg

SEQ ID NO: 477251 - RNA, 32 nt, Human
gugaguuauagucugcuuauuuaauuaccacu

SEQ ID NO: 477252 - RNA, 32 nt, Human
gugaguucacauuuagcaacagcuuauuaaua

SEQ ID NO: 477253 - RNA, 20 nt, Human
gugaguucagacucccagca

SEQ ID NO: 477254 - RNA, 32 nt, Human
gugaguuccuucuuccccuugaggaaucagca

SEQ ID NO: 477255 - RNA, 32 nt, Human
gugaguucucaagaaaaggaaagggaggcuga

SEQ ID NO: 477256 - RNA, 32 nt, Human
gugaguucuuucucccuauccugggccucugu

SEQ ID NO: 477257 - RNA, 21 nt, Human
gugaguugaguguggcuggga

SEQ ID NO: 477258 - RNA, 32 nt, Human
gugaguugauguagaggagagccaccugacag

SEQ ID NO: 477259 - RNA, 32 nt, Human
gugaguugcccagaguggaagcuccuaguaga

SEQ ID NO: 477260 - RNA, 32 nt, Human
gugaguuggaguccuuucugucugucuccaug

SEQ ID NO: 477261 - RNA, 29 nt, Human
gugaguuggcugcucucuccccauagugg

SEQ ID NO: 477262 - RNA, 32 nt, Human
gugaguugggaaaguugauuagucgggucgga

SEQ ID NO: 477263 - RNA, 32 nt, Human
gugaguuucccuugaguuccucccccgacagg

SEQ ID NO: 477264 - RNA, 32 nt, Human
gugaguuucuacagucaucccuugguauccau

SEQ ID NO: 477265 - RNA, 32 nt, Human
gugaguuucugcuuuguagguuguggucacau

SEQ ID NO: 477266 - RNA, 32 nt, Human
gugaguuucuggcaaguagcuuggggaagcug

SEQ ID NO: 477267 - RNA, 32 nt, Human
gugaguuucuggcugugaaccugugaggcuga

SEQ ID NO: 477268 - RNA, 32 nt, Human
gugaguuuguuuaggugggaagguggcauggg

SEQ ID NO: 477269 - RNA, 32 nt, Human
gugauaaaaauuaaaaucacacuacuauuuga

SEQ ID NO: 477270 - RNA, 32 nt, Human
gugauaaaacaacaugguauguagaagccuag

SEQ ID NO: 477271 - RNA, 21 nt, Human
gugauaacaugaacaugagua

SEQ ID NO: 477272 - RNA, 32 nt, Human
gugauaaccuugaagcuauucuccccuaauua

SEQ ID NO: 477273 - RNA, 32 nt, Human
gugauaagaacauaugcugucggcgacucacu

SEQ ID NO: 477274 - RNA, 32 nt, Human
gugauaagaugaagcacaaagugcugggauua

SEQ ID NO: 477275 - RNA, 32 nt, Human
gugauaagggaugaggaagaagaagagacaga

SEQ ID NO: 477276 - RNA, 32 nt, Human
gugauaagggugucgguuggcagaucaaaggg

SEQ ID NO: 477277 - RNA, 32 nt, Human
gugauaauaagaaagauguaguagggauagag

SEQ ID NO: 477278 - RNA, 32 nt, Human
gugauaaucccaccacccuuugcugacucucu

SEQ ID NO: 477279 - RNA, 32 nt, Human
gugauaaugaacacauggacuucuguuuauua

SEQ ID NO: 477280 - RNA, 32 nt, Human
gugauacaaagaaugaagagaaggaaggugcu

SEQ ID NO: 477281 - RNA, 21 nt, Human
gugauacaacagcuccacuca

SEQ ID NO: 477282 - RNA, 17 nt, Human
gugauacagaaguacua

SEQ ID NO: 477283 - RNA, 32 nt, Human
gugauacagcacugucuccaaauguggagcug

SEQ ID NO: 477284 - RNA, 32 nt, Human
gugauacagcacugucuccaaauguggggcug

SEQ ID NO: 477285 - RNA, 32 nt, Human
gugauacaucuucagcaccucagucugggaag

SEQ ID NO: 477286 - RNA, 31 nt, Human
gugauacauuccuuuuccugccaaaguucug

SEQ ID NO: 477287 - RNA, 32 nt, Human
gugauaccagaccacauugacagggaggauca

SEQ ID NO: 477288 - RNA, 32 nt, Human
gugauaccaguucagacacuaccccauauaca

SEQ ID NO: 477289 - RNA, 32 nt, Human
gugauaccccacucucuccauuauuguccagc

SEQ ID NO: 477290 - RNA, 32 nt, Human
gugauaccuccccuaaguuacucucacaauaa

SEQ ID NO: 477291 - RNA, 32 nt, Human
gugauaccuugaucuuucccacuuucuguuuu

SEQ ID NO: 477292 - RNA, 32 nt, Human
gugauacggagagcaacaguuccccagcaaca

SEQ ID NO: 477293 - RNA, 32 nt, Human
gugauacuccugccucagccuccugagaagcu

SEQ ID NO: 477294 - RNA, 32 nt, Human
gugauacugauugccacauuaagguugaacag

SEQ ID NO: 477295 - RNA, 32 nt, Human
gugauacuguacuccagccugagcaacagagc

SEQ ID NO: 477296 - RNA, 32 nt, Human
gugauagaaaucuaggccccagaagaggaaag

SEQ ID NO: 477297 - RNA, 22 nt, Human
gugauagagugagacucugucu

SEQ ID NO: 477298 - RNA, 32 nt, Human
gugcuugccaacaaucgcagagaagcugaaga

SEQ ID NO: 477299 - RNA, 32 nt, Human
gugcuugcccucucuacugucccggcggcauc

SEQ ID NO: 477300 - RNA, 32 nt, Human
gugcuugccgugagggccccaggauuuggccg

SEQ ID NO: 477301 - RNA, 32 nt, Human
gugcuugccucaccagcucucugcucacauuu

SEQ ID NO: 477302 - RNA, 32 nt, Human
gugcuugccucaccagcucucugcucacuuuu

SEQ ID NO: 477303 - RNA, 32 nt, Human
gugcuugcuaucugucucauguuacagagcuu

SEQ ID NO: 477304 - RNA, 32 nt, Human
gugcuugcucagaaaaacaaacaaacaaacag

SEQ ID NO: 477305 - RNA, 32 nt, Human
gugcuuggaagagaugaaagaucuucauggcu

SEQ ID NO: 477306 - RNA, 22 nt, Human
gugcuuggcauauuguagggug

SEQ ID NO: 477307 - RNA, 32 nt, Human
gugcuuggcuaugacucuaccuccagguuuac

SEQ ID NO: 477308 - RNA, 32 nt, Human
gugcuuggcuucccuaggcaugcaguaccaua

SEQ ID NO: 477309 - RNA, 32 nt, Human
gugcuuggguuaugauggcaggagucaagaag

SEQ ID NO: 477310 - RNA, 32 nt, Human
gugcuuggucuuaaaauacaugguuggacaga

SEQ ID NO: 477311 - RNA, 20 nt, Human
gugcuugucaggagguccag

SEQ ID NO: 477312 - RNA, 32 nt, Human
gugcuugugccacuguacuccagccuggccca

SEQ ID NO: 477313 - RNA, 32 nt, Human
gugcuugugggggugaaggguuggggugagaa

SEQ ID NO: 477314 - RNA, 32 nt, Human
gugcuugugugguccaaccucagucuggcccc

SEQ ID NO: 477315 - RNA, 32 nt, Human
gugcuuguuccucucaucuccccaccgguguc

SEQ ID NO: 477316 - RNA, 32 nt, Human
gugcuuguucuuccucuuaccuguaauagccu

SEQ ID NO: 477317 - RNA, 32 nt, Human
gugcuuguugcccaggcuggagugcaguggug

SEQ ID NO: 477318 - RNA, 32 nt, Human
gugcuuguuuacagcacuacucugugccagcc

SEQ ID NO: 477319 - RNA, 32 nt, Human
gugcuuguuugcucaccuggggugugggaggc

SEQ ID NO: 477320 - RNA, 32 nt, Human
gugcuuuaaaaaccagccuggcgaggacagcc

SEQ ID NO: 477321 - RNA, 32 nt, Human
gugcuuuaacaucaguugaaaccuaaauuuuc

SEQ ID NO: 477322 - RNA, 32 nt, Human
gugcuuuagaagauacuugcuguuggcugggc

SEQ ID NO: 477323 - RNA, 32 nt, Human
gugcuuuagaagggagaaagcaaaaacauuuu

SEQ ID NO: 477324 - RNA, 19 nt, Human
gugcuuuaggcccaggcgg

SEQ ID NO: 477325 - RNA, 32 nt, Human
gugcuuuauucaaaucuaaucuuauauggaac

SEQ ID NO: 477326 - RNA, 32 nt, Human
gugcuuucagcccggcccccuggagucgggcc

SEQ ID NO: 477327 - RNA, 32 nt, Human
gugcuuucaguuagccuucuguaggaaguaga

SEQ ID NO: 477328 - RNA, 32 nt, Human
gugcuuucauuauauaaugauacauuuagaca

SEQ ID NO: 477329 - RNA, 21 nt, Human
gugcuuuccggccgcccucug

SEQ ID NO: 477330 - RNA, 32 nt, Human
gugcuuuccucaggcuggguagauggagcucu

SEQ ID NO: 477331 - RNA, 32 nt, Human
gugcuuuccucccucuccccugcccaccucaa

SEQ ID NO: 477332 - RNA, 32 nt, Human
gugcuuucuaguugucaggaaugcugaagaau

SEQ ID NO: 477333 - RNA, 32 nt, Human
gugcuuucucugacgucucugccccuggcagg

SEQ ID NO: 477334 - RNA, 32 nt, Human
gugcuuucucugcuauugggcccagccuugcu

SEQ ID NO: 477335 - RNA, 32 nt, Human
gugcuuugaucaaagcagagcuggcagaauug

SEQ ID NO: 477336 - RNA, 32 nt, Human
gugcuuuggaaacugccagguggggucauguc

SEQ ID NO: 477337 - RNA, 32 nt, Human
gugcuuuguaugcuaaggaagugcuacgaugc

SEQ ID NO: 477338 - RNA, 32 nt, Human
gugcuuuguggcuucucuuuacagcuuuguuu

SEQ ID NO: 477339 - RNA, 32 nt, Human
gugcuuuguguagaguccagggcagcuggagc

SEQ ID NO: 477340 - RNA, 32 nt, Human
gugcuuuguuuccucuguuucuuccaauucuc

SEQ ID NO: 477341 - RNA, 32 nt, Human
gugcuuuuauguuuaauuuuaugagggccacg

SEQ ID NO: 477342 - RNA, 32 nt, Human
gugcuuuucaaucuaguaaaucuagaggguug

SEQ ID NO: 477343 - RNA, 32 nt, Human
gugcuuuucacuuugggacaaaguucuauaau

SEQ ID NO: 477344 - RNA, 32 nt, Human
gugcuuuuccacagaagguuagacccugaaag

SEQ ID NO: 477345 - RNA, 32 nt, Human
gugcuuuucccaagggucugggcucugaguug

SEQ ID NO: 477346 - RNA, 32 nt, Human
gugcuuuucgacgggcccucguggcuuggaac

SEQ ID NO: 477347 - RNA, 32 nt, Human
gugcuuuuguauuaaauuuaaauuuucacaua

SEQ ID NO: 477348 - RNA, 32 nt, Human
gugcuuuuuaaugugcagucuauuuccagagc

SEQ ID NO: 477349 - RNA, 32 nt, Human
gugcuuuuucgcuuuccuaagcuccugucgcu

SEQ ID NO: 477350 - RNA, 32 nt, Human
guggaaaaacccacuccugguuguuuagacgu

SEQ ID NO: 477351 - RNA, 32 nt, Human
guggaaaaacugccuuccacuaaaccaguccc

SEQ ID NO: 477352 - RNA, 23 nt, Human
guggaaaaauuuucaaguaacau

SEQ ID NO: 477353 - RNA, 31 nt, Human
guggaaaacaucuuuguacauuuaagucugu

SEQ ID NO: 477354 - RNA, 32 nt, Human
guggaaaagaaagaaugagaggugcgccguuu

SEQ ID NO: 477355 - RNA, 22 nt, Human
guggaaaagaccaagaugccau

SEQ ID NO: 477356 - RNA, 32 nt, Human
guggaaaagcaguaccagagagccuccgaggc

SEQ ID NO: 477357 - RNA, 24 nt, Human
guggaaaagccuucaagaugacau

SEQ ID NO: 477358 - RNA, 21 nt, Human
guggaaaagccuucagcugga

SEQ ID NO: 477359 - RNA, 20 nt, Human
guggaaaagccuuuauugac

SEQ ID NO: 477360 - RNA, 22 nt, Human
guggaaaaggccaaaccauagg

SEQ ID NO: 477361 - RNA, 32 nt, Human
guggaaaaugaacugaaggaugccacccaggg

SEQ ID NO: 477362 - RNA, 32 nt, Human
guggaaaauggacugggcuacugagauauuuu

SEQ ID NO: 477363 - RNA, 32 nt, Human
guggaaaauguucuugaucauuugcaguuaag

SEQ ID NO: 477364 - RNA, 32 nt, Human
guggaaacauuuuaaguuuucucuccggacug

SEQ ID NO: 477365 - RNA, 32 nt, Human
guggaaaccucccagggauauuguucccacga

SEQ ID NO: 477366 - RNA, 21 nt, Human
guggaaacuaugcauuuucug

SEQ ID NO: 477367 - RNA, 32 nt, Human
guggaaagaaggacaaagggagagggaggugc

SEQ ID NO: 477368 - RNA, 32 nt, Human
guggaaagaguuaagagcaagauggaaugauu

SEQ ID NO: 477369 - RNA, 32 nt, Human
guggaaagcgugugagugagggagacaggaac

SEQ ID NO: 477370 - RNA, 32 nt, Human
guggaaaggaagagugagcgagcaaguuaagg

SEQ ID NO: 477371 - RNA, 32 nt, Human
guggaaaggccuucaaucggagugcacaucuu

SEQ ID NO: 477372 - RNA, 32 nt, Human
guggaaaggccuucauucgggccucacaccuu

SEQ ID NO: 477373 - RNA, 31 nt, Human
guggaaagggacuucuuuggguuuuccuuuu

SEQ ID NO: 477374 - RNA, 32 nt, Human
guggaaagucucucuccuuccucauaagacau

SEQ ID NO: 477375 - RNA, 32 nt, Human
guggaaauagccaugacccagggaaagccaaa

SEQ ID NO: 477376 - RNA, 32 nt, Human
guggaaauauagaaaaauauuuuauaauauaa

SEQ ID NO: 477377 - RNA, 32 nt, Human
guggaaaucaacccucuccugucugcccucug

SEQ ID NO: 477378 - RNA, 31 nt, Human
guggaaaugaagagucuuccaauccuacugu

SEQ ID NO: 477379 - RNA, 32 nt, Human
guggaaaugaaugaggcacagccguagagcug

SEQ ID NO: 477380 - RNA, 19 nt, Human
guggaaaugaggauggagg

SEQ ID NO: 477381 - RNA, 32 nt, Human
guggaaaugcauuugagauggugacagggcug

SEQ ID NO: 477382 - RNA, 32 nt, Human
guggaaauggccuggaggaugugagggcaccc

SEQ ID NO: 477383 - RNA, 32 nt, Human
guggaaauggggaagggggccuggagagggga

SEQ ID NO: 477384 - RNA, 32 nt, Human
guggaacaaauaccaacauccauccaaaauga

SEQ ID NO: 477385 - RNA, 32 nt, Human
guggaacaacagcaagucacccaucagauacc

SEQ ID NO: 477386 - RNA, 32 nt, Human
guggaacaacccaguaauaucagacucgaauu

SEQ ID NO: 477387 - RNA, 32 nt, Human
guggaacaacgauaauucacacugcuuuauga

SEQ ID NO: 477388 - RNA, 32 nt, Human
guggaacagccuucuauagagccuucugcaag

SEQ ID NO: 477389 - RNA, 25 nt, Human
guggaacaggaaggaugugcuuuaa

SEQ ID NO: 477390 - RNA, 32 nt, Human
guggaacaggcaugugacagaguggggagccu

SEQ ID NO: 477391 - RNA, 19 nt, Human
guggaacauaaagccgccu

SEQ ID NO: 477392 - RNA, 32 nt, Human
guggaacauuuaauaaaaugaggggaaaugga

SEQ ID NO: 477393 - RNA, 32 nt, Human
guggaaccaagccagggaugggcuggccauug

SEQ ID NO: 477394 - RNA, 19 nt, Human
guggaaccacacugcuuga

SEQ ID NO: 477395 - RNA, 32 nt, Human
guggaaccagaacaaggccccgacagggguag

SEQ ID NO: 477396 - RNA, 32 nt, Human
guggaaccagugucacaugccugugcaucucu

SEQ ID NO: 477397 - RNA, 32 nt, Human
guggaacccgccauggcccccaaccaauguac

SEQ ID NO: 477398 - RNA, 32 nt, Human
guggaacccugccucuacuaaaaacacacaca

SEQ ID NO: 477399 - RNA, 32 nt, Human
guggaaccgggcugccccugggggccuggacu

SEQ ID NO: 477400 - RNA, 32 nt, Human
guggaaccuccaugcuaccaugugcacaaacc

SEQ ID NO: 477401 - RNA, 32 nt, Human
guggaaccucugucucauccuccuggaaccuu

SEQ ID NO: 477402 - RNA, 19 nt, Human
guggaaccugguauggagg

SEQ ID NO: 477403 - RNA, 32 nt, Human
guggaacgaauucaucaauucauuucaucaac

SEQ ID NO: 477404 - RNA, 32 nt, Human
guggaacgaugccucuggagguggugguggag

SEQ ID NO: 477405 - RNA, 32 nt, Human
guggaacggggcggguuggcagaggaggucac

SEQ ID NO: 477406 - RNA, 32 nt, Human
guggaacggugccucccacugcagccucugcc

SEQ ID NO: 477407 - RNA, 19 nt, Human
guggaacuaccaucuuuua

SEQ ID NO: 477408 - RNA, 32 nt, Human
guggaacuucuuuaagcauucagugugcccac

SEQ ID NO: 477409 - RNA, 32 nt, Human
guggaagaaaaggggugugcagcuggagcguu

SEQ ID NO: 477410 - RNA, 21 nt, Human
guggaagaaaccaugggcagg

SEQ ID NO: 477411 - RNA, 32 nt, Human
guggaagaaaggaggcugucucugccuucucu

SEQ ID NO: 477412 - RNA, 32 nt, Human
guggaagaaaggcuguuaaaaugauuacaaau

SEQ ID NO: 477413 - RNA, 32 nt, Human
guggaagaacuucugaaaauugcagugggagc

SEQ ID NO: 477414 - RNA, 32 nt, Human
guggaagaagacagagagaaucaaugugagga

SEQ ID NO: 477415 - RNA, 32 nt, Human
guggaagaagcgaaggaggagaagaagaaggg

SEQ ID NO: 477416 - RNA, 32 nt, Human
guggaagaagugagggugcagcgugucagaca

SEQ ID NO: 477417 - RNA, 32 nt, Human
guggaagaauuucgugccauguggaaacuuuu

SEQ ID NO: 477418 - RNA, 32 nt, Human
guggaagacagcuuccuguacuggcggauucg

SEQ ID NO: 477419 - RNA, 22 nt, Human
guggaagaccccaugaugacau

SEQ ID NO: 477420 - RNA, 32 nt, Human
guggaagacucgggcuuugagcuccagcucag

SEQ ID NO: 477421 - RNA, 32 nt, Human
guggaagaggagaagagggaccuggaaggcau

SEQ ID NO: 477422 - RNA, 32 nt, Human
guggaagaggagaggguggaaggggaauaaga

SEQ ID NO: 477423 - RNA, 32 nt, Human
guggaagaggcugagguuguggaacacacuga

SEQ ID NO: 477424 - RNA, 32 nt, Human
guggaagauccagagucaacagaggcucguca

SEQ ID NO: 477425 - RNA, 32 nt, Human
guggaagauucaggagaaagaaaggagaggcu

SEQ ID NO: 477426 - RNA, 32 nt, Human
guggaagcaccggaaguccagggagggccaag

SEQ ID NO: 477427 - RNA, 32 nt, Human
guggaagcagaggcccugcccccaccccuucc

SEQ ID NO: 477428 - RNA, 32 nt, Human
guggaagcagauuggcugggcuucugucccag

SEQ ID NO: 477429 - RNA, 32 nt, Human
guggaagcagguguauugugggcaguuuuguc

SEQ ID NO: 477430 - RNA, 19 nt, Human
guggaagccuguaguccca

SEQ ID NO: 477431 - RNA, 32 nt, Human
guggaagccuuucugugccuugcccuuugccc

SEQ ID NO: 477432 - RNA, 22 nt, Human
guggaagcguccaaaccugcuu

SEQ ID NO: 477433 - RNA, 31 nt, Human
guggaagcuaaaggaacuugggcauucaggg

SEQ ID NO: 477434 - RNA, 32 nt, Human
guggaagcuguggugggcagagccccaaaaca

SEQ ID NO: 477435 - RNA, 32 nt, Human
guggaagcuucucaaggccucaccagaagaag

SEQ ID NO: 477436 - RNA, 32 nt, Human
guggaagcuuuguccuugcagucuucacagua

SEQ ID NO: 477437 - RNA, 32 nt, Human
guggaaggaaagcaggagagagacugaguggc

SEQ ID NO: 477438 - RNA, 32 nt, Human
guggaaggaagccacacacuggucagucauuu

SEQ ID NO: 477439 - RNA, 32 nt, Human
guggaaggaaggaggaaaggagaggggccucc

SEQ ID NO: 477440 - RNA, 31 nt, Human
guggaaggacacuucuuucuaucacccucuu

SEQ ID NO: 477441 - RNA, 32 nt, Human
guggaaggacagcaucaacaccuggcauggga

SEQ ID NO: 477442 - RNA, 22 nt, Human
guggaaggagaaaaggauggga

SEQ ID NO: 477443 - RNA, 32 nt, Human
guggaaggagaaaggggcuagcacuggaugga

SEQ ID NO: 477444 - RNA, 24 nt, Human
guggaaggagacccccagaugaca

SEQ ID NO: 477445 - RNA, 24 nt, Human
guggaaggagcacugggcuagggg

SEQ ID NO: 477446 - RNA, 32 nt, Human
guggaaggaggcggaggcgcaggaggaagggg

SEQ ID NO: 477447 - RNA, 24 nt, Human
guggaaggaucauuugagcccagg

SEQ ID NO: 477448 - RNA, 24 nt, Human
guggaaggaucgcuugagcccagg

SEQ ID NO: 477449 - RNA, 24 nt, Human
guggaaggauggcuuaagcucagg

SEQ ID NO: 477450 - RNA, 24 nt, Human
guggaaggauugcucgaggccagg

SEQ ID NO: 477451 - RNA, 24 nt, Human
guggaaggauugcuugaguccagg

SEQ ID NO: 477452 - RNA, 32 nt, Human
guggaaggcccaguagagcugcccuuccccag

SEQ ID NO: 477453 - RNA, 32 nt, Human
guggaaggccgaggcaggaggaucacuugagu

SEQ ID NO: 477454 - RNA, 32 nt, Human
guggaaggccggccacaaggaggaggccacca

SEQ ID NO: 477455 - RNA, 32 nt, Human
guggaaggccggccgcaaggaggaggccacca

SEQ ID NO: 477456 - RNA, 32 nt, Human
guggaaggcuugagcccaggaguuugagggug

SEQ ID NO: 477457 - RNA, 19 nt, Human
guggaagggacuaggagca

SEQ ID NO: 477458 - RNA, 22 nt, Human
guggaagggacuugccuuguuu

SEQ ID NO: 477459 - RNA, 23 nt, Human
guggaagggguucugagguggga

SEQ ID NO: 477460 - RNA, 22 nt, Human
guggaaggugacucccagucuc

SEQ ID NO: 477461 - RNA, 32 nt, Human
guggaaggugcugagggggcccugaggcagga

SEQ ID NO: 477462 - RNA, 23 nt, Human
guggaaggugguggcuccugcuc

SEQ ID NO: 477463 - RNA, 20 nt, Human
guggaaggugucgccugcuc

SEQ ID NO: 477464 - RNA, 32 nt, Human
guggaaguccuccagggauccgcuacaucccc

SEQ ID NO: 477465 - RNA, 32 nt, Human
guggaagugccuguagucccagcuacucugga

SEQ ID NO: 477466 - RNA, 32 nt, Human
guggaaguggauguggaggagugaccagacca

SEQ ID NO: 477467 - RNA, 32 nt, Human
guggaauaagagaauuuugagauggaaaugau

SEQ ID NO: 477468 - RNA, 32 nt, Human
guggaaucacuggaucguaggcccagaugucu

SEQ ID NO: 477469 - RNA, 19 nt, Human
guggaaucagaaagagcaa

SEQ ID NO: 477470 - RNA, 18 nt, Human
guggaaucagcaggcagg

SEQ ID NO: 477471 - RNA, 32 nt, Human
guggaauccuaaggccccuuccucauucucuu

SEQ ID NO: 477472 - RNA, 21 nt, Human
guggaaucucucgagugcaaa

SEQ ID NO: 477473 - RNA, 32 nt, Human
guggaaugaauccauacuucugccucacuucg

SEQ ID NO: 477474 - RNA, 32 nt, Human
guggaaugacaguaaccaaaucugugaaaaua

SEQ ID NO: 477475 - RNA, 32 nt, Human
guggaaugagccuggaucaggagaaguaugcu

SEQ ID NO: 477476 - RNA, 23 nt, Human
guggaaugcgggggagcaggcag

SEQ ID NO: 477477 - RNA, 32 nt, Human
guggaaugcuaaaaauacauuaauuucuaaaa

SEQ ID NO: 477478 - RNA, 18 nt, Human
guggaaugucucucagca

SEQ ID NO: 477479 - RNA, 32 nt, Human
guggaaugugaggggagguggaggagauggcg

SEQ ID NO: 477480 - RNA, 32 nt, Human
guggaauucagucuacuggauuuaagggaaug

SEQ ID NO: 477481 - RNA, 32 nt, Human
guggaauucuaaagugaagguacuguggauuc

SEQ ID NO: 477482 - RNA, 32 nt, Human
guggaauucugcuugauaaagcugcuggguuu

SEQ ID NO: 477483 - RNA, 32 nt, Human
guggaauuguccugagucauugcuuugggcug

SEQ ID NO: 477484 - RNA, 32 nt, Human
guggaauuuccagauuuccugagagcuuggua

SEQ ID NO: 477485 - RNA, 32 nt, Human
guggacaaauugacuucuccuggguggaucuu

SEQ ID NO: 477486 - RNA, 22 nt, Human
guggacaaccuggacagccugc

SEQ ID NO: 477487 - RNA, 32 nt, Human
guggacaagaagccugagaagcugcuggagga

SEQ ID NO: 477488 - RNA, 32 nt, Human
guggacaagacaccuccaggagcccagcucac

SEQ ID NO: 477489 - RNA, 32 nt, Human
guggacaagguggaggagagagaauuccuugg

SEQ ID NO: 477490 - RNA, 32 nt, Human
guggacaaguagaaggugagcaaggugaagag

SEQ ID NO: 477491 - RNA, 32 nt, Human
guggacaaguucaugcaggaccuacagugacc

SEQ ID NO: 477492 - RNA, 32 nt, Human
guggacaauucgaacucugaccugagagcaag

SEQ ID NO: 477493 - RNA, 32 nt, Human
guggacacagcacuccaacuuacuccagggcu

SEQ ID NO: 477494 - RNA, 31 nt, Human
guggacaccugugccaaacucacuuaaaacg

SEQ ID NO: 477495 - RNA, 31 nt, Human
guggacacguuggagauuaccaaagccgaac

SEQ ID NO: 477496 - RNA, 32 nt, Human
guggacagaaggaagagaggagagggugagug

SEQ ID NO: 477497 - RNA, 32 nt, Human
guggacagacccaguagacaauggaagcccag

SEQ ID NO: 477498 - RNA, 20 nt, Human
guggacagacccuguccaca

SEQ ID NO: 477499 - RNA, 32 nt, Human
guggacagaggagggagccagcuaagccaaau

SEQ ID NO: 477500 - RNA, 20 nt, Human
guggacagcagggaccugcg

SEQ ID NO: 477501 - RNA, 32 nt, Human
guggacagcaugguccucacacccagcucccu

SEQ ID NO: 477502 - RNA, 32 nt, Human
guggacagcccaccccuccgcagccccauccc

SEQ ID NO: 477503 - RNA, 32 nt, Human
guggacagcccaucccagcccucagaggcuca

SEQ ID NO: 477504 - RNA, 32 nt, Human
guggacagccugugggagacucgcacgcccac

SEQ ID NO: 477505 - RNA, 32 nt, Human
guggacaggaaggcacaggaguuugucuggga

SEQ ID NO: 477506 - RNA, 32 nt, Human
guggacaggagaaggaacgccuuccaggaacc

SEQ ID NO: 477507 - RNA, 32 nt, Human
guggacaggaucaggauucccuugaaagccca

SEQ ID NO: 477508 - RNA, 18 nt, Human
guggacaggcaucagccu

SEQ ID NO: 477509 - RNA, 32 nt, Human
guggacagggggaaaaaucaagaggcaaaaag

SEQ ID NO: 477510 - RNA, 32 nt, Human
guggacaggguuucaccauguuggccaggcug

SEQ ID NO: 477511 - RNA, 24 nt, Human
guggacagucaugagucuagagga

SEQ ID NO: 477512 - RNA, 32 nt, Human
guggacaguccugggagaaccucaggcuuccu

SEQ ID NO: 477513 - RNA, 32 nt, Human
guggacagugauuugcguggggagacacagug

SEQ ID NO: 477514 - RNA, 32 nt, Human
guggacauagagagaggggaaggguuggaaag

SEQ ID NO: 477515 - RNA, 32 nt, Human
guggacauagcauguacaggcaguuuucuguc

SEQ ID NO: 477516 - RNA, 32 nt, Human
guggacaucacuguugacccuaccucacgugc

SEQ ID NO: 477517 - RNA, 32 nt, Human
guggacaucaugggagaggaugaggauggacu

SEQ ID NO: 477518 - RNA, 32 nt, Human
guggacaugccaucccuggucuccuuagacug

SEQ ID NO: 477519 - RNA, 32 nt, Human
guggacaugguggcgagcaccuguaaucccag

SEQ ID NO: 477520 - RNA, 32 nt, Human
guggacauuaagcaucuucuagaaacucuucu

SEQ ID NO: 477521 - RNA, 32 nt, Human
guggacauucagcagagugcgaguggagagag

SEQ ID NO: 477522 - RNA, 32 nt, Human
guggacauuugagaucagagagcaccacaggg

SEQ ID NO: 477523 - RNA, 32 nt, Human
guggaccaacuugcucuuaaucacagggcaag

SEQ ID NO: 477524 - RNA, 32 nt, Human
guggaccacugcuccugauuucccaggucuua

SEQ ID NO: 477525 - RNA, 32 nt, Human
guggaccagaaacaaacguuuuuccaaaggau

SEQ ID NO: 477526 - RNA, 19 nt, Human
guggaccaggcaucuccug

SEQ ID NO: 477527 - RNA, 32 nt, Human
guggaccauccuaguuuauucucccauaaguc

SEQ ID NO: 477528 - RNA, 32 nt, Human
guggaccauuccacuuuuuagcuccuauugau

SEQ ID NO: 477529 - RNA, 32 nt, Human
guggacccaggaggcagagcuugcagugagcc

SEQ ID NO: 477530 - RNA, 32 nt, Human
guggacccaucccgcgggugaccggugccugu

SEQ ID NO: 477531 - RNA, 32 nt, Human
guggacccaucuuccuccucugccaccccgau

SEQ ID NO: 477532 - RNA, 19 nt, Human
guggacccggucucccaca

SEQ ID NO: 477533 - RNA, 21 nt, Human
guggacccuaccagccugcgg

SEQ ID NO: 477534 - RNA, 32 nt, Human
guggaccgagagaagaaggggcccagggaagc

SEQ ID NO: 477535 - RNA, 32 nt, Human
guggaccgcagcgcgcagccacaugcccuggc

SEQ ID NO: 477536 - RNA, 32 nt, Human
guggaccucacuguagccuggucauggcuucc

SEQ ID NO: 477537 - RNA, 32 nt, Human
guggaccuccaggaaugccucccuuugcaucu

SEQ ID NO: 477538 - RNA, 32 nt, Human
guggaccugcuguuggccucuggggcugucau

SEQ ID NO: 477539 - RNA, 32 nt, Human
guggaccugggaacccucaggucucuagguga

SEQ ID NO: 477540 - RNA, 32 nt, Human
guggaccugugucugugucuguccugagaacu

SEQ ID NO: 477541 - RNA, 32 nt, Human
guggaccuuugugcuccuggggcagagccucc

SEQ ID NO: 477542 - RNA, 32 nt, Human
guggacgacgcuggcggcccagccugggcagg

SEQ ID NO: 477543 - RNA, 32 nt, Human
guggacgacgcuugcggcccagccugggcagg

SEQ ID NO: 477544 - RNA, 32 nt, Human
guggacgagccuguggagugggagacaccuga

SEQ ID NO: 477545 - RNA, 32 nt, Human
guggacgaggagcacugugacccccugggccg

SEQ ID NO: 477546 - RNA, 32 nt, Human
guggacgcaggcggaucucugaagagcugggu

SEQ ID NO: 477547 - RNA, 32 nt, Human
guggacgccaggguucugggaacgcgcuggca

SEQ ID NO: 477548 - RNA, 32 nt, Human
guggacgccgcucuuccucuccccacaucucc

SEQ ID NO: 477549 - RNA, 32 nt, Human
guggacgccguugguccugccagggauggaga

SEQ ID NO: 477550 - RNA, 32 nt, Human
guggacgccguuuguccugccagggcaggaug

SEQ ID NO: 477551 - RNA, 32 nt, Human
guggacgccuguaaucccagcuacuugggagg

SEQ ID NO: 477552 - RNA, 32 nt, Human
guggacgcgcccugggcgcacgcccaggcagc

SEQ ID NO: 477553 - RNA, 32 nt, Human
guggacgcucaggggcuggaggcucagcggaa

SEQ ID NO: 477554 - RNA, 32 nt, Human
guggacgcugggagguggaugcugcagugagc

SEQ ID NO: 477555 - RNA, 20 nt, Human
guggacggagaucacccgcg

SEQ ID NO: 477556 - RNA, 32 nt, Human
guggacggcgugccucucccaggagccuuccc

SEQ ID NO: 477557 - RNA, 32 nt, Human
guggacgggcguuuucacagggcucugagugg

SEQ ID NO: 477558 - RNA, 19 nt, Human
guggacggggcgucuccua

SEQ ID NO: 477559 - RNA, 32 nt, Human
guggacgggggaggaggaaggggacagaggga

SEQ ID NO: 477560 - RNA, 21 nt, Human
guggacgguuggucuugaaga

SEQ ID NO: 477561 - RNA, 32 nt, Human
guggacguuguuuucugccuucccaggauucu

SEQ ID NO: 477562 - RNA, 32 nt, Human
guggacuaaugcaagaaaauuauuaccagagu

SEQ ID NO: 477563 - RNA, 32 nt, Human
guggacuaauggaagcuacagagcagggaagg

SEQ ID NO: 477564 - RNA, 32 nt, Human
guggacuauuuguacacauacacacaugcaca

SEQ ID NO: 477565 - RNA, 32 nt, Human
guggacuccagaaagccugaaaagcuaucaug

SEQ ID NO: 477566 - RNA, 32 nt, Human
guggacuccagguucaggagggagaagagcaa

SEQ ID NO: 477567 - RNA, 32 nt, Human
guggacuccauuuugaccaguuaacccauucu

SEQ ID NO: 477568 - RNA, 32 nt, Human
guggacucgagucccuggagcaggcagugugg

SEQ ID NO: 477569 - RNA, 21 nt, Human
guggacucgccuguaaucuca

SEQ ID NO: 477570 - RNA, 16 nt, Human
guggacucuacagagu

SEQ ID NO: 477571 - RNA, 32 nt, Human
guggacucuacagagugcuugaccucaacaca

SEQ ID NO: 477572 - RNA, 32 nt, Human
guggacucugcugcaaaauggugcuucaggcu

SEQ ID NO: 477573 - RNA, 32 nt, Human
guggacucuggacuuggggaccaccuguuauc

SEQ ID NO: 477574 - RNA, 32 nt, Human
guggacucugggauguguagccuucuccccaa

SEQ ID NO: 477575 - RNA, 32 nt, Human
guggacugauuugcuggaguucagggaacuac

SEQ ID NO: 477576 - RNA, 32 nt, Human
guggacugcagcccuggggguugcaggcugcg

SEQ ID NO: 477577 - RNA, 32 nt, Human
guggacugcaggggaaagagcagugauuuggg

SEQ ID NO: 477578 - RNA, 32 nt, Human
guggacugccacugcuggcugccuccucucca

SEQ ID NO: 477579 - RNA, 32 nt, Human
guggacugcgccccuggcugggaggaaggacu

SEQ ID NO: 477580 - RNA, 32 nt, Human
guggacugcuaaaaauaucacaaauggcaaug

SEQ ID NO: 477581 - RNA, 32 nt, Human
guggacuggagaccaggauucaugcuggucug

SEQ ID NO: 477582 - RNA, 32 nt, Human
guggacugugugucccagcucuggagcaagcu

SEQ ID NO: 477583 - RNA, 21 nt, Human
guggacuuaacuuuuaaggua

SEQ ID NO: 477584 - RNA, 32 nt, Human
guggacuuccaaagugcugggauuacaggugu

SEQ ID NO: 477585 - RNA, 19 nt, Human
guggacuuccugccagggc

SEQ ID NO: 477586 - RNA, 32 nt, Human
guggacuucggaaucccaggaggcaggggccg

SEQ ID NO: 477587 - RNA, 18 nt, Human
guggacuucuucaggacu

SEQ ID NO: 477588 - RNA, 32 nt, Human
guggacuucuucugccccuccuccuuuucugu

SEQ ID NO: 477589 - RNA, 19 nt, Human
guggacuugaucauggacu

SEQ ID NO: 477590 - RNA, 20 nt, Human
guggagaaaauuuaucaccu

SEQ ID NO: 477591 - RNA, 32 nt, Human
guggagaaacuagagcuucaguucauccaccu

SEQ ID NO: 477592 - RNA, 32 nt, Human
guggagaaacugcagccccacuucuguuuccc

SEQ ID NO: 477593 - RNA, 19 nt, Human
guggagaaagcgguccucu

SEQ ID NO: 477594 - RNA, 32 nt, Human
guggagaacagcgcggaggcaccccacgagau

SEQ ID NO: 477595 - RNA, 23 nt, Human
guggagaacuccauguagcuucu

SEQ ID NO: 477596 - RNA, 32 nt, Human
guggagaagagggagggagcgagagcgagaga

SEQ ID NO: 477597 - RNA, 32 nt, Human
guggagaagcggcggcacaagcgcggcggcgg

SEQ ID NO: 477598 - RNA, 32 nt, Human
guggagaaggagagagaaauaugugagguagu

SEQ ID NO: 477599 - RNA, 32 nt, Human
guggagaaggagcaaugcugaggggugaggcc

SEQ ID NO: 477600 - RNA, 32 nt, Human
guggagaagguagaggauggaguugcagacuc

SEQ ID NO: 477601 - RNA, 18 nt, Human
guggagaaucucucagca

SEQ ID NO: 477602 - RNA, 32 nt, Human
guggagaaugucccucguuuccauccuguuuc

SEQ ID NO: 477603 - RNA, 32 nt, Human
guggagaauugggacaggcagagccaggaugc

SEQ ID NO: 477604 - RNA, 32 nt, Human
guggagacuguggagcugggcagcuaugagaa

SEQ ID NO: 477605 - RNA, 32 nt, Human
guggagagacacaccugcuccaauuuccccac

SEQ ID NO: 477606 - RNA, 32 nt, Human
guggagagacagguauuccucacuuuguggca

SEQ ID NO: 477607 - RNA, 32 nt, Human
guggagagagcaggcaggcccacugcugcuga

SEQ ID NO: 477608 - RNA, 32 nt, Human
guggagagagggacagaggcuggagaaggaug

SEQ ID NO: 477609 - RNA, 32 nt, Human
guggagagcauaguaaauuuucagagaacuug

SEQ ID NO: 477610 - RNA, 32 nt, Human
guggagagccugccuuuggguuuaguucccga

SEQ ID NO: 477611 - RNA, 19 nt, Human
guggagagcucuuugccca

SEQ ID NO: 477612 - RNA, 32 nt, Human
guggagagcugggagagcgcagccagcucgcu

SEQ ID NO: 477613 - RNA, 32 nt, Human
guggagaggagagaguggagggagaucaugcc

SEQ ID NO: 477614 - RNA, 32 nt, Human
guggagaggaggaggaggaugaagaagguuau

SEQ ID NO: 477615 - RNA, 32 nt, Human
guggagaggaugagguuugaggagcagaggga

SEQ ID NO: 477616 - RNA, 32 nt, Human
guggagaggcccgcucucacaccgggucgggc

SEQ ID NO: 477617 - RNA, 32 nt, Human
guggagagggagaggcuggaggccugggcaga

SEQ ID NO: 477618 - RNA, 32 nt, Human
guggagagggagaugugugagcauccugcaag

SEQ ID NO: 477619 - RNA, 22 nt, Human
guggagaggggaucagcccagg

SEQ ID NO: 477620 - RNA, 32 nt, Human
guggagagggugggugcaggaggcagacccuc

SEQ ID NO: 477621 - RNA, 32 nt, Human
guggagaguagcacuggcagcccugccuggac

SEQ ID NO: 477622 - RNA, 32 nt, Human
guggagagucauucauuuagcacaagcagcug

SEQ ID NO: 477623 - RNA, 32 nt, Human
guggagaguggagagacaagaagugugagcua

SEQ ID NO: 477624 - RNA, 32 nt, Human
guggagaguuggggaccaggguguuugaggcg

SEQ ID NO: 477625 - RNA, 32 nt, Human
guggagauauguggaacuucuccaacccuguu

SEQ ID NO: 477626 - RNA, 32 nt, Human
guggagaucacgccacugcaacuccagcuugg

SEQ ID NO: 477627 - RNA, 32 nt, Human
guggagaugacagcaaccacacaagguuaagg

SEQ ID NO: 477628 - RNA, 31 nt, Human
guggagaugcccaggaaucugcuuuauucuc

SEQ ID NO: 477629 - RNA, 32 nt, Human
guggagauggaaggagaaacagcauccgguca

SEQ ID NO: 477630 - RNA, 31 nt, Human
guggagauggcaguguaucuaccucacaaag

SEQ ID NO: 477631 - RNA, 32 nt, Human
guggagauggccuguagguagcaaaugcagga

SEQ ID NO: 477632 - RNA, 32 nt, Human
guggagauggcggcuggagcaguguccgaggu

SEQ ID NO: 477633 - RNA, 32 nt, Human
guggagaugggaagacagggaaaggaaggcag

SEQ ID NO: 477634 - RNA, 32 nt, Human
guggagaugggggcgggggugguggugaagag

SEQ ID NO: 477635 - RNA, 19 nt, Human
guggagcaaaaaggcaaga

SEQ ID NO: 477636 - RNA, 32 nt, Human
guggagcaaguuggacugcauagggacccacc

SEQ ID NO: 477637 - RNA, 32 nt, Human
guggagcaccuaguccaaaagggaagcagaaa

SEQ ID NO: 477638 - RNA, 18 nt, Human
guggagcagaaggcagga

SEQ ID NO: 477639 - RNA, 32 nt, Human
guggagcagcacaucagcagggacuggucuag

SEQ ID NO: 477640 - RNA, 32 nt, Human
guggagcagcagccacugcacaggaggaggug

SEQ ID NO: 477641 - RNA, 32 nt, Human
guggagcagcagugucagcaucagggcggaag

SEQ ID NO: 477642 - RNA, 32 nt, Human
guggagcagcuggggcugggggcacagccugg

SEQ ID NO: 477643 - RNA, 32 nt, Human
guggagcagggcucccucugugcacuguguac

SEQ ID NO: 477644 - RNA, 25 nt, Human
guggagcagggcuuagcaggagcag

SEQ ID NO: 477645 - RNA, 32 nt, Human
guggagcaguuacugucaaaaguuuucugucu

SEQ ID NO: 477646 - RNA, 32 nt, Human
guggagccaagauuugaacccagcuagaaugu

SEQ ID NO: 477647 - RNA, 32 nt, Human
guggagccaccugaacagaagaugaccaucau

SEQ ID NO: 477648 - RNA, 19 nt, Human
guggagccagcacagcgga

SEQ ID NO: 477649 - RNA, 32 nt, Human
guggagccagcagaaccacaggagagugcccu

SEQ ID NO: 477650 - RNA, 32 nt, Human
guggagccaggcagccuccaccucacaagacc

SEQ ID NO: 477651 - RNA, 32 nt, Human
guggagccaugguggugcguccuuuacucaac

SEQ ID NO: 477652 - RNA, 32 nt, Human
guggagcccagggagagggagcgcgagagagg

SEQ ID NO: 477653 - RNA, 32 nt, Human
guggagcccgggagguaauugggggugaggaa

SEQ ID NO: 477654 - RNA, 32 nt, Human
guggagcccuggaggccugagccggcccccgg

SEQ ID NO: 477655 - RNA, 32 nt, Human
guggagccgggcuggggguggggaagggaggc

SEQ ID NO: 477656 - RNA, 18 nt, Human
guggagccugucccuaca

SEQ ID NO: 477657 - RNA, 32 nt, Human
guggagcgacgucacugacccugucuuugucc

SEQ ID NO: 477658 - RNA, 32 nt, Human
guggagcgggagaaggagcgggaccccgagca

SEQ ID NO: 477659 - RNA, 32 nt, Human
guggagcgucggacauggaugggugaacugac

SEQ ID NO: 477660 - RNA, 32 nt, Human
guggagcucagcaacaaggcugcacagcucaa

SEQ ID NO: 477661 - RNA, 32 nt, Human
guggagcuccccugcacccaccagggagcuug

SEQ ID NO: 477662 - RNA, 32 nt, Human
guggagcucucauuggcucguugcaugugagu

SEQ ID NO: 477663 - RNA, 32 nt, Human
guggagcugagagcucaggucugggcucagcc

SEQ ID NO: 477664 - RNA, 32 nt, Human
guggagcugagcacugccuagccugggccaga

SEQ ID NO: 477665 - RNA, 32 nt, Human
guggagcugagcagagaggccuaaccaggauc

SEQ ID NO: 477666 - RNA, 32 nt, Human
guggagcugcuagaaagauuccuuuggggaga

SEQ ID NO: 477667 - RNA, 32 nt, Human
guggagcuggagugugaggagggcgagcuguc

SEQ ID NO: 477668 - RNA, 32 nt, Human
guggagcuugccaagguccguggcucccaggg

SEQ ID NO: 477669 - RNA, 32 nt, Human
guggaggaaagccaacauaaugaccgagcccc

SEQ ID NO: 477670 - RNA, 32 nt, Human
guggaggaaaggaggugaauucaucugcuagc

SEQ ID NO: 477671 - RNA, 32 nt, Human
guggaggaagaaggaaggagaggcuuggaaag

SEQ ID NO: 477672 - RNA, 32 nt, Human
guggaggaagccagcuugcagagagagcaaga

SEQ ID NO: 477673 - RNA, 32 nt, Human
guggaggaagccaggaggaggguggcuugcuu

SEQ ID NO: 477674 - RNA, 32 nt, Human
guggaggaagcugaggcucagagagguuaagc

SEQ ID NO: 477675 - RNA, 32 nt, Human
guggaggaaggagcaggugcugccugugacuc

SEQ ID NO: 477676 - RNA, 32 nt, Human
guggaggaauacacauacacacacaaacauac

SEQ ID NO: 477677 - RNA, 32 nt, Human
guggaggacaugccgggacugaggcagccacc

SEQ ID NO: 477678 - RNA, 32 nt, Human
guggaggaccugcccuacacacucagcauggu

SEQ ID NO: 477679 - RNA, 32 nt, Human
guggaggacgagguaucucagcagcaauguca

SEQ ID NO: 477680 - RNA, 32 nt, Human
guggaggacucagccuggccucugccuggccu

SEQ ID NO: 477681 - RNA, 32 nt, Human
guggaggacuccugccuuuccuguuuagacac

SEQ ID NO: 477682 - RNA, 31 nt, Human
guggaggagacgucucccaugaggccaaggc

SEQ ID NO: 477683 - RNA, 32 nt, Human
guggaggagaggcgggguaauggggaagcuga

SEQ ID NO: 477684 - RNA, 32 nt, Human
guggaggagauggugacagccggcgcuacagc

SEQ ID NO: 477685 - RNA, 32 nt, Human
guggaggaggaagaggaggaggaagaggacuu

SEQ ID NO: 477686 - RNA, 32 nt, Human
guggaggaggaaggaggaucacuguggaaauc

SEQ ID NO: 477687 - RNA, 32 nt, Human
guggaggaggaggaggaagagguggaggagga

SEQ ID NO: 477688 - RNA, 21 nt, Human
guggaggaggaggaggagccu

SEQ ID NO: 477689 - RNA, 32 nt, Human
guggaggaggaggaggaggaggaaggcaaagc

SEQ ID NO: 477690 - RNA, 32 nt, Human
guggaggaggaggaggaggaggaggagguggc

SEQ ID NO: 477691 - RNA, 32 nt, Human
guggaggaggaggaggaggaggugguggagga

SEQ ID NO: 477692 - RNA, 32 nt, Human
guggaggaggcagugggggcagcagcagccuc

SEQ ID NO: 477693 - RNA, 32 nt, Human
guggaggaggccccucggucagggagcggccu

SEQ ID NO: 477694 - RNA, 32 nt, Human
guggaggaggcgcuggagcugaaggaauggac

SEQ ID NO: 477695 - RNA, 32 nt, Human
guggaggagggaggggaggagcaggugggcug

SEQ ID NO: 477696 - RNA, 32 nt, Human
guggaggaggggcacggggccuccgagcucca

SEQ ID NO: 477697 - RNA, 32 nt, Human
guggaggagguggcaggccucggcggguaacc

SEQ ID NO: 477698 - RNA, 32 nt, Human
guggaggagguggugaccaccaccgcuccucc

SEQ ID NO: 477699 - RNA, 31 nt, Human
guggaggagucagucgugguuggagguucau

SEQ ID NO: 477700 - RNA, 32 nt, Human
guggaggcaaagcauucuuucugugacuauuu

SEQ ID NO: 477701 - RNA, 32 nt, Human
guggaggcagcagccuggggcagggacugugc

SEQ ID NO: 477702 - RNA, 32 nt, Human
guggaggcagugagcugagaucgugccacugu

SEQ ID NO: 477703 - RNA, 32 nt, Human
guggaggcagugucauuugcucugccuaauua

SEQ ID NO: 477704 - RNA, 32 nt, Human
guggaggcaugcaggggagacgacucagggau

SEQ ID NO: 477705 - RNA, 32 nt, Human
guggaggccaggaagguggagaagccugggug

SEQ ID NO: 477706 - RNA, 32 nt, Human
guggaggccaggcuggggugggguguggcagg

SEQ ID NO: 477707 - RNA, 32 nt, Human
guggaggccccaggcugcuagcacagguggaa

SEQ ID NO: 477708 - RNA, 32 nt, Human
guggaggcccccucccugucuggaccccggcc

SEQ ID NO: 477709 - RNA, 32 nt, Human
guggaggccuccuucccacagcuccugguuua

SEQ ID NO: 477710 - RNA, 32 nt, Human
guggaggcgacggagcagggggccaguggggc

SEQ ID NO: 477711 - RNA, 23 nt, Human
guggaggcgccagcugccuguuc

SEQ ID NO: 477712 - RNA, 16 nt, Human
guggaggcgcgcgagg

SEQ ID NO: 477713 - RNA, 32 nt, Human
guggaggcgcugucugucccucugucccucug

SEQ ID NO: 477714 - RNA, 32 nt, Human
guggaggcucaaguuuucugcucacuugguga

SEQ ID NO: 477715 - RNA, 22 nt, Human
guggaggcucaugccuguaauc

SEQ ID NO: 477716 - RNA, 32 nt, Human
guggaggcuccaggcugggagaagguggaagg

SEQ ID NO: 477717 - RNA, 32 nt, Human
guggaggcuccucugugagcucuaccugccuc

SEQ ID NO: 477718 - RNA, 32 nt, Human
guggaggcucuuccuuugaucucagaaaggau

SEQ ID NO: 477719 - RNA, 32 nt, Human
guggaggcugaggaggcggcggcggagaucug

SEQ ID NO: 477720 - RNA, 32 nt, Human
guggaggcugcuggcccugccaucuguaagaa

SEQ ID NO: 477721 - RNA, 32 nt, Human
guggaggcugggccaccauggcagaccuucca

SEQ ID NO: 477722 - RNA, 32 nt, Human
guggaggcugugagcccgcagccuggaauucu

SEQ ID NO: 477723 - RNA, 20 nt, Human
guggaggcugugcugcagcu

SEQ ID NO: 477724 - RNA, 32 nt, Human
guggaggcuucaucugaaagccaagaaaagag

SEQ ID NO: 477725 - RNA, 32 nt, Human
guggaggcuugaugaggaggugguggccugug

SEQ ID NO: 477726 - RNA, 32 nt, Human
guggagggaacagcaggugcugggggcaggga

SEQ ID NO: 477727 - RNA, 32 nt, Human
guggagggaagguggugccauugaaaggcacu

SEQ ID NO: 477728 - RNA, 32 nt, Human
guggagggagagaggacuuaagucagauggac

SEQ ID NO: 477729 - RNA, 32 nt, Human
guggagggagcagcuccccacucagcccuggg

SEQ ID NO: 477730 - RNA, 32 nt, Human
guggagggaggaacuuuggcacuagcccuugg

SEQ ID NO: 477731 - RNA, 22 nt, Human
guggagggaggaagggcuggga

SEQ ID NO: 477732 - RNA, 32 nt, Human
guggagggaggcaaaggccaggcugaggauca

SEQ ID NO: 477733 - RNA, 32 nt, Human
guggagggagggagggaggggagcaugguguc

SEQ ID NO: 477734 - RNA, 32 nt, Human
guggagggagggccccuugcucuccagcaaaa

SEQ ID NO: 477735 - RNA, 32 nt, Human
guggagggaggugcuuggggaggcagagguua

SEQ ID NO: 477736 - RNA, 32 nt, Human
guggagggagucagggucugucuggaagcauc

SEQ ID NO: 477737 - RNA, 23 nt, Human
guggagggaguucccgcuugcuc

SEQ ID NO: 477738 - RNA, 32 nt, Human
guggagggcagaggagaggggacaagacaggg

SEQ ID NO: 477739 - RNA, 21 nt, Human
guggagggccagcuuuuguuc

SEQ ID NO: 477740 - RNA, 20 nt, Human
guggagggcccugcgccugc

SEQ ID NO: 477741 - RNA, 32 nt, Human
guggagggccucgccauguccugcugcccgac

SEQ ID NO: 477742 - RNA, 24 nt, Human
guggagggccugacuguccugcuc

SEQ ID NO: 477743 - RNA, 32 nt, Human
guggagggccuggaugaugaggaggaggauga

SEQ ID NO: 477744 - RNA, 32 nt, Human
guggagggcgaacggcugcaggcuccagacuu

SEQ ID NO: 477745 - RNA, 32 nt, Human
guggagggcguagggugggggcagugaggaau

SEQ ID NO: 477746 - RNA, 32 nt, Human
guggagggcugcagagccugcagggugaccug

SEQ ID NO: 477747 - RNA, 32 nt, Human
guggaggggaaagggauagaaagcggauagaa

SEQ ID NO: 477748 - RNA, 32 nt, Human
guggaggggaaaguaggaggccuguacaagaa

SEQ ID NO: 477749 - RNA, 23 nt, Human
guggaggggagcggagaccugau

SEQ ID NO: 477750 - RNA, 32 nt, Human
guggaggggaggccaguguacauguaaaugcc

SEQ ID NO: 477751 - RNA, 32 nt, Human
guggaggggcagccugugccugccuuuguguc

SEQ ID NO: 477752 - RNA, 32 nt, Human
guggaggggcaugccuguggucucagcuauuc

SEQ ID NO: 477753 - RNA, 32 nt, Human
guggaggggccaccucagcagguggguucuga

SEQ ID NO: 477754 - RNA, 32 nt, Human
guggaggggcccaggcucugagcuccacaggu

SEQ ID NO: 477755 - RNA, 32 nt, Human
guggaggggcgacaauggagggaaauccaugg

SEQ ID NO: 477756 - RNA, 32 nt, Human
guggaggggcuggggguacacacagcucagga

SEQ ID NO: 477757 - RNA, 32 nt, Human
guggaggggcugucucuggacauaucaucccu

SEQ ID NO: 477758 - RNA, 18 nt, Human
guggagggggaagaucug

SEQ ID NO: 477759 - RNA, 32 nt, Human
guggagggggauaaguggggacuggggacaug

SEQ ID NO: 477760 - RNA, 18 nt, Human
guggagggggcaggggag

SEQ ID NO: 477761 - RNA, 23 nt, Human
guggagggggugaaagugaggga

SEQ ID NO: 477762 - RNA, 32 nt, Human
guggaggggucaacaccaaggugguguucgug

SEQ ID NO: 477763 - RNA, 22 nt, Human
guggagggugccuguaauccca

SEQ ID NO: 477764 - RNA, 32 nt, Human
guggaggguggaggagggagcaggaacagccc

SEQ ID NO: 477765 - RNA, 32 nt, Human
guggagguagguguggggaagguuggagaaga

SEQ ID NO: 477766 - RNA, 32 nt, Human
guggaggucacugcacuaccacccaccucugg

SEQ ID NO: 477767 - RNA, 32 nt, Human
guggaggucgagguggggagggggaggcgggc

SEQ ID NO: 477768 - RNA, 32 nt, Human
guggaggugcgcaguggacucacagcugacuc

SEQ ID NO: 477769 - RNA, 21 nt, Human
guggagguggacgacaugaug

SEQ ID NO: 477770 - RNA, 32 nt, Human
guggagguggacugcauagcccagagcccuuc

SEQ ID NO: 477771 - RNA, 32 nt, Human
guggagguggcggagagcaagguggcagccgg

SEQ ID NO: 477772 - RNA, 32 nt, Human
guggagguggucugggugagucugaaggccuc

SEQ ID NO: 477773 - RNA, 32 nt, Human
guggaggugguugugggugcaggugugugcag

SEQ ID NO: 477774 - RNA, 32 nt, Human
guggagguucucaaacaacuccuuaagcuccu

SEQ ID NO: 477775 - RNA, 32 nt, Human
guggagguucucucucuuuuaggcuugcagua

SEQ ID NO: 477776 - RNA, 32 nt, Human
guggagguucucugcccaccucaggcacugga

SEQ ID NO: 477777 - RNA, 23 nt, Human
guggagguugcagugagcuggga

SEQ ID NO: 477778 - RNA, 32 nt, Human
guggagguuguaccacugcacuccagccuggc

SEQ ID NO: 477779 - RNA, 23 nt, Human
guggagguuucagugagcuggga

SEQ ID NO: 477780 - RNA, 32 nt, Human
guggagguuuuacauuuguuugcacaucucag

SEQ ID NO: 477781 - RNA, 32 nt, Human
guggaguaagaugcccucccacuuuuaucagu

SEQ ID NO: 477782 - RNA, 32 nt, Human
guggaguacagaaccaggagccucuuccauac

SEQ ID NO: 477783 - RNA, 32 nt, Human
guggaguaccuuccuuucucaagucucgagau

SEQ ID NO: 477784 - RNA, 32 nt, Human
guggaguagggaggaggcaaggagggggagaa

SEQ ID NO: 477785 - RNA, 32 nt, Human
guggaguauaggcugcaucaucuuugaauacu

SEQ ID NO: 477786 - RNA, 32 nt, Human
guggaguaucuggcugggcagcauugccagca

SEQ ID NO: 477787 - RNA, 32 nt, Human
guggaguauggggcugucuccaggggagaggu

SEQ ID NO: 477788 - RNA, 32 nt, Human
guggaguccacagucccucccugagagacaug

SEQ ID NO: 477789 - RNA, 32 nt, Human
guggaguccagccuuuucccucugggcccagc

SEQ ID NO: 477790 - RNA, 32 nt, Human
guggaguccgaggaggaggagaaggaggccug

SEQ ID NO: 477791 - RNA, 32 nt, Human
guggagucgucugguccccauacagagggacc

SEQ ID NO: 477792 - RNA, 32 nt, Human
guggagucuacccccaagcccuucuccucuuc

SEQ ID NO: 477793 - RNA, 32 nt, Human
guggagucuauguugcccaggcuggucucuua

SEQ ID NO: 477794 - RNA, 32 nt, Human
guggagucuccaggaguggagccccgggcgcc

SEQ ID NO: 477795 - RNA, 32 nt, Human
guggagucucugcugaaaugaaucaggauucg

SEQ ID NO: 477796 - RNA, 32 nt, Human
guggagugaaaauugggcaugccauuacauug

SEQ ID NO: 477797 - RNA, 32 nt, Human
guggagugacuggcacuggacccacugcagag

SEQ ID NO: 477798 - RNA, 22 nt, Human
guggagugaggccagcaugcag

SEQ ID NO: 477799 - RNA, 32 nt, Human
guggagugaggccccugcagagcugcugauga

SEQ ID NO: 477800 - RNA, 21 nt, Human
guggagugaugaggaccugau

SEQ ID NO: 477801 - RNA, 21 nt, Human
guggagugcaaaggaggcgac

SEQ ID NO: 477802 - RNA, 32 nt, Human
guggagugcaguggcaggaucacagcuuacug

SEQ ID NO: 477803 - RNA, 24 nt, Human
guggagugcaguucagagcuuaua

SEQ ID NO: 477804 - RNA, 32 nt, Human
guggagugccagggaggaggaggcacacggag

SEQ ID NO: 477805 - RNA, 23 nt, Human
guggagugcccaggaccuuggua

SEQ ID NO: 477806 - RNA, 32 nt, Human
guggaguggagauuugucuggaaucuaaaaau

SEQ ID NO: 477807 - RNA, 24 nt, Human
guggaguggcucauaccuguaauc

SEQ ID NO: 477808 - RNA, 32 nt, Human
guggagugucggcugcaaaggcagcaguagcu

SEQ ID NO: 477809 - RNA, 32 nt, Human
guggaguguggagaggaaggaggcagauucau

SEQ ID NO: 477810 - RNA, 32 nt, Human
guggaguguucuacugggaaauggaguuauga

SEQ ID NO: 477811 - RNA, 32 nt, Human
guggaguuacugaacaguaacauagcugugau

SEQ ID NO: 477812 - RNA, 32 nt, Human
guggaguuauugcaagaguuccuuaauuccuc

SEQ ID NO: 477813 - RNA, 32 nt, Human
guggaguuccaucauguuggccaggcuggucu

SEQ ID NO: 477814 - RNA, 23 nt, Human
guggaguugggugccugagcuca

SEQ ID NO: 477815 - RNA, 32 nt, Human
guggauaagaugaccuguguaauaaucuuugu

SEQ ID NO: 477816 - RNA, 32 nt, Human
guggauaauagcguucagcagcacucaccuuc

SEQ ID NO: 477817 - RNA, 32 nt, Human
guggauaccauguaauugucagguaauuucag

SEQ ID NO: 477818 - RNA, 32 nt, Human
guggauacccucaguaagacucagggagccuu

SEQ ID NO: 477819 - RNA, 32 nt, Human
guggauagaggaaggggaagagucgaggauga

SEQ ID NO: 477820 - RNA, 32 nt, Human
guggauagcauuguuuucuuuuacagacuagc

SEQ ID NO: 477821 - RNA, 32 nt, Human
guggauagccugggaggcagguagaacagaac

SEQ ID NO: 477822 - RNA, 32 nt, Human
guggauagcgugaaagaagcuugugauccugc

SEQ ID NO: 477823 - RNA, 23 nt, Human
guggauagucuguuuucucugag

SEQ ID NO: 477824 - RNA, 32 nt, Human
guggauauuguugccaucaaugaccccuucau

SEQ ID NO: 477825 - RNA, 32 nt, Human
guggaucaacugaacugucacuccagagauuu

SEQ ID NO: 477826 - RNA, 32 nt, Human
guggaucaauugagcccaggaguucaagacca

SEQ ID NO: 477827 - RNA, 32 nt, Human
guggaucaccaggucaggagaucaagaccauc

SEQ ID NO: 477828 - RNA, 20 nt, Human
guggaucaccugaggucagg

SEQ ID NO: 477829 - RNA, 32 nt, Human
guggaucaccugcugguggaaauguggacauc

SEQ ID NO: 477830 - RNA, 22 nt, Human
guggaucacgccuguaauccca

SEQ ID NO: 477831 - RNA, 20 nt, Human
guggaucacuugagcccagg

SEQ ID NO: 477832 - RNA, 32 nt, Human
guggaucacuugagcccaggagucugagacca

SEQ ID NO: 477833 - RNA, 32 nt, Human
guggaucacuugagcccaggaguuugaaacca

SEQ ID NO: 477834 - RNA, 32 nt, Human
guggaucacuugagcccaggaguuugagacca

SEQ ID NO: 477835 - RNA, 32 nt, Human
guggaucagguuuacuagcaccugccagggag

SEQ ID NO: 477836 - RNA, 32 nt, Human
guggaucauccuuccuuguggguuagcaggca

SEQ ID NO: 477837 - RNA, 32 nt, Human
guggaucaugccagaguucguagauccuguuu

SEQ ID NO: 477838 - RNA, 26 nt, Human
guggaucauuauuauggcauuucuua

SEQ ID NO: 477839 - RNA, 32 nt, Human
guggauccaagaaaccagggccaugaccaggu

SEQ ID NO: 477840 - RNA, 20 nt, Human
guggauccagggaaagcuuu

SEQ ID NO: 477841 - RNA, 20 nt, Human
guggauccagggaacgcuuu

SEQ ID NO: 477842 - RNA, 32 nt, Human
guggaucccagaguggcucugauguccacauu

SEQ ID NO: 477843 - RNA, 32 nt, Human
guggaucccauggguguggcucugaggaaauu

SEQ ID NO: 477844 - RNA, 32 nt, Human
guggaucccgagagugcagagcucggggcagg

SEQ ID NO: 477845 - RNA, 32 nt, Human
guggaucccuacugcugguuucugccuucucc

SEQ ID NO: 477846 - RNA, 32 nt, Human
guggaucccuuagcccuuggggcagagacccc

SEQ ID NO: 477847 - RNA, 32 nt, Human
guggaucccuugagcccaggaguucgagacca

SEQ ID NO: 477848 - RNA, 32 nt, Human
guggauccuuaguuuucucuucacugccugcc

SEQ ID NO: 477849 - RNA, 22 nt, Human
guggaucgcaccuguaauccca

SEQ ID NO: 477850 - RNA, 32 nt, Human
guggaucgccgcggccccuccucccagagcgg

SEQ ID NO: 477851 - RNA, 19 nt, Human
guggaucgcuugagcccag

SEQ ID NO: 477852 - RNA, 20 nt, Human
guggaucgcuugagcccagg

SEQ ID NO: 477853 - RNA, 32 nt, Human
guggaucgcuugaucccaggaggucgagacca

SEQ ID NO: 477854 - RNA, 32 nt, Human
guggaucggccuccucuucaccccggcaggcc

SEQ ID NO: 477855 - RNA, 32 nt, Human
guggaucgguccagcaccugcuguuagcccag

SEQ ID NO: 477856 - RNA, 23 nt, Human
guggaucuaaggggaaugcuuua

SEQ ID NO: 477857 - RNA, 32 nt, Human
guggaucucagccucagacccuccucuggccc

SEQ ID NO: 477858 - RNA, 32 nt, Human
guggaucuccuugagauccugauagccuguua

SEQ ID NO: 477859 - RNA, 32 nt, Human
guggaucucuugagcccaggaguuugaggcca

SEQ ID NO: 477860 - RNA, 32 nt, Human
guggaucuggggacugagugugggagugcaga

SEQ ID NO: 477861 - RNA, 18 nt, Human
guggaugaaggaugggga

SEQ ID NO: 477862 - RNA, 32 nt, Human
guggaugaggagaagaagcaggugaccaugga

SEQ ID NO: 477863 - RNA, 32 nt, Human
guggaugcacuucccgcaccuccagucuucug

SEQ ID NO: 477864 - RNA, 32 nt, Human
guggaugcagaggccaguccauauaccaccca

SEQ ID NO: 477865 - RNA, 32 nt, Human
guggaugcaggucauuuugggggagggaggaa

SEQ ID NO: 477866 - RNA, 32 nt, Human
guggaugcccgggugagugugugugcaugcac

SEQ ID NO: 477867 - RNA, 32 nt, Human
guggaugccuauaaucccagcuacucagaagg

SEQ ID NO: 477868 - RNA, 32 nt, Human
guggaugcuaaggugagagggaugcaggcaug

SEQ ID NO: 477869 - RNA, 32 nt, Human
guggaugcugcacucgggcucgggauccgccc

SEQ ID NO: 477870 - RNA, 32 nt, Human
guggaugcuggcgggugacuugcagugggcgc

SEQ ID NO: 477871 - RNA, 32 nt, Human
guggaugcugggaggcaggaggcucaugcucc

SEQ ID NO: 477872 - RNA, 32 nt, Human
guggaugcugucuucucucuucuugaucccuu

SEQ ID NO: 477873 - RNA, 32 nt, Human
guggaugcuguugccaaacaccucagggcaag

SEQ ID NO: 477874 - RNA, 32 nt, Human
guggauggagcugccuuucagacccaucaccg

SEQ ID NO: 477875 - RNA, 30 nt, Human
guggauggaggcaccgugcauucugagggg

SEQ ID NO: 477876 - RNA, 32 nt, Human
guggauggagggaagggugaggaagagagcgu

SEQ ID NO: 477877 - RNA, 24 nt, Human
guggauggaucaccugagccuggg

SEQ ID NO: 477878 - RNA, 32 nt, Human
guggauggaucucuugaggucaggaguuugag

SEQ ID NO: 477879 - RNA, 32 nt, Human
guggauggcaggcaggagcauggagcccucag

SEQ ID NO: 477880 - RNA, 32 nt, Human
guggauggcccaggaggugcuggagcuagguc

SEQ ID NO: 477881 - RNA, 32 nt, Human
guggauggccuggagcuauguuuuuaaaauug

SEQ ID NO: 477882 - RNA, 32 nt, Human
guggauggcugagguuuucagcagcaagagac

SEQ ID NO: 477883 - RNA, 32 nt, Human
guggauggcuggaggugcagggccaggaggaa

SEQ ID NO: 477884 - RNA, 32 nt, Human
guggauggcuugagcccaggaguuugagacca

SEQ ID NO: 477885 - RNA, 32 nt, Human
guggaugggcagaagguguagcauucggagau

SEQ ID NO: 477886 - RNA, 32 nt, Human
guggaugggccaccgccuugcccagccuggau

SEQ ID NO: 477887 - RNA, 32 nt, Human
guggauggggagaaggaauuauaggagcugga

SEQ ID NO: 477888 - RNA, 32 nt, Human
guggaugggggaguucagacgugcuuguuccc

SEQ ID NO: 477889 - RNA, 32 nt, Human
guggauggugaugcagaggaugucucuaugcu

SEQ ID NO: 477890 - RNA, 32 nt, Human
guggaugguucagguugggaagaagagcagug

SEQ ID NO: 477891 - RNA, 32 nt, Human
guggaugucugucauguagaagugaggaccuu

SEQ ID NO: 477892 - RNA, 32 nt, Human
guggauguugugaccacagagcaggauugugc

SEQ ID NO: 477893 - RNA, 32 nt, Human
guggauguuuucccucuccuacguuagaaacc

SEQ ID NO: 477894 - RNA, 32 nt, Human
guggauuagugagucuguggccugugcccucc

SEQ ID NO: 477895 - RNA, 32 nt, Human
guggauucacauuucuguggagauuuucggaa

SEQ ID NO: 477896 - RNA, 19 nt, Human
guggauucagaacugcagc

SEQ ID NO: 477897 - RNA, 32 nt, Human
guggauucauguccagagcucauuucgggguc

SEQ ID NO: 477898 - RNA, 27 nt, Human
guggauuccaucaggagcugguuuuga

SEQ ID NO: 477899 - RNA, 32 nt, Human
guggauuccauucaagcaugcacauaacuagc

SEQ ID NO: 477900 - RNA, 32 nt, Human
guggauucccaaauuucaaagcucuuuuaaug

SEQ ID NO: 477901 - RNA, 22 nt, Human
guggauucucacugaguuuuga

SEQ ID NO: 477902 - RNA, 32 nt, Human
guggauucucccccugucuucuccccucagca

SEQ ID NO: 477903 - RNA, 32 nt, Human
guggauucugugagacauaccugcuggaguug

SEQ ID NO: 477904 - RNA, 32 nt, Human
guggauucuuuaaggcacuuuuguggccagcc

SEQ ID NO: 477905 - RNA, 32 nt, Human
guggauugagagaaagggagagagggagggag

SEQ ID NO: 477906 - RNA, 32 nt, Human
guggauugcgccacugcacuccagccugggca

SEQ ID NO: 477907 - RNA, 20 nt, Human
guggauugcuugaacccagg

SEQ ID NO: 477908 - RNA, 32 nt, Human
guggauugcuugaacccaggaguucgagacca

SEQ ID NO: 477909 - RNA, 20 nt, Human
guggauugcuugagcccagg

SEQ ID NO: 477910 - RNA, 32 nt, Human
guggauugcuugagcccaggagucugagacca

SEQ ID NO: 477911 - RNA, 32 nt, Human
guggauugcuugagcccaggaguucaagacca

SEQ ID NO: 477912 - RNA, 32 nt, Human
guggauugcuugagcccaggaguucaagagca

SEQ ID NO: 477913 - RNA, 32 nt, Human
guggauugcuugagcccaggaguuggagacca

SEQ ID NO: 477914 - RNA, 32 nt, Human
guggauugcuugagcccaggaguuugagacca

SEQ ID NO: 477915 - RNA, 32 nt, Human
guggauugcuuugaggccaggaguucuagacc

SEQ ID NO: 477916 - RNA, 32 nt, Human
guggauuggacaguccaucaaguggacugggg

SEQ ID NO: 477917 - RNA, 32 nt, Human
guggauuguggguggcaccaggagcucuaaaa

SEQ ID NO: 477918 - RNA, 22 nt, Human
guggauuuauuagucugguaga

SEQ ID NO: 477919 - RNA, 32 nt, Human
guggauuuccccucaaaucagaugccucuaag

SEQ ID NO: 477920 - RNA, 32 nt, Human
guggauuugcauauugaaguggagauuccaua

SEQ ID NO: 477921 - RNA, 32 nt, Human
guggauuuucaggccagcacaaggaugcagga

SEQ ID NO: 477922 - RNA, 23 nt, Human
guggcaaaacccugucuccacua

SEQ ID NO: 477923 - RNA, 32 nt, Human
guggcaaaacuaaguuaauaaaaaugaaacau

SEQ ID NO: 477924 - RNA, 32 nt, Human
guggcaaaauggagguuucacaggcugugcgg

SEQ ID NO: 477925 - RNA, 22 nt, Human
guggcaaacgccuguaauccca

SEQ ID NO: 477926 - RNA, 32 nt, Human
guggcaaacuccucaugaguucaaguauuaau

SEQ ID NO: 477927 - RNA, 32 nt, Human
guggcaaagagcuugacccaggaaauagaugg

SEQ ID NO: 477928 - RNA, 32 nt, Human
guggcaaagccuugagacaauccacaguucug

SEQ ID NO: 477929 - RNA, 32 nt, Human
guggcaaagcuuuuaaccuaucuuacaacuua

SEQ ID NO: 477930 - RNA, 32 nt, Human
guggcaaaguguuugccaaagcucaggagaga

SEQ ID NO: 477931 - RNA, 32 nt, Human
guggcaaaucacuuauaaauggugcugaagca

SEQ ID NO: 477932 - RNA, 32 nt, Human
guggcaaaugaagccaggcugugcggcaggau

SEQ ID NO: 477933 - RNA, 22 nt, Human
guggcaaaugccuguaauccca

SEQ ID NO: 477934 - RNA, 32 nt, Human
guggcaaccaguuucaagcagggcugaaccuu

SEQ ID NO: 477935 - RNA, 32 nt, Human
guggcaacugggucaaucguguuaacaacugu

SEQ ID NO: 477936 - RNA, 32 nt, Human
guggcaagaaggagccuggugcaggggaggaa

SEQ ID NO: 477937 - RNA, 32 nt, Human
guggcaagacccagaggucauuagguccagcu

SEQ ID NO: 477938 - RNA, 22 nt, Human
guggcaagagccuguaaucuca

SEQ ID NO: 477939 - RNA, 22 nt, Human
guggcaagcgccuguaguccca

SEQ ID NO: 477940 - RNA, 32 nt, Human
guggcaaggaagcuggacagggcaggccucug

SEQ ID NO: 477941 - RNA, 20 nt, Human
guggcaaggcggcacuccug

SEQ ID NO: 477942 - RNA, 32 nt, Human
guggcaaguccucaauccugugucccagaggu

SEQ ID NO: 477943 - RNA, 32 nt, Human
guggcaagugacccucccuguggcugaagugu

SEQ ID NO: 477944 - RNA, 32 nt, Human
guggcaagugauuggaguugugcuucaaaaau

SEQ ID NO: 477945 - RNA, 22 nt, Human
guggcaagugccuuuaauccca

SEQ ID NO: 477946 - RNA, 28 nt, Human
guggcaagugcuccucauccaaaugauc

SEQ ID NO: 477947 - RNA, 32 nt, Human
guggcaauaaagauuuucugugccucacaaaa

SEQ ID NO: 477948 - RNA, 32 nt, Human
guggcaaugcuuguaacuaaaucucaaacuuu

SEQ ID NO: 477949 - RNA, 32 nt, Human
guggcacaaagucccuggggccagugugugug

SEQ ID NO: 477950 - RNA, 23 nt, Human
guggcacaaaucaaagcugcaug

SEQ ID NO: 477951 - RNA, 32 nt, Human
guggcacaagaauggcucaacucuccaaauag

SEQ ID NO: 477952 - RNA, 32 nt, Human
guggcacaaugucgguucacuucaaccucaac

SEQ ID NO: 477953 - RNA, 22 nt, Human
guggcacacaccaguaauccca

SEQ ID NO: 477954 - RNA, 22 nt, Human
guggcacacacccguaauccca

SEQ ID NO: 477955 - RNA, 22 nt, Human
guggcacacaccuauaaucuca

SEQ ID NO: 477956 - RNA, 22 nt, Human
guggcacacaccuauaguccca

SEQ ID NO: 477957 - RNA, 19 nt, Human
guggcacacaccuguaauc

SEQ ID NO: 477958 - RNA, 22 nt, Human
guggcacacaccuguaauccca

SEQ ID NO: 477959 - RNA, 22 nt, Human
guggcacacaccuguaguccca

SEQ ID NO: 477960 - RNA, 22 nt, Human
guggcacacaccugucauccca

SEQ ID NO: 477961 - RNA, 32 nt, Human
guggcacacacguguuaugaccgcggcugcug

SEQ ID NO: 477962 - RNA, 22 nt, Human
guggcacaccccuguaguccca

SEQ ID NO: 477963 - RNA, 22 nt, Human
guggcacacgccuguaaaccca

SEQ ID NO: 477964 - RNA, 19 nt, Human
guggcacacgccuguaauc

SEQ ID NO: 477965 - RNA, 22 nt, Human
guggcacacgccuguaauccca

SEQ ID NO: 477966 - RNA, 22 nt, Human
guggcacacgccuguaaucuca

SEQ ID NO: 477967 - RNA, 22 nt, Human
guggcacacgccuguaguccca

SEQ ID NO: 477968 - RNA, 22 nt, Human
guggcacacgccugucauccca

SEQ ID NO: 477969 - RNA, 22 nt, Human
guggcacacuccuguaauccca

SEQ ID NO: 477970 - RNA, 22 nt, Human
guggcacagaugcccacguaug

SEQ ID NO: 477971 - RNA, 22 nt, Human
guggcacagauggugcugugua

SEQ ID NO: 477972 - RNA, 32 nt, Human
guggcacagcuucaaaaugacaucuaaguagc

SEQ ID NO: 477973 - RNA, 32 nt, Human
guggcacaggacgccuacucuccaguugccac

SEQ ID NO: 477974 - RNA, 32 nt, Human
guggcacagggaggggagaaaggggccagggg

SEQ ID NO: 477975 - RNA, 19 nt, Human
guggcacagggcucgcugc

SEQ ID NO: 477976 - RNA, 32 nt, Human
guggcacagugaugaugucaaaaauauuauac

SEQ ID NO: 477977 - RNA, 32 nt, Human
guggcacaguugggaagcguccuggccaugcc

SEQ ID NO: 477978 - RNA, 22 nt, Human
guggcacauaccuguaaugcca

SEQ ID NO: 477979 - RNA, 22 nt, Human
guggcacaucccuguaauucca

SEQ ID NO: 477980 - RNA, 25 nt, Human
guggcacauccuuucaggauguaug

SEQ ID NO: 477981 - RNA, 22 nt, Human
guggcacaugccuauaauccca

SEQ ID NO: 477982 - RNA, 22 nt, Human
guggcacaugccuauaguccca

SEQ ID NO: 477983 - RNA, 22 nt, Human
guggcacaugccuaugauccca

SEQ ID NO: 477984 - RNA, 22 nt, Human
guggcacaugccuguaacucca

SEQ ID NO: 477985 - RNA, 19 nt, Human
guggcacaugccuguaauc

SEQ ID NO: 477986 - RNA, 20 nt, Human
guggcacaugccuguaaucc

SEQ ID NO: 477987 - RNA, 22 nt, Human
guggcacaugccuguaauccca

SEQ ID NO: 477988 - RNA, 22 nt, Human
guggcacaugccuguaaucgca

SEQ ID NO: 477989 - RNA, 22 nt, Human
guggcacaugccuguaaucuca

SEQ ID NO: 477990 - RNA, 22 nt, Human
guggcacaugccuguaaugcca

SEQ ID NO: 477991 - RNA, 22 nt, Human
guggcacaugccuguaauucca

SEQ ID NO: 477992 - RNA, 22 nt, Human
guggcacaugccuguaguccca

SEQ ID NO: 477993 - RNA, 22 nt, Human
guggcacaugccuguauuccca

SEQ ID NO: 477994 - RNA, 22 nt, Human
guggcacaugccugugauccca

SEQ ID NO: 477995 - RNA, 22 nt, Human
guggcacaugcuuguaauccca

SEQ ID NO: 477996 - RNA, 22 nt, Human
guggcacauuccuguaauccca

SEQ ID NO: 477997 - RNA, 32 nt, Human
guggcaccaacggggucagccucccagcagac

SEQ ID NO: 477998 - RNA, 32 nt, Human
guggcaccaagcuccuggcccuguccgccaaa

SEQ ID NO: 477999 - RNA, 19 nt, Human
guggcaccaauaucucuua

SEQ ID NO: 478000 - RNA, 32 nt, Human
guggcaccacugcacuccagccugggugacag

SEQ ID NO: 478001 - RNA, 32 nt, Human
guggcaccacugcccuccagccuggaugacag

SEQ ID NO: 478002 - RNA, 32 nt, Human
guggcaccacugccgucauuucagcuucuggc

SEQ ID NO: 478003 - RNA, 20 nt, Human
guggcaccagaggacugugu

SEQ ID NO: 478004 - RNA, 32 nt, Human
guggcacccaccacagaauacaguguguguua

SEQ ID NO: 478005 - RNA, 22 nt, Human
guggcacccgccuguaauccca

SEQ ID NO: 478006 - RNA, 32 nt, Human
guggcacccgguggaaccgaggagaacgugga

SEQ ID NO: 478007 - RNA, 32 nt, Human
guggcaccgugaggguugggacccaccgaggc

SEQ ID NO: 478008 - RNA, 25 nt, Human
guggcaccucaccucacaccugcuc

SEQ ID NO: 478009 - RNA, 22 nt, Human
guggcaccugccuauaauccca

SEQ ID NO: 478010 - RNA, 22 nt, Human
guggcaccugccuguaauccca

SEQ ID NO: 478011 - RNA, 32 nt, Human
guggcaccugcggguggaguccagccuuuucc

SEQ ID NO: 478012 - RNA, 32 nt, Human
guggcaccugggaccccuggcugcaguggcca

SEQ ID NO: 478013 - RNA, 32 nt, Human
guggcacgaucauagguggucacuacagucuc

SEQ ID NO: 478014 - RNA, 32 nt, Human
guggcacgaucucggcggcucacuacaaccuc

SEQ ID NO: 478015 - RNA, 22 nt, Human
guggcacgcaccuauaguccca

SEQ ID NO: 478016 - RNA, 22 nt, Human
guggcacgcaccuguaauccca

SEQ ID NO: 478017 - RNA, 22 nt, Human
guggcacgcaccuguaguccca

SEQ ID NO: 478018 - RNA, 22 nt, Human
guggcacgcgccuaugauccca

SEQ ID NO: 478019 - RNA, 22 nt, Human
guggcacgcgccuguaauacca

SEQ ID NO: 478020 - RNA, 22 nt, Human
guggcacgcgccuguaauccca

SEQ ID NO: 478021 - RNA, 22 nt, Human
guggcacgcgccuguaguccca

SEQ ID NO: 478022 - RNA, 22 nt, Human
guggcacgcuccuguaguccca

SEQ ID NO: 478023 - RNA, 21 nt, Human
guggcacgcucuguaauccca

SEQ ID NO: 478024 - RNA, 32 nt, Human
guggcacggucucagcucacucugugcaggac

SEQ ID NO: 478025 - RNA, 22 nt, Human
guggcacguaccuguaaucuca

SEQ ID NO: 478026 - RNA, 32 nt, Human
guggcacgucuguaaucccagcuacuccagag

SEQ ID NO: 478027 - RNA, 22 nt, Human
guggcacgugccuguaauccca

SEQ ID NO: 478028 - RNA, 22 nt, Human
guggcacgugccuguaauucca

SEQ ID NO: 478029 - RNA, 22 nt, Human
guggcacgugccuguaguccca

SEQ ID NO: 478030 - RNA, 22 nt, Human
guggcacgugccuguauuccca

SEQ ID NO: 478031 - RNA, 22 nt, Human
guggcacgugccugugauccca

SEQ ID NO: 478032 - RNA, 32 nt, Human
guggcacugaggcuggaugggcuggcagagga

SEQ ID NO: 478033 - RNA, 32 nt, Human
guggcacugcacuccagucugggugacagagu

SEQ ID NO: 478034 - RNA, 32 nt, Human
guggcacugcagcuccccgcuccugcaggucc

SEQ ID NO: 478035 - RNA, 32 nt, Human
guggcacugccacaucccacuggcagaaacuc

SEQ ID NO: 478036 - RNA, 32 nt, Human
guggcacugccaggugguggccuguguggagg

SEQ ID NO: 478037 - RNA, 21 nt, Human
guggcacugccucuugggcug

SEQ ID NO: 478038 - RNA, 32 nt, Human
guggcacuggacaagcuagugggcuuuucguu

SEQ ID NO: 478039 - RNA, 32 nt, Human
guggcacuguagccugcgucauggcucaagga

SEQ ID NO: 478040 - RNA, 32 nt, Human
guggcacugucaccccagccucgaugugugau

SEQ ID NO: 478041 - RNA, 32 nt, Human
guggcacuuccuggucuaaagcucugcuagac

SEQ ID NO: 478042 - RNA, 32 nt, Human
guggcacuucugagcuccugaccuaggccaag

SEQ ID NO: 478043 - RNA, 22 nt, Human
guggcacuugccuguaauccca

SEQ ID NO: 478044 - RNA, 32 nt, Human
guggcagaacagaucaaagcccaagagagcug

SEQ ID NO: 478045 - RNA, 32 nt, Human
guggcagaagauuuuaauuagaaacaaagcuu

SEQ ID NO: 478046 - RNA, 32 nt, Human
guggcagaccgggggccagacacagauacaug

SEQ ID NO: 478047 - RNA, 32 nt, Human
guggcagagccuggagcugagcucuuggugac

SEQ ID NO: 478048 - RNA, 32 nt, Human
guggcagagcuggguucuccuccugggggccc

SEQ ID NO: 478049 - RNA, 32 nt, Human
guggcagaggcaggccagaggaccuaagugug

SEQ ID NO: 478050 - RNA, 32 nt, Human
guggcagaggccugcaugugggugccagaggc

SEQ ID NO: 478051 - RNA, 22 nt, Human
guggcagaggccuguaauccca

SEQ ID NO: 478052 - RNA, 32 nt, Human
guggcagagggguaaggagagccuucuuggcu

SEQ ID NO: 478053 - RNA, 32 nt, Human
guggcagagggguugagggacaggggcccuua

SEQ ID NO: 478054 - RNA, 32 nt, Human
guggcagauccuggcuagaucugccucuguuu

SEQ ID NO: 478055 - RNA, 23 nt, Human
guggcagaucgcuugagccuagg

SEQ ID NO: 478056 - RNA, 32 nt, Human
guggcagaugagugggagacugguugcaaggu

SEQ ID NO: 478057 - RNA, 32 nt, Human
guggcagcaccacugccugcucccuggaaggu

SEQ ID NO: 478058 - RNA, 32 nt, Human
guggcagcagagaguggccucggagggaagcc

SEQ ID NO: 478059 - RNA, 20 nt, Human
guggcagcagaggccaagga

SEQ ID NO: 478060 - RNA, 32 nt, Human
guggcagcagagucccagaauaugagaccguu

SEQ ID NO: 478061 - RNA, 20 nt, Human
guggcagcaggggucaggga

SEQ ID NO: 478062 - RNA, 22 nt, Human
guggcagcaguaggagugugua

SEQ ID NO: 478063 - RNA, 32 nt, Human
guggcagcauugagaguuggacacccgggucc

SEQ ID NO: 478064 - RNA, 32 nt, Human
guggcagcauugagggaaaccaggucaccauc

SEQ ID NO: 478065 - RNA, 32 nt, Human
guggcagccaugagggccaucaacaucgcaga

SEQ ID NO: 478066 - RNA, 32 nt, Human
guggcagccccagaacugggaccaccgggggu

SEQ ID NO: 478067 - RNA, 32 nt, Human
guggcagccccgggugggugugaucuguggcu

SEQ ID NO: 478068 - RNA, 32 nt, Human
guggcagcccucucuuuccagggcaaggucug

SEQ ID NO: 478069 - RNA, 32 nt, Human
guggcagccuccaucuccagcaagucuccugg

SEQ ID NO: 478070 - RNA, 32 nt, Human
guggcagccuggauggacaggagagguuucuc

SEQ ID NO: 478071 - RNA, 32 nt, Human
guggcagcggugaccgccuccuggguuauuuu

SEQ ID NO: 478072 - RNA, 32 nt, Human
guggcagcucacucuaugcaacuugauccucu

SEQ ID NO: 478073 - RNA, 32 nt, Human
guggcagcugagccacugaggccagccucgug

SEQ ID NO: 478074 - RNA, 32 nt, Human
guggcagcugguccccagcccuaggagagaag

SEQ ID NO: 478075 - RNA, 32 nt, Human
guggcagcuggugaccuggccagaggggcugg

SEQ ID NO: 478076 - RNA, 32 nt, Human
guggcagcuguugccacacacaugcggaggga

SEQ ID NO: 478077 - RNA, 30 nt, Human
guggcaggaagccacaggaaucucacagag

SEQ ID NO: 478078 - RNA, 23 nt, Human
guggcaggacccaccggcaccuc

SEQ ID NO: 478079 - RNA, 32 nt, Human
guggcaggacugaguccuucucuuuaaggcag

SEQ ID NO: 478080 - RNA, 32 nt, Human
guggcaggagagaacaacaggggcugggaaug

SEQ ID NO: 478081 - RNA, 32 nt, Human
guggcaggagcagcccgcacgccgcgcucucu

SEQ ID NO: 478082 - RNA, 22 nt, Human
guggcaggagcccguaguccca

SEQ ID NO: 478083 - RNA, 22 nt, Human
guggcaggagccuguaauccca

SEQ ID NO: 478084 - RNA, 22 nt, Human
guggcaggagccuguaauccua

SEQ ID NO: 478085 - RNA, 22 nt, Human
guggcaggcaccuguaauccca

SEQ ID NO: 478086 - RNA, 22 nt, Human
guggcaggcaccuguaguccca

SEQ ID NO: 478087 - RNA, 32 nt, Human
guggcaggccaagaaugggaggcugacucaaa

SEQ ID NO: 478088 - RNA, 22 nt, Human
guggcaggccccuguaauccca

SEQ ID NO: 478089 - RNA, 32 nt, Human
guggcaggccuggucaggcucuccaggugguc

SEQ ID NO: 478090 - RNA, 22 nt, Human
guggcaggcgccuauaauccca

SEQ ID NO: 478091 - RNA, 22 nt, Human
guggcaggcgccuauaguccca

SEQ ID NO: 478092 - RNA, 20 nt, Human
guggcaggcgccuguaaucc

SEQ ID NO: 478093 - RNA, 22 nt, Human
guggcaggcgccuguaauccca

SEQ ID NO: 478094 - RNA, 22 nt, Human
guggcaggcgccuguaguccca

SEQ ID NO: 478095 - RNA, 22 nt, Human
guggcaggcgucuguaauccca

SEQ ID NO: 478096 - RNA, 32 nt, Human
guggcagggaaagcagcgugcggggaagucac

SEQ ID NO: 478097 - RNA, 32 nt, Human
guggcagggaagggacaggcaggaucuggaca

SEQ ID NO: 478098 - RNA, 32 nt, Human
guggcagggagaaaagaacaucagggugggug

SEQ ID NO: 478099 - RNA, 20 nt, Human
guggcagggagcgcggcagc

SEQ ID NO: 478100 - RNA, 32 nt, Human
guggcagggaggaggaagaggaaggugagaau

SEQ ID NO: 478101 - RNA, 32 nt, Human
guggcagggaggcagucgcccugcggugcaag

SEQ ID NO: 478102 - RNA, 32 nt, Human
guggcagggaggcggcguugcgguggcugcau

SEQ ID NO: 478103 - RNA, 22 nt, Human
guggcagggccccucggcacuc

SEQ ID NO: 478104 - RNA, 21 nt, Human
guggcaggggggcagcagcuc

SEQ ID NO: 478105 - RNA, 22 nt, Human
guggcagguaccuguaauccca

SEQ ID NO: 478106 - RNA, 21 nt, Human
guggcaggugccuguaauccc

SEQ ID NO: 478107 - RNA, 22 nt, Human
guggcaggugccuguaauccca

SEQ ID NO: 478108 - RNA, 22 nt, Human
guggcaggugccuguaguccca

SEQ ID NO: 478109 - RNA, 32 nt, Human
guggcaggugcuccaggcugugaucugcaccc

SEQ ID NO: 478110 - RNA, 22 nt, Human
guggcaggugcuuguaauccca

SEQ ID NO: 478111 - RNA, 32 nt, Human
guggcaggugguuggaaaagaaauggcuuccu

SEQ ID NO: 478112 - RNA, 32 nt, Human
guggcagguguuuucagcuuggaggaggaagu

SEQ ID NO: 478113 - RNA, 32 nt, Human
guggcagguuccacccuucucuaccagccccg

SEQ ID NO: 478114 - RNA, 32 nt, Human
guggcagguuccagagaaugcaguagaccuuu

SEQ ID NO: 478115 - RNA, 32 nt, Human
guggcagguugagagaggagaaugcuggaaag

SEQ ID NO: 478116 - RNA, 32 nt, Human
guggcaguaaaggguaaagggagggcaguggg

SEQ ID NO: 478117 - RNA, 32 nt, Human
guggcaguaagaaaggucccuggggcuucagg

SEQ ID NO: 478118 - RNA, 23 nt, Human
guggcaguagaccacaucuguuc

SEQ ID NO: 478119 - RNA, 32 nt, Human
guggcaguagugccauaagaaguuaucauacu

SEQ ID NO: 478120 - RNA, 32 nt, Human
guggcaguauuuuuauuuuuggcauuucccag

SEQ ID NO: 478121 - RNA, 22 nt, Human
guggcagucaccuguaauccca

SEQ ID NO: 478122 - RNA, 22 nt, Human
guggcagucaccuguaguccca

SEQ ID NO: 478123 - RNA, 32 nt, Human
guggcagugaagagaacaggucuuucaaaaag

SEQ ID NO: 478124 - RNA, 32 nt, Human
guggcagugaagauggggucugaaaggcuaug

SEQ ID NO: 478125 - RNA, 21 nt, Human
guggcagugccuguaauccca

SEQ ID NO: 478126 - RNA, 32 nt, Human
guggcagugccuguaaucccagcuauuuggga

SEQ ID NO: 478127 - RNA, 32 nt, Human
guggcagugccuguagucccagcugcucggga

SEQ ID NO: 478128 - RNA, 32 nt, Human
guggcaguggaggccgucagauuacugauacu

SEQ ID NO: 478129 - RNA, 32 nt, Human
guggcaguggcagcaguggcccaaaggcagga

SEQ ID NO: 478130 - RNA, 20 nt, Human
guggcagugggaacuucagc

SEQ ID NO: 478131 - RNA, 32 nt, Human
guggcaguugcagaugagaaaugcuuacagcu

SEQ ID NO: 478132 - RNA, 22 nt, Human
guggcaguugccuguaauccua

SEQ ID NO: 478133 - RNA, 32 nt, Human
guggcaguugggccuggugaggguuaggacuu

SEQ ID NO: 478134 - RNA, 32 nt, Human
guggcauaauuugagucuucuggcaacauuug

SEQ ID NO: 478135 - RNA, 22 nt, Human
guggcauacaccuguaguccca

SEQ ID NO: 478136 - RNA, 22 nt, Human
guggcauacgccuguaauccca

SEQ ID NO: 478137 - RNA, 22 nt, Human
guggcauacuccuguaguccca

SEQ ID NO: 478138 - RNA, 22 nt, Human
guggcauauaccuguaacccca

SEQ ID NO: 478139 - RNA, 22 nt, Human
guggcauauauggcaucugcug

SEQ ID NO: 478140 - RNA, 32 nt, Human
guggcauaugccuauauucuagcuacucagga

SEQ ID NO: 478141 - RNA, 22 nt, Human
guggcauaugccuguaguccca

SEQ ID NO: 478142 - RNA, 32 nt, Human
guggcaucacccaggugaaugguguccaggug

SEQ ID NO: 478143 - RNA, 32 nt, Human
guggcaucacuuccaacugauauaccuccuug

SEQ ID NO: 478144 - RNA, 32 nt, Human
guggcauccagaggagacuggcuggccccucc

SEQ ID NO: 478145 - RNA, 26 nt, Human
guggcaucccaggcuccgggcagcuc

SEQ ID NO: 478146 - RNA, 32 nt, Human
guggcauccucccagauucugacuagaaugac

SEQ ID NO: 478147 - RNA, 32 nt, Human
guggcauccugccuguggucugggugagauuu

SEQ ID NO: 478148 - RNA, 32 nt, Human
guggcaucucccaggugccacugcagggauag

SEQ ID NO: 478149 - RNA, 32 nt, Human
guggcaucuccugagggcaggaaggggaguuc

SEQ ID NO: 478150 - RNA, 32 nt, Human
guggcaucuuuauggaaucacuguggauacug

SEQ ID NO: 478151 - RNA, 32 nt, Human
guggcaugaccagcuguaucugaaagagaaaa

SEQ ID NO: 478152 - RNA, 19 nt, Human
guggcaugaucacaccuca

SEQ ID NO: 478153 - RNA, 31 nt, Human
guggcaugaucuugauaacuguugaaucugg

SEQ ID NO: 478154 - RNA, 22 nt, Human
guggcaugcaccugcaauccca

SEQ ID NO: 478155 - RNA, 22 nt, Human
guggcaugcaccugcauuccca

SEQ ID NO: 478156 - RNA, 22 nt, Human
guggcaugcaccuguaauccca

SEQ ID NO: 478157 - RNA, 22 nt, Human
guggcaugcaccuguaguccca

SEQ ID NO: 478158 - RNA, 22 nt, Human
guggcaugcaccugucauccca

SEQ ID NO: 478159 - RNA, 32 nt, Human
guggcaugccaugccaagagcaacguguaaag

SEQ ID NO: 478160 - RNA, 32 nt, Human
guggcaugccuguguucccagcuacucaggag

SEQ ID NO: 478161 - RNA, 22 nt, Human
guggcaugcgccuauaaucuca

SEQ ID NO: 478162 - RNA, 22 nt, Human
guggcaugcgccuauaguccca

SEQ ID NO: 478163 - RNA, 21 nt, Human
guggcaugcgccuguaauccc

SEQ ID NO: 478164 - RNA, 22 nt, Human
guggcaugcgccuguaauccca

SEQ ID NO: 478165 - RNA, 22 nt, Human
guggcaugcgccuguaguccca

SEQ ID NO: 478166 - RNA, 22 nt, Human
guggcaugcgccugugauccca

SEQ ID NO: 478167 - RNA, 22 nt, Human
guggcaugcuucuguaauccca

SEQ ID NO: 478168 - RNA, 32 nt, Human
guggcauggaaggcagaggcuggguggggugg

SEQ ID NO: 478169 - RNA, 32 nt, Human
guggcauggcccuguuuccuguugauauggug

SEQ ID NO: 478170 - RNA, 32 nt, Human
guggcauggcuccagucugcugcccuccaucc

SEQ ID NO: 478171 - RNA, 22 nt, Human
guggcauguaccugcauuccca

SEQ ID NO: 478172 - RNA, 23 nt, Human
guggcaugugaccucggagcugc

SEQ ID NO: 478173 - RNA, 22 nt, Human
guggcaugugccugcaauccca

SEQ ID NO: 478174 - RNA, 22 nt, Human
guggcaugugccuguaauccca

SEQ ID NO: 478175 - RNA, 22 nt, Human
guggcaugugccuguaguccca

SEQ ID NO: 478176 - RNA, 22 nt, Human
guggcaugugccuguauuccca

SEQ ID NO: 478177 - RNA, 22 nt, Human
guggcaugugcuuguaauccca

SEQ ID NO: 478178 - RNA, 32 nt, Human
guggcauguggcagcugcaggcugugguccag

SEQ ID NO: 478179 - RNA, 32 nt, Human
guggcauuagauucuuauagaagcacgaacac

SEQ ID NO: 478180 - RNA, 32 nt, Human
guggcauuaggacgaugaaggccaugcuucag

SEQ ID NO: 478181 - RNA, 32 nt, Human
guggcauuauguucuggugcucauguuuccug

SEQ ID NO: 478182 - RNA, 20 nt, Human
guggcauucagaaacugcag

SEQ ID NO: 478183 - RNA, 32 nt, Human
guggcauucccccuggugcaggccgguggguc

SEQ ID NO: 478184 - RNA, 32 nt, Human
guggcauugaaggaacaaagauacaggggcac

SEQ ID NO: 478185 - RNA, 32 nt, Human
guggcauugcgcucacaccaggaugcuggagc

SEQ ID NO: 478186 - RNA, 22 nt, Human
guggcauuugccuguaauccca

SEQ ID NO: 478187 - RNA, 32 nt, Human
guggccaaaaccagaaccagcagucuccugcc

SEQ ID NO: 478188 - RNA, 32 nt, Human
guggccaaaaucaauaaccaauuuggauacca

SEQ ID NO: 478189 - RNA, 32 nt, Human
guggccaaacugagggcaucagcaguauuggg

SEQ ID NO: 478190 - RNA, 21 nt, Human
guggccaaagugacugcagua

SEQ ID NO: 478191 - RNA, 18 nt, Human
guggccaaauaucccagc

SEQ ID NO: 478192 - RNA, 23 nt, Human
guggccaacaacagcaucuccug

SEQ ID NO: 478193 - RNA, 19 nt, Human
guggccaacaccccaggca

SEQ ID NO: 478194 - RNA, 32 nt, Human
guggccaacauggugaaaccccgucucuacua

SEQ ID NO: 478195 - RNA, 18 nt, Human
guggccaagagaucagca

SEQ ID NO: 478196 - RNA, 17 nt, Human
guggccaagaucacagu

SEQ ID NO: 478197 - RNA, 18 nt, Human
guggccaagcagccagca

SEQ ID NO: 478198 - RNA, 21 nt, Human
guggccaagccugaaggaccc

SEQ ID NO: 478199 - RNA, 32 nt, Human
guggccaagcgaggucucaggugcaaagcaaa

SEQ ID NO: 478200 - RNA, 18 nt, Human
guggccaaggacaccagc

SEQ ID NO: 478201 - RNA, 17 nt, Human
guggccaaggagcagcg

SEQ ID NO: 478202 - RNA, 32 nt, Human
guggccaaggcaggcagcaguggggcugugac

SEQ ID NO: 478203 - RNA, 15 nt, Human
guggccaaggccagu

SEQ ID NO: 478204 - RNA, 16 nt, Human
guggccaaggccaugu

SEQ ID NO: 478205 - RNA, 18 nt, Human
guggccaaggccccagca

SEQ ID NO: 478206 - RNA, 18 nt, Human
guggccaaggcccucggu

SEQ ID NO: 478207 - RNA, 18 nt, Human
guggccaaggcuacacag

SEQ ID NO: 478208 - RNA, 18 nt, Human
guggccaaggcugagagc

SEQ ID NO: 478209 - RNA, 19 nt, Human
guggccaaggggcccacca

SEQ ID NO: 478210 - RNA, 19 nt, Human
guggccaagguaauaggca

SEQ ID NO: 478211 - RNA, 18 nt, Human
guggccaagguagacuag

SEQ ID NO: 478212 - RNA, 20 nt, Human
guggccaaggucucggaggc

SEQ ID NO: 478213 - RNA, 19 nt, Human
guggccaaggugaauagca

SEQ ID NO: 478214 - RNA, 32 nt, Human
guggccaaggugggcggaucaccugaggucag

SEQ ID NO: 478215 - RNA, 19 nt, Human
guggccaauuccccaggca

SEQ ID NO: 478216 - RNA, 32 nt, Human
guggccacaaaccaaggaacaccuggagccac

SEQ ID NO: 478217 - RNA, 32 nt, Human
guggccacaauccacgcuucuccggaucgcgg

SEQ ID NO: 478218 - RNA, 20 nt, Human
guggccacaccuggaacacu

SEQ ID NO: 478219 - RNA, 32 nt, Human
guggccacccaccugcuccccgacauaucuaa

SEQ ID NO: 478220 - RNA, 24 nt, Human
guggccaccuccuuggagcacuua

SEQ ID NO: 478221 - RNA, 32 nt, Human
guggccaccucuaagaccacacugacuucuuc

SEQ ID NO: 478222 - RNA, 21 nt, Human
guggccaccugggucccagca

SEQ ID NO: 478223 - RNA, 32 nt, Human
guggccaccugguacaccacacuggagccgga

SEQ ID NO: 478224 - RNA, 32 nt, Human
guggccaccuugagugagccagugccaccccc

SEQ ID NO: 478225 - RNA, 32 nt, Human
guggccacggcaaauuaugaacaucucugagu

SEQ ID NO: 478226 - RNA, 32 nt, Human
guggccacgggggcagugugaggaccucccug

SEQ ID NO: 478227 - RNA, 32 nt, Human
guggccacugaacugcugggcccgggagacug

SEQ ID NO: 478228 - RNA, 32 nt, Human
guggccacugcaauccagccugggcgauagag

SEQ ID NO: 478229 - RNA, 20 nt, Human
guggccacugccucccggca

SEQ ID NO: 478230 - RNA, 32 nt, Human
guggccacugccucccggcacuguggcagacu

SEQ ID NO: 478231 - RNA, 32 nt, Human
guggccacugccuuugaucaaccuuugugugc

SEQ ID NO: 478232 - RNA, 32 nt, Human
guggccacugggggaaaggcagccuucugucu

SEQ ID NO: 478233 - RNA, 32 nt, Human
guggccacuuauuucacuaucuucuucaaaua

SEQ ID NO: 478234 - RNA, 20 nt, Human
guggccacuucauuccagca

SEQ ID NO: 478235 - RNA, 18 nt, Human
guggccagaagcucagca

SEQ ID NO: 478236 - RNA, 18 nt, Human
guggccagacucccacca

SEQ ID NO: 478237 - RNA, 32 nt, Human
guggccagagaagggaaaggauaagucauugc

SEQ ID NO: 478238 - RNA, 32 nt, Human
guggccagcagcagcuacaacauggucauccg

SEQ ID NO: 478239 - RNA, 32 nt, Human
guggccagcagucugggcacacacgagcaggu

SEQ ID NO: 478240 - RNA, 17 nt, Human
guggccagcauccccag

SEQ ID NO: 478241 - RNA, 19 nt, Human
guggccagcccugcugcca

SEQ ID NO: 478242 - RNA, 21 nt, Human
guggccagccugacuggcuuc

SEQ ID NO: 478243 - RNA, 32 nt, Human
guggccagcuacucaggaggcugaggcaggag

SEQ ID NO: 478244 - RNA, 32 nt, Human
guggccaggaaggauguucaguucaccucugg

SEQ ID NO: 478245 - RNA, 32 nt, Human
guggccaggagaacagagccccaccuggacca

SEQ ID NO: 478246 - RNA, 32 nt, Human
guggccaggagagaggccaggugacaggggcc

SEQ ID NO: 478247 - RNA, 25 nt, Human
guggccaggcacgccuguaauccca

SEQ ID NO: 478248 - RNA, 18 nt, Human
guggccaggcccccagcg

SEQ ID NO: 478249 - RNA, 19 nt, Human
guggccaggcggcccgagg

SEQ ID NO: 478250 - RNA, 24 nt, Human
guggccaggcugcagagcugcgug

SEQ ID NO: 478251 - RNA, 32 nt, Human
guggccagggaugaaccuugcccagccguggu

SEQ ID NO: 478252 - RNA, 32 nt, Human
guggccagggccugguggccugguggccagga

SEQ ID NO: 478253 - RNA, 23 nt, Human
guggccagggcuggagcugugug

SEQ ID NO: 478254 - RNA, 32 nt, Human
guggccaggggcccuggacgcuagccacggag

SEQ ID NO: 478255 - RNA, 32 nt, Human
guggccagggguggaggagaauaugugggugu

SEQ ID NO: 478256 - RNA, 32 nt, Human
guggccaggguaguucucagguugugcuagag

SEQ ID NO: 478257 - RNA, 32 nt, Human
guggccaggugcacuccucagaccugugcaca

SEQ ID NO: 478258 - RNA, 21 nt, Human
guggccagguggcccuuggug

SEQ ID NO: 478259 - RNA, 18 nt, Human
guggccagguucccagca

SEQ ID NO: 478260 - RNA, 32 nt, Human
guggccaguaaaauuauaccauuggcaugaag

SEQ ID NO: 478261 - RNA, 32 nt, Human
guggccagucuuccugaucuccaucuuucugc

SEQ ID NO: 478262 - RNA, 19 nt, Human
guggccauaccucccagca

SEQ ID NO: 478263 - RNA, 24 nt, Human
guggccauagcagcaguccucccc

SEQ ID NO: 478264 - RNA, 32 nt, Human
guggccaucacugucucaccccucacgggcag

SEQ ID NO: 478265 - RNA, 32 nt, Human
guggccaucccucccugcaccccuuagccauc

SEQ ID NO: 478266 - RNA, 23 nt, Human
guggccaucuucacaacugcagc

SEQ ID NO: 478267 - RNA, 32 nt, Human
guggccaugagagagaagcugagagcaaccag

SEQ ID NO: 478268 - RNA, 22 nt, Human
guggccaugcucuuggagcacu

SEQ ID NO: 478269 - RNA, 31 nt, Human
guggccauggggagccucagcggucugcgcc

SEQ ID NO: 478270 - RNA, 31 nt, Human
guggccauggugcugcugcugcugguggcca

SEQ ID NO: 478271 - RNA, 19 nt, Human
guggccauucagggguagu

SEQ ID NO: 478272 - RNA, 32 nt, Human
guggccauugacuucucucaggaggaguggga

SEQ ID NO: 478273 - RNA, 32 nt, Human
guggccauuucugcagccuccuggccucaccu

SEQ ID NO: 478274 - RNA, 18 nt, Human
guggcccaacucuccugg

SEQ ID NO: 478275 - RNA, 32 nt, Human
guggcccaagagugaguuccggccugagugcu

SEQ ID NO: 478276 - RNA, 22 nt, Human
guggcccaagccuguaguccca

SEQ ID NO: 478277 - RNA, 32 nt, Human
guggcccaaggcccucuucacacuccaucuug

SEQ ID NO: 478278 - RNA, 32 nt, Human
guggcccaaguaaaccuagcucggcgaucggc

SEQ ID NO: 478279 - RNA, 22 nt, Human
guggcccacaccugugguccca

SEQ ID NO: 478280 - RNA, 20 nt, Human
guggcccacaccuguuccua

SEQ ID NO: 478281 - RNA, 32 nt, Human
guggcccacacucggucaugugcucagacaac

SEQ ID NO: 478282 - RNA, 22 nt, Human
guggcccacagcuguaauccca

SEQ ID NO: 478283 - RNA, 32 nt, Human
guggcccacaguuuccuuucucuccacaccuc

SEQ ID NO: 478284 - RNA, 32 nt, Human
guggcccacaucugaccuggcagcccauguau

SEQ ID NO: 478285 - RNA, 22 nt, Human
guggcccacaucuguaauccca

SEQ ID NO: 478286 - RNA, 32 nt, Human
guggcccaccugggugggaggcugccaccgcg

SEQ ID NO: 478287 - RNA, 22 nt, Human
guggcccacgccuguaauccca

SEQ ID NO: 478288 - RNA, 32 nt, Human
guggcccacguucuacucaucuggagcccagg

SEQ ID NO: 478289 - RNA, 32 nt, Human
guggcccacucccggcccaggcugcuuuccgu

SEQ ID NO: 478290 - RNA, 32 nt, Human
guggcccacugcagcccuggcgagcaggcuuc

SEQ ID NO: 478291 - RNA, 32 nt, Human
guggcccacuugggcacccacgcuucugucca

SEQ ID NO: 478292 - RNA, 32 nt, Human
guggcccagaagcuggaaguuugggaaaggcc

SEQ ID NO: 478293 - RNA, 32 nt, Human
guggcccagagaggaugccacagggaaaguau

SEQ ID NO: 478294 - RNA, 32 nt, Human
guggcccagcaccgccuagcccugccacccca

SEQ ID NO: 478295 - RNA, 32 nt, Human
guggcccagccgcgggagcgguggggcggggg

SEQ ID NO: 478296 - RNA, 32 nt, Human
guggcccagcuggaggggcagcuggaggagcu

SEQ ID NO: 478297 - RNA, 32 nt, Human
guggcccagcuggcuggaguccaggcagccaa

SEQ ID NO: 478298 - RNA, 32 nt, Human
guggcccagcuuggccagcacacacuuuccuc

SEQ ID NO: 478299 - RNA, 32 nt, Human
guggcccaggcaggcugagugggugggccacc

SEQ ID NO: 478300 - RNA, 32 nt, Human
guggcccaggcucuccccugacccauccucgc

SEQ ID NO: 478301 - RNA, 24 nt, Human
guggcccaggcugaagugcagugg

SEQ ID NO: 478302 - RNA, 24 nt, Human
guggcccaggcuggagugcagugg

SEQ ID NO: 478303 - RNA, 24 nt, Human
guggcccaggcuggaguguagugg

SEQ ID NO: 478304 - RNA, 24 nt, Human
guggcccaggcuggcgugcagugg

SEQ ID NO: 478305 - RNA, 32 nt, Human
guggcccagggagugugaggcugcagccucag

SEQ ID NO: 478306 - RNA, 32 nt, Human
guggcccagggcaguggcuuuccugaggcagc

SEQ ID NO: 478307 - RNA, 22 nt, Human
guggcccaugccuauaauccca

SEQ ID NO: 478308 - RNA, 22 nt, Human
guggcccaugccuguaauccca

SEQ ID NO: 478309 - RNA, 22 nt, Human
guggcccaugccuguaaucuca

SEQ ID NO: 478310 - RNA, 22 nt, Human
guggcccaugccuguagcccca

SEQ ID NO: 478311 - RNA, 22 nt, Human
guggcccaugccuguuauccca

SEQ ID NO: 478312 - RNA, 32 nt, Human
guggccccacgauguccaccacagcgaugucc

SEQ ID NO: 478313 - RNA, 32 nt, Human
guggccccagaaccucagcucuguaaauaauc

SEQ ID NO: 478314 - RNA, 32 nt, Human
guggccccagaggagaacgugccagugaggca

SEQ ID NO: 478315 - RNA, 32 nt, Human
guggccccagaucaagucaugggaggaagcua

SEQ ID NO: 478316 - RNA, 32 nt, Human
guggccccaggccuguuuggaggaugggcugg

SEQ ID NO: 478317 - RNA, 19 nt, Human
guggccccaggggguuaga

SEQ ID NO: 478318 - RNA, 32 nt, Human
guggcccccacacacccagccugugaaaccua

SEQ ID NO: 478319 - RNA, 32 nt, Human
guggcccccagaggcgucccgacucccgcgcg

SEQ ID NO: 478320 - RNA, 20 nt, Human
guggccccccacccaucuca

SEQ ID NO: 478321 - RNA, 32 nt, Human
guggcccccucaccugccuucucuuuuuagcu

SEQ ID NO: 478322 - RNA, 32 nt, Human
guggcccccugcggcccuagccugacccggag

SEQ ID NO: 478323 - RNA, 32 nt, Human
guggccccgacuggcccugccgugcgggcuca

SEQ ID NO: 478324 - RNA, 32 nt, Human
guggccccgagugccuccccucccucccucug

SEQ ID NO: 478325 - RNA, 32 nt, Human
guggccccgcaaucucggcucacugcaaccuc

SEQ ID NO: 478326 - RNA, 32 nt, Human
guggccccucaccacacugacuuauuucccua

SEQ ID NO: 478327 - RNA, 32 nt, Human
guggccccucacugcucuuuuccuauucaaac

SEQ ID NO: 478328 - RNA, 32 nt, Human
guggccccuccaccacgcuucuucaaucccuc

SEQ ID NO: 478329 - RNA, 32 nt, Human
guggccccuccacccucucccccagccgcacg

SEQ ID NO: 478330 - RNA, 32 nt, Human
guggccccucccaagcuggagauucuacgggc

SEQ ID NO: 478331 - RNA, 32 nt, Human
guggccccuccccaacuccuuccucuuugcuu

SEQ ID NO: 478332 - RNA, 32 nt, Human
guggccccuccccauccccucccucuguucgu

SEQ ID NO: 478333 - RNA, 32 nt, Human
guggccccucccccuccuucucacccuuaagg

SEQ ID NO: 478334 - RNA, 32 nt, Human
guggccccucccccucuccuuuugcucucuuc

SEQ ID NO: 478335 - RNA, 32 nt, Human
guggccccucccucccccuccuccccucuuuu

SEQ ID NO: 478336 - RNA, 32 nt, Human
guggccccuccuggccccugggccuccugccu

SEQ ID NO: 478337 - RNA, 32 nt, Human
guggccccuucuucugcuuaaacacacggcag

SEQ ID NO: 478338 - RNA, 32 nt, Human
guggcccgagcagcggcgagcccagggcgccg

SEQ ID NO: 478339 - RNA, 32 nt, Human
guggcccgcacgucucuguucucuccaaguaa

SEQ ID NO: 478340 - RNA, 32 nt, Human
guggcccggaagcagaggcugaccaggagcag

SEQ ID NO: 478341 - RNA, 32 nt, Human
guggcccggaagguggugcgcauggugauccg

SEQ ID NO: 478342 - RNA, 32 nt, Human
guggcccggccuggcccgugccccgcugccgc

SEQ ID NO: 478343 - RNA, 32 nt, Human
guggcccgugcacugaaggucaacacagcccu

SEQ ID NO: 478344 - RNA, 22 nt, Human
guggcccgugccaaagcacuua

SEQ ID NO: 478345 - RNA, 32 nt, Human
guggcccuaaaauggugaaucagagcauaucu

SEQ ID NO: 478346 - RNA, 32 nt, Human
guggcccucagccaccaccuugucgcccgagu

SEQ ID NO: 478347 - RNA, 32 nt, Human
guggcccucagcccuccaccuccggcgggggc

SEQ ID NO: 478348 - RNA, 32 nt, Human
guggcccucaucacagcccuccaggagauauc

SEQ ID NO: 478349 - RNA, 32 nt, Human
guggcccugaacaucccaggaggccgaucgua

SEQ ID NO: 478350 - RNA, 32 nt, Human
guggcccugagcaucccaggaggccgaucgua

SEQ ID NO: 478351 - RNA, 32 nt, Human
guggcccugcacucaagcuccgcaauaaucag

SEQ ID NO: 478352 - RNA, 32 nt, Human
guggcccugcagccccugugcuccgagggugg

SEQ ID NO: 478353 - RNA, 23 nt, Human
guggcccugccaucuucccagca

SEQ ID NO: 478354 - RNA, 32 nt, Human
guggcccuggcccuccccuuccucacucccgc

SEQ ID NO: 478355 - RNA, 32 nt, Human
guggcccuggcuuuguuccuccaccucuugcu

SEQ ID NO: 478356 - RNA, 32 nt, Human
guggcccugggagcugucugucuuuccccuac

SEQ ID NO: 478357 - RNA, 32 nt, Human
guggcccuggggacaagagggaggagcccagg

SEQ ID NO: 478358 - RNA, 32 nt, Human
guggcccugggguggacccugcccuuuggaca

SEQ ID NO: 478359 - RNA, 32 nt, Human
guggcccugugcccaguggcccacaggacacg

SEQ ID NO: 478360 - RNA, 20 nt, Human
guggcccuuccuugccuucc

SEQ ID NO: 478361 - RNA, 22 nt, Human
guggcccuugccuguagucuca

SEQ ID NO: 478362 - RNA, 32 nt, Human
guggcccuuuagaaacacacagcuccauuuca

SEQ ID NO: 478363 - RNA, 32 nt, Human
guggccgaacaugccucauaggcacagcugac

SEQ ID NO: 478364 - RNA, 32 nt, Human
guggccgagacggguggaucaccugaggucaa

SEQ ID NO: 478365 - RNA, 17 nt, Human
guggccgaggcgggagg

SEQ ID NO: 478366 - RNA, 32 nt, Human
guggccgccaggggacuggaccgucagucugu

SEQ ID NO: 478367 - RNA, 24 nt, Human
guggccgcccuuacacgucuccua

SEQ ID NO: 478368 - RNA, 23 nt, Human
guggccgccgccuaagcugcagc

SEQ ID NO: 478369 - RNA, 32 nt, Human
guggccgccgcugcugccccagcuggagcccg

SEQ ID NO: 478370 - RNA, 32 nt, Human
guggccgccgggucuccugggcugaggcuccc

SEQ ID NO: 478371 - RNA, 19 nt, Human
guggccgccucugucccug

SEQ ID NO: 478372 - RNA, 32 nt, Human
guggccgccugcccuuucucuccgcuccagcc

SEQ ID NO: 478373 - RNA, 32 nt, Human
guggccgccuucagaccacaccaccucuacca

SEQ ID NO: 478374 - RNA, 19 nt, Human
guggccgccuuuuccagca

SEQ ID NO: 478375 - RNA, 32 nt, Human
guggccgcgcguuccucccagaggggcguccc

SEQ ID NO: 478376 - RNA, 22 nt, Human
guggccgcguccauuccgcgcg

SEQ ID NO: 478377 - RNA, 32 nt, Human
guggccgcugccgccuccgcagggccgggcac

SEQ ID NO: 478378 - RNA, 32 nt, Human
guggccgcugccgccuccgccccagguuuugc

SEQ ID NO: 478379 - RNA, 32 nt, Human
guggccggaagcugcugcugcccacgccccug

SEQ ID NO: 478380 - RNA, 32 nt, Human
guggccggaccagcuuccccaccuucauuagg

SEQ ID NO: 478381 - RNA, 32 nt, Human
guggccggaccugacagucagcacuuggcagu

SEQ ID NO: 478382 - RNA, 16 nt, Human
guggccggacucccag

SEQ ID NO: 478383 - RNA, 32 nt, Human
guggccggcagcucgcgaacagcagcugaucc

SEQ ID NO: 478384 - RNA, 32 nt, Human
guggccggccggccgcucucaucccccguaag

SEQ ID NO: 478385 - RNA, 22 nt, Human
guggccggcgccuguaauccca

SEQ ID NO: 478386 - RNA, 32 nt, Human
guggccggcgggauggagaaaaguaggaugaa

SEQ ID NO: 478387 - RNA, 32 nt, Human
guggccggcugcagggacugcacggugaggca

SEQ ID NO: 478388 - RNA, 32 nt, Human
guggccgggaagcagaguucaugugaggguca

SEQ ID NO: 478389 - RNA, 32 nt, Human
guggccgggccuguacagcagccugggccaug

SEQ ID NO: 478390 - RNA, 32 nt, Human
guggccgggccuugccuuugggauucuaccug

SEQ ID NO: 478391 - RNA, 32 nt, Human
guggccggggcugaagccacacagcccagaag

SEQ ID NO: 478392 - RNA, 17 nt, Human
guggccgggugcagugg

SEQ ID NO: 478393 - RNA, 22 nt, Human
guggccgucaguggaaugcagc

SEQ ID NO: 478394 - RNA, 19 nt, Human
guggccgucauucugcagu

SEQ ID NO: 478395 - RNA, 18 nt, Human
guggccguccaggcuagc

SEQ ID NO: 478396 - RNA, 20 nt, Human
guggccguccagggcgucgc

SEQ ID NO: 478397 - RNA, 32 nt, Human
guggccgucggggcggagggcgguggccggcc

SEQ ID NO: 478398 - RNA, 20 nt, Human
guggccgucuccaccucagc

SEQ ID NO: 478399 - RNA, 21 nt, Human
guggccgucuccucccucagc

SEQ ID NO: 478400 - RNA, 22 nt, Human
guggccgucugccaacuccagc

SEQ ID NO: 478401 - RNA, 22 nt, Human
guggccgugccugagcugcagc

SEQ ID NO: 478402 - RNA, 19 nt, Human
guggccguggacuaaguga

SEQ ID NO: 478403 - RNA, 32 nt, Human
guggccguggagguggugucugcugugcuuaa

SEQ ID NO: 478404 - RNA, 32 nt, Human
guggccgugguggagaugaugcagcccauggc

SEQ ID NO: 478405 - RNA, 21 nt, Human
guggccguuauggaacgcagc

SEQ ID NO: 478406 - RNA, 21 nt, Human
guggccguucacaucacgcgc

SEQ ID NO: 478407 - RNA, 32 nt, Human
guggccguucgggaggcggaaaaagaugagcg

SEQ ID NO: 478408 - RNA, 32 nt, Human
guggccuauuucucccugucagguugcacaga

SEQ ID NO: 478409 - RNA, 32 nt, Human
guggccucaagcaauccuuccaccucagacuc

SEQ ID NO: 478410 - RNA, 23 nt, Human
guggccucacgccuguaauccca

SEQ ID NO: 478411 - RNA, 32 nt, Human
guggccucagcaggacaggccccgggcacugc

SEQ ID NO: 478412 - RNA, 24 nt, Human
guggccucagcaucucauaacuca

SEQ ID NO: 478413 - RNA, 32 nt, Human
guggccucagugugcacgucugucuguccguc

SEQ ID NO: 478414 - RNA, 18 nt, Human
guggccucaugcccugug

SEQ ID NO: 478415 - RNA, 23 nt, Human
guggccucaugccuauaauccca

SEQ ID NO: 478416 - RNA, 32 nt, Human
guggccuccagggugccuccaccugcacaacc

SEQ ID NO: 478417 - RNA, 32 nt, Human
guggccucccaaagcgcuaggauuacaagcau

SEQ ID NO: 478418 - RNA, 32 nt, Human
guggccucccaaagugcugggauuacagacac

SEQ ID NO: 478419 - RNA, 32 nt, Human
guggccucccaaagugcugggauuacaggcau

SEQ ID NO: 478420 - RNA, 32 nt, Human
guggccucccagaccuccugaccugggugguu

SEQ ID NO: 478421 - RNA, 32 nt, Human
guggccuccgcuggcucugccugcuccugcaa

SEQ ID NO: 478422 - RNA, 32 nt, Human
guggccuccucagcuuccuccccaucugggug

SEQ ID NO: 478423 - RNA, 32 nt, Human
guggccuccuuccucuauccucaaagccagca

SEQ ID NO: 478424 - RNA, 32 nt, Human
guggccucuaucugcuaccaucuguguuuuau

SEQ ID NO: 478425 - RNA, 32 nt, Human
guggccucucagaauuggggugaagggcacgg

SEQ ID NO: 478426 - RNA, 32 nt, Human
guggccucucccagggcagccggcaggagcca

SEQ ID NO: 478427 - RNA, 21 nt, Human
guggccucucggccaauccca

SEQ ID NO: 478428 - RNA, 32 nt, Human
guggccucucuccccucucucuuuuccuccuu

SEQ ID NO: 478429 - RNA, 32 nt, Human
guggccucucuggaacucugcagaccaccugc

SEQ ID NO: 478430 - RNA, 32 nt, Human
guggccucugcaggagcaaaacugccucaagu

SEQ ID NO: 478431 - RNA, 32 nt, Human
guggccucuggcccaccaagcucccugucacc

SEQ ID NO: 478432 - RNA, 32 nt, Human
guggccucuggcugccucaggcauuuuccucu

SEQ ID NO: 478433 - RNA, 32 nt, Human
guggccucuguggagaugaaggcacgggaagc

SEQ ID NO: 478434 - RNA, 32 nt, Human
guggccucuuugagugucugcagcagcccugg

SEQ ID NO: 478435 - RNA, 32 nt, Human
guggccugaagaguccucugaaugaaccuucu

SEQ ID NO: 478436 - RNA, 22 nt, Human
guggccugagagagcccuggua

SEQ ID NO: 478437 - RNA, 32 nt, Human
guggccugaggacagugagcacugacugguca

SEQ ID NO: 478438 - RNA, 32 nt, Human
guggccugaggagaugguuggaucauuccaaa

SEQ ID NO: 478439 - RNA, 32 nt, Human
guggccugaggccaggaggcugcagcugcuuc

SEQ ID NO: 478440 - RNA, 32 nt, Human
guggccugaguauuucacuggcagguugugaa

SEQ ID NO: 478441 - RNA, 32 nt, Human
guggccugauucagcaggaagcaucucagaca

SEQ ID NO: 478442 - RNA, 22 nt, Human
guggccugcaccuguaguccca

SEQ ID NO: 478443 - RNA, 32 nt, Human
guggccugcagaccucagcuucucccucugaa

SEQ ID NO: 478444 - RNA, 32 nt, Human
guggccugcagaguccauuccaucaugaugcu

SEQ ID NO: 478445 - RNA, 32 nt, Human
guggccugcagcccugcgcagggccagugccu

SEQ ID NO: 478446 - RNA, 32 nt, Human
guggccugccccagcucucuucuggcuuucug

SEQ ID NO: 478447 - RNA, 31 nt, Human
guggccugccucucuuccgagucuuccagug

SEQ ID NO: 478448 - RNA, 32 nt, Human
guggccuggaaaugauucagcaggagaaauua

SEQ ID NO: 478449 - RNA, 31 nt, Human
guggccuggacaauccagccugacaaggagc

SEQ ID NO: 478450 - RNA, 32 nt, Human
guggccuggcaugguagguacuacccaaugaa

SEQ ID NO: 478451 - RNA, 32 nt, Human
guggccuggccggcuccagugcagagaggaag

SEQ ID NO: 478452 - RNA, 32 nt, Human
guggccuggcugucugucugucugucuaaccu

SEQ ID NO: 478453 - RNA, 32 nt, Human
guggccugggagaggcagugagccuucucucc

SEQ ID NO: 478454 - RNA, 32 nt, Human
guggccugggcaagauaacgcacuucuaacua

SEQ ID NO: 478455 - RNA, 32 nt, Human
guggccugggcuaggucacuccaccucucugu

SEQ ID NO: 478456 - RNA, 32 nt, Human
guggccugggcugagcugggugggccgggaga

SEQ ID NO: 478457 - RNA, 32 nt, Human
guggccuggggagggggccguggcacugaggc

SEQ ID NO: 478458 - RNA, 32 nt, Human
guggccugggugccucugcacacugaguggag

SEQ ID NO: 478459 - RNA, 32 nt, Human
guggccuggguuuccucauaccaaugguggcu

SEQ ID NO: 478460 - RNA, 32 nt, Human
guggccuggugcuggggugaaggugagcuggg

SEQ ID NO: 478461 - RNA, 32 nt, Human
guggccuguaaucccagcuacucgggaggcug

SEQ ID NO: 478462 - RNA, 32 nt, Human
guggccuguaaucccagcuacuugggaggcug

SEQ ID NO: 478463 - RNA, 32 nt, Human
guggccuguacaguucuagcacugguuagaga

SEQ ID NO: 478464 - RNA, 32 nt, Human
guggccuguagucccagcuaucccagaggucg

SEQ ID NO: 478465 - RNA, 32 nt, Human
guggccugugcccuccccacucccaggcgggg

SEQ ID NO: 478466 - RNA, 22 nt, Human
guggccugugccuauaguccca

SEQ ID NO: 478467 - RNA, 22 nt, Human
guggccugugccuguaaaccca

SEQ ID NO: 478468 - RNA, 32 nt, Human
guggccuguucaaggcagaaccacgacccuug

SEQ ID NO: 478469 - RNA, 32 nt, Human
guggccuucaggcagagcagcaaguggcccuu

SEQ ID NO: 478470 - RNA, 32 nt, Human
guggccuuccaucacaggaacagagacugaau

SEQ ID NO: 478471 - RNA, 32 nt, Human
guggccuucccaggccccgcuuuugcuuuugg

SEQ ID NO: 478472 - RNA, 22 nt, Human
guggccuuccuggaugccuucc

SEQ ID NO: 478473 - RNA, 32 nt, Human
guggccuuccuuggaaaucugucucaaaucuc

SEQ ID NO: 478474 - RNA, 32 nt, Human
guggccuuccuuggggcuucucugaccacaug

SEQ ID NO: 478475 - RNA, 32 nt, Human
guggccuugcccacgccucucaccucugccuu

SEQ ID NO: 478476 - RNA, 17 nt, Human
guggccuuggcccgagg

SEQ ID NO: 478477 - RNA, 22 nt, Human
guggccuugguccuuaauccca

SEQ ID NO: 478478 - RNA, 32 nt, Human
guggccuuguaaugaagccucacuucugcuuu

SEQ ID NO: 478479 - RNA, 32 nt, Human
guggccuuuccaggccuagcuuucgcuuuuug

SEQ ID NO: 478480 - RNA, 32 nt, Human
guggccuuucuuccucugggcaaagaagggcu

SEQ ID NO: 478481 - RNA, 32 nt, Human
guggcgaagagugcuggagcgcggcgaugggg

SEQ ID NO: 478482 - RNA, 22 nt, Human
guggcgaaugccuguaaucuca

SEQ ID NO: 478483 - RNA, 32 nt, Human
guggcgacagccgcacugacaucuuucaggac

SEQ ID NO: 478484 - RNA, 32 nt, Human
guggcgaccagcuguucuccauaugcacuaag

SEQ ID NO: 478485 - RNA, 32 nt, Human
guggcgagcaguuucccacuugccaaagaucc

SEQ ID NO: 478486 - RNA, 22 nt, Human
guggcgagcgccuguaguccca

SEQ ID NO: 478487 - RNA, 32 nt, Human
guggcgaggagccgcccgaggagcagccacac

SEQ ID NO: 478488 - RNA, 32 nt, Human
guggcgagggggaagcgaaggaaggggaaggg

SEQ ID NO: 478489 - RNA, 22 nt, Human
guggcgagugccuguaauccca

SEQ ID NO: 478490 - RNA, 32 nt, Human
guggcgauggcauguaaccacaucaaacucaa

SEQ ID NO: 478491 - RNA, 32 nt, Human
guggcgcaagagccuggacgcacgugugggag

SEQ ID NO: 478492 - RNA, 22 nt, Human
guggcgcacaccuauaaucuca

SEQ ID NO: 478493 - RNA, 19 nt, Human
guggcgcacaccuguaauc

SEQ ID NO: 478494 - RNA, 22 nt, Human
guggcgcacaccuguaauccca

SEQ ID NO: 478495 - RNA, 22 nt, Human
guggcgcacaccuguaauccua

SEQ ID NO: 478496 - RNA, 22 nt, Human
guggcgcacaccuguaaucuca

SEQ ID NO: 478497 - RNA, 22 nt, Human
guggcgcacaccuguaguccca

SEQ ID NO: 478498 - RNA, 22 nt, Human
guggcgcacaccuguauuccca

SEQ ID NO: 478499 - RNA, 22 nt, Human
guggcgcaccccuguaaucuca

SEQ ID NO: 478500 - RNA, 22 nt, Human
guggcgcacgccucuaauccca

SEQ ID NO: 478501 - RNA, 22 nt, Human
guggcgcacgccuguaauccca

SEQ ID NO: 478502 - RNA, 22 nt, Human
guggcgcacgccuguaguccca

SEQ ID NO: 478503 - RNA, 22 nt, Human
guggcgcacuacuauaauccca

SEQ ID NO: 478504 - RNA, 21 nt, Human
guggcgcagaccaugcuguau

SEQ ID NO: 478505 - RNA, 22 nt, Human
guggcgcagcgcagcgucccua

SEQ ID NO: 478506 - RNA, 32 nt, Human
guggcgcagcuuucugugugaugcagaugugu

SEQ ID NO: 478507 - RNA, 21 nt, Human
guggcgcaggcuuaguaacgc

SEQ ID NO: 478508 - RNA, 22 nt, Human
guggcgcauaccuguaauccca

SEQ ID NO: 478509 - RNA, 22 nt, Human
guggcgcauaccuguaauucca

SEQ ID NO: 478510 - RNA, 22 nt, Human
guggcgcauaccuguaguccca

SEQ ID NO: 478511 - RNA, 22 nt, Human
guggcgcaugccuauaauccca

SEQ ID NO: 478512 - RNA, 22 nt, Human
guggcgcaugccuauaguccca

SEQ ID NO: 478513 - RNA, 22 nt, Human
guggcgcaugccuguaacccca

SEQ ID NO: 478514 - RNA, 19 nt, Human
guggcgcaugccuguaauc

SEQ ID NO: 478515 - RNA, 22 nt, Human
guggcgcaugccuguaauccca

SEQ ID NO: 478516 - RNA, 22 nt, Human
guggcgcaugccuguaauccua

SEQ ID NO: 478517 - RNA, 22 nt, Human
guggcgcaugccuguaaucuca

SEQ ID NO: 478518 - RNA, 22 nt, Human
guggcgcaugccuguaauucca

SEQ ID NO: 478519 - RNA, 22 nt, Human
guggcgcaugccuguaguccca

SEQ ID NO: 478520 - RNA, 22 nt, Human
guggcgcaugccugugauccca

SEQ ID NO: 478521 - RNA, 22 nt, Human
guggcgcaugcuuguaauccca

SEQ ID NO: 478522 - RNA, 22 nt, Human
guggcgcaugucuguaauccca

SEQ ID NO: 478523 - RNA, 24 nt, Human
guggcgcaugugccuguaauccca

SEQ ID NO: 478524 - RNA, 23 nt, Human
guggcgcauugccuguaauccca

SEQ ID NO: 478525 - RNA, 32 nt, Human
guggcgccagcaggcuuggacacugcccuggc

SEQ ID NO: 478526 - RNA, 32 nt, Human
guggcgcccaggaaagcggggaagcagagcag

SEQ ID NO: 478527 - RNA, 32 nt, Human
guggcgcccccuggagggaggaaggggaacug

SEQ ID NO: 478528 - RNA, 32 nt, Human
guggcgccccuccaaccguccuaacgccgggc

SEQ ID NO: 478529 - RNA, 32 nt, Human
guggcgcccgggcagcuuguccauuuucagau

SEQ ID NO: 478530 - RNA, 32 nt, Human
guggcgcccugcauaggggagcagggggaacg

SEQ ID NO: 478531 - RNA, 32 nt, Human
guggcgcccuuuccuucuuguuuguuccucug

SEQ ID NO: 478532 - RNA, 22 nt, Human
guggcgccugccuguaauccca

SEQ ID NO: 478533 - RNA, 32 nt, Human
guggcgcgauggagggacuggaagagaaugga

SEQ ID NO: 478534 - RNA, 22 nt, Human
guggcgcgcaccuguaauccca

SEQ ID NO: 478535 - RNA, 22 nt, Human
guggcgcgcaccuguaguccca

SEQ ID NO: 478536 - RNA, 22 nt, Human
guggcgcgcgccuauaauccca

SEQ ID NO: 478537 - RNA, 22 nt, Human
guggcgcgcgccuguaauccca

SEQ ID NO: 478538 - RNA, 22 nt, Human
guggcgcgcgucuguaauccca

SEQ ID NO: 478539 - RNA, 32 nt, Human
guggcgcgggcgguggaggaggagguggggcu

SEQ ID NO: 478540 - RNA, 22 nt, Human
guggcgcgugccuguaauccca

SEQ ID NO: 478541 - RNA, 22 nt, Human
guggcgcgugccuguaauccua

SEQ ID NO: 478542 - RNA, 22 nt, Human
guggcgcgugccuguaauucca

SEQ ID NO: 478543 - RNA, 22 nt, Human
guggcgcgugccuguaguccca

SEQ ID NO: 478544 - RNA, 22 nt, Human
guggcgcgugcuuguaauccca

SEQ ID NO: 478545 - RNA, 32 nt, Human
guggcgcucaagguccaugcagucucuuuccu

SEQ ID NO: 478546 - RNA, 21 nt, Human
guggcgcucaccuguaauccc

SEQ ID NO: 478547 - RNA, 22 nt, Human
guggcgcucaccuguaauccca

SEQ ID NO: 478548 - RNA, 32 nt, Human
guggcgcucgucaggggagaaacagugaaguc

SEQ ID NO: 478549 - RNA, 22 nt, Human
guggcggacaccuguaauccca

SEQ ID NO: 478550 - RNA, 32 nt, Human
guggcggagauggagaugaggauggaucugcc

SEQ ID NO: 478551 - RNA, 32 nt, Human
guggcggaggcugaggagaaggaggagcgggc

SEQ ID NO: 478552 - RNA, 32 nt, Human
guggcggaguuuggagguuggagagaaaucca

SEQ ID NO: 478553 - RNA, 32 nt, Human
guggcggcagaggcagagaugggagugaugcg

SEQ ID NO: 478554 - RNA, 32 nt, Human
guggcggcagcugucuguguuucuccuguucu

SEQ ID NO: 478555 - RNA, 32 nt, Human
guggcggcgccgcagccauggagggaggcggc

SEQ ID NO: 478556 - RNA, 31 nt, Human
guggcggcgccuguaaucccagcuacuuggg

SEQ ID NO: 478557 - RNA, 32 nt, Human
guggcggcguccuggggccaggaggagcgaac

SEQ ID NO: 478558 - RNA, 32 nt, Human
guggcggcgugggagcaccucuggggcuaugg

SEQ ID NO: 478559 - RNA, 32 nt, Human
guggcggcuacugggcccugcccagccccgga

SEQ ID NO: 478560 - RNA, 32 nt, Human
guggcggcuagagcguuccuccccagcucgaa

SEQ ID NO: 478561 - RNA, 22 nt, Human
guggcggcucacgccuguaauc

SEQ ID NO: 478562 - RNA, 22 nt, Human
guggcggcucaugccuauaauc

SEQ ID NO: 478563 - RNA, 22 nt, Human
guggcggcucaugccuguaauc

SEQ ID NO: 478564 - RNA, 32 nt, Human
guggcggcucccacucgcuucucccucggguc

SEQ ID NO: 478565 - RNA, 32 nt, Human
guggcgggacugggugaagagugggauuggga

SEQ ID NO: 478566 - RNA, 22 nt, Human
guggcgggagccuguaguccca

SEQ ID NO: 478567 - RNA, 32 nt, Human
guggcgggcaagcggggagaccccggcgcagc

SEQ ID NO: 478568 - RNA, 22 nt, Human
guggcgggcaccuauaauccca

SEQ ID NO: 478569 - RNA, 22 nt, Human
guggcgggcaccuauaguccca

SEQ ID NO: 478570 - RNA, 22 nt, Human
guggcgggcaccuguaauacca

SEQ ID NO: 478571 - RNA, 22 nt, Human
guggcgggcaccuguaauccca

SEQ ID NO: 478572 - RNA, 22 nt, Human
guggcgggcaccuguaaucgca

SEQ ID NO: 478573 - RNA, 22 nt, Human
guggcgggcaccuguaguccca

SEQ ID NO: 478574 - RNA, 22 nt, Human
guggcgggcaccuguauuccca

SEQ ID NO: 478575 - RNA, 22 nt, Human
guggcgggcaccugucauccca

SEQ ID NO: 478576 - RNA, 22 nt, Human
guggcgggcacuuguaauccca

SEQ ID NO: 478577 - RNA, 22 nt, Human
guggcgggcccccguaguccca

SEQ ID NO: 478578 - RNA, 22 nt, Human
guggcgggccccuguaauccca

SEQ ID NO: 478579 - RNA, 22 nt, Human
guggcgggccccuguaguccca

SEQ ID NO: 478580 - RNA, 22 nt, Human
guggcgggcgcccguaauccca

SEQ ID NO: 478581 - RNA, 22 nt, Human
guggcgggcgccuauaauccca

SEQ ID NO: 478582 - RNA, 22 nt, Human
guggcgggcgccuauaauccua

SEQ ID NO: 478583 - RNA, 22 nt, Human
guggcgggcgccuguaauccca

SEQ ID NO: 478584 - RNA, 22 nt, Human
guggcgggcgccuguaauccua

SEQ ID NO: 478585 - RNA, 22 nt, Human
guggcgggcgccuguagcccca

SEQ ID NO: 478586 - RNA, 22 nt, Human
guggcgggcgccuguaguccca

SEQ ID NO: 478587 - RNA, 22 nt, Human
guggcgggcgccuguauuccca

SEQ ID NO: 478588 - RNA, 22 nt, Human
guggcgggcgccuguuauccca

SEQ ID NO: 478589 - RNA, 22 nt, Human
guggcgggcuccuguaguccca

SEQ ID NO: 478590 - RNA, 32 nt, Human
guggcggggcagcaggagcgguagaaaggggu

SEQ ID NO: 478591 - RNA, 32 nt, Human
guggcggggccagcaggcugucccagcccuca

SEQ ID NO: 478592 - RNA, 32 nt, Human
guggcggggcuggagggcuggggugcacuuua

SEQ ID NO: 478593 - RNA, 22 nt, Human
guggcgggggccuguaauccca

SEQ ID NO: 478594 - RNA, 32 nt, Human
guggcggguccagcuacucgggaggcugaggc

SEQ ID NO: 478595 - RNA, 22 nt, Human
guggcgggugccuauaauccca

SEQ ID NO: 478596 - RNA, 21 nt, Human
guggcgggugccuguaauccc

SEQ ID NO: 478597 - RNA, 22 nt, Human
guggcgggugccuguaauccca

SEQ ID NO: 478598 - RNA, 22 nt, Human
guggcgggugccuguaguccca

SEQ ID NO: 478599 - RNA, 32 nt, Human
guggcggguguagaaggagcuaaagagaucug

SEQ ID NO: 478600 - RNA, 21 nt, Human
guggcggucaccuguaaccca

SEQ ID NO: 478601 - RNA, 22 nt, Human
guggcggucaccuguaguccca

SEQ ID NO: 478602 - RNA, 32 nt, Human
guggcggucaucauccccuuuaacaccgggaa

SEQ ID NO: 478603 - RNA, 21 nt, Human
guggcggucucuguaauccca

SEQ ID NO: 478604 - RNA, 32 nt, Human
guggcggugcaggaggccgggcaggggugcgg

SEQ ID NO: 478605 - RNA, 32 nt, Human
guggcgguggaccaaaggaaggaagcaagcau

SEQ ID NO: 478606 - RNA, 32 nt, Human
guggcgguggaggugugcugagcucagccuau

SEQ ID NO: 478607 - RNA, 32 nt, Human
guggcgguguuggaggauaugaugguuacaau

SEQ ID NO: 478608 - RNA, 22 nt, Human
guggcguacgccuauaguccca

SEQ ID NO: 478609 - RNA, 22 nt, Human
guggcguacgccuguaguccca

SEQ ID NO: 478610 - RNA, 22 nt, Human
guggcguaugccuguaauccca

SEQ ID NO: 478611 - RNA, 32 nt, Human
guggcgucagcccagcugcaggagaagcuggc

SEQ ID NO: 478612 - RNA, 32 nt, Human
guggcgucaucuuuacauucuaguccuccugc

SEQ ID NO: 478613 - RNA, 32 nt, Human
guggcguccagcucuucaacaggcgccggcag

SEQ ID NO: 478614 - RNA, 32 nt, Human
guggcgucuacaccacuuguuccaagcaggcg

SEQ ID NO: 478615 - RNA, 32 nt, Human
guggcgucuccacacgcaaccaugaaguugaa

SEQ ID NO: 478616 - RNA, 22 nt, Human
guggcgugcaccuguaauccca

SEQ ID NO: 478617 - RNA, 22 nt, Human
guggcgugcaccuguaguccca

SEQ ID NO: 478618 - RNA, 20 nt, Human
guggcgugccuguauuccca

SEQ ID NO: 478619 - RNA, 22 nt, Human
guggcgugcgccuguaauccca

SEQ ID NO: 478620 - RNA, 22 nt, Human
guggcgugcgccuguaaucuca

SEQ ID NO: 478621 - RNA, 22 nt, Human
guggcgugcgccuguaguccca

SEQ ID NO: 478622 - RNA, 24 nt, Human
guggcguggcggggucucgcggcg

SEQ ID NO: 478623 - RNA, 23 nt, Human
guggcguggcguggaguggcgug

SEQ ID NO: 478624 - RNA, 26 nt, Human
guggcguggcguggcggggucucgcg

SEQ ID NO: 478625 - RNA, 32 nt, Human
guggcgugggggcugaggaggggcuaaggcgg

SEQ ID NO: 478626 - RNA, 22 nt, Human
guggcgugugccuguaauccca

SEQ ID NO: 478627 - RNA, 22 nt, Human
guggcgugugccuguaaucuca

SEQ ID NO: 478628 - RNA, 22 nt, Human
guggcgugugccuguaaugcca

SEQ ID NO: 478629 - RNA, 22 nt, Human
guggcgugugccuguaguccca

SEQ ID NO: 478630 - RNA, 22 nt, Human
guggcgugugccugugauccca

SEQ ID NO: 478631 - RNA, 32 nt, Human
guggcgugugugugccacauauuuccccguca

SEQ ID NO: 478632 - RNA, 32 nt, Human
guggcguguugggcgacuucucucccccgucc

SEQ ID NO: 478633 - RNA, 32 nt, Human
guggcuaaacacccuccuacugcagagacaga

SEQ ID NO: 478634 - RNA, 22 nt, Human
guggcuaaagccuguaauccca

SEQ ID NO: 478635 - RNA, 32 nt, Human
guggcuaacacggugaaaccccgucucuacua

SEQ ID NO: 478636 - RNA, 32 nt, Human
guggcuaacauggugaaacccuggcucuacua

SEQ ID NO: 478637 - RNA, 22 nt, Human
guggcuaacgccuguaauccca

SEQ ID NO: 478638 - RNA, 32 nt, Human
guggcuaaggcagaggcugagggggcugggcg

SEQ ID NO: 478639 - RNA, 32 nt, Human
guggcuaagggguggggugaggggauggagag

SEQ ID NO: 478640 - RNA, 32 nt, Human
guggcuaaggugagaggguggcuugagcccgg

SEQ ID NO: 478641 - RNA, 32 nt, Human
guggcuacagcacccagcacugugcuguuguu

SEQ ID NO: 478642 - RNA, 22 nt, Human
guggcuaccaaccaggguccca

SEQ ID NO: 478643 - RNA, 32 nt, Human
guggcuaccuuggcagcagcugugaagcugcu

SEQ ID NO: 478644 - RNA, 32 nt, Human
guggcuacgccuguaaucccagcacuuuggga

SEQ ID NO: 478645 - RNA, 32 nt, Human
guggcuacugagcgccaugaagguugucccag

SEQ ID NO: 478646 - RNA, 32 nt, Human
guggcuacuguggcugcgcuguggucaccuga

SEQ ID NO: 478647 - RNA, 32 nt, Human
guggcuacuuuuggucugaaacccacuuggcc

SEQ ID NO: 478648 - RNA, 32 nt, Human
guggcuagaccccaaaaagccgauucuccugu

SEQ ID NO: 478649 - RNA, 32 nt, Human
guggcuagagagaaaaguagaaaaccagagug

SEQ ID NO: 478650 - RNA, 32 nt, Human
guggcuagagcaaaaauccagaccuuguuucu

SEQ ID NO: 478651 - RNA, 32 nt, Human
guggcuagagguggggugggaagagaggaggc

SEQ ID NO: 478652 - RNA, 32 nt, Human
guggcuagccacugugcuccagccugggcaac

SEQ ID NO: 478653 - RNA, 32 nt, Human
guggcuagcuacacagaguccaucuaauuuuu

SEQ ID NO: 478654 - RNA, 32 nt, Human
guggcuaguggucagacugaagucaccagcug

SEQ ID NO: 478655 - RNA, 23 nt, Human
guggcuauaaugagaauugcaug

SEQ ID NO: 478656 - RNA, 32 nt, Human
guggcuaugggaaucagcugguggcuagguuu

SEQ ID NO: 478657 - RNA, 32 nt, Human
guggcuauugaccacucggcauuaugguuagu

SEQ ID NO: 478658 - RNA, 24 nt, Human
guggcucaaaugccuguaauccca

SEQ ID NO: 478659 - RNA, 22 nt, Human
guggcucaagcccauaauccca

SEQ ID NO: 478660 - RNA, 22 nt, Human
guggcucaagccuauaauccca

SEQ ID NO: 478661 - RNA, 22 nt, Human
guggcucaagccuguaauccca

SEQ ID NO: 478662 - RNA, 32 nt, Human
guggcucaagccuguaaugucagcacuuuaaa

SEQ ID NO: 478663 - RNA, 19 nt, Human
guggcucacaacuguaauc

SEQ ID NO: 478664 - RNA, 21 nt, Human
guggcucacaacuguaauccc

SEQ ID NO: 478665 - RNA, 22 nt, Human
guggcucacaacuguaauccua

SEQ ID NO: 478666 - RNA, 22 nt, Human
guggcucacacauguaauccca

SEQ ID NO: 478667 - RNA, 22 nt, Human
guggcucacacccauaauccca

SEQ ID NO: 478668 - RNA, 22 nt, Human
guggcucacacccguaauccca

SEQ ID NO: 478669 - RNA, 22 nt, Human
guggcucacaccgguaauccca

SEQ ID NO: 478670 - RNA, 20 nt, Human
guggcucacaccuaauccca

SEQ ID NO: 478671 - RNA, 19 nt, Human
guggcucacaccuauaauc

SEQ ID NO: 478672 - RNA, 22 nt, Human
guggcucacaccuauaauccca

SEQ ID NO: 478673 - RNA, 21 nt, Human
guggcucacaccuauaauccu

SEQ ID NO: 478674 - RNA, 22 nt, Human
guggcucacaccuauaauccua

SEQ ID NO: 478675 - RNA, 22 nt, Human
guggcucacaccuauaauucca

SEQ ID NO: 478676 - RNA, 22 nt, Human
guggcucacaccuauaguccca

SEQ ID NO: 478677 - RNA, 22 nt, Human
guggcucacaccucuaauccca

SEQ ID NO: 478678 - RNA, 19 nt, Human
guggcucacaccugaaauc

SEQ ID NO: 478679 - RNA, 19 nt, Human
guggcucacaccugcaauc

SEQ ID NO: 478680 - RNA, 20 nt, Human
guggcucacaccuguaaccc

SEQ ID NO: 478681 - RNA, 22 nt, Human
guggcucacaccuguaacccca

SEQ ID NO: 478682 - RNA, 22 nt, Human
guggcucacaccuguaauacca

SEQ ID NO: 478683 - RNA, 19 nt, Human
guggcucacaccuguaauc

SEQ ID NO: 478684 - RNA, 21 nt, Human
guggcucacaccuguaauccc

SEQ ID NO: 478685 - RNA, 22 nt, Human
guggcucacaccuguaauccca

SEQ ID NO: 478686 - RNA, 22 nt, Human
guggcucacaccuguaauccua

SEQ ID NO: 478687 - RNA, 20 nt, Human
guggcucacaccuguaaucu

SEQ ID NO: 478688 - RNA, 22 nt, Human
guggcucacaccuguaaucuca

SEQ ID NO: 478689 - RNA, 19 nt, Human
guggcucacaccuguaauu

SEQ ID NO: 478690 - RNA, 22 nt, Human
guggcucacaccuguaauucca

SEQ ID NO: 478691 - RNA, 22 nt, Human
guggcucacaccuguaauugca

SEQ ID NO: 478692 - RNA, 22 nt, Human
guggcucacaccuguaauuuca

SEQ ID NO: 478693 - RNA, 22 nt, Human
guggcucacaccuguacuccca

SEQ ID NO: 478694 - RNA, 22 nt, Human
guggcucacaccuguaguccca

SEQ ID NO: 478695 - RNA, 32 nt, Human
guggcucacaccuguaucccagcacuuuggga

SEQ ID NO: 478696 - RNA, 19 nt, Human
guggcucacaccuguauuc

SEQ ID NO: 478697 - RNA, 22 nt, Human
guggcucacaccuguauuccca

SEQ ID NO: 478698 - RNA, 22 nt, Human
guggcucacaccugucauccca

SEQ ID NO: 478699 - RNA, 21 nt, Human
guggcucacaccugucauucc

SEQ ID NO: 478700 - RNA, 19 nt, Human
guggcucacaccugugauc

SEQ ID NO: 478701 - RNA, 21 nt, Human
guggcucacaccugugauccc

SEQ ID NO: 478702 - RNA, 22 nt, Human
guggcucacaccugugauccca

SEQ ID NO: 478703 - RNA, 22 nt, Human
guggcucacaccugugaucuca

SEQ ID NO: 478704 - RNA, 22 nt, Human
guggcucacaccuguggaaucc

SEQ ID NO: 478705 - RNA, 22 nt, Human
guggcucacaccuguguucuca

SEQ ID NO: 478706 - RNA, 21 nt, Human
guggcucacaccuuaauccca

SEQ ID NO: 478707 - RNA, 23 nt, Human
guggcucacaccuuguaauccca

SEQ ID NO: 478708 - RNA, 22 nt, Human
guggcucacaccuuuaauccca

SEQ ID NO: 478709 - RNA, 22 nt, Human
guggcucacaccuuuaauccua

SEQ ID NO: 478710 - RNA, 22 nt, Human
guggcucacacguguaauccca

SEQ ID NO: 478711 - RNA, 22 nt, Human
guggcucacacuuauaauccca

SEQ ID NO: 478712 - RNA, 22 nt, Human
guggcucacacuuauaauccua

SEQ ID NO: 478713 - RNA, 19 nt, Human
guggcucacacuuguaacc

SEQ ID NO: 478714 - RNA, 19 nt, Human
guggcucacacuuguaauc

SEQ ID NO: 478715 - RNA, 22 nt, Human
guggcucacacuuguaauccca

SEQ ID NO: 478716 - RNA, 32 nt, Human
guggcucacagaacccuuggagccaauggaga

SEQ ID NO: 478717 - RNA, 22 nt, Human
guggcucacagcuauaaucuca

SEQ ID NO: 478718 - RNA, 31 nt, Human
guggcucacagcuauaaucucagcacuuugg

SEQ ID NO: 478719 - RNA, 31 nt, Human
guggcucacagcuuugaaccugccaaaggac

SEQ ID NO: 478720 - RNA, 22 nt, Human
guggcucacaucuguaacccca

SEQ ID NO: 478721 - RNA, 18 nt, Human
guggcucacaucuguaau

SEQ ID NO: 478722 - RNA, 22 nt, Human
guggcucacaucuguaauacca

SEQ ID NO: 478723 - RNA, 19 nt, Human
guggcucacaucuguaauc

SEQ ID NO: 478724 - RNA, 22 nt, Human
guggcucacaucuguaauccca

SEQ ID NO: 478725 - RNA, 22 nt, Human
guggcucacaucuguaaucuca

SEQ ID NO: 478726 - RNA, 22 nt, Human
guggcucacauguguaauccca

SEQ ID NO: 478727 - RNA, 22 nt, Human
guggcucacauucguaauccca

SEQ ID NO: 478728 - RNA, 23 nt, Human
guggcucacccccuguaauccca

SEQ ID NO: 478729 - RNA, 19 nt, Human
guggcucaccccuguaauc

SEQ ID NO: 478730 - RNA, 22 nt, Human
guggcucaccccuguaauccca

SEQ ID NO: 478731 - RNA, 22 nt, Human
guggcucaccccuguaauccua

SEQ ID NO: 478732 - RNA, 22 nt, Human
guggcucaccccuguaaucuca

SEQ ID NO: 478733 - RNA, 22 nt, Human
guggcucaccccuguaauucca

SEQ ID NO: 478734 - RNA, 32 nt, Human
guggcucacccuagauuguggcccagaucuca

SEQ ID NO: 478735 - RNA, 32 nt, Human
guggcucaccucucugccucuccagaugugag

SEQ ID NO: 478736 - RNA, 19 nt, Human
guggcucaccucuguaauc

SEQ ID NO: 478737 - RNA, 22 nt, Human
guggcucaccucuguaauccca

SEQ ID NO: 478738 - RNA, 32 nt, Human
guggcucaccuguaaucccaacacuuugggag

SEQ ID NO: 478739 - RNA, 32 nt, Human
guggcucaccuguaaucccagcacuuugggag

SEQ ID NO: 478740 - RNA, 22 nt, Human
guggcucacgacuguaauucca

SEQ ID NO: 478741 - RNA, 22 nt, Human
guggcucacgcauguaauccca

SEQ ID NO: 478742 - RNA, 22 nt, Human
guggcucacgcauguaauccua

SEQ ID NO: 478743 - RNA, 22 nt, Human
guggcucacgccacuaauccca

SEQ ID NO: 478744 - RNA, 22 nt, Human
guggcucacgccaguaauccca

SEQ ID NO: 478745 - RNA, 32 nt, Human
guggcucacgcccaauacuuugggagaccaag

SEQ ID NO: 478746 - RNA, 22 nt, Human
guggcucacgcccguaauccca

SEQ ID NO: 478747 - RNA, 22 nt, Human
guggcucacgccgguaauccca

SEQ ID NO: 478748 - RNA, 22 nt, Human
guggcucacgccuauaauccca

SEQ ID NO: 478749 - RNA, 22 nt, Human
guggcucacgccuauaauccua

SEQ ID NO: 478750 - RNA, 22 nt, Human
guggcucacgccuauaaucuca

SEQ ID NO: 478751 - RNA, 22 nt, Human
guggcucacgccuauaauucca

SEQ ID NO: 478752 - RNA, 22 nt, Human
guggcucacgccuaugauccca

SEQ ID NO: 478753 - RNA, 22 nt, Human
guggcucacgccucuaauccca

SEQ ID NO: 478754 - RNA, 22 nt, Human
guggcucacgccugcaauccca

SEQ ID NO: 478755 - RNA, 22 nt, Human
guggcucacgccuguaaaccca

SEQ ID NO: 478756 - RNA, 22 nt, Human
guggcucacgccuguaacccca

SEQ ID NO: 478757 - RNA, 22 nt, Human
guggcucacgccuguaaccuca

SEQ ID NO: 478758 - RNA, 22 nt, Human
guggcucacgccuguaauacca

SEQ ID NO: 478759 - RNA, 19 nt, Human
guggcucacgccuguaauc

SEQ ID NO: 478760 - RNA, 20 nt, Human
guggcucacgccuguaaucc

SEQ ID NO: 478761 - RNA, 32 nt, Human
guggcucacgccuguaauccagcacuuuggga

SEQ ID NO: 478762 - RNA, 21 nt, Human
guggcucacgccuguaauccc

SEQ ID NO: 478763 - RNA, 22 nt, Human
guggcucacgccuguaauccca

SEQ ID NO: 478764 - RNA, 22 nt, Human
guggcucacgccuguaauccua

SEQ ID NO: 478765 - RNA, 22 nt, Human
guggcucacgccuguaaucgca

SEQ ID NO: 478766 - RNA, 22 nt, Human
guggcucacgccuguaaucuca

SEQ ID NO: 478767 - RNA, 22 nt, Human
guggcucacgccuguaauucca

SEQ ID NO: 478768 - RNA, 22 nt, Human
guggcucacgccuguaguccca

SEQ ID NO: 478769 - RNA, 32 nt, Human
guggcucacgccuguaucccagcacuuuggga

SEQ ID NO: 478770 - RNA, 32 nt, Human
guggcucacgccuguauuccagcacuuuggga

SEQ ID NO: 478771 - RNA, 22 nt, Human
guggcucacgccugucauccca

SEQ ID NO: 478772 - RNA, 22 nt, Human
guggcucacgccugugauccca

SEQ ID NO: 478773 - RNA, 22 nt, Human
guggcucacgccuguuauccca

SEQ ID NO: 478774 - RNA, 22 nt, Human
guggcucacgcuuauaauccca

SEQ ID NO: 478775 - RNA, 24 nt, Human
guggcucacgcuuauguaguccca

SEQ ID NO: 478776 - RNA, 22 nt, Human
guggcucacgcuuguaauccca

SEQ ID NO: 478777 - RNA, 22 nt, Human
guggcucacgcuuguaaucgca

SEQ ID NO: 478778 - RNA, 22 nt, Human
guggcucacgcuuguaauucca

SEQ ID NO: 478779 - RNA, 22 nt, Human
guggcucacguauguaauccca

SEQ ID NO: 478780 - RNA, 22 nt, Human
guggcucacgucuauaauccca

SEQ ID NO: 478781 - RNA, 19 nt, Human
guggcucacgucuguaauc

SEQ ID NO: 478782 - RNA, 22 nt, Human
guggcucacgucuguaauccca

SEQ ID NO: 478783 - RNA, 22 nt, Human
guggcucacguuuguaauccca

SEQ ID NO: 478784 - RNA, 22 nt, Human
guggcucacuacucuaauucca

SEQ ID NO: 478785 - RNA, 32 nt, Human
guggcucacuccguaauuccggcacuuuggga

SEQ ID NO: 478786 - RNA, 19 nt, Human
guggcucacuccuguaauc

SEQ ID NO: 478787 - RNA, 20 nt, Human
guggcucacuccuguaaucc

SEQ ID NO: 478788 - RNA, 21 nt, Human
guggcucacuccuguaauccc

SEQ ID NO: 478789 - RNA, 22 nt, Human
guggcucacuccuguaauccca

SEQ ID NO: 478790 - RNA, 22 nt, Human
guggcucacuccuguaauccua

SEQ ID NO: 478791 - RNA, 22 nt, Human
guggcucacuccuguaaucuca

SEQ ID NO: 478792 - RNA, 22 nt, Human
guggcucacuccuguaguccca

SEQ ID NO: 478793 - RNA, 22 nt, Human
guggcucacucuuguaauccca

SEQ ID NO: 478794 - RNA, 32 nt, Human
guggcucacugcagccuccaccuccugggcuc

SEQ ID NO: 478795 - RNA, 32 nt, Human
guggcucacugcagccuccaucucccggggcu

SEQ ID NO: 478796 - RNA, 22 nt, Human
guggcucagaccuauaauccca

SEQ ID NO: 478797 - RNA, 32 nt, Human
guggcucagagacaggacccugguuuuaaauc

SEQ ID NO: 478798 - RNA, 32 nt, Human
guggcucagagauaggacccugguuuuaaauc

SEQ ID NO: 478799 - RNA, 32 nt, Human
guggcucagcaacagucagaggcccucagaca

SEQ ID NO: 478800 - RNA, 22 nt, Human
guggcucagccuuguaauccca

SEQ ID NO: 478801 - RNA, 21 nt, Human
guggcucagcuucuaauccca

SEQ ID NO: 478802 - RNA, 19 nt, Human
guggcucaggccuguaauc

SEQ ID NO: 478803 - RNA, 22 nt, Human
guggcucaggccuguaauccca

SEQ ID NO: 478804 - RNA, 22 nt, Human
guggcucaggccuguaauccua

SEQ ID NO: 478805 - RNA, 32 nt, Human
guggcucagggaccagcuuggggaaggaaagg

SEQ ID NO: 478806 - RNA, 32 nt, Human
guggcucaguggaaagagagcaggcaucugua

SEQ ID NO: 478807 - RNA, 28 nt, Human
guggcucauaaagacucaaagcuguaua

SEQ ID NO: 478808 - RNA, 22 nt, Human
guggcucauaccuauaauccua

SEQ ID NO: 478809 - RNA, 19 nt, Human
guggcucauaccuguaauc

SEQ ID NO: 478810 - RNA, 22 nt, Human
guggcucauaccuguaauccca

SEQ ID NO: 478811 - RNA, 22 nt, Human
guggcucauaccuguaauccua

SEQ ID NO: 478812 - RNA, 22 nt, Human
guggcucauaccuguaaugcca

SEQ ID NO: 478813 - RNA, 22 nt, Human
guggcucauaccuuuaauccca

SEQ ID NO: 478814 - RNA, 22 nt, Human
guggcucauacguguaauccca

SEQ ID NO: 478815 - RNA, 21 nt, Human
guggcucauacuuguaauccc

SEQ ID NO: 478816 - RNA, 19 nt, Human
guggcucaucccuguaauc

SEQ ID NO: 478817 - RNA, 22 nt, Human
guggcucaucccuguaauccca

SEQ ID NO: 478818 - RNA, 22 nt, Human
guggcucaucccuguaauucca

SEQ ID NO: 478819 - RNA, 22 nt, Human
guggcucaugacuauaauccca

SEQ ID NO: 478820 - RNA, 26 nt, Human
guggcucaugcacaccuguaauccca

SEQ ID NO: 478821 - RNA, 32 nt, Human
guggcucaugcacaccuguaaucccaaagugc

SEQ ID NO: 478822 - RNA, 22 nt, Human
guggcucaugcacguaauccca

SEQ ID NO: 478823 - RNA, 32 nt, Human
guggcucaugccaguaauugcagccucccuua

SEQ ID NO: 478824 - RNA, 22 nt, Human
guggcucaugcccauaauccca

SEQ ID NO: 478825 - RNA, 22 nt, Human
guggcucaugcccguaauccca

SEQ ID NO: 478826 - RNA, 22 nt, Human
guggcucaugccgauaauccca

SEQ ID NO: 478827 - RNA, 32 nt, Human
guggcucaugccuaauccuagcacuuugggag

SEQ ID NO: 478828 - RNA, 21 nt, Human
guggcucaugccuauaauccc

SEQ ID NO: 478829 - RNA, 22 nt, Human
guggcucaugccuauaauccca

SEQ ID NO: 478830 - RNA, 22 nt, Human
guggcucaugccuauaauccua

SEQ ID NO: 478831 - RNA, 22 nt, Human
guggcucaugccuauaaucuca

SEQ ID NO: 478832 - RNA, 22 nt, Human
guggcucaugccuauaauucca

SEQ ID NO: 478833 - RNA, 32 nt, Human
guggcucaugccuauauuccagcacuuuggga

SEQ ID NO: 478834 - RNA, 19 nt, Human
guggcucaugccucuaauc

SEQ ID NO: 478835 - RNA, 22 nt, Human
guggcucaugccucuaauccca

SEQ ID NO: 478836 - RNA, 32 nt, Human
guggcucaugccugaaucucagcacuuuggga

SEQ ID NO: 478837 - RNA, 32 nt, Human
guggcucaugccugccuguaaucccagcacug

SEQ ID NO: 478838 - RNA, 22 nt, Human
guggcucaugccuguaaaccca

SEQ ID NO: 478839 - RNA, 22 nt, Human
guggcucaugccuguaacccca

SEQ ID NO: 478840 - RNA, 22 nt, Human
guggcucaugccuguaagccca

SEQ ID NO: 478841 - RNA, 19 nt, Human
guggcucaugccuguaauc

SEQ ID NO: 478842 - RNA, 32 nt, Human
guggcucaugccuguaaucaaucccagcacuu

SEQ ID NO: 478843 - RNA, 20 nt, Human
guggcucaugccuguaaucc

SEQ ID NO: 478844 - RNA, 32 nt, Human
guggcucaugccuguaauccagcacuuuggga

SEQ ID NO: 478845 - RNA, 21 nt, Human
guggcucaugccuguaauccc

SEQ ID NO: 478846 - RNA, 22 nt, Human
guggcucaugccuguaauccca

SEQ ID NO: 478847 - RNA, 22 nt, Human
guggcucaugccuguaauccua

SEQ ID NO: 478848 - RNA, 22 nt, Human
guggcucaugccuguaaucgca

SEQ ID NO: 478849 - RNA, 22 nt, Human
guggcucaugccuguaaucuca

SEQ ID NO: 478850 - RNA, 19 nt, Human
guggcucaugccuguaauu

SEQ ID NO: 478851 - RNA, 22 nt, Human
guggcucaugccuguaauucca

SEQ ID NO: 478852 - RNA, 20 nt, Human
guggcucaugccuguagucc

SEQ ID NO: 478853 - RNA, 22 nt, Human
guggcucaugccuguaguccca

SEQ ID NO: 478854 - RNA, 24 nt, Human
guggcucaugccuguauaauccca

SEQ ID NO: 478855 - RNA, 32 nt, Human
guggcucaugccuguauccagcacuuugggag

SEQ ID NO: 478856 - RNA, 32 nt, Human
guggcucaugccuguaucccagcacuuuggga

SEQ ID NO: 478857 - RNA, 22 nt, Human
guggcucaugccuguauuccca

SEQ ID NO: 478858 - RNA, 19 nt, Human
guggcucaugccugucauc

SEQ ID NO: 478859 - RNA, 22 nt, Human
guggcucaugccugucauccca

SEQ ID NO: 478860 - RNA, 19 nt, Human
guggcucaugccugugauc

SEQ ID NO: 478861 - RNA, 22 nt, Human
guggcucaugccugugauccca

SEQ ID NO: 478862 - RNA, 20 nt, Human
guggcucaugccuguggucc

SEQ ID NO: 478863 - RNA, 32 nt, Human
guggcucaugccuuaaucccagcacuuuggga

SEQ ID NO: 478864 - RNA, 32 nt, Human
guggcucaugccuuaaucccagcacuuuugga

SEQ ID NO: 478865 - RNA, 19 nt, Human
guggcucaugccuuuaauc

SEQ ID NO: 478866 - RNA, 22 nt, Human
guggcucaugccuuuaauccca

SEQ ID NO: 478867 - RNA, 19 nt, Human
guggcucaugcuuguaauc

SEQ ID NO: 478868 - RNA, 22 nt, Human
guggcucaugcuuguaauccca

SEQ ID NO: 478869 - RNA, 22 nt, Human
guggcucaugcuuguaauccua

SEQ ID NO: 478870 - RNA, 22 nt, Human
guggcucaugcuuguaaucuca

SEQ ID NO: 478871 - RNA, 22 nt, Human
guggcucaugcuuguaauucca

SEQ ID NO: 478872 - RNA, 32 nt, Human
guggcucauggcuacgcuccagccccgggugu

SEQ ID NO: 478873 - RNA, 32 nt, Human
guggcucaugggcggaggagggcagauuacuu

SEQ ID NO: 478874 - RNA, 22 nt, Human
guggcucauguauguaauccua

SEQ ID NO: 478875 - RNA, 22 nt, Human
guggcucaugucuauaauccca

SEQ ID NO: 478876 - RNA, 22 nt, Human
guggcucaugucuguaauccca

SEQ ID NO: 478877 - RNA, 22 nt, Human
guggcucauguguguaauccca

SEQ ID NO: 478878 - RNA, 22 nt, Human
guggcucauguuuguaauccua

SEQ ID NO: 478879 - RNA, 19 nt, Human
guggcucauuccuguaauc

SEQ ID NO: 478880 - RNA, 22 nt, Human
guggcucauuccuguaauccca

SEQ ID NO: 478881 - RNA, 22 nt, Human
guggcucccaccuauaauccca

SEQ ID NO: 478882 - RNA, 22 nt, Human
guggcucccaccuauaauccua

SEQ ID NO: 478883 - RNA, 22 nt, Human
guggcucccaccuguaaucuca

SEQ ID NO: 478884 - RNA, 22 nt, Human
guggcucccaccuguaguccca

SEQ ID NO: 478885 - RNA, 17 nt, Human
guggcucccagcagagg

SEQ ID NO: 478886 - RNA, 32 nt, Human
guggcuccccacuuccgacuggcucccuucgg

SEQ ID NO: 478887 - RNA, 20 nt, Human
guggcucccccagagcacuu

SEQ ID NO: 478888 - RNA, 32 nt, Human
guggcuccccucaucagcuccccacaccaguc

SEQ ID NO: 478889 - RNA, 22 nt, Human
guggcucccgccuguaauccca

SEQ ID NO: 478890 - RNA, 22 nt, Human
guggcucccgccuguaauccua

SEQ ID NO: 478891 - RNA, 32 nt, Human
guggcucccugcagcggauccugggugcaggg

SEQ ID NO: 478892 - RNA, 32 nt, Human
guggcucccugccuaugccucuaagcuguauu

SEQ ID NO: 478893 - RNA, 22 nt, Human
guggcuccgaccuguaauccca

SEQ ID NO: 478894 - RNA, 32 nt, Human
guggcuccgagggcgggagcugagccgggccc

SEQ ID NO: 478895 - RNA, 32 nt, Human
guggcuccgggacacgccagcuccagcaggcg

SEQ ID NO: 478896 - RNA, 32 nt, Human
guggcuccuaaaggaggcagaucuuuccaagg

SEQ ID NO: 478897 - RNA, 32 nt, Human
guggcuccucaagccugccuguccugcagagu

SEQ ID NO: 478898 - RNA, 32 nt, Human
guggcuccuccaccaccuucaaacccaggaca

SEQ ID NO: 478899 - RNA, 32 nt, Human
guggcuccuccccucgcuccucgcccugggcc

SEQ ID NO: 478900 - RNA, 19 nt, Human
guggcuccugccuguaauc

SEQ ID NO: 478901 - RNA, 22 nt, Human
guggcuccugccuguaauccca

SEQ ID NO: 478902 - RNA, 22 nt, Human
guggcuccugccuguaaucgca

SEQ ID NO: 478903 - RNA, 22 nt, Human
guggcuccugccuguauuccca

SEQ ID NO: 478904 - RNA, 32 nt, Human
guggcuccugggagacuuuuccucccugccuc

SEQ ID NO: 478905 - RNA, 32 nt, Human
guggcuccuuucucccuuccucuuggccucca

SEQ ID NO: 478906 - RNA, 32 nt, Human
guggcucgccuguaaucccagcacuuugggag

SEQ ID NO: 478907 - RNA, 22 nt, Human
guggcucgcgccuguaauccca

SEQ ID NO: 478908 - RNA, 22 nt, Human
guggcucgcgcuugugauccca

SEQ ID NO: 478909 - RNA, 32 nt, Human
guggcucggcaggccggccauggagccaggca

SEQ ID NO: 478910 - RNA, 22 nt, Human
guggcucgggccuguaauccca

SEQ ID NO: 478911 - RNA, 20 nt, Human
guggcucguaccuguaaucc

SEQ ID NO: 478912 - RNA, 32 nt, Human
guggcucguaccuguaauccagcacuuuggga

SEQ ID NO: 478913 - RNA, 19 nt, Human
guggcucgugccuguaauc

SEQ ID NO: 478914 - RNA, 22 nt, Human
guggcucgugccuguaauccca

SEQ ID NO: 478915 - RNA, 22 nt, Human
guggcucgugccuguaaucuca

SEQ ID NO: 478916 - RNA, 22 nt, Human
guggcucgugccuguaguccca

SEQ ID NO: 478917 - RNA, 22 nt, Human
guggcucgugcuuguaauccca

SEQ ID NO: 478918 - RNA, 32 nt, Human
guggcucuagaugaccuagaguucugggacug

SEQ ID NO: 478919 - RNA, 32 nt, Human
guggcucuagcucagggaaagccaggcccacc

SEQ ID NO: 478920 - RNA, 32 nt, Human
guggcucuaguuuuuggaccucaguaaugcca

SEQ ID NO: 478921 - RNA, 32 nt, Human
guggcucuccugauucuucacucuggggugcg

SEQ ID NO: 478922 - RNA, 22 nt, Human
guggcucucgccuauaauccca

SEQ ID NO: 478923 - RNA, 22 nt, Human
guggcucucgccuguaauccca

SEQ ID NO: 478924 - RNA, 22 nt, Human
guggcucucgccuguaaucuca

SEQ ID NO: 478925 - RNA, 32 nt, Human
guggcucugaagcugccuucagacaaggcuag

SEQ ID NO: 478926 - RNA, 32 nt, Human
guggcucugcagccccugcuccuuucugcggc

SEQ ID NO: 478927 - RNA, 32 nt, Human
guggcucugcguauacuacacacucauucucc

SEQ ID NO: 478928 - RNA, 32 nt, Human
guggcucuggacugcgcggacguuggcgucag

SEQ ID NO: 478929 - RNA, 32 nt, Human
guggcucugggccccaucucuccacuguccug

SEQ ID NO: 478930 - RNA, 32 nt, Human
guggcucugugggaaggagggagccgggagcc

SEQ ID NO: 478931 - RNA, 19 nt, Human
guggcucuugccuguaauc

SEQ ID NO: 478932 - RNA, 22 nt, Human
guggcucuugccuguaauccca

SEQ ID NO: 478933 - RNA, 22 nt, Human
guggcucuugucuguaauccca

SEQ ID NO: 478934 - RNA, 25 nt, Human
guggcucuugugcccugaaaucuca

SEQ ID NO: 478935 - RNA, 22 nt, Human
guggcugaagccugugauccca

SEQ ID NO: 478936 - RNA, 19 nt, Human
guggcugacaccuguaauc

SEQ ID NO: 478937 - RNA, 22 nt, Human
guggcugacaccuguaauccca

SEQ ID NO: 478938 - RNA, 19 nt, Human
guggcugacaucuguaauc

SEQ ID NO: 478939 - RNA, 21 nt, Human
guggcugacaucuguaauccc

SEQ ID NO: 478940 - RNA, 32 nt, Human
guggcugaccucugccccagcccucuuucuuc

SEQ ID NO: 478941 - RNA, 22 nt, Human
guggcugacgccuguaauccca

SEQ ID NO: 478942 - RNA, 32 nt, Human
guggcugagaaacugggcuggagucaggaggc

SEQ ID NO: 478943 - RNA, 32 nt, Human
guggcugagacgugggcucuccagggagccaa

SEQ ID NO: 478944 - RNA, 32 nt, Human
guggcugagcacuggggugggcuuggcacugu

SEQ ID NO: 478945 - RNA, 32 nt, Human
guggcugagcccccagccccuggaauaugcag

SEQ ID NO: 478946 - RNA, 20 nt, Human
guggcugagcucacccagca

SEQ ID NO: 478947 - RNA, 32 nt, Human
guggcugaggcaggagggauugcuugaaccug

SEQ ID NO: 478948 - RNA, 32 nt, Human
guggcugaggcccugaguguccagccacaugg

SEQ ID NO: 478949 - RNA, 32 nt, Human
guggcugagguggacggaucaccugaggucag

SEQ ID NO: 478950 - RNA, 17 nt, Human
guggcugagugguucua

SEQ ID NO: 478951 - RNA, 22 nt, Human
guggcugaugccuauaauccca

SEQ ID NO: 478952 - RNA, 22 nt, Human
guggcugaugccuguaauccca

SEQ ID NO: 478953 - RNA, 22 nt, Human
guggcugaugccugucauccca

SEQ ID NO: 478954 - RNA, 32 nt, Human
guggcugcaaggaagggaaacagucuauuaua

SEQ ID NO: 478955 - RNA, 18 nt, Human
guggcugcaccacuucca

SEQ ID NO: 478956 - RNA, 32 nt, Human
guggcugcagccugugcccccagcagguaggc

SEQ ID NO: 478957 - RNA, 32 nt, Human
guggcugcaggccuuuguuuuccaauggugcu

SEQ ID NO: 478958 - RNA, 32 nt, Human
guggcugcaguaagccaagaucacaccacugg

SEQ ID NO: 478959 - RNA, 32 nt, Human
guggcugcagugagcugagaucgugccacugc

SEQ ID NO: 478960 - RNA, 32 nt, Human
guggcugcagugagcugugaugugcccuuaug

SEQ ID NO: 478961 - RNA, 32 nt, Human
guggcugcagugguagccugaggaaggccaag

SEQ ID NO: 478962 - RNA, 32 nt, Human
guggcugcauuugugguacaggcuccucuucc

SEQ ID NO: 478963 - RNA, 32 nt, Human
guggcugccacaucuaccugcaagggccaggc

SEQ ID NO: 478964 - RNA, 32 nt, Human
guggcugccagcccacugccuccugccugggg

SEQ ID NO: 478965 - RNA, 32 nt, Human
guggcugccaucauuccuugguuugugacugc

SEQ ID NO: 478966 - RNA, 32 nt, Human
guggcugccauggaggaggacaagcucuuauc

SEQ ID NO: 478967 - RNA, 32 nt, Human
guggcugccgccgcaccagccucaguggcaga

SEQ ID NO: 478968 - RNA, 28 nt, Human
guggcugccggagcugccuccuccuccu

SEQ ID NO: 478969 - RNA, 32 nt, Human
guggcugccuaaagugcuucuuuucuaaccca

SEQ ID NO: 478970 - RNA, 32 nt, Human
guggcugccucugggggcaccagcaccuucug

SEQ ID NO: 478971 - RNA, 31 nt, Human
guggcugccugagggagucacuuguaugguc

SEQ ID NO: 478972 - RNA, 32 nt, Human
guggcugccugccugccugccugccucaguuu

SEQ ID NO: 478973 - RNA, 32 nt, Human
guggcugccugggacuggggccucucuccauc

SEQ ID NO: 478974 - RNA, 32 nt, Human
guggcugccugggcaccucucccaggaagugg

SEQ ID NO: 478975 - RNA, 31 nt, Human
guggcugccuucucugggccauggaucacac

SEQ ID NO: 478976 - RNA, 32 nt, Human
guggcugcggccguagccuguggcgggcaagc

SEQ ID NO: 478977 - RNA, 32 nt, Human
guggcugcuccagcuacugggcauuuugucug

SEQ ID NO: 478978 - RNA, 32 nt, Human
guggcugcugcuugcuugccuccucguggaga

SEQ ID NO: 478979 - RNA, 32 nt, Human
guggcuggaaacccaggcagggcugcaccaca

SEQ ID NO: 478980 - RNA, 32 nt, Human
guggcuggaagcacugaaccuaccucauccuc

SEQ ID NO: 478981 - RNA, 21 nt, Human
guggcuggacaggacugcagc

SEQ ID NO: 478982 - RNA, 22 nt, Human
guggcuggcaccuguaauccca

SEQ ID NO: 478983 - RNA, 22 nt, Human
guggcuggcaccuguaguccca

SEQ ID NO: 478984 - RNA, 32 nt, Human
guggcuggcaggugggugaggggcaggcuugg

SEQ ID NO: 478985 - RNA, 32 nt, Human
guggcuggccagauucugcccuuaggauccaa

SEQ ID NO: 478986 - RNA, 32 nt, Human
guggcuggccauggcgcuguucuacgucgcgc

SEQ ID NO: 478987 - RNA, 22 nt, Human
guggcuggcgccuguaauccca

SEQ ID NO: 478988 - RNA, 22 nt, Human
guggcuggcgccuguaguccca

SEQ ID NO: 478989 - RNA, 32 nt, Human
guggcuggcucucggcccugcccagcuuuguu

SEQ ID NO: 478990 - RNA, 32 nt, Human
guggcuggcugugccaucgucauagugcacag

SEQ ID NO: 478991 - RNA, 32 nt, Human
guggcugggaacaccuuccaccaugaccaccu

SEQ ID NO: 478992 - RNA, 32 nt, Human
guggcugggacuacaauugugagccaccaugc

SEQ ID NO: 478993 - RNA, 19 nt, Human
guggcugggagggcuccag

SEQ ID NO: 478994 - RNA, 32 nt, Human
guggcugggagguggggugcugaagcuugaag

SEQ ID NO: 478995 - RNA, 32 nt, Human
guggcugggauuacaggcaugugccaccacac

SEQ ID NO: 478996 - RNA, 32 nt, Human
guggcugggauuacaggugugcgccaccaugc

SEQ ID NO: 478997 - RNA, 32 nt, Human
guggcugggauuauaggcgugcaccaccacgc

SEQ ID NO: 478998 - RNA, 32 nt, Human
guggcugggauuauaggugcccaucaccacgc

SEQ ID NO: 478999 - RNA, 32 nt, Human
guggcugggauuauaggugugugccaccaugc

SEQ ID NO: 479000 - RNA, 32 nt, Human
guggcugggcaggcaaguucugugacaaagau

SEQ ID NO: 479001 - RNA, 32 nt, Human
guggcugggcagggcugggcagggccgcggac

SEQ ID NO: 479002 - RNA, 32 nt, Human
guggcugggccagcaggggcccucacucuuga

SEQ ID NO: 479003 - RNA, 20 nt, Human
guggcugggccucaccagca

SEQ ID NO: 479004 - RNA, 32 nt, Human
guggcugggcucuguguguggccugugucccc

SEQ ID NO: 479005 - RNA, 32 nt, Human
guggcugggcuggagugcaauggcgcgaucuu

SEQ ID NO: 479006 - RNA, 32 nt, Human
guggcugggcugggaauggagcugucagcacu

SEQ ID NO: 479007 - RNA, 32 nt, Human
guggcuggggccaagccccgagggccccugca

SEQ ID NO: 479008 - RNA, 32 nt, Human
guggcuggggccugacacugagcuguagggaa

SEQ ID NO: 479009 - RNA, 32 nt, Human
guggcuggggccugggagaggccaggugaaug

SEQ ID NO: 479010 - RNA, 32 nt, Human
guggcugggggaggcaggcucacuggccauuu

SEQ ID NO: 479011 - RNA, 32 nt, Human
guggcugggugagcgcucaucagucccagaca

SEQ ID NO: 479012 - RNA, 32 nt, Human
guggcuggucucaaacuccugggcucaaguga

SEQ ID NO: 479013 - RNA, 32 nt, Human
guggcuggucugguucucauguaaacccacuc

SEQ ID NO: 479014 - RNA, 32 nt, Human
guggcuggugaggcugcacagagcagauucaa

SEQ ID NO: 479015 - RNA, 22 nt, Human
guggcuggugccuguaguccca

SEQ ID NO: 479016 - RNA, 32 nt, Human
guggcuggugucauucugggucugacuggagc

SEQ ID NO: 479017 - RNA, 22 nt, Human
guggcuggugucuguaauccca

SEQ ID NO: 479018 - RNA, 32 nt, Human
guggcuguaggccuuuguuuuccaauggugcu

SEQ ID NO: 479019 - RNA, 32 nt, Human
guggcugucagacccgaagggguggggagcca

SEQ ID NO: 479020 - RNA, 32 nt, Human
guggcugucuacccacccucccuucuagcaga

SEQ ID NO: 479021 - RNA, 32 nt, Human
guggcugucucagggauacugccauuuguuuu

SEQ ID NO: 479022 - RNA, 32 nt, Human
guggcugugcaggauucaggguuugcagaaau

SEQ ID NO: 479023 - RNA, 32 nt, Human
guggcugugcccucaguugcccccagggcugg

SEQ ID NO: 479024 - RNA, 32 nt, Human
guggcuguggacuaagggagaaggauuaaggg

SEQ ID NO: 479025 - RNA, 32 nt, Human
guggcuguggcuuugcccuuuggccuuugcug

SEQ ID NO: 479026 - RNA, 32 nt, Human
guggcugugggacagagguuggaaggaaagga

SEQ ID NO: 479027 - RNA, 32 nt, Human
guggcugugggcaccaggcaugggacugagcc

SEQ ID NO: 479028 - RNA, 32 nt, Human
guggcuguggugaggaguaugucgccugccuc

SEQ ID NO: 479029 - RNA, 32 nt, Human
guggcugugugccgggacaagauguuuguauu

SEQ ID NO: 479030 - RNA, 32 nt, Human
guggcuguguggagcucagcuguguugugugg

SEQ ID NO: 479031 - RNA, 32 nt, Human
guggcuguguucucuccauggguggggucggc

SEQ ID NO: 479032 - RNA, 19 nt, Human
guggcuguuucucccggca

SEQ ID NO: 479033 - RNA, 32 nt, Human
guggcuguuuuuaaaaaguaaaguucuuagag

SEQ ID NO: 479034 - RNA, 20 nt, Human
guggcuuaaaauaaauccca

SEQ ID NO: 479035 - RNA, 32 nt, Human
guggcuuaaucugaagguucucagucaaauuc

SEQ ID NO: 479036 - RNA, 22 nt, Human
guggcuuacaccuauaauccca

SEQ ID NO: 479037 - RNA, 20 nt, Human
guggcuuacaccuguaaccc

SEQ ID NO: 479038 - RNA, 22 nt, Human
guggcuuacaccuguaacccca

SEQ ID NO: 479039 - RNA, 19 nt, Human
guggcuuacaccuguaauc

SEQ ID NO: 479040 - RNA, 22 nt, Human
guggcuuacaccuguaauccca

SEQ ID NO: 479041 - RNA, 22 nt, Human
guggcuuacaccuguaauccua

SEQ ID NO: 479042 - RNA, 22 nt, Human
guggcuuacacggugaaaccca

SEQ ID NO: 479043 - RNA, 32 nt, Human
guggcuuacacggugaaacccacgucucuacu

SEQ ID NO: 479044 - RNA, 20 nt, Human
guggcuuacacuuguaaccc

SEQ ID NO: 479045 - RNA, 20 nt, Human
guggcuuacagaugaaccca

SEQ ID NO: 479046 - RNA, 19 nt, Human
guggcuuacaucuguaauc

SEQ ID NO: 479047 - RNA, 22 nt, Human
guggcuuacaucuguaauccca

SEQ ID NO: 479048 - RNA, 22 nt, Human
guggcuuaccccuguaauccca

SEQ ID NO: 479049 - RNA, 22 nt, Human
guggcuuacgccuauaauccca

SEQ ID NO: 479050 - RNA, 22 nt, Human
guggcuuacgccuguaauccca

SEQ ID NO: 479051 - RNA, 22 nt, Human
guggcuuacgccuguaauccua

SEQ ID NO: 479052 - RNA, 22 nt, Human
guggcuuacgcuuguaguccca

SEQ ID NO: 479053 - RNA, 32 nt, Human
guggcuuaggccagggugggagcagugaacgg

SEQ ID NO: 479054 - RNA, 32 nt, Human
guggcuuaucuggagccaccugcccaagucuu

SEQ ID NO: 479055 - RNA, 22 nt, Human
guggcuuaugccuguaacccca

SEQ ID NO: 479056 - RNA, 19 nt, Human
guggcuuaugccuguaauc

SEQ ID NO: 479057 - RNA, 21 nt, Human
guggcuuaugccuguaauccc

SEQ ID NO: 479058 - RNA, 22 nt, Human
guggcuuaugccuguaauccca

SEQ ID NO: 479059 - RNA, 22 nt, Human
guggcuuaugccuguaauccua

SEQ ID NO: 479060 - RNA, 20 nt, Human
guggcuuaugccuguaaucu

SEQ ID NO: 479061 - RNA, 22 nt, Human
guggcuuaugccuguaaucuca

SEQ ID NO: 479062 - RNA, 22 nt, Human
guggcuuaugcuuguaauccca

SEQ ID NO: 479063 - RNA, 22 nt, Human
guggcuuauuccuguaauccca

SEQ ID NO: 479064 - RNA, 32 nt, Human
guggcuucaaacauuauggagaugucuuuaau

SEQ ID NO: 479065 - RNA, 32 nt, Human
guggcuucaaucuccccaccuaggaugucagc

SEQ ID NO: 479066 - RNA, 23 nt, Human
guggcuucacgccuguaauacca

SEQ ID NO: 479067 - RNA, 20 nt, Human
guggcuucacuuguaauccc

SEQ ID NO: 479068 - RNA, 26 nt, Human
guggcuucagaacuucagggcagcug

SEQ ID NO: 479069 - RNA, 32 nt, Human
guggcuucagauuggagaccagccugggacuu

SEQ ID NO: 479070 - RNA, 32 nt, Human
guggcuucagcaugucguccucggugaaaacc

SEQ ID NO: 479071 - RNA, 32 nt, Human
guggcuuccaccucagcucuagaagccugcuc

SEQ ID NO: 479072 - RNA, 27 nt, Human
guggcuuccaggccucagagcugugug

SEQ ID NO: 479073 - RNA, 32 nt, Human
guggcuucccuucucccuccaggccaaagugc

SEQ ID NO: 479074 - RNA, 32 nt, Human
guggcuuccucuuuucuugcugacccuucgga

SEQ ID NO: 479075 - RNA, 32 nt, Human
guggcuuccugccucugaagacagcacacaac

SEQ ID NO: 479076 - RNA, 32 nt, Human
guggcuuccuugcauccuccauccuguuacuc

SEQ ID NO: 479077 - RNA, 32 nt, Human
guggcuucucauuuuccauucccuucacugug

SEQ ID NO: 479078 - RNA, 32 nt, Human
guggcuucucucucagggguaacauuuacuuc

SEQ ID NO: 479079 - RNA, 32 nt, Human
guggcuucuguaaccagggcugucuucagaug

SEQ ID NO: 479080 - RNA, 32 nt, Human
guggcuucuguaaucccaggacuuugggaggc

SEQ ID NO: 479081 - RNA, 19 nt, Human
guggcuugaauauauccca

SEQ ID NO: 479082 - RNA, 32 nt, Human
guggcuugacaaucauuugagcuuugaaagca

SEQ ID NO: 479083 - RNA, 32 nt, Human
guggcuugaggcaggccguccuggagggggcu

SEQ ID NO: 479084 - RNA, 22 nt, Human
guggcuugcaccuguaauccca

SEQ ID NO: 479085 - RNA, 32 nt, Human
guggcuuggaguuuuguuguuguuuucuuggu

SEQ ID NO: 479086 - RNA, 32 nt, Human
guggcuuggcucugcuguggcccuccuggcug

SEQ ID NO: 479087 - RNA, 32 nt, Human
guggcuugggcaacagugagggaaauguugga

SEQ ID NO: 479088 - RNA, 20 nt, Human
guggcuugggcuucccagca

SEQ ID NO: 479089 - RNA, 32 nt, Human
guggcuugguuacugugacuguagcuggagug

SEQ ID NO: 479090 - RNA, 22 nt, Human
guggcuuguacccguaauccca

SEQ ID NO: 479091 - RNA, 20 nt, Human
guggcuugugccuguaaucc

SEQ ID NO: 479092 - RNA, 22 nt, Human
guggcuugugccuguaauccca

SEQ ID NO: 479093 - RNA, 22 nt, Human
guggcuuguuccuguaguccca

SEQ ID NO: 479094 - RNA, 32 nt, Human
guggcuuguuucaugguuuuuguauuuguguc

SEQ ID NO: 479095 - RNA, 32 nt, Human
guggcuuucccaagccuuggcaaaccagcuuc

SEQ ID NO: 479096 - RNA, 32 nt, Human
guggcuuuccugaggcagcagccuucguggca

SEQ ID NO: 479097 - RNA, 32 nt, Human
guggcuuucuuguggccccaugggaugcagcg

SEQ ID NO: 479098 - RNA, 32 nt, Human
guggcuuuggauuuccuuaugugucuuacagg

SEQ ID NO: 479099 - RNA, 32 nt, Human
guggcuuugugcggucuccuagggaaggggca

SEQ ID NO: 479100 - RNA, 32 nt, Human
guggcuuuucauggaugucucuagucagagaa

SEQ ID NO: 479101 - RNA, 32 nt, Human
guggcuuuucugcgaguucuucugccuccugc

SEQ ID NO: 479102 - RNA, 22 nt, Human
guggcuuuugccuguaauccca

SEQ ID NO: 479103 - RNA, 32 nt, Human
gugggaaaacagucagcuguccuggccaaagg

SEQ ID NO: 479104 - RNA, 24 nt, Human
gugggaaaaucacuugagcccagg

SEQ ID NO: 479105 - RNA, 24 nt, Human
gugggaaaaugacuugagcccagg

SEQ ID NO: 479106 - RNA, 32 nt, Human
gugggaaacaauucugguuuagugcaaacaug

SEQ ID NO: 479107 - RNA, 32 nt, Human
gugggaaacauccuggauuuuguuacuuggca

SEQ ID NO: 479108 - RNA, 32 nt, Human
gugggaaaccuucuagcaacaggaugacucug

SEQ ID NO: 479109 - RNA, 32 nt, Human
gugggaaacugaggcccagcuuggggaaggcc

SEQ ID NO: 479110 - RNA, 32 nt, Human
gugggaaagaaaugccuagaaaguguugucaa

SEQ ID NO: 479111 - RNA, 32 nt, Human
gugggaaagaggagcaggucuggagguuugug

SEQ ID NO: 479112 - RNA, 19 nt, Human
gugggaaagaggaggggga

SEQ ID NO: 479113 - RNA, 32 nt, Human
gugggaaagccucuaacagauccucaauucuu

SEQ ID NO: 479114 - RNA, 17 nt, Human
gugggaaaucucccagc

SEQ ID NO: 479115 - RNA, 32 nt, Human
gugggaaaugauuuaauuuuuccuauugcucu

SEQ ID NO: 479116 - RNA, 19 nt, Human
gugggaacagggaauugaa

SEQ ID NO: 479117 - RNA, 19 nt, Human
gugggaacauuaauuguca

SEQ ID NO: 479118 - RNA, 32 nt, Human
gugggaaccaauauguacauguuugcaauuau

SEQ ID NO: 479119 - RNA, 32 nt, Human
gugggaaccgggcacaacuaggaacaaugcca

SEQ ID NO: 479120 - RNA, 32 nt, Human
gugggaaccuguccguguuccugcguggaucc

SEQ ID NO: 479121 - RNA, 32 nt, Human
gugggaacgauggcagaugaucagggcuguau

SEQ ID NO: 479122 - RNA, 32 nt, Human
gugggaacugcagacauuccucucacagcuag

SEQ ID NO: 479123 - RNA, 32 nt, Human
gugggaacuggguggaacugaaaaggaagaaa

SEQ ID NO: 479124 - RNA, 32 nt, Human
gugggaacugucaugggugaucccagaauggg

SEQ ID NO: 479125 - RNA, 32 nt, Human
gugggaagagaagggaagccucuucaggguga

SEQ ID NO: 479126 - RNA, 32 nt, Human
gugggaagagaggaggccaggccaggcccuca

SEQ ID NO: 479127 - RNA, 32 nt, Human
gugggaagagggguuaaggugcagugaugaug

SEQ ID NO: 479128 - RNA, 32 nt, Human
gugggaagagugagccaggcaagaaagaaaag

SEQ ID NO: 479129 - RNA, 24 nt, Human
gugggaagaucacuugagcccagg

SEQ ID NO: 479130 - RNA, 24 nt, Human
gugggaagaucauuugagcccagg

SEQ ID NO: 479131 - RNA, 24 nt, Human
gugggaagaucccuugagcccagg

SEQ ID NO: 479132 - RNA, 22 nt, Human
gugggaagaucucuugagccca

SEQ ID NO: 479133 - RNA, 32 nt, Human
gugggaagaugccuuacgucugaucuugaugg

SEQ ID NO: 479134 - RNA, 24 nt, Human
gugggaagauggcuugagcccagg

SEQ ID NO: 479135 - RNA, 24 nt, Human
gugggaagauugccugagcucagg

SEQ ID NO: 479136 - RNA, 24 nt, Human
gugggaagauugcuugaacucagg

SEQ ID NO: 479137 - RNA, 24 nt, Human
gugggaagauugcuugagcccagg

SEQ ID NO: 479138 - RNA, 32 nt, Human
gugggaagauuggggaugggauccucacucag

SEQ ID NO: 479139 - RNA, 19 nt, Human
gugggaagcagcucugggg

SEQ ID NO: 479140 - RNA, 32 nt, Human
gugggaagccacggaagcagguucuuuauguc

SEQ ID NO: 479141 - RNA, 32 nt, Human
gugggaagccagggguuggagaaggugcuaca

SEQ ID NO: 479142 - RNA, 32 nt, Human
gugggaagccuguaaucccagcuacuugggag

SEQ ID NO: 479143 - RNA, 32 nt, Human
gugggaaggaaaggagcuuggcauugggagcc

SEQ ID NO: 479144 - RNA, 32 nt, Human
gugggaaggagagcgagccauaggggagugac

SEQ ID NO: 479145 - RNA, 32 nt, Human
gugggaaggagaggagugagugaaguagccug

SEQ ID NO: 479146 - RNA, 32 nt, Human
gugggaaggagagugucaaggacgaagaggag

SEQ ID NO: 479147 - RNA, 32 nt, Human
gugggaagggaugcuuucucuuugucgcccac

SEQ ID NO: 479148 - RNA, 32 nt, Human
gugggaaggggugauggaugaugaaccuggca

SEQ ID NO: 479149 - RNA, 32 nt, Human
gugggaagguaggugggaaaugacaagaugag

SEQ ID NO: 479150 - RNA, 32 nt, Human
gugggaaguggguuggagggaggccaggccgg

SEQ ID NO: 479151 - RNA, 32 nt, Human
gugggaauaucugggcaugcacugaagacacc

SEQ ID NO: 479152 - RNA, 32 nt, Human
gugggaaucaucgcucagguccucgcuccccu

SEQ ID NO: 479153 - RNA, 32 nt, Human
gugggaaucuuucaguugaaguacaauauguc

SEQ ID NO: 479154 - RNA, 32 nt, Human
gugggaaugaauuggcauugcaggaaagacag

SEQ ID NO: 479155 - RNA, 23 nt, Human
gugggaaugugacuugagcccag

SEQ ID NO: 479156 - RNA, 32 nt, Human
gugggaauuacagauaaacggaagccggcugg

SEQ ID NO: 479157 - RNA, 32 nt, Human
gugggaauucccaguuccuauccucugaguaa

SEQ ID NO: 479158 - RNA, 32 nt, Human
gugggacaaaagggagaaaaaggaagcaagau

SEQ ID NO: 479159 - RNA, 17 nt, Human
gugggacacaccuguga

SEQ ID NO: 479160 - RNA, 19 nt, Human
gugggacacugaucuguga

SEQ ID NO: 479161 - RNA, 32 nt, Human
gugggacagagguggagacaggugcagugacc

SEQ ID NO: 479162 - RNA, 22 nt, Human
gugggacagauuugguuuuuua

SEQ ID NO: 479163 - RNA, 32 nt, Human
gugggacagccaaguacucguuuccacaccaa

SEQ ID NO: 479164 - RNA, 32 nt, Human
gugggacagccaggccagaugaccugauucca

SEQ ID NO: 479165 - RNA, 32 nt, Human
gugggacagcgucugacgggaagccugaucug

SEQ ID NO: 479166 - RNA, 32 nt, Human
gugggacaggagacagauguuccaugacagcc

SEQ ID NO: 479167 - RNA, 32 nt, Human
gugggacagguaaacuacauucagcaggaacu

SEQ ID NO: 479168 - RNA, 32 nt, Human
gugggacaguacagugugagcccccgggaagu

SEQ ID NO: 479169 - RNA, 32 nt, Human
gugggacagugagaagacugagaagaugugaa

SEQ ID NO: 479170 - RNA, 32 nt, Human
gugggaccaacaccccucccacacucccccag

SEQ ID NO: 479171 - RNA, 32 nt, Human
gugggaccaggacaguggcuuaagucuccacu

SEQ ID NO: 479172 - RNA, 32 nt, Human
gugggaccaggacgguggcuuaagucuccacu

SEQ ID NO: 479173 - RNA, 19 nt, Human
gugggaccaucucuauucc

SEQ ID NO: 479174 - RNA, 18 nt, Human
gugggaccauuuuuucca

SEQ ID NO: 479175 - RNA, 32 nt, Human
gugggacccacccacccccauccaggaaccgu

SEQ ID NO: 479176 - RNA, 32 nt, Human
gugggacccacuggacacacacagucccuugu

SEQ ID NO: 479177 - RNA, 32 nt, Human
gugggaccccuuucauuuucaguuuugcucau

SEQ ID NO: 479178 - RNA, 32 nt, Human
gugggacccucccaccauggcagcugagcaca

SEQ ID NO: 479179 - RNA, 32 nt, Human
gugggaccggucgcuccgcccugcugcgcaga

SEQ ID NO: 479180 - RNA, 32 nt, Human
gugggacgaaugcacuugcuuccuguggcaau

SEQ ID NO: 479181 - RNA, 32 nt, Human
gugggacgaugaccaggagcuggaugaggagg

SEQ ID NO: 479182 - RNA, 24 nt, Human
gugggacggcuccagcucaggacu

SEQ ID NO: 479183 - RNA, 19 nt, Human
gugggacgggagauuacca

SEQ ID NO: 479184 - RNA, 32 nt, Human
gugggacgggaggcgggagggggcugguggug

SEQ ID NO: 479185 - RNA, 32 nt, Human
gugggacgucuguaaucccagcuacuugggag

SEQ ID NO: 479186 - RNA, 32 nt, Human
gugggacuacaggcacgugccaccauacucag

SEQ ID NO: 479187 - RNA, 19 nt, Human
gugggacuaggaacucagc

SEQ ID NO: 479188 - RNA, 32 nt, Human
gugggacuaggaggggaacagggcggagcuga

SEQ ID NO: 479189 - RNA, 32 nt, Human
gugggacucccagacacugccaccacagcuga

SEQ ID NO: 479190 - RNA, 32 nt, Human
gugggacuccgagccugggcuauuucuggcgc

SEQ ID NO: 479191 - RNA, 32 nt, Human
gugggacugaagacaguggucaagagacuuga

SEQ ID NO: 479192 - RNA, 32 nt, Human
gugggacugcuggcccugacucugcagcccac

SEQ ID NO: 479193 - RNA, 32 nt, Human
gugggacuggaagucgggcccugggcugcccg

SEQ ID NO: 479194 - RNA, 32 nt, Human
gugggacuggcuggaggccugccugugucuag

SEQ ID NO: 479195 - RNA, 32 nt, Human
gugggacugggcccuggacacaccccucagcc

SEQ ID NO: 479196 - RNA, 32 nt, Human
gugggacuggguuucuguagccaagccagacu

SEQ ID NO: 479197 - RNA, 32 nt, Human
gugggacuuccuccugcccuuucaaagaauaa

SEQ ID NO: 479198 - RNA, 29 nt, Human
gugggacuucuguguguguuuaggguugg

SEQ ID NO: 479199 - RNA, 32 nt, Human
gugggagaaacugccuccuacuuuuauaauac

SEQ ID NO: 479200 - RNA, 32 nt, Human
gugggagaagugaggcugugacugggguugga

SEQ ID NO: 479201 - RNA, 24 nt, Human
gugggagaaucaccugagcccagg

SEQ ID NO: 479202 - RNA, 24 nt, Human
gugggagaaucacuugagcccagg

SEQ ID NO: 479203 - RNA, 23 nt, Human
gugggagaaucgcuugagcccag

SEQ ID NO: 479204 - RNA, 32 nt, Human
gugggagaaucgcuugagcucaggaguucgag

SEQ ID NO: 479205 - RNA, 24 nt, Human
gugggagaaucgcuugaguccagg

SEQ ID NO: 479206 - RNA, 24 nt, Human
gugggagaaucucuugagcccagg

SEQ ID NO: 479207 - RNA, 32 nt, Human
gugggagaaucucuugagcccaggaauucgag

SEQ ID NO: 479208 - RNA, 24 nt, Human
gugggagaauggcuugagcccagg

SEQ ID NO: 479209 - RNA, 23 nt, Human
gugggagaauguuccccugggga

SEQ ID NO: 479210 - RNA, 24 nt, Human
gugggagaauuaccugagcccagg

SEQ ID NO: 479211 - RNA, 24 nt, Human
gugggagaauuacuuaagcccagg

SEQ ID NO: 479212 - RNA, 24 nt, Human
gugggagaauugccugagcccagg

SEQ ID NO: 479213 - RNA, 24 nt, Human
gugggagaauugcucaagcccagg

SEQ ID NO: 479214 - RNA, 32 nt, Human
gugggagaauugcuucaaccugggaggcagag

SEQ ID NO: 479215 - RNA, 24 nt, Human
gugggagaauugcuugaacccagg

SEQ ID NO: 479216 - RNA, 24 nt, Human
gugggagaauugcuugaacccggg

SEQ ID NO: 479217 - RNA, 24 nt, Human
gugggagaauugcuugaagccagg

SEQ ID NO: 479218 - RNA, 24 nt, Human
gugggagaauugcuugagcccagg

SEQ ID NO: 479219 - RNA, 32 nt, Human
gugggagaauuuccucucccaccuccucacau

SEQ ID NO: 479220 - RNA, 32 nt, Human
gugggagacccaacagugggugcaguuucuca

SEQ ID NO: 479221 - RNA, 20 nt, Human
gugggagacccgugauccca

SEQ ID NO: 479222 - RNA, 32 nt, Human
gugggagagagaggagacagaaagagcgagcg

SEQ ID NO: 479223 - RNA, 32 nt, Human
gugggagagaggcuacccagagcccggcccgc

SEQ ID NO: 479224 - RNA, 32 nt, Human
gugggagagccagagcaaagaggcagagaugc

SEQ ID NO: 479225 - RNA, 22 nt, Human
gugggagagggagggggguuaa

SEQ ID NO: 479226 - RNA, 32 nt, Human
gugggagaguugaccgugucacccccugcauu

SEQ ID NO: 479227 - RNA, 32 nt, Human
gugggagauggcaccagcagugccccagugcc

SEQ ID NO: 479228 - RNA, 23 nt, Human
gugggagauugcuugaguccagg

SEQ ID NO: 479229 - RNA, 32 nt, Human
gugggagcaauggcacugacacugcuagagga

SEQ ID NO: 479230 - RNA, 32 nt, Human
gugggagcaauuauaagacuggcuuauuuuga

SEQ ID NO: 479231 - RNA, 19 nt, Human
gugggagcacaucccagca

SEQ ID NO: 479232 - RNA, 32 nt, Human
gugggagcagaggagguggcuccugccccagu

SEQ ID NO: 479233 - RNA, 32 nt, Human
gugggagcagggugagcugcaggccuggggcc

SEQ ID NO: 479234 - RNA, 32 nt, Human
gugggagcagguggggucaggggccagagugc

SEQ ID NO: 479235 - RNA, 32 nt, Human
gugggagcaguuacaucgggucuggugcucca

SEQ ID NO: 479236 - RNA, 32 nt, Human
gugggagcaguuuauuccaguaucacccaggg

SEQ ID NO: 479237 - RNA, 32 nt, Human
gugggagccaacgguccauugaccucaacaag

SEQ ID NO: 479238 - RNA, 32 nt, Human
gugggagccacugcacccggccugaaugauga

SEQ ID NO: 479239 - RNA, 23 nt, Human
gugggagccacugcaccuggcuc

SEQ ID NO: 479240 - RNA, 32 nt, Human
gugggagcccaggcagaggaggcgccgagagc

SEQ ID NO: 479241 - RNA, 32 nt, Human
gugggagccgcuccagccaggccugggcagug

SEQ ID NO: 479242 - RNA, 32 nt, Human
gugggagccuccaggugggaggagagcaugcc

SEQ ID NO: 479243 - RNA, 32 nt, Human
gugggagccuccauccgcugcucuuuaccuuu

SEQ ID NO: 479244 - RNA, 32 nt, Human
gugggagccugggaggucaaggcugcagugag

SEQ ID NO: 479245 - RNA, 32 nt, Human
gugggagcgccuggcccucccucccuagcccu

SEQ ID NO: 479246 - RNA, 20 nt, Human
gugggagcgggaaggucaaa

SEQ ID NO: 479247 - RNA, 32 nt, Human
gugggagcguguugaagauuuuaaguggucuc

SEQ ID NO: 479248 - RNA, 19 nt, Human
gugggagcuaccuguggca

SEQ ID NO: 479249 - RNA, 32 nt, Human
gugggagcuggaagcaggcucccggcugagcg

SEQ ID NO: 479250 - RNA, 32 nt, Human
gugggagcuggcagagcgcagggaagaaguuc

SEQ ID NO: 479251 - RNA, 32 nt, Human
gugggagcuucucccuuccuuccaucuuccuc

SEQ ID NO: 479252 - RNA, 32 nt, Human
gugggaggaagagucaggcucacagcuggggu

SEQ ID NO: 479253 - RNA, 32 nt, Human
gugggaggaccugguggggaggaggccguguu

SEQ ID NO: 479254 - RNA, 24 nt, Human
gugggaggacgacuugagcccagg

SEQ ID NO: 479255 - RNA, 24 nt, Human
gugggaggacugcuuaagcucagg

SEQ ID NO: 479256 - RNA, 22 nt, Human
gugggaggacugcuugagccca

SEQ ID NO: 479257 - RNA, 24 nt, Human
gugggaggacugcuugagcccagg

SEQ ID NO: 479258 - RNA, 32 nt, Human
gugggaggacugggaguggggagccagaggga

SEQ ID NO: 479259 - RNA, 32 nt, Human
gugggaggagaaaucugaccugagaugggaaa

SEQ ID NO: 479260 - RNA, 23 nt, Human
gugggaggaggaggggaagcggc

SEQ ID NO: 479261 - RNA, 32 nt, Human
gugggaggaggaggggaagcggcgaaggagga

SEQ ID NO: 479262 - RNA, 32 nt, Human
gugggaggaggcaccggccgcgcggcgggagg

SEQ ID NO: 479263 - RNA, 24 nt, Human
gugggaggaguacuugagcccagg

SEQ ID NO: 479264 - RNA, 22 nt, Human
gugggaggauagcuugggccca

SEQ ID NO: 479265 - RNA, 32 nt, Human
gugggaggaucacaugaacccaggagguugaa

SEQ ID NO: 479266 - RNA, 24 nt, Human
gugggaggaucacucgaguccagg

SEQ ID NO: 479267 - RNA, 32 nt, Human
gugggaggaucacugagaccagccugggcaac

SEQ ID NO: 479268 - RNA, 24 nt, Human
gugggaggaucacuuaagcccggg

SEQ ID NO: 479269 - RNA, 24 nt, Human
gugggaggaucacuucagcccagg

SEQ ID NO: 479270 - RNA, 32 nt, Human
gugggaggaucacuugaacccaggagguagag

SEQ ID NO: 479271 - RNA, 21 nt, Human
gugggaggaucacuugagccc

SEQ ID NO: 479272 - RNA, 22 nt, Human
gugggaggaucacuugagccca

SEQ ID NO: 479273 - RNA, 23 nt, Human
gugggaggaucacuugagcccag

SEQ ID NO: 479274 - RNA, 24 nt, Human
gugggaggaucacuugagcccagg

SEQ ID NO: 479275 - RNA, 32 nt, Human
gugggaggaucacuugagcccaggaaguccag

SEQ ID NO: 479276 - RNA, 24 nt, Human
gugggaggaucauuugagcccagg

SEQ ID NO: 479277 - RNA, 22 nt, Human
gugggaggaucauuugugccca

SEQ ID NO: 479278 - RNA, 22 nt, Human
gugggaggaucccuugagccca

SEQ ID NO: 479279 - RNA, 23 nt, Human
gugggaggaucccuugagcccag

SEQ ID NO: 479280 - RNA, 24 nt, Human
gugggaggaucccuugagcccagg

SEQ ID NO: 479281 - RNA, 32 nt, Human
gugggaggaucccuugagcucaggaguuugag

SEQ ID NO: 479282 - RNA, 32 nt, Human
gugggaggaucccuugagcuggggagauggag

SEQ ID NO: 479283 - RNA, 24 nt, Human
gugggaggaucgccugagcccagg

SEQ ID NO: 479284 - RNA, 24 nt, Human
gugggaggaucgcuuaagcccagg

SEQ ID NO: 479285 - RNA, 22 nt, Human
gugggaggaucgcuugagccca

SEQ ID NO: 479286 - RNA, 23 nt, Human
gugggaggaucgcuugagcccag

SEQ ID NO: 479287 - RNA, 24 nt, Human
gugggaggaucgcuugagcccagg

SEQ ID NO: 479288 - RNA, 24 nt, Human
gugggaggaucgcuugagccccgg

SEQ ID NO: 479289 - RNA, 24 nt, Human
gugggaggaucgguugagcccagg

SEQ ID NO: 479290 - RNA, 32 nt, Human
gugggaggaucucucgggccagggagguugag

SEQ ID NO: 479291 - RNA, 24 nt, Human
gugggaggaucucuugagcccagg

SEQ ID NO: 479292 - RNA, 32 nt, Human
gugggaggaucucuugagccugggaggucaag

SEQ ID NO: 479293 - RNA, 32 nt, Human
gugggaggaucucuugggcccaggagauugag

SEQ ID NO: 479294 - RNA, 24 nt, Human
gugggaggauggcuugagcccagg

SEQ ID NO: 479295 - RNA, 32 nt, Human
gugggaggauggcuugagcucaggauguaagg

SEQ ID NO: 479296 - RNA, 22 nt, Human
gugggaggauuacuugagccca

SEQ ID NO: 479297 - RNA, 24 nt, Human
gugggaggauuacuugagcccagg

SEQ ID NO: 479298 - RNA, 22 nt, Human
gugggaggauuccuuggauccc

SEQ ID NO: 479299 - RNA, 32 nt, Human
gugggaggauugauugagcucaggagguggaa

SEQ ID NO: 479300 - RNA, 24 nt, Human
gugggaggauugcccgaguccagg

SEQ ID NO: 479301 - RNA, 24 nt, Human
gugggaggauugccugagcccagg

SEQ ID NO: 479302 - RNA, 24 nt, Human
gugggaggauugccugagccuagg

SEQ ID NO: 479303 - RNA, 24 nt, Human
gugggaggauugcuuaagcccggg

SEQ ID NO: 479304 - RNA, 22 nt, Human
gugggaggauugcuugaaccca

SEQ ID NO: 479305 - RNA, 24 nt, Human
gugggaggauugcuugaacccagg

SEQ ID NO: 479306 - RNA, 24 nt, Human
gugggaggauugcuugaacccggg

SEQ ID NO: 479307 - RNA, 24 nt, Human
gugggaggauugcuugagaccagg

SEQ ID NO: 479308 - RNA, 24 nt, Human
gugggaggauugcuugagccaagg

SEQ ID NO: 479309 - RNA, 22 nt, Human
gugggaggauugcuugagccca

SEQ ID NO: 479310 - RNA, 24 nt, Human
gugggaggauugcuugagcccagg

SEQ ID NO: 479311 - RNA, 24 nt, Human
gugggaggauugcuugagcccugg

SEQ ID NO: 479312 - RNA, 22 nt, Human
gugggaggauugcuugagccua

SEQ ID NO: 479313 - RNA, 24 nt, Human
gugggaggauugcuugagccuagg

SEQ ID NO: 479314 - RNA, 22 nt, Human
gugggaggauugcuugagcuca

SEQ ID NO: 479315 - RNA, 24 nt, Human
gugggaggauugcuugagcucagg

SEQ ID NO: 479316 - RNA, 32 nt, Human
gugggaggauugcuugagcucaggaauuugau

SEQ ID NO: 479317 - RNA, 32 nt, Human
gugggaggauugcuugagcucaggaguuugag

SEQ ID NO: 479318 - RNA, 32 nt, Human
gugggaggauugcuugagcucggaagauggag

SEQ ID NO: 479319 - RNA, 24 nt, Human
gugggaggauugcuugaggccagg

SEQ ID NO: 479320 - RNA, 24 nt, Human
gugggaggauugcuugaguccagg

SEQ ID NO: 479321 - RNA, 24 nt, Human
gugggaggauugcuugugcccagg

SEQ ID NO: 479322 - RNA, 24 nt, Human
gugggaggauugcuuuagcccagg

SEQ ID NO: 479323 - RNA, 32 nt, Human
gugggaggauuggagguuggugggauaggggu

SEQ ID NO: 479324 - RNA, 22 nt, Human
gugggaggauuguuugagccca

SEQ ID NO: 479325 - RNA, 24 nt, Human
gugggaggauuguuugagcccagg

SEQ ID NO: 479326 - RNA, 23 nt, Human
gugggaggauuugcuugaaccca

SEQ ID NO: 479327 - RNA, 24 nt, Human
gugggaggcaaacacgccuuguuc

SEQ ID NO: 479328 - RNA, 32 nt, Human
gugggaggcaagagugaagcagaggagagcaa

SEQ ID NO: 479329 - RNA, 22 nt, Human
gugggaggcacccccauugcuc

SEQ ID NO: 479330 - RNA, 22 nt, Human
gugggaggcaccuguaauccca

SEQ ID NO: 479331 - RNA, 26 nt, Human
gugggaggcacggccugggccugcuc

SEQ ID NO: 479332 - RNA, 21 nt, Human
gugggaggcacucccaucugc

SEQ ID NO: 479333 - RNA, 32 nt, Human
gugggaggcacucggucucuccccacaccucu

SEQ ID NO: 479334 - RNA, 32 nt, Human
gugggaggcagaggcaggagaaucauuugaac

SEQ ID NO: 479335 - RNA, 32 nt, Human
gugggaggcaggcagaaggugacaauugacac

SEQ ID NO: 479336 - RNA, 25 nt, Human
gugggaggcaggcagcugccugcuc

SEQ ID NO: 479337 - RNA, 32 nt, Human
gugggaggccgaggcagacggaucacuugagg

SEQ ID NO: 479338 - RNA, 32 nt, Human
gugggaggccgaggcaggaggaucacgagguc

SEQ ID NO: 479339 - RNA, 32 nt, Human
gugggaggccgaggcggauggaucaccugagg

SEQ ID NO: 479340 - RNA, 32 nt, Human
gugggaggccgaggcgggcggaucaccugaga

SEQ ID NO: 479341 - RNA, 32 nt, Human
gugggaggccgaggcggguggaucaccugagg

SEQ ID NO: 479342 - RNA, 22 nt, Human
gugggaggcggcaacauuguuu

SEQ ID NO: 479343 - RNA, 23 nt, Human
gugggaggcuccgcgcaccugcu

SEQ ID NO: 479344 - RNA, 32 nt, Human
gugggaggcugaggcaggagaaucacuugaac

SEQ ID NO: 479345 - RNA, 32 nt, Human
gugggaggcugaggcggguggaucaucugaga

SEQ ID NO: 479346 - RNA, 32 nt, Human
gugggaggcugagguggguggaucaccagguc

SEQ ID NO: 479347 - RNA, 32 nt, Human
gugggagggaaacuucauuucacuggaaugag

SEQ ID NO: 479348 - RNA, 32 nt, Human
gugggagggaccgugagggagccccagaaugg

SEQ ID NO: 479349 - RNA, 32 nt, Human
gugggagggaggcagugggaaguaguugaauc

SEQ ID NO: 479350 - RNA, 32 nt, Human
gugggagggcaccauccucuugcucugcucuc

SEQ ID NO: 479351 - RNA, 32 nt, Human
gugggagggcggcccuuuccagccucugcccc

SEQ ID NO: 479352 - RNA, 32 nt, Human
gugggagggcugggacaguuuuucuucuagaa

SEQ ID NO: 479353 - RNA, 32 nt, Human
gugggaggggaauaaaguucuguuauauuucc

SEQ ID NO: 479354 - RNA, 32 nt, Human
gugggaggggauaagguggcagaaggaaccug

SEQ ID NO: 479355 - RNA, 32 nt, Human
gugggaggggcagacucuguggucugagacac

SEQ ID NO: 479356 - RNA, 32 nt, Human
gugggaggggcaugucaguaagugguguguuc

SEQ ID NO: 479357 - RNA, 32 nt, Human
gugggagggggacaaggucaguauuuaccaaa

SEQ ID NO: 479358 - RNA, 32 nt, Human
gugggaggguaaccucacucuucuccaggcca

SEQ ID NO: 479359 - RNA, 32 nt, Human
gugggaggguccuugucugcucuccuuugaac

SEQ ID NO: 479360 - RNA, 24 nt, Human
gugggagggucgcuugagcccagg

SEQ ID NO: 479361 - RNA, 32 nt, Human
gugggaggguggacaggcaaugguucaguggc

SEQ ID NO: 479362 - RNA, 32 nt, Human
gugggaggguugaucacuugaggcugagaggu

SEQ ID NO: 479363 - RNA, 24 nt, Human
gugggaggguugcuugagcccagg

SEQ ID NO: 479364 - RNA, 32 nt, Human
gugggagguaacugaaucauggggacaggucu

SEQ ID NO: 479365 - RNA, 32 nt, Human
gugggagguaggcagagggcaggcaggagaaa

SEQ ID NO: 479366 - RNA, 32 nt, Human
gugggagguggaagaagggagaagaaagguga

SEQ ID NO: 479367 - RNA, 32 nt, Human
gugggagguugaggcaggagaaucacuugaac

SEQ ID NO: 479368 - RNA, 24 nt, Human
gugggagguuugcuuaagcccagg

SEQ ID NO: 479369 - RNA, 32 nt, Human
gugggaguagagugcccaggagagggucugag

SEQ ID NO: 479370 - RNA, 32 nt, Human
gugggagucaacucuagucacuguggugaugc

SEQ ID NO: 479371 - RNA, 32 nt, Human
gugggagucaccugaaagcugaaggaauggcu

SEQ ID NO: 479372 - RNA, 32 nt, Human
gugggagucaggagacaagacagcgcagagag

SEQ ID NO: 479373 - RNA, 32 nt, Human
gugggagucaucugucagccuucuauguuuca

SEQ ID NO: 479374 - RNA, 18 nt, Human
gugggaguccucccagca

SEQ ID NO: 479375 - RNA, 32 nt, Human
gugggagucugcacucuucaaggggccugggc

SEQ ID NO: 479376 - RNA, 32 nt, Human
gugggagugagcuggggguuuuguccauagcu

SEQ ID NO: 479377 - RNA, 32 nt, Human
gugggaguucagcugcuucucuugccuaagua

SEQ ID NO: 479378 - RNA, 32 nt, Human
gugggaguucugugccaggagcucccagagca

SEQ ID NO: 479379 - RNA, 32 nt, Human
gugggaguugacaggccagggagagggugaag

SEQ ID NO: 479380 - RNA, 32 nt, Human
gugggaguuggugagagcaggaggagaggugg

SEQ ID NO: 479381 - RNA, 23 nt, Human
gugggaguuuugcuugaggccag

SEQ ID NO: 479382 - RNA, 32 nt, Human
gugggauaaacggagagcagcagccgcccgcu

SEQ ID NO: 479383 - RNA, 32 nt, Human
gugggauaaagggaggaggaggagcuagcaga

SEQ ID NO: 479384 - RNA, 32 nt, Human
gugggauagauucucauggggagugggggagc

SEQ ID NO: 479385 - RNA, 32 nt, Human
gugggauaucagagccccagacagcacugccu

SEQ ID NO: 479386 - RNA, 32 nt, Human
gugggauaugaagcaugagacggaaugagguc

SEQ ID NO: 479387 - RNA, 20 nt, Human
gugggaucacgccuguaauc

SEQ ID NO: 479388 - RNA, 23 nt, Human
gugggaucacgccuguaauccca

SEQ ID NO: 479389 - RNA, 22 nt, Human
gugggaucauaggagccuucug

SEQ ID NO: 479390 - RNA, 32 nt, Human
gugggaucccaaccccaugagcucuccagggg

SEQ ID NO: 479391 - RNA, 32 nt, Human
gugggaucuggugggaaggaaaggcggaaggu

SEQ ID NO: 479392 - RNA, 32 nt, Human
gugggaugaagcacaucuuaaaggaaugaagu

SEQ ID NO: 479393 - RNA, 24 nt, Human
gugggaugaccgcuugagcccagg

SEQ ID NO: 479394 - RNA, 32 nt, Human
gugggaugagcgcggaggugucacagugcgcc

SEQ ID NO: 479395 - RNA, 32 nt, Human
gugggaugaggguggaggagagcaguguaaag

SEQ ID NO: 479396 - RNA, 32 nt, Human
gugggaugaucugucacuacaccugcagcacc

SEQ ID NO: 479397 - RNA, 32 nt, Human
gugggaugccuugccagugugucuuacuuggu

SEQ ID NO: 479398 - RNA, 32 nt, Human
gugggaugcuccucccuucucuaccucauggg

SEQ ID NO: 479399 - RNA, 32 nt, Human
gugggauggaguuucacuugucacccaggcug

SEQ ID NO: 479400 - RNA, 32 nt, Human
gugggauggccagaggaggggacaguguuggu

SEQ ID NO: 479401 - RNA, 32 nt, Human
gugggauggggagaaagguggggaagaagaca

SEQ ID NO: 479402 - RNA, 32 nt, Human
gugggauggggcuugggaguugcagugaaugu

SEQ ID NO: 479403 - RNA, 32 nt, Human
gugggaugggggaggguggggagcagcuccca

SEQ ID NO: 479404 - RNA, 32 nt, Human
gugggaugggggagugggggaggcagaaaaag

SEQ ID NO: 479405 - RNA, 32 nt, Human
gugggauggugcccagggguugccuugggacc

SEQ ID NO: 479406 - RNA, 32 nt, Human
gugggauguugugagaggaacaugagccagac

SEQ ID NO: 479407 - RNA, 32 nt, Human
gugggauuaucuugccuccucacuuagaauac

SEQ ID NO: 479408 - RNA, 32 nt, Human
gugggauuugagauguguuuuucuuuuugguu

SEQ ID NO: 479409 - RNA, 32 nt, Human
gugggcaaagugcugggauuacaagcaugagc

SEQ ID NO: 479410 - RNA, 24 nt, Human
gugggcaaauugcuugaccucagg

SEQ ID NO: 479411 - RNA, 32 nt, Human
gugggcaacagagugagaaccaucucuaccca

SEQ ID NO: 479412 - RNA, 32 nt, Human
gugggcaacguagugaaacccugccucuagaa

SEQ ID NO: 479413 - RNA, 32 nt, Human
gugggcaagccccgacacuggagcuuagccug

SEQ ID NO: 479414 - RNA, 24 nt, Human
gugggcaagcuuauggguuucuug

SEQ ID NO: 479415 - RNA, 32 nt, Human
gugggcaaguagaaggugagcaaggugaagag

SEQ ID NO: 479416 - RNA, 32 nt, Human
gugggcaaucucacuuggcaauaaaagaugac

SEQ ID NO: 479417 - RNA, 23 nt, Human
gugggcaauggcuugagcccagg

SEQ ID NO: 479418 - RNA, 32 nt, Human
gugggcaauuccagagaauucaguaccugcuu

SEQ ID NO: 479419 - RNA, 32 nt, Human
gugggcacacagauugccugggacccagccgu

SEQ ID NO: 479420 - RNA, 21 nt, Human
gugggcacaccccagacccca

SEQ ID NO: 479421 - RNA, 20 nt, Human
gugggcacacuccagggccc

SEQ ID NO: 479422 - RNA, 32 nt, Human
gugggcacagccuuccaugccuccaggagugu

SEQ ID NO: 479423 - RNA, 21 nt, Human
gugggcacagcuccccacaga

SEQ ID NO: 479424 - RNA, 32 nt, Human
gugggcacaggggccuucugggggacuuggcu

SEQ ID NO: 479425 - RNA, 26 nt, Human
gugggcacagggguggcuaguugggg

SEQ ID NO: 479426 - RNA, 19 nt, Human
gugggcacauguaauccca

SEQ ID NO: 479427 - RNA, 32 nt, Human
gugggcaccaggagcagagggaagggaggaug

SEQ ID NO: 479428 - RNA, 32 nt, Human
gugggcacccacccugcgauucuccacccuuu

SEQ ID NO: 479429 - RNA, 19 nt, Human
gugggcacccguaauccca

SEQ ID NO: 479430 - RNA, 23 nt, Human
gugggcaccggaaaggaggggac

SEQ ID NO: 479431 - RNA, 32 nt, Human
gugggcaccggagggaggaugggaugggcagg

SEQ ID NO: 479432 - RNA, 32 nt, Human
gugggcacggggagggcuuggccccgccuauc

SEQ ID NO: 479433 - RNA, 32 nt, Human
gugggcacuauggaagcuaaaccccaugcucc

SEQ ID NO: 479434 - RNA, 32 nt, Human
gugggcacucccugcucaugcccacagccucg

SEQ ID NO: 479435 - RNA, 21 nt, Human
gugggcacugacccaccccca

SEQ ID NO: 479436 - RNA, 32 nt, Human
gugggcacuggucacuccuaugugcuaagaca

SEQ ID NO: 479437 - RNA, 32 nt, Human
gugggcagaagcacaaacacacaugcugacag

SEQ ID NO: 479438 - RNA, 32 nt, Human
gugggcagaauccagaugagcuggccagugcu

SEQ ID NO: 479439 - RNA, 32 nt, Human
gugggcagacagauugccugggaccgagccgu

SEQ ID NO: 479440 - RNA, 32 nt, Human
gugggcagagagacauggcccugcuacugcuu

SEQ ID NO: 479441 - RNA, 32 nt, Human
gugggcagagcaccagccugggcaucaggaag

SEQ ID NO: 479442 - RNA, 32 nt, Human
gugggcagagccaccaggaacccagacaccac

SEQ ID NO: 479443 - RNA, 19 nt, Human
gugggcagagcugcccucu

SEQ ID NO: 479444 - RNA, 22 nt, Human
gugggcagagguggcgcccagg

SEQ ID NO: 479445 - RNA, 24 nt, Human
gugggcagauagcuugagccgagg

SEQ ID NO: 479446 - RNA, 22 nt, Human
gugggcagaucacaaggucagg

SEQ ID NO: 479447 - RNA, 24 nt, Human
gugggcagaucaccugaggucagg

SEQ ID NO: 479448 - RNA, 22 nt, Human
gugggcagaucacgagcucagg

SEQ ID NO: 479449 - RNA, 20 nt, Human
gugggcagaucacgagguca

SEQ ID NO: 479450 - RNA, 24 nt, Human
gugggcagaucacuugagcccagg

SEQ ID NO: 479451 - RNA, 32 nt, Human
gugggcagaucacuugagcucaggagcucaag

SEQ ID NO: 479452 - RNA, 24 nt, Human
gugggcagaucgccugagccuagg

SEQ ID NO: 479453 - RNA, 24 nt, Human
gugggcagaucuccugagcucagg

SEQ ID NO: 479454 - RNA, 32 nt, Human
gugggcagaucuccugagcucaggaguucgac

SEQ ID NO: 479455 - RNA, 24 nt, Human
gugggcagaugccagcggcccagg

SEQ ID NO: 479456 - RNA, 21 nt, Human
gugggcagaugucuuugaaga

SEQ ID NO: 479457 - RNA, 24 nt, Human
gugggcagauugccugagcucagg

SEQ ID NO: 479458 - RNA, 24 nt, Human
gugggcagauugcuugagcugagg

SEQ ID NO: 479459 - RNA, 22 nt, Human
gugggcagauugcuugauccua

SEQ ID NO: 479460 - RNA, 24 nt, Human
gugggcagauugcuugauccuagg

SEQ ID NO: 479461 - RNA, 24 nt, Human
gugggcagauugcuugcgcucugg

SEQ ID NO: 479462 - RNA, 32 nt, Human
gugggcagcacccucccccgcagcgggguagg

SEQ ID NO: 479463 - RNA, 32 nt, Human
gugggcagcagaaaggagaggcuccuugaagc

SEQ ID NO: 479464 - RNA, 32 nt, Human
gugggcagccccucuaccuccuggacugaacu

SEQ ID NO: 479465 - RNA, 21 nt, Human
gugggcagcccuggccucuug

SEQ ID NO: 479466 - RNA, 32 nt, Human
gugggcagccuccugcccucucugggucucag

SEQ ID NO: 479467 - RNA, 32 nt, Human
gugggcagcuucccacccucccugggccuugg

SEQ ID NO: 479468 - RNA, 32 nt, Human
gugggcaggagagagcaugugcaggggaacuc

SEQ ID NO: 479469 - RNA, 32 nt, Human
gugggcaggcaaccuccccgggcaggguccug

SEQ ID NO: 479470 - RNA, 32 nt, Human
gugggcaggcagcggagccaggggcugugaca

SEQ ID NO: 479471 - RNA, 32 nt, Human
gugggcaggcaggccagggcugcgcaucagug

SEQ ID NO: 479472 - RNA, 32 nt, Human
gugggcaggcgaggagcgggaagaccaucucu

SEQ ID NO: 479473 - RNA, 32 nt, Human
gugggcaggcuggauggaaaugggccagagaa

SEQ ID NO: 479474 - RNA, 32 nt, Human
gugggcagggaaauccugccacccucacuucu

SEQ ID NO: 479475 - RNA, 32 nt, Human
gugggcagggccgggggugguccagcccucgc

SEQ ID NO: 479476 - RNA, 32 nt, Human
gugggcaggggagagagggaaaugccaaaaac

SEQ ID NO: 479477 - RNA, 32 nt, Human
gugggcaggggguguggcaggagcucccagca

SEQ ID NO: 479478 - RNA, 32 nt, Human
gugggcaggguucuuaguggaugaguuacugg

SEQ ID NO: 479479 - RNA, 32 nt, Human
gugggcagucaccacuuauucaccaucaagca

SEQ ID NO: 479480 - RNA, 32 nt, Human
gugggcaguggcaucccagagcagcaggggua

SEQ ID NO: 479481 - RNA, 20 nt, Human
gugggcaguuugguuucuug

SEQ ID NO: 479482 - RNA, 32 nt, Human
gugggcaucauuuugugccccucaaaugucac

SEQ ID NO: 479483 - RNA, 32 nt, Human
gugggcauccuuccagcugacucaugguuuga

SEQ ID NO: 479484 - RNA, 32 nt, Human
gugggcaucuguccagccuggaagaggggcac

SEQ ID NO: 479485 - RNA, 32 nt, Human
gugggcaugccacccucacacacacagcuggg

SEQ ID NO: 479486 - RNA, 32 nt, Human
gugggcaugguggcucaugccuguaaucccag

SEQ ID NO: 479487 - RNA, 32 nt, Human
gugggcauuaacuauauugcuacagcaucuag

SEQ ID NO: 479488 - RNA, 23 nt, Human
gugggcauucacaccacccccca

SEQ ID NO: 479489 - RNA, 32 nt, Human
gugggccaagccuggcaaccuuguaguagaug

SEQ ID NO: 479490 - RNA, 32 nt, Human
gugggccacagccauggugggaguggccugga

SEQ ID NO: 479491 - RNA, 23 nt, Human
gugggccacaggcugguuucuug

SEQ ID NO: 479492 - RNA, 24 nt, Human
gugggccaccaguagcaucuucua

SEQ ID NO: 479493 - RNA, 32 nt, Human
gugggccacugcacaucugccucucucaggga

SEQ ID NO: 479494 - RNA, 32 nt, Human
gugggccacugguagagauugcccggaauaga

SEQ ID NO: 479495 - RNA, 32 nt, Human
gugggccagccgauuccuccagcccuggugcu

SEQ ID NO: 479496 - RNA, 32 nt, Human
gugggccagcugucacaggacagaggugagcu

SEQ ID NO: 479497 - RNA, 32 nt, Human
gugggccaggaguucaagaucagccuggccaa

SEQ ID NO: 479498 - RNA, 22 nt, Human
gugggccaggccugggcccagg

SEQ ID NO: 479499 - RNA, 21 nt, Human
gugggccaggcugcccuccau

SEQ ID NO: 479500 - RNA, 23 nt, Human
gugggccaggcuguggggacgac

SEQ ID NO: 479501 - RNA, 32 nt, Human
gugggccaguguccaagcagagcuugugaaga

SEQ ID NO: 479502 - RNA, 32 nt, Human
gugggccagugugccugguucuuccaauauuu

SEQ ID NO: 479503 - RNA, 32 nt, Human
gugggcccaccucugccuccacccucacugug

SEQ ID NO: 479504 - RNA, 32 nt, Human
gugggcccaccuggcccacuggcuguuuaugc

SEQ ID NO: 479505 - RNA, 32 nt, Human
gugggcccaggauccacccagagcaggcaggc

SEQ ID NO: 479506 - RNA, 32 nt, Human
gugggccccaggaagcugaggcauccagucac

SEQ ID NO: 479507 - RNA, 32 nt, Human
gugggcccccuucacgugggacccacuuccca

SEQ ID NO: 479508 - RNA, 32 nt, Human
gugggccccucccagcccgucuguugagggcc

SEQ ID NO: 479509 - RNA, 32 nt, Human
gugggcccucggugccugcugugaacugcuuu

SEQ ID NO: 479510 - RNA, 32 nt, Human
gugggcccugccucugccuguucuucuggaau

SEQ ID NO: 479511 - RNA, 32 nt, Human
gugggcccuggguuugaagcagccuggcuuuc

SEQ ID NO: 479512 - RNA, 32 nt, Human
gugggcccugucuucgggucucaggacccaaa

SEQ ID NO: 479513 - RNA, 32 nt, Human
gugggcccuugucucugcucugggucaggcga

SEQ ID NO: 479514 - RNA, 32 nt, Human
gugggcccuuucuccauagucugccgcuuccc

SEQ ID NO: 479515 - RNA, 32 nt, Human
gugggccgaagcagugccucugcgcaaucucc

SEQ ID NO: 479516 - RNA, 32 nt, Human
gugggccgcagguggagguguugggaaagcgc

SEQ ID NO: 479517 - RNA, 32 nt, Human
gugggccgcuacccuucuuucccuuuagaaaa

SEQ ID NO: 479518 - RNA, 32 nt, Human
gugggccgggcucacacacaaaugaugcuuca

SEQ ID NO: 479519 - RNA, 32 nt, Human
gugggccuaccaccuggugcccucauggagac

SEQ ID NO: 479520 - RNA, 32 nt, Human
gugggccuagaucacuggugugauaaacccca

SEQ ID NO: 479521 - RNA, 32 nt, Human
gugggccuauuccucucuaccuuuaaggacau

SEQ ID NO: 479522 - RNA, 32 nt, Human
gugggccucacccucuggcagcugagccaagc

SEQ ID NO: 479523 - RNA, 32 nt, Human
gugggccucgcccuuccucucccuccagguuu

SEQ ID NO: 479524 - RNA, 32 nt, Human
gugggccucugccuucucuucuguuuggccac

SEQ ID NO: 479525 - RNA, 32 nt, Human
gugggccucugguuuggggcgaggcagaggac

SEQ ID NO: 479526 - RNA, 32 nt, Human
gugggccugagugcugcuguguuuacuugugc

SEQ ID NO: 479527 - RNA, 32 nt, Human
gugggccugaugggcucggccacccagggaug

SEQ ID NO: 479528 - RNA, 32 nt, Human
gugggccugcagucccagcuaccugggaggcu

SEQ ID NO: 479529 - RNA, 32 nt, Human
gugggccugccuggcuuggcaggugcuuuuug

SEQ ID NO: 479530 - RNA, 32 nt, Human
gugggccugggcugggcuggggcuaggagggc

SEQ ID NO: 479531 - RNA, 32 nt, Human
gugggccuguaaucgcagcuacucaggaagcu

SEQ ID NO: 479532 - RNA, 32 nt, Human
gugggccuguggacugcagccucggcgaucag

SEQ ID NO: 479533 - RNA, 32 nt, Human
gugggccuuagccgucacccaccagcuuccuc

SEQ ID NO: 479534 - RNA, 32 nt, Human
gugggccuucccugggcugugcugcaggcaca

SEQ ID NO: 479535 - RNA, 32 nt, Human
gugggccuucuccuggccuuguucuugcucau

SEQ ID NO: 479536 - RNA, 32 nt, Human
gugggcgcagaugucaguguuccguggagagg

SEQ ID NO: 479537 - RNA, 32 nt, Human
gugggcgcaguggcucacaccuguaaucccag

SEQ ID NO: 479538 - RNA, 32 nt, Human
gugggcgcaucccucuuuuccuucccuggguu

SEQ ID NO: 479539 - RNA, 32 nt, Human
gugggcgccccuuccccagccucgcugccgcc

SEQ ID NO: 479540 - RNA, 32 nt, Human
gugggcgccuguaaucccagcuacucgggagg

SEQ ID NO: 479541 - RNA, 32 nt, Human
gugggcgccuguaaucccagcuacuugggagg

SEQ ID NO: 479542 - RNA, 32 nt, Human
gugggcgccuguaaucccaguuacucgggagg

SEQ ID NO: 479543 - RNA, 32 nt, Human
gugggcgccuguaaucucagcuacuugggagg

SEQ ID NO: 479544 - RNA, 32 nt, Human
gugggcgccuguaauuccagcuacucaggagg

SEQ ID NO: 479545 - RNA, 32 nt, Human
gugggcgccuguaauuccagcuacucaggagu

SEQ ID NO: 479546 - RNA, 32 nt, Human
gugggcgccuguaauuccagcuacucaggggg

SEQ ID NO: 479547 - RNA, 32 nt, Human
gugggcgccuguaauuccagcuacucgggagg

SEQ ID NO: 479548 - RNA, 32 nt, Human
gugggcgccuguaauuccagcuacucuggaag

SEQ ID NO: 479549 - RNA, 32 nt, Human
gugggcgcgcagcuggaaccuccggcugucag

SEQ ID NO: 479550 - RNA, 32 nt, Human
gugggcgcgggaggggcucggagccagggucg

SEQ ID NO: 479551 - RNA, 32 nt, Human
gugggcgcgguggcucuugccuguaaucccag

SEQ ID NO: 479552 - RNA, 32 nt, Human
gugggcgcugcuuccaggauaaggagacugag

SEQ ID NO: 479553 - RNA, 32 nt, Human
gugggcggagccacccgaaaggcuccggucgg

SEQ ID NO: 479554 - RNA, 32 nt, Human
gugggcggagggagaccgggaggcacgggcgc

SEQ ID NO: 479555 - RNA, 22 nt, Human
gugggcggaucacaaguucagg

SEQ ID NO: 479556 - RNA, 24 nt, Human
gugggcggaucaccugagcucagg

SEQ ID NO: 479557 - RNA, 32 nt, Human
gugggcggaucaccugagcucaggaguuuaag

SEQ ID NO: 479558 - RNA, 24 nt, Human
gugggcggaucaccugaggucagg

SEQ ID NO: 479559 - RNA, 24 nt, Human
gugggcggaucaccugaguucagg

SEQ ID NO: 479560 - RNA, 22 nt, Human
gugggcggaucacgaggucagg

SEQ ID NO: 479561 - RNA, 32 nt, Human
gugggcggaucacgaggucaggcgaucgagac

SEQ ID NO: 479562 - RNA, 23 nt, Human
gugggcggaucgcucgagcccag

SEQ ID NO: 479563 - RNA, 24 nt, Human
gugggcggaugacuggaguccagg

SEQ ID NO: 479564 - RNA, 24 nt, Human
gugggcggauugccugaguucagg

SEQ ID NO: 479565 - RNA, 24 nt, Human
gugggcggauugcuugagcuuagg

SEQ ID NO: 479566 - RNA, 32 nt, Human
gugggcggauugcuugagcuuaggaguuugag

SEQ ID NO: 479567 - RNA, 24 nt, Human
gugggcggauugcuugaggucggg

SEQ ID NO: 479568 - RNA, 32 nt, Human
gugggcgggagccugcagcaggcacaucugac

SEQ ID NO: 479569 - RNA, 32 nt, Human
gugggcgggagggagaggggguguccgagggc

SEQ ID NO: 479570 - RNA, 32 nt, Human
gugggcgggagggagagggguuguccgagggc

SEQ ID NO: 479571 - RNA, 32 nt, Human
gugggcgggcggcagagaacgggugaaguccg

SEQ ID NO: 479572 - RNA, 32 nt, Human
gugggcggggcugagagaggguaucagggaca

SEQ ID NO: 479573 - RNA, 23 nt, Human
gugggcgggggaggggguucuug

SEQ ID NO: 479574 - RNA, 32 nt, Human
gugggcguaguggcucuugccuguaaucccag

SEQ ID NO: 479575 - RNA, 32 nt, Human
gugggcgucuuccugccccaugcuccccugcc

SEQ ID NO: 479576 - RNA, 32 nt, Human
gugggcgucuuggagaacagagcgagauggag

SEQ ID NO: 479577 - RNA, 18 nt, Human
gugggcuacaggaagagg

SEQ ID NO: 479578 - RNA, 32 nt, Human
gugggcuaugccacuaggcccuggucuggcuu

SEQ ID NO: 479579 - RNA, 32 nt, Human
gugggcucacugcaaccucugccuuccagguu

SEQ ID NO: 479580 - RNA, 32 nt, Human
gugggcucacugcauuugguuuucuuuucaga

SEQ ID NO: 479581 - RNA, 32 nt, Human
gugggcucaggaauauauguaucuagcaagcu

SEQ ID NO: 479582 - RNA, 32 nt, Human
gugggcucauucucuccaagcugcuuuucauu

SEQ ID NO: 479583 - RNA, 32 nt, Human
gugggcuccagggacuggaguguaaugcucgg

SEQ ID NO: 479584 - RNA, 32 nt, Human
gugggcuccagucagucuuacacugcccuucu

SEQ ID NO: 479585 - RNA, 32 nt, Human
gugggcucccucugcccauggaaacgggcagc

SEQ ID NO: 479586 - RNA, 32 nt, Human
gugggcuccucccaggccugacugucaccaac

SEQ ID NO: 479587 - RNA, 32 nt, Human
gugggcuccucuaacaaagugcauuagccugg

SEQ ID NO: 479588 - RNA, 19 nt, Human
gugggcuccuguaguccca

SEQ ID NO: 479589 - RNA, 32 nt, Human
gugggcucggggaggugggagcagggaccauc

SEQ ID NO: 479590 - RNA, 24 nt, Human
gugggcucugaggacggcuucuug

SEQ ID NO: 479591 - RNA, 32 nt, Human
gugggcucugccagagcagccugugacuaaug

SEQ ID NO: 479592 - RNA, 32 nt, Human
gugggcucugcugugugcccucaggcaagcca

SEQ ID NO: 479593 - RNA, 32 nt, Human
gugggcugaacugucugcuugcuuggaaggcc

SEQ ID NO: 479594 - RNA, 32 nt, Human
gugggcugaacugugcccuccaccccaccaag

SEQ ID NO: 479595 - RNA, 24 nt, Human
gugggcugacugcuugagcucagg

SEQ ID NO: 479596 - RNA, 32 nt, Human
gugggcugagccagaggaaggcaggcaggagc

SEQ ID NO: 479597 - RNA, 32 nt, Human
gugggcugaggucagagguuggugggguguca

SEQ ID NO: 479598 - RNA, 32 nt, Human
gugggcugauaguugaucacacauugugcuuu

SEQ ID NO: 479599 - RNA, 32 nt, Human
gugggcugcagagugggcucccugccccucuc

SEQ ID NO: 479600 - RNA, 32 nt, Human
gugggcugcccaggaugcggugcgugcuucug

SEQ ID NO: 479601 - RNA, 32 nt, Human
gugggcugcgugugugguagggaugugcaggu

SEQ ID NO: 479602 - RNA, 32 nt, Human
gugggcugcguuuugggcaagacacugagcuc

SEQ ID NO: 479603 - RNA, 32 nt, Human
gugggcugcucuggcccuggugugcacggcug

SEQ ID NO: 479604 - RNA, 32 nt, Human
gugggcugcugcagcugcaugggugccugcug

SEQ ID NO: 479605 - RNA, 32 nt, Human
gugggcugcuggccaugaaucucugccucucc

SEQ ID NO: 479606 - RNA, 32 nt, Human
gugggcuggaugccgccaugcccaccgguuug

SEQ ID NO: 479607 - RNA, 32 nt, Human
gugggcuggcaccugggcacagugcuuccagg

SEQ ID NO: 479608 - RNA, 32 nt, Human
gugggcuggcgauucccuagccucagauggcu

SEQ ID NO: 479609 - RNA, 32 nt, Human
gugggcuggcgccgccgaggaggcaggagacc

SEQ ID NO: 479610 - RNA, 32 nt, Human
gugggcuggcgggguggguucacagcuggacu

SEQ ID NO: 479611 - RNA, 32 nt, Human
gugggcugggcccucgcuccugacuguugcug

SEQ ID NO: 479612 - RNA, 32 nt, Human
gugggcugggggcaguggcucacaccuauaau

SEQ ID NO: 479613 - RNA, 32 nt, Human
gugggcuggggugggaacaggauggcgggcaa

SEQ ID NO: 479614 - RNA, 32 nt, Human
gugggcugugcaggcugguggccugggugccu

SEQ ID NO: 479615 - RNA, 32 nt, Human
gugggcugugccucgggcuuggcuccaccuca

SEQ ID NO: 479616 - RNA, 24 nt, Human
gugggcuuagagggaggaccugau

SEQ ID NO: 479617 - RNA, 32 nt, Human
gugggcuuccaccucagacaguugcgcuggcu

SEQ ID NO: 479618 - RNA, 32 nt, Human
gugggcuuccccagguggccuggaggugggca

SEQ ID NO: 479619 - RNA, 32 nt, Human
gugggcuucucgggcgguggggugggcgcgga

SEQ ID NO: 479620 - RNA, 32 nt, Human
gugggcuucuggucgcacugggugacagcaca

SEQ ID NO: 479621 - RNA, 32 nt, Human
gugggcuuggagggugaagaggaugugguccu

SEQ ID NO: 479622 - RNA, 32 nt, Human
gugggcuuguguucuuguccugggucuuuguc

SEQ ID NO: 479623 - RNA, 32 nt, Human
gugggcuuugaaaccuaaugaaaccuguuagc

SEQ ID NO: 479624 - RNA, 18 nt, Human
guggggaaagagaugggg

SEQ ID NO: 479625 - RNA, 32 nt, Human
guggggaaagcaggggagccugugcuggguga

SEQ ID NO: 479626 - RNA, 32 nt, Human
guggggaagaccugggugcuucccugggugcc

SEQ ID NO: 479627 - RNA, 32 nt, Human
guggggaagagaguguuuauaauuauguuauu

SEQ ID NO: 479628 - RNA, 32 nt, Human
guggggaagcugggcagagagcagaggggguc

SEQ ID NO: 479629 - RNA, 32 nt, Human
guggggaaggagaguccccugaaggucugaca

SEQ ID NO: 479630 - RNA, 32 nt, Human
guggggaaggauuggugcuggggcaacaggaa

SEQ ID NO: 479631 - RNA, 32 nt, Human
guggggaaggcagaggaguaacuguggggacu

SEQ ID NO: 479632 - RNA, 32 nt, Human
guggggaagggaaagaaagacagaggagagag

SEQ ID NO: 479633 - RNA, 32 nt, Human
guggggaagggcccuggagaagcccucauccu

SEQ ID NO: 479634 - RNA, 32 nt, Human
guggggaaggggguggccaggagcagaaggaa

SEQ ID NO: 479635 - RNA, 32 nt, Human
guggggaaugaaguugggggaugugggggaag

SEQ ID NO: 479636 - RNA, 32 nt, Human
guggggaaugccuucuauguacacacuguucu

SEQ ID NO: 479637 - RNA, 32 nt, Human
guggggaauggacgccagcagaguuguaccag

SEQ ID NO: 479638 - RNA, 32 nt, Human
guggggacacuuguuuauaaaugcagaaucaa

SEQ ID NO: 479639 - RNA, 32 nt, Human
guggggacaguucuuccagcaggcacugguuu

SEQ ID NO: 479640 - RNA, 32 nt, Human
guggggaccaaaggaaacagagccagagcagc

SEQ ID NO: 479641 - RNA, 32 nt, Human
guggggaccagcuggccacauggugcugcuuu

SEQ ID NO: 479642 - RNA, 32 nt, Human
guggggaccccacggcaggcacccuaagucuu

SEQ ID NO: 479643 - RNA, 32 nt, Human
guggggacccguccaaggacaggcuggcugcu

SEQ ID NO: 479644 - RNA, 32 nt, Human
guggggacccugggcccaucucucccugcgca

SEQ ID NO: 479645 - RNA, 32 nt, Human
guggggacgcaggauggcggcagcaguggcgg

SEQ ID NO: 479646 - RNA, 32 nt, Human
guggggacucuggccucuccagacuaauguuc

SEQ ID NO: 479647 - RNA, 32 nt, Human
guggggacuggcugcccccuagagccugccag

SEQ ID NO: 479648 - RNA, 32 nt, Human
guggggacugugaauagcucuccagcaggaag

SEQ ID NO: 479649 - RNA, 32 nt, Human
guggggacuucugauuucuccaccccauagau

SEQ ID NO: 479650 - RNA, 32 nt, Human
guggggacuugaacagagcuccaugggagcug

SEQ ID NO: 479651 - RNA, 17 nt, Human
guggggagaaagaggga

SEQ ID NO: 479652 - RNA, 16 nt, Human
guggggagaaaguggg

SEQ ID NO: 479653 - RNA, 32 nt, Human
guggggagagaaguugaaggaucccgaagcuu

SEQ ID NO: 479654 - RNA, 32 nt, Human
guggggagagacggcaggugcagugauggcug

SEQ ID NO: 479655 - RNA, 32 nt, Human
guggggagagagaaggggaggaguaggguggg

SEQ ID NO: 479656 - RNA, 32 nt, Human
guggggagaggaccagcugggugcuugggcau

SEQ ID NO: 479657 - RNA, 32 nt, Human
guggggagaggcauggcugggguggggguggg

SEQ ID NO: 479658 - RNA, 32 nt, Human
guggggagagggcugggugauuguauucugug

SEQ ID NO: 479659 - RNA, 32 nt, Human
guggggagagugaagaaagagauagaauacag

SEQ ID NO: 479660 - RNA, 32 nt, Human
guggggagagugagccaggugagaaagaaaag

SEQ ID NO: 479661 - RNA, 32 nt, Human
guggggagaguucggaaagaaauauguuuuua

SEQ ID NO: 479662 - RNA, 32 nt, Human
guggggagauggguuagggaggaggacgggcu

SEQ ID NO: 479663 - RNA, 20 nt, Human
guggggagcagcucccagca

SEQ ID NO: 479664 - RNA, 32 nt, Human
guggggagcauggugggaaugagucuugcuuu

SEQ ID NO: 479665 - RNA, 22 nt, Human
guggggagccaggccccuggug

SEQ ID NO: 479666 - RNA, 18 nt, Human
guggggagccgaugggga

SEQ ID NO: 479667 - RNA, 32 nt, Human
guggggagcgagucacugccuccucugagcag

SEQ ID NO: 479668 - RNA, 32 nt, Human
guggggagcuggagaggacugaagagcugagg

SEQ ID NO: 479669 - RNA, 32 nt, Human
guggggaggacuuugguaucagguguggauag

SEQ ID NO: 479670 - RNA, 32 nt, Human
guggggaggagaaguggggaaagguggagcag

SEQ ID NO: 479671 - RNA, 32 nt, Human
guggggaggaggaggaagaagaggaggaggga

SEQ ID NO: 479672 - RNA, 32 nt, Human
guggggaggaggcacagcuagcugcacaguuc

SEQ ID NO: 479673 - RNA, 32 nt, Human
guggggaggaggucagaggagaugggggccgg

SEQ ID NO: 479674 - RNA, 32 nt, Human
guggggaggaggucagaggagaugggggcugg

SEQ ID NO: 479675 - RNA, 32 nt, Human
guggggaggcggacguuccagccggcauggcu

SEQ ID NO: 479676 - RNA, 32 nt, Human
guggggaggcuggaaagcaugguugccccgcc

SEQ ID NO: 479677 - RNA, 32 nt, Human
guggggagggaagggagccaagggauggacau

SEQ ID NO: 479678 - RNA, 32 nt, Human
guggggagggagaaggugguagcuuauguucu

SEQ ID NO: 479679 - RNA, 32 nt, Human
guggggagggagggagaggccgccacccccgc

SEQ ID NO: 479680 - RNA, 32 nt, Human
guggggagggagguggaggagccgugcaaucc

SEQ ID NO: 479681 - RNA, 32 nt, Human
guggggagggccucugacugcugggacugacc

SEQ ID NO: 479682 - RNA, 32 nt, Human
guggggaggggagauuguugagagauggacua

SEQ ID NO: 479683 - RNA, 32 nt, Human
guggggaggggaggcagguguggguagcgcac

SEQ ID NO: 479684 - RNA, 31 nt, Human
guggggaggguggaagaaaugguggacugua

SEQ ID NO: 479685 - RNA, 32 nt, Human
guggggaggguggaggggugacaguggaggaa

SEQ ID NO: 479686 - RNA, 32 nt, Human
guggggagguacaguggguggaagaggagaag

SEQ ID NO: 479687 - RNA, 22 nt, Human
guggggaguccuaagacagaca

SEQ ID NO: 479688 - RNA, 32 nt, Human
guggggagugccugcugggcaccugaaggaug

SEQ ID NO: 479689 - RNA, 32 nt, Human
guggggagugcugugucuccugggucugccca

SEQ ID NO: 479690 - RNA, 32 nt, Human
guggggaguggcugccccugccucagggucau

SEQ ID NO: 479691 - RNA, 32 nt, Human
guggggagugggaggaagagccugggacagug

SEQ ID NO: 479692 - RNA, 32 nt, Human
guggggagugggggucuuggaggcagggcugu

SEQ ID NO: 479693 - RNA, 32 nt, Human
guggggagugugagaggugcguuuggugcagc

SEQ ID NO: 479694 - RNA, 32 nt, Human
guggggaucagacagagauuggagagaagggc

SEQ ID NO: 479695 - RNA, 32 nt, Human
guggggaucagguuuggccaggagaacacuca

SEQ ID NO: 479696 - RNA, 32 nt, Human
guggggauccugcagucacacucuccaccuga

SEQ ID NO: 479697 - RNA, 32 nt, Human
guggggaucugguuccccuugagaccaugcgg

SEQ ID NO: 479698 - RNA, 19 nt, Human
guggggaucuucugagaca

SEQ ID NO: 479699 - RNA, 32 nt, Human
guggggaugggacagauaagaauaagauguuu

SEQ ID NO: 479700 - RNA, 22 nt, Human
guggggaugggaggggagagac

SEQ ID NO: 479701 - RNA, 32 nt, Human
guggggaugggaggggagagacagaaguugag

SEQ ID NO: 479702 - RNA, 32 nt, Human
guggggauguggcagugaggaagacgacagac

SEQ ID NO: 479703 - RNA, 32 nt, Human
guggggcaaagggcuggaccccugccaggucu

SEQ ID NO: 479704 - RNA, 32 nt, Human
guggggcaaggagauccucucuaaggccucug

SEQ ID NO: 479705 - RNA, 32 nt, Human
guggggcaaggcugggagaugcaggcucuguu

SEQ ID NO: 479706 - RNA, 32 nt, Human
guggggcaauccagagccaugggggcuuccca

SEQ ID NO: 479707 - RNA, 32 nt, Human
guggggcaauccagagccaugggggcuuucca

SEQ ID NO: 479708 - RNA, 32 nt, Human
guggggcaauccagagcugugggggcuuccau

SEQ ID NO: 479709 - RNA, 32 nt, Human
guggggcacugaggcagcccagccaggcugcc

SEQ ID NO: 479710 - RNA, 32 nt, Human
guggggcagaaggcacccuggccaugcacagg

SEQ ID NO: 479711 - RNA, 32 nt, Human
guggggcagagcaggguuaggaccgcguuacc

SEQ ID NO: 479712 - RNA, 32 nt, Human
guggggcagaucuuaucuuuguggauuacagg

SEQ ID NO: 479713 - RNA, 32 nt, Human
guggggcagcagcaguggagagaugggacaau

SEQ ID NO: 479714 - RNA, 32 nt, Human
guggggcagcggcgagcggaaagggaagccgg

SEQ ID NO: 479715 - RNA, 32 nt, Human
guggggcagcuccagcccugcccacaggccac

SEQ ID NO: 479716 - RNA, 17 nt, Human
guggggcaggagauggg

SEQ ID NO: 479717 - RNA, 32 nt, Human
guggggcaggagggugccugauuucggggagu

SEQ ID NO: 479718 - RNA, 32 nt, Human
guggggcaggagugccaggaccagccuguacc

SEQ ID NO: 479719 - RNA, 32 nt, Human
guggggcaggcggagguugcaguaagccaaga

SEQ ID NO: 479720 - RNA, 32 nt, Human
guggggcaggggucaggccagccuucugccau

SEQ ID NO: 479721 - RNA, 32 nt, Human
guggggcagggugagcaggggcuuccaggcug

SEQ ID NO: 479722 - RNA, 32 nt, Human
guggggcagggugagcguggaagaagggacgc

SEQ ID NO: 479723 - RNA, 32 nt, Human
guggggcagguguggagaagggcuuuaaggag

SEQ ID NO: 479724 - RNA, 32 nt, Human
guggggcagucagcuaagccauuugccuaagg

SEQ ID NO: 479725 - RNA, 32 nt, Human
guggggcagugugagguaguccuggauccccg

SEQ ID NO: 479726 - RNA, 32 nt, Human
guggggcaguguguggggaagcuggcugucgg

SEQ ID NO: 479727 - RNA, 32 nt, Human
guggggcauugagaauggaggcucccaggguc

SEQ ID NO: 479728 - RNA, 32 nt, Human
guggggccaauacccagaccccuucagccacc

SEQ ID NO: 479729 - RNA, 32 nt, Human
guggggccagagaaagcugggguuuccggugg

SEQ ID NO: 479730 - RNA, 32 nt, Human
guggggccagagcugggcucugaccucuguac

SEQ ID NO: 479731 - RNA, 32 nt, Human
guggggcccacccuccggucuguguaugauga

SEQ ID NO: 479732 - RNA, 21 nt, Human
guggggcccagcaaccugagu

SEQ ID NO: 479733 - RNA, 32 nt, Human
guggggcccagccacugcacuucaccggaugc

SEQ ID NO: 479734 - RNA, 32 nt, Human
guggggcccagccaggaggugggguguggacc

SEQ ID NO: 479735 - RNA, 32 nt, Human
guggggcccauggaggagacaggaagccucaa

SEQ ID NO: 479736 - RNA, 32 nt, Human
guggggcccauggccccagcuggcugggucgc

SEQ ID NO: 479737 - RNA, 32 nt, Human
guggggcccccuccucaucagaaucacuagau

SEQ ID NO: 479738 - RNA, 32 nt, Human
guggggccccugaucuaauauucaaaguguca

SEQ ID NO: 479739 - RNA, 32 nt, Human
guggggccccuggagugugcucuccuccagug

SEQ ID NO: 479740 - RNA, 32 nt, Human
guggggcccuccugcagguccuagaucugagg

SEQ ID NO: 479741 - RNA, 32 nt, Human
guggggcccucugcucaggcucagggagcucu

SEQ ID NO: 479742 - RNA, 32 nt, Human
guggggcccugacgcccaccucccaggugccc

SEQ ID NO: 479743 - RNA, 32 nt, Human
guggggcccuggacgguggcccagugguggca

SEQ ID NO: 479744 - RNA, 32 nt, Human
guggggcccuggauggcagcucuggcccagac

SEQ ID NO: 479745 - RNA, 32 nt, Human
guggggcccuggggccaccuggugggcucagg

SEQ ID NO: 479746 - RNA, 23 nt, Human
guggggccgggaccgcgagggag

SEQ ID NO: 479747 - RNA, 32 nt, Human
guggggccgugcgcuccuucagccuggaggcc

SEQ ID NO: 479748 - RNA, 32 nt, Human
guggggccugaggaggugggccuggaggugag

SEQ ID NO: 479749 - RNA, 32 nt, Human
guggggccuggacuugcucuccccugcuggaa

SEQ ID NO: 479750 - RNA, 32 nt, Human
guggggccugggaggggcaauccucaaaugcg

SEQ ID NO: 479751 - RNA, 32 nt, Human
guggggcgcuauucccaccccugggccugagu

SEQ ID NO: 479752 - RNA, 32 nt, Human
guggggcgggagccucucagcuguccagauuc

SEQ ID NO: 479753 - RNA, 32 nt, Human
guggggcgggcuggguaccugaggucaccagc

SEQ ID NO: 479754 - RNA, 32 nt, Human
guggggcuauaggcagccucucugaugcacuc

SEQ ID NO: 479755 - RNA, 32 nt, Human
guggggcuauucugugccuucuaccucuuucu

SEQ ID NO: 479756 - RNA, 31 nt, Human
guggggcucaauaaauggcucugugaacuuc

SEQ ID NO: 479757 - RNA, 21 nt, Human
guggggcucacaccuguaauc

SEQ ID NO: 479758 - RNA, 18 nt, Human
guggggcucagguuucca

SEQ ID NO: 479759 - RNA, 20 nt, Human
guggggcuccagaaucucca

SEQ ID NO: 479760 - RNA, 32 nt, Human
guggggcucccuaggccucucccucuucagag

SEQ ID NO: 479761 - RNA, 32 nt, Human
guggggcucugaccucagggcucccagcucgg

SEQ ID NO: 479762 - RNA, 32 nt, Human
guggggcugaccgauaagacccugaccaccuu

SEQ ID NO: 479763 - RNA, 32 nt, Human
guggggcugagacugggcugacaucuagaauc

SEQ ID NO: 479764 - RNA, 31 nt, Human
guggggcugaggagagaaaagggugauuagc

SEQ ID NO: 479765 - RNA, 32 nt, Human
guggggcugcccaggcaaagucagugaacaug

SEQ ID NO: 479766 - RNA, 32 nt, Human
guggggcugcggcucuggccucccaggcccau

SEQ ID NO: 479767 - RNA, 32 nt, Human
guggggcugcuuguugaaagauuuaagaguuu

SEQ ID NO: 479768 - RNA, 22 nt, Human
guggggcuggaaaaggguuaga

SEQ ID NO: 479769 - RNA, 32 nt, Human
guggggcuggagcugcucccaccucccugacc

SEQ ID NO: 479770 - RNA, 32 nt, Human
guggggcuggccggggacaggagggguggcca

SEQ ID NO: 479771 - RNA, 32 nt, Human
guggggcugggagcaugggcucucaggcugcu

SEQ ID NO: 479772 - RNA, 32 nt, Human
guggggcugggcagggaugggggcuugagaaa

SEQ ID NO: 479773 - RNA, 32 nt, Human
guggggcugggcugggcugggcugggcugggc

SEQ ID NO: 479774 - RNA, 32 nt, Human
guggggcuggggacccucacaggugacaggga

SEQ ID NO: 479775 - RNA, 32 nt, Human
guggggcuggggacuuugagggaguuggcucu

SEQ ID NO: 479776 - RNA, 32 nt, Human
guggggcuggggcagagcaggguuccuggggc

SEQ ID NO: 479777 - RNA, 32 nt, Human
guggggcuuucaacccucucccccaccaccca

SEQ ID NO: 479778 - RNA, 32 nt, Human
guggggcuuuugggagaugaccagggguggaa

SEQ ID NO: 479779 - RNA, 32 nt, Human
gugggggaaggggaggaggggaagaaggaaag

SEQ ID NO: 479780 - RNA, 24 nt, Human
gugggggaaucacuugagccuagg

SEQ ID NO: 479781 - RNA, 24 nt, Human
gugggggaaucccuugagcccagg

SEQ ID NO: 479782 - RNA, 32 nt, Human
gugggggaaucuugccuuucccuuucagagcc

SEQ ID NO: 479783 - RNA, 23 nt, Human
gugggggaauuuggcaccugcuc

SEQ ID NO: 479784 - RNA, 32 nt, Human
gugggggacuccguuuacuaccacagggagac

SEQ ID NO: 479785 - RNA, 32 nt, Human
gugggggagaaaaggcuucaaaggaacuuggu

SEQ ID NO: 479786 - RNA, 32 nt, Human
gugggggagagggaaagcagguauugcaguuu

SEQ ID NO: 479787 - RNA, 32 nt, Human
gugggggagagggaaauaaaggggagucaugc

SEQ ID NO: 479788 - RNA, 32 nt, Human
gugggggagagggcuggggcaggggagaggga

SEQ ID NO: 479789 - RNA, 21 nt, Human
gugggggagaggggaggggac

SEQ ID NO: 479790 - RNA, 32 nt, Human
gugggggagaggggaggggacgggcagggucu

SEQ ID NO: 479791 - RNA, 20 nt, Human
gugggggagaggggguuaga

SEQ ID NO: 479792 - RNA, 32 nt, Human
gugggggagagggguggaauggagaggaaaca

SEQ ID NO: 479793 - RNA, 32 nt, Human
gugggggagaucgcuuaaccccaggagguggg

SEQ ID NO: 479794 - RNA, 32 nt, Human
gugggggagcugcucacuggggagagggccug

SEQ ID NO: 479795 - RNA, 32 nt, Human
gugggggaggagcacaaaacuccagcccacug

SEQ ID NO: 479796 - RNA, 32 nt, Human
gugggggagggagggagacgugaagccuauuu

SEQ ID NO: 479797 - RNA, 32 nt, Human
gugggggaggguguuguuggggccugagaaga

SEQ ID NO: 479798 - RNA, 32 nt, Human
gugggggaggugaaccagggaggggcagggca

SEQ ID NO: 479799 - RNA, 32 nt, Human
gugggggaugcuaaccacagggccugagaagu

SEQ ID NO: 479800 - RNA, 19 nt, Human
gugggggauggggguuaaa

SEQ ID NO: 479801 - RNA, 20 nt, Human
gugggggcaaccccuggaua

SEQ ID NO: 479802 - RNA, 32 nt, Human
gugggggcagauggguggacagcugcugcugc

SEQ ID NO: 479803 - RNA, 32 nt, Human
gugggggcaggcagaagggagaaccagcucaa

SEQ ID NO: 479804 - RNA, 31 nt, Human
gugggggcaguguccauccacaaaggggcag

SEQ ID NO: 479805 - RNA, 32 nt, Human
gugggggcauacaccuguaauuccagcuacuc

SEQ ID NO: 479806 - RNA, 32 nt, Human
gugggggccacugaucuuccuggacaggagug

SEQ ID NO: 479807 - RNA, 32 nt, Human
gugggggccacugcgcauggcgcagggcuugg

SEQ ID NO: 479808 - RNA, 32 nt, Human
gugggggccacugcucacagaaggcucugggc

SEQ ID NO: 479809 - RNA, 32 nt, Human
gugggggccacuucugagcacccauguggcac

SEQ ID NO: 479810 - RNA, 20 nt, Human
gugggggccaucacaccugc

SEQ ID NO: 479811 - RNA, 32 nt, Human
gugggggcccagacagggaggcaccugccacc

SEQ ID NO: 479812 - RNA, 32 nt, Human
gugggggcccuggcuagggagugggacuggca

SEQ ID NO: 479813 - RNA, 32 nt, Human
gugggggccucccaggggcauuuacgcaccag

SEQ ID NO: 479814 - RNA, 32 nt, Human
gugggggccucuuuaccauagcuuaagaagua

SEQ ID NO: 479815 - RNA, 22 nt, Human
gugggggcucaugccuguaauc

SEQ ID NO: 479816 - RNA, 32 nt, Human
gugggggcucccuugaagagcuuccucccucc

SEQ ID NO: 479817 - RNA, 32 nt, Human
gugggggcuggaucugcccuuccuucggugcc

SEQ ID NO: 479818 - RNA, 32 nt, Human
gugggggcuuccagguggcccuucccggcaca

SEQ ID NO: 479819 - RNA, 32 nt, Human
gugggggcuuugcccaaugacuguagcauuca

SEQ ID NO: 479820 - RNA, 23 nt, Human
guggggggauucggggggauaaa

SEQ ID NO: 479821 - RNA, 22 nt, Human
guggggggcaccuguaacccca

SEQ ID NO: 479822 - RNA, 22 nt, Human
guggggggcagucaccacugcu

SEQ ID NO: 479823 - RNA, 17 nt, Human
guggggggccucccagc

SEQ ID NO: 479824 - RNA, 20 nt, Human
gugggggguaaucccugcuu

SEQ ID NO: 479825 - RNA, 23 nt, Human
guggggggucucuacgccagcuc

SEQ ID NO: 479826 - RNA, 22 nt, Human
guggggggucucugacuugcuc

SEQ ID NO: 479827 - RNA, 23 nt, Human
guggggggugaacaccuugguuc

SEQ ID NO: 479828 - RNA, 32 nt, Human
gugggggucugcgggcugggaacucucguccu

SEQ ID NO: 479829 - RNA, 32 nt, Human
gugggggucuggaggaggggacaugaggugag

SEQ ID NO: 479830 - RNA, 21 nt, Human
gugggggugacuuuuggcagc

SEQ ID NO: 479831 - RNA, 32 nt, Human
gugggggugagaaaaugcuucugccuguuguu

SEQ ID NO: 479832 - RNA, 32 nt, Human
gugggggugcagaugagguugcuagagaaugu

SEQ ID NO: 479833 - RNA, 32 nt, Human
guggggguggagaaaggggaagugguccagaa

SEQ ID NO: 479834 - RNA, 19 nt, Human
guggggguggagaugagga

SEQ ID NO: 479835 - RNA, 32 nt, Human
gugggggugggacuucuaacugcaugaauuaa

SEQ ID NO: 479836 - RNA, 32 nt, Human
gugggggugggaggggcagaggccaacggauc

SEQ ID NO: 479837 - RNA, 32 nt, Human
gugggggugggggaugaagggaagaaaucacu

SEQ ID NO: 479838 - RNA, 32 nt, Human
gugggggugggggcgggggccugcuuugaucg

SEQ ID NO: 479839 - RNA, 32 nt, Human
guggggguuggcaggauggugacauugaacau

SEQ ID NO: 479840 - RNA, 32 nt, Human
guggggguuggggguggggugggugggugcug

SEQ ID NO: 479841 - RNA, 32 nt, Human
gugggguaaggaggagaaaauaaaccaacaau

SEQ ID NO: 479842 - RNA, 32 nt, Human
gugggguaggagggacagagagacagggagag

SEQ ID NO: 479843 - RNA, 16 nt, Human
gugggguaggcugcug

SEQ ID NO: 479844 - RNA, 32 nt, Human
gugggguagggaggggcuuagaggucaucaac

SEQ ID NO: 479845 - RNA, 32 nt, Human
gugggguagggggugauggagacugugggcaa

SEQ ID NO: 479846 - RNA, 32 nt, Human
gugggguauccaggaacacccucccagcaggg

SEQ ID NO: 479847 - RNA, 32 nt, Human
guggggucaaaaagauagccaauuuccauuac

SEQ ID NO: 479848 - RNA, 32 nt, Human
guggggucagugugugagugagagcaggagua

SEQ ID NO: 479849 - RNA, 32 nt, Human
gugggguccaggcugggccaggagaccaggca

SEQ ID NO: 479850 - RNA, 18 nt, Human
guggggucccaaauucca

SEQ ID NO: 479851 - RNA, 18 nt, Human
gugggguccccucccagc

SEQ ID NO: 479852 - RNA, 32 nt, Human
gugggguccccuuugauguucucccccaaguu

SEQ ID NO: 479853 - RNA, 32 nt, Human
guggggucccugucccagcugcuccuggggag

SEQ ID NO: 479854 - RNA, 32 nt, Human
gugggguccucccauggaucaucaaggugaaa

SEQ ID NO: 479855 - RNA, 32 nt, Human
gugggguccuucaggacugcccuuuucugccu

SEQ ID NO: 479856 - RNA, 32 nt, Human
guggggucucuagccugauauuccauugaaag

SEQ ID NO: 479857 - RNA, 32 nt, Human
guggggucugaggagggcuggggaugaguaga

SEQ ID NO: 479858 - RNA, 32 nt, Human
guggggucuggccuguugauguuuacauggcg

SEQ ID NO: 479859 - RNA, 32 nt, Human
guggggucugggcaguggggaggcaggagcca

SEQ ID NO: 479860 - RNA, 32 nt, Human
guggggugaaggaggaggcaggugggcugcug

SEQ ID NO: 479861 - RNA, 32 nt, Human
guggggugaaggaggcgugcagggaggaaccu

SEQ ID NO: 479862 - RNA, 32 nt, Human
guggggugacucggagcagcagguguggcccc

SEQ ID NO: 479863 - RNA, 31 nt, Human
guggggugacuucccuggucaccaaggcagu

SEQ ID NO: 479864 - RNA, 32 nt, Human
guggggugagggugagcuuacucagggccccc

SEQ ID NO: 479865 - RNA, 32 nt, Human
guggggugaggguggccagcguacaacagguc

SEQ ID NO: 479866 - RNA, 32 nt, Human
guggggugauucacagcacaaaagaccucacc

SEQ ID NO: 479867 - RNA, 32 nt, Human
guggggugcagaggcagaagaugaaggacaaa

SEQ ID NO: 479868 - RNA, 32 nt, Human
guggggugcaggaaggcaccaagggugaaccc

SEQ ID NO: 479869 - RNA, 32 nt, Human
guggggugcgaggggagcaggacgcccggccg

SEQ ID NO: 479870 - RNA, 32 nt, Human
guggggugcugaagcuugaagagcauuucuuu

SEQ ID NO: 479871 - RNA, 32 nt, Human
gugggguggcuccgcccaggaggcggcugcac

SEQ ID NO: 479872 - RNA, 32 nt, Human
guggggugggaagagaggaggccaggccaggc

SEQ ID NO: 479873 - RNA, 32 nt, Human
guggggugggacaacagugaaaucuaaaguaa

SEQ ID NO: 479874 - RNA, 22 nt, Human
guggggugggaggggaggagac

SEQ ID NO: 479875 - RNA, 32 nt, Human
guggggugggggcagaggagaggcggauacag

SEQ ID NO: 479876 - RNA, 32 nt, Human
guggggugggggugggcagcagcaucccagcc

SEQ ID NO: 479877 - RNA, 32 nt, Human
guggggugggugggaaggaagggauuuggggg

SEQ ID NO: 479878 - RNA, 31 nt, Human
gugggguggguggggucgggugguggagagg

SEQ ID NO: 479879 - RNA, 32 nt, Human
gugggguguauucagagcaccucuccagaugc

SEQ ID NO: 479880 - RNA, 32 nt, Human
gugggguguccagcaaggguugcaaggaguag

SEQ ID NO: 479881 - RNA, 23 nt, Human
guggggugugaacugugguuuaa

SEQ ID NO: 479882 - RNA, 32 nt, Human
gugggguguggccgauuccucccuuuagucau

SEQ ID NO: 479883 - RNA, 32 nt, Human
guggggugugggcuggaagcacuggcucccug

SEQ ID NO: 479884 - RNA, 32 nt, Human
gugggguguuucgccugcaccccugguuccuu

SEQ ID NO: 479885 - RNA, 32 nt, Human
gugggguguuucgccugcaccccugguuucuu

SEQ ID NO: 479886 - RNA, 32 nt, Human
gugggguuaccacauggagagauuuuccauua

SEQ ID NO: 479887 - RNA, 31 nt, Human
gugggguucaauaaauggcucugugaacuuc

SEQ ID NO: 479888 - RNA, 32 nt, Human
gugggguucccaagcuuuaaucuuccuacccc

SEQ ID NO: 479889 - RNA, 32 nt, Human
gugggguugauaccccaacucccucuacccuu

SEQ ID NO: 479890 - RNA, 32 nt, Human
gugggguuggaaaaugacgagauggaggcuac

SEQ ID NO: 479891 - RNA, 32 nt, Human
gugggguuguagagagcuggaacucaccugcu

SEQ ID NO: 479892 - RNA, 32 nt, Human
gugggguuuaauaccuaggugauggguugaca

SEQ ID NO: 479893 - RNA, 32 nt, Human
gugggguuuaccccucacagguuuaagagacc

SEQ ID NO: 479894 - RNA, 32 nt, Human
gugggguuuuggccagcacagagccggggcgu

SEQ ID NO: 479895 - RNA, 32 nt, Human
guggguaaaugagagucgacuggauucuguca

SEQ ID NO: 479896 - RNA, 32 nt, Human
guggguaagaggagcagagggcaggggugcug

SEQ ID NO: 479897 - RNA, 32 nt, Human
guggguacagcccaguggaggaggggguacag

SEQ ID NO: 479898 - RNA, 21 nt, Human
guggguaccaaucuuuuguga

SEQ ID NO: 479899 - RNA, 19 nt, Human
guggguaccuguaauccca

SEQ ID NO: 479900 - RNA, 32 nt, Human
guggguaccuguaaucccaguuacuuuggagg

SEQ ID NO: 479901 - RNA, 24 nt, Human
guggguagagcaaggaggcccagg

SEQ ID NO: 479902 - RNA, 32 nt, Human
guggguagaggccgggugagcaacauggcaca

SEQ ID NO: 479903 - RNA, 24 nt, Human
guggguagaucacuugaguccagg

SEQ ID NO: 479904 - RNA, 24 nt, Human
guggguagaucauuucagcucagg

SEQ ID NO: 479905 - RNA, 24 nt, Human
guggguagaucgcuugagcucagg

SEQ ID NO: 479906 - RNA, 32 nt, Human
guggguagaucgcuugagcucaggaguucaag

SEQ ID NO: 479907 - RNA, 24 nt, Human
guggguagauuacuugagcccagg

SEQ ID NO: 479908 - RNA, 32 nt, Human
guggguaggaagagaauggcugccaguggcug

SEQ ID NO: 479909 - RNA, 32 nt, Human
guuaacauuguugagugccugcugugugccag

SEQ ID NO: 479910 - RNA, 32 nt, Human
guuaaccaagcaggccaggcacgguggcucac

SEQ ID NO: 479911 - RNA, 32 nt, Human
guuaacccuccaccuccucucuuggacucccu

SEQ ID NO: 479912 - RNA, 32 nt, Human
guuaacccuguuuuucagaagggcuacuguua

SEQ ID NO: 479913 - RNA, 32 nt, Human
guuaaccuaacacaugacccuaaccuagccau

SEQ ID NO: 479914 - RNA, 32 nt, Human
guuaaccuaagcacauacacagcaauugcucg

SEQ ID NO: 479915 - RNA, 32 nt, Human
guuaaccuaguauucuaaccaguuaaccagcc

SEQ ID NO: 479916 - RNA, 32 nt, Human
guuaaccucuuaacaucuccccaaauugcauc

SEQ ID NO: 479917 - RNA, 32 nt, Human
guuaaccuguucccuucucuauccuuccccgu

SEQ ID NO: 479918 - RNA, 32 nt, Human
guuaaccuuccaccuccucccuucccuccucc

SEQ ID NO: 479919 - RNA, 32 nt, Human
guuaacggcucagagcuaacgaauccaugguc

SEQ ID NO: 479920 - RNA, 32 nt, Human
guuaacuaacuugcccaaggucacacaguuag

SEQ ID NO: 479921 - RNA, 32 nt, Human
guuaacucaacugucuauugucacaugaugaa

SEQ ID NO: 479922 - RNA, 32 nt, Human
guuaacucauuucucaugccauuagcucucua

SEQ ID NO: 479923 - RNA, 32 nt, Human
guuaacuccuuaguuucagaccacagacucaa

SEQ ID NO: 479924 - RNA, 32 nt, Human
guuaacugcauaggaggcucucgauagcaccu

SEQ ID NO: 479925 - RNA, 32 nt, Human
guuaacuggagugccugggagucgcgugccag

SEQ ID NO: 479926 - RNA, 32 nt, Human
guuaacugguuccugcucacacuccagaauua

SEQ ID NO: 479927 - RNA, 32 nt, Human
guuaacuugaaggagaacagaaaugguauuac

SEQ ID NO: 479928 - RNA, 32 nt, Human
guuaagaaaugauguuuucccaaccaaggcua

SEQ ID NO: 479929 - RNA, 32 nt, Human
guuaagaagaggaggaagugagacggggaagg

SEQ ID NO: 479930 - RNA, 32 nt, Human
guuaagaaggagguggacgaugccuuagugga

SEQ ID NO: 479931 - RNA, 32 nt, Human
guuaagaagugagucagagaggagauggguag

SEQ ID NO: 479932 - RNA, 32 nt, Human
guuaagaagugagucagagaguagauggguag

SEQ ID NO: 479933 - RNA, 32 nt, Human
guuaagaaugaccacauuuugagaaccauacu

SEQ ID NO: 479934 - RNA, 32 nt, Human
guuaagacaugauuuccuugaauguggcuuga

SEQ ID NO: 479935 - RNA, 32 nt, Human
guuaagaccagccugggcaacauggcaagacc

SEQ ID NO: 479936 - RNA, 32 nt, Human
guuaagaucccaaauccugagauauugcugau

SEQ ID NO: 479937 - RNA, 32 nt, Human
guuaagauugugccacugcacuccagccuggg

SEQ ID NO: 479938 - RNA, 32 nt, Human
guuaagccggauuugaagguugcgaugauuag

SEQ ID NO: 479939 - RNA, 32 nt, Human
guuaagccucaguauucuuagcuuuuguugau

SEQ ID NO: 479940 - RNA, 32 nt, Human
guuaagcuccaaagguucacuguguuucugcc

SEQ ID NO: 479941 - RNA, 32 nt, Human
guuaagcugaaccagugucuuuacauuucauu

SEQ ID NO: 479942 - RNA, 32 nt, Human
guuaagcuguguacagaugauggagaguuugg

SEQ ID NO: 479943 - RNA, 32 nt, Human
guuaagcuuacugcccaggugacuugugcauu

SEQ ID NO: 479944 - RNA, 32 nt, Human
guuaaggacacacaccccaguugaaaaucacu

SEQ ID NO: 479945 - RNA, 32 nt, Human
guuaaggaccuaauagagugacauauauaaau

SEQ ID NO: 479946 - RNA, 32 nt, Human
guuaaggauugugguagagaacugugacagcc

SEQ ID NO: 479947 - RNA, 32 nt, Human
guuaaggcaggggacacugaggagaaccaguc

SEQ ID NO: 479948 - RNA, 32 nt, Human
guuaaggccagucuuaacccacuggaugaaaa

SEQ ID NO: 479949 - RNA, 20 nt, Human
guuaaggcugccacagggca

SEQ ID NO: 479950 - RNA, 32 nt, Human
guuaaggggaggcggagagugacgcgguuugc

SEQ ID NO: 479951 - RNA, 32 nt, Human
guuaaggggaggggguguaagagccagcgaau

SEQ ID NO: 479952 - RNA, 32 nt, Human
guuaaggggcuacuggaaaaauuucuauucuc

SEQ ID NO: 479953 - RNA, 32 nt, Human
guuaagggggaaguuuguauugccaaguacac

SEQ ID NO: 479954 - RNA, 32 nt, Human
guuaagggggcugaagccggggagccaagugg

SEQ ID NO: 479955 - RNA, 32 nt, Human
guuaagguacaugauaccaugacaaacuguaa

SEQ ID NO: 479956 - RNA, 32 nt, Human
guuaagguacaugguaccaugacaaacuguaa

SEQ ID NO: 479957 - RNA, 32 nt, Human
guuaagguuguucacuaugauggcaucuuaga

SEQ ID NO: 479958 - RNA, 32 nt, Human
guuaaguaacaucuauuugccuucauuaguuu

SEQ ID NO: 479959 - RNA, 32 nt, Human
guuaaguaauuuaggagcaaagcaaugcucca

SEQ ID NO: 479960 - RNA, 32 nt, Human
guuaaguacauacauauucuccguuuugugcu

SEQ ID NO: 479961 - RNA, 32 nt, Human
guuaaguaccacacuuuacacagcauuucaaa

SEQ ID NO: 479962 - RNA, 32 nt, Human
guuaaguaccuugacucaggugacacagcaau

SEQ ID NO: 479963 - RNA, 32 nt, Human
guuaaguagggagaaggcaggggagguggcug

SEQ ID NO: 479964 - RNA, 32 nt, Human
guuaagucaaaaccaucuuggcuaauauguac

SEQ ID NO: 479965 - RNA, 32 nt, Human
guuaagucaagugccuggaacagaacagccau

SEQ ID NO: 479966 - RNA, 32 nt, Human
guuaagucacaaggugcugcuuuucagaucca

SEQ ID NO: 479967 - RNA, 32 nt, Human
guuaagucauuuucacccuaagccauucuugg

SEQ ID NO: 479968 - RNA, 32 nt, Human
guuaaguccucaccucagcccccagcccccuu

SEQ ID NO: 479969 - RNA, 32 nt, Human
guuaagucuguuucugacuccaacagggacca

SEQ ID NO: 479970 - RNA, 30 nt, Human
guuaagugaaaauaaaaacuguugccaggc

SEQ ID NO: 479971 - RNA, 31 nt, Human
guuaagugcaacaacaucacaguagagcuac

SEQ ID NO: 479972 - RNA, 32 nt, Human
guuaagugcaggaaguugagagagauaaaaau

SEQ ID NO: 479973 - RNA, 32 nt, Human
guuaagugggagacaaugucacaaguuaaaag

SEQ ID NO: 479974 - RNA, 32 nt, Human
guuaagugggcauuuugcaacauggcuucucc

SEQ ID NO: 479975 - RNA, 32 nt, Human
guuaaguuccuugauucaguccuugacaagga

SEQ ID NO: 479976 - RNA, 32 nt, Human
guuaaguugcagccgcuggguccucgggggcu

SEQ ID NO: 479977 - RNA, 32 nt, Human
guuaaguuguuggcuuggggcaagugaaguuu

SEQ ID NO: 479978 - RNA, 32 nt, Human
guuaaguuuuugcccacauugcauaugccuuu

SEQ ID NO: 479979 - RNA, 22 nt, Human
guuaauaagauugaaacuuuag

SEQ ID NO: 479980 - RNA, 20 nt, Human
guuaauaaguuaaaauucug

SEQ ID NO: 479981 - RNA, 20 nt, Human
guuaauaauaaugacucuaa

SEQ ID NO: 479982 - RNA, 23 nt, Human
guuaauaauuagcuaagcuuuag

SEQ ID NO: 479983 - RNA, 21 nt, Human
guuaauaauuguaaaacuuug

SEQ ID NO: 479984 - RNA, 32 nt, Human
guuaauaauuguuacuuacugcuccaggcauu

SEQ ID NO: 479985 - RNA, 32 nt, Human
guuaauacauuuacuuuagcauugaagccacu

SEQ ID NO: 479986 - RNA, 32 nt, Human
guuaauagaccagcuuagguucuucauuuagu

SEQ ID NO: 479987 - RNA, 32 nt, Human
guuaauagccgaugcugggauuggaggcucuc

SEQ ID NO: 479988 - RNA, 23 nt, Human
guuaauaguaaauaagacucuga

SEQ ID NO: 479989 - RNA, 32 nt, Human
guuaauauaucagucaugaaacaugcaauuac

SEQ ID NO: 479990 - RNA, 32 nt, Human
guuaauauuuuguuguugagguuuuuauuuuu

SEQ ID NO: 479991 - RNA, 31 nt, Human
guuaaucacagcuggauugaaagaguauuug

SEQ ID NO: 479992 - RNA, 32 nt, Human
guuaaucacauaguaaguuauuuucuaguuuu

SEQ ID NO: 479993 - RNA, 32 nt, Human
guuaaucauuugaauucugaacacuggagaaa

SEQ ID NO: 479994 - RNA, 32 nt, Human
guuaauccacaucuuuacucaggcaaggggca

SEQ ID NO: 479995 - RNA, 32 nt, Human
guuaauccuaugaacucccuuuuguaggagag

SEQ ID NO: 479996 - RNA, 32 nt, Human
guuaauccuugcauauucuccuuucauccugg

SEQ ID NO: 479997 - RNA, 24 nt, Human
guuaaugaugucaaagcuuccacu

SEQ ID NO: 479998 - RNA, 20 nt, Human
guuaaugauugaaacuguaa

SEQ ID NO: 479999 - RNA, 32 nt, Human
guuaaugcaguuucacuuauguuaaauguugc

SEQ ID NO: 480000 - RNA, 32 nt, Human
guuaaugccaaaagcaaagaucaagcccaugu

SEQ ID NO: 480001 - RNA, 32 nt, Human
guuaaugccagucuuccuccccuggacacuga

SEQ ID NO: 480002 - RNA, 32 nt, Human
guuaaugcggccuaauguagcagcgggaagag

SEQ ID NO: 480003 - RNA, 32 nt, Human
guuaaugcuaagaaaagauuuggggaagguua

SEQ ID NO: 480004 - RNA, 29 nt, Human
guuaauggaaagaggaaagaagaaaagaa

SEQ ID NO: 480005 - RNA, 29 nt, Human
guuaauggagcaguacugcuccauaaaga

SEQ ID NO: 480006 - RNA, 32 nt, Human
guuaaugguuaauguucccaaaccagagaaug

SEQ ID NO: 480007 - RNA, 32 nt, Human
guuaaugucacaucugccuucggagauuacaa

SEQ ID NO: 480008 - RNA, 32 nt, Human
guuaaugucacaucugccuuuggagauuacaa

SEQ ID NO: 480009 - RNA, 21 nt, Human
guuaauguggauguagugcuu

SEQ ID NO: 480010 - RNA, 32 nt, Human
guuaauguuaugaugugcauuaggcugcccca

SEQ ID NO: 480011 - RNA, 32 nt, Human
guuaauuccaaauauuuguucccaaguagcua

SEQ ID NO: 480012 - RNA, 32 nt, Human
guuaauucuucggugacacuggcauugcuggg

SEQ ID NO: 480013 - RNA, 19 nt, Human
guuaauuuaccaacugaua

SEQ ID NO: 480014 - RNA, 32 nt, Human
guuaauuuauaaaaucacagauugguaaaugc

SEQ ID NO: 480015 - RNA, 32 nt, Human
guuaauuucacucugccuguuagguggguuuu

SEQ ID NO: 480016 - RNA, 21 nt, Human
guuaauuuguuagaauucuaa

SEQ ID NO: 480017 - RNA, 32 nt, Human
guuaauuuuuaccuuacaugugagagucuuac

SEQ ID NO: 480018 - RNA, 32 nt, Human
guuacaaaaauggugcacccuauccuuuaauc

SEQ ID NO: 480019 - RNA, 32 nt, Human
guuacaaacuauguauaguauguauguuuugu

SEQ ID NO: 480020 - RNA, 32 nt, Human
guuacaaagucaggaaaagucuuggcuggacc

SEQ ID NO: 480021 - RNA, 20 nt, Human
guuacaacaaacccaccaga

SEQ ID NO: 480022 - RNA, 32 nt, Human
guuacaacagaagcuggggaggugagagugca

SEQ ID NO: 480023 - RNA, 32 nt, Human
guuacaacagaagcuggggaggugagagugcu

SEQ ID NO: 480024 - RNA, 32 nt, Human
guuacaaccaggagucaguacaggcuuuauuc

SEQ ID NO: 480025 - RNA, 32 nt, Human
guuacaacucagggcuccagaccucagcuaaa

SEQ ID NO: 480026 - RNA, 32 nt, Human
guuacaacuccuuggugccacugccuuuauga

SEQ ID NO: 480027 - RNA, 32 nt, Human
guuacaagcuaguaaguagcagagccaagauu

SEQ ID NO: 480028 - RNA, 32 nt, Human
guuacaaggcccuguccuggcuggugaccugc

SEQ ID NO: 480029 - RNA, 32 nt, Human
guuacaauucaagaugagaucuggguggggac

SEQ ID NO: 480030 - RNA, 32 nt, Human
guuacaauuccauagccagaagugcugacauu

SEQ ID NO: 480031 - RNA, 32 nt, Human
guuacacaaaacugaucaucacagaucuguag

SEQ ID NO: 480032 - RNA, 31 nt, Human
guuacacaagggguaccaaaguccacucuga

SEQ ID NO: 480033 - RNA, 32 nt, Human
guuacacacaaacuguuguggguuccugccag

SEQ ID NO: 480034 - RNA, 32 nt, Human
guuacacagagaaccuggcuucccuggucuua

SEQ ID NO: 480035 - RNA, 32 nt, Human
guuacacauauggaaguaagcaaaaugaaaag

SEQ ID NO: 480036 - RNA, 32 nt, Human
guuacacaugcuuucugaucucaguauuuacc

SEQ ID NO: 480037 - RNA, 32 nt, Human
guuacacauguucauguucaccucucauucac

SEQ ID NO: 480038 - RNA, 32 nt, Human
guuacaccuguaaucccagcacuuugggaggc

SEQ ID NO: 480039 - RNA, 32 nt, Human
guuacacucagguguccucagagcuagugugu

SEQ ID NO: 480040 - RNA, 32 nt, Human
guuacacugaaccaucucaugugucuuuucac

SEQ ID NO: 480041 - RNA, 31 nt, Human
guuacacugcuucucccaugccagagaauaa

SEQ ID NO: 480042 - RNA, 32 nt, Human
guuacacuuacuuuuucaaguuggaguauaua

SEQ ID NO: 480043 - RNA, 32 nt, Human
guuacagaaauguuguguagcagagaaauaag

SEQ ID NO: 480044 - RNA, 32 nt, Human
guuacagaaccaagggcucuguucauaaacug

SEQ ID NO: 480045 - RNA, 32 nt, Human
guuacagaaguggaaugguuucuggugguauu

SEQ ID NO: 480046 - RNA, 32 nt, Human
guuacagaaguuaagugacuugcucaaggccc

SEQ ID NO: 480047 - RNA, 32 nt, Human
guuacagacaguaaugcuggaccuggacgguc

SEQ ID NO: 480048 - RNA, 32 nt, Human
guuacagacucaaggaaaccucucauuuuaga

SEQ ID NO: 480049 - RNA, 32 nt, Human
guuacagagccucacaguuacaguuccaagaa

SEQ ID NO: 480050 - RNA, 32 nt, Human
guuacagaugugagccacuucgcccagcugag

SEQ ID NO: 480051 - RNA, 32 nt, Human
guuacagcaucaguccuugcaguauuaaaaac

SEQ ID NO: 480052 - RNA, 32 nt, Human
guuacagccaucccuugucauaacuuuugaac

SEQ ID NO: 480053 - RNA, 32 nt, Human
guuacagcccaguuuccaggggcgugugggcu

SEQ ID NO: 480054 - RNA, 32 nt, Human
guuacagcucugccguaaucucagccaaauug

SEQ ID NO: 480055 - RNA, 32 nt, Human
guuacaggaagucccuugccauccuaaaagcc

SEQ ID NO: 480056 - RNA, 32 nt, Human
guuacaggcagaauuggauagauacagcccua

SEQ ID NO: 480057 - RNA, 32 nt, Human
guuacaggcaggcugcacacagcagucccagg

SEQ ID NO: 480058 - RNA, 32 nt, Human
guuacaggcaugagccaccacacccagccuuc

SEQ ID NO: 480059 - RNA, 32 nt, Human
guuacaggcaugagccacugugcccagcccag

SEQ ID NO: 480060 - RNA, 21 nt, Human
guuacagggggaaucaaggca

SEQ ID NO: 480061 - RNA, 31 nt, Human
guuacagggugaccuguucucuagcugugau

SEQ ID NO: 480062 - RNA, 32 nt, Human
guuacaggguuauuuauauaaugugacauuau

SEQ ID NO: 480063 - RNA, 32 nt, Human
guuacagguaggucccaaaaguggccaggcug

SEQ ID NO: 480064 - RNA, 32 nt, Human
guuacagguaugagccaccacacccagcccaa

SEQ ID NO: 480065 - RNA, 32 nt, Human
guuacaggugugagccacugcacccggccaca

SEQ ID NO: 480066 - RNA, 32 nt, Human
guuacaggugugagccacugcgccuggacuga

SEQ ID NO: 480067 - RNA, 32 nt, Human
guuacaggugugagccaucgcgccuggccagg

SEQ ID NO: 480068 - RNA, 32 nt, Human
guuacaggugugugccgccaugcccagucucu

SEQ ID NO: 480069 - RNA, 31 nt, Human
guuacagugagaccuguguucgguggaagcc

SEQ ID NO: 480070 - RNA, 32 nt, Human
guuacagugagccaaguuugugccucacacuc

SEQ ID NO: 480071 - RNA, 32 nt, Human
guuacagugagcuaugauugcaccacugcacu

SEQ ID NO: 480072 - RNA, 32 nt, Human
guuacagugagcugagagugccccacugcacu

SEQ ID NO: 480073 - RNA, 23 nt, Human
guuacaguucagcguuugccuua

SEQ ID NO: 480074 - RNA, 32 nt, Human
guuacaguuuaucccuguaggauaaaugaucc

SEQ ID NO: 480075 - RNA, 32 nt, Human
guuacauagguaaacacaugucaugggguuuu

SEQ ID NO: 480076 - RNA, 32 nt, Human
guuacauagguaaacuugugucaugggggcuu

SEQ ID NO: 480077 - RNA, 32 nt, Human
guuacauagguaaacuugugucauggggguuu

SEQ ID NO: 480078 - RNA, 32 nt, Human
guuacaugagauguuuuguacaggcaugcaau

SEQ ID NO: 480079 - RNA, 32 nt, Human
guuacauguauaucuugccucucuuaagucuc

SEQ ID NO: 480080 - RNA, 19 nt, Human
guuacaugugaaacucuaa

SEQ ID NO: 480081 - RNA, 32 nt, Human
guuacaugugaccugaacagggccaaugagac

SEQ ID NO: 480082 - RNA, 32 nt, Human
guuacaugugguuccaggccagaggcauggaa

SEQ ID NO: 480083 - RNA, 32 nt, Human
guuacauuccucuccacaaugaggcuaaaugu

SEQ ID NO: 480084 - RNA, 32 nt, Human
guuacauuuuucucccuuuucuugggcuaaag

SEQ ID NO: 480085 - RNA, 32 nt, Human
guuaccaacucauggccaaucauuuuucaucu

SEQ ID NO: 480086 - RNA, 32 nt, Human
guuaccaacucauguggggaaggucuuacugc

SEQ ID NO: 480087 - RNA, 32 nt, Human
guuaccaaugaccuguugcaugcuucaauacc

SEQ ID NO: 480088 - RNA, 32 nt, Human
guuaccacaaauuucagguccuuaccuuauga

SEQ ID NO: 480089 - RNA, 20 nt, Human
guuaccacccauuucuccca

SEQ ID NO: 480090 - RNA, 32 nt, Human
guuaccaccguguuagaaagcagccucaggac

SEQ ID NO: 480091 - RNA, 32 nt, Human
guuaccacgguuggccaggcgcggugguucau

SEQ ID NO: 480092 - RNA, 32 nt, Human
guuaccagaguuuuuggugauugguuccuaua

SEQ ID NO: 480093 - RNA, 32 nt, Human
guuaccagcauauccugagucauuugaccaag

SEQ ID NO: 480094 - RNA, 32 nt, Human
guuaccagccugggcaacauagugagacccug

SEQ ID NO: 480095 - RNA, 32 nt, Human
guuaccaggccugaggcaucucagccaagcuu

SEQ ID NO: 480096 - RNA, 32 nt, Human
guuaccagugcugggcaguguccuccaagugc

SEQ ID NO: 480097 - RNA, 32 nt, Human
guuaccaguucuuccuccuuccucuuuucccc

SEQ ID NO: 480098 - RNA, 31 nt, Human
guuaccaugacaaccagccgcugcagucacc

SEQ ID NO: 480099 - RNA, 32 nt, Human
guuaccauugaaugagauggaucaguggauau

SEQ ID NO: 480100 - RNA, 32 nt, Human
guuacccacugcaguucuccucugagcuguac

SEQ ID NO: 480101 - RNA, 23 nt, Human
guuacccagauuggagugcagug

SEQ ID NO: 480102 - RNA, 24 nt, Human
guuacccagauuggagugcagugg

SEQ ID NO: 480103 - RNA, 23 nt, Human
guuacccagccuggagugcagug

SEQ ID NO: 480104 - RNA, 24 nt, Human
guuacccagccuggagugcagugg

SEQ ID NO: 480105 - RNA, 32 nt, Human
guuacccaggagaacaaggagauggucuaaac

SEQ ID NO: 480106 - RNA, 32 nt, Human
guuacccaggcaggagugcaguggcgugaucu

SEQ ID NO: 480107 - RNA, 23 nt, Human
guuacccaggccggagugcagug

SEQ ID NO: 480108 - RNA, 24 nt, Human
guuacccaggccggagugcagugg

SEQ ID NO: 480109 - RNA, 24 nt, Human
guuacccaggcuagaguguagugg

SEQ ID NO: 480110 - RNA, 23 nt, Human
guuacccaggcuccagugcagug

SEQ ID NO: 480111 - RNA, 24 nt, Human
guuacccaggcuccagugcagugg

SEQ ID NO: 480112 - RNA, 23 nt, Human
guuacccaggcuggaauacagug

SEQ ID NO: 480113 - RNA, 24 nt, Human
guuacccaggcuggaauacagugg

SEQ ID NO: 480114 - RNA, 23 nt, Human
guuacccaggcuggaaugcagug

SEQ ID NO: 480115 - RNA, 24 nt, Human
guuacccaggcuggaaugcagugg

SEQ ID NO: 480116 - RNA, 23 nt, Human
guuacccaggcuggaggacagug

SEQ ID NO: 480117 - RNA, 23 nt, Human
guuacccaggcuggaguacagug

SEQ ID NO: 480118 - RNA, 24 nt, Human
guuacccaggcuggaguacagugg

SEQ ID NO: 480119 - RNA, 23 nt, Human
guuacccaggcuggagugcaaug

SEQ ID NO: 480120 - RNA, 24 nt, Human
guuacccaggcuggagugcaaugg

SEQ ID NO: 480121 - RNA, 23 nt, Human
guuacccaggcuggagugcagug

SEQ ID NO: 480122 - RNA, 24 nt, Human
guuacccaggcuggagugcagugg

SEQ ID NO: 480123 - RNA, 23 nt, Human
guuacccaggguggagugcagug

SEQ ID NO: 480124 - RNA, 24 nt, Human
guuacccaggguggagugcagugg

SEQ ID NO: 480125 - RNA, 32 nt, Human
guuacccaggguggagugcagugguagcgauc

SEQ ID NO: 480126 - RNA, 21 nt, Human
guuacccaggguggauugcag

SEQ ID NO: 480127 - RNA, 32 nt, Human
guuacccaucuucucuacuguccccauucucu

SEQ ID NO: 480128 - RNA, 24 nt, Human
guuacccaugcuggaguacggugg

SEQ ID NO: 480129 - RNA, 32 nt, Human
guuaccccagagagacacauggggaguagacc

SEQ ID NO: 480130 - RNA, 32 nt, Human
guuaccccuccccauuccccaggcccugggcc

SEQ ID NO: 480131 - RNA, 32 nt, Human
guuacccuacagccugaucugcaccugcucca

SEQ ID NO: 480132 - RNA, 32 nt, Human
guuacccuagaggcaacaauuaauacccacug

SEQ ID NO: 480133 - RNA, 32 nt, Human
guuacccuccacugcccuggaugucccacguu

SEQ ID NO: 480134 - RNA, 20 nt, Human
guuacccuuuggggcuccuu

SEQ ID NO: 480135 - RNA, 32 nt, Human
guuaccgaugcuugugucuugugaaagagaac

SEQ ID NO: 480136 - RNA, 32 nt, Human
guuaccggauggcaucuguucucuccaugccc

SEQ ID NO: 480137 - RNA, 32 nt, Human
guuaccggcacccgcucccucgcucgcaaacu

SEQ ID NO: 480138 - RNA, 32 nt, Human
guuaccggcuggagagccggaggugggaccgg

SEQ ID NO: 480139 - RNA, 32 nt, Human
guuaccgugaaacugguuguaaaagagaaacu

SEQ ID NO: 480140 - RNA, 32 nt, Human
guuaccuacaucuaagcuguucccgaaagagu

SEQ ID NO: 480141 - RNA, 32 nt, Human
guuaccuacuguguucuuaacacugaguugug

SEQ ID NO: 480142 - RNA, 32 nt, Human
guuaccuagcuggcuggguagcaguggauguu

SEQ ID NO: 480143 - RNA, 32 nt, Human
guuaccuagcuucccucuaccguugucuacug

SEQ ID NO: 480144 - RNA, 32 nt, Human
guuaccucacaguccccacccuuucaaaguug

SEQ ID NO: 480145 - RNA, 32 nt, Human
guuaccuccauccuggacacaggaagccagcu

SEQ ID NO: 480146 - RNA, 32 nt, Human
guuaccuccugaccugaggguggagaguggca

SEQ ID NO: 480147 - RNA, 32 nt, Human
guuaccugacccuucucuucuggaaaagugag

SEQ ID NO: 480148 - RNA, 32 nt, Human
guuaccugagauacugaagugcagcucaggag

SEQ ID NO: 480149 - RNA, 32 nt, Human
guuaccugagucugggcaucugugaagaaggg

SEQ ID NO: 480150 - RNA, 32 nt, Human
guuaccuggacuggaacagacugugaauauag

SEQ ID NO: 480151 - RNA, 32 nt, Human
guuaccugggccccaccaggucaucaggagca

SEQ ID NO: 480152 - RNA, 32 nt, Human
guuaccuggucucauuccccuccccacaccua

SEQ ID NO: 480153 - RNA, 32 nt, Human
guuaccuuuaagaagguggaaguggcaaacca

SEQ ID NO: 480154 - RNA, 32 nt, Human
guuaccuuucccaugcugaauuauuuuguugu

SEQ ID NO: 480155 - RNA, 32 nt, Human
guuacgacccaggacaauuagaaaaauucacc

SEQ ID NO: 480156 - RNA, 32 nt, Human
guuacgcagccagccagcaucugggagcccgg

SEQ ID NO: 480157 - RNA, 32 nt, Human
guuacgccgggcauaauggaauugcagaggac

SEQ ID NO: 480158 - RNA, 32 nt, Human
guuacgcggccucucugugccgcuucauuugu

SEQ ID NO: 480159 - RNA, 31 nt, Human
guuacggaaauacgcgacaggagggaguaug

SEQ ID NO: 480160 - RNA, 32 nt, Human
guuacgggacuucucauugucuuaauuucgcu

SEQ ID NO: 480161 - RNA, 32 nt, Human
guuacgggcaacugcucacacaguuguuucuc

SEQ ID NO: 480162 - RNA, 32 nt, Human
guuacggucccaucucuucacaggcauggauu

SEQ ID NO: 480163 - RNA, 32 nt, Human
guuacguacuguguagccccaucuacuaaaac

SEQ ID NO: 480164 - RNA, 32 nt, Human
guuacguguucuguucuaugccuaagcauuuu

SEQ ID NO: 480165 - RNA, 32 nt, Human
guuacuaaaaugguacauuaaaaauucaauua

SEQ ID NO: 480166 - RNA, 32 nt, Human
guuacuaagaagcugcugcgagagggaaaaau

SEQ ID NO: 480167 - RNA, 32 nt, Human
guuacuacaugacaaguacuuauuucacauau

SEQ ID NO: 480168 - RNA, 32 nt, Human
guuacuaccugccuuacccaggaaaaggacau

SEQ ID NO: 480169 - RNA, 32 nt, Human
guuacuacuuagucacaaaccccacauuauuc

SEQ ID NO: 480170 - RNA, 32 nt, Human
guuacuaguuuggaauguccaucaggaccuuu

SEQ ID NO: 480171 - RNA, 32 nt, Human
guuacuauacaauuaugaaauguaauguaaga

SEQ ID NO: 480172 - RNA, 32 nt, Human
guuacuauccucugccuuccucuccuccccua

SEQ ID NO: 480173 - RNA, 32 nt, Human
guuacuauuaucugugcuuuugaggcuauuuc

SEQ ID NO: 480174 - RNA, 22 nt, Human
guuacucaguauaaaacucuga

SEQ ID NO: 480175 - RNA, 21 nt, Human
guuacuccagaggcuaaggca

SEQ ID NO: 480176 - RNA, 32 nt, Human
guuacuccauccacuucucucuccuucucccu

SEQ ID NO: 480177 - RNA, 32 nt, Human
guuacucccuuucucuuccuaccuguggcuca

SEQ ID NO: 480178 - RNA, 32 nt, Human
guuacucucagccuggaauccccaccuugccc

SEQ ID NO: 480179 - RNA, 32 nt, Human
guuacucuccuucccccuaccugggccaguga

SEQ ID NO: 480180 - RNA, 32 nt, Human
guuacucucuuugguaguugaacguugaauuc

SEQ ID NO: 480181 - RNA, 32 nt, Human
guuacucugaagggcaucaugcaucuuacuga

SEQ ID NO: 480182 - RNA, 32 nt, Human
guuacucugcucaugagacagaucugggcucc

SEQ ID NO: 480183 - RNA, 19 nt, Human
guuacucuuaaaacucuag

SEQ ID NO: 480184 - RNA, 32 nt, Human
guuacucuuucaaagcauucacaaacuuuugu

SEQ ID NO: 480185 - RNA, 21 nt, Human
guuacugaauacuccaaguca

SEQ ID NO: 480186 - RNA, 17 nt, Human
guuacugaccccagggc

SEQ ID NO: 480187 - RNA, 22 nt, Human
guuacugagaaacuccaaagca

SEQ ID NO: 480188 - RNA, 20 nt, Human
guuacugaggggccugaggu

SEQ ID NO: 480189 - RNA, 32 nt, Human
guuacugaucacuuaccuucuucucuuucaga

SEQ ID NO: 480190 - RNA, 19 nt, Human
guuacugaugauucagggc

SEQ ID NO: 480191 - RNA, 21 nt, Human
guuacugcagaggcugaggca

SEQ ID NO: 480192 - RNA, 32 nt, Human
guuacugcagcccuaggaaauucacaggguuc

SEQ ID NO: 480193 - RNA, 32 nt, Human
guuacugcaguugaagggcaauaugaaguuac

SEQ ID NO: 480194 - RNA, 32 nt, Human
guuacugccgguuugaaaauaugccugcaauc

SEQ ID NO: 480195 - RNA, 20 nt, Human
guuacuggaagacgaaggua

SEQ ID NO: 480196 - RNA, 22 nt, Human
guuacuggagacaagaagcgca

SEQ ID NO: 480197 - RNA, 32 nt, Human
guuacuggggacugcucugagcuccuagguga

SEQ ID NO: 480198 - RNA, 21 nt, Human
guuacuggggaggcugaggca

SEQ ID NO: 480199 - RNA, 32 nt, Human
guuacugguguugauccugaaagcagacugag

SEQ ID NO: 480200 - RNA, 32 nt, Human
guuacuguaggucuucaaaguuaagaguguaa

SEQ ID NO: 480201 - RNA, 32 nt, Human
guuacuguccacccucauuucugccagcgcau

SEQ ID NO: 480202 - RNA, 20 nt, Human
guuacugucugcuuaaggca

SEQ ID NO: 480203 - RNA, 32 nt, Human
guuacugugagccuggcagagcagaaaaggca

SEQ ID NO: 480204 - RNA, 32 nt, Human
guuacugugguuucacuaaaagcuaccguggu

SEQ ID NO: 480205 - RNA, 32 nt, Human
guuacugugucuuauugguucaaugaugauuu

SEQ ID NO: 480206 - RNA, 32 nt, Human
guuacuguuacccaaggagcaguugaauaucc

SEQ ID NO: 480207 - RNA, 32 nt, Human
guuacuguucaucauggggguaccguggacaa

SEQ ID NO: 480208 - RNA, 32 nt, Human
guuacuguugcauuuaggaggcuccuugaaag

SEQ ID NO: 480209 - RNA, 32 nt, Human
guuacuuaaaagcugacauaagaaaaauuauu

SEQ ID NO: 480210 - RNA, 32 nt, Human
guuacuuagcauuucuuaggugacacaacauu

SEQ ID NO: 480211 - RNA, 32 nt, Human
guuacuuaugaaaaguauuuugcuuaagguug

SEQ ID NO: 480212 - RNA, 32 nt, Human
guuacuuaugauugugccucagucccuaauuu

SEQ ID NO: 480213 - RNA, 32 nt, Human
guuacuuauugacaccucuaugugccaggcuc

SEQ ID NO: 480214 - RNA, 32 nt, Human
guuacuucaguuacccuugcagggggccaggg

SEQ ID NO: 480215 - RNA, 32 nt, Human
guuacuucuuuaucuuuuccuuucuucagacu

SEQ ID NO: 480216 - RNA, 23 nt, Human
guuacuugaccuucucuccuguu

SEQ ID NO: 480217 - RNA, 32 nt, Human
guuacuugaggugggaggaucgcuugagccca

SEQ ID NO: 480218 - RNA, 32 nt, Human
guuacuugauaacagcguuccaucuuuguguu

SEQ ID NO: 480219 - RNA, 32 nt, Human
guuacuugccuaggaggaauguccaagugugu

SEQ ID NO: 480220 - RNA, 32 nt, Human
guuacuugcuccuucauuuccugggccuggug

SEQ ID NO: 480221 - RNA, 32 nt, Human
guuacuuucaauaugacagaagguggaugaag

SEQ ID NO: 480222 - RNA, 32 nt, Human
guuacuuucaguuguccugcuggauuuuaaaa

SEQ ID NO: 480223 - RNA, 32 nt, Human
guuacuuucccaagaucuccccacaagcaagu

SEQ ID NO: 480224 - RNA, 32 nt, Human
guuacuuuccucacaucucccaaacucucucu

SEQ ID NO: 480225 - RNA, 32 nt, Human
guuacuuuucccuugacuggaucccaaguagc

SEQ ID NO: 480226 - RNA, 32 nt, Human
guuacuuuucuuaaaugugucuagucauauau

SEQ ID NO: 480227 - RNA, 32 nt, Human
guuacuuuuugucuuauugauggauuugaaaa

SEQ ID NO: 480228 - RNA, 32 nt, Human
guuagaaaaacaaggcccacagaggccaagag

SEQ ID NO: 480229 - RNA, 32 nt, Human
guuagaaaccagccuggccaacguggugaaac

SEQ ID NO: 480230 - RNA, 32 nt, Human
guuagaaagaugaucuguaucaacagaucuag

SEQ ID NO: 480231 - RNA, 32 nt, Human
guuagaaaggguaggacugagaaacagccuau

SEQ ID NO: 480232 - RNA, 32 nt, Human
guuagaagggaaggaaggaaagaucaaggaac

SEQ ID NO: 480233 - RNA, 32 nt, Human
guuagaagggccagauuucauucucaguccca

SEQ ID NO: 480234 - RNA, 32 nt, Human
guuagaagucaguauuucuucuaaucugaggc

SEQ ID NO: 480235 - RNA, 32 nt, Human
guuagaaguggacuggccauugaggaggcucu

SEQ ID NO: 480236 - RNA, 32 nt, Human
guuagaaguggaugugcaagaccagccacugg

SEQ ID NO: 480237 - RNA, 32 nt, Human
guuagaaugaggaggaaggagagaaggggagg

SEQ ID NO: 480238 - RNA, 32 nt, Human
guuagaaugucugccuuacugguuuccccagg

SEQ ID NO: 480239 - RNA, 32 nt, Human
guuagaauuagccacaggagaauguaaagcau

SEQ ID NO: 480240 - RNA, 32 nt, Human
guuagaauuuagcaggagcuauccugacuuaa

SEQ ID NO: 480241 - RNA, 32 nt, Human
guuagacaaucaguacacaugcugguguguuu

SEQ ID NO: 480242 - RNA, 32 nt, Human
guuagacaauuuaaaagggguguaugagggcc

SEQ ID NO: 480243 - RNA, 32 nt, Human
guuagacacagucccuggucugcagucagagc

SEQ ID NO: 480244 - RNA, 31 nt, Human
guuagaccgcagagagcuggcauucacucaa

SEQ ID NO: 480245 - RNA, 19 nt, Human
guuagaccucgcacaggga

SEQ ID NO: 480246 - RNA, 32 nt, Human
guuagacguuucuccccuuuucccuaccuucc

SEQ ID NO: 480247 - RNA, 32 nt, Human
guuagacuaggaauaagauaacaggaaugucu

SEQ ID NO: 480248 - RNA, 32 nt, Human
guuagacuuuucaguaaaacuaaaguaacugu

SEQ ID NO: 480249 - RNA, 32 nt, Human
guuagagaaaggagugaaggaggcagguggga

SEQ ID NO: 480250 - RNA, 32 nt, Human
guuagagaagcaguacauuugcuuuugauaga

SEQ ID NO: 480251 - RNA, 32 nt, Human
guuagagaaugagagggaaagagagagaauac

SEQ ID NO: 480252 - RNA, 32 nt, Human
guuagagaccagccugggcaacauggugaaau

SEQ ID NO: 480253 - RNA, 32 nt, Human
guuagagaccagccugggcaacguauugagac

SEQ ID NO: 480254 - RNA, 32 nt, Human
guuagagacggagaaagggaagaggcugggau

SEQ ID NO: 480255 - RNA, 32 nt, Human
guuagagagagggcuucucagcaggaugauga

SEQ ID NO: 480256 - RNA, 32 nt, Human
guuagagaugagaaaaggauugagaaggauaa

SEQ ID NO: 480257 - RNA, 32 nt, Human
guuagagcaggacugaugucuccuaagcaccu

SEQ ID NO: 480258 - RNA, 32 nt, Human
guuagagcccucuuucuccccgaagaaagagc

SEQ ID NO: 480259 - RNA, 32 nt, Human
guuagagcuggucagccuuuuuggguaacaca

SEQ ID NO: 480260 - RNA, 32 nt, Human
guuagagcugugguuuggaugcccagagggac

SEQ ID NO: 480261 - RNA, 31 nt, Human
guuagaggaaggaacucuggcauucagaggu

SEQ ID NO: 480262 - RNA, 32 nt, Human
guuagaggacugccugugauccuggccacuag

SEQ ID NO: 480263 - RNA, 32 nt, Human
guuagaggaggaagagggagucuggcaugagu

SEQ ID NO: 480264 - RNA, 32 nt, Human
guuagaggaggaggaggaggaggaagaggugg

SEQ ID NO: 480265 - RNA, 32 nt, Human
guuagaggcaaaaaugaugacccugacaagcc

SEQ ID NO: 480266 - RNA, 32 nt, Human
guuagaggccagccuggcgaaaccccaucucu

SEQ ID NO: 480267 - RNA, 32 nt, Human
guuagaggcccaggcugucugccugcgguccu

SEQ ID NO: 480268 - RNA, 32 nt, Human
guuagagggaaaccgagcuggccuggccagag

SEQ ID NO: 480269 - RNA, 32 nt, Human
guuagagggaaagaggcuugggaagaaaacag

SEQ ID NO: 480270 - RNA, 32 nt, Human
guuagagggagaagauggagggaaucuaggga

SEQ ID NO: 480271 - RNA, 32 nt, Human
guuagagggaugcaagaaggagaggugaaggu

SEQ ID NO: 480272 - RNA, 32 nt, Human
guuagagguauacauuuauuuaucuguuguac

SEQ ID NO: 480273 - RNA, 32 nt, Human
guuagaggucaaaagcagcugccugaaugagu

SEQ ID NO: 480274 - RNA, 32 nt, Human
guuagagguggaggauuuuccuauguuccccc

SEQ ID NO: 480275 - RNA, 32 nt, Human
guuagaggugugcuguguuaaaaggccagaua

SEQ ID NO: 480276 - RNA, 32 nt, Human
guuagagucgggcuccgacagcgcggccgagu

SEQ ID NO: 480277 - RNA, 21 nt, Human
guuagauaaauggaauccugu

SEQ ID NO: 480278 - RNA, 24 nt, Human
guuagauagauggaaucucuguca

SEQ ID NO: 480279 - RNA, 32 nt, Human
guuagaucaccaugcugcaacaugguuuauau

SEQ ID NO: 480280 - RNA, 22 nt, Human
guuagaugcugaaauguccaga

SEQ ID NO: 480281 - RNA, 32 nt, Human
guuagaugucauaaaccauuuguauuuguugu

SEQ ID NO: 480282 - RNA, 32 nt, Human
guuagauguucaugcuguaugugcccgugccu

SEQ ID NO: 480283 - RNA, 32 nt, Human
guuagauucaaaacaucauaaagaugauagca

SEQ ID NO: 480284 - RNA, 32 nt, Human
guuagauugcuucacauucucuugucaccacc

SEQ ID NO: 480285 - RNA, 32 nt, Human
guuagauuuucugccagaggggugggucagag

SEQ ID NO: 480286 - RNA, 32 nt, Human
guuagcaaaucaggaaugcaagccuuguucaa

SEQ ID NO: 480287 - RNA, 32 nt, Human
guuagcaaggcccacugcugcuccugggugag

SEQ ID NO: 480288 - RNA, 32 nt, Human
guuagcaaugccgaaagguuucugucuuaaaa

SEQ ID NO: 480289 - RNA, 32 nt, Human
guuagcacagccugugacagagccugggcagg

SEQ ID NO: 480290 - RNA, 32 nt, Human
guuagcacgaggaggaaggaagaaauggagau

SEQ ID NO: 480291 - RNA, 32 nt, Human
guuagcacgguggagcugguagccacgccugc

SEQ ID NO: 480292 - RNA, 32 nt, Human
guuagcagagaaaggacucaccuuagugguga

SEQ ID NO: 480293 - RNA, 32 nt, Human
guuagcagggguccccagggcaagucagccuc

SEQ ID NO: 480294 - RNA, 32 nt, Human
guuagcagugccugggccugggccucagaggg

SEQ ID NO: 480295 - RNA, 32 nt, Human
guuagcauccgucagggugacccuuuacagaa

SEQ ID NO: 480296 - RNA, 32 nt, Human
guuagcauccgucagggugacccuuugcagaa

SEQ ID NO: 480297 - RNA, 32 nt, Human
guuagcaucugccagggugacccuuuacagaa

SEQ ID NO: 480298 - RNA, 32 nt, Human
guuagcauguugaaggacacucccacgacagu

SEQ ID NO: 480299 - RNA, 19 nt, Human
guuagcauuaaaguucuag

SEQ ID NO: 480300 - RNA, 32 nt, Human
guuagccacggaaacauagaaacauacacaag

SEQ ID NO: 480301 - RNA, 32 nt, Human
guuagccacugcaggcccucggugggacagcg

SEQ ID NO: 480302 - RNA, 32 nt, Human
guuagccagcacuucugcucugucgucucucc

SEQ ID NO: 480303 - RNA, 32 nt, Human
guuagccaggacagugacagugaggcauaccc

SEQ ID NO: 480304 - RNA, 32 nt, Human
guuagccaguuucuucagauaaguacccccac

SEQ ID NO: 480305 - RNA, 32 nt, Human
guuagcccaaguugaagaaagccgggcugugc

SEQ ID NO: 480306 - RNA, 32 nt, Human
guuagccgcccucuacucccaggcuggaggga

SEQ ID NO: 480307 - RNA, 31 nt, Human
guuagccguggggaaagauggcggaaaauuu

SEQ ID NO: 480308 - RNA, 32 nt, Human
guuagccuaccuucauuaauucuaucacauag

SEQ ID NO: 480309 - RNA, 32 nt, Human
guuagccucuugcguauuggcuuuuucagagu

SEQ ID NO: 480310 - RNA, 32 nt, Human
guuagccuggcagagccaggggugaagggaga

SEQ ID NO: 480311 - RNA, 32 nt, Human
guuagccuuuucuccccagacuuguuggcaua

SEQ ID NO: 480312 - RNA, 32 nt, Human
guuagcgaccuacugggcuuuccucuugcuga

SEQ ID NO: 480313 - RNA, 32 nt, Human
guuagcggcgguggaggaggaggcagagagga

SEQ ID NO: 480314 - RNA, 32 nt, Human
guuagcuaagagaauagacagaauuggaaaau

SEQ ID NO: 480315 - RNA, 32 nt, Human
guuagcucccugcacucuggcucuuuacuggc

SEQ ID NO: 480316 - RNA, 32 nt, Human
guuagcuccuacugcuaaucuuuccauaagcg

SEQ ID NO: 480317 - RNA, 32 nt, Human
guuagcugagacacccccucuccaggggacag

SEQ ID NO: 480318 - RNA, 32 nt, Human
guuagcugauugugguaaacaauguuuaaugu

SEQ ID NO: 480319 - RNA, 32 nt, Human
guuagcuggaggacaggauguugggaaaggaa

SEQ ID NO: 480320 - RNA, 32 nt, Human
guuagcugggucuggugccucugugguuccag

SEQ ID NO: 480321 - RNA, 32 nt, Human
guuagcugugagccagcacucagcugugucag

SEQ ID NO: 480322 - RNA, 32 nt, Human
guuagcuuucagucaucagccaugguuccaag

SEQ ID NO: 480323 - RNA, 32 nt, Human
guuagcuuuggguugcagugcuagauauuguu

SEQ ID NO: 480324 - RNA, 32 nt, Human
guuaggaacauguaaggccaaguacacugaga

SEQ ID NO: 480325 - RNA, 32 nt, Human
guuaggaagcuuuuccucugaggcccacgauu

SEQ ID NO: 480326 - RNA, 24 nt, Human
guuaggaaugucaacagagcaagg

SEQ ID NO: 480327 - RNA, 32 nt, Human
guuaggaccaaagugcuggauuacaggcguga

SEQ ID NO: 480328 - RNA, 32 nt, Human
guuaggaccacagcccugggcaaaggggacca

SEQ ID NO: 480329 - RNA, 32 nt, Human
guuaggaccuccugugacccacccucauuccu

SEQ ID NO: 480330 - RNA, 32 nt, Human
guuaggagaagggguuucuugaucaugucaug

SEQ ID NO: 480331 - RNA, 32 nt, Human
guuaggagagcauagcaucaugauguauuagc

SEQ ID NO: 480332 - RNA, 32 nt, Human
guuaggagagcugccugaaacaacaccucugc

SEQ ID NO: 480333 - RNA, 30 nt, Human
guuaggagcuugcaggcauuaggacugucc

SEQ ID NO: 480334 - RNA, 32 nt, Human
guuaggaggaagaagggggaaaaaggaagaag

SEQ ID NO: 480335 - RNA, 32 nt, Human
guuaggaggcuccccauccacccuuuacauga

SEQ ID NO: 480336 - RNA, 32 nt, Human
guuaggaggcucuacaggagaaucauuuccuu

SEQ ID NO: 480337 - RNA, 32 nt, Human
guuaggaugcggcuuucucugccucugggcag

SEQ ID NO: 480338 - RNA, 32 nt, Human
guuaggcaaggaggugguuggccagagauggg

SEQ ID NO: 480339 - RNA, 32 nt, Human
guuaggcaagggacaaugaugccuuggaccug

SEQ ID NO: 480340 - RNA, 32 nt, Human
guuaggcauuguggagcuccuccugagccugg

SEQ ID NO: 480341 - RNA, 32 nt, Human
guuaggccagcggggauugaggcugcgggauc

SEQ ID NO: 480342 - RNA, 18 nt, Human
guuaggccaggugcaaug

SEQ ID NO: 480343 - RNA, 32 nt, Human
guuaggcccaagggugggggaggcaggaggag

SEQ ID NO: 480344 - RNA, 32 nt, Human
guuaggcccugcacuccaccuggggacggccc

SEQ ID NO: 480345 - RNA, 32 nt, Human
guuaggccugcucuggccuaauggaucuuacu

SEQ ID NO: 480346 - RNA, 32 nt, Human
guuaggccugggagaacugagggaccugagga

SEQ ID NO: 480347 - RNA, 32 nt, Human
guuaggcuauucacaaccacucauucaaaagu

SEQ ID NO: 480348 - RNA, 32 nt, Human
guuaggcucacugucuaggccaggcccaccuu

SEQ ID NO: 480349 - RNA, 32 nt, Human
guuaggcugucgucccccuccagugcuuggcu

SEQ ID NO: 480350 - RNA, 32 nt, Human
guuaggcuuagagagaaaagcuggauaugaga

SEQ ID NO: 480351 - RNA, 32 nt, Human
guuaggcuuccucucuuucuuucucacagaua

SEQ ID NO: 480352 - RNA, 32 nt, Human
guuaggcuugcaggaagauaugacccagcuga

SEQ ID NO: 480353 - RNA, 32 nt, Human
guuagggaagcauaaagggggcuugaaccugu

SEQ ID NO: 480354 - RNA, 32 nt, Human
guuagggacaccccuggcuggcagcagccguu

SEQ ID NO: 480355 - RNA, 32 nt, Human
guuagggaugucacagaaaugucugugucuga

SEQ ID NO: 480356 - RNA, 32 nt, Human
guuagggcaaagagagucuggccacaugcagc

SEQ ID NO: 480357 - RNA, 32 nt, Human
guuagggcagggaggggacuggggaagugcgc

SEQ ID NO: 480358 - RNA, 32 nt, Human
guuagggcagugaggaagggaaauauggggcu

SEQ ID NO: 480359 - RNA, 32 nt, Human
guuagggccucaccgaccugcuuccaccccuc

SEQ ID NO: 480360 - RNA, 32 nt, Human
guuagggcuagucagagaaucauagaacguua

SEQ ID NO: 480361 - RNA, 32 nt, Human
guuagggcuccuauucaacacacacaugcuuc

SEQ ID NO: 480362 - RNA, 32 nt, Human
guuagggcuggggcucagccugggggagccua

SEQ ID NO: 480363 - RNA, 32 nt, Human
guuagggcugguggugagggaucauguaaaga

SEQ ID NO: 480364 - RNA, 31 nt, Human
guuaggggagcaccuguuucagacugggcau

SEQ ID NO: 480365 - RNA, 32 nt, Human
guuaggggagcaccuguuucagacugggcaug

SEQ ID NO: 480366 - RNA, 32 nt, Human
guuaggggagccaacaugccaguggcccggag

SEQ ID NO: 480367 - RNA, 32 nt, Human
guuagggggcuugccuugcucucuccagggcc

SEQ ID NO: 480368 - RNA, 32 nt, Human
guuaggguguggggaauuucuacugaagucug

SEQ ID NO: 480369 - RNA, 32 nt, Human
guuagguaaugauuucuccaagucacaggagc

SEQ ID NO: 480370 - RNA, 32 nt, Human
guuagguacugaccccucccucuugggcagca

SEQ ID NO: 480371 - RNA, 32 nt, Human
guuagguagcuuuagggcaauauugccauggu

SEQ ID NO: 480372 - RNA, 32 nt, Human
guuagguagggagcugguuggagaaggugcua

SEQ ID NO: 480373 - RNA, 32 nt, Human
guuagguauuggggaagagagacugaagucac

SEQ ID NO: 480374 - RNA, 32 nt, Human
guuaggugauuucaucauccugcaacaucaga

SEQ ID NO: 480375 - RNA, 32 nt, Human
guuaggugcucaauaaaaacuguaugguuaga

SEQ ID NO: 480376 - RNA, 31 nt, Human
guuaggugcucaauaaacggaguugccgcug

SEQ ID NO: 480377 - RNA, 32 nt, Human
guuagguggagugugcagggagguaggucuuc

SEQ ID NO: 480378 - RNA, 32 nt, Human
guuagguggauaccugcccugacaugugaggc

SEQ ID NO: 480379 - RNA, 32 nt, Human
guuaggugucagaaagaaaaggaaguaauuua

SEQ ID NO: 480380 - RNA, 32 nt, Human
guuagguuaugacaggagcagcacugcagcca

SEQ ID NO: 480381 - RNA, 32 nt, Human
guuagguugcgcagagguggucuuauccagcu

SEQ ID NO: 480382 - RNA, 32 nt, Human
guuagguuuaccucccccuuucugugccuggg

SEQ ID NO: 480383 - RNA, 32 nt, Human
guuagguuuuuaccccuucuaaaauaaguuuu

SEQ ID NO: 480384 - RNA, 32 nt, Human
guuaguaauguucaacuuuucacaaagauggu

SEQ ID NO: 480385 - RNA, 21 nt, Human
guuaguagacgucuucauuca

SEQ ID NO: 480386 - RNA, 32 nt, Human
guuaguagaggaggcagcuaggcguggcucuc

SEQ ID NO: 480387 - RNA, 32 nt, Human
guuaguaguucuaauauccacuugagaguaua

SEQ ID NO: 480388 - RNA, 32 nt, Human
guuaguauuauuuauguguaucgggagugugu

SEQ ID NO: 480389 - RNA, 32 nt, Human
guuaguauugcugcccuucuucacauaaauuu

SEQ ID NO: 480390 - RNA, 32 nt, Human
guuagucaagaugaaggaggaggacuggcugc

SEQ ID NO: 480391 - RNA, 32 nt, Human
guuagucaucugugcuuucuuuaccaacuggc

SEQ ID NO: 480392 - RNA, 32 nt, Human
guuagucauuagcugagauguugauuuuaaaa

SEQ ID NO: 480393 - RNA, 32 nt, Human
guuaguccagccgccggcacgugucccggaac

SEQ ID NO: 480394 - RNA, 32 nt, Human
guuaguccuccaccaaggccaccagugaucag

SEQ ID NO: 480395 - RNA, 32 nt, Human
guuagucugcauuccacagcuucucaguugcc

SEQ ID NO: 480396 - RNA, 23 nt, Human
guuagucuguucucaugcugcua

SEQ ID NO: 480397 - RNA, 32 nt, Human
guuagugagaguuucacucuuguugccuaggc

SEQ ID NO: 480398 - RNA, 32 nt, Human
guuagugcacaugugcacccagaagaccacuc

SEQ ID NO: 480399 - RNA, 32 nt, Human
guuagugcagcuccugaccaggccuucagggu

SEQ ID NO: 480400 - RNA, 32 nt, Human
guuaguggagcuuggaugggaacuuacccagc

SEQ ID NO: 480401 - RNA, 32 nt, Human
guuaguggcugccucauauagcacuuuugaag

SEQ ID NO: 480402 - RNA, 31 nt, Human
guuagugggcagguggccacagcaggacuga

SEQ ID NO: 480403 - RNA, 32 nt, Human
guuaguguagugugugucugauuauuuacaug

SEQ ID NO: 480404 - RNA, 32 nt, Human
guuaguguggucuguucuuuaccucccuuuau

SEQ ID NO: 480405 - RNA, 32 nt, Human
guuaguuacuaguuauuacagcuguaaggaua

SEQ ID NO: 480406 - RNA, 32 nt, Human
guuaguuacuuucuccaauucucccuccuuuu

SEQ ID NO: 480407 - RNA, 32 nt, Human
guuaguuaugauuuuuaaaagcauuaaauuaa

SEQ ID NO: 480408 - RNA, 32 nt, Human
guuaguuauguauacagaacuggcaguuguca

SEQ ID NO: 480409 - RNA, 32 nt, Human
guuaguucacccaguucuguggggcaggaaag

SEQ ID NO: 480410 - RNA, 32 nt, Human
guuaguucgugucuaggauuugagugccuuac

SEQ ID NO: 480411 - RNA, 32 nt, Human
guuaguucuuuucuccccuugaggucaguaau

SEQ ID NO: 480412 - RNA, 32 nt, Human
guuaguugaagaaaaagcaguucccaggugcc

SEQ ID NO: 480413 - RNA, 32 nt, Human
guuaguugcuaguacaggaaucguuuauuggu

SEQ ID NO: 480414 - RNA, 32 nt, Human
guuaguugcucucugucauagcccgcagaagc

SEQ ID NO: 480415 - RNA, 32 nt, Human
guuaguugcugacucggaugcagagagucggu

SEQ ID NO: 480416 - RNA, 32 nt, Human
guuaguuucuccaagcaggacauggacaagga

SEQ ID NO: 480417 - RNA, 32 nt, Human
guuaguuuugccguggaucagaugguuuauaa

SEQ ID NO: 480418 - RNA, 32 nt, Human
guuauaaaaugagaaacuuuguaacuggaaaa

SEQ ID NO: 480419 - RNA, 32 nt, Human
guuauaaaccuacaaaaugggcccugcccuca

SEQ ID NO: 480420 - RNA, 32 nt, Human
guuauaaagaauugguuucuuggaaagcaggc

SEQ ID NO: 480421 - RNA, 32 nt, Human
guuauaaagaguauuuacaaauuuccauuggg

SEQ ID NO: 480422 - RNA, 32 nt, Human
guuauaaagccagaagcauguucuccacaauu

SEQ ID NO: 480423 - RNA, 32 nt, Human
guuauaaccugacugaaccaaauccaucagca

SEQ ID NO: 480424 - RNA, 32 nt, Human
guuauaacucugggaaauuccaucucuugcau

SEQ ID NO: 480425 - RNA, 32 nt, Human
guuauacaaacccugagucaacagaugcguuu

SEQ ID NO: 480426 - RNA, 32 nt, Human
guuauacaaugccaguuugcaauaguugauuu

SEQ ID NO: 480427 - RNA, 32 nt, Human
guuauacacagaaacaaacacacacgcacgua

SEQ ID NO: 480428 - RNA, 32 nt, Human
guuauacaugaacagaacaagauccucaugaa

SEQ ID NO: 480429 - RNA, 32 nt, Human
guuauacauugauauuuauucuuucugucccc

SEQ ID NO: 480430 - RNA, 32 nt, Human
guuauaccauuuccucagcuuaucucuuuuau

SEQ ID NO: 480431 - RNA, 32 nt, Human
guuauacuggaaaauucaggugccacugaaag

SEQ ID NO: 480432 - RNA, 19 nt, Human
guuauacuguaaccucuua

SEQ ID NO: 480433 - RNA, 32 nt, Human
guuauacuuccuauuuuuaaugggcuuuuaug

SEQ ID NO: 480434 - RNA, 32 nt, Human
guuauagacucauguguguucugaauucuggu

SEQ ID NO: 480435 - RNA, 32 nt, Human
guuauagaggucuuuggacucuaaagaccaau

SEQ ID NO: 480436 - RNA, 32 nt, Human
guuauagauggagagaccuauaaaggacucca

SEQ ID NO: 480437 - RNA, 32 nt, Human
guuauagauuaguuacugcuacccaggguauc

SEQ ID NO: 480438 - RNA, 32 nt, Human
guuauagcaggaggagaaaaacaagccauuuu

SEQ ID NO: 480439 - RNA, 32 nt, Human
guuauagccgagcaaaugaaccguccuccugc

SEQ ID NO: 480440 - RNA, 32 nt, Human
guuauagcugugacuucugcccugccaggccg

SEQ ID NO: 480441 - RNA, 32 nt, Human
guuauaggacaccaagcagauuuaacccaaag

SEQ ID NO: 480442 - RNA, 32 nt, Human
guuauaggucucccccuaggccugucucuccc

SEQ ID NO: 480443 - RNA, 32 nt, Human
guuauaggugugagccacugucccuggccuau

SEQ ID NO: 480444 - RNA, 32 nt, Human
guuauaguggaaagugccucagcuggaaagau

SEQ ID NO: 480445 - RNA, 20 nt, Human
guuauauaauuaaagcucug

SEQ ID NO: 480446 - RNA, 19 nt, Human
guuauauacucaaauguau

SEQ ID NO: 480447 - RNA, 32 nt, Human
guuauauaguuauauuucacuucucuuuuaau

SEQ ID NO: 480448 - RNA, 32 nt, Human
guuauaucagacaguccucuauaacucuguac

SEQ ID NO: 480449 - RNA, 32 nt, Human
guuauaucucuuguccuuagcacaguaccugg

SEQ ID NO: 480450 - RNA, 32 nt, Human
guuauauguuaugugcauucuaccacaauuca

SEQ ID NO: 480451 - RNA, 32 nt, Human
guuauauuacuguagaaccacagugcccaucu

SEQ ID NO: 480452 - RNA, 32 nt, Human
guuauauucugagucaaaguuggggcuuuuua

SEQ ID NO: 480453 - RNA, 32 nt, Human
guuauauugccuaggcuggaaugcagugguua

SEQ ID NO: 480454 - RNA, 32 nt, Human
guuaucaaaaccacacugaaagaagauacagu

SEQ ID NO: 480455 - RNA, 32 nt, Human
guuaucaacacacacccuagaguaaaucuguu

SEQ ID NO: 480456 - RNA, 32 nt, Human
guuaucacaccacugcacuccagccuggguga

SEQ ID NO: 480457 - RNA, 32 nt, Human
guuaucacaccacugcacuucagccuggauga

SEQ ID NO: 480458 - RNA, 32 nt, Human
guuaucacagaagauacugucucauagaaguu

SEQ ID NO: 480459 - RNA, 32 nt, Human
guuaucagaauccauuucuuccacaccucuga

SEQ ID NO: 480460 - RNA, 32 nt, Human
guuaucagggacugugcucgugagcgccgacc

SEQ ID NO: 480461 - RNA, 32 nt, Human
guuaucagggacugugcucgugagcgcggacc

SEQ ID NO: 480462 - RNA, 32 nt, Human
guuaucagucuggaaauauucagcauuauucu

SEQ ID NO: 480463 - RNA, 32 nt, Human
guuaucaguguacguucuaauugagagcauuc

SEQ ID NO: 480464 - RNA, 32 nt, Human
guuaucaugacuucuauuuggcaccggcccgu

SEQ ID NO: 480465 - RNA, 32 nt, Human
guuauccacagccugggaaccugccuuaagcu

SEQ ID NO: 480466 - RNA, 32 nt, Human
guuauccagaagcuguuauguccuguuuccau

SEQ ID NO: 480467 - RNA, 23 nt, Human
guuauccaggcuggugugcagug

SEQ ID NO: 480468 - RNA, 28 nt, Human
guuaucccaagugcucuuauucugguga

SEQ ID NO: 480469 - RNA, 32 nt, Human
guuaucccaagugcucuuauucuggugagaag

SEQ ID NO: 480470 - RNA, 32 nt, Human
guuaucccacugcacucugcuuaaggguuccu

SEQ ID NO: 480471 - RNA, 32 nt, Human
guuaucccagcacuuggggaggcugaggcggg

SEQ ID NO: 480472 - RNA, 32 nt, Human
guuaucccuacgcuucccagagagaacaaugc

SEQ ID NO: 480473 - RNA, 32 nt, Human
guuauccucccgccuuggcaucccaaaguguu

SEQ ID NO: 480474 - RNA, 32 nt, Human
guuauccucuccucugaauuuuguucuucaga

SEQ ID NO: 480475 - RNA, 32 nt, Human
guuauccuuagaguguuuuccgucuagggccg

SEQ ID NO: 480476 - RNA, 32 nt, Human
guuaucgaacuuucuuuguugcugcuaguuaa

SEQ ID NO: 480477 - RNA, 32 nt, Human
guuaucgugagcugacauugcgccacugcacu

SEQ ID NO: 480478 - RNA, 32 nt, Human
guuaucuaaugaggaacaaacacuaaccuaag

SEQ ID NO: 480479 - RNA, 32 nt, Human
guuaucucaaaccagucugcugguuaaaugga

SEQ ID NO: 480480 - RNA, 31 nt, Human
guuaucucaauaagauacuuauaugagaacu

SEQ ID NO: 480481 - RNA, 32 nt, Human
guuaucucaugcaccucugagugccuucuucc

SEQ ID NO: 480482 - RNA, 32 nt, Human
guuaucucauugugguuuugauuugcauuucu

SEQ ID NO: 480483 - RNA, 32 nt, Human
guuaucugaaagcucaguaacucagaacagga

SEQ ID NO: 480484 - RNA, 32 nt, Human
guuaucugcucccugcaggccuagagaaguuu

SEQ ID NO: 480485 - RNA, 32 nt, Human
guuaucuguuagaacagucucuguacacaauu

SEQ ID NO: 480486 - RNA, 32 nt, Human
guuaucuguuuugacacagauuuccuuguaaa

SEQ ID NO: 480487 - RNA, 22 nt, Human
guuaucuuccugcugggcagug

SEQ ID NO: 480488 - RNA, 22 nt, Human
guuaucuuugugcuauauagug

SEQ ID NO: 480489 - RNA, 32 nt, Human
guuaugaaaagaagcucagagcagagcaccga

SEQ ID NO: 480490 - RNA, 32 nt, Human
guuaugaaaggaguuaauguaucugcgagcuc

SEQ ID NO: 480491 - RNA, 32 nt, Human
guuaugaaaugaguaguaauauugggugguug

SEQ ID NO: 480492 - RNA, 32 nt, Human
guuaugaggaagggggaggccucuguaggcug

SEQ ID NO: 480493 - RNA, 32 nt, Human
guuaugauggggcaagauggcagagguauugg

SEQ ID NO: 480494 - RNA, 32 nt, Human
guuaugauugugccacugcgcuccaggcuggg

SEQ ID NO: 480495 - RNA, 32 nt, Human
guuaugauuuauuuugcaacuaccucaggaca

SEQ ID NO: 480496 - RNA, 32 nt, Human
guuaugauuucauauccugagauagcucugca

SEQ ID NO: 480497 - RNA, 32 nt, Human
guuaugcacaauauuaaauacauguuaccagu

SEQ ID NO: 480498 - RNA, 32 nt, Human
guuaugcacacuuuacaaacaaggggauugag

SEQ ID NO: 480499 - RNA, 32 nt, Human
guuaugcaccgccauggcccacauuaacgcuc

SEQ ID NO: 480500 - RNA, 32 nt, Human
guuaugcagaagcagagaugaggaggcuggcc

SEQ ID NO: 480501 - RNA, 32 nt, Human
guuaugcagcuacuuccucuccccagccuuac

SEQ ID NO: 480502 - RNA, 32 nt, Human
guuaugcaguuacuuccucuccccagccuuac

SEQ ID NO: 480503 - RNA, 32 nt, Human
guuaugccuccuccucaaguuccuggcccgug

SEQ ID NO: 480504 - RNA, 32 nt, Human
guuaugccuuucaguguuaacuccuuucuuuu

SEQ ID NO: 480505 - RNA, 32 nt, Human
guuaugcggcuggcugccaccgaccuguuguu

SEQ ID NO: 480506 - RNA, 32 nt, Human
guuaugcucugccaccuaccaaacucuggagu

SEQ ID NO: 480507 - RNA, 32 nt, Human
guuaugcuggaccgggcggugagggaaaccga

SEQ ID NO: 480508 - RNA, 32 nt, Human
guuauggaaggugacuuugggauguaagagug

SEQ ID NO: 480509 - RNA, 32 nt, Human
guuauggacacauaacucccgggccagaggcu

SEQ ID NO: 480510 - RNA, 32 nt, Human
guuauggacacauaacuccugggccagaggcu

SEQ ID NO: 480511 - RNA, 32 nt, Human
guuauggacacauaauccugggccagagacua

SEQ ID NO: 480512 - RNA, 32 nt, Human
guuauggacacauacuccugggccagaggcua

SEQ ID NO: 480513 - RNA, 32 nt, Human
guuauggaccaaaagccaaaucuccaucugac

SEQ ID NO: 480514 - RNA, 32 nt, Human
guuauggacugcugccuuuaaaccacaucggu

SEQ ID NO: 480515 - RNA, 32 nt, Human
guuauggagaaaaauacagcagaggaaggaga

SEQ ID NO: 480516 - RNA, 32 nt, Human
guuauggagaugguucagggaggcuuggagua

SEQ ID NO: 480517 - RNA, 32 nt, Human
guuauggaguaucagaaucuuuccauggaaac

SEQ ID NO: 480518 - RNA, 32 nt, Human
guuauggauuuccuuguucugugucuuuaucc

SEQ ID NO: 480519 - RNA, 32 nt, Human
guuauggccacugggcugggcggcugaccgcg

SEQ ID NO: 480520 - RNA, 32 nt, Human
guuauggccucugcacuccagccugggugaca

SEQ ID NO: 480521 - RNA, 32 nt, Human
guuauggcuaaggacaugaaauugucagaaug

SEQ ID NO: 480522 - RNA, 32 nt, Human
guuauggcucagaagaagaaaugaacugugaa

SEQ ID NO: 480523 - RNA, 32 nt, Human
guuauggcugcagccccugccugugugucugg

SEQ ID NO: 480524 - RNA, 32 nt, Human
guuaugggaggugagagaagaacgaugugaua

SEQ ID NO: 480525 - RNA, 28 nt, Human
guuaugggcccguuccaggcagaaagag

SEQ ID NO: 480526 - RNA, 32 nt, Human
guuaugggucuauuucuuccaugauuagagga

SEQ ID NO: 480527 - RNA, 32 nt, Human
guuaugggugugagccaccgcgccuggccuau

SEQ ID NO: 480528 - RNA, 32 nt, Human
guuauggucauuuauuaauuuucacuaaucca

SEQ ID NO: 480529 - RNA, 32 nt, Human
guuauggugauggauggauguggauuuggaag

SEQ ID NO: 480530 - RNA, 32 nt, Human
guuaugguguaaggaguaugcccagccccuga

SEQ ID NO: 480531 - RNA, 32 nt, Human
guuauguacaaggcacugggcuuagcaccaca

SEQ ID NO: 480532 - RNA, 32 nt, Human
guuauguauacacaugcacauaugugccuugg

SEQ ID NO: 480533 - RNA, 32 nt, Human
guuauguaucagcuagauacugagcuuugaua

SEQ ID NO: 480534 - RNA, 32 nt, Human
guuauguauuuccuggauguuuggaaacauuu

SEQ ID NO: 480535 - RNA, 32 nt, Human
guuaugucauuugagacuguuucuaauaacug

SEQ ID NO: 480536 - RNA, 32 nt, Human
guuaugugaaggaugaaaggugggugaaagga

SEQ ID NO: 480537 - RNA, 32 nt, Human
guuaugugagccacugucuuucccauuuuugg

SEQ ID NO: 480538 - RNA, 32 nt, Human
guuauguuaaugauaucucuauacugcaucau

SEQ ID NO: 480539 - RNA, 32 nt, Human
guuauguucccuuucuggcauagcauucacuu

SEQ ID NO: 480540 - RNA, 24 nt, Human
guuauguugcccaggcuggucuca

SEQ ID NO: 480541 - RNA, 32 nt, Human
guuauguugguucauuuguucaauuguacagg

SEQ ID NO: 480542 - RNA, 32 nt, Human
guuauguuuaucucaauucccuggugguauug

SEQ ID NO: 480543 - RNA, 32 nt, Human
guuauuaaaaauuugauacacacagaaaaucu

SEQ ID NO: 480544 - RNA, 32 nt, Human
guuauuaaaaccagaagaauacuuuguggcug

SEQ ID NO: 480545 - RNA, 19 nt, Human
guuauuaauagagcucuaa

SEQ ID NO: 480546 - RNA, 32 nt, Human
guuauuacauuuacuguauugggaaacuugag

SEQ ID NO: 480547 - RNA, 32 nt, Human
guuauuaccaggaggaagagaaagaggacaaa

SEQ ID NO: 480548 - RNA, 32 nt, Human
guuauuaccccauacuugaagauagcuuagug

SEQ ID NO: 480549 - RNA, 32 nt, Human
guuauuagcuuuguggcuuugugaaauucuaa

SEQ ID NO: 480550 - RNA, 32 nt, Human
guuauuaggagaauguacaaagagcacuguga

SEQ ID NO: 480551 - RNA, 32 nt, Human
guuauuauaugcagagcucuugguucacaguu

SEQ ID NO: 480552 - RNA, 32 nt, Human
guuauuauguguaagaugaguugcuauuuuuc

SEQ ID NO: 480553 - RNA, 32 nt, Human
guuauuauuauuauuacuacuauugccuucuc

SEQ ID NO: 480554 - RNA, 32 nt, Human
guuauucaaaagggaguggagugcagucaugc

SEQ ID NO: 480555 - RNA, 32 nt, Human
guuauucaaauuuguacaggacuguaaagauu

SEQ ID NO: 480556 - RNA, 32 nt, Human
guuauucauaaagagaaaaugaugaguuuuua

SEQ ID NO: 480557 - RNA, 32 nt, Human
guuauucauaaauauuggacaguuuauuaauu

SEQ ID NO: 480558 - RNA, 32 nt, Human
guuauucaucugccgugcaacugggguuugca

SEQ ID NO: 480559 - RNA, 32 nt, Human
guuauucauucuagaugauacaacucuuauuu

SEQ ID NO: 480560 - RNA, 32 nt, Human
guuauuccucaccccuucacucaacuccauug

SEQ ID NO: 480561 - RNA, 32 nt, Human
guuauuccuugugacauacuuucuuacauguu

SEQ ID NO: 480562 - RNA, 32 nt, Human
guuauuccuuugcagugcagcugcccuguaga

SEQ ID NO: 480563 - RNA, 32 nt, Human
guuauucucaacugaauuucugcuaagugcau

SEQ ID NO: 480564 - RNA, 32 nt, Human
guuauucuccaucucccagcucagcuuuuucu

SEQ ID NO: 480565 - RNA, 32 nt, Human
guuauucugucuccucuucuuugucaucagcc

SEQ ID NO: 480566 - RNA, 32 nt, Human
guuauugaaacagcuccagacagccaagccuu

SEQ ID NO: 480567 - RNA, 32 nt, Human
guuauugaagaaaugauggaguaagagacucu

SEQ ID NO: 480568 - RNA, 19 nt, Human
guuauugaaggccccaagg

SEQ ID NO: 480569 - RNA, 32 nt, Human
guuauugacuacuauucagcacugccuucaau

SEQ ID NO: 480570 - RNA, 32 nt, Human
guuauugacucugaauuugccucaucguaugu

SEQ ID NO: 480571 - RNA, 32 nt, Human
guuauugauaccuuaaaggucaccuaccacaa

SEQ ID NO: 480572 - RNA, 32 nt, Human
guuauugauauggugagccccaucucucaguu

SEQ ID NO: 480573 - RNA, 32 nt, Human
guuauugcagaacuuccuguccugguggagaa

SEQ ID NO: 480574 - RNA, 32 nt, Human
guuauugcugguacuuuugagggggcacaaua

SEQ ID NO: 480575 - RNA, 32 nt, Human
guuauugcuguucgcccgcugugugugcucau

SEQ ID NO: 480576 - RNA, 32 nt, Human
guuauuggagugaugacaggaacacgggagaa

SEQ ID NO: 480577 - RNA, 32 nt, Human
guuauugggaaguauucugaagaggcaauagc

SEQ ID NO: 480578 - RNA, 32 nt, Human
guuauuggugcucuuuacuggccaaagcucag

SEQ ID NO: 480579 - RNA, 32 nt, Human
guuauugguuuguaaugcuagcacagaacuga

SEQ ID NO: 480580 - RNA, 32 nt, Human
guuauuuaaauaaaaagaaaguggaacuggaa

SEQ ID NO: 480581 - RNA, 32 nt, Human
guuauuuaguaaaauaugaauuuugcucuauu

SEQ ID NO: 480582 - RNA, 32 nt, Human
guuauuuaugcuugcugcacagacauauuaga

SEQ ID NO: 480583 - RNA, 32 nt, Human
guuauuucauucuuuuucuaaauucacacuac

SEQ ID NO: 480584 - RNA, 32 nt, Human
guuauuucuaagccucccaguuuauaguauuu

SEQ ID NO: 480585 - RNA, 32 nt, Human
guuauuucucaaacucugaggcugcggaguuc

SEQ ID NO: 480586 - RNA, 19 nt, Human
guuauuucuggaagcugga

SEQ ID NO: 480587 - RNA, 32 nt, Human
guuauuucuuacaaccacugugugugaaauug

SEQ ID NO: 480588 - RNA, 32 nt, Human
guuauuucuuucucuucaggucuuuccuucuc

SEQ ID NO: 480589 - RNA, 32 nt, Human
guuauuugaucucucagccugcuuucucaucu

SEQ ID NO: 480590 - RNA, 32 nt, Human
guuauuugcccaaacuaccucucguggcuggu

SEQ ID NO: 480591 - RNA, 32 nt, Human
guuauuuggaaagaaagaaagaaagagagaga

SEQ ID NO: 480592 - RNA, 32 nt, Human
guuauuugggaaaguuaacugugugcacuuuu

SEQ ID NO: 480593 - RNA, 32 nt, Human
guuauuuguucugaaggcugcagagaauugaa

SEQ ID NO: 480594 - RNA, 32 nt, Human
guuauuuuagugaggcuccaaaaugagcaaag

SEQ ID NO: 480595 - RNA, 32 nt, Human
guuauuuuagugugaaggucaugggaaauggc

SEQ ID NO: 480596 - RNA, 32 nt, Human
guuauuuucucccauccuuggcccaaggaacu

SEQ ID NO: 480597 - RNA, 32 nt, Human
guuauuuucuuucuaaaauaaguguuauuacu

SEQ ID NO: 480598 - RNA, 32 nt, Human
guuauuuugaauaucacuuucucugaaauagc

SEQ ID NO: 480599 - RNA, 32 nt, Human
guuauuuuuggcugggugugguggcucacacc

SEQ ID NO: 480600 - RNA, 32 nt, Human
guuauuuuuggcugggugugguggcucauacc

SEQ ID NO: 480601 - RNA, 32 nt, Human
guucaaaaccagccugaccaacauggugaaac

SEQ ID NO: 480602 - RNA, 32 nt, Human
guucaaaaccagccuggccaacaugcugaaac

SEQ ID NO: 480603 - RNA, 32 nt, Human
guucaaaaccagccuggccaacauggugaaac

SEQ ID NO: 480604 - RNA, 32 nt, Human
guucaaaaccagccugggcaauauagugagac

SEQ ID NO: 480605 - RNA, 32 nt, Human
guucaaaagaagccaauggagggagagggagc

SEQ ID NO: 480606 - RNA, 32 nt, Human
guucaaaagguggcaacacugaaaguuguuuu

SEQ ID NO: 480607 - RNA, 32 nt, Human
guucaaaagucaugcagaaugugagacaauuu

SEQ ID NO: 480608 - RNA, 32 nt, Human
guucaaaauauccaauuggagaaaaauucaga

SEQ ID NO: 480609 - RNA, 32 nt, Human
guucaaaaucagccuggccaaaaugcugaaac

SEQ ID NO: 480610 - RNA, 32 nt, Human
guucaaacaaaaggaggcaaagugaucugucu

SEQ ID NO: 480611 - RNA, 21 nt, Human
guucaaacaauucuccugccu

SEQ ID NO: 480612 - RNA, 23 nt, Human
guucaaacaauucuccugccuca

SEQ ID NO: 480613 - RNA, 32 nt, Human
guucaaaccaauagagcagggaaagggaaaug

SEQ ID NO: 480614 - RNA, 32 nt, Human
guucaaacccaguugcugccccggcugcaacc

SEQ ID NO: 480615 - RNA, 32 nt, Human
guucaaaccuccagccugugaaucaacugugu

SEQ ID NO: 480616 - RNA, 32 nt, Human
guucaaacguguguucucuguucucuaagaug

SEQ ID NO: 480617 - RNA, 32 nt, Human
guucaaagacaagggaaauggcaaacaaaaga

SEQ ID NO: 480618 - RNA, 32 nt, Human
guucaaagaccacccuaccagccccuauuugc

SEQ ID NO: 480619 - RNA, 32 nt, Human
guucaaagagauugacugcuguggagacagau

SEQ ID NO: 480620 - RNA, 32 nt, Human
guucaaagcugcagugagucaugauagcacca

SEQ ID NO: 480621 - RNA, 32 nt, Human
guucaaaggugggaagagagccuggaaaagaa

SEQ ID NO: 480622 - RNA, 32 nt, Human
guucaaauaaaaccagccucagcggaauccua

SEQ ID NO: 480623 - RNA, 32 nt, Human
guucaaaucccagcuccagcaguugccagcgc

SEQ ID NO: 480624 - RNA, 32 nt, Human
guucaaaugagcgagaggaacauuuggcuaaa

SEQ ID NO: 480625 - RNA, 23 nt, Human
guucaaaugauucuccugccuca

SEQ ID NO: 480626 - RNA, 32 nt, Human
guucaaauguacagugguccuuuucagaguug

SEQ ID NO: 480627 - RNA, 32 nt, Human
guucaacaaggcauggaggcagggccaucuuu

SEQ ID NO: 480628 - RNA, 32 nt, Human
guucaacaccagccugggccauauugugagaa

SEQ ID NO: 480629 - RNA, 32 nt, Human
guucaacagacauuuacuugagugccugcucu

SEQ ID NO: 480630 - RNA, 32 nt, Human
guucaacagcggcaaacagugcagugaauaug

SEQ ID NO: 480631 - RNA, 32 nt, Human
guucaacaggaaagacaaaguguacgugaaug

SEQ ID NO: 480632 - RNA, 32 nt, Human
guucaacaucccugcugaccagcacuuggagu

SEQ ID NO: 480633 - RNA, 32 nt, Human
guucaacauggcgaaaccccauucuaccaaaa

SEQ ID NO: 480634 - RNA, 32 nt, Human
guucaacauuuuuaugcugaaguuucccuuag

SEQ ID NO: 480635 - RNA, 21 nt, Human
guucaaccaauucuccugccu

SEQ ID NO: 480636 - RNA, 32 nt, Human
guucaaccacuauuagagugagaaauggcauc

SEQ ID NO: 480637 - RNA, 32 nt, Human
guucaaccacugcacuccacuaagcaacuggc

SEQ ID NO: 480638 - RNA, 32 nt, Human
guucaacgaaguguaccaaaucucagcuauug

SEQ ID NO: 480639 - RNA, 32 nt, Human
guucaacucccacuuauaagugagaauaugca

SEQ ID NO: 480640 - RNA, 32 nt, Human
guucaacucugccaaaagauggaucuuuaaug

SEQ ID NO: 480641 - RNA, 21 nt, Human
guucaacugauucuucugccu

SEQ ID NO: 480642 - RNA, 23 nt, Human
guucaacugauucuucugccuca

SEQ ID NO: 480643 - RNA, 32 nt, Human
guucaacuuccucuguaaauauccaaguauaa

SEQ ID NO: 480644 - RNA, 25 nt, Human
guucaacuuucucauuuggccugug

SEQ ID NO: 480645 - RNA, 32 nt, Human
guucaacuuugcuuuugcugugccaguucaaa

SEQ ID NO: 480646 - RNA, 32 nt, Human
guucaagaacagcaaguuugcuauuuaaacac

SEQ ID NO: 480647 - RNA, 32 nt, Human
guucaagaagauggccagcagaugaaacccug

SEQ ID NO: 480648 - RNA, 32 nt, Human
guucaagacaagccuggccuacaugguugaaa

SEQ ID NO: 480649 - RNA, 32 nt, Human
guucaagacagccugggcaacauggugaaacc

SEQ ID NO: 480650 - RNA, 32 nt, Human
guucaagaccaaccuggugaaaccccgucucu

SEQ ID NO: 480651 - RNA, 32 nt, Human
guucaagaccaccuggccaacauggugaaacc

SEQ ID NO: 480652 - RNA, 32 nt, Human
guucaagaccagccuaggcaacauagugagau

SEQ ID NO: 480653 - RNA, 32 nt, Human
guucaagaccagccugaccaacauggugaaac

SEQ ID NO: 480654 - RNA, 32 nt, Human
guucaagaccagccugacgaacauggugaaac

SEQ ID NO: 480655 - RNA, 32 nt, Human
guucaagaccagccugacuaacauggagaaac

SEQ ID NO: 480656 - RNA, 32 nt, Human
guucaagaccagccugagaaacauagugagcc

SEQ ID NO: 480657 - RNA, 32 nt, Human
guucaagaccagccugagcaacauagugagac

SEQ ID NO: 480658 - RNA, 32 nt, Human
guucaagaccagccugaucaacauggugaaac

SEQ ID NO: 480659 - RNA, 32 nt, Human
guucaagaccagccugcccaacauagugaaac

SEQ ID NO: 480660 - RNA, 32 nt, Human
guucaagaccagccugcccaacauggugaaac

SEQ ID NO: 480661 - RNA, 32 nt, Human
guucaagaccagccuggacaacauagugagac

SEQ ID NO: 480662 - RNA, 32 nt, Human
guucaagaccagccuggacaacauggcaaaac

SEQ ID NO: 480663 - RNA, 32 nt, Human
guucaagaccagccuggacaacauggugaaac

SEQ ID NO: 480664 - RNA, 32 nt, Human
guucaagaccagccuggacaauauagugaaac

SEQ ID NO: 480665 - RNA, 32 nt, Human
guucaagaccagccuggcaaacauggugaaac

SEQ ID NO: 480666 - RNA, 32 nt, Human
guucaagaccagccuggccaaacauggugaaa

SEQ ID NO: 480667 - RNA, 32 nt, Human
guucaagaccagccuggccaacauagugaaaa

SEQ ID NO: 480668 - RNA, 32 nt, Human
guucaagaccagccuggccaacauagugaaac

SEQ ID NO: 480669 - RNA, 32 nt, Human
guucaagaccagccuggccaacaugguaaaac

SEQ ID NO: 480670 - RNA, 32 nt, Human
guucaagaccagccuggccaacauggugaaaa

SEQ ID NO: 480671 - RNA, 32 nt, Human
guucaagaccagccuggccaacauggugaaac

SEQ ID NO: 480672 - RNA, 32 nt, Human
guucaagaccagccuggccaacauggugaaau

SEQ ID NO: 480673 - RNA, 32 nt, Human
guucaagaccagccuggccaacauggugaauc

SEQ ID NO: 480674 - RNA, 32 nt, Human
guucaagaccagccuggccaacauggugaauu

SEQ ID NO: 480675 - RNA, 32 nt, Human
guucaagaccagccuggccaacauggugagac

SEQ ID NO: 480676 - RNA, 32 nt, Human
guucaagaccagccuggccaacaugguggaac

SEQ ID NO: 480677 - RNA, 32 nt, Human
guucaagaccagccuggccaacaugguguaac

SEQ ID NO: 480678 - RNA, 32 nt, Human
guucaagaccagccuggccaacguggugaaac

SEQ ID NO: 480679 - RNA, 32 nt, Human
guucaagaccagccuggccaacguggugaaag

SEQ ID NO: 480680 - RNA, 32 nt, Human
guucaagaccagccuggccaauguagugaaac

SEQ ID NO: 480681 - RNA, 32 nt, Human
guucaagaccagccuggccacauggugcaacc

SEQ ID NO: 480682 - RNA, 32 nt, Human
guucaagaccagccuggccagcauagugaaac

SEQ ID NO: 480683 - RNA, 32 nt, Human
guucaagaccagccuggccaucauggugaaac

SEQ ID NO: 480684 - RNA, 32 nt, Human
guucaagaccagccuggcuaacauggugaaau

SEQ ID NO: 480685 - RNA, 32 nt, Human
guucaagaccagccuggcuaauauggugaaac

SEQ ID NO: 480686 - RNA, 32 nt, Human
guucaagaccagccugggaaacauggcaaacu

SEQ ID NO: 480687 - RNA, 32 nt, Human
guucaagaccagccugggcaacauaccaagac

SEQ ID NO: 480688 - RNA, 32 nt, Human
guucaagaccagccugggcaacauaguaagac

SEQ ID NO: 480689 - RNA, 32 nt, Human
guucaagaccagccugggcaacauagugaaac

SEQ ID NO: 480690 - RNA, 32 nt, Human
guucaagaccagccugggcaacauagugagaa

SEQ ID NO: 480691 - RNA, 32 nt, Human
guucaagaccagccugggcaacauagugagac

SEQ ID NO: 480692 - RNA, 32 nt, Human
guucaagaccagccugggcaacauggcuauau

SEQ ID NO: 480693 - RNA, 32 nt, Human
guucaagaccagccugggcaacaugguaaaac

SEQ ID NO: 480694 - RNA, 32 nt, Human
guucaagaccagccugggcaacauggugaaac

SEQ ID NO: 480695 - RNA, 32 nt, Human
guucaagaccagccugggcaacauggugaaau

SEQ ID NO: 480696 - RNA, 32 nt, Human
guucaagaccagccugggcaacauggugagac

SEQ ID NO: 480697 - RNA, 32 nt, Human
guucaagaccagccugggcaacauggugagau

SEQ ID NO: 480698 - RNA, 32 nt, Human
guucaagaccagccugggcaacgugguggugu

SEQ ID NO: 480699 - RNA, 32 nt, Human
guucaagaccagccugggcaacuuagggagau

SEQ ID NO: 480700 - RNA, 32 nt, Human
guucaagaccagccugggcaacuuagugaggc

SEQ ID NO: 480701 - RNA, 32 nt, Human
guucaagaccagccugggcaauauagugagac

SEQ ID NO: 480702 - RNA, 32 nt, Human
guucaagaccagccugggcaauguaguaagac

SEQ ID NO: 480703 - RNA, 32 nt, Human
guucaagaccagccugggcagcauggugaaac

SEQ ID NO: 480704 - RNA, 32 nt, Human
guucaagaccagccugggcuacaugacgaaac

SEQ ID NO: 480705 - RNA, 32 nt, Human
guucaagaccagccuggguaacauggugaaau

SEQ ID NO: 480706 - RNA, 32 nt, Human
guucaagaccagccuggucaacauagugagac

SEQ ID NO: 480707 - RNA, 32 nt, Human
guucaagaccagccuggucaacauggugaaac

SEQ ID NO: 480708 - RNA, 32 nt, Human
guucaagaccagccuggucaacauggugaaau

SEQ ID NO: 480709 - RNA, 32 nt, Human
guucaagaccagccuguccaacauggugaaac

SEQ ID NO: 480710 - RNA, 32 nt, Human
guucaagaccagccuuggcaacauggugaaac

SEQ ID NO: 480711 - RNA, 32 nt, Human
guucaagagaucaggaggaacauucgaccuga

SEQ ID NO: 480712 - RNA, 32 nt, Human
guucaagagauccauccucccaccucagucuc

SEQ ID NO: 480713 - RNA, 32 nt, Human
guucaagagaucucuuguacaacauggggauu

SEQ ID NO: 480714 - RNA, 32 nt, Human
guucaagagcaauuucugcccuuuguaaauua

SEQ ID NO: 480715 - RNA, 32 nt, Human
guucaagagcagccuggucaacauggugaaac

SEQ ID NO: 480716 - RNA, 32 nt, Human
guucaagaucagccuggccaacauggugaaac

SEQ ID NO: 480717 - RNA, 32 nt, Human
guucaagaucagccugggaaacauagugagac

SEQ ID NO: 480718 - RNA, 32 nt, Human
guucaagaucagccugggcaacauagugaaac

SEQ ID NO: 480719 - RNA, 32 nt, Human
guucaagaucagccugggcaacauagugagac

SEQ ID NO: 480720 - RNA, 32 nt, Human
guucaagaucagccugggcaacauggugaaac

SEQ ID NO: 480721 - RNA, 32 nt, Human
guucaagaucagccugggcaauauagugaaac

SEQ ID NO: 480722 - RNA, 32 nt, Human
guucaagaucagcuugugcaauguaucaaaac

SEQ ID NO: 480723 - RNA, 32 nt, Human
guucaagcaagucuugugccucaguuuaccaa

SEQ ID NO: 480724 - RNA, 32 nt, Human
guucaagcaauuccccugccucagcuuccuga

SEQ ID NO: 480725 - RNA, 32 nt, Human
guucaagcaauucucccaucucagccuccuga

SEQ ID NO: 480726 - RNA, 20 nt, Human
guucaagcaauucuccugcc

SEQ ID NO: 480727 - RNA, 23 nt, Human
guucaagcaauucuccugcccca

SEQ ID NO: 480728 - RNA, 21 nt, Human
guucaagcaauucuccugccu

SEQ ID NO: 480729 - RNA, 23 nt, Human
guucaagcaauucuccugccuca

SEQ ID NO: 480730 - RNA, 32 nt, Human
guucaagcaauucuccugccucagcuucccaa

SEQ ID NO: 480731 - RNA, 32 nt, Human
guucaagcaauucuccugccucagcuucccga

SEQ ID NO: 480732 - RNA, 32 nt, Human
guucaagcaauucuccugccucagcuucccgc

SEQ ID NO: 480733 - RNA, 32 nt, Human
guucaagcaauucuccugccucagcuuccuga

SEQ ID NO: 480734 - RNA, 21 nt, Human
guucaagcaauucuucugccu

SEQ ID NO: 480735 - RNA, 32 nt, Human
guucaagcaguuuccugcuucagacuuccaag

SEQ ID NO: 480736 - RNA, 32 nt, Human
guucaagccauccucccaccucagccucccaa

SEQ ID NO: 480737 - RNA, 32 nt, Human
guucaagccauucuccugucucagccucccaa

SEQ ID NO: 480738 - RNA, 32 nt, Human
guucaagccauucuccugucucagccucccga

SEQ ID NO: 480739 - RNA, 32 nt, Human
guucaagccauucuccugucucagccuccuga

SEQ ID NO: 480740 - RNA, 32 nt, Human
guucaagccuuccagggauuugccucaccuug

SEQ ID NO: 480741 - RNA, 21 nt, Human
guucaagcgauucuccugccu

SEQ ID NO: 480742 - RNA, 23 nt, Human
guucaagcgauucuccugccuca

SEQ ID NO: 480743 - RNA, 32 nt, Human
guucaagcgauucuccugccucagcuucccag

SEQ ID NO: 480744 - RNA, 32 nt, Human
guucaagcgauucuccugccucagcuuccuga

SEQ ID NO: 480745 - RNA, 22 nt, Human
guucaagcgauucuccugccuu

SEQ ID NO: 480746 - RNA, 21 nt, Human
guucaagcgauucuccugcuu

SEQ ID NO: 480747 - RNA, 23 nt, Human
guucaagcgauucuccugcuuua

SEQ ID NO: 480748 - RNA, 21 nt, Human
guucaagcgauucuccugucu

SEQ ID NO: 480749 - RNA, 23 nt, Human
guucaagcgauucuccugucuca

SEQ ID NO: 480750 - RNA, 21 nt, Human
guucaagcgauuguccugccu

SEQ ID NO: 480751 - RNA, 32 nt, Human
guucaagcgauuguccugccucagcuucccaa

SEQ ID NO: 480752 - RNA, 21 nt, Human
guucaagcgauuuuccuaccu

SEQ ID NO: 480753 - RNA, 21 nt, Human
guucaagcgauuuuccugccu

SEQ ID NO: 480754 - RNA, 23 nt, Human
guucaagcgauuuuccugccuca

SEQ ID NO: 480755 - RNA, 32 nt, Human
guucaagcuauucucaugccucagccucucaa

SEQ ID NO: 480756 - RNA, 32 nt, Human
guucaagcucuggaggccagcccuggcuuugg

SEQ ID NO: 480757 - RNA, 32 nt, Human
guucaaggacagucuuucucuggugucauuuc

SEQ ID NO: 480758 - RNA, 24 nt, Human
guucaaggaccacauguguucucu

SEQ ID NO: 480759 - RNA, 32 nt, Human
guucaaggagcaagagcuucagccugaagaca

SEQ ID NO: 480760 - RNA, 32 nt, Human
guucaaggcacagucauucucuggcuuucaua

SEQ ID NO: 480761 - RNA, 32 nt, Human
guucaaggcaggcagggguugggaggugcgga

SEQ ID NO: 480762 - RNA, 32 nt, Human
guucaaggccagccuggacaacauaguaagac

SEQ ID NO: 480763 - RNA, 32 nt, Human
guucaaggccagccugggcaacauaguaagac

SEQ ID NO: 480764 - RNA, 32 nt, Human
guucaaggccagccugggcaacauagugaagc

SEQ ID NO: 480765 - RNA, 32 nt, Human
guucaaggccagccugggcaacauggugaaac

SEQ ID NO: 480766 - RNA, 32 nt, Human
guucaaggccagccugggcaacauggugucuc

SEQ ID NO: 480767 - RNA, 32 nt, Human
guucaaggcuagagcugcuggggaggggcugc

SEQ ID NO: 480768 - RNA, 32 nt, Human
guucaaggcugcagagagcuaggaucacacca

SEQ ID NO: 480769 - RNA, 32 nt, Human
guucaaggcugcagagagcuaugaucauccca

SEQ ID NO: 480770 - RNA, 32 nt, Human
guucaaggcuuucagacaagccacuuuuggca

SEQ ID NO: 480771 - RNA, 32 nt, Human
guucaagggaaagacgagaucuugcacaaggc

SEQ ID NO: 480772 - RNA, 21 nt, Human
guucaagggauucuccugccu

SEQ ID NO: 480773 - RNA, 23 nt, Human
guucaagggauucuccugccuca

SEQ ID NO: 480774 - RNA, 31 nt, Human
guucaagggucaaagggacccucugugccuu

SEQ ID NO: 480775 - RNA, 32 nt, Human
guucaagggucuuguacccccaccucagcugg

SEQ ID NO: 480776 - RNA, 32 nt, Human
guucaagguaaggagacaggaggaguaggagg

SEQ ID NO: 480777 - RNA, 32 nt, Human
guucaaguaauucuccugccucagcuuuccaa

SEQ ID NO: 480778 - RNA, 32 nt, Human
guucaagugauccucaugucucagccucccua

SEQ ID NO: 480779 - RNA, 22 nt, Human
guucaagugaugcuccugcuuc

SEQ ID NO: 480780 - RNA, 23 nt, Human
guucaagugauuccccugccuca

SEQ ID NO: 480781 - RNA, 21 nt, Human
guucaagugauucuccugccu

SEQ ID NO: 480782 - RNA, 23 nt, Human
guucaagugauucuccugccuca

SEQ ID NO: 480783 - RNA, 32 nt, Human
guucaagugauucuccugccucagcuucccaa

SEQ ID NO: 480784 - RNA, 23 nt, Human
guucaagugauucuccuggcuca

SEQ ID NO: 480785 - RNA, 32 nt, Human
guucaagugauucuugugccucagccauugag

SEQ ID NO: 480786 - RNA, 22 nt, Human
guucaagugauuuuccugccuu

SEQ ID NO: 480787 - RNA, 32 nt, Human
guucaaguggaggaaugcuggcuuugagcccu

SEQ ID NO: 480788 - RNA, 32 nt, Human
guucaaguggguuaaggagaccuccuguacau

SEQ ID NO: 480789 - RNA, 32 nt, Human
guucaaguucucuccugcuguggucagaguug

SEQ ID NO: 480790 - RNA, 32 nt, Human
guucaauaaauggugcugggauaacuggcuag

SEQ ID NO: 480791 - RNA, 32 nt, Human
guucaauccuaccuguuuuguggucagcugua

SEQ ID NO: 480792 - RNA, 32 nt, Human
guucaauggcugcugaagcugccugcuuuuca

SEQ ID NO: 480793 - RNA, 21 nt, Human
guucaauucaguugaucucga

SEQ ID NO: 480794 - RNA, 17 nt, Human
guucaauuggcuaccgg

SEQ ID NO: 480795 - RNA, 32 nt, Human
guucaauuuggggguuuuguuuugcaaaauaa

SEQ ID NO: 480796 - RNA, 32 nt, Human
guucacaagcucuaucggaguugaaagcgugg

SEQ ID NO: 480797 - RNA, 32 nt, Human
guucacaaggccccagcacaucgucuaggacg

SEQ ID NO: 480798 - RNA, 32 nt, Human
guucacaagguaccccaaaacucuguagcuua

SEQ ID NO: 480799 - RNA, 32 nt, Human
guucacaauucaguuccucccaaccaaccagu

SEQ ID NO: 480800 - RNA, 32 nt, Human
guucacacaaccagugcacuccugccuuuuca

SEQ ID NO: 480801 - RNA, 32 nt, Human
guucacacagcccaguucccgugacgaggcuc

SEQ ID NO: 480802 - RNA, 32 nt, Human
guucacaccacugcacuccagucugggcaaca

SEQ ID NO: 480803 - RNA, 32 nt, Human
guucacaccacugccauuuccuccugggcaac

SEQ ID NO: 480804 - RNA, 23 nt, Human
guucacaccauucuccugccuca

SEQ ID NO: 480805 - RNA, 32 nt, Human
guucacacccucccauccuuccugccuccugc

SEQ ID NO: 480806 - RNA, 32 nt, Human
guucacaccgcugcacucaagcuugggugaca

SEQ ID NO: 480807 - RNA, 32 nt, Human
guucacaccuguaauccaagcacuuugggagg

SEQ ID NO: 480808 - RNA, 32 nt, Human
guucacaccuguaaucccaacacuuugggagg

SEQ ID NO: 480809 - RNA, 32 nt, Human
guucacaccuguaaucccagcacuuugggagg

SEQ ID NO: 480810 - RNA, 32 nt, Human
guucacaccuguaauccccgcacuuuggaagg

SEQ ID NO: 480811 - RNA, 32 nt, Human
guucacaccuguaaucccggcacuuugggagg

SEQ ID NO: 480812 - RNA, 32 nt, Human
guucacaccuguaaucccggcauuuugggagg

SEQ ID NO: 480813 - RNA, 32 nt, Human
guucacaccuguaauccuagaacuuugggagg

SEQ ID NO: 480814 - RNA, 32 nt, Human
guucacaccuguaauccuagcaguuugggagg

SEQ ID NO: 480815 - RNA, 32 nt, Human
guucacaccuguaauugcagcacuuugggagg

SEQ ID NO: 480816 - RNA, 32 nt, Human
guucacacggaggcagagguggggaugaggua

SEQ ID NO: 480817 - RNA, 32 nt, Human
guucacacugggugcacuuguguggggacuuc

SEQ ID NO: 480818 - RNA, 32 nt, Human
guucacagcacuaggaaaugggagcacaguau

SEQ ID NO: 480819 - RNA, 32 nt, Human
guucacagcauguagggugaugagcacucaca

SEQ ID NO: 480820 - RNA, 32 nt, Human
guucacagcuacuacauucagugggaagguuu

SEQ ID NO: 480821 - RNA, 32 nt, Human
guucacagggugccugggcugcauuugaauau

SEQ ID NO: 480822 - RNA, 32 nt, Human
guucacaguacucggaaaugggagcauaguac

SEQ ID NO: 480823 - RNA, 23 nt, Human
guucacaguccuguuguugucga

SEQ ID NO: 480824 - RNA, 32 nt, Human
guucacaucagccuggcacucagcgaugagcc

SEQ ID NO: 480825 - RNA, 32 nt, Human
guucacauccaccugcuucucuuccaggcuuu

SEQ ID NO: 480826 - RNA, 32 nt, Human
guucacauccucuuuguuuccucuuuucacca

SEQ ID NO: 480827 - RNA, 32 nt, Human
guucacaugauucuccugccucagcuuccuaa

SEQ ID NO: 480828 - RNA, 32 nt, Human
guucacauuguacaaaaauaaugugacuucug

SEQ ID NO: 480829 - RNA, 32 nt, Human
guucacauuuaggacucucagugccauaugaa

SEQ ID NO: 480830 - RNA, 32 nt, Human
guucacauuuguaaucccagcacuuuggaagg

SEQ ID NO: 480831 - RNA, 32 nt, Human
guucaccaaacagcuagcacucuagcuugcau

SEQ ID NO: 480832 - RNA, 32 nt, Human
guucaccaaguugucauuuauuugauggaaua

SEQ ID NO: 480833 - RNA, 32 nt, Human
guucaccacuugggugcuguuaaaggcauuca

SEQ ID NO: 480834 - RNA, 32 nt, Human
guucaccaucaucucuugcuuuugucaccgcu

SEQ ID NO: 480835 - RNA, 32 nt, Human
guucaccauucauuccagaccugggccuuuga

SEQ ID NO: 480836 - RNA, 32 nt, Human
guucacccagcagaacugggaggugcaaagga

SEQ ID NO: 480837 - RNA, 32 nt, Human
guucacccaguucauacuaagcagagccaggc

SEQ ID NO: 480838 - RNA, 32 nt, Human
guucacccaucuguucugucugccucauuccc

SEQ ID NO: 480839 - RNA, 32 nt, Human
guucacccaucuuaucaaggacucugguuucu

SEQ ID NO: 480840 - RNA, 32 nt, Human
guucaccccaaagcccccgggcccucagaguu

SEQ ID NO: 480841 - RNA, 32 nt, Human
guucaccccucaccuccagccuggaggagaca

SEQ ID NO: 480842 - RNA, 32 nt, Human
guucaccccugggauuggacaguguauccuaa

SEQ ID NO: 480843 - RNA, 32 nt, Human
guucacccggaguucuggaggcaggcugccag

SEQ ID NO: 480844 - RNA, 32 nt, Human
guucaccuccuccagcuccaucaagggcuccu

SEQ ID NO: 480845 - RNA, 32 nt, Human
guucaccucuacucugcccuccucauagucau

SEQ ID NO: 480846 - RNA, 19 nt, Human
guucaccucuguguccuuu

SEQ ID NO: 480847 - RNA, 32 nt, Human
guucaccugcagucccagcuacuugggaggcc

SEQ ID NO: 480848 - RNA, 32 nt, Human
guucaccugccucuugcuuuuuguggguggcu

SEQ ID NO: 480849 - RNA, 32 nt, Human
guucaccugcuguguacuccuguuuggaagua

SEQ ID NO: 480850 - RNA, 32 nt, Human
guucaccugugacuaaggaguuguuguuaacg

SEQ ID NO: 480851 - RNA, 32 nt, Human
guucaccugugcaaaggcuuccucagacaugc

SEQ ID NO: 480852 - RNA, 32 nt, Human
guucaccuuuaaucccagcuacuugggaggcu

SEQ ID NO: 480853 - RNA, 32 nt, Human
guucacgaagugaggccgcuguugaaauucgu

SEQ ID NO: 480854 - RNA, 32 nt, Human
guucacgaccagccuggccaacauggugaaac

SEQ ID NO: 480855 - RNA, 32 nt, Human
guucacgccauccuccugccucagccucccaa

SEQ ID NO: 480856 - RNA, 32 nt, Human
guucacgccauccuccugccucagccuccuga

SEQ ID NO: 480857 - RNA, 23 nt, Human
guucacgccauucuacugccuca

SEQ ID NO: 480858 - RNA, 32 nt, Human
guucacgccauucuacugccucagccucccga

SEQ ID NO: 480859 - RNA, 21 nt, Human
guucacgccauucuccugccu

SEQ ID NO: 480860 - RNA, 23 nt, Human
guucacgccauucuccugccuca

SEQ ID NO: 480861 - RNA, 32 nt, Human
guucacgccuguaauccagcacugugggaggc

SEQ ID NO: 480862 - RNA, 19 nt, Human
guucacgccuguaauccca

SEQ ID NO: 480863 - RNA, 32 nt, Human
guucacgccuguaaucccaauacuuugggagg

SEQ ID NO: 480864 - RNA, 32 nt, Human
guucacgccuguaaucccagcacuuugggagg

SEQ ID NO: 480865 - RNA, 32 nt, Human
guucacgccuguaaucccagcacuuugggaug

SEQ ID NO: 480866 - RNA, 32 nt, Human
guucacgccuguaaugccagcacuuugggagg

SEQ ID NO: 480867 - RNA, 32 nt, Human
guucacgccuguaauuccagcacuuugagagg

SEQ ID NO: 480868 - RNA, 21 nt, Human
guucacgcgauucuccugccu

SEQ ID NO: 480869 - RNA, 23 nt, Human
guucacgcgauucuccugccuca

SEQ ID NO: 480870 - RNA, 32 nt, Human
guucacgugcagagaacaaagcagugacaacc

SEQ ID NO: 480871 - RNA, 32 nt, Human
guucacgugcagcucaaggaaaggccugaaag

SEQ ID NO: 480872 - RNA, 26 nt, Human
guucacguugccacagaauucacaug

SEQ ID NO: 480873 - RNA, 32 nt, Human
guucacguuucagagaggcugcagcccggcgc

SEQ ID NO: 480874 - RNA, 32 nt, Human
guucacuacaaccuccgccuccuggguccaag

SEQ ID NO: 480875 - RNA, 32 nt, Human
guucacuagaagagcauguugacaggaaugac

SEQ ID NO: 480876 - RNA, 32 nt, Human
guucacuagagacguggaauugagacuaauaa

SEQ ID NO: 480877 - RNA, 32 nt, Human
guucacuauguuggccaggauggucucgaucu

SEQ ID NO: 480878 - RNA, 32 nt, Human
guucacucaggaaccacuggcuccuccagugc

SEQ ID NO: 480879 - RNA, 32 nt, Human
guucacucauucucagauuaaauugccacuua

SEQ ID NO: 480880 - RNA, 32 nt, Human
guucacuccuuuccuuuccugacuuaugccug

SEQ ID NO: 480881 - RNA, 32 nt, Human
guucacucucaggggcgcacaaaggcaugaaa

SEQ ID NO: 480882 - RNA, 32 nt, Human
guucacucugcaguucucuugccuacugccau

SEQ ID NO: 480883 - RNA, 32 nt, Human
guucacugacagcacaggacccugcagauggu

SEQ ID NO: 480884 - RNA, 32 nt, Human
guucacugaggcccccacucugccauuuugga

SEQ ID NO: 480885 - RNA, 32 nt, Human
guucacugcaaccuccaccuccaggguucaga

SEQ ID NO: 480886 - RNA, 32 nt, Human
guucacugcaaccuccaccucccagguucaag

SEQ ID NO: 480887 - RNA, 32 nt, Human
guucacugcaaccuccaccucuuggguucaag

SEQ ID NO: 480888 - RNA, 32 nt, Human
guucacugcaaccuccgccuccuggauucaag

SEQ ID NO: 480889 - RNA, 22 nt, Human
guucacugcaaccucugccucc

SEQ ID NO: 480890 - RNA, 23 nt, Human
guucacugcaaccucugccuccu

SEQ ID NO: 480891 - RNA, 32 nt, Human
guucacugcaaccucugccuccugggcucaag

SEQ ID NO: 480892 - RNA, 32 nt, Human
guucacugcaaccucugccuccuggguucaag

SEQ ID NO: 480893 - RNA, 32 nt, Human
guucacugcaacuuccgcuucccagguucaag

SEQ ID NO: 480894 - RNA, 32 nt, Human
guucacugcaagcuccaccucccggguucacg

SEQ ID NO: 480895 - RNA, 32 nt, Human
guucacugcaaucucugccuccuggguuuaag

SEQ ID NO: 480896 - RNA, 32 nt, Human
guucacugcagccucaaccucuccagauucaa

SEQ ID NO: 480897 - RNA, 32 nt, Human
guucacugcagccuccaccuccccgguucaag

SEQ ID NO: 480898 - RNA, 32 nt, Human
guucacugcagccuccgcccuccagguucaag

SEQ ID NO: 480899 - RNA, 32 nt, Human
guucacugcagucuugaccucccaggcuuagg

SEQ ID NO: 480900 - RNA, 32 nt, Human
guucacugccucuaccaccaccucucacuucu

SEQ ID NO: 480901 - RNA, 32 nt, Human
guucacuggagggcccagccuggggaaaggau

SEQ ID NO: 480902 - RNA, 32 nt, Human
guucacugguaaucccagcacuuugggaggcc

SEQ ID NO: 480903 - RNA, 32 nt, Human
guucacuggucgcucuguugugccccacagca

SEQ ID NO: 480904 - RNA, 32 nt, Human
guucacuguccccaaaccuauggaaguuguug

SEQ ID NO: 480905 - RNA, 32 nt, Human
guucacugugcauauggcagagacaggagugg

SEQ ID NO: 480906 - RNA, 32 nt, Human
guucacuguggugggaaagaucacacuacaug

SEQ ID NO: 480907 - RNA, 32 nt, Human
guucacuguuccucugucauacuguaucugga

SEQ ID NO: 480908 - RNA, 32 nt, Human
guucacuucaaccccuaccuccugggcucaag

SEQ ID NO: 480909 - RNA, 32 nt, Human
guucacuugagcugccaagaucccaaguagau

SEQ ID NO: 480910 - RNA, 32 nt, Human
guucacuuugccuccugcugcuucugugcccu

SEQ ID NO: 480911 - RNA, 32 nt, Human
guucacuuugggcccacagacccaagagcuaa

SEQ ID NO: 480912 - RNA, 32 nt, Human
guucacuuugguuccagcauccuguccagcaa

SEQ ID NO: 480913 - RNA, 32 nt, Human
guucagaaaagcaccucuugaagaacugacuu

SEQ ID NO: 480914 - RNA, 32 nt, Human
guucagaaaccucaaagagaaauguuuucuaa

SEQ ID NO: 480915 - RNA, 32 nt, Human
guucagaaaccucaaagagaaauguuuuguaa

SEQ ID NO: 480916 - RNA, 32 nt, Human
guucagaaacuagacauuccauugaacuaaga

SEQ ID NO: 480917 - RNA, 32 nt, Human
guucagaaacuccaccaauuuuagggugaccg

SEQ ID NO: 480918 - RNA, 32 nt, Human
guucagaaccagccuggacaacauagugagac

SEQ ID NO: 480919 - RNA, 32 nt, Human
guucagaagucauuuccucuucaagauuccau

SEQ ID NO: 480920 - RNA, 32 nt, Human
guucagaaucuccagagcagagcccaggaauc

SEQ ID NO: 480921 - RNA, 32 nt, Human
guucagaauggcaguccuggaggcagggggug

SEQ ID NO: 480922 - RNA, 32 nt, Human
guucagaauggucauccauccaucguugcauc

SEQ ID NO: 480923 - RNA, 32 nt, Human
guucagaauuucaugcuggaaggaaaguuaga

SEQ ID NO: 480924 - RNA, 32 nt, Human
guucagacauuccauggugauuccugggaagg

SEQ ID NO: 480925 - RNA, 32 nt, Human
guucagacccuccauggagaaguuugggauga

SEQ ID NO: 480926 - RNA, 32 nt, Human
guucagacucaccuauguggcaccuuaaacuu

SEQ ID NO: 480927 - RNA, 32 nt, Human
guucagacuccugguuucuuccaggcuuacag

SEQ ID NO: 480928 - RNA, 21 nt, Human
guucagacuggagugcagugg

SEQ ID NO: 480929 - RNA, 32 nt, Human
guucagagauccaggccucccaccucagacuc

SEQ ID NO: 480930 - RNA, 32 nt, Human
guucagagcagccuggccaccauagugagauc

SEQ ID NO: 480931 - RNA, 32 nt, Human
guucagagcccagcucugccacugucagccau

SEQ ID NO: 480932 - RNA, 32 nt, Human
guucagagcccccguuccccaggguccugugg

SEQ ID NO: 480933 - RNA, 32 nt, Human
guucagagccugggucucagcgcgggacccgu

SEQ ID NO: 480934 - RNA, 32 nt, Human
guucagaggaagaggaaguguagccggcggac

SEQ ID NO: 480935 - RNA, 32 nt, Human
guucagaggaaggguguccccuguccucuuga

SEQ ID NO: 480936 - RNA, 32 nt, Human
guucagagucacccaucucagcaagcccagaa

SEQ ID NO: 480937 - RNA, 32 nt, Human
guucagaguggcagaggagaaagaaaauccca

SEQ ID NO: 480938 - RNA, 32 nt, Human
guucagauccacggccuccacccgggacgccu

SEQ ID NO: 480939 - RNA, 32 nt, Human
guucagauuuacuuugaaagaaucaaguaugu

SEQ ID NO: 480940 - RNA, 32 nt, Human
guucagcaacucccuggcaucugugaugaccu

SEQ ID NO: 480941 - RNA, 32 nt, Human
guucagcaacuguuuaaccuguuuucagucuu

SEQ ID NO: 480942 - RNA, 32 nt, Human
guucagcaacuugcccaacaucacacagcaac

SEQ ID NO: 480943 - RNA, 32 nt, Human
guucagcaaggcgagaagcagcuuuuugagaa

SEQ ID NO: 480944 - RNA, 31 nt, Human
guucagcaaguggagacuggcauucagauuc

SEQ ID NO: 480945 - RNA, 32 nt, Human
guucagcaaugucaauggcaucaggagggcgc

SEQ ID NO: 480946 - RNA, 32 nt, Human
guucagcacccaggcugugguacuucaacuuc

SEQ ID NO: 480947 - RNA, 32 nt, Human
guucagcaccucccaucccauggauacagugg

SEQ ID NO: 480948 - RNA, 32 nt, Human
guucagcacuugaaggaaggaucucgaaacau

SEQ ID NO: 480949 - RNA, 32 nt, Human
guucagcagaaaggaggaauccuggcccucag

SEQ ID NO: 480950 - RNA, 32 nt, Human
guucagcagaccaccaguaccagacucagaau

SEQ ID NO: 480951 - RNA, 32 nt, Human
guucagcagcggguuuggaacauagcgaaucc

SEQ ID NO: 480952 - RNA, 32 nt, Human
guucagcaguucuuccccuccuacaccuaagu

SEQ ID NO: 480953 - RNA, 32 nt, Human
guucagcaucaucuugguuauauacugaaaau

SEQ ID NO: 480954 - RNA, 32 nt, Human
guucagccauuuuguucagaacgaucauccag

SEQ ID NO: 480955 - RNA, 32 nt, Human
guucagcccaggaggaagccagcugcaaugug

SEQ ID NO: 480956 - RNA, 32 nt, Human
guucagccggugcaggcuccucccucccucuc

SEQ ID NO: 480957 - RNA, 23 nt, Human
guucagccucccuccccaccuca

SEQ ID NO: 480958 - RNA, 32 nt, Human
guucagccucuucgcugaccucgacccacucu

SEQ ID NO: 480959 - RNA, 32 nt, Human
guucagcgcacuccugaccucuucuagaccua

SEQ ID NO: 480960 - RNA, 17 nt, Human
guucagcggggcagcuu

SEQ ID NO: 480961 - RNA, 32 nt, Human
guucagcuagaagucauaccacccucaggaau

SEQ ID NO: 480962 - RNA, 32 nt, Human
guucagcucuucauucuucaaggccugaccuu

SEQ ID NO: 480963 - RNA, 32 nt, Human
guucagcugcugucacagucucauuuguucuu

SEQ ID NO: 480964 - RNA, 32 nt, Human
guucagcuggacucugccaucugugggcccag

SEQ ID NO: 480965 - RNA, 32 nt, Human
guucagcugguaccagaguagaaacaaggugc

SEQ ID NO: 480966 - RNA, 32 nt, Human
guucagcuguccucccuccaccuaccacucac

SEQ ID NO: 480967 - RNA, 32 nt, Human
guucagcuuccuccaccucgcuuccacugcac

SEQ ID NO: 480968 - RNA, 32 nt, Human
guucagcuuuucucccccacgccuugcucccu

SEQ ID NO: 480969 - RNA, 32 nt, Human
guucaggaaaacugggcuguugcucuggaauu

SEQ ID NO: 480970 - RNA, 32 nt, Human
guucaggaagggagacaggggcacagagagac

SEQ ID NO: 480971 - RNA, 32 nt, Human
guucaggaagucaguccucacagaucaaggua

SEQ ID NO: 480972 - RNA, 32 nt, Human
guucaggaccagccugaccaacauggugaaac

SEQ ID NO: 480973 - RNA, 32 nt, Human
guucaggaccagccuggccagcauggugaaac

SEQ ID NO: 480974 - RNA, 32 nt, Human
guucaggacugcugacuaaacacuuucaagca

SEQ ID NO: 480975 - RNA, 32 nt, Human
guucaggagcaugacuccagugcugggcucuu

SEQ ID NO: 480976 - RNA, 32 nt, Human
guucaggaggaggacuccaucucauucagaaa

SEQ ID NO: 480977 - RNA, 32 nt, Human
guucaggaguuuaagaccagccuggacaacau

SEQ ID NO: 480978 - RNA, 32 nt, Human
guucaggcaauucuccugccucagcuucccga

SEQ ID NO: 480979 - RNA, 32 nt, Human
guucaggcaggugacguguggaaagucuaggg

SEQ ID NO: 480980 - RNA, 32 nt, Human
guucaggcaucacagguuacuagaauacacau

SEQ ID NO: 480981 - RNA, 32 nt, Human
guucaggcauucucucaguguuuagggugaug

SEQ ID NO: 480982 - RNA, 32 nt, Human
guucaggccgccucccccuccucugccugggg

SEQ ID NO: 480983 - RNA, 32 nt, Human
guucaggccggcucccccuuccuggucucccu

SEQ ID NO: 480984 - RNA, 32 nt, Human
guucaggccucagcgcgugagccacacugucu

SEQ ID NO: 480985 - RNA, 32 nt, Human
guucaggccuguaauuccagcacuuugggagg

SEQ ID NO: 480986 - RNA, 23 nt, Human
guucaggcgauucuccugccuca

SEQ ID NO: 480987 - RNA, 32 nt, Human
guucaggcgauucuccugccucagcuucccga

SEQ ID NO: 480988 - RNA, 32 nt, Human
guucaggcuaggguuucaucaugggacaacag

SEQ ID NO: 480989 - RNA, 32 nt, Human
guucaggcucccaggaaaggcaacuuucaacu

SEQ ID NO: 480990 - RNA, 32 nt, Human
guucaggcuggguggagcagugggaacauaga

SEQ ID NO: 480991 - RNA, 32 nt, Human
guucaggcugucucaucccuugccaggagcuc

SEQ ID NO: 480992 - RNA, 32 nt, Human
guucaggcuucagccgaccaccucucgaccug

SEQ ID NO: 480993 - RNA, 32 nt, Human
guucaggcuugagcuggguggggugaggggug

SEQ ID NO: 480994 - RNA, 25 nt, Human
guucagggaaggaggggaaaaggga

SEQ ID NO: 480995 - RNA, 32 nt, Human
guucagggagcuagaagacacuuuaaguuaua

SEQ ID NO: 480996 - RNA, 18 nt, Human
guucagggaggggccaga

SEQ ID NO: 480997 - RNA, 21 nt, Human
guucagggauuacaggcauga

SEQ ID NO: 480998 - RNA, 32 nt, Human
guucagggcaaaaacugccuaacuuccauggc

SEQ ID NO: 480999 - RNA, 32 nt, Human
guucagggccagcuuugauaauggagcgagau

SEQ ID NO: 481000 - RNA, 32 nt, Human
guucagggcuacucguggguggacugaguccc

SEQ ID NO: 481001 - RNA, 23 nt, Human
guucaggggacagaugcaagcug

SEQ ID NO: 481002 - RNA, 20 nt, Human
guucaggggcacaugugcuc

SEQ ID NO: 481003 - RNA, 32 nt, Human
guucaggguggaggcacagaugagcagagugg

SEQ ID NO: 481004 - RNA, 32 nt, Human
guucagguaacaggcagauacaggaaaagcug

SEQ ID NO: 481005 - RNA, 32 nt, Human
guucagguauucuuugagacacacaguaucau

SEQ ID NO: 481006 - RNA, 32 nt, Human
guucaggucucagcaggugucagaggugauua

SEQ ID NO: 481007 - RNA, 32 nt, Human
guucaggugcagcucuuaaacacauugccuua

SEQ ID NO: 481008 - RNA, 32 nt, Human
guucaggugcagcugguccuccauuacccacu

SEQ ID NO: 481009 - RNA, 32 nt, Human
guucaggugcaggagcuagaugcguggacgcc

SEQ ID NO: 481010 - RNA, 32 nt, Human
guucaggugcccuggagggaaggggaagccug

SEQ ID NO: 481011 - RNA, 32 nt, Human
guucagguucuggcaggggcccagggauccag

SEQ ID NO: 481012 - RNA, 32 nt, Human
guucagguuuugcccaagagucagcucauuug

SEQ ID NO: 481013 - RNA, 32 nt, Human
guucaguaacacacccucccugcuccaagugc

SEQ ID NO: 481014 - RNA, 32 nt, Human
guucaguagaggccccgguuucccaguuguug

SEQ ID NO: 481015 - RNA, 32 nt, Human
guucaguauuuggaguucaacacugucucuca

SEQ ID NO: 481016 - RNA, 32 nt, Human
guucagucacuaccuuagagccuguuuuauuu

SEQ ID NO: 481017 - RNA, 32 nt, Human
guucagucaucugcuuucuguuucuggaugug

SEQ ID NO: 481018 - RNA, 32 nt, Human
guucagucauuuucuuuauuggugacuccucu

SEQ ID NO: 481019 - RNA, 32 nt, Human
guucaguccuggcuggaggagccacagccugu

SEQ ID NO: 481020 - RNA, 32 nt, Human
guucagucuuccagauuaugccucacaugcua

SEQ ID NO: 481021 - RNA, 32 nt, Human
guucagugcaaucuccgccuccuggguucaaa

SEQ ID NO: 481022 - RNA, 32 nt, Human
guucagugggcaagucuagggcagcagaguug

SEQ ID NO: 481023 - RNA, 32 nt, Human
guucagugucccaggcagcacagugugugaac

SEQ ID NO: 481024 - RNA, 32 nt, Human
guucaguguggcuggggaggccucaggaaacu

SEQ ID NO: 481025 - RNA, 32 nt, Human
guucaguucguuuggcaggcacacacaguggc

SEQ ID NO: 481026 - RNA, 23 nt, Human
guucaguuuuggugucugcuuca

SEQ ID NO: 481027 - RNA, 18 nt, Human
guucauacuccugcuuca

SEQ ID NO: 481028 - RNA, 32 nt, Human
guucauacuggagaaaggacuuaugagugcug

SEQ ID NO: 481029 - RNA, 32 nt, Human
guucauagaggcagaggguggggaagggcugg

SEQ ID NO: 481030 - RNA, 32 nt, Human
guucauaguccacaguugaugcagcauccuga

SEQ ID NO: 481031 - RNA, 32 nt, Human
guucauaucuguaauccuaacacuuugacagg

SEQ ID NO: 481032 - RNA, 23 nt, Human
guucauaucuguguugcugacua

SEQ ID NO: 481033 - RNA, 32 nt, Human
guucauauuuugcuuugagccagcuuuuuagu

SEQ ID NO: 481034 - RNA, 32 nt, Human
guucaucaacaaacuaaaggggaugccagaaa

SEQ ID NO: 481035 - RNA, 32 nt, Human
guucaucaagggugaagcauggucaaauguca

SEQ ID NO: 481036 - RNA, 32 nt, Human
guucaucacaaaaaucaguaagcacaauaaag

SEQ ID NO: 481037 - RNA, 32 nt, Human
guucaucacacguggguuggacaugcuaacag

SEQ ID NO: 481038 - RNA, 32 nt, Human
guucaucaccccaguaaaagugucaucaccca

SEQ ID NO: 481039 - RNA, 32 nt, Human
guucaucagacuccugugcaacuuucccaaug

SEQ ID NO: 481040 - RNA, 32 nt, Human
guucaucagagcagugugugaaauuccaugug

SEQ ID NO: 481041 - RNA, 32 nt, Human
guucaucaugauagaucugcuguuuccuuaua

SEQ ID NO: 481042 - RNA, 32 nt, Human
guucaucccagccauuccccugcuucuagaug

SEQ ID NO: 481043 - RNA, 32 nt, Human
guucaucccuugaccaccucuggaccacuaac

SEQ ID NO: 481044 - RNA, 32 nt, Human
guucaucgaacugcacugccugcccagaacgc

SEQ ID NO: 481045 - RNA, 32 nt, Human
guucaucggucugccuugauucagcaucagaa

SEQ ID NO: 481046 - RNA, 32 nt, Human
guucaucuagaaaucucaaagccaugucucag

SEQ ID NO: 481047 - RNA, 32 nt, Human
guucaucuaggaaacuguccugggaaccaaac

SEQ ID NO: 481048 - RNA, 32 nt, Human
guucaucugcagcuguugcaagguguucagau

SEQ ID NO: 481049 - RNA, 21 nt, Human
guucaucuuuaaauucuuucc

SEQ ID NO: 481050 - RNA, 32 nt, Human
guucaucuuuuccuugcucaagugugggcuau

SEQ ID NO: 481051 - RNA, 32 nt, Human
guucaugacacugcacuccagccugggugaua

SEQ ID NO: 481052 - RNA, 32 nt, Human
guucaugacuccuggccuugggaugcccaagg

SEQ ID NO: 481053 - RNA, 32 nt, Human
guucaugagaugcauucucuucugucuuuggu

SEQ ID NO: 481054 - RNA, 32 nt, Human
guucaugaggucagagggagcuagccuggcac

SEQ ID NO: 481055 - RNA, 32 nt, Human
guucaugagugaaggagcuccuggagucauga

SEQ ID NO: 481056 - RNA, 32 nt, Human
guucaugcaaccuccgccuccuggguucaagc

SEQ ID NO: 481057 - RNA, 32 nt, Human
guucaugcaauugcacuccagccugggcaaca

SEQ ID NO: 481058 - RNA, 32 nt, Human
guucaugcaggguccuuggcaggccugagggc

SEQ ID NO: 481059 - RNA, 32 nt, Human
guucaugccacugcacuuccagccugggugac

SEQ ID NO: 481060 - RNA, 32 nt, Human
guucaugccaguaaucccagcacuuucggagg

SEQ ID NO: 481061 - RNA, 21 nt, Human
guucaugccauucuccugccu

SEQ ID NO: 481062 - RNA, 23 nt, Human
guucaugccauucuccugccuca

SEQ ID NO: 481063 - RNA, 21 nt, Human
guucaugccauucuccugucu

SEQ ID NO: 481064 - RNA, 23 nt, Human
guucaugccauucuccugucuca

SEQ ID NO: 481065 - RNA, 32 nt, Human
guucaugcccuaacccucagaaccuauaaaua

SEQ ID NO: 481066 - RNA, 32 nt, Human
guucaugcccugccaaggcauuguucgacucc

SEQ ID NO: 481067 - RNA, 32 nt, Human
guucaugcccuguaauccuagaacuuugggag

SEQ ID NO: 481068 - RNA, 32 nt, Human
guucaugcccuguaauccuagcacuuugggag

SEQ ID NO: 481069 - RNA, 32 nt, Human
guucaugccuauaaucccagcacuuugggaga

SEQ ID NO: 481070 - RNA, 32 nt, Human
guucaugccuauacgauaaacaugauacauaa

SEQ ID NO: 481071 - RNA, 32 nt, Human
guucaugccuaucaucccagcacuuugggagg

SEQ ID NO: 481072 - RNA, 32 nt, Human
guucaugccuggaaucccagcacuuugggagg

SEQ ID NO: 481073 - RNA, 32 nt, Human
guucaugccuggaauccuagcacuuugggagg

SEQ ID NO: 481074 - RNA, 32 nt, Human
guucaugccuguaauaccagcguuuugggagg

SEQ ID NO: 481075 - RNA, 32 nt, Human
guucaugccuguaauccagcacuuugggaggc

SEQ ID NO: 481076 - RNA, 19 nt, Human
guucaugccuguaauccca

SEQ ID NO: 481077 - RNA, 32 nt, Human
guucaugccuguaaucccaacauuuugggagg

SEQ ID NO: 481078 - RNA, 32 nt, Human
guucaugccuguaaucccaaugcuuugggagg

SEQ ID NO: 481079 - RNA, 32 nt, Human
guucaugccuguaaucccagaacuucgggagg

SEQ ID NO: 481080 - RNA, 32 nt, Human
guucaugccuguaaucccagcacuaugggagg

SEQ ID NO: 481081 - RNA, 32 nt, Human
guucaugccuguaaucccagcacuucacuuug

SEQ ID NO: 481082 - RNA, 32 nt, Human
guucaugccuguaaucccagcacuugggaggc

SEQ ID NO: 481083 - RNA, 32 nt, Human
guucaugccuguaaucccagcacuuuggaagg

SEQ ID NO: 481084 - RNA, 32 nt, Human
guucaugccuguaaucccagcacuuugggagg

SEQ ID NO: 481085 - RNA, 32 nt, Human
guucaugccuguaaucccaguacuuuggaaag

SEQ ID NO: 481086 - RNA, 32 nt, Human
guucaugccuguaaucccaguacuuugggagg

SEQ ID NO: 481087 - RNA, 32 nt, Human
guucaugccuguagcucucuuccuuuuguuuc

SEQ ID NO: 481088 - RNA, 32 nt, Human
guucaugccuuaaucccagcacuuugggaggc

SEQ ID NO: 481089 - RNA, 32 nt, Human
guucaugccuucuguuuugcucuugucccugg

SEQ ID NO: 481090 - RNA, 32 nt, Human
guucaugcucaauauugugaaaagcuuuuaaa

SEQ ID NO: 481091 - RNA, 32 nt, Human
guucaugcucugagccucugccaagcugagua

SEQ ID NO: 481092 - RNA, 32 nt, Human
guucaugcuguaaucccaucacuuugggaggc

SEQ ID NO: 481093 - RNA, 32 nt, Human
guucauggacuuuuauuccugugucuuggcug

SEQ ID NO: 481094 - RNA, 19 nt, Human
guucauggauauccacuga

SEQ ID NO: 481095 - RNA, 32 nt, Human
guucaugggaggcggaggugacuggcuggcug

SEQ ID NO: 481096 - RNA, 32 nt, Human
guucaugggugagggauaaaaugaggcuccaa

SEQ ID NO: 481097 - RNA, 32 nt, Human
guucauguccuaggaagucagcuuuugcccca

SEQ ID NO: 481098 - RNA, 32 nt, Human
guucauguccucugcucauuguuuucaaaugg

SEQ ID NO: 481099 - RNA, 32 nt, Human
guucaugucuguaaucccagcacuuugugagg

SEQ ID NO: 481100 - RNA, 32 nt, Human
guucauguggacacacaaaggcaaacagaucu

SEQ ID NO: 481101 - RNA, 32 nt, Human
guucauguggcaccugccugccauguccacaa

SEQ ID NO: 481102 - RNA, 32 nt, Human
guucauguucuaggucuguacuguccaguaca

SEQ ID NO: 481103 - RNA, 32 nt, Human
guucauguucuagugaacacagcuuguucagg

SEQ ID NO: 481104 - RNA, 32 nt, Human
guucauucaaggagaguugagauacagugaaa

SEQ ID NO: 481105 - RNA, 32 nt, Human
guucauucauuuccuccauaaacaccaacuuc

SEQ ID NO: 481106 - RNA, 32 nt, Human
guucauucauuucucuucaccauguauccugc

SEQ ID NO: 481107 - RNA, 32 nt, Human
guucauucauuuucucuguuuugacucuuuua

SEQ ID NO: 481108 - RNA, 32 nt, Human
guucauuccauggcugggagucacugaugcug

SEQ ID NO: 481109 - RNA, 32 nt, Human
guucauucggcacagaccccugccucauucag

SEQ ID NO: 481110 - RNA, 32 nt, Human
guucauucucagugguggaugaugagcagguc

SEQ ID NO: 481111 - RNA, 32 nt, Human
guucauucucguaaccuccauauuuucaggau

SEQ ID NO: 481112 - RNA, 32 nt, Human
guucauucuguuuccaaaggcucuacuuucaa

SEQ ID NO: 481113 - RNA, 32 nt, Human
guucauugacaccuuuaagcuggugcacaggg

SEQ ID NO: 481114 - RNA, 32 nt, Human
guucauugagauguggagauugcuuggcagag

SEQ ID NO: 481115 - RNA, 32 nt, Human
guucauugcagcgcuauucacacuagcaaaga

SEQ ID NO: 481116 - RNA, 32 nt, Human
guucauuuauuuuucuucauugcaguggauug

SEQ ID NO: 481117 - RNA, 32 nt, Human
guucauuucaaaagcuaagaacuguccggcag

SEQ ID NO: 481118 - RNA, 32 nt, Human
guucauuucagccucagguccaagccauguuc

SEQ ID NO: 481119 - RNA, 32 nt, Human
guucauuucagccucuggauggcuggcugccu

SEQ ID NO: 481120 - RNA, 32 nt, Human
guucauuucaggagcuucuccuucccacagac

SEQ ID NO: 481121 - RNA, 17 nt, Human
guucauuugccauucga

SEQ ID NO: 481122 - RNA, 32 nt, Human
guucauuuggagcaucuugaaaagcuggagcu

SEQ ID NO: 481123 - RNA, 32 nt, Human
guucauuugucaggagaacugugagaaauaaa

SEQ ID NO: 481124 - RNA, 32 nt, Human
guucauuugucucucugucucagcuuccuccc

SEQ ID NO: 481125 - RNA, 21 nt, Human
guuccaaacacucggccugug

SEQ ID NO: 481126 - RNA, 32 nt, Human
guuccaaagaggaagccaaaggggaagaaaca

SEQ ID NO: 481127 - RNA, 32 nt, Human
guuccaaagugcugauauuacaggcauaauau

SEQ ID NO: 481128 - RNA, 32 nt, Human
guuccaacucacugugcgucuccuccacacag

SEQ ID NO: 481129 - RNA, 32 nt, Human
guuccaacuguacauacauacuguaugaagcu

SEQ ID NO: 481130 - RNA, 32 nt, Human
guuccaagaaggauuucucugaacaaccaguc

SEQ ID NO: 481131 - RNA, 32 nt, Human
guuccaagagccuuuuagugauuaaaauagaa

SEQ ID NO: 481132 - RNA, 32 nt, Human
guuccaaggcccgcgcugggaaaaaggugggg

SEQ ID NO: 481133 - RNA, 32 nt, Human
guuccaagggccugagucaaugugucuguggg

SEQ ID NO: 481134 - RNA, 24 nt, Human
guuccaaguacucacaggggcucu

SEQ ID NO: 481135 - RNA, 32 nt, Human
guuccaaguagcugggauuacagacgccugcc

SEQ ID NO: 481136 - RNA, 32 nt, Human
guuccaagucucuccuuuccuggcaggucuua

SEQ ID NO: 481137 - RNA, 32 nt, Human
guuccaauggcugacagaaacugccuauuuga

SEQ ID NO: 481138 - RNA, 32 nt, Human
guuccacaacaaccugugaaauagcugugagc

SEQ ID NO: 481139 - RNA, 32 nt, Human
guuccacacacacuccaaagccgauuucaaau

SEQ ID NO: 481140 - RNA, 32 nt, Human
guuccacacagccccggccuuucgcggugaca

SEQ ID NO: 481141 - RNA, 32 nt, Human
guuccacacccagcaggcgcaaccagagucuc

SEQ ID NO: 481142 - RNA, 32 nt, Human
guuccacacuucacguggacugagguagaccc

SEQ ID NO: 481143 - RNA, 20 nt, Human
guuccacaggcuguacggga

SEQ ID NO: 481144 - RNA, 32 nt, Human
guuccacaucccuagacugggugagagggccu

SEQ ID NO: 481145 - RNA, 32 nt, Human
guuccacauggcuggggaggccucaaaauagu

SEQ ID NO: 481146 - RNA, 32 nt, Human
guuccacauggcuggggaggccucaaaaucag

SEQ ID NO: 481147 - RNA, 32 nt, Human
guuccacauggcuggggaggccucagaaucau

SEQ ID NO: 481148 - RNA, 32 nt, Human
guuccaccucuacagggcauuuuauggcuuaa

SEQ ID NO: 481149 - RNA, 32 nt, Human
guuccaccuucccaucacucaaauccuuuuau

SEQ ID NO: 481150 - RNA, 32 nt, Human
guuccacggaggaggggagcugagagguucga

SEQ ID NO: 481151 - RNA, 32 nt, Human
guuccacuagcuacaggugagcauuuuaccca

SEQ ID NO: 481152 - RNA, 32 nt, Human
guuccacucuggccugggccugaggccagcgc

SEQ ID NO: 481153 - RNA, 32 nt, Human
guuccacugauuaaaaacuuucucuuccacgg

SEQ ID NO: 481154 - RNA, 32 nt, Human
guuccacugcacuccagccuggguuacagagg

SEQ ID NO: 481155 - RNA, 32 nt, Human
guuccacuggucucaaaagucaccugccuaca

SEQ ID NO: 481156 - RNA, 32 nt, Human
guuccacuucaugugguuuugcuucaucuucu

SEQ ID NO: 481157 - RNA, 32 nt, Human
guuccacuugcacacacgcacacacucaugcu

SEQ ID NO: 481158 - RNA, 32 nt, Human
guuccacuuugccucccccaaucacugcggcg

SEQ ID NO: 481159 - RNA, 32 nt, Human
guuccagaaaauuauguugucuuccucuaaua

SEQ ID NO: 481160 - RNA, 24 nt, Human
guuccagaaaggccuccagcugag

SEQ ID NO: 481161 - RNA, 32 nt, Human
guuccagaaaucccaacucucacacccagccc

SEQ ID NO: 481162 - RNA, 32 nt, Human
guuccagaacagguaccacagcuuugguuuua

SEQ ID NO: 481163 - RNA, 32 nt, Human
guuccagaaggggagaagcauagagggccugu

SEQ ID NO: 481164 - RNA, 32 nt, Human
guuccagaauuacuggagucuccugaugcuga

SEQ ID NO: 481165 - RNA, 32 nt, Human
guuccagaccagccuggccaacauagugaaac

SEQ ID NO: 481166 - RNA, 32 nt, Human
guuccagaccagccuggccaacauggugaaac

SEQ ID NO: 481167 - RNA, 32 nt, Human
guuccagaccagccuggccaucauggugaaau

SEQ ID NO: 481168 - RNA, 32 nt, Human
guuccagaccagccuggcuaauauggugaaac

SEQ ID NO: 481169 - RNA, 32 nt, Human
guuccagaccagccugggcaacauagugagac

SEQ ID NO: 481170 - RNA, 32 nt, Human
guuccagaccagccugggcaacauagugagau

SEQ ID NO: 481171 - RNA, 32 nt, Human
guuccagaccagccugggcaacaugcgagacc

SEQ ID NO: 481172 - RNA, 32 nt, Human
guuccagaccagccugggcaauacagcgagaa

SEQ ID NO: 481173 - RNA, 32 nt, Human
guuccagaccagccuggucaacauggugaaac

SEQ ID NO: 481174 - RNA, 32 nt, Human
guuccagagagggacagcagguacagaggccc

SEQ ID NO: 481175 - RNA, 32 nt, Human
guuccagagguaaaccaggucucagggaagag

SEQ ID NO: 481176 - RNA, 32 nt, Human
guuccagaucagccuggccaacauggugaaac

SEQ ID NO: 481177 - RNA, 32 nt, Human
guuccagauguggcaaaaucuggcaaaggcag

SEQ ID NO: 481178 - RNA, 32 nt, Human
guuccagcaaaucaagcugagcuuugaaaaag

SEQ ID NO: 481179 - RNA, 32 nt, Human
guuccagcagaacuggacuaauucuguggacc

SEQ ID NO: 481180 - RNA, 32 nt, Human
guuccagcagguagcugagcugagaggacaua

SEQ ID NO: 481181 - RNA, 32 nt, Human
guuccagcagguccuccggcucccagagguga

SEQ ID NO: 481182 - RNA, 32 nt, Human
guuccagccacugguugccuugcaggaaugca

SEQ ID NO: 481183 - RNA, 32 nt, Human
guuccagcccuuuaagauguugcgcgugguga

SEQ ID NO: 481184 - RNA, 23 nt, Human
guuccagcuacucaagaggccga

SEQ ID NO: 481185 - RNA, 23 nt, Human
guuccagcuacucaagaggcuga

SEQ ID NO: 481186 - RNA, 21 nt, Human
guuccagcuacucaggaggcu

SEQ ID NO: 481187 - RNA, 23 nt, Human
guuccagcuacucaggaggcuga

SEQ ID NO: 481188 - RNA, 23 nt, Human
guuccagcuacucgggaggcuga

SEQ ID NO: 481189 - RNA, 32 nt, Human
guuccagcugagcugccuucuggcuauucccu

SEQ ID NO: 481190 - RNA, 31 nt, Human
guuccagcugcucgggagguugagggagaag

SEQ ID NO: 481191 - RNA, 32 nt, Human
guuccagcuguucacaaccagugugugauuuu

SEQ ID NO: 481192 - RNA, 32 nt, Human
guuccaggaacucaggaucugcagugaggacc

SEQ ID NO: 481193 - RNA, 32 nt, Human
guuccaggauuacuucaugcuguccagguccu

SEQ ID NO: 481194 - RNA, 32 nt, Human
guuccaggcccagguagcuucccaucaccaac

SEQ ID NO: 481195 - RNA, 32 nt, Human
guuccaggccucggccuuccugcuccacgugc

SEQ ID NO: 481196 - RNA, 32 nt, Human
guuccaggccuuucaccugcucugccuugaaa

SEQ ID NO: 481197 - RNA, 17 nt, Human
guuccagggaaaguguc

SEQ ID NO: 481198 - RNA, 32 nt, Human
guuccagggaccccucugucacaaggccaggc

SEQ ID NO: 481199 - RNA, 32 nt, Human
guuccagggagccaaagggggagccagagagc

SEQ ID NO: 481200 - RNA, 32 nt, Human
guuccagggcccaaagcccagcucuuuguuca

SEQ ID NO: 481201 - RNA, 32 nt, Human
guuccagggcccagugcuggaggacugggaaa

SEQ ID NO: 481202 - RNA, 32 nt, Human
guuccagggcucugggcacacagcugugcuca

SEQ ID NO: 481203 - RNA, 32 nt, Human
guuccagguagugagagaagaaacucgaccug

SEQ ID NO: 481204 - RNA, 32 nt, Human
guuccagguauucugcauccucaccaacacuu

SEQ ID NO: 481205 - RNA, 32 nt, Human
guuccaggucacugcaucugucucuccaccau

SEQ ID NO: 481206 - RNA, 32 nt, Human
guuccaggugcccuggcuggagucaguccuca

SEQ ID NO: 481207 - RNA, 32 nt, Human
guuccagguuuuacuggcugcaccacaccccu

SEQ ID NO: 481208 - RNA, 32 nt, Human
guuccaguagacucaucacugcagccucagca

SEQ ID NO: 481209 - RNA, 32 nt, Human
guuccaguaugaaaguugggggagagcaccag

SEQ ID NO: 481210 - RNA, 23 nt, Human
guuccagugauucuccugccuca

SEQ ID NO: 481211 - RNA, 32 nt, Human
guuccagugcacacuucccaugcuucugaguc

SEQ ID NO: 481212 - RNA, 32 nt, Human
guuccaguucccaacaaguuccucaucuccau

SEQ ID NO: 481213 - RNA, 32 nt, Human
guuccauaaacaaaacauacauagugggaacu

SEQ ID NO: 481214 - RNA, 32 nt, Human
guuccauaucccuuucucucuuguccaauggg

SEQ ID NO: 481215 - RNA, 21 nt, Human
guuccauauucugguauugug

SEQ ID NO: 481216 - RNA, 32 nt, Human
guuccauccuaccugccugaccugcccagcau

SEQ ID NO: 481217 - RNA, 32 nt, Human
guuccaucucugucuccagccugcccacuucc

SEQ ID NO: 481218 - RNA, 32 nt, Human
guuccaucuugcccauuuccugggcuuauauc

SEQ ID NO: 481219 - RNA, 32 nt, Human
guuccaugaaaccucucaaguacacaauugua

SEQ ID NO: 481220 - RNA, 32 nt, Human
guuccaugaaaguuacccaggguccucauguc

SEQ ID NO: 481221 - RNA, 26 nt, Human
guuccaugccucucuccuuggcuugu

SEQ ID NO: 481222 - RNA, 32 nt, Human
guuccauucagucugcagcuauucacacacac

SEQ ID NO: 481223 - RNA, 32 nt, Human
guuccauucuaaccuaggaugaucucauuugg

SEQ ID NO: 481224 - RNA, 32 nt, Human
guuccauugcuccccgcugccaugcucucucc

SEQ ID NO: 481225 - RNA, 32 nt, Human
guuccauuggucuacaugacugucuuuguuuc

SEQ ID NO: 481226 - RNA, 32 nt, Human
guuccauugugccauucagguuugcugucaca

SEQ ID NO: 481227 - RNA, 32 nt, Human
guuccauuuaugcugguuaagagaucccuuaa

SEQ ID NO: 481228 - RNA, 32 nt, Human
guuccauuuccauuuucccuguucucaaggga

SEQ ID NO: 481229 - RNA, 32 nt, Human
guuccauuuucccccagcaccguguggcaccu

SEQ ID NO: 481230 - RNA, 32 nt, Human
guuccauuuuugaaugaacuaguuuaaugugg

SEQ ID NO: 481231 - RNA, 32 nt, Human
guucccaaacacaggaagugauuuucugccug

SEQ ID NO: 481232 - RNA, 32 nt, Human
guucccaaccauacuucuucugacccuuuacc

SEQ ID NO: 481233 - RNA, 32 nt, Human
guucccaaccuacaggccauggacagguccau

SEQ ID NO: 481234 - RNA, 32 nt, Human
guucccaagcucagaggcgcacugugaccccc

SEQ ID NO: 481235 - RNA, 32 nt, Human
guucccacagaacuuuggcacauucugaagaa

SEQ ID NO: 481236 - RNA, 32 nt, Human
guucccacccaccaguuccucuaagcacauac

SEQ ID NO: 481237 - RNA, 32 nt, Human
guucccaccucucuccaccacauacuuacagg

SEQ ID NO: 481238 - RNA, 32 nt, Human
guucccacuauguugaucaggcuggucucaaa

SEQ ID NO: 481239 - RNA, 32 nt, Human
guucccacucacuggaaucuccagccuuccag

SEQ ID NO: 481240 - RNA, 20 nt, Human
guucccacuccuucaggaca

SEQ ID NO: 481241 - RNA, 32 nt, Human
guucccagacacacaaccccucuagcucucgg

SEQ ID NO: 481242 - RNA, 32 nt, Human
guucccagacacccuacccacacacaugccuu

SEQ ID NO: 481243 - RNA, 32 nt, Human
guucccagacaggucccugaguacugacgguc

SEQ ID NO: 481244 - RNA, 32 nt, Human
guucccagacccaggaaguauaagucauugac

SEQ ID NO: 481245 - RNA, 32 nt, Human
guucccagacccuucccaagauggaaccaaua

SEQ ID NO: 481246 - RNA, 32 nt, Human
guucccagaggcaggcggagguugaagaaagg

SEQ ID NO: 481247 - RNA, 32 nt, Human
guucccagauacaaagaauugugcuuuuaauu

SEQ ID NO: 481248 - RNA, 32 nt, Human
guucccagcacacccacuugcucacuggggcc

SEQ ID NO: 481249 - RNA, 32 nt, Human
guucccagcacuaggugagauuugaaagauga

SEQ ID NO: 481250 - RNA, 24 nt, Human
guucccagcagaacagcggagccu

SEQ ID NO: 481251 - RNA, 32 nt, Human
guucccagcagggggagaaacccuucacaccc

SEQ ID NO: 481252 - RNA, 32 nt, Human
guucccagccaagaguaugagaacauccaguc

SEQ ID NO: 481253 - RNA, 32 nt, Human
guucccagccacugcucauguaauguacuccc

SEQ ID NO: 481254 - RNA, 32 nt, Human
guucccagccagacaguuauggggaagcaagg

SEQ ID NO: 481255 - RNA, 32 nt, Human
guucccagccccguucagcugguggcuuuuag

SEQ ID NO: 481256 - RNA, 32 nt, Human
guucccagcccucccucucucuugaccuggau

SEQ ID NO: 481257 - RNA, 32 nt, Human
guucccagccucugcugacagcaccucagcua

SEQ ID NO: 481258 - RNA, 32 nt, Human
guucccagccucuuccaggcacuggcaaugca

SEQ ID NO: 481259 - RNA, 32 nt, Human
guucccagcuacucaggaggcuauggugggag

SEQ ID NO: 481260 - RNA, 32 nt, Human
guucccagcuacucaggaggcugaagcaggag

SEQ ID NO: 481261 - RNA, 32 nt, Human
guucccagcuacuugggaggcuaaggugggaa

SEQ ID NO: 481262 - RNA, 32 nt, Human
guucccaggaagaggaaguaaaucugcaaccc

SEQ ID NO: 481263 - RNA, 32 nt, Human
guucccaggaaggacaaggaucugccuccccc

SEQ ID NO: 481264 - RNA, 31 nt, Human
guucccaggagaccugauucccuguggugau

SEQ ID NO: 481265 - RNA, 32 nt, Human
guucccagggcugggaggacagcucuggcccu

SEQ ID NO: 481266 - RNA, 32 nt, Human
guucccagggcuuugcccucugugucuuagca

SEQ ID NO: 481267 - RNA, 32 nt, Human
guucccaggguggggcagggagguggggguug

SEQ ID NO: 481268 - RNA, 32 nt, Human
guucccaguaggggcggccgggcagaggcgcc

SEQ ID NO: 481269 - RNA, 32 nt, Human
guucccaguguacuugaacaguugcauuuaua

SEQ ID NO: 481270 - RNA, 32 nt, Human
guucccaguguggcugaggccacccagaggca

SEQ ID NO: 481271 - RNA, 32 nt, Human
guucccaucaguuucaggccaggacuggagag

SEQ ID NO: 481272 - RNA, 32 nt, Human
guucccauccaggaauguuaaggugaggugaa

SEQ ID NO: 481273 - RNA, 32 nt, Human
guucccaucccccagcccuggcuccuaggucc

SEQ ID NO: 481274 - RNA, 32 nt, Human
guucccaucucaucugucagccacagucauuu

SEQ ID NO: 481275 - RNA, 32 nt, Human
guucccaucuucucucaccccuuucaucucug

SEQ ID NO: 481276 - RNA, 32 nt, Human
guucccaugcaagcccuggccuuccguucauc

SEQ ID NO: 481277 - RNA, 32 nt, Human
guucccauggaagaaguaaagaagaggucacu

SEQ ID NO: 481278 - RNA, 32 nt, Human
guucccauuaccagaagcaaagcugcugcuaa

SEQ ID NO: 481279 - RNA, 32 nt, Human
guucccauucuucuuugugagacagagagaau

SEQ ID NO: 481280 - RNA, 32 nt, Human
guuccccaaguguccuggaaauuugccuggua

SEQ ID NO: 481281 - RNA, 32 nt, Human
guuccccacccaguucuucauuuggaggaauc

SEQ ID NO: 481282 - RNA, 32 nt, Human
guuccccacgccacuccccacccaagagauug

SEQ ID NO: 481283 - RNA, 32 nt, Human
guuccccacugccagggaaccccacgccaccc

SEQ ID NO: 481284 - RNA, 27 nt, Human
guuccccagaagcugccagugcuuuca

SEQ ID NO: 481285 - RNA, 32 nt, Human
guuccccagcaccccaaauggauuuccaguca

SEQ ID NO: 481286 - RNA, 32 nt, Human
guuccccagcugaacuuuagaggacagauagg

SEQ ID NO: 481287 - RNA, 32 nt, Human
guuccccagcugcagggagacuggagugggac

SEQ ID NO: 481288 - RNA, 32 nt, Human
guuccccaggagacaagggucccugcagagau

SEQ ID NO: 481289 - RNA, 24 nt, Human
guuccccaggccggagugcagugg

SEQ ID NO: 481290 - RNA, 23 nt, Human
guuccccaggcuggagugcaaug

SEQ ID NO: 481291 - RNA, 24 nt, Human
guuccccaggcuggagugcaaugg

SEQ ID NO: 481292 - RNA, 32 nt, Human
guuccccaugcgcacacacauacacacacccc

SEQ ID NO: 481293 - RNA, 32 nt, Human
guuccccauucugccacauucugaccaugaga

SEQ ID NO: 481294 - RNA, 21 nt, Human
guucccccaaaccuguccucu

SEQ ID NO: 481295 - RNA, 32 nt, Human
guucccccagacaagagagggcaagucagcca

SEQ ID NO: 481296 - RNA, 21 nt, Human
guucccccucccucugagaaa

SEQ ID NO: 481297 - RNA, 32 nt, Human
guucccccugccucucuggccucuugucuccc

SEQ ID NO: 481298 - RNA, 32 nt, Human
guucccccugcuccaucccccauugcaugggg

SEQ ID NO: 481299 - RNA, 32 nt, Human
guuccccggagcaggcccugcccuccacaccc

SEQ ID NO: 481300 - RNA, 32 nt, Human
guuccccucagccucugagcugaggccccaca

SEQ ID NO: 481301 - RNA, 32 nt, Human
guuccccuccacugccaaguccucauuuucca

SEQ ID NO: 481302 - RNA, 24 nt, Human
guuccccuccagccuggugcuggg

SEQ ID NO: 481303 - RNA, 32 nt, Human
guuccccuccaggaugcugccggacuggaaga

SEQ ID NO: 481304 - RNA, 20 nt, Human
guuccccuccaggccgcuga

SEQ ID NO: 481305 - RNA, 32 nt, Human
guuccccuccauccacuuugguuuggaagccu

SEQ ID NO: 481306 - RNA, 32 nt, Human
guuccccuccuccagcccagcggcccucuuuc

SEQ ID NO: 481307 - RNA, 32 nt, Human
guuccccugaggugcucuggccuaugcccuga

SEQ ID NO: 481308 - RNA, 32 nt, Human
guuccccugcagcucuucaggaacccacaucu

SEQ ID NO: 481309 - RNA, 32 nt, Human
guuccccugcagcucuucaggaauccacaucu

SEQ ID NO: 481310 - RNA, 32 nt, Human
guuccccugcaguaucuguucugugaaguuug

SEQ ID NO: 481311 - RNA, 32 nt, Human
guuccccugccuccaccuuguuuucuuuucuc

SEQ ID NO: 481312 - RNA, 22 nt, Human
guuccccuggacuccagccaag

SEQ ID NO: 481313 - RNA, 32 nt, Human
guuccccugugggucccucccagcacagggga

SEQ ID NO: 481314 - RNA, 22 nt, Human
guuccccuuauucccgcuaagu

SEQ ID NO: 481315 - RNA, 32 nt, Human
guuccccuugguaccaggagagcugcucacuu

SEQ ID NO: 481316 - RNA, 32 nt, Human
guucccgagccaggaacucugggccccaugga

SEQ ID NO: 481317 - RNA, 32 nt, Human
guucccgaguagcugggacuacaggcaugugc

SEQ ID NO: 481318 - RNA, 32 nt, Human
guucccgauucacguuuuucuggaccaaggug

SEQ ID NO: 481319 - RNA, 18 nt, Human
guucccgcuccugucucc

SEQ ID NO: 481320 - RNA, 22 nt, Human
guucccggcaccucgguuugug

SEQ ID NO: 481321 - RNA, 32 nt, Human
guucccggcaugccaugaaauuggccucggcg

SEQ ID NO: 481322 - RNA, 32 nt, Human
guucccggccccugccacccagccucaugcaa

SEQ ID NO: 481323 - RNA, 32 nt, Human
guucccggcuccccgcaccaucauggcuuugc

SEQ ID NO: 481324 - RNA, 32 nt, Human
guucccgggaaagacuggagcagcgaacagga

SEQ ID NO: 481325 - RNA, 32 nt, Human
guucccgguaggucugcuuucccuggaagagc

SEQ ID NO: 481326 - RNA, 32 nt, Human
guucccguuucuggaguuucaugaggauuuac

SEQ ID NO: 481327 - RNA, 32 nt, Human
guucccuacucagugucuguucuaggugcuga

SEQ ID NO: 481328 - RNA, 32 nt, Human
guucccucaacagagcucugcagccccaagug

SEQ ID NO: 481329 - RNA, 32 nt, Human
guucccucacugcuagucagcuucuuuuggaa

SEQ ID NO: 481330 - RNA, 32 nt, Human
guucccuccagaacuccccauuccccucugag

SEQ ID NO: 481331 - RNA, 32 nt, Human
guucccuccccuccccuuccuguccuuucaca

SEQ ID NO: 481332 - RNA, 32 nt, Human
guucccuccgugguggccucagucuuuuggcg

SEQ ID NO: 481333 - RNA, 32 nt, Human
guucccucggcuguggaccgggcggcacgcac

SEQ ID NO: 481334 - RNA, 32 nt, Human
guucccucuccuccucccuucuucccgggacu

SEQ ID NO: 481335 - RNA, 32 nt, Human
guucccucuccucuccucauucccaacccaaa

SEQ ID NO: 481336 - RNA, 32 nt, Human
guucccucucucccucucccucucccacucuc

SEQ ID NO: 481337 - RNA, 32 nt, Human
guucccucuucuguucccuccuccugccccca

SEQ ID NO: 481338 - RNA, 18 nt, Human
guucccucuugcucagug

SEQ ID NO: 481339 - RNA, 32 nt, Human
guucccugaaccuuccugucucccagggacau

SEQ ID NO: 481340 - RNA, 32 nt, Human
guucccugagaccuggccucaaagggcugacc

SEQ ID NO: 481341 - RNA, 32 nt, Human
guucccugaucccugugccucuucccaucuca

SEQ ID NO: 481342 - RNA, 32 nt, Human
guucccugauucugaaagaaguuuacacuaca

SEQ ID NO: 481343 - RNA, 32 nt, Human
guucccugauuuuuacacaucaugucaaagau

SEQ ID NO: 481344 - RNA, 32 nt, Human
guucccugcaguaauuguaugaucucacccag

SEQ ID NO: 481345 - RNA, 32 nt, Human
guucccugcccaccgacgccagccugcuugga

SEQ ID NO: 481346 - RNA, 32 nt, Human
guucccugcuuuggcuaauguugacuggagug

SEQ ID NO: 481347 - RNA, 32 nt, Human
guucccugcuuugguguagggguugggaaaaa

SEQ ID NO: 481348 - RNA, 32 nt, Human
guucccuggaaccugagucgggaggccugcaa

SEQ ID NO: 481349 - RNA, 32 nt, Human
guucccuggagaaggagaaagacugaagccac

SEQ ID NO: 481350 - RNA, 32 nt, Human
guucccuggaggauccagggaugaggauagag

SEQ ID NO: 481351 - RNA, 32 nt, Human
guucccuggaggcauaaguggcugggguagag

SEQ ID NO: 481352 - RNA, 32 nt, Human
guucccugggagaaggcugggaauggcacguc

SEQ ID NO: 481353 - RNA, 32 nt, Human
guucccugggcugauuccaggcugggccaggc

SEQ ID NO: 481354 - RNA, 32 nt, Human
guucccuuccuguagcagcagcauuuaugaau

SEQ ID NO: 481355 - RNA, 32 nt, Human
guucccuucuuuccuuccuacuuuccuucauu

SEQ ID NO: 481356 - RNA, 32 nt, Human
guucccuugaaacuuugggaaaacauguuaau

SEQ ID NO: 481357 - RNA, 32 nt, Human
guucccuuucaugcugucugugugguugcaug

SEQ ID NO: 481358 - RNA, 32 nt, Human
guucccuuuggguuccauguuuuccuuguucc

SEQ ID NO: 481359 - RNA, 32 nt, Human
guuccgaaaugagaaacuguggaaucuaagcu

SEQ ID NO: 481360 - RNA, 32 nt, Human
guuccgaauucaggcuguuggccagguaauug

SEQ ID NO: 481361 - RNA, 32 nt, Human
guuccgaggaccugggaggagcccucgguacc

SEQ ID NO: 481362 - RNA, 32 nt, Human
guuccgaggcauucagagcaucagagcaagua

SEQ ID NO: 481363 - RNA, 32 nt, Human
guuccgcaacuugcuccugccucccagcccca

SEQ ID NO: 481364 - RNA, 32 nt, Human
guuccgcacccaggcgggggccccugcuaaug

SEQ ID NO: 481365 - RNA, 32 nt, Human
guuccgcagaugcagagguugagguggcugcg

SEQ ID NO: 481366 - RNA, 32 nt, Human
guuccgcagccuggcauggcuucuggggaccu

SEQ ID NO: 481367 - RNA, 26 nt, Human
guuccgcagcgcgcccacggccugug

SEQ ID NO: 481368 - RNA, 32 nt, Human
guuccgcagggcuggggaggccucaggaaacu

SEQ ID NO: 481369 - RNA, 32 nt, Human
guuccgccaggaguuugagcagcuggccaaua

SEQ ID NO: 481370 - RNA, 32 nt, Human
guuccgccccacccucuacagccuuccucagg

SEQ ID NO: 481371 - RNA, 32 nt, Human
guuccgccuguaaucccagcacuuugggaggu

SEQ ID NO: 481372 - RNA, 32 nt, Human
guuccgcuauucggucucacaccuacagugga

SEQ ID NO: 481373 - RNA, 23 nt, Human
guuccgcugccuucuugucugug

SEQ ID NO: 481374 - RNA, 24 nt, Human
guuccgcuggccgguaguguagca

SEQ ID NO: 481375 - RNA, 32 nt, Human
guuccggaacuccaguucugaggggucuugaa

SEQ ID NO: 481376 - RNA, 32 nt, Human
guuccggaggcugaggccaggaggaugggugg

SEQ ID NO: 481377 - RNA, 32 nt, Human
guuccggcacgaaucccauccccacgucuggg

SEQ ID NO: 481378 - RNA, 32 nt, Human
guuccggcaguggaagagacgcgccggcguug

SEQ ID NO: 481379 - RNA, 20 nt, Human
guuccggccacucucugccg

SEQ ID NO: 481380 - RNA, 32 nt, Human
guuccggccucccagggacucaggucacuaau

SEQ ID NO: 481381 - RNA, 32 nt, Human
guuccgggaggaagcaggaaguuauuuucagc

SEQ ID NO: 481382 - RNA, 32 nt, Human
guuccgggcagcaggaucgacgcccaguccag

SEQ ID NO: 481383 - RNA, 32 nt, Human
guuccgggcaggcauuucaggaagaccgccuu

SEQ ID NO: 481384 - RNA, 32 nt, Human
guuccgggcucggugcgacugcgcagcuccuc

SEQ ID NO: 481385 - RNA, 32 nt, Human
guuccggggcuccugucucugccuccugggcc

SEQ ID NO: 481386 - RNA, 32 nt, Human
guuccggggcuuuuggaccucugugauuccgg

SEQ ID NO: 481387 - RNA, 32 nt, Human
guuccggguuggaacagcagaggcucagaaac

SEQ ID NO: 481388 - RNA, 32 nt, Human
guuccggugguggcagaggugcuuguguuuuu

SEQ ID NO: 481389 - RNA, 32 nt, Human
guuccguaguuugguugcuggcuguaggaguu

SEQ ID NO: 481390 - RNA, 32 nt, Human
guuccgucaucaccccagcccaaacugaagac

SEQ ID NO: 481391 - RNA, 32 nt, Human
guuccguuuccaaacagccaugguggugucca

SEQ ID NO: 481392 - RNA, 32 nt, Human
guuccuaaagccaccucucagcagaaucguca

SEQ ID NO: 481393 - RNA, 32 nt, Human
guuccuaaccagccuggucaacauggugaaac

SEQ ID NO: 481394 - RNA, 32 nt, Human
guuccuaacuucauagaaacuaaagcagaaag

SEQ ID NO: 481395 - RNA, 32 nt, Human
guuccuaaucagagaugacauggagaucccuu

SEQ ID NO: 481396 - RNA, 32 nt, Human
guuccuacuguacuguaacuuugaucaugucu

SEQ ID NO: 481397 - RNA, 32 nt, Human
guuccuagaacaauuuccagcacauagcaagu

SEQ ID NO: 481398 - RNA, 26 nt, Human
guuccuagacaucaguguuugcuuca

SEQ ID NO: 481399 - RNA, 32 nt, Human
guuccuagagcagucgcuccagccggggcugc

SEQ ID NO: 481400 - RNA, 32 nt, Human
guuccuagcucccuccgggcucugaugccauu

SEQ ID NO: 481401 - RNA, 32 nt, Human
guuccuagcugcagaagggucccgccuaggcc

SEQ ID NO: 481402 - RNA, 22 nt, Human
guuccuaggcuccuuuguacaa

SEQ ID NO: 481403 - RNA, 32 nt, Human
guuccuagucccgggaaggcaacuacccaaag

SEQ ID NO: 481404 - RNA, 32 nt, Human
guuccuagucucuucuucauugcccuuccuca

SEQ ID NO: 481405 - RNA, 32 nt, Human
guuccuaucccaggauggcuguugggauuagg

SEQ ID NO: 481406 - RNA, 32 nt, Human
guuccuaugggugcuauucaucuggaaggccu

SEQ ID NO: 481407 - RNA, 32 nt, Human
guuccuauuaagaagucacuucccucuacucc

SEQ ID NO: 481408 - RNA, 32 nt, Human
guuccucaagagaguccuuggcuuaaagcugu

SEQ ID NO: 481409 - RNA, 32 nt, Human
guuccucaccugaggcuagagcagcagcugcc

SEQ ID NO: 481410 - RNA, 32 nt, Human
guuccucacucuuccuuuucagaaccugaugc

SEQ ID NO: 481411 - RNA, 32 nt, Human
guuccucagcuggucaugcugagcucauaccc

SEQ ID NO: 481412 - RNA, 32 nt, Human
guuccucaggaaaagcuccagcuagcauguuu

SEQ ID NO: 481413 - RNA, 32 nt, Human
guuccucaucacuguccaugcaccaugcagcc

SEQ ID NO: 481414 - RNA, 32 nt, Human
guuccucauggggcuggacucaucucaguggc

SEQ ID NO: 481415 - RNA, 32 nt, Human
guuccucauucacaucaacagagcgaggcugu

SEQ ID NO: 481416 - RNA, 25 nt, Human
guuccuccaaccccaggaggccagg

SEQ ID NO: 481417 - RNA, 25 nt, Human
guuccuccaacucuaggaggccagg

SEQ ID NO: 481418 - RNA, 32 nt, Human
guuccuccaagugcacauuuagccuuaaaauc

SEQ ID NO: 481419 - RNA, 32 nt, Human
guuccuccagcaggguauggccagcuuuaguc

SEQ ID NO: 481420 - RNA, 32 nt, Human
guuccuccagccccuucuccucucugcaccuu

SEQ ID NO: 481421 - RNA, 22 nt, Human
guuccucccagcaaccuucccu

SEQ ID NO: 481422 - RNA, 27 nt, Human
guuccucccaggaaaucaaaggccagg

SEQ ID NO: 481423 - RNA, 23 nt, Human
guuccuccccgcugcaggccagg

SEQ ID NO: 481424 - RNA, 32 nt, Human
guuccucccuuuucucugcuuuucuccucucu

SEQ ID NO: 481425 - RNA, 32 nt, Human
guuccuccuccccucuccuaucagcccuaauc

SEQ ID NO: 481426 - RNA, 32 nt, Human
guuccuccucuccuacucggcucugcaguccu

SEQ ID NO: 481427 - RNA, 32 nt, Human
guuccuccuguguucauucuccuuccugccac

SEQ ID NO: 481428 - RNA, 32 nt, Human
guuccuccuuagugccaucacagcaggugaau

SEQ ID NO: 481429 - RNA, 32 nt, Human
guuccucgaacucugcaccuuccuccaccagg

SEQ ID NO: 481430 - RNA, 32 nt, Human
guuccucuccaaugacacggugcagcugaacg

SEQ ID NO: 481431 - RNA, 32 nt, Human
guuccucuccccucaggaggccaccucaggaa

SEQ ID NO: 481432 - RNA, 32 nt, Human
guuccucugccugcuaacaagcccacguggac

SEQ ID NO: 481433 - RNA, 32 nt, Human
guuccucugcugcagcccuggcugggcagaca

SEQ ID NO: 481434 - RNA, 32 nt, Human
guuccucuggguugggagaggggcugggcaug

SEQ ID NO: 481435 - RNA, 32 nt, Human
guuccucuggugccugccguggcucaaauuau

SEQ ID NO: 481436 - RNA, 32 nt, Human
guuccucugguuccucccuacauuucaggccu

SEQ ID NO: 481437 - RNA, 32 nt, Human
guuccucugguucuugccugcuucacugugga

SEQ ID NO: 481438 - RNA, 32 nt, Human
guuccucuguuuccucacccuaacccuaaacc

SEQ ID NO: 481439 - RNA, 32 nt, Human
guuccucuguuuuucuuuuugauuuuuguuuu

SEQ ID NO: 481440 - RNA, 23 nt, Human
guuccucuuaggggucugccuca

SEQ ID NO: 481441 - RNA, 32 nt, Human
guuccucuucucauucucuccccgccgccugu

SEQ ID NO: 481442 - RNA, 32 nt, Human
guuccugaaagcuucugucacucaagaaucca

SEQ ID NO: 481443 - RNA, 20 nt, Human
guuccugaaccgaugagaaa

SEQ ID NO: 481444 - RNA, 32 nt, Human
guuccugacucugaaagccagcuuauugccga

SEQ ID NO: 481445 - RNA, 32 nt, Human
guuccugacucugacaagaaagcauaagucuc

SEQ ID NO: 481446 - RNA, 32 nt, Human
guuccugauagcuacccacagagcaagugauu

SEQ ID NO: 481447 - RNA, 32 nt, Human
guuccugaucaaagcaauagccagcuuucgac

SEQ ID NO: 481448 - RNA, 32 nt, Human
guuccugaucuagccccagaccuggccaggcc

SEQ ID NO: 481449 - RNA, 32 nt, Human
guuccugcaacgcguguuccugcugggguucu

SEQ ID NO: 481450 - RNA, 32 nt, Human
guuccugcacacaggagcacccacagagagac

SEQ ID NO: 481451 - RNA, 32 nt, Human
guuccugcacguggcuaugcuguggggccucu

SEQ ID NO: 481452 - RNA, 32 nt, Human
guuccugcacuccugguggugcgucuucuggg

SEQ ID NO: 481453 - RNA, 32 nt, Human
guuccugcauuucagcagugcauaaucgagca

SEQ ID NO: 481454 - RNA, 32 nt, Human
guuccugccaaucagagaucucuauauuaaau

SEQ ID NO: 481455 - RNA, 32 nt, Human
guuccugccagccucaggccagggguucagag

SEQ ID NO: 481456 - RNA, 32 nt, Human
guuccugccaugacauggaaaccuggugguau

SEQ ID NO: 481457 - RNA, 32 nt, Human
guuccugccccaggaauaggccaggagggaag

SEQ ID NO: 481458 - RNA, 32 nt, Human
guuccugccccuuccuccucguaaccaaaacc

SEQ ID NO: 481459 - RNA, 32 nt, Human
guuccugcccucauggaggggagggaggcaau

SEQ ID NO: 481460 - RNA, 32 nt, Human
guuccugccgcagcucucuccccuucuuaccu

SEQ ID NO: 481461 - RNA, 32 nt, Human
guuccugccuccuugauauuuguauuuauucu

SEQ ID NO: 481462 - RNA, 32 nt, Human
guuccugccuucucuucuauccugcaauuucu

SEQ ID NO: 481463 - RNA, 32 nt, Human
guuccugcugaagacauuuacuuucaaugauc

SEQ ID NO: 481464 - RNA, 32 nt, Human
guuccugcuucuggucuucuccugggcuccac

SEQ ID NO: 481465 - RNA, 32 nt, Human
guuccuggaggaccagcugccaaggaagggca

SEQ ID NO: 481466 - RNA, 32 nt, Human
guuccuggcugcaggcucgaguucagggggca

SEQ ID NO: 481467 - RNA, 32 nt, Human
guuccuggcuuccaugugacuuguaagugugc

SEQ ID NO: 481468 - RNA, 32 nt, Human
guuccugggagaagccgggcugccucacgagg

SEQ ID NO: 481469 - RNA, 32 nt, Human
guuccugggaggcgggcgcggcaggacuggga

SEQ ID NO: 481470 - RNA, 32 nt, Human
guuccugggcuccccuucucucuaccuucucc

SEQ ID NO: 481471 - RNA, 32 nt, Human
guuccugggcugggagaggagccuucugacug

SEQ ID NO: 481472 - RNA, 32 nt, Human
guuccuggggcaagaagccagaugggagauga

SEQ ID NO: 481473 - RNA, 32 nt, Human
guuccugggugaggaccacacaaucagauaag

SEQ ID NO: 481474 - RNA, 32 nt, Human
guuccugggugaggcugaagccacuaguccau

SEQ ID NO: 481475 - RNA, 32 nt, Human
guuccugguccuuucacuaagaauuuccacau

SEQ ID NO: 481476 - RNA, 32 nt, Human
guuccuggugacccaggcucucaccagccaau

SEQ ID NO: 481477 - RNA, 32 nt, Human
guuccugguguucccuuucccugcugaccuug

SEQ ID NO: 481478 - RNA, 32 nt, Human
guuccugguuauggcaguuucuuggugauuug

SEQ ID NO: 481479 - RNA, 32 nt, Human
guuccuguaacauuaccuccacacaacugcac

SEQ ID NO: 481480 - RNA, 32 nt, Human
guuccuguagcucuggggccaggucagccgug

SEQ ID NO: 481481 - RNA, 21 nt, Human
guuccuguccccucugagaaa

SEQ ID NO: 481482 - RNA, 32 nt, Human
guuccugugccacccuuuccccgccccucaaa

SEQ ID NO: 481483 - RNA, 32 nt, Human
guuccugugccuccagacuaugcagcucauca

SEQ ID NO: 481484 - RNA, 32 nt, Human
guuccugugccugccuuccccaccccagcagu

SEQ ID NO: 481485 - RNA, 32 nt, Human
guuccugugcugcccugcaccuaggagagacu

SEQ ID NO: 481486 - RNA, 32 nt, Human
guuccuguggauagccugggaggcagguagaa

SEQ ID NO: 481487 - RNA, 31 nt, Human
guuccuguuuaugagagucauguuucaucuc

SEQ ID NO: 481488 - RNA, 23 nt, Human
guuccuguuucagccucugccuu

SEQ ID NO: 481489 - RNA, 32 nt, Human
guuccuguuuccuggaaucacuggugcuauga

SEQ ID NO: 481490 - RNA, 32 nt, Human
guuccuguuuggacccaggagaguggaagaga

SEQ ID NO: 481491 - RNA, 28 nt, Human
guuccuguuuuacaaugcuucugucuua

SEQ ID NO: 481492 - RNA, 32 nt, Human
guuccuuaaucuccucuucuuucauccucagc

SEQ ID NO: 481493 - RNA, 23 nt, Human
guuccuuagccuccugguuugug

SEQ ID NO: 481494 - RNA, 32 nt, Human
guuccuucacaacauaaaauaggauaaaugac

SEQ ID NO: 481495 - RNA, 32 nt, Human
guuccuucacaacaugaaauaggauaaaugac

SEQ ID NO: 481496 - RNA, 32 nt, Human
guuccuucacguccucccuucucagccucguc

SEQ ID NO: 481497 - RNA, 32 nt, Human
guuccuuccagugucauuucucauccacauac

SEQ ID NO: 481498 - RNA, 32 nt, Human
guuccuuccaugcucugugacuuuaagagaag

SEQ ID NO: 481499 - RNA, 32 nt, Human
guuccuucccagcacucccagccugggauaag

SEQ ID NO: 481500 - RNA, 32 nt, Human
guuccuuccucugcgcccuccuguuucucccu

SEQ ID NO: 481501 - RNA, 32 nt, Human
guuccuuccucuuucuccucuccaauuuaugc

SEQ ID NO: 481502 - RNA, 32 nt, Human
guuccuuccugagucaggcuuuguacuugacc

SEQ ID NO: 481503 - RNA, 32 nt, Human
guuccuuccuuguaccucagcacucugggggu

SEQ ID NO: 481504 - RNA, 32 nt, Human
guuccuucuagggccaccuguccccuuaaaca

SEQ ID NO: 481505 - RNA, 21 nt, Human
guuccuucuggugucugcuuu

SEQ ID NO: 481506 - RNA, 23 nt, Human
guuccuucuggugucugcuuucu

SEQ ID NO: 481507 - RNA, 32 nt, Human
guuccuucuguucagcagcccgugcagaggag

SEQ ID NO: 481508 - RNA, 32 nt, Human
guuccuugaaucugaaagagcauuauuccugg

SEQ ID NO: 481509 - RNA, 32 nt, Human
guuccuuggcacccuguuggguauuggguacu

SEQ ID NO: 481510 - RNA, 32 nt, Human
guuccuuggcagacugccuuuccuggaagagg

SEQ ID NO: 481511 - RNA, 32 nt, Human
guuccuuggcugccccggcuucugcacuuacc

SEQ ID NO: 481512 - RNA, 32 nt, Human
guuccuuggugcuaggaggagccuucuggaug

SEQ ID NO: 481513 - RNA, 32 nt, Human
guuccuuuauguccuguacaucauucucugcu

SEQ ID NO: 481514 - RNA, 32 nt, Human
guuccuuucacugcauuuuccaccaacaguca

SEQ ID NO: 481515 - RNA, 32 nt, Human
guuccuuucauaauuacuuuagcuuuucucca

SEQ ID NO: 481516 - RNA, 32 nt, Human
guuccuuuccccucaccugcuugccuccuuaa

SEQ ID NO: 481517 - RNA, 32 nt, Human
guuccuuuccucucuugccucuucccacucac

SEQ ID NO: 481518 - RNA, 32 nt, Human
guuccuuuccuugugggggcccagugugcaau

SEQ ID NO: 481519 - RNA, 32 nt, Human
guuccuuucuaggagcauccaacaggagucag

SEQ ID NO: 481520 - RNA, 32 nt, Human
guuccuuucucccauucccagccucauuucuu

SEQ ID NO: 481521 - RNA, 32 nt, Human
guuccuuuuuagucugacauuuuguggagcag

SEQ ID NO: 481522 - RNA, 32 nt, Human
guucgaaaccagccuggccaacauagugaaac

SEQ ID NO: 481523 - RNA, 32 nt, Human
guucgaaaccagccuggccaacauggugaaac

SEQ ID NO: 481524 - RNA, 32 nt, Human
guucgaaaccagccugggcaacauagugagac

SEQ ID NO: 481525 - RNA, 32 nt, Human
guucgaaccagccuggccaacauggugaaacu

SEQ ID NO: 481526 - RNA, 32 nt, Human
guucgaaccaguuugggcaacauggcgaaacc

SEQ ID NO: 481527 - RNA, 32 nt, Human
guucgaagagucauauuauagcaacggaaauc

SEQ ID NO: 481528 - RNA, 32 nt, Human
guucgaaggguggccaagugccacugcaauua

SEQ ID NO: 481529 - RNA, 32 nt, Human
guucgaccccuccaaggagcgccugcucgagu

SEQ ID NO: 481530 - RNA, 32 nt, Human
guucgacggcgccgggcgaguggcuguugagc

SEQ ID NO: 481531 - RNA, 32 nt, Human
guucgacuggacugugcugagugcgggcacug

SEQ ID NO: 481532 - RNA, 32 nt, Human
guucgacuuguggaucuucacacucagaaaca

SEQ ID NO: 481533 - RNA, 32 nt, Human
guucgagaccaaccgaccaacauggugaaacc

SEQ ID NO: 481534 - RNA, 32 nt, Human
guucgagaccaaccuccaacauggugaaaccc

SEQ ID NO: 481535 - RNA, 32 nt, Human
guucgagaccagacuggcaacauagugagacc

SEQ ID NO: 481536 - RNA, 32 nt, Human
guucgagaccagccugaccaacauagugaaac

SEQ ID NO: 481537 - RNA, 32 nt, Human
guucgagaccagccugaccaacaugguaaaac

SEQ ID NO: 481538 - RNA, 32 nt, Human
guucgagaccagccugaccaacauggugaaaa

SEQ ID NO: 481539 - RNA, 32 nt, Human
guucgagaccagccugaccaacauggugaaac

SEQ ID NO: 481540 - RNA, 32 nt, Human
guucgagaccagccugaccaacauggugaaag

SEQ ID NO: 481541 - RNA, 32 nt, Human
guucgagaccagccugaccaacauggugaaau

SEQ ID NO: 481542 - RNA, 32 nt, Human
guucgagaccagccugaccaacauggugagac

SEQ ID NO: 481543 - RNA, 32 nt, Human
guucgagaccagccugaccaacauggugaggc

SEQ ID NO: 481544 - RNA, 32 nt, Human
guucgagaccagccugagaaacauagugagcc

SEQ ID NO: 481545 - RNA, 32 nt, Human
guucgagaccagccugagcaacauggugaaac

SEQ ID NO: 481546 - RNA, 32 nt, Human
guucgagaccagccugccaacauggugaaacc

SEQ ID NO: 481547 - RNA, 32 nt, Human
guucgagaccagccugcccaacauggugaaac

SEQ ID NO: 481548 - RNA, 32 nt, Human
guucgagaccagccugccuaacauggugaaac

SEQ ID NO: 481549 - RNA, 32 nt, Human
guucgagaccagccuggacaacauagugagac

SEQ ID NO: 481550 - RNA, 32 nt, Human
guucgagaccagccuggccaacauagugaaac

SEQ ID NO: 481551 - RNA, 32 nt, Human
guucgagaccagccuggccaacaugguaaaac

SEQ ID NO: 481552 - RNA, 32 nt, Human
guucgagaccagccuggccaacaugguaaacg

SEQ ID NO: 481553 - RNA, 32 nt, Human
guucgagaccagccuggccaacauggugaaaa

SEQ ID NO: 481554 - RNA, 32 nt, Human
guucgagaccagccuggccaacauggugaaac

SEQ ID NO: 481555 - RNA, 32 nt, Human
guucgagaccagccuggccaacauggugaagc

SEQ ID NO: 481556 - RNA, 32 nt, Human
guucgagaccagccuggccaacauggugauac

SEQ ID NO: 481557 - RNA, 32 nt, Human
guucgagaccagccuggccaacauggugugag

SEQ ID NO: 481558 - RNA, 32 nt, Human
guucgagaccagccuggccaacguggugaaac

SEQ ID NO: 481559 - RNA, 32 nt, Human
guucgagaccagccuggccaauacggcaaaac

SEQ ID NO: 481560 - RNA, 32 nt, Human
guucgagaccagccuggccacauggugaaacc

SEQ ID NO: 481561 - RNA, 32 nt, Human
guucgagaccagccuggccagcauggugaaac

SEQ ID NO: 481562 - RNA, 32 nt, Human
guucgagaccagccuggccagcauggugagac

SEQ ID NO: 481563 - RNA, 32 nt, Human
guucgagaccagccuggcccacauggugaaac

SEQ ID NO: 481564 - RNA, 32 nt, Human
guucgagaccagccuggcuaacauggugaaac

SEQ ID NO: 481565 - RNA, 32 nt, Human
guucgagaccagccugggcaacauagugagac

SEQ ID NO: 481566 - RNA, 32 nt, Human
guucgagaccagccugggcaacauaugagaaa

SEQ ID NO: 481567 - RNA, 32 nt, Human
guucgagaccagccugggcaacauggugaaac

SEQ ID NO: 481568 - RNA, 32 nt, Human
guucgagaccagccugggcaacauggugaaau

SEQ ID NO: 481569 - RNA, 32 nt, Human
guucgagaccagccugggcaacauggugagac

SEQ ID NO: 481570 - RNA, 32 nt, Human
guucgagaccagccugggcaaccuaaugagag

SEQ ID NO: 481571 - RNA, 32 nt, Human
guucgagaccagccugggcaacguggugaaac

SEQ ID NO: 481572 - RNA, 32 nt, Human
guucgagaccagccugggcaucguagugagac

SEQ ID NO: 481573 - RNA, 32 nt, Human
guucgagaccagccuggguaacauagcuagac

SEQ ID NO: 481574 - RNA, 32 nt, Human
guucgagaccagccuggucaacauggugaaac

SEQ ID NO: 481575 - RNA, 32 nt, Human
guucgagaccagccuggucaauauggugaaac

SEQ ID NO: 481576 - RNA, 32 nt, Human
guucgagaccagcugggcaacauggugaaacc

SEQ ID NO: 481577 - RNA, 32 nt, Human
guucgagaccaucuuggcuaacauggugaaac

SEQ ID NO: 481578 - RNA, 32 nt, Human
guucgagaggcugaggcaagaagaucacuuga

SEQ ID NO: 481579 - RNA, 32 nt, Human
guucgagaucagccuggccaacauggugaaac

SEQ ID NO: 481580 - RNA, 32 nt, Human
guucgagaucagccuggccaacauggugaaau

SEQ ID NO: 481581 - RNA, 32 nt, Human
guucgagcaauucuccuguaaucccagcuacu

SEQ ID NO: 481582 - RNA, 32 nt, Human
guucgagccagccugaccaacaugaugaaacc

SEQ ID NO: 481583 - RNA, 32 nt, Human
guucgaggccagccuggccaacauggugaaac

SEQ ID NO: 481584 - RNA, 32 nt, Human
guucgaggccagccugguuaacacgcugaaau

SEQ ID NO: 481585 - RNA, 32 nt, Human
guucgaggcugcagucagucaugauggcacca

SEQ ID NO: 481586 - RNA, 32 nt, Human
guucgauaccagccugggcaacauagugggau

SEQ ID NO: 481587 - RNA, 32 nt, Human
guucgaucacuugaggccaggaguucgagauc

SEQ ID NO: 481588 - RNA, 32 nt, Human
guucgaucagcccuccuaaagcuggcuggaaa

SEQ ID NO: 481589 - RNA, 32 nt, Human
guucgaugacgacauggagcagcuucgagacg

SEQ ID NO: 481590 - RNA, 32 nt, Human
guucgaugcugauuaugcagaccgaugaguag

SEQ ID NO: 481591 - RNA, 32 nt, Human
guucgauuucuaccucagcagcaguuggaucu

SEQ ID NO: 481592 - RNA, 32 nt, Human
guucgcaccacugcacuccagccugggugaua

SEQ ID NO: 481593 - RNA, 32 nt, Human
guucgcaggccugcuaagcagccggcggccgg

SEQ ID NO: 481594 - RNA, 32 nt, Human
guucgcaugccacugcacuccagccugggcga

SEQ ID NO: 481595 - RNA, 32 nt, Human
guucgcauugguaaccugcugcuguauuucau

SEQ ID NO: 481596 - RNA, 32 nt, Human
guucgccauuuccaccaccgccagcugccagc

SEQ ID NO: 481597 - RNA, 32 nt, Human
guucgcccucaagguggugccguguggcgggg

SEQ ID NO: 481598 - RNA, 32 nt, Human
guucgccucaucuaaccccugccugcaggguc

SEQ ID NO: 481599 - RNA, 32 nt, Human
guucgcggaggugcggagagacuccuuggggg

SEQ ID NO: 481600 - RNA, 32 nt, Human
guucgcggccgcgugcagaggugcaggcagag

SEQ ID NO: 481601 - RNA, 32 nt, Human
guucgcggggcugcaggagcugcaggggcugc

SEQ ID NO: 481602 - RNA, 22 nt, Human
guucgcgggucgcuggcggggg

SEQ ID NO: 481603 - RNA, 32 nt, Human
guucgcuuaucaacuaaugauuuagugaucaa

SEQ ID NO: 481604 - RNA, 30 nt, Human
guucggagaccaugugcguugugugcaugc

SEQ ID NO: 481605 - RNA, 32 nt, Human
guucggagaggggacguggccuggggaagagc

SEQ ID NO: 481606 - RNA, 32 nt, Human
guucggagcucccaccuggacgcaucccucac

SEQ ID NO: 481607 - RNA, 32 nt, Human
guucggagcucuucugugcccuggcuccaugc

SEQ ID NO: 481608 - RNA, 25 nt, Human
guucggaggauuauucgucuucucc

SEQ ID NO: 481609 - RNA, 32 nt, Human
guucggagucauccuccagauguccacaaagg

SEQ ID NO: 481610 - RNA, 31 nt, Human
guucggauuuccaauaaagaaacagagugau

SEQ ID NO: 481611 - RNA, 32 nt, Human
guucggauuuccaauaaagaaacagagugaug

SEQ ID NO: 481612 - RNA, 32 nt, Human
guucggcaaucacugucacccccggacagcag

SEQ ID NO: 481613 - RNA, 32 nt, Human
guucgggaaagauaccagcugcaugacagggu

SEQ ID NO: 481614 - RNA, 32 nt, Human
guucgggaccagccuagccuacauggugaaac

SEQ ID NO: 481615 - RNA, 32 nt, Human
guucgggaccagccugggaaauauagugaaac

SEQ ID NO: 481616 - RNA, 32 nt, Human
guucgggaccagccugggcaacauggugaaac

SEQ ID NO: 481617 - RNA, 19 nt, Human
guucgggacggcgggcuga

SEQ ID NO: 481618 - RNA, 32 nt, Human
guucgggaggcugaggcaggagaaucacuuga

SEQ ID NO: 481619 - RNA, 32 nt, Human
guucgggcugugcgggguggccagcagggacg

SEQ ID NO: 481620 - RNA, 32 nt, Human
guucggguuaagugaugaaaauggcaguggug

SEQ ID NO: 481621 - RNA, 32 nt, Human
guucgguccucccaguuuccgcuaagacacaa

SEQ ID NO: 481622 - RNA, 32 nt, Human
guucguacucaagugaucuauuaucuagcugc

SEQ ID NO: 481623 - RNA, 32 nt, Human
guucguaggaaggugcaggagaggaggugggc

SEQ ID NO: 481624 - RNA, 32 nt, Human
guucgucagagagcauguugaaguucuauuuu

SEQ ID NO: 481625 - RNA, 28 nt, Human
guucgucagcuggcugccucauugccac

SEQ ID NO: 481626 - RNA, 32 nt, Human
guucgucauccucccuucccauauccuucaaa

SEQ ID NO: 481627 - RNA, 32 nt, Human
guucgucccgggcuguuucgcguccggccuga

SEQ ID NO: 481628 - RNA, 32 nt, Human
guucguccgccugcagcuucugagagcugugc

SEQ ID NO: 481629 - RNA, 32 nt, Human
guucguccugagacggagucucgcucugucgc

SEQ ID NO: 481630 - RNA, 22 nt, Human
guucgucgccuccuugcccgug

SEQ ID NO: 481631 - RNA, 32 nt, Human
guucgucucugcccugaugcugccucaggauc

SEQ ID NO: 481632 - RNA, 32 nt, Human
guucgucugcugucugugucuucuauuuggca

SEQ ID NO: 481633 - RNA, 32 nt, Human
guucgugccaucggacuccagccugggugaag

SEQ ID NO: 481634 - RNA, 32 nt, Human
guucgugccauuacacuccagccugggugaca

SEQ ID NO: 481635 - RNA, 32 nt, Human
guucgugccuguaaucccagcucuuugggagg

SEQ ID NO: 481636 - RNA, 32 nt, Human
guucgugcuccugguugggccccucggggugc

SEQ ID NO: 481637 - RNA, 32 nt, Human
guucguggagccacaggcagacgaugucaacc

SEQ ID NO: 481638 - RNA, 32 nt, Human
guucguggucacugcacuccagccuggcuaca

SEQ ID NO: 481639 - RNA, 32 nt, Human
guucguggucggccugccauguuuccaugugc

SEQ ID NO: 481640 - RNA, 32 nt, Human
guucguggucucacuggcuucaggagugaagg

SEQ ID NO: 481641 - RNA, 32 nt, Human
guucguguucucuugcccucccugccuaagag

SEQ ID NO: 481642 - RNA, 32 nt, Human
guucguucagaauagugcuguguguuaccacg

SEQ ID NO: 481643 - RNA, 32 nt, Human
guucguucugagacggagucucgcucugucgc

SEQ ID NO: 481644 - RNA, 32 nt, Human
guucguuuguucaugcaaacuauauuugcauu

SEQ ID NO: 481645 - RNA, 32 nt, Human
guucuaaagacccgugguaacagggcaaguuu

SEQ ID NO: 481646 - RNA, 32 nt, Human
guucuaagcaccuguuccuggccaggcucuag

SEQ ID NO: 481647 - RNA, 32 nt, Human
guucuaaggcugcugcuaauuacagcccccaa

SEQ ID NO: 481648 - RNA, 32 nt, Human
guucuaaguuagcuuucucauaacgguucuca

SEQ ID NO: 481649 - RNA, 18 nt, Human
guucuaauauccacuuga

SEQ ID NO: 481650 - RNA, 32 nt, Human
guucuaaugcuauaauaacuuaccucagcuuu

SEQ ID NO: 481651 - RNA, 32 nt, Human
guucuaauguacaacuaacuauuugcauauaa

SEQ ID NO: 481652 - RNA, 32 nt, Human
guucuaauugccuucuaaccugggagaucauc

SEQ ID NO: 481653 - RNA, 32 nt, Human
guucuacaaugagugccaaaucugcuaucagc

SEQ ID NO: 481654 - RNA, 32 nt, Human
guucuacacagauuucacaaauugugcuaaga

SEQ ID NO: 481655 - RNA, 32 nt, Human
guucuacauaaauagaaaaguugaucauucaa

SEQ ID NO: 481656 - RNA, 32 nt, Human
guucuaccaguaaaaauaaagaaccaggagug

SEQ ID NO: 481657 - RNA, 32 nt, Human
guucuaccuagugcccauguucugauugugug

SEQ ID NO: 481658 - RNA, 32 nt, Human
guucuaccucuugcugucuguguguucuuaag

SEQ ID NO: 481659 - RNA, 21 nt, Human
guucuacgccuggauccggga

SEQ ID NO: 481660 - RNA, 32 nt, Human
guucuacucuguuccuggcccugccggcagcc

SEQ ID NO: 481661 - RNA, 32 nt, Human
guucuacucuucucucaaccagacucauacac

SEQ ID NO: 481662 - RNA, 32 nt, Human
guucuacugccucagccucccguguagcuggg

SEQ ID NO: 481663 - RNA, 32 nt, Human
guucuacugguacagauagucccacuggcaca

SEQ ID NO: 481664 - RNA, 32 nt, Human
guucuagaagcccguuccccaguggcuguauc

SEQ ID NO: 481665 - RNA, 32 nt, Human
guucuagaccagccugaccaacauggugaaac

SEQ ID NO: 481666 - RNA, 32 nt, Human
guucuagaccagccuggccagcauggugaaaa

SEQ ID NO: 481667 - RNA, 32 nt, Human
guucuagaccagccuggccagcauggugaaac

SEQ ID NO: 481668 - RNA, 32 nt, Human
guucuagaccagccugggcaacguggugaaac

SEQ ID NO: 481669 - RNA, 32 nt, Human
guucuagacuugcuucucccaccucugagauu

SEQ ID NO: 481670 - RNA, 32 nt, Human
guucuagagauuuaccaccauugcuuauugcu

SEQ ID NO: 481671 - RNA, 32 nt, Human
guucuagauuuauacagggagguggauauuua

SEQ ID NO: 481672 - RNA, 23 nt, Human
guucuagcaguccccagcugagu

SEQ ID NO: 481673 - RNA, 32 nt, Human
guucuagcccaggagcgguggcucacacuugu

SEQ ID NO: 481674 - RNA, 32 nt, Human
guucuagcuagcagcacgcuccucagagaggg

SEQ ID NO: 481675 - RNA, 32 nt, Human
guucuaggagccucugguuacuguugggaaug

SEQ ID NO: 481676 - RNA, 32 nt, Human
guucuaggccccuucccagccugggugagggg

SEQ ID NO: 481677 - RNA, 32 nt, Human
guucuagggaaugggggcagggaggauuuugc

SEQ ID NO: 481678 - RNA, 32 nt, Human
guucuagggacaggagaagcagaggaagaggc

SEQ ID NO: 481679 - RNA, 32 nt, Human
guucuagggcuggagggcaggggugacaugga

SEQ ID NO: 481680 - RNA, 21 nt, Human
guucuaguaagaagggauucu

SEQ ID NO: 481681 - RNA, 32 nt, Human
guucuaguccuccucuaguuaacuuagcuuua

SEQ ID NO: 481682 - RNA, 31 nt, Human
guucuagugaaacugcauuauuuguugacua

SEQ ID NO: 481683 - RNA, 32 nt, Human
guucuagugggaaggggugcccccaggcucuc

SEQ ID NO: 481684 - RNA, 32 nt, Human
guucuaguucccaaauuaucuuuucuuccuug

SEQ ID NO: 481685 - RNA, 32 nt, Human
guucuauaaauuucucgcuuccuucacuucug

SEQ ID NO: 481686 - RNA, 32 nt, Human
guucuauacccuacagucagacaggaaaagaa

SEQ ID NO: 481687 - RNA, 32 nt, Human
guucuauaguaaaauaauguuuccacauuaua

SEQ ID NO: 481688 - RNA, 32 nt, Human
guucuaucagguuuguaaucacuguagcuuca

SEQ ID NO: 481689 - RNA, 32 nt, Human
guucuaugaaggagauugagggagaagagaca

SEQ ID NO: 481690 - RNA, 32 nt, Human
guucuaugccuauggagccacagugccucccu

SEQ ID NO: 481691 - RNA, 32 nt, Human
guucuaugcugagccuuagccucccagguuau

SEQ ID NO: 481692 - RNA, 32 nt, Human
guucuauggggaggacaaucaguagagguuuc

SEQ ID NO: 481693 - RNA, 32 nt, Human
guucuauguggagucuguuacugugauuccuu

SEQ ID NO: 481694 - RNA, 32 nt, Human
guucuauuccucaguauccagaaaguuacuga

SEQ ID NO: 481695 - RNA, 32 nt, Human
guucucaacuauuuaugaacuguggugacuac

SEQ ID NO: 481696 - RNA, 25 nt, Human
guucucaagaaacaaaugcuagcuu

SEQ ID NO: 481697 - RNA, 32 nt, Human
guucucaaggucucaggcuauuugggaaauuc

SEQ ID NO: 481698 - RNA, 32 nt, Human
guucucaccacucacucaugguugagacucau

SEQ ID NO: 481699 - RNA, 17 nt, Human
guucucaccacuguccc

SEQ ID NO: 481700 - RNA, 32 nt, Human
guucucacgcccuguuuuaauuuaacccagcu

SEQ ID NO: 481701 - RNA, 32 nt, Human
guucucacgccuguaaucccagcacuuuggga

SEQ ID NO: 481702 - RNA, 32 nt, Human
guucucacucccuguuuuaauucaacccagcc

SEQ ID NO: 481703 - RNA, 24 nt, Human
guucucacugucuccuggucugug

SEQ ID NO: 481704 - RNA, 32 nt, Human
guucucacuguucccucugcuccuggagccuu

SEQ ID NO: 481705 - RNA, 23 nt, Human
guucucagaauaguggcuagcuu

SEQ ID NO: 481706 - RNA, 32 nt, Human
guucucagcaaucccugucaccaucucaucac

SEQ ID NO: 481707 - RNA, 32 nt, Human
guucucagcacaccuuccaugaaucugcuugc

SEQ ID NO: 481708 - RNA, 32 nt, Human
guucucagccaguacaccagagccaggccaug

SEQ ID NO: 481709 - RNA, 21 nt, Human
guucucagcucacugcaaccu

SEQ ID NO: 481710 - RNA, 32 nt, Human
guucucagcuuacucaaccucugccucuuggg

SEQ ID NO: 481711 - RNA, 22 nt, Human
guucucaggaaguuacagucuu

SEQ ID NO: 481712 - RNA, 32 nt, Human
guucucaggagaaaacagacaaauccuccugc

SEQ ID NO: 481713 - RNA, 21 nt, Human
guucucaggaucaccggcagu

SEQ ID NO: 481714 - RNA, 32 nt, Human
guucucaggccucuccucaccccaccaacuuc

SEQ ID NO: 481715 - RNA, 32 nt, Human
guucucaggcuggcugacaggucugacagccc

SEQ ID NO: 481716 - RNA, 32 nt, Human
guucucagggguucaggaauccgugcaugugg

SEQ ID NO: 481717 - RNA, 32 nt, Human
guucucagguucuuauguagacagugagggcu

SEQ ID NO: 481718 - RNA, 32 nt, Human
guucucagugccugugcauugcugccacuaca

SEQ ID NO: 481719 - RNA, 32 nt, Human
guucucaguggcaguggguggaagugagcaca

SEQ ID NO: 481720 - RNA, 32 nt, Human
guucucaucauuucuccucuggauucaucugc

SEQ ID NO: 481721 - RNA, 32 nt, Human
guucucaucuuucuugaucaacaucuuuucuu

SEQ ID NO: 481722 - RNA, 19 nt, Human
guucucauuguucaucucc

SEQ ID NO: 481723 - RNA, 32 nt, Human
guucuccaaacaguaaaccaguauuucacacu

SEQ ID NO: 481724 - RNA, 32 nt, Human
guucuccaaacgugcugggauuacaggcauga

SEQ ID NO: 481725 - RNA, 32 nt, Human
guucuccaaauugucugugaacugcuuaggua

SEQ ID NO: 481726 - RNA, 32 nt, Human
guucuccaacuugagacaauuucuccccgcau

SEQ ID NO: 481727 - RNA, 32 nt, Human
guucuccaagcucuagaaaucucugacacauc

SEQ ID NO: 481728 - RNA, 21 nt, Human
guucuccaaguccccagcccg

SEQ ID NO: 481729 - RNA, 32 nt, Human
guucuccaauccagcucuaucagcuauaaagc

SEQ ID NO: 481730 - RNA, 32 nt, Human
guucuccacagccugugugagccgcacuuccg

SEQ ID NO: 481731 - RNA, 32 nt, Human
guucuccacagccugugugagccucacuuccg

SEQ ID NO: 481732 - RNA, 32 nt, Human
guucuccacagugucuccaguggaaacuuguc

SEQ ID NO: 481733 - RNA, 32 nt, Human
guucuccacguucucaccuaagcccagagcaa

SEQ ID NO: 481734 - RNA, 21 nt, Human
guucuccagaaacagcuccgu

SEQ ID NO: 481735 - RNA, 32 nt, Human
guucuccagcugagcagcuuuccccaacgugg

SEQ ID NO: 481736 - RNA, 20 nt, Human
guucuccaggauccagaucc

SEQ ID NO: 481737 - RNA, 32 nt, Human
guucuccaguucuuuccgucucugccucucuc

SEQ ID NO: 481738 - RNA, 32 nt, Human
guucuccauauauucaauaaaaaccaauuuga

SEQ ID NO: 481739 - RNA, 32 nt, Human
guucuccaugccaguaucugggugugggucuc

SEQ ID NO: 481740 - RNA, 32 nt, Human
guucucccaaagugcugagauuacagguguga

SEQ ID NO: 481741 - RNA, 32 nt, Human
guucucccaaagugcugggauuacagguguga

SEQ ID NO: 481742 - RNA, 32 nt, Human
guucucccaaauaggagaccuggggccuggcc

SEQ ID NO: 481743 - RNA, 32 nt, Human
guucucccaacaacaugaaacugccuauucac

SEQ ID NO: 481744 - RNA, 32 nt, Human
guucucccagcuccucaccugggcuacuuccu

SEQ ID NO: 481745 - RNA, 26 nt, Human
guucucccauaaagaggaggaaaagg

SEQ ID NO: 481746 - RNA, 32 nt, Human
guucuccccagccacuguggucuacagauucc

SEQ ID NO: 481747 - RNA, 32 nt, Human
guucuccccagccgaaccucacgcccggcccc

SEQ ID NO: 481748 - RNA, 32 nt, Human
guucucccccagcaucacuaacaaauaugcuu

SEQ ID NO: 481749 - RNA, 18 nt, Human
guucuccccucugcugcc

SEQ ID NO: 481750 - RNA, 32 nt, Human
guucucccuccaggaaagggggaggagggacc

SEQ ID NO: 481751 - RNA, 32 nt, Human
guucucccuccaggggacacagcucccccucg

SEQ ID NO: 481752 - RNA, 32 nt, Human
guucucccuccccuccuacuucucucacacuc

SEQ ID NO: 481753 - RNA, 32 nt, Human
guucucccugcaacccaggcccugccauucuu

SEQ ID NO: 481754 - RNA, 32 nt, Human
guucucccugccccucagccugggggaagaag

SEQ ID NO: 481755 - RNA, 22 nt, Human
guucucccugucugaagaggga

SEQ ID NO: 481756 - RNA, 32 nt, Human
guucucccuuaagcaaccucacaaacaagccg

SEQ ID NO: 481757 - RNA, 32 nt, Human
guucucccuuucuccguccuucauggaagccc

SEQ ID NO: 481758 - RNA, 32 nt, Human
guucucccuuucucucuccucucugcuucaua

SEQ ID NO: 481759 - RNA, 32 nt, Human
guucuccgggccugaaugucuggggugcuugu

SEQ ID NO: 481760 - RNA, 32 nt, Human
guucuccguggccauuuggggauucaugccug

SEQ ID NO: 481761 - RNA, 21 nt, Human
guucuccuauuccucauaaag

SEQ ID NO: 481762 - RNA, 32 nt, Human
guucuccuccacuguuugaccaaauucucagu

SEQ ID NO: 481763 - RNA, 32 nt, Human
guucuccuccauugcuguuguugcagggaagu

SEQ ID NO: 481764 - RNA, 32 nt, Human
guucuccucccaucagcaagaagacaaaccga

SEQ ID NO: 481765 - RNA, 32 nt, Human
guucuccuccccugagcauccaugaagacccc

SEQ ID NO: 481766 - RNA, 32 nt, Human
guucuccucuaaaaggaaaccccaucccauua

SEQ ID NO: 481767 - RNA, 32 nt, Human
guucuccucuggacuggccacacccaccccau

SEQ ID NO: 481768 - RNA, 25 nt, Human
guucuccugacaccaggaaaagaga

SEQ ID NO: 481769 - RNA, 32 nt, Human
guucuccugagggaagaggaguggaguagggg

SEQ ID NO: 481770 - RNA, 32 nt, Human
guucuccugagugcucuagugucuccaguugu

SEQ ID NO: 481771 - RNA, 32 nt, Human
guucuccugcacuuccuccucauguagucugg

SEQ ID NO: 481772 - RNA, 19 nt, Human
guucuccugccccagccuc

SEQ ID NO: 481773 - RNA, 23 nt, Human
guucuccugccucagccuggcca

SEQ ID NO: 481774 - RNA, 32 nt, Human
guucuccugcugccuccugccugcugcagcug

SEQ ID NO: 481775 - RNA, 32 nt, Human
guucuccuggaagggagguuuuugcuuuaccc

SEQ ID NO: 481776 - RNA, 32 nt, Human
guucuccugucuccagauaccuaaaugaccuu

SEQ ID NO: 481777 - RNA, 32 nt, Human
guucuccuuacuccaucuccuccccaaacacg

SEQ ID NO: 481778 - RNA, 32 nt, Human
guucuccuucaccacagaacccaaaccucagg

SEQ ID NO: 481779 - RNA, 32 nt, Human
guucuccuuuagcccucuuccugggcaucacc

SEQ ID NO: 481780 - RNA, 23 nt, Human
guucuccuuugagguagggaagg

SEQ ID NO: 481781 - RNA, 32 nt, Human
guucucgaaacacacaaacucagagacacaga

SEQ ID NO: 481782 - RNA, 32 nt, Human
guucucgaauauuuaauaaaacugauauuauu

SEQ ID NO: 481783 - RNA, 32 nt, Human
guucucgcucaucugggcaggugguuuguccc

SEQ ID NO: 481784 - RNA, 32 nt, Human
guucucgcucccggccgccaucaugcuggcgc

SEQ ID NO: 481785 - RNA, 32 nt, Human
guucucggacucguuccuccuggaccagccca

SEQ ID NO: 481786 - RNA, 31 nt, Human
guucucggccaucuccugcuucugggaccug

SEQ ID NO: 481787 - RNA, 32 nt, Human
guucucgggauuagaaggacaagagcacuccc

SEQ ID NO: 481788 - RNA, 24 nt, Human
guucucgguauuucacaugcagcu

SEQ ID NO: 481789 - RNA, 32 nt, Human
guucucuacuaaaaauacaaaaauuagcuggg

SEQ ID NO: 481790 - RNA, 32 nt, Human
guucucuacuguuuucuuuguaauguaugacu

SEQ ID NO: 481791 - RNA, 32 nt, Human
guucucuagagcuguaaucugauuuguuguuu

SEQ ID NO: 481792 - RNA, 32 nt, Human
guucucuauacucagguaccucuuucaggguu

SEQ ID NO: 481793 - RNA, 32 nt, Human
guucucuaugcaagauggagagaggaugcacc

SEQ ID NO: 481794 - RNA, 32 nt, Human
guucucucaggcucccguucaggauuuuuaga

SEQ ID NO: 481795 - RNA, 32 nt, Human
guucucucauuuccaaaccaucagcugcuuuu

SEQ ID NO: 481796 - RNA, 32 nt, Human
guucucuccaaaucagagagcuacucaucucu

SEQ ID NO: 481797 - RNA, 32 nt, Human
guucucucccucucuccuucccagagcaauuu

SEQ ID NO: 481798 - RNA, 32 nt, Human
guucucuccugcaacccccacugcucagccuc

SEQ ID NO: 481799 - RNA, 32 nt, Human
guucucuccuuuucucucuuugccucacucuc

SEQ ID NO: 481800 - RNA, 32 nt, Human
guucucucuauauuuugcuauuuugcaaggga

SEQ ID NO: 481801 - RNA, 32 nt, Human
guucucucuggcaccagccgagcugcuucgug

SEQ ID NO: 481802 - RNA, 32 nt, Human
guucucucugugucccccucgcgggccccgca

SEQ ID NO: 481803 - RNA, 32 nt, Human
guucucucuuauuuucagcuuuacagacaaga

SEQ ID NO: 481804 - RNA, 32 nt, Human
guucucucuuccuuguccuccccuccuccacc

SEQ ID NO: 481805 - RNA, 32 nt, Human
guucucucuugcccaccuccccaagcuccuuu

SEQ ID NO: 481806 - RNA, 32 nt, Human
guucucugagagucaccugucccgccuggccc

SEQ ID NO: 481807 - RNA, 32 nt, Human
guucucugaggacaggauuuaauucgauggua

SEQ ID NO: 481808 - RNA, 32 nt, Human
guucucugaugcauacggccacugcagaugug

SEQ ID NO: 481809 - RNA, 32 nt, Human
guucucugcaugccccaggccauuucucccac

SEQ ID NO: 481810 - RNA, 32 nt, Human
guucucugccuugucucucuuugucuuaaaau

SEQ ID NO: 481811 - RNA, 32 nt, Human
guucucugcuccaggaacagagcugcugcucu

SEQ ID NO: 481812 - RNA, 32 nt, Human
guucucugcuuccagaaugagaagcuuugcug

SEQ ID NO: 481813 - RNA, 32 nt, Human
guucucuggaaacccauccauaugguugaagg

SEQ ID NO: 481814 - RNA, 32 nt, Human
guucucuggaaccugacuuuagauguuuuggg

SEQ ID NO: 481815 - RNA, 32 nt, Human
guucucugggccugagccuggggccaccccca

SEQ ID NO: 481816 - RNA, 32 nt, Human
guucucuguccccuagcacuagacucagcugu

SEQ ID NO: 481817 - RNA, 32 nt, Human
guucucuguccugccuugaagggaaggagacc

SEQ ID NO: 481818 - RNA, 32 nt, Human
guucucugucucacuguaaacuaguguucucu

SEQ ID NO: 481819 - RNA, 32 nt, Human
guucucugugagagucuggauuuucauuucug

SEQ ID NO: 481820 - RNA, 32 nt, Human
guucucugugugugugcacauaugcagaugua

SEQ ID NO: 481821 - RNA, 32 nt, Human
guucucuuagguugaguaacccacucugaauu

SEQ ID NO: 481822 - RNA, 32 nt, Human
guucucuucucccagcaggccucauugugugc

SEQ ID NO: 481823 - RNA, 32 nt, Human
guucucuucuccuguguucccuuugaguccag

SEQ ID NO: 481824 - RNA, 32 nt, Human
guucucuugcccaggcuggagugcaguggcac

SEQ ID NO: 481825 - RNA, 32 nt, Human
guucucuuggaaggcugcuuugcaguuuguau

SEQ ID NO: 481826 - RNA, 32 nt, Human
guucucuuguccacacagcucuuccaauaaag

SEQ ID NO: 481827 - RNA, 32 nt, Human
guucucuugucugucugucucugucuugaagc

SEQ ID NO: 481828 - RNA, 32 nt, Human
guucucuuguguccuauggaauccaguucuga

SEQ ID NO: 481829 - RNA, 32 nt, Human
guucucuuguguuguuuuuccuuuuuaaaccc

SEQ ID NO: 481830 - RNA, 32 nt, Human
guucucuuuccauuugccucccccucuucagc

SEQ ID NO: 481831 - RNA, 32 nt, Human
guucugaaagcccauucccugcucugcggcuc

SEQ ID NO: 481832 - RNA, 32 nt, Human
guucugaagggcugccggcuuccuucugggau

SEQ ID NO: 481833 - RNA, 32 nt, Human
guucugaauaccuucagguuccuggccucccu

SEQ ID NO: 481834 - RNA, 32 nt, Human
guucugaaucaggauguugacacuucuugguu

SEQ ID NO: 481835 - RNA, 30 nt, Human
guucugaaucauguagauacauggcaggua

SEQ ID NO: 481836 - RNA, 32 nt, Human
guucugaauguucacauugcuuuaccaguuug

SEQ ID NO: 481837 - RNA, 32 nt, Human
guucugaauuuaaaggaugaaaaaccuccauu

SEQ ID NO: 481838 - RNA, 32 nt, Human
guucugacuggcagggggagaaaguaaacaga

SEQ ID NO: 481839 - RNA, 32 nt, Human
guucugagacaugucacuuggcaauuucauca

SEQ ID NO: 481840 - RNA, 32 nt, Human
guucugagaucuagucccucucugauucacuu

SEQ ID NO: 481841 - RNA, 31 nt, Human
guucugaggagaccugcacuugagaacaaaa

SEQ ID NO: 481842 - RNA, 32 nt, Human
guucugaggccugguuugcucuuaauuaauau

SEQ ID NO: 481843 - RNA, 32 nt, Human
guucugaggccuugggauuagccucuuccuca

SEQ ID NO: 481844 - RNA, 32 nt, Human
guucugagggacaggcuugagaucggcugaag

SEQ ID NO: 481845 - RNA, 32 nt, Human
guucugagggcagcuaaggagcuguuuauucc

SEQ ID NO: 481846 - RNA, 32 nt, Human
guucugagggcuuaugccgggugcaggcuuuc

SEQ ID NO: 481847 - RNA, 23 nt, Human
guucugaggggauucccagccuc

SEQ ID NO: 481848 - RNA, 32 nt, Human
guucugaguagcugggauuagaggcgugugcc

SEQ ID NO: 481849 - RNA, 32 nt, Human
guucugauaaaaucaguccagcacuuuuagaa

SEQ ID NO: 481850 - RNA, 32 nt, Human
guucugaucuucucauucugguugaguaccug

SEQ ID NO: 481851 - RNA, 32 nt, Human
guucugaugaaacugaaacaggaggugauugu

SEQ ID NO: 481852 - RNA, 32 nt, Human
guucugauugugugugggauugcauggugucc

SEQ ID NO: 481853 - RNA, 32 nt, Human
guucugcacaguacuguccuccagagagggug

SEQ ID NO: 481854 - RNA, 32 nt, Human
guucugcaccaaacccacacuugagugauggg

SEQ ID NO: 481855 - RNA, 32 nt, Human
guucugcacgaggcugggccugccucacucuc

SEQ ID NO: 481856 - RNA, 25 nt, Human
guucugcacugccccuuggccugug

SEQ ID NO: 481857 - RNA, 32 nt, Human
guucugcagggccuuccuccuccagguugggu

SEQ ID NO: 481858 - RNA, 17 nt, Human
guucugcagggcugcuc

SEQ ID NO: 481859 - RNA, 32 nt, Human
guucugcagggugucagcuccaggacccacag

SEQ ID NO: 481860 - RNA, 32 nt, Human
guucugcauggcuggggaagccucaggaaucu

SEQ ID NO: 481861 - RNA, 32 nt, Human
guucugcauggcuggggaggccucacaaucau

SEQ ID NO: 481862 - RNA, 32 nt, Human
guucugcauuccccaccaccucccaggauggc

SEQ ID NO: 481863 - RNA, 32 nt, Human
guucugccacuuccugucccuggggagccacu

SEQ ID NO: 481864 - RNA, 32 nt, Human
guucugccacuugcacugugcuugcuccuaag

SEQ ID NO: 481865 - RNA, 32 nt, Human
guucugccagggcuccccucccugccuguccc

SEQ ID NO: 481866 - RNA, 32 nt, Human
guucugccaucucugguuaagaugggcucacc

SEQ ID NO: 481867 - RNA, 32 nt, Human
guucugccgcuucuccccugauggccaccucu

SEQ ID NO: 481868 - RNA, 32 nt, Human
guucugccuccuggccaagcaggcugguuugc

SEQ ID NO: 481869 - RNA, 32 nt, Human
guucugccucucaaacuccugaccucaaguaa

SEQ ID NO: 481870 - RNA, 32 nt, Human
guucugccugccaggccagcugucucccagcc

SEQ ID NO: 481871 - RNA, 32 nt, Human
guucugccugggcauguaggggagguguuuuu

SEQ ID NO: 481872 - RNA, 21 nt, Human
guucugccugucugaaagguu

SEQ ID NO: 481873 - RNA, 32 nt, Human
guucugccuuacaguacaugcaggugggaguc

SEQ ID NO: 481874 - RNA, 32 nt, Human
guucugccuugccugugagcuaugucacuccc

SEQ ID NO: 481875 - RNA, 32 nt, Human
guucugccuuucugaucaaucuuuuggguuca

SEQ ID NO: 481876 - RNA, 32 nt, Human
guucugcggcuggagugggugggugcagcaac

SEQ ID NO: 481877 - RNA, 32 nt, Human
guucugcguaccccucuccagugucaaccugg

SEQ ID NO: 481878 - RNA, 32 nt, Human
guucugcuacuccccagaccucagggacaacu

SEQ ID NO: 481879 - RNA, 32 nt, Human
guucugcuaggaagaaggggagcagguggugc

SEQ ID NO: 481880 - RNA, 32 nt, Human
guucugcucagaccauaggaggccaacccaaa

SEQ ID NO: 481881 - RNA, 32 nt, Human
guucugcuccaaucagaauuuugccuuaccuu

SEQ ID NO: 481882 - RNA, 32 nt, Human
guucugcucuccccaucaucuuugugcaaggc

SEQ ID NO: 481883 - RNA, 32 nt, Human
guucugcucuguggaucaucccauggaaguuu

SEQ ID NO: 481884 - RNA, 32 nt, Human
guucugcugcaccaagugauuuuuaagcccca

SEQ ID NO: 481885 - RNA, 32 nt, Human
guucugcugcccaagcuggaguggcaguggca

SEQ ID NO: 481886 - RNA, 32 nt, Human
guucugcugcccagguuggagugcaguggcac

SEQ ID NO: 481887 - RNA, 32 nt, Human
guucugcuggacugagcugguugccucauguu

SEQ ID NO: 481888 - RNA, 32 nt, Human
guucugcugggaagggaagggaauggggagaa

SEQ ID NO: 481889 - RNA, 32 nt, Human
guucugcuggggccaugaaggcagaagguuua

SEQ ID NO: 481890 - RNA, 32 nt, Human
guucugcugucucccugaagagugaacccucu

SEQ ID NO: 481891 - RNA, 32 nt, Human
guucugcuguuugguugcugaagggggucagu

SEQ ID NO: 481892 - RNA, 32 nt, Human
guucugcuucugcuucucucugcuccacuguc

SEQ ID NO: 481893 - RNA, 23 nt, Human
guucugcuuggcaguaguuauua

SEQ ID NO: 481894 - RNA, 32 nt, Human
guucugcuugugggcgggccugucuuucacca

SEQ ID NO: 481895 - RNA, 32 nt, Human
guucugcuuugcuguuugucuuccuaguuaag

SEQ ID NO: 481896 - RNA, 32 nt, Human
guucuggaagaaacagaucuccuggcaaaggc

SEQ ID NO: 481897 - RNA, 32 nt, Human
guucuggaaggaugacaucacccaggaugcaa

SEQ ID NO: 481898 - RNA, 32 nt, Human
guucuggacuguguucugggccugcugaggau

SEQ ID NO: 481899 - RNA, 32 nt, Human
guucuggagaaagacgaccacugugggccuuu

SEQ ID NO: 481900 - RNA, 32 nt, Human
guucuggagagggacaaggagaggaggagacu

SEQ ID NO: 481901 - RNA, 32 nt, Human
guucuggaggaaagggaggaguggaggugggc

SEQ ID NO: 481902 - RNA, 32 nt, Human
guucuggaggccccugaacagagggcuauggc

SEQ ID NO: 481903 - RNA, 32 nt, Human
guucuggaggcgacugcugggccuccugccug

SEQ ID NO: 481904 - RNA, 32 nt, Human
guucuggaggcuggaagucccggaucaaggug

SEQ ID NO: 481905 - RNA, 32 nt, Human
guucuggagguuggagguuccgcucagugaca

SEQ ID NO: 481906 - RNA, 32 nt, Human
guucuggaugaaaagagcaggaguaacaauug

SEQ ID NO: 481907 - RNA, 32 nt, Human
guucuggaugccaaaugagacuguguguaaau

SEQ ID NO: 481908 - RNA, 32 nt, Human
guucuggccaggagcuggaggagcaggcagug

SEQ ID NO: 481909 - RNA, 32 nt, Human
guucuggccccuuggauuuaaaaauaaaauua

SEQ ID NO: 481910 - RNA, 32 nt, Human
guucuggcccuuggcugugcucuccuuagccu

SEQ ID NO: 481911 - RNA, 32 nt, Human
guucuggccuaacagcagacuugcuguuuuca

SEQ ID NO: 481912 - RNA, 32 nt, Human
guucuggccuaggugggcucuagaaccauuua

SEQ ID NO: 481913 - RNA, 32 nt, Human
guucugggaaguugaaaguggggaaugaagag

SEQ ID NO: 481914 - RNA, 32 nt, Human
guucugggagugagaggcccacaggcaggaag

SEQ ID NO: 481915 - RNA, 32 nt, Human
guucugggccagcccauugcucugggcuguuu

SEQ ID NO: 481916 - RNA, 32 nt, Human
guucugggccaggucccagcuugagcugccuc

SEQ ID NO: 481917 - RNA, 32 nt, Human
guucugggcucaggcaggagggcgggguccca

SEQ ID NO: 481918 - RNA, 32 nt, Human
guucugggcuguagugcacugugcugauccac

SEQ ID NO: 481919 - RNA, 32 nt, Human
guucuggggcauaggaaacacauacacuucca

SEQ ID NO: 481920 - RNA, 32 nt, Human
guucuggggccccuuggcaguaccauggagca

SEQ ID NO: 481921 - RNA, 32 nt, Human
guucuggggcugagcagcuaggaagcuaggaa

SEQ ID NO: 481922 - RNA, 32 nt, Human
guucuggggugagggucuagugccagggaugg

SEQ ID NO: 481923 - RNA, 32 nt, Human
guucuggguccuggagugcaggccugucaacu

SEQ ID NO: 481924 - RNA, 32 nt, Human
guucugggugaggcaggagcugggaggggugg

SEQ ID NO: 481925 - RNA, 32 nt, Human
guucuggguggaagcagcggugccgcggaggg

SEQ ID NO: 481926 - RNA, 32 nt, Human
guucuggguggggguagaaugagguggggugg

SEQ ID NO: 481927 - RNA, 32 nt, Human
guucuggucagaauggaagugguggccuccac

SEQ ID NO: 481928 - RNA, 32 nt, Human
guucuggugaaacagacuuacacuucuucaga

SEQ ID NO: 481929 - RNA, 32 nt, Human
guucuggugauggcuggcucugguucauacau

SEQ ID NO: 481930 - RNA, 23 nt, Human
guucugguggugggaagggaggc

SEQ ID NO: 481931 - RNA, 32 nt, Human
guucuggugucaacuccagcgucggcacaggc

SEQ ID NO: 481932 - RNA, 32 nt, Human
guucugguuggggccaggcaugguggcucacg

SEQ ID NO: 481933 - RNA, 32 nt, Human
guucuguaaaauauuagaacgcuuuguuuuac

SEQ ID NO: 481934 - RNA, 32 nt, Human
guucuguaacccaggcuggagugcaguggccu

SEQ ID NO: 481935 - RNA, 32 nt, Human
guucuguacagagagagaugcagcaggggcgg

SEQ ID NO: 481936 - RNA, 32 nt, Human
guucuguacaguuuaggaaauagaggcuuuca

SEQ ID NO: 481937 - RNA, 32 nt, Human
guucuguacuaaggaacaacauucccuuugaa

SEQ ID NO: 481938 - RNA, 32 nt, Human
guucuguacuuuucgagagaagggaauaggga

SEQ ID NO: 481939 - RNA, 32 nt, Human
guucuguaggagagacuggccagaggcagcua

SEQ ID NO: 481940 - RNA, 32 nt, Human
guucuguaggcucugugacaucuuugguuuau

SEQ ID NO: 481941 - RNA, 32 nt, Human
guucugucaaccaggcuagaaugcagcggugc

SEQ ID NO: 481942 - RNA, 32 nt, Human
guucugucacccaggcuggagugcagugacuc

SEQ ID NO: 481943 - RNA, 32 nt, Human
guucugucacccaggcuggagugcaguggcac

SEQ ID NO: 481944 - RNA, 32 nt, Human
guucugucacccaggcuggagugcaguggugu

SEQ ID NO: 481945 - RNA, 32 nt, Human
guucugucacccaggcuggcgugcaauaguuc

SEQ ID NO: 481946 - RNA, 32 nt, Human
guucugucacccaggcuggggugcaguggcgu

SEQ ID NO: 481947 - RNA, 32 nt, Human
guucugucaccuaggcuggaaugcaguggugc

SEQ ID NO: 481948 - RNA, 32 nt, Human
guucugucaccuaggguggagugcaguggcac

SEQ ID NO: 481949 - RNA, 32 nt, Human
guucugucacucaggcuggaguacaguggugc

SEQ ID NO: 481950 - RNA, 32 nt, Human
guucugucagugaauggauaaucuaugugcuu

SEQ ID NO: 481951 - RNA, 32 nt, Human
guucugucaucaauggaguguauucuuguaau

SEQ ID NO: 481952 - RNA, 32 nt, Human
guucuguccccgaggccggagugcaauggcgu

SEQ ID NO: 481953 - RNA, 32 nt, Human
guucuguccuacuucugacuuuacuuguggug

SEQ ID NO: 481954 - RNA, 32 nt, Human
guucugucgcccaggcuggagugcaggggcau

SEQ ID NO: 481955 - RNA, 32 nt, Human
guucugucgcccaggcuggcgugcaguggcgc

SEQ ID NO: 481956 - RNA, 32 nt, Human
guucugucgcccuggcuggaguggaaugccgu

SEQ ID NO: 481957 - RNA, 32 nt, Human
guucugucgcuuagcuggagugcgguggcgug

SEQ ID NO: 481958 - RNA, 32 nt, Human
guucugucguccaggcuggagugcaguggugu

SEQ ID NO: 481959 - RNA, 32 nt, Human
guucugucguccaggcuggagugcgguggcgu

SEQ ID NO: 481960 - RNA, 32 nt, Human
guucugucuacaauaagacacagacuuuugac

SEQ ID NO: 481961 - RNA, 32 nt, Human
guucugucucagaggacaaaaggccugggagc

SEQ ID NO: 481962 - RNA, 32 nt, Human
guucugucucccaggcugaagugcagugaguc

SEQ ID NO: 481963 - RNA, 32 nt, Human
guucugucuguccgugcaccgaugcacacacc

SEQ ID NO: 481964 - RNA, 32 nt, Human
guucugucuguccgugcaccgaugcauacacc

SEQ ID NO: 481965 - RNA, 32 nt, Human
guucugucuuuuccuugacuaauuguagaacu

SEQ ID NO: 481966 - RNA, 32 nt, Human
guucugugaaaucccgcucaccuccuggaggg

SEQ ID NO: 481967 - RNA, 32 nt, Human
guucugugaacaaguccaugcugccaucaagg

SEQ ID NO: 481968 - RNA, 32 nt, Human
guucugugaacugguccaaggagguucuguua

SEQ ID NO: 481969 - RNA, 32 nt, Human
guucugugacagcagagcaugaccuuaagggu

SEQ ID NO: 481970 - RNA, 32 nt, Human
guucugugacauccuuugcucucugaccaacu

SEQ ID NO: 481971 - RNA, 32 nt, Human
guucugugagcuaugggaaggccauugguugu

SEQ ID NO: 481972 - RNA, 32 nt, Human
guucugugcaugccauuagaggagcugaaguu

SEQ ID NO: 481973 - RNA, 32 nt, Human
guucugugccuguaaacauagauucgcuuucc

SEQ ID NO: 481974 - RNA, 32 nt, Human
guucuguggcccuggcuggaguucaguggugu

SEQ ID NO: 481975 - RNA, 32 nt, Human
guucugugucagcacccaggacaguggugucu

SEQ ID NO: 481976 - RNA, 32 nt, Human
guucugugucaugguuggaagacagaguagga

SEQ ID NO: 481977 - RNA, 29 nt, Human
guucugugucugucugucaccuggucacg

SEQ ID NO: 481978 - RNA, 32 nt, Human
guucugugucugugcuccuccuucccucucag

SEQ ID NO: 481979 - RNA, 32 nt, Human
guucuguguggguggucacaggagggugugag

SEQ ID NO: 481980 - RNA, 23 nt, Human
guucuguguucuccccgcccgug

SEQ ID NO: 481981 - RNA, 32 nt, Human
guucuguuaauguggcuuaguacauugauuua

SEQ ID NO: 481982 - RNA, 20 nt, Human
guucuguuagcucaccauag

SEQ ID NO: 481983 - RNA, 32 nt, Human
guucuguuccaaccuccugcucugggaggugg

SEQ ID NO: 481984 - RNA, 32 nt, Human
guucuguuccaugucuguguuguggacauucc

SEQ ID NO: 481985 - RNA, 32 nt, Human
guucuguucuuucuuguguugccauguuacua

SEQ ID NO: 481986 - RNA, 32 nt, Human
guucuguugcccaggagggagugcaguggugc

SEQ ID NO: 481987 - RNA, 32 nt, Human
guucuguugcccaggcaagagugcagugguau

SEQ ID NO: 481988 - RNA, 32 nt, Human
guucuguugccuaggccagagugcaguggcau

SEQ ID NO: 481989 - RNA, 32 nt, Human
guucuguugccugggcuggagugcaguggcau

SEQ ID NO: 481990 - RNA, 32 nt, Human
guucuguugccugggcuggagugcaguggcgu

SEQ ID NO: 481991 - RNA, 32 nt, Human
guucuguuguccaggauggagugcagugguug

SEQ ID NO: 481992 - RNA, 32 nt, Human
guucuguugugaugcuaauuucucagaugagg

SEQ ID NO: 481993 - RNA, 32 nt, Human
guucuguuucccaggcuggagugcaguggugg

SEQ ID NO: 481994 - RNA, 32 nt, Human
guucuguuucugugcugaucuggaccaucuuu

SEQ ID NO: 481995 - RNA, 32 nt, Human
guucuguuuuaagccucagaaaaugaacuaag

SEQ ID NO: 481996 - RNA, 32 nt, Human
guucuuaaaauguguauuuccuaacaacagag

SEQ ID NO: 481997 - RNA, 32 nt, Human
guucuuaaagguaguguacaccagguuuuuac

SEQ ID NO: 481998 - RNA, 32 nt, Human
guucuuaccauguuggccaggcuggucucaaa

SEQ ID NO: 481999 - RNA, 21 nt, Human
guucuuacccacaagcaccac

SEQ ID NO: 482000 - RNA, 32 nt, Human
guucuuaccugggaaccuaauuccccagaagc

SEQ ID NO: 482001 - RNA, 32 nt, Human
guucuuacugccugugacgaugcagcuacagc

SEQ ID NO: 482002 - RNA, 32 nt, Human
guucuuacuugcauucccacugccuuucaugg

SEQ ID NO: 482003 - RNA, 32 nt, Human
guucuuagacaccuguaugauuuucuaaaguu

SEQ ID NO: 482004 - RNA, 32 nt, Human
guucuuagcuuguuugaugaggaagaggauaa

SEQ ID NO: 482005 - RNA, 32 nt, Human
guucuuaggacuccaguccaggcuggacggcu

SEQ ID NO: 482006 - RNA, 32 nt, Human
guucuuagucucuuuccaucugugucuuggcu

SEQ ID NO: 482007 - RNA, 32 nt, Human
guucuuaguguucacaacuuccauaagauacu

SEQ ID NO: 482008 - RNA, 23 nt, Human
guucuuauuuuaaagaaagguug

SEQ ID NO: 482009 - RNA, 32 nt, Human
guucuucaaccagcaacagcaacagcuaggga

SEQ ID NO: 482010 - RNA, 32 nt, Human
guucuucaagaacuuucucugccaucaacuac

SEQ ID NO: 482011 - RNA, 32 nt, Human
guucuucaagcaucgugucacugugaaauccu

SEQ ID NO: 482012 - RNA, 32 nt, Human
guucuucaccacccuccaaguccucugaccua

SEQ ID NO: 482013 - RNA, 32 nt, Human
guucuucaccauguuugucaccagcagggccu

SEQ ID NO: 482014 - RNA, 32 nt, Human
guucuucaggagaaagcuuacaguguuucagg

SEQ ID NO: 482015 - RNA, 32 nt, Human
guucuucaggguggguggcagggggauauagu

SEQ ID NO: 482016 - RNA, 32 nt, Human
guucuucauaggagagcaacuguaggugauca

SEQ ID NO: 482017 - RNA, 32 nt, Human
guucuucauggcguccccaccuccucugugag

SEQ ID NO: 482018 - RNA, 32 nt, Human
guucuucauuuuuaaagaaggaagggucauau

SEQ ID NO: 482019 - RNA, 32 nt, Human
guucuuccacaaaggcagccagugcucaccug

SEQ ID NO: 482020 - RNA, 32 nt, Human
guucuuccauucuggcaggcuuggggaccugg

SEQ ID NO: 482021 - RNA, 32 nt, Human
guucuucccuuuccucugcuguuuccuucuug

SEQ ID NO: 482022 - RNA, 31 nt, Human
guucuuccgccuccuuucccugugucauacu

SEQ ID NO: 482023 - RNA, 32 nt, Human
guucuuccuaaaggucaugcagcugguggugg

SEQ ID NO: 482024 - RNA, 32 nt, Human
guucuuccuccaccuccacccagugaucccaa

SEQ ID NO: 482025 - RNA, 32 nt, Human
guucuuccucucucaacauccauaucaaguug

SEQ ID NO: 482026 - RNA, 20 nt, Human
guucuuccugcaauacagug

SEQ ID NO: 482027 - RNA, 32 nt, Human
guucuuccugcccuuuccuuccuuccuuuucu

SEQ ID NO: 482028 - RNA, 32 nt, Human
guucuuccuucacaaccuucugagccuucuuu

SEQ ID NO: 482029 - RNA, 32 nt, Human
guucuucuagugggugagugcagagagagaag

SEQ ID NO: 482030 - RNA, 32 nt, Human
guucuucuaugcucccuccuucuugcugccuc

SEQ ID NO: 482031 - RNA, 32 nt, Human
guucuucuccauccucaauuuugccacuuuca

SEQ ID NO: 482032 - RNA, 32 nt, Human
guucuucucucccuuuuuccccuuccaggaag

SEQ ID NO: 482033 - RNA, 32 nt, Human
guucuucugaaagugugacaguguccagccgg

SEQ ID NO: 482034 - RNA, 32 nt, Human
guucuucuggcugcccggcugcagagagcuga

SEQ ID NO: 482035 - RNA, 32 nt, Human
guucuucuguaucccgggaaaaguacgcucgg

SEQ ID NO: 482036 - RNA, 32 nt, Human
guucuucuguugacccagacgaauagggcaca

SEQ ID NO: 482037 - RNA, 32 nt, Human
guucuucuuaccuugccuguaaaacaaaaccu

SEQ ID NO: 482038 - RNA, 22 nt, Human
guucuucuugcucuggaucccc

SEQ ID NO: 482039 - RNA, 32 nt, Human
guucuugaaaacuuguacuucaagagaaauga

SEQ ID NO: 482040 - RNA, 32 nt, Human
guucuugaacaccacucugauucuccaaggac

SEQ ID NO: 482041 - RNA, 32 nt, Human
guucuugaacaccacugugauucuccaaggac

SEQ ID NO: 482042 - RNA, 32 nt, Human
guucuugaacagaaugaaaucacaucuccauu

SEQ ID NO: 482043 - RNA, 32 nt, Human
guucuugacccgaggucgcccugaaggugucg

SEQ ID NO: 482044 - RNA, 32 nt, Human
guucuugaucugcuccuucuccugggugcgca

SEQ ID NO: 482045 - RNA, 32 nt, Human
guucuugcaacaaauucugcaugguccagcgc

SEQ ID NO: 482046 - RNA, 32 nt, Human
guucuugcauccuauacuggauaagccuguuu

SEQ ID NO: 482047 - RNA, 22 nt, Human
guucuugcauccucagccugug

SEQ ID NO: 482048 - RNA, 30 nt, Human
guucuugcaugacaaucagagggacacgga

SEQ ID NO: 482049 - RNA, 32 nt, Human
guucuugccccaggguuaggcaccccaaagau

SEQ ID NO: 482050 - RNA, 17 nt, Human
guucuugcccugagcca

SEQ ID NO: 482051 - RNA, 32 nt, Human
guucuugccguggcucuuccuccucccucagc

SEQ ID NO: 482052 - RNA, 32 nt, Human
guucuuggcaccucucuaccagaaagauauca

SEQ ID NO: 482053 - RNA, 32 nt, Human
guucuuggccuaccuaauggcccugaggauca

SEQ ID NO: 482054 - RNA, 32 nt, Human
guucuuggccugggccuguugcuuuugagccc

SEQ ID NO: 482055 - RNA, 32 nt, Human
guucuugggagagaggggaagagucgggacuu

SEQ ID NO: 482056 - RNA, 32 nt, Human
guucuugggcuagguaguggggaccaaguuca

SEQ ID NO: 482057 - RNA, 31 nt, Human
guucuuggggcugcucccaugcagacaggau

SEQ ID NO: 482058 - RNA, 32 nt, Human
guucuuggucucacugacuucaagaaugaagc

SEQ ID NO: 482059 - RNA, 32 nt, Human
guucuuggugucugcuuucucagauuccaagg

SEQ ID NO: 482060 - RNA, 32 nt, Human
guucuugguucugggauuuucuuaauuggguc

SEQ ID NO: 482061 - RNA, 32 nt, Human
guucuuguccaucaguucauacugcaauuuua

SEQ ID NO: 482062 - RNA, 32 nt, Human
guucuugucccccaggcuugagugcaaugacu

SEQ ID NO: 482063 - RNA, 32 nt, Human
guucuugucugcuggagguggcauuaccugug

SEQ ID NO: 482064 - RNA, 32 nt, Human
guucuuguguaccucauugcuuuagcugguca

SEQ ID NO: 482065 - RNA, 32 nt, Human
guucuuguguugucagcuucugaccucuugau

SEQ ID NO: 482066 - RNA, 32 nt, Human
guucuuguuaauacagucauuccauggaauua

SEQ ID NO: 482067 - RNA, 32 nt, Human
guucuuguugcccaaccuggagugcaguggug

SEQ ID NO: 482068 - RNA, 32 nt, Human
guucuuguugcccaggcugcagugcaauggca

SEQ ID NO: 482069 - RNA, 32 nt, Human
guucuuguugcccaggcuggaaugcaauggcg

SEQ ID NO: 482070 - RNA, 32 nt, Human
guucuuuaccuggcucugcuuccagcaguauu

SEQ ID NO: 482071 - RNA, 32 nt, Human
guucuuucacuuguaaguuucagucauuuucu

SEQ ID NO: 482072 - RNA, 32 nt, Human
guucuuucauuucccccuuccccauuccuuua

SEQ ID NO: 482073 - RNA, 32 nt, Human
guucuuucauuuccuccagcacuuucuuuccg

SEQ ID NO: 482074 - RNA, 27 nt, Human
guucuuucccugcuuaaugaaaagcuu

SEQ ID NO: 482075 - RNA, 32 nt, Human
guucuuuccuagccaccuuucuagccucccac

SEQ ID NO: 482076 - RNA, 32 nt, Human
guucuuucgggaccggcaggagcugcuacagc

SEQ ID NO: 482077 - RNA, 32 nt, Human
guucuuucuagcaucucuccccacccucugag

SEQ ID NO: 482078 - RNA, 32 nt, Human
guucuuucuccucugugccccucaugcugauc

SEQ ID NO: 482079 - RNA, 32 nt, Human
guucuuucugagaaacuggagaugucuuguua

SEQ ID NO: 482080 - RNA, 32 nt, Human
guucuuucuuucuccauccacuggcugaaugg

SEQ ID NO: 482081 - RNA, 32 nt, Human
guucuuugacaagaaaaguugagaggacuuua

SEQ ID NO: 482082 - RNA, 32 nt, Human
guucuuugagacaaauuuccucuuggcauuua

SEQ ID NO: 482083 - RNA, 20 nt, Human
guucuuugcccccugucuca

SEQ ID NO: 482084 - RNA, 32 nt, Human
guucuuugcucuucugaguucuugguggcuaa

SEQ ID NO: 482085 - RNA, 32 nt, Human
guucuuugcugcauucugccucucuaggacca

SEQ ID NO: 482086 - RNA, 32 nt, Human
guucuuuggagggaaaacuuugcugaauuguu

SEQ ID NO: 482087 - RNA, 32 nt, Human
guucuuugggguuuuuguuuguuuucccccau

SEQ ID NO: 482088 - RNA, 32 nt, Human
guucuuuucaaggcuccagucaccgcagcagu

SEQ ID NO: 482089 - RNA, 32 nt, Human
guucuuuucccaggauggcuccaggauaagga

SEQ ID NO: 482090 - RNA, 32 nt, Human
guucuuuuccuuacacgcaaaacauuuuuaac

SEQ ID NO: 482091 - RNA, 32 nt, Human
guucuuuuccuuccuuccuuccuuccucccuu

SEQ ID NO: 482092 - RNA, 32 nt, Human
guucuuuucucaaguccugcugcccaggccca

SEQ ID NO: 482093 - RNA, 32 nt, Human
guucuuuugacagccgugagcuuccccgccag

SEQ ID NO: 482094 - RNA, 32 nt, Human
guucuuuugccuagguuggaguacagcgguga

SEQ ID NO: 482095 - RNA, 32 nt, Human
guucuuuugccucccauagccucuugcuuuuc

SEQ ID NO: 482096 - RNA, 32 nt, Human
guucuuuugugccagcucuguaugauguuugu

SEQ ID NO: 482097 - RNA, 32 nt, Human
guucuuuuuaacauguaguuaugaaaaucucc

SEQ ID NO: 482098 - RNA, 32 nt, Human
guucuuuuuccucuuggcauuuccuaauaaca

SEQ ID NO: 482099 - RNA, 32 nt, Human
guucuuuuugccuaggcuggagugcaguggua

SEQ ID NO: 482100 - RNA, 32 nt, Human
guucuuuuugccucagaaccucuccuucagga

SEQ ID NO: 482101 - RNA, 32 nt, Human
guucuuuuugcuauuucuccaggcuuugccug

SEQ ID NO: 482102 - RNA, 22 nt, Human
guugaaaaaaggcagagcaggg

SEQ ID NO: 482103 - RNA, 32 nt, Human
guugaaaacuccagaaauacaucacccaaggu

SEQ ID NO: 482104 - RNA, 32 nt, Human
guugaaaacuuaguauaugacacagaaagaaa

SEQ ID NO: 482105 - RNA, 32 nt, Human
guugaaaagaaagaagaaggaggcggaaaucu

SEQ ID NO: 482106 - RNA, 32 nt, Human
guugaaaagucaggaauaaauuuguugaaaau

SEQ ID NO: 482107 - RNA, 32 nt, Human
guugaaaaucuacaauauaugcugcauuuaau

SEQ ID NO: 482108 - RNA, 32 nt, Human
guugaaaauguccuuugugggggagaacucag

SEQ ID NO: 482109 - RNA, 21 nt, Human
guugaaacauuauucaggcug

SEQ ID NO: 482110 - RNA, 32 nt, Human
guugaaaccaacacaacguugaaauccaggcu

SEQ ID NO: 482111 - RNA, 32 nt, Human
guugaaaccacuucauuggacauguugcaaua

SEQ ID NO: 482112 - RNA, 32 nt, Human
guugaaacccuccucugccagccugggguccu

SEQ ID NO: 482113 - RNA, 32 nt, Human
guugaaaccucuggaaguacagaagggaaggg

SEQ ID NO: 482114 - RNA, 32 nt, Human
guugaaaccugcugggacuuuuuagccauucu

SEQ ID NO: 482115 - RNA, 32 nt, Human
guugaaacuucaaacaacaggacccauaugga

SEQ ID NO: 482116 - RNA, 32 nt, Human
guugaaagaaccaggccagacaugguggcuca

SEQ ID NO: 482117 - RNA, 32 nt, Human
guugaaagaagauuaggggaaaagaggucacc

SEQ ID NO: 482118 - RNA, 32 nt, Human
guugaaaggaagcucaauccaacucucagaca

SEQ ID NO: 482119 - RNA, 32 nt, Human
guugaaaggagagaccaauauuugugacaugg

SEQ ID NO: 482120 - RNA, 32 nt, Human
guugaaagggagcaaugacaugggggacaguu

SEQ ID NO: 482121 - RNA, 32 nt, Human
guugaaaugccuuucaaccauuuccuucugug

SEQ ID NO: 482122 - RNA, 32 nt, Human
guugaaauggucuuucucccuuccucagagag

SEQ ID NO: 482123 - RNA, 32 nt, Human
guugaacaacggccaggcacaguggcucaugc

SEQ ID NO: 482124 - RNA, 30 nt, Human
guugaacagucucgaucagaaaggcauuug

SEQ ID NO: 482125 - RNA, 32 nt, Human
guugaacauacaaacaaguccagguuuuucau

SEQ ID NO: 482126 - RNA, 32 nt, Human
guugaacaucacugauuccugaccugcagcac

SEQ ID NO: 482127 - RNA, 32 nt, Human
guugaaccagccuugcauucaugguauaaauc

SEQ ID NO: 482128 - RNA, 32 nt, Human
guugaaccaguguggccgagguugcagugagu

SEQ ID NO: 482129 - RNA, 32 nt, Human
guugaacccaggaggcggagguugcagugagc

SEQ ID NO: 482130 - RNA, 32 nt, Human
guugaacccaggagguggagguugcagugagc

SEQ ID NO: 482131 - RNA, 32 nt, Human
guugaacccgggaggcggagguugcagugagc

SEQ ID NO: 482132 - RNA, 32 nt, Human
guugaacccgggagguggagguugcagugagc

SEQ ID NO: 482133 - RNA, 32 nt, Human
guugaacccguguggcagagguugcggugagu

SEQ ID NO: 482134 - RNA, 32 nt, Human
guugaaccugggaggcggagguugcagugagc

SEQ ID NO: 482135 - RNA, 32 nt, Human
guugaaccugggaggcggagguugugaugagc

SEQ ID NO: 482136 - RNA, 32 nt, Human
guugaaccugggagguggagguugaggugagc

SEQ ID NO: 482137 - RNA, 32 nt, Human
guugaaccugggccagcuccuugaggacacag

SEQ ID NO: 482138 - RNA, 32 nt, Human
guugaaccuguggcuaggggaagacauugucu

SEQ ID NO: 482139 - RNA, 32 nt, Human
guugaacgugggaggcggagguugcagugagc

SEQ ID NO: 482140 - RNA, 32 nt, Human
guugaacucuacugugucaggccagccugagu

SEQ ID NO: 482141 - RNA, 32 nt, Human
guugaagaaagccaugugggagcucagcaaau

SEQ ID NO: 482142 - RNA, 32 nt, Human
guugaagaauagaguuaggcaccagaagaaga

SEQ ID NO: 482143 - RNA, 32 nt, Human
guugaagaauguaaacuccaaauguuuacagc

SEQ ID NO: 482144 - RNA, 32 nt, Human
guugaagaccagccuggccaacauggugaaac

SEQ ID NO: 482145 - RNA, 32 nt, Human
guugaagaccagccugggcaacauagugagaa

SEQ ID NO: 482146 - RNA, 32 nt, Human
guugaagaccaguucugaggugaagcugggca

SEQ ID NO: 482147 - RNA, 32 nt, Human
guugaagagacacaggccacacauuucaggcu

SEQ ID NO: 482148 - RNA, 32 nt, Human
guugaagagacagagacaaguaauuucagugu

SEQ ID NO: 482149 - RNA, 32 nt, Human
guugaagagggcugcaaggugggaagugaagu

SEQ ID NO: 482150 - RNA, 32 nt, Human
guugaagauaaauaagcuuaaacaaauaacuu

SEQ ID NO: 482151 - RNA, 32 nt, Human
guugaagaugcauuucagggccugggaaaaga

SEQ ID NO: 482152 - RNA, 32 nt, Human
guugaagccuccaaggcagugaggggcuuggg

SEQ ID NO: 482153 - RNA, 32 nt, Human
guugaaggaggcagcgggagcggagagcgccc

SEQ ID NO: 482154 - RNA, 32 nt, Human
guugaaggccugaguguaacaaaagggcuuau

SEQ ID NO: 482155 - RNA, 32 nt, Human
guugaagggaaacgcuacaucuucucugguug

SEQ ID NO: 482156 - RNA, 22 nt, Human
guugaagggaaaugucgaggcu

SEQ ID NO: 482157 - RNA, 18 nt, Human
guugaaggggauccuguc

SEQ ID NO: 482158 - RNA, 32 nt, Human
guugaagggggcggcuuccuggagccagcacc

SEQ ID NO: 482159 - RNA, 32 nt, Human
guugaaguacagagggagguugggguggguca

SEQ ID NO: 482160 - RNA, 32 nt, Human
guugaaguccccauccuggccuccucucagcc

SEQ ID NO: 482161 - RNA, 32 nt, Human
guugaagucuuguugugugcucuuccuuccag

SEQ ID NO: 482162 - RNA, 32 nt, Human
guugaagugagcugagauugcaccacugcacu

SEQ ID NO: 482163 - RNA, 32 nt, Human
guugaagugcagugucagaaaugaugugaguu

SEQ ID NO: 482164 - RNA, 32 nt, Human
guugaauagcuuuucuucugcaaugggaguug

SEQ ID NO: 482165 - RNA, 31 nt, Human
guugaaucaauaaauaccaauuugugaaaca

SEQ ID NO: 482166 - RNA, 32 nt, Human
guugaaucauugcuguuggaggcagcacaaau

SEQ ID NO: 482167 - RNA, 32 nt, Human
guugaauccacaacuucauuuauauacaggcu

SEQ ID NO: 482168 - RNA, 32 nt, Human
guugaaucccugagaagagagagcauggggcg

SEQ ID NO: 482169 - RNA, 32 nt, Human
guugaaucugggagggaaguggagguugcugu

SEQ ID NO: 482170 - RNA, 32 nt, Human
guugaaugaguguguuuuguacauaacuucag

SEQ ID NO: 482171 - RNA, 32 nt, Human
guugaauggaaagaggcaggcagggggagagg

SEQ ID NO: 482172 - RNA, 32 nt, Human
guugaauggagauuaaguggauucaggaggau

SEQ ID NO: 482173 - RNA, 32 nt, Human
guugaauguaaugcuggggacaggcaugcugc

SEQ ID NO: 482174 - RNA, 32 nt, Human
guugaaugugccaugcccucucccucucugga

SEQ ID NO: 482175 - RNA, 21 nt, Human
guugaauguguuuauuuuuag

SEQ ID NO: 482176 - RNA, 23 nt, Human
guugaauucuauuuuauuuuuaa

SEQ ID NO: 482177 - RNA, 32 nt, Human
guugaauuguaauccccaauauuggagauagg

SEQ ID NO: 482178 - RNA, 32 nt, Human
guugaauuguaauccccaaugcuggagguagg

SEQ ID NO: 482179 - RNA, 32 nt, Human
guugacaagaaagaggagacgcagccgcccau

SEQ ID NO: 482180 - RNA, 32 nt, Human
guugacacauugcacacacagucuguucagag

SEQ ID NO: 482181 - RNA, 32 nt, Human
guugacaccauucagugaagguugugaacuuu

SEQ ID NO: 482182 - RNA, 32 nt, Human
guugacacccuccauccucagagcaggucgaa

SEQ ID NO: 482183 - RNA, 32 nt, Human
guugacacgaggcacagaaaacaaauaucaaa

SEQ ID NO: 482184 - RNA, 32 nt, Human
guugacagagguuuaccucccuacuuucuuag

SEQ ID NO: 482185 - RNA, 32 nt, Human
guugacagggaggggaggauugugaggugagg

SEQ ID NO: 482186 - RNA, 32 nt, Human
guugacaggugcgugacagugggagcugcucu

SEQ ID NO: 482187 - RNA, 32 nt, Human
guugacaucccccuucuggcucaugugucuga

SEQ ID NO: 482188 - RNA, 31 nt, Human
guugacaugacuuacgugcauuuaaauauau

SEQ ID NO: 482189 - RNA, 32 nt, Human
guugacauggagaaaguuuuaguggccugagu

SEQ ID NO: 482190 - RNA, 32 nt, Human
guugacauggaggcagugcuugcauugcuuug

SEQ ID NO: 482191 - RNA, 32 nt, Human
guugacauugaauaaaagaacaugacaaaccc

SEQ ID NO: 482192 - RNA, 20 nt, Human
guugacauuuagaacuuuaa

SEQ ID NO: 482193 - RNA, 31 nt, Human
guugacauuuucuuucagcauuuaaaauuuu

SEQ ID NO: 482194 - RNA, 32 nt, Human
guugaccaaacagaaagaggccucuauuucaa

SEQ ID NO: 482195 - RNA, 21 nt, Human
guugaccaacuuugauuucca

SEQ ID NO: 482196 - RNA, 32 nt, Human
guugaccacaucuggcuccugccaggcaacga

SEQ ID NO: 482197 - RNA, 24 nt, Human
guugaccaggcuggagugaagugg

SEQ ID NO: 482198 - RNA, 24 nt, Human
guugaccaggcuggagugcagugg

SEQ ID NO: 482199 - RNA, 32 nt, Human
guugaccaucgauauuuccucccacauguggc

SEQ ID NO: 482200 - RNA, 32 nt, Human
guugacccgaaacagcccuccgucuuccugcc

SEQ ID NO: 482201 - RNA, 32 nt, Human
guugaccggaccuuccuuccagggcuuuuccu

SEQ ID NO: 482202 - RNA, 32 nt, Human
guugaccucugccuggcucccccuuggugcaa

SEQ ID NO: 482203 - RNA, 32 nt, Human
guugaccuguccuuggucacugaggccauugg

SEQ ID NO: 482204 - RNA, 32 nt, Human
guugaccuucauuuaguugauguaauacauag

SEQ ID NO: 482205 - RNA, 31 nt, Human
guugaccuugggguaggcugggugaagggua

SEQ ID NO: 482206 - RNA, 32 nt, Human
guugaccuuguacagaaccagaauccuguccc

SEQ ID NO: 482207 - RNA, 32 nt, Human
guugacgauguuuuaagauugcaccuggcagu

SEQ ID NO: 482208 - RNA, 32 nt, Human
guugacgcuucacaaguaaauguugucaggcu

SEQ ID NO: 482209 - RNA, 32 nt, Human
guugacguugccuggugguuccuaccuucugu

SEQ ID NO: 482210 - RNA, 32 nt, Human
guugacucacuacagccucugccucccagguu

SEQ ID NO: 482211 - RNA, 32 nt, Human
guugacucuacagucaugaaacauacaggucu

SEQ ID NO: 482212 - RNA, 32 nt, Human
guugacucuccgggggcacuggcucauuccaa

SEQ ID NO: 482213 - RNA, 32 nt, Human
guugacucucucuggaaugcgguaauaagagc

SEQ ID NO: 482214 - RNA, 32 nt, Human
guugacugcaugcacacuuuacauuuauuuau

SEQ ID NO: 482215 - RNA, 32 nt, Human
guugacugcuacauuuccccagccugguacca

SEQ ID NO: 482216 - RNA, 32 nt, Human
guugacugcuuuggaggcacaaacccaugcaa

SEQ ID NO: 482217 - RNA, 32 nt, Human
guugacuggaggcggagguugcagugagccga

SEQ ID NO: 482218 - RNA, 32 nt, Human
guugacuguggcugaagagcuuggggaagagc

SEQ ID NO: 482219 - RNA, 32 nt, Human
guugacuuaacauugaguucaagccuuaauug

SEQ ID NO: 482220 - RNA, 32 nt, Human
guugacuuaacauugaguucaagccuuuauug

SEQ ID NO: 482221 - RNA, 32 nt, Human
guugacuugagagaagggcugaucucagagcc

SEQ ID NO: 482222 - RNA, 32 nt, Human
guugacuuucaaaucacguuaggaccuggauu

SEQ ID NO: 482223 - RNA, 32 nt, Human
guugacuuuuggcugaaggugggagccggugu

SEQ ID NO: 482224 - RNA, 32 nt, Human
guugagaaaggccauaugacuguaaggaauuu

SEQ ID NO: 482225 - RNA, 32 nt, Human
guugagaacaccuuucauauugguccuaguuc

SEQ ID NO: 482226 - RNA, 32 nt, Human
guugagaagacuccugggcuucagccucuccc

SEQ ID NO: 482227 - RNA, 32 nt, Human
guugagaaggagagaaaaagguggcaggaauu

SEQ ID NO: 482228 - RNA, 19 nt, Human
guugagaagggccagggua

SEQ ID NO: 482229 - RNA, 32 nt, Human
guugagaccaauuguaaccaguuuaacucauu

SEQ ID NO: 482230 - RNA, 32 nt, Human
guugagaccagccugaacaacauggugaaacc

SEQ ID NO: 482231 - RNA, 32 nt, Human
guugagaccagccuggccaacauggugaaacc

SEQ ID NO: 482232 - RNA, 32 nt, Human
guugagaccaggaguucgaguccagccugacc

SEQ ID NO: 482233 - RNA, 32 nt, Human
guugagaccauccuggccaacauggugaaacc

SEQ ID NO: 482234 - RNA, 32 nt, Human
guugagacgcacucccacccugggugcugcag

SEQ ID NO: 482235 - RNA, 32 nt, Human
guugagacugaaguguucacuuccauagaaga

SEQ ID NO: 482236 - RNA, 32 nt, Human
guugagaggaaaugcauaaaaugaaagaugaa

SEQ ID NO: 482237 - RNA, 32 nt, Human
guugagaggagaaaagggaagaaaagucgggg

SEQ ID NO: 482238 - RNA, 32 nt, Human
guugagaggcagcugcuucgcacagaccagag

SEQ ID NO: 482239 - RNA, 32 nt, Human
guugagaggccccucuucuggagcucagcagc

SEQ ID NO: 482240 - RNA, 32 nt, Human
guugagauagagacggccugcccacacaacuc

SEQ ID NO: 482241 - RNA, 32 nt, Human
guugagauauaggguucauccauguugcugca

SEQ ID NO: 482242 - RNA, 32 nt, Human
guugagauaugaguucuucguacuggaaaagc

SEQ ID NO: 482243 - RNA, 32 nt, Human
guugagaucgcacuccagccugggugacagag

SEQ ID NO: 482244 - RNA, 32 nt, Human
guugagaucgccacugcacuccagccugggaa

SEQ ID NO: 482245 - RNA, 32 nt, Human
guugagaugaaugauguguucacaaaugaggg

SEQ ID NO: 482246 - RNA, 32 nt, Human
guugagaugcagauuccucagaguccguguca

SEQ ID NO: 482247 - RNA, 32 nt, Human
guugagauucugugagucuagguugaccacag

SEQ ID NO: 482248 - RNA, 24 nt, Human
guugagcaacaacaaaaugcugua

SEQ ID NO: 482249 - RNA, 23 nt, Human
guugagcacucggaguguaguca

SEQ ID NO: 482250 - RNA, 32 nt, Human
guugagcagagggaaggcaugggggcaggaag

SEQ ID NO: 482251 - RNA, 32 nt, Human
guugagcagugucaugccuuggcguuucagcu

SEQ ID NO: 482252 - RNA, 23 nt, Human
guugagcauuugaaauaugguua

SEQ ID NO: 482253 - RNA, 32 nt, Human
guugagcccaggaguucaagaccagccuggac

SEQ ID NO: 482254 - RNA, 24 nt, Human
guugagccccuccuaguucuucau

SEQ ID NO: 482255 - RNA, 32 nt, Human
guugagccgacuuggaaaugugaacgcaagaa

SEQ ID NO: 482256 - RNA, 32 nt, Human
guugagccgccggccucggccucccaggaagu

SEQ ID NO: 482257 - RNA, 32 nt, Human
guugagccucuuucugggucucugccuggguc

SEQ ID NO: 482258 - RNA, 32 nt, Human
guugagccucuuucugugucucugccuggguc

SEQ ID NO: 482259 - RNA, 32 nt, Human
guugagccugggauggaggagcccuaggccag

SEQ ID NO: 482260 - RNA, 32 nt, Human
guugagcucuacugagagccaaggccccuaga

SEQ ID NO: 482261 - RNA, 32 nt, Human
guugagcugagcagggggaggggaagaucuac

SEQ ID NO: 482262 - RNA, 32 nt, Human
guugagcugggcucucgcuuuguugcccaggc

SEQ ID NO: 482263 - RNA, 32 nt, Human
guugagcuuaggagguugaggcugcagugagc

SEQ ID NO: 482264 - RNA, 32 nt, Human
guugagcuuccagacaugugauguugcuaaag

SEQ ID NO: 482265 - RNA, 21 nt, Human
guugaggacagcuauccuguu

SEQ ID NO: 482266 - RNA, 30 nt, Human
guugaggacuugugaucagaaaaacugaag

SEQ ID NO: 482267 - RNA, 32 nt, Human
guugaggagacacccgcaauccuccacgaucu

SEQ ID NO: 482268 - RNA, 32 nt, Human
guugaggaggaaugugcuuaauguuuuaggaa

SEQ ID NO: 482269 - RNA, 32 nt, Human
guugaggaucucugccugccuuccugccgucc

SEQ ID NO: 482270 - RNA, 32 nt, Human
guugaggaugugggaacuuuucugucaggaaa

SEQ ID NO: 482271 - RNA, 32 nt, Human
guugaggcagaggcaauaaccucccauugcuc

SEQ ID NO: 482272 - RNA, 32 nt, Human
guugaggcagccagcugugcagccagguguga

SEQ ID NO: 482273 - RNA, 32 nt, Human
guugaggcagggccaucccgauccuugcucua

SEQ ID NO: 482274 - RNA, 32 nt, Human
guugaggcagggugaguagcugcuugacaccc

SEQ ID NO: 482275 - RNA, 32 nt, Human
guugaggccacuguucagggggcugguggccg

SEQ ID NO: 482276 - RNA, 32 nt, Human
guugaggccaggaguuugaggcugcagugagc

SEQ ID NO: 482277 - RNA, 32 nt, Human
guugaggcgggcagaucacugaggucaggagu

SEQ ID NO: 482278 - RNA, 32 nt, Human
guugaggcuaaaacaaaucucagaacagucug

SEQ ID NO: 482279 - RNA, 32 nt, Human
guugaggcugcagugagccaugaucauuccac

SEQ ID NO: 482280 - RNA, 32 nt, Human
guugaggcugcgauuuucucucucccaguacc

SEQ ID NO: 482281 - RNA, 32 nt, Human
guugagggaaauuuguuuuguuuuccacauug

SEQ ID NO: 482282 - RNA, 32 nt, Human
guugagggagagaagaccuugggccaagaugc

SEQ ID NO: 482283 - RNA, 22 nt, Human
guugagggcaggacccagggca

SEQ ID NO: 482284 - RNA, 32 nt, Human
guugagggcaggcagagguagcugaggguagc

SEQ ID NO: 482285 - RNA, 32 nt, Human
guugagggcugagggagagacugaggugcagc

SEQ ID NO: 482286 - RNA, 32 nt, Human
guugaggggaaaggagggauggcagguaggug

SEQ ID NO: 482287 - RNA, 32 nt, Human
guugagggggacgcccugcacauggcuuugcu

SEQ ID NO: 482288 - RNA, 24 nt, Human
guugagggggcacacagggcaagg

SEQ ID NO: 482289 - RNA, 32 nt, Human
guugagggggcuagagggagaaugggaaccac

SEQ ID NO: 482290 - RNA, 32 nt, Human
guugaggggguguugagggcggagaaaugcaa

SEQ ID NO: 482291 - RNA, 28 nt, Human
guugagggucgagccuguuuguuucuaa

SEQ ID NO: 482292 - RNA, 32 nt, Human
guugaggguggguggagggguuugcagugugg

SEQ ID NO: 482293 - RNA, 32 nt, Human
guugaggugagcugggguuggccccggcccag

SEQ ID NO: 482294 - RNA, 25 nt, Human
guugaguagggcuauugauuucuag

SEQ ID NO: 482295 - RNA, 32 nt, Human
guugagucaucaacacuuugccaauuagcuca

SEQ ID NO: 482296 - RNA, 32 nt, Human
guugaguccuggaaagggagccuggagagcgg

SEQ ID NO: 482297 - RNA, 32 nt, Human
guugagucuccucucugagacugcuaaguagg

SEQ ID NO: 482298 - RNA, 32 nt, Human
guugagugaauaaccaauuugcagugguggau

SEQ ID NO: 482299 - RNA, 32 nt, Human
guugagugagccaaugaggccaggaagaucag

SEQ ID NO: 482300 - RNA, 32 nt, Human
guugaguugguucacauccacauucuggcugu

SEQ ID NO: 482301 - RNA, 32 nt, Human
guugaguuucuuuuucugucaugcccuggggg

SEQ ID NO: 482302 - RNA, 32 nt, Human
guugauaaagaaugccaaaugcucuggagaua

SEQ ID NO: 482303 - RNA, 32 nt, Human
guugauacucaagccuuguacaagcacauauc

SEQ ID NO: 482304 - RNA, 32 nt, Human
guugauagggagucugaagccacccagacgug

SEQ ID NO: 482305 - RNA, 32 nt, Human
guugauauccauaagcuggcacuggaugcucu

SEQ ID NO: 482306 - RNA, 32 nt, Human
guugauauggccaaagggagagaggccuuuua

SEQ ID NO: 482307 - RNA, 32 nt, Human
guugaucacagacaaucucugccauccauaag

SEQ ID NO: 482308 - RNA, 20 nt, Human
guugaucaccugaggucagg

SEQ ID NO: 482309 - RNA, 18 nt, Human
guugaucagcaugcaaug

SEQ ID NO: 482310 - RNA, 32 nt, Human
guugaucaggagugaauucacagucuaccaug

SEQ ID NO: 482311 - RNA, 32 nt, Human
guugaucauccagaacugguaccgagguuaca

SEQ ID NO: 482312 - RNA, 32 nt, Human
guugaucaugcugguggcuugguuacugugac

SEQ ID NO: 482313 - RNA, 32 nt, Human
guugaucccagccgugaaagugcaugaugccu

SEQ ID NO: 482314 - RNA, 32 nt, Human
guugauccuggaugugucugugaggguguugu

SEQ ID NO: 482315 - RNA, 32 nt, Human
guugauccugggugugucugugaggguguugu

SEQ ID NO: 482316 - RNA, 32 nt, Human
guugaucuccugguagcaugaccuuuuggccu

SEQ ID NO: 482317 - RNA, 32 nt, Human
guugaucugugcaugccacuccugggucagac

SEQ ID NO: 482318 - RNA, 32 nt, Human
guugaucuuucuggcugcuggaauuggagaua

SEQ ID NO: 482319 - RNA, 32 nt, Human
guugaugaaaacagcaauguuuaucaaguguu

SEQ ID NO: 482320 - RNA, 32 nt, Human
guugaugaacagcacuuggauuuccuguuggc

SEQ ID NO: 482321 - RNA, 32 nt, Human
guugaugaaggcucggccgcggcacuuccuga

SEQ ID NO: 482322 - RNA, 32 nt, Human
guugaugacuaggaaaggcugagggaauucca

SEQ ID NO: 482323 - RNA, 32 nt, Human
guugaugagcacuguagguggcuucgagaugc

SEQ ID NO: 482324 - RNA, 24 nt, Human
guugaugaggcuggagugcagugg

SEQ ID NO: 482325 - RNA, 32 nt, Human
guugaugaucuagcacuuucaccaagaaaugg

SEQ ID NO: 482326 - RNA, 32 nt, Human
guugaugcauagcuagaucaccaguuuaaaug

SEQ ID NO: 482327 - RNA, 32 nt, Human
guugaugccagcugcuccauggaccaggcccu

SEQ ID NO: 482328 - RNA, 32 nt, Human
guugaugccccaggacacagagacuucaucaa

SEQ ID NO: 482329 - RNA, 32 nt, Human
guugaugccggauucgaagccaggaaggccca

SEQ ID NO: 482330 - RNA, 24 nt, Human
guugaugccuugcagggcauucuu

SEQ ID NO: 482331 - RNA, 32 nt, Human
guugaugcugcuguucauggcacuacaaagcu

SEQ ID NO: 482332 - RNA, 32 nt, Human
guugauggaugcugcugcccucuccucaaccu

SEQ ID NO: 482333 - RNA, 32 nt, Human
guugauggguuuccuuauccccaaagucacuc

SEQ ID NO: 482334 - RNA, 31 nt, Human
guugauggucuuuucuguacuggaggccucc

SEQ ID NO: 482335 - RNA, 32 nt, Human
guugaugugcauucauuuccauucacugauga

SEQ ID NO: 482336 - RNA, 32 nt, Human
guugauguucuagagaggacagcagacaaggc

SEQ ID NO: 482337 - RNA, 32 nt, Human
guugauuaacacucauaacuagggagugagug

SEQ ID NO: 482338 - RNA, 32 nt, Human
guugauucauuucccaaauuccccagacugaa

SEQ ID NO: 482339 - RNA, 32 nt, Human
guugauucccacccucccuccccaguuacuua

SEQ ID NO: 482340 - RNA, 32 nt, Human
guugauucuagguugaaaauguuauaggcacu

SEQ ID NO: 482341 - RNA, 32 nt, Human
guugauugaagcuuccucuguaucugaaucuu

SEQ ID NO: 482342 - RNA, 32 nt, Human
guugauugaauaccuauuaugugccaggcacu

SEQ ID NO: 482343 - RNA, 32 nt, Human
guugauugcaccacugcacucuagccugcgug

SEQ ID NO: 482344 - RNA, 32 nt, Human
guugauuggcaaaagcagcacaguauuaauau

SEQ ID NO: 482345 - RNA, 32 nt, Human
guugauugugacauuuucccagaagagaggcu

SEQ ID NO: 482346 - RNA, 32 nt, Human
guugauuucuccaccaaaugcaugucauguau

SEQ ID NO: 482347 - RNA, 32 nt, Human
guugauuugagaagaaaucuggcugguuugag

SEQ ID NO: 482348 - RNA, 32 nt, Human
guugauuugcugcaagaguagcugagaauuca

SEQ ID NO: 482349 - RNA, 32 nt, Human
guugauuuucacugcaacucugccuuugugug

SEQ ID NO: 482350 - RNA, 32 nt, Human
guugauuuuucagaccugcuccucaguaauaa

SEQ ID NO: 482351 - RNA, 32 nt, Human
guugauuuuucuauuuauauuuccuuguacaa

SEQ ID NO: 482352 - RNA, 32 nt, Human
guugcaaagacaauuucuucacuugagcccuu

SEQ ID NO: 482353 - RNA, 32 nt, Human
guugcaaaguaugcacacauaucuugaauggc

SEQ ID NO: 482354 - RNA, 32 nt, Human
guugcaaaguuagccgagaucacgccaucaca

SEQ ID NO: 482355 - RNA, 32 nt, Human
guugcaacacuguacuccagccugggcaacag

SEQ ID NO: 482356 - RNA, 32 nt, Human
guugcaaccaggagucaguacaggcuuuauuc

SEQ ID NO: 482357 - RNA, 32 nt, Human
guugcaacccauguggugauaaggcucacagc

SEQ ID NO: 482358 - RNA, 32 nt, Human
guugcaagaauaguuuuaguucagagaauugu

SEQ ID NO: 482359 - RNA, 32 nt, Human
guugcaagguugagccaagaucaugccacugc

SEQ ID NO: 482360 - RNA, 24 nt, Human
guugcaagugauucuccugccuca

SEQ ID NO: 482361 - RNA, 32 nt, Human
guugcaaucuuucuccuuagguccucacacaa

SEQ ID NO: 482362 - RNA, 32 nt, Human
guugcaaugaagcggagguugcagugagccga

SEQ ID NO: 482363 - RNA, 32 nt, Human
guugcaaugaggcaaaggaugcagugacuuuu

SEQ ID NO: 482364 - RNA, 32 nt, Human
guugcacaaaaaggaaaguuugggaagggaug

SEQ ID NO: 482365 - RNA, 31 nt, Human
guugcacaagaacuuuuacucacuuguaauu

SEQ ID NO: 482366 - RNA, 32 nt, Human
guugcacaaucagaauugauaagcacuguucc

SEQ ID NO: 482367 - RNA, 32 nt, Human
guugcacaaugccacccauccacuccuugcca

SEQ ID NO: 482368 - RNA, 32 nt, Human
guugcacacaugcuccccacacacacauagac

SEQ ID NO: 482369 - RNA, 32 nt, Human
guugcacaccugcacacacgcccuggcacaca

SEQ ID NO: 482370 - RNA, 32 nt, Human
guugcacagacugucuguauucaauggcuauc

SEQ ID NO: 482371 - RNA, 32 nt, Human
guugcacagagaaagccagcugucgucauuug

SEQ ID NO: 482372 - RNA, 32 nt, Human
guugcacagcugcugcugacaggucuaccuga

SEQ ID NO: 482373 - RNA, 32 nt, Human
guugcacauuauacuccguguguucuucaacu

SEQ ID NO: 482374 - RNA, 32 nt, Human
guugcaccacuguacuccagccugggcgauac

SEQ ID NO: 482375 - RNA, 32 nt, Human
guugcaccauugcacuccacccugggcgacag

SEQ ID NO: 482376 - RNA, 32 nt, Human
guugcaccauuguacuccagccugggcaacaa

SEQ ID NO: 482377 - RNA, 32 nt, Human
guugcaccucauucucccgaugacuauucaaa

SEQ ID NO: 482378 - RNA, 32 nt, Human
guugcaccuuucucaccuacuuugggaccuuu

SEQ ID NO: 482379 - RNA, 32 nt, Human
guugcacgucggccccagcccugaggagccgg

SEQ ID NO: 482380 - RNA, 32 nt, Human
guugcacucauuuuuccuggaccucagucuau

SEQ ID NO: 482381 - RNA, 32 nt, Human
guugcacucuguagacuggaucuguuuuagga

SEQ ID NO: 482382 - RNA, 22 nt, Human
guuuucauuuuuguuguacgug

SEQ ID NO: 482383 - RNA, 32 nt, Human
guuuuccaaaggaguggucaagcccuugccca

SEQ ID NO: 482384 - RNA, 32 nt, Human
guuuuccaaauacugucucuucucaauaacuc

SEQ ID NO: 482385 - RNA, 20 nt, Human
guuuuccaaauuuaaacuca

SEQ ID NO: 482386 - RNA, 20 nt, Human
guuuuccaacccccagccuc

SEQ ID NO: 482387 - RNA, 32 nt, Human
guuuuccaagaguguaccauuaacuugauugu

SEQ ID NO: 482388 - RNA, 32 nt, Human
guuuuccaaggcuuccuccacccugccaccga

SEQ ID NO: 482389 - RNA, 21 nt, Human
guuuuccaccucacugucucc

SEQ ID NO: 482390 - RNA, 32 nt, Human
guuuuccacugaagcaugcacaugccacuguc

SEQ ID NO: 482391 - RNA, 32 nt, Human
guuuuccacugcauucugaagagcaggugaca

SEQ ID NO: 482392 - RNA, 32 nt, Human
guuuuccagaucaccacccaaguugugugggg

SEQ ID NO: 482393 - RNA, 32 nt, Human
guuuuccagcuuuuauacacacguaucucauu

SEQ ID NO: 482394 - RNA, 32 nt, Human
guuuuccaggagauggagccaguugggugugg

SEQ ID NO: 482395 - RNA, 32 nt, Human
guuuuccagggcccuugaccaacaucggcuuc

SEQ ID NO: 482396 - RNA, 32 nt, Human
guuuuccagugaucuugggacaugaaguugcu

SEQ ID NO: 482397 - RNA, 32 nt, Human
guuuuccauccccuucagguccuuccucggga

SEQ ID NO: 482398 - RNA, 32 nt, Human
guuuuccaucuuguucuggccuagaggucagu

SEQ ID NO: 482399 - RNA, 32 nt, Human
guuuuccaugaagaaaucaaccaguccagaaa

SEQ ID NO: 482400 - RNA, 32 nt, Human
guuuuccauucuauggagaggaucccagucuu

SEQ ID NO: 482401 - RNA, 32 nt, Human
guuuuccauugccaccauaacaaguuacaaaa

SEQ ID NO: 482402 - RNA, 28 nt, Human
guuuucccaaguggcauuuucaucucgc

SEQ ID NO: 482403 - RNA, 32 nt, Human
guuuucccacgaggaaucugugggucugggag

SEQ ID NO: 482404 - RNA, 19 nt, Human
guuuucccacuuuuuggua

SEQ ID NO: 482405 - RNA, 32 nt, Human
guuuucccaucuccugggaagggaucuuucga

SEQ ID NO: 482406 - RNA, 32 nt, Human
guuuuccccaaaacauaucaguuugaauacuu

SEQ ID NO: 482407 - RNA, 32 nt, Human
guuuuccccacaagucaucuugccuuguggca

SEQ ID NO: 482408 - RNA, 32 nt, Human
guuuuccccacauucuauagccauaaaccuga

SEQ ID NO: 482409 - RNA, 32 nt, Human
guuuuccccacccccucaaucugucggggagc

SEQ ID NO: 482410 - RNA, 32 nt, Human
guuuuccccuaaaagcuuacucuagaaaggau

SEQ ID NO: 482411 - RNA, 32 nt, Human
guuuuccccuccuguccucaugauacugaaua

SEQ ID NO: 482412 - RNA, 32 nt, Human
guuuuccccugccuuccuugcagaggccaugg

SEQ ID NO: 482413 - RNA, 28 nt, Human
guuuucccuacugcugccugaucccucg

SEQ ID NO: 482414 - RNA, 32 nt, Human
guuuucccucagccuggaaaacauauuaaucc

SEQ ID NO: 482415 - RNA, 32 nt, Human
guuuucccucauaaccaaagcuucagguuaga

SEQ ID NO: 482416 - RNA, 32 nt, Human
guuuucccucuacagacacugucugguuuuag

SEQ ID NO: 482417 - RNA, 32 nt, Human
guuuucccucugcgugaaucucugucucuuca

SEQ ID NO: 482418 - RNA, 32 nt, Human
guuuucccugagggaauguggagcagcucggc

SEQ ID NO: 482419 - RNA, 32 nt, Human
guuuucccugauccgugguguugcaguccguu

SEQ ID NO: 482420 - RNA, 32 nt, Human
guuuucccuuuuccuuuuaagccucgccuugu

SEQ ID NO: 482421 - RNA, 32 nt, Human
guuuuccgccgugccccgaggcuccccagcgu

SEQ ID NO: 482422 - RNA, 32 nt, Human
guuuuccuacacaaauacaaaauaauugggga

SEQ ID NO: 482423 - RNA, 32 nt, Human
guuuuccucaagaagacuacuggaacuggaug

SEQ ID NO: 482424 - RNA, 32 nt, Human
guuuuccucacacuccuuacuugacugcuuuc

SEQ ID NO: 482425 - RNA, 32 nt, Human
guuuuccuccacccuuuccucucccucaguuu

SEQ ID NO: 482426 - RNA, 32 nt, Human
guuuuccuccccgcccugucccucucugguca

SEQ ID NO: 482427 - RNA, 32 nt, Human
guuuuccucuauacaucucuccccaacccuag

SEQ ID NO: 482428 - RNA, 32 nt, Human
guuuuccucuucaacauaaugaaauagacuug

SEQ ID NO: 482429 - RNA, 32 nt, Human
guuuuccugcagcaggugcauagucaaaucca

SEQ ID NO: 482430 - RNA, 32 nt, Human
guuuuccugcagcucuccaacaaacgccugag

SEQ ID NO: 482431 - RNA, 32 nt, Human
guuuuccugcagcuguugacuuguugcccuga

SEQ ID NO: 482432 - RNA, 32 nt, Human
guuuuccugcugacccucuccccaccauuagc

SEQ ID NO: 482433 - RNA, 32 nt, Human
guuuuccugcugacucucuccccacuauuacc

SEQ ID NO: 482434 - RNA, 32 nt, Human
guuuuccugucuuuugacauuugacuuugcau

SEQ ID NO: 482435 - RNA, 32 nt, Human
guuuuccuuaucuguaagacagguaaauggua

SEQ ID NO: 482436 - RNA, 32 nt, Human
guuuuccuuccucugcuaucucucacaccucu

SEQ ID NO: 482437 - RNA, 20 nt, Human
guuuuccuugcucuauacag

SEQ ID NO: 482438 - RNA, 32 nt, Human
guuuuccuuugguaugaauacaggaaaaggcu

SEQ ID NO: 482439 - RNA, 32 nt, Human
guuuuccuuuguccucacuacaggucucauua

SEQ ID NO: 482440 - RNA, 32 nt, Human
guuuucgacgacagauuaaccaaaaaugcccc

SEQ ID NO: 482441 - RNA, 32 nt, Human
guuuucgccauguugcccaggcuggucucaaa

SEQ ID NO: 482442 - RNA, 32 nt, Human
guuuucgucuguucaguagacuccgauuccag

SEQ ID NO: 482443 - RNA, 32 nt, Human
guuuucuaaaacaaaccaaggcuuuucuccug

SEQ ID NO: 482444 - RNA, 32 nt, Human
guuuucuaaaacugacaaccaggugggaccaa

SEQ ID NO: 482445 - RNA, 32 nt, Human
guuuucuaccucuccaggccugcccacuaccc

SEQ ID NO: 482446 - RNA, 22 nt, Human
guuuucuagaucuuuuacagug

SEQ ID NO: 482447 - RNA, 32 nt, Human
guuuucuagguaaacuucacuacugguaauua

SEQ ID NO: 482448 - RNA, 32 nt, Human
guuuucuaguguccuggcauguucacucagcc

SEQ ID NO: 482449 - RNA, 32 nt, Human
guuuucuauggagccuguggcccuuuugcagc

SEQ ID NO: 482450 - RNA, 32 nt, Human
guuuucucaaagucaggagcugaccaggagca

SEQ ID NO: 482451 - RNA, 32 nt, Human
guuuucucacagcagcugccugggugaagcau

SEQ ID NO: 482452 - RNA, 32 nt, Human
guuuucucacuguuggacucuaccucacuggu

SEQ ID NO: 482453 - RNA, 32 nt, Human
guuuucucagagaaguggagggaggaggaagg

SEQ ID NO: 482454 - RNA, 20 nt, Human
guuuucucagcuuaauagug

SEQ ID NO: 482455 - RNA, 20 nt, Human
guuuucucaucuguaaagug

SEQ ID NO: 482456 - RNA, 32 nt, Human
guuuucucccagaagagggucugccuugagau

SEQ ID NO: 482457 - RNA, 32 nt, Human
guuuucucccagacacaccacaccuaccuugg

SEQ ID NO: 482458 - RNA, 32 nt, Human
guuuucucccccagacgccugauauugaagua

SEQ ID NO: 482459 - RNA, 20 nt, Human
guuuucucccgccugcugug

SEQ ID NO: 482460 - RNA, 18 nt, Human
guuuucuccuaacacgug

SEQ ID NO: 482461 - RNA, 21 nt, Human
guuuucuccugccugugcugu

SEQ ID NO: 482462 - RNA, 17 nt, Human
guuuucuccugcuggug

SEQ ID NO: 482463 - RNA, 19 nt, Human
guuuucuccuggcgcaugg

SEQ ID NO: 482464 - RNA, 19 nt, Human
guuuucuccugggauggug

SEQ ID NO: 482465 - RNA, 20 nt, Human
guuuucuccuguguuauaua

SEQ ID NO: 482466 - RNA, 17 nt, Human
guuuucuccuuacacag

SEQ ID NO: 482467 - RNA, 21 nt, Human
guuuucuccuugaugcaugug

SEQ ID NO: 482468 - RNA, 32 nt, Human
guuuucuccuugggguugaaucauucaacuua

SEQ ID NO: 482469 - RNA, 32 nt, Human
guuuucucucaaacaugaacacuuuagaauug

SEQ ID NO: 482470 - RNA, 32 nt, Human
guuuucucucacccucucucuuuuguuuaucu

SEQ ID NO: 482471 - RNA, 32 nt, Human
guuuucucucaguguguucucagaguugcgcu

SEQ ID NO: 482472 - RNA, 19 nt, Human
guuuucucucugccgggug

SEQ ID NO: 482473 - RNA, 20 nt, Human
guuuucucucugccuuggug

SEQ ID NO: 482474 - RNA, 32 nt, Human
guuuucucucugcuuccuagcuucaaucuuug

SEQ ID NO: 482475 - RNA, 32 nt, Human
guuuucucugaacucuuccccuuguuccaagg

SEQ ID NO: 482476 - RNA, 32 nt, Human
guuuucucugauggacaaaggcaggggaccag

SEQ ID NO: 482477 - RNA, 32 nt, Human
guuuucucuggcucgcuccccuuuccccauuc

SEQ ID NO: 482478 - RNA, 32 nt, Human
guuuucucugucugcugucuaacccugugccu

SEQ ID NO: 482479 - RNA, 20 nt, Human
guuuucucuuacuauuugug

SEQ ID NO: 482480 - RNA, 32 nt, Human
guuuucucuugaauuugggggcugccauuuaa

SEQ ID NO: 482481 - RNA, 19 nt, Human
guuuucucuuguuugcagu

SEQ ID NO: 482482 - RNA, 19 nt, Human
guuuucucuuuuuuacagu

SEQ ID NO: 482483 - RNA, 32 nt, Human
guuuucugaagccagccaggugcaguggcuca

SEQ ID NO: 482484 - RNA, 32 nt, Human
guuuucugaaugaacugaauaaagcuucuguu

SEQ ID NO: 482485 - RNA, 32 nt, Human
guuuucugcaggggaaguucugauucccuuag

SEQ ID NO: 482486 - RNA, 32 nt, Human
guuuucugcaucugccaaagggguuaaacacu

SEQ ID NO: 482487 - RNA, 32 nt, Human
guuuucugcauucuguaaagaaacauaucaaa

SEQ ID NO: 482488 - RNA, 32 nt, Human
guuuucugccuguauuucccagugauuuacuc

SEQ ID NO: 482489 - RNA, 32 nt, Human
guuuucugcuucugugccaaaaugagauauuc

SEQ ID NO: 482490 - RNA, 32 nt, Human
guuuucuggaccagaagcagggagggugugga

SEQ ID NO: 482491 - RNA, 32 nt, Human
guuuucuggagugcuuuggaggagaggacuau

SEQ ID NO: 482492 - RNA, 32 nt, Human
guuuucuggaugcucccuuacuuucucagcgc

SEQ ID NO: 482493 - RNA, 32 nt, Human
guuuucuggcuucugcuucauccugcuccauc

SEQ ID NO: 482494 - RNA, 32 nt, Human
guuuucugggcugugacugaaagacacacuga

SEQ ID NO: 482495 - RNA, 32 nt, Human
guuuucuguagccucagauugccuaucugcuu

SEQ ID NO: 482496 - RNA, 32 nt, Human
guuuucugucacuggugggcacuggacaggca

SEQ ID NO: 482497 - RNA, 32 nt, Human
guuuucuguggacugaaaaaucguguccuuuu

SEQ ID NO: 482498 - RNA, 20 nt, Human
guuuucuguugaaugcagug

SEQ ID NO: 482499 - RNA, 18 nt, Human
guuuucuuaaugccagug

SEQ ID NO: 482500 - RNA, 32 nt, Human
guuuucuuauccuuugaacacuccucauuuca

SEQ ID NO: 482501 - RNA, 17 nt, Human
guuuucuuauuauagug

SEQ ID NO: 482502 - RNA, 20 nt, Human
guuuucuucacagugcagug

SEQ ID NO: 482503 - RNA, 22 nt, Human
guuuucuucacuuaauauagug

SEQ ID NO: 482504 - RNA, 23 nt, Human
guuuucuucagugcuguacugug

SEQ ID NO: 482505 - RNA, 25 nt, Human
guuuucuuccuauauuuguauagug

SEQ ID NO: 482506 - RNA, 20 nt, Human
guuuucuuccucaaacagug

SEQ ID NO: 482507 - RNA, 32 nt, Human
guuuucuuccuucugcagcagcuuucugcuuc

SEQ ID NO: 482508 - RNA, 21 nt, Human
guuuucuucugcauuuuagug

SEQ ID NO: 482509 - RNA, 19 nt, Human
guuuucuucuguguaaagu

SEQ ID NO: 482510 - RNA, 32 nt, Human
guuuucuucuucucguccucguuuguguucug

SEQ ID NO: 482511 - RNA, 21 nt, Human
guuuucuucuugcucacacug

SEQ ID NO: 482512 - RNA, 32 nt, Human
guuuucuugagaugcaaaaguucacuguugca

SEQ ID NO: 482513 - RNA, 32 nt, Human
guuuucuugagcaacaguuacacuagguagaa

SEQ ID NO: 482514 - RNA, 32 nt, Human
guuuucuugcagcuggugccauccaugucuca

SEQ ID NO: 482515 - RNA, 32 nt, Human
guuuucuuuaacuuggcagugugcagaggaga

SEQ ID NO: 482516 - RNA, 32 nt, Human
guuuucuuuaccuuuuuccuccaugcaccaug

SEQ ID NO: 482517 - RNA, 23 nt, Human
guuuucuuuaugaugauacagug

SEQ ID NO: 482518 - RNA, 32 nt, Human
guuuucuuuccagauuggagguuuccaagagg

SEQ ID NO: 482519 - RNA, 32 nt, Human
guuuucuuuccuggugggguaguggggugggg

SEQ ID NO: 482520 - RNA, 21 nt, Human
guuuucuuucuuguguacagu

SEQ ID NO: 482521 - RNA, 32 nt, Human
guuuucuuucuuucuuuuuguuuuugacacag

SEQ ID NO: 482522 - RNA, 32 nt, Human
guuuucuuugaaaaggagggcuggaaugguac

SEQ ID NO: 482523 - RNA, 32 nt, Human
guuuucuuugagauggagucucgcucugucac

SEQ ID NO: 482524 - RNA, 19 nt, Human
guuuucuuugcuuuaagug

SEQ ID NO: 482525 - RNA, 19 nt, Human
guuuucuuugguauaugug

SEQ ID NO: 482526 - RNA, 32 nt, Human
guuuucuuugugaccagaacacauuuaaaauu

SEQ ID NO: 482527 - RNA, 19 nt, Human
guuuucuuuugcuugagug

SEQ ID NO: 482528 - RNA, 32 nt, Human
guuuugaaaaugucaugauaccuguugagaua

SEQ ID NO: 482529 - RNA, 32 nt, Human
guuuugaaaccaggaacugugagucuuccagc

SEQ ID NO: 482530 - RNA, 32 nt, Human
guuuugaaaguccuguucacaugaguuccuau

SEQ ID NO: 482531 - RNA, 32 nt, Human
guuuugaaaugaggaaguguggaucggcauuc

SEQ ID NO: 482532 - RNA, 32 nt, Human
guuuugaaauuaugcaggcaugguggcacaca

SEQ ID NO: 482533 - RNA, 32 nt, Human
guuuugaacuccuggccucaagcaauccacuc

SEQ ID NO: 482534 - RNA, 32 nt, Human
guuuugaagguggccugagaauggagcuucuc

SEQ ID NO: 482535 - RNA, 32 nt, Human
guuuugaaguuuucaaagacuggcucugcugu

SEQ ID NO: 482536 - RNA, 32 nt, Human
guuuugaauuggguugugugugcacuggaguc

SEQ ID NO: 482537 - RNA, 32 nt, Human
guuuugacacaaugaaaauggaagcacuuuag

SEQ ID NO: 482538 - RNA, 32 nt, Human
guuuugacauuuaggauuuugugucuuuuaaa

SEQ ID NO: 482539 - RNA, 18 nt, Human
guuuugaccacccccaga

SEQ ID NO: 482540 - RNA, 24 nt, Human
guuuugaccagagaggcccagaug

SEQ ID NO: 482541 - RNA, 32 nt, Human
guuuugaccccaaaguaaagagaagcucuucu

SEQ ID NO: 482542 - RNA, 32 nt, Human
guuuugaccucccaggcaucugaacaggauga

SEQ ID NO: 482543 - RNA, 24 nt, Human
guuuugaccuguauccuuuauuua

SEQ ID NO: 482544 - RNA, 21 nt, Human
guuuugacgucuuuuuacuug

SEQ ID NO: 482545 - RNA, 32 nt, Human
guuuugacucacugcaaccuccgccuccuggg

SEQ ID NO: 482546 - RNA, 32 nt, Human
guuuugacuguggagcucuucuaacacccaua

SEQ ID NO: 482547 - RNA, 32 nt, Human
guuuugacuguuccacagcuacuucccaggac

SEQ ID NO: 482548 - RNA, 32 nt, Human
guuuugagaaugccagaucuguggcugucuuc

SEQ ID NO: 482549 - RNA, 32 nt, Human
guuuugagagagagucuugcucugucucccug

SEQ ID NO: 482550 - RNA, 32 nt, Human
guuuugagaucaaacuccccacccucacaaaa

SEQ ID NO: 482551 - RNA, 32 nt, Human
guuuugagauggagucucucucugucaccuag

SEQ ID NO: 482552 - RNA, 32 nt, Human
guuuugagcaaaauuuuggacugugaagcaag

SEQ ID NO: 482553 - RNA, 32 nt, Human
guuuugagcaacaaacuuuuucuucaaucugu

SEQ ID NO: 482554 - RNA, 32 nt, Human
guuuugagcugcagagacccgugcccgguagc

SEQ ID NO: 482555 - RNA, 31 nt, Human
guuuugaggguggaaugaggugaagggcaag

SEQ ID NO: 482556 - RNA, 32 nt, Human
guuuugaggguuauuggaaaacagagcaguga

SEQ ID NO: 482557 - RNA, 32 nt, Human
guuuugagucauggcuacuguuagaggaugga

SEQ ID NO: 482558 - RNA, 32 nt, Human
guuuugagugaagggaaaggaaacccagaaac

SEQ ID NO: 482559 - RNA, 32 nt, Human
guuuugauagaagggaagaccugcagugcacg

SEQ ID NO: 482560 - RNA, 32 nt, Human
guuuugauaguagaaucaagguguuugccaac

SEQ ID NO: 482561 - RNA, 21 nt, Human
guuuugaucaucuguacagug

SEQ ID NO: 482562 - RNA, 32 nt, Human
guuuugaucuucuuccccuucuuuucuucccc

SEQ ID NO: 482563 - RNA, 32 nt, Human
guuuugaucuuuucaaaacuaaaacagacccu

SEQ ID NO: 482564 - RNA, 21 nt, Human
guuuugauguguuguacagug

SEQ ID NO: 482565 - RNA, 32 nt, Human
guuuugcaagcaccuucuccuguguccuuggg

SEQ ID NO: 482566 - RNA, 32 nt, Human
guuuugcacagacgugggccugggccuucuca

SEQ ID NO: 482567 - RNA, 32 nt, Human
guuuugcagagcucaguuggaggcccucuccg

SEQ ID NO: 482568 - RNA, 32 nt, Human
guuuugcagagcuggucuucaggaacuggccu

SEQ ID NO: 482569 - RNA, 32 nt, Human
guuuugcagaugggggaaacugaggaagcacc

SEQ ID NO: 482570 - RNA, 32 nt, Human
guuuugcagcccaggcuggagugcaguggcac

SEQ ID NO: 482571 - RNA, 32 nt, Human
guuuugcagcuuuguacaaguaacauaaauug

SEQ ID NO: 482572 - RNA, 32 nt, Human
guuuugcaggugggagugcagggugagcccgg

SEQ ID NO: 482573 - RNA, 26 nt, Human
guuuugcauagggagugguaugacca

SEQ ID NO: 482574 - RNA, 31 nt, Human
guuuugcauaucuacugcaugccaagcacuu

SEQ ID NO: 482575 - RNA, 32 nt, Human
guuuugccaacacacugguagaugugugugca

SEQ ID NO: 482576 - RNA, 32 nt, Human
guuuugcccgcaucuucuguuccaugggugcc

SEQ ID NO: 482577 - RNA, 32 nt, Human
guuuugccugccacuagucuggcagccuccac

SEQ ID NO: 482578 - RNA, 32 nt, Human
guuuugcggagacugguucugcccuuucuauu

SEQ ID NO: 482579 - RNA, 32 nt, Human
guuuugcgugagcccucaaccugccugcaaua

SEQ ID NO: 482580 - RNA, 32 nt, Human
guuuugcuacuugcaaaggaaauguucauguu

SEQ ID NO: 482581 - RNA, 32 nt, Human
guuuugcuauagacuucagaaguguuuauuua

SEQ ID NO: 482582 - RNA, 32 nt, Human
guuuugcuauguuaaaaguggcagaacaggaa

SEQ ID NO: 482583 - RNA, 32 nt, Human
guuuugcuauuacaaaauacuacacaggagca

SEQ ID NO: 482584 - RNA, 32 nt, Human
guuuugcuccuugguauuugauuugcacuaua

SEQ ID NO: 482585 - RNA, 32 nt, Human
guuuugcucuccaaucuagguucaguugaagg

SEQ ID NO: 482586 - RNA, 32 nt, Human
guuuugcucuguuuugauaccuguaauauagg

SEQ ID NO: 482587 - RNA, 32 nt, Human
guuuugcugccagcccccaaaaagcaggcgau

SEQ ID NO: 482588 - RNA, 32 nt, Human
guuuugcugcugcaucucaccggaauacugag

SEQ ID NO: 482589 - RNA, 32 nt, Human
guuuugcugggcagugguucccagagagucag

SEQ ID NO: 482590 - RNA, 32 nt, Human
guuuugcuguguugcccaagcuggaacuugaa

SEQ ID NO: 482591 - RNA, 32 nt, Human
guuuugcuuaauuccacuuaugcaucagucau

SEQ ID NO: 482592 - RNA, 32 nt, Human
guuuugcuucugucugucuguuuauuggaaac

SEQ ID NO: 482593 - RNA, 32 nt, Human
guuuugcuuugcuugcuugucccccauccugu

SEQ ID NO: 482594 - RNA, 32 nt, Human
guuuugcuuugcuuguugugaauuaaaauggg

SEQ ID NO: 482595 - RNA, 23 nt, Human
guuuuggaagagcuuuuuauuua

SEQ ID NO: 482596 - RNA, 32 nt, Human
guuuuggaaggugaagggcuaucagaaacaau

SEQ ID NO: 482597 - RNA, 32 nt, Human
guuuuggacaaaacagucacuggggagaucac

SEQ ID NO: 482598 - RNA, 32 nt, Human
guuuuggagagggaaguggagcagccagcaag

SEQ ID NO: 482599 - RNA, 32 nt, Human
guuuuggagauuacuccaucuguccaucaaaa

SEQ ID NO: 482600 - RNA, 32 nt, Human
guuuuggagccaagucgaccuggcaucagguc

SEQ ID NO: 482601 - RNA, 32 nt, Human
guuuuggaggcaggcgggagucauggauguag

SEQ ID NO: 482602 - RNA, 32 nt, Human
guuuuggagguggcugggcaguggcgggcaga

SEQ ID NO: 482603 - RNA, 32 nt, Human
guuuuggauacaguuauugaugaggcuuggcc

SEQ ID NO: 482604 - RNA, 32 nt, Human
guuuuggcucaauuuggguuuguuggucacau

SEQ ID NO: 482605 - RNA, 32 nt, Human
guuuuggcucacugcagccuccgccuucuggg

SEQ ID NO: 482606 - RNA, 32 nt, Human
guuuuggcuccuggugcugacaugggcugggg

SEQ ID NO: 482607 - RNA, 32 nt, Human
guuuuggcugcucuccaucucuuguaccagcc

SEQ ID NO: 482608 - RNA, 32 nt, Human
guuuugggaagcgcuucacuccagguugguag

SEQ ID NO: 482609 - RNA, 32 nt, Human
guuuugggcacaggggaaggaggacuccgguc

SEQ ID NO: 482610 - RNA, 32 nt, Human
guuuuggggaaaggaagaaguucuuggcugag

SEQ ID NO: 482611 - RNA, 32 nt, Human
guuuuggggaaaguuggagaagccguggccuu

SEQ ID NO: 482612 - RNA, 31 nt, Human
guuuuggggcauucaggaguuggagauagcc

SEQ ID NO: 482613 - RNA, 32 nt, Human
guuuuggggccagacacgcgacggcucugcug

SEQ ID NO: 482614 - RNA, 32 nt, Human
guuuuggggcguucugucagaggggaaggacg

SEQ ID NO: 482615 - RNA, 32 nt, Human
guuuugggggcauucauugcagguguggcagu

SEQ ID NO: 482616 - RNA, 32 nt, Human
guuuuggguuaauuuguuauacagcuguagau

SEQ ID NO: 482617 - RNA, 32 nt, Human
guuuuggguuccugcccugauggucuaugucu

SEQ ID NO: 482618 - RNA, 32 nt, Human
guuuugguaggagugcucaugguucugucauu

SEQ ID NO: 482619 - RNA, 32 nt, Human
guuuugguccaucaugcauccauccucauuaa

SEQ ID NO: 482620 - RNA, 32 nt, Human
guuuuggucccugcacuuuguggugugacucc

SEQ ID NO: 482621 - RNA, 32 nt, Human
guuuugguggcagaggugggaugagcuggaaa

SEQ ID NO: 482622 - RNA, 32 nt, Human
guuuugguucuagcuuuagauuuuggauuuuc

SEQ ID NO: 482623 - RNA, 32 nt, Human
guuuugguuuccuucuaacuugcccacggcag

SEQ ID NO: 482624 - RNA, 32 nt, Human
guuuugguuuuguuuggggugggugggucauu

SEQ ID NO: 482625 - RNA, 32 nt, Human
guuuuguaaaaauacaaaaauuaccugggccu

SEQ ID NO: 482626 - RNA, 32 nt, Human
guuuuguacauacuucauuucuuuccuccucu

SEQ ID NO: 482627 - RNA, 32 nt, Human
guuuuguagauauggugacuccagucuuuguu

SEQ ID NO: 482628 - RNA, 32 nt, Human
guuuuguaguaacuugcacuucccuggugcca

SEQ ID NO: 482629 - RNA, 23 nt, Human
guuuuguauaguuuucuguuuga

SEQ ID NO: 482630 - RNA, 19 nt, Human
guuuuguaugcccuggaga

SEQ ID NO: 482631 - RNA, 32 nt, Human
guuuuguauuuuuaguagagacaggguuucac

SEQ ID NO: 482632 - RNA, 32 nt, Human
guuuuguauuuuuaguagagaugggguuucac

SEQ ID NO: 482633 - RNA, 32 nt, Human
guuuugucacagacuucccuaguguuuguacu

SEQ ID NO: 482634 - RNA, 32 nt, Human
guuuugucacccaggcuggagugcaguggggc

SEQ ID NO: 482635 - RNA, 32 nt, Human
guuuugucacccaggcuggagugcaguggugu

SEQ ID NO: 482636 - RNA, 32 nt, Human
guuuugucacccuguuggucagaaagaugucu

SEQ ID NO: 482637 - RNA, 32 nt, Human
guuuugucagcuuucucauguugagaucuguu

SEQ ID NO: 482638 - RNA, 32 nt, Human
guuuuguccaugccuuccucccugcacgcaca

SEQ ID NO: 482639 - RNA, 32 nt, Human
guuuuguccugccucuuguuucugugccccgg

SEQ ID NO: 482640 - RNA, 32 nt, Human
guuuugucgcccaggcuggagugcaguggcau

SEQ ID NO: 482641 - RNA, 32 nt, Human
guuuugucuaacuccauucugaacuuucaccg

SEQ ID NO: 482642 - RNA, 32 nt, Human
guuuugucuccucugagguuggcccauggcca

SEQ ID NO: 482643 - RNA, 32 nt, Human
guuuugucugauuuucuccaucauccugauua

SEQ ID NO: 482644 - RNA, 32 nt, Human
guuuugucuguuucccccuugugugguuuccg

SEQ ID NO: 482645 - RNA, 32 nt, Human
guuuugugaaacacacacucugccauuucagg

SEQ ID NO: 482646 - RNA, 32 nt, Human
guuuugugcuugaacccagggcugugcuggug

SEQ ID NO: 482647 - RNA, 31 nt, Human
guuuuguggugccuggagccuguguccugcc

SEQ ID NO: 482648 - RNA, 32 nt, Human
guuuugugugcuguuuggagacuggguguuua

SEQ ID NO: 482649 - RNA, 32 nt, Human
guuuugugugugugcccacacguagacaaaug

SEQ ID NO: 482650 - RNA, 32 nt, Human
guuuugugugugugcguguguguaaaugugua

SEQ ID NO: 482651 - RNA, 32 nt, Human
guuuuguucucagcaucugaugaaggggcuca

SEQ ID NO: 482652 - RNA, 31 nt, Human
guuuuguucucaguuuuaaccaaagccagug

SEQ ID NO: 482653 - RNA, 32 nt, Human
guuuuguucucccacauauucucuucaaugcu

SEQ ID NO: 482654 - RNA, 32 nt, Human
guuuuguucuucuuggugugcuuuuuggaugg

SEQ ID NO: 482655 - RNA, 32 nt, Human
guuuuguucuuucuuuugccuuaaguaaugac

SEQ ID NO: 482656 - RNA, 32 nt, Human
guuuuguugcccaggcuggucuccagcuucua

SEQ ID NO: 482657 - RNA, 32 nt, Human
guuuuguuguuuuuguuguugauggcuaacca

SEQ ID NO: 482658 - RNA, 32 nt, Human
guuuuguuuccccucagugucuguaacccuua

SEQ ID NO: 482659 - RNA, 32 nt, Human
guuuuguuucuauuuguaguuucuugaguaag

SEQ ID NO: 482660 - RNA, 32 nt, Human
guuuuguuucuugucuuuguguucugugguac

SEQ ID NO: 482661 - RNA, 32 nt, Human
guuuuguuugagacucagucucgcucuguugc

SEQ ID NO: 482662 - RNA, 32 nt, Human
guuuuguuugagauagggucuugcucuaucac

SEQ ID NO: 482663 - RNA, 32 nt, Human
guuuuguuugagauggagucucgcucuguugc

SEQ ID NO: 482664 - RNA, 32 nt, Human
guuuuguuuggaggauggcuucugcugcuaaa

SEQ ID NO: 482665 - RNA, 32 nt, Human
guuuuguuuguuuccuuugugguacaaaaguu

SEQ ID NO: 482666 - RNA, 32 nt, Human
guuuuguuuuaaaauagcuuugcagugaaagc

SEQ ID NO: 482667 - RNA, 32 nt, Human
guuuuguuuuggugguuguuuuggaaaaacag

SEQ ID NO: 482668 - RNA, 23 nt, Human
guuuuguuuuguucuucuuggug

SEQ ID NO: 482669 - RNA, 32 nt, Human
guuuuguuuuuaaagaauacagaaggagccaa

SEQ ID NO: 482670 - RNA, 32 nt, Human
guuuuguuuuucuuuccuugggcucagcaauu

SEQ ID NO: 482671 - RNA, 29 nt, Human
guuuuguuuuuguuacugccuggaugagg

SEQ ID NO: 482672 - RNA, 32 nt, Human
guuuuguuuuuguuuuguaacuuugguugaug

SEQ ID NO: 482673 - RNA, 32 nt, Human
guuuuuaaaaaucaguuucauuuucauauuuc

SEQ ID NO: 482674 - RNA, 32 nt, Human
guuuuuaaaagguuuugaaacagcugcauccu

SEQ ID NO: 482675 - RNA, 32 nt, Human
guuuuuaaaguguggcaguuuugaguaguaac

SEQ ID NO: 482676 - RNA, 32 nt, Human
guuuuuaaaugcuauagcccugggcuugcccc

SEQ ID NO: 482677 - RNA, 32 nt, Human
guuuuuaagagagggcugauuaucacagcccu

SEQ ID NO: 482678 - RNA, 32 nt, Human
guuuuuaaggaaauauggcugugagaggaaua

SEQ ID NO: 482679 - RNA, 32 nt, Human
guuuuuaauacauagcaacagacuggguuauu

SEQ ID NO: 482680 - RNA, 32 nt, Human
guuuuuaauaucuguauauaaguuguguauuu

SEQ ID NO: 482681 - RNA, 32 nt, Human
guuuuuacacuucucuuuaauucccaccuaag

SEQ ID NO: 482682 - RNA, 32 nt, Human
guuuuuacauuggaaauugucuucucaaaauu

SEQ ID NO: 482683 - RNA, 32 nt, Human
guuuuuaccugacaguuauaccacagguagac

SEQ ID NO: 482684 - RNA, 32 nt, Human
guuuuuacuacaaaauaaguuacuuaguuuua

SEQ ID NO: 482685 - RNA, 19 nt, Human
guuuuuacucuauauagug

SEQ ID NO: 482686 - RNA, 32 nt, Human
guuuuuacucuauauagugaaaagcuagggag

SEQ ID NO: 482687 - RNA, 32 nt, Human
guuuuuacuguguauggggagguuguaguauu

SEQ ID NO: 482688 - RNA, 32 nt, Human
guuuuuacuugucaguuuucucucagcaaaca

SEQ ID NO: 482689 - RNA, 32 nt, Human
guuuuuagacccuuccaaggaagaggccagaa

SEQ ID NO: 482690 - RNA, 32 nt, Human
guuuuuagagaaggaaaaaugcuacucaguga

SEQ ID NO: 482691 - RNA, 32 nt, Human
guuuuuagccaauugauccucuacuuuccuuc

SEQ ID NO: 482692 - RNA, 32 nt, Human
guuuuuaguagagacaggguuucuccaugcug

SEQ ID NO: 482693 - RNA, 32 nt, Human
guuuuuaguagagacaggguuucuccauguug

SEQ ID NO: 482694 - RNA, 32 nt, Human
guuuuuaguagagaugggguuucuccaugucg

SEQ ID NO: 482695 - RNA, 32 nt, Human
guuuuuaguccauugacuaugcagccuaaugu

SEQ ID NO: 482696 - RNA, 32 nt, Human
guuuuuaguugcucaaagagccucacaguuac

SEQ ID NO: 482697 - RNA, 32 nt, Human
guuuuuauaucuguucccuaccccuguaaucc

SEQ ID NO: 482698 - RNA, 31 nt, Human
guuuuuaucaauaaauacuuguugauugugg

SEQ ID NO: 482699 - RNA, 32 nt, Human
guuuuuauccugucuuuucuucaucacaaaag

SEQ ID NO: 482700 - RNA, 32 nt, Human
guuuuuaucugguacccacacacacauaauac

SEQ ID NO: 482701 - RNA, 21 nt, Human
guuuuuaucuuguuauuggug

SEQ ID NO: 482702 - RNA, 32 nt, Human
guuuuuaugcugaagaggagaauggagcacua

SEQ ID NO: 482703 - RNA, 32 nt, Human
guuuuuauggauccuugucuucucccauucau

SEQ ID NO: 482704 - RNA, 32 nt, Human
guuuuuauuagggauuuuaaaaggggaggggu

SEQ ID NO: 482705 - RNA, 32 nt, Human
guuuuuauucucaguaccucaggcuccccugu

SEQ ID NO: 482706 - RNA, 32 nt, Human
guuuuuauuuaauucuuuuaaaaugaaaaauu

SEQ ID NO: 482707 - RNA, 32 nt, Human
guuuuucaaauccauugcuuagcuaacuuuuu

SEQ ID NO: 482708 - RNA, 32 nt, Human
guuuuucacgagacaggagcgcagagauggag

SEQ ID NO: 482709 - RNA, 32 nt, Human
guuuuucacuguucaguggccuaaauguagau

SEQ ID NO: 482710 - RNA, 32 nt, Human
guuuuucagagaacugaacuguggaaaaauga

SEQ ID NO: 482711 - RNA, 32 nt, Human
guuuuucagcaacuaaggugccucauguucug

SEQ ID NO: 482712 - RNA, 22 nt, Human
guuuuucaggcugggcacagug

SEQ ID NO: 482713 - RNA, 32 nt, Human
guuuuucagucauuuccuacugugaguggagu

SEQ ID NO: 482714 - RNA, 32 nt, Human
guuuuucauuggccugaccucugcuucucagg

SEQ ID NO: 482715 - RNA, 32 nt, Human
guuuuucauuuugccuuuaccaaagaucauuu

SEQ ID NO: 482716 - RNA, 32 nt, Human
guuuuuccagaagagaguagcuuuaggaagag

SEQ ID NO: 482717 - RNA, 32 nt, Human
guuuuuccagccuccaagucaccuggccuggg

SEQ ID NO: 482718 - RNA, 32 nt, Human
guuuuuccagcggcccagccccagaaaggucc

SEQ ID NO: 482719 - RNA, 32 nt, Human
guuuuuccagugccauuggugaaagcauuucu

SEQ ID NO: 482720 - RNA, 32 nt, Human
guuuuuccauuuccucacauguccacgagaug

SEQ ID NO: 482721 - RNA, 32 nt, Human
guuuuucccaaguacccugagauacuucccaa

SEQ ID NO: 482722 - RNA, 32 nt, Human
guuuuucccacauuugcugcaggcauggcugu

SEQ ID NO: 482723 - RNA, 32 nt, Human
guuuuuccccagcaccaccaucaaggccucga

SEQ ID NO: 482724 - RNA, 32 nt, Human
guuuuucccccuucaaauuuaugucuuuguua

SEQ ID NO: 482725 - RNA, 32 nt, Human
guuuuuccccuccacucagaaaccccugcccu

SEQ ID NO: 482726 - RNA, 32 nt, Human
guuuuuccccuucacacauuaucucucauguu

SEQ ID NO: 482727 - RNA, 32 nt, Human
guuuuuccuagaggagagauuaguaccuauuc

SEQ ID NO: 482728 - RNA, 32 nt, Human
guuuuuccucaccgacaguaccaucaugccuu

SEQ ID NO: 482729 - RNA, 32 nt, Human
guuuuuccuccuuuaagacuuaccucaacacu

SEQ ID NO: 482730 - RNA, 32 nt, Human
guuuuuccucuguuaaaaaccuuaagugcugc

SEQ ID NO: 482731 - RNA, 32 nt, Human
guuuuuccuuucucucucuuaagccuuauucu

SEQ ID NO: 482732 - RNA, 32 nt, Human
guuuuucuagcuauagugucucgaguacuaau

SEQ ID NO: 482733 - RNA, 32 nt, Human
guuuuucucauugugucucugccuagcucccu

SEQ ID NO: 482734 - RNA, 32 nt, Human
guuuuucuccaaaaccugaacauuuuuacucu

SEQ ID NO: 482735 - RNA, 22 nt, Human
guuuuucucccuuuuccauccc

SEQ ID NO: 482736 - RNA, 21 nt, Human
guuuuucuccuucuccuuccc

SEQ ID NO: 482737 - RNA, 32 nt, Human
guuuuucucuauaaagggucaggcccgucagc

SEQ ID NO: 482738 - RNA, 32 nt, Human
guuuuucucuuucuuacucccucucucccuuu

SEQ ID NO: 482739 - RNA, 32 nt, Human
guuuuucugagugccuuagacauugacuucau

SEQ ID NO: 482740 - RNA, 32 nt, Human
guuuuucugccauuaggaaacagccccuuacu

SEQ ID NO: 482741 - RNA, 32 nt, Human
guuuuucugucugccuucgguucucuguuucu

SEQ ID NO: 482742 - RNA, 32 nt, Human
guuuuucuuaaugccaguuuacaugggaaugc

SEQ ID NO: 482743 - RNA, 32 nt, Human
guuuuucuuacuggagcuucauuuugguaaga

SEQ ID NO: 482744 - RNA, 32 nt, Human
guuuuucuucagaacaucaacagcuucuuucc

SEQ ID NO: 482745 - RNA, 32 nt, Human
guuuuucuucgggugcauuuaugagaguucac

SEQ ID NO: 482746 - RNA, 32 nt, Human
guuuuucuuuauagcuccuuuuuacucuccug

SEQ ID NO: 482747 - RNA, 32 nt, Human
guuuuucuuuuaagaauggccccacacugaac

SEQ ID NO: 482748 - RNA, 32 nt, Human
guuuuucuuuuucauuuauucagcaacuauuu

SEQ ID NO: 482749 - RNA, 32 nt, Human
guuuuugaaacagggucucacucuguugccca

SEQ ID NO: 482750 - RNA, 32 nt, Human
guuuuugaaagaagaaaaauauggcucuguuc

SEQ ID NO: 482751 - RNA, 32 nt, Human
guuuuugaagcugcaaacacuacaaugcuuug

SEQ ID NO: 482752 - RNA, 32 nt, Human
guuuuugaaggcagaaagcaaaauuauguuug

SEQ ID NO: 482753 - RNA, 32 nt, Human
guuuuugacuugacuugaauugcuugauacuu

SEQ ID NO: 482754 - RNA, 32 nt, Human
guuuuugagacagggucucgcucuauggccca

SEQ ID NO: 482755 - RNA, 32 nt, Human
guuuuugagacagggucuugcucugucaccca

SEQ ID NO: 482756 - RNA, 32 nt, Human
guuuuugagauggagucucgcucugucgccca

SEQ ID NO: 482757 - RNA, 32 nt, Human
guuuuugagauggagucucuugcucugucauc

SEQ ID NO: 482758 - RNA, 32 nt, Human
guuuuugagauggagucuuguucugucaccca

SEQ ID NO: 482759 - RNA, 32 nt, Human
guuuuugagggcagaaagcuagcuauggguag

SEQ ID NO: 482760 - RNA, 32 nt, Human
guuuuugagguaaaguuguuuuugaaauuucu

SEQ ID NO: 482761 - RNA, 32 nt, Human
guuuuugaugcuagaaaaauggaaacaagaga

SEQ ID NO: 482762 - RNA, 32 nt, Human
guuuuugcaaagcaccuggagauguuugcugg

SEQ ID NO: 482763 - RNA, 32 nt, Human
guuuuugccaguuuagggcaguagcugcuuuu

SEQ ID NO: 482764 - RNA, 32 nt, Human
guuuuugccaucaccaguuucucaggcugggg

SEQ ID NO: 482765 - RNA, 32 nt, Human
guuuuugccauguugcccagacuggucuugaa

SEQ ID NO: 482766 - RNA, 32 nt, Human
guuuuugccauuaaaaaugauguaauaguuac

SEQ ID NO: 482767 - RNA, 32 nt, Human
guuuuugcccauccucccaaucucaauacagc

SEQ ID NO: 482768 - RNA, 32 nt, Human
guuuuugccucugccauagagcucaccucauu

SEQ ID NO: 482769 - RNA, 32 nt, Human
guuuuugcguuggucacccugcccuccgcacg

SEQ ID NO: 482770 - RNA, 32 nt, Human
guuuuugcucugccauuuacuugcuguguguc

SEQ ID NO: 482771 - RNA, 32 nt, Human
guuuuugcugggacaaauacuacucaaauacu

SEQ ID NO: 482772 - RNA, 32 nt, Human
guuuuugcuguagcccuagagcacuuuguuug

SEQ ID NO: 482773 - RNA, 32 nt, Human
guuuuugcuguugaacggugauuucuguccaa

SEQ ID NO: 482774 - RNA, 32 nt, Human
guuuuuggaagacagcaaagaggggcaauggc

SEQ ID NO: 482775 - RNA, 32 nt, Human
guuuuuggagagaaauucaggagcaccuagcu

SEQ ID NO: 482776 - RNA, 32 nt, Human
guuuuuggagaucaugaauguuucuacaacac

SEQ ID NO: 482777 - RNA, 32 nt, Human
guuuuuggcaaaaacuccaugacuuuaaacua

SEQ ID NO: 482778 - RNA, 31 nt, Human
guuuuuggcaaaggaagguaacuucaaugua

SEQ ID NO: 482779 - RNA, 31 nt, Human
guuuuuggcuuuuucugaaauagcugagagg

SEQ ID NO: 482780 - RNA, 21 nt, Human
guuuuugggggaacagggagc

SEQ ID NO: 482781 - RNA, 21 nt, Human
guuuuuggggucauggggagg

SEQ ID NO: 482782 - RNA, 20 nt, Human
guuuuugggguggggggugu

SEQ ID NO: 482783 - RNA, 32 nt, Human
guuuuuggugcuaauggaaaggacccgagaua

SEQ ID NO: 482784 - RNA, 32 nt, Human
guuuuugguuagagccaagauagcucccaugc

SEQ ID NO: 482785 - RNA, 32 nt, Human
guuuuuguaaaguguggucccaacaggaggac

SEQ ID NO: 482786 - RNA, 32 nt, Human
guuuuuguaauagugagccucacuuuccuguc

SEQ ID NO: 482787 - RNA, 32 nt, Human
guuuuuguagcaaaugaaaauuucuucaaaua

SEQ ID NO: 482788 - RNA, 32 nt, Human
guuuuuguauuuuuaguagagacagaguuucg

SEQ ID NO: 482789 - RNA, 32 nt, Human
guuuuugucacauacacauacagcauuuggaa

SEQ ID NO: 482790 - RNA, 32 nt, Human
guuuuugucaugccacgugccaaaggccacau

SEQ ID NO: 482791 - RNA, 32 nt, Human
guuuuugucugacuucuacucugucaaucucu

SEQ ID NO: 482792 - RNA, 20 nt, Human
guuuuugucugcuguaagug

SEQ ID NO: 482793 - RNA, 32 nt, Human
guuuuugugaagaucaaagaagcuaaauauau

SEQ ID NO: 482794 - RNA, 32 nt, Human
guuuuugugcaggaacagccccucccgucuuu

SEQ ID NO: 482795 - RNA, 32 nt, Human
guuuuuguggcagccuuugugggaguggucug

SEQ ID NO: 482796 - RNA, 32 nt, Human
guuuuuguggccagggucuucaugaacacuaa

SEQ ID NO: 482797 - RNA, 22 nt, Human
guuuuuguggguauuugccuca

SEQ ID NO: 482798 - RNA, 32 nt, Human
guuuuugugguuagcuccuucuugccaaccaa

SEQ ID NO: 482799 - RNA, 32 nt, Human
guuuuuguguccugccaggcaccguggucuca

SEQ ID NO: 482800 - RNA, 32 nt, Human
guuuuuguguuacugggcaugugccccuuuag

SEQ ID NO: 482801 - RNA, 32 nt, Human
guuuuuguguuaggaauaaaaagucauaaacu

SEQ ID NO: 482802 - RNA, 32 nt, Human
guuuuuguguuuuuaguaaagacagggguuuc

SEQ ID NO: 482803 - RNA, 24 nt, Human
guuuuuguucaguuuaucuguuca

SEQ ID NO: 482804 - RNA, 32 nt, Human
guuuuuguugagauguaauuuugcucuuguug

SEQ ID NO: 482805 - RNA, 32 nt, Human
guuuuuguuguuguuuauagacacucuugggu

SEQ ID NO: 482806 - RNA, 32 nt, Human
guuuuuguuguuguuuuuccucuccuuuugag

SEQ ID NO: 482807 - RNA, 32 nt, Human
guuuuuguuucucaagcucagugcauaguggu

SEQ ID NO: 482808 - RNA, 32 nt, Human
guuuuuguuuugcugaggcucagcuucuuccu

SEQ ID NO: 482809 - RNA, 32 nt, Human
guuuuuguuuuguuuuuacuguauuuauuuua

SEQ ID NO: 482810 - RNA, 32 nt, Human
guuuuuguuuuuguuuuccuugcagauacugu

SEQ ID NO: 482811 - RNA, 20 nt, Human
guuuuuucaaugcugcagug

SEQ ID NO: 482812 - RNA, 23 nt, Human
guuuuuuccacgaaacccagaug

SEQ ID NO: 482813 - RNA, 21 nt, Human
guuuuuuccaguuugucagug

SEQ ID NO: 482814 - RNA, 19 nt, Human
guuuuuuccugcacaugug

SEQ ID NO: 482815 - RNA, 20 nt, Human
guuuuuuccuggagucagug

SEQ ID NO: 482816 - RNA, 20 nt, Human
guuuuuuccuuugaauggug

SEQ ID NO: 482817 - RNA, 20 nt, Human
guuuuuucuucugugcauug

SEQ ID NO: 482818 - RNA, 23 nt, Human
guuuuuugagguggagugagugg

SEQ ID NO: 482819 - RNA, 22 nt, Human
guuuuuuggccgggcgcagugg

SEQ ID NO: 482820 - RNA, 32 nt, Human
  misc_feature (1)..(1): n is a, c, g or u
ncacgccuguaaucccagcacuuugggaggcc

SEQ ID NO: 482821 - RNA, 32 nt, Human
  misc_feature (1)..(1): n is a, c, g or u
ngcucacaccuguaauccuagcacuuugggag

SEQ ID NO: 482822 - RNA, 32 nt, Human
  misc_feature (1)..(2): n is a, c, g or u
nncacgccuguaaucccagcacuuugggaggc

SEQ ID NO: 482823 - RNA, 32 nt, Human
  misc_feature (1)..(3): n is a, c, g or u
nnncacgccuguaaucccagcacuuugggagg

SEQ ID NO: 482824 - RNA, 23 nt, Human
uaaaaaagaucauguucauuguu

SEQ ID NO: 482825 - RNA, 23 nt, Human
uaaaaaauuuacuucugucauua

SEQ ID NO: 482826 - RNA, 32 nt, Human
uaaaaacaacacagucauugacuuuacaauuc

SEQ ID NO: 482827 - RNA, 32 nt, Human
uaaaaacaagaaaaggagcagcuuugagaguu

SEQ ID NO: 482828 - RNA, 32 nt, Human
uaaaaacaauuuacaacaguaagcaccuguac

SEQ ID NO: 482829 - RNA, 32 nt, Human
uaaaaacacaugcacauguauguucauugcag

SEQ ID NO: 482830 - RNA, 32 nt, Human
uaaaaacaccaaagaaggagguugcuacaccu

SEQ ID NO: 482831 - RNA, 32 nt, Human
uaaaaacacugcauccucuuaggcaaccacuu

SEQ ID NO: 482832 - RNA, 32 nt, Human
uaaaaacagacaccuucuauagcauuguuuua

SEQ ID NO: 482833 - RNA, 32 nt, Human
uaaaaacagcaaaaccaaauaaaguggagaug

SEQ ID NO: 482834 - RNA, 32 nt, Human
uaaaaacaggaaaaacccaaaggagagaacua

SEQ ID NO: 482835 - RNA, 31 nt, Human
uaaaaacauacuuuauaacuuuaagagauuu

SEQ ID NO: 482836 - RNA, 32 nt, Human
uaaaaaccaaaccaauaaaauuuuuauuuauu

SEQ ID NO: 482837 - RNA, 32 nt, Human
uaaaaaccaaggauccuguccuagagaaagca

SEQ ID NO: 482838 - RNA, 32 nt, Human
uaaaaaccacugccucaaucucugguucacuc

SEQ ID NO: 482839 - RNA, 32 nt, Human
uaaaaaccaguccucucuaaucucagguggga

SEQ ID NO: 482840 - RNA, 32 nt, Human
uaaaaaccauaugcaauaaauaccucauugua

SEQ ID NO: 482841 - RNA, 32 nt, Human
uaaaaaccccacagugacacacacaaaagagc

SEQ ID NO: 482842 - RNA, 32 nt, Human
uaaaaacccugaacacugaggcuugagggagu

SEQ ID NO: 482843 - RNA, 32 nt, Human
uaaaaaccucaaaaaugcauugccaugauuuu

SEQ ID NO: 482844 - RNA, 32 nt, Human
uaaaaacguagcuaccguacacacacaucaau

SEQ ID NO: 482845 - RNA, 32 nt, Human
uaaaaacuaaaucacauugguaaaaggccuac

SEQ ID NO: 482846 - RNA, 32 nt, Human
uaaaaacucagaauguaccaucuuguuuccuu

SEQ ID NO: 482847 - RNA, 32 nt, Human
uaaaaacugcauuggcugggugcaguggcuca

SEQ ID NO: 482848 - RNA, 32 nt, Human
uaaaaacugccaccccaacacccuuccauuaa

SEQ ID NO: 482849 - RNA, 32 nt, Human
uaaaaacuggagaaauaggaauuugugaaccc

SEQ ID NO: 482850 - RNA, 32 nt, Human
uaaaaacuguaacacucaccgccaggguccgc

SEQ ID NO: 482851 - RNA, 32 nt, Human
uaaaaagaaaacaaaaccaaaaguuauuaaaa

SEQ ID NO: 482852 - RNA, 32 nt, Human
uaaaaagaaaacagcuccuugaacacagugag

SEQ ID NO: 482853 - RNA, 31 nt, Human
uaaaaagaacaaucauuuaaucaguaccauu

SEQ ID NO: 482854 - RNA, 32 nt, Human
uaaaaagaagccauggaaaaacuuccuaguaa

SEQ ID NO: 482855 - RNA, 23 nt, Human
uaaaaagacacaaguuuucuuuu

SEQ ID NO: 482856 - RNA, 32 nt, Human
uaaaaagacgcuuuccucuccucuucccuccu

SEQ ID NO: 482857 - RNA, 32 nt, Human
uaaaaagacguccugcccugugccccaguaca

SEQ ID NO: 482858 - RNA, 32 nt, Human
uaaaaagagcaucugcucuuggacuuguaucu

SEQ ID NO: 482859 - RNA, 32 nt, Human
uaaaaagagccaucuggucucuggcuagaguu

SEQ ID NO: 482860 - RNA, 32 nt, Human
uaaaaagauagucuucccauuagcuagagagc

SEQ ID NO: 482861 - RNA, 32 nt, Human
uaaaaagauucuggggaaggggaaaggcaggc

SEQ ID NO: 482862 - RNA, 32 nt, Human
uaaaaagcaaacauuucaaacuguccaaauga

SEQ ID NO: 482863 - RNA, 32 nt, Human
uaaaaagcaacuccugccucccuuccucaccc

SEQ ID NO: 482864 - RNA, 32 nt, Human
uaaaaagcacagggggaagaagaagagauuuc

SEQ ID NO: 482865 - RNA, 32 nt, Human
uaaaaagcacccuuucuuuguacagugggggu

SEQ ID NO: 482866 - RNA, 32 nt, Human
uaaaaagcaggcugagguggucucagauggcg

SEQ ID NO: 482867 - RNA, 32 nt, Human
uaaaaagccaaaggucaaagucaaaguccuuu

SEQ ID NO: 482868 - RNA, 32 nt, Human
uaaaaagccaccugagcuccugaggccauguc

SEQ ID NO: 482869 - RNA, 32 nt, Human
uaaaaagccaugaaagggacucucauuagaag

SEQ ID NO: 482870 - RNA, 32 nt, Human
uaaaaagccccuuuuaaagcaucuacuugaag

SEQ ID NO: 482871 - RNA, 32 nt, Human
uaaaaagccuccaucacucuauuuggcucauu

SEQ ID NO: 482872 - RNA, 32 nt, Human
uaaaaagccugagacgccuuacaaaaagcaag

SEQ ID NO: 482873 - RNA, 32 nt, Human
uaaaaagccugauuauuuuaggccaguuuacc

SEQ ID NO: 482874 - RNA, 32 nt, Human
uaaaaagcuagcauuugccuagaucauaacua

SEQ ID NO: 482875 - RNA, 32 nt, Human
uaaaaagcucagucuuuccccugggcccagaa

SEQ ID NO: 482876 - RNA, 32 nt, Human
uaaaaagcucuaagcucuagagucuagaucca

SEQ ID NO: 482877 - RNA, 32 nt, Human
uaaaaaggaaauaguugcugaagaggaaaacc

SEQ ID NO: 482878 - RNA, 32 nt, Human
uaaaaaggaacaaaacuuuaguauuuaauuag

SEQ ID NO: 482879 - RNA, 32 nt, Human
uaaaaaggaaugagaucauguccuuugcaggg

SEQ ID NO: 482880 - RNA, 32 nt, Human
uaaaaaggacagaggcuacagauggaguugcu

SEQ ID NO: 482881 - RNA, 32 nt, Human
uaaaaaggagaaacagggcucagcuggcaucu

SEQ ID NO: 482882 - RNA, 32 nt, Human
uaaaaaggagccacccagaaacuuagacagaa

SEQ ID NO: 482883 - RNA, 32 nt, Human
uaaaaaggccccagagagcuaacucacccuuc

SEQ ID NO: 482884 - RNA, 32 nt, Human
uaaaaagggaagagaaggaccgagacagaagc

SEQ ID NO: 482885 - RNA, 32 nt, Human
uaaaaagggggcugcauucuuguugguagcau

SEQ ID NO: 482886 - RNA, 32 nt, Human
uaaaaaggucuguuaaugucauggccuugaaa

SEQ ID NO: 482887 - RNA, 32 nt, Human
uaaaaaggugugcaauugacaauguuugugcc

SEQ ID NO: 482888 - RNA, 32 nt, Human
uaaaaaguaaagcauacaaauacuagaagaaa

SEQ ID NO: 482889 - RNA, 32 nt, Human
uaaaaaguaaaggggaagaaagaacuugacag

SEQ ID NO: 482890 - RNA, 32 nt, Human
uaaaaaguacauguaaaaguacauuugaugac

SEQ ID NO: 482891 - RNA, 32 nt, Human
uaaaaaguaccuguaucaaaggaauuuuaaca

SEQ ID NO: 482892 - RNA, 32 nt, Human
uaaaaaguagccaggcgugguggugcaugccu

SEQ ID NO: 482893 - RNA, 32 nt, Human
uaaaaaguaggagggguggaggugagaaggag

SEQ ID NO: 482894 - RNA, 32 nt, Human
uaaaaaguaucuaagcuguuacaguagcuuuc

SEQ ID NO: 482895 - RNA, 32 nt, Human
uaaaaagucaaauuacgaccauaaugaguauu

SEQ ID NO: 482896 - RNA, 32 nt, Human
uaaaaagucaucuuucccucacagaaagaaac

SEQ ID NO: 482897 - RNA, 32 nt, Human
uaaaaagucaugccacaggaagggucuauugc

SEQ ID NO: 482898 - RNA, 32 nt, Human
uaaaaagucauuuggguccugggaagcacugg

SEQ ID NO: 482899 - RNA, 32 nt, Human
uaaaaagucuucacucucugaagaugaucauu

SEQ ID NO: 482900 - RNA, 32 nt, Human
uaaaaagugaaauaugggauggauucuagaaa

SEQ ID NO: 482901 - RNA, 32 nt, Human
uaaaaagugagaaauggggaaaagaagaggag

SEQ ID NO: 482902 - RNA, 24 nt, Human
uaaaaagugguagcuacagaugau

SEQ ID NO: 482903 - RNA, 32 nt, Human
uaaaaauaaaaauugcuuucagagaguagccc

SEQ ID NO: 482904 - RNA, 32 nt, Human
uaaaaauaaggucauuuuucuccaucaggggc

SEQ ID NO: 482905 - RNA, 32 nt, Human
uaaaaauacaaaaaguuagcugggcauggugg

SEQ ID NO: 482906 - RNA, 32 nt, Human
uaaaaauacaaaaauuaacagcagagcgagac

SEQ ID NO: 482907 - RNA, 32 nt, Human
uaaaaauacaaaaauuagccuggggugguggc

SEQ ID NO: 482908 - RNA, 32 nt, Human
uaaaaauacaaaagaaaauuagccgggugugg

SEQ ID NO: 482909 - RNA, 32 nt, Human
uaaaaauacaaaauauuagcugggcguggugg

SEQ ID NO: 482910 - RNA, 32 nt, Human
uaaaaauacaaacuuggcugggcuuaguggug

SEQ ID NO: 482911 - RNA, 32 nt, Human
uaaaaauacaauaaauuagcugggcauggugg

SEQ ID NO: 482912 - RNA, 32 nt, Human
uaaaaauacacaaaauuagcugggcguggugg

SEQ ID NO: 482913 - RNA, 32 nt, Human
uaaaaauacagaaaauuagcugggcgcagugg

SEQ ID NO: 482914 - RNA, 32 nt, Human
uaaaaauacagcaaauuagcugggcguggugg

SEQ ID NO: 482915 - RNA, 32 nt, Human
uaaaaauaccaaaaauuagccgagcguaguga

SEQ ID NO: 482916 - RNA, 32 nt, Human
uaaaaauacgaaaaauuagcugggcauggugg

SEQ ID NO: 482917 - RNA, 32 nt, Human
uaaaaauacugaauuuaccuucacaaaagauu

SEQ ID NO: 482918 - RNA, 32 nt, Human
uaaaaauagaagaagaaagaauaaagcuuagu

SEQ ID NO: 482919 - RNA, 32 nt, Human
uaaaaauagacaggguacccaguguugccugg

SEQ ID NO: 482920 - RNA, 32 nt, Human
uaaaaauagcucuguaaucugugugacauggc

SEQ ID NO: 482921 - RNA, 32 nt, Human
uaaaaauagcuguguacuacuaauuaauagaa

SEQ ID NO: 482922 - RNA, 32 nt, Human
uaaaaauaggaaauaaagcaguugcuuaaaau

SEQ ID NO: 482923 - RNA, 32 nt, Human
uaaaaauauaaaacuagcugggcacaguggcu

SEQ ID NO: 482924 - RNA, 32 nt, Human
uaaaaauauaaauuguacauuuuguaaaauau

SEQ ID NO: 482925 - RNA, 32 nt, Human
uaaaaauaucuuuuucuccucucagcucauac

SEQ ID NO: 482926 - RNA, 32 nt, Human
uaaaaauaugaggugacaucuuuggcaaccag

SEQ ID NO: 482927 - RNA, 32 nt, Human
uaaaaauauguauuaauuuacuuggccugcua

SEQ ID NO: 482928 - RNA, 32 nt, Human
uaaaaauauuaaaaauaauggcaaaaacuggc

SEQ ID NO: 482929 - RNA, 32 nt, Human
uaaaaauauuuuuaguagagacaggguuucac

SEQ ID NO: 482930 - RNA, 32 nt, Human
uaaaaaucaagaaauauaaaccagauguagca

SEQ ID NO: 482931 - RNA, 32 nt, Human
uaaaaaucaaugaucagaaccccacauuuuag

SEQ ID NO: 482932 - RNA, 32 nt, Human
uaaaaaucacggccaggcacaguggcucaugc

SEQ ID NO: 482933 - RNA, 32 nt, Human
uaaaaaucagaggccuaucuccacuuuaaauc

SEQ ID NO: 482934 - RNA, 32 nt, Human
uaaaaauccuaccuugaguauucagccaauau

SEQ ID NO: 482935 - RNA, 32 nt, Human
uaaaaaucugccagugguguucccaagggaag

SEQ ID NO: 482936 - RNA, 32 nt, Human
uaaaaaucuguggagguugcugguacacacca

SEQ ID NO: 482937 - RNA, 30 nt, Human
uaaaaaugaagcaagagguugaggauucug

SEQ ID NO: 482938 - RNA, 32 nt, Human
uaaaaaugaaggagaaggaggguuugggaugg

SEQ ID NO: 482939 - RNA, 32 nt, Human
uaaaaaugaauugaaccauuucaacuauuuuc

SEQ ID NO: 482940 - RNA, 32 nt, Human
uaaaaaugacuguauuuuuaaaggaauaaauc

SEQ ID NO: 482941 - RNA, 32 nt, Human
uaaaaaugagaaaucacuaaugcuuuuuagac

SEQ ID NO: 482942 - RNA, 32 nt, Human
uaaaaaugagaucucaauagcagcgggcuggg

SEQ ID NO: 482943 - RNA, 32 nt, Human
uaaaaaugagccuuucucaagcacgugagcag

SEQ ID NO: 482944 - RNA, 32 nt, Human
uaaaaaugcaaacuguguaaacagggccucuu

SEQ ID NO: 482945 - RNA, 32 nt, Human
uaaaaaugcuuuucuggcugggcacaguggcu

SEQ ID NO: 482946 - RNA, 32 nt, Human
uaaaaauggaacuuauuuuugucaaaaauaag

SEQ ID NO: 482947 - RNA, 32 nt, Human
uaaaaauggagaaaggagucauggcucucuuu

SEQ ID NO: 482948 - RNA, 31 nt, Human
uaaaaaugggacuucuuuucacauucuuaua

SEQ ID NO: 482949 - RNA, 32 nt, Human
uaaaaaugggugucuucucaggaucuagcagu

SEQ ID NO: 482950 - RNA, 32 nt, Human
uaaaaaugguauggccauuagaucugugcuuu

SEQ ID NO: 482951 - RNA, 32 nt, Human
uaaaaaugucuauuaauauuccaucguauaga

SEQ ID NO: 482952 - RNA, 32 nt, Human
uaaaaaugugccagaauccaccuguggcccga

SEQ ID NO: 482953 - RNA, 22 nt, Human
uaaaaauguguuuucaagcugu

SEQ ID NO: 482954 - RNA, 32 nt, Human
uaaaaauguuguaaauacaucaaaagccugca

SEQ ID NO: 482955 - RNA, 20 nt, Human
uaaaaauuaaauagagguga

SEQ ID NO: 482956 - RNA, 32 nt, Human
uaaaaauuaaccaguaaacacucuguaguaac

SEQ ID NO: 482957 - RNA, 32 nt, Human
uaaaaauuacuuuucuagaaacaccauucugg

SEQ ID NO: 482958 - RNA, 32 nt, Human
uaaaaauuagccaggcgugguggugcaugccu

SEQ ID NO: 482959 - RNA, 32 nt, Human
uaaaaauuagcugagcaugcuggugauuuucu

SEQ ID NO: 482960 - RNA, 32 nt, Human
uaaaaauuagcuggaugugguggugcacaccu

SEQ ID NO: 482961 - RNA, 32 nt, Human
uaaaaauuagcugggugugguggugcaugccu

SEQ ID NO: 482962 - RNA, 32 nt, Human
uaaaaauuauucucucgaagagcaacuuacga

SEQ ID NO: 482963 - RNA, 32 nt, Human
uaaaaauucagaaaauuugcagccugacaaug

SEQ ID NO: 482964 - RNA, 32 nt, Human
uaaaaauucucaaagaccccuaccugcagagg

SEQ ID NO: 482965 - RNA, 32 nt, Human
uaaaaauugcaccccuggacugugcauugucu

SEQ ID NO: 482966 - RNA, 32 nt, Human
uaaaaauugcuauauuuucacaguuucauuau

SEQ ID NO: 482967 - RNA, 32 nt, Human
uaaaaauugcucccaugaaauuccaagcacuc

SEQ ID NO: 482968 - RNA, 32 nt, Human
uaaaaauugucucugcaccaucuuccuuuugu

SEQ ID NO: 482969 - RNA, 32 nt, Human
uaaaaauuucucuuggcuuuaaugacauuuag

SEQ ID NO: 482970 - RNA, 32 nt, Human
uaaaaauuugcucuaauaaaacauaccaaauc

SEQ ID NO: 482971 - RNA, 32 nt, Human
uaaaacaaaguaggaugaaaauucucuuaguu

SEQ ID NO: 482972 - RNA, 32 nt, Human
uaaaacaaaugcggaggcugggcacgguggcu

SEQ ID NO: 482973 - RNA, 24 nt, Human
uaaaacaacaaugagauaccacua

SEQ ID NO: 482974 - RNA, 32 nt, Human
uaaaacaagauggugauuccugacauuccuug

SEQ ID NO: 482975 - RNA, 32 nt, Human
uaaaacaagguguugcuuuguauaucaaaagc

SEQ ID NO: 482976 - RNA, 32 nt, Human
uaaaacaaguagcuucaagaaaccacuggugu

SEQ ID NO: 482977 - RNA, 32 nt, Human
uaaaacaaugcauauuuuacuacaguacagag

SEQ ID NO: 482978 - RNA, 32 nt, Human
uaaaacaauugcucaggaauucugggcuccca

SEQ ID NO: 482979 - RNA, 32 nt, Human
uaaaacacaaaugacagauauggaagaaaaua

SEQ ID NO: 482980 - RNA, 32 nt, Human
uaaaacacaccucacuuauuguacauguugga

SEQ ID NO: 482981 - RNA, 32 nt, Human
uaaaacacagagguguucugaccugcaacuug

SEQ ID NO: 482982 - RNA, 32 nt, Human
uaaaacacagccgucuggccagcugccucgaa

SEQ ID NO: 482983 - RNA, 32 nt, Human
uaaaacaccaauauauucaacuuuacacuucu

SEQ ID NO: 482984 - RNA, 32 nt, Human
uaaaacaccucugcuuucugauguugccuuaa

SEQ ID NO: 482985 - RNA, 32 nt, Human
uaaaacaccuuuccuuaugucuccugaccuga

SEQ ID NO: 482986 - RNA, 32 nt, Human
uaaaacacucucaggauuucaccagaaguuac

SEQ ID NO: 482987 - RNA, 32 nt, Human
uaaaacacuggcauggccuaggaagggcguug

SEQ ID NO: 482988 - RNA, 32 nt, Human
uaaaacagaacaguaacucuaugugaccccag

SEQ ID NO: 482989 - RNA, 32 nt, Human
uaaaacagacuuggacagagucuggaaaaaca

SEQ ID NO: 482990 - RNA, 32 nt, Human
uaaaacagcaccacauaacgcacacaaagaua

SEQ ID NO: 482991 - RNA, 32 nt, Human
uaaaacagccccaccccuaucucccuuugcug

SEQ ID NO: 482992 - RNA, 32 nt, Human
uaaaacagcuggagcauuuccuucccuuucca

SEQ ID NO: 482993 - RNA, 32 nt, Human
uaaaacaggcugcagucuggcacuuuuagaag

SEQ ID NO: 482994 - RNA, 27 nt, Human
uaaaacagguugccagccgaguacaga

SEQ ID NO: 482995 - RNA, 32 nt, Human
uaaaacaguauuuauuuuuacuuuugugacca

SEQ ID NO: 482996 - RNA, 32 nt, Human
uaaaacaguuauuuaauuuccacauauucaag

SEQ ID NO: 482997 - RNA, 32 nt, Human
uaaaacauaccauggagaaugaccucagccuu

SEQ ID NO: 482998 - RNA, 32 nt, Human
uaaaacauauagaaaagagcaagaaugcacau

SEQ ID NO: 482999 - RNA, 24 nt, Human
uaaaacauccuaacuuguuuuuca

SEQ ID NO: 483000 - RNA, 32 nt, Human
uaaaacaugaugacugugucugccugucccca

SEQ ID NO: 483001 - RNA, 32 nt, Human
uaaaacaugcuucagaagaacuggcaccccuu

SEQ ID NO: 483002 - RNA, 32 nt, Human
uaaaacaugugaagcucagagagggguaauga

SEQ ID NO: 483003 - RNA, 32 nt, Human
uaaaacauuagcugggugugguggcgcauacc

SEQ ID NO: 483004 - RNA, 32 nt, Human
uaaaacauucauuaagucuggggugaagauuu

SEQ ID NO: 483005 - RNA, 32 nt, Human
uaaaacauugcuuccuuccuggcucugcuaaa

SEQ ID NO: 483006 - RNA, 32 nt, Human
uaaaacauuuauuuguaaaaugagcuauguuc

SEQ ID NO: 483007 - RNA, 32 nt, Human
uaaaacauuucuccaucacucauuccaggucc

SEQ ID NO: 483008 - RNA, 32 nt, Human
uaaaacauuugguugcuacuguguagacucag

SEQ ID NO: 483009 - RNA, 32 nt, Human
uaaaaccaaagaaaucaauggaacccuugcac

SEQ ID NO: 483010 - RNA, 32 nt, Human
uaaaaccaauacacaaccuauuuucuaggcag

SEQ ID NO: 483011 - RNA, 32 nt, Human
uaaaaccacagccaugaacagacguuggggcu

SEQ ID NO: 483012 - RNA, 32 nt, Human
uaaaaccacccaucuaggucaggaaucacuug

SEQ ID NO: 483013 - RNA, 32 nt, Human
uaaaaccacugcagggaagccaucuggagacu

SEQ ID NO: 483014 - RNA, 22 nt, Human
uaaaaccagcaccgaggcccag

SEQ ID NO: 483015 - RNA, 32 nt, Human
uaaaaccaggugcaugccuguucuuccaucca

SEQ ID NO: 483016 - RNA, 32 nt, Human
uaaaaccaucugcucaguuugacauuuaaaag

SEQ ID NO: 483017 - RNA, 25 nt, Human
uaaaacccacaauaagauauuacua

SEQ ID NO: 483018 - RNA, 32 nt, Human
uaaaacccacaggccaucagcagcuagaggug

SEQ ID NO: 483019 - RNA, 32 nt, Human
uaaaacccaggaggcagagcuugcagugagcc

SEQ ID NO: 483020 - RNA, 32 nt, Human
uaaaaccccacaauaacuuuacauuccuagcu

SEQ ID NO: 483021 - RNA, 32 nt, Human
uaaaaccccaucucccugcccuuuuguuuucu

SEQ ID NO: 483022 - RNA, 32 nt, Human
uaaaacccugaacuuuggcugccugugaaucc

SEQ ID NO: 483023 - RNA, 20 nt, Human
uaaaaccgcugaccugugug

SEQ ID NO: 483024 - RNA, 32 nt, Human
uaaaaccgggcuuucacccaaccugcucccuc

SEQ ID NO: 483025 - RNA, 32 nt, Human
uaaaaccguacaguuucauuugcauuuugaca

SEQ ID NO: 483026 - RNA, 32 nt, Human
uaaaaccuaguauuuuccacuuguucaucaau

SEQ ID NO: 483027 - RNA, 32 nt, Human
uaaaaccuccacaauugauucucccccuguga

SEQ ID NO: 483028 - RNA, 32 nt, Human
uaaaaccucugaaccaaaaucuucccaggaau

SEQ ID NO: 483029 - RNA, 32 nt, Human
uaaaaccucuuuggagcuucugaggacucagc

SEQ ID NO: 483030 - RNA, 32 nt, Human
uaaaaccugcuguucuuccuuuaagucuccau

SEQ ID NO: 483031 - RNA, 32 nt, Human
uaaaaccuuacacccauuauugauuuauuuuu

SEQ ID NO: 483032 - RNA, 32 nt, Human
uaaaaccuuauuuaugucuuauuugaagauga

SEQ ID NO: 483033 - RNA, 32 nt, Human
uaaaaccuucauuccucaagaccagcaauucu

SEQ ID NO: 483034 - RNA, 32 nt, Human
uaaaaccuucuauuugaugucauuccauuuau

SEQ ID NO: 483035 - RNA, 32 nt, Human
uaaaaccuuuccaguauugguacaucuuggcu

SEQ ID NO: 483036 - RNA, 32 nt, Human
uaaaaccuuuucuccccuuuccccauccucua

SEQ ID NO: 483037 - RNA, 32 nt, Human
uaaaacgaggagagagaaaaauaauggcaaaa

SEQ ID NO: 483038 - RNA, 32 nt, Human
uaaaacggccccaccccuaucucccuucgcug

SEQ ID NO: 483039 - RNA, 32 nt, Human
uaaaacggccccacccuuaucucccuucacug

SEQ ID NO: 483040 - RNA, 32 nt, Human
uaaaacggugguagcugugcagcugcugcuga

SEQ ID NO: 483041 - RNA, 32 nt, Human
uaaaacguucugcagugccaggcugcagugug

SEQ ID NO: 483042 - RNA, 32 nt, Human
uaaaacuacagaaccacaucccaaagguaccu

SEQ ID NO: 483043 - RNA, 19 nt, Human
uaaaacuagagcaguuuga

SEQ ID NO: 483044 - RNA, 22 nt, Human
uaaaacuauaucugccugugug

SEQ ID NO: 483045 - RNA, 32 nt, Human
uaaaacuauuuuggaucccagcacuuugggaa

SEQ ID NO: 483046 - RNA, 32 nt, Human
uaaaacucaaaucuuguuggaucucugcaggg

SEQ ID NO: 483047 - RNA, 32 nt, Human
uaaaacuccauucucagagaaaaggccuccaa

SEQ ID NO: 483048 - RNA, 32 nt, Human
uaaaacucugaagacauuaaacaggcaguuug

SEQ ID NO: 483049 - RNA, 19 nt, Human
uaaaacugaguccugugua

SEQ ID NO: 483050 - RNA, 32 nt, Human
uaaaacugagucucaccguacuucugacuaua

SEQ ID NO: 483051 - RNA, 32 nt, Human
uaaaacugauggcuacauggaaaaagaggacu

SEQ ID NO: 483052 - RNA, 32 nt, Human
uaaaacugcaugaugaauagcaccuuaauuuc

SEQ ID NO: 483053 - RNA, 32 nt, Human
uaaaacugccaaggaaaguaauuaccuguagg

SEQ ID NO: 483054 - RNA, 32 nt, Human
uaaaacugccaagggagcucuaacuugaagcc

SEQ ID NO: 483055 - RNA, 32 nt, Human
uaaaacugccaucacacagaagagagaacuua

SEQ ID NO: 483056 - RNA, 32 nt, Human
uaaaacugcucacacauuuuacuguacuuucc

SEQ ID NO: 483057 - RNA, 32 nt, Human
uaaaacugcugauuuuucugguggcaaauaag

SEQ ID NO: 483058 - RNA, 23 nt, Human
uaaaacuggacccuagaggccca

SEQ ID NO: 483059 - RNA, 32 nt, Human
uaaaacuggcaacaagcaaacaggucuucagc

SEQ ID NO: 483060 - RNA, 32 nt, Human
uaaaacugggcccugaagacgguuccagccuu

SEQ ID NO: 483061 - RNA, 32 nt, Human
uaaaacuucacugcaguggccacuucugaauc

SEQ ID NO: 483062 - RNA, 32 nt, Human
uaaaacuucaggcagaacauccauucauucau

SEQ ID NO: 483063 - RNA, 32 nt, Human
uaaaacuuccccugacagaggguggcagcccc

SEQ ID NO: 483064 - RNA, 23 nt, Human
uaaaacuucucaagauacugcua

SEQ ID NO: 483065 - RNA, 32 nt, Human
uaaaacuucugauuucucuucagcuuugaaaa

SEQ ID NO: 483066 - RNA, 32 nt, Human
uaaaacuugguugcauuauuuguggaggcuca

SEQ ID NO: 483067 - RNA, 32 nt, Human
uaaaacuuuaaucccacuugccccuguuaccu

SEQ ID NO: 483068 - RNA, 32 nt, Human
uaaaacuuuaaugccauuucuaaugcuuuuau

SEQ ID NO: 483069 - RNA, 32 nt, Human
uaaaacuuuacacccaaguguccugguuaacu

SEQ ID NO: 483070 - RNA, 32 nt, Human
uaaaagaaaaacaaaagaccucuaaacuucaa

SEQ ID NO: 483071 - RNA, 32 nt, Human
uaaaagaaaauagaauguggccacuucacuau

SEQ ID NO: 483072 - RNA, 32 nt, Human
uaaaagaaaggcugcugcagucacauguuaua

SEQ ID NO: 483073 - RNA, 32 nt, Human
uaaaagaaauauaggaaacacuucauucuuua

SEQ ID NO: 483074 - RNA, 32 nt, Human
uaaaagaacuccaggaaacaugaauucuggaa

SEQ ID NO: 483075 - RNA, 32 nt, Human
uaaaagaagacaaauaggucuuaaacauauga

SEQ ID NO: 483076 - RNA, 32 nt, Human
uaaaagaagggaugugggaucaaggaggacag

SEQ ID NO: 483077 - RNA, 32 nt, Human
uaaaagacaaccaacggccgacugccugugaa

SEQ ID NO: 483078 - RNA, 32 nt, Human
uaaaagacagauacaaaccaguaccauggaaa

SEQ ID NO: 483079 - RNA, 32 nt, Human
uaaaagacauaagguggauaauucuacauuug

SEQ ID NO: 483080 - RNA, 32 nt, Human
uaaaagacccagacucagcugcagugaggaga

SEQ ID NO: 483081 - RNA, 32 nt, Human
uaaaagacuccaccaucucccuucucaucuag

SEQ ID NO: 483082 - RNA, 32 nt, Human
uaaaagacugcacuuuggagaggcaagcacgc

SEQ ID NO: 483083 - RNA, 32 nt, Human
uaaaagagagaagcaggaaaagaucuuccuuu

SEQ ID NO: 483084 - RNA, 32 nt, Human
uaaaagagagcagagcuuagucaguggaggaa

SEQ ID NO: 483085 - RNA, 32 nt, Human
uaaaagagagggucuguccccuccucuccacg

SEQ ID NO: 483086 - RNA, 32 nt, Human
uaaaagagccaguuuuuaaauaauggggcauu

SEQ ID NO: 483087 - RNA, 32 nt, Human
uaaaagagcuccagguguugucuguuuugaga

SEQ ID NO: 483088 - RNA, 32 nt, Human
uaaaagagcucccaucugaucugcagucauua

SEQ ID NO: 483089 - RNA, 32 nt, Human
uaaaagagcuguuccccacccccagggagcuc

SEQ ID NO: 483090 - RNA, 32 nt, Human
uaaaagaggaagaagagaggcuccagcuggcg

SEQ ID NO: 483091 - RNA, 32 nt, Human
uaaaagaggcauugggagagaccccucaccuu

SEQ ID NO: 483092 - RNA, 32 nt, Human
uaaaagaggguuuucucagaccuucugccaau

SEQ ID NO: 483093 - RNA, 32 nt, Human
uaaaagaggugugggagcagaggaauggaaac

SEQ ID NO: 483094 - RNA, 32 nt, Human
uaaaagagucaagugaccaucauuucaccugc

SEQ ID NO: 483095 - RNA, 32 nt, Human
uaaaagagucaguguaagcauugaaagagaua

SEQ ID NO: 483096 - RNA, 32 nt, Human
uaaaagagugccuggcacauaguaggugccau

SEQ ID NO: 483097 - RNA, 32 nt, Human
uaaaagagugggagacauucccagggagguga

SEQ ID NO: 483098 - RNA, 32 nt, Human
uaaaagauaaugcauccugaaagggaucauuu

SEQ ID NO: 483099 - RNA, 32 nt, Human
uaaaagauacacaccaauaucuucuucaggcu

SEQ ID NO: 483100 - RNA, 32 nt, Human
uaaaagaucaaaacauauuuauaauaauauuu

SEQ ID NO: 483101 - RNA, 32 nt, Human
uaaaagaucaaauucauucaacuaagaauuag

SEQ ID NO: 483102 - RNA, 32 nt, Human
uaaaagaucaguagcuuccuuuaccgacgugu

SEQ ID NO: 483103 - RNA, 32 nt, Human
uaaaagauugccccauguuggagcucaguagc

SEQ ID NO: 483104 - RNA, 32 nt, Human
uaaaagcaaagaggaaggaagggaggucugug

SEQ ID NO: 483105 - RNA, 32 nt, Human
uaaaagcaaguguccuacagcauuucccaaau

SEQ ID NO: 483106 - RNA, 32 nt, Human
uaaaagcaauggcaagugcucuccaauaaagu

SEQ ID NO: 483107 - RNA, 32 nt, Human
uaaaagcaauucugacuguccaggagcuaauc

SEQ ID NO: 483108 - RNA, 30 nt, Human
uaaaagcacuggcugugugauuuuacccuc

SEQ ID NO: 483109 - RNA, 32 nt, Human
uaaaagcagcagcugcucacauaagccggggu

SEQ ID NO: 483110 - RNA, 32 nt, Human
uaaaagcaggagaagucuaugggauucuagaa

SEQ ID NO: 483111 - RNA, 31 nt, Human
uaaaagcaggggagagaaaagccuugugaag

SEQ ID NO: 483112 - RNA, 32 nt, Human
uaaaagcaguacuccaaucugcagagacucua

SEQ ID NO: 483113 - RNA, 32 nt, Human
uaaaagcagucugggcgcaggcuggggaccca

SEQ ID NO: 483114 - RNA, 32 nt, Human
uaaaagcaucacagcuuaccauuuuucuuuuu

SEQ ID NO: 483115 - RNA, 22 nt, Human
uaaaagccaaaagcugcugccu

SEQ ID NO: 483116 - RNA, 32 nt, Human
uaaaagccaaucuaugagcuucucccgauggc

SEQ ID NO: 483117 - RNA, 32 nt, Human
uaaaagccaccuggguugacaccuuccuacuu

SEQ ID NO: 483118 - RNA, 32 nt, Human
uaaaagccacugcagugugcagugagaaacuc

SEQ ID NO: 483119 - RNA, 32 nt, Human
uaaaagccagguaacaccuaccaguccaguua

SEQ ID NO: 483120 - RNA, 32 nt, Human
uaaaagccaguucuguggugaugaccuaugga

SEQ ID NO: 483121 - RNA, 32 nt, Human
uaaaagccuguugccacuguugugucaugauu

SEQ ID NO: 483122 - RNA, 32 nt, Human
uaaaagccuuucuagaaggcagacuuagcccc

SEQ ID NO: 483123 - RNA, 32 nt, Human
uaaaagcgccucuuuggacacugaggcccucu

SEQ ID NO: 483124 - RNA, 32 nt, Human
uaaaagcgguagcaccacaugguuguguagau

SEQ ID NO: 483125 - RNA, 32 nt, Human
uaaaagcuacucuggaccuacaguguccggca

SEQ ID NO: 483126 - RNA, 32 nt, Human
uaaaagcuggggacccacagagggguuggcag

SEQ ID NO: 483127 - RNA, 32 nt, Human
uaaaagcuuggcuuuccuuauaugagugaggc

SEQ ID NO: 483128 - RNA, 32 nt, Human
uaaaagcuuugccacauucuucacauuuguag
